United States Patent 7,888,497 (BIOINFORMATICALLY DETECTABLE GROUP OF NOVEL REGULATORY OLIGONUCLEOTIDES AND USES THEREOF) - sequence listing, part 7

SEQ ID NO: 245112 - DNA, 22 bp, Homo sapiens
atatatgaaaggcttctgggac

SEQ ID NO: 245113 - DNA, 17 bp, Homo sapiens
atatatgaagtaagttc

SEQ ID NO: 245114 - DNA, 18 bp, Homo sapiens
atatatgaataattatgt

SEQ ID NO: 245115 - DNA, 15 bp, Homo sapiens
atatatgtatgtaaa

SEQ ID NO: 245116 - DNA, 16 bp, Homo sapiens
atatatgtatgtaaaa

SEQ ID NO: 245117 - DNA, 12 bp, Homo sapiens
atatatgtattt

SEQ ID NO: 245118 - DNA, 16 bp, Homo sapiens
atatatgtgtgtttaa

SEQ ID NO: 245119 - DNA, 23 bp, Homo sapiens
atatatgtgtgtttaaataaagt

SEQ ID NO: 245120 - DNA, 10 bp, Homo sapiens
atatatgttt

SEQ ID NO: 245121 - DNA, 11 bp, Homo sapiens
atatatgtttt

SEQ ID NO: 245122 - DNA, 13 bp, Homo sapiens
atatatgttttaa

SEQ ID NO: 245123 - DNA, 14 bp, Homo sapiens
atatatgttttgag

SEQ ID NO: 245124 - DNA, 20 bp, Homo sapiens
atatattctggctgataaaa

SEQ ID NO: 245125 - DNA, 14 bp, Homo sapiens
atatattcttataa

SEQ ID NO: 245126 - DNA, 12 bp, Homo sapiens
atatattgcata

SEQ ID NO: 245127 - DNA, 23 bp, Homo sapiens
atatattgccagtatataagctg

SEQ ID NO: 245128 - DNA, 10 bp, Homo sapiens
atatatttat

SEQ ID NO: 245129 - DNA, 12 bp, Homo sapiens
atatatttataa

SEQ ID NO: 245130 - DNA, 13 bp, Homo sapiens
atatatttataac

SEQ ID NO: 245131 - DNA, 14 bp, Homo sapiens
atatatttataact

SEQ ID NO: 245132 - DNA, 16 bp, Homo sapiens
atatatttataactca

SEQ ID NO: 245133 - DNA, 14 bp, Homo sapiens
atatatttctttgt

SEQ ID NO: 245134 - DNA, 14 bp, Homo sapiens
atatatttgaaaga

SEQ ID NO: 245135 - DNA, 16 bp, Homo sapiens
atatattttattttca

SEQ ID NO: 245136 - DNA, 13 bp, Homo sapiens
atatattttgaaa

SEQ ID NO: 245137 - DNA, 18 bp, Homo sapiens
atatattttgaaaggaga

SEQ ID NO: 245138 - DNA, 16 bp, Homo sapiens
atatcaacaacaagtt

SEQ ID NO: 245139 - DNA, 18 bp, Homo sapiens
atatcaacaacaagttgt

SEQ ID NO: 245140 - DNA, 21 bp, Homo sapiens
atatcaacagatagttgtgtt

SEQ ID NO: 245141 - DNA, 21 bp, Homo sapiens
atatcaagaagtcagagaaaa

SEQ ID NO: 245142 - DNA, 14 bp, Homo sapiens
atatcaaggatgtt

SEQ ID NO: 245143 - DNA, 18 bp, Homo sapiens
atatcaagtcccgaggca

SEQ ID NO: 245144 - DNA, 17 bp, Homo sapiens
atatcagaaaagggaag

SEQ ID NO: 245145 - DNA, 15 bp, Homo sapiens
atatcagacctctga

SEQ ID NO: 245146 - DNA, 19 bp, Homo sapiens
atatcagcagacactccag

SEQ ID NO: 245147 - DNA, 12 bp, Homo sapiens
atatcagcctga

SEQ ID NO: 245148 - DNA, 16 bp, Homo sapiens
atatcataatgtaatg

SEQ ID NO: 245149 - DNA, 22 bp, Homo sapiens
atatcatatgtatctaaatgaa

SEQ ID NO: 245150 - DNA, 16 bp, Homo sapiens
atatcatgaagccttg

SEQ ID NO: 245151 - DNA, 17 bp, Homo sapiens
atatcattatagcatgt

SEQ ID NO: 245152 - DNA, 14 bp, Homo sapiens
atatcattcagcaa

SEQ ID NO: 245153 - DNA, 20 bp, Homo sapiens
atatcattctttgtatctta

SEQ ID NO: 245154 - DNA, 21 bp, Homo sapiens
atatcattctttgtatcttaa

SEQ ID NO: 245155 - DNA, 21 bp, Homo sapiens
atatcatttattttttacatt

SEQ ID NO: 245156 - DNA, 18 bp, Homo sapiens
atatcatttcataaaaat

SEQ ID NO: 245157 - DNA, 13 bp, Homo sapiens
atatcattttatt

SEQ ID NO: 245158 - DNA, 17 bp, Homo sapiens
atatcattttattcaca

SEQ ID NO: 245159 - DNA, 15 bp, Homo sapiens
atatccaaagactgt

SEQ ID NO: 245160 - DNA, 16 bp, Homo sapiens
atatccaaagactgta

SEQ ID NO: 245161 - DNA, 20 bp, Homo sapiens
atatccacctacctattcat

SEQ ID NO: 245162 - DNA, 12 bp, Homo sapiens
atatccatgtac

SEQ ID NO: 245163 - DNA, 17 bp, Homo sapiens
atatccatgtactgtag

SEQ ID NO: 245164 - DNA, 18 bp, Homo sapiens
atatccatgtactgtagt

SEQ ID NO: 245165 - DNA, 20 bp, Homo sapiens
atatccctatgtcccagccc

SEQ ID NO: 245166 - DNA, 14 bp, Homo sapiens
atatcctatactgg

SEQ ID NO: 245167 - DNA, 16 bp, Homo sapiens
atatcctatactggtt

SEQ ID NO: 245168 - DNA, 15 bp, Homo sapiens
atatcctccgccctt

SEQ ID NO: 245169 - DNA, 15 bp, Homo sapiens
atatcctgagccatc

SEQ ID NO: 245170 - DNA, 15 bp, Homo sapiens
atatcctttctaaca

SEQ ID NO: 245171 - DNA, 16 bp, Homo sapiens
atatcctttctaacaa

SEQ ID NO: 245172 - DNA, 23 bp, Homo sapiens
atatctatttatctgtctgagcc

SEQ ID NO: 245173 - DNA, 15 bp, Homo sapiens
atatctctagtccct

SEQ ID NO: 245174 - DNA, 13 bp, Homo sapiens
atatctgctgtat

SEQ ID NO: 245175 - DNA, 16 bp, Homo sapiens
atatctgctgtatgtc

SEQ ID NO: 245176 - DNA, 17 bp, Homo sapiens
atatctgggattctact

SEQ ID NO: 245177 - DNA, 21 bp, Homo sapiens
atatctgtaaatttaactgca

SEQ ID NO: 245178 - DNA, 17 bp, Homo sapiens
atatctgtttgcttcta

SEQ ID NO: 245179 - DNA, 16 bp, Homo sapiens
atatcttaaagaaaca

SEQ ID NO: 245180 - DNA, 12 bp, Homo sapiens
atatcttgaaga

SEQ ID NO: 245181 - DNA, 13 bp, Homo sapiens
atatcttgaagaa

SEQ ID NO: 245182 - DNA, 15 bp, Homo sapiens
atatcttgaagaata

SEQ ID NO: 245183 - DNA, 17 bp, Homo sapiens
atatctttaaataaatg

SEQ ID NO: 245184 - DNA, 19 bp, Homo sapiens
atatctttaaataaatgtg

SEQ ID NO: 245185 - DNA, 20 bp, Homo sapiens
atatctttaataagtaatct

SEQ ID NO: 245186 - DNA, 15 bp, Homo sapiens
atatctttatactta

SEQ ID NO: 245187 - DNA, 20 bp, Homo sapiens
atatctttatacttaaacag

SEQ ID NO: 245188 - DNA, 20 bp, Homo sapiens
atatgaacagggcccaggcc

SEQ ID NO: 245189 - DNA, 22 bp, Homo sapiens
atatgaacagggcccaggcctg

SEQ ID NO: 245190 - DNA, 17 bp, Homo sapiens
atatgaacttaacatgc

SEQ ID NO: 245191 - DNA, 22 bp, Homo sapiens
atatgaatacagggcatgcatt

SEQ ID NO: 245192 - DNA, 22 bp, Homo sapiens
atatgacaatttcaaaatgcat

SEQ ID NO: 245193 - DNA, 19 bp, Homo sapiens
atatgacttcttgttcatg

SEQ ID NO: 245194 - DNA, 13 bp, Homo sapiens
atatgagagggat

SEQ ID NO: 245195 - DNA, 14 bp, Homo sapiens
atatgagattggaa

SEQ ID NO: 245196 - DNA, 22 bp, Homo sapiens
atatgagattggaaaaaattag

SEQ ID NO: 245197 - DNA, 18 bp, Homo sapiens
atatgaggggactgcatg

SEQ ID NO: 245198 - DNA, 19 bp, Homo sapiens
atatgaggggactgcatgc

SEQ ID NO: 245199 - DNA, 16 bp, Homo sapiens
atatgagtatctttaa

SEQ ID NO: 245200 - DNA, 17 bp, Homo sapiens
atatgagttactgaagg

SEQ ID NO: 245201 - DNA, 20 bp, Homo sapiens
atatgatgtttaaaagcata

SEQ ID NO: 245202 - DNA, 19 bp, Homo sapiens
atatgattctcctctccca

SEQ ID NO: 245203 - DNA, 16 bp, Homo sapiens
taacctttaagtctta

SEQ ID NO: 245204 - DNA, 17 bp, Homo sapiens
taacctttttgtaaata

SEQ ID NO: 245205 - DNA, 17 bp, Homo sapiens
taacgcaggagagagag

SEQ ID NO: 245206 - DNA, 19 bp, Homo sapiens
taactaatctattgggttc

SEQ ID NO: 245207 - DNA, 22 bp, Homo sapiens
taactaatctattgggttcatt

SEQ ID NO: 245208 - DNA, 17 bp, Homo sapiens
taactaccctacacctc

SEQ ID NO: 245209 - DNA, 14 bp, Homo sapiens
taactactaagaat

SEQ ID NO: 245210 - DNA, 17 bp, Homo sapiens
taactactgcaaaaagt

SEQ ID NO: 245211 - DNA, 14 bp, Homo sapiens
taactactgtgttc

SEQ ID NO: 245212 - DNA, 17 bp, Homo sapiens
taactagaatttattca

SEQ ID NO: 245213 - DNA, 18 bp, Homo sapiens
taactagaatttattcaa

SEQ ID NO: 245214 - DNA, 13 bp, Homo sapiens
taactagatctcc

SEQ ID NO: 245215 - DNA, 17 bp, Homo sapiens
taactagatctcctgta

SEQ ID NO: 245216 - DNA, 19 bp, Homo sapiens
taactagatggtgctgaga

SEQ ID NO: 245217 - DNA, 17 bp, Homo sapiens
taactcagacattccaa

SEQ ID NO: 245218 - DNA, 13 bp, Homo sapiens
taactcagatcac

SEQ ID NO: 245219 - DNA, 14 bp, Homo sapiens
taactcagatcact

SEQ ID NO: 245220 - DNA, 20 bp, Homo sapiens
taactcagatcactactgca

SEQ ID NO: 245221 - DNA, 14 bp, Homo sapiens
taactcatcataaa

SEQ ID NO: 245222 - DNA, 21 bp, Homo sapiens
taactcatggcaggcatctgt

SEQ ID NO: 245223 - DNA, 14 bp, Homo sapiens
taactccttcttgt

SEQ ID NO: 245224 - DNA, 16 bp, Homo sapiens
taactctgcatagaca

SEQ ID NO: 245225 - DNA, 14 bp, Homo sapiens
taactcttgctcac

SEQ ID NO: 245226 - DNA, 22 bp, Homo sapiens
taactcttgctcactccctaaa

SEQ ID NO: 245227 - DNA, 14 bp, Homo sapiens
taactcttgtctat

SEQ ID NO: 245228 - DNA, 22 bp, Homo sapiens
taactgactattcttgatgtaa

SEQ ID NO: 245229 - DNA, 15 bp, Homo sapiens
taactgacttagttc

SEQ ID NO: 245230 - DNA, 18 bp, Homo sapiens
taactgacttagttcttc

SEQ ID NO: 245231 - DNA, 13 bp, Homo sapiens
taactgagagaag

SEQ ID NO: 245232 - DNA, 17 bp, Homo sapiens
taactgcatatagataa

SEQ ID NO: 245233 - DNA, 18 bp, Homo sapiens
taactgccagccttggag

SEQ ID NO: 245234 - DNA, 21 bp, Homo sapiens
taactgcccaaagcagcactt

SEQ ID NO: 245235 - DNA, 19 bp, Homo sapiens
taactgcccttttaaatgg

SEQ ID NO: 245236 - DNA, 21 bp, Homo sapiens
taactgcccttttaaatggca

SEQ ID NO: 245237 - DNA, 22 bp, Homo sapiens
taactgcccttttaaatggcat

SEQ ID NO: 245238 - DNA, 17 bp, Homo sapiens
taactgtgaagtttaca

SEQ ID NO: 245239 - DNA, 18 bp, Homo sapiens
taactgtgaagtttacat

SEQ ID NO: 245240 - DNA, 13 bp, Homo sapiens
taactgtgtatgt

SEQ ID NO: 245241 - DNA, 14 bp, Homo sapiens
taactgtgtatgta

SEQ ID NO: 245242 - DNA, 19 bp, Homo sapiens
taactgtgtatgtacatat

SEQ ID NO: 245243 - DNA, 20 bp, Homo sapiens
taactgtgtatgtacatata

SEQ ID NO: 245244 - DNA, 17 bp, Homo sapiens
taactgtgtgaagaaat

SEQ ID NO: 245245 - DNA, 19 bp, Homo sapiens
taactgttagtattaacta

SEQ ID NO: 245246 - DNA, 17 bp, Homo sapiens
taacttaaaaatgtaaa

SEQ ID NO: 245247 - DNA, 20 bp, Homo sapiens
taacttaaaaatgtaaatat

SEQ ID NO: 245248 - DNA, 21 bp, Homo sapiens
taacttaaaaatgtaaatatt

SEQ ID NO: 245249 - DNA, 23 bp, Homo sapiens
taacttaaaaatgtaaatattct

SEQ ID NO: 245250 - DNA, 17 bp, Homo sapiens
taacttagtattttacc

SEQ ID NO: 245251 - DNA, 21 bp, Homo sapiens
taacttattgcctgggcagtg

SEQ ID NO: 245252 - DNA, 14 bp, Homo sapiens
taacttcagagaag

SEQ ID NO: 245253 - DNA, 15 bp, Homo sapiens
taacttcagagaagt

SEQ ID NO: 245254 - DNA, 13 bp, Homo sapiens
taacttcataaaa

SEQ ID NO: 245255 - DNA, 17 bp, Homo sapiens
taacttccaatttacat

SEQ ID NO: 245256 - DNA, 21 bp, Homo sapiens
taacttgagttttatttattt

SEQ ID NO: 245257 - DNA, 23 bp, Homo sapiens
taacttgatggcttaaaaatact

SEQ ID NO: 245258 - DNA, 13 bp, Homo sapiens
taacttgctgtga

SEQ ID NO: 245259 - DNA, 16 bp, Homo sapiens
taacttgctgtgaaat

SEQ ID NO: 245260 - DNA, 23 bp, Homo sapiens
taacttggagagggacgaagaaa

SEQ ID NO: 245261 - DNA, 14 bp, Homo sapiens
taacttggggaggc

SEQ ID NO: 245262 - DNA, 21 bp, Homo sapiens
taactttatcacattatttgc

SEQ ID NO: 245263 - DNA, 23 bp, Homo sapiens
taactttcagaagagatgggctt

SEQ ID NO: 245264 - DNA, 18 bp, Homo sapiens
taactttgcatgttcttg

SEQ ID NO: 245265 - DNA, 24 bp, Homo sapiens
taactttgcccttcactgttgctt

SEQ ID NO: 245266 - DNA, 20 bp, Homo sapiens
taacttttgtaaatacacat

SEQ ID NO: 245267 - DNA, 22 bp, Homo sapiens
taagaaaaaaataattttatga

SEQ ID NO: 245268 - DNA, 12 bp, Homo sapiens
taagaaaaacat

SEQ ID NO: 245269 - DNA, 13 bp, Homo sapiens
taagaaaaacatg

SEQ ID NO: 245270 - DNA, 17 bp, Homo sapiens
taagaaacaatttaaat

SEQ ID NO: 245271 - DNA, 16 bp, Homo sapiens
taagaaacagagcagt

SEQ ID NO: 245272 - DNA, 16 bp, Homo sapiens
taagaaagctatatat

SEQ ID NO: 245273 - DNA, 15 bp, Homo sapiens
taagaaagtgaagca

SEQ ID NO: 245274 - DNA, 22 bp, Homo sapiens
taagaaagtgaagcaaatcaga

SEQ ID NO: 245275 - DNA, 19 bp, Homo sapiens
taagaaatcaaagagagaa

SEQ ID NO: 245276 - DNA, 18 bp, Homo sapiens
taagaaatggctttccac

SEQ ID NO: 245277 - DNA, 22 bp, Homo sapiens
taagaactttgcacacttcaaa

SEQ ID NO: 245278 - DNA, 14 bp, Homo sapiens
taagaagacatgaa

SEQ ID NO: 245279 - DNA, 15 bp, Homo sapiens
taagaagacatgaac

SEQ ID NO: 245280 - DNA, 12 bp, Homo sapiens
taagaagagact

SEQ ID NO: 245281 - DNA, 21 bp, Homo sapiens
taagaataaataaagaagaaa

SEQ ID NO: 245282 - DNA, 23 bp, Homo sapiens
taagaataatgacgtattgtgaa

SEQ ID NO: 245283 - DNA, 17 bp, Homo sapiens
taagaatagttctaaaa

SEQ ID NO: 245284 - DNA, 22 bp, Homo sapiens
taagaatgcagattcctgggcc

SEQ ID NO: 245285 - DNA, 23 bp, Homo sapiens
taagaatgcagattcctgggcct

SEQ ID NO: 245286 - DNA, 23 bp, Homo sapiens
taagaatgctggttttcctaaat

SEQ ID NO: 245287 - DNA, 19 bp, Homo sapiens
taagaattcccagatagtc

SEQ ID NO: 245288 - DNA, 21 bp, Homo sapiens
taagaattgtttttgaattta

SEQ ID NO: 245289 - DNA, 17 bp, Homo sapiens
taagaatttattattaa

SEQ ID NO: 245290 - DNA, 15 bp, Homo sapiens
taagacaaatgggac

SEQ ID NO: 245291 - DNA, 20 bp, Homo sapiens
taagacaaatgggactgatg

SEQ ID NO: 245292 - DNA, 21 bp, Homo sapiens
taagacaaatgggactgatgt

SEQ ID NO: 245293 - DNA, 15 bp, Homo sapiens
taagacaacaggcat

SEQ ID NO: 245294 - DNA, 13 bp, Homo sapiens
taagacacacagc

SEQ ID NO: 245295 - DNA, 17 bp, Homo sapiens
taagacacacagccttt

SEQ ID NO: 245296 - DNA, 20 bp, Homo sapiens
taagacacacagcctttctg

SEQ ID NO: 245297 - DNA, 22 bp, Homo sapiens
taagacacacagcctttctgta

SEQ ID NO: 245298 - DNA, 23 bp, Homo sapiens
taagacacacagcctttctgtat

SEQ ID NO: 245299 - DNA, 16 bp, Homo sapiens
taagacatatctctaa

SEQ ID NO: 245300 - DNA, 16 bp, Homo sapiens
taagaccggaagctcc

SEQ ID NO: 245301 - DNA, 16 bp, Homo sapiens
taagaccgtgtcccaa

SEQ ID NO: 245302 - DNA, 19 bp, Homo sapiens
taagaccgtgtcccaagga

SEQ ID NO: 245303 - DNA, 22 bp, Homo sapiens
taagaccgtgtcccaaggagct

SEQ ID NO: 245304 - DNA, 17 bp, Homo sapiens
taagactaaatctgtaa

SEQ ID NO: 245305 - DNA, 18 bp, Homo sapiens
taagactaaatctgtaag

SEQ ID NO: 245306 - DNA, 18 bp, Homo sapiens
taagacttgtttctttct

SEQ ID NO: 245307 - DNA, 13 bp, Homo sapiens
taagagaaagaaa

SEQ ID NO: 245308 - DNA, 15 bp, Homo sapiens
taagagaaatgagct

SEQ ID NO: 245309 - DNA, 16 bp, Homo sapiens
taagagagagagcctt

SEQ ID NO: 245310 - DNA, 15 bp, Homo sapiens
taagagcaccttcct

SEQ ID NO: 245311 - DNA, 20 bp, Homo sapiens
taagagcaccttcctcactt

SEQ ID NO: 245312 - DNA, 17 bp, Homo sapiens
taagagcagagtctccc

SEQ ID NO: 245313 - DNA, 14 bp, Homo sapiens
taagagctggtgtc

SEQ ID NO: 245314 - DNA, 20 bp, Homo sapiens
taagataattaaatgaaata

SEQ ID NO: 245315 - DNA, 23 bp, Homo sapiens
taagatacaagtttcagacaggg

SEQ ID NO: 245316 - DNA, 16 bp, Homo sapiens
taagatacactcctgc

SEQ ID NO: 245317 - DNA, 19 bp, Homo sapiens
taagatacactcctgctgt

SEQ ID NO: 245318 - DNA, 21 bp, Homo sapiens
taagatacactcctgctgtgc

SEQ ID NO: 245319 - DNA, 22 bp, Homo sapiens
taagatacttagattagaccta

SEQ ID NO: 245320 - DNA, 18 bp, Homo sapiens
taagatattctttacaaa

SEQ ID NO: 245321 - DNA, 23 bp, Homo sapiens
taagatattctttacaaactgaa

SEQ ID NO: 245322 - DNA, 18 bp, Homo sapiens
taagatcgttctctgcct

SEQ ID NO: 245323 - DNA, 12 bp, Homo sapiens
taagatgaaatt

SEQ ID NO: 245324 - DNA, 18 bp, Homo sapiens
taagatgaggaaataatg

SEQ ID NO: 245325 - DNA, 20 bp, Homo sapiens
taagatgccagcatatactg

SEQ ID NO: 245326 - DNA, 17 bp, Homo sapiens
taagatggattctcaga

SEQ ID NO: 245327 - DNA, 22 bp, Homo sapiens
taagatggattctcagatattt

SEQ ID NO: 245328 - DNA, 14 bp, Homo sapiens
taagattaaattat

SEQ ID NO: 245329 - DNA, 22 bp, Homo sapiens
taagattaaattatatctgagg

SEQ ID NO: 245330 - DNA, 21 bp, Homo sapiens
taagattccattttggaaaat

SEQ ID NO: 245331 - DNA, 13 bp, Homo sapiens
taagattcttggt

SEQ ID NO: 245332 - DNA, 16 bp, Homo sapiens
taataaatgaccagtt

SEQ ID NO: 245333 - DNA, 14 bp, Homo sapiens
taataaatgggaaa

SEQ ID NO: 245334 - DNA, 17 bp, Homo sapiens
taataaatgtacattaa

SEQ ID NO: 245335 - DNA, 11 bp, Homo sapiens
taataaattaa

SEQ ID NO: 245336 - DNA, 17 bp, Homo sapiens
taataaattgaaattgt

SEQ ID NO: 245337 - DNA, 15 bp, Homo sapiens
taataactagatctc

SEQ ID NO: 245338 - DNA, 19 bp, Homo sapiens
taataactagatctcctgt

SEQ ID NO: 245339 - DNA, 20 bp, Homo sapiens
taataactagatctcctgta

SEQ ID NO: 245340 - DNA, 21 bp, Homo sapiens
taataactagatctcctgtaa

SEQ ID NO: 245341 - DNA, 21 bp, Homo sapiens
taataactgtgaagtttacat

SEQ ID NO: 245342 - DNA, 18 bp, Homo sapiens
taataatttttgctgaat

SEQ ID NO: 245343 - DNA, 19 bp, Homo sapiens
taataatttttgctgaatt

SEQ ID NO: 245344 - DNA, 13 bp, Homo sapiens
taatacagatgta

SEQ ID NO: 245345 - DNA, 23 bp, Homo sapiens
taatacagcagtgtcatcagaag

SEQ ID NO: 245346 - DNA, 19 bp, Homo sapiens
taatacattccatcacagc

SEQ ID NO: 245347 - DNA, 23 bp, Homo sapiens
taatacattccatcacagccagc

SEQ ID NO: 245348 - DNA, 16 bp, Homo sapiens
taatacctttaaatat

SEQ ID NO: 245349 - DNA, 22 bp, Homo sapiens
taatacctttaaatatcattct

SEQ ID NO: 245350 - DNA, 14 bp, Homo sapiens
taatactaatttat

SEQ ID NO: 245351 - DNA, 21 bp, Homo sapiens
taatactgaatttctttgatt

SEQ ID NO: 245352 - DNA, 19 bp, Homo sapiens
taatactggttatcctgtg

SEQ ID NO: 245353 - DNA, 14 bp, Homo sapiens
taatacttaaaaat

SEQ ID NO: 245354 - DNA, 20 bp, Homo sapiens
taatacttaaaaatatgtga

SEQ ID NO: 245355 - DNA, 18 bp, Homo sapiens
taatagaaaactgaaaat

SEQ ID NO: 245356 - DNA, 14 bp, Homo sapiens
taatagaaatgcat

SEQ ID NO: 245357 - DNA, 21 bp, Homo sapiens
taatagaatataattatcgga

SEQ ID NO: 245358 - DNA, 21 bp, Homo sapiens
taatagaatatactgtcttgt

SEQ ID NO: 245359 - DNA, 19 bp, Homo sapiens
taatagaatttcctaatga

SEQ ID NO: 245360 - DNA, 20 bp, Homo sapiens
taatagagtacttaatatac

SEQ ID NO: 245361 - DNA, 14 bp, Homo sapiens
taatagcctcacct

SEQ ID NO: 245362 - DNA, 19 bp, Homo sapiens
taatagcgggttactttca

SEQ ID NO: 245363 - DNA, 15 bp, Homo sapiens
taatagctgaacctg

SEQ ID NO: 245364 - DNA, 20 bp, Homo sapiens
taataggaaagatttaatgt

SEQ ID NO: 245365 - DNA, 17 bp, Homo sapiens
taataggaagaacagta

SEQ ID NO: 245366 - DNA, 15 bp, Homo sapiens
taatagttagccctc

SEQ ID NO: 245367 - DNA, 19 bp, Homo sapiens
taatagttagccctcagtc

SEQ ID NO: 245368 - DNA, 19 bp, Homo sapiens
taatagtttacatgtagta

SEQ ID NO: 245369 - DNA, 23 bp, Homo sapiens
taatataacaatatatgatatat

SEQ ID NO: 245370 - DNA, 16 bp, Homo sapiens
taatatactatattta

SEQ ID NO: 245371 - DNA, 14 bp, Homo sapiens
taatatagggtttg

SEQ ID NO: 245372 - DNA, 17 bp, Homo sapiens
taatatatcccagaaat

SEQ ID NO: 245373 - DNA, 22 bp, Homo sapiens
taatatatttttatatttagtt

SEQ ID NO: 245374 - DNA, 15 bp, Homo sapiens
taatatcatttcata

SEQ ID NO: 245375 - DNA, 16 bp, Homo sapiens
taatatctgactgaaa

SEQ ID NO: 245376 - DNA, 12 bp, Homo sapiens
taatatcttgaa

SEQ ID NO: 245377 - DNA, 14 bp, Homo sapiens
taatatcttgaaga

SEQ ID NO: 245378 - DNA, 22 bp, Homo sapiens
taatatcttgaagaatattgtt

SEQ ID NO: 245379 - DNA, 16 bp, Homo sapiens
taatatctttaaatga

SEQ ID NO: 245380 - DNA, 15 bp, Homo sapiens
taatatgggcattgt

SEQ ID NO: 245381 - DNA, 19 bp, Homo sapiens
taatatgggcattgtagtt

SEQ ID NO: 245382 - DNA, 17 bp, Homo sapiens
taatatgtttgaggtta

SEQ ID NO: 245383 - DNA, 18 bp, Homo sapiens
taatattaaaaatatgga

SEQ ID NO: 245384 - DNA, 22 bp, Homo sapiens
taatattaaaaatatggaactt

SEQ ID NO: 245385 - DNA, 19 bp, Homo sapiens
taatattaatttatatttg

SEQ ID NO: 245386 - DNA, 21 bp, Homo sapiens
taatattactgtctttattct

SEQ ID NO: 245387 - DNA, 14 bp, Homo sapiens
taatattatattgt

SEQ ID NO: 245388 - DNA, 14 bp, Homo sapiens
taatattctctgat

SEQ ID NO: 245389 - DNA, 14 bp, Homo sapiens
taatattgagaaag

SEQ ID NO: 245390 - DNA, 21 bp, Homo sapiens
taatattgatatgcttataca

SEQ ID NO: 245391 - DNA, 14 bp, Homo sapiens
taatatttatgttt

SEQ ID NO: 245392 - DNA, 15 bp, Homo sapiens
taatatttatgttta

SEQ ID NO: 245393 - DNA, 19 bp, Homo sapiens
taatatttatgtttaagtg

SEQ ID NO: 245394 - DNA, 15 bp, Homo sapiens
taatatttattgaat

SEQ ID NO: 245395 - DNA, 18 bp, Homo sapiens
taatatttcttcaagtga

SEQ ID NO: 245396 - DNA, 22 bp, Homo sapiens
taatatttcttcaagtgagtgg

SEQ ID NO: 245397 - DNA, 17 bp, Homo sapiens
taatcaatacccttggc

SEQ ID NO: 245398 - DNA, 19 bp, Homo sapiens
taatcaatgaatattgaag

SEQ ID NO: 245399 - DNA, 16 bp, Homo sapiens
taatcacaactcagca

SEQ ID NO: 245400 - DNA, 20 bp, Homo sapiens
taatcagaaatttttatcag

SEQ ID NO: 245401 - DNA, 11 bp, Homo sapiens
taatcagcctc

SEQ ID NO: 245402 - DNA, 14 bp, Homo sapiens
taatcagcctctta

SEQ ID NO: 245403 - DNA, 18 bp, Homo sapiens
taatcagtgtagccccaa

SEQ ID NO: 245404 - DNA, 17 bp, Homo sapiens
taatcagtgtgtctaaa

SEQ ID NO: 245405 - DNA, 23 bp, Homo sapiens
taatcagtgtgtctaaatttgaa

SEQ ID NO: 245406 - DNA, 13 bp, Homo sapiens
taatcatcttctc

SEQ ID NO: 245407 - DNA, 19 bp, Homo sapiens
taatcatgtgggtgagcca

SEQ ID NO: 245408 - DNA, 21 bp, Homo sapiens
taatcatgtgggtgagccagt

SEQ ID NO: 245409 - DNA, 19 bp, Homo sapiens
taatcatttccagcaaaat

SEQ ID NO: 245410 - DNA, 12 bp, Homo sapiens
taatcatttctt

SEQ ID NO: 245411 - DNA, 19 bp, Homo sapiens
taatcatttcttgggccct

SEQ ID NO: 245412 - DNA, 22 bp, Homo sapiens
taatcatttcttgggccctcct

SEQ ID NO: 245413 - DNA, 18 bp, Homo sapiens
taatccacgctcatcttg

SEQ ID NO: 245414 - DNA, 20 bp, Homo sapiens
taatcccagctacttgggaa

SEQ ID NO: 245415 - DNA, 14 bp, Homo sapiens
taatccccttctcc

SEQ ID NO: 245416 - DNA, 19 bp, Homo sapiens
taatcccggtttcagaagc

SEQ ID NO: 245417 - DNA, 21 bp, Homo sapiens
taatccttctaactaaactaa

SEQ ID NO: 245418 - DNA, 19 bp, Homo sapiens
taatctagagctatgcaca

SEQ ID NO: 245419 - DNA, 22 bp, Homo sapiens
taatctagagctatgcacacca

SEQ ID NO: 245420 - DNA, 15 bp, Homo sapiens
taatctagtttacag

SEQ ID NO: 245421 - DNA, 21 bp, Homo sapiens
taatctctaaatcaagtattt

SEQ ID NO: 245422 - DNA, 20 bp, Homo sapiens
taatctgacaaagtcatgaa

SEQ ID NO: 245423 - DNA, 15 bp, Homo sapiens
taatctggactcctc

SEQ ID NO: 245424 - DNA, 17 bp, Homo sapiens
taatctgggaagggaag

SEQ ID NO: 245425 - DNA, 21 bp, Homo sapiens
taatctggtgttcttgctaac

SEQ ID NO: 245426 - DNA, 16 bp, Homo sapiens
taatctgtagggctgg

SEQ ID NO: 245427 - DNA, 15 bp, Homo sapiens
taatctgttgtttga

SEQ ID NO: 245428 - DNA, 16 bp, Homo sapiens
taatctgttgtttgaa

SEQ ID NO: 245429 - DNA, 20 bp, Homo sapiens
taatcttaggggagagcttt

SEQ ID NO: 245430 - DNA, 16 bp, Homo sapiens
taatcttcagttttat

SEQ ID NO: 245431 - DNA, 20 bp, Homo sapiens
taatctttattttattattc

SEQ ID NO: 245432 - DNA, 21 bp, Homo sapiens
taatctttctttacctgagac

SEQ ID NO: 245433 - DNA, 19 bp, Homo sapiens
taatctttttctccaccca

SEQ ID NO: 245434 - DNA, 17 bp, Homo sapiens
taatgaaaatgataaaa

SEQ ID NO: 245435 - DNA, 13 bp, Homo sapiens
taatgaaaatgtc

SEQ ID NO: 245436 - DNA, 14 bp, Homo sapiens
taatgaaaatgtca

SEQ ID NO: 245437 - DNA, 15 bp, Homo sapiens
taatgaaaatgtcag

SEQ ID NO: 245438 - DNA, 15 bp, Homo sapiens
taatgaactgtgaca

SEQ ID NO: 245439 - DNA, 15 bp, Homo sapiens
taatgaaggtgtgct

SEQ ID NO: 245440 - DNA, 11 bp, Homo sapiens
taatgaataat

SEQ ID NO: 245441 - DNA, 16 bp, Homo sapiens
taatgaattttatgtg

SEQ ID NO: 245442 - DNA, 15 bp, Homo sapiens
taatgacagagagtt

SEQ ID NO: 245443 - DNA, 17 bp, Homo sapiens
taatgacgtattgtgaa

SEQ ID NO: 245444 - DNA, 18 bp, Homo sapiens
taatgacgtattgtgaaa

SEQ ID NO: 245445 - DNA, 19 bp, Homo sapiens
taatgacgtattgtgaaat

SEQ ID NO: 245446 - DNA, 21 bp, Homo sapiens
taatgacgtattgtgaaattt

SEQ ID NO: 245447 - DNA, 15 bp, Homo sapiens
taatgacttaagcac

SEQ ID NO: 245448 - DNA, 18 bp, Homo sapiens
taatgagatatatcttta

SEQ ID NO: 245449 - DNA, 18 bp, Homo sapiens
taatgagttttacattac

SEQ ID NO: 245450 - DNA, 19 bp, Homo sapiens
taatgataagtaaatgcta

SEQ ID NO: 245451 - DNA, 22 bp, Homo sapiens
taatgatactgtctaagaataa

SEQ ID NO: 245452 - DNA, 11 bp, Homo sapiens
taatgatgttt

SEQ ID NO: 245453 - DNA, 17 bp, Homo sapiens
taatgatttttgtgtat

SEQ ID NO: 245454 - DNA, 18 bp, Homo sapiens
taatgcagacatttacat

SEQ ID NO: 245455 - DNA, 19 bp, Homo sapiens
taatgcatgtggtatgagt

SEQ ID NO: 245456 - DNA, 14 bp, Homo sapiens
taatgcctttttgg

SEQ ID NO: 245457 - DNA, 20 bp, Homo sapiens
taatgcttatgtgttgcata

SEQ ID NO: 245458 - DNA, 15 bp, Homo sapiens
taatggaattatgta

SEQ ID NO: 245459 - DNA, 14 bp, Homo sapiens
taatggaggccaag

SEQ ID NO: 245460 - DNA, 16 bp, Homo sapiens
taatggaggccaagcc

SEQ ID NO: 245461 - DNA, 13 bp, Homo sapiens
taatggtttactg

SEQ ID NO: 245462 - DNA, 18 bp, Homo sapiens
agccttcctctgcagctg

SEQ ID NO: 245463 - DNA, 21 bp, Homo sapiens
agccttcctctgcagctgacc

SEQ ID NO: 245464 - DNA, 22 bp, Homo sapiens
agccttcctctgcagctgacct

SEQ ID NO: 245465 - DNA, 12 bp, Homo sapiens
agccttgcccag

SEQ ID NO: 245466 - DNA, 21 bp, Homo sapiens
agccttgcgcaaaacccagaa

SEQ ID NO: 245467 - DNA, 18 bp, Homo sapiens
agccttgctgtagagact

SEQ ID NO: 245468 - DNA, 19 bp, Homo sapiens
agccttgctgtagagactt

SEQ ID NO: 245469 - DNA, 22 bp, Homo sapiens
agccttgctgtagagacttccg

SEQ ID NO: 245470 - DNA, 17 bp, Homo sapiens
agccttggcctgacctg

SEQ ID NO: 245471 - DNA, 22 bp, Homo sapiens
agccttggcctgacctggcaca

SEQ ID NO: 245472 - DNA, 16 bp, Homo sapiens
agccttgtaattctaa

SEQ ID NO: 245473 - DNA, 13 bp, Homo sapiens
agccttgtgccct

SEQ ID NO: 245474 - DNA, 13 bp, Homo sapiens
agcctttaaattg

SEQ ID NO: 245475 - DNA, 23 bp, Homo sapiens
agcctttaccctcctctatttct

SEQ ID NO: 245476 - DNA, 11 bp, Homo sapiens
agcctttgaat

SEQ ID NO: 245477 - DNA, 16 bp, Homo sapiens
agcctttgcctccccg

SEQ ID NO: 245478 - DNA, 17 bp, Homo sapiens
agcctttggtgaataac

SEQ ID NO: 245479 - DNA, 19 bp, Homo sapiens
agccttttattaacatata

SEQ ID NO: 245480 - DNA, 23 bp, Homo sapiens
agcgacagaaaacctcaagggct

SEQ ID NO: 245481 - DNA, 12 bp, Homo sapiens
agcgagaccctt

SEQ ID NO: 245482 - DNA, 22 bp, Homo sapiens
agcgagacccttgcattagaaa

SEQ ID NO: 245483 - DNA, 23 bp, Homo sapiens
agcgaggcgaggctgcctctggg

SEQ ID NO: 245484 - DNA, 21 bp, Homo sapiens
agcgatgatgtccccttccct

SEQ ID NO: 245485 - DNA, 19 bp, Homo sapiens
agcgattattatctaaagt

SEQ ID NO: 245486 - DNA, 14 bp, Homo sapiens
agcgccacccgccc

SEQ ID NO: 245487 - DNA, 15 bp, Homo sapiens
agcgccccgccccca

SEQ ID NO: 245488 - DNA, 15 bp, Homo sapiens
agcgcccctccctag

SEQ ID NO: 245489 - DNA, 16 bp, Homo sapiens
agcgcccctccctagt

SEQ ID NO: 245490 - DNA, 12 bp, Homo sapiens
agcgcctcccgc

SEQ ID NO: 245491 - DNA, 16 bp, Homo sapiens
agcgcctcctggacac

SEQ ID NO: 245492 - DNA, 22 bp, Homo sapiens
agcgcgcgtgatagaagaaaag

SEQ ID NO: 245493 - DNA, 14 bp, Homo sapiens
agcgcgggagagag

SEQ ID NO: 245494 - DNA, 15 bp, Homo sapiens
agcgctatccacaga

SEQ ID NO: 245495 - DNA, 15 bp, Homo sapiens
agcgctcctctgcct

SEQ ID NO: 245496 - DNA, 13 bp, Homo sapiens
agcgctgcccaca

SEQ ID NO: 245497 - DNA, 14 bp, Homo sapiens
agcggaggaggaag

SEQ ID NO: 245498 - DNA, 18 bp, Homo sapiens
agcggcccggcccacgca

SEQ ID NO: 245499 - DNA, 22 bp, Homo sapiens
agcggcccggcccacgcagagc

SEQ ID NO: 245500 - DNA, 15 bp, Homo sapiens
agcgggacaaagcct

SEQ ID NO: 245501 - DNA, 11 bp, Homo sapiens
agcgggcagcc

SEQ ID NO: 245502 - DNA, 12 bp, Homo sapiens
agcgggcagccc

SEQ ID NO: 245503 - DNA, 14 bp, Homo sapiens
agcgggcagccccg

SEQ ID NO: 245504 - DNA, 20 bp, Homo sapiens
agcggggccttgtctcttcc

SEQ ID NO: 245505 - DNA, 13 bp, Homo sapiens
agcggggggaggg

SEQ ID NO: 245506 - DNA, 14 bp, Homo sapiens
agcggggggagggt

SEQ ID NO: 245507 - DNA, 17 bp, Homo sapiens
agcgggtaaaaagagaa

SEQ ID NO: 245508 - DNA, 18 bp, Homo sapiens
agcgggtctagtggaaag

SEQ ID NO: 245509 - DNA, 17 bp, Homo sapiens
agcggtggaaggagcct

SEQ ID NO: 245510 - DNA, 19 bp, Homo sapiens
agcggtttggggagcagag

SEQ ID NO: 245511 - DNA, 22 bp, Homo sapiens
agcggtttggggagcagagaca

SEQ ID NO: 245512 - DNA, 16 bp, Homo sapiens
agcgtcccagtctctg

SEQ ID NO: 245513 - DNA, 16 bp, Homo sapiens
agcgtccttccccctg

SEQ ID NO: 245514 - DNA, 14 bp, Homo sapiens
agcgtctcccttgg

SEQ ID NO: 245515 - DNA, 22 bp, Homo sapiens
agcgtctgagcggccgcctgtc

SEQ ID NO: 245516 - DNA, 22 bp, Homo sapiens
agcgtggcgcagtggccctgag

SEQ ID NO: 245517 - DNA, 24 bp, Homo sapiens
agcgtggcgcagtggccctgagca

SEQ ID NO: 245518 - DNA, 18 bp, Homo sapiens
agcgttaacacagtaaaa

SEQ ID NO: 245519 - DNA, 15 bp, Homo sapiens
agcgttcctggcctt

SEQ ID NO: 245520 - DNA, 21 bp, Homo sapiens
agcgtttgaggggctggcctt

SEQ ID NO: 245521 - DNA, 14 bp, Homo sapiens
agctaaaaatatat

SEQ ID NO: 245522 - DNA, 19 bp, Homo sapiens
agctaaaaatatatataac

SEQ ID NO: 245523 - DNA, 15 bp, Homo sapiens
agctaaaatgatttt

SEQ ID NO: 245524 - DNA, 15 bp, Homo sapiens
agctaaagaggctga

SEQ ID NO: 245525 - DNA, 23 bp, Homo sapiens
agctaaagaggtggggtgaagct

SEQ ID NO: 245526 - DNA, 13 bp, Homo sapiens
agctaaatccttt

SEQ ID NO: 245527 - DNA, 17 bp, Homo sapiens
agctaacactggcccct

SEQ ID NO: 245528 - DNA, 12 bp, Homo sapiens
agctaacagaca

SEQ ID NO: 245529 - DNA, 20 bp, Homo sapiens
agctaacatggaagtactat

SEQ ID NO: 245530 - DNA, 17 bp, Homo sapiens
agctaacattttaaata

SEQ ID NO: 245531 - DNA, 20 bp, Homo sapiens
agctaacattttaaataaaa

SEQ ID NO: 245532 - DNA, 20 bp, Homo sapiens
agctaagcagaataatggaa

SEQ ID NO: 245533 - DNA, 18 bp, Homo sapiens
agctaagctcaaatgtat

SEQ ID NO: 245534 - DNA, 15 bp, Homo sapiens
agctaataaaatatc

SEQ ID NO: 245535 - DNA, 16 bp, Homo sapiens
agctaataaaatatca

SEQ ID NO: 245536 - DNA, 21 bp, Homo sapiens
agctaataaaatatcattcag

SEQ ID NO: 245537 - DNA, 23 bp, Homo sapiens
agctaatctgtagggctggacct

SEQ ID NO: 245538 - DNA, 18 bp, Homo sapiens
agctacaggggaggctga

SEQ ID NO: 245539 - DNA, 18 bp, Homo sapiens
agctacattcctcagctg

SEQ ID NO: 245540 - DNA, 21 bp, Homo sapiens
agctacattcctcagctgcca

SEQ ID NO: 245541 - DNA, 16 bp, Homo sapiens
agctaccccttctttg

SEQ ID NO: 245542 - DNA, 16 bp, Homo sapiens
agctacctcaaacttc

SEQ ID NO: 245543 - DNA, 18 bp, Homo sapiens
agctacggttccctgcct

SEQ ID NO: 245544 - DNA, 21 bp, Homo sapiens
agctactaacctggagacagt

SEQ ID NO: 245545 - DNA, 14 bp, Homo sapiens
agctactctcttgc

SEQ ID NO: 245546 - DNA, 17 bp, Homo sapiens
agctactctgtccaggc

SEQ ID NO: 245547 - DNA, 18 bp, Homo sapiens
agctactctgtccaggcc

SEQ ID NO: 245548 - DNA, 20 bp, Homo sapiens
agctactctgtccaggccac

SEQ ID NO: 245549 - DNA, 23 bp, Homo sapiens
agctactctgtccaggccactgt

SEQ ID NO: 245550 - DNA, 20 bp, Homo sapiens
agctactgatttcctttgga

SEQ ID NO: 245551 - DNA, 16 bp, Homo sapiens
agctactgatttttgt

SEQ ID NO: 245552 - DNA, 18 bp, Homo sapiens
agctacttgggagcctga

SEQ ID NO: 245553 - DNA, 16 bp, Homo sapiens
agctacttgggaggct

SEQ ID NO: 245554 - DNA, 16 bp, Homo sapiens
agctagaaagtggcag

SEQ ID NO: 245555 - DNA, 17 bp, Homo sapiens
agctagagaggggcctc

SEQ ID NO: 245556 - DNA, 22 bp, Homo sapiens
agctagagaggggcctctggct

SEQ ID NO: 245557 - DNA, 14 bp, Homo sapiens
agctagagcttcaa

SEQ ID NO: 245558 - DNA, 23 bp, Homo sapiens
agctagcccagtccctggagctg

SEQ ID NO: 245559 - DNA, 15 bp, Homo sapiens
agctagctatttcta

SEQ ID NO: 245560 - DNA, 22 bp, Homo sapiens
agctagctatttctatgtatgt

SEQ ID NO: 245561 - DNA, 18 bp, Homo sapiens
acagcagcctgcttccca

SEQ ID NO: 245562 - DNA, 18 bp, Homo sapiens
acagcagcttcaccagag

SEQ ID NO: 245563 - DNA, 21 bp, Homo sapiens
acagcaggatgtgcctgtggc

SEQ ID NO: 245564 - DNA, 11 bp, Homo sapiens
acagcaggtgt

SEQ ID NO: 245565 - DNA, 21 bp, Homo sapiens
acagcagtcccagtattctca

SEQ ID NO: 245566 - DNA, 22 bp, Homo sapiens
acagcagtcccagtattctcag

SEQ ID NO: 245567 - DNA, 17 bp, Homo sapiens
acagcatcaaaatacaa

SEQ ID NO: 245568 - DNA, 14 bp, Homo sapiens
acagcatgtctact

SEQ ID NO: 245569 - DNA, 19 bp, Homo sapiens
acagcattcttgtcacaat

SEQ ID NO: 245570 - DNA, 18 bp, Homo sapiens
acagcatttcagctgtga

SEQ ID NO: 245571 - DNA, 12 bp, Homo sapiens
acagccaagccc

SEQ ID NO: 245572 - DNA, 18 bp, Homo sapiens
acagccaccacctggatg

SEQ ID NO: 245573 - DNA, 13 bp, Homo sapiens
acagccacctcca

SEQ ID NO: 245574 - DNA, 12 bp, Homo sapiens
acagccagccca

SEQ ID NO: 245575 - DNA, 13 bp, Homo sapiens
acagccagcccag

SEQ ID NO: 245576 - DNA, 14 bp, Homo sapiens
acagccagcccagc

SEQ ID NO: 245577 - DNA, 22 bp, Homo sapiens
acagccatgtccaagttcttca

SEQ ID NO: 245578 - DNA, 22 bp, Homo sapiens
acagccattcatctgggctggc

SEQ ID NO: 245579 - DNA, 16 bp, Homo sapiens
acagcccaaccaggag

SEQ ID NO: 245580 - DNA, 20 bp, Homo sapiens
acagcccgcatgcagcagct

SEQ ID NO: 245581 - DNA, 15 bp, Homo sapiens
acagccctcggcctc

SEQ ID NO: 245582 - DNA, 13 bp, Homo sapiens
acagccctgggag

SEQ ID NO: 245583 - DNA, 13 bp, Homo sapiens
acagccctgtcag

SEQ ID NO: 245584 - DNA, 18 bp, Homo sapiens
acagccggatcttggaga

SEQ ID NO: 245585 - DNA, 18 bp, Homo sapiens
acagccggggcctgccta

SEQ ID NO: 245586 - DNA, 22 bp, Homo sapiens
acagccgtcccgcgttcaagac

SEQ ID NO: 245587 - DNA, 23 bp, Homo sapiens
acagccgtcccgcgttcaagact

SEQ ID NO: 245588 - DNA, 18 bp, Homo sapiens
acagcctaatgaaggcca

SEQ ID NO: 245589 - DNA, 12 bp, Homo sapiens
acagcctcaccc

SEQ ID NO: 245590 - DNA, 19 bp, Homo sapiens
acagcctcacccctgcagg

SEQ ID NO: 245591 - DNA, 15 bp, Homo sapiens
acagcctccagggcc

SEQ ID NO: 245592 - DNA, 14 bp, Homo sapiens
acagtctctttaat

SEQ ID NO: 245593 - DNA, 16 bp, Homo sapiens
acagtgaacagcttca

SEQ ID NO: 245594 - DNA, 22 bp, Homo sapiens
acagtgaacataactgtaacat

SEQ ID NO: 245595 - DNA, 14 bp, Homo sapiens
acagtgaggagggt

SEQ ID NO: 245596 - DNA, 22 bp, Homo sapiens
acagtgatctccatatgttaca

SEQ ID NO: 245597 - DNA, 13 bp, Homo sapiens
acagtgcagacag

SEQ ID NO: 245598 - DNA, 14 bp, Homo sapiens
acagtgcagacagg

SEQ ID NO: 245599 - DNA, 12 bp, Homo sapiens
acagtggatgcc

SEQ ID NO: 245600 - DNA, 21 bp, Homo sapiens
acagtgggccggccccaggct

SEQ ID NO: 245601 - DNA, 22 bp, Homo sapiens
acagtgggccggccccaggctc

SEQ ID NO: 245602 - DNA, 16 bp, Homo sapiens
acagtggggcccatgg

SEQ ID NO: 245603 - DNA, 22 bp, Homo sapiens
acagtggggcccatggccccag

SEQ ID NO: 245604 - DNA, 10 bp, Homo sapiens
acagtggggg

SEQ ID NO: 245605 - DNA, 16 bp, Homo sapiens
acagtgggtggcacct

SEQ ID NO: 245606 - DNA, 18 bp, Homo sapiens
acagtgtggatgtaaatt

SEQ ID NO: 245607 - DNA, 21 bp, Homo sapiens
acagtgtggcttaaacatttt

SEQ ID NO: 245608 - DNA, 16 bp, Homo sapiens
acagtgtttcccataa

SEQ ID NO: 245609 - DNA, 22 bp, Homo sapiens
acagtgtttcccataattttct

SEQ ID NO: 245610 - DNA, 18 bp, Homo sapiens
acagttaaacttgcaatg

SEQ ID NO: 245611 - DNA, 21 bp, Homo sapiens
acagttaaatgagaacatgaa

SEQ ID NO: 245612 - DNA, 16 bp, Homo sapiens
acagttaactctccca

SEQ ID NO: 245613 - DNA, 16 bp, Homo sapiens
acagttactcttcagt

SEQ ID NO: 245614 - DNA, 22 bp, Homo sapiens
acagttagggttgagttacttc

SEQ ID NO: 245615 - DNA, 17 bp, Homo sapiens
acagttcacaccctgca

SEQ ID NO: 245616 - DNA, 15 bp, Homo sapiens
acagttcttcgggaa

SEQ ID NO: 245617 - DNA, 21 bp, Homo sapiens
acagttcttcgggaagagagg

SEQ ID NO: 245618 - DNA, 15 bp, Homo sapiens
acagttgactggctt

SEQ ID NO: 245619 - DNA, 18 bp, Homo sapiens
acagttgagagagaatct

SEQ ID NO: 245620 - DNA, 22 bp, Homo sapiens
acagttgagtttcttctaaaga

SEQ ID NO: 245621 - DNA, 22 bp, Homo sapiens
acagttggcagagaaggcctct

SEQ ID NO: 245622 - DNA, 21 bp, Homo sapiens
acagttgtaccactgctaata

SEQ ID NO: 245623 - DNA, 23 bp, Homo sapiens
acagttgtaccactgctaataaa

SEQ ID NO: 245624 - DNA, 17 bp, Homo sapiens
acagttgtctagagata

SEQ ID NO: 245625 - DNA, 22 bp, Homo sapiens
acagttgtctattctgagcctt

SEQ ID NO: 245626 - DNA, 23 bp, Homo sapiens
acagttgtctattctgagccttg

SEQ ID NO: 245627 - DNA, 21 bp, Homo sapiens
acagtttatgcagtgctgctt

SEQ ID NO: 245628 - DNA, 20 bp, Homo sapiens
acagtttgatgctgagtcat

SEQ ID NO: 245629 - DNA, 18 bp, Homo sapiens
acagtttgctatttgctt

SEQ ID NO: 245630 - DNA, 14 bp, Homo sapiens
acagtttgctctag

SEQ ID NO: 245631 - DNA, 12 bp, Homo sapiens
acagttttccat

SEQ ID NO: 245632 - DNA, 17 bp, Homo sapiens
acagttttccatgaaaa

SEQ ID NO: 245633 - DNA, 18 bp, Homo sapiens
acagttttccatgaaaac

SEQ ID NO: 245634 - DNA, 19 bp, Homo sapiens
acagttttccatgaaaacg

SEQ ID NO: 245635 - DNA, 23 bp, Homo sapiens
acagttttccatgaaaacgtttt

SEQ ID NO: 245636 - DNA, 12 bp, Homo sapiens
acataaaaagtt

SEQ ID NO: 245637 - DNA, 18 bp, Homo sapiens
acataaaagagtggaact

SEQ ID NO: 245638 - DNA, 14 bp, Homo sapiens
acataaaatctgtg

SEQ ID NO: 245639 - DNA, 17 bp, Homo sapiens
acataaaatctgtgaat

SEQ ID NO: 245640 - DNA, 15 bp, Homo sapiens
acataaactgacttt

SEQ ID NO: 245641 - DNA, 18 bp, Homo sapiens
acataaagaaacactttc

SEQ ID NO: 245642 - DNA, 18 bp, Homo sapiens
acataaatctgtctgatt

SEQ ID NO: 245643 - DNA, 13 bp, Homo sapiens
acataacaggcat

SEQ ID NO: 245644 - DNA, 16 bp, Homo sapiens
acataacagggtaaat

SEQ ID NO: 245645 - DNA, 22 bp, Homo sapiens
acataacagggtaaattattca

SEQ ID NO: 245646 - DNA, 16 bp, Homo sapiens
acataaccactgcttc

SEQ ID NO: 245647 - DNA, 18 bp, Homo sapiens
acataactgacttagttc

SEQ ID NO: 245648 - DNA, 14 bp, Homo sapiens
acataactgtaaca

SEQ ID NO: 245649 - DNA, 19 bp, Homo sapiens
acataagaccgtgtcccaa

SEQ ID NO: 245650 - DNA, 21 bp, Homo sapiens
acataagtaattcaagaaaac

SEQ ID NO: 245651 - DNA, 17 bp, Homo sapiens
acataataagtttcata

SEQ ID NO: 245652 - DNA, 15 bp, Homo sapiens
acataatacattcca

SEQ ID NO: 245653 - DNA, 15 bp, Homo sapiens
acataatagaatttc

SEQ ID NO: 245654 - DNA, 15 bp, Homo sapiens
acataatatcttgaa

SEQ ID NO: 245655 - DNA, 21 bp, Homo sapiens
acataatatcttgaagaatat

SEQ ID NO: 245656 - DNA, 22 bp, Homo sapiens
acataatatcttgaagaatatt

SEQ ID NO: 245657 - DNA, 21 bp, Homo sapiens
acataatgttagtagcactga

SEQ ID NO: 245658 - DNA, 21 bp, Homo sapiens
acataattttttttttttaac

SEQ ID NO: 245659 - DNA, 15 bp, Homo sapiens
acataccagcttaga

SEQ ID NO: 245660 - DNA, 20 bp, Homo sapiens
acatacctctctctatatat

SEQ ID NO: 245661 - DNA, 14 bp, Homo sapiens
acatactagaaagc

SEQ ID NO: 245662 - DNA, 24 bp, Homo sapiens
acatactccttccatcaaatagaa

SEQ ID NO: 245663 - DNA, 19 bp, Homo sapiens
acatactgcatgtaagcca

SEQ ID NO: 245664 - DNA, 19 bp, Homo sapiens
acatagattcacctgtaaa

SEQ ID NO: 245665 - DNA, 12 bp, Homo sapiens
acatagcccctg

SEQ ID NO: 245666 - DNA, 13 bp, Homo sapiens
acatagcccctgc

SEQ ID NO: 245667 - DNA, 13 bp, Homo sapiens
acatagtgaattt

SEQ ID NO: 245668 - DNA, 15 bp, Homo sapiens
acatagtgaatttta

SEQ ID NO: 245669 - DNA, 16 bp, Homo sapiens
acatagtgaattttaa

SEQ ID NO: 245670 - DNA, 16 bp, Homo sapiens
acatagtgatggttcc

SEQ ID NO: 245671 - DNA, 21 bp, Homo sapiens
acatagttgaaaaaagaagtt

SEQ ID NO: 245672 - DNA, 12 bp, Homo sapiens
acatagtttctt

SEQ ID NO: 245673 - DNA, 17 bp, Homo sapiens
acatagttttaaactca

SEQ ID NO: 245674 - DNA, 19 bp, Homo sapiens
acatataaattaatacata

SEQ ID NO: 245675 - DNA, 16 bp, Homo sapiens
acatataatatatgtt

SEQ ID NO: 245676 - DNA, 15 bp, Homo sapiens
acatatacacaaaga

SEQ ID NO: 245677 - DNA, 16 bp, Homo sapiens
acatatacagcaggat

SEQ ID NO: 245678 - DNA, 22 bp, Homo sapiens
acatatagccctttccccactc

SEQ ID NO: 245679 - DNA, 16 bp, Homo sapiens
acatatattttttaca

SEQ ID NO: 245680 - DNA, 15 bp, Homo sapiens
acatatgaaaataca

SEQ ID NO: 245681 - DNA, 23 bp, Homo sapiens
acatatgtagatattgttttctg

SEQ ID NO: 245682 - DNA, 14 bp, Homo sapiens
acatatgtcttact

SEQ ID NO: 245683 - DNA, 18 bp, Homo sapiens
acatattcaaatcagcaa

SEQ ID NO: 245684 - DNA, 23 bp, Homo sapiens
acatattcttgctttcacaaata

SEQ ID NO: 245685 - DNA, 22 bp, Homo sapiens
acatatttgtagctagaatatc

SEQ ID NO: 245686 - DNA, 18 bp, Homo sapiens
acatattttcctttagat

SEQ ID NO: 245687 - DNA, 14 bp, Homo sapiens
acatcaaataaact

SEQ ID NO: 245688 - DNA, 14 bp, Homo sapiens
acatcaaataaatt

SEQ ID NO: 245689 - DNA, 17 bp, Homo sapiens
acatcaaataaatttct

SEQ ID NO: 245690 - DNA, 19 bp, Homo sapiens
acatcaaataaatttctgg

SEQ ID NO: 245691 - DNA, 16 bp, Homo sapiens
acatcaacatcttggt

SEQ ID NO: 245692 - DNA, 18 bp, Homo sapiens
acatcaacatcttggtca

SEQ ID NO: 245693 - DNA, 12 bp, Homo sapiens
acatcaagatac

SEQ ID NO: 245694 - DNA, 15 bp, Homo sapiens
acatcaatgttcatt

SEQ ID NO: 245695 - DNA, 13 bp, Homo sapiens
acatcacacacac

SEQ ID NO: 245696 - DNA, 19 bp, Homo sapiens
acatcagacctgtcttcca

SEQ ID NO: 245697 - DNA, 21 bp, Homo sapiens
acatcagcttgaccagtataa

SEQ ID NO: 245698 - DNA, 15 bp, Homo sapiens
acatcagtaatgtat

SEQ ID NO: 245699 - DNA, 23 bp, Homo sapiens
acatcagtggcatggctccagtc

SEQ ID NO: 245700 - DNA, 16 bp, Homo sapiens
acatcatgttatttta

SEQ ID NO: 245701 - DNA, 19 bp, Homo sapiens
acatcattggataaatttg

SEQ ID NO: 245702 - DNA, 12 bp, Homo sapiens
acatcatttctt

SEQ ID NO: 245703 - DNA, 16 bp, Homo sapiens
agctgacaaaattttg

SEQ ID NO: 245704 - DNA, 19 bp, Homo sapiens
agctgacaaaattttgctc

SEQ ID NO: 245705 - DNA, 15 bp, Homo sapiens
agctgacctctgttg

SEQ ID NO: 245706 - DNA, 20 bp, Homo sapiens
agctgacgaggctgggccaa

SEQ ID NO: 245707 - DNA, 16 bp, Homo sapiens
agctgactcattcttt

SEQ ID NO: 245708 - DNA, 11 bp, Homo sapiens
agctgactgtg

SEQ ID NO: 245709 - DNA, 13 bp, Homo sapiens
agctgactgtggc

SEQ ID NO: 245710 - DNA, 15 bp, Homo sapiens
agctgagatgtggac

SEQ ID NO: 245711 - DNA, 12 bp, Homo sapiens
agctgagctgga

SEQ ID NO: 245712 - DNA, 23 bp, Homo sapiens
agctgagcttcggttctccagaa

SEQ ID NO: 245713 - DNA, 15 bp, Homo sapiens
agctgagcttgagct

SEQ ID NO: 245714 - DNA, 20 bp, Homo sapiens
agctgaggacacaccccaca

SEQ ID NO: 245715 - DNA, 23 bp, Homo sapiens
agctgaggccattccctgtagga

SEQ ID NO: 245716 - DNA, 14 bp, Homo sapiens
agctgaggccccag

SEQ ID NO: 245717 - DNA, 22 bp, Homo sapiens
agctgaggccccagggctgtgg

SEQ ID NO: 245718 - DNA, 23 bp, Homo sapiens
agctgaggccccagggctgtggg

SEQ ID NO: 245719 - DNA, 18 bp, Homo sapiens
agctgaggtctcttgagg

SEQ ID NO: 245720 - DNA, 23 bp, Homo sapiens
agctgaggtctcttgagggagct

SEQ ID NO: 245721 - DNA, 18 bp, Homo sapiens
agctgagtcggctgggca

SEQ ID NO: 245722 - DNA, 14 bp, Homo sapiens
acattgtcaataaa

SEQ ID NO: 245723 - DNA, 14 bp, Homo sapiens
acattgttgttttt

SEQ ID NO: 245724 - DNA, 20 bp, Homo sapiens
acattgttgtttttttaata

SEQ ID NO: 245725 - DNA, 12 bp, Homo sapiens
acatttacagtc

SEQ ID NO: 245726 - DNA, 21 bp, Homo sapiens
acatttacagtccttcaaaat

SEQ ID NO: 245727 - DNA, 14 bp, Homo sapiens
acatttaggagaag

SEQ ID NO: 245728 - DNA, 16 bp, Homo sapiens
acatttaggagaagtt

SEQ ID NO: 245729 - DNA, 20 bp, Homo sapiens
acatttataatgtttgctat

SEQ ID NO: 245730 - DNA, 18 bp, Homo sapiens
acatttatcttctgtttt

SEQ ID NO: 245731 - DNA, 20 bp, Homo sapiens
acatttatcttctgtttttc

SEQ ID NO: 245732 - DNA, 22 bp, Homo sapiens
acatttatcttctgtttttctc

SEQ ID NO: 245733 - DNA, 19 bp, Homo sapiens
acatttcaagatccaaatg

SEQ ID NO: 245734 - DNA, 20 bp, Homo sapiens
acatttcataaggcctgccc

SEQ ID NO: 245735 - DNA, 22 bp, Homo sapiens
acatttcataaggcctgccctc

SEQ ID NO: 245736 - DNA, 13 bp, Homo sapiens
acatttctcatgt

SEQ ID NO: 245737 - DNA, 20 bp, Homo sapiens
acatttctcttcagtgtgtt

SEQ ID NO: 245738 - DNA, 20 bp, Homo sapiens
acatttctggccatttaact

SEQ ID NO: 245739 - DNA, 24 bp, Homo sapiens
acatttctggccatttaactagca

SEQ ID NO: 245740 - DNA, 19 bp, Homo sapiens
acatttgagtcccttccag

SEQ ID NO: 245741 - DNA, 19 bp, Homo sapiens
acatttgctgaatatgcaa

SEQ ID NO: 245742 - DNA, 20 bp, Homo sapiens
acatttggaaaccatgcact

SEQ ID NO: 245743 - DNA, 22 bp, Homo sapiens
acatttgggagactgagcttga

SEQ ID NO: 245744 - DNA, 18 bp, Homo sapiens
acatttgggtaaatcatg

SEQ ID NO: 245745 - DNA, 22 bp, Homo sapiens
acatttggtggtactttattct

SEQ ID NO: 245746 - DNA, 13 bp, Homo sapiens
acatttgtacatt

SEQ ID NO: 245747 - DNA, 17 bp, Homo sapiens
acatttgtagttggagt

SEQ ID NO: 245748 - DNA, 16 bp, Homo sapiens
acatttgtcctgcaga

SEQ ID NO: 245749 - DNA, 15 bp, Homo sapiens
acatttgtgcataaa

SEQ ID NO: 245750 - DNA, 22 bp, Homo sapiens
acatttgtgcataaatttccac

SEQ ID NO: 245751 - DNA, 15 bp, Homo sapiens
acattttaaaatcaa

SEQ ID NO: 245752 - DNA, 20 bp, Homo sapiens
acattttaaataaaagaaaa

SEQ ID NO: 245753 - DNA, 16 bp, Homo sapiens
acattttagacagtaa

SEQ ID NO: 245754 - DNA, 13 bp, Homo sapiens
acattttgcttgc

SEQ ID NO: 245755 - DNA, 19 bp, Homo sapiens
acattttgttatagaatac

SEQ ID NO: 245756 - DNA, 12 bp, Homo sapiens
acatttttacaa

SEQ ID NO: 245757 - DNA, 21 bp, Homo sapiens
acattttttgtttcttggtgt

SEQ ID NO: 245758 - DNA, 11 bp, Homo sapiens
accaaaaatat

SEQ ID NO: 245759 - DNA, 17 bp, Homo sapiens
accaaaacataagacga

SEQ ID NO: 245760 - DNA, 17 bp, Homo sapiens
accaaaatatagttaat

SEQ ID NO: 245761 - DNA, 12 bp, Homo sapiens
accaaaatgaca

SEQ ID NO: 245762 - DNA, 16 bp, Homo sapiens
accaaacggaactctt

SEQ ID NO: 245763 - DNA, 21 bp, Homo sapiens
accaaagctgacgaggctggg

SEQ ID NO: 245764 - DNA, 18 bp, Homo sapiens
accaaataaaaatattgt

SEQ ID NO: 245765 - DNA, 14 bp, Homo sapiens
accaaatctgtcta

SEQ ID NO: 245766 - DNA, 20 bp, Homo sapiens
accaaatgcctctgccttga

SEQ ID NO: 245767 - DNA, 14 bp, Homo sapiens
accaaattgctgag

SEQ ID NO: 245768 - DNA, 17 bp, Homo sapiens
accaaattgctgagatg

SEQ ID NO: 245769 - DNA, 22 bp, Homo sapiens
accaaattttgaggtcttttac

SEQ ID NO: 245770 - DNA, 21 bp, Homo sapiens
accaacaattaggtctgcatt

SEQ ID NO: 245771 - DNA, 21 bp, Homo sapiens
accaacaccatcacagcttgt

SEQ ID NO: 245772 - DNA, 15 bp, Homo sapiens
accaacataaaacaa

SEQ ID NO: 245773 - DNA, 16 bp, Homo sapiens
accaacataaaacaaa

SEQ ID NO: 245774 - DNA, 15 bp, Homo sapiens
accaaccctcagagc

SEQ ID NO: 245775 - DNA, 15 bp, Homo sapiens
accaactctgcactc

SEQ ID NO: 245776 - DNA, 14 bp, Homo sapiens
accaactgagccaa

SEQ ID NO: 245777 - DNA, 22 bp, Homo sapiens
accaacttggttctgcttcaat

SEQ ID NO: 245778 - DNA, 19 bp, Homo sapiens
accaactttctgtaaactc

SEQ ID NO: 245779 - DNA, 22 bp, Homo sapiens
accaacttttctattaaaagtg

SEQ ID NO: 245780 - DNA, 20 bp, Homo sapiens
accaagaaaccactgggcat

SEQ ID NO: 245781 - DNA, 14 bp, Homo sapiens
accaagaaagcagg

SEQ ID NO: 245782 - DNA, 12 bp, Homo sapiens
accaagaactgc

SEQ ID NO: 245783 - DNA, 14 bp, Homo sapiens
accaagaactgcat

SEQ ID NO: 245784 - DNA, 15 bp, Homo sapiens
accaagaactgcatg

SEQ ID NO: 245785 - DNA, 19 bp, Homo sapiens
accaagagtatgagaaata

SEQ ID NO: 245786 - DNA, 14 bp, Homo sapiens
accaagagtattcc

SEQ ID NO: 245787 - DNA, 21 bp, Homo sapiens
accaagatcacaaatagtgtt

SEQ ID NO: 245788 - DNA, 16 bp, Homo sapiens
accaagatgccatctg

SEQ ID NO: 245789 - DNA, 22 bp, Homo sapiens
accaagatgccatctgtgtcct

SEQ ID NO: 245790 - DNA, 12 bp, Homo sapiens
accaagcagctt

SEQ ID NO: 245791 - DNA, 14 bp, Homo sapiens
accaagccgtggct

SEQ ID NO: 245792 - DNA, 18 bp, Homo sapiens
accaagccgtggcttccc

SEQ ID NO: 245793 - DNA, 13 bp, Homo sapiens
accaagccttggc

SEQ ID NO: 245794 - DNA, 21 bp, Homo sapiens
accaagctgctctccttcact

SEQ ID NO: 245795 - DNA, 18 bp, Homo sapiens
accaagcttaaggagagg

SEQ ID NO: 245796 - DNA, 18 bp, Homo sapiens
accaagcttagaagccac

SEQ ID NO: 245797 - DNA, 19 bp, Homo sapiens
accaagcttgtttccctgc

SEQ ID NO: 245798 - DNA, 23 bp, Homo sapiens
accaagcttgtttccctgctggc

SEQ ID NO: 245799 - DNA, 13 bp, Homo sapiens
accaaggacccct

SEQ ID NO: 245800 - DNA, 15 bp, Homo sapiens
accaaggcagcctcc

SEQ ID NO: 245801 - DNA, 17 bp, Homo sapiens
accaaggcagcctccag

SEQ ID NO: 245802 - DNA, 18 bp, Homo sapiens
accaaggcagcctccaga

SEQ ID NO: 245803 - DNA, 17 bp, Homo sapiens
accaagggtatctgctg

SEQ ID NO: 245804 - DNA, 15 bp, Homo sapiens
accaagtcctggcta

SEQ ID NO: 245805 - DNA, 23 bp, Homo sapiens
accaagtcctggctacatcccag

SEQ ID NO: 245806 - DNA, 20 bp, Homo sapiens
accaagtgccttgagctgcc

SEQ ID NO: 245807 - DNA, 16 bp, Homo sapiens
accaagtggaccttga

SEQ ID NO: 245808 - DNA, 20 bp, Homo sapiens
accaagttcattacctccct

SEQ ID NO: 245809 - DNA, 18 bp, Homo sapiens
accaataacttcagagaa

SEQ ID NO: 245810 - DNA, 18 bp, Homo sapiens
accaatattaccatctta

SEQ ID NO: 245811 - DNA, 18 bp, Homo sapiens
accaatcccgtgaaagaa

SEQ ID NO: 245812 - DNA, 20 bp, Homo sapiens
accaatcctatgtcatttct

SEQ ID NO: 245813 - DNA, 22 bp, Homo sapiens
accaatgattcataacaatgta

SEQ ID NO: 245814 - DNA, 12 bp, Homo sapiens
accaatgcatgc

SEQ ID NO: 245815 - DNA, 22 bp, Homo sapiens
accaatgcattaccttctgttc

SEQ ID NO: 245816 - DNA, 18 bp, Homo sapiens
accaatgctgttgtaaac

SEQ ID NO: 245817 - DNA, 22 bp, Homo sapiens
accaatggtgatcctctatttt

SEQ ID NO: 245818 - DNA, 14 bp, Homo sapiens
accaattgccctgc

SEQ ID NO: 245819 - DNA, 15 bp, Homo sapiens
accaattgccctgcc

SEQ ID NO: 245820 - DNA, 15 bp, Homo sapiens
accaattgtttcttg

SEQ ID NO: 245821 - DNA, 13 bp, Homo sapiens
accacacacaccc

SEQ ID NO: 245822 - DNA, 20 bp, Homo sapiens
accacacacacccttcccca

SEQ ID NO: 245823 - DNA, 11 bp, Homo sapiens
accacactgaa

SEQ ID NO: 245824 - DNA, 13 bp, Homo sapiens
accacactgacca

SEQ ID NO: 245825 - DNA, 14 bp, Homo sapiens
accacactgaccac

SEQ ID NO: 245826 - DNA, 18 bp, Homo sapiens
accacactgaccacactg

SEQ ID NO: 245827 - DNA, 14 bp, Homo sapiens
accacactgttgag

SEQ ID NO: 245828 - DNA, 17 bp, Homo sapiens
accacactgttgagttg

SEQ ID NO: 245829 - DNA, 16 bp, Homo sapiens
accacacttcctgtcc

SEQ ID NO: 245830 - DNA, 17 bp, Homo sapiens
accacacttcctgtcca

SEQ ID NO: 245831 - DNA, 22 bp, Homo sapiens
accacacttcctgtccagagag

SEQ ID NO: 245832 - DNA, 22 bp, Homo sapiens
accacagaagcttgtattatca

SEQ ID NO: 245833 - DNA, 20 bp, Homo sapiens
accacagacgccacctggcg

SEQ ID NO: 245834 - DNA, 19 bp, Homo sapiens
accacagcaggtgtcatat

SEQ ID NO: 245835 - DNA, 13 bp, Homo sapiens
accacagccctgt

SEQ ID NO: 245836 - DNA, 15 bp, Homo sapiens
accacagccctgtca

SEQ ID NO: 245837 - DNA, 12 bp, Homo sapiens
accacagctgct

SEQ ID NO: 245838 - DNA, 14 bp, Homo sapiens
accacaggaagccg

SEQ ID NO: 245839 - DNA, 19 bp, Homo sapiens
accacaggatctgaacttt

SEQ ID NO: 245840 - DNA, 17 bp, Homo sapiens
accacagggttcaaaat

SEQ ID NO: 245841 - DNA, 22 bp, Homo sapiens
accacagggttcaaaatgtctg

SEQ ID NO: 245842 - DNA, 16 bp, Homo sapiens
accacagtgggtggca

SEQ ID NO: 245843 - DNA, 19 bp, Homo sapiens
accacagtgggtggcacct

SEQ ID NO: 245844 - DNA, 22 bp, Homo sapiens
accacatcctccgtccagccgc

SEQ ID NO: 245845 - DNA, 14 bp, Homo sapiens
accacatcttgtct

SEQ ID NO: 245846 - DNA, 20 bp, Homo sapiens
accacatggtccatttcatg

SEQ ID NO: 245847 - DNA, 14 bp, Homo sapiens
accaccacacccct

SEQ ID NO: 245848 - DNA, 16 bp, Homo sapiens
aggaaatctcacccca

SEQ ID NO: 245849 - DNA, 19 bp, Homo sapiens
aggaaatctcctcttttgt

SEQ ID NO: 245850 - DNA, 22 bp, Homo sapiens
aggaaatcttgtccagagacaa

SEQ ID NO: 245851 - DNA, 14 bp, Homo sapiens
aggaaatgttattg

SEQ ID NO: 245852 - DNA, 18 bp, Homo sapiens
accagtgtactgctttca

SEQ ID NO: 245853 - DNA, 21 bp, Homo sapiens
accagtgttaagtgacataga

SEQ ID NO: 245854 - DNA, 19 bp, Homo sapiens
accagtgttagtgggaaga

SEQ ID NO: 245855 - DNA, 22 bp, Homo sapiens
accagtgttagtgggaagagct

SEQ ID NO: 245856 - DNA, 17 bp, Homo sapiens
accagttatgtgaatga

SEQ ID NO: 245857 - DNA, 21 bp, Homo sapiens
accagttgcacttggcctctg

SEQ ID NO: 245858 - DNA, 15 bp, Homo sapiens
accagttgggagcac

SEQ ID NO: 245859 - DNA, 19 bp, Homo sapiens
accagttgggagcactgga

SEQ ID NO: 245860 - DNA, 11 bp, Homo sapiens
accagtttacc

SEQ ID NO: 245861 - DNA, 14 bp, Homo sapiens
accagttttgctgc

SEQ ID NO: 245862 - DNA, 23 bp, Homo sapiens
accataacccaggaatgaagata

SEQ ID NO: 245863 - DNA, 14 bp, Homo sapiens
accatagaactgtc

SEQ ID NO: 245864 - DNA, 12 bp, Homo sapiens
accatcaataaa

SEQ ID NO: 245865 - DNA, 18 bp, Homo sapiens
accatcacaatacagata

SEQ ID NO: 245866 - DNA, 16 bp, Homo sapiens
accatcacagcttgtt

SEQ ID NO: 245867 - DNA, 23 bp, Homo sapiens
accatcagtgcacaaatcattcc

SEQ ID NO: 245868 - DNA, 20 bp, Homo sapiens
accatcagttactggtttca

SEQ ID NO: 245869 - DNA, 23 bp, Homo sapiens
accatcagttactggtttcagtt

SEQ ID NO: 245870 - DNA, 14 bp, Homo sapiens
accatcccactgat

SEQ ID NO: 245871 - DNA, 18 bp, Homo sapiens
accatcccctcctagcac

SEQ ID NO: 245872 - DNA, 14 bp, Homo sapiens
accatcctggcccc

SEQ ID NO: 245873 - DNA, 17 bp, Homo sapiens
accatcctggcccctcc

SEQ ID NO: 245874 - DNA, 16 bp, Homo sapiens
accatcggtcagcagg

SEQ ID NO: 245875 - DNA, 13 bp, Homo sapiens
accatctcaggcc

SEQ ID NO: 245876 - DNA, 16 bp, Homo sapiens
accatctcaggccacc

SEQ ID NO: 245877 - DNA, 21 bp, Homo sapiens
accatctcaggccacctgccc

SEQ ID NO: 245878 - DNA, 15 bp, Homo sapiens
accatctggcctggc

SEQ ID NO: 245879 - DNA, 14 bp, Homo sapiens
accatcttaatctt

SEQ ID NO: 245880 - DNA, 23 bp, Homo sapiens
accatcttaatctttattttatt

SEQ ID NO: 245881 - DNA, 15 bp, Homo sapiens
accatgaaacaaagc

SEQ ID NO: 245882 - DNA, 14 bp, Homo sapiens
accatgaagtgaaa

SEQ ID NO: 245883 - DNA, 18 bp, Homo sapiens
accatgagaagagggcct

SEQ ID NO: 245884 - DNA, 17 bp, Homo sapiens
accatgcacagagtcct

SEQ ID NO: 245885 - DNA, 23 bp, Homo sapiens
accatgctgctttttggcacagt

SEQ ID NO: 245886 - DNA, 21 bp, Homo sapiens
accatgctggcggcgcagagg

SEQ ID NO: 245887 - DNA, 21 bp, Homo sapiens
accatggctaaggcaccagcc

SEQ ID NO: 245888 - DNA, 14 bp, Homo sapiens
accatgtaaaacaa

SEQ ID NO: 245889 - DNA, 15 bp, Homo sapiens
accatgtaaaacaaa

SEQ ID NO: 245890 - DNA, 21 bp, Homo sapiens
accatgtaaaacaaaaaacaa

SEQ ID NO: 245891 - DNA, 11 bp, Homo sapiens
accatgtacat

SEQ ID NO: 245892 - DNA, 17 bp, Homo sapiens
accatgtgcatcaggaa

SEQ ID NO: 245893 - DNA, 12 bp, Homo sapiens
accatgtgccat

SEQ ID NO: 245894 - DNA, 21 bp, Homo sapiens
accatgtgccatctgtacata

SEQ ID NO: 245895 - DNA, 13 bp, Homo sapiens
accattaaaactg

SEQ ID NO: 245896 - DNA, 20 bp, Homo sapiens
accattaaaactgctttttt

SEQ ID NO: 245897 - DNA, 14 bp, Homo sapiens
accattataaaatc

SEQ ID NO: 245898 - DNA, 12 bp, Homo sapiens
accattccccat

SEQ ID NO: 245899 - DNA, 21 bp, Homo sapiens
accattcctttaaattctcca

SEQ ID NO: 245900 - DNA, 22 bp, Homo sapiens
accattgacctcagctgcacat

SEQ ID NO: 245901 - DNA, 13 bp, Homo sapiens
accattgcttcac

SEQ ID NO: 245902 - DNA, 15 bp, Homo sapiens
accattgcttcacta

SEQ ID NO: 245903 - DNA, 14 bp, Homo sapiens
accatttaatcatt

SEQ ID NO: 245904 - DNA, 19 bp, Homo sapiens
accatttagtcctcacctt

SEQ ID NO: 245905 - DNA, 16 bp, Homo sapiens
accatttcccctgtgg

SEQ ID NO: 245906 - DNA, 22 bp, Homo sapiens
accatttcccctgtggtttgtt

SEQ ID NO: 245907 - DNA, 17 bp, Homo sapiens
accatttcttatggaaa

SEQ ID NO: 245908 - DNA, 19 bp, Homo sapiens
accatttgtaataaagtat

SEQ ID NO: 245909 - DNA, 22 bp, Homo sapiens
accattttaacctagatgttta

SEQ ID NO: 245910 - DNA, 16 bp, Homo sapiens
acccaaaccccttccc

SEQ ID NO: 245911 - DNA, 19 bp, Homo sapiens
acccaactgacttctgcta

SEQ ID NO: 245912 - DNA, 15 bp, Homo sapiens
acccaagtccacccc

SEQ ID NO: 245913 - DNA, 11 bp, Homo sapiens
acccaataaag

SEQ ID NO: 245914 - DNA, 13 bp, Homo sapiens
acccaatttccaa

SEQ ID NO: 245915 - DNA, 21 bp, Homo sapiens
acccaattttaaaaaataaca

SEQ ID NO: 245916 - DNA, 22 bp, Homo sapiens
acccaattttaaaaaataacat

SEQ ID NO: 245917 - DNA, 13 bp, Homo sapiens
acccacaagtgcc

SEQ ID NO: 245918 - DNA, 21 bp, Homo sapiens
acccacaccccgtctgcccct

SEQ ID NO: 245919 - DNA, 14 bp, Homo sapiens
acccacagagcaag

SEQ ID NO: 245920 - DNA, 22 bp, Homo sapiens
acccacagggcctgacttttac

SEQ ID NO: 245921 - DNA, 17 bp, Homo sapiens
acccaccaaactgcaca

SEQ ID NO: 245922 - DNA, 20 bp, Homo sapiens
acccaccaaatgcctctgcc

SEQ ID NO: 245923 - DNA, 14 bp, Homo sapiens
acccaccagggctc

SEQ ID NO: 245924 - DNA, 14 bp, Homo sapiens
acccaccagtcagg

SEQ ID NO: 245925 - DNA, 11 bp, Homo sapiens
acccaccagtg

SEQ ID NO: 245926 - DNA, 16 bp, Homo sapiens
acccacccagcaccca

SEQ ID NO: 245927 - DNA, 14 bp, Homo sapiens
acccacccatcttc

SEQ ID NO: 245928 - DNA, 21 bp, Homo sapiens
acccacccatcttcctgctgc

SEQ ID NO: 245929 - DNA, 12 bp, Homo sapiens
acccaccccaac

SEQ ID NO: 245930 - DNA, 15 bp, Homo sapiens
acccaccccaactct

SEQ ID NO: 245931 - DNA, 16 bp, Homo sapiens
acccacccctcctggg

SEQ ID NO: 245932 - DNA, 23 bp, Homo sapiens
acccacccctcctgggcccaggc

SEQ ID NO: 245933 - DNA, 14 bp, Homo sapiens
acccacccctgccc

SEQ ID NO: 245934 - DNA, 16 bp, Homo sapiens
acccacccctgcccag

SEQ ID NO: 245935 - DNA, 13 bp, Homo sapiens
acccaccctctgg

SEQ ID NO: 245936 - DNA, 15 bp, Homo sapiens
acccacccttctccc

SEQ ID NO: 245937 - DNA, 22 bp, Homo sapiens
acccaccgatggagcccccaga

SEQ ID NO: 245938 - DNA, 13 bp, Homo sapiens
acccacctcagcc

SEQ ID NO: 245939 - DNA, 14 bp, Homo sapiens
acccacctccaccc

SEQ ID NO: 245940 - DNA, 15 bp, Homo sapiens
acccacctccaccca

SEQ ID NO: 245941 - DNA, 19 bp, Homo sapiens
acccacctccacccagccc

SEQ ID NO: 245942 - DNA, 16 bp, Homo sapiens
acccacctgagctttg

SEQ ID NO: 245943 - DNA, 20 bp, Homo sapiens
acccaccttgttggagcctg

SEQ ID NO: 245944 - DNA, 18 bp, Homo sapiens
acccacgaacgctcttag

SEQ ID NO: 245945 - DNA, 17 bp, Homo sapiens
acccactaagtaacctc

SEQ ID NO: 245946 - DNA, 19 bp, Homo sapiens
acccactagccctctttct

SEQ ID NO: 245947 - DNA, 15 bp, Homo sapiens
acccactcaccaggg

SEQ ID NO: 245948 - DNA, 19 bp, Homo sapiens
acccactgtccgcctctgc

SEQ ID NO: 245949 - DNA, 21 bp, Homo sapiens
acccactgtggggcaagcctg

SEQ ID NO: 245950 - DNA, 23 bp, Homo sapiens
acccagaagatgtattcagagcc

SEQ ID NO: 245951 - DNA, 18 bp, Homo sapiens
acccagagaatatataca

SEQ ID NO: 245952 - DNA, 23 bp, Homo sapiens
acccagaggaggcagaataagaa

SEQ ID NO: 245953 - DNA, 13 bp, Homo sapiens
acccagcaggggc

SEQ ID NO: 245954 - DNA, 20 bp, Homo sapiens
acccagcaggggcagaagga

SEQ ID NO: 245955 - DNA, 16 bp, Homo sapiens
acccagccaccttcct

SEQ ID NO: 245956 - DNA, 17 bp, Homo sapiens
acccagccaccttcctg

SEQ ID NO: 245957 - DNA, 22 bp, Homo sapiens
acccagccccagcgagtctgga

SEQ ID NO: 245958 - DNA, 21 bp, Homo sapiens
acccagccgccatcagcccaa

SEQ ID NO: 245959 - DNA, 18 bp, Homo sapiens
acccagcgttcttcagga

SEQ ID NO: 245960 - DNA, 14 bp, Homo sapiens
acccagctactctg

SEQ ID NO: 245961 - DNA, 13 bp, Homo sapiens
acccagctccagg

SEQ ID NO: 245962 - DNA, 21 bp, Homo sapiens
acccagctccttttgtcccca

SEQ ID NO: 245963 - DNA, 21 bp, Homo sapiens
acccaggaagggaaagcgggc

SEQ ID NO: 245964 - DNA, 12 bp, Homo sapiens
acccaggccctc

SEQ ID NO: 245965 - DNA, 16 bp, Homo sapiens
acccaggccctccatg

SEQ ID NO: 245966 - DNA, 11 bp, Homo sapiens
acccaggctgc

SEQ ID NO: 245967 - DNA, 13 bp, Homo sapiens
acccaggctgcac

SEQ ID NO: 245968 - DNA, 19 bp, Homo sapiens
acccaggctgcactgcagt

SEQ ID NO: 245969 - DNA, 21 bp, Homo sapiens
acccagggcagtgtggtggga

SEQ ID NO: 245970 - DNA, 18 bp, Homo sapiens
acccagggcccggcacag

SEQ ID NO: 245971 - DNA, 20 bp, Homo sapiens
acccagggctccctcctgga

SEQ ID NO: 245972 - DNA, 22 bp, Homo sapiens
acccagtcccagaaccacactg

SEQ ID NO: 245973 - DNA, 17 bp, Homo sapiens
acccagtccccgtgccc

SEQ ID NO: 245974 - DNA, 21 bp, Homo sapiens
acccagtccccgtgccccgcc

SEQ ID NO: 245975 - DNA, 21 bp, Homo sapiens
acccagtgctgccatgccact

SEQ ID NO: 245976 - DNA, 15 bp, Homo sapiens
acccagtggaaccaa

SEQ ID NO: 245977 - DNA, 18 bp, Homo sapiens
acccatagatcttctgaa

SEQ ID NO: 245978 - DNA, 22 bp, Homo sapiens
acccatagatcttctgaaatga

SEQ ID NO: 245979 - DNA, 15 bp, Homo sapiens
acccatcttccccgg

SEQ ID NO: 245980 - DNA, 23 bp, Homo sapiens
acccatgactgccccttgcttct

SEQ ID NO: 245981 - DNA, 15 bp, Homo sapiens
acccatgagcctgcc

SEQ ID NO: 245982 - DNA, 18 bp, Homo sapiens
acccctgtggagcccgca

SEQ ID NO: 245983 - DNA, 16 bp, Homo sapiens
accccttagcctccct

SEQ ID NO: 245984 - DNA, 18 bp, Homo sapiens
accccttcagccgagccc

SEQ ID NO: 245985 - DNA, 10 bp, Homo sapiens
accccttccc

SEQ ID NO: 245986 - DNA, 11 bp, Homo sapiens
accccttcccc

SEQ ID NO: 245987 - DNA, 14 bp, Homo sapiens
accccttccccact

SEQ ID NO: 245988 - DNA, 22 bp, Homo sapiens
accccttccccactgcctgccc

SEQ ID NO: 245989 - DNA, 23 bp, Homo sapiens
accccttccccactgcctgccca

SEQ ID NO: 245990 - DNA, 18 bp, Homo sapiens
accccttccccatttcct

SEQ ID NO: 245991 - DNA, 20 bp, Homo sapiens
accccttccccatttcctct

SEQ ID NO: 245992 - DNA, 20 bp, Homo sapiens
accccttcctgtctggccca

SEQ ID NO: 245993 - DNA, 23 bp, Homo sapiens
accccttccttttttctttcttt

SEQ ID NO: 245994 - DNA, 19 bp, Homo sapiens
accccttctttgcagggct

SEQ ID NO: 245995 - DNA, 16 bp, Homo sapiens
accccttgctcccttc

SEQ ID NO: 245996 - DNA, 12 bp, Homo sapiens
acccctttgctg

SEQ ID NO: 245997 - DNA, 13 bp, Homo sapiens
aggaggctggcag

SEQ ID NO: 245998 - DNA, 23 bp, Homo sapiens
aggaggctttaagctccagcttt

SEQ ID NO: 245999 - DNA, 15 bp, Homo sapiens
aggagggagggggct

SEQ ID NO: 246000 - DNA, 18 bp, Homo sapiens
aggagggcctcagagaca

SEQ ID NO: 246001 - DNA, 20 bp, Homo sapiens
aggagggcctcagagacagc

SEQ ID NO: 246002 - DNA, 15 bp, Homo sapiens
aggagggcctctggt

SEQ ID NO: 246003 - DNA, 14 bp, Homo sapiens
aggagggcgcccat

SEQ ID NO: 246004 - DNA, 14 bp, Homo sapiens
aggaggggaagctg

SEQ ID NO: 246005 - DNA, 22 bp, Homo sapiens
aggaggggacttgtaggaatct

SEQ ID NO: 246006 - DNA, 18 bp, Homo sapiens
aggagggggaggacggag

SEQ ID NO: 246007 - DNA, 13 bp, Homo sapiens
aggaggggtctgc

SEQ ID NO: 246008 - DNA, 21 bp, Homo sapiens
aggagggtggaggaaggtgct

SEQ ID NO: 246009 - DNA, 18 bp, Homo sapiens
aggaggtcccaggaagtc

SEQ ID NO: 246010 - DNA, 20 bp, Homo sapiens
aggaggtgtgatagagcctt

SEQ ID NO: 246011 - DNA, 20 bp, Homo sapiens
aggaggttgagaatgcagtg

SEQ ID NO: 246012 - DNA, 20 bp, Homo sapiens
aggagtaaagataaaaggat

SEQ ID NO: 246013 - DNA, 12 bp, Homo sapiens
aggagtactttc

SEQ ID NO: 246014 - DNA, 14 bp, Homo sapiens
aggagtcctttctt

SEQ ID NO: 246015 - DNA, 21 bp, Homo sapiens
aggagtctctgccacccactc

SEQ ID NO: 246016 - DNA, 22 bp, Homo sapiens
aggagtctctgccacccactca

SEQ ID NO: 246017 - DNA, 13 bp, Homo sapiens
aggagtctgtgct

SEQ ID NO: 246018 - DNA, 14 bp, Homo sapiens
aggagtctgtgctc

SEQ ID NO: 246019 - DNA, 16 bp, Homo sapiens
aggagtctgtgctctt

SEQ ID NO: 246020 - DNA, 17 bp, Homo sapiens
aggagtctgtgctcttt

SEQ ID NO: 246021 - DNA, 14 bp, Homo sapiens
aggagtgcatggcc

SEQ ID NO: 246022 - DNA, 18 bp, Homo sapiens
aggagtgcatggccacag

SEQ ID NO: 246023 - DNA, 19 bp, Homo sapiens
aggagtgcatggccacagc

SEQ ID NO: 246024 - DNA, 21 bp, Homo sapiens
aggagtgccgtgtgttgcatg

SEQ ID NO: 246025 - DNA, 17 bp, Homo sapiens
aggagtgcgctagagca

SEQ ID NO: 246026 - DNA, 17 bp, Homo sapiens
aggagtgtgctcaggcc

SEQ ID NO: 246027 - DNA, 16 bp, Homo sapiens
aggagtgtggccacgt

SEQ ID NO: 246028 - DNA, 14 bp, Homo sapiens
aggagttcaatgat

SEQ ID NO: 246029 - DNA, 16 bp, Homo sapiens
aggagttcaatgatct

SEQ ID NO: 246030 - DNA, 19 bp, Homo sapiens
aggagttcctaaccagcct

SEQ ID NO: 246031 - DNA, 18 bp, Homo sapiens
aggagttgtttctgaccc

SEQ ID NO: 246032 - DNA, 20 bp, Homo sapiens
aggagttgtttctgacccac

SEQ ID NO: 246033 - DNA, 14 bp, Homo sapiens
aggatacatgtgcc

SEQ ID NO: 246034 - DNA, 14 bp, Homo sapiens
aggatagcattttt

SEQ ID NO: 246035 - DNA, 13 bp, Homo sapiens
aggatagcctttg

SEQ ID NO: 246036 - DNA, 14 bp, Homo sapiens
aggatagcctttgt

SEQ ID NO: 246037 - DNA, 17 bp, Homo sapiens
aggatatttaagaaaat

SEQ ID NO: 246038 - DNA, 19 bp, Homo sapiens
aggatatttaagaaaatac

SEQ ID NO: 246039 - DNA, 19 bp, Homo sapiens
aggatcacttaagcccagg

SEQ ID NO: 246040 - DNA, 12 bp, Homo sapiens
aggatcacttga

SEQ ID NO: 246041 - DNA, 19 bp, Homo sapiens
aggatcacttgagcccaga

SEQ ID NO: 246042 - DNA, 15 bp, Homo sapiens
aggatccgtgctgtc

SEQ ID NO: 246043 - DNA, 16 bp, Homo sapiens
aggatcctgcaggaac

SEQ ID NO: 246044 - DNA, 15 bp, Homo sapiens
aggatctctcaggag

SEQ ID NO: 246045 - DNA, 20 bp, Homo sapiens
aggatctctcaggagcacag

SEQ ID NO: 246046 - DNA, 13 bp, Homo sapiens
aggatgaaagaca

SEQ ID NO: 246047 - DNA, 19 bp, Homo sapiens
aggatgaagaacacagcat

SEQ ID NO: 246048 - DNA, 21 bp, Homo sapiens
aggatgacccggggcagctgg

SEQ ID NO: 246049 - DNA, 15 bp, Homo sapiens
aggatgagctggaag

SEQ ID NO: 246050 - DNA, 14 bp, Homo sapiens
aggatgatgtaatt

SEQ ID NO: 246051 - DNA, 15 bp, Homo sapiens
aggatgattgtacag

SEQ ID NO: 246052 - DNA, 21 bp, Homo sapiens
aggatgcacagtttgctattt

SEQ ID NO: 246053 - DNA, 12 bp, Homo sapiens
aggatgctgaag

SEQ ID NO: 246054 - DNA, 13 bp, Homo sapiens
aggatgctgtgcc

SEQ ID NO: 246055 - DNA, 15 bp, Homo sapiens
aggatgctgtgcctc

SEQ ID NO: 246056 - DNA, 17 bp, Homo sapiens
aggatggagccagctct

SEQ ID NO: 246057 - DNA, 12 bp, Homo sapiens
aggatggagggg

SEQ ID NO: 246058 - DNA, 14 bp, Homo sapiens
aggatggcgtgtcc

SEQ ID NO: 246059 - DNA, 18 bp, Homo sapiens
aggatggcgtgtcccctg

SEQ ID NO: 246060 - DNA, 16 bp, Homo sapiens
aggatgtggatggagg

SEQ ID NO: 246061 - DNA, 21 bp, Homo sapiens
aggattaagttcgaggtggct

SEQ ID NO: 246062 - DNA, 18 bp, Homo sapiens
aggattaatctctaaaat

SEQ ID NO: 246063 - DNA, 15 bp, Homo sapiens
aggattatatgtatt

SEQ ID NO: 246064 - DNA, 18 bp, Homo sapiens
aggattcaaccctggctt

SEQ ID NO: 246065 - DNA, 15 bp, Homo sapiens
aggattcctccccca

SEQ ID NO: 246066 - DNA, 17 bp, Homo sapiens
aggattctaaacagatg

SEQ ID NO: 246067 - DNA, 20 bp, Homo sapiens
aggattgtctggggccgagg

SEQ ID NO: 246068 - DNA, 18 bp, Homo sapiens
aggatttaaaaactggaa

SEQ ID NO: 246069 - DNA, 12 bp, Homo sapiens
aggatttaacag

SEQ ID NO: 246070 - DNA, 16 bp, Homo sapiens
aggatttaacagtcat

SEQ ID NO: 246071 - DNA, 14 bp, Homo sapiens
aggatttacttttt

SEQ ID NO: 246072 - DNA, 15 bp, Homo sapiens
aggatttgaaaacac

SEQ ID NO: 246073 - DNA, 18 bp, Homo sapiens
aggatttggtttttctct

SEQ ID NO: 246074 - DNA, 19 bp, Homo sapiens
aggatttggtttttctctt

SEQ ID NO: 246075 - DNA, 20 bp, Homo sapiens
aggatttggtttttctcttt

SEQ ID NO: 246076 - DNA, 14 bp, Homo sapiens
aggattttgtattg

SEQ ID NO: 246077 - DNA, 17 bp, Homo sapiens
aggattttgtgtttttt

SEQ ID NO: 246078 - DNA, 16 bp, Homo sapiens
aggatttttttctgag

SEQ ID NO: 246079 - DNA, 21 bp, Homo sapiens
aggcaaacaatcccaatcttt

SEQ ID NO: 246080 - DNA, 11 bp, Homo sapiens
aggcaaatgtc

SEQ ID NO: 246081 - DNA, 12 bp, Homo sapiens
aggcaaatgtcc

SEQ ID NO: 246082 - DNA, 20 bp, Homo sapiens
aggcaacagtgttctgagcc

SEQ ID NO: 246083 - DNA, 21 bp, Homo sapiens
aggcaacagtgttctgagccc

SEQ ID NO: 246084 - DNA, 20 bp, Homo sapiens
aggcaacattacaaacaaag

SEQ ID NO: 246085 - DNA, 17 bp, Homo sapiens
aggcaactattaataat

SEQ ID NO: 246086 - DNA, 18 bp, Homo sapiens
aggcaactgaacaaaaaa

SEQ ID NO: 246087 - DNA, 22 bp, Homo sapiens
aggcaacttcagtcctgggaga

SEQ ID NO: 246088 - DNA, 15 bp, Homo sapiens
aggcaagaagtggga

SEQ ID NO: 246089 - DNA, 20 bp, Homo sapiens
aggcaagagaaatgaggaag

SEQ ID NO: 246090 - DNA, 20 bp, Homo sapiens
aggcaagatccccgccaccc

SEQ ID NO: 246091 - DNA, 13 bp, Homo sapiens
aggcaagcccctc

SEQ ID NO: 246092 - DNA, 14 bp, Homo sapiens
aggcaagcccctca

SEQ ID NO: 246093 - DNA, 19 bp, Homo sapiens
aggcaagctggcaggaggg

SEQ ID NO: 246094 - DNA, 14 bp, Homo sapiens
aggcaaggatgaaa

SEQ ID NO: 246095 - DNA, 15 bp, Homo sapiens
aggcaaggctgccgg

SEQ ID NO: 246096 - DNA, 19 bp, Homo sapiens
aggcaaggctgccggctgc

SEQ ID NO: 246097 - DNA, 16 bp, Homo sapiens
aggcaaggctgtcaat

SEQ ID NO: 246098 - DNA, 18 bp, Homo sapiens
aggcaaggggtgcctggg

SEQ ID NO: 246099 - DNA, 18 bp, Homo sapiens
aggcaagtttctagctag

SEQ ID NO: 246100 - DNA, 17 bp, Homo sapiens
aggcaataaaaatcata

SEQ ID NO: 246101 - DNA, 19 bp, Homo sapiens
aggcacactgagcaagttt

SEQ ID NO: 246102 - DNA, 19 bp, Homo sapiens
aggcacactgctaaattta

SEQ ID NO: 246103 - DNA, 13 bp, Homo sapiens
aggcaccagctct

SEQ ID NO: 246104 - DNA, 16 bp, Homo sapiens
aggcaccagctctgtg

SEQ ID NO: 246105 - DNA, 17 bp, Homo sapiens
aggcaccagctctgtgg

SEQ ID NO: 246106 - DNA, 19 bp, Homo sapiens
aggcaccatagaagaacag

SEQ ID NO: 246107 - DNA, 17 bp, Homo sapiens
aggcaccattcaggaac

SEQ ID NO: 246108 - DNA, 22 bp, Homo sapiens
aggcacccctccgtgtggagca

SEQ ID NO: 246109 - DNA, 23 bp, Homo sapiens
aggcacccgccctttccttgcct

SEQ ID NO: 246110 - DNA, 18 bp, Homo sapiens
aggcaccgagaatgttgt

SEQ ID NO: 246111 - DNA, 15 bp, Homo sapiens
aggcacctggcctgc

SEQ ID NO: 246112 - DNA, 21 bp, Homo sapiens
aggcacctggcctgctgggaa

SEQ ID NO: 246113 - DNA, 20 bp, Homo sapiens
aggccccagagactcagagg

SEQ ID NO: 246114 - DNA, 13 bp, Homo sapiens
aggccccagccaa

SEQ ID NO: 246115 - DNA, 13 bp, Homo sapiens
aggccccagcctc

SEQ ID NO: 246116 - DNA, 14 bp, Homo sapiens
aggccccagcctcc

SEQ ID NO: 246117 - DNA, 19 bp, Homo sapiens
aggccccagcctccaggcc

SEQ ID NO: 246118 - DNA, 19 bp, Homo sapiens
aggcccccaaacatagccc

SEQ ID NO: 246119 - DNA, 19 bp, Homo sapiens
aggcccccggaggcgccca

SEQ ID NO: 246120 - DNA, 22 bp, Homo sapiens
aggcccccggaggcgcccacct

SEQ ID NO: 246121 - DNA, 13 bp, Homo sapiens
aggcccctgagga

SEQ ID NO: 246122 - DNA, 17 bp, Homo sapiens
aggcccctgaggactgg

SEQ ID NO: 246123 - DNA, 15 bp, Homo sapiens
aggcccctggcccag

SEQ ID NO: 246124 - DNA, 20 bp, Homo sapiens
aggcccctggcccagcggcc

SEQ ID NO: 246125 - DNA, 15 bp, Homo sapiens
aggccctagaccctc

SEQ ID NO: 246126 - DNA, 12 bp, Homo sapiens
aggccctaggcg

SEQ ID NO: 246127 - DNA, 18 bp, Homo sapiens
aggccctccatgggctag

SEQ ID NO: 246128 - DNA, 15 bp, Homo sapiens
aggccctccctgtct

SEQ ID NO: 246129 - DNA, 23 bp, Homo sapiens
aggccctcctgctggctgaggct

SEQ ID NO: 246130 - DNA, 12 bp, Homo sapiens
aggccctgcagt

SEQ ID NO: 246131 - DNA, 14 bp, Homo sapiens
aggccctgtctgta

SEQ ID NO: 246132 - DNA, 13 bp, Homo sapiens
aggcccttcctct

SEQ ID NO: 246133 - DNA, 14 bp, Homo sapiens
aggcccttgtcctg

SEQ ID NO: 246134 - DNA, 22 bp, Homo sapiens
aggcccttgtcctgccagctgc

SEQ ID NO: 246135 - DNA, 15 bp, Homo sapiens
aggcccttttctggc

SEQ ID NO: 246136 - DNA, 22 bp, Homo sapiens
aggcccttttctggctcctgtg

SEQ ID NO: 246137 - DNA, 16 bp, Homo sapiens
aggccgaggagagagg

SEQ ID NO: 246138 - DNA, 14 bp, Homo sapiens
aggccgccccagcc

SEQ ID NO: 246139 - DNA, 14 bp, Homo sapiens
aggccgctagaggc

SEQ ID NO: 246140 - DNA, 17 bp, Homo sapiens
accgcatatgcatgcca

SEQ ID NO: 246141 - DNA, 15 bp, Homo sapiens
accgcatcctccagg

SEQ ID NO: 246142 - DNA, 20 bp, Homo sapiens
accgcatctgctcatctgat

SEQ ID NO: 246143 - DNA, 17 bp, Homo sapiens
accgccagatggggcct

SEQ ID NO: 246144 - DNA, 20 bp, Homo sapiens
accgccagatggggcctctg

SEQ ID NO: 246145 - DNA, 20 bp, Homo sapiens
accgcccaacccccacctcc

SEQ ID NO: 246146 - DNA, 18 bp, Homo sapiens
accgccctgggctggact

SEQ ID NO: 246147 - DNA, 16 bp, Homo sapiens
accgcctgcttcacac

SEQ ID NO: 246148 - DNA, 22 bp, Homo sapiens
accgcctgcttcacacccctca

SEQ ID NO: 246149 - DNA, 15 bp, Homo sapiens
accgctccccagccc

SEQ ID NO: 246150 - DNA, 17 bp, Homo sapiens
accgctccccagcccag

SEQ ID NO: 246151 - DNA, 20 bp, Homo sapiens
accgctccccagcccagggt

SEQ ID NO: 246152 - DNA, 16 bp, Homo sapiens
accgctgccagcacag

SEQ ID NO: 246153 - DNA, 19 bp, Homo sapiens
accgctgccagcacagagc

SEQ ID NO: 246154 - DNA, 20 bp, Homo sapiens
accgcttcacccctgcactt

SEQ ID NO: 246155 - DNA, 15 bp, Homo sapiens
accgcttctgccttt

SEQ ID NO: 246156 - DNA, 17 bp, Homo sapiens
accgcttctgccttttc

SEQ ID NO: 246157 - DNA, 17 bp, Homo sapiens
accggaagctcctggta

SEQ ID NO: 246158 - DNA, 16 bp, Homo sapiens
accggaattgagaggt

SEQ ID NO: 246159 - DNA, 16 bp, Homo sapiens
accggcccgccacctt

SEQ ID NO: 246160 - DNA, 22 bp, Homo sapiens
accggccgcatgtctgcatggc

SEQ ID NO: 246161 - DNA, 14 bp, Homo sapiens
accggctgcttttc

SEQ ID NO: 246162 - DNA, 19 bp, Homo sapiens
accgggagcctgcgtggcc

SEQ ID NO: 246163 - DNA, 22 bp, Homo sapiens
accgggagcctgcgtggcctgg

SEQ ID NO: 246164 - DNA, 21 bp, Homo sapiens
accgggctgggagctctgcag

SEQ ID NO: 246165 - DNA, 21 bp, Homo sapiens
accggggcactggctgctctg

SEQ ID NO: 246166 - DNA, 14 bp, Homo sapiens
accgggtgggcctg

SEQ ID NO: 246167 - DNA, 15 bp, Homo sapiens
accgggtgggcctgg

SEQ ID NO: 246168 - DNA, 17 bp, Homo sapiens
accgggtgggcctggcc

SEQ ID NO: 246169 - DNA, 18 bp, Homo sapiens
accgggtgggcctggcct

SEQ ID NO: 246170 - DNA, 16 bp, Homo sapiens
accgtaattttattat

SEQ ID NO: 246171 - DNA, 14 bp, Homo sapiens
accgtactctcaca

SEQ ID NO: 246172 - DNA, 13 bp, Homo sapiens
accgtagcctccg

SEQ ID NO: 246173 - DNA, 20 bp, Homo sapiens
accgtgagcaggaaggcctg

SEQ ID NO: 246174 - DNA, 22 bp, Homo sapiens
accgtgagcaggaaggcctggg

SEQ ID NO: 246175 - DNA, 22 bp, Homo sapiens
accgtgagcgccccgcccccac

SEQ ID NO: 246176 - DNA, 13 bp, Homo sapiens
accgtgccattgt

SEQ ID NO: 246177 - DNA, 20 bp, Homo sapiens
accgtgcccggctaattttt

SEQ ID NO: 246178 - DNA, 18 bp, Homo sapiens
accgtggtgtgaggcccc

SEQ ID NO: 246179 - DNA, 21 bp, Homo sapiens
accgtggtgtgaggcccccgg

SEQ ID NO: 246180 - DNA, 20 bp, Homo sapiens
accgtgtcccaaggagctga

SEQ ID NO: 246181 - DNA, 14 bp, Homo sapiens
accgttcacttccc

SEQ ID NO: 246182 - DNA, 13 bp, Homo sapiens
accgtttggtgtc

SEQ ID NO: 246183 - DNA, 18 bp, Homo sapiens
accgttttcatcctggcc

SEQ ID NO: 246184 - DNA, 18 bp, Homo sapiens
accgtttttatattactt

SEQ ID NO: 246185 - DNA, 17 bp, Homo sapiens
acctaaaaaaagagaat

SEQ ID NO: 246186 - DNA, 19 bp, Homo sapiens
acctaaaaccagttttgct

SEQ ID NO: 246187 - DNA, 19 bp, Homo sapiens
acctaaaattaagaagtac

SEQ ID NO: 246188 - DNA, 20 bp, Homo sapiens
acctaaatccattttctaaa

SEQ ID NO: 246189 - DNA, 11 bp, Homo sapiens
acctaacattc

SEQ ID NO: 246190 - DNA, 19 bp, Homo sapiens
acctaagggctaaggcctc

SEQ ID NO: 246191 - DNA, 14 bp, Homo sapiens
acctaagtgactac

SEQ ID NO: 246192 - DNA, 23 bp, Homo sapiens
acctacattccctctcctgccca

SEQ ID NO: 246193 - DNA, 15 bp, Homo sapiens
acctaccacagtgtc

SEQ ID NO: 246194 - DNA, 16 bp, Homo sapiens
acctaccacagtgtct

SEQ ID NO: 246195 - DNA, 17 bp, Homo sapiens
acctaccacagtgtctg

SEQ ID NO: 246196 - DNA, 18 bp, Homo sapiens
acctaccctcaaagtagg

SEQ ID NO: 246197 - DNA, 17 bp, Homo sapiens
acctaccttcaaagctg

SEQ ID NO: 246198 - DNA, 16 bp, Homo sapiens
acctacgaccccagag

SEQ ID NO: 246199 - DNA, 17 bp, Homo sapiens
acctactatgtgctggg

SEQ ID NO: 246200 - DNA, 11 bp, Homo sapiens
acctactgagt

SEQ ID NO: 246201 - DNA, 22 bp, Homo sapiens
acctagaaacctttatccctgc

SEQ ID NO: 246202 - DNA, 21 bp, Homo sapiens
acctagaccttgcctcccctc

SEQ ID NO: 246203 - DNA, 23 bp, Homo sapiens
acctagaccttgcctcccctcct

SEQ ID NO: 246204 - DNA, 19 bp, Homo sapiens
acctagcatcttacaaaaa

SEQ ID NO: 246205 - DNA, 17 bp, Homo sapiens
acctagccaacatggtg

SEQ ID NO: 246206 - DNA, 17 bp, Homo sapiens
acctagggaggacctta

SEQ ID NO: 246207 - DNA, 16 bp, Homo sapiens
acctataaagtaaagc

SEQ ID NO: 246208 - DNA, 22 bp, Homo sapiens
acctatataataaagctactga

SEQ ID NO: 246209 - DNA, 22 bp, Homo sapiens
acctatgcttctagaaagcccc

SEQ ID NO: 246210 - DNA, 23 bp, Homo sapiens
acctatgtcctaaggacacacta

SEQ ID NO: 246211 - DNA, 12 bp, Homo sapiens
acctatgtttgc

SEQ ID NO: 246212 - DNA, 13 bp, Homo sapiens
acctattgccagg

SEQ ID NO: 246213 - DNA, 23 bp, Homo sapiens
acctattgccaggaatgtttcag

SEQ ID NO: 246214 - DNA, 16 bp, Homo sapiens
acctcaaaatgtctaa

SEQ ID NO: 246215 - DNA, 16 bp, Homo sapiens
acctcaacctgtaaat

SEQ ID NO: 246216 - DNA, 18 bp, Homo sapiens
acctcaacctgtaaatta

SEQ ID NO: 246217 - DNA, 19 bp, Homo sapiens
acctcaacctgtaaattat

SEQ ID NO: 246218 - DNA, 21 bp, Homo sapiens
acctcaacctgtaaattattt

SEQ ID NO: 246219 - DNA, 16 bp, Homo sapiens
acctcaacctgtgatg

SEQ ID NO: 246220 - DNA, 12 bp, Homo sapiens
acctcaagggct

SEQ ID NO: 246221 - DNA, 14 bp, Homo sapiens
acctcacaactcct

SEQ ID NO: 246222 - DNA, 20 bp, Homo sapiens
acctcaccccgttacagctc

SEQ ID NO: 246223 - DNA, 15 bp, Homo sapiens
acctcacgctctgga

SEQ ID NO: 246224 - DNA, 14 bp, Homo sapiens
acctcactgccctc

SEQ ID NO: 246225 - DNA, 18 bp, Homo sapiens
acctcactggtgcattta

SEQ ID NO: 246226 - DNA, 16 bp, Homo sapiens
acctcagagccccgca

SEQ ID NO: 246227 - DNA, 17 bp, Homo sapiens
acctcagagtccaggcc

SEQ ID NO: 246228 - DNA, 15 bp, Homo sapiens
acctcagcaacctgt

SEQ ID NO: 246229 - DNA, 23 bp, Homo sapiens
acctcagcatttactttgtttct

SEQ ID NO: 246230 - DNA, 11 bp, Homo sapiens
acctcagcctc

SEQ ID NO: 246231 - DNA, 14 bp, Homo sapiens
acctcagctctggg

SEQ ID NO: 246232 - DNA, 12 bp, Homo sapiens
acctcagctgca

SEQ ID NO: 246233 - DNA, 18 bp, Homo sapiens
acctcagctgcacattcc

SEQ ID NO: 246234 - DNA, 14 bp, Homo sapiens
acctcaggacccca

SEQ ID NO: 246235 - DNA, 15 bp, Homo sapiens
acctcaggaccccag

SEQ ID NO: 246236 - DNA, 12 bp, Homo sapiens
acctcaggcagg

SEQ ID NO: 246237 - DNA, 15 bp, Homo sapiens
acctcaggttccaaa

SEQ ID NO: 246238 - DNA, 16 bp, Homo sapiens
acctcagtgtcattta

SEQ ID NO: 246239 - DNA, 19 bp, Homo sapiens
acctcagttcccttggcct

SEQ ID NO: 246240 - DNA, 21 bp, Homo sapiens
acctcagttcccttggcctca

SEQ ID NO: 246241 - DNA, 23 bp, Homo sapiens
acctcagttcccttggcctcaga

SEQ ID NO: 246242 - DNA, 21 bp, Homo sapiens
acctcagtttctgttgtttct

SEQ ID NO: 246243 - DNA, 15 bp, Homo sapiens
caaatagcataagtt

SEQ ID NO: 246244 - DNA, 20 bp, Homo sapiens
caaatagggcaaagaatcaa

SEQ ID NO: 246245 - DNA, 23 bp, Homo sapiens
caaatagtaggctaaaaacattt

SEQ ID NO: 246246 - DNA, 15 bp, Homo sapiens
caaatagtgaaaagt

SEQ ID NO: 246247 - DNA, 20 bp, Homo sapiens
caaatagtttataaatgtga

SEQ ID NO: 246248 - DNA, 15 bp, Homo sapiens
caaatataagatttt

SEQ ID NO: 246249 - DNA, 18 bp, Homo sapiens
caaatataagattttctg

SEQ ID NO: 246250 - DNA, 14 bp, Homo sapiens
caaatatagttgaa

SEQ ID NO: 246251 - DNA, 13 bp, Homo sapiens
caaatatctcaga

SEQ ID NO: 246252 - DNA, 14 bp, Homo sapiens
caaatatctcagag

SEQ ID NO: 246253 - DNA, 15 bp, Homo sapiens
caaatatctcagagg

SEQ ID NO: 246254 - DNA, 14 bp, Homo sapiens
caaatatgtcctgg

SEQ ID NO: 246255 - DNA, 15 bp, Homo sapiens
caaatatgtcctggg

SEQ ID NO: 246256 - DNA, 16 bp, Homo sapiens
caaatattcattttga

SEQ ID NO: 246257 - DNA, 18 bp, Homo sapiens
caaatattgcttggacta

SEQ ID NO: 246258 - DNA, 21 bp, Homo sapiens
caaatatttatgacctcaaca

SEQ ID NO: 246259 - DNA, 17 bp, Homo sapiens
caaatattttagaagct

SEQ ID NO: 246260 - DNA, 22 bp, Homo sapiens
caaatcaaagcaagggctccag

SEQ ID NO: 246261 - DNA, 18 bp, Homo sapiens
caaatcactgtatttatc

SEQ ID NO: 246262 - DNA, 15 bp, Homo sapiens
caaatcagacacaat

SEQ ID NO: 246263 - DNA, 13 bp, Homo sapiens
caaatcagtctca

SEQ ID NO: 246264 - DNA, 17 bp, Homo sapiens
caaatcagtctcacaat

SEQ ID NO: 246265 - DNA, 19 bp, Homo sapiens
caaatcccctccctgtgac

SEQ ID NO: 246266 - DNA, 20 bp, Homo sapiens
caaatccttccaaaaattat

SEQ ID NO: 246267 - DNA, 23 bp, Homo sapiens
caaatctaatctcttattctaat

SEQ ID NO: 246268 - DNA, 16 bp, Homo sapiens
caaatctactgagcca

SEQ ID NO: 246269 - DNA, 17 bp, Homo sapiens
caaatctactgagccac

SEQ ID NO: 246270 - DNA, 13 bp, Homo sapiens
caaatctattcag

SEQ ID NO: 246271 - DNA, 19 bp, Homo sapiens
caaatctgtatatgttgta

SEQ ID NO: 246272 - DNA, 12 bp, Homo sapiens
caaatctgtcta

SEQ ID NO: 246273 - DNA, 12 bp, Homo sapiens
caaatcttcctc

SEQ ID NO: 246274 - DNA, 14 bp, Homo sapiens
caaatcttcctctg

SEQ ID NO: 246275 - DNA, 13 bp, Homo sapiens
caaatctttaaga

SEQ ID NO: 246276 - DNA, 20 bp, Homo sapiens
caaatgaccgcacgttctct

SEQ ID NO: 246277 - DNA, 16 bp, Homo sapiens
caaatgacttcatttc

SEQ ID NO: 246278 - DNA, 22 bp, Homo sapiens
caaatgagatgtatgcccaaag

SEQ ID NO: 246279 - DNA, 21 bp, Homo sapiens
caaatgattttcatcaattta

SEQ ID NO: 246280 - DNA, 15 bp, Homo sapiens
caaatgcagacacac

SEQ ID NO: 246281 - DNA, 16 bp, Homo sapiens
caaatgcagacacaca

SEQ ID NO: 246282 - DNA, 19 bp, Homo sapiens
caaatgcagacacacaaca

SEQ ID NO: 246283 - DNA, 20 bp, Homo sapiens
caaatgcagggaggggaggc

SEQ ID NO: 246284 - DNA, 14 bp, Homo sapiens
caaatgcctctgcc

SEQ ID NO: 246285 - DNA, 20 bp, Homo sapiens
attttttccctcctgacaaa

SEQ ID NO: 246286 - DNA, 16 bp, Homo sapiens
atttttttaaatttgc

SEQ ID NO: 246287 - DNA, 19 bp, Homo sapiens
atttttttaactgaaaatg

SEQ ID NO: 246288 - DNA, 23 bp, Homo sapiens
atttttttatataagttaaagag

SEQ ID NO: 246289 - DNA, 15 bp, Homo sapiens
atttttttattcttc

SEQ ID NO: 246290 - DNA, 21 bp, Homo sapiens
atttttttcactggagttaca

SEQ ID NO: 246291 - DNA, 22 bp, Homo sapiens
atttttttctagctataacaac

SEQ ID NO: 246292 - DNA, 13 bp, Homo sapiens
atttttttgtatt

SEQ ID NO: 246293 - DNA, 14 bp, Homo sapiens
atttttttgtattt

SEQ ID NO: 246294 - DNA, 15 bp, Homo sapiens
attttttttaactgc

SEQ ID NO: 246295 - DNA, 21 bp, Homo sapiens
attttttttggttgtttgctg

SEQ ID NO: 246296 - DNA, 22 bp, Homo sapiens
attttttttggttgtttgctgt

SEQ ID NO: 246297 - DNA, 16 bp, Homo sapiens
caaaaaaacactagtt

SEQ ID NO: 246298 - DNA, 23 bp, Homo sapiens
caaaaaaatatatttaatgataa

SEQ ID NO: 246299 - DNA, 22 bp, Homo sapiens
caaaaaacaatatttattgtat

SEQ ID NO: 246300 - DNA, 15 bp, Homo sapiens
caaaaaagggacagc

SEQ ID NO: 246301 - DNA, 20 bp, Homo sapiens
caaaaaatgtgagctataat

SEQ ID NO: 246302 - DNA, 17 bp, Homo sapiens
caaaaacaataaacgaa

SEQ ID NO: 246303 - DNA, 14 bp, Homo sapiens
caaaaaccagcagg

SEQ ID NO: 246304 - DNA, 19 bp, Homo sapiens
caaaaactagtaaagacat

SEQ ID NO: 246305 - DNA, 14 bp, Homo sapiens
caaaaactttccat

SEQ ID NO: 246306 - DNA, 18 bp, Homo sapiens
caaaaactttccatgaca

SEQ ID NO: 246307 - DNA, 24 bp, Homo sapiens
caaaaactttccatgacagtagca

SEQ ID NO: 246308 - DNA, 22 bp, Homo sapiens
caaaaagaatctgcatttagca

SEQ ID NO: 246309 - DNA, 23 bp, Homo sapiens
caaaaagctttaaaaaataaagc

SEQ ID NO: 246310 - DNA, 11 bp, Homo sapiens
caaaaagtgtt

SEQ ID NO: 246311 - DNA, 15 bp, Homo sapiens
caaaaagtttccata

SEQ ID NO: 246312 - DNA, 11 bp, Homo sapiens
caaaaatataa

SEQ ID NO: 246313 - DNA, 15 bp, Homo sapiens
caaaaatatattaaa

SEQ ID NO: 246314 - DNA, 20 bp, Homo sapiens
caaaaatatattaaaaatat

SEQ ID NO: 246315 - DNA, 17 bp, Homo sapiens
caaaaatgaactgaagt

SEQ ID NO: 246316 - DNA, 18 bp, Homo sapiens
caaaaatgccacttaaca

SEQ ID NO: 246317 - DNA, 13 bp, Homo sapiens
caaaaattaaaat

SEQ ID NO: 246318 - DNA, 15 bp, Homo sapiens
caaaaattagccggg

SEQ ID NO: 246319 - DNA, 11 bp, Homo sapiens
caaaaattatc

SEQ ID NO: 246320 - DNA, 22 bp, Homo sapiens
caaaaattgcgagcctttaccc

SEQ ID NO: 246321 - DNA, 10 bp, Homo sapiens
caaaacaaca

SEQ ID NO: 246322 - DNA, 12 bp, Homo sapiens
caaaacaacagc

SEQ ID NO: 246323 - DNA, 13 bp, Homo sapiens
caaaacaacagca

SEQ ID NO: 246324 - DNA, 16 bp, Homo sapiens
caaaacaacagcaaca

SEQ ID NO: 246325 - DNA, 21 bp, Homo sapiens
caaaacaacagcaacaacaac

SEQ ID NO: 246326 - DNA, 14 bp, Homo sapiens
caaaacaagaaaga

SEQ ID NO: 246327 - DNA, 17 bp, Homo sapiens
caaaacaagaaagaaac

SEQ ID NO: 246328 - DNA, 12 bp, Homo sapiens
caaaacagaacg

SEQ ID NO: 246329 - DNA, 22 bp, Homo sapiens
caaaacatgctacctgatccca

SEQ ID NO: 246330 - DNA, 16 bp, Homo sapiens
caaaaccaagccttgg

SEQ ID NO: 246331 - DNA, 17 bp, Homo sapiens
caaaaccattgcttcac

SEQ ID NO: 246332 - DNA, 22 bp, Homo sapiens
caaaaccggcaacctgtaactg

SEQ ID NO: 246333 - DNA, 14 bp, Homo sapiens
caaaacctaacttg

SEQ ID NO: 246334 - DNA, 21 bp, Homo sapiens
caaaacctgatgttaaaattc

SEQ ID NO: 246335 - DNA, 19 bp, Homo sapiens
caaaacctgtgccaggctg

SEQ ID NO: 246336 - DNA, 19 bp, Homo sapiens
caaaactatcggttcaagt

SEQ ID NO: 246337 - DNA, 17 bp, Homo sapiens
caaaactgcctgaaagc

SEQ ID NO: 246338 - DNA, 19 bp, Homo sapiens
caaaactgcctgaaagcaa

SEQ ID NO: 246339 - DNA, 12 bp, Homo sapiens
caaaactttcag

SEQ ID NO: 246340 - DNA, 14 bp, Homo sapiens
caaaagataaaact

SEQ ID NO: 246341 - DNA, 18 bp, Homo sapiens
caaaagcacaaaccctgg

SEQ ID NO: 246342 - DNA, 19 bp, Homo sapiens
caaaagcaggcttgtgctt

SEQ ID NO: 246343 - DNA, 18 bp, Homo sapiens
caaaagccataacttgaa

SEQ ID NO: 246344 - DNA, 11 bp, Homo sapiens
caaaagcctct

SEQ ID NO: 246345 - DNA, 11 bp, Homo sapiens
caaaagcctgg

SEQ ID NO: 246346 - DNA, 14 bp, Homo sapiens
caaaagcctgggtg

SEQ ID NO: 246347 - DNA, 20 bp, Homo sapiens
caaaagccttacggtcatga

SEQ ID NO: 246348 - DNA, 14 bp, Homo sapiens
caaaagctatatgt

SEQ ID NO: 246349 - DNA, 15 bp, Homo sapiens
caaaagctgtgtctc

SEQ ID NO: 246350 - DNA, 22 bp, Homo sapiens
caaaaggagaactgtgctctcc

SEQ ID NO: 246351 - DNA, 12 bp, Homo sapiens
caaaaggcagct

SEQ ID NO: 246352 - DNA, 13 bp, Homo sapiens
caaaaggcagctc

SEQ ID NO: 246353 - DNA, 22 bp, Homo sapiens
caaaaggcagctcacccctggg

SEQ ID NO: 246354 - DNA, 16 bp, Homo sapiens
caaaagggagaacatg

SEQ ID NO: 246355 - DNA, 23 bp, Homo sapiens
caaaagggagaacatggccaata

SEQ ID NO: 246356 - DNA, 16 bp, Homo sapiens
caaaaggttaagccat

SEQ ID NO: 246357 - DNA, 19 bp, Homo sapiens
caaaagtccttagaatgag

SEQ ID NO: 246358 - DNA, 22 bp, Homo sapiens
caaaagtccttagaatgaggga

SEQ ID NO: 246359 - DNA, 21 bp, Homo sapiens
caaaagtctcaatgttccatt

SEQ ID NO: 246360 - DNA, 20 bp, Homo sapiens
caaaagtgagatgggaaggg

SEQ ID NO: 246361 - DNA, 20 bp, Homo sapiens
caaaagtggattttcctgaa

SEQ ID NO: 246362 - DNA, 21 bp, Homo sapiens
caaaataaaaagtgacacagc

SEQ ID NO: 246363 - DNA, 19 bp, Homo sapiens
caaaataaagaatagcaat

SEQ ID NO: 246364 - DNA, 18 bp, Homo sapiens
caaaataattttaagaaa

SEQ ID NO: 246365 - DNA, 18 bp, Homo sapiens
caaaatacagcactttga

SEQ ID NO: 246366 - DNA, 22 bp, Homo sapiens
caaaatacatgatgatttcaga

SEQ ID NO: 246367 - DNA, 13 bp, Homo sapiens
caaaatagaagct

SEQ ID NO: 246368 - DNA, 13 bp, Homo sapiens
caaaatagttcta

SEQ ID NO: 246369 - DNA, 14 bp, Homo sapiens
caaaatagttctat

SEQ ID NO: 246370 - DNA, 15 bp, Homo sapiens
caaaatagttctatt

SEQ ID NO: 246371 - DNA, 15 bp, Homo sapiens
caaaatatatgtttg

SEQ ID NO: 246372 - DNA, 14 bp, Homo sapiens
caaaatatttattt

SEQ ID NO: 246373 - DNA, 22 bp, Homo sapiens
caaaatatttctaagcttattt

SEQ ID NO: 246374 - DNA, 17 bp, Homo sapiens
caaaatcagtgatggga

SEQ ID NO: 246375 - DNA, 12 bp, Homo sapiens
caaaatcattcc

SEQ ID NO: 246376 - DNA, 20 bp, Homo sapiens
caaaatctaaaacaaaatct

SEQ ID NO: 246377 - DNA, 21 bp, Homo sapiens
caaaatctgtagagcagggca

SEQ ID NO: 246378 - DNA, 22 bp, Homo sapiens
caaaatgaaacgcaaccaccac

SEQ ID NO: 246379 - DNA, 15 bp, Homo sapiens
caaaatgaatgcatt

SEQ ID NO: 246380 - DNA, 15 bp, Homo sapiens
caaaatgacaatgat

SEQ ID NO: 246381 - DNA, 15 bp, Homo sapiens
caaaatgcatgtgat

SEQ ID NO: 246382 - DNA, 22 bp, Homo sapiens
caaaatgtctgtagctcctcaa

SEQ ID NO: 246383 - DNA, 17 bp, Homo sapiens
caaaatgtctgttttag

SEQ ID NO: 246384 - DNA, 11 bp, Homo sapiens
caaaatgtgcc

SEQ ID NO: 246385 - DNA, 16 bp, Homo sapiens
caaaatgttaacaact

SEQ ID NO: 246386 - DNA, 17 bp, Homo sapiens
caaaatgttaacaactt

SEQ ID NO: 246387 - DNA, 23 bp, Homo sapiens
caaaattacctaccccagttcat

SEQ ID NO: 246388 - DNA, 21 bp, Homo sapiens
caaaattataggagacttgta

SEQ ID NO: 246389 - DNA, 22 bp, Homo sapiens
caaaattataggagacttgtag

SEQ ID NO: 246390 - DNA, 22 bp, Homo sapiens
caaaattgatgtgtttatttat

SEQ ID NO: 246391 - DNA, 15 bp, Homo sapiens
caaaatttccagtac

SEQ ID NO: 246392 - DNA, 18 bp, Homo sapiens
caaaatttccagtacctt

SEQ ID NO: 246393 - DNA, 20 bp, Homo sapiens
caaaatttccagtacctttg

SEQ ID NO: 246394 - DNA, 21 bp, Homo sapiens
caaaatttgatggtgaatatt

SEQ ID NO: 246395 - DNA, 20 bp, Homo sapiens
caaacaaaggatttgaaaac

SEQ ID NO: 246396 - DNA, 22 bp, Homo sapiens
caaacaaaggatttgaaaacac

SEQ ID NO: 246397 - DNA, 15 bp, Homo sapiens
caaacaaatatgcaa

SEQ ID NO: 246398 - DNA, 19 bp, Homo sapiens
caaacaatcccaatctttc

SEQ ID NO: 246399 - DNA, 17 bp, Homo sapiens
caaacaccattattcca

SEQ ID NO: 246400 - DNA, 19 bp, Homo sapiens
caaacagaacactgtaata

SEQ ID NO: 246401 - DNA, 16 bp, Homo sapiens
caaacagtaaaggcca

SEQ ID NO: 246402 - DNA, 14 bp, Homo sapiens
caaacagtaggttg

SEQ ID NO: 246403 - DNA, 19 bp, Homo sapiens
caaacagtaggttggcagt

SEQ ID NO: 246404 - DNA, 13 bp, Homo sapiens
caaacagtgaatt

SEQ ID NO: 246405 - DNA, 20 bp, Homo sapiens
caaacatagcccctgccccg

SEQ ID NO: 246406 - DNA, 14 bp, Homo sapiens
caaacatgaaaaca

SEQ ID NO: 246407 - DNA, 15 bp, Homo sapiens
caaacatgaaaacat

SEQ ID NO: 246408 - DNA, 21 bp, Homo sapiens
caaacatgtgcaactcttgta

SEQ ID NO: 246409 - DNA, 14 bp, Homo sapiens
caaacattcttatt

SEQ ID NO: 246410 - DNA, 18 bp, Homo sapiens
caaacatttctttttcct

SEQ ID NO: 246411 - DNA, 13 bp, Homo sapiens
caaaccaggactc

SEQ ID NO: 246412 - DNA, 17 bp, Homo sapiens
caaaccaggactctgcc

SEQ ID NO: 246413 - DNA, 22 bp, Homo sapiens
caaaccaggagcattttgtgtc

SEQ ID NO: 246414 - DNA, 14 bp, Homo sapiens
caaaccccagcccc

SEQ ID NO: 246415 - DNA, 14 bp, Homo sapiens
caaaccccttccca

SEQ ID NO: 246416 - DNA, 11 bp, Homo sapiens
caaaccctgct

SEQ ID NO: 246417 - DNA, 24 bp, Homo sapiens
caaaccctgcttctgctgccctga

SEQ ID NO: 246418 - DNA, 13 bp, Homo sapiens
caaaccctgggga

SEQ ID NO: 246419 - DNA, 13 bp, Homo sapiens
caaaccctgttta

SEQ ID NO: 246420 - DNA, 16 bp, Homo sapiens
caaacctgccccatcc

SEQ ID NO: 246421 - DNA, 20 bp, Homo sapiens
caaacctttattttagaatt

SEQ ID NO: 246422 - DNA, 20 bp, Homo sapiens
caaacctttttatattttat

SEQ ID NO: 246423 - DNA, 23 bp, Homo sapiens
caaacctttttatattttatact

SEQ ID NO: 246424 - DNA, 14 bp, Homo sapiens
caaactactttctt

SEQ ID NO: 246425 - DNA, 17 bp, Homo sapiens
caaactcccaggacctg

SEQ ID NO: 246426 - DNA, 12 bp, Homo sapiens
caaactcctgcc

SEQ ID NO: 246427 - DNA, 13 bp, Homo sapiens
caaactcctgcct

SEQ ID NO: 246428 - DNA, 18 bp, Homo sapiens
caaactcctgcctgtgtt

SEQ ID NO: 246429 - DNA, 15 bp, Homo sapiens
caaactcgtctgatg

SEQ ID NO: 246430 - DNA, 16 bp, Homo sapiens
caaactcgtctgatgt

SEQ ID NO: 246431 - DNA, 16 bp, Homo sapiens
caaactctactaattt

SEQ ID NO: 246432 - DNA, 19 bp, Homo sapiens
caaactgatggaccgggtg

SEQ ID NO: 246433 - DNA, 19 bp, Homo sapiens
caaactgcaatagagactg

SEQ ID NO: 246434 - DNA, 22 bp, Homo sapiens
caaactgcacacacagctcctc

SEQ ID NO: 246435 - DNA, 22 bp, Homo sapiens
caaactgcctgttaagtctgag

SEQ ID NO: 246436 - DNA, 17 bp, Homo sapiens
caaactggggcctccct

SEQ ID NO: 246437 - DNA, 23 bp, Homo sapiens
caaactgtgggtattgttaatat

SEQ ID NO: 246438 - DNA, 15 bp, Homo sapiens
caaactgtgtaactg

SEQ ID NO: 246439 - DNA, 18 bp, Homo sapiens
caaactgtgtaactgccc

SEQ ID NO: 246440 - DNA, 15 bp, Homo sapiens
caaacttgggccgct

SEQ ID NO: 246441 - DNA, 14 bp, Homo sapiens
caaacttgttttct

SEQ ID NO: 246442 - DNA, 19 bp, Homo sapiens
caaacttttcccctgtcct

SEQ ID NO: 246443 - DNA, 15 bp, Homo sapiens
caaagaaaatgagaa

SEQ ID NO: 246444 - DNA, 16 bp, Homo sapiens
caaagaaaattctcaa

SEQ ID NO: 246445 - DNA, 19 bp, Homo sapiens
caaagaaagaaagtttaga

SEQ ID NO: 246446 - DNA, 15 bp, Homo sapiens
caaagaacccccctc

SEQ ID NO: 246447 - DNA, 19 bp, Homo sapiens
caaagaacttgatttgcat

SEQ ID NO: 246448 - DNA, 11 bp, Homo sapiens
caaagaagagt

SEQ ID NO: 246449 - DNA, 16 bp, Homo sapiens
caaagaaggaaaagag

SEQ ID NO: 246450 - DNA, 13 bp, Homo sapiens
caaagaagtggtt

SEQ ID NO: 246451 - DNA, 16 bp, Homo sapiens
caaagaatcaacagtg

SEQ ID NO: 246452 - DNA, 22 bp, Homo sapiens
caaagaatcacctaattaattt

SEQ ID NO: 246453 - DNA, 22 bp, Homo sapiens
caaagaatttcaatttgttcag

SEQ ID NO: 246454 - DNA, 15 bp, Homo sapiens
caaagacacacagga

SEQ ID NO: 246455 - DNA, 16 bp, Homo sapiens
caaagacacacaggag

SEQ ID NO: 246456 - DNA, 21 bp, Homo sapiens
caaagacagggaatagtggga

SEQ ID NO: 246457 - DNA, 15 bp, Homo sapiens
caaagaccaatgtga

SEQ ID NO: 246458 - DNA, 22 bp, Homo sapiens
caaagagaaggcctggtcagca

SEQ ID NO: 246459 - DNA, 15 bp, Homo sapiens
caaagagaataaaga

SEQ ID NO: 246460 - DNA, 20 bp, Homo sapiens
caaagaggtgctgctttgct

SEQ ID NO: 246461 - DNA, 20 bp, Homo sapiens
caaagataacgcaggagaga

SEQ ID NO: 246462 - DNA, 22 bp, Homo sapiens
caaagataacgcaggagagaga

SEQ ID NO: 246463 - DNA, 21 bp, Homo sapiens
caaagataagacttgtttctt

SEQ ID NO: 246464 - DNA, 16 bp, Homo sapiens
caaagatattatttat

SEQ ID NO: 246465 - DNA, 14 bp, Homo sapiens
caaagatcaaaata

SEQ ID NO: 246466 - DNA, 22 bp, Homo sapiens
caaagatctgaattaaataaat

SEQ ID NO: 246467 - DNA, 23 bp, Homo sapiens
caaagatctgaattaaataaata

SEQ ID NO: 246468 - DNA, 23 bp, Homo sapiens
caaagatgcagccgccttccttg

SEQ ID NO: 246469 - DNA, 17 bp, Homo sapiens
caaagatgtactgagag

SEQ ID NO: 246470 - DNA, 21 bp, Homo sapiens
caaagatgtactgagaggagg

SEQ ID NO: 246471 - DNA, 16 bp, Homo sapiens
caaagcaaccacctgt

SEQ ID NO: 246472 - DNA, 11 bp, Homo sapiens
caaagcaaggg

SEQ ID NO: 246473 - DNA, 14 bp, Homo sapiens
caaagcaagggctc

SEQ ID NO: 246474 - DNA, 17 bp, Homo sapiens
caaagcaagggctccag

SEQ ID NO: 246475 - DNA, 22 bp, Homo sapiens
caaagcacagtgttaaatgaaa

SEQ ID NO: 246476 - DNA, 22 bp, Homo sapiens
caaagcaccttgaatggaaggt

SEQ ID NO: 246477 - DNA, 22 bp, Homo sapiens
caaagcacgaaatgttattttt

SEQ ID NO: 246478 - DNA, 15 bp, Homo sapiens
caaagcagtgcatgc

SEQ ID NO: 246479 - DNA, 14 bp, Homo sapiens
caaagcatcaaata

SEQ ID NO: 246480 - DNA, 20 bp, Homo sapiens
caaagcatcaaataatacat

SEQ ID NO: 246481 - DNA, 14 bp, Homo sapiens
caaagcatgctcag

SEQ ID NO: 246482 - DNA, 20 bp, Homo sapiens
caaagcatgctcagtattga

SEQ ID NO: 246483 - DNA, 18 bp, Homo sapiens
caaagccacaaggctggc

SEQ ID NO: 246484 - DNA, 16 bp, Homo sapiens
caaagcccagcccggc

SEQ ID NO: 246485 - DNA, 17 bp, Homo sapiens
caaagcccagcccggct

SEQ ID NO: 246486 - DNA, 22 bp, Homo sapiens
caaagcccctacaactccagcc

SEQ ID NO: 246487 - DNA, 11 bp, Homo sapiens
caaagccttat

SEQ ID NO: 246488 - DNA, 14 bp, Homo sapiens
caaagcctttaaat

SEQ ID NO: 246489 - DNA, 15 bp, Homo sapiens
caaagcctttaaatt

SEQ ID NO: 246490 - DNA, 20 bp, Homo sapiens
caaagctaggaaaggcagaa

SEQ ID NO: 246491 - DNA, 21 bp, Homo sapiens
caaagctaggaaaggcagaaa

SEQ ID NO: 246492 - DNA, 22 bp, Homo sapiens
caaagctagggtggcccttgca

SEQ ID NO: 246493 - DNA, 20 bp, Homo sapiens
caaagctgaagaaaatgaag

SEQ ID NO: 246494 - DNA, 14 bp, Homo sapiens
caaagctgaatatt

SEQ ID NO: 246495 - DNA, 15 bp, Homo sapiens
caaagctgaatattt

SEQ ID NO: 246496 - DNA, 21 bp, Homo sapiens
caaagctgagttacttgtctg

SEQ ID NO: 246497 - DNA, 14 bp, Homo sapiens
caaagcttgaagat

SEQ ID NO: 246498 - DNA, 18 bp, Homo sapiens
caaagctttcctgcccca

SEQ ID NO: 246499 - DNA, 22 bp, Homo sapiens
caaagctttcctgccccaggcc

SEQ ID NO: 246500 - DNA, 22 bp, Homo sapiens
caaaggaaaatagtaatgtttt

SEQ ID NO: 246501 - DNA, 22 bp, Homo sapiens
caaaggaagacttggcccagga

SEQ ID NO: 246502 - DNA, 18 bp, Homo sapiens
caaaggactgacctgccc

SEQ ID NO: 246503 - DNA, 19 bp, Homo sapiens
caaaggagacaaagcagga

SEQ ID NO: 246504 - DNA, 13 bp, Homo sapiens
caaaggagggcct

SEQ ID NO: 246505 - DNA, 14 bp, Homo sapiens
caaaggagggcctc

SEQ ID NO: 246506 - DNA, 20 bp, Homo sapiens
caaaggagggcctcagagac

SEQ ID NO: 246507 - DNA, 21 bp, Homo sapiens
caaaggagggcctcagagaca

SEQ ID NO: 246508 - DNA, 22 bp, Homo sapiens
caaaggagggcctcagagacag

SEQ ID NO: 246509 - DNA, 17 bp, Homo sapiens
caaaggagtgcatggcc

SEQ ID NO: 246510 - DNA, 19 bp, Homo sapiens
caaaggagtgcatggccac

SEQ ID NO: 246511 - DNA, 15 bp, Homo sapiens
caaaggatttgaaaa

SEQ ID NO: 246512 - DNA, 18 bp, Homo sapiens
caaaggcagaaaggagat

SEQ ID NO: 246513 - DNA, 11 bp, Homo sapiens
caaaggcccag

SEQ ID NO: 246514 - DNA, 13 bp, Homo sapiens
caaaggcccagaa

SEQ ID NO: 246515 - DNA, 11 bp, Homo sapiens
caaaggggctg

SEQ ID NO: 246516 - DNA, 20 bp, Homo sapiens
caaaggggctgctggggcat

SEQ ID NO: 246517 - DNA, 11 bp, Homo sapiens
caaagggtgtg

SEQ ID NO: 246518 - DNA, 20 bp, Homo sapiens
caaagtaccaactgagccaa

SEQ ID NO: 246519 - DNA, 18 bp, Homo sapiens
caaagtactaaaactaga

SEQ ID NO: 246520 - DNA, 13 bp, Homo sapiens
caaagtagagaag

SEQ ID NO: 246521 - DNA, 22 bp, Homo sapiens
caaagtagagaagtatccaatt

SEQ ID NO: 246522 - DNA, 23 bp, Homo sapiens
caaagtaggtatacaaaagacta

SEQ ID NO: 246523 - DNA, 18 bp, Homo sapiens
caaagtataaatttgtgt

SEQ ID NO: 246524 - DNA, 19 bp, Homo sapiens
caaagtataaatttgtgta

SEQ ID NO: 246525 - DNA, 23 bp, Homo sapiens
caaagtattaatgtacagagtgg

SEQ ID NO: 246526 - DNA, 20 bp, Homo sapiens
caaagtctaaagtttacagt

SEQ ID NO: 246527 - DNA, 19 bp, Homo sapiens
caaagtcttgatagcaagc

SEQ ID NO: 246528 - DNA, 15 bp, Homo sapiens
caaagtgcagccctt

SEQ ID NO: 246529 - DNA, 19 bp, Homo sapiens
caaagtgcagcccttcctc

SEQ ID NO: 246530 - DNA, 17 bp, Homo sapiens
caaagtggggagggaca

SEQ ID NO: 246531 - DNA, 20 bp, Homo sapiens
caaagtggggagggacaagg

SEQ ID NO: 246532 - DNA, 19 bp, Homo sapiens
caaagtgtacaattttcat

SEQ ID NO: 246533 - DNA, 20 bp, Homo sapiens
caaagtgtacaattttcatc

SEQ ID NO: 246534 - DNA, 16 bp, Homo sapiens
caaagttaacctacct

SEQ ID NO: 246535 - DNA, 14 bp, Homo sapiens
caaagttccagttt

SEQ ID NO: 246536 - DNA, 21 bp, Homo sapiens
caaagttccctacttcctgtg

SEQ ID NO: 246537 - DNA, 22 bp, Homo sapiens
caaagttccctacttcctgtga

SEQ ID NO: 246538 - DNA, 22 bp, Homo sapiens
caaagtttcctaatcagaaatt

SEQ ID NO: 246539 - DNA, 13 bp, Homo sapiens
caaagttttcaga

SEQ ID NO: 246540 - DNA, 20 bp, Homo sapiens
caaagttttcagattgtaaa

SEQ ID NO: 246541 - DNA, 16 bp, Homo sapiens
caaagtttttacagtg

SEQ ID NO: 246542 - DNA, 15 bp, Homo sapiens
caaataaaaatattg

SEQ ID NO: 246543 - DNA, 16 bp, Homo sapiens
caaataaaaatattgt

SEQ ID NO: 246544 - DNA, 19 bp, Homo sapiens
caaataaagttaaaagtaa

SEQ ID NO: 246545 - DNA, 19 bp, Homo sapiens
caaataaatttataacaat

SEQ ID NO: 246546 - DNA, 14 bp, Homo sapiens
caaataagtaatat

SEQ ID NO: 246547 - DNA, 15 bp, Homo sapiens
caaatacattccagt

SEQ ID NO: 246548 - DNA, 19 bp, Homo sapiens
caaatacctccattaaatg

SEQ ID NO: 246549 - DNA, 22 bp, Homo sapiens
caaatacctccattaaatggtc

SEQ ID NO: 246550 - DNA, 12 bp, Homo sapiens
caaatagaaaac

SEQ ID NO: 246551 - DNA, 14 bp, Homo sapiens
caaatagaaaacag

SEQ ID NO: 246552 - DNA, 19 bp, Homo sapiens
atttgatgtctagataaca

SEQ ID NO: 246553 - DNA, 21 bp, Homo sapiens
atttgatgtctagataacatt

SEQ ID NO: 246554 - DNA, 16 bp, Homo sapiens
atttgatttcgatgta

SEQ ID NO: 246555 - DNA, 13 bp, Homo sapiens
atttgcaaatgca

SEQ ID NO: 246556 - DNA, 12 bp, Homo sapiens
atttgcaacatt

SEQ ID NO: 246557 - DNA, 14 bp, Homo sapiens
atttgcagctgctg

SEQ ID NO: 246558 - DNA, 19 bp, Homo sapiens
atttgcataatactaattt

SEQ ID NO: 246559 - DNA, 19 bp, Homo sapiens
atttgcatattctattgta

SEQ ID NO: 246560 - DNA, 16 bp, Homo sapiens
atttgcatttttgtat

SEQ ID NO: 246561 - DNA, 22 bp, Homo sapiens
atttgccaaaaactaaaattca

SEQ ID NO: 246562 - DNA, 14 bp, Homo sapiens
atttgccagcacag

SEQ ID NO: 246563 - DNA, 22 bp, Homo sapiens
atttgccccaacttaagtttag

SEQ ID NO: 246564 - DNA, 15 bp, Homo sapiens
atttgcccttcagga

SEQ ID NO: 246565 - DNA, 20 bp, Homo sapiens
atttgccgatttcctaagct

SEQ ID NO: 246566 - DNA, 17 bp, Homo sapiens
atttgcctaattcctgg

SEQ ID NO: 246567 - DNA, 14 bp, Homo sapiens
atttgcctttaaaa

SEQ ID NO: 246568 - DNA, 13 bp, Homo sapiens
atttgctgaataa

SEQ ID NO: 246569 - DNA, 20 bp, Homo sapiens
atttgctgaataacaacaat

SEQ ID NO: 246570 - DNA, 15 bp, Homo sapiens
atttgctgcatttca

SEQ ID NO: 246571 - DNA, 21 bp, Homo sapiens
atttgctggagtgctggctcc

SEQ ID NO: 246572 - DNA, 23 bp, Homo sapiens
atttgctgggctttttttttctc

SEQ ID NO: 246573 - DNA, 15 bp, Homo sapiens
atttgcttatttata

SEQ ID NO: 246574 - DNA, 16 bp, Homo sapiens
atttgctttagagaca

SEQ ID NO: 246575 - DNA, 19 bp, Homo sapiens
atttgctttagagacaggg

SEQ ID NO: 246576 - DNA, 19 bp, Homo sapiens
atttgctttgggattttct

SEQ ID NO: 246577 - DNA, 20 bp, Homo sapiens
atttggaagagaggcacctg

SEQ ID NO: 246578 - DNA, 13 bp, Homo sapiens
atttggaaggaaa

SEQ ID NO: 246579 - DNA, 20 bp, Homo sapiens
atttggagaaaacagccact

SEQ ID NO: 246580 - DNA, 20 bp, Homo sapiens
atttggagacacaactattt

SEQ ID NO: 246581 - DNA, 14 bp, Homo sapiens
atttggagtggagg

SEQ ID NO: 246582 - DNA, 16 bp, Homo sapiens
atttggagtggaggca

SEQ ID NO: 246583 - DNA, 20 bp, Homo sapiens
atttggagttaggtcctcac

SEQ ID NO: 246584 - DNA, 17 bp, Homo sapiens
atttggatatctgttag

SEQ ID NO: 246585 - DNA, 16 bp, Homo sapiens
atttgggtaaatcatg

SEQ ID NO: 246586 - DNA, 16 bp, Homo sapiens
atttggtcttagcttt

SEQ ID NO: 246587 - DNA, 19 bp, Homo sapiens
atttggtcttagctttaca

SEQ ID NO: 246588 - DNA, 21 bp, Homo sapiens
atttggtgcacttttctgtgt

SEQ ID NO: 246589 - DNA, 20 bp, Homo sapiens
atttggtggcctaatttaca

SEQ ID NO: 246590 - DNA, 16 bp, Homo sapiens
atttggtttttctctt

SEQ ID NO: 246591 - DNA, 15 bp, Homo sapiens
atttgtaaatattaa

SEQ ID NO: 246592 - DNA, 17 bp, Homo sapiens
atttgtaacctcagctc

SEQ ID NO: 246593 - DNA, 19 bp, Homo sapiens
atttgtaacctcagctctg

SEQ ID NO: 246594 - DNA, 17 bp, Homo sapiens
atttgtaactttgcatg

SEQ ID NO: 246595 - DNA, 14 bp, Homo sapiens
atttgtaagtttat

SEQ ID NO: 246596 - DNA, 14 bp, Homo sapiens
atttgtaataaagt

SEQ ID NO: 246597 - DNA, 22 bp, Homo sapiens
atttgtaatgtatcttatttat

SEQ ID NO: 246598 - DNA, 20 bp, Homo sapiens
atttgtaatttttttctagt

SEQ ID NO: 246599 - DNA, 15 bp, Homo sapiens
atttgtacagttcag

SEQ ID NO: 246600 - DNA, 13 bp, Homo sapiens
atttgtaccttat

SEQ ID NO: 246601 - DNA, 19 bp, Homo sapiens
atttgtaccttattgatct

SEQ ID NO: 246602 - DNA, 14 bp, Homo sapiens
atttgtactttgtt

SEQ ID NO: 246603 - DNA, 18 bp, Homo sapiens
atttgtagctagaatatc

SEQ ID NO: 246604 - DNA, 15 bp, Homo sapiens
atttgtatatataca

SEQ ID NO: 246605 - DNA, 16 bp, Homo sapiens
atttgtatatatacat

SEQ ID NO: 246606 - DNA, 20 bp, Homo sapiens
atttgtatctctgaagcatg

SEQ ID NO: 246607 - DNA, 14 bp, Homo sapiens
atttgtatctgaag

SEQ ID NO: 246608 - DNA, 18 bp, Homo sapiens
atttgtatgttgtgaaga

SEQ ID NO: 246609 - DNA, 13 bp, Homo sapiens
atttgtatttata

SEQ ID NO: 246610 - DNA, 16 bp, Homo sapiens
atttgtatttatatta

SEQ ID NO: 246611 - DNA, 17 bp, Homo sapiens
atttgtcaatgacagtt

SEQ ID NO: 246612 - DNA, 22 bp, Homo sapiens
atttgtcacagaaatcagagga

SEQ ID NO: 246613 - DNA, 17 bp, Homo sapiens
atttgtcctgcagagct

SEQ ID NO: 246614 - DNA, 19 bp, Homo sapiens
atttgtcggggaagatgaa

SEQ ID NO: 246615 - DNA, 13 bp, Homo sapiens
atttgtctcattt

SEQ ID NO: 246616 - DNA, 15 bp, Homo sapiens
atttgtctcattttg

SEQ ID NO: 246617 - DNA, 18 bp, Homo sapiens
atttgtctcattttgtat

SEQ ID NO: 246618 - DNA, 21 bp, Homo sapiens
atttgtctcattttgtatgta

SEQ ID NO: 246619 - DNA, 16 bp, Homo sapiens
atttgtcttagagaga

SEQ ID NO: 246620 - DNA, 15 bp, Homo sapiens
atttgtctttcagga

SEQ ID NO: 246621 - DNA, 15 bp, Homo sapiens
atttgtgagattcct

SEQ ID NO: 246622 - DNA, 18 bp, Homo sapiens
atttgtgagccaaagaga

SEQ ID NO: 246623 - DNA, 21 bp, Homo sapiens
atttgtgagccaaagagaaaa

SEQ ID NO: 246624 - DNA, 12 bp, Homo sapiens
atttgtgtgtgt

SEQ ID NO: 246625 - DNA, 15 bp, Homo sapiens
atttgtgtgtgtgca

SEQ ID NO: 246626 - DNA, 13 bp, Homo sapiens
atttgtgtttttc

SEQ ID NO: 246627 - DNA, 19 bp, Homo sapiens
atttgtgtttttctttttc

SEQ ID NO: 246628 - DNA, 20 bp, Homo sapiens
atttgttatgataaaaggaa

SEQ ID NO: 246629 - DNA, 18 bp, Homo sapiens
atttgttatttgtacagt

SEQ ID NO: 246630 - DNA, 19 bp, Homo sapiens
atttgttatttgtacagtt

SEQ ID NO: 246631 - DNA, 20 bp, Homo sapiens
atttgttgaaattatgtatg

SEQ ID NO: 246632 - DNA, 17 bp, Homo sapiens
atttgttgtcatgtgta

SEQ ID NO: 246633 - DNA, 19 bp, Homo sapiens
atttgtttaaagaataaag

SEQ ID NO: 246634 - DNA, 23 bp, Homo sapiens
atttgtttatttttatatagctt

SEQ ID NO: 246635 - DNA, 20 bp, Homo sapiens
atttgttttgttttaaaata

SEQ ID NO: 246636 - DNA, 18 bp, Homo sapiens
attttaaaaagtcttcac

SEQ ID NO: 246637 - DNA, 17 bp, Homo sapiens
attttaaaaattggaaa

SEQ ID NO: 246638 - DNA, 14 bp, Homo sapiens
attttaaaagcata

SEQ ID NO: 246639 - DNA, 17 bp, Homo sapiens
attttaaaatcaacttt

SEQ ID NO: 246640 - DNA, 16 bp, Homo sapiens
attttaaataaaagaa

SEQ ID NO: 246641 - DNA, 18 bp, Homo sapiens
attttaaattacacagtt

SEQ ID NO: 246642 - DNA, 17 bp, Homo sapiens
attttaaattataagga

SEQ ID NO: 246643 - DNA, 18 bp, Homo sapiens
attttaaattataaggac

SEQ ID NO: 246644 - DNA, 21 bp, Homo sapiens
attttaaattataaggactgc

SEQ ID NO: 246645 - DNA, 16 bp, Homo sapiens
attttaacaaaagcaa

SEQ ID NO: 246646 - DNA, 14 bp, Homo sapiens
attttaacaataac

SEQ ID NO: 246647 - DNA, 19 bp, Homo sapiens
attttaactttatcacatt

SEQ ID NO: 246648 - DNA, 21 bp, Homo sapiens
attttaagcactcttaaagca

SEQ ID NO: 246649 - DNA, 12 bp, Homo sapiens
attttaagtgct

SEQ ID NO: 246650 - DNA, 19 bp, Homo sapiens
attttaatacctttaaata

SEQ ID NO: 246651 - DNA, 14 bp, Homo sapiens
attttaatcaaatt

SEQ ID NO: 246652 - DNA, 12 bp, Homo sapiens
attttaatggct

SEQ ID NO: 246653 - DNA, 19 bp, Homo sapiens
attttaatgtaaaattcat

SEQ ID NO: 246654 - DNA, 20 bp, Homo sapiens
attttaatgtaaaattcata

SEQ ID NO: 246655 - DNA, 18 bp, Homo sapiens
attttaatttatgagttt

SEQ ID NO: 246656 - DNA, 11 bp, Homo sapiens
attttacaaaa

SEQ ID NO: 246657 - DNA, 20 bp, Homo sapiens
attttacaataggtgcttat

SEQ ID NO: 246658 - DNA, 23 bp, Homo sapiens
attttacacagcaattttgtatc

SEQ ID NO: 246659 - DNA, 23 bp, Homo sapiens
attttactgtctgtaagagaatt

SEQ ID NO: 246660 - DNA, 13 bp, Homo sapiens
attttacttccat

SEQ ID NO: 246661 - DNA, 13 bp, Homo sapiens
attttactttgta

SEQ ID NO: 246662 - DNA, 18 bp, Homo sapiens
attttactttgtgcaata

SEQ ID NO: 246663 - DNA, 16 bp, Homo sapiens
attttagacaaccata

SEQ ID NO: 246664 - DNA, 21 bp, Homo sapiens
attttagacaaccatagaact

SEQ ID NO: 246665 - DNA, 15 bp, Homo sapiens
attttagatgtttaa

SEQ ID NO: 246666 - DNA, 21 bp, Homo sapiens
attttagcagttctgcaaata

SEQ ID NO: 246667 - DNA, 19 bp, Homo sapiens
attttaggagacagtctca

SEQ ID NO: 246668 - DNA, 20 bp, Homo sapiens
attttaggtcccagaatgga

SEQ ID NO: 246669 - DNA, 22 bp, Homo sapiens
attttagtatatttatataatt

SEQ ID NO: 246670 - DNA, 11 bp, Homo sapiens
attttatactg

SEQ ID NO: 246671 - DNA, 23 bp, Homo sapiens
attttatactgcactttagtgta

SEQ ID NO: 246672 - DNA, 14 bp, Homo sapiens
attttatataataa

SEQ ID NO: 246673 - DNA, 22 bp, Homo sapiens
attttatccctttctcttctga

SEQ ID NO: 246674 - DNA, 23 bp, Homo sapiens
attttatccctttctcttctgac

SEQ ID NO: 246675 - DNA, 15 bp, Homo sapiens
attttatgtctatat

SEQ ID NO: 246676 - DNA, 14 bp, Homo sapiens
attttattattcag

SEQ ID NO: 246677 - DNA, 21 bp, Homo sapiens
attttattcacatatgtctta

SEQ ID NO: 246678 - DNA, 13 bp, Homo sapiens
attttattgaata

SEQ ID NO: 246679 - DNA, 16 bp, Homo sapiens
attttattgaatataa

SEQ ID NO: 246680 - DNA, 17 bp, Homo sapiens
attttatttaaactatt

SEQ ID NO: 246681 - DNA, 20 bp, Homo sapiens
attttatttattagctgtaa

SEQ ID NO: 246682 - DNA, 22 bp, Homo sapiens
attttatttattagctgtaaat

SEQ ID NO: 246683 - DNA, 15 bp, Homo sapiens
attttattttagcag

SEQ ID NO: 246684 - DNA, 14 bp, Homo sapiens
attttattttctaa

SEQ ID NO: 246685 - DNA, 13 bp, Homo sapiens
attttcaaaatct

SEQ ID NO: 246686 - DNA, 20 bp, Homo sapiens
agcccgtgaagcagtgcctc

SEQ ID NO: 246687 - DNA, 20 bp, Homo sapiens
agcccgtgcagtacaggcaa

SEQ ID NO: 246688 - DNA, 16 bp, Homo sapiens
agcccgtgtggcccct

SEQ ID NO: 246689 - DNA, 17 bp, Homo sapiens
agcccgtgtggcccctt

SEQ ID NO: 246690 - DNA, 14 bp, Homo sapiens
agccctaaataaat

SEQ ID NO: 246691 - DNA, 18 bp, Homo sapiens
agccctaacatagtgtct

SEQ ID NO: 246692 - DNA, 22 bp, Homo sapiens
agccctagaggcgagccaggca

SEQ ID NO: 246693 - DNA, 15 bp, Homo sapiens
agccctaggctaccc

SEQ ID NO: 246694 - DNA, 21 bp, Homo sapiens
agccctagtgggagcccagca

SEQ ID NO: 246695 - DNA, 22 bp, Homo sapiens
agccctagtgggagcccagcac

SEQ ID NO: 246696 - DNA, 23 bp, Homo sapiens
agccctcatcttgaagggcccag

SEQ ID NO: 246697 - DNA, 15 bp, Homo sapiens
agccctccaaaagca

SEQ ID NO: 246698 - DNA, 17 bp, Homo sapiens
agccctccaaaagcact

SEQ ID NO: 246699 - DNA, 16 bp, Homo sapiens
agccctccccctcaac

SEQ ID NO: 246700 - DNA, 17 bp, Homo sapiens
agccctccctcttccca

SEQ ID NO: 246701 - DNA, 13 bp, Homo sapiens
agccctccctgcc

SEQ ID NO: 246702 - DNA, 17 bp, Homo sapiens
agccctccctgcccctc

SEQ ID NO: 246703 - DNA, 19 bp, Homo sapiens
agccctccctgcccctccc

SEQ ID NO: 246704 - DNA, 23 bp, Homo sapiens
agccctccctgcccctcccttca

SEQ ID NO: 246705 - DNA, 15 bp, Homo sapiens
agccctcctgagcac

SEQ ID NO: 246706 - DNA, 15 bp, Homo sapiens
agccctccttgccac

SEQ ID NO: 246707 - DNA, 16 bp, Homo sapiens
agccctccttgccacc

SEQ ID NO: 246708 - DNA, 19 bp, Homo sapiens
agccctcgaaccaaggcag

SEQ ID NO: 246709 - DNA, 24 bp, Homo sapiens
agccctcgaaccaaggcagcctcc

SEQ ID NO: 246710 - DNA, 20 bp, Homo sapiens
agccctcggcctccgaggct

SEQ ID NO: 246711 - DNA, 18 bp, Homo sapiens
agccctctcactgtgtcc

SEQ ID NO: 246712 - DNA, 20 bp, Homo sapiens
agccctcttcaggggtcacc

SEQ ID NO: 246713 - DNA, 21 bp, Homo sapiens
agccctcttcaggggtcacct

SEQ ID NO: 246714 - DNA, 15 bp, Homo sapiens
agccctctttctctc

SEQ ID NO: 246715 - DNA, 19 bp, Homo sapiens
agccctctttctctctgtg

SEQ ID NO: 246716 - DNA, 24 bp, Homo sapiens
agccctctttctctctgtgtggca

SEQ ID NO: 246717 - DNA, 19 bp, Homo sapiens
agccctgaccttggctgac

SEQ ID NO: 246718 - DNA, 23 bp, Homo sapiens
agccctgaccttggctgactggg

SEQ ID NO: 246719 - DNA, 22 bp, Homo sapiens
agccctgaggtgaaagggagct

SEQ ID NO: 246720 - DNA, 23 bp, Homo sapiens
agccctgagtttcaagtatcctt

SEQ ID NO: 246721 - DNA, 15 bp, Homo sapiens
agccctgcaaatttt

SEQ ID NO: 246722 - DNA, 11 bp, Homo sapiens
agccctgccct

SEQ ID NO: 246723 - DNA, 16 bp, Homo sapiens
agccctgccctcactc

SEQ ID NO: 246724 - DNA, 20 bp, Homo sapiens
agccctgccctcactccact

SEQ ID NO: 246725 - DNA, 22 bp, Homo sapiens
agccctgccctcactccactcc

SEQ ID NO: 246726 - DNA, 22 bp, Homo sapiens
agccctgctttgggctgccctg

SEQ ID NO: 246727 - DNA, 17 bp, Homo sapiens
agccctggacacccctg

SEQ ID NO: 246728 - DNA, 20 bp, Homo sapiens
agccctggacacccctgctc

SEQ ID NO: 246729 - DNA, 24 bp, Homo sapiens
agccctggctgggttcaggtccca

SEQ ID NO: 246730 - DNA, 20 bp, Homo sapiens
agccctggttctccatcccc

SEQ ID NO: 246731 - DNA, 16 bp, Homo sapiens
agccctgtcagtgcag

SEQ ID NO: 246732 - DNA, 17 bp, Homo sapiens
agccctgtcagtgcagc

SEQ ID NO: 246733 - DNA, 14 bp, Homo sapiens
agccctgtcctggt

SEQ ID NO: 246734 - DNA, 17 bp, Homo sapiens
agccctgtcgagacact

SEQ ID NO: 246735 - DNA, 23 bp, Homo sapiens
agcccttccatgtcgcctctgca

SEQ ID NO: 246736 - DNA, 13 bp, Homo sapiens
agcccttcccagg

SEQ ID NO: 246737 - DNA, 13 bp, Homo sapiens
agcccttccctgc

SEQ ID NO: 246738 - DNA, 17 bp, Homo sapiens
agcccttccctgctttg

SEQ ID NO: 246739 - DNA, 17 bp, Homo sapiens
agcccttccctggcccc

SEQ ID NO: 246740 - DNA, 15 bp, Homo sapiens
agcccttcctcctga

SEQ ID NO: 246741 - DNA, 21 bp, Homo sapiens
agcccttctccatggccctgc

SEQ ID NO: 246742 - DNA, 15 bp, Homo sapiens
agcccttctgccttt

SEQ ID NO: 246743 - DNA, 17 bp, Homo sapiens
agccctttccccactca

SEQ ID NO: 246744 - DNA, 16 bp, Homo sapiens
agccctttctgtgtgc

SEQ ID NO: 246745 - DNA, 18 bp, Homo sapiens
agccctttctgtgtgcac

SEQ ID NO: 246746 - DNA, 17 bp, Homo sapiens
agccctttgcctgtaga

SEQ ID NO: 246747 - DNA, 15 bp, Homo sapiens
agccctttggagaac

SEQ ID NO: 246748 - DNA, 23 bp, Homo sapiens
agccctttggagaacgccagtct

SEQ ID NO: 246749 - DNA, 21 bp, Homo sapiens
agccgagatcggggtggcaga

SEQ ID NO: 246750 - DNA, 21 bp, Homo sapiens
agccgagccgggcctggggct

SEQ ID NO: 246751 - DNA, 13 bp, Homo sapiens
agccgagctctcc

SEQ ID NO: 246752 - DNA, 18 bp, Homo sapiens
agccgagctctcctgggc

SEQ ID NO: 246753 - DNA, 18 bp, Homo sapiens
agccgccattgccaccag

SEQ ID NO: 246754 - DNA, 20 bp, Homo sapiens
agccgccattgccaccagga

SEQ ID NO: 246755 - DNA, 22 bp, Homo sapiens
agccgccggaagtggctccgtg

SEQ ID NO: 246756 - DNA, 23 bp, Homo sapiens
agccgcctctggttccactcagc

SEQ ID NO: 246757 - DNA, 15 bp, Homo sapiens
agccgccttccttga

SEQ ID NO: 246758 - DNA, 16 bp, Homo sapiens
agccgcgctctgcccc

SEQ ID NO: 246759 - DNA, 17 bp, Homo sapiens
agccgcgctctgcccct

SEQ ID NO: 246760 - DNA, 18 bp, Homo sapiens
agccgctgccaggggctg

SEQ ID NO: 246761 - DNA, 15 bp, Homo sapiens
agccggcacagggtc

SEQ ID NO: 246762 - DNA, 11 bp, Homo sapiens
agccgggccgc

SEQ ID NO: 246763 - DNA, 18 bp, Homo sapiens
agccggggcctgcctagc

SEQ ID NO: 246764 - DNA, 23 bp, Homo sapiens
agccgggtgtggcacgcacctgt

SEQ ID NO: 246765 - DNA, 13 bp, Homo sapiens
agccggtgcccac

SEQ ID NO: 246766 - DNA, 18 bp, Homo sapiens
agccgtccaacttaaaaa

SEQ ID NO: 246767 - DNA, 16 bp, Homo sapiens
agccgtccatggcacc

SEQ ID NO: 246768 - DNA, 17 bp, Homo sapiens
agccgtccatggcacca

SEQ ID NO: 246769 - DNA, 18 bp, Homo sapiens
agccgtccatggcaccag

SEQ ID NO: 246770 - DNA, 18 bp, Homo sapiens
agccgtgatgctcaggct

SEQ ID NO: 246771 - DNA, 21 bp, Homo sapiens
agccgtggcttcccgctcagc

SEQ ID NO: 246772 - DNA, 14 bp, Homo sapiens
agccgttcctggga

SEQ ID NO: 246773 - DNA, 21 bp, Homo sapiens
agccgtttgaatatattttat

SEQ ID NO: 246774 - DNA, 23 bp, Homo sapiens
agccgtttgaatatattttatct

SEQ ID NO: 246775 - DNA, 13 bp, Homo sapiens
agcctaaaattaa

SEQ ID NO: 246776 - DNA, 16 bp, Homo sapiens
agcctaaaattaaata

SEQ ID NO: 246777 - DNA, 23 bp, Homo sapiens
agcctaaaattaaataaatcttt

SEQ ID NO: 246778 - DNA, 18 bp, Homo sapiens
agcctaagaaaaaggaaa

SEQ ID NO: 246779 - DNA, 14 bp, Homo sapiens
agcctactgtctcc

SEQ ID NO: 246780 - DNA, 15 bp, Homo sapiens
agcctactgtctcct

SEQ ID NO: 246781 - DNA, 23 bp, Homo sapiens
agcctaggggtcagggaccaagg

SEQ ID NO: 246782 - DNA, 18 bp, Homo sapiens
agcctatatttcctcttc

SEQ ID NO: 246783 - DNA, 20 bp, Homo sapiens
agcctatatttcctcttctg

SEQ ID NO: 246784 - DNA, 16 bp, Homo sapiens
agcctcacttgaatgt

SEQ ID NO: 246785 - DNA, 22 bp, Homo sapiens
agcctcacttgaatgtgtcact

SEQ ID NO: 246786 - DNA, 17 bp, Homo sapiens
agcctcagggcttcctt

SEQ ID NO: 246787 - DNA, 19 bp, Homo sapiens
agcctccaagcctgcctcc

SEQ ID NO: 246788 - DNA, 21 bp, Homo sapiens
agcctccaagctccatctcca

SEQ ID NO: 246789 - DNA, 20 bp, Homo sapiens
agcctccactgcctctggaa

SEQ ID NO: 246790 - DNA, 12 bp, Homo sapiens
agcctccagagc

SEQ ID NO: 246791 - DNA, 17 bp, Homo sapiens
agcctccagagccagcc

SEQ ID NO: 246792 - DNA, 18 bp, Homo sapiens
agcctccagagccagcct

SEQ ID NO: 246793 - DNA, 20 bp, Homo sapiens
agcctccagagccagcctgg

SEQ ID NO: 246794 - DNA, 24 bp, Homo sapiens
agcctccagagccagcctgggact

SEQ ID NO: 246795 - DNA, 20 bp, Homo sapiens
agcctccaggcccccaactc

SEQ ID NO: 246796 - DNA, 21 bp, Homo sapiens
agcctccaggcccccaactcc

SEQ ID NO: 246797 - DNA, 12 bp, Homo sapiens
agcctccagggc

SEQ ID NO: 246798 - DNA, 17 bp, Homo sapiens
agcctccagggcccccc

SEQ ID NO: 246799 - DNA, 21 bp, Homo sapiens
agcctccatttagttctttgt

SEQ ID NO: 246800 - DNA, 17 bp, Homo sapiens
agcctcccccaggctgc

SEQ ID NO: 246801 - DNA, 21 bp, Homo sapiens
agcctcccccaggctgcgcct

SEQ ID NO: 246802 - DNA, 13 bp, Homo sapiens
agcctcccctccc

SEQ ID NO: 246803 - DNA, 20 bp, Homo sapiens
agcctcccctcccctgggga

SEQ ID NO: 246804 - DNA, 24 bp, Homo sapiens
agcctccctcctcgtcccctgcct

SEQ ID NO: 246805 - DNA, 12 bp, Homo sapiens
agcctccctgtc

SEQ ID NO: 246806 - DNA, 13 bp, Homo sapiens
agcctccctgtca

SEQ ID NO: 246807 - DNA, 17 bp, Homo sapiens
agcctccgccattccaa

SEQ ID NO: 246808 - DNA, 19 bp, Homo sapiens
agcctccgtttatgggcct

SEQ ID NO: 246809 - DNA, 22 bp, Homo sapiens
agcctccgtttatgggccttgc

SEQ ID NO: 246810 - DNA, 16 bp, Homo sapiens
agcctcctcctgacca

SEQ ID NO: 246811 - DNA, 13 bp, Homo sapiens
agcctcctctctc

SEQ ID NO: 246812 - DNA, 12 bp, Homo sapiens
agcctcctgacc

SEQ ID NO: 246813 - DNA, 19 bp, Homo sapiens
agcctcctgagtagctgga

SEQ ID NO: 246814 - DNA, 19 bp, Homo sapiens
agcctcctgccccctgcca

SEQ ID NO: 246815 - DNA, 13 bp, Homo sapiens
agcctcctgctga

SEQ ID NO: 246816 - DNA, 15 bp, Homo sapiens
agcctcgaactcctg

SEQ ID NO: 246817 - DNA, 14 bp, Homo sapiens
agcctctcccaccc

SEQ ID NO: 246818 - DNA, 18 bp, Homo sapiens
attttcaacgcagccctg

SEQ ID NO: 246819 - DNA, 15 bp, Homo sapiens
attttcaagcaaata

SEQ ID NO: 246820 - DNA, 15 bp, Homo sapiens
attttcaagctttca

SEQ ID NO: 246821 - DNA, 19 bp, Homo sapiens
attttcaagtaattgtgaa

SEQ ID NO: 246822 - DNA, 22 bp, Homo sapiens
attttcacattcccatctgtca

SEQ ID NO: 246823 - DNA, 21 bp, Homo sapiens
attttcacctgtttttaagct

SEQ ID NO: 246824 - DNA, 17 bp, Homo sapiens
attttcagaaaatatta

SEQ ID NO: 246825 - DNA, 19 bp, Homo sapiens
attttcagcatcaaacatg

SEQ ID NO: 246826 - DNA, 23 bp, Homo sapiens
attttcagcatgaaaatgtgtgt

SEQ ID NO: 246827 - DNA, 17 bp, Homo sapiens
attttcagtaccaaaga

SEQ ID NO: 246828 - DNA, 21 bp, Homo sapiens
attttcagtaccaaagaaaca

SEQ ID NO: 246829 - DNA, 14 bp, Homo sapiens
attttcatcaagta

SEQ ID NO: 246830 - DNA, 20 bp, Homo sapiens
attttcatgacttttccatg

SEQ ID NO: 246831 - DNA, 18 bp, Homo sapiens
attttcattggatgcagt

SEQ ID NO: 246832 - DNA, 19 bp, Homo sapiens
attttccattaatttcaac

SEQ ID NO: 246833 - DNA, 14 bp, Homo sapiens
attttccccccact

SEQ ID NO: 246834 - DNA, 14 bp, Homo sapiens
attttcctccccag

SEQ ID NO: 246835 - DNA, 14 bp, Homo sapiens
attttcctttagat

SEQ ID NO: 246836 - DNA, 14 bp, Homo sapiens
attttctaaactgt

SEQ ID NO: 246837 - DNA, 18 bp, Homo sapiens
attttctaagcaatttct

SEQ ID NO: 246838 - DNA, 22 bp, Homo sapiens
attttctaagcaatttcttgct

SEQ ID NO: 246839 - DNA, 18 bp, Homo sapiens
attttctagactttctgt

SEQ ID NO: 246840 - DNA, 19 bp, Homo sapiens
attttctagactttctgtt

SEQ ID NO: 246841 - DNA, 17 bp, Homo sapiens
attttctatatttgtaa

SEQ ID NO: 246842 - DNA, 16 bp, Homo sapiens
attttctattgttact

SEQ ID NO: 246843 - DNA, 15 bp, Homo sapiens
attttctatttaaaa

SEQ ID NO: 246844 - DNA, 19 bp, Homo sapiens
attttctcaaaagcattta

SEQ ID NO: 246845 - DNA, 20 bp, Homo sapiens
attttctcaaaagcatttat

SEQ ID NO: 246846 - DNA, 23 bp, Homo sapiens
attttctcaaaagcatttatcat

SEQ ID NO: 246847 - DNA, 18 bp, Homo sapiens
attttctctgtgtttgtt

SEQ ID NO: 246848 - DNA, 17 bp, Homo sapiens
attttctggtagataga

SEQ ID NO: 246849 - DNA, 20 bp, Homo sapiens
attttctggtagatagaaat

SEQ ID NO: 246850 - DNA, 13 bp, Homo sapiens
attttctgtcact

SEQ ID NO: 246851 - DNA, 19 bp, Homo sapiens
attttctgtgttgttcata

SEQ ID NO: 246852 - DNA, 16 bp, Homo sapiens
attttcttcccatttg

SEQ ID NO: 246853 - DNA, 22 bp, Homo sapiens
attttcttcccatttgtaatgt

SEQ ID NO: 246854 - DNA, 16 bp, Homo sapiens
attttctttctatgta

SEQ ID NO: 246855 - DNA, 22 bp, Homo sapiens
attttctttctatgtagaactg

SEQ ID NO: 246856 - DNA, 18 bp, Homo sapiens
attttcttttatatctgt

SEQ ID NO: 246857 - DNA, 20 bp, Homo sapiens
attttcttttatatctgtaa

SEQ ID NO: 246858 - DNA, 21 bp, Homo sapiens
attttcttttatatctgtaaa

SEQ ID NO: 246859 - DNA, 22 bp, Homo sapiens
attttcttttatatctgtaaat

SEQ ID NO: 246860 - DNA, 18 bp, Homo sapiens
attttgaaaacacttatt

SEQ ID NO: 246861 - DNA, 12 bp, Homo sapiens
attttgaaatat

SEQ ID NO: 246862 - DNA, 20 bp, Homo sapiens
attttgaataaataaatgta

SEQ ID NO: 246863 - DNA, 15 bp, Homo sapiens
attttgaataccatt

SEQ ID NO: 246864 - DNA, 14 bp, Homo sapiens
attttgaatgtgat

SEQ ID NO: 246865 - DNA, 15 bp, Homo sapiens
attttgaatgtgatc

SEQ ID NO: 246866 - DNA, 20 bp, Homo sapiens
attttgagggtgtaaccagt

SEQ ID NO: 246867 - DNA, 18 bp, Homo sapiens
attttgagtggcaaaata

SEQ ID NO: 246868 - DNA, 13 bp, Homo sapiens
attttgataataa

SEQ ID NO: 246869 - DNA, 14 bp, Homo sapiens
attttgatgcacaa

SEQ ID NO: 246870 - DNA, 18 bp, Homo sapiens
attttgcaaaatttccag

SEQ ID NO: 246871 - DNA, 14 bp, Homo sapiens
attttgcagcagtg

SEQ ID NO: 246872 - DNA, 16 bp, Homo sapiens
attttgcagcagtgag

SEQ ID NO: 246873 - DNA, 15 bp, Homo sapiens
attttgcagtgtgca

SEQ ID NO: 246874 - DNA, 16 bp, Homo sapiens
attttgcgatgtgttt

SEQ ID NO: 246875 - DNA, 15 bp, Homo sapiens
attttggaaaagaaa

SEQ ID NO: 246876 - DNA, 19 bp, Homo sapiens
attttggaaaatgattagg

SEQ ID NO: 246877 - DNA, 19 bp, Homo sapiens
attttggaattggtgtata

SEQ ID NO: 246878 - DNA, 20 bp, Homo sapiens
attttggaattggtgtatat

SEQ ID NO: 246879 - DNA, 16 bp, Homo sapiens
attttggacgtgtgag

SEQ ID NO: 246880 - DNA, 22 bp, Homo sapiens
attttggataaatcatttcagt

SEQ ID NO: 246881 - DNA, 21 bp, Homo sapiens
atttaaaaatgccaaaactta

SEQ ID NO: 246882 - DNA, 16 bp, Homo sapiens
atttaaaagacaaaca

SEQ ID NO: 246883 - DNA, 14 bp, Homo sapiens
atttaaaatgatta

SEQ ID NO: 246884 - DNA, 19 bp, Homo sapiens
atttaaacaataaatgtgc

SEQ ID NO: 246885 - DNA, 20 bp, Homo sapiens
atttaaactaaccttttatc

SEQ ID NO: 246886 - DNA, 13 bp, Homo sapiens
atttaaagaaagt

SEQ ID NO: 246887 - DNA, 13 bp, Homo sapiens
atttaaataaagt

SEQ ID NO: 246888 - DNA, 19 bp, Homo sapiens
atttaaatagaacttgatt

SEQ ID NO: 246889 - DNA, 13 bp, Homo sapiens
atttaaatataat

SEQ ID NO: 246890 - DNA, 15 bp, Homo sapiens
atttaaatataattc

SEQ ID NO: 246891 - DNA, 21 bp, Homo sapiens
atttaaatcattttaacttct

SEQ ID NO: 246892 - DNA, 23 bp, Homo sapiens
atttaaatctgattaatccattt

SEQ ID NO: 246893 - DNA, 17 bp, Homo sapiens
atttaaatgctttgttt

SEQ ID NO: 246894 - DNA, 14 bp, Homo sapiens
atttaaattgttat

SEQ ID NO: 246895 - DNA, 16 bp, Homo sapiens
atttaaattttcacct

SEQ ID NO: 246896 - DNA, 16 bp, Homo sapiens
atttaacagtcattta

SEQ ID NO: 246897 - DNA, 18 bp, Homo sapiens
atttaacagtcatttaaa

SEQ ID NO: 246898 - DNA, 12 bp, Homo sapiens
atttaactgcat

SEQ ID NO: 246899 - DNA, 14 bp, Homo sapiens
atttaactgcatat

SEQ ID NO: 246900 - DNA, 15 bp, Homo sapiens
atttaactgcatata

SEQ ID NO: 246901 - DNA, 21 bp, Homo sapiens
atttaacttgagggtaataaa

SEQ ID NO: 246902 - DNA, 22 bp, Homo sapiens
atttaacttgagggtaataaac

SEQ ID NO: 246903 - DNA, 22 bp, Homo sapiens
atttaagaaaaacaaaatgtta

SEQ ID NO: 246904 - DNA, 20 bp, Homo sapiens
atttaagaaaatacaataaa

SEQ ID NO: 246905 - DNA, 13 bp, Homo sapiens
atttaagagtcct

SEQ ID NO: 246906 - DNA, 15 bp, Homo sapiens
atttaagagtcctga

SEQ ID NO: 246907 - DNA, 15 bp, Homo sapiens
atttaagataattat

SEQ ID NO: 246908 - DNA, 18 bp, Homo sapiens
atttaagcacaaacttta

SEQ ID NO: 246909 - DNA, 17 bp, Homo sapiens
atttaagcatgagtggc

SEQ ID NO: 246910 - DNA, 14 bp, Homo sapiens
atttaagcattgtt

SEQ ID NO: 246911 - DNA, 17 bp, Homo sapiens
atttaagccaataaata

SEQ ID NO: 246912 - DNA, 10 bp, Homo sapiens
atttaagccc

SEQ ID NO: 246913 - DNA, 15 bp, Homo sapiens
atttaagccccctct

SEQ ID NO: 246914 - DNA, 23 bp, Homo sapiens
atttaagtcgggaaattctgctg

SEQ ID NO: 246915 - DNA, 18 bp, Homo sapiens
atttaataactttgctgg

SEQ ID NO: 246916 - DNA, 15 bp, Homo sapiens
atttaatatgcatct

SEQ ID NO: 246917 - DNA, 18 bp, Homo sapiens
atttaatatgcatctttg

SEQ ID NO: 246918 - DNA, 23 bp, Homo sapiens
atttaatatgcatctttgagaat

SEQ ID NO: 246919 - DNA, 18 bp, Homo sapiens
atttaatcagtgtgacag

SEQ ID NO: 246920 - DNA, 16 bp, Homo sapiens
atttaatgatgtgtca

SEQ ID NO: 246921 - DNA, 17 bp, Homo sapiens
atttaatgttacagcat

SEQ ID NO: 246922 - DNA, 12 bp, Homo sapiens
atttaattatta

SEQ ID NO: 246923 - DNA, 12 bp, Homo sapiens
atttaatttcat

SEQ ID NO: 246924 - DNA, 14 bp, Homo sapiens
atttaatttttaaa

SEQ ID NO: 246925 - DNA, 20 bp, Homo sapiens
atttaatttttaaaagactt

SEQ ID NO: 246926 - DNA, 18 bp, Homo sapiens
atttacagtccttcaaaa

SEQ ID NO: 246927 - DNA, 15 bp, Homo sapiens
atttacagtgcctgt

SEQ ID NO: 246928 - DNA, 17 bp, Homo sapiens
atttacagttactgcct

SEQ ID NO: 246929 - DNA, 16 bp, Homo sapiens
atttacatcatttctt

SEQ ID NO: 246930 - DNA, 21 bp, Homo sapiens
atttacatgaattgcatttta

SEQ ID NO: 246931 - DNA, 20 bp, Homo sapiens
atttaccttttctgttgtac

SEQ ID NO: 246932 - DNA, 15 bp, Homo sapiens
atttacgtaaaaaga

SEQ ID NO: 246933 - DNA, 16 bp, Homo sapiens
atttacgtatatttca

SEQ ID NO: 246934 - DNA, 22 bp, Homo sapiens
atttacgtatatttcattgaat

SEQ ID NO: 246935 - DNA, 13 bp, Homo sapiens
atttactcattat

SEQ ID NO: 246936 - DNA, 12 bp, Homo sapiens
atttactgtact

SEQ ID NO: 246937 - DNA, 14 bp, Homo sapiens
atttacttcttata

SEQ ID NO: 246938 - DNA, 16 bp, Homo sapiens
atttacttcttataca

SEQ ID NO: 246939 - DNA, 18 bp, Homo sapiens
atttactttttaaacagt

SEQ ID NO: 246940 - DNA, 13 bp, Homo sapiens
atttagaaaaaag

SEQ ID NO: 246941 - DNA, 18 bp, Homo sapiens
atttagaaaaaagtttac

SEQ ID NO: 246942 - DNA, 22 bp, Homo sapiens
atttagaaaatagagcttttaa

SEQ ID NO: 246943 - DNA, 22 bp, Homo sapiens
atttagaaagaagcccaatatt

SEQ ID NO: 246944 - DNA, 14 bp, Homo sapiens
atttagaactgtat

SEQ ID NO: 246945 - DNA, 18 bp, Homo sapiens
atttagaatttgaaagga

SEQ ID NO: 246946 - DNA, 14 bp, Homo sapiens
atttagcacatttt

SEQ ID NO: 246947 - DNA, 16 bp, Homo sapiens
atttaggaatgctcaa

SEQ ID NO: 246948 - DNA, 22 bp, Homo sapiens
atttaggaatgctcaatgtgct

SEQ ID NO: 246949 - DNA, 23 bp, Homo sapiens
atttagggaagcagggacacccc

SEQ ID NO: 246950 - DNA, 22 bp, Homo sapiens
atttagggagaaatgttgttca

SEQ ID NO: 246951 - DNA, 15 bp, Homo sapiens
atttagtcctcacct

SEQ ID NO: 246952 - DNA, 16 bp, Homo sapiens
atttagttctttgtta

SEQ ID NO: 246953 - DNA, 17 bp, Homo sapiens
atttataaactaatttt

SEQ ID NO: 246954 - DNA, 20 bp, Homo sapiens
atttataaactaattttgta

SEQ ID NO: 246955 - DNA, 19 bp, Homo sapiens
atttataaactagatctcc

SEQ ID NO: 246956 - DNA, 14 bp, Homo sapiens
atttataaatatat

SEQ ID NO: 246957 - DNA, 22 bp, Homo sapiens
atttataaatgagcaaatggaa

SEQ ID NO: 246958 - DNA, 14 bp, Homo sapiens
atttataaatgtgt

SEQ ID NO: 246959 - DNA, 18 bp, Homo sapiens
atttataacaattgattt

SEQ ID NO: 246960 - DNA, 15 bp, Homo sapiens
atttataacattgta

SEQ ID NO: 246961 - DNA, 13 bp, Homo sapiens
atttataactcat

SEQ ID NO: 246962 - DNA, 16 bp, Homo sapiens
atttataactcatcat

SEQ ID NO: 246963 - DNA, 23 bp, Homo sapiens
atttataactcatcataaaataa

SEQ ID NO: 246964 - DNA, 13 bp, Homo sapiens
atttatagggctt

SEQ ID NO: 246965 - DNA, 16 bp, Homo sapiens
atttatagtttataca

SEQ ID NO: 246966 - DNA, 18 bp, Homo sapiens
atttatagtttatacagt

SEQ ID NO: 246967 - DNA, 20 bp, Homo sapiens
atttatagtttatacagttt

SEQ ID NO: 246968 - DNA, 14 bp, Homo sapiens
atttatagtttgta

SEQ ID NO: 246969 - DNA, 15 bp, Homo sapiens
agcaggcctgttgct

SEQ ID NO: 246970 - DNA, 18 bp, Homo sapiens
agcaggcctgttgctttt

SEQ ID NO: 246971 - DNA, 21 bp, Homo sapiens
agcaggcggtggggagagatg

SEQ ID NO: 246972 - DNA, 18 bp, Homo sapiens
agcaggctgcagcaggca

SEQ ID NO: 246973 - DNA, 20 bp, Homo sapiens
agcaggctgcagcaggcaga

SEQ ID NO: 246974 - DNA, 21 bp, Homo sapiens
agcaggctgcagcaggcagag

SEQ ID NO: 246975 - DNA, 13 bp, Homo sapiens
agcaggctggcag

SEQ ID NO: 246976 - DNA, 19 bp, Homo sapiens
agcagggaaagctccacgg

SEQ ID NO: 246977 - DNA, 21 bp, Homo sapiens
agcagggattaacctctgcac

SEQ ID NO: 246978 - DNA, 22 bp, Homo sapiens
agcagggattaacctctgcact

SEQ ID NO: 246979 - DNA, 13 bp, Homo sapiens
agcagggccctca

SEQ ID NO: 246980 - DNA, 18 bp, Homo sapiens
agcagggccctcagagga

SEQ ID NO: 246981 - DNA, 16 bp, Homo sapiens
agcagggctgggctct

SEQ ID NO: 246982 - DNA, 15 bp, Homo sapiens
agcaggggcagaagg

SEQ ID NO: 246983 - DNA, 23 bp, Homo sapiens
agcaggggggttgggttccagac

SEQ ID NO: 246984 - DNA, 17 bp, Homo sapiens
agcaggggtgggaggct

SEQ ID NO: 246985 - DNA, 18 bp, Homo sapiens
agcagggtagtctggttt

SEQ ID NO: 246986 - DNA, 21 bp, Homo sapiens
agcagggtagtctggtttcta

SEQ ID NO: 246987 - DNA, 16 bp, Homo sapiens
agcagggtcttgctgt

SEQ ID NO: 246988 - DNA, 20 bp, Homo sapiens
agcaggtctgcaggccacca

SEQ ID NO: 246989 - DNA, 14 bp, Homo sapiens
agcaggtggggagg

SEQ ID NO: 246990 - DNA, 22 bp, Homo sapiens
agcaggtgtggtggctcatggc

SEQ ID NO: 246991 - DNA, 21 bp, Homo sapiens
agcagtatcacaggccagatg

SEQ ID NO: 246992 - DNA, 14 bp, Homo sapiens
agcagtatgaatga

SEQ ID NO: 246993 - DNA, 12 bp, Homo sapiens
agcagtcacagg

SEQ ID NO: 246994 - DNA, 17 bp, Homo sapiens
agcagtctacttctgtg

SEQ ID NO: 246995 - DNA, 13 bp, Homo sapiens
agcagtcttgctc

SEQ ID NO: 246996 - DNA, 18 bp, Homo sapiens
agcagtgcatgctgtccc

SEQ ID NO: 246997 - DNA, 22 bp, Homo sapiens
agcagtgcctcgaggcaccggc

SEQ ID NO: 246998 - DNA, 11 bp, Homo sapiens
agcagtgctgg

SEQ ID NO: 246999 - DNA, 19 bp, Homo sapiens
agcagtgctgggcccagcc

SEQ ID NO: 247000 - DNA, 19 bp, Homo sapiens
agcagtgtcatcagaagat

SEQ ID NO: 247001 - DNA, 21 bp, Homo sapiens
agcagtgtcgccgtccctctg

SEQ ID NO: 247002 - DNA, 20 bp, Homo sapiens
agcagtgtcttccataatgt

SEQ ID NO: 247003 - DNA, 17 bp, Homo sapiens
agcagtgtgtctcctgc

SEQ ID NO: 247004 - DNA, 22 bp, Homo sapiens
agcagtgtgtctcctgcatgca

SEQ ID NO: 247005 - DNA, 22 bp, Homo sapiens
agcagttgacatccaaatctag

SEQ ID NO: 247006 - DNA, 13 bp, Homo sapiens
agcagttgtgtca

SEQ ID NO: 247007 - DNA, 14 bp, Homo sapiens
agcagtttcactgc

SEQ ID NO: 247008 - DNA, 20 bp, Homo sapiens
agcagttttcttttaatttt

SEQ ID NO: 247009 - DNA, 23 bp, Homo sapiens
agcataagtttctgggacctcag

SEQ ID NO: 247010 - DNA, 17 bp, Homo sapiens
agcatacaaaaatatat

SEQ ID NO: 247011 - DNA, 18 bp, Homo sapiens
agcatacaaaaatatatt

SEQ ID NO: 247012 - DNA, 15 bp, Homo sapiens
agcatataaatgttt

SEQ ID NO: 247013 - DNA, 18 bp, Homo sapiens
agcatataaatgtttata

SEQ ID NO: 247014 - DNA, 20 bp, Homo sapiens
agcatatattcatacctgtt

SEQ ID NO: 247015 - DNA, 17 bp, Homo sapiens
agcatcaaacatgaaaa

SEQ ID NO: 247016 - DNA, 13 bp, Homo sapiens
agcatcaccacca

SEQ ID NO: 247017 - DNA, 15 bp, Homo sapiens
agcatcaccaccaca

SEQ ID NO: 247018 - DNA, 21 bp, Homo sapiens
agcatcaccaccacacccctg

SEQ ID NO: 247019 - DNA, 16 bp, Homo sapiens
agcatcagagagtgta

SEQ ID NO: 247020 - DNA, 22 bp, Homo sapiens
agcatccatgcggccggcctgg

SEQ ID NO: 247021 - DNA, 24 bp, Homo sapiens
agcatccatgtgtggactcaagtc

SEQ ID NO: 247022 - DNA, 16 bp, Homo sapiens
agcatcccccaaagtt

SEQ ID NO: 247023 - DNA, 20 bp, Homo sapiens
agcatcccccaaagttcaca

SEQ ID NO: 247024 - DNA, 20 bp, Homo sapiens
agcatccggcatgagggctg

SEQ ID NO: 247025 - DNA, 21 bp, Homo sapiens
agcatcctgattattgaatgt

SEQ ID NO: 247026 - DNA, 19 bp, Homo sapiens
agcatcgtgacccttcagg

SEQ ID NO: 247027 - DNA, 23 bp, Homo sapiens
agcatcgtgacccttcagggcca

SEQ ID NO: 247028 - DNA, 13 bp, Homo sapiens
agcatctgctaat

SEQ ID NO: 247029 - DNA, 20 bp, Homo sapiens
agcatctgtcccactgggac

SEQ ID NO: 247030 - DNA, 18 bp, Homo sapiens
agcatcttcacttctaaa

SEQ ID NO: 247031 - DNA, 23 bp, Homo sapiens
agcatcttcacttctaaatgcat

SEQ ID NO: 247032 - DNA, 13 bp, Homo sapiens
agcatgaaaaagc

SEQ ID NO: 247033 - DNA, 14 bp, Homo sapiens
agcatgaaaggtaa

SEQ ID NO: 247034 - DNA, 17 bp, Homo sapiens
agcatgacaagccccag

SEQ ID NO: 247035 - DNA, 19 bp, Homo sapiens
agcatgacaagccccaggc

SEQ ID NO: 247036 - DNA, 20 bp, Homo sapiens
agcatgacaagccccaggca

SEQ ID NO: 247037 - DNA, 21 bp, Homo sapiens
agcatgaccttttggcctttg

SEQ ID NO: 247038 - DNA, 18 bp, Homo sapiens
agcatgcacaaagtgtat

SEQ ID NO: 247039 - DNA, 21 bp, Homo sapiens
agcatgcacaaagtgtattca

SEQ ID NO: 247040 - DNA, 16 bp, Homo sapiens
agcatgccccttggct

SEQ ID NO: 247041 - DNA, 19 bp, Homo sapiens
agcatgccccttggctgga

SEQ ID NO: 247042 - DNA, 16 bp, Homo sapiens
agcatgctcagtattg

SEQ ID NO: 247043 - DNA, 16 bp, Homo sapiens
agcatgctttgctgct

SEQ ID NO: 247044 - DNA, 17 bp, Homo sapiens
agcatgctttgctgcta

SEQ ID NO: 247045 - DNA, 18 bp, Homo sapiens
agcatgctttgctgctat

SEQ ID NO: 247046 - DNA, 16 bp, Homo sapiens
agcatgtaatattaaa

SEQ ID NO: 247047 - DNA, 17 bp, Homo sapiens
agcatgtaatattaaat

SEQ ID NO: 247048 - DNA, 14 bp, Homo sapiens
agcatgtctactgc

SEQ ID NO: 247049 - DNA, 15 bp, Homo sapiens
agcatgtctctgctt

SEQ ID NO: 247050 - DNA, 18 bp, Homo sapiens
agcatgtctctgcttcca

SEQ ID NO: 247051 - DNA, 19 bp, Homo sapiens
agcatgtgtatttccagtg

SEQ ID NO: 247052 - DNA, 13 bp, Homo sapiens
agcatgtgtcaga

SEQ ID NO: 247053 - DNA, 14 bp, Homo sapiens
agcatgtgtgtgtc

SEQ ID NO: 247054 - DNA, 18 bp, Homo sapiens
agcatgttgaatgtatct

SEQ ID NO: 247055 - DNA, 16 bp, Homo sapiens
agcatgttgagccagg

SEQ ID NO: 247056 - DNA, 19 bp, Homo sapiens
agcatgttgagccaggcct

SEQ ID NO: 247057 - DNA, 23 bp, Homo sapiens
agcatgttgtagatacaatcagc

SEQ ID NO: 247058 - DNA, 17 bp, Homo sapiens
agcatgttgttttttca

SEQ ID NO: 247059 - DNA, 19 bp, Homo sapiens
agcatgttgttttttcata

SEQ ID NO: 247060 - DNA, 17 bp, Homo sapiens
agcatgtttcatgtttt

SEQ ID NO: 247061 - DNA, 18 bp, Homo sapiens
agcatgtttcatgttttg

SEQ ID NO: 247062 - DNA, 17 bp, Homo sapiens
agcattaaaaataaaag

SEQ ID NO: 247063 - DNA, 17 bp, Homo sapiens
agcattaacttctctgg

SEQ ID NO: 247064 - DNA, 21 bp, Homo sapiens
agcattaggcttttaagaaac

SEQ ID NO: 247065 - DNA, 15 bp, Homo sapiens
agcattattcttcag

SEQ ID NO: 247066 - DNA, 18 bp, Homo sapiens
agcattccttagcagctc

SEQ ID NO: 247067 - DNA, 18 bp, Homo sapiens
agcattctcactcctacc

SEQ ID NO: 247068 - DNA, 17 bp, Homo sapiens
agcattctgagctgggc

SEQ ID NO: 247069 - DNA, 18 bp, Homo sapiens
agcattctgagctgggct

SEQ ID NO: 247070 - DNA, 15 bp, Homo sapiens
agcattctgcctgcc

SEQ ID NO: 247071 - DNA, 16 bp, Homo sapiens
agcattctgcctgcct

SEQ ID NO: 247072 - DNA, 21 bp, Homo sapiens
agcattctgcctgcctgggaa

SEQ ID NO: 247073 - DNA, 13 bp, Homo sapiens
agcattctggggt

SEQ ID NO: 247074 - DNA, 16 bp, Homo sapiens
agcattcttgtcacaa

SEQ ID NO: 247075 - DNA, 22 bp, Homo sapiens
agcattcttgtcacaataaatg

SEQ ID NO: 247076 - DNA, 17 bp, Homo sapiens
agcattgaaataataat

SEQ ID NO: 247077 - DNA, 19 bp, Homo sapiens
agcattgaaataataatat

SEQ ID NO: 247078 - DNA, 15 bp, Homo sapiens
agcattgaaattata

SEQ ID NO: 247079 - DNA, 15 bp, Homo sapiens
agcatttatcattct

SEQ ID NO: 247080 - DNA, 17 bp, Homo sapiens
agcatttccaacaccac

SEQ ID NO: 247081 - DNA, 21 bp, Homo sapiens
agcatttccaacaccacagac

SEQ ID NO: 247082 - DNA, 21 bp, Homo sapiens
agcatttgactttctgtctgt

SEQ ID NO: 247083 - DNA, 13 bp, Homo sapiens
agcatttggaagg

SEQ ID NO: 247084 - DNA, 17 bp, Homo sapiens
agcatttggaaggaaag

SEQ ID NO: 247085 - DNA, 17 bp, Homo sapiens
agcattttactgtctgt

SEQ ID NO: 247086 - DNA, 13 bp, Homo sapiens
agcattttcagca

SEQ ID NO: 247087 - DNA, 18 bp, Homo sapiens
agcattttctttctgttt

SEQ ID NO: 247088 - DNA, 14 bp, Homo sapiens
agcattttgtgtct

SEQ ID NO: 247089 - DNA, 19 bp, Homo sapiens
atgtctgcatggcagaagc

SEQ ID NO: 247090 - DNA, 16 bp, Homo sapiens
atgtctgtggccttgt

SEQ ID NO: 247091 - DNA, 21 bp, Homo sapiens
atgtctgttttagttggaatg

SEQ ID NO: 247092 - DNA, 17 bp, Homo sapiens
atgtcttactactttaa

SEQ ID NO: 247093 - DNA, 15 bp, Homo sapiens
atgtcttataagaaa

SEQ ID NO: 247094 - DNA, 23 bp, Homo sapiens
atgtcttataagaaaacatgtaa

SEQ ID NO: 247095 - DNA, 20 bp, Homo sapiens
atgtcttcatttcattgtat

SEQ ID NO: 247096 - DNA, 20 bp, Homo sapiens
atgtcttcgtacagttcttc

SEQ ID NO: 247097 - DNA, 14 bp, Homo sapiens
atgtcttgagatgt

SEQ ID NO: 247098 - DNA, 14 bp, Homo sapiens
atagcatcccatct

SEQ ID NO: 247099 - DNA, 14 bp, Homo sapiens
atagcatctgctct

SEQ ID NO: 247100 - DNA, 15 bp, Homo sapiens
atagcattaactaat

SEQ ID NO: 247101 - DNA, 21 bp, Homo sapiens
atagcattaactaatctattg

SEQ ID NO: 247102 - DNA, 12 bp, Homo sapiens
atagcctttgta

SEQ ID NO: 247103 - DNA, 14 bp, Homo sapiens
atagcctttgtagg

SEQ ID NO: 247104 - DNA, 23 bp, Homo sapiens
atagcggggccttgtctcttcct

SEQ ID NO: 247105 - DNA, 13 bp, Homo sapiens
atagctaaatggc

SEQ ID NO: 247106 - DNA, 15 bp, Homo sapiens
atagctacaggaagc

SEQ ID NO: 247107 - DNA, 14 bp, Homo sapiens
atagctactatatg

SEQ ID NO: 247108 - DNA, 21 bp, Homo sapiens
atagctagctatttctatgta

SEQ ID NO: 247109 - DNA, 22 bp, Homo sapiens
atagctagctatttctatgtat

SEQ ID NO: 247110 - DNA, 17 bp, Homo sapiens
atagctatatccatgta

SEQ ID NO: 247111 - DNA, 19 bp, Homo sapiens
atagctatatccatgtact

SEQ ID NO: 247112 - DNA, 18 bp, Homo sapiens
atagctatttagagatat

SEQ ID NO: 247113 - DNA, 20 bp, Homo sapiens
atagctccccgcttctgcct

SEQ ID NO: 247114 - DNA, 20 bp, Homo sapiens
atagctccttggagcaggca

SEQ ID NO: 247115 - DNA, 17 bp, Homo sapiens
atagctgagctggaaag

SEQ ID NO: 247116 - DNA, 24 bp, Homo sapiens
atagctgggaacccgactgtgaaa

SEQ ID NO: 247117 - DNA, 23 bp, Homo sapiens
atagctggtcttatttgtaaagc

SEQ ID NO: 247118 - DNA, 15 bp, Homo sapiens
atagctgtatatttg

SEQ ID NO: 247119 - DNA, 20 bp, Homo sapiens
atagctgtatatttgaaact

SEQ ID NO: 247120 - DNA, 10 bp, Homo sapiens
atagctttat

SEQ ID NO: 247121 - DNA, 21 bp, Homo sapiens
atagctttattttttaagtat

SEQ ID NO: 247122 - DNA, 15 bp, Homo sapiens
ataggaaaactgaat

SEQ ID NO: 247123 - DNA, 12 bp, Homo sapiens
ataggaaaagat

SEQ ID NO: 247124 - DNA, 18 bp, Homo sapiens
ataggaaaagtacattta

SEQ ID NO: 247125 - DNA, 18 bp, Homo sapiens
ataggacatactgcatgt

SEQ ID NO: 247126 - DNA, 19 bp, Homo sapiens
ataggacatactgcatgta

SEQ ID NO: 247127 - DNA, 15 bp, Homo sapiens
ataggagacttgtag

SEQ ID NO: 247128 - DNA, 15 bp, Homo sapiens
ataggagaggagggt

SEQ ID NO: 247129 - DNA, 16 bp, Homo sapiens
ataggagcttccagat

SEQ ID NO: 247130 - DNA, 18 bp, Homo sapiens
ataggagcttccagatgg

SEQ ID NO: 247131 - DNA, 13 bp, Homo sapiens
ataggaggacaga

SEQ ID NO: 247132 - DNA, 18 bp, Homo sapiens
ataggccatctgtaaata

SEQ ID NO: 247133 - DNA, 23 bp, Homo sapiens
ataggcccaaggtcccctccaca

SEQ ID NO: 247134 - DNA, 22 bp, Homo sapiens
ataggctctgcacagatggatt

SEQ ID NO: 247135 - DNA, 16 bp, Homo sapiens
atagggtctcttcagg

SEQ ID NO: 247136 - DNA, 21 bp, Homo sapiens
atagggtctcttcaggttctt

SEQ ID NO: 247137 - DNA, 14 bp, Homo sapiens
atagggtggacaga

SEQ ID NO: 247138 - DNA, 14 bp, Homo sapiens
ataggtaatcaatg

SEQ ID NO: 247139 - DNA, 20 bp, Homo sapiens
ataggtaggagacctcttct

SEQ ID NO: 247140 - DNA, 22 bp, Homo sapiens
ataggtgcttattctcaaagca

SEQ ID NO: 247141 - DNA, 20 bp, Homo sapiens
atagtaaaaagattctctgc

SEQ ID NO: 247142 - DNA, 18 bp, Homo sapiens
atagtaagcctccctcct

SEQ ID NO: 247143 - DNA, 20 bp, Homo sapiens
atagtaagcctccctcctcg

SEQ ID NO: 247144 - DNA, 17 bp, Homo sapiens
atagtaggctaaaaaca

SEQ ID NO: 247145 - DNA, 20 bp, Homo sapiens
atagtaggctaaaaacattt

SEQ ID NO: 247146 - DNA, 21 bp, Homo sapiens
atagtaggctaaaaacatttt

SEQ ID NO: 247147 - DNA, 18 bp, Homo sapiens
atagtagtaaaattagaa

SEQ ID NO: 247148 - DNA, 21 bp, Homo sapiens
atagtagtaaaattagaaaaa

SEQ ID NO: 247149 - DNA, 22 bp, Homo sapiens
atagtatgcagctaaaaaataa

SEQ ID NO: 247150 - DNA, 21 bp, Homo sapiens
atagtatggaagtatttgaga

SEQ ID NO: 247151 - DNA, 20 bp, Homo sapiens
atagtatttgagagttctaa

SEQ ID NO: 247152 - DNA, 21 bp, Homo sapiens
atagtcaatcaaacagggaca

SEQ ID NO: 247153 - DNA, 21 bp, Homo sapiens
atagtcagctgtaccaagccc

SEQ ID NO: 247154 - DNA, 13 bp, Homo sapiens
atagtcgggcata

SEQ ID NO: 247155 - DNA, 23 bp, Homo sapiens
atagtctctacctatagaaatgt

SEQ ID NO: 247156 - DNA, 20 bp, Homo sapiens
atagtgcaactatgaatgta

SEQ ID NO: 247157 - DNA, 21 bp, Homo sapiens
atagtgcctcagcgctgccca

SEQ ID NO: 247158 - DNA, 23 bp, Homo sapiens
atagtgcctcagcgctgcccaca

SEQ ID NO: 247159 - DNA, 12 bp, Homo sapiens
atagtgcctttt

SEQ ID NO: 247160 - DNA, 17 bp, Homo sapiens
atagtgcttcttgtaat

SEQ ID NO: 247161 - DNA, 13 bp, Homo sapiens
atagtggccagac

SEQ ID NO: 247162 - DNA, 21 bp, Homo sapiens
atagtggtgttttaaagagaa

SEQ ID NO: 247163 - DNA, 18 bp, Homo sapiens
atagtggttcttggaaaa

SEQ ID NO: 247164 - DNA, 13 bp, Homo sapiens
atagtgtaaaata

SEQ ID NO: 247165 - DNA, 14 bp, Homo sapiens
atagtgtaaaataa

SEQ ID NO: 247166 - DNA, 22 bp, Homo sapiens
atagtgtataccacctgtacat

SEQ ID NO: 247167 - DNA, 12 bp, Homo sapiens
atagtgtgttct

SEQ ID NO: 247168 - DNA, 13 bp, Homo sapiens
atagtgtgttctg

SEQ ID NO: 247169 - DNA, 19 bp, Homo sapiens
atagtgttgatcagatctt

SEQ ID NO: 247170 - DNA, 21 bp, Homo sapiens
atagttaatgaaggtgtgcta

SEQ ID NO: 247171 - DNA, 15 bp, Homo sapiens
atagttcaggatttg

SEQ ID NO: 247172 - DNA, 13 bp, Homo sapiens
atagttctatttc

SEQ ID NO: 247173 - DNA, 16 bp, Homo sapiens
atagttctatttctat

SEQ ID NO: 247174 - DNA, 12 bp, Homo sapiens
atagttctgtta

SEQ ID NO: 247175 - DNA, 20 bp, Homo sapiens
atagttctgttaaatatttt

SEQ ID NO: 247176 - DNA, 16 bp, Homo sapiens
atagttgaacaagatt

SEQ ID NO: 247177 - DNA, 15 bp, Homo sapiens
atagttgtctttctt

SEQ ID NO: 247178 - DNA, 16 bp, Homo sapiens
atagtttaggagaaac

SEQ ID NO: 247179 - DNA, 21 bp, Homo sapiens
atagtttcagatatatatcat

SEQ ID NO: 247180 - DNA, 15 bp, Homo sapiens
atagtttgtacatgc

SEQ ID NO: 247181 - DNA, 20 bp, Homo sapiens
atagttttaaactcattttt

SEQ ID NO: 247182 - DNA, 18 bp, Homo sapiens
atataaaaagaaaagata

SEQ ID NO: 247183 - DNA, 20 bp, Homo sapiens
atataaaaagaaaagataaa

SEQ ID NO: 247184 - DNA, 12 bp, Homo sapiens
atataaaaataa

SEQ ID NO: 247185 - DNA, 13 bp, Homo sapiens
atataaaaataat

SEQ ID NO: 247186 - DNA, 22 bp, Homo sapiens
atataaaataaatatactaata

SEQ ID NO: 247187 - DNA, 17 bp, Homo sapiens
atataaaatgtattcaa

SEQ ID NO: 247188 - DNA, 15 bp, Homo sapiens
atataaactgtgaga

SEQ ID NO: 247189 - DNA, 16 bp, Homo sapiens
atataaactgtgagat

SEQ ID NO: 247190 - DNA, 17 bp, Homo sapiens
atataaagtactactgt

SEQ ID NO: 247191 - DNA, 18 bp, Homo sapiens
atataaagtactactgta

SEQ ID NO: 247192 - DNA, 12 bp, Homo sapiens
atataaagtttt

SEQ ID NO: 247193 - DNA, 15 bp, Homo sapiens
atataaatgaatgaa

SEQ ID NO: 247194 - DNA, 17 bp, Homo sapiens
atataaatgtactacat

SEQ ID NO: 247195 - DNA, 14 bp, Homo sapiens
atataaatgtttat

SEQ ID NO: 247196 - DNA, 16 bp, Homo sapiens
atataaatgtttatat

SEQ ID NO: 247197 - DNA, 12 bp, Homo sapiens
atataaattaag

SEQ ID NO: 247198 - DNA, 17 bp, Homo sapiens
atataaattattacttt

SEQ ID NO: 247199 - DNA, 18 bp, Homo sapiens
atataacaatatatgata

SEQ ID NO: 247200 - DNA, 23 bp, Homo sapiens
atataaggaaagcaataaatgaa

SEQ ID NO: 247201 - DNA, 14 bp, Homo sapiens
atataagttaaaga

SEQ ID NO: 247202 - DNA, 18 bp, Homo sapiens
atataataaagctactga

SEQ ID NO: 247203 - DNA, 21 bp, Homo sapiens
atataataaagctactgattt

SEQ ID NO: 247204 - DNA, 17 bp, Homo sapiens
atataataaagtattcc

SEQ ID NO: 247205 - DNA, 14 bp, Homo sapiens
atataataaatggg

SEQ ID NO: 247206 - DNA, 17 bp, Homo sapiens
atataataatgtccttt

SEQ ID NO: 247207 - DNA, 23 bp, Homo sapiens
atataatatgtcttcataatata

SEQ ID NO: 247208 - DNA, 18 bp, Homo sapiens
atataatgagtttcatta

SEQ ID NO: 247209 - DNA, 18 bp, Homo sapiens
atataatggtttactgct

SEQ ID NO: 247210 - DNA, 19 bp, Homo sapiens
atataatggtttactgctg

SEQ ID NO: 247211 - DNA, 21 bp, Homo sapiens
atataatgttgttatttaaag

SEQ ID NO: 247212 - DNA, 14 bp, Homo sapiens
atataattatgtta

SEQ ID NO: 247213 - DNA, 19 bp, Homo sapiens
atataattatgttattgaa

SEQ ID NO: 247214 - DNA, 23 bp, Homo sapiens
atataatttttttatgttttgtt

SEQ ID NO: 247215 - DNA, 16 bp, Homo sapiens
atatacacaaagatat

SEQ ID NO: 247216 - DNA, 20 bp, Homo sapiens
atatacacaaagatattatt

SEQ ID NO: 247217 - DNA, 21 bp, Homo sapiens
atatacacggattattatttg

SEQ ID NO: 247218 - DNA, 15 bp, Homo sapiens
atatacagatgaaaa

SEQ ID NO: 247219 - DNA, 11 bp, Homo sapiens
atatgttgtaa

SEQ ID NO: 247220 - DNA, 17 bp, Homo sapiens
atatgttttaaatatag

SEQ ID NO: 247221 - DNA, 13 bp, Homo sapiens
atatgttttgaga

SEQ ID NO: 247222 - DNA, 16 bp, Homo sapiens
atatgttttgagaaaa

SEQ ID NO: 247223 - DNA, 17 bp, Homo sapiens
atatgttttgagaaaaa

SEQ ID NO: 247224 - DNA, 23 bp, Homo sapiens
atattaaaaatataaacaatgtt

SEQ ID NO: 247225 - DNA, 20 bp, Homo sapiens
atattaaagcgcaaatgaat

SEQ ID NO: 247226 - DNA, 15 bp, Homo sapiens
atattaaataaatgt

SEQ ID NO: 247227 - DNA, 12 bp, Homo sapiens
atattaaataca

SEQ ID NO: 247228 - DNA, 16 bp, Homo sapiens
atattaagaaacaatt

SEQ ID NO: 247229 - DNA, 17 bp, Homo sapiens
atattaataaaacttta

SEQ ID NO: 247230 - DNA, 20 bp, Homo sapiens
atattaatttatcagattgc

SEQ ID NO: 247231 - DNA, 15 bp, Homo sapiens
atattacattgcatt

SEQ ID NO: 247232 - DNA, 19 bp, Homo sapiens
atattacattgcattcaaa

SEQ ID NO: 247233 - DNA, 15 bp, Homo sapiens
atattaccagcaaga

SEQ ID NO: 247234 - DNA, 20 bp, Homo sapiens
atattaccatcttaatcttt

SEQ ID NO: 247235 - DNA, 23 bp, Homo sapiens
atattaccatcttaatctttatt

SEQ ID NO: 247236 - DNA, 14 bp, Homo sapiens
atattactgtcttt

SEQ ID NO: 247237 - DNA, 19 bp, Homo sapiens
atattactgtctttattct

SEQ ID NO: 247238 - DNA, 21 bp, Homo sapiens
atattactgtctttattctta

SEQ ID NO: 247239 - DNA, 15 bp, Homo sapiens
atattactgttgcat

SEQ ID NO: 247240 - DNA, 20 bp, Homo sapiens
atattactgttgcatttact

SEQ ID NO: 247241 - DNA, 21 bp, Homo sapiens
atattactgttgcatttactt

SEQ ID NO: 247242 - DNA, 19 bp, Homo sapiens
atattacttttgtaaatat

SEQ ID NO: 247243 - DNA, 16 bp, Homo sapiens
atattagagtgccctt

SEQ ID NO: 247244 - DNA, 17 bp, Homo sapiens
atattagagtgccctta

SEQ ID NO: 247245 - DNA, 14 bp, Homo sapiens
atattataaatcca

SEQ ID NO: 247246 - DNA, 21 bp, Homo sapiens
atattataagttgacctttat

SEQ ID NO: 247247 - DNA, 22 bp, Homo sapiens
atattataataatgttctctgg

SEQ ID NO: 247248 - DNA, 20 bp, Homo sapiens
atattatactaagaaaagat

SEQ ID NO: 247249 - DNA, 14 bp, Homo sapiens
atattatgatttta

SEQ ID NO: 247250 - DNA, 20 bp, Homo sapiens
atattatgattttatttaaa

SEQ ID NO: 247251 - DNA, 22 bp, Homo sapiens
atattatgtggcttttatttca

SEQ ID NO: 247252 - DNA, 13 bp, Homo sapiens
atattatgtgttt

SEQ ID NO: 247253 - DNA, 15 bp, Homo sapiens
atattcaaacacaca

SEQ ID NO: 247254 - DNA, 18 bp, Homo sapiens
atattcaaacacacagta

SEQ ID NO: 247255 - DNA, 23 bp, Homo sapiens
atattcaaatcagcaagcttgta

SEQ ID NO: 247256 - DNA, 15 bp, Homo sapiens
atattcaataaagct

SEQ ID NO: 247257 - DNA, 14 bp, Homo sapiens
atattcagagatgt

SEQ ID NO: 247258 - DNA, 16 bp, Homo sapiens
atattcaggagttgga

SEQ ID NO: 247259 - DNA, 19 bp, Homo sapiens
atattcaggagttggaatg

SEQ ID NO: 247260 - DNA, 23 bp, Homo sapiens
atattcatacctgttgtacactt

SEQ ID NO: 247261 - DNA, 20 bp, Homo sapiens
atattcatcaaataaacctt

SEQ ID NO: 247262 - DNA, 17 bp, Homo sapiens
atattcattctttataa

SEQ ID NO: 247263 - DNA, 16 bp, Homo sapiens
atattccatgaatgta

SEQ ID NO: 247264 - DNA, 14 bp, Homo sapiens
atattcccatggta

SEQ ID NO: 247265 - DNA, 18 bp, Homo sapiens
atattcccctatctctag

SEQ ID NO: 247266 - DNA, 18 bp, Homo sapiens
atattcctgaatgaaata

SEQ ID NO: 247267 - DNA, 13 bp, Homo sapiens
atattctaagcca

SEQ ID NO: 247268 - DNA, 17 bp, Homo sapiens
atattctggctgataaa

SEQ ID NO: 247269 - DNA, 19 bp, Homo sapiens
atattcttgctttcacaaa

SEQ ID NO: 247270 - DNA, 22 bp, Homo sapiens
atattctttacaaactgaagat

SEQ ID NO: 247271 - DNA, 16 bp, Homo sapiens
atattctttatatact

SEQ ID NO: 247272 - DNA, 15 bp, Homo sapiens
atattgaccatgtga

SEQ ID NO: 247273 - DNA, 16 bp, Homo sapiens
atattgaccatgtgat

SEQ ID NO: 247274 - DNA, 19 bp, Homo sapiens
atattgaccatgtgattat

SEQ ID NO: 247275 - DNA, 15 bp, Homo sapiens
atattgagacaaaaa

SEQ ID NO: 247276 - DNA, 14 bp, Homo sapiens
atattgatgaaaag

SEQ ID NO: 247277 - DNA, 15 bp, Homo sapiens
atattgcttggacta

SEQ ID NO: 247278 - DNA, 13 bp, Homo sapiens
atattggtattca

SEQ ID NO: 247279 - DNA, 14 bp, Homo sapiens
atattggtgtgaat

SEQ ID NO: 247280 - DNA, 12 bp, Homo sapiens
atattgtatgta

SEQ ID NO: 247281 - DNA, 22 bp, Homo sapiens
atattgtatttaacccattatt

SEQ ID NO: 247282 - DNA, 19 bp, Homo sapiens
atattgtcacaacactgaa

SEQ ID NO: 247283 - DNA, 21 bp, Homo sapiens
atattgtgccaatatgtattg

SEQ ID NO: 247284 - DNA, 17 bp, Homo sapiens
atattgtttttatatat

SEQ ID NO: 247285 - DNA, 21 bp, Homo sapiens
atatttaaaaaaaaaatcagt

SEQ ID NO: 247286 - DNA, 22 bp, Homo sapiens
atatttaaaagacaaacacctt

SEQ ID NO: 247287 - DNA, 15 bp, Homo sapiens
atatttaacttctag

SEQ ID NO: 247288 - DNA, 18 bp, Homo sapiens
atatttaagaaaatacaa

SEQ ID NO: 247289 - DNA, 22 bp, Homo sapiens
atatttaataggataaattaat

SEQ ID NO: 247290 - DNA, 12 bp, Homo sapiens
atatttaatgat

SEQ ID NO: 247291 - DNA, 22 bp, Homo sapiens
atatttagttatagtttcagat

SEQ ID NO: 247292 - DNA, 14 bp, Homo sapiens
atatttatataatt

SEQ ID NO: 247293 - DNA, 20 bp, Homo sapiens
atatttatataattatgtta

SEQ ID NO: 247294 - DNA, 22 bp, Homo sapiens
atatttatataattatgttatt

SEQ ID NO: 247295 - DNA, 21 bp, Homo sapiens
atatttatgacctcaacaaag

SEQ ID NO: 247296 - DNA, 20 bp, Homo sapiens
atatttatgtagatgtgcat

SEQ ID NO: 247297 - DNA, 22 bp, Homo sapiens
atatttattgaattattttgtt

SEQ ID NO: 247298 - DNA, 14 bp, Homo sapiens
atatttatttctag

SEQ ID NO: 247299 - DNA, 18 bp, Homo sapiens
atatttatttctagcaaa

SEQ ID NO: 247300 - DNA, 22 bp, Homo sapiens
atatttattttcagtatactgt

SEQ ID NO: 247301 - DNA, 12 bp, Homo sapiens
atatttcactta

SEQ ID NO: 247302 - DNA, 21 bp, Homo sapiens
atatttccatatggattttct

SEQ ID NO: 247303 - DNA, 18 bp, Homo sapiens
atatttctaagcttattt

SEQ ID NO: 247304 - DNA, 21 bp, Homo sapiens
atatttctaagcttatttcta

SEQ ID NO: 247305 - DNA, 15 bp, Homo sapiens
atatttctatgtaaa

SEQ ID NO: 247306 - DNA, 13 bp, Homo sapiens
atatttcttgctt

SEQ ID NO: 247307 - DNA, 14 bp, Homo sapiens
atatttcttgcttt

SEQ ID NO: 247308 - DNA, 15 bp, Homo sapiens
atatttcttgctttc

SEQ ID NO: 247309 - DNA, 19 bp, Homo sapiens
atatttgacattcttcact

SEQ ID NO: 247310 - DNA, 13 bp, Homo sapiens
atatttgatgtag

SEQ ID NO: 247311 - DNA, 21 bp, Homo sapiens
atatttgctggagtgctggct

SEQ ID NO: 247312 - DNA, 15 bp, Homo sapiens
atatttgcttattta

SEQ ID NO: 247313 - DNA, 16 bp, Homo sapiens
atatttgcttatttat

SEQ ID NO: 247314 - DNA, 17 bp, Homo sapiens
atatttgcttctaatgt

SEQ ID NO: 247315 - DNA, 15 bp, Homo sapiens
atatttggattgtca

SEQ ID NO: 247316 - DNA, 14 bp, Homo sapiens
atatttgtaacttt

SEQ ID NO: 247317 - DNA, 18 bp, Homo sapiens
atatttgtaactttgcat

SEQ ID NO: 247318 - DNA, 21 bp, Homo sapiens
atatttgtaactttgcatgtt

SEQ ID NO: 247319 - DNA, 18 bp, Homo sapiens
atatttgtagctagaata

SEQ ID NO: 247320 - DNA, 18 bp, Homo sapiens
atatttgtctcattttgt

SEQ ID NO: 247321 - DNA, 20 bp, Homo sapiens
atatttgttatgataaaagg

SEQ ID NO: 247322 - DNA, 16 bp, Homo sapiens
atattttatactgcac

SEQ ID NO: 247323 - DNA, 15 bp, Homo sapiens
atattttatttttat

SEQ ID NO: 247324 - DNA, 19 bp, Homo sapiens
atattttcaaagtacataa

SEQ ID NO: 247325 - DNA, 23 bp, Homo sapiens
atattttcatgacttttccatgt

SEQ ID NO: 247326 - DNA, 19 bp, Homo sapiens
atatttttaataaaagttg

SEQ ID NO: 247327 - DNA, 22 bp, Homo sapiens
atatttttacaaataattatca

SEQ ID NO: 247328 - DNA, 22 bp, Homo sapiens
agaggatgaatgtatgtgcact

SEQ ID NO: 247329 - DNA, 16 bp, Homo sapiens
agaggatgatgtaatt

SEQ ID NO: 247330 - DNA, 16 bp, Homo sapiens
agaggattgcttccct

SEQ ID NO: 247331 - DNA, 18 bp, Homo sapiens
agaggatttttttctgag

SEQ ID NO: 247332 - DNA, 22 bp, Homo sapiens
agaggcaacagtgttctgagcc

SEQ ID NO: 247333 - DNA, 14 bp, Homo sapiens
agaggcagagtgcc

SEQ ID NO: 247334 - DNA, 12 bp, Homo sapiens
agaggcagggcc

SEQ ID NO: 247335 - DNA, 15 bp, Homo sapiens
agaggcagggccctg

SEQ ID NO: 247336 - DNA, 16 bp, Homo sapiens
agaggcagggccctgg

SEQ ID NO: 247337 - DNA, 14 bp, Homo sapiens
agaggcagtggcag

SEQ ID NO: 247338 - DNA, 16 bp, Homo sapiens
agaggcagtggcagca

SEQ ID NO: 247339 - DNA, 17 bp, Homo sapiens
agaggcagtggcagcaa

SEQ ID NO: 247340 - DNA, 15 bp, Homo sapiens
agaggcatgacagct

SEQ ID NO: 247341 - DNA, 23 bp, Homo sapiens
agaggcatttgtcttagagagag

SEQ ID NO: 247342 - DNA, 18 bp, Homo sapiens
agaggccagccccaccca

SEQ ID NO: 247343 - DNA, 21 bp, Homo sapiens
agaggccagccccacccagga

SEQ ID NO: 247344 - DNA, 19 bp, Homo sapiens
agaggccatgattcgccca

SEQ ID NO: 247345 - DNA, 21 bp, Homo sapiens
agaggcctcccccagccagga

SEQ ID NO: 247346 - DNA, 22 bp, Homo sapiens
agaggcctcccccagccaggac

SEQ ID NO: 247347 - DNA, 22 bp, Homo sapiens
agaggcctccctggctgcctct

SEQ ID NO: 247348 - DNA, 13 bp, Homo sapiens
agaggcctgagga

SEQ ID NO: 247349 - DNA, 12 bp, Homo sapiens
agaggccttggg

SEQ ID NO: 247350 - DNA, 18 bp, Homo sapiens
agaggccttgggggtctg

SEQ ID NO: 247351 - DNA, 14 bp, Homo sapiens
agaggcgagccagg

SEQ ID NO: 247352 - DNA, 21 bp, Homo sapiens
agaggcgtcctggtgaggaca

SEQ ID NO: 247353 - DNA, 22 bp, Homo sapiens
agaggcgttagtgggcaggtgg

SEQ ID NO: 247354 - DNA, 16 bp, Homo sapiens
agaggctaagatgaga

SEQ ID NO: 247355 - DNA, 12 bp, Homo sapiens
agaggctagccc

SEQ ID NO: 247356 - DNA, 16 bp, Homo sapiens
agaggctagccccagg

SEQ ID NO: 247357 - DNA, 17 bp, Homo sapiens
agaggctagccccaggg

SEQ ID NO: 247358 - DNA, 14 bp, Homo sapiens
agaggctcctggag

SEQ ID NO: 247359 - DNA, 17 bp, Homo sapiens
agaggctcctggagcca

SEQ ID NO: 247360 - DNA, 20 bp, Homo sapiens
agaggctcctggagccagcc

SEQ ID NO: 247361 - DNA, 15 bp, Homo sapiens
agaggctgagcagga

SEQ ID NO: 247362 - DNA, 18 bp, Homo sapiens
agagggaaatacaaggag

SEQ ID NO: 247363 - DNA, 12 bp, Homo sapiens
agagggaatgtg

SEQ ID NO: 247364 - DNA, 15 bp, Homo sapiens
agagggaatgtgaaa

SEQ ID NO: 247365 - DNA, 19 bp, Homo sapiens
agagggaatgttccctgca

SEQ ID NO: 247366 - DNA, 12 bp, Homo sapiens
agagggacagat

SEQ ID NO: 247367 - DNA, 18 bp, Homo sapiens
agagggaccagctggggg

SEQ ID NO: 247368 - DNA, 23 bp, Homo sapiens
agagggagccggtttgggagaga

SEQ ID NO: 247369 - DNA, 18 bp, Homo sapiens
agagggagtacaaagaca

SEQ ID NO: 247370 - DNA, 20 bp, Homo sapiens
agagggcaggggctgcatcc

SEQ ID NO: 247371 - DNA, 20 bp, Homo sapiens
agagggcagtacctgggaaa

SEQ ID NO: 247372 - DNA, 16 bp, Homo sapiens
agagggcccagctgta

SEQ ID NO: 247373 - DNA, 15 bp, Homo sapiens
agagggcctgtggga

SEQ ID NO: 247374 - DNA, 16 bp, Homo sapiens
agagggcctgtgggag

SEQ ID NO: 247375 - DNA, 22 bp, Homo sapiens
agaggggacttggataggagct

SEQ ID NO: 247376 - DNA, 14 bp, Homo sapiens
agaggggagaggaa

SEQ ID NO: 247377 - DNA, 15 bp, Homo sapiens
agaggggaggggcct

SEQ ID NO: 247378 - DNA, 15 bp, Homo sapiens
agagggggctctcca

SEQ ID NO: 247379 - DNA, 21 bp, Homo sapiens
agaggggtgagacagtggggg

SEQ ID NO: 247380 - DNA, 23 bp, Homo sapiens
agaggggtgcacccactcaccag

SEQ ID NO: 247381 - DNA, 18 bp, Homo sapiens
agaggtacccaaggtcac

SEQ ID NO: 247382 - DNA, 17 bp, Homo sapiens
agaggtgagggaggcct

SEQ ID NO: 247383 - DNA, 18 bp, Homo sapiens
agaggtgagggaggcctg

SEQ ID NO: 247384 - DNA, 14 bp, Homo sapiens
agaggtgctgcttt

SEQ ID NO: 247385 - DNA, 18 bp, Homo sapiens
agaggtgctgctttgctt

SEQ ID NO: 247386 - DNA, 23 bp, Homo sapiens
agaggtgggaggcccctggtggc

SEQ ID NO: 247387 - DNA, 19 bp, Homo sapiens
agaggtgggcagctgggcc

SEQ ID NO: 247388 - DNA, 18 bp, Homo sapiens
agaggtggggaagagagc

SEQ ID NO: 247389 - DNA, 19 bp, Homo sapiens
agaggtggggaagagagcc

SEQ ID NO: 247390 - DNA, 18 bp, Homo sapiens
agaggtgggggatgctga

SEQ ID NO: 247391 - DNA, 22 bp, Homo sapiens
agaggtgggggatgctgaggag

SEQ ID NO: 247392 - DNA, 17 bp, Homo sapiens
agaggtggggtgaagct

SEQ ID NO: 247393 - DNA, 18 bp, Homo sapiens
agaggtggggtgaagctg

SEQ ID NO: 247394 - DNA, 13 bp, Homo sapiens
agaggtgtgtgcc

SEQ ID NO: 247395 - DNA, 20 bp, Homo sapiens
agaggttaaggtgggtccag

SEQ ID NO: 247396 - DNA, 22 bp, Homo sapiens
agaggttaaggtgggtccagga

SEQ ID NO: 247397 - DNA, 17 bp, Homo sapiens
agaggttatctgcctgg

SEQ ID NO: 247398 - DNA, 20 bp, Homo sapiens
agaggttatctgcctggcct

SEQ ID NO: 247399 - DNA, 21 bp, Homo sapiens
agaggttatctgcctggcctg

SEQ ID NO: 247400 - DNA, 17 bp, Homo sapiens
agaggttctcagcaagt

SEQ ID NO: 247401 - DNA, 13 bp, Homo sapiens
agaggttgtgaaa

SEQ ID NO: 247402 - DNA, 19 bp, Homo sapiens
agaggttgtggtgagccga

SEQ ID NO: 247403 - DNA, 18 bp, Homo sapiens
agagtaaatattgtcaca

SEQ ID NO: 247404 - DNA, 16 bp, Homo sapiens
agagtacccccctgag

SEQ ID NO: 247405 - DNA, 17 bp, Homo sapiens
agagtacccccctgaga

SEQ ID NO: 247406 - DNA, 16 bp, Homo sapiens
agagtacttaatatac

SEQ ID NO: 247407 - DNA, 21 bp, Homo sapiens
agagtagatggtgaaatttat

SEQ ID NO: 247408 - DNA, 22 bp, Homo sapiens
agagtagatggtgaaatttatt

SEQ ID NO: 247409 - DNA, 18 bp, Homo sapiens
atgatatttcttgctttc

SEQ ID NO: 247410 - DNA, 12 bp, Homo sapiens
atgatattttat

SEQ ID NO: 247411 - DNA, 20 bp, Homo sapiens
atgatcaaaacctgtgccag

SEQ ID NO: 247412 - DNA, 22 bp, Homo sapiens
atgatcagaactgggaaaacag

SEQ ID NO: 247413 - DNA, 21 bp, Homo sapiens
atgatccatgagtttgccctg

SEQ ID NO: 247414 - DNA, 20 bp, Homo sapiens
atgatccctgtgttgtctct

SEQ ID NO: 247415 - DNA, 19 bp, Homo sapiens
atgatctaggtttaactca

SEQ ID NO: 247416 - DNA, 22 bp, Homo sapiens
atgatctaggtttaactcagat

SEQ ID NO: 247417 - DNA, 12 bp, Homo sapiens
atgatctattgc

SEQ ID NO: 247418 - DNA, 14 bp, Homo sapiens
atgatctgtcaaag

SEQ ID NO: 247419 - DNA, 15 bp, Homo sapiens
atgatcttctttata

SEQ ID NO: 247420 - DNA, 18 bp, Homo sapiens
atgatcttctttataatt

SEQ ID NO: 247421 - DNA, 20 bp, Homo sapiens
atgatgagccttcgtgcccc

SEQ ID NO: 247422 - DNA, 16 bp, Homo sapiens
atgatgattaaacacc

SEQ ID NO: 247423 - DNA, 23 bp, Homo sapiens
atgatgattaaacacctgacaca

SEQ ID NO: 247424 - DNA, 15 bp, Homo sapiens
atgatgattcaatca

SEQ ID NO: 247425 - DNA, 21 bp, Homo sapiens
atgatgcatggagtgtttgac

SEQ ID NO: 247426 - DNA, 15 bp, Homo sapiens
atgatgctgtgacaa

SEQ ID NO: 247427 - DNA, 14 bp, Homo sapiens
atgatgcttactac

SEQ ID NO: 247428 - DNA, 17 bp, Homo sapiens
atgatggatgagaaaaa

SEQ ID NO: 247429 - DNA, 19 bp, Homo sapiens
atgatgtccagaagaatat

SEQ ID NO: 247430 - DNA, 19 bp, Homo sapiens
atgatgtctcttgtagaag

SEQ ID NO: 247431 - DNA, 14 bp, Homo sapiens
atgatgtgttgtga

SEQ ID NO: 247432 - DNA, 19 bp, Homo sapiens
atgattaaacacctgacac

SEQ ID NO: 247433 - DNA, 20 bp, Homo sapiens
atgattaaacacctgacaca

SEQ ID NO: 247434 - DNA, 16 bp, Homo sapiens
atgattaattcacctt

SEQ ID NO: 247435 - DNA, 21 bp, Homo sapiens
atgattagacaatgtggaatt

SEQ ID NO: 247436 - DNA, 21 bp, Homo sapiens
atgattcaacaggttttcctg

SEQ ID NO: 247437 - DNA, 17 bp, Homo sapiens
atgattcacttttattg

SEQ ID NO: 247438 - DNA, 18 bp, Homo sapiens
atgattcacttttattgt

SEQ ID NO: 247439 - DNA, 14 bp, Homo sapiens
atgattcataacaa

SEQ ID NO: 247440 - DNA, 13 bp, Homo sapiens
atgattccaaata

SEQ ID NO: 247441 - DNA, 22 bp, Homo sapiens
atgattccttgatggagatatt

SEQ ID NO: 247442 - DNA, 13 bp, Homo sapiens
atgattctcctct

SEQ ID NO: 247443 - DNA, 16 bp, Homo sapiens
atgattctcctctccc

SEQ ID NO: 247444 - DNA, 14 bp, Homo sapiens
atgattgaaaagaa

SEQ ID NO: 247445 - DNA, 13 bp, Homo sapiens
atgattggattat

SEQ ID NO: 247446 - DNA, 16 bp, Homo sapiens
atgattggattattca

SEQ ID NO: 247447 - DNA, 21 bp, Homo sapiens
atgattggattattcatttaa

SEQ ID NO: 247448 - DNA, 14 bp, Homo sapiens
atgattgtaaaata

SEQ ID NO: 247449 - DNA, 15 bp, Homo sapiens
atgattgtaacatat

SEQ ID NO: 247450 - DNA, 20 bp, Homo sapiens
atgatttaaatagaacttga

SEQ ID NO: 247451 - DNA, 12 bp, Homo sapiens
atgatttaacat

SEQ ID NO: 247452 - DNA, 15 bp, Homo sapiens
atgatttatagtttg

SEQ ID NO: 247453 - DNA, 14 bp, Homo sapiens
atgatttcatttca

SEQ ID NO: 247454 - DNA, 18 bp, Homo sapiens
atgattttgatgcacaac

SEQ ID NO: 247455 - DNA, 21 bp, Homo sapiens
atgatttttaagtacaaaaaa

SEQ ID NO: 247456 - DNA, 22 bp, Homo sapiens
atgatttttagatgagattgtt

SEQ ID NO: 247457 - DNA, 14 bp, Homo sapiens
atgatttttgtgta

SEQ ID NO: 247458 - DNA, 16 bp, Homo sapiens
atgccgtctcatattt

SEQ ID NO: 247459 - DNA, 22 bp, Homo sapiens
atgccgtctcatatttttacaa

SEQ ID NO: 247460 - DNA, 19 bp, Homo sapiens
atgcctatttactggaaac

SEQ ID NO: 247461 - DNA, 16 bp, Homo sapiens
atgcctcacgagattt

SEQ ID NO: 247462 - DNA, 18 bp, Homo sapiens
atgcctcatgccacacct

SEQ ID NO: 247463 - DNA, 22 bp, Homo sapiens
atgcctccctgaccctgcagag

SEQ ID NO: 247464 - DNA, 15 bp, Homo sapiens
atgcctcctctgtcc

SEQ ID NO: 247465 - DNA, 21 bp, Homo sapiens
atgcctgacacaggggacact

SEQ ID NO: 247466 - DNA, 12 bp, Homo sapiens
atgcctgagggt

SEQ ID NO: 247467 - DNA, 15 bp, Homo sapiens
atgcctgagggtgga

SEQ ID NO: 247468 - DNA, 12 bp, Homo sapiens
atgcctgcctga

SEQ ID NO: 247469 - DNA, 12 bp, Homo sapiens
atgcctgtaatc

SEQ ID NO: 247470 - DNA, 20 bp, Homo sapiens
atgcctgtcagtttcatgga

SEQ ID NO: 247471 - DNA, 16 bp, Homo sapiens
atgcctgtccagcctg

SEQ ID NO: 247472 - DNA, 17 bp, Homo sapiens
atgcctgtccagcctgg

SEQ ID NO: 247473 - DNA, 19 bp, Homo sapiens
atgcctgtggtgaagtgtg

SEQ ID NO: 247474 - DNA, 22 bp, Homo sapiens
atgcctgtggtgaagtgtggct

SEQ ID NO: 247475 - DNA, 14 bp, Homo sapiens
atgccttcttattg

SEQ ID NO: 247476 - DNA, 20 bp, Homo sapiens
atgccttcttattgctttta

SEQ ID NO: 247477 - DNA, 20 bp, Homo sapiens
atgcctttaaatctgtgatg

SEQ ID NO: 247478 - DNA, 21 bp, Homo sapiens
atgcctttaaatctgtgatga

SEQ ID NO: 247479 - DNA, 14 bp, Homo sapiens
atgcctttgctgtt

SEQ ID NO: 247480 - DNA, 15 bp, Homo sapiens
atgcctttgtaagtt

SEQ ID NO: 247481 - DNA, 16 bp, Homo sapiens
atgcctttgtaagtta

SEQ ID NO: 247482 - DNA, 17 bp, Homo sapiens
atgcgcaaaactgcctg

SEQ ID NO: 247483 - DNA, 19 bp, Homo sapiens
atgcgctcttcaccaggaa

SEQ ID NO: 247484 - DNA, 20 bp, Homo sapiens
atgcgctcttcaccaggaag

SEQ ID NO: 247485 - DNA, 21 bp, Homo sapiens
atgcgctcttcaccaggaaga

SEQ ID NO: 247486 - DNA, 15 bp, Homo sapiens
atgcggccggcctgg

SEQ ID NO: 247487 - DNA, 16 bp, Homo sapiens
atgcggccggcctggg

SEQ ID NO: 247488 - DNA, 17 bp, Homo sapiens
atgcgggcattttgaat

SEQ ID NO: 247489 - DNA, 19 bp, Homo sapiens
atgcgggctgggcagctgt

SEQ ID NO: 247490 - DNA, 15 bp, Homo sapiens
atgcgtccactttcc

SEQ ID NO: 247491 - DNA, 19 bp, Homo sapiens
atgctaacaaactgaaaaa

SEQ ID NO: 247492 - DNA, 20 bp, Homo sapiens
atgctaagggcaggcccaaa

SEQ ID NO: 247493 - DNA, 14 bp, Homo sapiens
atgctaataaactg

SEQ ID NO: 247494 - DNA, 18 bp, Homo sapiens
atgctacaaaatgtgtgc

SEQ ID NO: 247495 - DNA, 20 bp, Homo sapiens
atgctacctctgatcaaagc

SEQ ID NO: 247496 - DNA, 16 bp, Homo sapiens
atgctactcagtatat

SEQ ID NO: 247497 - DNA, 21 bp, Homo sapiens
atgctactgtcagtgtcctca

SEQ ID NO: 247498 - DNA, 16 bp, Homo sapiens
atgctaggcctgtagt

SEQ ID NO: 247499 - DNA, 18 bp, Homo sapiens
atgctatctcgctagcca

SEQ ID NO: 247500 - DNA, 19 bp, Homo sapiens
atgctatctcgctagccat

SEQ ID NO: 247501 - DNA, 19 bp, Homo sapiens
atgctcaaagatgtaatgt

SEQ ID NO: 247502 - DNA, 17 bp, Homo sapiens
atgctcaacccccctcc

SEQ ID NO: 247503 - DNA, 22 bp, Homo sapiens
atgctcaacccccctcccagac

SEQ ID NO: 247504 - DNA, 15 bp, Homo sapiens
atgctcaatgtgctg

SEQ ID NO: 247505 - DNA, 18 bp, Homo sapiens
atgctcacctctagcctt

SEQ ID NO: 247506 - DNA, 20 bp, Homo sapiens
atgctccagccaacccctgt

SEQ ID NO: 247507 - DNA, 22 bp, Homo sapiens
atgctcccccatcctccccttc

SEQ ID NO: 247508 - DNA, 19 bp, Homo sapiens
atgctccctcccctgccct

SEQ ID NO: 247509 - DNA, 15 bp, Homo sapiens
atgctccttgttcct

SEQ ID NO: 247510 - DNA, 12 bp, Homo sapiens
atgctctaacaa

SEQ ID NO: 247511 - DNA, 16 bp, Homo sapiens
atgctctacttctttt

SEQ ID NO: 247512 - DNA, 20 bp, Homo sapiens
atgctctctatagaggagga

SEQ ID NO: 247513 - DNA, 13 bp, Homo sapiens
atgctctgcccca

SEQ ID NO: 247514 - DNA, 13 bp, Homo sapiens
atgctctgtgcca

SEQ ID NO: 247515 - DNA, 18 bp, Homo sapiens
atgctgaaataaactagg

SEQ ID NO: 247516 - DNA, 18 bp, Homo sapiens
atgctgaatatctgttca

SEQ ID NO: 247517 - DNA, 16 bp, Homo sapiens
atgctgaattgaacat

SEQ ID NO: 247518 - DNA, 19 bp, Homo sapiens
atgctgactgtactcctcc

SEQ ID NO: 247519 - DNA, 19 bp, Homo sapiens
atgctgcctaggctgacct

SEQ ID NO: 247520 - DNA, 11 bp, Homo sapiens
atgctgcctgc

SEQ ID NO: 247521 - DNA, 12 bp, Homo sapiens
atgctgcctgcc

SEQ ID NO: 247522 - DNA, 13 bp, Homo sapiens
atgctgcctgcct

SEQ ID NO: 247523 - DNA, 21 bp, Homo sapiens
atgctgcctgcctccggccct

SEQ ID NO: 247524 - DNA, 14 bp, Homo sapiens
atgctgcctgcctg

SEQ ID NO: 247525 - DNA, 19 bp, Homo sapiens
atgctgcgcccttccccag

SEQ ID NO: 247526 - DNA, 13 bp, Homo sapiens
atgctgctactta

SEQ ID NO: 247527 - DNA, 12 bp, Homo sapiens
atgctgctgtga

SEQ ID NO: 247528 - DNA, 19 bp, Homo sapiens
atgctgctgtgaatttttt

SEQ ID NO: 247529 - DNA, 19 bp, Homo sapiens
atgctgctttttggcacag

SEQ ID NO: 247530 - DNA, 20 bp, Homo sapiens
atgctgctttttggcacagt

SEQ ID NO: 247531 - DNA, 12 bp, Homo sapiens
atgctggagagg

SEQ ID NO: 247532 - DNA, 11 bp, Homo sapiens
atgctggagcg

SEQ ID NO: 247533 - DNA, 23 bp, Homo sapiens
atgctggccagcctggggcctgg

SEQ ID NO: 247534 - DNA, 12 bp, Homo sapiens
atgctggcccca

SEQ ID NO: 247535 - DNA, 17 bp, Homo sapiens
atgctggggtacacagt

SEQ ID NO: 247536 - DNA, 22 bp, Homo sapiens
atgctgtaactttctgaaataa

SEQ ID NO: 247537 - DNA, 14 bp, Homo sapiens
atgctgtatatgtt

SEQ ID NO: 247538 - DNA, 11 bp, Homo sapiens
atgctgtgaca

SEQ ID NO: 247539 - DNA, 21 bp, Homo sapiens
atgctgtgacaataagtttga

SEQ ID NO: 247540 - DNA, 13 bp, Homo sapiens
atgcttaatttct

SEQ ID NO: 247541 - DNA, 14 bp, Homo sapiens
atgcttaatttcta

SEQ ID NO: 247542 - DNA, 15 bp, Homo sapiens
atgcttaatttctaa

SEQ ID NO: 247543 - DNA, 13 bp, Homo sapiens
atgcttactattt

SEQ ID NO: 247544 - DNA, 15 bp, Homo sapiens
atgcttactcttgct

SEQ ID NO: 247545 - DNA, 15 bp, Homo sapiens
atgcttagagcatgt

SEQ ID NO: 247546 - DNA, 19 bp, Homo sapiens
atgcttatcatctaaagat

SEQ ID NO: 247547 - DNA, 16 bp, Homo sapiens
atgcttcaagtgttgc

SEQ ID NO: 247548 - DNA, 14 bp, Homo sapiens
atgcttcagttgta

SEQ ID NO: 247549 - DNA, 15 bp, Homo sapiens
atgcttcatgaaaat

SEQ ID NO: 247550 - DNA, 22 bp, Homo sapiens
atgcttcatgaaaatcctacca

SEQ ID NO: 247551 - DNA, 15 bp, Homo sapiens
atgcttcctgacaat

SEQ ID NO: 247552 - DNA, 20 bp, Homo sapiens
atgcttcctgacaatcaact

SEQ ID NO: 247553 - DNA, 10 bp, Homo sapiens
agatcccaaa

SEQ ID NO: 247554 - DNA, 20 bp, Homo sapiens
agatcccaagtcaaacagtg

SEQ ID NO: 247555 - DNA, 22 bp, Homo sapiens
agatcccagaaggacctcctga

SEQ ID NO: 247556 - DNA, 21 bp, Homo sapiens
agatcccatccatcagctccc

SEQ ID NO: 247557 - DNA, 13 bp, Homo sapiens
agatccccgccac

SEQ ID NO: 247558 - DNA, 19 bp, Homo sapiens
agatccctcggtcagcacc

SEQ ID NO: 247559 - DNA, 20 bp, Homo sapiens
agatccctcggtcagcaccg

SEQ ID NO: 247560 - DNA, 15 bp, Homo sapiens
agatccgcatgtgtc

SEQ ID NO: 247561 - DNA, 23 bp, Homo sapiens
agatccgcatgtgtctgtattca

SEQ ID NO: 247562 - DNA, 15 bp, Homo sapiens
agatcctacccctga

SEQ ID NO: 247563 - DNA, 13 bp, Homo sapiens
agatcctgcaccc

SEQ ID NO: 247564 - DNA, 12 bp, Homo sapiens
agatcctgctgc

SEQ ID NO: 247565 - DNA, 13 bp, Homo sapiens
agatcctgctgcc

SEQ ID NO: 247566 - DNA, 12 bp, Homo sapiens
agatccttcaca

SEQ ID NO: 247567 - DNA, 16 bp, Homo sapiens
agatccttcacaggca

SEQ ID NO: 247568 - DNA, 23 bp, Homo sapiens
agatccttcacaggcagtgcatg

SEQ ID NO: 247569 - DNA, 17 bp, Homo sapiens
agatcctttcaaaagaa

SEQ ID NO: 247570 - DNA, 19 bp, Homo sapiens
agatcgcttgagcccagga

SEQ ID NO: 247571 - DNA, 15 bp, Homo sapiens
agatcggggccagag

SEQ ID NO: 247572 - DNA, 17 bp, Homo sapiens
agatcggggccagaggc

SEQ ID NO: 247573 - DNA, 16 bp, Homo sapiens
agatcgttagtatcta

SEQ ID NO: 247574 - DNA, 16 bp, Homo sapiens
agatcgttctgccact

SEQ ID NO: 247575 - DNA, 14 bp, Homo sapiens
agatctataaagcg

SEQ ID NO: 247576 - DNA, 13 bp, Homo sapiens
agatctcctgtaa

SEQ ID NO: 247577 - DNA, 12 bp, Homo sapiens
agatctgagccc

SEQ ID NO: 247578 - DNA, 13 bp, Homo sapiens
agatctgagccct

SEQ ID NO: 247579 - DNA, 20 bp, Homo sapiens
agatctgatggtgagctggg

SEQ ID NO: 247580 - DNA, 12 bp, Homo sapiens
agatctgcctgg

SEQ ID NO: 247581 - DNA, 13 bp, Homo sapiens
agatctgcctggg

SEQ ID NO: 247582 - DNA, 17 bp, Homo sapiens
agatctgcctgggcctg

SEQ ID NO: 247583 - DNA, 24 bp, Homo sapiens
agatctgcctgggcctgtgcagca

SEQ ID NO: 247584 - DNA, 12 bp, Homo sapiens
agatctgtgccc

SEQ ID NO: 247585 - DNA, 13 bp, Homo sapiens
agatctgtgcccc

SEQ ID NO: 247586 - DNA, 19 bp, Homo sapiens
agatctgtgccccatgcct

SEQ ID NO: 247587 - DNA, 14 bp, Homo sapiens
agatcttaaatttt

SEQ ID NO: 247588 - DNA, 17 bp, Homo sapiens
agatcttctgaaatgaa

SEQ ID NO: 247589 - DNA, 17 bp, Homo sapiens
agatcttgagagctgct

SEQ ID NO: 247590 - DNA, 16 bp, Homo sapiens
agattcctacttaaac

SEQ ID NO: 247591 - DNA, 18 bp, Homo sapiens
agattcctacttaaacaa

SEQ ID NO: 247592 - DNA, 20 bp, Homo sapiens
agattcctacttaaacaaaa

SEQ ID NO: 247593 - DNA, 17 bp, Homo sapiens
agattcctgggcctgtc

SEQ ID NO: 247594 - DNA, 16 bp, Homo sapiens
agattctccaaatgat

SEQ ID NO: 247595 - DNA, 15 bp, Homo sapiens
agattctgggaaagg

SEQ ID NO: 247596 - DNA, 19 bp, Homo sapiens
agattctgggaaaggtgct

SEQ ID NO: 247597 - DNA, 18 bp, Homo sapiens
agattctttaaactactg

SEQ ID NO: 247598 - DNA, 22 bp, Homo sapiens
agattctttaaactactgaact

SEQ ID NO: 247599 - DNA, 19 bp, Homo sapiens
agattgctgaattaaggat

SEQ ID NO: 247600 - DNA, 15 bp, Homo sapiens
agattgctgcttctg

SEQ ID NO: 247601 - DNA, 17 bp, Homo sapiens
agattgcttctgtagta

SEQ ID NO: 247602 - DNA, 23 bp, Homo sapiens
agattggacataactgacttagt

SEQ ID NO: 247603 - DNA, 23 bp, Homo sapiens
agattggcatggctttatttgtt

SEQ ID NO: 247604 - DNA, 18 bp, Homo sapiens
agattggctttgccttta

SEQ ID NO: 247605 - DNA, 18 bp, Homo sapiens
agattgggggccctgggg

SEQ ID NO: 247606 - DNA, 21 bp, Homo sapiens
agattgtccagtgcaaccaca

SEQ ID NO: 247607 - DNA, 18 bp, Homo sapiens
agattgtgaatatttcca

SEQ ID NO: 247608 - DNA, 12 bp, Homo sapiens
agattgtgtctg

SEQ ID NO: 247609 - DNA, 20 bp, Homo sapiens
agattgtgtctggtcgtttg

SEQ ID NO: 247610 - DNA, 22 bp, Homo sapiens
agattgttttatcatgacatgt

SEQ ID NO: 247611 - DNA, 20 bp, Homo sapiens
agatttaagcacaaacttta

SEQ ID NO: 247612 - DNA, 20 bp, Homo sapiens
agatttaccctttatagaac

SEQ ID NO: 247613 - DNA, 22 bp, Homo sapiens
agatttaccttttctgttgtac

SEQ ID NO: 247614 - DNA, 22 bp, Homo sapiens
agatttctagaaaagcttccta

SEQ ID NO: 247615 - DNA, 17 bp, Homo sapiens
agatttgaactcttcaa

SEQ ID NO: 247616 - DNA, 12 bp, Homo sapiens
agatttgtattt

SEQ ID NO: 247617 - DNA, 15 bp, Homo sapiens
agattttaatcaaat

SEQ ID NO: 247618 - DNA, 16 bp, Homo sapiens
agattttaatcaaatt

SEQ ID NO: 247619 - DNA, 17 bp, Homo sapiens
agattttaattttgaat

SEQ ID NO: 247620 - DNA, 19 bp, Homo sapiens
agattttacaaaagatgta

SEQ ID NO: 247621 - DNA, 15 bp, Homo sapiens
agattttaggtgttg

SEQ ID NO: 247622 - DNA, 12 bp, Homo sapiens
agattttcagaa

SEQ ID NO: 247623 - DNA, 20 bp, Homo sapiens
agattttctattatggaaat

SEQ ID NO: 247624 - DNA, 13 bp, Homo sapiens
agatttttagatt

SEQ ID NO: 247625 - DNA, 21 bp, Homo sapiens
agcaaaaactagtaaagacat

SEQ ID NO: 247626 - DNA, 16 bp, Homo sapiens
agcaaaaatgccaggc

SEQ ID NO: 247627 - DNA, 20 bp, Homo sapiens
agcaaaaccattgcttcact

SEQ ID NO: 247628 - DNA, 12 bp, Homo sapiens
agcaaaactgca

SEQ ID NO: 247629 - DNA, 13 bp, Homo sapiens
agcaaaaggatga

SEQ ID NO: 247630 - DNA, 14 bp, Homo sapiens
agcaaaaggcagct

SEQ ID NO: 247631 - DNA, 22 bp, Homo sapiens
agcaaaaggcagctcacccctg

SEQ ID NO: 247632 - DNA, 24 bp, Homo sapiens
agcaaaatatgccccttcttgggc

SEQ ID NO: 247633 - DNA, 14 bp, Homo sapiens
agcaaacctgcccc

SEQ ID NO: 247634 - DNA, 19 bp, Homo sapiens
agcaaactgaagcccacag

SEQ ID NO: 247635 - DNA, 13 bp, Homo sapiens
agcaaagatcaaa

SEQ ID NO: 247636 - DNA, 14 bp, Homo sapiens
agcaaagcttggtg

SEQ ID NO: 247637 - DNA, 22 bp, Homo sapiens
agcaaagcttggtgtcttggca

SEQ ID NO: 247638 - DNA, 18 bp, Homo sapiens
agcaaaggagacaaagca

SEQ ID NO: 247639 - DNA, 21 bp, Homo sapiens
agcaaaggagacaaagcagga

SEQ ID NO: 247640 - DNA, 23 bp, Homo sapiens
agcaaaggagacaaagcaggagt

SEQ ID NO: 247641 - DNA, 20 bp, Homo sapiens
agcaaagtctaaagtttaca

SEQ ID NO: 247642 - DNA, 22 bp, Homo sapiens
agcaaagtctaaagtttacagt

SEQ ID NO: 247643 - DNA, 15 bp, Homo sapiens
agcaaagttttcaga

SEQ ID NO: 247644 - DNA, 16 bp, Homo sapiens
agcaaatcagacacaa

SEQ ID NO: 247645 - DNA, 22 bp, Homo sapiens
agcaaatcagacacaattagag

SEQ ID NO: 247646 - DNA, 21 bp, Homo sapiens
agcaaatgagatgtatgccca

SEQ ID NO: 247647 - DNA, 21 bp, Homo sapiens
agcaaatttctagatatgaga

SEQ ID NO: 247648 - DNA, 19 bp, Homo sapiens
agcaacaaaggatttgaaa

SEQ ID NO: 247649 - DNA, 14 bp, Homo sapiens
agcaacaacttact

SEQ ID NO: 247650 - DNA, 12 bp, Homo sapiens
agcaacatgaat

SEQ ID NO: 247651 - DNA, 22 bp, Homo sapiens
agcaacccctgtacccagctcc

SEQ ID NO: 247652 - DNA, 16 bp, Homo sapiens
agcaaccctacagtat

SEQ ID NO: 247653 - DNA, 22 bp, Homo sapiens
agcaacctatttgactgcttca

SEQ ID NO: 247654 - DNA, 13 bp, Homo sapiens
agcaacctcccaa

SEQ ID NO: 247655 - DNA, 16 bp, Homo sapiens
agcaaccttaaagcaa

SEQ ID NO: 247656 - DNA, 19 bp, Homo sapiens
agcaaccttaaagcaataa

SEQ ID NO: 247657 - DNA, 15 bp, Homo sapiens
agcaactgtgcagca

SEQ ID NO: 247658 - DNA, 17 bp, Homo sapiens
agcaactgtgcagcacc

SEQ ID NO: 247659 - DNA, 20 bp, Homo sapiens
agcaactgttagctgggaag

SEQ ID NO: 247660 - DNA, 15 bp, Homo sapiens
agcaacttgtctttt

SEQ ID NO: 247661 - DNA, 19 bp, Homo sapiens
agcaactttccaacttttc

SEQ ID NO: 247662 - DNA, 18 bp, Homo sapiens
agcaactttgatggaaga

SEQ ID NO: 247663 - DNA, 15 bp, Homo sapiens
agcaagaagattcta

SEQ ID NO: 247664 - DNA, 21 bp, Homo sapiens
agcaagaataaaaaagaaatc

SEQ ID NO: 247665 - DNA, 16 bp, Homo sapiens
agcaagacgtcctgga

SEQ ID NO: 247666 - DNA, 14 bp, Homo sapiens
agcaaggacattgc

SEQ ID NO: 247667 - DNA, 16 bp, Homo sapiens
agcaaggacattgccc

SEQ ID NO: 247668 - DNA, 23 bp, Homo sapiens
agcaaggacattgccccaagata

SEQ ID NO: 247669 - DNA, 22 bp, Homo sapiens
agcaaggcaagaagtgggattc

SEQ ID NO: 247670 - DNA, 17 bp, Homo sapiens
agcaaggcacaggctcc

SEQ ID NO: 247671 - DNA, 11 bp, Homo sapiens
agcaaggcctt

SEQ ID NO: 247672 - DNA, 13 bp, Homo sapiens
agcaaggctgggt

SEQ ID NO: 247673 - DNA, 18 bp, Homo sapiens
agcaagggctccagcatc

SEQ ID NO: 247674 - DNA, 16 bp, Homo sapiens
agcaaggggctctgcc

SEQ ID NO: 247675 - DNA, 14 bp, Homo sapiens
agcaagtatattta

SEQ ID NO: 247676 - DNA, 20 bp, Homo sapiens
agcaagtcccagacaaggag

SEQ ID NO: 247677 - DNA, 16 bp, Homo sapiens
agcaagtgctgagtct

SEQ ID NO: 247678 - DNA, 19 bp, Homo sapiens
agcaagtgtgcactccagc

SEQ ID NO: 247679 - DNA, 15 bp, Homo sapiens
agcaataaatgaatg

SEQ ID NO: 247680 - DNA, 16 bp, Homo sapiens
agcaatatattaccag

SEQ ID NO: 247681 - DNA, 23 bp, Homo sapiens
agcaatatattaccagcaagaat

SEQ ID NO: 247682 - DNA, 12 bp, Homo sapiens
agcaatatttat

SEQ ID NO: 247683 - DNA, 13 bp, Homo sapiens
agcaatatttata

SEQ ID NO: 247684 - DNA, 17 bp, Homo sapiens
agcaatcctcctgagtg

SEQ ID NO: 247685 - DNA, 13 bp, Homo sapiens
agcaatcttgctg

SEQ ID NO: 247686 - DNA, 14 bp, Homo sapiens
agcaatcttgctgt

SEQ ID NO: 247687 - DNA, 20 bp, Homo sapiens
agcaatgggactggagtcag

SEQ ID NO: 247688 - DNA, 21 bp, Homo sapiens
agcaatgggactggagtcaga

SEQ ID NO: 247689 - DNA, 17 bp, Homo sapiens
agcaattatttaaagaa

SEQ ID NO: 247690 - DNA, 22 bp, Homo sapiens
agcaattctcctgcctcagcct

SEQ ID NO: 247691 - DNA, 14 bp, Homo sapiens
agcaattgccctgt

SEQ ID NO: 247692 - DNA, 15 bp, Homo sapiens
agcaattgccctgta

SEQ ID NO: 247693 - DNA, 18 bp, Homo sapiens
agcaattgctgcatctta

SEQ ID NO: 247694 - DNA, 20 bp, Homo sapiens
agcaattgctgcatcttagt

SEQ ID NO: 247695 - DNA, 20 bp, Homo sapiens
atggcgtaatgggcctgccc

SEQ ID NO: 247696 - DNA, 19 bp, Homo sapiens
atggcgtgtcccctgcctg

SEQ ID NO: 247697 - DNA, 17 bp, Homo sapiens
atggctaaggcaccagc

SEQ ID NO: 247698 - DNA, 23 bp, Homo sapiens
atggctagtactgtattggctct

SEQ ID NO: 247699 - DNA, 13 bp, Homo sapiens
atggctataaata

SEQ ID NO: 247700 - DNA, 21 bp, Homo sapiens
atggctataaatatataaaaa

SEQ ID NO: 247701 - DNA, 12 bp, Homo sapiens
atggctcaggca

SEQ ID NO: 247702 - DNA, 16 bp, Homo sapiens
atggctcaggcaagcc

SEQ ID NO: 247703 - DNA, 23 bp, Homo sapiens
atggctccagtctgctgccctcc

SEQ ID NO: 247704 - DNA, 14 bp, Homo sapiens
atggctcctgtctg

SEQ ID NO: 247705 - DNA, 18 bp, Homo sapiens
atggctcctgtctggctc

SEQ ID NO: 247706 - DNA, 19 bp, Homo sapiens
atggctgggagggggccct

SEQ ID NO: 247707 - DNA, 16 bp, Homo sapiens
atggctgtatttttag

SEQ ID NO: 247708 - DNA, 15 bp, Homo sapiens
atggctgtgcctctg

SEQ ID NO: 247709 - DNA, 19 bp, Homo sapiens
atggctgttatctgtcttt

SEQ ID NO: 247710 - DNA, 20 bp, Homo sapiens
atggctgttatctgtcttta

SEQ ID NO: 247711 - DNA, 16 bp, Homo sapiens
atggcttaaaaatact

SEQ ID NO: 247712 - DNA, 14 bp, Homo sapiens
atggcttattgtgt

SEQ ID NO: 247713 - DNA, 13 bp, Homo sapiens
atggcttcctgag

SEQ ID NO: 247714 - DNA, 17 bp, Homo sapiens
atggcttctatgatcag

SEQ ID NO: 247715 - DNA, 13 bp, Homo sapiens
atggcttgacatg

SEQ ID NO: 247716 - DNA, 19 bp, Homo sapiens
atggcttgtagggtgaggc

SEQ ID NO: 247717 - DNA, 20 bp, Homo sapiens
atggctttatttgttttttt

SEQ ID NO: 247718 - DNA, 16 bp, Homo sapiens
atgggaacaagtgtac

SEQ ID NO: 247719 - DNA, 17 bp, Homo sapiens
atgggaacaagtgtaca

SEQ ID NO: 247720 - DNA, 14 bp, Homo sapiens
agggagttcatctg

SEQ ID NO: 247721 - DNA, 18 bp, Homo sapiens
agggatcagccctgccct

SEQ ID NO: 247722 - DNA, 16 bp, Homo sapiens
agggatctggggaagg

SEQ ID NO: 247723 - DNA, 18 bp, Homo sapiens
agggatgcaggtgggccg

SEQ ID NO: 247724 - DNA, 15 bp, Homo sapiens
agggatggaaaagga

SEQ ID NO: 247725 - DNA, 17 bp, Homo sapiens
agggatgggatttcatg

SEQ ID NO: 247726 - DNA, 15 bp, Homo sapiens
agggatggggagcag

SEQ ID NO: 247727 - DNA, 17 bp, Homo sapiens
agggattaacctctgca

SEQ ID NO: 247728 - DNA, 19 bp, Homo sapiens
agggattaacctctgcact

SEQ ID NO: 247729 - DNA, 15 bp, Homo sapiens
agggattcaggctgc

SEQ ID NO: 247730 - DNA, 13 bp, Homo sapiens
agggattctggga

SEQ ID NO: 247731 - DNA, 23 bp, Homo sapiens
agggattctgggcttggggtgtg

SEQ ID NO: 247732 - DNA, 19 bp, Homo sapiens
agggcacctcttgtgctga

SEQ ID NO: 247733 - DNA, 19 bp, Homo sapiens
agggcactctctgccagct

SEQ ID NO: 247734 - DNA, 20 bp, Homo sapiens
agggcactctctgccagctc

SEQ ID NO: 247735 - DNA, 14 bp, Homo sapiens
agggcactggtggc

SEQ ID NO: 247736 - DNA, 20 bp, Homo sapiens
agggcagagccatgggcctg

SEQ ID NO: 247737 - DNA, 13 bp, Homo sapiens
agggcagcccctc

SEQ ID NO: 247738 - DNA, 17 bp, Homo sapiens
agggcagcccctcccca

SEQ ID NO: 247739 - DNA, 18 bp, Homo sapiens
agggcagcctgtgggaga

SEQ ID NO: 247740 - DNA, 16 bp, Homo sapiens
agggcaggaaggagag

SEQ ID NO: 247741 - DNA, 15 bp, Homo sapiens
agggcaggcagagct

SEQ ID NO: 247742 - DNA, 16 bp, Homo sapiens
agggcaggcagagctc

SEQ ID NO: 247743 - DNA, 17 bp, Homo sapiens
agggcaggcagagctca

SEQ ID NO: 247744 - DNA, 20 bp, Homo sapiens
agggcaggcccaaattatca

SEQ ID NO: 247745 - DNA, 15 bp, Homo sapiens
agggcagggctctga

SEQ ID NO: 247746 - DNA, 16 bp, Homo sapiens
agggcagggctctgat

SEQ ID NO: 247747 - DNA, 22 bp, Homo sapiens
agggcaggggctgcatcctcag

SEQ ID NO: 247748 - DNA, 18 bp, Homo sapiens
agggcagggtgggcagcc

SEQ ID NO: 247749 - DNA, 23 bp, Homo sapiens
agggcagggtgggcagcctatgg

SEQ ID NO: 247750 - DNA, 18 bp, Homo sapiens
agggcagggttctagaag

SEQ ID NO: 247751 - DNA, 17 bp, Homo sapiens
agggcagtacctgggaa

SEQ ID NO: 247752 - DNA, 23 bp, Homo sapiens
agggcagtggcacgatctcagct

SEQ ID NO: 247753 - DNA, 22 bp, Homo sapiens
agggcagtgtggtgggaggggt

SEQ ID NO: 247754 - DNA, 23 bp, Homo sapiens
agggcatcagctttccctggctc

SEQ ID NO: 247755 - DNA, 22 bp, Homo sapiens
agggcatgtgatattttcacat

SEQ ID NO: 247756 - DNA, 17 bp, Homo sapiens
agggccagaaggagggc

SEQ ID NO: 247757 - DNA, 22 bp, Homo sapiens
agggccagaaggagggcagagc

SEQ ID NO: 247758 - DNA, 16 bp, Homo sapiens
agggccagagcctggt

SEQ ID NO: 247759 - DNA, 13 bp, Homo sapiens
agggccagggttg

SEQ ID NO: 247760 - DNA, 19 bp, Homo sapiens
agggccagtcctgcctggc

SEQ ID NO: 247761 - DNA, 23 bp, Homo sapiens
agggccatacttttgagaggggt

SEQ ID NO: 247762 - DNA, 23 bp, Homo sapiens
agggcccacttgtatcctctggt

SEQ ID NO: 247763 - DNA, 13 bp, Homo sapiens
agggcccagaggg

SEQ ID NO: 247764 - DNA, 17 bp, Homo sapiens
agggcccagctgtagcc

SEQ ID NO: 247765 - DNA, 23 bp, Homo sapiens
agggcccagctgtagccatggct

SEQ ID NO: 247766 - DNA, 12 bp, Homo sapiens
agggcccaggag

SEQ ID NO: 247767 - DNA, 17 bp, Homo sapiens
agggcccaggcctggag

SEQ ID NO: 247768 - DNA, 13 bp, Homo sapiens
agggcccatctgc

SEQ ID NO: 247769 - DNA, 21 bp, Homo sapiens
agggccccccaaatcccaggg

SEQ ID NO: 247770 - DNA, 18 bp, Homo sapiens
agggcccctctgcccagc

SEQ ID NO: 247771 - DNA, 12 bp, Homo sapiens
agggcccctgcg

SEQ ID NO: 247772 - DNA, 19 bp, Homo sapiens
agggcccctgcgtgggggc

SEQ ID NO: 247773 - DNA, 16 bp, Homo sapiens
agggcctactgccacc

SEQ ID NO: 247774 - DNA, 17 bp, Homo sapiens
agggcctcacctttccc

SEQ ID NO: 247775 - DNA, 13 bp, Homo sapiens
agggcctcagaga

SEQ ID NO: 247776 - DNA, 15 bp, Homo sapiens
agggcctcagagaca

SEQ ID NO: 247777 - DNA, 15 bp, Homo sapiens
agggcctccagccct

SEQ ID NO: 247778 - DNA, 20 bp, Homo sapiens
agggcctctggtgttcctgg

SEQ ID NO: 247779 - DNA, 11 bp, Homo sapiens
agggcctggcc

SEQ ID NO: 247780 - DNA, 12 bp, Homo sapiens
agggcctggcct

SEQ ID NO: 247781 - DNA, 13 bp, Homo sapiens
agggcctggcctg

SEQ ID NO: 247782 - DNA, 20 bp, Homo sapiens
agggcgaggcgggggagcct

SEQ ID NO: 247783 - DNA, 21 bp, Homo sapiens
agggcgaggcgggggagcctg

SEQ ID NO: 247784 - DNA, 21 bp, Homo sapiens
agggcgcccattcgtctgtcc

SEQ ID NO: 247785 - DNA, 20 bp, Homo sapiens
agggcgctccggcagaggca

SEQ ID NO: 247786 - DNA, 23 bp, Homo sapiens
agggcgctccggcagaggcaggg

SEQ ID NO: 247787 - DNA, 15 bp, Homo sapiens
agggcgctgagggca

SEQ ID NO: 247788 - DNA, 18 bp, Homo sapiens
agggcgctgagggcaggg

SEQ ID NO: 247789 - DNA, 17 bp, Homo sapiens
agggcggccagggacag

SEQ ID NO: 247790 - DNA, 20 bp, Homo sapiens
agggcggcccctctgttctg

SEQ ID NO: 247791 - DNA, 23 bp, Homo sapiens
agggcggctaggccggccagctc

SEQ ID NO: 247792 - DNA, 14 bp, Homo sapiens
agggcgggccagga

SEQ ID NO: 247793 - DNA, 19 bp, Homo sapiens
agggctaccctcccccagg

SEQ ID NO: 247794 - DNA, 16 bp, Homo sapiens
agggctagcatccctg

SEQ ID NO: 247795 - DNA, 22 bp, Homo sapiens
agggctagtgacttgtgtccca

SEQ ID NO: 247796 - DNA, 14 bp, Homo sapiens
agggctatggcaag

SEQ ID NO: 247797 - DNA, 20 bp, Homo sapiens
agggctccacgggggcctag

SEQ ID NO: 247798 - DNA, 13 bp, Homo sapiens
agggctccagcat

SEQ ID NO: 247799 - DNA, 17 bp, Homo sapiens
agggctccagggccagg

SEQ ID NO: 247800 - DNA, 19 bp, Homo sapiens
agggctcccggagagggag

SEQ ID NO: 247801 - DNA, 18 bp, Homo sapiens
agggctccctcctggagc

SEQ ID NO: 247802 - DNA, 20 bp, Homo sapiens
agggctccctcctggagcat

SEQ ID NO: 247803 - DNA, 22 bp, Homo sapiens
agggctccctcctggagcatcc

SEQ ID NO: 247804 - DNA, 19 bp, Homo sapiens
aaagctggacaagaagctg

SEQ ID NO: 247805 - DNA, 16 bp, Homo sapiens
aaagctgtgtctctgt

SEQ ID NO: 247806 - DNA, 19 bp, Homo sapiens
aaagctgtgtctttaggga

SEQ ID NO: 247807 - DNA, 19 bp, Homo sapiens
aaagcttaaattgcttttg

SEQ ID NO: 247808 - DNA, 14 bp, Homo sapiens
aaagctttcctgcc

SEQ ID NO: 247809 - DNA, 15 bp, Homo sapiens
aaagctttcctggag

SEQ ID NO: 247810 - DNA, 20 bp, Homo sapiens
actctagcctgggccagaga

SEQ ID NO: 247811 - DNA, 16 bp, Homo sapiens
actctagtgacttcct

SEQ ID NO: 247812 - DNA, 18 bp, Homo sapiens
actctatagactctagga

SEQ ID NO: 247813 - DNA, 22 bp, Homo sapiens
actctattttttactacataat

SEQ ID NO: 247814 - DNA, 16 bp, Homo sapiens
actctcaaaagtctat

SEQ ID NO: 247815 - DNA, 14 bp, Homo sapiens
actctcacatgtgg

SEQ ID NO: 247816 - DNA, 16 bp, Homo sapiens
actctcacatgtggca

SEQ ID NO: 247817 - DNA, 19 bp, Homo sapiens
actctcagagactcccagg

SEQ ID NO: 247818 - DNA, 22 bp, Homo sapiens
actctcagtgcttcttactatt

SEQ ID NO: 247819 - DNA, 20 bp, Homo sapiens
actctccaggattgtccaca

SEQ ID NO: 247820 - DNA, 23 bp, Homo sapiens
actctcccagaggctcctggagc

SEQ ID NO: 247821 - DNA, 15 bp, Homo sapiens
actctccccacacta

SEQ ID NO: 247822 - DNA, 11 bp, Homo sapiens
actctccccag

SEQ ID NO: 247823 - DNA, 18 bp, Homo sapiens
actctccccagtgcctgc

SEQ ID NO: 247824 - DNA, 15 bp, Homo sapiens
actctcctcatctct

SEQ ID NO: 247825 - DNA, 19 bp, Homo sapiens
actctcctcggccccctcc

SEQ ID NO: 247826 - DNA, 22 bp, Homo sapiens
actctcctcggccccctccatc

SEQ ID NO: 247827 - DNA, 19 bp, Homo sapiens
actctcctctttttttaaa

SEQ ID NO: 247828 - DNA, 18 bp, Homo sapiens
actctcctgctcctcagg

SEQ ID NO: 247829 - DNA, 14 bp, Homo sapiens
actctcctgggccc

SEQ ID NO: 247830 - DNA, 15 bp, Homo sapiens
actctcctgggcccc

SEQ ID NO: 247831 - DNA, 18 bp, Homo sapiens
actctccttcgtgtctct

SEQ ID NO: 247832 - DNA, 22 bp, Homo sapiens
actctccttcgtgtctctccca

SEQ ID NO: 247833 - DNA, 14 bp, Homo sapiens
actctcggggccct

SEQ ID NO: 247834 - DNA, 17 bp, Homo sapiens
actctcggggcccttgg

SEQ ID NO: 247835 - DNA, 20 bp, Homo sapiens
actctctagttccctcagtg

SEQ ID NO: 247836 - DNA, 12 bp, Homo sapiens
actctctgctct

SEQ ID NO: 247837 - DNA, 19 bp, Homo sapiens
actctctgctctagccagg

SEQ ID NO: 247838 - DNA, 18 bp, Homo sapiens
actctctgggactctcct

SEQ ID NO: 247839 - DNA, 21 bp, Homo sapiens
actctctgggactctcctcct

SEQ ID NO: 247840 - DNA, 16 bp, Homo sapiens
actctctgtcttctct

SEQ ID NO: 247841 - DNA, 15 bp, Homo sapiens
actctctttcttcca

SEQ ID NO: 247842 - DNA, 22 bp, Homo sapiens
actctgaaaagcaattgccctg

SEQ ID NO: 247843 - DNA, 21 bp, Homo sapiens
actctgaagtcccttcctgtc

SEQ ID NO: 247844 - DNA, 14 bp, Homo sapiens
actctgacataaac

SEQ ID NO: 247845 - DNA, 21 bp, Homo sapiens
actctgagtttaccatttgta

SEQ ID NO: 247846 - DNA, 15 bp, Homo sapiens
actctgcactactcc

SEQ ID NO: 247847 - DNA, 19 bp, Homo sapiens
actctgcactatagccatt

SEQ ID NO: 247848 - DNA, 13 bp, Homo sapiens
actctgcactcca

SEQ ID NO: 247849 - DNA, 18 bp, Homo sapiens
actctgcactccatggcc

SEQ ID NO: 247850 - DNA, 20 bp, Homo sapiens
actctgcactccatggccac

SEQ ID NO: 247851 - DNA, 16 bp, Homo sapiens
actctgcattctagta

SEQ ID NO: 247852 - DNA, 11 bp, Homo sapiens
actctgccagg

SEQ ID NO: 247853 - DNA, 14 bp, Homo sapiens
actctgccccaatc

SEQ ID NO: 247854 - DNA, 21 bp, Homo sapiens
actctgccccttctgtttcca

SEQ ID NO: 247855 - DNA, 16 bp, Homo sapiens
actctgcctcctcttc

SEQ ID NO: 247856 - DNA, 19 bp, Homo sapiens
actctgcctctaaggccaa

SEQ ID NO: 247857 - DNA, 16 bp, Homo sapiens
actctgccttccaggc

SEQ ID NO: 247858 - DNA, 19 bp, Homo sapiens
actctgcggatagcatttg

SEQ ID NO: 247859 - DNA, 17 bp, Homo sapiens
actctgctaatcatgtg

SEQ ID NO: 247860 - DNA, 9 bp, Homo sapiens
actctgctg

SEQ ID NO: 247861 - DNA, 12 bp, Homo sapiens
actctgctgctc

SEQ ID NO: 247862 - DNA, 16 bp, Homo sapiens
actctgcttggctgtc

SEQ ID NO: 247863 - DNA, 23 bp, Homo sapiens
actctgcttggctgtcccctcca

SEQ ID NO: 247864 - DNA, 14 bp, Homo sapiens
actctgctttgact

SEQ ID NO: 247865 - DNA, 23 bp, Homo sapiens
actctgctttgactgagcagact

SEQ ID NO: 247866 - DNA, 13 bp, Homo sapiens
actctgctttgca

SEQ ID NO: 247867 - DNA, 18 bp, Homo sapiens
actctggaccccaggcca

SEQ ID NO: 247868 - DNA, 19 bp, Homo sapiens
actctgggtttcatatcca

SEQ ID NO: 247869 - DNA, 15 bp, Homo sapiens
actctggttctttgt

SEQ ID NO: 247870 - DNA, 23 bp, Homo sapiens
actctgtccaggccactgtggcc

SEQ ID NO: 247871 - DNA, 13 bp, Homo sapiens
actctgtctcaaa

SEQ ID NO: 247872 - DNA, 21 bp, Homo sapiens
actctgtgtaatctctgatta

SEQ ID NO: 247873 - DNA, 12 bp, Homo sapiens
actctgttgcct

SEQ ID NO: 247874 - DNA, 14 bp, Homo sapiens
actctgttgcctcc

SEQ ID NO: 247875 - DNA, 18 bp, Homo sapiens
actctgttgcctcctctc

SEQ ID NO: 247876 - DNA, 13 bp, Homo sapiens
actcttaaagcaa

SEQ ID NO: 247877 - DNA, 20 bp, Homo sapiens
actcttaaagcaaaaaatga

SEQ ID NO: 247878 - DNA, 16 bp, Homo sapiens
actcttaaatatacaa

SEQ ID NO: 247879 - DNA, 17 bp, Homo sapiens
actcttaggaagagaaa

SEQ ID NO: 247880 - DNA, 19 bp, Homo sapiens
actcttaggaagagaaacc

SEQ ID NO: 247881 - DNA, 20 bp, Homo sapiens
actcttaggaagagaaacca

SEQ ID NO: 247882 - DNA, 15 bp, Homo sapiens
actcttatgaaatgg

SEQ ID NO: 247883 - DNA, 16 bp, Homo sapiens
actcttcaaggccaag

SEQ ID NO: 247884 - DNA, 12 bp, Homo sapiens
actcttcactgt

SEQ ID NO: 247885 - DNA, 13 bp, Homo sapiens
actcttcactgtt

SEQ ID NO: 247886 - DNA, 19 bp, Homo sapiens
actcttcagcctcattcac

SEQ ID NO: 247887 - DNA, 22 bp, Homo sapiens
actcttcagcctcattcactgt

SEQ ID NO: 247888 - DNA, 17 bp, Homo sapiens
actcttccctctcgctc

SEQ ID NO: 247889 - DNA, 15 bp, Homo sapiens
actcttcctcatcct

SEQ ID NO: 247890 - DNA, 20 bp, Homo sapiens
actcttcctcatcctgcttc

SEQ ID NO: 247891 - DNA, 13 bp, Homo sapiens
actcttgctcact

SEQ ID NO: 247892 - DNA, 17 bp, Homo sapiens
actcttgctcactccct

SEQ ID NO: 247893 - DNA, 18 bp, Homo sapiens
actcttgctcactcccta

SEQ ID NO: 247894 - DNA, 14 bp, Homo sapiens
actcttgctctttc

SEQ ID NO: 247895 - DNA, 17 bp, Homo sapiens
actcttggtcacctcaa

SEQ ID NO: 247896 - DNA, 20 bp, Homo sapiens
actcttggtcagcttttgtt

SEQ ID NO: 247897 - DNA, 20 bp, Homo sapiens
actcttgtattgctccattt

SEQ ID NO: 247898 - DNA, 11 bp, Homo sapiens
agtctgtcctt

SEQ ID NO: 247899 - DNA, 16 bp, Homo sapiens
agtctgtctactgtgg

SEQ ID NO: 247900 - DNA, 19 bp, Homo sapiens
agtctgtctactgtggtga

SEQ ID NO: 247901 - DNA, 15 bp, Homo sapiens
agtctgtctgcactg

SEQ ID NO: 247902 - DNA, 18 bp, Homo sapiens
agtctgtgaataaagcca

SEQ ID NO: 247903 - DNA, 14 bp, Homo sapiens
agtctgtgcctgga

SEQ ID NO: 247904 - DNA, 22 bp, Homo sapiens
agtctgtgcctggagctcctgg

SEQ ID NO: 247905 - DNA, 23 bp, Homo sapiens
agtctgtgcctggagctcctggg

SEQ ID NO: 247906 - DNA, 11 bp, Homo sapiens
agtctgtgtga

SEQ ID NO: 247907 - DNA, 12 bp, Homo sapiens
agtctgtgtgaa

SEQ ID NO: 247908 - DNA, 18 bp, Homo sapiens
agtctgtgtgatgaactt

SEQ ID NO: 247909 - DNA, 21 bp, Homo sapiens
agtctgtgtgatgaactttct

SEQ ID NO: 247910 - DNA, 22 bp, Homo sapiens
agtctgtgtgatgaactttctc

SEQ ID NO: 247911 - DNA, 21 bp, Homo sapiens
agtctgtgtgctgtggttcct

SEQ ID NO: 247912 - DNA, 21 bp, Homo sapiens
agtcttaacaacagcttcttg

SEQ ID NO: 247913 - DNA, 17 bp, Homo sapiens
agtcttaattttctaaa

SEQ ID NO: 247914 - DNA, 19 bp, Homo sapiens
agtcttcacttgcactggg

SEQ ID NO: 247915 - DNA, 14 bp, Homo sapiens
agtcttccatcagc

SEQ ID NO: 247916 - DNA, 17 bp, Homo sapiens
agtcttccatcagcagt

SEQ ID NO: 247917 - DNA, 19 bp, Homo sapiens
agtcttccatcagcagtga

SEQ ID NO: 247918 - DNA, 18 bp, Homo sapiens
agtcttccctagggctgg

SEQ ID NO: 247919 - DNA, 12 bp, Homo sapiens
agtcttctcata

SEQ ID NO: 247920 - DNA, 21 bp, Homo sapiens
agtcttctcatagcattaact

SEQ ID NO: 247921 - DNA, 13 bp, Homo sapiens
agtcttctccctg

SEQ ID NO: 247922 - DNA, 14 bp, Homo sapiens
agtcttgagtgggc

SEQ ID NO: 247923 - DNA, 15 bp, Homo sapiens
agtcttgagtgggcc

SEQ ID NO: 247924 - DNA, 17 bp, Homo sapiens
agtcttgagtgggcccc

SEQ ID NO: 247925 - DNA, 20 bp, Homo sapiens
agtcttgctgtggtctcttt

SEQ ID NO: 247926 - DNA, 22 bp, Homo sapiens
agtcttgtgactagtgctgaag

SEQ ID NO: 247927 - DNA, 15 bp, Homo sapiens
agtctttgccttctc

SEQ ID NO: 247928 - DNA, 16 bp, Homo sapiens
agtctttgccttctct

SEQ ID NO: 247929 - DNA, 20 bp, Homo sapiens
agtctttgggggattcaaat

SEQ ID NO: 247930 - DNA, 22 bp, Homo sapiens
agtctttgtaagtaaactgccc

SEQ ID NO: 247931 - DNA, 12 bp, Homo sapiens
agtcttttctgt

SEQ ID NO: 247932 - DNA, 22 bp, Homo sapiens
agtgaaaaatatgttgagtgtt

SEQ ID NO: 247933 - DNA, 17 bp, Homo sapiens
agtgaaaccatgactgt

SEQ ID NO: 247934 - DNA, 23 bp, Homo sapiens
agtgaacagattgctacacacac

SEQ ID NO: 247935 - DNA, 15 bp, Homo sapiens
agtgaacagcttcac

SEQ ID NO: 247936 - DNA, 21 bp, Homo sapiens
agtgaaccatcattataaacg

SEQ ID NO: 247937 - DNA, 18 bp, Homo sapiens
agtgaagaagccatcaat

SEQ ID NO: 247938 - DNA, 20 bp, Homo sapiens
agtgaagcccaggaggacct

SEQ ID NO: 247939 - DNA, 22 bp, Homo sapiens
agtgaatacatggtagcagggt

SEQ ID NO: 247940 - DNA, 16 bp, Homo sapiens
agtgtataccacctgt

SEQ ID NO: 247941 - DNA, 18 bp, Homo sapiens
agtgtataccacctgtac

SEQ ID NO: 247942 - DNA, 14 bp, Homo sapiens
agtgtatatcagaa

SEQ ID NO: 247943 - DNA, 15 bp, Homo sapiens
agtgtattttaaatt

SEQ ID NO: 247944 - DNA, 23 bp, Homo sapiens
agtgtattttaaattctcagtca

SEQ ID NO: 247945 - DNA, 17 bp, Homo sapiens
agtgtcactgagctgtg

SEQ ID NO: 247946 - DNA, 17 bp, Homo sapiens
agtgtcacttgactctt

SEQ ID NO: 247947 - DNA, 16 bp, Homo sapiens
agtgtcacttttttcc

SEQ ID NO: 247948 - DNA, 23 bp, Homo sapiens
agtgtcacttttttcctgtcaat

SEQ ID NO: 247949 - DNA, 17 bp, Homo sapiens
agtgtcaggctctgaat

SEQ ID NO: 247950 - DNA, 21 bp, Homo sapiens
agtgtccattatctgctgttc

SEQ ID NO: 247951 - DNA, 17 bp, Homo sapiens
agtgtcctcatctataa

SEQ ID NO: 247952 - DNA, 18 bp, Homo sapiens
agtgtcctgtgctttctg

SEQ ID NO: 247953 - DNA, 19 bp, Homo sapiens
agtgtctaagttttgtcat

SEQ ID NO: 247954 - DNA, 15 bp, Homo sapiens
agtgtctgtaaggac

SEQ ID NO: 247955 - DNA, 22 bp, Homo sapiens
agtgtctgtatcggagacagtg

SEQ ID NO: 247956 - DNA, 19 bp, Homo sapiens
agtgtctgtgccatggatt

SEQ ID NO: 247957 - DNA, 15 bp, Homo sapiens
agtgtcttccataat

SEQ ID NO: 247958 - DNA, 20 bp, Homo sapiens
agtgtgacgggggttggggt

SEQ ID NO: 247959 - DNA, 21 bp, Homo sapiens
agtgtgacgggggttggggtg

SEQ ID NO: 247960 - DNA, 14 bp, Homo sapiens
agtgtgagggcagc

SEQ ID NO: 247961 - DNA, 16 bp, Homo sapiens
agtgtgagtaagagct

SEQ ID NO: 247962 - DNA, 17 bp, Homo sapiens
agtgtgagtaagagctg

SEQ ID NO: 247963 - DNA, 18 bp, Homo sapiens
agtgtgagtaagagctgg

SEQ ID NO: 247964 - DNA, 19 bp, Homo sapiens
agtgtgagtggcagccatg

SEQ ID NO: 247965 - DNA, 18 bp, Homo sapiens
agtgtgcaagcaaagaac

SEQ ID NO: 247966 - DNA, 16 bp, Homo sapiens
agtgtgcacgagtggg

SEQ ID NO: 247967 - DNA, 22 bp, Homo sapiens
agtgtgcacgagtgggaaggac

SEQ ID NO: 247968 - DNA, 12 bp, Homo sapiens
agtgtgctttat

SEQ ID NO: 247969 - DNA, 18 bp, Homo sapiens
agtgtgctttatgctgaa

SEQ ID NO: 247970 - DNA, 21 bp, Homo sapiens
agtgtgctttatgctgaaaca

SEQ ID NO: 247971 - DNA, 13 bp, Homo sapiens
agtgtggagaggg

SEQ ID NO: 247972 - DNA, 21 bp, Homo sapiens
agtgtggatgtaaattttata

SEQ ID NO: 247973 - DNA, 16 bp, Homo sapiens
agtgtggctggtgtcc

SEQ ID NO: 247974 - DNA, 17 bp, Homo sapiens
agtgtggctggtgtccc

SEQ ID NO: 247975 - DNA, 22 bp, Homo sapiens
agtgtggctggtgtccccttcc

SEQ ID NO: 247976 - DNA, 16 bp, Homo sapiens
agtgtggggcgggggt

SEQ ID NO: 247977 - DNA, 16 bp, Homo sapiens
agtgtgtattgttccc

SEQ ID NO: 247978 - DNA, 18 bp, Homo sapiens
agtgtgtccaagtgtgtg

SEQ ID NO: 247979 - DNA, 19 bp, Homo sapiens
agtgtgtctcctgcatgca

SEQ ID NO: 247980 - DNA, 11 bp, Homo sapiens
agtgtgtgtct

SEQ ID NO: 247981 - DNA, 12 bp, Homo sapiens
agtgtgtgtctt

SEQ ID NO: 247982 - DNA, 18 bp, Homo sapiens
agtgtgtgtgcaatgttc

SEQ ID NO: 247983 - DNA, 12 bp, Homo sapiens
agtgtgttctga

SEQ ID NO: 247984 - DNA, 21 bp, Homo sapiens
agtgtgttctgattagaaatg

SEQ ID NO: 247985 - DNA, 12 bp, Homo sapiens
agtgtgttgact

SEQ ID NO: 247986 - DNA, 17 bp, Homo sapiens
agtgtgtttgtgagtat

SEQ ID NO: 247987 - DNA, 22 bp, Homo sapiens
agtgtgtttgtgagtatgtgtg

SEQ ID NO: 247988 - DNA, 21 bp, Homo sapiens
agtgttaaaaaatttttgaaa

SEQ ID NO: 247989 - DNA, 19 bp, Homo sapiens
agtgttagtgggaagagct

SEQ ID NO: 247990 - DNA, 15 bp, Homo sapiens
agtgttataaaatct

SEQ ID NO: 247991 - DNA, 23 bp, Homo sapiens
agtgttataaaatctgtattgct

SEQ ID NO: 247992 - DNA, 15 bp, Homo sapiens
agtgttcgcttggct

SEQ ID NO: 247993 - DNA, 12 bp, Homo sapiens
agtgttctgagc

SEQ ID NO: 247994 - DNA, 23 bp, Homo sapiens
agtgttctgtgggcttggccttg

SEQ ID NO: 247995 - DNA, 15 bp, Homo sapiens
agtgttcttctcaag

SEQ ID NO: 247996 - DNA, 15 bp, Homo sapiens
agtgttgcctcctcc

SEQ ID NO: 247997 - DNA, 22 bp, Homo sapiens
agtgttggtctttctaatgtag

SEQ ID NO: 247998 - DNA, 21 bp, Homo sapiens
agtgttgtttgtaaataagag

SEQ ID NO: 247999 - DNA, 22 bp, Homo sapiens
agtgttgtttgtaaataagaga

SEQ ID NO: 248000 - DNA, 17 bp, Homo sapiens
agtgtttatttttcata

SEQ ID NO: 248001 - DNA, 14 bp, Homo sapiens
agtgtttcatgggt

SEQ ID NO: 248002 - DNA, 16 bp, Homo sapiens
agtgtttcccataatt

SEQ ID NO: 248003 - DNA, 19 bp, Homo sapiens
agtgtttcgtaagacaaaa

SEQ ID NO: 248004 - DNA, 14 bp, Homo sapiens
agtgtttctgcaga

SEQ ID NO: 248005 - DNA, 15 bp, Homo sapiens
agtgtttctgcagag

SEQ ID NO: 248006 - DNA, 16 bp, Homo sapiens
agtgtttctgcagagg

SEQ ID NO: 248007 - DNA, 20 bp, Homo sapiens
agtgtttctgcagaggcagc

SEQ ID NO: 248008 - DNA, 11 bp, Homo sapiens
agtgtttctgt

SEQ ID NO: 248009 - DNA, 13 bp, Homo sapiens
agtgtttctgttc

SEQ ID NO: 248010 - DNA, 14 bp, Homo sapiens
agtgttttactctt

SEQ ID NO: 248011 - DNA, 22 bp, Homo sapiens
agtgttttctcagaacagctga

SEQ ID NO: 248012 - DNA, 15 bp, Homo sapiens
agtgtttttctttaa

SEQ ID NO: 248013 - DNA, 22 bp, Homo sapiens
agtgtttttctttaatcaaaag

SEQ ID NO: 248014 - DNA, 13 bp, Homo sapiens
agttaaaaaaaat

SEQ ID NO: 248015 - DNA, 18 bp, Homo sapiens
agttaaaaaaaataataa

SEQ ID NO: 248016 - DNA, 23 bp, Homo sapiens
agttaaagagcagcctggctaac

SEQ ID NO: 248017 - DNA, 19 bp, Homo sapiens
agttaaaggcagtccagag

SEQ ID NO: 248018 - DNA, 20 bp, Homo sapiens
agttaaaggcagtccagagc

SEQ ID NO: 248019 - DNA, 23 bp, Homo sapiens
agttaaatagagtatatgcactt

SEQ ID NO: 248020 - DNA, 14 bp, Homo sapiens
agttaacaaggaat

SEQ ID NO: 248021 - DNA, 17 bp, Homo sapiens
agttaacaaggaatgcc

SEQ ID NO: 248022 - DNA, 20 bp, Homo sapiens
agttaacaaggaatgcctgt

SEQ ID NO: 248023 - DNA, 17 bp, Homo sapiens
agttaacatctgaagtg

SEQ ID NO: 248024 - DNA, 14 bp, Homo sapiens
agttaactttcaga

SEQ ID NO: 248025 - DNA, 14 bp, Homo sapiens
agttaagaaaaaaa

SEQ ID NO: 248026 - DNA, 18 bp, Homo sapiens
agttaagacaacaggcat

SEQ ID NO: 248027 - DNA, 16 bp, Homo sapiens
agttaagattcttggt

SEQ ID NO: 248028 - DNA, 21 bp, Homo sapiens
agttaagcagcctttctgtgg

SEQ ID NO: 248029 - DNA, 19 bp, Homo sapiens
agttaagtgtcatttcttt

SEQ ID NO: 248030 - DNA, 21 bp, Homo sapiens
agttaatattggaagtgaaat

SEQ ID NO: 248031 - DNA, 15 bp, Homo sapiens
agttaatcttgcttt

SEQ ID NO: 248032 - DNA, 21 bp, Homo sapiens
agttaatgaaggtgtgctaca

SEQ ID NO: 248033 - DNA, 21 bp, Homo sapiens
agttaattatgtgcatattaa

SEQ ID NO: 248034 - DNA, 13 bp, Homo sapiens
agttacccaccct

SEQ ID NO: 248035 - DNA, 14 bp, Homo sapiens
agttacccacccta

SEQ ID NO: 248036 - DNA, 16 bp, Homo sapiens
agttactatcctggct

SEQ ID NO: 248037 - DNA, 17 bp, Homo sapiens
agttactatcctggctt

SEQ ID NO: 248038 - DNA, 21 bp, Homo sapiens
agttactgccacggtcctttg

SEQ ID NO: 248039 - DNA, 14 bp, Homo sapiens
agttacttcctatc

SEQ ID NO: 248040 - DNA, 16 bp, Homo sapiens
agttacttgaatttca

SEQ ID NO: 248041 - DNA, 14 bp, Homo sapiens
agttagagatgcct

SEQ ID NO: 248042 - DNA, 18 bp, Homo sapiens
agttagcaggaaatagtg

SEQ ID NO: 248043 - DNA, 12 bp, Homo sapiens
agttaggaaata

SEQ ID NO: 248044 - DNA, 16 bp, Homo sapiens
agttaggccacgctcc

SEQ ID NO: 248045 - DNA, 14 bp, Homo sapiens
agttagtagcatgt

SEQ ID NO: 248046 - DNA, 15 bp, Homo sapiens
agttagtagcatgtt

SEQ ID NO: 248047 - DNA, 15 bp, Homo sapiens
agttatagtttcaga

SEQ ID NO: 248048 - DNA, 12 bp, Homo sapiens
agttatgaatca

SEQ ID NO: 248049 - DNA, 17 bp, Homo sapiens
agttattaatttcttca

SEQ ID NO: 248050 - DNA, 21 bp, Homo sapiens
agttattatgtagctgaaaca

SEQ ID NO: 248051 - DNA, 19 bp, Homo sapiens
agttattgaatcttaattt

SEQ ID NO: 248052 - DNA, 12 bp, Homo sapiens
agttattgtaca

SEQ ID NO: 248053 - DNA, 13 bp, Homo sapiens
agttattgtacag

SEQ ID NO: 248054 - DNA, 13 bp, Homo sapiens
agttattttagga

SEQ ID NO: 248055 - DNA, 14 bp, Homo sapiens
agttcaaattttgc

SEQ ID NO: 248056 - DNA, 10 bp, Homo sapiens
agttcaatga

SEQ ID NO: 248057 - DNA, 15 bp, Homo sapiens
agttcaatgatctag

SEQ ID NO: 248058 - DNA, 15 bp, Homo sapiens
agttcaattgtgtct

SEQ ID NO: 248059 - DNA, 14 bp, Homo sapiens
agttcacaccctgc

SEQ ID NO: 248060 - DNA, 16 bp, Homo sapiens
agttcacaccctgcaa

SEQ ID NO: 248061 - DNA, 18 bp, Homo sapiens
agttcacaccctgcaagg

SEQ ID NO: 248062 - DNA, 21 bp, Homo sapiens
agttcactataaatggtgttt

SEQ ID NO: 248063 - DNA, 15 bp, Homo sapiens
agttcaggaattttt

SEQ ID NO: 248064 - DNA, 17 bp, Homo sapiens
agttcaggaatttttgt

SEQ ID NO: 248065 - DNA, 18 bp, Homo sapiens
agttcagggaggggctga

SEQ ID NO: 248066 - DNA, 20 bp, Homo sapiens
agttcagtaagaccggaagc

SEQ ID NO: 248067 - DNA, 20 bp, Homo sapiens
agttcagttcctctttgcat

SEQ ID NO: 248068 - DNA, 22 bp, Homo sapiens
agttcatatgtaccatgtacat

SEQ ID NO: 248069 - DNA, 16 bp, Homo sapiens
agttcatccaatcctc

SEQ ID NO: 248070 - DNA, 16 bp, Homo sapiens
agttcatctctgctga

SEQ ID NO: 248071 - DNA, 11 bp, Homo sapiens
agtttctgttg

SEQ ID NO: 248072 - DNA, 14 bp, Homo sapiens
agtttcttctaaag

SEQ ID NO: 248073 - DNA, 19 bp, Homo sapiens
agtttgagacaagccctgg

SEQ ID NO: 248074 - DNA, 17 bp, Homo sapiens
agtttgcaatcttatgt

SEQ ID NO: 248075 - DNA, 21 bp, Homo sapiens
agtttgcaatcttatgttgat

SEQ ID NO: 248076 - DNA, 15 bp, Homo sapiens
agtttgctgggttta

SEQ ID NO: 248077 - DNA, 21 bp, Homo sapiens
agtttgctgtatacaaacagg

SEQ ID NO: 248078 - DNA, 18 bp, Homo sapiens
agtttggctgtaatttaa

SEQ ID NO: 248079 - DNA, 17 bp, Homo sapiens
agtttgtagtaaatatt

SEQ ID NO: 248080 - DNA, 22 bp, Homo sapiens
agtttgtatgccaagtgagaag

SEQ ID NO: 248081 - DNA, 12 bp, Homo sapiens
agtttgtattaa

SEQ ID NO: 248082 - DNA, 14 bp, Homo sapiens
agtttgtcccattt

SEQ ID NO: 248083 - DNA, 16 bp, Homo sapiens
agtttgtcctgtagag

SEQ ID NO: 248084 - DNA, 13 bp, Homo sapiens
agtttgtccttta

SEQ ID NO: 248085 - DNA, 22 bp, Homo sapiens
agtttgtgaagtgattgacatt

SEQ ID NO: 248086 - DNA, 16 bp, Homo sapiens
agtttgtgcaagacac

SEQ ID NO: 248087 - DNA, 17 bp, Homo sapiens
agtttgtgcaagacacc

SEQ ID NO: 248088 - DNA, 16 bp, Homo sapiens
agtttgttaattgatt

SEQ ID NO: 248089 - DNA, 23 bp, Homo sapiens
agttttaaactcatttttgccat

SEQ ID NO: 248090 - DNA, 14 bp, Homo sapiens
agttttaaagaagt

SEQ ID NO: 248091 - DNA, 15 bp, Homo sapiens
agttttaaagaagtc

SEQ ID NO: 248092 - DNA, 16 bp, Homo sapiens
agttttaatccagaat

SEQ ID NO: 248093 - DNA, 22 bp, Homo sapiens
agttttacattacaaatttctg

SEQ ID NO: 248094 - DNA, 22 bp, Homo sapiens
agttttactcttgttgcccagg

SEQ ID NO: 248095 - DNA, 20 bp, Homo sapiens
agttttagggtacagtttgg

SEQ ID NO: 248096 - DNA, 15 bp, Homo sapiens
agttttagtttcaaa

SEQ ID NO: 248097 - DNA, 21 bp, Homo sapiens
agttttagtttcaaaatgtta

SEQ ID NO: 248098 - DNA, 14 bp, Homo sapiens
agttttataaaact

SEQ ID NO: 248099 - DNA, 18 bp, Homo sapiens
agttttcagaacctcttc

SEQ ID NO: 248100 - DNA, 15 bp, Homo sapiens
agttttccagtattg

SEQ ID NO: 248101 - DNA, 13 bp, Homo sapiens
agttttccatgaa

SEQ ID NO: 248102 - DNA, 16 bp, Homo sapiens
agttttcttttactat

SEQ ID NO: 248103 - DNA, 14 bp, Homo sapiens
agttttgaaagaaa

SEQ ID NO: 248104 - DNA, 15 bp, Homo sapiens
agttttgaaagaaaa

SEQ ID NO: 248105 - DNA, 15 bp, Homo sapiens
agttttgatgaaatt

SEQ ID NO: 248106 - DNA, 23 bp, Homo sapiens
agttttgccccatgataaaataa

SEQ ID NO: 248107 - DNA, 14 bp, Homo sapiens
agttttggttttta

SEQ ID NO: 248108 - DNA, 15 bp, Homo sapiens
agttttgtataaata

SEQ ID NO: 248109 - DNA, 17 bp, Homo sapiens
agttttgtataaataat

SEQ ID NO: 248110 - DNA, 16 bp, Homo sapiens
agttttgtgtacagta

SEQ ID NO: 248111 - DNA, 16 bp, Homo sapiens
agttttgtgtgtatat

SEQ ID NO: 248112 - DNA, 16 bp, Homo sapiens
agtttttacagtgtat

SEQ ID NO: 248113 - DNA, 18 bp, Homo sapiens
agtttttattccttgtga

SEQ ID NO: 248114 - DNA, 14 bp, Homo sapiens
agtttttctctcaa

SEQ ID NO: 248115 - DNA, 18 bp, Homo sapiens
agttttttctcttgggct

SEQ ID NO: 248116 - DNA, 17 bp, Homo sapiens
agttttttgccactgca

SEQ ID NO: 248117 - DNA, 20 bp, Homo sapiens
agttttttgccactgcaaac

SEQ ID NO: 248118 - DNA, 16 bp, Homo sapiens
ataaaaaacatttgta

SEQ ID NO: 248119 - DNA, 20 bp, Homo sapiens
ataaaaaacatttgtacatt

SEQ ID NO: 248120 - DNA, 11 bp, Homo sapiens
ataaaaaagaa

SEQ ID NO: 248121 - DNA, 13 bp, Homo sapiens
ataaaaaagaaaa

SEQ ID NO: 248122 - DNA, 23 bp, Homo sapiens
ataaaaaagaaaacattccagat

SEQ ID NO: 248123 - DNA, 18 bp, Homo sapiens
ataaaaaagtgtcctata

SEQ ID NO: 248124 - DNA, 13 bp, Homo sapiens
ataaaaaataagt

SEQ ID NO: 248125 - DNA, 18 bp, Homo sapiens
ataaaaaatttattatgt

SEQ ID NO: 248126 - DNA, 13 bp, Homo sapiens
ataaaaataaatt

SEQ ID NO: 248127 - DNA, 14 bp, Homo sapiens
ataaaaatattgtg

SEQ ID NO: 248128 - DNA, 14 bp, Homo sapiens
ataaaaatggaatt

SEQ ID NO: 248129 - DNA, 15 bp, Homo sapiens
ataaaaattctgaat

SEQ ID NO: 248130 - DNA, 18 bp, Homo sapiens
ataaaacaaaacaaacaa

SEQ ID NO: 248131 - DNA, 16 bp, Homo sapiens
ataaaacaagaatact

SEQ ID NO: 248132 - DNA, 15 bp, Homo sapiens
ataaaacagaatatt

SEQ ID NO: 248133 - DNA, 16 bp, Homo sapiens
ataaaacatctttcca

SEQ ID NO: 248134 - DNA, 12 bp, Homo sapiens
ataaaacattcc

SEQ ID NO: 248135 - DNA, 15 bp, Homo sapiens
ataaaacctttcaaa

SEQ ID NO: 248136 - DNA, 20 bp, Homo sapiens
ataaaacctttcaaatttca

SEQ ID NO: 248137 - DNA, 22 bp, Homo sapiens
ataaaactagggggtgtatatt

SEQ ID NO: 248138 - DNA, 14 bp, Homo sapiens
ataaaactatttaa

SEQ ID NO: 248139 - DNA, 17 bp, Homo sapiens
ataaaagggcaaatctg

SEQ ID NO: 248140 - DNA, 20 bp, Homo sapiens
ataaaaggtgacccttctgt

SEQ ID NO: 248141 - DNA, 13 bp, Homo sapiens
ataaaagtgatca

SEQ ID NO: 248142 - DNA, 22 bp, Homo sapiens
ataaaagtgatcaataaaatgt

SEQ ID NO: 248143 - DNA, 16 bp, Homo sapiens
ataaaagtgcacacct

SEQ ID NO: 248144 - DNA, 22 bp, Homo sapiens
ataaaatactctagcctgggcc

SEQ ID NO: 248145 - DNA, 17 bp, Homo sapiens
ataaaatatcattcagc

SEQ ID NO: 248146 - DNA, 20 bp, Homo sapiens
ataaaatctttccatctcat

SEQ ID NO: 248147 - DNA, 12 bp, Homo sapiens
ataaaatgaggg

SEQ ID NO: 248148 - DNA, 13 bp, Homo sapiens
ataaaatgtgatt

SEQ ID NO: 248149 - DNA, 20 bp, Homo sapiens
ataaaatgtgatttttctga

SEQ ID NO: 248150 - DNA, 16 bp, Homo sapiens
ataaaattcatttcta

SEQ ID NO: 248151 - DNA, 23 bp, Homo sapiens
ataaaattgtaaaattgtataga

SEQ ID NO: 248152 - DNA, 23 bp, Homo sapiens
ataaacacatagattcacctgta

SEQ ID NO: 248153 - DNA, 16 bp, Homo sapiens
ataaacacattgaatg

SEQ ID NO: 248154 - DNA, 13 bp, Homo sapiens
ataaacagataat

SEQ ID NO: 248155 - DNA, 22 bp, Homo sapiens
ataaacagtggaatataaggaa

SEQ ID NO: 248156 - DNA, 15 bp, Homo sapiens
ataaacatatgcaaa

SEQ ID NO: 248157 - DNA, 18 bp, Homo sapiens
ataaacatatgcaaacag

SEQ ID NO: 248158 - DNA, 13 bp, Homo sapiens
ataaacattaaac

SEQ ID NO: 248159 - DNA, 15 bp, Homo sapiens
ataaacattaaacac

SEQ ID NO: 248160 - DNA, 18 bp, Homo sapiens
ataaacattaaacactgt

SEQ ID NO: 248161 - DNA, 19 bp, Homo sapiens
ataaacccatctgtaatat

SEQ ID NO: 248162 - DNA, 15 bp, Homo sapiens
ataaaccttaaatga

SEQ ID NO: 248163 - DNA, 14 bp, Homo sapiens
ataaacgaaacaca

SEQ ID NO: 248164 - DNA, 20 bp, Homo sapiens
ataaacgtgatgatcagctg

SEQ ID NO: 248165 - DNA, 23 bp, Homo sapiens
ataaactagggttttggcctgcc

SEQ ID NO: 248166 - DNA, 15 bp, Homo sapiens
ataaactctaaacat

SEQ ID NO: 248167 - DNA, 13 bp, Homo sapiens
ataaactgacttt

SEQ ID NO: 248168 - DNA, 20 bp, Homo sapiens
ataaactgactttatcctca

SEQ ID NO: 248169 - DNA, 11 bp, Homo sapiens
ataaactgtga

SEQ ID NO: 248170 - DNA, 14 bp, Homo sapiens
ataaactgtgagat

SEQ ID NO: 248171 - DNA, 16 bp, Homo sapiens
ataaactgtgagataa

SEQ ID NO: 248172 - DNA, 17 bp, Homo sapiens
ataaactgtgagataaa

SEQ ID NO: 248173 - DNA, 22 bp, Homo sapiens
ataaactgtgagataaatatca

SEQ ID NO: 248174 - DNA, 16 bp, Homo sapiens
ataaactttcagaact

SEQ ID NO: 248175 - DNA, 13 bp, Homo sapiens
ataaagaaaaaaa

SEQ ID NO: 248176 - DNA, 21 bp, Homo sapiens
ataaagaactccttattttgt

SEQ ID NO: 248177 - DNA, 23 bp, Homo sapiens
ataaagaactccttattttgtat

SEQ ID NO: 248178 - DNA, 17 bp, Homo sapiens
ataaagaagaaaataac

SEQ ID NO: 248179 - DNA, 12 bp, Homo sapiens
ataaagacacct

SEQ ID NO: 248180 - DNA, 11 bp, Homo sapiens
ataaagacagg

SEQ ID NO: 248181 - DNA, 15 bp, Homo sapiens
ataaagatggctatt

SEQ ID NO: 248182 - DNA, 18 bp, Homo sapiens
ataaagatttttgttaag

SEQ ID NO: 248183 - DNA, 14 bp, Homo sapiens
ataaagcataagta

SEQ ID NO: 248184 - DNA, 20 bp, Homo sapiens
ataaagcctgttttgtcttt

SEQ ID NO: 248185 - DNA, 21 bp, Homo sapiens
ataaagcgatatacagatgaa

SEQ ID NO: 248186 - DNA, 20 bp, Homo sapiens
ataaagctggacaagaagct

SEQ ID NO: 248187 - DNA, 23 bp, Homo sapiens
ataaagctggacaagaagctgct

SEQ ID NO: 248188 - DNA, 14 bp, Homo sapiens
ataaaggtcatatt

SEQ ID NO: 248189 - DNA, 23 bp, Homo sapiens
ataaaggtcatattggaaacata

SEQ ID NO: 248190 - DNA, 14 bp, Homo sapiens
ataaagtaaagcta

SEQ ID NO: 248191 - DNA, 17 bp, Homo sapiens
ataaagtaaagctaaaa

SEQ ID NO: 248192 - DNA, 22 bp, Homo sapiens
ataaagtaaatgctacctctga

SEQ ID NO: 248193 - DNA, 18 bp, Homo sapiens
ataaagtactactgtaga

SEQ ID NO: 248194 - DNA, 20 bp, Homo sapiens
ataaagtattccaccttaaa

SEQ ID NO: 248195 - DNA, 15 bp, Homo sapiens
ataaagtcctcttcc

SEQ ID NO: 248196 - DNA, 14 bp, Homo sapiens
ataaagtgcaattg

SEQ ID NO: 248197 - DNA, 17 bp, Homo sapiens
ataaagttacttgaatt

SEQ ID NO: 248198 - DNA, 13 bp, Homo sapiens
ataaagttattaa

SEQ ID NO: 248199 - DNA, 15 bp, Homo sapiens
ataaataaaaatgga

SEQ ID NO: 248200 - DNA, 14 bp, Homo sapiens
ataaataaagaaga

SEQ ID NO: 248201 - DNA, 15 bp, Homo sapiens
ataaataaagaagaa

SEQ ID NO: 248202 - DNA, 18 bp, Homo sapiens
ataagttaaagagacaaa

SEQ ID NO: 248203 - DNA, 15 bp, Homo sapiens
ataagttaaaggcag

SEQ ID NO: 248204 - DNA, 20 bp, Homo sapiens
ataagttaaaggcagtccag

SEQ ID NO: 248205 - DNA, 15 bp, Homo sapiens
ataagttgaccttta

SEQ ID NO: 248206 - DNA, 13 bp, Homo sapiens
ataataaatggga

SEQ ID NO: 248207 - DNA, 16 bp, Homo sapiens
ataataaattaacatt

SEQ ID NO: 248208 - DNA, 18 bp, Homo sapiens
ataataaattaacattat

SEQ ID NO: 248209 - DNA, 12 bp, Homo sapiens
ataataaattga

SEQ ID NO: 248210 - DNA, 15 bp, Homo sapiens
ataataaattgcatg

SEQ ID NO: 248211 - DNA, 21 bp, Homo sapiens
ataataactagatctcctgta

SEQ ID NO: 248212 - DNA, 21 bp, Homo sapiens
ataatacactaattcctttct

SEQ ID NO: 248213 - DNA, 22 bp, Homo sapiens
ataatacactaattcctttcta

SEQ ID NO: 248214 - DNA, 14 bp, Homo sapiens
ataatactaattta

SEQ ID NO: 248215 - DNA, 15 bp, Homo sapiens
ataatactaatttat

SEQ ID NO: 248216 - DNA, 22 bp, Homo sapiens
ataatacttaaaaatatgtgag

SEQ ID NO: 248217 - DNA, 15 bp, Homo sapiens
ataatagaatttcct

SEQ ID NO: 248218 - DNA, 22 bp, Homo sapiens
ataatagacttatatgcaggct

SEQ ID NO: 248219 - DNA, 13 bp, Homo sapiens
ataatagtactat

SEQ ID NO: 248220 - DNA, 16 bp, Homo sapiens
ataatagtcaatttct

SEQ ID NO: 248221 - DNA, 18 bp, Homo sapiens
ataatagttcaggatttg

SEQ ID NO: 248222 - DNA, 16 bp, Homo sapiens
ataatataacaacact

SEQ ID NO: 248223 - DNA, 21 bp, Homo sapiens
ataatatgctgccaaattttg

SEQ ID NO: 248224 - DNA, 13 bp, Homo sapiens
ataatattactgt

SEQ ID NO: 248225 - DNA, 14 bp, Homo sapiens
ataatattactgtt

SEQ ID NO: 248226 - DNA, 14 bp, Homo sapiens
ataatatttaggca

SEQ ID NO: 248227 - DNA, 20 bp, Homo sapiens
ataatatttaggcatgagct

SEQ ID NO: 248228 - DNA, 21 bp, Homo sapiens
ataatcaattattacatttat

SEQ ID NO: 248229 - DNA, 14 bp, Homo sapiens
ataatcagcctctt

SEQ ID NO: 248230 - DNA, 15 bp, Homo sapiens
ataatcagcctctta

SEQ ID NO: 248231 - DNA, 17 bp, Homo sapiens
ataatcagcctcttaaa

SEQ ID NO: 248232 - DNA, 20 bp, Homo sapiens
ataatcagtgtgtctaaatt

SEQ ID NO: 248233 - DNA, 14 bp, Homo sapiens
ataatctagtttac

SEQ ID NO: 248234 - DNA, 16 bp, Homo sapiens
ataatctcatccccaa

SEQ ID NO: 248235 - DNA, 13 bp, Homo sapiens
ataatgaagaatg

SEQ ID NO: 248236 - DNA, 22 bp, Homo sapiens
ataatgacgtattgtgaaattt

SEQ ID NO: 248237 - DNA, 18 bp, Homo sapiens
ataatgagttttacatta

SEQ ID NO: 248238 - DNA, 11 bp, Homo sapiens
ataatgattta

SEQ ID NO: 248239 - DNA, 17 bp, Homo sapiens
ataatgcttaatttcta

SEQ ID NO: 248240 - DNA, 18 bp, Homo sapiens
ataatgcttaatttctaa

SEQ ID NO: 248241 - DNA, 23 bp, Homo sapiens
ataatggcctcttaaaaattatc

SEQ ID NO: 248242 - DNA, 20 bp, Homo sapiens
ataatgggaaaggttgaatt

SEQ ID NO: 248243 - DNA, 17 bp, Homo sapiens
ataatggtttactgctg

SEQ ID NO: 248244 - DNA, 21 bp, Homo sapiens
ataatgtcctttccctggagt

SEQ ID NO: 248245 - DNA, 11 bp, Homo sapiens
ataatgttctt

SEQ ID NO: 248246 - DNA, 19 bp, Homo sapiens
ataatgttctttaatgttg

SEQ ID NO: 248247 - DNA, 22 bp, Homo sapiens
ataatgtttaatattgagaaag

SEQ ID NO: 248248 - DNA, 22 bp, Homo sapiens
ataatgtttccctcaagaacaa

SEQ ID NO: 248249 - DNA, 16 bp, Homo sapiens
ataattaaatgaaata

SEQ ID NO: 248250 - DNA, 18 bp, Homo sapiens
ataattaaattttaatgt

SEQ ID NO: 248251 - DNA, 20 bp, Homo sapiens
ataattaaattttgagttct

SEQ ID NO: 248252 - DNA, 20 bp, Homo sapiens
ataattatcggaagcagtgc

SEQ ID NO: 248253 - DNA, 18 bp, Homo sapiens
ataattatgacagttata

SEQ ID NO: 248254 - DNA, 20 bp, Homo sapiens
ataattatgacagttatact

SEQ ID NO: 248255 - DNA, 20 bp, Homo sapiens
ataattatgttattgaaaaa

SEQ ID NO: 248256 - DNA, 13 bp, Homo sapiens
ataattatgttta

SEQ ID NO: 248257 - DNA, 16 bp, Homo sapiens
ataattatttatttaa

SEQ ID NO: 248258 - DNA, 23 bp, Homo sapiens
ataattcagggtggtaaagtatg

SEQ ID NO: 248259 - DNA, 18 bp, Homo sapiens
ataattctatactgttga

SEQ ID NO: 248260 - DNA, 15 bp, Homo sapiens
ataattgatcaaatt

SEQ ID NO: 248261 - DNA, 15 bp, Homo sapiens
ataattgtggagagg

SEQ ID NO: 248262 - DNA, 16 bp, Homo sapiens
ataattgtggagagga

SEQ ID NO: 248263 - DNA, 21 bp, Homo sapiens
ataattgtggagaggagagaa

SEQ ID NO: 248264 - DNA, 13 bp, Homo sapiens
ataattgtgtaca

SEQ ID NO: 248265 - DNA, 14 bp, Homo sapiens
ataattgtgtacaa

SEQ ID NO: 248266 - DNA, 15 bp, Homo sapiens
ataattgtgtacaaa

SEQ ID NO: 248267 - DNA, 21 bp, Homo sapiens
ataatttaagccaataaataa

SEQ ID NO: 248268 - DNA, 11 bp, Homo sapiens
ataatttccca

SEQ ID NO: 248269 - DNA, 18 bp, Homo sapiens
ataatttcccaattagga

SEQ ID NO: 248270 - DNA, 21 bp, Homo sapiens
ataatttcccaattaggaagt

SEQ ID NO: 248271 - DNA, 22 bp, Homo sapiens
ataatttcccaattaggaagtg

SEQ ID NO: 248272 - DNA, 21 bp, Homo sapiens
ataatttgcatattctattgt

SEQ ID NO: 248273 - DNA, 13 bp, Homo sapiens
ataattttatgaa

SEQ ID NO: 248274 - DNA, 13 bp, Homo sapiens
ataattttcttca

SEQ ID NO: 248275 - DNA, 17 bp, Homo sapiens
ataattttcttcatgca

SEQ ID NO: 248276 - DNA, 20 bp, Homo sapiens
ataatttttaaaagaggaaa

SEQ ID NO: 248277 - DNA, 19 bp, Homo sapiens
ataatttttatatttaatt

SEQ ID NO: 248278 - DNA, 19 bp, Homo sapiens
ataatttttgctgaattcc

SEQ ID NO: 248279 - DNA, 17 bp, Homo sapiens
ataattttttagttaaa

SEQ ID NO: 248280 - DNA, 19 bp, Homo sapiens
ataattttttagttaaaat

SEQ ID NO: 248281 - DNA, 20 bp, Homo sapiens
ataattttttagttaaaatc

SEQ ID NO: 248282 - DNA, 17 bp, Homo sapiens
ataattttttattcaag

SEQ ID NO: 248283 - DNA, 13 bp, Homo sapiens
atacaaaagaatt

SEQ ID NO: 248284 - DNA, 11 bp, Homo sapiens
atacaaacagg

SEQ ID NO: 248285 - DNA, 20 bp, Homo sapiens
atacaactttggaatttgaa

SEQ ID NO: 248286 - DNA, 21 bp, Homo sapiens
atacaataaactattggaaag

SEQ ID NO: 248287 - DNA, 15 bp, Homo sapiens
atacaatatcatcca

SEQ ID NO: 248288 - DNA, 14 bp, Homo sapiens
atacaattaaaggt

SEQ ID NO: 248289 - DNA, 18 bp, Homo sapiens
atacacaaagatattatt

SEQ ID NO: 248290 - DNA, 13 bp, Homo sapiens
atacacacaaaaa

SEQ ID NO: 248291 - DNA, 21 bp, Homo sapiens
atacacacatagtttcttttt

SEQ ID NO: 248292 - DNA, 22 bp, Homo sapiens
atacacacatagtttctttttt

SEQ ID NO: 248293 - DNA, 14 bp, Homo sapiens
atacaccgggcctg

SEQ ID NO: 248294 - DNA, 22 bp, Homo sapiens
atacactatttgtgagcaaagg

SEQ ID NO: 248295 - DNA, 14 bp, Homo sapiens
atacactcctgctg

SEQ ID NO: 248296 - DNA, 17 bp, Homo sapiens
atacactgacttggtgc

SEQ ID NO: 248297 - DNA, 23 bp, Homo sapiens
atacactgtatctaaaaaataac

SEQ ID NO: 248298 - DNA, 16 bp, Homo sapiens
atacacttgtaaataa

SEQ ID NO: 248299 - DNA, 14 bp, Homo sapiens
atacagaaaatgct

SEQ ID NO: 248300 - DNA, 12 bp, Homo sapiens
atacagacacta

SEQ ID NO: 248301 - DNA, 23 bp, Homo sapiens
atacagacactaagttatagtat

SEQ ID NO: 248302 - DNA, 18 bp, Homo sapiens
atacagacctaatatcat

SEQ ID NO: 248303 - DNA, 15 bp, Homo sapiens
atacagataacatta

SEQ ID NO: 248304 - DNA, 16 bp, Homo sapiens
atacagatccgcatgt

SEQ ID NO: 248305 - DNA, 17 bp, Homo sapiens
atacagatccgcatgtg

SEQ ID NO: 248306 - DNA, 18 bp, Homo sapiens
atacagatccgcatgtgt

SEQ ID NO: 248307 - DNA, 20 bp, Homo sapiens
atacagatccgcatgtgtct

SEQ ID NO: 248308 - DNA, 22 bp, Homo sapiens
atacagcactacttacttagag

SEQ ID NO: 248309 - DNA, 20 bp, Homo sapiens
atacagccctcccccagcag

SEQ ID NO: 248310 - DNA, 22 bp, Homo sapiens
atacagcctctacagccgtccc

SEQ ID NO: 248311 - DNA, 18 bp, Homo sapiens
atacagtattatagatat

SEQ ID NO: 248312 - DNA, 14 bp, Homo sapiens
atacagtattctgt

SEQ ID NO: 248313 - DNA, 15 bp, Homo sapiens
atacagtcaggacac

SEQ ID NO: 248314 - DNA, 21 bp, Homo sapiens
atacagtcattatttaaagca

SEQ ID NO: 248315 - DNA, 20 bp, Homo sapiens
atacagttgttggcctccgg

SEQ ID NO: 248316 - DNA, 16 bp, Homo sapiens
atacagttttaaagaa

SEQ ID NO: 248317 - DNA, 23 bp, Homo sapiens
atacagttttaaagaatcattat

SEQ ID NO: 248318 - DNA, 12 bp, Homo sapiens
atacataacagg

SEQ ID NO: 248319 - DNA, 17 bp, Homo sapiens
atacatacctctctcta

SEQ ID NO: 248320 - DNA, 14 bp, Homo sapiens
atacatcagttatt

SEQ ID NO: 248321 - DNA, 23 bp, Homo sapiens
atacatctaagtcagtttcacat

SEQ ID NO: 248322 - DNA, 14 bp, Homo sapiens
atacatctttatca

SEQ ID NO: 248323 - DNA, 22 bp, Homo sapiens
atacatctttatcattaaacat

SEQ ID NO: 248324 - DNA, 12 bp, Homo sapiens
atacatgtatag

SEQ ID NO: 248325 - DNA, 19 bp, Homo sapiens
atacatgttattgttttca

SEQ ID NO: 248326 - DNA, 14 bp, Homo sapiens
atacattaaaagaa

SEQ ID NO: 248327 - DNA, 16 bp, Homo sapiens
atacattccatcacag

SEQ ID NO: 248328 - DNA, 14 bp, Homo sapiens
acttaacattgcat

SEQ ID NO: 248329 - DNA, 23 bp, Homo sapiens
acttaactattcaggagagtaga

SEQ ID NO: 248330 - DNA, 15 bp, Homo sapiens
acttaagacaaatgg

SEQ ID NO: 248331 - DNA, 17 bp, Homo sapiens
acttaagacaaatggga

SEQ ID NO: 248332 - DNA, 23 bp, Homo sapiens
atacattccatcacagccagccc

SEQ ID NO: 248333 - DNA, 10 bp, Homo sapiens
atacattcct

SEQ ID NO: 248334 - DNA, 11 bp, Homo sapiens
atacattcctg

SEQ ID NO: 248335 - DNA, 14 bp, Homo sapiens
atacattcctgaga

SEQ ID NO: 248336 - DNA, 17 bp, Homo sapiens
atacattgtataggcca

SEQ ID NO: 248337 - DNA, 21 bp, Homo sapiens
atacattgtataggccatctg

SEQ ID NO: 248338 - DNA, 16 bp, Homo sapiens
atacatttatcttctg

SEQ ID NO: 248339 - DNA, 18 bp, Homo sapiens
atacatttatcttctgtt

SEQ ID NO: 248340 - DNA, 19 bp, Homo sapiens
atacatttatcttctgttt

SEQ ID NO: 248341 - DNA, 12 bp, Homo sapiens
atacatttgtat

SEQ ID NO: 248342 - DNA, 16 bp, Homo sapiens
atacattttatatctg

SEQ ID NO: 248343 - DNA, 22 bp, Homo sapiens
atacattttgttatagaatact

SEQ ID NO: 248344 - DNA, 12 bp, Homo sapiens
atacatttttaa

SEQ ID NO: 248345 - DNA, 16 bp, Homo sapiens
ataccaaagcagttgg

SEQ ID NO: 248346 - DNA, 15 bp, Homo sapiens
ataccacctgtacat

SEQ ID NO: 248347 - DNA, 11 bp, Homo sapiens
ataccatcagc

SEQ ID NO: 248348 - DNA, 17 bp, Homo sapiens
ataccattaaaactgct

SEQ ID NO: 248349 - DNA, 16 bp, Homo sapiens
ataccattttgaaata

SEQ ID NO: 248350 - DNA, 18 bp, Homo sapiens
atacccagagagaaaaag

SEQ ID NO: 248351 - DNA, 18 bp, Homo sapiens
atacccatagcttccatg

SEQ ID NO: 248352 - DNA, 22 bp, Homo sapiens
atacccccgtcggaatggtaac

SEQ ID NO: 248353 - DNA, 17 bp, Homo sapiens
ataccccctgccccaga

SEQ ID NO: 248354 - DNA, 20 bp, Homo sapiens
ataccccctgccccagagaa

SEQ ID NO: 248355 - DNA, 16 bp, Homo sapiens
ataccctaggtctcca

SEQ ID NO: 248356 - DNA, 18 bp, Homo sapiens
ataccctaggtctccacc

SEQ ID NO: 248357 - DNA, 19 bp, Homo sapiens
ataccctaggtctccaccc

SEQ ID NO: 248358 - DNA, 18 bp, Homo sapiens
ataccgtttggtgtctga

SEQ ID NO: 248359 - DNA, 23 bp, Homo sapiens
ataccgtttggtgtctgatgtgt

SEQ ID NO: 248360 - DNA, 17 bp, Homo sapiens
atacctccattaaatgg

SEQ ID NO: 248361 - DNA, 18 bp, Homo sapiens
atacctctctctatatat

SEQ ID NO: 248362 - DNA, 20 bp, Homo sapiens
atacctctctctatatatac

SEQ ID NO: 248363 - DNA, 16 bp, Homo sapiens
atacctctttgaaaga

SEQ ID NO: 248364 - DNA, 19 bp, Homo sapiens
atacctggcttttacttta

SEQ ID NO: 248365 - DNA, 23 bp, Homo sapiens
atacctggcttttactttattaa

SEQ ID NO: 248366 - DNA, 13 bp, Homo sapiens
atacctttaaata

SEQ ID NO: 248367 - DNA, 14 bp, Homo sapiens
atacctttaaatat

SEQ ID NO: 248368 - DNA, 16 bp, Homo sapiens
atacctttaaatatca

SEQ ID NO: 248369 - DNA, 12 bp, Homo sapiens
atactaataaaa

SEQ ID NO: 248370 - DNA, 15 bp, Homo sapiens
atactaataaaaagg

SEQ ID NO: 248371 - DNA, 13 bp, Homo sapiens
atactaatttatt

SEQ ID NO: 248372 - DNA, 22 bp, Homo sapiens
atactaggttaacatttgtaat

SEQ ID NO: 248373 - DNA, 15 bp, Homo sapiens
atactataaatatat

SEQ ID NO: 248374 - DNA, 22 bp, Homo sapiens
atactattggacagacacagag

SEQ ID NO: 248375 - DNA, 17 bp, Homo sapiens
atactcacctcctccca

SEQ ID NO: 248376 - DNA, 22 bp, Homo sapiens
atactcacctcctcccagactt

SEQ ID NO: 248377 - DNA, 22 bp, Homo sapiens
atactccctttttgagtaattt

SEQ ID NO: 248378 - DNA, 20 bp, Homo sapiens
atactctcaccatttggatc

SEQ ID NO: 248379 - DNA, 21 bp, Homo sapiens
atactctgtgtaatctctgat

SEQ ID NO: 248380 - DNA, 22 bp, Homo sapiens
atactctgtgtaatctctgatt

SEQ ID NO: 248381 - DNA, 12 bp, Homo sapiens
atactctgttgc

SEQ ID NO: 248382 - DNA, 15 bp, Homo sapiens
atactctgttgcctc

SEQ ID NO: 248383 - DNA, 17 bp, Homo sapiens
atactctgttgcctcct

SEQ ID NO: 248384 - DNA, 18 bp, Homo sapiens
atactctgttgcctcctc

SEQ ID NO: 248385 - DNA, 19 bp, Homo sapiens
atactctgttgcctcctct

SEQ ID NO: 248386 - DNA, 20 bp, Homo sapiens
atactctgttgcctcctctc

SEQ ID NO: 248387 - DNA, 21 bp, Homo sapiens
atactctgttgcctcctctct

SEQ ID NO: 248388 - DNA, 14 bp, Homo sapiens
atactcttggtcac

SEQ ID NO: 248389 - DNA, 19 bp, Homo sapiens
atactcttggtcacctcaa

SEQ ID NO: 248390 - DNA, 14 bp, Homo sapiens
atactgaaacattt

SEQ ID NO: 248391 - DNA, 13 bp, Homo sapiens
atactgaatttct

SEQ ID NO: 248392 - DNA, 18 bp, Homo sapiens
atactgaatttctttgat

SEQ ID NO: 248393 - DNA, 16 bp, Homo sapiens
atactgagtgcctgca

SEQ ID NO: 248394 - DNA, 13 bp, Homo sapiens
atactgatgagac

SEQ ID NO: 248395 - DNA, 18 bp, Homo sapiens
atactgatgagacaacac

SEQ ID NO: 248396 - DNA, 21 bp, Homo sapiens
atactgatgagacaacacaca

SEQ ID NO: 248397 - DNA, 21 bp, Homo sapiens
atactgctgatgctgaaataa

SEQ ID NO: 248398 - DNA, 14 bp, Homo sapiens
atactgcttttgca

SEQ ID NO: 248399 - DNA, 14 bp, Homo sapiens
atactggaagtttt

SEQ ID NO: 248400 - DNA, 16 bp, Homo sapiens
atactggaagttttgc

SEQ ID NO: 248401 - DNA, 20 bp, Homo sapiens
atactggaagttttgcattt

SEQ ID NO: 248402 - DNA, 23 bp, Homo sapiens
atactgggttcttgttttatata

SEQ ID NO: 248403 - DNA, 14 bp, Homo sapiens
atactgtctaagaa

SEQ ID NO: 248404 - DNA, 20 bp, Homo sapiens
atactgtgtgggatacttag

SEQ ID NO: 248405 - DNA, 18 bp, Homo sapiens
atactgtttgtaatatac

SEQ ID NO: 248406 - DNA, 16 bp, Homo sapiens
atacttaaaaatatgt

SEQ ID NO: 248407 - DNA, 15 bp, Homo sapiens
atacttaatatgtgg

SEQ ID NO: 248408 - DNA, 20 bp, Homo sapiens
atacttagtggtatgtctct

SEQ ID NO: 248409 - DNA, 14 bp, Homo sapiens
atacttatctatat

SEQ ID NO: 248410 - DNA, 17 bp, Homo sapiens
atacttcaaaagccata

SEQ ID NO: 248411 - DNA, 16 bp, Homo sapiens
atacttctttttcatt

SEQ ID NO: 248412 - DNA, 20 bp, Homo sapiens
atacttgctccttgaataag

SEQ ID NO: 248413 - DNA, 13 bp, Homo sapiens
atactttatttct

SEQ ID NO: 248414 - DNA, 14 bp, Homo sapiens
atactttatttctg

SEQ ID NO: 248415 - DNA, 15 bp, Homo sapiens
atactttatttctga

SEQ ID NO: 248416 - DNA, 15 bp, Homo sapiens
atactttgtgtcttt

SEQ ID NO: 248417 - DNA, 22 bp, Homo sapiens
atacttttttttttgaggcaga

SEQ ID NO: 248418 - DNA, 14 bp, Homo sapiens
atagaaaaagcaca

SEQ ID NO: 248419 - DNA, 15 bp, Homo sapiens
atagaaaaagcacag

SEQ ID NO: 248420 - DNA, 21 bp, Homo sapiens
atagaaaacaggaaaaaaact

SEQ ID NO: 248421 - DNA, 17 bp, Homo sapiens
atagaaaactgaaaatc

SEQ ID NO: 248422 - DNA, 16 bp, Homo sapiens
atagaaatgtattttg

SEQ ID NO: 248423 - DNA, 22 bp, Homo sapiens
atagaaatgtattttgaaaaca

SEQ ID NO: 248424 - DNA, 15 bp, Homo sapiens
atagaactctgggct

SEQ ID NO: 248425 - DNA, 23 bp, Homo sapiens
atagaactgtcccacaaaatatt

SEQ ID NO: 248426 - DNA, 14 bp, Homo sapiens
atagaagatgtttg

SEQ ID NO: 248427 - DNA, 13 bp, Homo sapiens
atagaagctgtag

SEQ ID NO: 248428 - DNA, 21 bp, Homo sapiens
atagaagcttcttgctcctgt

SEQ ID NO: 248429 - DNA, 14 bp, Homo sapiens
atagaagtttagat

SEQ ID NO: 248430 - DNA, 22 bp, Homo sapiens
atagaatacttttttctagttt

SEQ ID NO: 248431 - DNA, 12 bp, Homo sapiens
atagaatattta

SEQ ID NO: 248432 - DNA, 13 bp, Homo sapiens
atagaatatttat

SEQ ID NO: 248433 - DNA, 22 bp, Homo sapiens
atagaatatttattacctctga

SEQ ID NO: 248434 - DNA, 17 bp, Homo sapiens
atagaatgaactgtcta

SEQ ID NO: 248435 - DNA, 16 bp, Homo sapiens
atagaatgttactttg

SEQ ID NO: 248436 - DNA, 19 bp, Homo sapiens
atagaatttttaatgtttt

SEQ ID NO: 248437 - DNA, 11 bp, Homo sapiens
atagacacagt

SEQ ID NO: 248438 - DNA, 13 bp, Homo sapiens
atagacttcgaaa

SEQ ID NO: 248439 - DNA, 23 bp, Homo sapiens
atagacttcgaaaacagatgaga

SEQ ID NO: 248440 - DNA, 17 bp, Homo sapiens
atagagagggggctctc

SEQ ID NO: 248441 - DNA, 14 bp, Homo sapiens
atagagatatttaa

SEQ ID NO: 248442 - DNA, 16 bp, Homo sapiens
atagagatatttaaaa

SEQ ID NO: 248443 - DNA, 18 bp, Homo sapiens
atagagatatttaaaaga

SEQ ID NO: 248444 - DNA, 17 bp, Homo sapiens
atagagatgagctttct

SEQ ID NO: 248445 - DNA, 16 bp, Homo sapiens
atagagatgtttttaa

SEQ ID NO: 248446 - DNA, 18 bp, Homo sapiens
atagaggatgatgtaatt

SEQ ID NO: 248447 - DNA, 21 bp, Homo sapiens
atagaggatgatgtaattaaa

SEQ ID NO: 248448 - DNA, 16 bp, Homo sapiens
atagaggtaccagcaa

SEQ ID NO: 248449 - DNA, 19 bp, Homo sapiens
atagagtacttaatatact

SEQ ID NO: 248450 - DNA, 18 bp, Homo sapiens
atagataccattttgaaa

SEQ ID NO: 248451 - DNA, 19 bp, Homo sapiens
atagatcaaagtcaaaaat

SEQ ID NO: 248452 - DNA, 17 bp, Homo sapiens
atagatcacggcatgtt

SEQ ID NO: 248453 - DNA, 15 bp, Homo sapiens
atagatcagtatttc

SEQ ID NO: 248454 - DNA, 14 bp, Homo sapiens
atagatcttctgaa

SEQ ID NO: 248455 - DNA, 18 bp, Homo sapiens
atagatgaactttttaac

SEQ ID NO: 248456 - DNA, 15 bp, Homo sapiens
atagattagattata

SEQ ID NO: 248457 - DNA, 13 bp, Homo sapiens
atagattcacctg

SEQ ID NO: 248458 - DNA, 15 bp, Homo sapiens
atagattcacctgta

SEQ ID NO: 248459 - DNA, 20 bp, Homo sapiens
atagatttaccctttataga

SEQ ID NO: 248460 - DNA, 16 bp, Homo sapiens
atagcaaacttggaat

SEQ ID NO: 248461 - DNA, 15 bp, Homo sapiens
atagcaacatgcttc

SEQ ID NO: 248462 - DNA, 22 bp, Homo sapiens
atagcaacctatttgactgctt

SEQ ID NO: 248463 - DNA, 16 bp, Homo sapiens
cctctggtttggggcg

SEQ ID NO: 248464 - DNA, 21 bp, Homo sapiens
cctctggtttggggcgaggca

SEQ ID NO: 248465 - DNA, 23 bp, Homo sapiens
cctctggtttggggcgaggcaga

SEQ ID NO: 248466 - DNA, 22 bp, Homo sapiens
cctctgtagctccctcctccca

SEQ ID NO: 248467 - DNA, 15 bp, Homo sapiens
cctctgtcagtttgt

SEQ ID NO: 248468 - DNA, 22 bp, Homo sapiens
cctctgtcatcactccctggat

SEQ ID NO: 248469 - DNA, 12 bp, Homo sapiens
cctctgtccaca

SEQ ID NO: 248470 - DNA, 16 bp, Homo sapiens
cctctgtccacatgtg

SEQ ID NO: 248471 - DNA, 22 bp, Homo sapiens
cctctgtccccgagccgagctc

SEQ ID NO: 248472 - DNA, 12 bp, Homo sapiens
cctctgtgccta

SEQ ID NO: 248473 - DNA, 18 bp, Homo sapiens
cctctgtgcctaataaag

SEQ ID NO: 248474 - DNA, 14 bp, Homo sapiens
cctctgtgctccct

SEQ ID NO: 248475 - DNA, 20 bp, Homo sapiens
cctctgttacatcctgctac

SEQ ID NO: 248476 - DNA, 19 bp, Homo sapiens
cctctgttctggtggcccc

SEQ ID NO: 248477 - DNA, 21 bp, Homo sapiens
cctctgttctggtggccccag

SEQ ID NO: 248478 - DNA, 21 bp, Homo sapiens
cctctgttggaaattgggtgt

SEQ ID NO: 248479 - DNA, 18 bp, Homo sapiens
cctctgttgtcctcccct

SEQ ID NO: 248480 - DNA, 23 bp, Homo sapiens
cctctgttgtcctccccttgggc

SEQ ID NO: 248481 - DNA, 17 bp, Homo sapiens
cctcttaaagctgcctg

SEQ ID NO: 248482 - DNA, 19 bp, Homo sapiens
cctcttaaagctgcctgta

SEQ ID NO: 248483 - DNA, 20 bp, Homo sapiens
cctcttaaagctgcctgtag

SEQ ID NO: 248484 - DNA, 22 bp, Homo sapiens
cctcttaaagctgcctgtagtt

SEQ ID NO: 248485 - DNA, 23 bp, Homo sapiens
cctcttaaagctgcctgtagtta

SEQ ID NO: 248486 - DNA, 17 bp, Homo sapiens
cctcttaagacactagt

SEQ ID NO: 248487 - DNA, 17 bp, Homo sapiens
cctcttaccgtagcctc

SEQ ID NO: 248488 - DNA, 18 bp, Homo sapiens
cctcttagcttttctgca

SEQ ID NO: 248489 - DNA, 22 bp, Homo sapiens
cctcttaggtcccgggaggaac

SEQ ID NO: 248490 - DNA, 19 bp, Homo sapiens
cctcttagtgattgtgtct

SEQ ID NO: 248491 - DNA, 17 bp, Homo sapiens
cctcttcaccccggcag

SEQ ID NO: 248492 - DNA, 19 bp, Homo sapiens
cctcttcaggggtcacctc

SEQ ID NO: 248493 - DNA, 20 bp, Homo sapiens
cctcttcccccttcccctgc

SEQ ID NO: 248494 - DNA, 20 bp, Homo sapiens
cctcttccctgtcttcccca

SEQ ID NO: 248495 - DNA, 22 bp, Homo sapiens
cctcttcccttagcctctccca

SEQ ID NO: 248496 - DNA, 17 bp, Homo sapiens
cctcttccttctctact

SEQ ID NO: 248497 - DNA, 16 bp, Homo sapiens
cctcttctcaagtgcc

SEQ ID NO: 248498 - DNA, 15 bp, Homo sapiens
cctcttctcagctcc

SEQ ID NO: 248499 - DNA, 22 bp, Homo sapiens
cctcttctcagctccactctga

SEQ ID NO: 248500 - DNA, 17 bp, Homo sapiens
cctcttctctgggccca

SEQ ID NO: 248501 - DNA, 19 bp, Homo sapiens
cctcttgagcagtggctgg

SEQ ID NO: 248502 - DNA, 24 bp, Homo sapiens
cctcttgagcagtggctggtccag

SEQ ID NO: 248503 - DNA, 14 bp, Homo sapiens
cctcttgccactgc

SEQ ID NO: 248504 - DNA, 22 bp, Homo sapiens
cctcttgccactgcctcttcct

SEQ ID NO: 248505 - DNA, 12 bp, Homo sapiens
cctcttgccccc

SEQ ID NO: 248506 - DNA, 18 bp, Homo sapiens
cctcttgcctctctcagg

SEQ ID NO: 248507 - DNA, 22 bp, Homo sapiens
cctcttgctcagagctaggccc

SEQ ID NO: 248508 - DNA, 12 bp, Homo sapiens
cctcttgctggt

SEQ ID NO: 248509 - DNA, 22 bp, Homo sapiens
cctctttactcccttcctggcc

SEQ ID NO: 248510 - DNA, 16 bp, Homo sapiens
cctctttcagaaaaca

SEQ ID NO: 248511 - DNA, 22 bp, Homo sapiens
cctctttctctctgtgtggcaa

SEQ ID NO: 248512 - DNA, 15 bp, Homo sapiens
cctctttgagtgaag

SEQ ID NO: 248513 - DNA, 15 bp, Homo sapiens
cctctttgcatggaa

SEQ ID NO: 248514 - DNA, 19 bp, Homo sapiens
cctctttgttttgttttaa

SEQ ID NO: 248515 - DNA, 18 bp, Homo sapiens
cctcttttccctctctag

SEQ ID NO: 248516 - DNA, 14 bp, Homo sapiens
cctcttttgagact

SEQ ID NO: 248517 - DNA, 14 bp, Homo sapiens
cctcttttggcctt

SEQ ID NO: 248518 - DNA, 20 bp, Homo sapiens
cctgaaaaatgactgtccca

SEQ ID NO: 248519 - DNA, 19 bp, Homo sapiens
cctgaaaacgaaggggccc

SEQ ID NO: 248520 - DNA, 16 bp, Homo sapiens
cctgaaacagccatgt

SEQ ID NO: 248521 - DNA, 18 bp, Homo sapiens
cctgaaacagccatgtcc

SEQ ID NO: 248522 - DNA, 19 bp, Homo sapiens
cctgaaagaggctgaggcc

SEQ ID NO: 248523 - DNA, 22 bp, Homo sapiens
cctgaaagaggctgaggcctgg

SEQ ID NO: 248524 - DNA, 14 bp, Homo sapiens
cctgaaataaaact

SEQ ID NO: 248525 - DNA, 21 bp, Homo sapiens
cctgaaatgtttccaggcatg

SEQ ID NO: 248526 - DNA, 13 bp, Homo sapiens
cctgaacaagaaa

SEQ ID NO: 248527 - DNA, 16 bp, Homo sapiens
cctgaacaagaaagag

SEQ ID NO: 248528 - DNA, 17 bp, Homo sapiens
cctgaagagcgctcctc

SEQ ID NO: 248529 - DNA, 20 bp, Homo sapiens
cctgaagagcgctcctctgc

SEQ ID NO: 248530 - DNA, 21 bp, Homo sapiens
cctgaagagcgctcctctgcc

SEQ ID NO: 248531 - DNA, 15 bp, Homo sapiens
cctgaagcctctgcc

SEQ ID NO: 248532 - DNA, 18 bp, Homo sapiens
cctgaagggtgacatccc

SEQ ID NO: 248533 - DNA, 16 bp, Homo sapiens
cctgaatattaatccc

SEQ ID NO: 248534 - DNA, 13 bp, Homo sapiens
cctgaatgaaata

SEQ ID NO: 248535 - DNA, 15 bp, Homo sapiens
cctgaatgcttctga

SEQ ID NO: 248536 - DNA, 22 bp, Homo sapiens
cctgaatggttccatgcctgag

SEQ ID NO: 248537 - DNA, 23 bp, Homo sapiens
cctgaatggttccatgcctgagg

SEQ ID NO: 248538 - DNA, 14 bp, Homo sapiens
cctgaattctattt

SEQ ID NO: 248539 - DNA, 21 bp, Homo sapiens
cctgaattctatttgctgggc

SEQ ID NO: 248540 - DNA, 18 bp, Homo sapiens
cctgacaatggcagctag

SEQ ID NO: 248541 - DNA, 16 bp, Homo sapiens
cctgacagaaggactc

SEQ ID NO: 248542 - DNA, 20 bp, Homo sapiens
cctgacagatgtcagccgag

SEQ ID NO: 248543 - DNA, 18 bp, Homo sapiens
cctgacagtcttgtgctt

SEQ ID NO: 248544 - DNA, 22 bp, Homo sapiens
cctgacatgtgacatctacctc

SEQ ID NO: 248545 - DNA, 20 bp, Homo sapiens
cctgaccacgctttctagct

SEQ ID NO: 248546 - DNA, 15 bp, Homo sapiens
cctgacccagtcccc

SEQ ID NO: 248547 - DNA, 21 bp, Homo sapiens
cctgaccctgtgatgcctgac

SEQ ID NO: 248548 - DNA, 18 bp, Homo sapiens
cctgacctcaagcaacca

SEQ ID NO: 248549 - DNA, 21 bp, Homo sapiens
cctgacctcatgatccaccca

SEQ ID NO: 248550 - DNA, 16 bp, Homo sapiens
cctgacctccctctaa

SEQ ID NO: 248551 - DNA, 13 bp, Homo sapiens
cctgacctggcac

SEQ ID NO: 248552 - DNA, 19 bp, Homo sapiens
cctgaccttagcgttctgg

SEQ ID NO: 248553 - DNA, 13 bp, Homo sapiens
cctgacgccctgc

SEQ ID NO: 248554 - DNA, 14 bp, Homo sapiens
cctgacgccctgcg

SEQ ID NO: 248555 - DNA, 22 bp, Homo sapiens
cctgacgccctgcgttggagcc

SEQ ID NO: 248556 - DNA, 20 bp, Homo sapiens
cctgactaatttttgtattt

SEQ ID NO: 248557 - DNA, 10 bp, Homo sapiens
cctgactcaa

SEQ ID NO: 248558 - DNA, 16 bp, Homo sapiens
cctgactcaggcatca

SEQ ID NO: 248559 - DNA, 18 bp, Homo sapiens
cctgactcgtctgactgt

SEQ ID NO: 248560 - DNA, 23 bp, Homo sapiens
cctgacttagcccgtcaccctta

SEQ ID NO: 248561 - DNA, 18 bp, Homo sapiens
cctgacttcccagctggc

SEQ ID NO: 248562 - DNA, 19 bp, Homo sapiens
cctgacttttacagctttt

SEQ ID NO: 248563 - DNA, 22 bp, Homo sapiens
cctgacttttacagcttttctc

SEQ ID NO: 248564 - DNA, 17 bp, Homo sapiens
cctgagaaagcccacct

SEQ ID NO: 248565 - DNA, 14 bp, Homo sapiens
cctgagaaggcgag

SEQ ID NO: 248566 - DNA, 20 bp, Homo sapiens
cctgagacgggcatcgcagg

SEQ ID NO: 248567 - DNA, 22 bp, Homo sapiens
cctgagacgggcatcgcaggag

SEQ ID NO: 248568 - DNA, 13 bp, Homo sapiens
cctgagactccag

SEQ ID NO: 248569 - DNA, 15 bp, Homo sapiens
cctgagagcagaatg

SEQ ID NO: 248570 - DNA, 19 bp, Homo sapiens
cctgagagcatgtggggga

SEQ ID NO: 248571 - DNA, 14 bp, Homo sapiens
cctgagattctggg

SEQ ID NO: 248572 - DNA, 16 bp, Homo sapiens
cctgagattctgggaa

SEQ ID NO: 248573 - DNA, 18 bp, Homo sapiens
cctgagattctgggaaag

SEQ ID NO: 248574 - DNA, 19 bp, Homo sapiens
cctgagcacccgctgacat

SEQ ID NO: 248575 - DNA, 22 bp, Homo sapiens
cctgagcagtctacttctgtgt

SEQ ID NO: 248576 - DNA, 23 bp, Homo sapiens
cctgagccacagtggggcccatg

SEQ ID NO: 248577 - DNA, 16 bp, Homo sapiens
cctgagcccaggagct

SEQ ID NO: 248578 - DNA, 18 bp, Homo sapiens
cctgagcccccacccggg

SEQ ID NO: 248579 - DNA, 17 bp, Homo sapiens
cctgagcctgccccagc

SEQ ID NO: 248580 - DNA, 13 bp, Homo sapiens
cctgagcctgtct

SEQ ID NO: 248581 - DNA, 15 bp, Homo sapiens
cctgagcctgtgggt

SEQ ID NO: 248582 - DNA, 17 bp, Homo sapiens
cctgagctgccatccag

SEQ ID NO: 248583 - DNA, 12 bp, Homo sapiens
cctgagctgggg

SEQ ID NO: 248584 - DNA, 16 bp, Homo sapiens
cctgagcttggccaga

SEQ ID NO: 248585 - DNA, 22 bp, Homo sapiens
cctgagctttccggggaggagc

SEQ ID NO: 248586 - DNA, 22 bp, Homo sapiens
cctgagctttggacgcacacag

SEQ ID NO: 248587 - DNA, 21 bp, Homo sapiens
cctgaggaaggaggggaagct

SEQ ID NO: 248588 - DNA, 23 bp, Homo sapiens
cctgaggaaggaggggaagctgc

SEQ ID NO: 248589 - DNA, 20 bp, Homo sapiens
cctgaggcagaacctggtgg

SEQ ID NO: 248590 - DNA, 21 bp, Homo sapiens
cctgaggcagaacctggtggc

SEQ ID NO: 248591 - DNA, 14 bp, Homo sapiens
cctgaggctggggc

SEQ ID NO: 248592 - DNA, 22 bp, Homo sapiens
cctgagggaagcccacccgccc

SEQ ID NO: 248593 - DNA, 22 bp, Homo sapiens
cctgagggcccctctgcccagc

SEQ ID NO: 248594 - DNA, 20 bp, Homo sapiens
cctgaggggcatctgcccct

SEQ ID NO: 248595 - DNA, 16 bp, Homo sapiens
caatttcctttatatt

SEQ ID NO: 248596 - DNA, 20 bp, Homo sapiens
caatttcctttatatttagt

SEQ ID NO: 248597 - DNA, 22 bp, Homo sapiens
caatttctcccgaatcctgagg

SEQ ID NO: 248598 - DNA, 17 bp, Homo sapiens
caatttcttctgtagct

SEQ ID NO: 248599 - DNA, 17 bp, Homo sapiens
caatttgggtcccagct

SEQ ID NO: 248600 - DNA, 23 bp, Homo sapiens
caatttgggtcccagctaaagag

SEQ ID NO: 248601 - DNA, 16 bp, Homo sapiens
caatttgtataaaatg

SEQ ID NO: 248602 - DNA, 15 bp, Homo sapiens
caattttaaaaaata

SEQ ID NO: 248603 - DNA, 18 bp, Homo sapiens
caattttaaaaaataaca

SEQ ID NO: 248604 - DNA, 19 bp, Homo sapiens
caattttaaaaaataacat

SEQ ID NO: 248605 - DNA, 13 bp, Homo sapiens
caattttgtatcc

SEQ ID NO: 248606 - DNA, 22 bp, Homo sapiens
caatttttacacaaacctgaaa

SEQ ID NO: 248607 - DNA, 21 bp, Homo sapiens
cacaaaaagaaagctgtgaaa

SEQ ID NO: 248608 - DNA, 22 bp, Homo sapiens
cacaaaaagaaagctgtgaaat

SEQ ID NO: 248609 - DNA, 22 bp, Homo sapiens
cacaaaacaacagcaacaacaa

SEQ ID NO: 248610 - DNA, 23 bp, Homo sapiens
cacaaaacaacagcaacaacaac

SEQ ID NO: 248611 - DNA, 15 bp, Homo sapiens
cacaaaatctgtcca

SEQ ID NO: 248612 - DNA, 14 bp, Homo sapiens
cacaaacacctcct

SEQ ID NO: 248613 - DNA, 17 bp, Homo sapiens
cacaaaccctggggact

SEQ ID NO: 248614 - DNA, 21 bp, Homo sapiens
cacaaagagttctggaaaaga

SEQ ID NO: 248615 - DNA, 22 bp, Homo sapiens
cacaaagataacgcaggagaga

SEQ ID NO: 248616 - DNA, 18 bp, Homo sapiens
cacaaagcggggggaggg

SEQ ID NO: 248617 - DNA, 17 bp, Homo sapiens
cacaaatgtcctcagag

SEQ ID NO: 248618 - DNA, 21 bp, Homo sapiens
cacaaatgtgtcccagtgaac

SEQ ID NO: 248619 - DNA, 11 bp, Homo sapiens
cacaacaaaaa

SEQ ID NO: 248620 - DNA, 17 bp, Homo sapiens
cacaacaaaaatttgaa

SEQ ID NO: 248621 - DNA, 18 bp, Homo sapiens
cacaacctcctcctccag

SEQ ID NO: 248622 - DNA, 23 bp, Homo sapiens
cacaacctctctgatcttgtgct

SEQ ID NO: 248623 - DNA, 19 bp, Homo sapiens
cacaaccttctgtggctca

SEQ ID NO: 248624 - DNA, 13 bp, Homo sapiens
cacaactaacaat

SEQ ID NO: 248625 - DNA, 19 bp, Homo sapiens
cacaactatttttccaaaa

SEQ ID NO: 248626 - DNA, 14 bp, Homo sapiens
cacaactctccaaa

SEQ ID NO: 248627 - DNA, 13 bp, Homo sapiens
cacaacttaaaaa

SEQ ID NO: 248628 - DNA, 12 bp, Homo sapiens
cacaagaaattt

SEQ ID NO: 248629 - DNA, 12 bp, Homo sapiens
cacaagaagtgg

SEQ ID NO: 248630 - DNA, 17 bp, Homo sapiens
cacaagaagtgggagtg

SEQ ID NO: 248631 - DNA, 22 bp, Homo sapiens
cacaagaagtgggagtgggaga

SEQ ID NO: 248632 - DNA, 22 bp, Homo sapiens
cacaagacccctgctcctgact

SEQ ID NO: 248633 - DNA, 15 bp, Homo sapiens
cacaagagacttaaa

SEQ ID NO: 248634 - DNA, 22 bp, Homo sapiens
cacaagagggactgtatttctg

SEQ ID NO: 248635 - DNA, 12 bp, Homo sapiens
cacaagctgcct

SEQ ID NO: 248636 - DNA, 17 bp, Homo sapiens
cacaagctgcctctgac

SEQ ID NO: 248637 - DNA, 18 bp, Homo sapiens
cacaaggaataaatgaga

SEQ ID NO: 248638 - DNA, 16 bp, Homo sapiens
cacaaggctgaaaagt

SEQ ID NO: 248639 - DNA, 12 bp, Homo sapiens
cacaaggctggc

SEQ ID NO: 248640 - DNA, 15 bp, Homo sapiens
cacaaggtcaggagt

SEQ ID NO: 248641 - DNA, 15 bp, Homo sapiens
cacaaggtccactcc

SEQ ID NO: 248642 - DNA, 15 bp, Homo sapiens
cacaaggtgggcagg

SEQ ID NO: 248643 - DNA, 21 bp, Homo sapiens
cacaagtagatgcctgaactt

SEQ ID NO: 248644 - DNA, 17 bp, Homo sapiens
cacaagtagattgatct

SEQ ID NO: 248645 - DNA, 20 bp, Homo sapiens
cacaagtcctgtgaatttct

SEQ ID NO: 248646 - DNA, 17 bp, Homo sapiens
cacaagttaagattctt

SEQ ID NO: 248647 - DNA, 20 bp, Homo sapiens
cacaagttaagattcttggt

SEQ ID NO: 248648 - DNA, 17 bp, Homo sapiens
cacaatagggttcaaat

SEQ ID NO: 248649 - DNA, 12 bp, Homo sapiens
cacaatatgaat

SEQ ID NO: 248650 - DNA, 20 bp, Homo sapiens
cacaatcctaacacattatc

SEQ ID NO: 248651 - DNA, 22 bp, Homo sapiens
cacaatcctaacacattatcgg

SEQ ID NO: 248652 - DNA, 17 bp, Homo sapiens
cacaatctcacacagct

SEQ ID NO: 248653 - DNA, 22 bp, Homo sapiens
cacaatggctgggagggggccc

SEQ ID NO: 248654 - DNA, 14 bp, Homo sapiens
cacaatgtactata

SEQ ID NO: 248655 - DNA, 22 bp, Homo sapiens
cacaatgtgatatgtgtaatat

SEQ ID NO: 248656 - DNA, 13 bp, Homo sapiens
cacaattagagaa

SEQ ID NO: 248657 - DNA, 13 bp, Homo sapiens
cacaattctgtcc

SEQ ID NO: 248658 - DNA, 15 bp, Homo sapiens
cacaattctgtccct

SEQ ID NO: 248659 - DNA, 23 bp, Homo sapiens
cacaattctgtccctgtccctgc

SEQ ID NO: 248660 - DNA, 20 bp, Homo sapiens
cacacaaaaaggagcgggca

SEQ ID NO: 248661 - DNA, 23 bp, Homo sapiens
cacacaaaaaggagcgggcaggg

SEQ ID NO: 248662 - DNA, 14 bp, Homo sapiens
cacacaaaacaaca

SEQ ID NO: 248663 - DNA, 17 bp, Homo sapiens
cacacaaaacaacagca

SEQ ID NO: 248664 - DNA, 16 bp, Homo sapiens
cacacaaacacctcct

SEQ ID NO: 248665 - DNA, 20 bp, Homo sapiens
cacacaaacacctcctagca

SEQ ID NO: 248666 - DNA, 11 bp, Homo sapiens
cacacaaatgc

SEQ ID NO: 248667 - DNA, 23 bp, Homo sapiens
cacacaaatgcagacacacaaca

SEQ ID NO: 248668 - DNA, 16 bp, Homo sapiens
cacacaacaccaggac

SEQ ID NO: 248669 - DNA, 17 bp, Homo sapiens
cacacaacaccaggact

SEQ ID NO: 248670 - DNA, 10 bp, Homo sapiens
cacacacaaa

SEQ ID NO: 248671 - DNA, 12 bp, Homo sapiens
cacacacaaaac

SEQ ID NO: 248672 - DNA, 14 bp, Homo sapiens
cacacacaaaacaa

SEQ ID NO: 248673 - DNA, 14 bp, Homo sapiens
cacacacaaatgca

SEQ ID NO: 248674 - DNA, 16 bp, Homo sapiens
cacacacacacacaca

SEQ ID NO: 248675 - DNA, 14 bp, Homo sapiens
cacacacacacagc

SEQ ID NO: 248676 - DNA, 15 bp, Homo sapiens
cacacacacacagcc

SEQ ID NO: 248677 - DNA, 13 bp, Homo sapiens
cacacacacacgc

SEQ ID NO: 248678 - DNA, 13 bp, Homo sapiens
cacacacacagcc

SEQ ID NO: 248679 - DNA, 14 bp, Homo sapiens
cacacacacagcca

SEQ ID NO: 248680 - DNA, 14 bp, Homo sapiens
cacacacacagctg

SEQ ID NO: 248681 - DNA, 12 bp, Homo sapiens
cacacacacagg

SEQ ID NO: 248682 - DNA, 13 bp, Homo sapiens
cacacacacagga

SEQ ID NO: 248683 - DNA, 13 bp, Homo sapiens
cacacacacccac

SEQ ID NO: 248684 - DNA, 13 bp, Homo sapiens
cacacacagccat

SEQ ID NO: 248685 - DNA, 13 bp, Homo sapiens
cacacacagctcc

SEQ ID NO: 248686 - DNA, 22 bp, Homo sapiens
cacacacagctgggcaaagcca

SEQ ID NO: 248687 - DNA, 12 bp, Homo sapiens
cacacacagctt

SEQ ID NO: 248688 - DNA, 12 bp, Homo sapiens
cacacacaggag

SEQ ID NO: 248689 - DNA, 15 bp, Homo sapiens
cacacaccacagaag

SEQ ID NO: 248690 - DNA, 15 bp, Homo sapiens
cacacacctgcctgc

SEQ ID NO: 248691 - DNA, 15 bp, Homo sapiens
cacacacgcacgcac

SEQ ID NO: 248692 - DNA, 16 bp, Homo sapiens
cacacacgcacgcaca

SEQ ID NO: 248693 - DNA, 16 bp, Homo sapiens
cacacacgcagacaca

SEQ ID NO: 248694 - DNA, 19 bp, Homo sapiens
cacacacgcagacacacac

SEQ ID NO: 248695 - DNA, 20 bp, Homo sapiens
cacacacgcagacacacaca

SEQ ID NO: 248696 - DNA, 21 bp, Homo sapiens
cacacactcgcccgcccactg

SEQ ID NO: 248697 - DNA, 14 bp, Homo sapiens
cacacagagtggtc

SEQ ID NO: 248698 - DNA, 15 bp, Homo sapiens
cacacagagtggtct

SEQ ID NO: 248699 - DNA, 10 bp, Homo sapiens
cacacagcca

SEQ ID NO: 248700 - DNA, 15 bp, Homo sapiens
cacacagccattcat

SEQ ID NO: 248701 - DNA, 19 bp, Homo sapiens
cacacagccattcatctgg

SEQ ID NO: 248702 - DNA, 21 bp, Homo sapiens
cacacagcctggcctcccctg

SEQ ID NO: 248703 - DNA, 13 bp, Homo sapiens
cacacagcctttc

SEQ ID NO: 248704 - DNA, 15 bp, Homo sapiens
cacacagctgcagag

SEQ ID NO: 248705 - DNA, 17 bp, Homo sapiens
cacacaggagtcctttc

SEQ ID NO: 248706 - DNA, 18 bp, Homo sapiens
cacacaggagtcctttct

SEQ ID NO: 248707 - DNA, 19 bp, Homo sapiens
cacacaggagtcctttctt

SEQ ID NO: 248708 - DNA, 17 bp, Homo sapiens
cacacaggcccatgccc

SEQ ID NO: 248709 - DNA, 16 bp, Homo sapiens
cacacaggcctggccc

SEQ ID NO: 248710 - DNA, 17 bp, Homo sapiens
cacacaggcctggccca

SEQ ID NO: 248711 - DNA, 20 bp, Homo sapiens
cacacaggcctggcccagcc

SEQ ID NO: 248712 - DNA, 23 bp, Homo sapiens
cacacaggcctggcccagccagc

SEQ ID NO: 248713 - DNA, 22 bp, Homo sapiens
cacacaggggaggtgatagcat

SEQ ID NO: 248714 - DNA, 23 bp, Homo sapiens
cacacagtgggccggccccaggc

SEQ ID NO: 248715 - DNA, 12 bp, Homo sapiens
cacacatacaca

SEQ ID NO: 248716 - DNA, 17 bp, Homo sapiens
cacacatagtttctttt

SEQ ID NO: 248717 - DNA, 12 bp, Homo sapiens
cacacatttaaa

SEQ ID NO: 248718 - DNA, 21 bp, Homo sapiens
cacaccaccgccctcctcgct

SEQ ID NO: 248719 - DNA, 22 bp, Homo sapiens
cacaccacgtccttattggaat

SEQ ID NO: 248720 - DNA, 14 bp, Homo sapiens
cacaccactgccct

SEQ ID NO: 248721 - DNA, 15 bp, Homo sapiens
cacaccactgccctg

SEQ ID NO: 248722 - DNA, 16 bp, Homo sapiens
cacaccactgccctgc

SEQ ID NO: 248723 - DNA, 19 bp, Homo sapiens
cacaccagaagtgccatgc

SEQ ID NO: 248724 - DNA, 23 bp, Homo sapiens
cacaccaggccgtcctcccgggc

SEQ ID NO: 248725 - DNA, 20 bp, Homo sapiens
cacaccaggctgtgggcctc

SEQ ID NO: 248726 - DNA, 15 bp, Homo sapiens
cacacccaggaaggg

SEQ ID NO: 248727 - DNA, 16 bp, Homo sapiens
cacaccccgtctgccc

SEQ ID NO: 248728 - DNA, 17 bp, Homo sapiens
cacaccccgtctgcccc

SEQ ID NO: 248729 - DNA, 20 bp, Homo sapiens
cacaccccgtctgccccttg

SEQ ID NO: 248730 - DNA, 15 bp, Homo sapiens
cctgagggtggagac

SEQ ID NO: 248731 - DNA, 20 bp, Homo sapiens
cctgagggtttccaccttgg

SEQ ID NO: 248732 - DNA, 16 bp, Homo sapiens
cctgaggttaagggga

SEQ ID NO: 248733 - DNA, 22 bp, Homo sapiens
cctgagtaccttctacaggccc

SEQ ID NO: 248734 - DNA, 19 bp, Homo sapiens
cctgagtagctggattaca

SEQ ID NO: 248735 - DNA, 16 bp, Homo sapiens
cctgagtcagggccca

SEQ ID NO: 248736 - DNA, 17 bp, Homo sapiens
cctgagtcagggcccag

SEQ ID NO: 248737 - DNA, 21 bp, Homo sapiens
cctgagtcagggcccagaggc

SEQ ID NO: 248738 - DNA, 17 bp, Homo sapiens
cctgagtccccacctgc

SEQ ID NO: 248739 - DNA, 14 bp, Homo sapiens
cctgagtctcctgt

SEQ ID NO: 248740 - DNA, 16 bp, Homo sapiens
cctgagtctcctgtgc

SEQ ID NO: 248741 - DNA, 12 bp, Homo sapiens
cctgagtggtga

SEQ ID NO: 248742 - DNA, 23 bp, Homo sapiens
cctgagttgcaccattctttctt

SEQ ID NO: 248743 - DNA, 23 bp, Homo sapiens
cctgagttggcgttgtgggcagg

SEQ ID NO: 248744 - DNA, 22 bp, Homo sapiens
cctgataaacattaaacactgt

SEQ ID NO: 248745 - DNA, 22 bp, Homo sapiens
cctgatagctacccacagagca

SEQ ID NO: 248746 - DNA, 20 bp, Homo sapiens
cctgatagtcacctgctggt

SEQ ID NO: 248747 - DNA, 20 bp, Homo sapiens
cctgatcattacatggctgt

SEQ ID NO: 248748 - DNA, 15 bp, Homo sapiens
cctgatgccccttcc

SEQ ID NO: 248749 - DNA, 16 bp, Homo sapiens
cctgatgccccttccc

SEQ ID NO: 248750 - DNA, 17 bp, Homo sapiens
cctgatgcgtctaccca

SEQ ID NO: 248751 - DNA, 20 bp, Homo sapiens
cctgatgcgtctacccagac

SEQ ID NO: 248752 - DNA, 22 bp, Homo sapiens
cctgatgcgtctacccagactc

SEQ ID NO: 248753 - DNA, 23 bp, Homo sapiens
cctgatgcgtctacccagactca

SEQ ID NO: 248754 - DNA, 13 bp, Homo sapiens
cctgatgctccct

SEQ ID NO: 248755 - DNA, 16 bp, Homo sapiens
cctgatgctgccccgt

SEQ ID NO: 248756 - DNA, 18 bp, Homo sapiens
cctgatggagaggagaac

SEQ ID NO: 248757 - DNA, 12 bp, Homo sapiens
cctgatggccaa

SEQ ID NO: 248758 - DNA, 21 bp, Homo sapiens
cctgatggccaagggggtgga

SEQ ID NO: 248759 - DNA, 21 bp, Homo sapiens
cctgatggtacaggaaagctc

SEQ ID NO: 248760 - DNA, 18 bp, Homo sapiens
cctgatggtcagctccct

SEQ ID NO: 248761 - DNA, 22 bp, Homo sapiens
cctgatggtcagctcccttctc

SEQ ID NO: 248762 - DNA, 17 bp, Homo sapiens
cctgatgttaaaattcc

SEQ ID NO: 248763 - DNA, 18 bp, Homo sapiens
cctgattattgaatgtta

SEQ ID NO: 248764 - DNA, 14 bp, Homo sapiens
cctgattggggcct

SEQ ID NO: 248765 - DNA, 20 bp, Homo sapiens
cctgattgtgtatattcata

SEQ ID NO: 248766 - DNA, 14 bp, Homo sapiens
cctgcaaaatttta

SEQ ID NO: 248767 - DNA, 16 bp, Homo sapiens
cctgcaaactcactgc

SEQ ID NO: 248768 - DNA, 22 bp, Homo sapiens
cctgcaaactcactgctcaaga

SEQ ID NO: 248769 - DNA, 18 bp, Homo sapiens
cctgcaactcaaggactt

SEQ ID NO: 248770 - DNA, 15 bp, Homo sapiens
cctgcaagagtgggc

SEQ ID NO: 248771 - DNA, 15 bp, Homo sapiens
cctgcaagccccagg

SEQ ID NO: 248772 - DNA, 13 bp, Homo sapiens
cctgcaaggccca

SEQ ID NO: 248773 - DNA, 14 bp, Homo sapiens
cctgcaaggcccac

SEQ ID NO: 248774 - DNA, 15 bp, Homo sapiens
cctgcaaggcccaca

SEQ ID NO: 248775 - DNA, 18 bp, Homo sapiens
cctgcaatctccagggct

SEQ ID NO: 248776 - DNA, 20 bp, Homo sapiens
cctgcaatctccagggctgc

SEQ ID NO: 248777 - DNA, 19 bp, Homo sapiens
cctgcaatttcatatgctg

SEQ ID NO: 248778 - DNA, 14 bp, Homo sapiens
cctgcacacacctg

SEQ ID NO: 248779 - DNA, 22 bp, Homo sapiens
cctgcaccagcccttccctgct

SEQ ID NO: 248780 - DNA, 14 bp, Homo sapiens
cctgcaccaggaga

SEQ ID NO: 248781 - DNA, 15 bp, Homo sapiens
cctgcacccacccct

SEQ ID NO: 248782 - DNA, 19 bp, Homo sapiens
cctgcacccacccctgccc

SEQ ID NO: 248783 - DNA, 21 bp, Homo sapiens
cctgcacccacccctgcccag

SEQ ID NO: 248784 - DNA, 21 bp, Homo sapiens
cctgcaccccagcattccagc

SEQ ID NO: 248785 - DNA, 22 bp, Homo sapiens
cctgcaccccagcattccagct

SEQ ID NO: 248786 - DNA, 12 bp, Homo sapiens
cctgcaccctct

SEQ ID NO: 248787 - DNA, 13 bp, Homo sapiens
cctgcaccctgga

SEQ ID NO: 248788 - DNA, 15 bp, Homo sapiens
cctgcaccctggaaa

SEQ ID NO: 248789 - DNA, 12 bp, Homo sapiens
cctgcactgtaa

SEQ ID NO: 248790 - DNA, 14 bp, Homo sapiens
cctgcagagctggg

SEQ ID NO: 248791 - DNA, 12 bp, Homo sapiens
cctgcagaggcc

SEQ ID NO: 248792 - DNA, 18 bp, Homo sapiens
cctgcagcctcctcctga

SEQ ID NO: 248793 - DNA, 19 bp, Homo sapiens
cctgcagcctcctcctgac

SEQ ID NO: 248794 - DNA, 12 bp, Homo sapiens
cctgcagcctgg

SEQ ID NO: 248795 - DNA, 16 bp, Homo sapiens
cctgcagcctggaggc

SEQ ID NO: 248796 - DNA, 16 bp, Homo sapiens
cctgcaggaacgagca

SEQ ID NO: 248797 - DNA, 17 bp, Homo sapiens
cctgcaggaacgagcac

SEQ ID NO: 248798 - DNA, 22 bp, Homo sapiens
cctgcaggaacgagcactggcc

SEQ ID NO: 248799 - DNA, 21 bp, Homo sapiens
cctgcaggaggcctgggaggg

SEQ ID NO: 248800 - DNA, 23 bp, Homo sapiens
cctgcaggaggcctgggagggca

SEQ ID NO: 248801 - DNA, 12 bp, Homo sapiens
cctgcaggcccc

SEQ ID NO: 248802 - DNA, 20 bp, Homo sapiens
cctgcaggccccagccaagt

SEQ ID NO: 248803 - DNA, 20 bp, Homo sapiens
cctgcaggctggctgttggc

SEQ ID NO: 248804 - DNA, 16 bp, Homo sapiens
cctgcagggtaggggg

SEQ ID NO: 248805 - DNA, 19 bp, Homo sapiens
cctgcagggtggtgctggg

SEQ ID NO: 248806 - DNA, 20 bp, Homo sapiens
cctgcagggtggtgctggga

SEQ ID NO: 248807 - DNA, 23 bp, Homo sapiens
cctgcagggtggtgctgggactg

SEQ ID NO: 248808 - DNA, 21 bp, Homo sapiens
cctgcagtgttcgcttggctc

SEQ ID NO: 248809 - DNA, 15 bp, Homo sapiens
cctgcagttcctgag

SEQ ID NO: 248810 - DNA, 21 bp, Homo sapiens
cctgcatatctctagtccctg

SEQ ID NO: 248811 - DNA, 13 bp, Homo sapiens
cctgcatattgtg

SEQ ID NO: 248812 - DNA, 18 bp, Homo sapiens
cctgcatcagcctctggc

SEQ ID NO: 248813 - DNA, 16 bp, Homo sapiens
cctgcatccctccacc

SEQ ID NO: 248814 - DNA, 18 bp, Homo sapiens
cctgcatcccttggcccc

SEQ ID NO: 248815 - DNA, 23 bp, Homo sapiens
cctgcatcccttggcccctctct

SEQ ID NO: 248816 - DNA, 22 bp, Homo sapiens
cctgcatctatcgagtttgcaa

SEQ ID NO: 248817 - DNA, 17 bp, Homo sapiens
cctgcatctttcatagt

SEQ ID NO: 248818 - DNA, 16 bp, Homo sapiens
cctgcatgcaactaat

SEQ ID NO: 248819 - DNA, 16 bp, Homo sapiens
cctgcattcgcagcag

SEQ ID NO: 248820 - DNA, 23 bp, Homo sapiens
cctgcattcgcagcagctccgcc

SEQ ID NO: 248821 - DNA, 23 bp, Homo sapiens
cctgcatttgtgaaatgatggtg

SEQ ID NO: 248822 - DNA, 10 bp, Homo sapiens
cctgcatttt

SEQ ID NO: 248823 - DNA, 14 bp, Homo sapiens
cctgccaactttcc

SEQ ID NO: 248824 - DNA, 15 bp, Homo sapiens
cctgccaactttcca

SEQ ID NO: 248825 - DNA, 15 bp, Homo sapiens
cctgccaagcctgga

SEQ ID NO: 248826 - DNA, 17 bp, Homo sapiens
cctgccaagcctggagc

SEQ ID NO: 248827 - DNA, 15 bp, Homo sapiens
cctgccaatgccaca

SEQ ID NO: 248828 - DNA, 18 bp, Homo sapiens
cctgccaatgccacagcc

SEQ ID NO: 248829 - DNA, 19 bp, Homo sapiens
cctgccaccgtcacacagt

SEQ ID NO: 248830 - DNA, 13 bp, Homo sapiens
cctgccacctccc

SEQ ID NO: 248831 - DNA, 17 bp, Homo sapiens
cctgccacctcctgcct

SEQ ID NO: 248832 - DNA, 19 bp, Homo sapiens
cctgccacctcctgcctca

SEQ ID NO: 248833 - DNA, 16 bp, Homo sapiens
cctgccacctggggca

SEQ ID NO: 248834 - DNA, 12 bp, Homo sapiens
cctgccacctgt

SEQ ID NO: 248835 - DNA, 13 bp, Homo sapiens
cctgccacctgtc

SEQ ID NO: 248836 - DNA, 19 bp, Homo sapiens
cctgccactaggctgggtg

SEQ ID NO: 248837 - DNA, 20 bp, Homo sapiens
cctgccactaggctgggtgc

SEQ ID NO: 248838 - DNA, 16 bp, Homo sapiens
cctgccactctctggg

SEQ ID NO: 248839 - DNA, 18 bp, Homo sapiens
cctgccactctctgggac

SEQ ID NO: 248840 - DNA, 12 bp, Homo sapiens
cctgccagcaac

SEQ ID NO: 248841 - DNA, 14 bp, Homo sapiens
cctgccagctgcct

SEQ ID NO: 248842 - DNA, 16 bp, Homo sapiens
cctgccagctgccttc

SEQ ID NO: 248843 - DNA, 10 bp, Homo sapiens
cctgccagga

SEQ ID NO: 248844 - DNA, 18 bp, Homo sapiens
cctgccaggctctccctc

SEQ ID NO: 248845 - DNA, 17 bp, Homo sapiens
cctgccagtgaagtcct

SEQ ID NO: 248846 - DNA, 15 bp, Homo sapiens
cctgcccaagggcct

SEQ ID NO: 248847 - DNA, 12 bp, Homo sapiens
cctgcccacccg

SEQ ID NO: 248848 - DNA, 13 bp, Homo sapiens
cctgcccacccgt

SEQ ID NO: 248849 - DNA, 22 bp, Homo sapiens
cctgcccacccgtggagatggg

SEQ ID NO: 248850 - DNA, 20 bp, Homo sapiens
cctgcccagatgccctttgg

SEQ ID NO: 248851 - DNA, 13 bp, Homo sapiens
cctgcccagctct

SEQ ID NO: 248852 - DNA, 14 bp, Homo sapiens
cctgcccagctctg

SEQ ID NO: 248853 - DNA, 19 bp, Homo sapiens
cctgcccagctctgaccct

SEQ ID NO: 248854 - DNA, 18 bp, Homo sapiens
cctgcccaggccggccag

SEQ ID NO: 248855 - DNA, 23 bp, Homo sapiens
cctgcccagtgttgtttgtaaat

SEQ ID NO: 248856 - DNA, 12 bp, Homo sapiens
cctgccccacac

SEQ ID NO: 248857 - DNA, 14 bp, Homo sapiens
cctgccccacacag

SEQ ID NO: 248858 - DNA, 20 bp, Homo sapiens
cctgccccacacaggcctgg

SEQ ID NO: 248859 - DNA, 16 bp, Homo sapiens
cctgccccacacggac

SEQ ID NO: 248860 - DNA, 12 bp, Homo sapiens
cctgccccagag

SEQ ID NO: 248861 - DNA, 14 bp, Homo sapiens
cctgccccagagaa

SEQ ID NO: 248862 - DNA, 17 bp, Homo sapiens
cctgccccagagaagcc

SEQ ID NO: 248863 - DNA, 16 bp, Homo sapiens
cctgccccagctgggc

SEQ ID NO: 248864 - DNA, 17 bp, Homo sapiens
cacacccctgccggcct

SEQ ID NO: 248865 - DNA, 23 bp, Homo sapiens
cacacccgacaccagccctgctg

SEQ ID NO: 248866 - DNA, 18 bp, Homo sapiens
cacaccctcactctgcca

SEQ ID NO: 248867 - DNA, 17 bp, Homo sapiens
cacaccctccagcacag

SEQ ID NO: 248868 - DNA, 19 bp, Homo sapiens
cacaccctccagcacagac

SEQ ID NO: 248869 - DNA, 13 bp, Homo sapiens
cacaccctgcaag

SEQ ID NO: 248870 - DNA, 12 bp, Homo sapiens
cacacccttccc

SEQ ID NO: 248871 - DNA, 13 bp, Homo sapiens
cacacccttcccc

SEQ ID NO: 248872 - DNA, 17 bp, Homo sapiens
cacacccttccccactc

SEQ ID NO: 248873 - DNA, 22 bp, Homo sapiens
cacacctcagttcccttggcct

SEQ ID NO: 248874 - DNA, 18 bp, Homo sapiens
cacacctccacccgtcct

SEQ ID NO: 248875 - DNA, 14 bp, Homo sapiens
cacacctctgggct

SEQ ID NO: 248876 - DNA, 18 bp, Homo sapiens
cacacctgcctctgaact

SEQ ID NO: 248877 - DNA, 12 bp, Homo sapiens
cacacctgcctg

SEQ ID NO: 248878 - DNA, 13 bp, Homo sapiens
cacacctggccag

SEQ ID NO: 248879 - DNA, 23 bp, Homo sapiens
cacacctgggcccgggcaggcca

SEQ ID NO: 248880 - DNA, 24 bp, Homo sapiens
cacacctgggcccgggcaggccag

SEQ ID NO: 248881 - DNA, 14 bp, Homo sapiens
cacacgcacacaca

SEQ ID NO: 248882 - DNA, 15 bp, Homo sapiens
cacacgcacacacac

SEQ ID NO: 248883 - DNA, 23 bp, Homo sapiens
cacacgcacacacacacacagga

SEQ ID NO: 248884 - DNA, 21 bp, Homo sapiens
cacacgcacgcacacacacaa

SEQ ID NO: 248885 - DNA, 16 bp, Homo sapiens
cacacgcagacacaca

SEQ ID NO: 248886 - DNA, 18 bp, Homo sapiens
cacacgcagacacacaca

SEQ ID NO: 248887 - DNA, 20 bp, Homo sapiens
cacacgccggggctggccct

SEQ ID NO: 248888 - DNA, 13 bp, Homo sapiens
cacacgctgccca

SEQ ID NO: 248889 - DNA, 17 bp, Homo sapiens
cacacgctgcccaggct

SEQ ID NO: 248890 - DNA, 22 bp, Homo sapiens
cacacgctgcccaggctctgct

SEQ ID NO: 248891 - DNA, 17 bp, Homo sapiens
cacacggactcccgggc

SEQ ID NO: 248892 - DNA, 19 bp, Homo sapiens
cacacggggcacccagccc

SEQ ID NO: 248893 - DNA, 17 bp, Homo sapiens
cacacgtacttaaatga

SEQ ID NO: 248894 - DNA, 20 bp, Homo sapiens
cacacgtctgaccctctcca

SEQ ID NO: 248895 - DNA, 18 bp, Homo sapiens
cacacgtgtgatgtatgt

SEQ ID NO: 248896 - DNA, 21 bp, Homo sapiens
cacactaacctgggttccctt

SEQ ID NO: 248897 - DNA, 20 bp, Homo sapiens
cacactattaccatgagaag

SEQ ID NO: 248898 - DNA, 13 bp, Homo sapiens
cacactcagtccc

SEQ ID NO: 248899 - DNA, 18 bp, Homo sapiens
cacactgacataatgtag

SEQ ID NO: 248900 - DNA, 15 bp, Homo sapiens
cacactgaccacact

SEQ ID NO: 248901 - DNA, 18 bp, Homo sapiens
cacactgctaaatttacg

SEQ ID NO: 248902 - DNA, 12 bp, Homo sapiens
cacactgctggg

SEQ ID NO: 248903 - DNA, 20 bp, Homo sapiens
cacactgtgcgttttagagt

SEQ ID NO: 248904 - DNA, 12 bp, Homo sapiens
cacacttcaaat

SEQ ID NO: 248905 - DNA, 14 bp, Homo sapiens
cacacttcaggctc

SEQ ID NO: 248906 - DNA, 18 bp, Homo sapiens
cacacttcaggctcttct

SEQ ID NO: 248907 - DNA, 15 bp, Homo sapiens
cacacttcctgtcca

SEQ ID NO: 248908 - DNA, 23 bp, Homo sapiens
cacacttcctgtccagagagaga

SEQ ID NO: 248909 - DNA, 22 bp, Homo sapiens
cacacttctgtgagacccccac

SEQ ID NO: 248910 - DNA, 17 bp, Homo sapiens
cacacttgagaggatga

SEQ ID NO: 248911 - DNA, 17 bp, Homo sapiens
cacactttttaagaaat

SEQ ID NO: 248912 - DNA, 14 bp, Homo sapiens
cacagaaaccctgt

SEQ ID NO: 248913 - DNA, 20 bp, Homo sapiens
cacagaaatcagaggagaga

SEQ ID NO: 248914 - DNA, 16 bp, Homo sapiens
cacagaacctttgtca

SEQ ID NO: 248915 - DNA, 22 bp, Homo sapiens
cacagaacctttgtcaacttca

SEQ ID NO: 248916 - DNA, 16 bp, Homo sapiens
cacagaactcagcctt

SEQ ID NO: 248917 - DNA, 20 bp, Homo sapiens
cacagaagacacgtgttttt

SEQ ID NO: 248918 - DNA, 14 bp, Homo sapiens
cacagacacacaca

SEQ ID NO: 248919 - DNA, 18 bp, Homo sapiens
cacagacacacacacgca

SEQ ID NO: 248920 - DNA, 15 bp, Homo sapiens
cacagacagatccca

SEQ ID NO: 248921 - DNA, 17 bp, Homo sapiens
cacagacagatcccatc

SEQ ID NO: 248922 - DNA, 15 bp, Homo sapiens
cacagacgccacctg

SEQ ID NO: 248923 - DNA, 16 bp, Homo sapiens
cacagacgtccctcca

SEQ ID NO: 248924 - DNA, 11 bp, Homo sapiens
cacagactctg

SEQ ID NO: 248925 - DNA, 13 bp, Homo sapiens
cacagactgttcc

SEQ ID NO: 248926 - DNA, 23 bp, Homo sapiens
cacagactgttccctccaaggtc

SEQ ID NO: 248927 - DNA, 21 bp, Homo sapiens
cacagacttcacacagcacct

SEQ ID NO: 248928 - DNA, 23 bp, Homo sapiens
cacagacttctggaaggctggct

SEQ ID NO: 248929 - DNA, 23 bp, Homo sapiens
cacagagaactagtggtggctct

SEQ ID NO: 248930 - DNA, 14 bp, Homo sapiens
cacagagacacagg

SEQ ID NO: 248931 - DNA, 12 bp, Homo sapiens
cacagagagaaa

SEQ ID NO: 248932 - DNA, 19 bp, Homo sapiens
cacagagcgtccttccccc

SEQ ID NO: 248933 - DNA, 19 bp, Homo sapiens
cacagaggacagtgctgac

SEQ ID NO: 248934 - DNA, 17 bp, Homo sapiens
cacagaggcagtggcag

SEQ ID NO: 248935 - DNA, 18 bp, Homo sapiens
cacagagtggtctttctg

SEQ ID NO: 248936 - DNA, 19 bp, Homo sapiens
cacagagtttgtagtaaat

SEQ ID NO: 248937 - DNA, 21 bp, Homo sapiens
cacagagtttgtagtaaatat

SEQ ID NO: 248938 - DNA, 23 bp, Homo sapiens
cacagagtttgtagtaaatatta

SEQ ID NO: 248939 - DNA, 15 bp, Homo sapiens
cacagatacacatac

SEQ ID NO: 248940 - DNA, 20 bp, Homo sapiens
cacagatattgttataaata

SEQ ID NO: 248941 - DNA, 12 bp, Homo sapiens
cacagatctgga

SEQ ID NO: 248942 - DNA, 20 bp, Homo sapiens
cacagatgccatggcctgtg

SEQ ID NO: 248943 - DNA, 22 bp, Homo sapiens
cacagatgccatggcctgtgct

SEQ ID NO: 248944 - DNA, 12 bp, Homo sapiens
cacagatggatt

SEQ ID NO: 248945 - DNA, 19 bp, Homo sapiens
cacagatgggcaaggcctt

SEQ ID NO: 248946 - DNA, 20 bp, Homo sapiens
cacagatgggtattaaactt

SEQ ID NO: 248947 - DNA, 16 bp, Homo sapiens
cacagcaattttgtat

SEQ ID NO: 248948 - DNA, 23 bp, Homo sapiens
cacagcacatgctggccagcctg

SEQ ID NO: 248949 - DNA, 22 bp, Homo sapiens
cacagcagcttcaccagagcat

SEQ ID NO: 248950 - DNA, 19 bp, Homo sapiens
cacagcagtacttgctcaa

SEQ ID NO: 248951 - DNA, 19 bp, Homo sapiens
cacagcagtatgaatgatg

SEQ ID NO: 248952 - DNA, 17 bp, Homo sapiens
cacagcatgtgccaaga

SEQ ID NO: 248953 - DNA, 13 bp, Homo sapiens
cacagccaagccc

SEQ ID NO: 248954 - DNA, 11 bp, Homo sapiens
cacagccagaa

SEQ ID NO: 248955 - DNA, 20 bp, Homo sapiens
cacagccagaaactgaactg

SEQ ID NO: 248956 - DNA, 13 bp, Homo sapiens
cacagccagaacc

SEQ ID NO: 248957 - DNA, 12 bp, Homo sapiens
cacagccagccc

SEQ ID NO: 248958 - DNA, 21 bp, Homo sapiens
cacagccagcccagctccact

SEQ ID NO: 248959 - DNA, 20 bp, Homo sapiens
cacagccattcatctgggct

SEQ ID NO: 248960 - DNA, 22 bp, Homo sapiens
cacagccattcatctgggctgg

SEQ ID NO: 248961 - DNA, 13 bp, Homo sapiens
cacagcccagcca

SEQ ID NO: 248962 - DNA, 15 bp, Homo sapiens
cacagcccgcatgca

SEQ ID NO: 248963 - DNA, 21 bp, Homo sapiens
cacagcccgcatgcagcagct

SEQ ID NO: 248964 - DNA, 12 bp, Homo sapiens
cacagccctggg

SEQ ID NO: 248965 - DNA, 15 bp, Homo sapiens
cacagccctgggagg

SEQ ID NO: 248966 - DNA, 17 bp, Homo sapiens
cacagccctgggagggg

SEQ ID NO: 248967 - DNA, 20 bp, Homo sapiens
cacagccggggcctgcctag

SEQ ID NO: 248968 - DNA, 23 bp, Homo sapiens
cacagccgtttgaatatatttta

SEQ ID NO: 248969 - DNA, 12 bp, Homo sapiens
cacagcctctcc

SEQ ID NO: 248970 - DNA, 13 bp, Homo sapiens
cacagcctggcct

SEQ ID NO: 248971 - DNA, 16 bp, Homo sapiens
cacagcctggcctccc

SEQ ID NO: 248972 - DNA, 15 bp, Homo sapiens
cacagcctttctgta

SEQ ID NO: 248973 - DNA, 20 bp, Homo sapiens
cacagcggggccccagggct

SEQ ID NO: 248974 - DNA, 15 bp, Homo sapiens
cacagctaacatgga

SEQ ID NO: 248975 - DNA, 22 bp, Homo sapiens
cacagctaacatggaagtacta

SEQ ID NO: 248976 - DNA, 16 bp, Homo sapiens
cacagctacctgagac

SEQ ID NO: 248977 - DNA, 17 bp, Homo sapiens
cacagctctcactggcc

SEQ ID NO: 248978 - DNA, 21 bp, Homo sapiens
cacagctctcactggccagta

SEQ ID NO: 248979 - DNA, 14 bp, Homo sapiens
cacagctctgtgtt

SEQ ID NO: 248980 - DNA, 18 bp, Homo sapiens
cacagctgagagactttt

SEQ ID NO: 248981 - DNA, 12 bp, Homo sapiens
cacagctgcagc

SEQ ID NO: 248982 - DNA, 13 bp, Homo sapiens
cacagctgcagct

SEQ ID NO: 248983 - DNA, 14 bp, Homo sapiens
cacagctgcagctg

SEQ ID NO: 248984 - DNA, 15 bp, Homo sapiens
cacagctgcagctgg

SEQ ID NO: 248985 - DNA, 16 bp, Homo sapiens
cacagctgctggccag

SEQ ID NO: 248986 - DNA, 19 bp, Homo sapiens
cacagctgggcaaagccac

SEQ ID NO: 248987 - DNA, 22 bp, Homo sapiens
cacagctgtggtgaggttgggc

SEQ ID NO: 248988 - DNA, 15 bp, Homo sapiens
cacagcttggggcca

SEQ ID NO: 248989 - DNA, 21 bp, Homo sapiens
cacagcttttagtacccacct

SEQ ID NO: 248990 - DNA, 19 bp, Homo sapiens
cacaggacgatttcactga

SEQ ID NO: 248991 - DNA, 20 bp, Homo sapiens
cacaggaggcaagcaagctc

SEQ ID NO: 248992 - DNA, 18 bp, Homo sapiens
cacaggcaacattacaaa

SEQ ID NO: 248993 - DNA, 16 bp, Homo sapiens
cacaggcagctggatg

SEQ ID NO: 248994 - DNA, 16 bp, Homo sapiens
cacaggcaggggtaga

SEQ ID NO: 248995 - DNA, 16 bp, Homo sapiens
cacaggcagtgcatgt

SEQ ID NO: 248996 - DNA, 18 bp, Homo sapiens
cacaggcagtgcatgtga

SEQ ID NO: 248997 - DNA, 21 bp, Homo sapiens
cacaggccacacgctgcccag

SEQ ID NO: 248998 - DNA, 18 bp, Homo sapiens
cctgccccagctgggctg

SEQ ID NO: 248999 - DNA, 19 bp, Homo sapiens
cctgccccagctgggctgt

SEQ ID NO: 249000 - DNA, 16 bp, Homo sapiens
cctgccccaggcctga

SEQ ID NO: 249001 - DNA, 13 bp, Homo sapiens
cctgccccatccc

SEQ ID NO: 249002 - DNA, 14 bp, Homo sapiens
cctgccccccttcc

SEQ ID NO: 249003 - DNA, 22 bp, Homo sapiens
cctgccccccttcccaccccta

SEQ ID NO: 249004 - DNA, 12 bp, Homo sapiens
cctgcccccttc

SEQ ID NO: 249005 - DNA, 13 bp, Homo sapiens
cctgccccgcccc

SEQ ID NO: 249006 - DNA, 14 bp, Homo sapiens
cctgccccgccccc

SEQ ID NO: 249007 - DNA, 18 bp, Homo sapiens
cctgccccgccccccaga

SEQ ID NO: 249008 - DNA, 15 bp, Homo sapiens
cctgccccggaggaa

SEQ ID NO: 249009 - DNA, 23 bp, Homo sapiens
cctgccccgtcaccatctcaggc

SEQ ID NO: 249010 - DNA, 13 bp, Homo sapiens
cctgccccgtccc

SEQ ID NO: 249011 - DNA, 19 bp, Homo sapiens
cctgccccgtcccctgggc

SEQ ID NO: 249012 - DNA, 22 bp, Homo sapiens
cctgccccgtcccctgggccac

SEQ ID NO: 249013 - DNA, 17 bp, Homo sapiens
cctgcccctccccagcc

SEQ ID NO: 249014 - DNA, 16 bp, Homo sapiens
cctgcccctcccttca

SEQ ID NO: 249015 - DNA, 16 bp, Homo sapiens
cctgcccctctcccgc

SEQ ID NO: 249016 - DNA, 17 bp, Homo sapiens
cctgcccctgccccgtc

SEQ ID NO: 249017 - DNA, 17 bp, Homo sapiens
cctgcccctgcccgaga

SEQ ID NO: 249018 - DNA, 19 bp, Homo sapiens
cctgccccttctacactct

SEQ ID NO: 249019 - DNA, 21 bp, Homo sapiens
cctgccccttctacactctcc

SEQ ID NO: 249020 - DNA, 16 bp, Homo sapiens
cctgcccgagagctct

SEQ ID NO: 249021 - DNA, 15 bp, Homo sapiens
cctgcccgcacagca

SEQ ID NO: 249022 - DNA, 20 bp, Homo sapiens
cctgcccgcacagcagcctg

SEQ ID NO: 249023 - DNA, 18 bp, Homo sapiens
cctgcccgccccaagccc

SEQ ID NO: 249024 - DNA, 23 bp, Homo sapiens
cctgcccggtggtttgccatgtc

SEQ ID NO: 249025 - DNA, 21 bp, Homo sapiens
cctgcccgttgccgggcctgg

SEQ ID NO: 249026 - DNA, 22 bp, Homo sapiens
cctgcccgttgccgggcctgga

SEQ ID NO: 249027 - DNA, 16 bp, Homo sapiens
cctgccctcactccac

SEQ ID NO: 249028 - DNA, 21 bp, Homo sapiens
cctgccctccccagagcactg

SEQ ID NO: 249029 - DNA, 12 bp, Homo sapiens
cctgccctgcac

SEQ ID NO: 249030 - DNA, 11 bp, Homo sapiens
cctgccctgcc

SEQ ID NO: 249031 - DNA, 14 bp, Homo sapiens
cctgccctgccacc

SEQ ID NO: 249032 - DNA, 17 bp, Homo sapiens
cctgccctgccacctgt

SEQ ID NO: 249033 - DNA, 21 bp, Homo sapiens
cctgccctgccacctgtctgt

SEQ ID NO: 249034 - DNA, 16 bp, Homo sapiens
cctgccctgccctgcc

SEQ ID NO: 249035 - DNA, 15 bp, Homo sapiens
cctgccctgcctgag

SEQ ID NO: 249036 - DNA, 13 bp, Homo sapiens
cctgccctgctgc

SEQ ID NO: 249037 - DNA, 20 bp, Homo sapiens
cctgccctgctgccgcctcc

SEQ ID NO: 249038 - DNA, 23 bp, Homo sapiens
cctgccctgtacctctctctgct

SEQ ID NO: 249039 - DNA, 14 bp, Homo sapiens
cctgccgcccaaag

SEQ ID NO: 249040 - DNA, 22 bp, Homo sapiens
cctgccgcctgtgcccttgctg

SEQ ID NO: 249041 - DNA, 18 bp, Homo sapiens
cctgccggccgcccagac

SEQ ID NO: 249042 - DNA, 16 bp, Homo sapiens
cctgccgtgcatggct

SEQ ID NO: 249043 - DNA, 15 bp, Homo sapiens
cctgcctaggagctg

SEQ ID NO: 249044 - DNA, 17 bp, Homo sapiens
cctgcctaggagctggg

SEQ ID NO: 249045 - DNA, 13 bp, Homo sapiens
cctgcctcagcct

SEQ ID NO: 249046 - DNA, 14 bp, Homo sapiens
cctgcctcagcctt

SEQ ID NO: 249047 - DNA, 15 bp, Homo sapiens
cctgcctcagccttc

SEQ ID NO: 249048 - DNA, 22 bp, Homo sapiens
cctgcctcccgcccccttggct

SEQ ID NO: 249049 - DNA, 21 bp, Homo sapiens
cctgcctccctttctgggagg

SEQ ID NO: 249050 - DNA, 16 bp, Homo sapiens
cctgcctccggccctg

SEQ ID NO: 249051 - DNA, 17 bp, Homo sapiens
cctgcctccggccctgc

SEQ ID NO: 249052 - DNA, 18 bp, Homo sapiens
cctgcctccggccctgcc

SEQ ID NO: 249053 - DNA, 20 bp, Homo sapiens
cctgcctcctgcctgcccct

SEQ ID NO: 249054 - DNA, 16 bp, Homo sapiens
cctgcctctccccaaa

SEQ ID NO: 249055 - DNA, 20 bp, Homo sapiens
cctgcctgaccatcccatga

SEQ ID NO: 249056 - DNA, 17 bp, Homo sapiens
cctgcctgagcccagga

SEQ ID NO: 249057 - DNA, 14 bp, Homo sapiens
cctgcctgagggcc

SEQ ID NO: 249058 - DNA, 14 bp, Homo sapiens
cctgcctgcccact

SEQ ID NO: 249059 - DNA, 19 bp, Homo sapiens
cctgcctgcgaaacccagc

SEQ ID NO: 249060 - DNA, 23 bp, Homo sapiens
cctgcctggatttcttcctatta

SEQ ID NO: 249061 - DNA, 12 bp, Homo sapiens
cctgcctggcca

SEQ ID NO: 249062 - DNA, 13 bp, Homo sapiens
cctgcctggccag

SEQ ID NO: 249063 - DNA, 14 bp, Homo sapiens
cctgccttcgttaa

SEQ ID NO: 249064 - DNA, 13 bp, Homo sapiens
cctgccttctggg

SEQ ID NO: 249065 - DNA, 16 bp, Homo sapiens
cctgcgaaacccagcg

SEQ ID NO: 249066 - DNA, 18 bp, Homo sapiens
cctgcgaaacccagcgtt

SEQ ID NO: 249067 - DNA, 15 bp, Homo sapiens
cctgcgccctccctc

SEQ ID NO: 249068 - DNA, 12 bp, Homo sapiens
cctgcgctcctc

SEQ ID NO: 249069 - DNA, 18 bp, Homo sapiens
cctgcgctcctctgcagc

SEQ ID NO: 249070 - DNA, 18 bp, Homo sapiens
cctgcggactccatggcc

SEQ ID NO: 249071 - DNA, 19 bp, Homo sapiens
cctgcggactccatggccc

SEQ ID NO: 249072 - DNA, 16 bp, Homo sapiens
cctgcggcctgctgga

SEQ ID NO: 249073 - DNA, 15 bp, Homo sapiens
cctgcgtcatggctc

SEQ ID NO: 249074 - DNA, 23 bp, Homo sapiens
cctgcgtcatggctcaaggattc

SEQ ID NO: 249075 - DNA, 20 bp, Homo sapiens
cctgcgtcctgacgccctgc

SEQ ID NO: 249076 - DNA, 17 bp, Homo sapiens
cctgcgtggcctggggc

SEQ ID NO: 249077 - DNA, 18 bp, Homo sapiens
cctgctaaatgacttatt

SEQ ID NO: 249078 - DNA, 18 bp, Homo sapiens
cctgctaaggctcctcct

SEQ ID NO: 249079 - DNA, 17 bp, Homo sapiens
cctgctacactcatccg

SEQ ID NO: 249080 - DNA, 21 bp, Homo sapiens
cctgctactccactgacctgg

SEQ ID NO: 249081 - DNA, 13 bp, Homo sapiens
cctgctagagcaa

SEQ ID NO: 249082 - DNA, 23 bp, Homo sapiens
cctgctagatgagaattcagctg

SEQ ID NO: 249083 - DNA, 16 bp, Homo sapiens
cctgctagctgtagaa

SEQ ID NO: 249084 - DNA, 13 bp, Homo sapiens
cctgctatccagc

SEQ ID NO: 249085 - DNA, 15 bp, Homo sapiens
cctgctatccagccg

SEQ ID NO: 249086 - DNA, 14 bp, Homo sapiens
cctgctatttccca

SEQ ID NO: 249087 - DNA, 19 bp, Homo sapiens
cctgctcacgtctgtgagt

SEQ ID NO: 249088 - DNA, 15 bp, Homo sapiens
cctgctcagctggcc

SEQ ID NO: 249089 - DNA, 12 bp, Homo sapiens
cctgctcaggcc

SEQ ID NO: 249090 - DNA, 14 bp, Homo sapiens
cctgctcaggcctc

SEQ ID NO: 249091 - DNA, 19 bp, Homo sapiens
cctgctccacgaagcctta

SEQ ID NO: 249092 - DNA, 20 bp, Homo sapiens
cctgctccatgactggctgt

SEQ ID NO: 249093 - DNA, 13 bp, Homo sapiens
cctgctcccagca

SEQ ID NO: 249094 - DNA, 14 bp, Homo sapiens
cctgctcccagcag

SEQ ID NO: 249095 - DNA, 16 bp, Homo sapiens
cctgctcccagcctgc

SEQ ID NO: 249096 - DNA, 19 bp, Homo sapiens
cctgctcccattcctccct

SEQ ID NO: 249097 - DNA, 12 bp, Homo sapiens
cctgctcctcag

SEQ ID NO: 249098 - DNA, 14 bp, Homo sapiens
cctgctcctcagga

SEQ ID NO: 249099 - DNA, 20 bp, Homo sapiens
cctgctccttggcaccccca

SEQ ID NO: 249100 - DNA, 20 bp, Homo sapiens
cctgctccttggcctagtca

SEQ ID NO: 249101 - DNA, 22 bp, Homo sapiens
cctgctccttggcctagtcaga

SEQ ID NO: 249102 - DNA, 20 bp, Homo sapiens
cctgctctacccatgagcct

SEQ ID NO: 249103 - DNA, 20 bp, Homo sapiens
cctgctctccttgccctggg

SEQ ID NO: 249104 - DNA, 21 bp, Homo sapiens
cctgctctctacccagcccat

SEQ ID NO: 249105 - DNA, 24 bp, Homo sapiens
cctgctctttctacatgactgggc

SEQ ID NO: 249106 - DNA, 14 bp, Homo sapiens
cctgctgaccttgg

SEQ ID NO: 249107 - DNA, 13 bp, Homo sapiens
cctgctgagagcc

SEQ ID NO: 249108 - DNA, 17 bp, Homo sapiens
cctgctgagagccccca

SEQ ID NO: 249109 - DNA, 22 bp, Homo sapiens
cctgctgccccagctgactgtg

SEQ ID NO: 249110 - DNA, 21 bp, Homo sapiens
cctgctgccgcctcccagcct

SEQ ID NO: 249111 - DNA, 22 bp, Homo sapiens
cctgctgccgcctcccagcctg

SEQ ID NO: 249112 - DNA, 17 bp, Homo sapiens
cctgctgcctccccaac

SEQ ID NO: 249113 - DNA, 19 bp, Homo sapiens
cctgctgcctccccaaccc

SEQ ID NO: 249114 - DNA, 21 bp, Homo sapiens
cctgctgcctgccggccgccc

SEQ ID NO: 249115 - DNA, 23 bp, Homo sapiens
cctgctgcgtcagaccagtactg

SEQ ID NO: 249116 - DNA, 18 bp, Homo sapiens
cctgctgctcgggaaggc

SEQ ID NO: 249117 - DNA, 20 bp, Homo sapiens
cctgctgctcgggaaggcct

SEQ ID NO: 249118 - DNA, 23 bp, Homo sapiens
cctgctgctcgggaaggcctgag

SEQ ID NO: 249119 - DNA, 15 bp, Homo sapiens
cctgctgctgcctgc

SEQ ID NO: 249120 - DNA, 17 bp, Homo sapiens
cctgctgctgcctgcct

SEQ ID NO: 249121 - DNA, 22 bp, Homo sapiens
cctgctgctgtaactgctgagc

SEQ ID NO: 249122 - DNA, 23 bp, Homo sapiens
cctgctgctgtaactgctgagcc

SEQ ID NO: 249123 - DNA, 14 bp, Homo sapiens
cctgctgcttccta

SEQ ID NO: 249124 - DNA, 15 bp, Homo sapiens
cctgctggctgaggc

SEQ ID NO: 249125 - DNA, 21 bp, Homo sapiens
cctgctggctgaggcttgggc

SEQ ID NO: 249126 - DNA, 19 bp, Homo sapiens
cctgctgggaaccccgcag

SEQ ID NO: 249127 - DNA, 20 bp, Homo sapiens
cctgctgggaaccccgcagc

SEQ ID NO: 249128 - DNA, 17 bp, Homo sapiens
cctgctgggtaaactgt

SEQ ID NO: 249129 - DNA, 20 bp, Homo sapiens
cctgctggttgttgccaggt

SEQ ID NO: 249130 - DNA, 11 bp, Homo sapiens
cctgctgtgga

SEQ ID NO: 249131 - DNA, 15 bp, Homo sapiens
cctgctgtgggtcag

SEQ ID NO: 249132 - DNA, 16 bp, Homo sapiens
cctgcttcacacccct

SEQ ID NO: 249133 - DNA, 19 bp, Homo sapiens
cctgcttcacacccctcag

SEQ ID NO: 249134 - DNA, 12 bp, Homo sapiens
cctgcttcccac

SEQ ID NO: 249135 - DNA, 20 bp, Homo sapiens
cctgcttcccacctccctgc

SEQ ID NO: 249136 - DNA, 23 bp, Homo sapiens
cctgcttcccacctccctgccca

SEQ ID NO: 249137 - DNA, 24 bp, Homo sapiens
cctgcttcccacctccctgcccag

SEQ ID NO: 249138 - DNA, 18 bp, Homo sapiens
cctgcttctcttttcctc

SEQ ID NO: 249139 - DNA, 12 bp, Homo sapiens
cctgcttctgct

SEQ ID NO: 249140 - DNA, 19 bp, Homo sapiens
cctgcttctgctgccctga

SEQ ID NO: 249141 - DNA, 22 bp, Homo sapiens
cctgcttgtactaagccaggag

SEQ ID NO: 249142 - DNA, 18 bp, Homo sapiens
cctgctttgaggacaaag

SEQ ID NO: 249143 - DNA, 17 bp, Homo sapiens
cctgctttgggctgccc

SEQ ID NO: 249144 - DNA, 21 bp, Homo sapiens
cctgctttgggctgccctggt

SEQ ID NO: 249145 - DNA, 23 bp, Homo sapiens
cctgctttgggctgccctggtgc

SEQ ID NO: 249146 - DNA, 15 bp, Homo sapiens
cctgcttttccagga

SEQ ID NO: 249147 - DNA, 18 bp, Homo sapiens
cctgcttttccaggatcc

SEQ ID NO: 249148 - DNA, 22 bp, Homo sapiens
cctggaaccagcaagtcccaga

SEQ ID NO: 249149 - DNA, 20 bp, Homo sapiens
cctggaactctatctgggcc

SEQ ID NO: 249150 - DNA, 22 bp, Homo sapiens
cctggaactctatctgggcctg

SEQ ID NO: 249151 - DNA, 14 bp, Homo sapiens
cctggaagagctgg

SEQ ID NO: 249152 - DNA, 14 bp, Homo sapiens
cctggaatggagct

SEQ ID NO: 249153 - DNA, 18 bp, Homo sapiens
cctggaattcagcaccct

SEQ ID NO: 249154 - DNA, 23 bp, Homo sapiens
cctggaattcagcaccctgggtg

SEQ ID NO: 249155 - DNA, 16 bp, Homo sapiens
cctggacacccctgct

SEQ ID NO: 249156 - DNA, 17 bp, Homo sapiens
cctggacacccctgctc

SEQ ID NO: 249157 - DNA, 18 bp, Homo sapiens
cctggacacccctgctct

SEQ ID NO: 249158 - DNA, 20 bp, Homo sapiens
cctggacacccctgctctac

SEQ ID NO: 249159 - DNA, 20 bp, Homo sapiens
cctggacatcctcttctgct

SEQ ID NO: 249160 - DNA, 17 bp, Homo sapiens
cctggaccacacctccg

SEQ ID NO: 249161 - DNA, 20 bp, Homo sapiens
cctggaccaccagccccagc

SEQ ID NO: 249162 - DNA, 17 bp, Homo sapiens
cctggaccagcctcctg

SEQ ID NO: 249163 - DNA, 16 bp, Homo sapiens
cctggacccagcaggg

SEQ ID NO: 249164 - DNA, 23 bp, Homo sapiens
cctggacctgcctcctgcctgcc

SEQ ID NO: 249165 - DNA, 14 bp, Homo sapiens
cctggactctgtgt

SEQ ID NO: 249166 - DNA, 18 bp, Homo sapiens
cctggactggcccttgcc

SEQ ID NO: 249167 - DNA, 14 bp, Homo sapiens
cctggactgtccta

SEQ ID NO: 249168 - DNA, 19 bp, Homo sapiens
cctggacttggcccctgcc

SEQ ID NO: 249169 - DNA, 15 bp, Homo sapiens
cctggactttcctgc

SEQ ID NO: 249170 - DNA, 16 bp, Homo sapiens
cctggactttcctgca

SEQ ID NO: 249171 - DNA, 12 bp, Homo sapiens
cctggagaacta

SEQ ID NO: 249172 - DNA, 13 bp, Homo sapiens
cctggagacagta

SEQ ID NO: 249173 - DNA, 15 bp, Homo sapiens
cctggagacagtaac

SEQ ID NO: 249174 - DNA, 19 bp, Homo sapiens
cctggagcagcagctgagg

SEQ ID NO: 249175 - DNA, 16 bp, Homo sapiens
cctggagcatcccagg

SEQ ID NO: 249176 - DNA, 14 bp, Homo sapiens
cctggagcccctgt

SEQ ID NO: 249177 - DNA, 15 bp, Homo sapiens
cctggagcccctgtg

SEQ ID NO: 249178 - DNA, 22 bp, Homo sapiens
cctggagcccctgtgtgggagg

SEQ ID NO: 249179 - DNA, 21 bp, Homo sapiens
cctggagcccctgtgttgggg

SEQ ID NO: 249180 - DNA, 19 bp, Homo sapiens
cctggagccgtggccgagg

SEQ ID NO: 249181 - DNA, 13 bp, Homo sapiens
cctggagctgtcc

SEQ ID NO: 249182 - DNA, 22 bp, Homo sapiens
cctggagtcggatctagccatg

SEQ ID NO: 249183 - DNA, 17 bp, Homo sapiens
cctggagttctggttcc

SEQ ID NO: 249184 - DNA, 22 bp, Homo sapiens
cctggatctaccagcataaata

SEQ ID NO: 249185 - DNA, 18 bp, Homo sapiens
cctggatgccaaggagcc

SEQ ID NO: 249186 - DNA, 20 bp, Homo sapiens
cctggatggatctgctccat

SEQ ID NO: 249187 - DNA, 22 bp, Homo sapiens
cctggatggatctgctccatgc

SEQ ID NO: 249188 - DNA, 17 bp, Homo sapiens
cctggatgggcattggg

SEQ ID NO: 249189 - DNA, 15 bp, Homo sapiens
cctggatgtcccctg

SEQ ID NO: 249190 - DNA, 12 bp, Homo sapiens
cctggcacacca

SEQ ID NO: 249191 - DNA, 13 bp, Homo sapiens
cctggcacaccag

SEQ ID NO: 249192 - DNA, 14 bp, Homo sapiens
cctggcacaccaga

SEQ ID NO: 249193 - DNA, 18 bp, Homo sapiens
cctggcagaactgagctc

SEQ ID NO: 249194 - DNA, 22 bp, Homo sapiens
cctggcagccgtgccttcagct

SEQ ID NO: 249195 - DNA, 21 bp, Homo sapiens
cctggcagggaggtcaggccc

SEQ ID NO: 249196 - DNA, 17 bp, Homo sapiens
cctggcatgacactcta

SEQ ID NO: 249197 - DNA, 14 bp, Homo sapiens
cctggcatgggaat

SEQ ID NO: 249198 - DNA, 16 bp, Homo sapiens
cctggcatgggaatga

SEQ ID NO: 249199 - DNA, 23 bp, Homo sapiens
cctggcatgggaatgaatgtcag

SEQ ID NO: 249200 - DNA, 22 bp, Homo sapiens
cctggccacgcagccaggacac

SEQ ID NO: 249201 - DNA, 12 bp, Homo sapiens
cctggccagagg

SEQ ID NO: 249202 - DNA, 15 bp, Homo sapiens
cctggccaggagctc

SEQ ID NO: 249203 - DNA, 21 bp, Homo sapiens
cctggccaggagctcttcagg

SEQ ID NO: 249204 - DNA, 22 bp, Homo sapiens
cctggccaggcagatctgtgcc

SEQ ID NO: 249205 - DNA, 17 bp, Homo sapiens
cctggcccagccagcag

SEQ ID NO: 249206 - DNA, 18 bp, Homo sapiens
cctggcccagccagcagg

SEQ ID NO: 249207 - DNA, 19 bp, Homo sapiens
cctggcccagccagcaggt

SEQ ID NO: 249208 - DNA, 23 bp, Homo sapiens
cctggcccatctcagcctcctga

SEQ ID NO: 249209 - DNA, 16 bp, Homo sapiens
cctggccccaaatgtt

SEQ ID NO: 249210 - DNA, 20 bp, Homo sapiens
cctggcccccctccaggcat

SEQ ID NO: 249211 - DNA, 23 bp, Homo sapiens
cctggccccgggctctggccacc

SEQ ID NO: 249212 - DNA, 12 bp, Homo sapiens
cctggcccctcc

SEQ ID NO: 249213 - DNA, 14 bp, Homo sapiens
cctggcccctccag

SEQ ID NO: 249214 - DNA, 20 bp, Homo sapiens
cctggccggggcccctcacc

SEQ ID NO: 249215 - DNA, 19 bp, Homo sapiens
cctggccgggtcaccctgt

SEQ ID NO: 249216 - DNA, 21 bp, Homo sapiens
cctggccgggtcaccctgtga

SEQ ID NO: 249217 - DNA, 13 bp, Homo sapiens
cctggcctattta

SEQ ID NO: 249218 - DNA, 17 bp, Homo sapiens
cctggcctatttaagcc

SEQ ID NO: 249219 - DNA, 19 bp, Homo sapiens
cctggcctatttaagcccc

SEQ ID NO: 249220 - DNA, 18 bp, Homo sapiens
cctggcctcaagccatct

SEQ ID NO: 249221 - DNA, 16 bp, Homo sapiens
cctggcctcactggct

SEQ ID NO: 249222 - DNA, 22 bp, Homo sapiens
cctggcctcactggctggggca

SEQ ID NO: 249223 - DNA, 19 bp, Homo sapiens
cctggcctcagccagctgc

SEQ ID NO: 249224 - DNA, 20 bp, Homo sapiens
cctggcctcagccagctgcc

SEQ ID NO: 249225 - DNA, 14 bp, Homo sapiens
cctggcctcccctg

SEQ ID NO: 249226 - DNA, 18 bp, Homo sapiens
cctggcctcccctgcgga

SEQ ID NO: 249227 - DNA, 13 bp, Homo sapiens
cctggcctcgggg

SEQ ID NO: 249228 - DNA, 19 bp, Homo sapiens
cctggcctcggggcagggc

SEQ ID NO: 249229 - DNA, 18 bp, Homo sapiens
cctggcctgagctggggc

SEQ ID NO: 249230 - DNA, 22 bp, Homo sapiens
cctggcctgagctggggccaca

SEQ ID NO: 249231 - DNA, 13 bp, Homo sapiens
cctggcctgctgg

SEQ ID NO: 249232 - DNA, 13 bp, Homo sapiens
cctggcctggctc

SEQ ID NO: 249233 - DNA, 13 bp, Homo sapiens
cctggcctgttct

SEQ ID NO: 249234 - DNA, 13 bp, Homo sapiens
cctggccttctga

SEQ ID NO: 249235 - DNA, 20 bp, Homo sapiens
cctggccttctgaactccat

SEQ ID NO: 249236 - DNA, 12 bp, Homo sapiens
cctggcgggcag

SEQ ID NO: 249237 - DNA, 13 bp, Homo sapiens
cctggcgggcagc

SEQ ID NO: 249238 - DNA, 15 bp, Homo sapiens
cctggcgggcagccc

SEQ ID NO: 249239 - DNA, 22 bp, Homo sapiens
cctggcgggcagcccctgctgg

SEQ ID NO: 249240 - DNA, 21 bp, Homo sapiens
cctggcgtggggggagctctg

SEQ ID NO: 249241 - DNA, 22 bp, Homo sapiens
cctggcgtggggggagctctgg

SEQ ID NO: 249242 - DNA, 18 bp, Homo sapiens
cctggctacatcccagcc

SEQ ID NO: 249243 - DNA, 23 bp, Homo sapiens
cctggctacatcccagcctgtgg

SEQ ID NO: 249244 - DNA, 12 bp, Homo sapiens
cctggctagatg

SEQ ID NO: 249245 - DNA, 13 bp, Homo sapiens
cctggctcacagc

SEQ ID NO: 249246 - DNA, 14 bp, Homo sapiens
cctggctcacagcc

SEQ ID NO: 249247 - DNA, 16 bp, Homo sapiens
cctggctcacagccac

SEQ ID NO: 249248 - DNA, 18 bp, Homo sapiens
cctggctcacagccacca

SEQ ID NO: 249249 - DNA, 12 bp, Homo sapiens
cctggctcaggg

SEQ ID NO: 249250 - DNA, 13 bp, Homo sapiens
cctggctcaggga

SEQ ID NO: 249251 - DNA, 22 bp, Homo sapiens
cctggctcagggatcttctccc

SEQ ID NO: 249252 - DNA, 13 bp, Homo sapiens
cctggctccaggc

SEQ ID NO: 249253 - DNA, 15 bp, Homo sapiens
cctggctccaggctc

SEQ ID NO: 249254 - DNA, 14 bp, Homo sapiens
cctggctcccatga

SEQ ID NO: 249255 - DNA, 21 bp, Homo sapiens
cctggctcccatgaccatact

SEQ ID NO: 249256 - DNA, 13 bp, Homo sapiens
cctggctccccac

SEQ ID NO: 249257 - DNA, 12 bp, Homo sapiens
cctggctccgct

SEQ ID NO: 249258 - DNA, 23 bp, Homo sapiens
cctggctcctgaggggcatctgc

SEQ ID NO: 249259 - DNA, 12 bp, Homo sapiens
cctggctgccag

SEQ ID NO: 249260 - DNA, 14 bp, Homo sapiens
cctggctgccaggc

SEQ ID NO: 249261 - DNA, 15 bp, Homo sapiens
cctggctgccaggcg

SEQ ID NO: 249262 - DNA, 19 bp, Homo sapiens
cctggctgggttcaggtcc

SEQ ID NO: 249263 - DNA, 18 bp, Homo sapiens
cctggctgtgagcagcct

SEQ ID NO: 249264 - DNA, 13 bp, Homo sapiens
cctggctgtggag

SEQ ID NO: 249265 - DNA, 14 bp, Homo sapiens
cctggctgtggagg

SEQ ID NO: 249266 - DNA, 23 bp, Homo sapiens
cacaggccacacgctgcccaggc

SEQ ID NO: 249267 - DNA, 12 bp, Homo sapiens
cacaggccactg

SEQ ID NO: 249268 - DNA, 18 bp, Homo sapiens
cacaggccacttgctcag

SEQ ID NO: 249269 - DNA, 17 bp, Homo sapiens
cacaggcccttcctctc

SEQ ID NO: 249270 - DNA, 21 bp, Homo sapiens
cacaggcccttcctctccact

SEQ ID NO: 249271 - DNA, 22 bp, Homo sapiens
cacaggcccttcctctccactg

SEQ ID NO: 249272 - DNA, 12 bp, Homo sapiens
cacaggcctggc

SEQ ID NO: 249273 - DNA, 13 bp, Homo sapiens
cacaggcctggcc

SEQ ID NO: 249274 - DNA, 14 bp, Homo sapiens
cacaggctcctgta

SEQ ID NO: 249275 - DNA, 12 bp, Homo sapiens
cacaggctgccc

SEQ ID NO: 249276 - DNA, 14 bp, Homo sapiens
cacaggctgcccca

SEQ ID NO: 249277 - DNA, 19 bp, Homo sapiens
cacaggctgccccacccct

SEQ ID NO: 249278 - DNA, 11 bp, Homo sapiens
cacagggactg

SEQ ID NO: 249279 - DNA, 20 bp, Homo sapiens
cacagggcatccaactgaga

SEQ ID NO: 249280 - DNA, 13 bp, Homo sapiens
cacagggcctgac

SEQ ID NO: 249281 - DNA, 13 bp, Homo sapiens
cacagggctcttt

SEQ ID NO: 249282 - DNA, 15 bp, Homo sapiens
cacaggggacactga

SEQ ID NO: 249283 - DNA, 17 bp, Homo sapiens
cacaggggacactgaac

SEQ ID NO: 249284 - DNA, 17 bp, Homo sapiens
cacaggggaggtgatag

SEQ ID NO: 249285 - DNA, 13 bp, Homo sapiens
cacaggggcaggc

SEQ ID NO: 249286 - DNA, 17 bp, Homo sapiens
cacaggggcaggcctgg

SEQ ID NO: 249287 - DNA, 19 bp, Homo sapiens
cacaggggcaggcctggga

SEQ ID NO: 249288 - DNA, 14 bp, Homo sapiens
cacaggggccccag

SEQ ID NO: 249289 - DNA, 15 bp, Homo sapiens
cacaggggccccaga

SEQ ID NO: 249290 - DNA, 19 bp, Homo sapiens
cacaggggcggggcaggaa

SEQ ID NO: 249291 - DNA, 16 bp, Homo sapiens
cacagggtctgctctt

SEQ ID NO: 249292 - DNA, 19 bp, Homo sapiens
cacagggtctgctctttct

SEQ ID NO: 249293 - DNA, 23 bp, Homo sapiens
cacagggtctgctctttctctgc

SEQ ID NO: 249294 - DNA, 23 bp, Homo sapiens
cacagggtgggatgagcctctcc

SEQ ID NO: 249295 - DNA, 22 bp, Homo sapiens
cacagggttgggcccagatctg

SEQ ID NO: 249296 - DNA, 23 bp, Homo sapiens
cacagggttgggcccagatctgg

SEQ ID NO: 249297 - DNA, 15 bp, Homo sapiens
cacagggttttgtat

SEQ ID NO: 249298 - DNA, 16 bp, Homo sapiens
cacagggttttgtatt

SEQ ID NO: 249299 - DNA, 21 bp, Homo sapiens
cacaggtgtccccagcccact

SEQ ID NO: 249300 - DNA, 20 bp, Homo sapiens
cacagtagctccaacacttt

SEQ ID NO: 249301 - DNA, 15 bp, Homo sapiens
cacagtattgttctt

SEQ ID NO: 249302 - DNA, 13 bp, Homo sapiens
cacagtccctcct

SEQ ID NO: 249303 - DNA, 13 bp, Homo sapiens
cacagtcctcaca

SEQ ID NO: 249304 - DNA, 16 bp, Homo sapiens
cacagtcctcacagcc

SEQ ID NO: 249305 - DNA, 20 bp, Homo sapiens
cacagtcctcacagcctctc

SEQ ID NO: 249306 - DNA, 19 bp, Homo sapiens
cacagtctctccctggggt

SEQ ID NO: 249307 - DNA, 23 bp, Homo sapiens
cacagtgaacataactgtaacat

SEQ ID NO: 249308 - DNA, 19 bp, Homo sapiens
cacagtgagagtactcact

SEQ ID NO: 249309 - DNA, 19 bp, Homo sapiens
cacagtgcatctcagccca

SEQ ID NO: 249310 - DNA, 13 bp, Homo sapiens
cacagtgctgctt

SEQ ID NO: 249311 - DNA, 13 bp, Homo sapiens
cacagtgctgttg

SEQ ID NO: 249312 - DNA, 15 bp, Homo sapiens
cacagtgggccggcc

SEQ ID NO: 249313 - DNA, 18 bp, Homo sapiens
cacagtgggccggcccca

SEQ ID NO: 249314 - DNA, 20 bp, Homo sapiens
cacagtgggccggccccagg

SEQ ID NO: 249315 - DNA, 20 bp, Homo sapiens
cacagtggggcccatggccc

SEQ ID NO: 249316 - DNA, 15 bp, Homo sapiens
cacagtgggtggcac

SEQ ID NO: 249317 - DNA, 20 bp, Homo sapiens
cacagtgggtggcacctcct

SEQ ID NO: 249318 - DNA, 18 bp, Homo sapiens
cacagtgtctgtatcgga

SEQ ID NO: 249319 - DNA, 11 bp, Homo sapiens
cacagtgtgtg

SEQ ID NO: 249320 - DNA, 14 bp, Homo sapiens
cacagtgttgccca

SEQ ID NO: 249321 - DNA, 13 bp, Homo sapiens
cacagttgtttca

SEQ ID NO: 249322 - DNA, 22 bp, Homo sapiens
cacagtttgcaatcttatgttg

SEQ ID NO: 249323 - DNA, 17 bp, Homo sapiens
cacagttttgaaagaaa

SEQ ID NO: 249324 - DNA, 21 bp, Homo sapiens
cacagttttgaaagaaaaata

SEQ ID NO: 249325 - DNA, 20 bp, Homo sapiens
cacataaaaagaaatgtgaa

SEQ ID NO: 249326 - DNA, 14 bp, Homo sapiens
cacataacacacat

SEQ ID NO: 249327 - DNA, 13 bp, Homo sapiens
cacataccctccc

SEQ ID NO: 249328 - DNA, 14 bp, Homo sapiens
cacatagattcacc

SEQ ID NO: 249329 - DNA, 16 bp, Homo sapiens
cacatagattcacctg

SEQ ID NO: 249330 - DNA, 17 bp, Homo sapiens
cacatagattcacctgt

SEQ ID NO: 249331 - DNA, 14 bp, Homo sapiens
cacatatacatcta

SEQ ID NO: 249332 - DNA, 21 bp, Homo sapiens
cacatatacatctagcacagc

SEQ ID NO: 249333 - DNA, 13 bp, Homo sapiens
cacatatgtctta

SEQ ID NO: 249334 - DNA, 21 bp, Homo sapiens
cacatattaagaatagtctct

SEQ ID NO: 249335 - DNA, 17 bp, Homo sapiens
cacatcaataaatactt

SEQ ID NO: 249336 - DNA, 20 bp, Homo sapiens
cacatccaacatttcctcag

SEQ ID NO: 249337 - DNA, 18 bp, Homo sapiens
cacatccaggcaatggcc

SEQ ID NO: 249338 - DNA, 15 bp, Homo sapiens
cacatccccaccctc

SEQ ID NO: 249339 - DNA, 22 bp, Homo sapiens
cacatcccccgtgtattcagga

SEQ ID NO: 249340 - DNA, 16 bp, Homo sapiens
cacatcccggcctctt

SEQ ID NO: 249341 - DNA, 20 bp, Homo sapiens
cacatcccggcctcttccac

SEQ ID NO: 249342 - DNA, 18 bp, Homo sapiens
cacatcctccgtccagcc

SEQ ID NO: 249343 - DNA, 13 bp, Homo sapiens
cacatctcccttc

SEQ ID NO: 249344 - DNA, 15 bp, Homo sapiens
cacatcttaattaag

SEQ ID NO: 249345 - DNA, 21 bp, Homo sapiens
cacatgacaactttgccagct

SEQ ID NO: 249346 - DNA, 19 bp, Homo sapiens
cacatgacatttgtcctgc

SEQ ID NO: 249347 - DNA, 20 bp, Homo sapiens
cacatgacatttgtcctgca

SEQ ID NO: 249348 - DNA, 15 bp, Homo sapiens
cacatgcactcagtg

SEQ ID NO: 249349 - DNA, 13 bp, Homo sapiens
cacatgcccgctg

SEQ ID NO: 249350 - DNA, 21 bp, Homo sapiens
cacatgccgcgggcggccagg

SEQ ID NO: 249351 - DNA, 22 bp, Homo sapiens
cacatgccgcgggcggccaggc

SEQ ID NO: 249352 - DNA, 18 bp, Homo sapiens
cacatgctggccagcctg

SEQ ID NO: 249353 - DNA, 14 bp, Homo sapiens
cacatggaggagac

SEQ ID NO: 249354 - DNA, 22 bp, Homo sapiens
cacatggaggagacgtccaccc

SEQ ID NO: 249355 - DNA, 23 bp, Homo sapiens
cacatggccgggccctctgtagc

SEQ ID NO: 249356 - DNA, 22 bp, Homo sapiens
cacatggggcctggcccacgcc

SEQ ID NO: 249357 - DNA, 11 bp, Homo sapiens
cacatgtgtgc

SEQ ID NO: 249358 - DNA, 17 bp, Homo sapiens
cacattaagtggctttt

SEQ ID NO: 249359 - DNA, 14 bp, Homo sapiens
cacattatagaaat

SEQ ID NO: 249360 - DNA, 17 bp, Homo sapiens
cacattatagaaattac

SEQ ID NO: 249361 - DNA, 18 bp, Homo sapiens
cacattatagaaattact

SEQ ID NO: 249362 - DNA, 16 bp, Homo sapiens
cacattatcgggagca

SEQ ID NO: 249363 - DNA, 21 bp, Homo sapiens
cacattatgttagagaggtag

SEQ ID NO: 249364 - DNA, 14 bp, Homo sapiens
cacattcctggccc

SEQ ID NO: 249365 - DNA, 21 bp, Homo sapiens
cacattcctggccccgggctc

SEQ ID NO: 249366 - DNA, 23 bp, Homo sapiens
cacattcctggccccgggctctg

SEQ ID NO: 249367 - DNA, 21 bp, Homo sapiens
cacattgcccacacctgcctc

SEQ ID NO: 249368 - DNA, 17 bp, Homo sapiens
cacattgttgttttttt

SEQ ID NO: 249369 - DNA, 21 bp, Homo sapiens
cacattgttgtttttttaata

SEQ ID NO: 249370 - DNA, 16 bp, Homo sapiens
cacatttaaaacattt

SEQ ID NO: 249371 - DNA, 17 bp, Homo sapiens
cacatttcctctctatc

SEQ ID NO: 249372 - DNA, 18 bp, Homo sapiens
cacatttctaatttgaat

SEQ ID NO: 249373 - DNA, 14 bp, Homo sapiens
cacatttgtgcata

SEQ ID NO: 249374 - DNA, 12 bp, Homo sapiens
cacattttaaca

SEQ ID NO: 249375 - DNA, 20 bp, Homo sapiens
cacattttgacacaatgttg

SEQ ID NO: 249376 - DNA, 22 bp, Homo sapiens
cacattttgacacaatgttgca

SEQ ID NO: 249377 - DNA, 15 bp, Homo sapiens
cacattttgctttat

SEQ ID NO: 249378 - DNA, 16 bp, Homo sapiens
cacattttgctttata

SEQ ID NO: 249379 - DNA, 16 bp, Homo sapiens
caccaaactgcacaca

SEQ ID NO: 249380 - DNA, 14 bp, Homo sapiens
caccaaatctgtct

SEQ ID NO: 249381 - DNA, 13 bp, Homo sapiens
caccaaccctcag

SEQ ID NO: 249382 - DNA, 16 bp, Homo sapiens
caccaactctgcactc

SEQ ID NO: 249383 - DNA, 18 bp, Homo sapiens
caccaactctgcactcca

SEQ ID NO: 249384 - DNA, 15 bp, Homo sapiens
caccaagaaggggct

SEQ ID NO: 249385 - DNA, 22 bp, Homo sapiens
caccaagacttgttttatgctc

SEQ ID NO: 249386 - DNA, 23 bp, Homo sapiens
caccaagcccacaggtgtcccca

SEQ ID NO: 249387 - DNA, 15 bp, Homo sapiens
caccaagtacagcct

SEQ ID NO: 249388 - DNA, 12 bp, Homo sapiens
caccaataactt

SEQ ID NO: 249389 - DNA, 23 bp, Homo sapiens
caccaataacttcagagaagtca

SEQ ID NO: 249390 - DNA, 24 bp, Homo sapiens
caccaataacttcagagaagtcag

SEQ ID NO: 249391 - DNA, 14 bp, Homo sapiens
caccacaactaaca

SEQ ID NO: 249392 - DNA, 14 bp, Homo sapiens
caccacaagagctc

SEQ ID NO: 249393 - DNA, 22 bp, Homo sapiens
caccacaagagctccttgatga

SEQ ID NO: 249394 - DNA, 20 bp, Homo sapiens
caccacaagccaccttttgt

SEQ ID NO: 249395 - DNA, 13 bp, Homo sapiens
caccacacccctg

SEQ ID NO: 249396 - DNA, 18 bp, Homo sapiens
caccacacccctgccggc

SEQ ID NO: 249397 - DNA, 17 bp, Homo sapiens
caccacactgaatctcc

SEQ ID NO: 249398 - DNA, 15 bp, Homo sapiens
caccacactgaccac

SEQ ID NO: 249399 - DNA, 16 bp, Homo sapiens
caccacactgaccaca

SEQ ID NO: 249400 - DNA, 19 bp, Homo sapiens
cctggctgtggaggcctga

SEQ ID NO: 249401 - DNA, 23 bp, Homo sapiens
cctggctgtggaggcctgatgct

SEQ ID NO: 249402 - DNA, 19 bp, Homo sapiens
cctggcttgcttgccgagc

SEQ ID NO: 249403 - DNA, 21 bp, Homo sapiens
cctggcttgcttgccgagcct

SEQ ID NO: 249404 - DNA, 18 bp, Homo sapiens
cctggctttgacatgaaa

SEQ ID NO: 249405 - DNA, 18 bp, Homo sapiens
cctggctttgcccaacct

SEQ ID NO: 249406 - DNA, 23 bp, Homo sapiens
cctggctttgcccaacctcagca

SEQ ID NO: 249407 - DNA, 16 bp, Homo sapiens
cctggcttttcactgc

SEQ ID NO: 249408 - DNA, 18 bp, Homo sapiens
cctggcttttctggctgg

SEQ ID NO: 249409 - DNA, 19 bp, Homo sapiens
cctggcttttctggctggg

SEQ ID NO: 249410 - DNA, 21 bp, Homo sapiens
cctggcttttctggctgggga

SEQ ID NO: 249411 - DNA, 22 bp, Homo sapiens
cctgggaaggctactcaccttg

SEQ ID NO: 249412 - DNA, 14 bp, Homo sapiens
cctgggaatgtatt

SEQ ID NO: 249413 - DNA, 23 bp, Homo sapiens
cctgggacccagctactctgtcc

SEQ ID NO: 249414 - DNA, 14 bp, Homo sapiens
cctgggactcccag

SEQ ID NO: 249415 - DNA, 16 bp, Homo sapiens
cctgggactcccagtg

SEQ ID NO: 249416 - DNA, 14 bp, Homo sapiens
cctgggagatgctg

SEQ ID NO: 249417 - DNA, 22 bp, Homo sapiens
cctgggagatgctgggaccctc

SEQ ID NO: 249418 - DNA, 19 bp, Homo sapiens
cctgggcaagtgaggcaag

SEQ ID NO: 249419 - DNA, 21 bp, Homo sapiens
cctgggcacccacctccaccc

SEQ ID NO: 249420 - DNA, 15 bp, Homo sapiens
cctgggcacctgggg

SEQ ID NO: 249421 - DNA, 23 bp, Homo sapiens
cctgggcagccaggctgccaagg

SEQ ID NO: 249422 - DNA, 14 bp, Homo sapiens
cctgggcagcccag

SEQ ID NO: 249423 - DNA, 15 bp, Homo sapiens
cctgggcagcccaga

SEQ ID NO: 249424 - DNA, 18 bp, Homo sapiens
cctgggcagcccagagag

SEQ ID NO: 249425 - DNA, 10 bp, Homo sapiens
cctgggcagg

SEQ ID NO: 249426 - DNA, 14 bp, Homo sapiens
cctgggcaggcggt

SEQ ID NO: 249427 - DNA, 13 bp, Homo sapiens
cctgggcagtgcc

SEQ ID NO: 249428 - DNA, 14 bp, Homo sapiens
cctgggcagtgccc

SEQ ID NO: 249429 - DNA, 21 bp, Homo sapiens
cctgggcatccccagccccct

SEQ ID NO: 249430 - DNA, 12 bp, Homo sapiens
cctgggccaccc

SEQ ID NO: 249431 - DNA, 13 bp, Homo sapiens
cctgggccaccct

SEQ ID NO: 249432 - DNA, 16 bp, Homo sapiens
cctgggccacccttca

SEQ ID NO: 249433 - DNA, 17 bp, Homo sapiens
cctgggccactggcatc

SEQ ID NO: 249434 - DNA, 19 bp, Homo sapiens
cctgggccactggcatctc

SEQ ID NO: 249435 - DNA, 13 bp, Homo sapiens
cctgggccagggt

SEQ ID NO: 249436 - DNA, 16 bp, Homo sapiens
cctgggcccaggcagc

SEQ ID NO: 249437 - DNA, 23 bp, Homo sapiens
cctgggcccaggcagcacctgga

SEQ ID NO: 249438 - DNA, 18 bp, Homo sapiens
cctgggcccctccctacc

SEQ ID NO: 249439 - DNA, 13 bp, Homo sapiens
cctgggccctagg

SEQ ID NO: 249440 - DNA, 15 bp, Homo sapiens
cctgggccctaggca

SEQ ID NO: 249441 - DNA, 22 bp, Homo sapiens
cctgggcctcccatagtgctgg

SEQ ID NO: 249442 - DNA, 21 bp, Homo sapiens
cctgggcctgcttttccagga

SEQ ID NO: 249443 - DNA, 15 bp, Homo sapiens
cctgggcctgtcccc

SEQ ID NO: 249444 - DNA, 20 bp, Homo sapiens
cctgggcctgtcccccaagg

SEQ ID NO: 249445 - DNA, 15 bp, Homo sapiens
cctgggcctgtgcag

SEQ ID NO: 249446 - DNA, 17 bp, Homo sapiens
cctgggccttctcagct

SEQ ID NO: 249447 - DNA, 15 bp, Homo sapiens
cctgggcctttcctg

SEQ ID NO: 249448 - DNA, 13 bp, Homo sapiens
cctgggcgccctg

SEQ ID NO: 249449 - DNA, 17 bp, Homo sapiens
cctgggcgccctggaag

SEQ ID NO: 249450 - DNA, 11 bp, Homo sapiens
cctgggctctg

SEQ ID NO: 249451 - DNA, 12 bp, Homo sapiens
cctgggctctgg

SEQ ID NO: 249452 - DNA, 14 bp, Homo sapiens
cctgggctggactg

SEQ ID NO: 249453 - DNA, 14 bp, Homo sapiens
cctgggctgggaga

SEQ ID NO: 249454 - DNA, 17 bp, Homo sapiens
cctggggaagaggcctt

SEQ ID NO: 249455 - DNA, 16 bp, Homo sapiens
cctggggaccaggagc

SEQ ID NO: 249456 - DNA, 17 bp, Homo sapiens
cctggggaccaggagct

SEQ ID NO: 249457 - DNA, 20 bp, Homo sapiens
cctggggactctgcttggct

SEQ ID NO: 249458 - DNA, 14 bp, Homo sapiens
cctggggagtgagc

SEQ ID NO: 249459 - DNA, 18 bp, Homo sapiens
cctggggagtgagcttgg

SEQ ID NO: 249460 - DNA, 19 bp, Homo sapiens
cctggggagtgggacagag

SEQ ID NO: 249461 - DNA, 21 bp, Homo sapiens
cctggggatgtaaccaagctg

SEQ ID NO: 249462 - DNA, 23 bp, Homo sapiens
cctggggcagtcacctgcccaga

SEQ ID NO: 249463 - DNA, 13 bp, Homo sapiens
cctggggccccgc

SEQ ID NO: 249464 - DNA, 17 bp, Homo sapiens
cctggggccccgctggg

SEQ ID NO: 249465 - DNA, 16 bp, Homo sapiens
cctggggcctggacct

SEQ ID NO: 249466 - DNA, 17 bp, Homo sapiens
cctggggcctggacctg

SEQ ID NO: 249467 - DNA, 13 bp, Homo sapiens
cctggggctccct

SEQ ID NO: 249468 - DNA, 22 bp, Homo sapiens
cctggggctcctttctccagcc

SEQ ID NO: 249469 - DNA, 13 bp, Homo sapiens
cctggggctgggc

SEQ ID NO: 249470 - DNA, 15 bp, Homo sapiens
cctggggctgggccc

SEQ ID NO: 249471 - DNA, 13 bp, Homo sapiens
cctggggctgggt

SEQ ID NO: 249472 - DNA, 17 bp, Homo sapiens
cctggggcttctcctga

SEQ ID NO: 249473 - DNA, 18 bp, Homo sapiens
cctggggcttctcctgac

SEQ ID NO: 249474 - DNA, 16 bp, Homo sapiens
cctgggggcagtgact

SEQ ID NO: 249475 - DNA, 20 bp, Homo sapiens
cctgggggcagtgactggca

SEQ ID NO: 249476 - DNA, 15 bp, Homo sapiens
cctgggggccgtgct

SEQ ID NO: 249477 - DNA, 22 bp, Homo sapiens
cctgggggccttgggtgagtgg

SEQ ID NO: 249478 - DNA, 17 bp, Homo sapiens
cctggggggcacagcca

SEQ ID NO: 249479 - DNA, 13 bp, Homo sapiens
cctggggggggca

SEQ ID NO: 249480 - DNA, 19 bp, Homo sapiens
cctgggggtcccaggatcc

SEQ ID NO: 249481 - DNA, 20 bp, Homo sapiens
cctgggggtcccaggatccc

SEQ ID NO: 249482 - DNA, 21 bp, Homo sapiens
cctgggggttctttcttcctc

SEQ ID NO: 249483 - DNA, 21 bp, Homo sapiens
cctggggtataaaactttcct

SEQ ID NO: 249484 - DNA, 22 bp, Homo sapiens
cctggggtataaaactttcctc

SEQ ID NO: 249485 - DNA, 17 bp, Homo sapiens
cctggggtctctgagca

SEQ ID NO: 249486 - DNA, 13 bp, Homo sapiens
cctggggtgggga

SEQ ID NO: 249487 - DNA, 22 bp, Homo sapiens
cctggggtgggtttagcaggct

SEQ ID NO: 249488 - DNA, 21 bp, Homo sapiens
cctggggtggttggaggcctg

SEQ ID NO: 249489 - DNA, 17 bp, Homo sapiens
cctggggtttccacaca

SEQ ID NO: 249490 - DNA, 22 bp, Homo sapiens
cctggggtttccacacaggccc

SEQ ID NO: 249491 - DNA, 23 bp, Homo sapiens
cctgggtcaaagtggtacaggaa

SEQ ID NO: 249492 - DNA, 20 bp, Homo sapiens
cctgggtcaccttcctgggc

SEQ ID NO: 249493 - DNA, 14 bp, Homo sapiens
cctgggtctccctg

SEQ ID NO: 249494 - DNA, 19 bp, Homo sapiens
cctgggtctccctggtggg

SEQ ID NO: 249495 - DNA, 21 bp, Homo sapiens
cctgggtctgtgtctcttttc

SEQ ID NO: 249496 - DNA, 18 bp, Homo sapiens
cctgggtgacagagcgag

SEQ ID NO: 249497 - DNA, 21 bp, Homo sapiens
cctgggtgagaatcctgcctc

SEQ ID NO: 249498 - DNA, 18 bp, Homo sapiens
cctgggtgccattcccag

SEQ ID NO: 249499 - DNA, 22 bp, Homo sapiens
cctgggtgccattcccagcgtt

SEQ ID NO: 249500 - DNA, 16 bp, Homo sapiens
cctgggtgctggctgc

SEQ ID NO: 249501 - DNA, 22 bp, Homo sapiens
cctgggtggatcggcctcctct

SEQ ID NO: 249502 - DNA, 21 bp, Homo sapiens
cctgggtggggcagggcctgg

SEQ ID NO: 249503 - DNA, 19 bp, Homo sapiens
cctgggttcagaaatgctg

SEQ ID NO: 249504 - DNA, 22 bp, Homo sapiens
cctgggttcagaaatgctgcct

SEQ ID NO: 249505 - DNA, 18 bp, Homo sapiens
cctgggttccaatcctgg

SEQ ID NO: 249506 - DNA, 20 bp, Homo sapiens
cctgggttccaatcctggct

SEQ ID NO: 249507 - DNA, 14 bp, Homo sapiens
cctggtagagacta

SEQ ID NO: 249508 - DNA, 15 bp, Homo sapiens
cctggtagagactag

SEQ ID NO: 249509 - DNA, 16 bp, Homo sapiens
cctggtagcatgacct

SEQ ID NO: 249510 - DNA, 18 bp, Homo sapiens
cctggtagcatgaccttt

SEQ ID NO: 249511 - DNA, 13 bp, Homo sapiens
cctggtcagcaga

SEQ ID NO: 249512 - DNA, 14 bp, Homo sapiens
cctggtcagcagag

SEQ ID NO: 249513 - DNA, 19 bp, Homo sapiens
cctggtccctcgtccacag

SEQ ID NO: 249514 - DNA, 15 bp, Homo sapiens
cctggtgacaggcag

SEQ ID NO: 249515 - DNA, 16 bp, Homo sapiens
cctggtgacaggcaga

SEQ ID NO: 249516 - DNA, 21 bp, Homo sapiens
cctggtgaggaagctccagtc

SEQ ID NO: 249517 - DNA, 20 bp, Homo sapiens
cctggtgaggcccagcctgt

SEQ ID NO: 249518 - DNA, 20 bp, Homo sapiens
cctggtgcactggccccacc

SEQ ID NO: 249519 - DNA, 18 bp, Homo sapiens
cctggtgctgccacactt

SEQ ID NO: 249520 - DNA, 14 bp, Homo sapiens
cctggtgtctagtt

SEQ ID NO: 249521 - DNA, 16 bp, Homo sapiens
cctggtgtctagtttg

SEQ ID NO: 249522 - DNA, 17 bp, Homo sapiens
cctggttcccccaggac

SEQ ID NO: 249523 - DNA, 20 bp, Homo sapiens
cctggttcccccaggaccct

SEQ ID NO: 249524 - DNA, 17 bp, Homo sapiens
cctggttccctctttcc

SEQ ID NO: 249525 - DNA, 21 bp, Homo sapiens
cctggttccggaatcctgtcc

SEQ ID NO: 249526 - DNA, 16 bp, Homo sapiens
cctggttttaccccag

SEQ ID NO: 249527 - DNA, 13 bp, Homo sapiens
cctgtaaaacttt

SEQ ID NO: 249528 - DNA, 13 bp, Homo sapiens
cctgtaaacactc

SEQ ID NO: 249529 - DNA, 20 bp, Homo sapiens
cctgtaaacactcagctgtt

SEQ ID NO: 249530 - DNA, 16 bp, Homo sapiens
cctgtaaaccaaagtt

SEQ ID NO: 249531 - DNA, 14 bp, Homo sapiens
cctgtaaattattt

SEQ ID NO: 249532 - DNA, 18 bp, Homo sapiens
cctgtaacttgagagtag

SEQ ID NO: 249533 - DNA, 16 bp, Homo sapiens
cctgtaagaaacagag

SEQ ID NO: 249534 - DNA, 21 bp, Homo sapiens
cctgtaatcacaactcagcat

SEQ ID NO: 249535 - DNA, 17 bp, Homo sapiens
cctgtaatcccagcact

SEQ ID NO: 249536 - DNA, 23 bp, Homo sapiens
cctgtaatcccagcactttggga

SEQ ID NO: 249537 - DNA, 14 bp, Homo sapiens
cctgtaatcttttt

SEQ ID NO: 249538 - DNA, 15 bp, Homo sapiens
cctgtaatctttttc

SEQ ID NO: 249539 - DNA, 24 bp, Homo sapiens
cctgtacatacattgtataggcca

SEQ ID NO: 249540 - DNA, 22 bp, Homo sapiens
cctgtacatatagccctttccc

SEQ ID NO: 249541 - DNA, 16 bp, Homo sapiens
cctgtacattgtggga

SEQ ID NO: 249542 - DNA, 16 bp, Homo sapiens
cctgtacccagccacc

SEQ ID NO: 249543 - DNA, 22 bp, Homo sapiens
cctgtacccagccaccttcctg

SEQ ID NO: 249544 - DNA, 18 bp, Homo sapiens
cctgtagacctagggagg

SEQ ID NO: 249545 - DNA, 17 bp, Homo sapiens
cctgtagagccagcctt

SEQ ID NO: 249546 - DNA, 12 bp, Homo sapiens
cctgtaggaaac

SEQ ID NO: 249547 - DNA, 20 bp, Homo sapiens
cctgtaggaaacagaaaaga

SEQ ID NO: 249548 - DNA, 21 bp, Homo sapiens
cctgtaggcacaaaaccagaa

SEQ ID NO: 249549 - DNA, 13 bp, Homo sapiens
cctgtaggttgct

SEQ ID NO: 249550 - DNA, 22 bp, Homo sapiens
cctgtagtgcccctcccatggc

SEQ ID NO: 249551 - DNA, 23 bp, Homo sapiens
cctgtagtgcccctcccatggcc

SEQ ID NO: 249552 - DNA, 15 bp, Homo sapiens
cctgtagttaggaaa

SEQ ID NO: 249553 - DNA, 16 bp, Homo sapiens
cctgtagttaggaaat

SEQ ID NO: 249554 - DNA, 15 bp, Homo sapiens
cctgtataagacact

SEQ ID NO: 249555 - DNA, 22 bp, Homo sapiens
cctgtatagttaggatagcatt

SEQ ID NO: 249556 - DNA, 21 bp, Homo sapiens
cctgtatcttttattttcctg

SEQ ID NO: 249557 - DNA, 23 bp, Homo sapiens
cctgtatcttttattttcctgtc

SEQ ID NO: 249558 - DNA, 18 bp, Homo sapiens
cctgtcaagttaacaagg

SEQ ID NO: 249559 - DNA, 13 bp, Homo sapiens
cctgtcaatatat

SEQ ID NO: 249560 - DNA, 23 bp, Homo sapiens
cctgtcaatatatagagacttct

SEQ ID NO: 249561 - DNA, 17 bp, Homo sapiens
cctgtcaatgtttgctt

SEQ ID NO: 249562 - DNA, 14 bp, Homo sapiens
cctgtcactactgg

SEQ ID NO: 249563 - DNA, 15 bp, Homo sapiens
cctgtcactcagctg

SEQ ID NO: 249564 - DNA, 18 bp, Homo sapiens
cctgtcactcagctgaga

SEQ ID NO: 249565 - DNA, 19 bp, Homo sapiens
cctgtcactcagctgagaa

SEQ ID NO: 249566 - DNA, 12 bp, Homo sapiens
cctgtcagaggc

SEQ ID NO: 249567 - DNA, 16 bp, Homo sapiens
cctgtcagaggctaag

SEQ ID NO: 249568 - DNA, 17 bp, Homo sapiens
cctgtcagtttcatgga

SEQ ID NO: 249569 - DNA, 22 bp, Homo sapiens
cctgtccacccccgcctccctc

SEQ ID NO: 249570 - DNA, 15 bp, Homo sapiens
cctgtccatccccag

SEQ ID NO: 249571 - DNA, 18 bp, Homo sapiens
cctgtccatccccagttg

SEQ ID NO: 249572 - DNA, 19 bp, Homo sapiens
cctgtcccaccaactctgc

SEQ ID NO: 249573 - DNA, 21 bp, Homo sapiens
cctgtcccaccaactctgcac

SEQ ID NO: 249574 - DNA, 12 bp, Homo sapiens
cctgtcccacct

SEQ ID NO: 249575 - DNA, 13 bp, Homo sapiens
cctgtcccacctc

SEQ ID NO: 249576 - DNA, 23 bp, Homo sapiens
cctgtcccagaggttatctgcct

SEQ ID NO: 249577 - DNA, 17 bp, Homo sapiens
cctgtcccattctagat

SEQ ID NO: 249578 - DNA, 15 bp, Homo sapiens
cctgtcccccaaggt

SEQ ID NO: 249579 - DNA, 14 bp, Homo sapiens
cctgtccccgcctt

SEQ ID NO: 249580 - DNA, 22 bp, Homo sapiens
cctgtcccgccttcctcctcca

SEQ ID NO: 249581 - DNA, 14 bp, Homo sapiens
cctgtccctgcccc

SEQ ID NO: 249582 - DNA, 22 bp, Homo sapiens
cctgtccctgccccgcccccca

SEQ ID NO: 249583 - DNA, 23 bp, Homo sapiens
cctgtccctgccccgccccccag

SEQ ID NO: 249584 - DNA, 10 bp, Homo sapiens
cctgtcctca

SEQ ID NO: 249585 - DNA, 13 bp, Homo sapiens
cctgtcctcaccg

SEQ ID NO: 249586 - DNA, 10 bp, Homo sapiens
cctgtccttc

SEQ ID NO: 249587 - DNA, 14 bp, Homo sapiens
cctgtcgagacact

SEQ ID NO: 249588 - DNA, 20 bp, Homo sapiens
cctgtcgagacacttgcctt

SEQ ID NO: 249589 - DNA, 16 bp, Homo sapiens
cctgtcgtgccagtcc

SEQ ID NO: 249590 - DNA, 17 bp, Homo sapiens
cctgtcgtgccagtcct

SEQ ID NO: 249591 - DNA, 14 bp, Homo sapiens
cctgtctaggcaca

SEQ ID NO: 249592 - DNA, 21 bp, Homo sapiens
cctgtctaggtcagtacccac

SEQ ID NO: 249593 - DNA, 23 bp, Homo sapiens
cctgtctaggtcagtacccacct

SEQ ID NO: 249594 - DNA, 21 bp, Homo sapiens
cctgtctaggtctcctcaggg

SEQ ID NO: 249595 - DNA, 22 bp, Homo sapiens
cctgtctaggtctcctcagggt

SEQ ID NO: 249596 - DNA, 13 bp, Homo sapiens
cctgtctcagcct

SEQ ID NO: 249597 - DNA, 15 bp, Homo sapiens
cctgtctcagcctcc

SEQ ID NO: 249598 - DNA, 16 bp, Homo sapiens
cctgtctccaagaatg

SEQ ID NO: 249599 - DNA, 13 bp, Homo sapiens
cctgtctccaggg

SEQ ID NO: 249600 - DNA, 21 bp, Homo sapiens
cctgtctccagggcccccacc

SEQ ID NO: 249601 - DNA, 18 bp, Homo sapiens
cctgtctcccctctgctg

SEQ ID NO: 249602 - DNA, 16 bp, Homo sapiens
cctgtctcctctgtca

SEQ ID NO: 249603 - DNA, 22 bp, Homo sapiens
cctgtctgctaggcgctgggga

SEQ ID NO: 249604 - DNA, 21 bp, Homo sapiens
cctgtctggctcggacccacc

SEQ ID NO: 249605 - DNA, 22 bp, Homo sapiens
cctgtctggctcggacccaccc

SEQ ID NO: 249606 - DNA, 20 bp, Homo sapiens
cctgtctgtctgtctgtccc

SEQ ID NO: 249607 - DNA, 10 bp, Homo sapiens
cctgtcttct

SEQ ID NO: 249608 - DNA, 18 bp, Homo sapiens
cctgtctttgctgtttat

SEQ ID NO: 249609 - DNA, 17 bp, Homo sapiens
cctgtgaccagcactgt

SEQ ID NO: 249610 - DNA, 22 bp, Homo sapiens
cctgtgaccggggtcctgaggc

SEQ ID NO: 249611 - DNA, 23 bp, Homo sapiens
cctgtgaccggggtcctgaggct

SEQ ID NO: 249612 - DNA, 13 bp, Homo sapiens
cctgtgactcctc

SEQ ID NO: 249613 - DNA, 22 bp, Homo sapiens
cctgtgactcctcccttcccca

SEQ ID NO: 249614 - DNA, 14 bp, Homo sapiens
cctgtgagcatcct

SEQ ID NO: 249615 - DNA, 18 bp, Homo sapiens
cctgtgagggagtgcaga

SEQ ID NO: 249616 - DNA, 20 bp, Homo sapiens
cctgtgagggagtgcagaac

SEQ ID NO: 249617 - DNA, 20 bp, Homo sapiens
cctgtgaggtaactgggatc

SEQ ID NO: 249618 - DNA, 16 bp, Homo sapiens
cctgtgatcgtgtgtt

SEQ ID NO: 249619 - DNA, 17 bp, Homo sapiens
cctgtgatcgtgtgttg

SEQ ID NO: 249620 - DNA, 19 bp, Homo sapiens
cctgtgatgcctgacacag

SEQ ID NO: 249621 - DNA, 13 bp, Homo sapiens
cctgtgcagcagc

SEQ ID NO: 249622 - DNA, 22 bp, Homo sapiens
cctgtgccaggactctctttct

SEQ ID NO: 249623 - DNA, 23 bp, Homo sapiens
cctgtgcccacatcccaggcttc

SEQ ID NO: 249624 - DNA, 20 bp, Homo sapiens
cctgtgcccacccagggccc

SEQ ID NO: 249625 - DNA, 24 bp, Homo sapiens
cctgtgcccatcatctctgccttt

SEQ ID NO: 249626 - DNA, 15 bp, Homo sapiens
cctgtgcccttgctg

SEQ ID NO: 249627 - DNA, 18 bp, Homo sapiens
cctgtgcccttgctgggt

SEQ ID NO: 249628 - DNA, 18 bp, Homo sapiens
cctgtgcgttcccttcag

SEQ ID NO: 249629 - DNA, 19 bp, Homo sapiens
cctgtgcgttcccttcagt

SEQ ID NO: 249630 - DNA, 12 bp, Homo sapiens
cctgtgctacag

SEQ ID NO: 249631 - DNA, 14 bp, Homo sapiens
cctgtgctacagag

SEQ ID NO: 249632 - DNA, 13 bp, Homo sapiens
cctgtgctagttt

SEQ ID NO: 249633 - DNA, 14 bp, Homo sapiens
cctgtgctttctgc

SEQ ID NO: 249634 - DNA, 18 bp, Homo sapiens
cctgtgctttctgcatgc

SEQ ID NO: 249635 - DNA, 18 bp, Homo sapiens
cctgtggcaaatgccagg

SEQ ID NO: 249636 - DNA, 21 bp, Homo sapiens
cctgtggcagaaaagaggaga

SEQ ID NO: 249637 - DNA, 18 bp, Homo sapiens
cctgtggcatctttgcct

SEQ ID NO: 249638 - DNA, 13 bp, Homo sapiens
cctgtggccagag

SEQ ID NO: 249639 - DNA, 14 bp, Homo sapiens
cctgtggccttgcc

SEQ ID NO: 249640 - DNA, 12 bp, Homo sapiens
cctgtgggagaa

SEQ ID NO: 249641 - DNA, 14 bp, Homo sapiens
cctgtgggagaagg

SEQ ID NO: 249642 - DNA, 21 bp, Homo sapiens
cctgtgggagtccactttcct

SEQ ID NO: 249643 - DNA, 22 bp, Homo sapiens
cctgtgggagtccactttcctc

SEQ ID NO: 249644 - DNA, 23 bp, Homo sapiens
cctgtgggagtccactttcctct

SEQ ID NO: 249645 - DNA, 19 bp, Homo sapiens
cctgtggggatttctccca

SEQ ID NO: 249646 - DNA, 20 bp, Homo sapiens
cctgtggggatttctcccag

SEQ ID NO: 249647 - DNA, 13 bp, Homo sapiens
cctgtgggtcccc

SEQ ID NO: 249648 - DNA, 18 bp, Homo sapiens
cctgtgggtccccactca

SEQ ID NO: 249649 - DNA, 18 bp, Homo sapiens
cctgtggtgaagtgtggc

SEQ ID NO: 249650 - DNA, 19 bp, Homo sapiens
cctgtggtgacaggcccag

SEQ ID NO: 249651 - DNA, 21 bp, Homo sapiens
cctgtggtttgctccagaatt

SEQ ID NO: 249652 - DNA, 13 bp, Homo sapiens
cctgtgtagctgg

SEQ ID NO: 249653 - DNA, 13 bp, Homo sapiens
cctgtgtcatctg

SEQ ID NO: 249654 - DNA, 14 bp, Homo sapiens
cctgtgtcatctgt

SEQ ID NO: 249655 - DNA, 18 bp, Homo sapiens
cctgtgtccagcagctgc

SEQ ID NO: 249656 - DNA, 21 bp, Homo sapiens
cctgtgtctggtccacacacc

SEQ ID NO: 249657 - DNA, 13 bp, Homo sapiens
cctgtgtggagag

SEQ ID NO: 249658 - DNA, 14 bp, Homo sapiens
cctgtgtgggaggg

SEQ ID NO: 249659 - DNA, 18 bp, Homo sapiens
cctgtgtgttcttttgat

SEQ ID NO: 249660 - DNA, 21 bp, Homo sapiens
cctgtgtgttcttttgataca

SEQ ID NO: 249661 - DNA, 21 bp, Homo sapiens
cctgtgtgttgccaggcaggc

SEQ ID NO: 249662 - DNA, 22 bp, Homo sapiens
cctgtgttagtgtctgtccatc

SEQ ID NO: 249663 - DNA, 15 bp, Homo sapiens
cctgttacccagaga

SEQ ID NO: 249664 - DNA, 24 bp, Homo sapiens
cctgttacttaaatagcatctgct

SEQ ID NO: 249665 - DNA, 20 bp, Homo sapiens
cctgttatgccaaacagttg

SEQ ID NO: 249666 - DNA, 21 bp, Homo sapiens
cctgttatgccaaacagttgt

SEQ ID NO: 249667 - DNA, 12 bp, Homo sapiens
caccacagacac

SEQ ID NO: 249668 - DNA, 15 bp, Homo sapiens
caccacagacacaca

SEQ ID NO: 249669 - DNA, 19 bp, Homo sapiens
caccacagacacacacacg

SEQ ID NO: 249670 - DNA, 21 bp, Homo sapiens
caccacatcctccgtccagcc

SEQ ID NO: 249671 - DNA, 19 bp, Homo sapiens
caccacatcttgtcttttc

SEQ ID NO: 249672 - DNA, 20 bp, Homo sapiens
caccaccaagccctgcaaat

SEQ ID NO: 249673 - DNA, 16 bp, Homo sapiens
caccaccacacccctg

SEQ ID NO: 249674 - DNA, 18 bp, Homo sapiens
caccaccagatgagaagt

SEQ ID NO: 249675 - DNA, 23 bp, Homo sapiens
caccacccctccctctgctctca

SEQ ID NO: 249676 - DNA, 21 bp, Homo sapiens
caccaccgccctcctcgctgt

SEQ ID NO: 249677 - DNA, 23 bp, Homo sapiens
caccaccgccctcctcgctgtgc

SEQ ID NO: 249678 - DNA, 18 bp, Homo sapiens
caccacctcactcctgtt

SEQ ID NO: 249679 - DNA, 17 bp, Homo sapiens
caccacgtctgccaggc

SEQ ID NO: 249680 - DNA, 17 bp, Homo sapiens
caccactaaccatcccc

SEQ ID NO: 249681 - DNA, 19 bp, Homo sapiens
caccactaaccatccccaa

SEQ ID NO: 249682 - DNA, 20 bp, Homo sapiens
caccactaggaatcccagag

SEQ ID NO: 249683 - DNA, 19 bp, Homo sapiens
caccactgccctgcctgcc

SEQ ID NO: 249684 - DNA, 21 bp, Homo sapiens
caccactgccctgcctgccca

SEQ ID NO: 249685 - DNA, 17 bp, Homo sapiens
caccactgtccctacca

SEQ ID NO: 249686 - DNA, 21 bp, Homo sapiens
caccactgtccctaccactga

SEQ ID NO: 249687 - DNA, 21 bp, Homo sapiens
caccacttggagatctttgct

SEQ ID NO: 249688 - DNA, 22 bp, Homo sapiens
caccacttggagatctttgctt

SEQ ID NO: 249689 - DNA, 18 bp, Homo sapiens
caccagaacgcaccccac

SEQ ID NO: 249690 - DNA, 19 bp, Homo sapiens
caccagaacgcaccccact

SEQ ID NO: 249691 - DNA, 20 bp, Homo sapiens
caccagaacgcaccccactg

SEQ ID NO: 249692 - DNA, 21 bp, Homo sapiens
caccagaacgcaccccactgg

SEQ ID NO: 249693 - DNA, 18 bp, Homo sapiens
caccagaattgtgcaaat

SEQ ID NO: 249694 - DNA, 12 bp, Homo sapiens
caccagagtgaa

SEQ ID NO: 249695 - DNA, 23 bp, Homo sapiens
caccagagtgaaagggctatggc

SEQ ID NO: 249696 - DNA, 17 bp, Homo sapiens
caccagcaacatctcga

SEQ ID NO: 249697 - DNA, 15 bp, Homo sapiens
caccagcagcacaat

SEQ ID NO: 249698 - DNA, 23 bp, Homo sapiens
caccagcagcacaattctgtccc

SEQ ID NO: 249699 - DNA, 14 bp, Homo sapiens
caccagccccagca

SEQ ID NO: 249700 - DNA, 20 bp, Homo sapiens
caccagccccctggatgggc

SEQ ID NO: 249701 - DNA, 24 bp, Homo sapiens
caccagccccctggatgggcattg

SEQ ID NO: 249702 - DNA, 16 bp, Homo sapiens
caccagcccggcctgc

SEQ ID NO: 249703 - DNA, 18 bp, Homo sapiens
caccagcccggcctgctc

SEQ ID NO: 249704 - DNA, 17 bp, Homo sapiens
caccagccctgctgctt

SEQ ID NO: 249705 - DNA, 15 bp, Homo sapiens
caccagcccttccct

SEQ ID NO: 249706 - DNA, 20 bp, Homo sapiens
caccagcccttccctgcttt

SEQ ID NO: 249707 - DNA, 19 bp, Homo sapiens
caccagccgccccagcccc

SEQ ID NO: 249708 - DNA, 16 bp, Homo sapiens
caccagccggggaaga

SEQ ID NO: 249709 - DNA, 22 bp, Homo sapiens
caccagcctgagccacagtggg

SEQ ID NO: 249710 - DNA, 19 bp, Homo sapiens
caccagcgtttgaggggct

SEQ ID NO: 249711 - DNA, 21 bp, Homo sapiens
caccagctagaaagtggcaga

SEQ ID NO: 249712 - DNA, 21 bp, Homo sapiens
caccagctcagccccggccac

SEQ ID NO: 249713 - DNA, 14 bp, Homo sapiens
caccagctctgtgg

SEQ ID NO: 249714 - DNA, 23 bp, Homo sapiens
caccagctctgtggcctgtgtcc

SEQ ID NO: 249715 - DNA, 12 bp, Homo sapiens
caccagctgctc

SEQ ID NO: 249716 - DNA, 13 bp, Homo sapiens
caccagctgctct

SEQ ID NO: 249717 - DNA, 14 bp, Homo sapiens
caccagctgctgga

SEQ ID NO: 249718 - DNA, 17 bp, Homo sapiens
caccaggaacctcttca

SEQ ID NO: 249719 - DNA, 11 bp, Homo sapiens
caccaggaaga

SEQ ID NO: 249720 - DNA, 16 bp, Homo sapiens
caccaggaagaaggcc

SEQ ID NO: 249721 - DNA, 18 bp, Homo sapiens
caccaggaagaaggcccg

SEQ ID NO: 249722 - DNA, 23 bp, Homo sapiens
caccaggaagaaggcccgggagg

SEQ ID NO: 249723 - DNA, 11 bp, Homo sapiens
caccaggactt

SEQ ID NO: 249724 - DNA, 21 bp, Homo sapiens
caccaggacttggggtcagga

SEQ ID NO: 249725 - DNA, 14 bp, Homo sapiens
caccaggagacaga

SEQ ID NO: 249726 - DNA, 15 bp, Homo sapiens
caccaggctgtgggc

SEQ ID NO: 249727 - DNA, 18 bp, Homo sapiens
caccaggctgtgggcctc

SEQ ID NO: 249728 - DNA, 21 bp, Homo sapiens
caccagggtccgcaccagctg

SEQ ID NO: 249729 - DNA, 12 bp, Homo sapiens
caccaggtcctg

SEQ ID NO: 249730 - DNA, 21 bp, Homo sapiens
caccagtcagggacagcagcc

SEQ ID NO: 249731 - DNA, 16 bp, Homo sapiens
caccagtctcacccac

SEQ ID NO: 249732 - DNA, 15 bp, Homo sapiens
caccagtggcctcgt

SEQ ID NO: 249733 - DNA, 15 bp, Homo sapiens
caccatcacagcttg

SEQ ID NO: 249734 - DNA, 17 bp, Homo sapiens
caccatcccctcctagc

SEQ ID NO: 249735 - DNA, 22 bp, Homo sapiens
caccatcccctcctagcacaag

SEQ ID NO: 249736 - DNA, 21 bp, Homo sapiens
caccatcctgcagcctcctcc

SEQ ID NO: 249737 - DNA, 13 bp, Homo sapiens
caccatctcaggc

SEQ ID NO: 249738 - DNA, 19 bp, Homo sapiens
caccatctcaggccacctg

SEQ ID NO: 249739 - DNA, 21 bp, Homo sapiens
caccatctcaggccacctgcc

SEQ ID NO: 249740 - DNA, 16 bp, Homo sapiens
caccatgtaaaacaaa

SEQ ID NO: 249741 - DNA, 21 bp, Homo sapiens
caccatgtgcatcaggaaaca

SEQ ID NO: 249742 - DNA, 22 bp, Homo sapiens
caccatgtgccatctgtacata

SEQ ID NO: 249743 - DNA, 15 bp, Homo sapiens
caccattcaggaacc

SEQ ID NO: 249744 - DNA, 22 bp, Homo sapiens
caccattcaggaacctggacca

SEQ ID NO: 249745 - DNA, 23 bp, Homo sapiens
caccattccacatccccaccttc

SEQ ID NO: 249746 - DNA, 20 bp, Homo sapiens
caccatttaatcatttccag

SEQ ID NO: 249747 - DNA, 16 bp, Homo sapiens
caccatttcccctgtg

SEQ ID NO: 249748 - DNA, 21 bp, Homo sapiens
caccatttcccctgtggtttg

SEQ ID NO: 249749 - DNA, 13 bp, Homo sapiens
cacccaagcttgg

SEQ ID NO: 249750 - DNA, 15 bp, Homo sapiens
cacccaagtccaccc

SEQ ID NO: 249751 - DNA, 15 bp, Homo sapiens
cacccaattttaaaa

SEQ ID NO: 249752 - DNA, 19 bp, Homo sapiens
cacccaattttaaaaaata

SEQ ID NO: 249753 - DNA, 23 bp, Homo sapiens
cacccacacactcgcccgcccac

SEQ ID NO: 249754 - DNA, 22 bp, Homo sapiens
cacccacaccccgtctgcccct

SEQ ID NO: 249755 - DNA, 21 bp, Homo sapiens
cacccaccaaatgcctctgcc

SEQ ID NO: 249756 - DNA, 15 bp, Homo sapiens
cacccaccagggcga

SEQ ID NO: 249757 - DNA, 20 bp, Homo sapiens
cacccacccctcctgggccc

SEQ ID NO: 249758 - DNA, 14 bp, Homo sapiens
cacccacccctgcc

SEQ ID NO: 249759 - DNA, 15 bp, Homo sapiens
cacccaccctctggt

SEQ ID NO: 249760 - DNA, 14 bp, Homo sapiens
cacccacctccacc

SEQ ID NO: 249761 - DNA, 15 bp, Homo sapiens
cacccacctccaccc

SEQ ID NO: 249762 - DNA, 16 bp, Homo sapiens
cacccacctccaccca

SEQ ID NO: 249763 - DNA, 17 bp, Homo sapiens
cacccacctccacccag

SEQ ID NO: 249764 - DNA, 16 bp, Homo sapiens
cacccacgtgagagaa

SEQ ID NO: 249765 - DNA, 23 bp, Homo sapiens
cacccacgtgagagaatctgcct

SEQ ID NO: 249766 - DNA, 14 bp, Homo sapiens
cacccactagccct

SEQ ID NO: 249767 - DNA, 18 bp, Homo sapiens
cacccactcaccagggtc

SEQ ID NO: 249768 - DNA, 21 bp, Homo sapiens
cacccactccggattccggcc

SEQ ID NO: 249769 - DNA, 14 bp, Homo sapiens
cacccactgtccgc

SEQ ID NO: 249770 - DNA, 19 bp, Homo sapiens
cacccactgtccgcctctg

SEQ ID NO: 249771 - DNA, 13 bp, Homo sapiens
cacccagccccag

SEQ ID NO: 249772 - DNA, 15 bp, Homo sapiens
cacccagccccagcg

SEQ ID NO: 249773 - DNA, 23 bp, Homo sapiens
cacccagccccagcgagtctgga

SEQ ID NO: 249774 - DNA, 15 bp, Homo sapiens
cacccaggctgcact

SEQ ID NO: 249775 - DNA, 17 bp, Homo sapiens
cacccaggctgcactgc

SEQ ID NO: 249776 - DNA, 21 bp, Homo sapiens
cacccagggctccctcctgga

SEQ ID NO: 249777 - DNA, 14 bp, Homo sapiens
cacccagtgctgcc

SEQ ID NO: 249778 - DNA, 17 bp, Homo sapiens
cacccagtgctgccatg

SEQ ID NO: 249779 - DNA, 22 bp, Homo sapiens
cacccagtgctgccatgccact

SEQ ID NO: 249780 - DNA, 18 bp, Homo sapiens
cacccagtggaaccaaaa

SEQ ID NO: 249781 - DNA, 14 bp, Homo sapiens
cacccagtggaagg

SEQ ID NO: 249782 - DNA, 22 bp, Homo sapiens
cacccatcctaccaatgcatgc

SEQ ID NO: 249783 - DNA, 23 bp, Homo sapiens
cacccatcctaccaatgcatgca

SEQ ID NO: 249784 - DNA, 17 bp, Homo sapiens
cacccatcgtataagga

SEQ ID NO: 249785 - DNA, 14 bp, Homo sapiens
cacccatcttcctg

SEQ ID NO: 249786 - DNA, 15 bp, Homo sapiens
cacccatcttcctgc

SEQ ID NO: 249787 - DNA, 17 bp, Homo sapiens
cacccatcttcctgctg

SEQ ID NO: 249788 - DNA, 15 bp, Homo sapiens
cacccatgactgccc

SEQ ID NO: 249789 - DNA, 16 bp, Homo sapiens
caccccaaaccccagc

SEQ ID NO: 249790 - DNA, 16 bp, Homo sapiens
caccccaaacttccag

SEQ ID NO: 249791 - DNA, 15 bp, Homo sapiens
caccccaaccactct

SEQ ID NO: 249792 - DNA, 12 bp, Homo sapiens
caccccaactct

SEQ ID NO: 249793 - DNA, 18 bp, Homo sapiens
caccccaactctccccag

SEQ ID NO: 249794 - DNA, 16 bp, Homo sapiens
caccccaattaactga

SEQ ID NO: 249795 - DNA, 16 bp, Homo sapiens
caccccacaccccagc

SEQ ID NO: 249796 - DNA, 18 bp, Homo sapiens
caccccacaccccagccc

SEQ ID NO: 249797 - DNA, 12 bp, Homo sapiens
caccccacagat

SEQ ID NO: 249798 - DNA, 14 bp, Homo sapiens
caccccacccttcc

SEQ ID NO: 249799 - DNA, 17 bp, Homo sapiens
caccccactcacagaga

SEQ ID NO: 249800 - DNA, 13 bp, Homo sapiens
cctgttcaaagta

SEQ ID NO: 249801 - DNA, 12 bp, Homo sapiens
cctgttcccatt

SEQ ID NO: 249802 - DNA, 16 bp, Homo sapiens
cctgttcctgccttct

SEQ ID NO: 249803 - DNA, 22 bp, Homo sapiens
cctgttcctgccttctcttcta

SEQ ID NO: 249804 - DNA, 21 bp, Homo sapiens
cctgttccttgctagccctgg

SEQ ID NO: 249805 - DNA, 22 bp, Homo sapiens
cctgttctcagagctccacaga

SEQ ID NO: 249806 - DNA, 14 bp, Homo sapiens
cctgttctcagcat

SEQ ID NO: 249807 - DNA, 21 bp, Homo sapiens
cctgttctgaactgtggggtg

SEQ ID NO: 249808 - DNA, 19 bp, Homo sapiens
cctgttctgggtgcagctg

SEQ ID NO: 249809 - DNA, 14 bp, Homo sapiens
cctgttctgtagga

SEQ ID NO: 249810 - DNA, 18 bp, Homo sapiens
cctgttctgtaggagaga

SEQ ID NO: 249811 - DNA, 24 bp, Homo sapiens
cctgttgagtatttgctgtttgtc

SEQ ID NO: 249812 - DNA, 13 bp, Homo sapiens
ccttaaaactagg

SEQ ID NO: 249813 - DNA, 23 bp, Homo sapiens
ccttaaaatgcattgaaagaatt

SEQ ID NO: 249814 - DNA, 15 bp, Homo sapiens
ccttaaactgtgtgg

SEQ ID NO: 249815 - DNA, 14 bp, Homo sapiens
ccttaaatgaaaaa

SEQ ID NO: 249816 - DNA, 19 bp, Homo sapiens
ccttaagggttgaaggcag

SEQ ID NO: 249817 - DNA, 16 bp, Homo sapiens
ccttaagtatcagaaa

SEQ ID NO: 249818 - DNA, 14 bp, Homo sapiens
ccttaagtggctgt

SEQ ID NO: 249819 - DNA, 20 bp, Homo sapiens
ccttaatatgatctgtggag

SEQ ID NO: 249820 - DNA, 18 bp, Homo sapiens
ccttaatggatgctcatt

SEQ ID NO: 249821 - DNA, 14 bp, Homo sapiens
ccttacacaatggt

SEQ ID NO: 249822 - DNA, 22 bp, Homo sapiens
ccttacacgtacctctcatcag

SEQ ID NO: 249823 - DNA, 13 bp, Homo sapiens
ccttacatttgtg

SEQ ID NO: 249824 - DNA, 18 bp, Homo sapiens
ccttaccctactggctgt

SEQ ID NO: 249825 - DNA, 23 bp, Homo sapiens
ccttactattcccactttcattc

SEQ ID NO: 249826 - DNA, 18 bp, Homo sapiens
ccttactctgagcccagg

SEQ ID NO: 249827 - DNA, 21 bp, Homo sapiens
ccttactctgagcccaggccg

SEQ ID NO: 249828 - DNA, 14 bp, Homo sapiens
ccttacttagcatg

SEQ ID NO: 249829 - DNA, 20 bp, Homo sapiens
ccttagaaaagactgacctt

SEQ ID NO: 249830 - DNA, 16 bp, Homo sapiens
ccttagacccgccagg

SEQ ID NO: 249831 - DNA, 23 bp, Homo sapiens
ccttagactccttctccccaatc

SEQ ID NO: 249832 - DNA, 21 bp, Homo sapiens
ccttagagactagacaaataa

SEQ ID NO: 249833 - DNA, 23 bp, Homo sapiens
ccttagagattgccccagagccc

SEQ ID NO: 249834 - DNA, 17 bp, Homo sapiens
ccttagcagctcaggcg

SEQ ID NO: 249835 - DNA, 22 bp, Homo sapiens
ccttagcccggatgcccacccc

SEQ ID NO: 249836 - DNA, 15 bp, Homo sapiens
ccttagcctccctga

SEQ ID NO: 249837 - DNA, 16 bp, Homo sapiens
ccttagcctccctgaa

SEQ ID NO: 249838 - DNA, 18 bp, Homo sapiens
ccttagcctctcccaccc

SEQ ID NO: 249839 - DNA, 17 bp, Homo sapiens
ccttagcgttctggact

SEQ ID NO: 249840 - DNA, 23 bp, Homo sapiens
ccttagcgttctggactctgccc

SEQ ID NO: 249841 - DNA, 22 bp, Homo sapiens
ccttagctacaatcctaccttt

SEQ ID NO: 249842 - DNA, 19 bp, Homo sapiens
ccttagctccctcccgcac

SEQ ID NO: 249843 - DNA, 23 bp, Homo sapiens
ccttagctgccagtgctggtcac

SEQ ID NO: 249844 - DNA, 17 bp, Homo sapiens
ccttaggaagtgacttg

SEQ ID NO: 249845 - DNA, 15 bp, Homo sapiens
ccttaggagatgtca

SEQ ID NO: 249846 - DNA, 14 bp, Homo sapiens
ccttagtcttctca

SEQ ID NO: 249847 - DNA, 18 bp, Homo sapiens
ccttagtgtcacctttct

SEQ ID NO: 249848 - DNA, 14 bp, Homo sapiens
ccttatcaagtgtc

SEQ ID NO: 249849 - DNA, 16 bp, Homo sapiens
ccttatcataaattca

SEQ ID NO: 249850 - DNA, 20 bp, Homo sapiens
ccttatgtcctccaccacaa

SEQ ID NO: 249851 - DNA, 19 bp, Homo sapiens
ccttattgagcgtgattct

SEQ ID NO: 249852 - DNA, 21 bp, Homo sapiens
ccttattgagcgtgattctgt

SEQ ID NO: 249853 - DNA, 15 bp, Homo sapiens
ccttattgtacctct

SEQ ID NO: 249854 - DNA, 23 bp, Homo sapiens
ccttatttgtcggggaagatgaa

SEQ ID NO: 249855 - DNA, 14 bp, Homo sapiens
ccttattttgtatt

SEQ ID NO: 249856 - DNA, 19 bp, Homo sapiens
ccttcacaggcagtgcatg

SEQ ID NO: 249857 - DNA, 15 bp, Homo sapiens
ccttcaccacctcat

SEQ ID NO: 249858 - DNA, 16 bp, Homo sapiens
ccttcaccccttcagc

SEQ ID NO: 249859 - DNA, 16 bp, Homo sapiens
ccttcacgctggcttc

SEQ ID NO: 249860 - DNA, 12 bp, Homo sapiens
ccttcactgcca

SEQ ID NO: 249861 - DNA, 19 bp, Homo sapiens
ccttcactgccatgatagc

SEQ ID NO: 249862 - DNA, 21 bp, Homo sapiens
ccttcactgttgcttaattgt

SEQ ID NO: 249863 - DNA, 22 bp, Homo sapiens
ccttcacttctgaccacacttc

SEQ ID NO: 249864 - DNA, 17 bp, Homo sapiens
ccttcagaccccagttc

SEQ ID NO: 249865 - DNA, 18 bp, Homo sapiens
ccttcagaggtggctctg

SEQ ID NO: 249866 - DNA, 16 bp, Homo sapiens
ccttcagatggaaact

SEQ ID NO: 249867 - DNA, 16 bp, Homo sapiens
ccttcagccatagctt

SEQ ID NO: 249868 - DNA, 17 bp, Homo sapiens
ccttcaggacccttcta

SEQ ID NO: 249869 - DNA, 18 bp, Homo sapiens
ccttcagggagacaggca

SEQ ID NO: 249870 - DNA, 19 bp, Homo sapiens
ccttcagggagacaggcag

SEQ ID NO: 249871 - DNA, 13 bp, Homo sapiens
ccttcagggccag

SEQ ID NO: 249872 - DNA, 22 bp, Homo sapiens
ccttcagtatcaaggctgcctg

SEQ ID NO: 249873 - DNA, 24 bp, Homo sapiens
ccttcagtatcaaggctgcctgga

SEQ ID NO: 249874 - DNA, 17 bp, Homo sapiens
ccttcagtgagcccctc

SEQ ID NO: 249875 - DNA, 19 bp, Homo sapiens
ccttcagtgagcccctccc

SEQ ID NO: 249876 - DNA, 14 bp, Homo sapiens
ccttcagtgccaaa

SEQ ID NO: 249877 - DNA, 22 bp, Homo sapiens
ccttcagtttgaaggctgcaca

SEQ ID NO: 249878 - DNA, 19 bp, Homo sapiens
ccttcataaattatttcta

SEQ ID NO: 249879 - DNA, 17 bp, Homo sapiens
ccttcatctccagggag

SEQ ID NO: 249880 - DNA, 17 bp, Homo sapiens
ccttcatgcttttctca

SEQ ID NO: 249881 - DNA, 11 bp, Homo sapiens
ccttcattaaa

SEQ ID NO: 249882 - DNA, 18 bp, Homo sapiens
ccttcattccgttaggaa

SEQ ID NO: 249883 - DNA, 12 bp, Homo sapiens
ccttccacctca

SEQ ID NO: 249884 - DNA, 13 bp, Homo sapiens
ccttccacctcac

SEQ ID NO: 249885 - DNA, 12 bp, Homo sapiens
ccttccacctcc

SEQ ID NO: 249886 - DNA, 17 bp, Homo sapiens
ccttccacctcctagag

SEQ ID NO: 249887 - DNA, 20 bp, Homo sapiens
ccttccactgcctctgcctt

SEQ ID NO: 249888 - DNA, 21 bp, Homo sapiens
ccttccactgcctctgcctta

SEQ ID NO: 249889 - DNA, 21 bp, Homo sapiens
ccttccacttcagggttctaa

SEQ ID NO: 249890 - DNA, 18 bp, Homo sapiens
ccttccagcctgagatgt

SEQ ID NO: 249891 - DNA, 13 bp, Homo sapiens
ccttccaggccat

SEQ ID NO: 249892 - DNA, 22 bp, Homo sapiens
ccttccaggcgtagggccaggg

SEQ ID NO: 249893 - DNA, 24 bp, Homo sapiens
ccttccaggcgtagggccagggct

SEQ ID NO: 249894 - DNA, 11 bp, Homo sapiens
ccttccataat

SEQ ID NO: 249895 - DNA, 19 bp, Homo sapiens
ccttccatgtcgcctctgc

SEQ ID NO: 249896 - DNA, 22 bp, Homo sapiens
ccttcccaacgtactcctcaga

SEQ ID NO: 249897 - DNA, 14 bp, Homo sapiens
ccttcccaccccta

SEQ ID NO: 249898 - DNA, 15 bp, Homo sapiens
ccttcccactgtcct

SEQ ID NO: 249899 - DNA, 16 bp, Homo sapiens
ccttcccactgtcctt

SEQ ID NO: 249900 - DNA, 17 bp, Homo sapiens
ccttcccagtgggctgt

SEQ ID NO: 249901 - DNA, 15 bp, Homo sapiens
ccttcccatctcttc

SEQ ID NO: 249902 - DNA, 18 bp, Homo sapiens
ccttccccactctgctcc

SEQ ID NO: 249903 - DNA, 12 bp, Homo sapiens
ccttccccactg

SEQ ID NO: 249904 - DNA, 15 bp, Homo sapiens
ccttccccagcgtcc

SEQ ID NO: 249905 - DNA, 17 bp, Homo sapiens
ccttcccccagcccaat

SEQ ID NO: 249906 - DNA, 21 bp, Homo sapiens
ccttcccccagcccaataaag

SEQ ID NO: 249907 - DNA, 19 bp, Homo sapiens
ccttccccctccaatccca

SEQ ID NO: 249908 - DNA, 20 bp, Homo sapiens
ccttccccctgtagactagt

SEQ ID NO: 249909 - DNA, 15 bp, Homo sapiens
ccttcccctccctgg

SEQ ID NO: 249910 - DNA, 14 bp, Homo sapiens
ccttcccctgcctg

SEQ ID NO: 249911 - DNA, 13 bp, Homo sapiens
ccttcccctgcgc

SEQ ID NO: 249912 - DNA, 17 bp, Homo sapiens
ccttcccctgcgccctc

SEQ ID NO: 249913 - DNA, 21 bp, Homo sapiens
ccttcccctgcgccctccctc

SEQ ID NO: 249914 - DNA, 18 bp, Homo sapiens
ccttcccctgctgacctt

SEQ ID NO: 249915 - DNA, 15 bp, Homo sapiens
ccttcccctgtgact

SEQ ID NO: 249916 - DNA, 18 bp, Homo sapiens
ccttccccttttgcctgg

SEQ ID NO: 249917 - DNA, 20 bp, Homo sapiens
ccttccccttttgcctggct

SEQ ID NO: 249918 - DNA, 12 bp, Homo sapiens
ccttccctctgt

SEQ ID NO: 249919 - DNA, 12 bp, Homo sapiens
ccttccctggcc

SEQ ID NO: 249920 - DNA, 13 bp, Homo sapiens
ccttccctggccc

SEQ ID NO: 249921 - DNA, 14 bp, Homo sapiens
ccttccctgggaag

SEQ ID NO: 249922 - DNA, 20 bp, Homo sapiens
ccttcccttccactgcctct

SEQ ID NO: 249923 - DNA, 23 bp, Homo sapiens
ccttcccttccactgcctctgcc

SEQ ID NO: 249924 - DNA, 16 bp, Homo sapiens
ccttccgctcccacca

SEQ ID NO: 249925 - DNA, 17 bp, Homo sapiens
ccttccgctcccaccag

SEQ ID NO: 249926 - DNA, 18 bp, Homo sapiens
ccttcctaaatatccaaa

SEQ ID NO: 249927 - DNA, 21 bp, Homo sapiens
ccttcctaaatatccaaagac

SEQ ID NO: 249928 - DNA, 19 bp, Homo sapiens
ccttcctatgcccaggtac

SEQ ID NO: 249929 - DNA, 21 bp, Homo sapiens
ccttcctccgctcccctttcc

SEQ ID NO: 249930 - DNA, 13 bp, Homo sapiens
ccttcctcctcca

SEQ ID NO: 249931 - DNA, 15 bp, Homo sapiens
ccttcctcctccaca

SEQ ID NO: 249932 - DNA, 23 bp, Homo sapiens
ccttcctcctccacagtgctgct

SEQ ID NO: 249933 - DNA, 17 bp, Homo sapiens
caccccactgggagagc

SEQ ID NO: 249934 - DNA, 20 bp, Homo sapiens
caccccagcattccagctct

SEQ ID NO: 249935 - DNA, 22 bp, Homo sapiens
caccccagcattccagctctgc

SEQ ID NO: 249936 - DNA, 14 bp, Homo sapiens
caccccagcccacc

SEQ ID NO: 249937 - DNA, 11 bp, Homo sapiens
caccccagcct

SEQ ID NO: 249938 - DNA, 19 bp, Homo sapiens
caccccagctaccccttct

SEQ ID NO: 249939 - DNA, 20 bp, Homo sapiens
caccccagctgctcccctcc

SEQ ID NO: 249940 - DNA, 17 bp, Homo sapiens
caccccagtccccggga

SEQ ID NO: 249941 - DNA, 16 bp, Homo sapiens
caccccagtgcctgtc

SEQ ID NO: 249942 - DNA, 20 bp, Homo sapiens
caccccataactacagagtc

SEQ ID NO: 249943 - DNA, 15 bp, Homo sapiens
caccccatcccacac

SEQ ID NO: 249944 - DNA, 18 bp, Homo sapiens
caccccatctctcttccc

SEQ ID NO: 249945 - DNA, 12 bp, Homo sapiens
caccccatgcca

SEQ ID NO: 249946 - DNA, 22 bp, Homo sapiens
caccccatgtgggtgaccaggt

SEQ ID NO: 249947 - DNA, 17 bp, Homo sapiens
cacccccacccacctcc

SEQ ID NO: 249948 - DNA, 14 bp, Homo sapiens
cacccccagcctcc

SEQ ID NO: 249949 - DNA, 15 bp, Homo sapiens
cacccccagcctccc

SEQ ID NO: 249950 - DNA, 20 bp, Homo sapiens
cacccccagcctcccccagg

SEQ ID NO: 249951 - DNA, 13 bp, Homo sapiens
cacccccatccct

SEQ ID NO: 249952 - DNA, 17 bp, Homo sapiens
cacccccatgctgcctt

SEQ ID NO: 249953 - DNA, 18 bp, Homo sapiens
cacccccatgctgccttc

SEQ ID NO: 249954 - DNA, 22 bp, Homo sapiens
cacccccatgctgccttcaggg

SEQ ID NO: 249955 - DNA, 17 bp, Homo sapiens
cacccccgccacggcca

SEQ ID NO: 249956 - DNA, 14 bp, Homo sapiens
caccccctgtccca

SEQ ID NO: 249957 - DNA, 22 bp, Homo sapiens
caccccctgtcccattctagat

SEQ ID NO: 249958 - DNA, 13 bp, Homo sapiens
cacccccttctct

SEQ ID NO: 249959 - DNA, 22 bp, Homo sapiens
cacccccttctctgctccacca

SEQ ID NO: 249960 - DNA, 14 bp, Homo sapiens
caccccgctgcctg

SEQ ID NO: 249961 - DNA, 13 bp, Homo sapiens
caccccggcaggc

SEQ ID NO: 249962 - DNA, 20 bp, Homo sapiens
caccccggcaggccctgcag

SEQ ID NO: 249963 - DNA, 22 bp, Homo sapiens
caccccggcaggccctgcagtg

SEQ ID NO: 249964 - DNA, 12 bp, Homo sapiens
caccccggcctc

SEQ ID NO: 249965 - DNA, 16 bp, Homo sapiens
caccccggcctccact

SEQ ID NO: 249966 - DNA, 18 bp, Homo sapiens
caccccgggctctctgct

SEQ ID NO: 249967 - DNA, 12 bp, Homo sapiens
caccccgtcccg

SEQ ID NO: 249968 - DNA, 15 bp, Homo sapiens
caccccgtcccggcc

SEQ ID NO: 249969 - DNA, 14 bp, Homo sapiens
cacccctaaagaga

SEQ ID NO: 249970 - DNA, 15 bp, Homo sapiens
cacccctaaagagat

SEQ ID NO: 249971 - DNA, 17 bp, Homo sapiens
cacccctaagtgcccaa

SEQ ID NO: 249972 - DNA, 19 bp, Homo sapiens
cacccctcaagccaggaga

SEQ ID NO: 249973 - DNA, 21 bp, Homo sapiens
cacccctcagcgctccctgtc

SEQ ID NO: 249974 - DNA, 20 bp, Homo sapiens
cacccctccctctgctctca

SEQ ID NO: 249975 - DNA, 20 bp, Homo sapiens
cacccctccgtgtggagcac

SEQ ID NO: 249976 - DNA, 21 bp, Homo sapiens
cacccctcctgggcccaggca

SEQ ID NO: 249977 - DNA, 19 bp, Homo sapiens
cacccctccttccctggtc

SEQ ID NO: 249978 - DNA, 20 bp, Homo sapiens
cacccctccttccctggtcc

SEQ ID NO: 249979 - DNA, 16 bp, Homo sapiens
cacccctcttccccct

SEQ ID NO: 249980 - DNA, 21 bp, Homo sapiens
cacccctcttcccccttcccc

SEQ ID NO: 249981 - DNA, 13 bp, Homo sapiens
cacccctgcaggc

SEQ ID NO: 249982 - DNA, 24 bp, Homo sapiens
cacccctgctctacccatgagcct

SEQ ID NO: 249983 - DNA, 18 bp, Homo sapiens
cacccctgggcaggcggt

SEQ ID NO: 249984 - DNA, 14 bp, Homo sapiens
caccccttccccac

SEQ ID NO: 249985 - DNA, 18 bp, Homo sapiens
caccccttccccactgcc

SEQ ID NO: 249986 - DNA, 21 bp, Homo sapiens
caccccttccccatttcctct

SEQ ID NO: 249987 - DNA, 12 bp, Homo sapiens
cacccgccccag

SEQ ID NO: 249988 - DNA, 13 bp, Homo sapiens
cacccgccccaga

SEQ ID NO: 249989 - DNA, 16 bp, Homo sapiens
cacccgccccagagac

SEQ ID NO: 249990 - DNA, 17 bp, Homo sapiens
cacccgccccagagact

SEQ ID NO: 249991 - DNA, 19 bp, Homo sapiens
cacccgcccgcccccgccc

SEQ ID NO: 249992 - DNA, 23 bp, Homo sapiens
cacccgccgccactaggtgtccc

SEQ ID NO: 249993 - DNA, 19 bp, Homo sapiens
cacccgctgcccagccctc

SEQ ID NO: 249994 - DNA, 17 bp, Homo sapiens
cacccgcttcctgtttc

SEQ ID NO: 249995 - DNA, 14 bp, Homo sapiens
cacccggaaagact

SEQ ID NO: 249996 - DNA, 14 bp, Homo sapiens
cacccggccacagc

SEQ ID NO: 249997 - DNA, 16 bp, Homo sapiens
cacccggccacagctg

SEQ ID NO: 249998 - DNA, 19 bp, Homo sapiens
cacccggccacagctgctg

SEQ ID NO: 249999 - DNA, 18 bp, Homo sapiens
cacccgtaggcagcctct

SEQ ID NO: 250000 - DNA, 22 bp, Homo sapiens
cacccgtaggcagcctctctgc

SEQ ID NO: 250001 - DNA, 20 bp, Homo sapiens
cacccgtcttcaatctctgt

SEQ ID NO: 250002 - DNA, 17 bp, Homo sapiens
cacccgtgttctcctcc

SEQ ID NO: 250003 - DNA, 18 bp, Homo sapiens
cacccgtgttctcctcca

SEQ ID NO: 250004 - DNA, 19 bp, Homo sapiens
cacccgttctgctggcctg

SEQ ID NO: 250005 - DNA, 14 bp, Homo sapiens
cacccgtttccaag

SEQ ID NO: 250006 - DNA, 17 bp, Homo sapiens
cacccgtttccaagcct

SEQ ID NO: 250007 - DNA, 18 bp, Homo sapiens
caccctaaagcaggctga

SEQ ID NO: 250008 - DNA, 17 bp, Homo sapiens
caccctaactcttgctc

SEQ ID NO: 250009 - DNA, 22 bp, Homo sapiens
caccctaactcttgctcactcc

SEQ ID NO: 250010 - DNA, 18 bp, Homo sapiens
caccctaactgagctgcc

SEQ ID NO: 250011 - DNA, 20 bp, Homo sapiens
caccctaatttgcccttcag

SEQ ID NO: 250012 - DNA, 18 bp, Homo sapiens
caccctagtcccttcccc

SEQ ID NO: 250013 - DNA, 15 bp, Homo sapiens
caccctcacacacac

SEQ ID NO: 250014 - DNA, 19 bp, Homo sapiens
caccctcactctgccaggg

SEQ ID NO: 250015 - DNA, 15 bp, Homo sapiens
caccctcagctggcg

SEQ ID NO: 250016 - DNA, 16 bp, Homo sapiens
caccctccagcacaga

SEQ ID NO: 250017 - DNA, 14 bp, Homo sapiens
caccctcccctctt

SEQ ID NO: 250018 - DNA, 13 bp, Homo sapiens
caccctccttccc

SEQ ID NO: 250019 - DNA, 14 bp, Homo sapiens
caccctccttcccg

SEQ ID NO: 250020 - DNA, 15 bp, Homo sapiens
caccctccttcccgc

SEQ ID NO: 250021 - DNA, 11 bp, Homo sapiens
caccctgcaag

SEQ ID NO: 250022 - DNA, 11 bp, Homo sapiens
caccctgcaga

SEQ ID NO: 250023 - DNA, 13 bp, Homo sapiens
caccctgcagcca

SEQ ID NO: 250024 - DNA, 16 bp, Homo sapiens
caccctgcagccagga

SEQ ID NO: 250025 - DNA, 13 bp, Homo sapiens
caccctgccttat

SEQ ID NO: 250026 - DNA, 19 bp, Homo sapiens
caccctgccttatcttgca

SEQ ID NO: 250027 - DNA, 18 bp, Homo sapiens
caccctgcttggggcctg

SEQ ID NO: 250028 - DNA, 21 bp, Homo sapiens
caccctggaggatttcatctc

SEQ ID NO: 250029 - DNA, 21 bp, Homo sapiens
caccctggattgatcggagcc

SEQ ID NO: 250030 - DNA, 16 bp, Homo sapiens
caccctggcccgcccc

SEQ ID NO: 250031 - DNA, 17 bp, Homo sapiens
caccctggcccgcccct

SEQ ID NO: 250032 - DNA, 19 bp, Homo sapiens
caccctgggatgggccacc

SEQ ID NO: 250033 - DNA, 22 bp, Homo sapiens
caccctgggatgggccacccac

SEQ ID NO: 250034 - DNA, 14 bp, Homo sapiens
caccctgggcctcc

SEQ ID NO: 250035 - DNA, 15 bp, Homo sapiens
caccctgggcctccc

SEQ ID NO: 250036 - DNA, 18 bp, Homo sapiens
caccctgggcctcccgtc

SEQ ID NO: 250037 - DNA, 20 bp, Homo sapiens
caccctggggcctggacctg

SEQ ID NO: 250038 - DNA, 22 bp, Homo sapiens
caccctgtcaagttaacaagga

SEQ ID NO: 250039 - DNA, 12 bp, Homo sapiens
caccctgtggca

SEQ ID NO: 250040 - DNA, 20 bp, Homo sapiens
cacccttcacataccctccc

SEQ ID NO: 250041 - DNA, 22 bp, Homo sapiens
cacccttcacataccctccccc

SEQ ID NO: 250042 - DNA, 12 bp, Homo sapiens
cacccttcccca

SEQ ID NO: 250043 - DNA, 13 bp, Homo sapiens
cacccttccccac

SEQ ID NO: 250044 - DNA, 14 bp, Homo sapiens
cacccttccccact

SEQ ID NO: 250045 - DNA, 15 bp, Homo sapiens
cacccttccccactc

SEQ ID NO: 250046 - DNA, 21 bp, Homo sapiens
cacccttccccactcccgtga

SEQ ID NO: 250047 - DNA, 14 bp, Homo sapiens
cacccttcccctcc

SEQ ID NO: 250048 - DNA, 23 bp, Homo sapiens
cacccttcccctccttctccctt

SEQ ID NO: 250049 - DNA, 18 bp, Homo sapiens
cacccttctcccctgccc

SEQ ID NO: 250050 - DNA, 13 bp, Homo sapiens
cacccttggactt

SEQ ID NO: 250051 - DNA, 12 bp, Homo sapiens
cacccttggcct

SEQ ID NO: 250052 - DNA, 13 bp, Homo sapiens
cacccttggcctg

SEQ ID NO: 250053 - DNA, 21 bp, Homo sapiens
cacccttggcctgtctcatcc

SEQ ID NO: 250054 - DNA, 18 bp, Homo sapiens
caccgaccccctttctaa

SEQ ID NO: 250055 - DNA, 15 bp, Homo sapiens
caccgaggccagcga

SEQ ID NO: 250056 - DNA, 14 bp, Homo sapiens
caccgaggttccca

SEQ ID NO: 250057 - DNA, 16 bp, Homo sapiens
caccgaggttcccagg

SEQ ID NO: 250058 - DNA, 15 bp, Homo sapiens
caccgcagcctgtca

SEQ ID NO: 250059 - DNA, 16 bp, Homo sapiens
caccgcagcctgtcag

SEQ ID NO: 250060 - DNA, 14 bp, Homo sapiens
caccgcatatgcat

SEQ ID NO: 250061 - DNA, 20 bp, Homo sapiens
caccgcccaacccccacctc

SEQ ID NO: 250062 - DNA, 21 bp, Homo sapiens
caccgcccaacccccacctcc

SEQ ID NO: 250063 - DNA, 17 bp, Homo sapiens
caccgccctcctcgctg

SEQ ID NO: 250064 - DNA, 14 bp, Homo sapiens
caccgcggcgcctc

SEQ ID NO: 250065 - DNA, 14 bp, Homo sapiens
caccgctccccagc

SEQ ID NO: 250066 - DNA, 16 bp, Homo sapiens
caccgctccccagccc

SEQ ID NO: 250067 - DNA, 18 bp, Homo sapiens
caccgctccccagcccag

SEQ ID NO: 250068 - DNA, 20 bp, Homo sapiens
ccttcctcctgaagcctctg

SEQ ID NO: 250069 - DNA, 15 bp, Homo sapiens
ccttcctctccactg

SEQ ID NO: 250070 - DNA, 16 bp, Homo sapiens
ccttcctctccactgc

SEQ ID NO: 250071 - DNA, 21 bp, Homo sapiens
ccttcctctccactgccttcg

SEQ ID NO: 250072 - DNA, 11 bp, Homo sapiens
ccttcctgccc

SEQ ID NO: 250073 - DNA, 12 bp, Homo sapiens
ccttcctgccct

SEQ ID NO: 250074 - DNA, 20 bp, Homo sapiens
ccttcctgccctgtacctct

SEQ ID NO: 250075 - DNA, 18 bp, Homo sapiens
ccttcctggactggccct

SEQ ID NO: 250076 - DNA, 14 bp, Homo sapiens
ccttcctggcctca

SEQ ID NO: 250077 - DNA, 15 bp, Homo sapiens
ccttcctggcctcac

SEQ ID NO: 250078 - DNA, 19 bp, Homo sapiens
ccttcctgggcagcccaga

SEQ ID NO: 250079 - DNA, 12 bp, Homo sapiens
ccttcctgtccg

SEQ ID NO: 250080 - DNA, 16 bp, Homo sapiens
ccttcctgtccgccct

SEQ ID NO: 250081 - DNA, 12 bp, Homo sapiens
ccttcctgtctg

SEQ ID NO: 250082 - DNA, 17 bp, Homo sapiens
ccttcctgtctggccca

SEQ ID NO: 250083 - DNA, 14 bp, Homo sapiens
ccttccttcttgct

SEQ ID NO: 250084 - DNA, 20 bp, Homo sapiens
ccttcgagggttccaggctg

SEQ ID NO: 250085 - DNA, 21 bp, Homo sapiens
ccttcgagggttccaggctgt

SEQ ID NO: 250086 - DNA, 13 bp, Homo sapiens
ccttcgtgccccc

SEQ ID NO: 250087 - DNA, 13 bp, Homo sapiens
ccttcgtgtctct

SEQ ID NO: 250088 - DNA, 20 bp, Homo sapiens
ccttcgtgtctctcccaccc

SEQ ID NO: 250089 - DNA, 17 bp, Homo sapiens
ccttcgttaactgtgta

SEQ ID NO: 250090 - DNA, 18 bp, Homo sapiens
ccttctacactctcctgg

SEQ ID NO: 250091 - DNA, 19 bp, Homo sapiens
ccttctacctgcaggactc

SEQ ID NO: 250092 - DNA, 15 bp, Homo sapiens
ccttctactttttcc

SEQ ID NO: 250093 - DNA, 16 bp, Homo sapiens
ccttctaggcatctcc

SEQ ID NO: 250094 - DNA, 10 bp, Homo sapiens
ccttctcagg

SEQ ID NO: 250095 - DNA, 22 bp, Homo sapiens
ccttctccatggccctgccatg

SEQ ID NO: 250096 - DNA, 13 bp, Homo sapiens
ccttctcccagca

SEQ ID NO: 250097 - DNA, 12 bp, Homo sapiens
ccttctccccaa

SEQ ID NO: 250098 - DNA, 17 bp, Homo sapiens
ccttctcccctccagac

SEQ ID NO: 250099 - DNA, 20 bp, Homo sapiens
ccttctcccctccagacccc

SEQ ID NO: 250100 - DNA, 21 bp, Homo sapiens
ccttctcccctccagacccct

SEQ ID NO: 250101 - DNA, 13 bp, Homo sapiens
ccttctcccctgc

SEQ ID NO: 250102 - DNA, 22 bp, Homo sapiens
ccttctcccctgcactgtaaaa

SEQ ID NO: 250103 - DNA, 12 bp, Homo sapiens
ccttctcctctc

SEQ ID NO: 250104 - DNA, 17 bp, Homo sapiens
ccttctcctctctgggc

SEQ ID NO: 250105 - DNA, 19 bp, Homo sapiens
ccttctccttccaactgct

SEQ ID NO: 250106 - DNA, 14 bp, Homo sapiens
ccttctccttccca

SEQ ID NO: 250107 - DNA, 22 bp, Homo sapiens
ccttctccttcccatttctcta

SEQ ID NO: 250108 - DNA, 16 bp, Homo sapiens
ccttctcgtcttcctc

SEQ ID NO: 250109 - DNA, 18 bp, Homo sapiens
ccttctcgtcttcctctc

SEQ ID NO: 250110 - DNA, 20 bp, Homo sapiens
ccttctctactcatgccaga

SEQ ID NO: 250111 - DNA, 22 bp, Homo sapiens
ccttctctactcatgccagatt

SEQ ID NO: 250112 - DNA, 22 bp, Homo sapiens
ccttctctattgggcacagcct

SEQ ID NO: 250113 - DNA, 13 bp, Homo sapiens
ccttctctgctcc

SEQ ID NO: 250114 - DNA, 20 bp, Homo sapiens
ccttctctgctccaccacat

SEQ ID NO: 250115 - DNA, 21 bp, Homo sapiens
ccttctctgtagggaactctg

SEQ ID NO: 250116 - DNA, 16 bp, Homo sapiens
ccttctgaagatctca

SEQ ID NO: 250117 - DNA, 12 bp, Homo sapiens
ccttctgctttc

SEQ ID NO: 250118 - DNA, 22 bp, Homo sapiens
ccttctggaataaggagaatga

SEQ ID NO: 250119 - DNA, 11 bp, Homo sapiens
ccttctgggca

SEQ ID NO: 250120 - DNA, 16 bp, Homo sapiens
ccttctgtccccagcc

SEQ ID NO: 250121 - DNA, 15 bp, Homo sapiens
ccttctgtgaaagta

SEQ ID NO: 250122 - DNA, 14 bp, Homo sapiens
ccttctgtgcccag

SEQ ID NO: 250123 - DNA, 16 bp, Homo sapiens
ccttctgtgcccagct

SEQ ID NO: 250124 - DNA, 20 bp, Homo sapiens
ccttctgtgcccagctcagt

SEQ ID NO: 250125 - DNA, 19 bp, Homo sapiens
ccttcttcacccagctaat

SEQ ID NO: 250126 - DNA, 18 bp, Homo sapiens
ccttcttgggccccagac

SEQ ID NO: 250127 - DNA, 19 bp, Homo sapiens
ccttcttgggccccagacc

SEQ ID NO: 250128 - DNA, 13 bp, Homo sapiens
ccttcttggtgct

SEQ ID NO: 250129 - DNA, 21 bp, Homo sapiens
ccttcttttgaccccttcctg

SEQ ID NO: 250130 - DNA, 14 bp, Homo sapiens
ccttctttttcttc

SEQ ID NO: 250131 - DNA, 18 bp, Homo sapiens
ccttgaactgttctggcc

SEQ ID NO: 250132 - DNA, 20 bp, Homo sapiens
ccttgaagaatttgttcttg

SEQ ID NO: 250133 - DNA, 16 bp, Homo sapiens
ccttgaagatgtagct

SEQ ID NO: 250134 - DNA, 18 bp, Homo sapiens
ccttgaagatgtagcttc

SEQ ID NO: 250135 - DNA, 21 bp, Homo sapiens
ccttgactgaagcgaacatct

SEQ ID NO: 250136 - DNA, 22 bp, Homo sapiens
ccttgactgaagcgaacatctt

SEQ ID NO: 250137 - DNA, 19 bp, Homo sapiens
ccttgagaaaccttattgt

SEQ ID NO: 250138 - DNA, 14 bp, Homo sapiens
ccttgagacagctt

SEQ ID NO: 250139 - DNA, 22 bp, Homo sapiens
ccttgagacccccaagcttcca

SEQ ID NO: 250140 - DNA, 17 bp, Homo sapiens
ccttgagaccctcttct

SEQ ID NO: 250141 - DNA, 21 bp, Homo sapiens
ccttgagaccctcttctctgg

SEQ ID NO: 250142 - DNA, 20 bp, Homo sapiens
ccttgagaggcatgacagct

SEQ ID NO: 250143 - DNA, 14 bp, Homo sapiens
ccttgagctgagat

SEQ ID NO: 250144 - DNA, 21 bp, Homo sapiens
ccttgagggtgcttgttccct

SEQ ID NO: 250145 - DNA, 19 bp, Homo sapiens
ccttgagtagtttttatct

SEQ ID NO: 250146 - DNA, 21 bp, Homo sapiens
ccttgatggagaaggaaaagg

SEQ ID NO: 250147 - DNA, 14 bp, Homo sapiens
ccttgatgtcttga

SEQ ID NO: 250148 - DNA, 20 bp, Homo sapiens
ccttgatgtcttgagagcgc

SEQ ID NO: 250149 - DNA, 21 bp, Homo sapiens
ccttgatttatcacacaaagc

SEQ ID NO: 250150 - DNA, 16 bp, Homo sapiens
ccttgcaacacacaga

SEQ ID NO: 250151 - DNA, 17 bp, Homo sapiens
ccttgcaacacacagac

SEQ ID NO: 250152 - DNA, 18 bp, Homo sapiens
ccttgcaacacacagaca

SEQ ID NO: 250153 - DNA, 22 bp, Homo sapiens
ccttgcaacacacagacacacg

SEQ ID NO: 250154 - DNA, 14 bp, Homo sapiens
ccttgcactggtca

SEQ ID NO: 250155 - DNA, 18 bp, Homo sapiens
ccttgcaggggtcccccc

SEQ ID NO: 250156 - DNA, 19 bp, Homo sapiens
ccttgcaggggtcccccct

SEQ ID NO: 250157 - DNA, 22 bp, Homo sapiens
ccttgcagttcagcaccaccct

SEQ ID NO: 250158 - DNA, 23 bp, Homo sapiens
ccttgcagttcagcaccacccta

SEQ ID NO: 250159 - DNA, 11 bp, Homo sapiens
ccttgcatcaa

SEQ ID NO: 250160 - DNA, 12 bp, Homo sapiens
ccttgcatttgt

SEQ ID NO: 250161 - DNA, 18 bp, Homo sapiens
ccttgccaagctttcttc

SEQ ID NO: 250162 - DNA, 16 bp, Homo sapiens
ccttgccaaggccgcc

SEQ ID NO: 250163 - DNA, 16 bp, Homo sapiens
ccttgcccaactccca

SEQ ID NO: 250164 - DNA, 20 bp, Homo sapiens
ccttgcccaactcccagcca

SEQ ID NO: 250165 - DNA, 18 bp, Homo sapiens
ccttgcccagcaaggacc

SEQ ID NO: 250166 - DNA, 13 bp, Homo sapiens
ccttgccccagtc

SEQ ID NO: 250167 - DNA, 15 bp, Homo sapiens
ccttgccccagtcct

SEQ ID NO: 250168 - DNA, 17 bp, Homo sapiens
ccttgccccagtcctgg

SEQ ID NO: 250169 - DNA, 17 bp, Homo sapiens
ccttgcccccatccctc

SEQ ID NO: 250170 - DNA, 20 bp, Homo sapiens
ccttgcccccatccctcgga

SEQ ID NO: 250171 - DNA, 12 bp, Homo sapiens
ccttgcccgcca

SEQ ID NO: 250172 - DNA, 17 bp, Homo sapiens
ccttgcccgccagccag

SEQ ID NO: 250173 - DNA, 16 bp, Homo sapiens
ccttgcccgccagcct

SEQ ID NO: 250174 - DNA, 14 bp, Homo sapiens
ccttgccctgggcc

SEQ ID NO: 250175 - DNA, 15 bp, Homo sapiens
ccttgccctgggcca

SEQ ID NO: 250176 - DNA, 18 bp, Homo sapiens
ccttgccgctgggagagc

SEQ ID NO: 250177 - DNA, 15 bp, Homo sapiens
ccttgcctcaatgcc

SEQ ID NO: 250178 - DNA, 21 bp, Homo sapiens
ccttgcctcccctcctctcct

SEQ ID NO: 250179 - DNA, 16 bp, Homo sapiens
ccttgctagccctggg

SEQ ID NO: 250180 - DNA, 15 bp, Homo sapiens
ccttgctcagtgcct

SEQ ID NO: 250181 - DNA, 18 bp, Homo sapiens
ccttgctcagtgcctcct

SEQ ID NO: 250182 - DNA, 19 bp, Homo sapiens
ccttgctcagtgcctcctg

SEQ ID NO: 250183 - DNA, 14 bp, Homo sapiens
ccttgctctccctc

SEQ ID NO: 250184 - DNA, 16 bp, Homo sapiens
ccttgctgcagtgtcc

SEQ ID NO: 250185 - DNA, 23 bp, Homo sapiens
ccttgctgccaagtcctgccttt

SEQ ID NO: 250186 - DNA, 17 bp, Homo sapiens
ccttgctgggtccaggg

SEQ ID NO: 250187 - DNA, 21 bp, Homo sapiens
ccttgctgggtccagggtagg

SEQ ID NO: 250188 - DNA, 22 bp, Homo sapiens
ccttgctttgggctttgcaggc

SEQ ID NO: 250189 - DNA, 13 bp, Homo sapiens
ccttgcttttatg

SEQ ID NO: 250190 - DNA, 19 bp, Homo sapiens
ccttggaaacctgccctgc

SEQ ID NO: 250191 - DNA, 22 bp, Homo sapiens
ccttggaaacctgccctgcctg

SEQ ID NO: 250192 - DNA, 16 bp, Homo sapiens
ccttggacaccatccc

SEQ ID NO: 250193 - DNA, 17 bp, Homo sapiens
ccttggagagcagctgg

SEQ ID NO: 250194 - DNA, 21 bp, Homo sapiens
ccttggagagcagctggctct

SEQ ID NO: 250195 - DNA, 14 bp, Homo sapiens
ccttggagagctca

SEQ ID NO: 250196 - DNA, 16 bp, Homo sapiens
ccttggagcttacata

SEQ ID NO: 250197 - DNA, 14 bp, Homo sapiens
ccttggatttttga

SEQ ID NO: 250198 - DNA, 14 bp, Homo sapiens
ccttggcaccaaag

SEQ ID NO: 250199 - DNA, 16 bp, Homo sapiens
ccttggcaccaaagat

SEQ ID NO: 250200 - DNA, 18 bp, Homo sapiens
ccttggcacccccatgct

SEQ ID NO: 250201 - DNA, 16 bp, Homo sapiens
ccttggccacggcctg

SEQ ID NO: 250202 - DNA, 13 bp, Homo sapiens
caccggcgctgca

SEQ ID NO: 250203 - DNA, 15 bp, Homo sapiens
caccggcgctgcagg

SEQ ID NO: 250204 - DNA, 14 bp, Homo sapiens
caccgggcagggcc

SEQ ID NO: 250205 - DNA, 19 bp, Homo sapiens
caccggggcactggctgct

SEQ ID NO: 250206 - DNA, 21 bp, Homo sapiens
caccggggcactggctgctct

SEQ ID NO: 250207 - DNA, 18 bp, Homo sapiens
caccggttgcttctggga

SEQ ID NO: 250208 - DNA, 19 bp, Homo sapiens
caccggttgcttctgggaa

SEQ ID NO: 250209 - DNA, 19 bp, Homo sapiens
caccgtcatggcttaatgt

SEQ ID NO: 250210 - DNA, 20 bp, Homo sapiens
caccgtggtgtgaggccccc

SEQ ID NO: 250211 - DNA, 21 bp, Homo sapiens
caccgtttgtcccccggggca

SEQ ID NO: 250212 - DNA, 23 bp, Homo sapiens
cacctaaaaccagttttgctgct

SEQ ID NO: 250213 - DNA, 15 bp, Homo sapiens
cacctaaagcagcca

SEQ ID NO: 250214 - DNA, 11 bp, Homo sapiens
cacctaagtga

SEQ ID NO: 250215 - DNA, 14 bp, Homo sapiens
cacctaatgtttat

SEQ ID NO: 250216 - DNA, 15 bp, Homo sapiens
cacctaattaatttc

SEQ ID NO: 250217 - DNA, 16 bp, Homo sapiens
cacctaccatgctgct

SEQ ID NO: 250218 - DNA, 18 bp, Homo sapiens
cacctactaaaaaagtta

SEQ ID NO: 250219 - DNA, 21 bp, Homo sapiens
cacctactacatcgccctcca

SEQ ID NO: 250220 - DNA, 13 bp, Homo sapiens
cacctacttcctc

SEQ ID NO: 250221 - DNA, 15 bp, Homo sapiens
cacctagtccagtga

SEQ ID NO: 250222 - DNA, 20 bp, Homo sapiens
cacctatctcgtgggagagc

SEQ ID NO: 250223 - DNA, 23 bp, Homo sapiens
cacctatgagatggccatgctca

SEQ ID NO: 250224 - DNA, 19 bp, Homo sapiens
cacctatgcctgtggtgaa

SEQ ID NO: 250225 - DNA, 18 bp, Homo sapiens
cacctcaccccgttacag

SEQ ID NO: 250226 - DNA, 18 bp, Homo sapiens
cacctcacgctctggaca

SEQ ID NO: 250227 - DNA, 19 bp, Homo sapiens
cacctcacgctctggacat

SEQ ID NO: 250228 - DNA, 13 bp, Homo sapiens
cacctcactcctg

SEQ ID NO: 250229 - DNA, 15 bp, Homo sapiens
cacctcactcctgtt

SEQ ID NO: 250230 - DNA, 10 bp, Homo sapiens
cacctcagcc

SEQ ID NO: 250231 - DNA, 19 bp, Homo sapiens
cacctcaggaccccagagg

SEQ ID NO: 250232 - DNA, 17 bp, Homo sapiens
cacctcagttcccttgg

SEQ ID NO: 250233 - DNA, 19 bp, Homo sapiens
cacctcagttcccttggcc

SEQ ID NO: 250234 - DNA, 19 bp, Homo sapiens
cacctcatgcctggccccc

SEQ ID NO: 250235 - DNA, 17 bp, Homo sapiens
cacctccacccagcccc

SEQ ID NO: 250236 - DNA, 18 bp, Homo sapiens
cacctccacccagcccct

SEQ ID NO: 250237 - DNA, 14 bp, Homo sapiens
cacctccaccccca

SEQ ID NO: 250238 - DNA, 18 bp, Homo sapiens
cacctccacccccaagaa

SEQ ID NO: 250239 - DNA, 21 bp, Homo sapiens
cacctccacccccgccacggc

SEQ ID NO: 250240 - DNA, 23 bp, Homo sapiens
cacctccacccccgccacggcca

SEQ ID NO: 250241 - DNA, 15 bp, Homo sapiens
cacctccacccgtcc

SEQ ID NO: 250242 - DNA, 16 bp, Homo sapiens
cacctccagcccacag

SEQ ID NO: 250243 - DNA, 23 bp, Homo sapiens
cacctccagcccacagtgctcag

SEQ ID NO: 250244 - DNA, 13 bp, Homo sapiens
cacctccagtccc

SEQ ID NO: 250245 - DNA, 15 bp, Homo sapiens
cacctccccaggccg

SEQ ID NO: 250246 - DNA, 21 bp, Homo sapiens
cacctccccaggccgtggctg

SEQ ID NO: 250247 - DNA, 18 bp, Homo sapiens
cacctcccccaaaccctg

SEQ ID NO: 250248 - DNA, 20 bp, Homo sapiens
cacctcccccaaaccctgct

SEQ ID NO: 250249 - DNA, 11 bp, Homo sapiens
cacctcccctc

SEQ ID NO: 250250 - DNA, 22 bp, Homo sapiens
cacctcccggtgtatgcagtgg

SEQ ID NO: 250251 - DNA, 12 bp, Homo sapiens
cacctccctccc

SEQ ID NO: 250252 - DNA, 14 bp, Homo sapiens
cacctccctgaccc

SEQ ID NO: 250253 - DNA, 23 bp, Homo sapiens
cacctccctgcccaggccggcca

SEQ ID NO: 250254 - DNA, 22 bp, Homo sapiens
cacctcctagcaagacctgttg

SEQ ID NO: 250255 - DNA, 15 bp, Homo sapiens
cacctcctccagcga

SEQ ID NO: 250256 - DNA, 23 bp, Homo sapiens
cacctcctgagaaggcgaggaga

SEQ ID NO: 250257 - DNA, 15 bp, Homo sapiens
cacctcctgcctcag

SEQ ID NO: 250258 - DNA, 21 bp, Homo sapiens
cacctcgcggcgcagcccctg

SEQ ID NO: 250259 - DNA, 16 bp, Homo sapiens
cacctctaggcctcag

SEQ ID NO: 250260 - DNA, 15 bp, Homo sapiens
cacctctatccaaag

SEQ ID NO: 250261 - DNA, 22 bp, Homo sapiens
cacctctcaatattcaataaag

SEQ ID NO: 250262 - DNA, 23 bp, Homo sapiens
cacctctcaatattcaataaagc

SEQ ID NO: 250263 - DNA, 18 bp, Homo sapiens
cacctctccaagtctctc

SEQ ID NO: 250264 - DNA, 13 bp, Homo sapiens
cacctctccctca

SEQ ID NO: 250265 - DNA, 12 bp, Homo sapiens
cacctctctgtc

SEQ ID NO: 250266 - DNA, 14 bp, Homo sapiens
cacctctctgtctt

SEQ ID NO: 250267 - DNA, 20 bp, Homo sapiens
cacctctctgtctttttcct

SEQ ID NO: 250268 - DNA, 11 bp, Homo sapiens
cacctctgagg

SEQ ID NO: 250269 - DNA, 18 bp, Homo sapiens
cacctctgaggactctgg

SEQ ID NO: 250270 - DNA, 19 bp, Homo sapiens
cacctctgaggactctgga

SEQ ID NO: 250271 - DNA, 16 bp, Homo sapiens
cacctctgctgcccac

SEQ ID NO: 250272 - DNA, 17 bp, Homo sapiens
cacctctggactggcta

SEQ ID NO: 250273 - DNA, 18 bp, Homo sapiens
cacctctggccaaatatg

SEQ ID NO: 250274 - DNA, 21 bp, Homo sapiens
cacctctggccaaatatgcac

SEQ ID NO: 250275 - DNA, 23 bp, Homo sapiens
cacctctggccaaatatgcactt

SEQ ID NO: 250276 - DNA, 12 bp, Homo sapiens
cacctctgggcc

SEQ ID NO: 250277 - DNA, 17 bp, Homo sapiens
cacctctgggccctgca

SEQ ID NO: 250278 - DNA, 19 bp, Homo sapiens
cacctctgggccctgcagg

SEQ ID NO: 250279 - DNA, 14 bp, Homo sapiens
cacctctgggcttc

SEQ ID NO: 250280 - DNA, 12 bp, Homo sapiens
cacctcttcctt

SEQ ID NO: 250281 - DNA, 16 bp, Homo sapiens
cacctcttgtgctgag

SEQ ID NO: 250282 - DNA, 13 bp, Homo sapiens
cacctcttttcct

SEQ ID NO: 250283 - DNA, 14 bp, Homo sapiens
cacctgaaacactt

SEQ ID NO: 250284 - DNA, 14 bp, Homo sapiens
cacctgaaagcctg

SEQ ID NO: 250285 - DNA, 19 bp, Homo sapiens
cacctgaaccccatgggct

SEQ ID NO: 250286 - DNA, 17 bp, Homo sapiens
cacctgacaatggcagc

SEQ ID NO: 250287 - DNA, 17 bp, Homo sapiens
cacctgacctctgaaga

SEQ ID NO: 250288 - DNA, 10 bp, Homo sapiens
cacctgagct

SEQ ID NO: 250289 - DNA, 14 bp, Homo sapiens
cacctgagctttgg

SEQ ID NO: 250290 - DNA, 13 bp, Homo sapiens
cacctgaggccca

SEQ ID NO: 250291 - DNA, 16 bp, Homo sapiens
cacctgaggcccagca

SEQ ID NO: 250292 - DNA, 15 bp, Homo sapiens
cacctgcaagcccca

SEQ ID NO: 250293 - DNA, 18 bp, Homo sapiens
cacctgcaagccccaggg

SEQ ID NO: 250294 - DNA, 19 bp, Homo sapiens
cacctgcaagccccagggc

SEQ ID NO: 250295 - DNA, 22 bp, Homo sapiens
cacctgcaagccccagggcctg

SEQ ID NO: 250296 - DNA, 14 bp, Homo sapiens
cacctgcagcgtct

SEQ ID NO: 250297 - DNA, 17 bp, Homo sapiens
cacctgcagcgtctgag

SEQ ID NO: 250298 - DNA, 18 bp, Homo sapiens
cacctgcagcgtctgagc

SEQ ID NO: 250299 - DNA, 12 bp, Homo sapiens
cacctgccaggg

SEQ ID NO: 250300 - DNA, 13 bp, Homo sapiens
cacctgccagggc

SEQ ID NO: 250301 - DNA, 14 bp, Homo sapiens
cacctgccagggcc

SEQ ID NO: 250302 - DNA, 15 bp, Homo sapiens
cacctgccagggccc

SEQ ID NO: 250303 - DNA, 18 bp, Homo sapiens
cacctgcccaacctgctc

SEQ ID NO: 250304 - DNA, 19 bp, Homo sapiens
cacctgcccaacctgctct

SEQ ID NO: 250305 - DNA, 18 bp, Homo sapiens
cacctgcccagttagccc

SEQ ID NO: 250306 - DNA, 22 bp, Homo sapiens
cacctgcccagttagcccggcc

SEQ ID NO: 250307 - DNA, 15 bp, Homo sapiens
cacctgcccccttct

SEQ ID NO: 250308 - DNA, 14 bp, Homo sapiens
cacctgccctctgt

SEQ ID NO: 250309 - DNA, 18 bp, Homo sapiens
cacctgccctgccctgcc

SEQ ID NO: 250310 - DNA, 21 bp, Homo sapiens
cacctgccctgccctgccacc

SEQ ID NO: 250311 - DNA, 23 bp, Homo sapiens
cacctgccctgccctgccacctg

SEQ ID NO: 250312 - DNA, 20 bp, Homo sapiens
cacctgcctatccatcctgc

SEQ ID NO: 250313 - DNA, 21 bp, Homo sapiens
cacctgcctcggcctcccaaa

SEQ ID NO: 250314 - DNA, 23 bp, Homo sapiens
cacctgcctcggcctcccaaagt

SEQ ID NO: 250315 - DNA, 13 bp, Homo sapiens
cacctgcctctga

SEQ ID NO: 250316 - DNA, 17 bp, Homo sapiens
cacctgcctgcagagca

SEQ ID NO: 250317 - DNA, 19 bp, Homo sapiens
cacctgcctgccccacacg

SEQ ID NO: 250318 - DNA, 13 bp, Homo sapiens
cacctgctgctgc

SEQ ID NO: 250319 - DNA, 10 bp, Homo sapiens
cacctgctgg

SEQ ID NO: 250320 - DNA, 15 bp, Homo sapiens
cacctgctggcccct

SEQ ID NO: 250321 - DNA, 18 bp, Homo sapiens
cacctgctggcccctcac

SEQ ID NO: 250322 - DNA, 22 bp, Homo sapiens
cacctgcttgtgttgggcccca

SEQ ID NO: 250323 - DNA, 23 bp, Homo sapiens
cacctgcttgtgttgggccccag

SEQ ID NO: 250324 - DNA, 22 bp, Homo sapiens
cacctggaccatttgattgttt

SEQ ID NO: 250325 - DNA, 22 bp, Homo sapiens
cacctggagcccacagagtctg

SEQ ID NO: 250326 - DNA, 14 bp, Homo sapiens
cacctggcctgctg

SEQ ID NO: 250327 - DNA, 14 bp, Homo sapiens
cacctggcttccca

SEQ ID NO: 250328 - DNA, 18 bp, Homo sapiens
cacctggcttcccaggac

SEQ ID NO: 250329 - DNA, 20 bp, Homo sapiens
cacctgggccctaggcatac

SEQ ID NO: 250330 - DNA, 18 bp, Homo sapiens
cacctgggcctcccatag

SEQ ID NO: 250331 - DNA, 19 bp, Homo sapiens
cacctgggcctttcctgtg

SEQ ID NO: 250332 - DNA, 15 bp, Homo sapiens
cacctgggctgagga

SEQ ID NO: 250333 - DNA, 16 bp, Homo sapiens
cacctgggctttctgg

SEQ ID NO: 250334 - DNA, 17 bp, Homo sapiens
cacctggggagtgggac

SEQ ID NO: 250335 - DNA, 22 bp, Homo sapiens
cacctggggagtgggacagagt

SEQ ID NO: 250336 - DNA, 19 bp, Homo sapiens
ccttggccacggcctggga

SEQ ID NO: 250337 - DNA, 17 bp, Homo sapiens
ccttggcccctctctgt

SEQ ID NO: 250338 - DNA, 22 bp, Homo sapiens
ccttggcctagcccaccctgct

SEQ ID NO: 250339 - DNA, 11 bp, Homo sapiens
ccttggcctca

SEQ ID NO: 250340 - DNA, 14 bp, Homo sapiens
ccttggcctcagaa

SEQ ID NO: 250341 - DNA, 20 bp, Homo sapiens
ccttggcctgacctggcaca

SEQ ID NO: 250342 - DNA, 14 bp, Homo sapiens
ccttggccttgggg

SEQ ID NO: 250343 - DNA, 16 bp, Homo sapiens
ccttggcgcgcagccc

SEQ ID NO: 250344 - DNA, 21 bp, Homo sapiens
ccttggcgtgtgtccctgtgg

SEQ ID NO: 250345 - DNA, 18 bp, Homo sapiens
ccttggctgactggggct

SEQ ID NO: 250346 - DNA, 19 bp, Homo sapiens
ccttgggacagccagagct

SEQ ID NO: 250347 - DNA, 21 bp, Homo sapiens
ccttgggatgggcacaggctg

SEQ ID NO: 250348 - DNA, 18 bp, Homo sapiens
ccttgggcacgggagagc

SEQ ID NO: 250349 - DNA, 16 bp, Homo sapiens
ccttgggcatccaccc

SEQ ID NO: 250350 - DNA, 17 bp, Homo sapiens
ccttgggcatccaccca

SEQ ID NO: 250351 - DNA, 19 bp, Homo sapiens
ccttgggcatccacccagt

SEQ ID NO: 250352 - DNA, 22 bp, Homo sapiens
ccttgggcatccacccagtgct

SEQ ID NO: 250353 - DNA, 14 bp, Homo sapiens
ccttgggcggctga

SEQ ID NO: 250354 - DNA, 18 bp, Homo sapiens
ccttgggcggctgagagc

SEQ ID NO: 250355 - DNA, 15 bp, Homo sapiens
ccttgggctcctggc

SEQ ID NO: 250356 - DNA, 18 bp, Homo sapiens
ccttgggctcctggctgc

SEQ ID NO: 250357 - DNA, 21 bp, Homo sapiens
ccttgggctcctggctgccag

SEQ ID NO: 250358 - DNA, 22 bp, Homo sapiens
ccttgggctcctggctgccagg

SEQ ID NO: 250359 - DNA, 17 bp, Homo sapiens
ccttgggctgctcctca

SEQ ID NO: 250360 - DNA, 17 bp, Homo sapiens
ccttggggaggggtcag

SEQ ID NO: 250361 - DNA, 20 bp, Homo sapiens
ccttggggaggggtcagctc

SEQ ID NO: 250362 - DNA, 22 bp, Homo sapiens
ccttggggaggggtcagctctg

SEQ ID NO: 250363 - DNA, 17 bp, Homo sapiens
ccttggggccagactgg

SEQ ID NO: 250364 - DNA, 22 bp, Homo sapiens
ccttggggcctggcttgctcca

SEQ ID NO: 250365 - DNA, 16 bp, Homo sapiens
ccttgggggtctgctc

SEQ ID NO: 250366 - DNA, 21 bp, Homo sapiens
ccttgggtatttgcaatattc

SEQ ID NO: 250367 - DNA, 14 bp, Homo sapiens
ccttggtctaactt

SEQ ID NO: 250368 - DNA, 16 bp, Homo sapiens
ccttggttcctccagc

SEQ ID NO: 250369 - DNA, 21 bp, Homo sapiens
ccttggttggacctattgcca

SEQ ID NO: 250370 - DNA, 15 bp, Homo sapiens
ccttgtcctgccagc

SEQ ID NO: 250371 - DNA, 18 bp, Homo sapiens
ccttgtcctgccagctgc

SEQ ID NO: 250372 - DNA, 20 bp, Homo sapiens
ccttgtcctgccagctgcct

SEQ ID NO: 250373 - DNA, 13 bp, Homo sapiens
ccttgtctgctgc

SEQ ID NO: 250374 - DNA, 20 bp, Homo sapiens
ccttgtctgctgctcccagc

SEQ ID NO: 250375 - DNA, 16 bp, Homo sapiens
ccttgtgactcagtgt

SEQ ID NO: 250376 - DNA, 20 bp, Homo sapiens
ccttgtgatcactttctgaa

SEQ ID NO: 250377 - DNA, 12 bp, Homo sapiens
ccttgtgcttgg

SEQ ID NO: 250378 - DNA, 24 bp, Homo sapiens
ccttgtgcttggtggggctcgtgg

SEQ ID NO: 250379 - DNA, 18 bp, Homo sapiens
ccttgtgtgctggcttcc

SEQ ID NO: 250380 - DNA, 17 bp, Homo sapiens
ccttgttcttagagcag

SEQ ID NO: 250381 - DNA, 18 bp, Homo sapiens
ccttgttcttagagcaga

SEQ ID NO: 250382 - DNA, 14 bp, Homo sapiens
ccttgtttctttct

SEQ ID NO: 250383 - DNA, 22 bp, Homo sapiens
ccttgtttgcctttaggcagga

SEQ ID NO: 250384 - DNA, 17 bp, Homo sapiens
ccttgtttgttttattc

SEQ ID NO: 250385 - DNA, 18 bp, Homo sapiens
ccttgtttgttttattca

SEQ ID NO: 250386 - DNA, 14 bp, Homo sapiens
ccttgtttttttct

SEQ ID NO: 250387 - DNA, 15 bp, Homo sapiens
cctttaaagacttaa

SEQ ID NO: 250388 - DNA, 12 bp, Homo sapiens
cctttaaatact

SEQ ID NO: 250389 - DNA, 14 bp, Homo sapiens
cctttaaatatcat

SEQ ID NO: 250390 - DNA, 16 bp, Homo sapiens
cctttaaatatcattc

SEQ ID NO: 250391 - DNA, 18 bp, Homo sapiens
cctttaaatatcattctt

SEQ ID NO: 250392 - DNA, 17 bp, Homo sapiens
cctttaaattctccaac

SEQ ID NO: 250393 - DNA, 15 bp, Homo sapiens
cctttacaactaaat

SEQ ID NO: 250394 - DNA, 19 bp, Homo sapiens
cctttagccaaacccttgt

SEQ ID NO: 250395 - DNA, 15 bp, Homo sapiens
cctttaggcagcctg

SEQ ID NO: 250396 - DNA, 16 bp, Homo sapiens
cctttaggcagcctgc

SEQ ID NO: 250397 - DNA, 14 bp, Homo sapiens
cctttaggcaggaa

SEQ ID NO: 250398 - DNA, 16 bp, Homo sapiens
cctttatccctgctta

SEQ ID NO: 250399 - DNA, 11 bp, Homo sapiens
cctttatccta

SEQ ID NO: 250400 - DNA, 22 bp, Homo sapiens
cctttatcctagttccattctt

SEQ ID NO: 250401 - DNA, 16 bp, Homo sapiens
cctttattaatgaact

SEQ ID NO: 250402 - DNA, 17 bp, Homo sapiens
cctttattaatgaactg

SEQ ID NO: 250403 - DNA, 16 bp, Homo sapiens
cctttattctttaatt

SEQ ID NO: 250404 - DNA, 14 bp, Homo sapiens
cctttatttattaa

SEQ ID NO: 250405 - DNA, 22 bp, Homo sapiens
cctttatttattaaacttcagc

SEQ ID NO: 250406 - DNA, 15 bp, Homo sapiens
cctttcaaatttcac

SEQ ID NO: 250407 - DNA, 14 bp, Homo sapiens
cctttcagatgtct

SEQ ID NO: 250408 - DNA, 15 bp, Homo sapiens
cctttcagtcccaaa

SEQ ID NO: 250409 - DNA, 13 bp, Homo sapiens
cctttcatcctca

SEQ ID NO: 250410 - DNA, 15 bp, Homo sapiens
cctttcatcctcagc

SEQ ID NO: 250411 - DNA, 17 bp, Homo sapiens
cctttcatcctcagcaa

SEQ ID NO: 250412 - DNA, 18 bp, Homo sapiens
cctttcatcctcagcaag

SEQ ID NO: 250413 - DNA, 15 bp, Homo sapiens
cctttccaattccaa

SEQ ID NO: 250414 - DNA, 19 bp, Homo sapiens
cctttccactcccactgcc

SEQ ID NO: 250415 - DNA, 20 bp, Homo sapiens
cctttccactcccactgcca

SEQ ID NO: 250416 - DNA, 24 bp, Homo sapiens
cctttcccacagtctctccctggg

SEQ ID NO: 250417 - DNA, 20 bp, Homo sapiens
cctttcctgtgccaacctga

SEQ ID NO: 250418 - DNA, 21 bp, Homo sapiens
cctttctaaggatagcctttg

SEQ ID NO: 250419 - DNA, 17 bp, Homo sapiens
cctttctccagccagca

SEQ ID NO: 250420 - DNA, 20 bp, Homo sapiens
cctttctccagccagcaatg

SEQ ID NO: 250421 - DNA, 18 bp, Homo sapiens
cctttctgacaataaata

SEQ ID NO: 250422 - DNA, 16 bp, Homo sapiens
cctttctgtatcaagc

SEQ ID NO: 250423 - DNA, 11 bp, Homo sapiens
cctttctgtgg

SEQ ID NO: 250424 - DNA, 17 bp, Homo sapiens
cctttcttcactgcaga

SEQ ID NO: 250425 - DNA, 18 bp, Homo sapiens
cctttcttcactgcagat

SEQ ID NO: 250426 - DNA, 13 bp, Homo sapiens
cctttgacttcag

SEQ ID NO: 250427 - DNA, 21 bp, Homo sapiens
cctttgacttcagctgcctga

SEQ ID NO: 250428 - DNA, 13 bp, Homo sapiens
cctttgaggtcta

SEQ ID NO: 250429 - DNA, 16 bp, Homo sapiens
cctttgcactgagggc

SEQ ID NO: 250430 - DNA, 20 bp, Homo sapiens
cctttgcaggcccagcagac

SEQ ID NO: 250431 - DNA, 20 bp, Homo sapiens
cctttgcgtggatcaagctt

SEQ ID NO: 250432 - DNA, 20 bp, Homo sapiens
cctttgctccaccccactca

SEQ ID NO: 250433 - DNA, 12 bp, Homo sapiens
cctttgctctgg

SEQ ID NO: 250434 - DNA, 14 bp, Homo sapiens
cctttgctcttgca

SEQ ID NO: 250435 - DNA, 19 bp, Homo sapiens
cctttgctgaggcctccag

SEQ ID NO: 250436 - DNA, 13 bp, Homo sapiens
cctttgctgtgag

SEQ ID NO: 250437 - DNA, 16 bp, Homo sapiens
cctttggcatctagat

SEQ ID NO: 250438 - DNA, 15 bp, Homo sapiens
cctttgtcaacttca

SEQ ID NO: 250439 - DNA, 13 bp, Homo sapiens
cctttgtcttttt

SEQ ID NO: 250440 - DNA, 20 bp, Homo sapiens
cctttgtcttttttttcatc

SEQ ID NO: 250441 - DNA, 14 bp, Homo sapiens
cctttgtggacttt

SEQ ID NO: 250442 - DNA, 16 bp, Homo sapiens
cctttgtgtaataaaa

SEQ ID NO: 250443 - DNA, 14 bp, Homo sapiens
cctttgttgctcag

SEQ ID NO: 250444 - DNA, 19 bp, Homo sapiens
cctttgtttttttttcctg

SEQ ID NO: 250445 - DNA, 23 bp, Homo sapiens
ccttttaaaaaaataatataaat

SEQ ID NO: 250446 - DNA, 13 bp, Homo sapiens
ccttttacagctc

SEQ ID NO: 250447 - DNA, 17 bp, Homo sapiens
ccttttacttttttata

SEQ ID NO: 250448 - DNA, 21 bp, Homo sapiens
ccttttagcctagttcatcca

SEQ ID NO: 250449 - DNA, 11 bp, Homo sapiens
ccttttatagc

SEQ ID NO: 250450 - DNA, 20 bp, Homo sapiens
ccttttatcaataaagcact

SEQ ID NO: 250451 - DNA, 21 bp, Homo sapiens
ccttttccataaagtgtaatt

SEQ ID NO: 250452 - DNA, 18 bp, Homo sapiens
ccttttctaaaaagtcaa

SEQ ID NO: 250453 - DNA, 22 bp, Homo sapiens
ccttttctattccttctggcct

SEQ ID NO: 250454 - DNA, 14 bp, Homo sapiens
ccttttctttttcc

SEQ ID NO: 250455 - DNA, 20 bp, Homo sapiens
ccttttctttttcccttgaa

SEQ ID NO: 250456 - DNA, 23 bp, Homo sapiens
ccttttgaagtagtttgtataac

SEQ ID NO: 250457 - DNA, 21 bp, Homo sapiens
ccttttgataaaatgttcctt

SEQ ID NO: 250458 - DNA, 12 bp, Homo sapiens
ccttttggcact

SEQ ID NO: 250459 - DNA, 19 bp, Homo sapiens
ccttttggcccccgagctg

SEQ ID NO: 250460 - DNA, 19 bp, Homo sapiens
ccttttggccgggcatggt

SEQ ID NO: 250461 - DNA, 16 bp, Homo sapiens
ccttttggcctttgta

SEQ ID NO: 250462 - DNA, 15 bp, Homo sapiens
ccttttgggtttctg

SEQ ID NO: 250463 - DNA, 18 bp, Homo sapiens
ccttttgggtttgcctta

SEQ ID NO: 250464 - DNA, 20 bp, Homo sapiens
ccttttgtccccagggcccc

SEQ ID NO: 250465 - DNA, 22 bp, Homo sapiens
cctttttccttatttcaagggt

SEQ ID NO: 250466 - DNA, 16 bp, Homo sapiens
cctttttctacctttt

SEQ ID NO: 250467 - DNA, 14 bp, Homo sapiens
cctttttgactttt

SEQ ID NO: 250468 - DNA, 20 bp, Homo sapiens
ccttttttatcatttctact

SEQ ID NO: 250469 - DNA, 22 bp, Homo sapiens
ccttttttatttttttaagctg

SEQ ID NO: 250470 - DNA, 20 bp, Homo sapiens
ccatttcatccatatttctt

SEQ ID NO: 250471 - DNA, 16 bp, Homo sapiens
ccatttcatgtgatct

SEQ ID NO: 250472 - DNA, 14 bp, Homo sapiens
ccatttcccctgtg

SEQ ID NO: 250473 - DNA, 22 bp, Homo sapiens
ccatttcccttctggacactga

SEQ ID NO: 250474 - DNA, 15 bp, Homo sapiens
ccatttcctcctggg

SEQ ID NO: 250475 - DNA, 18 bp, Homo sapiens
ccatttcctcttccttct

SEQ ID NO: 250476 - DNA, 19 bp, Homo sapiens
ccatttcctcttccttctc

SEQ ID NO: 250477 - DNA, 20 bp, Homo sapiens
ccatttcctcttccttctct

SEQ ID NO: 250478 - DNA, 17 bp, Homo sapiens
ccatttctatttattta

SEQ ID NO: 250479 - DNA, 14 bp, Homo sapiens
ccatttctcactga

SEQ ID NO: 250480 - DNA, 16 bp, Homo sapiens
ccatttctcactgaga

SEQ ID NO: 250481 - DNA, 15 bp, Homo sapiens
ccatttcttcccaag

SEQ ID NO: 250482 - DNA, 13 bp, Homo sapiens
ccatttgccccaa

SEQ ID NO: 250483 - DNA, 13 bp, Homo sapiens
ccatttgctcctt

SEQ ID NO: 250484 - DNA, 13 bp, Homo sapiens
ccatttgtaataa

SEQ ID NO: 250485 - DNA, 12 bp, Homo sapiens
ccatttgtcttt

SEQ ID NO: 250486 - DNA, 14 bp, Homo sapiens
ccatttgtgtgtgt

SEQ ID NO: 250487 - DNA, 17 bp, Homo sapiens
ccattttgcaaaatttc

SEQ ID NO: 250488 - DNA, 12 bp, Homo sapiens
ccattttggaaa

SEQ ID NO: 250489 - DNA, 22 bp, Homo sapiens
ccattttgtaactgcctaccag

SEQ ID NO: 250490 - DNA, 12 bp, Homo sapiens
ccatttttccca

SEQ ID NO: 250491 - DNA, 15 bp, Homo sapiens
ccatttttcccagga

SEQ ID NO: 250492 - DNA, 11 bp, Homo sapiens
cccaaaagatt

SEQ ID NO: 250493 - DNA, 15 bp, Homo sapiens
cccaaaatgaagatt

SEQ ID NO: 250494 - DNA, 17 bp, Homo sapiens
cccaaaattatcagtgc

SEQ ID NO: 250495 - DNA, 13 bp, Homo sapiens
cccaaaccccagc

SEQ ID NO: 250496 - DNA, 16 bp, Homo sapiens
cccaaagagctgccta

SEQ ID NO: 250497 - DNA, 14 bp, Homo sapiens
cccaaagcccagcc

SEQ ID NO: 250498 - DNA, 17 bp, Homo sapiens
cccaaagcccagcccgg

SEQ ID NO: 250499 - DNA, 14 bp, Homo sapiens
cccaaagctttcct

SEQ ID NO: 250500 - DNA, 21 bp, Homo sapiens
cccaaaggaagctttctctgc

SEQ ID NO: 250501 - DNA, 15 bp, Homo sapiens
cccaaagtggggagg

SEQ ID NO: 250502 - DNA, 18 bp, Homo sapiens
cccaaataaatttataac

SEQ ID NO: 250503 - DNA, 23 bp, Homo sapiens
cccaaatatgcccctccccagta

SEQ ID NO: 250504 - DNA, 19 bp, Homo sapiens
cccaaattatcaagctaat

SEQ ID NO: 250505 - DNA, 21 bp, Homo sapiens
cccaacaatactttgtgtctt

SEQ ID NO: 250506 - DNA, 18 bp, Homo sapiens
cccaacacaaggtgggca

SEQ ID NO: 250507 - DNA, 15 bp, Homo sapiens
cccaacaccacccct

SEQ ID NO: 250508 - DNA, 23 bp, Homo sapiens
cccaacagccttagctgccagtg

SEQ ID NO: 250509 - DNA, 13 bp, Homo sapiens
cccaaccactctt

SEQ ID NO: 250510 - DNA, 13 bp, Homo sapiens
cccaaccaggagg

SEQ ID NO: 250511 - DNA, 19 bp, Homo sapiens
cccaacccccacctcccgg

SEQ ID NO: 250512 - DNA, 21 bp, Homo sapiens
cccaaccccgcggtgctctgg

SEQ ID NO: 250513 - DNA, 16 bp, Homo sapiens
cccaaccctgcccctg

SEQ ID NO: 250514 - DNA, 12 bp, Homo sapiens
cccaacctcagc

SEQ ID NO: 250515 - DNA, 13 bp, Homo sapiens
cccaacctgctct

SEQ ID NO: 250516 - DNA, 14 bp, Homo sapiens
cccaacctgctgaa

SEQ ID NO: 250517 - DNA, 14 bp, Homo sapiens
cccaacgggaagca

SEQ ID NO: 250518 - DNA, 17 bp, Homo sapiens
cccaacgtcccctccgc

SEQ ID NO: 250519 - DNA, 16 bp, Homo sapiens
cccaactcactgtgct

SEQ ID NO: 250520 - DNA, 16 bp, Homo sapiens
cccaactccaggggca

SEQ ID NO: 250521 - DNA, 19 bp, Homo sapiens
cccaactccaggggcacct

SEQ ID NO: 250522 - DNA, 17 bp, Homo sapiens
cccaactcccagccacc

SEQ ID NO: 250523 - DNA, 15 bp, Homo sapiens
cccaactccttcctc

SEQ ID NO: 250524 - DNA, 12 bp, Homo sapiens
cccaactctccc

SEQ ID NO: 250525 - DNA, 14 bp, Homo sapiens
cccaactctcccca

SEQ ID NO: 250526 - DNA, 14 bp, Homo sapiens
cccaacttccctgt

SEQ ID NO: 250527 - DNA, 20 bp, Homo sapiens
cccaactttgtggatgtctt

SEQ ID NO: 250528 - DNA, 14 bp, Homo sapiens
cccaagaaggctgg

SEQ ID NO: 250529 - DNA, 20 bp, Homo sapiens
cccaagaatagatgctgact

SEQ ID NO: 250530 - DNA, 19 bp, Homo sapiens
cccaagacagatgccccag

SEQ ID NO: 250531 - DNA, 21 bp, Homo sapiens
cccaagagcagagtctgggcc

SEQ ID NO: 250532 - DNA, 13 bp, Homo sapiens
cccaagcagccag

SEQ ID NO: 250533 - DNA, 14 bp, Homo sapiens
cccaagcagccagc

SEQ ID NO: 250534 - DNA, 17 bp, Homo sapiens
cccaagcagccagccag

SEQ ID NO: 250535 - DNA, 16 bp, Homo sapiens
cccaagcatgccccac

SEQ ID NO: 250536 - DNA, 18 bp, Homo sapiens
cccaagcgttcctggcct

SEQ ID NO: 250537 - DNA, 18 bp, Homo sapiens
cccaagcttggcagccga

SEQ ID NO: 250538 - DNA, 20 bp, Homo sapiens
cccaagcttggcagccgagc

SEQ ID NO: 250539 - DNA, 21 bp, Homo sapiens
cccaaggaagaacaaatatga

SEQ ID NO: 250540 - DNA, 22 bp, Homo sapiens
cccaaggagctgatttccaggc

SEQ ID NO: 250541 - DNA, 21 bp, Homo sapiens
cccaaggcaaggggtgcctgg

SEQ ID NO: 250542 - DNA, 20 bp, Homo sapiens
cccaaggcagtgttcctcac

SEQ ID NO: 250543 - DNA, 16 bp, Homo sapiens
cccaagggcctcccac

SEQ ID NO: 250544 - DNA, 22 bp, Homo sapiens
cccaaggggtctgtatatacat

SEQ ID NO: 250545 - DNA, 19 bp, Homo sapiens
cccaaggtcccctccacat

SEQ ID NO: 250546 - DNA, 17 bp, Homo sapiens
cccaaggtcctctcagt

SEQ ID NO: 250547 - DNA, 14 bp, Homo sapiens
cccaataaaagtga

SEQ ID NO: 250548 - DNA, 22 bp, Homo sapiens
cccaataaagcgaatggaccat

SEQ ID NO: 250549 - DNA, 16 bp, Homo sapiens
cccaataaagtcctct

SEQ ID NO: 250550 - DNA, 17 bp, Homo sapiens
cccaataaagtcctctt

SEQ ID NO: 250551 - DNA, 18 bp, Homo sapiens
cccaataaagtcctcttc

SEQ ID NO: 250552 - DNA, 19 bp, Homo sapiens
cccaatatggtggccctgg

SEQ ID NO: 250553 - DNA, 21 bp, Homo sapiens
cccaatatggtggccctgggg

SEQ ID NO: 250554 - DNA, 22 bp, Homo sapiens
cccaatatggtggccctgggga

SEQ ID NO: 250555 - DNA, 12 bp, Homo sapiens
cccaatattata

SEQ ID NO: 250556 - DNA, 15 bp, Homo sapiens
cccaatattataatt

SEQ ID NO: 250557 - DNA, 23 bp, Homo sapiens
cccaatcacgagatcttccttcc

SEQ ID NO: 250558 - DNA, 19 bp, Homo sapiens
attacactgtatttgtatc

SEQ ID NO: 250559 - DNA, 12 bp, Homo sapiens
attacagagagg

SEQ ID NO: 250560 - DNA, 17 bp, Homo sapiens
attacagagaggagaaa

SEQ ID NO: 250561 - DNA, 19 bp, Homo sapiens
attacagagaggagaaaca

SEQ ID NO: 250562 - DNA, 17 bp, Homo sapiens
attacagaggaagttat

SEQ ID NO: 250563 - DNA, 19 bp, Homo sapiens
attacagatgggcaaatta

SEQ ID NO: 250564 - DNA, 15 bp, Homo sapiens
attacagatttagtt

SEQ ID NO: 250565 - DNA, 13 bp, Homo sapiens
attacagcttcac

SEQ ID NO: 250566 - DNA, 21 bp, Homo sapiens
attacaggattaatatattga

SEQ ID NO: 250567 - DNA, 12 bp, Homo sapiens
attacagtgaaa

SEQ ID NO: 250568 - DNA, 14 bp, Homo sapiens
attacataaataaa

SEQ ID NO: 250569 - DNA, 15 bp, Homo sapiens
attacataatgttag

SEQ ID NO: 250570 - DNA, 12 bp, Homo sapiens
attacatcttta

SEQ ID NO: 250571 - DNA, 14 bp, Homo sapiens
attacattagttaa

SEQ ID NO: 250572 - DNA, 22 bp, Homo sapiens
attacattccttgataatgttg

SEQ ID NO: 250573 - DNA, 23 bp, Homo sapiens
attacattgcattcaaaatcttc

SEQ ID NO: 250574 - DNA, 14 bp, Homo sapiens
attacatttataca

SEQ ID NO: 250575 - DNA, 14 bp, Homo sapiens
attaccatcttaat

SEQ ID NO: 250576 - DNA, 18 bp, Homo sapiens
attacctaccccagttca

SEQ ID NO: 250577 - DNA, 22 bp, Homo sapiens
attacctgaattttggctgtgt

SEQ ID NO: 250578 - DNA, 18 bp, Homo sapiens
attacctgataagggaga

SEQ ID NO: 250579 - DNA, 13 bp, Homo sapiens
attactaaattgt

SEQ ID NO: 250580 - DNA, 15 bp, Homo sapiens
attactacaaaattt

SEQ ID NO: 250581 - DNA, 20 bp, Homo sapiens
attactacaaaatttgaaat

SEQ ID NO: 250582 - DNA, 14 bp, Homo sapiens
attactagtactat

SEQ ID NO: 250583 - DNA, 11 bp, Homo sapiens
attactctgca

SEQ ID NO: 250584 - DNA, 20 bp, Homo sapiens
attactctgcactatagcca

SEQ ID NO: 250585 - DNA, 15 bp, Homo sapiens
attactgtcaataaa

SEQ ID NO: 250586 - DNA, 13 bp, Homo sapiens
attactgtcttta

SEQ ID NO: 250587 - DNA, 15 bp, Homo sapiens
attactgttcttatt

SEQ ID NO: 250588 - DNA, 13 bp, Homo sapiens
attactgtttgga

SEQ ID NO: 250589 - DNA, 19 bp, Homo sapiens
attacttgattaagatttt

SEQ ID NO: 250590 - DNA, 16 bp, Homo sapiens
attactttaacatgcc

SEQ ID NO: 250591 - DNA, 19 bp, Homo sapiens
attactttgtagatgtatt

SEQ ID NO: 250592 - DNA, 18 bp, Homo sapiens
attacttttctgcaatgt

SEQ ID NO: 250593 - DNA, 19 bp, Homo sapiens
attacttttctgcaatgtt

SEQ ID NO: 250594 - DNA, 13 bp, Homo sapiens
attacttttgtaa

SEQ ID NO: 250595 - DNA, 20 bp, Homo sapiens
attacttttgtaaatattct

SEQ ID NO: 250596 - DNA, 23 bp, Homo sapiens
attacttttgtaaatattcttgt

SEQ ID NO: 250597 - DNA, 15 bp, Homo sapiens
attagaaaaaaacaa

SEQ ID NO: 250598 - DNA, 20 bp, Homo sapiens
attagaaaatgtatttatag

SEQ ID NO: 250599 - DNA, 14 bp, Homo sapiens
attagaagaaaaca

SEQ ID NO: 250600 - DNA, 15 bp, Homo sapiens
attagaagaaaacat

SEQ ID NO: 250601 - DNA, 13 bp, Homo sapiens
ccccagagccagg

SEQ ID NO: 250602 - DNA, 16 bp, Homo sapiens
ccccagagccagggct

SEQ ID NO: 250603 - DNA, 21 bp, Homo sapiens
ccccagagccagggctgtcct

SEQ ID NO: 250604 - DNA, 11 bp, Homo sapiens
ccccagagctc

SEQ ID NO: 250605 - DNA, 21 bp, Homo sapiens
ccccagagctgtttatggcct

SEQ ID NO: 250606 - DNA, 14 bp, Homo sapiens
ccccagaggctccc

SEQ ID NO: 250607 - DNA, 20 bp, Homo sapiens
ccccagaggctcccaatcag

SEQ ID NO: 250608 - DNA, 16 bp, Homo sapiens
ccccagagggaccagc

SEQ ID NO: 250609 - DNA, 18 bp, Homo sapiens
ccccagagggaccagctg

SEQ ID NO: 250610 - DNA, 19 bp, Homo sapiens
ccccagagggaccagctgg

SEQ ID NO: 250611 - DNA, 23 bp, Homo sapiens
ccccagatagagctgggtggcct

SEQ ID NO: 250612 - DNA, 15 bp, Homo sapiens
ccccagatctgcctg

SEQ ID NO: 250613 - DNA, 21 bp, Homo sapiens
ccccagatctgcctgggcctg

SEQ ID NO: 250614 - DNA, 24 bp, Homo sapiens
ccccagatctgcctgggcctgtgc

SEQ ID NO: 250615 - DNA, 12 bp, Homo sapiens
ccccagcaagag

SEQ ID NO: 250616 - DNA, 11 bp, Homo sapiens
ccccagcaggt

SEQ ID NO: 250617 - DNA, 12 bp, Homo sapiens
ccccagcaggtg

SEQ ID NO: 250618 - DNA, 23 bp, Homo sapiens
ccccagcagttgaatgacaacag

SEQ ID NO: 250619 - DNA, 22 bp, Homo sapiens
ccccagcattccagctctgccc

SEQ ID NO: 250620 - DNA, 22 bp, Homo sapiens
ccccagccactcctcaaccttg

SEQ ID NO: 250621 - DNA, 12 bp, Homo sapiens
ccccagccagcc

SEQ ID NO: 250622 - DNA, 13 bp, Homo sapiens
ccccagccagccc

SEQ ID NO: 250623 - DNA, 14 bp, Homo sapiens
ccccagcccaataa

SEQ ID NO: 250624 - DNA, 16 bp, Homo sapiens
ccccagcccaataaag

SEQ ID NO: 250625 - DNA, 17 bp, Homo sapiens
ccccagcccaataaagg

SEQ ID NO: 250626 - DNA, 11 bp, Homo sapiens
ccccagcccac

SEQ ID NO: 250627 - DNA, 21 bp, Homo sapiens
ccccagcccagggttccccca

SEQ ID NO: 250628 - DNA, 16 bp, Homo sapiens
ccccagccccatccca

SEQ ID NO: 250629 - DNA, 18 bp, Homo sapiens
ccccagccccctggcccc

SEQ ID NO: 250630 - DNA, 21 bp, Homo sapiens
ccccagccccttctcccagca

SEQ ID NO: 250631 - DNA, 14 bp, Homo sapiens
ccccagcccttctg

SEQ ID NO: 250632 - DNA, 19 bp, Homo sapiens
ccccagcctaagatgaaga

SEQ ID NO: 250633 - DNA, 11 bp, Homo sapiens
ccccagcctcc

SEQ ID NO: 250634 - DNA, 15 bp, Homo sapiens
ccccagcctccaggc

SEQ ID NO: 250635 - DNA, 12 bp, Homo sapiens
ccccagcctccc

SEQ ID NO: 250636 - DNA, 19 bp, Homo sapiens
ccccagcctgacctgagac

SEQ ID NO: 250637 - DNA, 23 bp, Homo sapiens
ccccagcgtcccagtctctggca

SEQ ID NO: 250638 - DNA, 13 bp, Homo sapiens
ccccagctcaggg

SEQ ID NO: 250639 - DNA, 14 bp, Homo sapiens
ccccagctcagggg

SEQ ID NO: 250640 - DNA, 16 bp, Homo sapiens
ccccagctcaggggca

SEQ ID NO: 250641 - DNA, 21 bp, Homo sapiens
ccccagctcaggggcagctca

SEQ ID NO: 250642 - DNA, 15 bp, Homo sapiens
ccccagctgactgtg

SEQ ID NO: 250643 - DNA, 13 bp, Homo sapiens
ccccagctgggct

SEQ ID NO: 250644 - DNA, 23 bp, Homo sapiens
ccccagcttttcttgccagctca

SEQ ID NO: 250645 - DNA, 17 bp, Homo sapiens
ccccaggaccaagctta

SEQ ID NO: 250646 - DNA, 23 bp, Homo sapiens
ccccaggccaggtccctggacca

SEQ ID NO: 250647 - DNA, 15 bp, Homo sapiens
ccccaggcctccagc

SEQ ID NO: 250648 - DNA, 16 bp, Homo sapiens
ccccaggcctccagcc

SEQ ID NO: 250649 - DNA, 21 bp, Homo sapiens
ccccaggcctgaaagaggctg

SEQ ID NO: 250650 - DNA, 15 bp, Homo sapiens
ccccaggctcccctg

SEQ ID NO: 250651 - DNA, 15 bp, Homo sapiens
ccccaggctgcgcct

SEQ ID NO: 250652 - DNA, 18 bp, Homo sapiens
ccccaggctgcgcctgcc

SEQ ID NO: 250653 - DNA, 21 bp, Homo sapiens
ccccagggcccctccctctgc

SEQ ID NO: 250654 - DNA, 23 bp, Homo sapiens
ccccagggcccctccctctgccc

SEQ ID NO: 250655 - DNA, 15 bp, Homo sapiens
ccccagggccctgct

SEQ ID NO: 250656 - DNA, 18 bp, Homo sapiens
ccccagggccctgctcag

SEQ ID NO: 250657 - DNA, 20 bp, Homo sapiens
ccccagggccctgctcaggc

SEQ ID NO: 250658 - DNA, 17 bp, Homo sapiens
ccccaggggaaaatgaa

SEQ ID NO: 250659 - DNA, 18 bp, Homo sapiens
ccccaggggaaaatgaag

SEQ ID NO: 250660 - DNA, 17 bp, Homo sapiens
ccccaggggtcccagcc

SEQ ID NO: 250661 - DNA, 18 bp, Homo sapiens
ccccagggtgagcagggc

SEQ ID NO: 250662 - DNA, 16 bp, Homo sapiens
ccccagggttctgtat

SEQ ID NO: 250663 - DNA, 18 bp, Homo sapiens
ccccaggtgccaccaata

SEQ ID NO: 250664 - DNA, 22 bp, Homo sapiens
ccccaggtgccaccaataaaaa

SEQ ID NO: 250665 - DNA, 13 bp, Homo sapiens
ccccaggtgctgg

SEQ ID NO: 250666 - DNA, 16 bp, Homo sapiens
ccccagtaagccactg

SEQ ID NO: 250667 - DNA, 20 bp, Homo sapiens
ccccagtacctccaagcaag

SEQ ID NO: 250668 - DNA, 13 bp, Homo sapiens
ccccagtccccgg

SEQ ID NO: 250669 - DNA, 14 bp, Homo sapiens
ccccagtccccggg

SEQ ID NO: 250670 - DNA, 13 bp, Homo sapiens
ccccagtgcctgc

SEQ ID NO: 250671 - DNA, 16 bp, Homo sapiens
ccccagtgtattttgt

SEQ ID NO: 250672 - DNA, 16 bp, Homo sapiens
ccccagtgtccccagg

SEQ ID NO: 250673 - DNA, 18 bp, Homo sapiens
ccccagtgtccccagggg

SEQ ID NO: 250674 - DNA, 20 bp, Homo sapiens
ccccagtgtccccaggggca

SEQ ID NO: 250675 - DNA, 23 bp, Homo sapiens
ccccagttctaggggagaagagc

SEQ ID NO: 250676 - DNA, 18 bp, Homo sapiens
ccccagttggggctgcga

SEQ ID NO: 250677 - DNA, 15 bp, Homo sapiens
ccccatactctgtct

SEQ ID NO: 250678 - DNA, 16 bp, Homo sapiens
ccccatatttgtgttc

SEQ ID NO: 250679 - DNA, 13 bp, Homo sapiens
ccccatccccacc

SEQ ID NO: 250680 - DNA, 14 bp, Homo sapiens
ccccatccctgctt

SEQ ID NO: 250681 - DNA, 18 bp, Homo sapiens
ccccatcctccagcttct

SEQ ID NO: 250682 - DNA, 16 bp, Homo sapiens
ccccatctccccaggc

SEQ ID NO: 250683 - DNA, 20 bp, Homo sapiens
ccccatctcctcccatggcc

SEQ ID NO: 250684 - DNA, 21 bp, Homo sapiens
ccccatctcctcccatggcct

SEQ ID NO: 250685 - DNA, 17 bp, Homo sapiens
ccccatgataaaataag

SEQ ID NO: 250686 - DNA, 22 bp, Homo sapiens
ccccatgccaaagctagggtgg

SEQ ID NO: 250687 - DNA, 18 bp, Homo sapiens
ccccatgcctgtccagcc

SEQ ID NO: 250688 - DNA, 19 bp, Homo sapiens
ccccatgcctgtccagcct

SEQ ID NO: 250689 - DNA, 22 bp, Homo sapiens
ccccatgcctgtccagcctggg

SEQ ID NO: 250690 - DNA, 24 bp, Homo sapiens
ccccatgcctgtccagcctgggca

SEQ ID NO: 250691 - DNA, 13 bp, Homo sapiens
ccccatgctctgc

SEQ ID NO: 250692 - DNA, 14 bp, Homo sapiens
ccccatgctgcctt

SEQ ID NO: 250693 - DNA, 14 bp, Homo sapiens
ccccatgtgcctgc

SEQ ID NO: 250694 - DNA, 18 bp, Homo sapiens
ccccatgtgcctgcacca

SEQ ID NO: 250695 - DNA, 14 bp, Homo sapiens
ccccatgtgcctgt

SEQ ID NO: 250696 - DNA, 17 bp, Homo sapiens
ccccatgtgcctgtcac

SEQ ID NO: 250697 - DNA, 22 bp, Homo sapiens
ccccatttcctcttccttctct

SEQ ID NO: 250698 - DNA, 22 bp, Homo sapiens
cccccaaacatagcccctgccc

SEQ ID NO: 250699 - DNA, 19 bp, Homo sapiens
cccccaaattgccttcagc

SEQ ID NO: 250700 - DNA, 20 bp, Homo sapiens
cccccaaattgccttcagcc

SEQ ID NO: 250701 - DNA, 23 bp, Homo sapiens
cccccaaggggcagtctggaggg

SEQ ID NO: 250702 - DNA, 15 bp, Homo sapiens
cccccaccacactga

SEQ ID NO: 250703 - DNA, 13 bp, Homo sapiens
cccccacccacct

SEQ ID NO: 250704 - DNA, 13 bp, Homo sapiens
cccccacccctgt

SEQ ID NO: 250705 - DNA, 13 bp, Homo sapiens
cccccaccctcca

SEQ ID NO: 250706 - DNA, 14 bp, Homo sapiens
cccccaccttgatc

SEQ ID NO: 250707 - DNA, 12 bp, Homo sapiens
cccccagaaagc

SEQ ID NO: 250708 - DNA, 18 bp, Homo sapiens
cccccagagccagggctg

SEQ ID NO: 250709 - DNA, 22 bp, Homo sapiens
cccccagagccagggctgtcct

SEQ ID NO: 250710 - DNA, 11 bp, Homo sapiens
cccccagccct

SEQ ID NO: 250711 - DNA, 16 bp, Homo sapiens
cccccagcctccccca

SEQ ID NO: 250712 - DNA, 21 bp, Homo sapiens
cccccagctcaggggcagctc

SEQ ID NO: 250713 - DNA, 12 bp, Homo sapiens
cccccaggaccc

SEQ ID NO: 250714 - DNA, 12 bp, Homo sapiens
cccccaggagga

SEQ ID NO: 250715 - DNA, 12 bp, Homo sapiens
cccccaggctgc

SEQ ID NO: 250716 - DNA, 16 bp, Homo sapiens
cccccaggctgctgga

SEQ ID NO: 250717 - DNA, 11 bp, Homo sapiens
cccccagtgtg

SEQ ID NO: 250718 - DNA, 19 bp, Homo sapiens
cccccatctccccaggcct

SEQ ID NO: 250719 - DNA, 20 bp, Homo sapiens
cccccatctccccaggcctc

SEQ ID NO: 250720 - DNA, 15 bp, Homo sapiens
cccccatgccaccac

SEQ ID NO: 250721 - DNA, 20 bp, Homo sapiens
cccccatgccaccacccacc

SEQ ID NO: 250722 - DNA, 21 bp, Homo sapiens
cccccatgccaccacccaccc

SEQ ID NO: 250723 - DNA, 19 bp, Homo sapiens
cccccatgctgccttcagg

SEQ ID NO: 250724 - DNA, 13 bp, Homo sapiens
cccccattgtgaa

SEQ ID NO: 250725 - DNA, 20 bp, Homo sapiens
cccccattgtgaatgttgtc

SEQ ID NO: 250726 - DNA, 11 bp, Homo sapiens
ccccccactcc

SEQ ID NO: 250727 - DNA, 11 bp, Homo sapiens
ccccccactct

SEQ ID NO: 250728 - DNA, 12 bp, Homo sapiens
ccccccagagcc

SEQ ID NO: 250729 - DNA, 15 bp, Homo sapiens
atttaagcattttac

SEQ ID NO: 250730 - DNA, 18 bp, Homo sapiens
atttaagccaataaataa

SEQ ID NO: 250731 - DNA, 18 bp, Homo sapiens
atttaagttatcaacttt

SEQ ID NO: 250732 - DNA, 23 bp, Homo sapiens
atttccaacaaacttactgtcag

SEQ ID NO: 250733 - DNA, 20 bp, Homo sapiens
ccccccttgaatctgcaggg

SEQ ID NO: 250734 - DNA, 13 bp, Homo sapiens
cccccgacactgc

SEQ ID NO: 250735 - DNA, 23 bp, Homo sapiens
cccccgacactgctgcaccagag

SEQ ID NO: 250736 - DNA, 15 bp, Homo sapiens
cccccgagctggggg

SEQ ID NO: 250737 - DNA, 12 bp, Homo sapiens
cccccgccggca

SEQ ID NO: 250738 - DNA, 19 bp, Homo sapiens
cccccgctctgccatcagc

SEQ ID NO: 250739 - DNA, 22 bp, Homo sapiens
ccccctaaggaatatccagtca

SEQ ID NO: 250740 - DNA, 16 bp, Homo sapiens
ccccctatccttggca

SEQ ID NO: 250741 - DNA, 10 bp, Homo sapiens
ccccctcagg

SEQ ID NO: 250742 - DNA, 12 bp, Homo sapiens
ccccctccacac

SEQ ID NO: 250743 - DNA, 20 bp, Homo sapiens
ccccctccaggcatgctggc

SEQ ID NO: 250744 - DNA, 13 bp, Homo sapiens
ccccctccagtgc

SEQ ID NO: 250745 - DNA, 12 bp, Homo sapiens
ccccctcccaga

SEQ ID NO: 250746 - DNA, 12 bp, Homo sapiens
ccccctgcaccc

SEQ ID NO: 250747 - DNA, 12 bp, Homo sapiens
ccccctgcatct

SEQ ID NO: 250748 - DNA, 17 bp, Homo sapiens
ccccctgccccagagaa

SEQ ID NO: 250749 - DNA, 19 bp, Homo sapiens
ccccctgccccttctacac

SEQ ID NO: 250750 - DNA, 18 bp, Homo sapiens
ccccctggatgtcccctg

SEQ ID NO: 250751 - DNA, 20 bp, Homo sapiens
ccccctggatgtcccctgtc

SEQ ID NO: 250752 - DNA, 20 bp, Homo sapiens
ccccctggggggcacagcca

SEQ ID NO: 250753 - DNA, 22 bp, Homo sapiens
ccccctggggggcacagccaga

SEQ ID NO: 250754 - DNA, 23 bp, Homo sapiens
ccccctggggggcacagccagaa

SEQ ID NO: 250755 - DNA, 19 bp, Homo sapiens
ccccctgtcccattctaga

SEQ ID NO: 250756 - DNA, 22 bp, Homo sapiens
ccccctgtgcccacccagggcc

SEQ ID NO: 250757 - DNA, 15 bp, Homo sapiens
cccccttctcccaca

SEQ ID NO: 250758 - DNA, 16 bp, Homo sapiens
cccccttctctgctcc

SEQ ID NO: 250759 - DNA, 23 bp, Homo sapiens
cccccttgaatctgcagggagca

SEQ ID NO: 250760 - DNA, 15 bp, Homo sapiens
cccccttgtctgctg

SEQ ID NO: 250761 - DNA, 18 bp, Homo sapiens
cccccttgtctgctgctc

SEQ ID NO: 250762 - DNA, 18 bp, Homo sapiens
ccccctttgctgtgagga

SEQ ID NO: 250763 - DNA, 16 bp, Homo sapiens
ccccgacactgctgca

SEQ ID NO: 250764 - DNA, 18 bp, Homo sapiens
ccccgacgccacagccca

SEQ ID NO: 250765 - DNA, 13 bp, Homo sapiens
ccccgagctgggg

SEQ ID NO: 250766 - DNA, 16 bp, Homo sapiens
ccccgcaaaacccact

SEQ ID NO: 250767 - DNA, 15 bp, Homo sapiens
ccccgcagtccccag

SEQ ID NO: 250768 - DNA, 18 bp, Homo sapiens
ccccgcagtccccagccc

SEQ ID NO: 250769 - DNA, 14 bp, Homo sapiens
ccccgccacggcca

SEQ ID NO: 250770 - DNA, 21 bp, Homo sapiens
ccccgccacggccaccctcct

SEQ ID NO: 250771 - DNA, 13 bp, Homo sapiens
ccccgccccacat

SEQ ID NO: 250772 - DNA, 16 bp, Homo sapiens
ccccgcccccacccct

SEQ ID NO: 250773 - DNA, 20 bp, Homo sapiens
ccccgccccccagagccagg

SEQ ID NO: 250774 - DNA, 16 bp, Homo sapiens
ccccgccccgccccac

SEQ ID NO: 250775 - DNA, 20 bp, Homo sapiens
ccccgcccgccctcctctgc

SEQ ID NO: 250776 - DNA, 15 bp, Homo sapiens
ccccgccctcgctcc

SEQ ID NO: 250777 - DNA, 13 bp, Homo sapiens
ccccgcctccact

SEQ ID NO: 250778 - DNA, 15 bp, Homo sapiens
ccccgccttccctca

SEQ ID NO: 250779 - DNA, 16 bp, Homo sapiens
ccccgcgatgccctgg

SEQ ID NO: 250780 - DNA, 16 bp, Homo sapiens
ccccgcgggttctaga

SEQ ID NO: 250781 - DNA, 17 bp, Homo sapiens
ccccgcgggttctagac

SEQ ID NO: 250782 - DNA, 20 bp, Homo sapiens
ccccgctctgccatcagccc

SEQ ID NO: 250783 - DNA, 15 bp, Homo sapiens
ccccgctgcctggcg

SEQ ID NO: 250784 - DNA, 14 bp, Homo sapiens
ccccgcttctgcct

SEQ ID NO: 250785 - DNA, 16 bp, Homo sapiens
ccccggacgctggctc

SEQ ID NO: 250786 - DNA, 12 bp, Homo sapiens
ccccggagctgg

SEQ ID NO: 250787 - DNA, 16 bp, Homo sapiens
ccccggagctgggaag

SEQ ID NO: 250788 - DNA, 22 bp, Homo sapiens
ccccggagctgggaaggtcccg

SEQ ID NO: 250789 - DNA, 17 bp, Homo sapiens
ccccggaggcgcccacc

SEQ ID NO: 250790 - DNA, 21 bp, Homo sapiens
ccccggaggcgcccacctgcc

SEQ ID NO: 250791 - DNA, 14 bp, Homo sapiens
ccccggcaggccct

SEQ ID NO: 250792 - DNA, 17 bp, Homo sapiens
ccccggcaggccctgca

SEQ ID NO: 250793 - DNA, 21 bp, Homo sapiens
ccccggcaggccctgcagtgt

SEQ ID NO: 250794 - DNA, 20 bp, Homo sapiens
ccccggcctccaggctgggg

SEQ ID NO: 250795 - DNA, 17 bp, Homo sapiens
ccccgggctctggccac

SEQ ID NO: 250796 - DNA, 22 bp, Homo sapiens
ccccggggcatggacagggcca

SEQ ID NO: 250797 - DNA, 16 bp, Homo sapiens
ccccggggctggcaag

SEQ ID NO: 250798 - DNA, 21 bp, Homo sapiens
ccccgtcaccatctcaggcca

SEQ ID NO: 250799 - DNA, 16 bp, Homo sapiens
ccccgtcccacctcgc

SEQ ID NO: 250800 - DNA, 18 bp, Homo sapiens
ccccgtcccggccccgcg

SEQ ID NO: 250801 - DNA, 14 bp, Homo sapiens
ccccgtcggaatgg

SEQ ID NO: 250802 - DNA, 14 bp, Homo sapiens
ccccgtctctacta

SEQ ID NO: 250803 - DNA, 19 bp, Homo sapiens
ccccgtgcagactggaggg

SEQ ID NO: 250804 - DNA, 22 bp, Homo sapiens
ccccgtgcggcccgtgcgcagc

SEQ ID NO: 250805 - DNA, 18 bp, Homo sapiens
cccctaatgcctgcggag

SEQ ID NO: 250806 - DNA, 17 bp, Homo sapiens
cccctacaactccagcc

SEQ ID NO: 250807 - DNA, 15 bp, Homo sapiens
cccctacagcctgca

SEQ ID NO: 250808 - DNA, 17 bp, Homo sapiens
cccctacagcctgcaca

SEQ ID NO: 250809 - DNA, 13 bp, Homo sapiens
cccctaccagcca

SEQ ID NO: 250810 - DNA, 12 bp, Homo sapiens
cccctacccacc

SEQ ID NO: 250811 - DNA, 16 bp, Homo sapiens
cccctacccaccgatg

SEQ ID NO: 250812 - DNA, 14 bp, Homo sapiens
cccctaccctttcc

SEQ ID NO: 250813 - DNA, 19 bp, Homo sapiens
cccctaccgatggtcccag

SEQ ID NO: 250814 - DNA, 18 bp, Homo sapiens
cccctactcccctgatcc

SEQ ID NO: 250815 - DNA, 19 bp, Homo sapiens
cccctaggactcaggcctg

SEQ ID NO: 250816 - DNA, 20 bp, Homo sapiens
cccctatccttggcaccaaa

SEQ ID NO: 250817 - DNA, 13 bp, Homo sapiens
cccctcaccctgc

SEQ ID NO: 250818 - DNA, 13 bp, Homo sapiens
cccctcaccttgc

SEQ ID NO: 250819 - DNA, 20 bp, Homo sapiens
cccctcagagccctgccctg

SEQ ID NO: 250820 - DNA, 14 bp, Homo sapiens
cccctcagcccttg

SEQ ID NO: 250821 - DNA, 20 bp, Homo sapiens
cccctccacatcccagcagc

SEQ ID NO: 250822 - DNA, 20 bp, Homo sapiens
cccctccagacccctaccct

SEQ ID NO: 250823 - DNA, 17 bp, Homo sapiens
cccctccagaccctgcc

SEQ ID NO: 250824 - DNA, 19 bp, Homo sapiens
cccctccagaccctgcctg

SEQ ID NO: 250825 - DNA, 11 bp, Homo sapiens
cccctccaggc

SEQ ID NO: 250826 - DNA, 20 bp, Homo sapiens
cccctccaggcatgctggcc

SEQ ID NO: 250827 - DNA, 22 bp, Homo sapiens
cccctccaggcatgctggcctc

SEQ ID NO: 250828 - DNA, 12 bp, Homo sapiens
cccctcccagac

SEQ ID NO: 250829 - DNA, 16 bp, Homo sapiens
cccctcccagacaggc

SEQ ID NO: 250830 - DNA, 19 bp, Homo sapiens
cccctcccagacaggccct

SEQ ID NO: 250831 - DNA, 20 bp, Homo sapiens
cccctcccagacaggccctc

SEQ ID NO: 250832 - DNA, 17 bp, Homo sapiens
cccctcccatggcccag

SEQ ID NO: 250833 - DNA, 12 bp, Homo sapiens
cccctccccagc

SEQ ID NO: 250834 - DNA, 13 bp, Homo sapiens
cccctccccagcc

SEQ ID NO: 250835 - DNA, 14 bp, Homo sapiens
cccctccccagccc

SEQ ID NO: 250836 - DNA, 18 bp, Homo sapiens
cccctcccccaaccccca

SEQ ID NO: 250837 - DNA, 11 bp, Homo sapiens
cccctcccccg

SEQ ID NO: 250838 - DNA, 21 bp, Homo sapiens
cccctccccggccctaccagc

SEQ ID NO: 250839 - DNA, 16 bp, Homo sapiens
cccctcccctggggac

SEQ ID NO: 250840 - DNA, 15 bp, Homo sapiens
cccctccctacctca

SEQ ID NO: 250841 - DNA, 14 bp, Homo sapiens
cccctccctgcctg

SEQ ID NO: 250842 - DNA, 15 bp, Homo sapiens
cccctccctgcctgc

SEQ ID NO: 250843 - DNA, 12 bp, Homo sapiens
cccctccctggc

SEQ ID NO: 250844 - DNA, 15 bp, Homo sapiens
cccctccctggcctg

SEQ ID NO: 250845 - DNA, 22 bp, Homo sapiens
cccctccctggctcccatgacc

SEQ ID NO: 250846 - DNA, 18 bp, Homo sapiens
cccctccgtccccagggt

SEQ ID NO: 250847 - DNA, 13 bp, Homo sapiens
cccctcctagcac

SEQ ID NO: 250848 - DNA, 22 bp, Homo sapiens
cccctcctcacagttgccatgt

SEQ ID NO: 250849 - DNA, 10 bp, Homo sapiens
cccctcctcg

SEQ ID NO: 250850 - DNA, 21 bp, Homo sapiens
cccctcctcgggcgcctgcgc

SEQ ID NO: 250851 - DNA, 23 bp, Homo sapiens
cccctcctctcctgcccagctct

SEQ ID NO: 250852 - DNA, 13 bp, Homo sapiens
cccctcctctgtg

SEQ ID NO: 250853 - DNA, 16 bp, Homo sapiens
cccctcctctgtgctc

SEQ ID NO: 250854 - DNA, 11 bp, Homo sapiens
cccctccttct

SEQ ID NO: 250855 - DNA, 15 bp, Homo sapiens
cccctccttgcctcc

SEQ ID NO: 250856 - DNA, 18 bp, Homo sapiens
cccctccttgcctcctgt

SEQ ID NO: 250857 - DNA, 14 bp, Homo sapiens
cccctcgctgctgc

SEQ ID NO: 250858 - DNA, 13 bp, Homo sapiens
cccctcggagcct

SEQ ID NO: 250859 - DNA, 14 bp, Homo sapiens
cccctcggagcctg

SEQ ID NO: 250860 - DNA, 18 bp, Homo sapiens
cccctcggagcctgtgtt

SEQ ID NO: 250861 - DNA, 20 bp, Homo sapiens
cccctcggcattcacacaca

SEQ ID NO: 250862 - DNA, 22 bp, Homo sapiens
cccctcggcattcacacacagc

SEQ ID NO: 250863 - DNA, 23 bp, Homo sapiens
atttgtaattgcttacattttta

SEQ ID NO: 250864 - DNA, 16 bp, Homo sapiens
atttgtacattcctga

SEQ ID NO: 250865 - DNA, 22 bp, Homo sapiens
atttgtacattcctgatactgg

SEQ ID NO: 250866 - DNA, 17 bp, Homo sapiens
atttgtactatttaact

SEQ ID NO: 250867 - DNA, 19 bp, Homo sapiens
atttgtactatttaactga

SEQ ID NO: 250868 - DNA, 20 bp, Homo sapiens
atttgtactatttaactgac

SEQ ID NO: 250869 - DNA, 21 bp, Homo sapiens
atttgtatctctgaagcatgt

SEQ ID NO: 250870 - DNA, 17 bp, Homo sapiens
atttgtatctgaaggag

SEQ ID NO: 250871 - DNA, 15 bp, Homo sapiens
atttgtatttatatt

SEQ ID NO: 250872 - DNA, 22 bp, Homo sapiens
cccctctgtcatcactccctgg

SEQ ID NO: 250873 - DNA, 23 bp, Homo sapiens
cccctcttcctggagccccagaa

SEQ ID NO: 250874 - DNA, 20 bp, Homo sapiens
cccctcttgagaggggtgag

SEQ ID NO: 250875 - DNA, 11 bp, Homo sapiens
cccctgaggac

SEQ ID NO: 250876 - DNA, 18 bp, Homo sapiens
cccctgcacccacccctg

SEQ ID NO: 250877 - DNA, 22 bp, Homo sapiens
cccctgcacccacccctgccca

SEQ ID NO: 250878 - DNA, 18 bp, Homo sapiens
cccctgcactgtaaaatg

SEQ ID NO: 250879 - DNA, 22 bp, Homo sapiens
cccctgcaggcggtatccagag

SEQ ID NO: 250880 - DNA, 24 bp, Homo sapiens
cccctgcatctatcgagtttgcaa

SEQ ID NO: 250881 - DNA, 18 bp, Homo sapiens
cccctgccacctccctga

SEQ ID NO: 250882 - DNA, 15 bp, Homo sapiens
cccctgccacctcct

SEQ ID NO: 250883 - DNA, 15 bp, Homo sapiens
cccctgccccagaga

SEQ ID NO: 250884 - DNA, 22 bp, Homo sapiens
cccctgccccgtcaccatctca

SEQ ID NO: 250885 - DNA, 23 bp, Homo sapiens
cccctgccccttctacactctcc

SEQ ID NO: 250886 - DNA, 13 bp, Homo sapiens
cccctgcccgaga

SEQ ID NO: 250887 - DNA, 14 bp, Homo sapiens
cccctgccctgctg

SEQ ID NO: 250888 - DNA, 16 bp, Homo sapiens
cccctgccggccttgg

SEQ ID NO: 250889 - DNA, 17 bp, Homo sapiens
cccctgccggccttggc

SEQ ID NO: 250890 - DNA, 17 bp, Homo sapiens
cccctgcgccctccctc

SEQ ID NO: 250891 - DNA, 21 bp, Homo sapiens
cccctgcggagctgcatggac

SEQ ID NO: 250892 - DNA, 21 bp, Homo sapiens
cccctgcgtgggggccagtca

SEQ ID NO: 250893 - DNA, 18 bp, Homo sapiens
cccctgctcccagcctgc

SEQ ID NO: 250894 - DNA, 15 bp, Homo sapiens
cccctgctgaccttg

SEQ ID NO: 250895 - DNA, 18 bp, Homo sapiens
cccctgctgcctccccaa

SEQ ID NO: 250896 - DNA, 15 bp, Homo sapiens
cccctgctgctcctc

SEQ ID NO: 250897 - DNA, 14 bp, Homo sapiens
cccctgctggacca

SEQ ID NO: 250898 - DNA, 17 bp, Homo sapiens
cccctggaaccagcaag

SEQ ID NO: 250899 - DNA, 19 bp, Homo sapiens
cccctggaccacacctccg

SEQ ID NO: 250900 - DNA, 18 bp, Homo sapiens
cccctggcttttcactgc

SEQ ID NO: 250901 - DNA, 23 bp, Homo sapiens
cccctggcttttcactgctggct

SEQ ID NO: 250902 - DNA, 12 bp, Homo sapiens
cccctgggcagg

SEQ ID NO: 250903 - DNA, 19 bp, Homo sapiens
cccctgggccacccttcac

SEQ ID NO: 250904 - DNA, 15 bp, Homo sapiens
cccctggggcctaga

SEQ ID NO: 250905 - DNA, 15 bp, Homo sapiens
cccctggggggcaca

SEQ ID NO: 250906 - DNA, 17 bp, Homo sapiens
cccctgtacccagccac

SEQ ID NO: 250907 - DNA, 23 bp, Homo sapiens
cccctgtacccagccaccttcct

SEQ ID NO: 250908 - DNA, 20 bp, Homo sapiens
cccctgtcccaccaactctg

SEQ ID NO: 250909 - DNA, 21 bp, Homo sapiens
cccctgtcccaccaactctgc

SEQ ID NO: 250910 - DNA, 12 bp, Homo sapiens
cccctgtccttc

SEQ ID NO: 250911 - DNA, 15 bp, Homo sapiens
cccctgtctggaaga

SEQ ID NO: 250912 - DNA, 18 bp, Homo sapiens
cccctgtgactcctccct

SEQ ID NO: 250913 - DNA, 13 bp, Homo sapiens
cccctgtgcccac

SEQ ID NO: 250914 - DNA, 15 bp, Homo sapiens
cccctgtgcccaccc

SEQ ID NO: 250915 - DNA, 20 bp, Homo sapiens
ccccttagccagttgtatat

SEQ ID NO: 250916 - DNA, 22 bp, Homo sapiens
ccccttcacttctgaccacact

SEQ ID NO: 250917 - DNA, 16 bp, Homo sapiens
ccccttcatcctctga

SEQ ID NO: 250918 - DNA, 21 bp, Homo sapiens
ccccttccccactgcctgccc

SEQ ID NO: 250919 - DNA, 13 bp, Homo sapiens
ccccttccctgca

SEQ ID NO: 250920 - DNA, 19 bp, Homo sapiens
ccccttcctaaatatccaa

SEQ ID NO: 250921 - DNA, 16 bp, Homo sapiens
ccccttctcccacact

SEQ ID NO: 250922 - DNA, 18 bp, Homo sapiens
ccccttctcccctgcact

SEQ ID NO: 250923 - DNA, 19 bp, Homo sapiens
ccccttctcccctgcactg

SEQ ID NO: 250924 - DNA, 16 bp, Homo sapiens
ccccttctctgctcca

SEQ ID NO: 250925 - DNA, 15 bp, Homo sapiens
ccccttgaccccaca

SEQ ID NO: 250926 - DNA, 16 bp, Homo sapiens
ccccttgaccccacac

SEQ ID NO: 250927 - DNA, 19 bp, Homo sapiens
ccccttgcccgccagccag

SEQ ID NO: 250928 - DNA, 20 bp, Homo sapiens
ccccttgcccgccagccagt

SEQ ID NO: 250929 - DNA, 23 bp, Homo sapiens
ccccttgggcatccacccagtgc

SEQ ID NO: 250930 - DNA, 14 bp, Homo sapiens
ccccttgtctgctg

SEQ ID NO: 250931 - DNA, 16 bp, Homo sapiens
ccccttgtctgctgct

SEQ ID NO: 250932 - DNA, 22 bp, Homo sapiens
cccctttcccatcaccccttcc

SEQ ID NO: 250933 - DNA, 14 bp, Homo sapiens
cccctttctaagga

SEQ ID NO: 250934 - DNA, 20 bp, Homo sapiens
cccctttgatgattaattca

SEQ ID NO: 250935 - DNA, 17 bp, Homo sapiens
cccctttggttttacta

SEQ ID NO: 250936 - DNA, 18 bp, Homo sapiens
ccccttttacttttttat

SEQ ID NO: 250937 - DNA, 16 bp, Homo sapiens
ccccttttccttcaga

SEQ ID NO: 250938 - DNA, 14 bp, Homo sapiens
ccccttttgcctgg

SEQ ID NO: 250939 - DNA, 17 bp, Homo sapiens
ccccttttgcctggctg

SEQ ID NO: 250940 - DNA, 23 bp, Homo sapiens
ccccttttgcctggctgtggagg

SEQ ID NO: 250941 - DNA, 18 bp, Homo sapiens
cccctttttactcccctt

SEQ ID NO: 250942 - DNA, 18 bp, Homo sapiens
cccgaagccatcacttct

SEQ ID NO: 250943 - DNA, 22 bp, Homo sapiens
cccgaatggagtccagacctgg

SEQ ID NO: 250944 - DNA, 18 bp, Homo sapiens
cccgacactgctgcacca

SEQ ID NO: 250945 - DNA, 15 bp, Homo sapiens
cccgacagcctggca

SEQ ID NO: 250946 - DNA, 18 bp, Homo sapiens
cccgacagcctggcacag

SEQ ID NO: 250947 - DNA, 20 bp, Homo sapiens
cccgacatggacccggagct

SEQ ID NO: 250948 - DNA, 23 bp, Homo sapiens
cccgacatggacccggagctaac

SEQ ID NO: 250949 - DNA, 13 bp, Homo sapiens
cccgacttgctgt

SEQ ID NO: 250950 - DNA, 13 bp, Homo sapiens
cccgagagctctt

SEQ ID NO: 250951 - DNA, 22 bp, Homo sapiens
cccgagatgtgacccaccagtg

SEQ ID NO: 250952 - DNA, 13 bp, Homo sapiens
cccgagcccagct

SEQ ID NO: 250953 - DNA, 22 bp, Homo sapiens
cccgagctactctcttgccagc

SEQ ID NO: 250954 - DNA, 12 bp, Homo sapiens
cccgagctggtg

SEQ ID NO: 250955 - DNA, 12 bp, Homo sapiens
cccgaggcagca

SEQ ID NO: 250956 - DNA, 16 bp, Homo sapiens
cccgatgtggacctct

SEQ ID NO: 250957 - DNA, 14 bp, Homo sapiens
cccgattgtaactc

SEQ ID NO: 250958 - DNA, 18 bp, Homo sapiens
cccgcaatgtgcccccag

SEQ ID NO: 250959 - DNA, 22 bp, Homo sapiens
cccgcacaccctcactctgcca

SEQ ID NO: 250960 - DNA, 11 bp, Homo sapiens
cccgcacagca

SEQ ID NO: 250961 - DNA, 13 bp, Homo sapiens
cccgcacccccac

SEQ ID NO: 250962 - DNA, 17 bp, Homo sapiens
cccgcacccccaccctt

SEQ ID NO: 250963 - DNA, 15 bp, Homo sapiens
cccgcagacagacag

SEQ ID NO: 250964 - DNA, 16 bp, Homo sapiens
cccgcagacagacaga

SEQ ID NO: 250965 - DNA, 14 bp, Homo sapiens
cccgcagcaccagc

SEQ ID NO: 250966 - DNA, 16 bp, Homo sapiens
cccgcagcccgcctgc

SEQ ID NO: 250967 - DNA, 18 bp, Homo sapiens
cccgcagtccccagccct

SEQ ID NO: 250968 - DNA, 20 bp, Homo sapiens
cccgcatgcagcagcttgct

SEQ ID NO: 250969 - DNA, 15 bp, Homo sapiens
cccgcatgctgcctg

SEQ ID NO: 250970 - DNA, 16 bp, Homo sapiens
cccgcatgctgcctgc

SEQ ID NO: 250971 - DNA, 20 bp, Homo sapiens
cccgcatgctgcctgcctcc

SEQ ID NO: 250972 - DNA, 23 bp, Homo sapiens
cccgccacctatctcgtgggaga

SEQ ID NO: 250973 - DNA, 18 bp, Homo sapiens
cccgccacggccaccctc

SEQ ID NO: 250974 - DNA, 14 bp, Homo sapiens
cccgccagcctcag

SEQ ID NO: 250975 - DNA, 16 bp, Homo sapiens
cccgccatggccgtgt

SEQ ID NO: 250976 - DNA, 11 bp, Homo sapiens
cccgcccacca

SEQ ID NO: 250977 - DNA, 17 bp, Homo sapiens
cccgcccaccccgctgc

SEQ ID NO: 250978 - DNA, 12 bp, Homo sapiens
cccgcccacctg

SEQ ID NO: 250979 - DNA, 18 bp, Homo sapiens
cccgcccactgtcctggg

SEQ ID NO: 250980 - DNA, 19 bp, Homo sapiens
cccgcccactgtcctgggc

SEQ ID NO: 250981 - DNA, 20 bp, Homo sapiens
cccgcccactgtcctgggcg

SEQ ID NO: 250982 - DNA, 18 bp, Homo sapiens
cccgccccagagactgcc

SEQ ID NO: 250983 - DNA, 13 bp, Homo sapiens
cccgccccagagc

SEQ ID NO: 250984 - DNA, 15 bp, Homo sapiens
cccgcccccgccctc

SEQ ID NO: 250985 - DNA, 15 bp, Homo sapiens
cccgccctcctctgc

SEQ ID NO: 250986 - DNA, 17 bp, Homo sapiens
cccgccctcctctgccc

SEQ ID NO: 250987 - DNA, 21 bp, Homo sapiens
cccgccctcctctgccccctc

SEQ ID NO: 250988 - DNA, 18 bp, Homo sapiens
cccgccggttggccggct

SEQ ID NO: 250989 - DNA, 22 bp, Homo sapiens
cccgccggttggccggctggcc

SEQ ID NO: 250990 - DNA, 13 bp, Homo sapiens
cccgccgtgcctg

SEQ ID NO: 250991 - DNA, 15 bp, Homo sapiens
cccgccgtgcctgca

SEQ ID NO: 250992 - DNA, 16 bp, Homo sapiens
cccgccgtgcctgcat

SEQ ID NO: 250993 - DNA, 18 bp, Homo sapiens
attttctgaattcataaa

SEQ ID NO: 250994 - DNA, 21 bp, Homo sapiens
attttctggtagatagaaata

SEQ ID NO: 250995 - DNA, 19 bp, Homo sapiens
attttctggtaggaatagc

SEQ ID NO: 250996 - DNA, 16 bp, Homo sapiens
attttctgtaaatgaa

SEQ ID NO: 250997 - DNA, 17 bp, Homo sapiens
attttctgtaaatgaag

SEQ ID NO: 250998 - DNA, 16 bp, Homo sapiens
attttctgtcactgta

SEQ ID NO: 250999 - DNA, 17 bp, Homo sapiens
attttctgtcactgtag

SEQ ID NO: 251000 - DNA, 18 bp, Homo sapiens
attttctgtgttgttcat

SEQ ID NO: 251001 - DNA, 18 bp, Homo sapiens
attttcttcatgcaatga

SEQ ID NO: 251002 - DNA, 21 bp, Homo sapiens
attttcttcatgcaatgacat

SEQ ID NO: 251003 - DNA, 17 bp, Homo sapiens
attttcttcccatttgt

SEQ ID NO: 251004 - DNA, 14 bp, Homo sapiens
attttcttgtcaat

SEQ ID NO: 251005 - DNA, 22 bp, Homo sapiens
attttctttaaccagtctgaag

SEQ ID NO: 251006 - DNA, 18 bp, Homo sapiens
attttctttatcattgct

SEQ ID NO: 251007 - DNA, 12 bp, Homo sapiens
attttctttcta

SEQ ID NO: 251008 - DNA, 13 bp, Homo sapiens
attttctttctat

SEQ ID NO: 251009 - DNA, 13 bp, Homo sapiens
attttcttttata

SEQ ID NO: 251010 - DNA, 14 bp, Homo sapiens
cccgcgttcaagac

SEQ ID NO: 251011 - DNA, 13 bp, Homo sapiens
cccgctcagccct

SEQ ID NO: 251012 - DNA, 23 bp, Homo sapiens
cccgctcagccctccctgcccct

SEQ ID NO: 251013 - DNA, 12 bp, Homo sapiens
cccgctcccaca

SEQ ID NO: 251014 - DNA, 19 bp, Homo sapiens
cccgctgcaatgcctagac

SEQ ID NO: 251015 - DNA, 20 bp, Homo sapiens
cccgctgcaatgcctagact

SEQ ID NO: 251016 - DNA, 13 bp, Homo sapiens
cccgctgcccagc

SEQ ID NO: 251017 - DNA, 14 bp, Homo sapiens
cccgctgcccagcc

SEQ ID NO: 251018 - DNA, 17 bp, Homo sapiens
cccgctgcccagccctc

SEQ ID NO: 251019 - DNA, 22 bp, Homo sapiens
cccgctgcccagccctcccagc

SEQ ID NO: 251020 - DNA, 19 bp, Homo sapiens
cccgctgcctggcgggcag

SEQ ID NO: 251021 - DNA, 12 bp, Homo sapiens
cccgctgctgct

SEQ ID NO: 251022 - DNA, 16 bp, Homo sapiens
cccgctgctgctgctg

SEQ ID NO: 251023 - DNA, 13 bp, Homo sapiens
cccgctgctgtgc

SEQ ID NO: 251024 - DNA, 13 bp, Homo sapiens
cccgctgcttcca

SEQ ID NO: 251025 - DNA, 21 bp, Homo sapiens
cccgctgggatttcttcgctg

SEQ ID NO: 251026 - DNA, 12 bp, Homo sapiens
cccgctgggctg

SEQ ID NO: 251027 - DNA, 20 bp, Homo sapiens
cccgctttcttgctggttgt

SEQ ID NO: 251028 - DNA, 16 bp, Homo sapiens
cccggaaagactgaaa

SEQ ID NO: 251029 - DNA, 21 bp, Homo sapiens
cccggagcacagccctgggag

SEQ ID NO: 251030 - DNA, 19 bp, Homo sapiens
cccggagcaccacggggtc

SEQ ID NO: 251031 - DNA, 12 bp, Homo sapiens
cccggagcccca

SEQ ID NO: 251032 - DNA, 20 bp, Homo sapiens
cccggagctaacactggccc

SEQ ID NO: 251033 - DNA, 18 bp, Homo sapiens
cccggaggcgcccacctg

SEQ ID NO: 251034 - DNA, 20 bp, Homo sapiens
cccggaggcgcccacctgcc

SEQ ID NO: 251035 - DNA, 23 bp, Homo sapiens
cccggaggcgcccacctgcccag

SEQ ID NO: 251036 - DNA, 17 bp, Homo sapiens
cccggaggggcctggca

SEQ ID NO: 251037 - DNA, 17 bp, Homo sapiens
cccggatctccaggccc

SEQ ID NO: 251038 - DNA, 16 bp, Homo sapiens
cccggatgcccacccc

SEQ ID NO: 251039 - DNA, 23 bp, Homo sapiens
cccggcacagagtcgatgctcaa

SEQ ID NO: 251040 - DNA, 15 bp, Homo sapiens
cccggcagcccccca

SEQ ID NO: 251041 - DNA, 17 bp, Homo sapiens
cccggcagccccccagt

SEQ ID NO: 251042 - DNA, 15 bp, Homo sapiens
cccggcaggccctgc

SEQ ID NO: 251043 - DNA, 18 bp, Homo sapiens
cccggcaggccctgcagt

SEQ ID NO: 251044 - DNA, 21 bp, Homo sapiens
cccggcatgccgagtgcccca

SEQ ID NO: 251045 - DNA, 14 bp, Homo sapiens
cccggccacagctg

SEQ ID NO: 251046 - DNA, 16 bp, Homo sapiens
cccggccacagctgct

SEQ ID NO: 251047 - DNA, 19 bp, Homo sapiens
cccggccactccctgccaa

SEQ ID NO: 251048 - DNA, 13 bp, Homo sapiens
cccggcccacgca

SEQ ID NO: 251049 - DNA, 14 bp, Homo sapiens
cccggcccacgcag

SEQ ID NO: 251050 - DNA, 17 bp, Homo sapiens
cccggcccacgcagagc

SEQ ID NO: 251051 - DNA, 13 bp, Homo sapiens
cccggcccagcct

SEQ ID NO: 251052 - DNA, 20 bp, Homo sapiens
cccggcccccgccctctgcc

SEQ ID NO: 251053 - DNA, 20 bp, Homo sapiens
cccggccgccccgccccaga

SEQ ID NO: 251054 - DNA, 17 bp, Homo sapiens
cccggcctccaggctgg

SEQ ID NO: 251055 - DNA, 15 bp, Homo sapiens
cccggcctcttccac

SEQ ID NO: 251056 - DNA, 17 bp, Homo sapiens
cccggctccccctgcca

SEQ ID NO: 251057 - DNA, 22 bp, Homo sapiens
cccggctcgagcagtcctgcct

SEQ ID NO: 251058 - DNA, 23 bp, Homo sapiens
cccgggaggaacgtggttcagag

SEQ ID NO: 251059 - DNA, 14 bp, Homo sapiens
cccgggaggaggat

SEQ ID NO: 251060 - DNA, 22 bp, Homo sapiens
cccgggcagggctcccacagag

SEQ ID NO: 251061 - DNA, 16 bp, Homo sapiens
cccgggccacgcccca

SEQ ID NO: 251062 - DNA, 17 bp, Homo sapiens
cccgggccacgccccag

SEQ ID NO: 251063 - DNA, 18 bp, Homo sapiens
cccgggccacgccccagc

SEQ ID NO: 251064 - DNA, 22 bp, Homo sapiens
cccgggcccgttgaggatgagg

SEQ ID NO: 251065 - DNA, 17 bp, Homo sapiens
cccggggcagagctcag

SEQ ID NO: 251066 - DNA, 19 bp, Homo sapiens
cccggggcagagctcagag

SEQ ID NO: 251067 - DNA, 20 bp, Homo sapiens
cccggggcagagctcagagg

SEQ ID NO: 251068 - DNA, 14 bp, Homo sapiens
cccggggcagctgc

SEQ ID NO: 251069 - DNA, 21 bp, Homo sapiens
cccggggcagctgccagagaa

SEQ ID NO: 251070 - DNA, 15 bp, Homo sapiens
cccggggcagctggc

SEQ ID NO: 251071 - DNA, 16 bp, Homo sapiens
cccggggctggcaagc

SEQ ID NO: 251072 - DNA, 22 bp, Homo sapiens
cccggggctggcaagcagggaa

SEQ ID NO: 251073 - DNA, 23 bp, Homo sapiens
cccggggctggcaagcagggaaa

SEQ ID NO: 251074 - DNA, 17 bp, Homo sapiens
cccgggggtccccggac

SEQ ID NO: 251075 - DNA, 16 bp, Homo sapiens
cccgggttagcctggt

SEQ ID NO: 251076 - DNA, 23 bp, Homo sapiens
cccgggttcacgccattctcctg

SEQ ID NO: 251077 - DNA, 13 bp, Homo sapiens
cccggtcccaggc

SEQ ID NO: 251078 - DNA, 18 bp, Homo sapiens
cccggtgcccaagaatag

SEQ ID NO: 251079 - DNA, 18 bp, Homo sapiens
cccggtggtttgccatgt

SEQ ID NO: 251080 - DNA, 16 bp, Homo sapiens
cccggtgtatgcagtg

SEQ ID NO: 251081 - DNA, 17 bp, Homo sapiens
cccggttcaccttgccg

SEQ ID NO: 251082 - DNA, 21 bp, Homo sapiens
cccgtagccactctctgccca

SEQ ID NO: 251083 - DNA, 16 bp, Homo sapiens
cccgtaggcagcctct

SEQ ID NO: 251084 - DNA, 22 bp, Homo sapiens
cccgtaggcagcctctctgcta

SEQ ID NO: 251085 - DNA, 18 bp, Homo sapiens
cccgtcaccatctcaggc

SEQ ID NO: 251086 - DNA, 14 bp, Homo sapiens
cccgtcccacctcg

SEQ ID NO: 251087 - DNA, 14 bp, Homo sapiens
cccgtcccctgggc

SEQ ID NO: 251088 - DNA, 16 bp, Homo sapiens
cccgtccctttccctg

SEQ ID NO: 251089 - DNA, 19 bp, Homo sapiens
cccgtccctttccctgcat

SEQ ID NO: 251090 - DNA, 17 bp, Homo sapiens
cccgtccgtccgcccgc

SEQ ID NO: 251091 - DNA, 16 bp, Homo sapiens
cccgtcggaatggtaa

SEQ ID NO: 251092 - DNA, 12 bp, Homo sapiens
cccgtctgcccc

SEQ ID NO: 251093 - DNA, 20 bp, Homo sapiens
cccgtgaaagaattattttt

SEQ ID NO: 251094 - DNA, 14 bp, Homo sapiens
cccgtgaagcagtg

SEQ ID NO: 251095 - DNA, 16 bp, Homo sapiens
cccgtgcgcagccgcg

SEQ ID NO: 251096 - DNA, 18 bp, Homo sapiens
cccgtgtattcaggaccc

SEQ ID NO: 251097 - DNA, 14 bp, Homo sapiens
cccgtgtcccccca

SEQ ID NO: 251098 - DNA, 16 bp, Homo sapiens
cccgtgtccccccagg

SEQ ID NO: 251099 - DNA, 17 bp, Homo sapiens
cccgtgtccccccaggt

SEQ ID NO: 251100 - DNA, 18 bp, Homo sapiens
cccgtgtccccccaggtg

SEQ ID NO: 251101 - DNA, 21 bp, Homo sapiens
cccgtgtccccccaggtgctg

SEQ ID NO: 251102 - DNA, 18 bp, Homo sapiens
cccgtgtgccccaagagg

SEQ ID NO: 251103 - DNA, 17 bp, Homo sapiens
cccgtgtggccccttca

SEQ ID NO: 251104 - DNA, 22 bp, Homo sapiens
cccgtgtggccccttcacttct

SEQ ID NO: 251105 - DNA, 14 bp, Homo sapiens
cccgttccagctga

SEQ ID NO: 251106 - DNA, 17 bp, Homo sapiens
cccgttctgctggcctg

SEQ ID NO: 251107 - DNA, 19 bp, Homo sapiens
cccgttgcggggtggagtg

SEQ ID NO: 251108 - DNA, 19 bp, Homo sapiens
cccgttttatgatttactc

SEQ ID NO: 251109 - DNA, 21 bp, Homo sapiens
ccctaaagatggcgcacccgg

SEQ ID NO: 251110 - DNA, 17 bp, Homo sapiens
ccctaaagccctcttca

SEQ ID NO: 251111 - DNA, 16 bp, Homo sapiens
ccctaacatagtgtct

SEQ ID NO: 251112 - DNA, 14 bp, Homo sapiens
ccctaactcttgct

SEQ ID NO: 251113 - DNA, 16 bp, Homo sapiens
ccctaactcttgctca

SEQ ID NO: 251114 - DNA, 17 bp, Homo sapiens
ccctaactcttgctcac

SEQ ID NO: 251115 - DNA, 21 bp, Homo sapiens
ccctaactcttgctcactccc

SEQ ID NO: 251116 - DNA, 17 bp, Homo sapiens
ccctaagaattcccaga

SEQ ID NO: 251117 - DNA, 19 bp, Homo sapiens
ccctaaggatctctcagga

SEQ ID NO: 251118 - DNA, 12 bp, Homo sapiens
ccctaagtgccc

SEQ ID NO: 251119 - DNA, 14 bp, Homo sapiens
ccctaagtgcccaa

SEQ ID NO: 251120 - DNA, 15 bp, Homo sapiens
ccctaagtgcccaaa

SEQ ID NO: 251121 - DNA, 12 bp, Homo sapiens
ccctaatgcctg

SEQ ID NO: 251122 - DNA, 19 bp, Homo sapiens
ccctaattctcttcgctgt

SEQ ID NO: 251123 - DNA, 16 bp, Homo sapiens
caaaaagaaagctgtg

SEQ ID NO: 251124 - DNA, 19 bp, Homo sapiens
caaaaagaaagctgtgaaa

SEQ ID NO: 251125 - DNA, 12 bp, Homo sapiens
caaaaagaacaa

SEQ ID NO: 251126 - DNA, 18 bp, Homo sapiens
caaaaagaatctgcattt

SEQ ID NO: 251127 - DNA, 19 bp, Homo sapiens
caaaaagaatctgcattta

SEQ ID NO: 251128 - DNA, 15 bp, Homo sapiens
caaaaaggagctctt

SEQ ID NO: 251129 - DNA, 22 bp, Homo sapiens
caaaaagtacatagtgaatttt

SEQ ID NO: 251130 - DNA, 17 bp, Homo sapiens
caaaaagtgtttatttt

SEQ ID NO: 251131 - DNA, 16 bp, Homo sapiens
caaaaatatattaaaa

SEQ ID NO: 251132 - DNA, 19 bp, Homo sapiens
caaaaattatctatttgta

SEQ ID NO: 251133 - DNA, 21 bp, Homo sapiens
caaaaattatctatttgtata

SEQ ID NO: 251134 - DNA, 23 bp, Homo sapiens
caaaaattcacaagctgcctccc

SEQ ID NO: 251135 - DNA, 17 bp, Homo sapiens
caaaacaaagctgattt

SEQ ID NO: 251136 - DNA, 18 bp, Homo sapiens
caaaacaacagcaacaac

SEQ ID NO: 251137 - DNA, 20 bp, Homo sapiens
caaaacaacagcaacaacaa

SEQ ID NO: 251138 - DNA, 16 bp, Homo sapiens
caaaacaagaaagaaa

SEQ ID NO: 251139 - DNA, 19 bp, Homo sapiens
caaaacaagaaagaaacgt

SEQ ID NO: 251140 - DNA, 16 bp, Homo sapiens
caaaacacttgtaatt

SEQ ID NO: 251141 - DNA, 21 bp, Homo sapiens
caaaaccacagccctgtcagt

SEQ ID NO: 251142 - DNA, 18 bp, Homo sapiens
caaaaccggcaacctgta

SEQ ID NO: 251143 - DNA, 18 bp, Homo sapiens
caaaacctgatgttaaaa

SEQ ID NO: 251144 - DNA, 20 bp, Homo sapiens
caaaacctgcagttcctgag

SEQ ID NO: 251145 - DNA, 23 bp, Homo sapiens
caaaaccttgctaattttctcaa

SEQ ID NO: 251146 - DNA, 20 bp, Homo sapiens
caaaacgggttactaagatg

SEQ ID NO: 251147 - DNA, 20 bp, Homo sapiens
caaaactatcggttcaagtt

SEQ ID NO: 251148 - DNA, 21 bp, Homo sapiens
ccctagcaaaatgctaggcct

SEQ ID NO: 251149 - DNA, 15 bp, Homo sapiens
ccctagggctgggtg

SEQ ID NO: 251150 - DNA, 17 bp, Homo sapiens
ccctagggctgggtgta

SEQ ID NO: 251151 - DNA, 20 bp, Homo sapiens
ccctaggtctccacccctca

SEQ ID NO: 251152 - DNA, 21 bp, Homo sapiens
ccctaggtctccacccctcaa

SEQ ID NO: 251153 - DNA, 19 bp, Homo sapiens
ccctaggtgggtcaactcc

SEQ ID NO: 251154 - DNA, 16 bp, Homo sapiens
ccctagtatctggctg

SEQ ID NO: 251155 - DNA, 18 bp, Homo sapiens
ccctagtatctggctggg

SEQ ID NO: 251156 - DNA, 17 bp, Homo sapiens
ccctagtcccttcccct

SEQ ID NO: 251157 - DNA, 19 bp, Homo sapiens
ccctagtgacccggaggcc

SEQ ID NO: 251158 - DNA, 21 bp, Homo sapiens
ccctagtgacccggaggccac

SEQ ID NO: 251159 - DNA, 17 bp, Homo sapiens
ccctagtgggagcccag

SEQ ID NO: 251160 - DNA, 14 bp, Homo sapiens
ccctagttacccac

SEQ ID NO: 251161 - DNA, 18 bp, Homo sapiens
ccctatagagagggggct

SEQ ID NO: 251162 - DNA, 21 bp, Homo sapiens
ccctatagagagggggctctc

SEQ ID NO: 251163 - DNA, 16 bp, Homo sapiens
ccctatcctgcaccct

SEQ ID NO: 251164 - DNA, 18 bp, Homo sapiens
ccctatcctgcaccctct

SEQ ID NO: 251165 - DNA, 20 bp, Homo sapiens
ccctatcctgcaccctctgc

SEQ ID NO: 251166 - DNA, 14 bp, Homo sapiens
ccctatccttggca

SEQ ID NO: 251167 - DNA, 24 bp, Homo sapiens
ccctatgtcccagcccctggtact

SEQ ID NO: 251168 - DNA, 15 bp, Homo sapiens
ccctattccctaact

SEQ ID NO: 251169 - DNA, 17 bp, Homo sapiens
ccctcaacaagggagag

SEQ ID NO: 251170 - DNA, 18 bp, Homo sapiens
ccctcaacaagggagaga

SEQ ID NO: 251171 - DNA, 19 bp, Homo sapiens
ccctcaacaagggagagac

SEQ ID NO: 251172 - DNA, 21 bp, Homo sapiens
ccctcaagccaggagaccctg

SEQ ID NO: 251173 - DNA, 17 bp, Homo sapiens
ccctcacacacacagct

SEQ ID NO: 251174 - DNA, 18 bp, Homo sapiens
ccctcacacacacagctg

SEQ ID NO: 251175 - DNA, 20 bp, Homo sapiens
ccctcacacacacagctggg

SEQ ID NO: 251176 - DNA, 22 bp, Homo sapiens
ccctcacacacacagctgggca

SEQ ID NO: 251177 - DNA, 23 bp, Homo sapiens
ccctcacacacacagctgggcaa

SEQ ID NO: 251178 - DNA, 13 bp, Homo sapiens
ccctcaccccaag

SEQ ID NO: 251179 - DNA, 17 bp, Homo sapiens
ccctcacccgctgccca

SEQ ID NO: 251180 - DNA, 18 bp, Homo sapiens
ccctcacccgctgcccag

SEQ ID NO: 251181 - DNA, 21 bp, Homo sapiens
ccctcacccgctgcccagccc

SEQ ID NO: 251182 - DNA, 13 bp, Homo sapiens
ccctcacctcagg

SEQ ID NO: 251183 - DNA, 14 bp, Homo sapiens
ccctcacctgggcc

SEQ ID NO: 251184 - DNA, 16 bp, Homo sapiens
ccctcacctgggcctt

SEQ ID NO: 251185 - DNA, 17 bp, Homo sapiens
ccctcacctgggccttt

SEQ ID NO: 251186 - DNA, 19 bp, Homo sapiens
ccctcacctgggcctttcc

SEQ ID NO: 251187 - DNA, 21 bp, Homo sapiens
ccctcaccttgcaacacacag

SEQ ID NO: 251188 - DNA, 17 bp, Homo sapiens
ccctcactccactcccc

SEQ ID NO: 251189 - DNA, 21 bp, Homo sapiens
ccctcactccactcccctcat

SEQ ID NO: 251190 - DNA, 22 bp, Homo sapiens
ccctcactccactcccctcatc

SEQ ID NO: 251191 - DNA, 16 bp, Homo sapiens
ccctcactctgccagg

SEQ ID NO: 251192 - DNA, 20 bp, Homo sapiens
ccctcactctgccagggcag

SEQ ID NO: 251193 - DNA, 16 bp, Homo sapiens
ccctcactcttcctca

SEQ ID NO: 251194 - DNA, 14 bp, Homo sapiens
ccctcactggatga

SEQ ID NO: 251195 - DNA, 13 bp, Homo sapiens
ccctcagagccac

SEQ ID NO: 251196 - DNA, 18 bp, Homo sapiens
ccctcagagccctgccct

SEQ ID NO: 251197 - DNA, 17 bp, Homo sapiens
ccctcagcccctcttgc

SEQ ID NO: 251198 - DNA, 13 bp, Homo sapiens
ccctcagcccttg

SEQ ID NO: 251199 - DNA, 14 bp, Homo sapiens
ccctcagcccttgc

SEQ ID NO: 251200 - DNA, 19 bp, Homo sapiens
ccctcagcgctccctgtcg

SEQ ID NO: 251201 - DNA, 23 bp, Homo sapiens
ccctcagcgctccctgtcgcctg

SEQ ID NO: 251202 - DNA, 21 bp, Homo sapiens
ccctcagctatcagtgttctt

SEQ ID NO: 251203 - DNA, 15 bp, Homo sapiens
ccctcagctctctgg

SEQ ID NO: 251204 - DNA, 16 bp, Homo sapiens
ccctcagctctctggg

SEQ ID NO: 251205 - DNA, 17 bp, Homo sapiens
ccctcaggcctatgcaa

SEQ ID NO: 251206 - DNA, 18 bp, Homo sapiens
ccctcagtcagttcccgg

SEQ ID NO: 251207 - DNA, 18 bp, Homo sapiens
ccctcatcacacgtcaca

SEQ ID NO: 251208 - DNA, 13 bp, Homo sapiens
ccctcatcctttt

SEQ ID NO: 251209 - DNA, 22 bp, Homo sapiens
ccctcattccaccttcccatgc

SEQ ID NO: 251210 - DNA, 17 bp, Homo sapiens
ccctcatttctgccagc

SEQ ID NO: 251211 - DNA, 18 bp, Homo sapiens
ccctccaaaagcacttac

SEQ ID NO: 251212 - DNA, 17 bp, Homo sapiens
ccctccacaccagtggc

SEQ ID NO: 251213 - DNA, 13 bp, Homo sapiens
ccctccacatccc

SEQ ID NO: 251214 - DNA, 13 bp, Homo sapiens
ccctccaccccag

SEQ ID NO: 251215 - DNA, 18 bp, Homo sapiens
ccctccacctcctctctt

SEQ ID NO: 251216 - DNA, 10 bp, Homo sapiens
ccctccagac

SEQ ID NO: 251217 - DNA, 13 bp, Homo sapiens
ccctccagacccc

SEQ ID NO: 251218 - DNA, 16 bp, Homo sapiens
ccctccagacccctac

SEQ ID NO: 251219 - DNA, 15 bp, Homo sapiens
ccctccagaccctgc

SEQ ID NO: 251220 - DNA, 19 bp, Homo sapiens
ccctccagaccctgcctga

SEQ ID NO: 251221 - DNA, 22 bp, Homo sapiens
ccctccagaccctgcctgagcc

SEQ ID NO: 251222 - DNA, 12 bp, Homo sapiens
ccctccagagca

SEQ ID NO: 251223 - DNA, 11 bp, Homo sapiens
ccctccaggca

SEQ ID NO: 251224 - DNA, 14 bp, Homo sapiens
ccctccaggcatgc

SEQ ID NO: 251225 - DNA, 22 bp, Homo sapiens
ccctccaggcatgctggcctcc

SEQ ID NO: 251226 - DNA, 20 bp, Homo sapiens
ccctccagtgcttggctgcc

SEQ ID NO: 251227 - DNA, 23 bp, Homo sapiens
ccctccagtgcttggctgcccca

SEQ ID NO: 251228 - DNA, 15 bp, Homo sapiens
ccctccatctgggga

SEQ ID NO: 251229 - DNA, 16 bp, Homo sapiens
ccctccatctggggat

SEQ ID NO: 251230 - DNA, 21 bp, Homo sapiens
ccctccatggcaggaaggcgg

SEQ ID NO: 251231 - DNA, 21 bp, Homo sapiens
ccctccatgtggccccaggtg

SEQ ID NO: 251232 - DNA, 13 bp, Homo sapiens
ccctcccacacac

SEQ ID NO: 251233 - DNA, 16 bp, Homo sapiens
ccctcccacatccccc

SEQ ID NO: 251234 - DNA, 12 bp, Homo sapiens
ccctcccaccac

SEQ ID NO: 251235 - DNA, 16 bp, Homo sapiens
ccctcccaccagaacg

SEQ ID NO: 251236 - DNA, 21 bp, Homo sapiens
ccctcccaccagaacgcaccc

SEQ ID NO: 251237 - DNA, 12 bp, Homo sapiens
ccctcccacccc

SEQ ID NO: 251238 - DNA, 14 bp, Homo sapiens
ccctcccagacagg

SEQ ID NO: 251239 - DNA, 16 bp, Homo sapiens
ccctcccagacaggcc

SEQ ID NO: 251240 - DNA, 13 bp, Homo sapiens
ccctcccagtcct

SEQ ID NO: 251241 - DNA, 21 bp, Homo sapiens
ccctcccagtcctccagacca

SEQ ID NO: 251242 - DNA, 13 bp, Homo sapiens
ccctcccatggcc

SEQ ID NO: 251243 - DNA, 17 bp, Homo sapiens
ccctcccatggcccagc

SEQ ID NO: 251244 - DNA, 22 bp, Homo sapiens
ccctccccaccccaaccactct

SEQ ID NO: 251245 - DNA, 16 bp, Homo sapiens
ccctccccagagcact

SEQ ID NO: 251246 - DNA, 12 bp, Homo sapiens
ccctccccagcc

SEQ ID NO: 251247 - DNA, 17 bp, Homo sapiens
ccctccccagccagccc

SEQ ID NO: 251248 - DNA, 13 bp, Homo sapiens
ccctccccagccc

SEQ ID NO: 251249 - DNA, 15 bp, Homo sapiens
ccctccccagccctt

SEQ ID NO: 251250 - DNA, 23 bp, Homo sapiens
ccctcccccacggccgtccctga

SEQ ID NO: 251251 - DNA, 21 bp, Homo sapiens
ccctcccctaatgcctgcgga

SEQ ID NO: 251252 - DNA, 22 bp, Homo sapiens
ccctcccctctcctgagcctgt

SEQ ID NO: 251253 - DNA, 13 bp, Homo sapiens
ccctcccctgccc

SEQ ID NO: 251254 - DNA, 13 bp, Homo sapiens
ccctccctacctc

SEQ ID NO: 251255 - DNA, 14 bp, Homo sapiens
ccctccctacctca

SEQ ID NO: 251256 - DNA, 14 bp, Homo sapiens
ccctccctccacac

SEQ ID NO: 251257 - DNA, 17 bp, Homo sapiens
ccctccctcctggctca

SEQ ID NO: 251258 - DNA, 14 bp, Homo sapiens
ccctccctctgccc

SEQ ID NO: 251259 - DNA, 15 bp, Homo sapiens
ccctccctctgctct

SEQ ID NO: 251260 - DNA, 14 bp, Homo sapiens
ccctccctcttccc

SEQ ID NO: 251261 - DNA, 12 bp, Homo sapiens
ccctccctgcag

SEQ ID NO: 251262 - DNA, 15 bp, Homo sapiens
ccctccctgcagggt

SEQ ID NO: 251263 - DNA, 17 bp, Homo sapiens
ccctccctggcctgttc

SEQ ID NO: 251264 - DNA, 14 bp, Homo sapiens
ccctccctggctcc

SEQ ID NO: 251265 - DNA, 13 bp, Homo sapiens
ccctccctggctg

SEQ ID NO: 251266 - DNA, 15 bp, Homo sapiens
ccctccctggctgtg

SEQ ID NO: 251267 - DNA, 13 bp, Homo sapiens
ccctccctgggtt

SEQ ID NO: 251268 - DNA, 16 bp, Homo sapiens
ccctccctgggttcag

SEQ ID NO: 251269 - DNA, 13 bp, Homo sapiens
ccctccctgtccc

SEQ ID NO: 251270 - DNA, 16 bp, Homo sapiens
ccctccgactccagat

SEQ ID NO: 251271 - DNA, 21 bp, Homo sapiens
ccctccgggcaggggagccag

SEQ ID NO: 251272 - DNA, 19 bp, Homo sapiens
ccctccgtccactacgctc

SEQ ID NO: 251273 - DNA, 15 bp, Homo sapiens
ccctccgtccccagg

SEQ ID NO: 251274 - DNA, 17 bp, Homo sapiens
ccctccgtccccagggt

SEQ ID NO: 251275 - DNA, 18 bp, Homo sapiens
ccctcctaaatgtcagct

SEQ ID NO: 251276 - DNA, 12 bp, Homo sapiens
ccctcctagcac

SEQ ID NO: 251277 - DNA, 13 bp, Homo sapiens
ccctcctcacctc

SEQ ID NO: 251278 - DNA, 23 bp, Homo sapiens
ccctcctcacctctggactggct

SEQ ID NO: 251279 - DNA, 14 bp, Homo sapiens
ccctcctccagtac

SEQ ID NO: 251280 - DNA, 17 bp, Homo sapiens
ccctcctcgctgtgcca

SEQ ID NO: 251281 - DNA, 21 bp, Homo sapiens
ccctcctctcctgcccagctc

SEQ ID NO: 251282 - DNA, 22 bp, Homo sapiens
ccctcctctcctgcccagctct

SEQ ID NO: 251283 - DNA, 16 bp, Homo sapiens
caaaactcctgtcttt

SEQ ID NO: 251284 - DNA, 20 bp, Homo sapiens
caaaacttggtatttttcag

SEQ ID NO: 251285 - DNA, 14 bp, Homo sapiens
caaaagaagagttt

SEQ ID NO: 251286 - DNA, 21 bp, Homo sapiens
caaaagaagggtaagtgcttg

SEQ ID NO: 251287 - DNA, 16 bp, Homo sapiens
caaaagacatcctcaa

SEQ ID NO: 251288 - DNA, 13 bp, Homo sapiens
caaaagcacaaac

SEQ ID NO: 251289 - DNA, 21 bp, Homo sapiens
caaaagcatttatcattcttg

SEQ ID NO: 251290 - DNA, 13 bp, Homo sapiens
caaaagcctctca

SEQ ID NO: 251291 - DNA, 18 bp, Homo sapiens
caaaaggagaactgtgct

SEQ ID NO: 251292 - DNA, 14 bp, Homo sapiens
caaaaggatgattt

SEQ ID NO: 251293 - DNA, 14 bp, Homo sapiens
caaaaggcagctca

SEQ ID NO: 251294 - DNA, 19 bp, Homo sapiens
caaaaggcagctcacccct

SEQ ID NO: 251295 - DNA, 19 bp, Homo sapiens
caaaaggcagtggggctgg

SEQ ID NO: 251296 - DNA, 21 bp, Homo sapiens
caaaaggcagtggggctgggg

SEQ ID NO: 251297 - DNA, 15 bp, Homo sapiens
caaaagggagaacat

SEQ ID NO: 251298 - DNA, 16 bp, Homo sapiens
caaaaggtaaatacaa

SEQ ID NO: 251299 - DNA, 17 bp, Homo sapiens
caaaaggttaagccata

SEQ ID NO: 251300 - DNA, 19 bp, Homo sapiens
caaaaggttcactaaagca

SEQ ID NO: 251301 - DNA, 17 bp, Homo sapiens
caaaagtccttagaatg

SEQ ID NO: 251302 - DNA, 15 bp, Homo sapiens
caaaagtctattttt

SEQ ID NO: 251303 - DNA, 19 bp, Homo sapiens
caaaagtgcagtagtgtca

SEQ ID NO: 251304 - DNA, 14 bp, Homo sapiens
caaaagtgctttgg

SEQ ID NO: 251305 - DNA, 22 bp, Homo sapiens
caaaataaaaagtgacacagca

SEQ ID NO: 251306 - DNA, 20 bp, Homo sapiens
caaaataaagaatagcaatt

SEQ ID NO: 251307 - DNA, 14 bp, Homo sapiens
caaaataatacaac

SEQ ID NO: 251308 - DNA, 22 bp, Homo sapiens
caaaataattttaagaaatcaa

SEQ ID NO: 251309 - DNA, 13 bp, Homo sapiens
caaaatagagaat

SEQ ID NO: 251310 - DNA, 17 bp, Homo sapiens
caaaatagttctatttc

SEQ ID NO: 251311 - DNA, 18 bp, Homo sapiens
caaaatagttctatttct

SEQ ID NO: 251312 - DNA, 19 bp, Homo sapiens
caaaatagttctatttcta

SEQ ID NO: 251313 - DNA, 20 bp, Homo sapiens
caaaatagttctatttctat

SEQ ID NO: 251314 - DNA, 22 bp, Homo sapiens
caaaatagttctatttctatct

SEQ ID NO: 251315 - DNA, 23 bp, Homo sapiens
caaaatatatgtttggctgaaat

SEQ ID NO: 251316 - DNA, 15 bp, Homo sapiens
caaaatatgcccctt

SEQ ID NO: 251317 - DNA, 21 bp, Homo sapiens
caaaatatttatttgttttgg

SEQ ID NO: 251318 - DNA, 17 bp, Homo sapiens
caaaatatttctaagct

SEQ ID NO: 251319 - DNA, 21 bp, Homo sapiens
caaaatatttctaagcttatt

SEQ ID NO: 251320 - DNA, 19 bp, Homo sapiens
caaaatccttccaaagaat

SEQ ID NO: 251321 - DNA, 18 bp, Homo sapiens
caaaatcgattggcttta

SEQ ID NO: 251322 - DNA, 21 bp, Homo sapiens
caaaatctgtccaaaggaggc

SEQ ID NO: 251323 - DNA, 11 bp, Homo sapiens
caaaatgaaac

SEQ ID NO: 251324 - DNA, 10 bp, Homo sapiens
caaaatgtta

SEQ ID NO: 251325 - DNA, 14 bp, Homo sapiens
caaaattccatccc

SEQ ID NO: 251326 - DNA, 20 bp, Homo sapiens
caaaattcttatttttccta

SEQ ID NO: 251327 - DNA, 15 bp, Homo sapiens
caaaattgatgtgtt

SEQ ID NO: 251328 - DNA, 14 bp, Homo sapiens
caaaatttccagta

SEQ ID NO: 251329 - DNA, 23 bp, Homo sapiens
caaaatttgatggtgaatattac

SEQ ID NO: 251330 - DNA, 20 bp, Homo sapiens
caaaattttagtccaaataa

SEQ ID NO: 251331 - DNA, 23 bp, Homo sapiens
caaaattttatagctcagtttat

SEQ ID NO: 251332 - DNA, 16 bp, Homo sapiens
caaaatttttttaatc

SEQ ID NO: 251333 - DNA, 14 bp, Homo sapiens
caaacaaaacttaa

SEQ ID NO: 251334 - DNA, 14 bp, Homo sapiens
caaacaaatatgca

SEQ ID NO: 251335 - DNA, 13 bp, Homo sapiens
caaacagatgttt

SEQ ID NO: 251336 - DNA, 20 bp, Homo sapiens
caaacagcatcaaaatacaa

SEQ ID NO: 251337 - DNA, 16 bp, Homo sapiens
caaacagctcaggctg

SEQ ID NO: 251338 - DNA, 22 bp, Homo sapiens
caaacagggacactacaaacat

SEQ ID NO: 251339 - DNA, 16 bp, Homo sapiens
caaacaggtgctaaca

SEQ ID NO: 251340 - DNA, 20 bp, Homo sapiens
caaacagtgaatttaagcat

SEQ ID NO: 251341 - DNA, 22 bp, Homo sapiens
caaacagtgaatttaagcatga

SEQ ID NO: 251342 - DNA, 14 bp, Homo sapiens
caaacagtgtggct

SEQ ID NO: 251343 - DNA, 23 bp, Homo sapiens
caaacagtgtggcttaaacattt

SEQ ID NO: 251344 - DNA, 12 bp, Homo sapiens
caaacagttgta

SEQ ID NO: 251345 - DNA, 20 bp, Homo sapiens
caaacagttgtaccactgct

SEQ ID NO: 251346 - DNA, 20 bp, Homo sapiens
caaacatcaaataaatttct

SEQ ID NO: 251347 - DNA, 22 bp, Homo sapiens
caaacatcagacctgtcttcca

SEQ ID NO: 251348 - DNA, 20 bp, Homo sapiens
caaacatggggttggctggg

SEQ ID NO: 251349 - DNA, 14 bp, Homo sapiens
caaacatgtgcaac

SEQ ID NO: 251350 - DNA, 19 bp, Homo sapiens
caaacatgtgcaactcttg

SEQ ID NO: 251351 - DNA, 19 bp, Homo sapiens
caaacattcttattttaga

SEQ ID NO: 251352 - DNA, 14 bp, Homo sapiens
caaaccaaataaaa

SEQ ID NO: 251353 - DNA, 23 bp, Homo sapiens
caaaccaagtgccttgagctgcc

SEQ ID NO: 251354 - DNA, 20 bp, Homo sapiens
caaaccactttttgcagctt

SEQ ID NO: 251355 - DNA, 13 bp, Homo sapiens
caaaccaggagca

SEQ ID NO: 251356 - DNA, 17 bp, Homo sapiens
caaaccagtatcgctca

SEQ ID NO: 251357 - DNA, 12 bp, Homo sapiens
caaaccccagcc

SEQ ID NO: 251358 - DNA, 21 bp, Homo sapiens
caaaccccgaccacctgccca

SEQ ID NO: 251359 - DNA, 13 bp, Homo sapiens
caaaccccttccc

SEQ ID NO: 251360 - DNA, 14 bp, Homo sapiens
caaaccctgctgcc

SEQ ID NO: 251361 - DNA, 13 bp, Homo sapiens
caaaccctgtggg

SEQ ID NO: 251362 - DNA, 21 bp, Homo sapiens
caaaccttaagataatggata

SEQ ID NO: 251363 - DNA, 14 bp, Homo sapiens
caaacgaaatggct

SEQ ID NO: 251364 - DNA, 19 bp, Homo sapiens
caaacgcattaagaggttt

SEQ ID NO: 251365 - DNA, 16 bp, Homo sapiens
caaacgtaatttgtta

SEQ ID NO: 251366 - DNA, 18 bp, Homo sapiens
caaacgtaatttgttata

SEQ ID NO: 251367 - DNA, 16 bp, Homo sapiens
caaacgtgccccccag

SEQ ID NO: 251368 - DNA, 20 bp, Homo sapiens
caaactaaaagacatttgtt

SEQ ID NO: 251369 - DNA, 15 bp, Homo sapiens
caaactactgtacat

SEQ ID NO: 251370 - DNA, 18 bp, Homo sapiens
caaactactgtacatttt

SEQ ID NO: 251371 - DNA, 14 bp, Homo sapiens
caaactatgtaatg

SEQ ID NO: 251372 - DNA, 14 bp, Homo sapiens
caaactcccaggac

SEQ ID NO: 251373 - DNA, 14 bp, Homo sapiens
caaactcctgcctg

SEQ ID NO: 251374 - DNA, 15 bp, Homo sapiens
caaactcctgcctgt

SEQ ID NO: 251375 - DNA, 23 bp, Homo sapiens
caaactgatggaccgggtgggcc

SEQ ID NO: 251376 - DNA, 15 bp, Homo sapiens
caaactgcaatagag

SEQ ID NO: 251377 - DNA, 18 bp, Homo sapiens
caaactgcacacacagct

SEQ ID NO: 251378 - DNA, 21 bp, Homo sapiens
caaactgcacacacagctcct

SEQ ID NO: 251379 - DNA, 19 bp, Homo sapiens
caaactgtagtaattgtta

SEQ ID NO: 251380 - DNA, 21 bp, Homo sapiens
caaactgtagtaattgttaca

SEQ ID NO: 251381 - DNA, 22 bp, Homo sapiens
caaactgtagtaattgttacaa

SEQ ID NO: 251382 - DNA, 22 bp, Homo sapiens
caaacttggaatttgtaacctc

SEQ ID NO: 251383 - DNA, 14 bp, Homo sapiens
caaagaacccccct

SEQ ID NO: 251384 - DNA, 20 bp, Homo sapiens
caaatgagatctaagccttt

SEQ ID NO: 251385 - DNA, 15 bp, Homo sapiens
caaatgagggagggg

SEQ ID NO: 251386 - DNA, 21 bp, Homo sapiens
caaatgagtttaaaaaaataa

SEQ ID NO: 251387 - DNA, 15 bp, Homo sapiens
caaatgatacagtca

SEQ ID NO: 251388 - DNA, 18 bp, Homo sapiens
caaatgatacagtcagga

SEQ ID NO: 251389 - DNA, 22 bp, Homo sapiens
caaatgattttcatcaatttaa

SEQ ID NO: 251390 - DNA, 15 bp, Homo sapiens
caaatgcagggaggg

SEQ ID NO: 251391 - DNA, 22 bp, Homo sapiens
caaatgcatgatattgtatgta

SEQ ID NO: 251392 - DNA, 16 bp, Homo sapiens
caaatgcattcatgtt

SEQ ID NO: 251393 - DNA, 15 bp, Homo sapiens
caaatgcctctgcct

SEQ ID NO: 251394 - DNA, 16 bp, Homo sapiens
caaatgcctctgcctt

SEQ ID NO: 251395 - DNA, 15 bp, Homo sapiens
caaatgctgtgcaaa

SEQ ID NO: 251396 - DNA, 21 bp, Homo sapiens
caaatgctgtgcaaacagtgt

SEQ ID NO: 251397 - DNA, 18 bp, Homo sapiens
caaatgtaattgaataaa

SEQ ID NO: 251398 - DNA, 12 bp, Homo sapiens
caaatgtccaag

SEQ ID NO: 251399 - DNA, 14 bp, Homo sapiens
caaatgtcctcaga

SEQ ID NO: 251400 - DNA, 22 bp, Homo sapiens
caaatgtggcaattattttgga

SEQ ID NO: 251401 - DNA, 17 bp, Homo sapiens
caaatgtggcatttgtg

SEQ ID NO: 251402 - DNA, 19 bp, Homo sapiens
caaatgtggcatttgtgat

SEQ ID NO: 251403 - DNA, 14 bp, Homo sapiens
caaatgtggctcct

SEQ ID NO: 251404 - DNA, 20 bp, Homo sapiens
caaatgtgtactttattgat

SEQ ID NO: 251405 - DNA, 14 bp, Homo sapiens
caaatgtgtcccag

SEQ ID NO: 251406 - DNA, 23 bp, Homo sapiens
caaatgttgacctttgaggtcta

SEQ ID NO: 251407 - DNA, 14 bp, Homo sapiens
caaatgttttcatt

SEQ ID NO: 251408 - DNA, 15 bp, Homo sapiens
caaattaaaaatttt

SEQ ID NO: 251409 - DNA, 13 bp, Homo sapiens
caaattaacttga

SEQ ID NO: 251410 - DNA, 15 bp, Homo sapiens
caaattaatctttct

SEQ ID NO: 251411 - DNA, 20 bp, Homo sapiens
caaattagggctacattgta

SEQ ID NO: 251412 - DNA, 13 bp, Homo sapiens
caaattataaaaa

SEQ ID NO: 251413 - DNA, 13 bp, Homo sapiens
caaattattctag

SEQ ID NO: 251414 - DNA, 15 bp, Homo sapiens
caaattattctagtc

SEQ ID NO: 251415 - DNA, 12 bp, Homo sapiens
caaattatttgt

SEQ ID NO: 251416 - DNA, 23 bp, Homo sapiens
caaattcaaggagatataaaatc

SEQ ID NO: 251417 - DNA, 14 bp, Homo sapiens
caaattcctgcaaa

SEQ ID NO: 251418 - DNA, 13 bp, Homo sapiens
caaattgaaagct

SEQ ID NO: 251419 - DNA, 14 bp, Homo sapiens
caaattgccttcag

SEQ ID NO: 251420 - DNA, 16 bp, Homo sapiens
caaattgccttcagcc

SEQ ID NO: 251421 - DNA, 16 bp, Homo sapiens
caaattgctgagatgt

SEQ ID NO: 251422 - DNA, 19 bp, Homo sapiens
caaattggactttcaaaat

SEQ ID NO: 251423 - DNA, 19 bp, Homo sapiens
caaattgtatctagtgcag

SEQ ID NO: 251424 - DNA, 22 bp, Homo sapiens
caaatttgctttgggattttct

SEQ ID NO: 251425 - DNA, 13 bp, Homo sapiens
ccctgcaggcggt

SEQ ID NO: 251426 - DNA, 23 bp, Homo sapiens
ccctgcagggtagggggcctgag

SEQ ID NO: 251427 - DNA, 20 bp, Homo sapiens
ccctgcagtgttcgcttggc

SEQ ID NO: 251428 - DNA, 14 bp, Homo sapiens
ccctgccaactcca

SEQ ID NO: 251429 - DNA, 17 bp, Homo sapiens
ccctgccaactttccag

SEQ ID NO: 251430 - DNA, 21 bp, Homo sapiens
ccctgccaagaactctgggca

SEQ ID NO: 251431 - DNA, 15 bp, Homo sapiens
ccctgccaagcctgg

SEQ ID NO: 251432 - DNA, 18 bp, Homo sapiens
ccctgccaagcctggagc

SEQ ID NO: 251433 - DNA, 15 bp, Homo sapiens
ccctgccacctgtct

SEQ ID NO: 251434 - DNA, 17 bp, Homo sapiens
ccctgccacctgtctgt

SEQ ID NO: 251435 - DNA, 12 bp, Homo sapiens
ccctgccaggct

SEQ ID NO: 251436 - DNA, 17 bp, Homo sapiens
ccctgccaggctgtcag

SEQ ID NO: 251437 - DNA, 12 bp, Homo sapiens
ccctgcccaggc

SEQ ID NO: 251438 - DNA, 15 bp, Homo sapiens
ccctgcccaggccgg

SEQ ID NO: 251439 - DNA, 18 bp, Homo sapiens
ccctgcccaggccggcca

SEQ ID NO: 251440 - DNA, 13 bp, Homo sapiens
ccctgccccacac

SEQ ID NO: 251441 - DNA, 19 bp, Homo sapiens
ccctgccccacacaggcct

SEQ ID NO: 251442 - DNA, 20 bp, Homo sapiens
ccctgccccacacaggcctg

SEQ ID NO: 251443 - DNA, 21 bp, Homo sapiens
ccctgccccacacaggcctgg

SEQ ID NO: 251444 - DNA, 13 bp, Homo sapiens
ccctgccccagag

SEQ ID NO: 251445 - DNA, 16 bp, Homo sapiens
ccctgccccagagaag

SEQ ID NO: 251446 - DNA, 22 bp, Homo sapiens
ccctgccccagagaagcctcag

SEQ ID NO: 251447 - DNA, 15 bp, Homo sapiens
ccctgcccccatctc

SEQ ID NO: 251448 - DNA, 19 bp, Homo sapiens
ccctgcccccatctcccca

SEQ ID NO: 251449 - DNA, 18 bp, Homo sapiens
ccctgccccggaggaagc

SEQ ID NO: 251450 - DNA, 23 bp, Homo sapiens
ccctgccccgtcccctgggccac

SEQ ID NO: 251451 - DNA, 19 bp, Homo sapiens
ccctgcccctgccccgtca

SEQ ID NO: 251452 - DNA, 16 bp, Homo sapiens
ccctgcccctgcccga

SEQ ID NO: 251453 - DNA, 17 bp, Homo sapiens
ccctgcccctgcccgag

SEQ ID NO: 251454 - DNA, 20 bp, Homo sapiens
ccctgcccgagagctcttag

SEQ ID NO: 251455 - DNA, 22 bp, Homo sapiens
ccctgcccggtggtttgccatg

SEQ ID NO: 251456 - DNA, 13 bp, Homo sapiens
ccctgccctcact

SEQ ID NO: 251457 - DNA, 14 bp, Homo sapiens
ccctgccctcactc

SEQ ID NO: 251458 - DNA, 18 bp, Homo sapiens
ccctgccctcactccact

SEQ ID NO: 251459 - DNA, 15 bp, Homo sapiens
ccctgccctgccacc

SEQ ID NO: 251460 - DNA, 13 bp, Homo sapiens
ccctgccctgctg

SEQ ID NO: 251461 - DNA, 18 bp, Homo sapiens
ccctgccctggtccaggg

SEQ ID NO: 251462 - DNA, 10 bp, Homo sapiens
ccctgcctca

SEQ ID NO: 251463 - DNA, 17 bp, Homo sapiens
ccctgcctcacatctcc

SEQ ID NO: 251464 - DNA, 22 bp, Homo sapiens
ccctgcctccctttctgggagg

SEQ ID NO: 251465 - DNA, 15 bp, Homo sapiens
ccctgcctgagccca

SEQ ID NO: 251466 - DNA, 16 bp, Homo sapiens
ccctgcctgagcccag

SEQ ID NO: 251467 - DNA, 19 bp, Homo sapiens
ccctgcctgagggcccctc

SEQ ID NO: 251468 - DNA, 12 bp, Homo sapiens
ccctgcctgccc

SEQ ID NO: 251469 - DNA, 22 bp, Homo sapiens
ccctgcgccctccctccctcca

SEQ ID NO: 251470 - DNA, 17 bp, Homo sapiens
ccctgcgtgggggccag

SEQ ID NO: 251471 - DNA, 16 bp, Homo sapiens
ccctgcgttggagcca

SEQ ID NO: 251472 - DNA, 17 bp, Homo sapiens
ccctgcgttggagccac

SEQ ID NO: 251473 - DNA, 15 bp, Homo sapiens
ccctgctcaggcctc

SEQ ID NO: 251474 - DNA, 15 bp, Homo sapiens
ccctgctcccagcct

SEQ ID NO: 251475 - DNA, 16 bp, Homo sapiens
ccctgctcccagcctg

SEQ ID NO: 251476 - DNA, 18 bp, Homo sapiens
ccctgctcctcctgccct

SEQ ID NO: 251477 - DNA, 21 bp, Homo sapiens
ccctgctctacccatgagcct

SEQ ID NO: 251478 - DNA, 22 bp, Homo sapiens
ccctgctctacccatgagcctg

SEQ ID NO: 251479 - DNA, 14 bp, Homo sapiens
ccctgctgaccttg

SEQ ID NO: 251480 - DNA, 20 bp, Homo sapiens
ccctgctgccgcctcccagc

SEQ ID NO: 251481 - DNA, 11 bp, Homo sapiens
ccctgctgcct

SEQ ID NO: 251482 - DNA, 12 bp, Homo sapiens
ccctgctgcctc

SEQ ID NO: 251483 - DNA, 19 bp, Homo sapiens
ccctgctgctcctcggcca

SEQ ID NO: 251484 - DNA, 21 bp, Homo sapiens
ccctgctgctcctcggccaga

SEQ ID NO: 251485 - DNA, 13 bp, Homo sapiens
ccctgctgctgcc

SEQ ID NO: 251486 - DNA, 17 bp, Homo sapiens
ccctgctgctgcctgcc

SEQ ID NO: 251487 - DNA, 19 bp, Homo sapiens
ccctgcttcatatctctcc

SEQ ID NO: 251488 - DNA, 22 bp, Homo sapiens
ccctgcttcatatctctccctt

SEQ ID NO: 251489 - DNA, 14 bp, Homo sapiens
ccctgcttctgctg

SEQ ID NO: 251490 - DNA, 21 bp, Homo sapiens
ccctgcttgcccgctcccaca

SEQ ID NO: 251491 - DNA, 18 bp, Homo sapiens
ccctgcttggggcctggc

SEQ ID NO: 251492 - DNA, 20 bp, Homo sapiens
ccctgctttgggctgccctg

SEQ ID NO: 251493 - DNA, 23 bp, Homo sapiens
ccctgctttgggctgccctggtg

SEQ ID NO: 251494 - DNA, 18 bp, Homo sapiens
ccctggaaattctgcctt

SEQ ID NO: 251495 - DNA, 20 bp, Homo sapiens
ccctggaactctatctgggc

SEQ ID NO: 251496 - DNA, 22 bp, Homo sapiens
ccctggaactctatctgggcct

SEQ ID NO: 251497 - DNA, 22 bp, Homo sapiens
ccctggaagccggcggcccaag

SEQ ID NO: 251498 - DNA, 17 bp, Homo sapiens
ccctggaccaccagccc

SEQ ID NO: 251499 - DNA, 21 bp, Homo sapiens
ccctggaccaccagccccagc

SEQ ID NO: 251500 - DNA, 22 bp, Homo sapiens
ccctggaccaccagccccagca

SEQ ID NO: 251501 - DNA, 16 bp, Homo sapiens
ccctggaccagcctcc

SEQ ID NO: 251502 - DNA, 20 bp, Homo sapiens
ccctggagccagcagggctg

SEQ ID NO: 251503 - DNA, 16 bp, Homo sapiens
ccctggagctcctgct

SEQ ID NO: 251504 - DNA, 19 bp, Homo sapiens
ccctggagctcctgctggg

SEQ ID NO: 251505 - DNA, 19 bp, Homo sapiens
ccctggagctgtccttcat

SEQ ID NO: 251506 - DNA, 20 bp, Homo sapiens
ccctggagctgtccttcatt

SEQ ID NO: 251507 - DNA, 19 bp, Homo sapiens
ccctggatccatcaggcca

SEQ ID NO: 251508 - DNA, 13 bp, Homo sapiens
ccctggatgtccc

SEQ ID NO: 251509 - DNA, 13 bp, Homo sapiens
ccctggatgtgtg

SEQ ID NO: 251510 - DNA, 19 bp, Homo sapiens
ccctggatgtgtggggcat

SEQ ID NO: 251511 - DNA, 21 bp, Homo sapiens
ccctggatgtgtggggcatgg

SEQ ID NO: 251512 - DNA, 16 bp, Homo sapiens
ccctggcacgtcctcc

SEQ ID NO: 251513 - DNA, 17 bp, Homo sapiens
ccctggcacgtcctcca

SEQ ID NO: 251514 - DNA, 13 bp, Homo sapiens
cccttctctgctc

SEQ ID NO: 251515 - DNA, 17 bp, Homo sapiens
cccttctctgctccacc

SEQ ID NO: 251516 - DNA, 12 bp, Homo sapiens
cccttctgctgt

SEQ ID NO: 251517 - DNA, 13 bp, Homo sapiens
cccttctgctttc

SEQ ID NO: 251518 - DNA, 14 bp, Homo sapiens
cccttcttgggccc

SEQ ID NO: 251519 - DNA, 21 bp, Homo sapiens
cccttcttgggccccagaccc

SEQ ID NO: 251520 - DNA, 19 bp, Homo sapiens
cccttctttgcttcttttt

SEQ ID NO: 251521 - DNA, 21 bp, Homo sapiens
cccttgaactgttctggcctc

SEQ ID NO: 251522 - DNA, 20 bp, Homo sapiens
cccttgaagaggggaggggc

SEQ ID NO: 251523 - DNA, 22 bp, Homo sapiens
cccttgagaaaccttattgtac

SEQ ID NO: 251524 - DNA, 22 bp, Homo sapiens
cccttgagccccagaggcagag

SEQ ID NO: 251525 - DNA, 22 bp, Homo sapiens
cccttgcacaggccacttgctc

SEQ ID NO: 251526 - DNA, 19 bp, Homo sapiens
cccttgcagttcagcacca

SEQ ID NO: 251527 - DNA, 13 bp, Homo sapiens
cccttgccaaggc

SEQ ID NO: 251528 - DNA, 20 bp, Homo sapiens
cccttgcccaaccaatgcac

SEQ ID NO: 251529 - DNA, 18 bp, Homo sapiens
cccttgcccaactcccag

SEQ ID NO: 251530 - DNA, 19 bp, Homo sapiens
cccttgctgggtccagggt

SEQ ID NO: 251531 - DNA, 13 bp, Homo sapiens
cccttggaaacct

SEQ ID NO: 251532 - DNA, 17 bp, Homo sapiens
cccttggaaacctgccc

SEQ ID NO: 251533 - DNA, 14 bp, Homo sapiens
cccttggccacggc

SEQ ID NO: 251534 - DNA, 15 bp, Homo sapiens
cccttggccacggcc

SEQ ID NO: 251535 - DNA, 14 bp, Homo sapiens
cccttggcccctct

SEQ ID NO: 251536 - DNA, 13 bp, Homo sapiens
cccttggcctcag

SEQ ID NO: 251537 - DNA, 16 bp, Homo sapiens
cccttggcctgtctca

SEQ ID NO: 251538 - DNA, 19 bp, Homo sapiens
cccttggctggatcaggga

SEQ ID NO: 251539 - DNA, 14 bp, Homo sapiens
cccttggcttcctc

SEQ ID NO: 251540 - DNA, 19 bp, Homo sapiens
cccttggcttcctccgtcc

SEQ ID NO: 251541 - DNA, 17 bp, Homo sapiens
cccttgggatgggcaca

SEQ ID NO: 251542 - DNA, 20 bp, Homo sapiens
cccttgggatgggcacaggc

SEQ ID NO: 251543 - DNA, 22 bp, Homo sapiens
cccttgggatgggcacaggctg

SEQ ID NO: 251544 - DNA, 20 bp, Homo sapiens
cccttgggcagttctcactc

SEQ ID NO: 251545 - DNA, 18 bp, Homo sapiens
cccttggggagcaggctc

SEQ ID NO: 251546 - DNA, 16 bp, Homo sapiens
cccttggggcctggct

SEQ ID NO: 251547 - DNA, 17 bp, Homo sapiens
cccttggggcctggctt

SEQ ID NO: 251548 - DNA, 15 bp, Homo sapiens
cccttgggttctgat

SEQ ID NO: 251549 - DNA, 16 bp, Homo sapiens
cccttgggttctgata

SEQ ID NO: 251550 - DNA, 18 bp, Homo sapiens
cccttggtagagtttatt

SEQ ID NO: 251551 - DNA, 17 bp, Homo sapiens
cccttgtacagtgtctg

SEQ ID NO: 251552 - DNA, 22 bp, Homo sapiens
cccttgtcctgccagctgcctt

SEQ ID NO: 251553 - DNA, 17 bp, Homo sapiens
cccttgtgagagcccat

SEQ ID NO: 251554 - DNA, 14 bp, Homo sapiens
ccctttcaccccca

SEQ ID NO: 251555 - DNA, 17 bp, Homo sapiens
ccctttcagatgtcttc

SEQ ID NO: 251556 - DNA, 19 bp, Homo sapiens
ccctttcagatgtcttctg

SEQ ID NO: 251557 - DNA, 20 bp, Homo sapiens
ccctttcagatgtcttctgc

SEQ ID NO: 251558 - DNA, 18 bp, Homo sapiens
ccctttcccaaacccttc

SEQ ID NO: 251559 - DNA, 12 bp, Homo sapiens
ccctttccctgc

SEQ ID NO: 251560 - DNA, 13 bp, Homo sapiens
ccctttccctgca

SEQ ID NO: 251561 - DNA, 16 bp, Homo sapiens
ccctttcttggccagt

SEQ ID NO: 251562 - DNA, 13 bp, Homo sapiens
ccctttgctccac

SEQ ID NO: 251563 - DNA, 23 bp, Homo sapiens
ccctttgctgtgaggctgtcctg

SEQ ID NO: 251564 - DNA, 15 bp, Homo sapiens
ccctttgttgctgtc

SEQ ID NO: 251565 - DNA, 23 bp, Homo sapiens
cccttttacagctcttggcattt

SEQ ID NO: 251566 - DNA, 12 bp, Homo sapiens
cccttttacttt

SEQ ID NO: 251567 - DNA, 23 bp, Homo sapiens
cccttttcaagttgagaacaaaa

SEQ ID NO: 251568 - DNA, 14 bp, Homo sapiens
cccttttctggctc

SEQ ID NO: 251569 - DNA, 22 bp, Homo sapiens
cccttttctttttcccttgaac

SEQ ID NO: 251570 - DNA, 23 bp, Homo sapiens
cccttttgtgggtttctctgtgc

SEQ ID NO: 251571 - DNA, 16 bp, Homo sapiens
cccttttttgtccccc

SEQ ID NO: 251572 - DNA, 21 bp, Homo sapiens
cccttttttgtcccccaactt

SEQ ID NO: 251573 - DNA, 18 bp, Homo sapiens
ccgaagaagggtccttcc

SEQ ID NO: 251574 - DNA, 18 bp, Homo sapiens
ccgacaaccgatgctcca

SEQ ID NO: 251575 - DNA, 16 bp, Homo sapiens
ccgacactgctgcacc

SEQ ID NO: 251576 - DNA, 18 bp, Homo sapiens
ccgacactgctgcaccag

SEQ ID NO: 251577 - DNA, 13 bp, Homo sapiens
ccgacagtggctc

SEQ ID NO: 251578 - DNA, 16 bp, Homo sapiens
ccgacagtggctctcc

SEQ ID NO: 251579 - DNA, 17 bp, Homo sapiens
ccgacagtggctctcca

SEQ ID NO: 251580 - DNA, 15 bp, Homo sapiens
ccgaccacctgccca

SEQ ID NO: 251581 - DNA, 14 bp, Homo sapiens
ccgaccccatctca

SEQ ID NO: 251582 - DNA, 19 bp, Homo sapiens
ccgaccgaggctggagctg

SEQ ID NO: 251583 - DNA, 21 bp, Homo sapiens
ccgaccgaggctggagctggc

SEQ ID NO: 251584 - DNA, 19 bp, Homo sapiens
ccgacctggggctgagtgc

SEQ ID NO: 251585 - DNA, 14 bp, Homo sapiens
ccgactagcaggca

SEQ ID NO: 251586 - DNA, 12 bp, Homo sapiens
ccgactccagat

SEQ ID NO: 251587 - DNA, 23 bp, Homo sapiens
ccgacttgctgttttgttctgtg

SEQ ID NO: 251588 - DNA, 13 bp, Homo sapiens
ccgagaccgcaga

SEQ ID NO: 251589 - DNA, 22 bp, Homo sapiens
ccgagatgtgacccaccagtgc

SEQ ID NO: 251590 - DNA, 21 bp, Homo sapiens
ccgagcaaagatcaaaataaa

SEQ ID NO: 251591 - DNA, 14 bp, Homo sapiens
ccgagccccctgtc

SEQ ID NO: 251592 - DNA, 15 bp, Homo sapiens
ccgagccccctgtcc

SEQ ID NO: 251593 - DNA, 18 bp, Homo sapiens
ccgagccccctgtccttc

SEQ ID NO: 251594 - DNA, 21 bp, Homo sapiens
ccgagcgacggctcctccccg

SEQ ID NO: 251595 - DNA, 14 bp, Homo sapiens
ccgagcgcgtgcct

SEQ ID NO: 251596 - DNA, 16 bp, Homo sapiens
ccgagctactctcttg

SEQ ID NO: 251597 - DNA, 23 bp, Homo sapiens
ccgagctactctcttgccagcat

SEQ ID NO: 251598 - DNA, 19 bp, Homo sapiens
ccgagctcgtgtatcctgg

SEQ ID NO: 251599 - DNA, 19 bp, Homo sapiens
ccgagctctgtcctctgtc

SEQ ID NO: 251600 - DNA, 11 bp, Homo sapiens
ccgagctgggg

SEQ ID NO: 251601 - DNA, 20 bp, Homo sapiens
ccgagctggtgcattacaga

SEQ ID NO: 251602 - DNA, 16 bp, Homo sapiens
ccgaggagccaggcaa

SEQ ID NO: 251603 - DNA, 21 bp, Homo sapiens
ccgaggcagcaacaggaccag

SEQ ID NO: 251604 - DNA, 22 bp, Homo sapiens
ccgaggcagcaacaggaccagg

SEQ ID NO: 251605 - DNA, 23 bp, Homo sapiens
ccgaggcagcaacaggaccagga

SEQ ID NO: 251606 - DNA, 17 bp, Homo sapiens
ccgaggcaggggctggg

SEQ ID NO: 251607 - DNA, 22 bp, Homo sapiens
ccgaggcaggggctgggcagag

SEQ ID NO: 251608 - DNA, 17 bp, Homo sapiens
ccgaggctggagctggc

SEQ ID NO: 251609 - DNA, 22 bp, Homo sapiens
ccgagggcggccagggacagac

SEQ ID NO: 251610 - DNA, 13 bp, Homo sapiens
ccgaggggccagg

SEQ ID NO: 251611 - DNA, 16 bp, Homo sapiens
ccgaggggccagggtg

SEQ ID NO: 251612 - DNA, 23 bp, Homo sapiens
ccgagggtcctggctcctgaggg

SEQ ID NO: 251613 - DNA, 14 bp, Homo sapiens
ccgagtatctgtaa

SEQ ID NO: 251614 - DNA, 14 bp, Homo sapiens
ccgagtccaggagc

SEQ ID NO: 251615 - DNA, 16 bp, Homo sapiens
ccgagtctcttctcca

SEQ ID NO: 251616 - DNA, 19 bp, Homo sapiens
ccgagtctcttctccactg

SEQ ID NO: 251617 - DNA, 21 bp, Homo sapiens
ccgagtctcttctccactgga

SEQ ID NO: 251618 - DNA, 22 bp, Homo sapiens
ccgagtctcttctccactggat

SEQ ID NO: 251619 - DNA, 14 bp, Homo sapiens
ccgatattctccct

SEQ ID NO: 251620 - DNA, 13 bp, Homo sapiens
ccgatccacattg

SEQ ID NO: 251621 - DNA, 14 bp, Homo sapiens
ccgatgctccagcc

SEQ ID NO: 251622 - DNA, 12 bp, Homo sapiens
ccgatggagccc

SEQ ID NO: 251623 - DNA, 12 bp, Homo sapiens
ccgatggggccc

SEQ ID NO: 251624 - DNA, 17 bp, Homo sapiens
ccgcaaaacccactgac

SEQ ID NO: 251625 - DNA, 15 bp, Homo sapiens
ccgcaaccacttgct

SEQ ID NO: 251626 - DNA, 14 bp, Homo sapiens
ccgcacaccctcac

SEQ ID NO: 251627 - DNA, 21 bp, Homo sapiens
ccgcacaccctcactctgcca

SEQ ID NO: 251628 - DNA, 15 bp, Homo sapiens
ccgcacagcagcctg

SEQ ID NO: 251629 - DNA, 17 bp, Homo sapiens
ccgcacctaaagcagcc

SEQ ID NO: 251630 - DNA, 15 bp, Homo sapiens
ccgcagagcccacgc

SEQ ID NO: 251631 - DNA, 17 bp, Homo sapiens
ccgcagcaccagcctga

SEQ ID NO: 251632 - DNA, 13 bp, Homo sapiens
ccgcagcatgtgg

SEQ ID NO: 251633 - DNA, 20 bp, Homo sapiens
ccgcagcccgtgaagcagtg

SEQ ID NO: 251634 - DNA, 17 bp, Homo sapiens
ccgcagggcgctccggc

SEQ ID NO: 251635 - DNA, 17 bp, Homo sapiens
ccgcagtccccagccct

SEQ ID NO: 251636 - DNA, 18 bp, Homo sapiens
ccgcagtccccagccctt

SEQ ID NO: 251637 - DNA, 20 bp, Homo sapiens
ccgcatatgcatgccaggct

SEQ ID NO: 251638 - DNA, 14 bp, Homo sapiens
ccgcatgcagcagc

SEQ ID NO: 251639 - DNA, 18 bp, Homo sapiens
ccgcatgctgcctgcctc

SEQ ID NO: 251640 - DNA, 17 bp, Homo sapiens
ccgcatgtgtctgtatt

SEQ ID NO: 251641 - DNA, 14 bp, Homo sapiens
ccgcattggtggct

SEQ ID NO: 251642 - DNA, 13 bp, Homo sapiens
ccgccacggccac

SEQ ID NO: 251643 - DNA, 15 bp, Homo sapiens
ccgccacggccaccc

SEQ ID NO: 251644 - DNA, 12 bp, Homo sapiens
caacccaaagta

SEQ ID NO: 251645 - DNA, 20 bp, Homo sapiens
caacccaactgacttctgct

SEQ ID NO: 251646 - DNA, 15 bp, Homo sapiens
caacccatgcatggc

SEQ ID NO: 251647 - DNA, 16 bp, Homo sapiens
caacccatgcatggcc

SEQ ID NO: 251648 - DNA, 20 bp, Homo sapiens
caacccatgcatggcctccc

SEQ ID NO: 251649 - DNA, 22 bp, Homo sapiens
caacccatgcatggcctcccag

SEQ ID NO: 251650 - DNA, 23 bp, Homo sapiens
caacccatgcatggcctcccagc

SEQ ID NO: 251651 - DNA, 14 bp, Homo sapiens
caacccatgccctg

SEQ ID NO: 251652 - DNA, 16 bp, Homo sapiens
caacccatgccctgcc

SEQ ID NO: 251653 - DNA, 18 bp, Homo sapiens
caacccattcactacagg

SEQ ID NO: 251654 - DNA, 13 bp, Homo sapiens
caacccccacccc

SEQ ID NO: 251655 - DNA, 18 bp, Homo sapiens
caacccccaccccacact

SEQ ID NO: 251656 - DNA, 23 bp, Homo sapiens
caacccccaccccacacttgttc

SEQ ID NO: 251657 - DNA, 15 bp, Homo sapiens
caacccccacctccc

SEQ ID NO: 251658 - DNA, 19 bp, Homo sapiens
caacccccacctcccggtg

SEQ ID NO: 251659 - DNA, 18 bp, Homo sapiens
caaccccctcggagcctg

SEQ ID NO: 251660 - DNA, 20 bp, Homo sapiens
caaccccgcggtgctctggc

SEQ ID NO: 251661 - DNA, 12 bp, Homo sapiens
caacccctgtgg

SEQ ID NO: 251662 - DNA, 13 bp, Homo sapiens
caaccctcagagc

SEQ ID NO: 251663 - DNA, 18 bp, Homo sapiens
caaccctccctcagcccc

SEQ ID NO: 251664 - DNA, 19 bp, Homo sapiens
caaccctccctcagcccct

SEQ ID NO: 251665 - DNA, 21 bp, Homo sapiens
caaccctccctcagcccctct

SEQ ID NO: 251666 - DNA, 22 bp, Homo sapiens
caaccctccctcagcccctctt

SEQ ID NO: 251667 - DNA, 12 bp, Homo sapiens
caaccctgcaaa

SEQ ID NO: 251668 - DNA, 13 bp, Homo sapiens
caaccctgcccct

SEQ ID NO: 251669 - DNA, 22 bp, Homo sapiens
caaccctgcccctgccccgtca

SEQ ID NO: 251670 - DNA, 23 bp, Homo sapiens
caaccctgcccctgccccgtcac

SEQ ID NO: 251671 - DNA, 13 bp, Homo sapiens
caaccctgccctg

SEQ ID NO: 251672 - DNA, 15 bp, Homo sapiens
caaccctgccctgca

SEQ ID NO: 251673 - DNA, 22 bp, Homo sapiens
caaccctgttgagtatttgctg

SEQ ID NO: 251674 - DNA, 17 bp, Homo sapiens
caaccgatgctccagcc

SEQ ID NO: 251675 - DNA, 16 bp, Homo sapiens
caaccgggaaaggcat

SEQ ID NO: 251676 - DNA, 16 bp, Homo sapiens
caacctagaaaccttt

SEQ ID NO: 251677 - DNA, 19 bp, Homo sapiens
caacctagccaacatggtg

SEQ ID NO: 251678 - DNA, 16 bp, Homo sapiens
caacctatttgactgc

SEQ ID NO: 251679 - DNA, 19 bp, Homo sapiens
caacctcaatgccctgcca

SEQ ID NO: 251680 - DNA, 14 bp, Homo sapiens
caacctcactgccc

SEQ ID NO: 251681 - DNA, 21 bp, Homo sapiens
caacctcggcttgtgggctgg

SEQ ID NO: 251682 - DNA, 24 bp, Homo sapiens
caacctcggcttgtgggctggtgc

SEQ ID NO: 251683 - DNA, 21 bp, Homo sapiens
caacctctctgatcttgtgct

SEQ ID NO: 251684 - DNA, 23 bp, Homo sapiens
caacctctctgatcttgtgctca

SEQ ID NO: 251685 - DNA, 20 bp, Homo sapiens
caacctctgcctcccaggtt

SEQ ID NO: 251686 - DNA, 13 bp, Homo sapiens
caacctgaaagac

SEQ ID NO: 251687 - DNA, 12 bp, Homo sapiens
caacctgcctgt

SEQ ID NO: 251688 - DNA, 18 bp, Homo sapiens
caacctgcctgtgcatga

SEQ ID NO: 251689 - DNA, 14 bp, Homo sapiens
caaccttaaagcaa

SEQ ID NO: 251690 - DNA, 17 bp, Homo sapiens
caaccttctgtggctca

SEQ ID NO: 251691 - DNA, 20 bp, Homo sapiens
caaccttctgtggctcacag

SEQ ID NO: 251692 - DNA, 13 bp, Homo sapiens
caacgaaaagcac

SEQ ID NO: 251693 - DNA, 20 bp, Homo sapiens
caacgaagaaaaaaaataac

SEQ ID NO: 251694 - DNA, 15 bp, Homo sapiens
caacgcacaaatgac

SEQ ID NO: 251695 - DNA, 18 bp, Homo sapiens
caacgcagccctgctttg

SEQ ID NO: 251696 - DNA, 21 bp, Homo sapiens
caacgcctgccttctgggcaa

SEQ ID NO: 251697 - DNA, 16 bp, Homo sapiens
caacgctcactctacc

SEQ ID NO: 251698 - DNA, 14 bp, Homo sapiens
caacgtgcgtgtct

SEQ ID NO: 251699 - DNA, 21 bp, Homo sapiens
caacgtgcgtgtctctgccat

SEQ ID NO: 251700 - DNA, 16 bp, Homo sapiens
caacgtggacctgcct

SEQ ID NO: 251701 - DNA, 15 bp, Homo sapiens
ccgcgcgtgccccca

SEQ ID NO: 251702 - DNA, 15 bp, Homo sapiens
ccgcgctctgcccct

SEQ ID NO: 251703 - DNA, 15 bp, Homo sapiens
ccgcgggttctagac

SEQ ID NO: 251704 - DNA, 12 bp, Homo sapiens
ccgcggtgctct

SEQ ID NO: 251705 - DNA, 21 bp, Homo sapiens
ccgcgtagagagccgggcccc

SEQ ID NO: 251706 - DNA, 21 bp, Homo sapiens
ccgctaggagagactgaaagc

SEQ ID NO: 251707 - DNA, 20 bp, Homo sapiens
ccgctcaggtagccaccacc

SEQ ID NO: 251708 - DNA, 13 bp, Homo sapiens
ccgctcccacagc

SEQ ID NO: 251709 - DNA, 15 bp, Homo sapiens
ccgctcccacagctt

SEQ ID NO: 251710 - DNA, 23 bp, Homo sapiens
ccgctcccacagcttcctgaggg

SEQ ID NO: 251711 - DNA, 15 bp, Homo sapiens
ccgctccccagccca

SEQ ID NO: 251712 - DNA, 15 bp, Homo sapiens
ccgctcccctttccc

SEQ ID NO: 251713 - DNA, 13 bp, Homo sapiens
ccgctctgaggca

SEQ ID NO: 251714 - DNA, 12 bp, Homo sapiens
ccgctgccagca

SEQ ID NO: 251715 - DNA, 18 bp, Homo sapiens
ccgctgccagcacagagc

SEQ ID NO: 251716 - DNA, 12 bp, Homo sapiens
ccgctgcccagc

SEQ ID NO: 251717 - DNA, 13 bp, Homo sapiens
ccgctgcccagcc

SEQ ID NO: 251718 - DNA, 15 bp, Homo sapiens
ccgctgcccagccct

SEQ ID NO: 251719 - DNA, 12 bp, Homo sapiens
ccgctgcctggc

SEQ ID NO: 251720 - DNA, 19 bp, Homo sapiens
ccgctgcctggcgggcagc

SEQ ID NO: 251721 - DNA, 23 bp, Homo sapiens
ccgctgcctggcgggcagcccct

SEQ ID NO: 251722 - DNA, 16 bp, Homo sapiens
ccgctgctgctgctgc

SEQ ID NO: 251723 - DNA, 13 bp, Homo sapiens
ccgctgctgtgct

SEQ ID NO: 251724 - DNA, 14 bp, Homo sapiens
ccgctgcttccagg

SEQ ID NO: 251725 - DNA, 11 bp, Homo sapiens
ccgctgggaga

SEQ ID NO: 251726 - DNA, 13 bp, Homo sapiens
ccgctgggagagc

SEQ ID NO: 251727 - DNA, 19 bp, Homo sapiens
ccgctgggagagccaaggc

SEQ ID NO: 251728 - DNA, 20 bp, Homo sapiens
ccgctgggagagccaaggcc

SEQ ID NO: 251729 - DNA, 14 bp, Homo sapiens
ccgctgggctgagc

SEQ ID NO: 251730 - DNA, 20 bp, Homo sapiens
ccgctgtcacccagcaaggc

SEQ ID NO: 251731 - DNA, 14 bp, Homo sapiens
ccgcttcacccctg

SEQ ID NO: 251732 - DNA, 18 bp, Homo sapiens
ccgcttcacccctgcact

SEQ ID NO: 251733 - DNA, 20 bp, Homo sapiens
ccggaaataccatgcacaga

SEQ ID NO: 251734 - DNA, 23 bp, Homo sapiens
ccggacggacgttggttctgcac

SEQ ID NO: 251735 - DNA, 22 bp, Homo sapiens
ccggagaacatctgccttgctg

SEQ ID NO: 251736 - DNA, 16 bp, Homo sapiens
ccggagagggagtcag

SEQ ID NO: 251737 - DNA, 17 bp, Homo sapiens
ccggagagggagtcagt

SEQ ID NO: 251738 - DNA, 20 bp, Homo sapiens
ccggagattggacggcctga

SEQ ID NO: 251739 - DNA, 13 bp, Homo sapiens
ccggagcacagcc

SEQ ID NO: 251740 - DNA, 20 bp, Homo sapiens
ccggagcacagccctgggag

SEQ ID NO: 251741 - DNA, 14 bp, Homo sapiens
ccggagcggctgag

SEQ ID NO: 251742 - DNA, 17 bp, Homo sapiens
ccggagctaacactggc

SEQ ID NO: 251743 - DNA, 20 bp, Homo sapiens
ccggagctaacactggcccc

SEQ ID NO: 251744 - DNA, 22 bp, Homo sapiens
ccggagctaacactggccccta

SEQ ID NO: 251745 - DNA, 15 bp, Homo sapiens
ccggaggcgcccacc

SEQ ID NO: 251746 - DNA, 17 bp, Homo sapiens
ccggaggcgcccacctg

SEQ ID NO: 251747 - DNA, 20 bp, Homo sapiens
ccggaggcgcccacctgccc

SEQ ID NO: 251748 - DNA, 15 bp, Homo sapiens
ccggaggggcctggc

SEQ ID NO: 251749 - DNA, 14 bp, Homo sapiens
ccggatctccaggc

SEQ ID NO: 251750 - DNA, 19 bp, Homo sapiens
ccggatctccaggcccagc

SEQ ID NO: 251751 - DNA, 19 bp, Homo sapiens
ccggcacagggtctgctct

SEQ ID NO: 251752 - DNA, 20 bp, Homo sapiens
ccggcacagggtctgctctt

SEQ ID NO: 251753 - DNA, 13 bp, Homo sapiens
ccggcagaaggga

SEQ ID NO: 251754 - DNA, 12 bp, Homo sapiens
ccggcagaggca

SEQ ID NO: 251755 - DNA, 14 bp, Homo sapiens
ccggcagaggcagg

SEQ ID NO: 251756 - DNA, 15 bp, Homo sapiens
ccggcagaggcaggg

SEQ ID NO: 251757 - DNA, 23 bp, Homo sapiens
ccggcagcctggttccctctttc

SEQ ID NO: 251758 - DNA, 11 bp, Homo sapiens
ccggcaggccc

SEQ ID NO: 251759 - DNA, 17 bp, Homo sapiens
ccggcaggccctgcagt

SEQ ID NO: 251760 - DNA, 18 bp, Homo sapiens
ccggcaggccctgcagtg

SEQ ID NO: 251761 - DNA, 21 bp, Homo sapiens
ccggcaggccctgcagtgttc

SEQ ID NO: 251762 - DNA, 17 bp, Homo sapiens
ccggcaggggcccctcc

SEQ ID NO: 251763 - DNA, 15 bp, Homo sapiens
ccggccaaggacact

SEQ ID NO: 251764 - DNA, 12 bp, Homo sapiens
ccggccagctcc

SEQ ID NO: 251765 - DNA, 15 bp, Homo sapiens
ccggccatactgcct

SEQ ID NO: 251766 - DNA, 20 bp, Homo sapiens
ccggcccccttcaccccttc

SEQ ID NO: 251767 - DNA, 18 bp, Homo sapiens
ccggccccgcgcgtgccc

SEQ ID NO: 251768 - DNA, 18 bp, Homo sapiens
ccggcccctaccagccac

SEQ ID NO: 251769 - DNA, 15 bp, Homo sapiens
ccggcccgccacctt

SEQ ID NO: 251770 - DNA, 11 bp, Homo sapiens
ccggccctgcc

SEQ ID NO: 251771 - DNA, 22 bp, Homo sapiens
ccggccgcccagacaccacaga

SEQ ID NO: 251772 - DNA, 23 bp, Homo sapiens
ccggccgccccgccccagagctc

SEQ ID NO: 251773 - DNA, 18 bp, Homo sapiens
ccggcctccaggctgggg

SEQ ID NO: 251774 - DNA, 14 bp, Homo sapiens
ccggcctcttccac

SEQ ID NO: 251775 - DNA, 16 bp, Homo sapiens
caagaactgcatggac

SEQ ID NO: 251776 - DNA, 18 bp, Homo sapiens
caagaactgcatggacct

SEQ ID NO: 251777 - DNA, 12 bp, Homo sapiens
caagaagaatat

SEQ ID NO: 251778 - DNA, 17 bp, Homo sapiens
caagaagaatataaata

SEQ ID NO: 251779 - DNA, 19 bp, Homo sapiens
caagaagattctaaaacat

SEQ ID NO: 251780 - DNA, 23 bp, Homo sapiens
caagaagcaattatttaaagaaa

SEQ ID NO: 251781 - DNA, 14 bp, Homo sapiens
caagaagccctcct

SEQ ID NO: 251782 - DNA, 19 bp, Homo sapiens
caagaagccctccttgcca

SEQ ID NO: 251783 - DNA, 13 bp, Homo sapiens
caagaagctgcta

SEQ ID NO: 251784 - DNA, 17 bp, Homo sapiens
caagaaggatgattcaa

SEQ ID NO: 251785 - DNA, 13 bp, Homo sapiens
caagaaggctggg

SEQ ID NO: 251786 - DNA, 21 bp, Homo sapiens
caagaaggggctcgagtgccc

SEQ ID NO: 251787 - DNA, 22 bp, Homo sapiens
caagaagtcagagaaaacactt

SEQ ID NO: 251788 - DNA, 15 bp, Homo sapiens
caagaagtgaggcct

SEQ ID NO: 251789 - DNA, 19 bp, Homo sapiens
caagaagtgaggcctgggg

SEQ ID NO: 251790 - DNA, 14 bp, Homo sapiens
caagaagtgggatt

SEQ ID NO: 251791 - DNA, 16 bp, Homo sapiens
caagaagtttcttcag

SEQ ID NO: 251792 - DNA, 17 bp, Homo sapiens
caagaatattgtatgtt

SEQ ID NO: 251793 - DNA, 13 bp, Homo sapiens
caagacaatgaca

SEQ ID NO: 251794 - DNA, 12 bp, Homo sapiens
caagacacccag

SEQ ID NO: 251795 - DNA, 16 bp, Homo sapiens
caagacagatgcccca

SEQ ID NO: 251796 - DNA, 22 bp, Homo sapiens
caagacagatgccccagagctg

SEQ ID NO: 251797 - DNA, 19 bp, Homo sapiens
caagacagtggcagcaaag

SEQ ID NO: 251798 - DNA, 21 bp, Homo sapiens
caagacagttgtatcacaaag

SEQ ID NO: 251799 - DNA, 14 bp, Homo sapiens
caagacattgtcaa

SEQ ID NO: 251800 - DNA, 18 bp, Homo sapiens
caagacattgtcaataaa

SEQ ID NO: 251801 - DNA, 11 bp, Homo sapiens
caagaccaaaa

SEQ ID NO: 251802 - DNA, 18 bp, Homo sapiens
caagaccaaaatgacaat

SEQ ID NO: 251803 - DNA, 18 bp, Homo sapiens
caagacccccatctctgc

SEQ ID NO: 251804 - DNA, 21 bp, Homo sapiens
caagacccttttgggtttctg

SEQ ID NO: 251805 - DNA, 16 bp, Homo sapiens
caagacggggagtgag

SEQ ID NO: 251806 - DNA, 14 bp, Homo sapiens
caagacgtcctgga

SEQ ID NO: 251807 - DNA, 20 bp, Homo sapiens
caagacgtcctggaatgaag

SEQ ID NO: 251808 - DNA, 22 bp, Homo sapiens
caagacgtcctggaatgaagca

SEQ ID NO: 251809 - DNA, 20 bp, Homo sapiens
caagactaacctttgttcgt

SEQ ID NO: 251810 - DNA, 22 bp, Homo sapiens
caagactgaaatggcttctatg

SEQ ID NO: 251811 - DNA, 13 bp, Homo sapiens
caagactgcctcc

SEQ ID NO: 251812 - DNA, 15 bp, Homo sapiens
caagactgcctccct

SEQ ID NO: 251813 - DNA, 14 bp, Homo sapiens
caagactgttgctc

SEQ ID NO: 251814 - DNA, 16 bp, Homo sapiens
caagactgttgctcaa

SEQ ID NO: 251815 - DNA, 21 bp, Homo sapiens
caagacttcgggaaggtgtct

SEQ ID NO: 251816 - DNA, 17 bp, Homo sapiens
caagacttgaaggtgcc

SEQ ID NO: 251817 - DNA, 15 bp, Homo sapiens
caagacttggcaaca

SEQ ID NO: 251818 - DNA, 20 bp, Homo sapiens
caagacttggcaacagaagc

SEQ ID NO: 251819 - DNA, 18 bp, Homo sapiens
caagacttttctttgaag

SEQ ID NO: 251820 - DNA, 17 bp, Homo sapiens
caagagaaatgaggaag

SEQ ID NO: 251821 - DNA, 18 bp, Homo sapiens
caagagaaatgaggaaga

SEQ ID NO: 251822 - DNA, 14 bp, Homo sapiens
caagagcagagtct

SEQ ID NO: 251823 - DNA, 20 bp, Homo sapiens
caagagcagagtctgggcct

SEQ ID NO: 251824 - DNA, 21 bp, Homo sapiens
caagagcagcctgtggcatct

SEQ ID NO: 251825 - DNA, 22 bp, Homo sapiens
caagagccatgtaccagtgtac

SEQ ID NO: 251826 - DNA, 14 bp, Homo sapiens
caagagctcaggag

SEQ ID NO: 251827 - DNA, 16 bp, Homo sapiens
caagagctcaggagaa

SEQ ID NO: 251828 - DNA, 21 bp, Homo sapiens
caagagctctttgtctcacca

SEQ ID NO: 251829 - DNA, 18 bp, Homo sapiens
caagaggagcaggaagca

SEQ ID NO: 251830 - DNA, 18 bp, Homo sapiens
caagaggctagccccagg

SEQ ID NO: 251831 - DNA, 17 bp, Homo sapiens
caagagggactgtattt

SEQ ID NO: 251832 - DNA, 19 bp, Homo sapiens
caagagggactgtatttct

SEQ ID NO: 251833 - DNA, 20 bp, Homo sapiens
caagagggcactggtggccc

SEQ ID NO: 251834 - DNA, 16 bp, Homo sapiens
caagagtattccattt

SEQ ID NO: 251835 - DNA, 21 bp, Homo sapiens
caagagtgggctttccagggt

SEQ ID NO: 251836 - DNA, 22 bp, Homo sapiens
caagagtttatttccaaataaa

SEQ ID NO: 251837 - DNA, 18 bp, Homo sapiens
caagagttttcttccttg

SEQ ID NO: 251838 - DNA, 15 bp, Homo sapiens
caagatagcatccca

SEQ ID NO: 251839 - DNA, 16 bp, Homo sapiens
caagatatttatatat

SEQ ID NO: 251840 - DNA, 18 bp, Homo sapiens
ccgtaaagtgagcatgct

SEQ ID NO: 251841 - DNA, 17 bp, Homo sapiens
ccgtactctcacatgtg

SEQ ID NO: 251842 - DNA, 21 bp, Homo sapiens
ccgtagccactctctgcccac

SEQ ID NO: 251843 - DNA, 18 bp, Homo sapiens
ccgtagggagtacctgct

SEQ ID NO: 251844 - DNA, 23 bp, Homo sapiens
ccgtatttatttttttattcttc

SEQ ID NO: 251845 - DNA, 20 bp, Homo sapiens
ccgtcacccttggtagagtt

SEQ ID NO: 251846 - DNA, 16 bp, Homo sapiens
ccgtcacgctttcatg

SEQ ID NO: 251847 - DNA, 19 bp, Homo sapiens
ccgtcacgctttcatgacc

SEQ ID NO: 251848 - DNA, 15 bp, Homo sapiens
ccgtcagggtggctg

SEQ ID NO: 251849 - DNA, 13 bp, Homo sapiens
ccgtccacccagg

SEQ ID NO: 251850 - DNA, 19 bp, Homo sapiens
ccgtccacccaggctgcac

SEQ ID NO: 251851 - DNA, 23 bp, Homo sapiens
ccgtccacccaggctgcactgca

SEQ ID NO: 251852 - DNA, 20 bp, Homo sapiens
ccgtccatggcaccagcccc

SEQ ID NO: 251853 - DNA, 14 bp, Homo sapiens
ccgtcccggccccg

SEQ ID NO: 251854 - DNA, 15 bp, Homo sapiens
ccgtcccggccccgc

SEQ ID NO: 251855 - DNA, 22 bp, Homo sapiens
ccgtccctgacttcccagctgg

SEQ ID NO: 251856 - DNA, 16 bp, Homo sapiens
ccgtccctttccctgc

SEQ ID NO: 251857 - DNA, 19 bp, Homo sapiens
ccgtcctcccgggccctcc

SEQ ID NO: 251858 - DNA, 17 bp, Homo sapiens
ccgtcctggcagggcag

SEQ ID NO: 251859 - DNA, 18 bp, Homo sapiens
ccgtcggactgcccccag

SEQ ID NO: 251860 - DNA, 18 bp, Homo sapiens
ccgtctcatatttttaca

SEQ ID NO: 251861 - DNA, 12 bp, Homo sapiens
ccgtctcctccc

SEQ ID NO: 251862 - DNA, 14 bp, Homo sapiens
ccgtctcctccctc

SEQ ID NO: 251863 - DNA, 17 bp, Homo sapiens
ccgtctcctccctcagc

SEQ ID NO: 251864 - DNA, 19 bp, Homo sapiens
ccgtctgactccagagtct

SEQ ID NO: 251865 - DNA, 21 bp, Homo sapiens
ccgtctgccccttgaccccac

SEQ ID NO: 251866 - DNA, 17 bp, Homo sapiens
ccgtctggcgagccctt

SEQ ID NO: 251867 - DNA, 23 bp, Homo sapiens
ccgtcttcaatctctgttctgct

SEQ ID NO: 251868 - DNA, 18 bp, Homo sapiens
ccgtctttggttcctcat

SEQ ID NO: 251869 - DNA, 21 bp, Homo sapiens
ccgtctttggttcctcatggc

SEQ ID NO: 251870 - DNA, 14 bp, Homo sapiens
ccgtgaagcagtgc

SEQ ID NO: 251871 - DNA, 23 bp, Homo sapiens
ccgtgaagcagtgcctcgaggca

SEQ ID NO: 251872 - DNA, 14 bp, Homo sapiens
ccgtgagacacaag

SEQ ID NO: 251873 - DNA, 19 bp, Homo sapiens
ccgtgagcaggaaggcctg

SEQ ID NO: 251874 - DNA, 20 bp, Homo sapiens
ccgtgagcaggaaggcctgg

SEQ ID NO: 251875 - DNA, 22 bp, Homo sapiens
ccgtgagcaggaaggcctgggt

SEQ ID NO: 251876 - DNA, 19 bp, Homo sapiens
ccgtgagcgccccgccccc

SEQ ID NO: 251877 - DNA, 13 bp, Homo sapiens
ccgtgcacggggc

SEQ ID NO: 251878 - DNA, 18 bp, Homo sapiens
ccgtgcacggggccagca

SEQ ID NO: 251879 - DNA, 14 bp, Homo sapiens
ccgtgcagctggga

SEQ ID NO: 251880 - DNA, 22 bp, Homo sapiens
ccgtgccacccgtaggcagcct

SEQ ID NO: 251881 - DNA, 23 bp, Homo sapiens
ccgtgccaggagcaatgggactg

SEQ ID NO: 251882 - DNA, 22 bp, Homo sapiens
ccgtgccggcggcagccccact

SEQ ID NO: 251883 - DNA, 17 bp, Homo sapiens
ccgtgccttcagctcta

SEQ ID NO: 251884 - DNA, 13 bp, Homo sapiens
ccgtgcgcagccg

SEQ ID NO: 251885 - DNA, 19 bp, Homo sapiens
ccgtgcgcagccgcgctct

SEQ ID NO: 251886 - DNA, 15 bp, Homo sapiens
ccgtgcggcccgtgc

SEQ ID NO: 251887 - DNA, 13 bp, Homo sapiens
ccgtggatctggg

SEQ ID NO: 251888 - DNA, 15 bp, Homo sapiens
ccgtggcttcccgct

SEQ ID NO: 251889 - DNA, 21 bp, Homo sapiens
ccgtggcttcccgctcagccc

SEQ ID NO: 251890 - DNA, 16 bp, Homo sapiens
ccgtgggtcatcccag

SEQ ID NO: 251891 - DNA, 14 bp, Homo sapiens
ccgtgtcccaagga

SEQ ID NO: 251892 - DNA, 17 bp, Homo sapiens
ccgtgtccccccaggtg

SEQ ID NO: 251893 - DNA, 21 bp, Homo sapiens
ccgtgtccccttgttctaatg

SEQ ID NO: 251894 - DNA, 13 bp, Homo sapiens
ccgtgtggcccct

SEQ ID NO: 251895 - DNA, 14 bp, Homo sapiens
ccgtgtggcccctt

SEQ ID NO: 251896 - DNA, 11 bp, Homo sapiens
ccgtgttctcc

SEQ ID NO: 251897 - DNA, 20 bp, Homo sapiens
ccgttaggaataacactgca

SEQ ID NO: 251898 - DNA, 19 bp, Homo sapiens
ccgttagggaaatccaact

SEQ ID NO: 251899 - DNA, 23 bp, Homo sapiens
ccgttagggaaatccaactccag

SEQ ID NO: 251900 - DNA, 14 bp, Homo sapiens
ccgttcacttcccc

SEQ ID NO: 251901 - DNA, 12 bp, Homo sapiens
ccgttcatctga

SEQ ID NO: 251902 - DNA, 14 bp, Homo sapiens
ccgttcatctgagg

SEQ ID NO: 251903 - DNA, 15 bp, Homo sapiens
ccgttcatctgagga

SEQ ID NO: 251904 - DNA, 15 bp, Homo sapiens
ccgttccagctgaca

SEQ ID NO: 251905 - DNA, 15 bp, Homo sapiens
caagctcagaataga

SEQ ID NO: 251906 - DNA, 21 bp, Homo sapiens
caagctccatctccactccag

SEQ ID NO: 251907 - DNA, 14 bp, Homo sapiens
caagctgcctccct

SEQ ID NO: 251908 - DNA, 20 bp, Homo sapiens
caagctgcctccctgtccac

SEQ ID NO: 251909 - DNA, 12 bp, Homo sapiens
caagctgcctct

SEQ ID NO: 251910 - DNA, 16 bp, Homo sapiens
caagctgcctctgaca

SEQ ID NO: 251911 - DNA, 23 bp, Homo sapiens
caagctgcctctgacagcagcct

SEQ ID NO: 251912 - DNA, 19 bp, Homo sapiens
caagctgctctccttcact

SEQ ID NO: 251913 - DNA, 18 bp, Homo sapiens
caagctggcaggagggtg

SEQ ID NO: 251914 - DNA, 20 bp, Homo sapiens
caagctgtacccttgagacc

SEQ ID NO: 251915 - DNA, 15 bp, Homo sapiens
caagcttaaggagag

SEQ ID NO: 251916 - DNA, 18 bp, Homo sapiens
caagcttaaggagaggag

SEQ ID NO: 251917 - DNA, 18 bp, Homo sapiens
caagcttaatagccctcc

SEQ ID NO: 251918 - DNA, 19 bp, Homo sapiens
caagcttaatagccctccc

SEQ ID NO: 251919 - DNA, 15 bp, Homo sapiens
caagcttagaagcca

SEQ ID NO: 251920 - DNA, 14 bp, Homo sapiens
caagcttgtcttta

SEQ ID NO: 251921 - DNA, 16 bp, Homo sapiens
caagcttttcctttct

SEQ ID NO: 251922 - DNA, 16 bp, Homo sapiens
caaggaagcagagcac

SEQ ID NO: 251923 - DNA, 16 bp, Homo sapiens
caaggaaggaaacaat

SEQ ID NO: 251924 - DNA, 14 bp, Homo sapiens
caaggaataaatga

SEQ ID NO: 251925 - DNA, 19 bp, Homo sapiens
caaggaatgcctgtgccaa

SEQ ID NO: 251926 - DNA, 17 bp, Homo sapiens
caaggacaacctgcccc

SEQ ID NO: 251927 - DNA, 18 bp, Homo sapiens
caaggacaacctgcccct

SEQ ID NO: 251928 - DNA, 23 bp, Homo sapiens
caaggacaacctgcccctcccca

SEQ ID NO: 251929 - DNA, 12 bp, Homo sapiens
caaggacactga

SEQ ID NO: 251930 - DNA, 14 bp, Homo sapiens
caaggacactgatg

SEQ ID NO: 251931 - DNA, 12 bp, Homo sapiens
caaggacattgc

SEQ ID NO: 251932 - DNA, 13 bp, Homo sapiens
caaggacattgcc

SEQ ID NO: 251933 - DNA, 18 bp, Homo sapiens
caaggacattgccccaag

SEQ ID NO: 251934 - DNA, 15 bp, Homo sapiens
caaggacatttggga

SEQ ID NO: 251935 - DNA, 18 bp, Homo sapiens
caaggaccaggactccct

SEQ ID NO: 251936 - DNA, 20 bp, Homo sapiens
caaggaccaggactccctcc

SEQ ID NO: 251937 - DNA, 20 bp, Homo sapiens
caaggacccctcaccttgca

SEQ ID NO: 251938 - DNA, 20 bp, Homo sapiens
caaggacttgaaagcatcca

SEQ ID NO: 251939 - DNA, 16 bp, Homo sapiens
caaggactttgcagcc

SEQ ID NO: 251940 - DNA, 18 bp, Homo sapiens
caaggagcaaacactgaa

SEQ ID NO: 251941 - DNA, 23 bp, Homo sapiens
caaggagctgatttccaggcccc

SEQ ID NO: 251942 - DNA, 17 bp, Homo sapiens
caaggagggcctctggt

SEQ ID NO: 251943 - DNA, 16 bp, Homo sapiens
caaggaggtcccagga

SEQ ID NO: 251944 - DNA, 16 bp, Homo sapiens
caaggagtgaagtaat

SEQ ID NO: 251945 - DNA, 18 bp, Homo sapiens
caaggagtgcccgccttg

SEQ ID NO: 251946 - DNA, 13 bp, Homo sapiens
caaggatcctctc

SEQ ID NO: 251947 - DNA, 14 bp, Homo sapiens
caaggatgatccag

SEQ ID NO: 251948 - DNA, 23 bp, Homo sapiens
caaggcaaacaatcccaatcttt

SEQ ID NO: 251949 - DNA, 13 bp, Homo sapiens
caaggcaaatgtc

SEQ ID NO: 251950 - DNA, 15 bp, Homo sapiens
caaggcaaatgtcca

SEQ ID NO: 251951 - DNA, 18 bp, Homo sapiens
caaggcaactagtggaga

SEQ ID NO: 251952 - DNA, 16 bp, Homo sapiens
caaggcaagaagtggg

SEQ ID NO: 251953 - DNA, 22 bp, Homo sapiens
caaggcaccgcagcctgtcagc

SEQ ID NO: 251954 - DNA, 13 bp, Homo sapiens
caaggcagcctcc

SEQ ID NO: 251955 - DNA, 15 bp, Homo sapiens
caaggcagcctccag

SEQ ID NO: 251956 - DNA, 21 bp, Homo sapiens
caaggcagcctccagagccag

SEQ ID NO: 251957 - DNA, 16 bp, Homo sapiens
caaggcaggcctttcc

SEQ ID NO: 251958 - DNA, 19 bp, Homo sapiens
caaggcaggcctttcctac

SEQ ID NO: 251959 - DNA, 13 bp, Homo sapiens
caaggcagtgttc

SEQ ID NO: 251960 - DNA, 20 bp, Homo sapiens
caaggccagagtggcctggc

SEQ ID NO: 251961 - DNA, 21 bp, Homo sapiens
caaggccagagtggcctggcc

SEQ ID NO: 251962 - DNA, 16 bp, Homo sapiens
caaggccgcccacctg

SEQ ID NO: 251963 - DNA, 13 bp, Homo sapiens
caaggcctatgcc

SEQ ID NO: 251964 - DNA, 14 bp, Homo sapiens
caaggcctatgcca

SEQ ID NO: 251965 - DNA, 15 bp, Homo sapiens
caaggcctatgccac

SEQ ID NO: 251966 - DNA, 16 bp, Homo sapiens
caaggcctatgccacc

SEQ ID NO: 251967 - DNA, 18 bp, Homo sapiens
caaggcctatgccacctg

SEQ ID NO: 251968 - DNA, 12 bp, Homo sapiens
caaggcctcagg

SEQ ID NO: 251969 - DNA, 17 bp, Homo sapiens
caaggcctcaggagagc

SEQ ID NO: 251970 - DNA, 14 bp, Homo sapiens
caaggcctgtccct

SEQ ID NO: 251971 - DNA, 18 bp, Homo sapiens
caaggcctgtccctggcc

SEQ ID NO: 251972 - DNA, 13 bp, Homo sapiens
caaggcctgtgct

SEQ ID NO: 251973 - DNA, 14 bp, Homo sapiens
caaggccttctcct

SEQ ID NO: 251974 - DNA, 19 bp, Homo sapiens
caaggcgtccgcgcgccag

SEQ ID NO: 251975 - DNA, 16 bp, Homo sapiens
caaggctgaaaagtgc

SEQ ID NO: 251976 - DNA, 17 bp, Homo sapiens
caaggctgcctggagaa

SEQ ID NO: 251977 - DNA, 15 bp, Homo sapiens
caaggctggccagca

SEQ ID NO: 251978 - DNA, 23 bp, Homo sapiens
caaggctgtcaattacaggaagt

SEQ ID NO: 251979 - DNA, 20 bp, Homo sapiens
cctaccccacctcatgcctg

SEQ ID NO: 251980 - DNA, 15 bp, Homo sapiens
cctacccctgtcctg

SEQ ID NO: 251981 - DNA, 15 bp, Homo sapiens
cctaccctcaaagta

SEQ ID NO: 251982 - DNA, 13 bp, Homo sapiens
cctaccctcccac

SEQ ID NO: 251983 - DNA, 16 bp, Homo sapiens
cctaccgagtctcttc

SEQ ID NO: 251984 - DNA, 23 bp, Homo sapiens
cctaccgagtctcttctccactg

SEQ ID NO: 251985 - DNA, 15 bp, Homo sapiens
cctaccgatggtccc

SEQ ID NO: 251986 - DNA, 21 bp, Homo sapiens
cctaccggcaatttccggcca

SEQ ID NO: 251987 - DNA, 22 bp, Homo sapiens
cctacctcaacctgtaaattat

SEQ ID NO: 251988 - DNA, 13 bp, Homo sapiens
cctacctgttcag

SEQ ID NO: 251989 - DNA, 22 bp, Homo sapiens
cctacctgttcagtgtcccggg

SEQ ID NO: 251990 - DNA, 20 bp, Homo sapiens
cctacggagggtgggctctg

SEQ ID NO: 251991 - DNA, 18 bp, Homo sapiens
cctactaacatcccaata

SEQ ID NO: 251992 - DNA, 20 bp, Homo sapiens
cctactacatcgccctccac

SEQ ID NO: 251993 - DNA, 14 bp, Homo sapiens
cctactatgtgctg

SEQ ID NO: 251994 - DNA, 17 bp, Homo sapiens
cctactatgtgctgggt

SEQ ID NO: 251995 - DNA, 16 bp, Homo sapiens
cctactcccctgatcc

SEQ ID NO: 251996 - DNA, 12 bp, Homo sapiens
cctactggctgt

SEQ ID NO: 251997 - DNA, 21 bp, Homo sapiens
cctactgtctccttcccactg

SEQ ID NO: 251998 - DNA, 13 bp, Homo sapiens
cctacttaaacaa

SEQ ID NO: 251999 - DNA, 14 bp, Homo sapiens
cctacttaaacaaa

SEQ ID NO: 252000 - DNA, 16 bp, Homo sapiens
cctacttaaacaaaaa

SEQ ID NO: 252001 - DNA, 18 bp, Homo sapiens
cctacttaaacaaaaact

SEQ ID NO: 252002 - DNA, 20 bp, Homo sapiens
cctacttaaacaaaaacttt

SEQ ID NO: 252003 - DNA, 18 bp, Homo sapiens
cctacttccaagaaaaat

SEQ ID NO: 252004 - DNA, 15 bp, Homo sapiens
cctacttcctgtgac

SEQ ID NO: 252005 - DNA, 18 bp, Homo sapiens
cctacttgtgactgaagg

SEQ ID NO: 252006 - DNA, 19 bp, Homo sapiens
cctagaaagccatattcca

SEQ ID NO: 252007 - DNA, 20 bp, Homo sapiens
cctagaaagccatattccag

SEQ ID NO: 252008 - DNA, 20 bp, Homo sapiens
cctagaccttgcctcccctc

SEQ ID NO: 252009 - DNA, 22 bp, Homo sapiens
cctagaccttgcctcccctcct

SEQ ID NO: 252010 - DNA, 14 bp, Homo sapiens
cctagactgcatcc

SEQ ID NO: 252011 - DNA, 20 bp, Homo sapiens
cctagacttcccaacagcct

SEQ ID NO: 252012 - DNA, 17 bp, Homo sapiens
cctagaggtgggcagct

SEQ ID NO: 252013 - DNA, 18 bp, Homo sapiens
cctagagtagagtggagg

SEQ ID NO: 252014 - DNA, 22 bp, Homo sapiens
cctagagtagagtggagggagg

SEQ ID NO: 252015 - DNA, 18 bp, Homo sapiens
cctagatggttccctttg

SEQ ID NO: 252016 - DNA, 22 bp, Homo sapiens
cctagatgtttaacaaatctaa

SEQ ID NO: 252017 - DNA, 18 bp, Homo sapiens
cctagcaagacctgttgg

SEQ ID NO: 252018 - DNA, 22 bp, Homo sapiens
cctagcacaaggagtgcccgcc

SEQ ID NO: 252019 - DNA, 23 bp, Homo sapiens
cctagcagatatgtattactttt

SEQ ID NO: 252020 - DNA, 15 bp, Homo sapiens
cctagcccaccctgc

SEQ ID NO: 252021 - DNA, 16 bp, Homo sapiens
cctagcccaccctgct

SEQ ID NO: 252022 - DNA, 18 bp, Homo sapiens
cctagcgctctcttccag

SEQ ID NO: 252023 - DNA, 14 bp, Homo sapiens
cctagctgacgcca

SEQ ID NO: 252024 - DNA, 13 bp, Homo sapiens
cctagctgtgtgc

SEQ ID NO: 252025 - DNA, 16 bp, Homo sapiens
cctagcttatctccct

SEQ ID NO: 252026 - DNA, 21 bp, Homo sapiens
cctagcttatctccctgcttc

SEQ ID NO: 252027 - DNA, 22 bp, Homo sapiens
cctagcttatctccctgcttca

SEQ ID NO: 252028 - DNA, 14 bp, Homo sapiens
cctaggagagccaa

SEQ ID NO: 252029 - DNA, 12 bp, Homo sapiens
cctaggagctgg

SEQ ID NO: 252030 - DNA, 22 bp, Homo sapiens
cctaggagttgagtacagtgag

SEQ ID NO: 252031 - DNA, 17 bp, Homo sapiens
cctaggctgaccttgaa

SEQ ID NO: 252032 - DNA, 13 bp, Homo sapiens
cctagggctgggt

SEQ ID NO: 252033 - DNA, 20 bp, Homo sapiens
cctaggggtgcgctcacctg

SEQ ID NO: 252034 - DNA, 20 bp, Homo sapiens
cctagggtcttgggggtcag

SEQ ID NO: 252035 - DNA, 12 bp, Homo sapiens
ccacctgcctga

SEQ ID NO: 252036 - DNA, 15 bp, Homo sapiens
ccacctgcttcacag

SEQ ID NO: 252037 - DNA, 23 bp, Homo sapiens
ccacctgcttgtgttgggcccca

SEQ ID NO: 252038 - DNA, 15 bp, Homo sapiens
ccacctgggagatgc

SEQ ID NO: 252039 - DNA, 18 bp, Homo sapiens
ccacctgggagatgctgg

SEQ ID NO: 252040 - DNA, 20 bp, Homo sapiens
ccacctgggagatgctggga

SEQ ID NO: 252041 - DNA, 12 bp, Homo sapiens
ccacctgggctg

SEQ ID NO: 252042 - DNA, 15 bp, Homo sapiens
ccacctggggcagtc

SEQ ID NO: 252043 - DNA, 16 bp, Homo sapiens
ccacctggggcagtca

SEQ ID NO: 252044 - DNA, 15 bp, Homo sapiens
ccacctggtggcctc

SEQ ID NO: 252045 - DNA, 17 bp, Homo sapiens
ccacctggtggcctctg

SEQ ID NO: 252046 - DNA, 16 bp, Homo sapiens
ccacctgtcccacctc

SEQ ID NO: 252047 - DNA, 17 bp, Homo sapiens
ccacctgtcccacctca

SEQ ID NO: 252048 - DNA, 23 bp, Homo sapiens
ccacctgtctcagcctcccagag

SEQ ID NO: 252049 - DNA, 20 bp, Homo sapiens
ccacctgtgtgttcttttga

SEQ ID NO: 252050 - DNA, 15 bp, Homo sapiens
ccaccttaaattaaa

SEQ ID NO: 252051 - DNA, 16 bp, Homo sapiens
ccaccttaaattaaac

SEQ ID NO: 252052 - DNA, 18 bp, Homo sapiens
ccaccttaaattaaacaa

SEQ ID NO: 252053 - DNA, 22 bp, Homo sapiens
ccaccttaccctactggctgta

SEQ ID NO: 252054 - DNA, 14 bp, Homo sapiens
ccaccttcctgact

SEQ ID NO: 252055 - DNA, 16 bp, Homo sapiens
ccaccttcctgactgg

SEQ ID NO: 252056 - DNA, 23 bp, Homo sapiens
ccaccttgtacagaaccagcact

SEQ ID NO: 252057 - DNA, 19 bp, Homo sapiens
ccacctttgggatcagcct

SEQ ID NO: 252058 - DNA, 16 bp, Homo sapiens
ccacgaacgctcttag

SEQ ID NO: 252059 - DNA, 22 bp, Homo sapiens
ccacgaggtggtagctctgagc

SEQ ID NO: 252060 - DNA, 23 bp, Homo sapiens
ccacgaggtggtagctctgagcc

SEQ ID NO: 252061 - DNA, 18 bp, Homo sapiens
ccacgagtcacctgcaag

SEQ ID NO: 252062 - DNA, 19 bp, Homo sapiens
atgagtttttgatagcttt

SEQ ID NO: 252063 - DNA, 21 bp, Homo sapiens
atgagtttttgatagctttat

SEQ ID NO: 252064 - DNA, 15 bp, Homo sapiens
atgataaaaaagtgt

SEQ ID NO: 252065 - DNA, 14 bp, Homo sapiens
atgataaaaggaag

SEQ ID NO: 252066 - DNA, 19 bp, Homo sapiens
atgataaaaggaagtagat

SEQ ID NO: 252067 - DNA, 14 bp, Homo sapiens
atgataaaataagt

SEQ ID NO: 252068 - DNA, 14 bp, Homo sapiens
atgataaagatgtc

SEQ ID NO: 252069 - DNA, 18 bp, Homo sapiens
atgataaagatgtcaaat

SEQ ID NO: 252070 - DNA, 17 bp, Homo sapiens
atgataatacccacatt

SEQ ID NO: 252071 - DNA, 15 bp, Homo sapiens
atgatacagtcagga

SEQ ID NO: 252072 - DNA, 21 bp, Homo sapiens
atgatagacttcgaaaacaga

SEQ ID NO: 252073 - DNA, 22 bp, Homo sapiens
atgatagacttcgaaaacagat

SEQ ID NO: 252074 - DNA, 16 bp, Homo sapiens
atgataggcagcactg

SEQ ID NO: 252075 - DNA, 14 bp, Homo sapiens
atgatatatatgta

SEQ ID NO: 252076 - DNA, 21 bp, Homo sapiens
atgatatatatgtataatttc

SEQ ID NO: 252077 - DNA, 12 bp, Homo sapiens
atgatatgcatg

SEQ ID NO: 252078 - DNA, 18 bp, Homo sapiens
atgatatgcatgtagcat

SEQ ID NO: 252079 - DNA, 20 bp, Homo sapiens
atgatattctcattatttca

SEQ ID NO: 252080 - DNA, 18 bp, Homo sapiens
atgatattgtatgtacct

SEQ ID NO: 252081 - DNA, 19 bp, Homo sapiens
atgatcaaaacctgtgcca

SEQ ID NO: 252082 - DNA, 14 bp, Homo sapiens
atgatctactcaga

SEQ ID NO: 252083 - DNA, 15 bp, Homo sapiens
atgatctactcagaa

SEQ ID NO: 252084 - DNA, 16 bp, Homo sapiens
atgatctactcagaaa

SEQ ID NO: 252085 - DNA, 15 bp, Homo sapiens
atgatctaggtttaa

SEQ ID NO: 252086 - DNA, 17 bp, Homo sapiens
atgatctaggtttaact

SEQ ID NO: 252087 - DNA, 21 bp, Homo sapiens
atgatctaggtttaactcaga

SEQ ID NO: 252088 - DNA, 13 bp, Homo sapiens
atgatctgtcaaa

SEQ ID NO: 252089 - DNA, 13 bp, Homo sapiens
atgatctgtggag

SEQ ID NO: 252090 - DNA, 23 bp, Homo sapiens
atgatctgtggagaatgtacaca

SEQ ID NO: 252091 - DNA, 14 bp, Homo sapiens
atgatcttctttat

SEQ ID NO: 252092 - DNA, 18 bp, Homo sapiens
atgatgaaaaggttgcct

SEQ ID NO: 252093 - DNA, 22 bp, Homo sapiens
atgatgacgacgacaacgatga

SEQ ID NO: 252094 - DNA, 15 bp, Homo sapiens
atgatgatgggaatt

SEQ ID NO: 252095 - DNA, 22 bp, Homo sapiens
atgatgattaaacacctgacac

SEQ ID NO: 252096 - DNA, 22 bp, Homo sapiens
atgatggaagggccttctccac

SEQ ID NO: 252097 - DNA, 15 bp, Homo sapiens
atgatggagacttca

SEQ ID NO: 252098 - DNA, 14 bp, Homo sapiens
atgatgtccagaag

SEQ ID NO: 252099 - DNA, 19 bp, Homo sapiens
atgatgtgatggaacacac

SEQ ID NO: 252100 - DNA, 21 bp, Homo sapiens
atgatgtgatggaacacacac

SEQ ID NO: 252101 - DNA, 15 bp, Homo sapiens
atgatgtgttgtgat

SEQ ID NO: 252102 - DNA, 23 bp, Homo sapiens
atgattaaccccttctttcatgt

SEQ ID NO: 252103 - DNA, 13 bp, Homo sapiens
atgattagacaat

SEQ ID NO: 252104 - DNA, 19 bp, Homo sapiens
atgattagacaatgtggaa

SEQ ID NO: 252105 - DNA, 21 bp, Homo sapiens
atgattcacttttattgtata

SEQ ID NO: 252106 - DNA, 11 bp, Homo sapiens
atgattccaaa

SEQ ID NO: 252107 - DNA, 12 bp, Homo sapiens
atgattccaaat

SEQ ID NO: 252108 - DNA, 13 bp, Homo sapiens
atgattccttcct

SEQ ID NO: 252109 - DNA, 15 bp, Homo sapiens
atgattccttcctgt

SEQ ID NO: 252110 - DNA, 15 bp, Homo sapiens
atgattctcctctcc

SEQ ID NO: 252111 - DNA, 17 bp, Homo sapiens
atgattctcctctccca

SEQ ID NO: 252112 - DNA, 20 bp, Homo sapiens
atgattctttgttacaggca

SEQ ID NO: 252113 - DNA, 14 bp, Homo sapiens
atgattggattatt

SEQ ID NO: 252114 - DNA, 15 bp, Homo sapiens
atgattggattattc

SEQ ID NO: 252115 - DNA, 22 bp, Homo sapiens
atgattggattattcatttaaa

SEQ ID NO: 252116 - DNA, 15 bp, Homo sapiens
atgattgtaaaatag

SEQ ID NO: 252117 - DNA, 14 bp, Homo sapiens
atgattgtaacata

SEQ ID NO: 252118 - DNA, 13 bp, Homo sapiens
atgatttaacatt

SEQ ID NO: 252119 - DNA, 14 bp, Homo sapiens
atgatttatagttt

SEQ ID NO: 252120 - DNA, 20 bp, Homo sapiens
atgatttatagtttgtacat

SEQ ID NO: 252121 - DNA, 16 bp, Homo sapiens
atgatttcaatgattg

SEQ ID NO: 252122 - DNA, 13 bp, Homo sapiens
atgatttcagaaa

SEQ ID NO: 252123 - DNA, 18 bp, Homo sapiens
atgatttctagcaggcag

SEQ ID NO: 252124 - DNA, 15 bp, Homo sapiens
atgattttggccact

SEQ ID NO: 252125 - DNA, 22 bp, Homo sapiens
atgatttttaagtacaaaaaag

SEQ ID NO: 252126 - DNA, 11 bp, Homo sapiens
atgatttttag

SEQ ID NO: 252127 - DNA, 13 bp, Homo sapiens
atgcaaaatttgt

SEQ ID NO: 252128 - DNA, 14 bp, Homo sapiens
atgcaaacagttct

SEQ ID NO: 252129 - DNA, 15 bp, Homo sapiens
atgcaactccatgcc

SEQ ID NO: 252130 - DNA, 18 bp, Homo sapiens
atgcaactccatgcctat

SEQ ID NO: 252131 - DNA, 22 bp, Homo sapiens
atgcaactccatgcctatttac

SEQ ID NO: 252132 - DNA, 15 bp, Homo sapiens
atgcaaggaccagga

SEQ ID NO: 252133 - DNA, 22 bp, Homo sapiens
atgcaaggaccaggactccctc

SEQ ID NO: 252134 - DNA, 21 bp, Homo sapiens
atgcaaggcactgtactaggc

SEQ ID NO: 252135 - DNA, 18 bp, Homo sapiens
atgcaagggactgtgtgt

SEQ ID NO: 252136 - DNA, 23 bp, Homo sapiens
atgcaagtcactaaatttctcag

SEQ ID NO: 252137 - DNA, 20 bp, Homo sapiens
atgcaagtgggagatgaaaa

SEQ ID NO: 252138 - DNA, 16 bp, Homo sapiens
atgcaatgtcttaaat

SEQ ID NO: 252139 - DNA, 23 bp, Homo sapiens
atgcaatgtcttaaataaaacta

SEQ ID NO: 252140 - DNA, 20 bp, Homo sapiens
atgcaatttgttattctttt

SEQ ID NO: 252141 - DNA, 17 bp, Homo sapiens
atgcacaactctccaaa

SEQ ID NO: 252142 - DNA, 20 bp, Homo sapiens
atgcacacaaacacctccta

SEQ ID NO: 252143 - DNA, 17 bp, Homo sapiens
atgcacaccaaattgct

SEQ ID NO: 252144 - DNA, 22 bp, Homo sapiens
atgcacaccaaattgctgagat

SEQ ID NO: 252145 - DNA, 17 bp, Homo sapiens
atgcacacccattcaca

SEQ ID NO: 252146 - DNA, 14 bp, Homo sapiens
atgcacagctaaca

SEQ ID NO: 252147 - DNA, 21 bp, Homo sapiens
atgcacagctaacatggaagt

SEQ ID NO: 252148 - DNA, 11 bp, Homo sapiens
atgcaccaaac

SEQ ID NO: 252149 - DNA, 19 bp, Homo sapiens
atgcaccaagtacagcctt

SEQ ID NO: 252150 - DNA, 15 bp, Homo sapiens
atgcacccctggaac

SEQ ID NO: 252151 - DNA, 16 bp, Homo sapiens
atgcacctataaatac

SEQ ID NO: 252152 - DNA, 20 bp, Homo sapiens
atgcacggtttctgttctgc

SEQ ID NO: 252153 - DNA, 16 bp, Homo sapiens
atgcactactgaaatt

SEQ ID NO: 252154 - DNA, 18 bp, Homo sapiens
atgcactcgcactgcaaa

SEQ ID NO: 252155 - DNA, 18 bp, Homo sapiens
atgcactggcctgttctg

SEQ ID NO: 252156 - DNA, 23 bp, Homo sapiens
atgcactggcctgttctgtagga

SEQ ID NO: 252157 - DNA, 19 bp, Homo sapiens
atgcacttattttttaatg

SEQ ID NO: 252158 - DNA, 22 bp, Homo sapiens
atgcactttaaatggaataatt

SEQ ID NO: 252159 - DNA, 16 bp, Homo sapiens
atgcactttccctaga

SEQ ID NO: 252160 - DNA, 12 bp, Homo sapiens
atgcagacacac

SEQ ID NO: 252161 - DNA, 13 bp, Homo sapiens
atgcagacacaca

SEQ ID NO: 252162 - DNA, 16 bp, Homo sapiens
atgcagacatttacat

SEQ ID NO: 252163 - DNA, 17 bp, Homo sapiens
atgcagatagaatcaat

SEQ ID NO: 252164 - DNA, 16 bp, Homo sapiens
atgcagatctagccag

SEQ ID NO: 252165 - DNA, 12 bp, Homo sapiens
ccactgcaaaca

SEQ ID NO: 252166 - DNA, 17 bp, Homo sapiens
ccactgcagtcacccct

SEQ ID NO: 252167 - DNA, 22 bp, Homo sapiens
ccactgcagtcacccctgtctg

SEQ ID NO: 252168 - DNA, 23 bp, Homo sapiens
ccactgcagtcacccctgtctgc

SEQ ID NO: 252169 - DNA, 11 bp, Homo sapiens
ccactgcatcc

SEQ ID NO: 252170 - DNA, 21 bp, Homo sapiens
ccactgccaggattttgtatt

SEQ ID NO: 252171 - DNA, 12 bp, Homo sapiens
ccactgccaggc

SEQ ID NO: 252172 - DNA, 15 bp, Homo sapiens
ccactgccaggcacc

SEQ ID NO: 252173 - DNA, 21 bp, Homo sapiens
ccactgccaggcacctggcct

SEQ ID NO: 252174 - DNA, 17 bp, Homo sapiens
ccactgcccgagctggt

SEQ ID NO: 252175 - DNA, 22 bp, Homo sapiens
ccactgcccgagctggtgcatt

SEQ ID NO: 252176 - DNA, 16 bp, Homo sapiens
ccactgccctctccac

SEQ ID NO: 252177 - DNA, 17 bp, Homo sapiens
ccactgccctctccaca

SEQ ID NO: 252178 - DNA, 20 bp, Homo sapiens
ccactgccctctccacaccc

SEQ ID NO: 252179 - DNA, 13 bp, Homo sapiens
ccactgccctctg

SEQ ID NO: 252180 - DNA, 15 bp, Homo sapiens
ccactgccctgcctg

SEQ ID NO: 252181 - DNA, 16 bp, Homo sapiens
ccactgcctgcccacc

SEQ ID NO: 252182 - DNA, 23 bp, Homo sapiens
ccactgcctgcccacccgtggag

SEQ ID NO: 252183 - DNA, 15 bp, Homo sapiens
ccactgctaataaat

SEQ ID NO: 252184 - DNA, 19 bp, Homo sapiens
ccactgctaataaatgacc

SEQ ID NO: 252185 - DNA, 21 bp, Homo sapiens
ccactgctaataaatgaccag

SEQ ID NO: 252186 - DNA, 23 bp, Homo sapiens
ccactgctaataaatgaccagtt

SEQ ID NO: 252187 - DNA, 11 bp, Homo sapiens
ccactggacca

SEQ ID NO: 252188 - DNA, 22 bp, Homo sapiens
ccactggcatagccctcctgag

SEQ ID NO: 252189 - DNA, 13 bp, Homo sapiens
ccactggcatctc

SEQ ID NO: 252190 - DNA, 15 bp, Homo sapiens
ccactggcatctctg

SEQ ID NO: 252191 - DNA, 18 bp, Homo sapiens
ccactggccagctctggc

SEQ ID NO: 252192 - DNA, 18 bp, Homo sapiens
ccactggctgtgcctccc

SEQ ID NO: 252193 - DNA, 14 bp, Homo sapiens
ccactgggcctgct

SEQ ID NO: 252194 - DNA, 16 bp, Homo sapiens
ccactgggtctcactc

SEQ ID NO: 252195 - DNA, 20 bp, Homo sapiens
ccactgggtctcactcctga

SEQ ID NO: 252196 - DNA, 19 bp, Homo sapiens
ccactgtcactgtttctct

SEQ ID NO: 252197 - DNA, 23 bp, Homo sapiens
ccactgtcactgtttctctgctg

SEQ ID NO: 252198 - DNA, 20 bp, Homo sapiens
ccactgtccccctacccacc

SEQ ID NO: 252199 - DNA, 24 bp, Homo sapiens
atgcatgtgattggcagcttcaaa

SEQ ID NO: 252200 - DNA, 19 bp, Homo sapiens
atgcattagattatcaaaa

SEQ ID NO: 252201 - DNA, 15 bp, Homo sapiens
atgcattgaaagaat

SEQ ID NO: 252202 - DNA, 16 bp, Homo sapiens
atgcattgttgaggtg

SEQ ID NO: 252203 - DNA, 12 bp, Homo sapiens
atgcatttatgc

SEQ ID NO: 252204 - DNA, 19 bp, Homo sapiens
atgcatttatgcatgagaa

SEQ ID NO: 252205 - DNA, 20 bp, Homo sapiens
atgcatttatgcatgagaac

SEQ ID NO: 252206 - DNA, 23 bp, Homo sapiens
atgcatttgaggtcaagtaagaa

SEQ ID NO: 252207 - DNA, 20 bp, Homo sapiens
atgcattttctacatgtatt

SEQ ID NO: 252208 - DNA, 19 bp, Homo sapiens
atgcattttgcagcagtga

SEQ ID NO: 252209 - DNA, 18 bp, Homo sapiens
atgccaaaaaagatgcca

SEQ ID NO: 252210 - DNA, 22 bp, Homo sapiens
atgccaaagctagggtggccct

SEQ ID NO: 252211 - DNA, 15 bp, Homo sapiens
atgccaacaccttct

SEQ ID NO: 252212 - DNA, 16 bp, Homo sapiens
atgccaaggagcccct

SEQ ID NO: 252213 - DNA, 16 bp, Homo sapiens
atgccacacagagtgg

SEQ ID NO: 252214 - DNA, 19 bp, Homo sapiens
atgccacagccaagcccac

SEQ ID NO: 252215 - DNA, 21 bp, Homo sapiens
atgccacagccaagcccaccc

SEQ ID NO: 252216 - DNA, 15 bp, Homo sapiens
atgccaccctcacac

SEQ ID NO: 252217 - DNA, 14 bp, Homo sapiens
atgccacctgcagc

SEQ ID NO: 252218 - DNA, 22 bp, Homo sapiens
atgccactgccaggcacctggc

SEQ ID NO: 252219 - DNA, 18 bp, Homo sapiens
atgccaggacagctgcag

SEQ ID NO: 252220 - DNA, 23 bp, Homo sapiens
atgccaggacagctgcaggtgcc

SEQ ID NO: 252221 - DNA, 20 bp, Homo sapiens
atgccagtccagatgtgcct

SEQ ID NO: 252222 - DNA, 13 bp, Homo sapiens
atgccatgatatc

SEQ ID NO: 252223 - DNA, 13 bp, Homo sapiens
atgccatttgtct

SEQ ID NO: 252224 - DNA, 15 bp, Homo sapiens
atgccatttgtcttt

SEQ ID NO: 252225 - DNA, 15 bp, Homo sapiens
atgcccacctgccca

SEQ ID NO: 252226 - DNA, 16 bp, Homo sapiens
atgcccacctgcccat

SEQ ID NO: 252227 - DNA, 16 bp, Homo sapiens
atgcccagctcagagg

SEQ ID NO: 252228 - DNA, 23 bp, Homo sapiens
atgccccacccacccctcctggg

SEQ ID NO: 252229 - DNA, 15 bp, Homo sapiens
atgccccagagctgt

SEQ ID NO: 252230 - DNA, 19 bp, Homo sapiens
atgccccctttcagatgtc

SEQ ID NO: 252231 - DNA, 21 bp, Homo sapiens
atgccccctttcagatgtctt

SEQ ID NO: 252232 - DNA, 14 bp, Homo sapiens
atgcccctccccag

SEQ ID NO: 252233 - DNA, 18 bp, Homo sapiens
atgcccctctgcctgggc

SEQ ID NO: 252234 - DNA, 20 bp, Homo sapiens
atgcccctgtactccagcct

SEQ ID NO: 252235 - DNA, 19 bp, Homo sapiens
atgccccttcttgggcccc

SEQ ID NO: 252236 - DNA, 22 bp, Homo sapiens
atgccccttcttgggccccaga

SEQ ID NO: 252237 - DNA, 23 bp, Homo sapiens
atgccccttcttgggccccagac

SEQ ID NO: 252238 - DNA, 16 bp, Homo sapiens
atgccccttggctgga

SEQ ID NO: 252239 - DNA, 23 bp, Homo sapiens
atgcccgctgtcccaggggtctc

SEQ ID NO: 252240 - DNA, 13 bp, Homo sapiens
atgccctgccatt

SEQ ID NO: 252241 - DNA, 21 bp, Homo sapiens
atgccctgccttgtccctctc

SEQ ID NO: 252242 - DNA, 19 bp, Homo sapiens
atgccctttggaaagccat

SEQ ID NO: 252243 - DNA, 19 bp, Homo sapiens
atgccgcgggcggccaggc

SEQ ID NO: 252244 - DNA, 13 bp, Homo sapiens
atgcctacagata

SEQ ID NO: 252245 - DNA, 16 bp, Homo sapiens
atgcctacagataatt

SEQ ID NO: 252246 - DNA, 15 bp, Homo sapiens
atgcctatttactgg

SEQ ID NO: 252247 - DNA, 16 bp, Homo sapiens
atgcctcatcctccca

SEQ ID NO: 252248 - DNA, 23 bp, Homo sapiens
atgcctcccggctttgcagggag

SEQ ID NO: 252249 - DNA, 23 bp, Homo sapiens
atgcctcctctgtcctcattctt

SEQ ID NO: 252250 - DNA, 14 bp, Homo sapiens
atgcctctgccttg

SEQ ID NO: 252251 - DNA, 15 bp, Homo sapiens
atgcctcttctacct

SEQ ID NO: 252252 - DNA, 16 bp, Homo sapiens
atgcctcttctacctc

SEQ ID NO: 252253 - DNA, 21 bp, Homo sapiens
atgcctcttctacctcttcca

SEQ ID NO: 252254 - DNA, 22 bp, Homo sapiens
atgcctcttctacctcttccag

SEQ ID NO: 252255 - DNA, 15 bp, Homo sapiens
atgcctgaacttgaa

SEQ ID NO: 252256 - DNA, 19 bp, Homo sapiens
atgcctgaccccttgctcc

SEQ ID NO: 252257 - DNA, 14 bp, Homo sapiens
atgcctgagggtgg

SEQ ID NO: 252258 - DNA, 17 bp, Homo sapiens
atgcctgagggtggaga

SEQ ID NO: 252259 - DNA, 16 bp, Homo sapiens
atgcctgcggagttgt

SEQ ID NO: 252260 - DNA, 19 bp, Homo sapiens
atgcctggcccccctccag

SEQ ID NO: 252261 - DNA, 12 bp, Homo sapiens
atgcctgtattt

SEQ ID NO: 252262 - DNA, 16 bp, Homo sapiens
atgcctgtatttccaa

SEQ ID NO: 252263 - DNA, 20 bp, Homo sapiens
atgcctgtatttccaacaaa

SEQ ID NO: 252264 - DNA, 21 bp, Homo sapiens
atgcctgtctctgttcagatg

SEQ ID NO: 252265 - DNA, 14 bp, Homo sapiens
atgcctgtggtgaa

SEQ ID NO: 252266 - DNA, 21 bp, Homo sapiens
atgccttcataaattatttct

SEQ ID NO: 252267 - DNA, 22 bp, Homo sapiens
atgccttcataaattatttcta

SEQ ID NO: 252268 - DNA, 13 bp, Homo sapiens
atgcctttctagt

SEQ ID NO: 252269 - DNA, 12 bp, Homo sapiens
atgcctttgtaa

SEQ ID NO: 252270 - DNA, 13 bp, Homo sapiens
atgccttttgggt

SEQ ID NO: 252271 - DNA, 15 bp, Homo sapiens
atgcgaatgagctgg

SEQ ID NO: 252272 - DNA, 22 bp, Homo sapiens
atgcgaatgagctgggccctgg

SEQ ID NO: 252273 - DNA, 20 bp, Homo sapiens
atgcgccctggtatgtgcct

SEQ ID NO: 252274 - DNA, 14 bp, Homo sapiens
atgcggcccagcca

SEQ ID NO: 252275 - DNA, 13 bp, Homo sapiens
atgcggccggcct

SEQ ID NO: 252276 - DNA, 17 bp, Homo sapiens
atgcgggctgggcagct

SEQ ID NO: 252277 - DNA, 16 bp, Homo sapiens
atgctaacaaactgaa

SEQ ID NO: 252278 - DNA, 13 bp, Homo sapiens
atgctaataaact

SEQ ID NO: 252279 - DNA, 23 bp, Homo sapiens
atgctaatgtaatcatttatctt

SEQ ID NO: 252280 - DNA, 16 bp, Homo sapiens
atgctacaaaatgtgt

SEQ ID NO: 252281 - DNA, 13 bp, Homo sapiens
atgctacctctga

SEQ ID NO: 252282 - DNA, 16 bp, Homo sapiens
atgctactgtcagtgt

SEQ ID NO: 252283 - DNA, 12 bp, Homo sapiens
atgctactttta

SEQ ID NO: 252284 - DNA, 18 bp, Homo sapiens
atgctacttttacttgtt

SEQ ID NO: 252285 - DNA, 16 bp, Homo sapiens
atgctagcacaatatt

SEQ ID NO: 252286 - DNA, 22 bp, Homo sapiens
atgctatactgtgtcatggtga

SEQ ID NO: 252287 - DNA, 17 bp, Homo sapiens
atgctatggtcaggtta

SEQ ID NO: 252288 - DNA, 18 bp, Homo sapiens
atgctattgttgtgggct

SEQ ID NO: 252289 - DNA, 19 bp, Homo sapiens
atgctattgttgtgggctt

SEQ ID NO: 252290 - DNA, 19 bp, Homo sapiens
atgctcaacccccctccca

SEQ ID NO: 252291 - DNA, 14 bp, Homo sapiens
atgctcaatgtgct

SEQ ID NO: 252292 - DNA, 21 bp, Homo sapiens
atgctcaatgtgctgttgatt

SEQ ID NO: 252293 - DNA, 17 bp, Homo sapiens
atgctcactgcttctgc

SEQ ID NO: 252294 - DNA, 14 bp, Homo sapiens
atgctcagtattga

SEQ ID NO: 252295 - DNA, 23 bp, Homo sapiens
ccagacgcacgtgggtcttcagg

SEQ ID NO: 252296 - DNA, 15 bp, Homo sapiens
ccagacggcacccac

SEQ ID NO: 252297 - DNA, 17 bp, Homo sapiens
ccagactcaggttccag

SEQ ID NO: 252298 - DNA, 19 bp, Homo sapiens
ccagactcaggttccagaa

SEQ ID NO: 252299 - DNA, 22 bp, Homo sapiens
ccagactcgagagggctgagcc

SEQ ID NO: 252300 - DNA, 23 bp, Homo sapiens
ccagactcgagagggctgagccc

SEQ ID NO: 252301 - DNA, 23 bp, Homo sapiens
ccagactggctgcacagcccaac

SEQ ID NO: 252302 - DNA, 17 bp, Homo sapiens
ccagactgtaagatgtt

SEQ ID NO: 252303 - DNA, 20 bp, Homo sapiens
ccagacttcgctattcccag

SEQ ID NO: 252304 - DNA, 20 bp, Homo sapiens
ccagactttctacacctgtt

SEQ ID NO: 252305 - DNA, 16 bp, Homo sapiens
ccagagaacaatcact

SEQ ID NO: 252306 - DNA, 20 bp, Homo sapiens
ccagagaagcctcagtccct

SEQ ID NO: 252307 - DNA, 22 bp, Homo sapiens
ccagagaagcctcagtccctcc

SEQ ID NO: 252308 - DNA, 21 bp, Homo sapiens
ccagagacatgggcctcccac

SEQ ID NO: 252309 - DNA, 16 bp, Homo sapiens
ccagagaccacaccac

SEQ ID NO: 252310 - DNA, 15 bp, Homo sapiens
ccagagactgcccac

SEQ ID NO: 252311 - DNA, 16 bp, Homo sapiens
ccagagagaccctgcc

SEQ ID NO: 252312 - DNA, 21 bp, Homo sapiens
ccagagagcctggtgctgctg

SEQ ID NO: 252313 - DNA, 14 bp, Homo sapiens
ccagagaggagcac

SEQ ID NO: 252314 - DNA, 14 bp, Homo sapiens
ccagagagggccca

SEQ ID NO: 252315 - DNA, 15 bp, Homo sapiens
ccagagagggcccag

SEQ ID NO: 252316 - DNA, 14 bp, Homo sapiens
ccagagagtggctc

SEQ ID NO: 252317 - DNA, 16 bp, Homo sapiens
ccagagagtggctcct

SEQ ID NO: 252318 - DNA, 22 bp, Homo sapiens
ccagagagtggctcctcccggt

SEQ ID NO: 252319 - DNA, 22 bp, Homo sapiens
ccagagatggaggttctctcgg

SEQ ID NO: 252320 - DNA, 23 bp, Homo sapiens
ccagagatgggactgggagggcc

SEQ ID NO: 252321 - DNA, 15 bp, Homo sapiens
ccagagcaggagact

SEQ ID NO: 252322 - DNA, 21 bp, Homo sapiens
ccagagcaggaggcccctggc

SEQ ID NO: 252323 - DNA, 13 bp, Homo sapiens
ccagagccactac

SEQ ID NO: 252324 - DNA, 17 bp, Homo sapiens
ccagagccactaccttt

SEQ ID NO: 252325 - DNA, 20 bp, Homo sapiens
ccagagccactacctttgtc

SEQ ID NO: 252326 - DNA, 14 bp, Homo sapiens
ccagagccagggct

SEQ ID NO: 252327 - DNA, 15 bp, Homo sapiens
ccagagccagggctg

SEQ ID NO: 252328 - DNA, 19 bp, Homo sapiens
ccagagccagggctgtcct

SEQ ID NO: 252329 - DNA, 21 bp, Homo sapiens
ccagagccatggactctacac

SEQ ID NO: 252330 - DNA, 15 bp, Homo sapiens
ccagagccccactcc

SEQ ID NO: 252331 - DNA, 16 bp, Homo sapiens
ccagagccccccacaa

SEQ ID NO: 252332 - DNA, 18 bp, Homo sapiens
ccagagcccttcactgcc

SEQ ID NO: 252333 - DNA, 22 bp, Homo sapiens
ccagagcccttcactgccatga

SEQ ID NO: 252334 - DNA, 12 bp, Homo sapiens
ccagagcctggt

SEQ ID NO: 252335 - DNA, 13 bp, Homo sapiens
ccagagctcccag

SEQ ID NO: 252336 - DNA, 19 bp, Homo sapiens
ccagagctcccaggacgca

SEQ ID NO: 252337 - DNA, 11 bp, Homo sapiens
ccagagctccg

SEQ ID NO: 252338 - DNA, 22 bp, Homo sapiens
ccagagctctggagccacctgt

SEQ ID NO: 252339 - DNA, 13 bp, Homo sapiens
ccagagctggaag

SEQ ID NO: 252340 - DNA, 15 bp, Homo sapiens
ccagagctggaaggc

SEQ ID NO: 252341 - DNA, 18 bp, Homo sapiens
ccagagctggaaggcagg

SEQ ID NO: 252342 - DNA, 21 bp, Homo sapiens
ccagagctgggtgagtgggga

SEQ ID NO: 252343 - DNA, 23 bp, Homo sapiens
ccagagctgtctgaactcacgtg

SEQ ID NO: 252344 - DNA, 19 bp, Homo sapiens
ccagagctgtttatggcct

SEQ ID NO: 252345 - DNA, 21 bp, Homo sapiens
ccagagctgtttatggcctca

SEQ ID NO: 252346 - DNA, 21 bp, Homo sapiens
ccagaggagctgggagccggg

SEQ ID NO: 252347 - DNA, 20 bp, Homo sapiens
ccagaggaggggacttgtag

SEQ ID NO: 252348 - DNA, 13 bp, Homo sapiens
ccagaggcacagc

SEQ ID NO: 252349 - DNA, 14 bp, Homo sapiens
ccagaggcacagcc

SEQ ID NO: 252350 - DNA, 17 bp, Homo sapiens
ccagaggcacagccggg

SEQ ID NO: 252351 - DNA, 17 bp, Homo sapiens
ccagaggcagaaccctg

SEQ ID NO: 252352 - DNA, 23 bp, Homo sapiens
ccagaggcagctaaggggcagga

SEQ ID NO: 252353 - DNA, 10 bp, Homo sapiens
ccagaggctc

SEQ ID NO: 252354 - DNA, 12 bp, Homo sapiens
ccagaggctccc

SEQ ID NO: 252355 - DNA, 16 bp, Homo sapiens
ccagaggctcccaatc

SEQ ID NO: 252356 - DNA, 18 bp, Homo sapiens
ccagaggctcccaatcag

SEQ ID NO: 252357 - DNA, 22 bp, Homo sapiens
ccagaggctcccaatcagcttt

SEQ ID NO: 252358 - DNA, 14 bp, Homo sapiens
ccagaggctcctgg

SEQ ID NO: 252359 - DNA, 19 bp, Homo sapiens
ccagaggctcctggagcca

SEQ ID NO: 252360 - DNA, 13 bp, Homo sapiens
ccagaggctgagt

SEQ ID NO: 252361 - DNA, 16 bp, Homo sapiens
ccagaggtgagggagg

SEQ ID NO: 252362 - DNA, 19 bp, Homo sapiens
ccagaggtgagggaggcct

SEQ ID NO: 252363 - DNA, 14 bp, Homo sapiens
ccagaggtgggagg

SEQ ID NO: 252364 - DNA, 21 bp, Homo sapiens
ccagaggtgggatcctccctc

SEQ ID NO: 252365 - DNA, 15 bp, Homo sapiens
ccagaggtggggaag

SEQ ID NO: 252366 - DNA, 21 bp, Homo sapiens
ccagaggtggggaagagagcc

SEQ ID NO: 252367 - DNA, 22 bp, Homo sapiens
ccagaggtggggaagagagcct

SEQ ID NO: 252368 - DNA, 19 bp, Homo sapiens
ccagaggttatctgcctgg

SEQ ID NO: 252369 - DNA, 23 bp, Homo sapiens
ccagaggttatctgcctggcctg

SEQ ID NO: 252370 - DNA, 24 bp, Homo sapiens
ccagagtagggttgccagtcctgc

SEQ ID NO: 252371 - DNA, 18 bp, Homo sapiens
ccagagtaggtgggtctt

SEQ ID NO: 252372 - DNA, 13 bp, Homo sapiens
ccagagtctgagc

SEQ ID NO: 252373 - DNA, 18 bp, Homo sapiens
ccagagtctgagcccccg

SEQ ID NO: 252374 - DNA, 23 bp, Homo sapiens
ccagagtgactgacggctgtgta

SEQ ID NO: 252375 - DNA, 14 bp, Homo sapiens
ccagagtggcctgg

SEQ ID NO: 252376 - DNA, 18 bp, Homo sapiens
ccagagtggcctggccag

SEQ ID NO: 252377 - DNA, 21 bp, Homo sapiens
ccagagtggcctggccaggag

SEQ ID NO: 252378 - DNA, 15 bp, Homo sapiens
ccagatagagctggg

SEQ ID NO: 252379 - DNA, 16 bp, Homo sapiens
ccagatagtcccagca

SEQ ID NO: 252380 - DNA, 18 bp, Homo sapiens
ccagatcaccagcccggc

SEQ ID NO: 252381 - DNA, 17 bp, Homo sapiens
ccagatccagactgtaa

SEQ ID NO: 252382 - DNA, 15 bp, Homo sapiens
ccagatcgttctgcc

SEQ ID NO: 252383 - DNA, 14 bp, Homo sapiens
ccagatctgcctgg

SEQ ID NO: 252384 - DNA, 15 bp, Homo sapiens
ccagatctgcctggg

SEQ ID NO: 252385 - DNA, 16 bp, Homo sapiens
ccagatctgcctgggc

SEQ ID NO: 252386 - DNA, 17 bp, Homo sapiens
ccagatctgcctgggcc

SEQ ID NO: 252387 - DNA, 19 bp, Homo sapiens
ccagatctgcctgggcctg

SEQ ID NO: 252388 - DNA, 24 bp, Homo sapiens
ccagatctgcctgggcctgtgcag

SEQ ID NO: 252389 - DNA, 20 bp, Homo sapiens
ccagatgacacataaatctg

SEQ ID NO: 252390 - DNA, 23 bp, Homo sapiens
ccagatgacagggagctggggaa

SEQ ID NO: 252391 - DNA, 22 bp, Homo sapiens
ccagatgatctcttaggaagcc

SEQ ID NO: 252392 - DNA, 19 bp, Homo sapiens
ccagatgttgttcctggct

SEQ ID NO: 252393 - DNA, 11 bp, Homo sapiens
ccagattacaa

SEQ ID NO: 252394 - DNA, 14 bp, Homo sapiens
ccagattgggggcc

SEQ ID NO: 252395 - DNA, 16 bp, Homo sapiens
ccagattgggggccct

SEQ ID NO: 252396 - DNA, 21 bp, Homo sapiens
ccagattgggggccctggggt

SEQ ID NO: 252397 - DNA, 10 bp, Homo sapiens
ccagcaaaag

SEQ ID NO: 252398 - DNA, 14 bp, Homo sapiens
ccagcaaaatatat

SEQ ID NO: 252399 - DNA, 19 bp, Homo sapiens
ccagcaaaccaggactctg

SEQ ID NO: 252400 - DNA, 20 bp, Homo sapiens
ccagcaacatctcgagcccc

SEQ ID NO: 252401 - DNA, 23 bp, Homo sapiens
ccagcaacatctcgagccccctg

SEQ ID NO: 252402 - DNA, 15 bp, Homo sapiens
ccagcaaccctccta

SEQ ID NO: 252403 - DNA, 21 bp, Homo sapiens
ccagcaacttgtctttttctg

SEQ ID NO: 252404 - DNA, 19 bp, Homo sapiens
ccagcaagaataaaaaaga

SEQ ID NO: 252405 - DNA, 21 bp, Homo sapiens
ccagcaagaataaaaaagaaa

SEQ ID NO: 252406 - DNA, 16 bp, Homo sapiens
ccagcaaggcacaggc

SEQ ID NO: 252407 - DNA, 13 bp, Homo sapiens
ccagcaaggcagg

SEQ ID NO: 252408 - DNA, 18 bp, Homo sapiens
ccagcacagactgttccc

SEQ ID NO: 252409 - DNA, 14 bp, Homo sapiens
ccagcacagagcgt

SEQ ID NO: 252410 - DNA, 23 bp, Homo sapiens
ccagcacatgcggcttccgaggg

SEQ ID NO: 252411 - DNA, 14 bp, Homo sapiens
ccagcacatttcct

SEQ ID NO: 252412 - DNA, 17 bp, Homo sapiens
ccagcaccatctctcct

SEQ ID NO: 252413 - DNA, 13 bp, Homo sapiens
ccagcacctgcca

SEQ ID NO: 252414 - DNA, 18 bp, Homo sapiens
ccagcacctgccagggcc

SEQ ID NO: 252415 - DNA, 15 bp, Homo sapiens
ccagcacctttgtaa

SEQ ID NO: 252416 - DNA, 16 bp, Homo sapiens
ccagcactcccagggc

SEQ ID NO: 252417 - DNA, 17 bp, Homo sapiens
ccagcactcccagggcc

SEQ ID NO: 252418 - DNA, 21 bp, Homo sapiens
ccagcactcccagggcccgag

SEQ ID NO: 252419 - DNA, 22 bp, Homo sapiens
ccagcactcccagggcccgagc

SEQ ID NO: 252420 - DNA, 11 bp, Homo sapiens
ccagcactttg

SEQ ID NO: 252421 - DNA, 19 bp, Homo sapiens
ccagcagagccgttcctgg

SEQ ID NO: 252422 - DNA, 21 bp, Homo sapiens
ccagcagcacaattctgtccc

SEQ ID NO: 252423 - DNA, 23 bp, Homo sapiens
ccagcagcacaattctgtccctg

SEQ ID NO: 252424 - DNA, 21 bp, Homo sapiens
atggcaccttcagactttgct

SEQ ID NO: 252425 - DNA, 17 bp, Homo sapiens
atggcaccttcattctc

SEQ ID NO: 252426 - DNA, 19 bp, Homo sapiens
atggcaccttcattctccg

SEQ ID NO: 252427 - DNA, 22 bp, Homo sapiens
atggcacttagctatcagaaga

SEQ ID NO: 252428 - DNA, 20 bp, Homo sapiens
atggcatggtaggctacttt

SEQ ID NO: 252429 - DNA, 15 bp, Homo sapiens
atggccaagagcatc

SEQ ID NO: 252430 - DNA, 22 bp, Homo sapiens
atggccaaggggccagctgccc

SEQ ID NO: 252431 - DNA, 22 bp, Homo sapiens
atggccaggtggccactccaga

SEQ ID NO: 252432 - DNA, 16 bp, Homo sapiens
atggccataggagagg

SEQ ID NO: 252433 - DNA, 19 bp, Homo sapiens
atggcccagcagcttggct

SEQ ID NO: 252434 - DNA, 18 bp, Homo sapiens
atggcccagcctggagcc

SEQ ID NO: 252435 - DNA, 13 bp, Homo sapiens
atggcccagcctt

SEQ ID NO: 252436 - DNA, 12 bp, Homo sapiens
atggccccagct

SEQ ID NO: 252437 - DNA, 17 bp, Homo sapiens
atggcccctccaggaac

SEQ ID NO: 252438 - DNA, 14 bp, Homo sapiens
atggcccttcctgg

SEQ ID NO: 252439 - DNA, 21 bp, Homo sapiens
atggccgatggggcccacatt

SEQ ID NO: 252440 - DNA, 16 bp, Homo sapiens
atggccgggccctctg

SEQ ID NO: 252441 - DNA, 15 bp, Homo sapiens
atggccgggctgctg

SEQ ID NO: 252442 - DNA, 20 bp, Homo sapiens
atggccgggctgctgctgat

SEQ ID NO: 252443 - DNA, 20 bp, Homo sapiens
atggcctattatattaaaat

SEQ ID NO: 252444 - DNA, 21 bp, Homo sapiens
atggcctattatattaaaata

SEQ ID NO: 252445 - DNA, 16 bp, Homo sapiens
atggcctcagctgcct

SEQ ID NO: 252446 - DNA, 14 bp, Homo sapiens
atggcctcccagcc

SEQ ID NO: 252447 - DNA, 19 bp, Homo sapiens
atggcctctaagagtgccc

SEQ ID NO: 252448 - DNA, 19 bp, Homo sapiens
atggcctgtgctgggccag

SEQ ID NO: 252449 - DNA, 14 bp, Homo sapiens
atggccttccctcc

SEQ ID NO: 252450 - DNA, 20 bp, Homo sapiens
atggcgcacccggcagcccc

SEQ ID NO: 252451 - DNA, 16 bp, Homo sapiens
atggcgcagtgcctct

SEQ ID NO: 252452 - DNA, 17 bp, Homo sapiens
atggcgcagtgcctctg

SEQ ID NO: 252453 - DNA, 15 bp, Homo sapiens
atggcgcgggaggca

SEQ ID NO: 252454 - DNA, 17 bp, Homo sapiens
atggcgcgggaggcacc

SEQ ID NO: 252455 - DNA, 21 bp, Homo sapiens
atggcgtaatgggcctgccca

SEQ ID NO: 252456 - DNA, 15 bp, Homo sapiens
atggcgtgtcccctg

SEQ ID NO: 252457 - DNA, 20 bp, Homo sapiens
atggctaagatactgctgat

SEQ ID NO: 252458 - DNA, 21 bp, Homo sapiens
atggctaagcttaaaaaaaac

SEQ ID NO: 252459 - DNA, 14 bp, Homo sapiens
atggctataaatat

SEQ ID NO: 252460 - DNA, 22 bp, Homo sapiens
atggctcaggcaagcccctcag

SEQ ID NO: 252461 - DNA, 20 bp, Homo sapiens
atggctccagtctgctgccc

SEQ ID NO: 252462 - DNA, 22 bp, Homo sapiens
atggctccagtctgctgccctc

SEQ ID NO: 252463 - DNA, 23 bp, Homo sapiens
atggctcccctttttcttcctca

SEQ ID NO: 252464 - DNA, 20 bp, Homo sapiens
atggctcgtgggctctggct

SEQ ID NO: 252465 - DNA, 22 bp, Homo sapiens
atggctcgtgggctctggctcc

SEQ ID NO: 252466 - DNA, 19 bp, Homo sapiens
atggctctaacattactgc

SEQ ID NO: 252467 - DNA, 13 bp, Homo sapiens
atggctctggcta

SEQ ID NO: 252468 - DNA, 22 bp, Homo sapiens
atggctgaaggaaaccagtgca

SEQ ID NO: 252469 - DNA, 19 bp, Homo sapiens
atggctgtatttttagaga

SEQ ID NO: 252470 - DNA, 19 bp, Homo sapiens
atggctgtgaaaattacac

SEQ ID NO: 252471 - DNA, 16 bp, Homo sapiens
atggctgtgcctctgc

SEQ ID NO: 252472 - DNA, 17 bp, Homo sapiens
atggctgtgcctctgcc

SEQ ID NO: 252473 - DNA, 18 bp, Homo sapiens
atggctgtgcctctgcct

SEQ ID NO: 252474 - DNA, 19 bp, Homo sapiens
atggctgtgcctctgcctg

SEQ ID NO: 252475 - DNA, 20 bp, Homo sapiens
atggctgtgcctctgcctgt

SEQ ID NO: 252476 - DNA, 23 bp, Homo sapiens
ccagcttctggtactctcctaga

SEQ ID NO: 252477 - DNA, 18 bp, Homo sapiens
ccagcttgggcccagctg

SEQ ID NO: 252478 - DNA, 22 bp, Homo sapiens
ccagcttgggcccagctgggct

SEQ ID NO: 252479 - DNA, 21 bp, Homo sapiens
ccagcttggtggttatgtccc

SEQ ID NO: 252480 - DNA, 15 bp, Homo sapiens
ccagcttgttattta

SEQ ID NO: 252481 - DNA, 21 bp, Homo sapiens
ccagctttaagggttgtgagc

SEQ ID NO: 252482 - DNA, 17 bp, Homo sapiens
ccagcttttactgtttt

SEQ ID NO: 252483 - DNA, 18 bp, Homo sapiens
ccagcttttcctcccttg

SEQ ID NO: 252484 - DNA, 16 bp, Homo sapiens
ccagcttttcttgcca

SEQ ID NO: 252485 - DNA, 17 bp, Homo sapiens
ccagcttttcttgccag

SEQ ID NO: 252486 - DNA, 21 bp, Homo sapiens
ccagcttttcttgccagctca

SEQ ID NO: 252487 - DNA, 23 bp, Homo sapiens
ccagcttttcttgccagctcagc

SEQ ID NO: 252488 - DNA, 17 bp, Homo sapiens
ccaggaaaaacctgtgg

SEQ ID NO: 252489 - DNA, 18 bp, Homo sapiens
ccaggaaaaacctgtggg

SEQ ID NO: 252490 - DNA, 23 bp, Homo sapiens
ccaggaaactctgcattctagta

SEQ ID NO: 252491 - DNA, 20 bp, Homo sapiens
ccaggaagaaggcccgggag

SEQ ID NO: 252492 - DNA, 22 bp, Homo sapiens
ccaggaagaatggtgtgtttcc

SEQ ID NO: 252493 - DNA, 14 bp, Homo sapiens
ccaggaagcacagg

SEQ ID NO: 252494 - DNA, 17 bp, Homo sapiens
ccaggaagcacaggcca

SEQ ID NO: 252495 - DNA, 14 bp, Homo sapiens
ccaggaagcaggga

SEQ ID NO: 252496 - DNA, 20 bp, Homo sapiens
ccaggaagcagggagagttg

SEQ ID NO: 252497 - DNA, 23 bp, Homo sapiens
ccaggaagccccgctcaggtagc

SEQ ID NO: 252498 - DNA, 13 bp, Homo sapiens
ccaggaaggcagc

SEQ ID NO: 252499 - DNA, 16 bp, Homo sapiens
ccaggaaggcagctgc

SEQ ID NO: 252500 - DNA, 20 bp, Homo sapiens
ccaggaagggaaagcgggca

SEQ ID NO: 252501 - DNA, 14 bp, Homo sapiens
ccaggaagggtcaa

SEQ ID NO: 252502 - DNA, 19 bp, Homo sapiens
ccaggaagtccagctcctt

SEQ ID NO: 252503 - DNA, 20 bp, Homo sapiens
ccaggaatgtttcagctgca

SEQ ID NO: 252504 - DNA, 18 bp, Homo sapiens
ccaggacaccgggcaggg

SEQ ID NO: 252505 - DNA, 12 bp, Homo sapiens
ccaggacagctg

SEQ ID NO: 252506 - DNA, 13 bp, Homo sapiens
ccaggacaggaaa

SEQ ID NO: 252507 - DNA, 21 bp, Homo sapiens
ccaggaccaagcttaaggaga

SEQ ID NO: 252508 - DNA, 22 bp, Homo sapiens
ccaggaccaagcttaaggagag

SEQ ID NO: 252509 - DNA, 18 bp, Homo sapiens
ccaggacctggagacagg

SEQ ID NO: 252510 - DNA, 21 bp, Homo sapiens
ccaggacgcagggagaccctg

SEQ ID NO: 252511 - DNA, 18 bp, Homo sapiens
ccaggacgcttctgaatg

SEQ ID NO: 252512 - DNA, 20 bp, Homo sapiens
ccaggacgcttctgaatgct

SEQ ID NO: 252513 - DNA, 19 bp, Homo sapiens
ccaggacgtctggggtgtg

SEQ ID NO: 252514 - DNA, 14 bp, Homo sapiens
ccaggactccctcc

SEQ ID NO: 252515 - DNA, 20 bp, Homo sapiens
ccaggactctctttcttcca

SEQ ID NO: 252516 - DNA, 18 bp, Homo sapiens
ccaggactctgccttcca

SEQ ID NO: 252517 - DNA, 18 bp, Homo sapiens
ccaggacttggggtcagg

SEQ ID NO: 252518 - DNA, 19 bp, Homo sapiens
ccaggacttggggtcagga

SEQ ID NO: 252519 - DNA, 21 bp, Homo sapiens
ccaggagaggagcgggacctg

SEQ ID NO: 252520 - DNA, 19 bp, Homo sapiens
ccaggagcaatgggactgg

SEQ ID NO: 252521 - DNA, 16 bp, Homo sapiens
ccaggagcagcctcca

SEQ ID NO: 252522 - DNA, 19 bp, Homo sapiens
ccaggagcattttgtgtct

SEQ ID NO: 252523 - DNA, 19 bp, Homo sapiens
ccaggagcctcctgaccct

SEQ ID NO: 252524 - DNA, 12 bp, Homo sapiens
ccaggagctagc

SEQ ID NO: 252525 - DNA, 21 bp, Homo sapiens
ccaggagctagcccagtccct

SEQ ID NO: 252526 - DNA, 17 bp, Homo sapiens
ccaggagctcaggtggg

SEQ ID NO: 252527 - DNA, 13 bp, Homo sapiens
ccaggagctcttc

SEQ ID NO: 252528 - DNA, 21 bp, Homo sapiens
ccaggagctcttcaggcctcc

SEQ ID NO: 252529 - DNA, 14 bp, Homo sapiens
ccaggaggactgcc

SEQ ID NO: 252530 - DNA, 14 bp, Homo sapiens
ccaggaggcggcag

SEQ ID NO: 252531 - DNA, 15 bp, Homo sapiens
ccaggaggcggcagc

SEQ ID NO: 252532 - DNA, 22 bp, Homo sapiens
ccaggaggcggcagctcttctg

SEQ ID NO: 252533 - DNA, 20 bp, Homo sapiens
ccaggaggctggcagtacag

SEQ ID NO: 252534 - DNA, 21 bp, Homo sapiens
ccaggaggctttaagctccag

SEQ ID NO: 252535 - DNA, 17 bp, Homo sapiens
ccaggagggcatcagct

SEQ ID NO: 252536 - DNA, 22 bp, Homo sapiens
ccaggagggcatcagctttccc

SEQ ID NO: 252537 - DNA, 17 bp, Homo sapiens
ccaggaggggcctctga

SEQ ID NO: 252538 - DNA, 14 bp, Homo sapiens
ccaggaggggtctg

SEQ ID NO: 252539 - DNA, 18 bp, Homo sapiens
ccaggaggtcgaccccaa

SEQ ID NO: 252540 - DNA, 22 bp, Homo sapiens
ccaggaggtggctatggccacc

SEQ ID NO: 252541 - DNA, 18 bp, Homo sapiens
ccaggagtctgtgctctt

SEQ ID NO: 252542 - DNA, 18 bp, Homo sapiens
ccaggagtgggtgggaca

SEQ ID NO: 252543 - DNA, 21 bp, Homo sapiens
ccaggagtgtggccacgtggg

SEQ ID NO: 252544 - DNA, 17 bp, Homo sapiens
ccaggagtttgagacaa

SEQ ID NO: 252545 - DNA, 22 bp, Homo sapiens
ccaggagtttgagacaagccct

SEQ ID NO: 252546 - DNA, 21 bp, Homo sapiens
ccaggataaggagactgaggc

SEQ ID NO: 252547 - DNA, 18 bp, Homo sapiens
ccaggatatttctgagag

SEQ ID NO: 252548 - DNA, 18 bp, Homo sapiens
ccaggatcccctgctact

SEQ ID NO: 252549 - DNA, 14 bp, Homo sapiens
ccaggatcctcctg

SEQ ID NO: 252550 - DNA, 14 bp, Homo sapiens
ccaggatcctgcag

SEQ ID NO: 252551 - DNA, 18 bp, Homo sapiens
ccaggatcctgcaggaac

SEQ ID NO: 252552 - DNA, 22 bp, Homo sapiens
ccaggatggaggggtggtcctg

SEQ ID NO: 252553 - DNA, 11 bp, Homo sapiens
ccaggatggcg

SEQ ID NO: 252554 - DNA, 16 bp, Homo sapiens
ccaggattcaaccctg

SEQ ID NO: 252555 - DNA, 20 bp, Homo sapiens
ccaggattgtacgtgggaga

SEQ ID NO: 252556 - DNA, 16 bp, Homo sapiens
ccaggattgtccacaa

SEQ ID NO: 252557 - DNA, 20 bp, Homo sapiens
ccaggattgtccacaaatgt

SEQ ID NO: 252558 - DNA, 15 bp, Homo sapiens
ccaggattttgtatt

SEQ ID NO: 252559 - DNA, 19 bp, Homo sapiens
ccaggattttgtattgcca

SEQ ID NO: 252560 - DNA, 21 bp, Homo sapiens
ccaggcaacttcagtcctggg

SEQ ID NO: 252561 - DNA, 13 bp, Homo sapiens
ccaggcaatggcc

SEQ ID NO: 252562 - DNA, 19 bp, Homo sapiens
ccaggcaatggcctaaact

SEQ ID NO: 252563 - DNA, 14 bp, Homo sapiens
ccaggcacctggcc

SEQ ID NO: 252564 - DNA, 16 bp, Homo sapiens
ccaggcacctggcctg

SEQ ID NO: 252565 - DNA, 21 bp, Homo sapiens
ccaggcacctggcctgctggg

SEQ ID NO: 252566 - DNA, 18 bp, Homo sapiens
ccaggcactgctgcccag

SEQ ID NO: 252567 - DNA, 18 bp, Homo sapiens
ccaggcagaaaactggca

SEQ ID NO: 252568 - DNA, 20 bp, Homo sapiens
ccaggcagaaaactggcagt

SEQ ID NO: 252569 - DNA, 13 bp, Homo sapiens
ccaggcagagaca

SEQ ID NO: 252570 - DNA, 20 bp, Homo sapiens
ccaggcagatctgtgcccca

SEQ ID NO: 252571 - DNA, 18 bp, Homo sapiens
ccaggcagcacctggagc

SEQ ID NO: 252572 - DNA, 20 bp, Homo sapiens
ccaggcaggacgagactcct

SEQ ID NO: 252573 - DNA, 17 bp, Homo sapiens
ccaggcaggccctgcct

SEQ ID NO: 252574 - DNA, 18 bp, Homo sapiens
ccaggcaggccctgcctt

SEQ ID NO: 252575 - DNA, 14 bp, Homo sapiens
ccaggcaggctgtg

SEQ ID NO: 252576 - DNA, 15 bp, Homo sapiens
ccaggcagggaggga

SEQ ID NO: 252577 - DNA, 20 bp, Homo sapiens
ccaggcagggagtgtctgca

SEQ ID NO: 252578 - DNA, 15 bp, Homo sapiens
ccaggcatgaccctg

SEQ ID NO: 252579 - DNA, 21 bp, Homo sapiens
ccaggcatgaccctggagccc

SEQ ID NO: 252580 - DNA, 12 bp, Homo sapiens
ccaggcatgctg

SEQ ID NO: 252581 - DNA, 20 bp, Homo sapiens
ccaggcatggcccagcctgg

SEQ ID NO: 252582 - DNA, 23 bp, Homo sapiens
ccaggcatggcccagcctggagc

SEQ ID NO: 252583 - DNA, 12 bp, Homo sapiens
ccaggccaccca

SEQ ID NO: 252584 - DNA, 15 bp, Homo sapiens
ccaggccacccactg

SEQ ID NO: 252585 - DNA, 18 bp, Homo sapiens
ccaggccactgtggccag

SEQ ID NO: 252586 - DNA, 20 bp, Homo sapiens
ccaggccactgtggccagag

SEQ ID NO: 252587 - DNA, 22 bp, Homo sapiens
ccaggccactgtggccagagct

SEQ ID NO: 252588 - DNA, 18 bp, Homo sapiens
ccaggccataccaggtgc

SEQ ID NO: 252589 - DNA, 22 bp, Homo sapiens
ccaggccatccggcccccagag

SEQ ID NO: 252590 - DNA, 22 bp, Homo sapiens
ccaggccatggccaaggggcca

SEQ ID NO: 252591 - DNA, 13 bp, Homo sapiens
ccaggcccagcct

SEQ ID NO: 252592 - DNA, 16 bp, Homo sapiens
ccaggcccagcctggc

SEQ ID NO: 252593 - DNA, 17 bp, Homo sapiens
ccaggcccagcctggcc

SEQ ID NO: 252594 - DNA, 19 bp, Homo sapiens
ccaggcccagcctggcccc

SEQ ID NO: 252595 - DNA, 15 bp, Homo sapiens
ccaggccccagcctc

SEQ ID NO: 252596 - DNA, 15 bp, Homo sapiens
ccaggcccccaactc

SEQ ID NO: 252597 - DNA, 20 bp, Homo sapiens
ccaggccccgctcattcttt

SEQ ID NO: 252598 - DNA, 14 bp, Homo sapiens
ccaggcccctgagg

SEQ ID NO: 252599 - DNA, 18 bp, Homo sapiens
ccaggcccctgaggactg

SEQ ID NO: 252600 - DNA, 21 bp, Homo sapiens
ccaggccctaggattcctccc

SEQ ID NO: 252601 - DNA, 13 bp, Homo sapiens
ccaggccctcaga

SEQ ID NO: 252602 - DNA, 14 bp, Homo sapiens
ccaggccctccatg

SEQ ID NO: 252603 - DNA, 16 bp, Homo sapiens
ccaggccctccatggg

SEQ ID NO: 252604 - DNA, 18 bp, Homo sapiens
ccaggccctccatgggct

SEQ ID NO: 252605 - DNA, 19 bp, Homo sapiens
ccaggccctccatgggcta

SEQ ID NO: 252606 - DNA, 17 bp, Homo sapiens
ccaggccctcctgctgg

SEQ ID NO: 252607 - DNA, 15 bp, Homo sapiens
ccaggccgcatggcc

SEQ ID NO: 252608 - DNA, 16 bp, Homo sapiens
ccaggccgccccagcc

SEQ ID NO: 252609 - DNA, 23 bp, Homo sapiens
atggcttaaaaatacttaataaa

SEQ ID NO: 252610 - DNA, 19 bp, Homo sapiens
atggcttccgtgagacaca

SEQ ID NO: 252611 - DNA, 18 bp, Homo sapiens
atggcttgacatgtgcaa

SEQ ID NO: 252612 - DNA, 17 bp, Homo sapiens
atggctttcatcctgtg

SEQ ID NO: 252613 - DNA, 20 bp, Homo sapiens
atggctttcatcctgtgtcc

SEQ ID NO: 252614 - DNA, 18 bp, Homo sapiens
atgggaaacttccaagac

SEQ ID NO: 252615 - DNA, 14 bp, Homo sapiens
atgggaaagtgcaa

SEQ ID NO: 252616 - DNA, 22 bp, Homo sapiens
atgggaacaagtgtacagaaga

SEQ ID NO: 252617 - DNA, 12 bp, Homo sapiens
atgggaagccat

SEQ ID NO: 252618 - DNA, 22 bp, Homo sapiens
atgggaagccatattcacacct

SEQ ID NO: 252619 - DNA, 15 bp, Homo sapiens
atgggactgatgtca

SEQ ID NO: 252620 - DNA, 19 bp, Homo sapiens
atgggactggagtcagatg

SEQ ID NO: 252621 - DNA, 20 bp, Homo sapiens
atgggactggagtcagatga

SEQ ID NO: 252622 - DNA, 15 bp, Homo sapiens
atgggagagtagatg

SEQ ID NO: 252623 - DNA, 18 bp, Homo sapiens
atgggaggaacaaagaca

SEQ ID NO: 252624 - DNA, 23 bp, Homo sapiens
atgggaggtggccaggcctgcca

SEQ ID NO: 252625 - DNA, 18 bp, Homo sapiens
atgggagtaagagcaaat

SEQ ID NO: 252626 - DNA, 15 bp, Homo sapiens
atgggagtgggcacc

SEQ ID NO: 252627 - DNA, 19 bp, Homo sapiens
atgggagtgggcacctcag

SEQ ID NO: 252628 - DNA, 20 bp, Homo sapiens
atgggagtgggcacctcaga

SEQ ID NO: 252629 - DNA, 13 bp, Homo sapiens
atgggatttcatg

SEQ ID NO: 252630 - DNA, 13 bp, Homo sapiens
atgggcacaggct

SEQ ID NO: 252631 - DNA, 21 bp, Homo sapiens
atgggcacaggctgccccacc

SEQ ID NO: 252632 - DNA, 15 bp, Homo sapiens
atgggcacctcatgg

SEQ ID NO: 252633 - DNA, 23 bp, Homo sapiens
atgggcatggggtgggcctctgg

SEQ ID NO: 252634 - DNA, 15 bp, Homo sapiens
atgggcattgggctg

SEQ ID NO: 252635 - DNA, 16 bp, Homo sapiens
atgggcattgggctga

SEQ ID NO: 252636 - DNA, 17 bp, Homo sapiens
atgggccacccaccagg

SEQ ID NO: 252637 - DNA, 20 bp, Homo sapiens
atgggccacccaccagggct

SEQ ID NO: 252638 - DNA, 15 bp, Homo sapiens
atgggccctctgagc

SEQ ID NO: 252639 - DNA, 18 bp, Homo sapiens
atgggcctgggcctgctt

SEQ ID NO: 252640 - DNA, 15 bp, Homo sapiens
atgggccttgctttg

SEQ ID NO: 252641 - DNA, 22 bp, Homo sapiens
atgggccttgctttgggctttg

SEQ ID NO: 252642 - DNA, 23 bp, Homo sapiens
atgggctagtgtgagtggcagcc

SEQ ID NO: 252643 - DNA, 13 bp, Homo sapiens
atgggcttggact

SEQ ID NO: 252644 - DNA, 18 bp, Homo sapiens
atgggcttggacttcctg

SEQ ID NO: 252645 - DNA, 19 bp, Homo sapiens
atgggcttggacttcctgg

SEQ ID NO: 252646 - DNA, 23 bp, Homo sapiens
atgggcttggacttcctggggcc

SEQ ID NO: 252647 - DNA, 12 bp, Homo sapiens
atggggccacag

SEQ ID NO: 252648 - DNA, 17 bp, Homo sapiens
atggggccacagccaga

SEQ ID NO: 252649 - DNA, 14 bp, Homo sapiens
atggggcccacatt

SEQ ID NO: 252650 - DNA, 12 bp, Homo sapiens
atggggcctctg

SEQ ID NO: 252651 - DNA, 13 bp, Homo sapiens
atggggcttttaa

SEQ ID NO: 252652 - DNA, 14 bp, Homo sapiens
atgggggaggctct

SEQ ID NO: 252653 - DNA, 16 bp, Homo sapiens
atggggtgggcctctg

SEQ ID NO: 252654 - DNA, 13 bp, Homo sapiens
atggggttgggct

SEQ ID NO: 252655 - DNA, 21 bp, Homo sapiens
atggggtttgggcccctcaga

SEQ ID NO: 252656 - DNA, 15 bp, Homo sapiens
atgggtaacactgat

SEQ ID NO: 252657 - DNA, 15 bp, Homo sapiens
atgggtattaaactt

SEQ ID NO: 252658 - DNA, 22 bp, Homo sapiens
atgggtattaaacttgtcagaa

SEQ ID NO: 252659 - DNA, 13 bp, Homo sapiens
atgggtcacagga

SEQ ID NO: 252660 - DNA, 22 bp, Homo sapiens
atgggtgaagggagagccagct

SEQ ID NO: 252661 - DNA, 15 bp, Homo sapiens
atgggttatgtgtat

SEQ ID NO: 252662 - DNA, 16 bp, Homo sapiens
atgggttggtgcttct

SEQ ID NO: 252663 - DNA, 21 bp, Homo sapiens
atgggttttgttaggggtggg

SEQ ID NO: 252664 - DNA, 16 bp, Homo sapiens
atggtaatataacaat

SEQ ID NO: 252665 - DNA, 16 bp, Homo sapiens
atggtactaaggagaa

SEQ ID NO: 252666 - DNA, 19 bp, Homo sapiens
atggtactagggggaagtg

SEQ ID NO: 252667 - DNA, 21 bp, Homo sapiens
atggtagacaatttgccttag

SEQ ID NO: 252668 - DNA, 15 bp, Homo sapiens
atggtagactgtgac

SEQ ID NO: 252669 - DNA, 19 bp, Homo sapiens
atggtaggctacttttcag

SEQ ID NO: 252670 - DNA, 17 bp, Homo sapiens
atggtatatattttgaa

SEQ ID NO: 252671 - DNA, 20 bp, Homo sapiens
atggtatgcagcatacaaaa

SEQ ID NO: 252672 - DNA, 15 bp, Homo sapiens
atggtatttgagaca

SEQ ID NO: 252673 - DNA, 16 bp, Homo sapiens
atggtatttgagacat

SEQ ID NO: 252674 - DNA, 20 bp, Homo sapiens
atggtattttcgtgcatttg

SEQ ID NO: 252675 - DNA, 21 bp, Homo sapiens
atggtattttcgtgcatttgt

SEQ ID NO: 252676 - DNA, 13 bp, Homo sapiens
atggtcagctccc

SEQ ID NO: 252677 - DNA, 18 bp, Homo sapiens
atggtcagtgtgcaaaga

SEQ ID NO: 252678 - DNA, 14 bp, Homo sapiens
atggtcatattatt

SEQ ID NO: 252679 - DNA, 11 bp, Homo sapiens
atggtcccagg

SEQ ID NO: 252680 - DNA, 17 bp, Homo sapiens
atggtcccaggaagcag

SEQ ID NO: 252681 - DNA, 19 bp, Homo sapiens
atggtctccatatcagctc

SEQ ID NO: 252682 - DNA, 21 bp, Homo sapiens
atgtattttcaataaagaaaa

SEQ ID NO: 252683 - DNA, 18 bp, Homo sapiens
atgtattttgaaaacact

SEQ ID NO: 252684 - DNA, 23 bp, Homo sapiens
atgtcaaagtgaaagacatttca

SEQ ID NO: 252685 - DNA, 23 bp, Homo sapiens
atgtcaaccttgtgtgagtgtga

SEQ ID NO: 252686 - DNA, 21 bp, Homo sapiens
atgtcaaggtgctgttgtcat

SEQ ID NO: 252687 - DNA, 21 bp, Homo sapiens
atgtcaatgctatggactgca

SEQ ID NO: 252688 - DNA, 22 bp, Homo sapiens
atgtcaatgctatggactgcac

SEQ ID NO: 252689 - DNA, 22 bp, Homo sapiens
atgtcacaacctctctgatctt

SEQ ID NO: 252690 - DNA, 16 bp, Homo sapiens
atgtcactaaagcagg

SEQ ID NO: 252691 - DNA, 15 bp, Homo sapiens
atgtcagcagctctg

SEQ ID NO: 252692 - DNA, 23 bp, Homo sapiens
atgtcagccgagccgggcctggg

SEQ ID NO: 252693 - DNA, 13 bp, Homo sapiens
atgtcagccttgc

SEQ ID NO: 252694 - DNA, 14 bp, Homo sapiens
atgtcagccttgca

SEQ ID NO: 252695 - DNA, 21 bp, Homo sapiens
atgtcagtagtgcctgtgatc

SEQ ID NO: 252696 - DNA, 12 bp, Homo sapiens
atgtcagtgtga

SEQ ID NO: 252697 - DNA, 16 bp, Homo sapiens
atgtcagtgtgactga

SEQ ID NO: 252698 - DNA, 15 bp, Homo sapiens
atgtcatcttgagct

SEQ ID NO: 252699 - DNA, 17 bp, Homo sapiens
atgtcattatgtagaaa

SEQ ID NO: 252700 - DNA, 12 bp, Homo sapiens
atgtcatttcta

SEQ ID NO: 252701 - DNA, 12 bp, Homo sapiens
atgtcatttctc

SEQ ID NO: 252702 - DNA, 19 bp, Homo sapiens
atgtccaagcatcagcaag

SEQ ID NO: 252703 - DNA, 18 bp, Homo sapiens
atgtccagctgctgtcag

SEQ ID NO: 252704 - DNA, 19 bp, Homo sapiens
atgtccatttatatcattt

SEQ ID NO: 252705 - DNA, 12 bp, Homo sapiens
atgtcccaaata

SEQ ID NO: 252706 - DNA, 14 bp, Homo sapiens
atgtcccaaataaa

SEQ ID NO: 252707 - DNA, 18 bp, Homo sapiens
atgtcccaaataaattta

SEQ ID NO: 252708 - DNA, 16 bp, Homo sapiens
atgtccccattctata

SEQ ID NO: 252709 - DNA, 21 bp, Homo sapiens
atgtccccattctataaattc

SEQ ID NO: 252710 - DNA, 15 bp, Homo sapiens
atgtcccccaggggc

SEQ ID NO: 252711 - DNA, 15 bp, Homo sapiens
atgtccccccctaac

SEQ ID NO: 252712 - DNA, 19 bp, Homo sapiens
atgtccctgaagtcttgca

SEQ ID NO: 252713 - DNA, 17 bp, Homo sapiens
atgtcctaaggacacac

SEQ ID NO: 252714 - DNA, 20 bp, Homo sapiens
atgtcctaaggacacactaa

SEQ ID NO: 252715 - DNA, 23 bp, Homo sapiens
atgtcctaggggccgagggaaat

SEQ ID NO: 252716 - DNA, 16 bp, Homo sapiens
atgtcctattactgat

SEQ ID NO: 252717 - DNA, 23 bp, Homo sapiens
atgtcctattactgatgtgtgca

SEQ ID NO: 252718 - DNA, 20 bp, Homo sapiens
atgtcctccaccacaagagc

SEQ ID NO: 252719 - DNA, 18 bp, Homo sapiens
atgtcctccagaagcctc

SEQ ID NO: 252720 - DNA, 14 bp, Homo sapiens
atgtcgttcatttt

SEQ ID NO: 252721 - DNA, 18 bp, Homo sapiens
atgtctaaaagattcttt

SEQ ID NO: 252722 - DNA, 19 bp, Homo sapiens
atgtctaaaagattcttta

SEQ ID NO: 252723 - DNA, 14 bp, Homo sapiens
atgtctaaaattgt

SEQ ID NO: 252724 - DNA, 17 bp, Homo sapiens
atgtctaacaggacttg

SEQ ID NO: 252725 - DNA, 21 bp, Homo sapiens
atgtctaacaggacttgaatt

SEQ ID NO: 252726 - DNA, 14 bp, Homo sapiens
atgtctacaaaagc

SEQ ID NO: 252727 - DNA, 13 bp, Homo sapiens
atgtctactgctt

SEQ ID NO: 252728 - DNA, 19 bp, Homo sapiens
atgtctagataacattcat

SEQ ID NO: 252729 - DNA, 13 bp, Homo sapiens
atgtctccagatt

SEQ ID NO: 252730 - DNA, 15 bp, Homo sapiens
atgtctctaaagcac

SEQ ID NO: 252731 - DNA, 16 bp, Homo sapiens
atgtctcttgtagaag

SEQ ID NO: 252732 - DNA, 15 bp, Homo sapiens
atgtctctttaagtt

SEQ ID NO: 252733 - DNA, 14 bp, Homo sapiens
atgtctgcatggca

SEQ ID NO: 252734 - DNA, 18 bp, Homo sapiens
atgtctgggaaagcagag

SEQ ID NO: 252735 - DNA, 19 bp, Homo sapiens
atgtctgggaaagcagagt

SEQ ID NO: 252736 - DNA, 13 bp, Homo sapiens
atgtctgttacca

SEQ ID NO: 252737 - DNA, 20 bp, Homo sapiens
atgtctgttaccatgtcact

SEQ ID NO: 252738 - DNA, 21 bp, Homo sapiens
atgtcttaaataaaactattt

SEQ ID NO: 252739 - DNA, 19 bp, Homo sapiens
atgtcttactactttaaat

SEQ ID NO: 252740 - DNA, 20 bp, Homo sapiens
atgtcttcataatataacaa

SEQ ID NO: 252741 - DNA, 18 bp, Homo sapiens
atgtcttcatttcattgt

SEQ ID NO: 252742 - DNA, 15 bp, Homo sapiens
atgtcttctgcctgt

SEQ ID NO: 252743 - DNA, 17 bp, Homo sapiens
atgtcttctgcctgtta

SEQ ID NO: 252744 - DNA, 17 bp, Homo sapiens
atgtcttgagatgtatt

SEQ ID NO: 252745 - DNA, 20 bp, Homo sapiens
atgtcttgcaaagcctttaa

SEQ ID NO: 252746 - DNA, 21 bp, Homo sapiens
atgtcttgcaaagcctttaaa

SEQ ID NO: 252747 - DNA, 17 bp, Homo sapiens
atgtcttttcaaaagga

SEQ ID NO: 252748 - DNA, 18 bp, Homo sapiens
atgtgaagagaattatta

SEQ ID NO: 252749 - DNA, 14 bp, Homo sapiens
atgtgaagcatgct

SEQ ID NO: 252750 - DNA, 20 bp, Homo sapiens
ccagtcagggacagcagcct

SEQ ID NO: 252751 - DNA, 21 bp, Homo sapiens
ccagtcagggacagcagcctc

SEQ ID NO: 252752 - DNA, 22 bp, Homo sapiens
ccagtcccagaaccacactgtt

SEQ ID NO: 252753 - DNA, 15 bp, Homo sapiens
ccagtccccctatcc

SEQ ID NO: 252754 - DNA, 15 bp, Homo sapiens
ccagtccccgggaaa

SEQ ID NO: 252755 - DNA, 17 bp, Homo sapiens
ccagtccccgtgccccg

SEQ ID NO: 252756 - DNA, 12 bp, Homo sapiens
ccagtccctgga

SEQ ID NO: 252757 - DNA, 17 bp, Homo sapiens
ccagtccctggagctgt

SEQ ID NO: 252758 - DNA, 21 bp, Homo sapiens
ccagtcctcacatgcccgctg

SEQ ID NO: 252759 - DNA, 12 bp, Homo sapiens
ccagtcctgcaa

SEQ ID NO: 252760 - DNA, 16 bp, Homo sapiens
ccagtcctgcctggcc

SEQ ID NO: 252761 - DNA, 17 bp, Homo sapiens
ccagtcctgcctggcca

SEQ ID NO: 252762 - DNA, 22 bp, Homo sapiens
ccagtcctgcctggccaggcag

SEQ ID NO: 252763 - DNA, 22 bp, Homo sapiens
ccagtcctggttcagtgggaat

SEQ ID NO: 252764 - DNA, 17 bp, Homo sapiens
ccagtcgccctctgtgc

SEQ ID NO: 252765 - DNA, 19 bp, Homo sapiens
ccagtcgccctctgtgcct

SEQ ID NO: 252766 - DNA, 21 bp, Homo sapiens
ccagtcgccctctgtgcctaa

SEQ ID NO: 252767 - DNA, 15 bp, Homo sapiens
ccagtctcacccact

SEQ ID NO: 252768 - DNA, 15 bp, Homo sapiens
ccagtctgaacctga

SEQ ID NO: 252769 - DNA, 19 bp, Homo sapiens
ccagtctgggctgccgggt

SEQ ID NO: 252770 - DNA, 17 bp, Homo sapiens
ccagtctgtctactgtg

SEQ ID NO: 252771 - DNA, 16 bp, Homo sapiens
ccagtcttctccctgt

SEQ ID NO: 252772 - DNA, 15 bp, Homo sapiens
ccagtgaaaactaga

SEQ ID NO: 252773 - DNA, 21 bp, Homo sapiens
ccagtgaacttacacttggag

SEQ ID NO: 252774 - DNA, 23 bp, Homo sapiens
ccagtgaacttacacttggagcc

SEQ ID NO: 252775 - DNA, 17 bp, Homo sapiens
ccagtgaagtccttcag

SEQ ID NO: 252776 - DNA, 11 bp, Homo sapiens
ccagtgacact

SEQ ID NO: 252777 - DNA, 16 bp, Homo sapiens
ccagtgacacttcaga

SEQ ID NO: 252778 - DNA, 17 bp, Homo sapiens
ccagtgacagacaggct

SEQ ID NO: 252779 - DNA, 12 bp, Homo sapiens
ccagtgactcca

SEQ ID NO: 252780 - DNA, 16 bp, Homo sapiens
ccagtgactccaggag

SEQ ID NO: 252781 - DNA, 12 bp, Homo sapiens
ccagtgactttt

SEQ ID NO: 252782 - DNA, 13 bp, Homo sapiens
ccagtgatggcat

SEQ ID NO: 252783 - DNA, 14 bp, Homo sapiens
ccagtgatggcatt

SEQ ID NO: 252784 - DNA, 23 bp, Homo sapiens
ccagtgatggcattactctgcac

SEQ ID NO: 252785 - DNA, 18 bp, Homo sapiens
ccagtgccaaacttgggc

SEQ ID NO: 252786 - DNA, 13 bp, Homo sapiens
ccagtgcctgcca

SEQ ID NO: 252787 - DNA, 12 bp, Homo sapiens
ccagtgctgcca

SEQ ID NO: 252788 - DNA, 17 bp, Homo sapiens
ccagtgctgccatgcca

SEQ ID NO: 252789 - DNA, 17 bp, Homo sapiens
ccagtgcttggctgccc

SEQ ID NO: 252790 - DNA, 20 bp, Homo sapiens
ccagtgcttggctgccccac

SEQ ID NO: 252791 - DNA, 21 bp, Homo sapiens
ccagtgcttggctgccccaca

SEQ ID NO: 252792 - DNA, 24 bp, Homo sapiens
ccagtggaaggacactcttggctc

SEQ ID NO: 252793 - DNA, 19 bp, Homo sapiens
ccagtggccgaacccccca

SEQ ID NO: 252794 - DNA, 15 bp, Homo sapiens
ccagtggcctggctc

SEQ ID NO: 252795 - DNA, 14 bp, Homo sapiens
ccagtgggaggcgc

SEQ ID NO: 252796 - DNA, 17 bp, Homo sapiens
ccagtggggaaaaaaag

SEQ ID NO: 252797 - DNA, 14 bp, Homo sapiens
ccagtggtgccttg

SEQ ID NO: 252798 - DNA, 21 bp, Homo sapiens
ccagtgtactgctttcaactt

SEQ ID NO: 252799 - DNA, 18 bp, Homo sapiens
ccagtgtattttctgtgt

SEQ ID NO: 252800 - DNA, 19 bp, Homo sapiens
ccagtgtattttgtccaag

SEQ ID NO: 252801 - DNA, 19 bp, Homo sapiens
ccagtgtcaagttgtgctt

SEQ ID NO: 252802 - DNA, 22 bp, Homo sapiens
ccagtgtcaagttgtgcttgtt

SEQ ID NO: 252803 - DNA, 13 bp, Homo sapiens
ccagtgtccccag

SEQ ID NO: 252804 - DNA, 17 bp, Homo sapiens
ccagtgtccccaggggc

SEQ ID NO: 252805 - DNA, 22 bp, Homo sapiens
ccagtgtgggaatgcggcaaga

SEQ ID NO: 252806 - DNA, 17 bp, Homo sapiens
ccagtgttgcctcctcc

SEQ ID NO: 252807 - DNA, 19 bp, Homo sapiens
ccagtgttgcctcctccca

SEQ ID NO: 252808 - DNA, 20 bp, Homo sapiens
ccagtgttgtttgtaaataa

SEQ ID NO: 252809 - DNA, 18 bp, Homo sapiens
ccagttcatctctgctga

SEQ ID NO: 252810 - DNA, 23 bp, Homo sapiens
ccagttctaggggagaagagccc

SEQ ID NO: 252811 - DNA, 13 bp, Homo sapiens
ccagttctctttg

SEQ ID NO: 252812 - DNA, 18 bp, Homo sapiens
atgtggcttggtttggtc

SEQ ID NO: 252813 - DNA, 20 bp, Homo sapiens
atgtgggaagaaacaaaccc

SEQ ID NO: 252814 - DNA, 19 bp, Homo sapiens
atgtggggatgtttgtgct

SEQ ID NO: 252815 - DNA, 14 bp, Homo sapiens
atgtgggggaaggc

SEQ ID NO: 252816 - DNA, 18 bp, Homo sapiens
atgtgggtgaccaggtcc

SEQ ID NO: 252817 - DNA, 14 bp, Homo sapiens
atgtgggttgtgat

SEQ ID NO: 252818 - DNA, 18 bp, Homo sapiens
atgtggtggcaataaatg

SEQ ID NO: 252819 - DNA, 21 bp, Homo sapiens
atgtggttacttcctactgta

SEQ ID NO: 252820 - DNA, 15 bp, Homo sapiens
atgtgtaaaatgtga

SEQ ID NO: 252821 - DNA, 16 bp, Homo sapiens
atgtgtaaatgttatg

SEQ ID NO: 252822 - DNA, 18 bp, Homo sapiens
atgtgtaatatcatttca

SEQ ID NO: 252823 - DNA, 12 bp, Homo sapiens
atgtgtaatgat

SEQ ID NO: 252824 - DNA, 13 bp, Homo sapiens
atgtgtatgagaa

SEQ ID NO: 252825 - DNA, 19 bp, Homo sapiens
atgtgtatgagaagtactt

SEQ ID NO: 252826 - DNA, 17 bp, Homo sapiens
atgtgtcagagtgttgt

SEQ ID NO: 252827 - DNA, 23 bp, Homo sapiens
atgtgtcatgatttcaatgattg

SEQ ID NO: 252828 - DNA, 18 bp, Homo sapiens
atgtgtcccagtgaacag

SEQ ID NO: 252829 - DNA, 19 bp, Homo sapiens
atgtgtctagcaaagccac

SEQ ID NO: 252830 - DNA, 13 bp, Homo sapiens
atgtgtctgcaac

SEQ ID NO: 252831 - DNA, 13 bp, Homo sapiens
atgtgtctgtatt

SEQ ID NO: 252832 - DNA, 15 bp, Homo sapiens
atgtgtctgtattca

SEQ ID NO: 252833 - DNA, 20 bp, Homo sapiens
atgtgtctttatcagtgatg

SEQ ID NO: 252834 - DNA, 19 bp, Homo sapiens
atgtgtgaggagctgctgg

SEQ ID NO: 252835 - DNA, 17 bp, Homo sapiens
atgtgtgagtgtgtgca

SEQ ID NO: 252836 - DNA, 20 bp, Homo sapiens
atgtgtgccatagagtttaa

SEQ ID NO: 252837 - DNA, 12 bp, Homo sapiens
atgtgtgcccag

SEQ ID NO: 252838 - DNA, 16 bp, Homo sapiens
atgtgtgcctgtggca

SEQ ID NO: 252839 - DNA, 17 bp, Homo sapiens
atgtgtgcctgtggcag

SEQ ID NO: 252840 - DNA, 15 bp, Homo sapiens
atgtgtggatgtgta

SEQ ID NO: 252841 - DNA, 16 bp, Homo sapiens
atgtgtggctcattct

SEQ ID NO: 252842 - DNA, 15 bp, Homo sapiens
atgtgtggtttataa

SEQ ID NO: 252843 - DNA, 13 bp, Homo sapiens
atgtgtgtctcac

SEQ ID NO: 252844 - DNA, 11 bp, Homo sapiens
atgtgtgtgca

SEQ ID NO: 252845 - DNA, 15 bp, Homo sapiens
atgtgtgtgtatgtt

SEQ ID NO: 252846 - DNA, 16 bp, Homo sapiens
atgtgtgttttgctaa

SEQ ID NO: 252847 - DNA, 20 bp, Homo sapiens
atgtgttaaacatgctaaat

SEQ ID NO: 252848 - DNA, 14 bp, Homo sapiens
atgtgttgcaaatt

SEQ ID NO: 252849 - DNA, 23 bp, Homo sapiens
atgtgttgcaaattattctagtc

SEQ ID NO: 252850 - DNA, 18 bp, Homo sapiens
atgtgttgcataaacaat

SEQ ID NO: 252851 - DNA, 19 bp, Homo sapiens
atgtgttgcataaacaatc

SEQ ID NO: 252852 - DNA, 13 bp, Homo sapiens
atgtgtttttaaa

SEQ ID NO: 252853 - DNA, 21 bp, Homo sapiens
atgttaaagaggcgtcttgta

SEQ ID NO: 252854 - DNA, 21 bp, Homo sapiens
atgttaacctcagtgtcattt

SEQ ID NO: 252855 - DNA, 19 bp, Homo sapiens
atgttaattaaagtaaaat

SEQ ID NO: 252856 - DNA, 17 bp, Homo sapiens
atgttacactaagggtg

SEQ ID NO: 252857 - DNA, 16 bp, Homo sapiens
atgttacatgtagaaa

SEQ ID NO: 252858 - DNA, 21 bp, Homo sapiens
atgttacatgtagaaaaatac

SEQ ID NO: 252859 - DNA, 14 bp, Homo sapiens
atgttacattgttt

SEQ ID NO: 252860 - DNA, 14 bp, Homo sapiens
atgttaccttcaca

SEQ ID NO: 252861 - DNA, 16 bp, Homo sapiens
atgttactgatcatgc

SEQ ID NO: 252862 - DNA, 17 bp, Homo sapiens
atgttagaattgatttc

SEQ ID NO: 252863 - DNA, 16 bp, Homo sapiens
atgttagcaagatgat

SEQ ID NO: 252864 - DNA, 16 bp, Homo sapiens
atgttagtagcactga

SEQ ID NO: 252865 - DNA, 13 bp, Homo sapiens
atgttatatattt

SEQ ID NO: 252866 - DNA, 17 bp, Homo sapiens
atgttatatattttttg

SEQ ID NO: 252867 - DNA, 16 bp, Homo sapiens
atgttattcaataact

SEQ ID NO: 252868 - DNA, 22 bp, Homo sapiens
atgttattgaaaaaaattggca

SEQ ID NO: 252869 - DNA, 18 bp, Homo sapiens
atgttatttaagaatgac

SEQ ID NO: 252870 - DNA, 20 bp, Homo sapiens
atgttatttgttattttcag

SEQ ID NO: 252871 - DNA, 14 bp, Homo sapiens
atgttcaaagtcaa

SEQ ID NO: 252872 - DNA, 23 bp, Homo sapiens
atgttcaggagagtaaaaattca

SEQ ID NO: 252873 - DNA, 19 bp, Homo sapiens
atgttcctgaattctattt

SEQ ID NO: 252874 - DNA, 13 bp, Homo sapiens
atgttccttttga

SEQ ID NO: 252875 - DNA, 19 bp, Homo sapiens
atgttctcatgtttgtgca

SEQ ID NO: 252876 - DNA, 18 bp, Homo sapiens
atgttctgaataatttct

SEQ ID NO: 252877 - DNA, 19 bp, Homo sapiens
atgttctgacagcatttca

SEQ ID NO: 252878 - DNA, 14 bp, Homo sapiens
atgttctgacatta

SEQ ID NO: 252879 - DNA, 18 bp, Homo sapiens
atgttctgacattaacag

SEQ ID NO: 252880 - DNA, 19 bp, Homo sapiens
atgttctgacattaacagt

SEQ ID NO: 252881 - DNA, 23 bp, Homo sapiens
atgttctggctttacattttatt

SEQ ID NO: 252882 - DNA, 20 bp, Homo sapiens
atgttctttcacccttttct

SEQ ID NO: 252883 - DNA, 14 bp, Homo sapiens
atgttgacctttga

SEQ ID NO: 252884 - DNA, 13 bp, Homo sapiens
atgttgctgaaac

SEQ ID NO: 252885 - DNA, 21 bp, Homo sapiens
atgttggaactctgtgcaggt

SEQ ID NO: 252886 - DNA, 20 bp, Homo sapiens
atgttggtgcaattaactct

SEQ ID NO: 252887 - DNA, 21 bp, Homo sapiens
atgttggtgcaattaactctg

SEQ ID NO: 252888 - DNA, 23 bp, Homo sapiens
ccatctcaggccacctgccccct

SEQ ID NO: 252889 - DNA, 14 bp, Homo sapiens
ccatctccccaggc

SEQ ID NO: 252890 - DNA, 16 bp, Homo sapiens
ccatctccccaggcct

SEQ ID NO: 252891 - DNA, 24 bp, Homo sapiens
ccatctccctcgaacccacactgc

SEQ ID NO: 252892 - DNA, 14 bp, Homo sapiens
ccatctccttcccc

SEQ ID NO: 252893 - DNA, 16 bp, Homo sapiens
ccatctccttccccca

SEQ ID NO: 252894 - DNA, 19 bp, Homo sapiens
ccatctccttcccccagcc

SEQ ID NO: 252895 - DNA, 16 bp, Homo sapiens
ccatctccttgtcttt

SEQ ID NO: 252896 - DNA, 17 bp, Homo sapiens
ccatctctccctcccct

SEQ ID NO: 252897 - DNA, 23 bp, Homo sapiens
ccatctctccctcccctgccatt

SEQ ID NO: 252898 - DNA, 15 bp, Homo sapiens
ccatctctcctcctt

SEQ ID NO: 252899 - DNA, 14 bp, Homo sapiens
ccatctctctccct

SEQ ID NO: 252900 - DNA, 15 bp, Homo sapiens
ccatctctctccctt

SEQ ID NO: 252901 - DNA, 14 bp, Homo sapiens
ccatctctcttccc

SEQ ID NO: 252902 - DNA, 20 bp, Homo sapiens
ccatctctgctgcttctggg

SEQ ID NO: 252903 - DNA, 21 bp, Homo sapiens
ccatctctgctgcttctgggc

SEQ ID NO: 252904 - DNA, 22 bp, Homo sapiens
ccatctctgctgcttctgggcc

SEQ ID NO: 252905 - DNA, 13 bp, Homo sapiens
ccatctcttccta

SEQ ID NO: 252906 - DNA, 16 bp, Homo sapiens
ccatctgccgcctggg

SEQ ID NO: 252907 - DNA, 15 bp, Homo sapiens
ccatctggcctggcc

SEQ ID NO: 252908 - DNA, 17 bp, Homo sapiens
ccatctggcctggcctg

SEQ ID NO: 252909 - DNA, 22 bp, Homo sapiens
ccatctggcctggcctggccct

SEQ ID NO: 252910 - DNA, 15 bp, Homo sapiens
ccatctggggatgga

SEQ ID NO: 252911 - DNA, 15 bp, Homo sapiens
ccatctgtaaatatc

SEQ ID NO: 252912 - DNA, 22 bp, Homo sapiens
ccatctgtaaatatcccagaga

SEQ ID NO: 252913 - DNA, 20 bp, Homo sapiens
ccatctgtaccctgcttccc

SEQ ID NO: 252914 - DNA, 12 bp, Homo sapiens
ccatctgtctgt

SEQ ID NO: 252915 - DNA, 16 bp, Homo sapiens
ccatctgtctgtccta

SEQ ID NO: 252916 - DNA, 22 bp, Homo sapiens
ccatctgtgggcacgctgtggg

SEQ ID NO: 252917 - DNA, 13 bp, Homo sapiens
ccatcttaatctt

SEQ ID NO: 252918 - DNA, 14 bp, Homo sapiens
ccatcttaatcttt

SEQ ID NO: 252919 - DNA, 17 bp, Homo sapiens
ccatcttaatctttatt

SEQ ID NO: 252920 - DNA, 21 bp, Homo sapiens
ccatcttaatctttattttat

SEQ ID NO: 252921 - DNA, 19 bp, Homo sapiens
ccatcttcccgcctcagcc

SEQ ID NO: 252922 - DNA, 20 bp, Homo sapiens
ccatcttcccgcctcagcct

SEQ ID NO: 252923 - DNA, 20 bp, Homo sapiens
ccatgaaaacgttttattgt

SEQ ID NO: 252924 - DNA, 21 bp, Homo sapiens
ccatgaaaacgttttattgtg

SEQ ID NO: 252925 - DNA, 23 bp, Homo sapiens
ccatgaaaacgttttattgtgtt

SEQ ID NO: 252926 - DNA, 15 bp, Homo sapiens
ccatgaactttgtcc

SEQ ID NO: 252927 - DNA, 18 bp, Homo sapiens
ccatgaatgtatcaggaa

SEQ ID NO: 252928 - DNA, 22 bp, Homo sapiens
ccatgacaacttctaattgcca

SEQ ID NO: 252929 - DNA, 14 bp, Homo sapiens
ccatgacagtagca

SEQ ID NO: 252930 - DNA, 17 bp, Homo sapiens
ccatgaccaggccacca

SEQ ID NO: 252931 - DNA, 19 bp, Homo sapiens
ccatgaccttgacgtgtgt

SEQ ID NO: 252932 - DNA, 13 bp, Homo sapiens
ccatgactgcccc

SEQ ID NO: 252933 - DNA, 17 bp, Homo sapiens
ccatgactggctgtctg

SEQ ID NO: 252934 - DNA, 13 bp, Homo sapiens
ccatgagaagagg

SEQ ID NO: 252935 - DNA, 22 bp, Homo sapiens
ccatgagaataagagaaagaaa

SEQ ID NO: 252936 - DNA, 19 bp, Homo sapiens
ccatgagctccagaccccc

SEQ ID NO: 252937 - DNA, 17 bp, Homo sapiens
ccatgaggaacaaggca

SEQ ID NO: 252938 - DNA, 17 bp, Homo sapiens
ccatgagtttgccctgg

SEQ ID NO: 252939 - DNA, 17 bp, Homo sapiens
ccatgatgcatggagtg

SEQ ID NO: 252940 - DNA, 16 bp, Homo sapiens
ccatgattccaagggc

SEQ ID NO: 252941 - DNA, 22 bp, Homo sapiens
ccatgcaaagcaacgactactt

SEQ ID NO: 252942 - DNA, 20 bp, Homo sapiens
caagtgtacagtatttacct

SEQ ID NO: 252943 - DNA, 20 bp, Homo sapiens
caagtgtagatgtagcattg

SEQ ID NO: 252944 - DNA, 22 bp, Homo sapiens
caagtgtagatgtagcattgtt

SEQ ID NO: 252945 - DNA, 22 bp, Homo sapiens
caagtgtatgcacgtgtgcaca

SEQ ID NO: 252946 - DNA, 11 bp, Homo sapiens
caagtgtgtgc

SEQ ID NO: 252947 - DNA, 19 bp, Homo sapiens
caagtgtgtgtgcaatgtt

SEQ ID NO: 252948 - DNA, 15 bp, Homo sapiens
caagtgtttctgttc

SEQ ID NO: 252949 - DNA, 15 bp, Homo sapiens
caagtgtttcttgtt

SEQ ID NO: 252950 - DNA, 16 bp, Homo sapiens
caagttataaatcaat

SEQ ID NO: 252951 - DNA, 13 bp, Homo sapiens
caagttattaatt

SEQ ID NO: 252952 - DNA, 12 bp, Homo sapiens
caagttattgta

SEQ ID NO: 252953 - DNA, 20 bp, Homo sapiens
caagttattgtacagctgtt

SEQ ID NO: 252954 - DNA, 16 bp, Homo sapiens
catgagctccagaccc

SEQ ID NO: 252955 - DNA, 23 bp, Homo sapiens
catgagctccagacccccagcaa

SEQ ID NO: 252956 - DNA, 12 bp, Homo sapiens
catgagctctgt

SEQ ID NO: 252957 - DNA, 17 bp, Homo sapiens
catgaggaacaaggcaa

SEQ ID NO: 252958 - DNA, 20 bp, Homo sapiens
catgaggggcccgagcagaa

SEQ ID NO: 252959 - DNA, 15 bp, Homo sapiens
catgaggtaaaagag

SEQ ID NO: 252960 - DNA, 22 bp, Homo sapiens
catgagtgtcaactccaggact

SEQ ID NO: 252961 - DNA, 17 bp, Homo sapiens
catgagttgtcagcttt

SEQ ID NO: 252962 - DNA, 21 bp, Homo sapiens
catgataaaataagtaacata

SEQ ID NO: 252963 - DNA, 16 bp, Homo sapiens
catgatattgtatgta

SEQ ID NO: 252964 - DNA, 22 bp, Homo sapiens
catgatccacccacctcagcct

SEQ ID NO: 252965 - DNA, 23 bp, Homo sapiens
catgatccacccacctcagcctc

SEQ ID NO: 252966 - DNA, 22 bp, Homo sapiens
catgatccctgtgttgtctcta

SEQ ID NO: 252967 - DNA, 13 bp, Homo sapiens
catgatctgtcaa

SEQ ID NO: 252968 - DNA, 12 bp, Homo sapiens
catgatggagtc

SEQ ID NO: 252969 - DNA, 19 bp, Homo sapiens
catgatggagtcaggtttg

SEQ ID NO: 252970 - DNA, 19 bp, Homo sapiens
catgattccaagggcccag

SEQ ID NO: 252971 - DNA, 20 bp, Homo sapiens
catgattccaagggcccaga

SEQ ID NO: 252972 - DNA, 21 bp, Homo sapiens
catgattctttaatagaagtt

SEQ ID NO: 252973 - DNA, 18 bp, Homo sapiens
catgatttagggaagcag

SEQ ID NO: 252974 - DNA, 17 bp, Homo sapiens
catgatttcaatgattg

SEQ ID NO: 252975 - DNA, 16 bp, Homo sapiens
catgattttggccact

SEQ ID NO: 252976 - DNA, 18 bp, Homo sapiens
catgattttggctcactg

SEQ ID NO: 252977 - DNA, 17 bp, Homo sapiens
catgcaactccatgcct

SEQ ID NO: 252978 - DNA, 19 bp, Homo sapiens
catgcaactccatgcctat

SEQ ID NO: 252979 - DNA, 18 bp, Homo sapiens
catgcaatttattaaaat

SEQ ID NO: 252980 - DNA, 14 bp, Homo sapiens
catgcacagaacaa

SEQ ID NO: 252981 - DNA, 14 bp, Homo sapiens
catgcactcagtgt

SEQ ID NO: 252982 - DNA, 17 bp, Homo sapiens
catgcagactcctcaga

SEQ ID NO: 252983 - DNA, 19 bp, Homo sapiens
catgcagactcctcagatc

SEQ ID NO: 252984 - DNA, 19 bp, Homo sapiens
catgcagatctagccaggc

SEQ ID NO: 252985 - DNA, 12 bp, Homo sapiens
catgcagcagct

SEQ ID NO: 252986 - DNA, 17 bp, Homo sapiens
catgcagccactgtgct

SEQ ID NO: 252987 - DNA, 17 bp, Homo sapiens
catgcaggtctccatga

SEQ ID NO: 252988 - DNA, 18 bp, Homo sapiens
catgcaggtctccatgaa

SEQ ID NO: 252989 - DNA, 21 bp, Homo sapiens
catgcaggtctccatgaagaa

SEQ ID NO: 252990 - DNA, 17 bp, Homo sapiens
catgcagttcattattt

SEQ ID NO: 252991 - DNA, 20 bp, Homo sapiens
catgcagttcattattttgt

SEQ ID NO: 252992 - DNA, 20 bp, Homo sapiens
catgcatggcctcccagcca

SEQ ID NO: 252993 - DNA, 21 bp, Homo sapiens
catgcatggcctcccagccac

SEQ ID NO: 252994 - DNA, 23 bp, Homo sapiens
catgcatgttttatgtgcactca

SEQ ID NO: 252995 - DNA, 14 bp, Homo sapiens
catgcattcataca

SEQ ID NO: 252996 - DNA, 17 bp, Homo sapiens
catgcattgttgaggtg

SEQ ID NO: 252997 - DNA, 20 bp, Homo sapiens
catgcattgttgaggtggtc

SEQ ID NO: 252998 - DNA, 18 bp, Homo sapiens
catgcattttatcagaca

SEQ ID NO: 252999 - DNA, 21 bp, Homo sapiens
catgcattttatcagacaatt

SEQ ID NO: 253000 - DNA, 16 bp, Homo sapiens
catgccaccacccacc

SEQ ID NO: 253001 - DNA, 11 bp, Homo sapiens
catgccaccct

SEQ ID NO: 253002 - DNA, 21 bp, Homo sapiens
catgccactgccaggcacctg

SEQ ID NO: 253003 - DNA, 21 bp, Homo sapiens
catgccaggctgggcacggct

SEQ ID NO: 253004 - DNA, 13 bp, Homo sapiens
catgcccacctgc

SEQ ID NO: 253005 - DNA, 17 bp, Homo sapiens
catgcccacctgcccat

SEQ ID NO: 253006 - DNA, 13 bp, Homo sapiens
catgccccaccca

SEQ ID NO: 253007 - DNA, 14 bp, Homo sapiens
catgccccacccac

SEQ ID NO: 253008 - DNA, 15 bp, Homo sapiens
catgccccttggctg

SEQ ID NO: 253009 - DNA, 19 bp, Homo sapiens
catgcccgctgtcccaggg

SEQ ID NO: 253010 - DNA, 21 bp, Homo sapiens
catgccctaagagtgtcactg

SEQ ID NO: 253011 - DNA, 20 bp, Homo sapiens
catgccctgccaagcctgga

SEQ ID NO: 253012 - DNA, 21 bp, Homo sapiens
catgcctatttactggaaacc

SEQ ID NO: 253013 - DNA, 11 bp, Homo sapiens
catgcctgagg

SEQ ID NO: 253014 - DNA, 15 bp, Homo sapiens
catgcctgagggtgg

SEQ ID NO: 253015 - DNA, 20 bp, Homo sapiens
catgcctgccccaaacaaat

SEQ ID NO: 253016 - DNA, 18 bp, Homo sapiens
catgcctggcccccctcc

SEQ ID NO: 253017 - DNA, 22 bp, Homo sapiens
catgcctggcccccctccaggc

SEQ ID NO: 253018 - DNA, 14 bp, Homo sapiens
catgcctgtctctg

SEQ ID NO: 253019 - DNA, 15 bp, Homo sapiens
catgcctttgtaagt

SEQ ID NO: 253020 - DNA, 17 bp, Homo sapiens
catgcgaatgagctggg

SEQ ID NO: 253021 - DNA, 15 bp, Homo sapiens
catgcgacagcgtcc

SEQ ID NO: 253022 - DNA, 21 bp, Homo sapiens
catgcggccggcctggggccg

SEQ ID NO: 253023 - DNA, 16 bp, Homo sapiens
catgcggctgcccacg

SEQ ID NO: 253024 - DNA, 18 bp, Homo sapiens
catgcgggctgggcagct

SEQ ID NO: 253025 - DNA, 21 bp, Homo sapiens
catgcgggctgggcagctgtt

SEQ ID NO: 253026 - DNA, 20 bp, Homo sapiens
catgctcaacccccctccca

SEQ ID NO: 253027 - DNA, 21 bp, Homo sapiens
catgctcaacccccctcccag

SEQ ID NO: 253028 - DNA, 14 bp, Homo sapiens
catgctcacctcta

SEQ ID NO: 253029 - DNA, 15 bp, Homo sapiens
catgctcacctctag

SEQ ID NO: 253030 - DNA, 13 bp, Homo sapiens
catgctctgcccc

SEQ ID NO: 253031 - DNA, 20 bp, Homo sapiens
catgctgatttaccacttat

SEQ ID NO: 253032 - DNA, 14 bp, Homo sapiens
catgctgcctccag

SEQ ID NO: 253033 - DNA, 13 bp, Homo sapiens
catgctgcctgcc

SEQ ID NO: 253034 - DNA, 16 bp, Homo sapiens
catgctgcctgcctcc

SEQ ID NO: 253035 - DNA, 22 bp, Homo sapiens
catgctgcctgcctccggccct

SEQ ID NO: 253036 - DNA, 23 bp, Homo sapiens
catgctgcctgcctccggccctg

SEQ ID NO: 253037 - DNA, 15 bp, Homo sapiens
catgctgccttcagg

SEQ ID NO: 253038 - DNA, 17 bp, Homo sapiens
catgctgccttcaggga

SEQ ID NO: 253039 - DNA, 19 bp, Homo sapiens
catgctgctatgaagacta

SEQ ID NO: 253040 - DNA, 18 bp, Homo sapiens
atagtgcctaaaattgta

SEQ ID NO: 253041 - DNA, 14 bp, Homo sapiens
atagtgcctcagcg

SEQ ID NO: 253042 - DNA, 17 bp, Homo sapiens
atagtgcttaaaaatca

SEQ ID NO: 253043 - DNA, 15 bp, Homo sapiens
atagtgcttcttgta

SEQ ID NO: 253044 - DNA, 22 bp, Homo sapiens
atagtgggccttcattaaatgt

SEQ ID NO: 253045 - DNA, 17 bp, Homo sapiens
atagtggtcatttggtg

SEQ ID NO: 253046 - DNA, 19 bp, Homo sapiens
atagtgtataccacctgta

SEQ ID NO: 253047 - DNA, 14 bp, Homo sapiens
atagtgtgtccatg

SEQ ID NO: 253048 - DNA, 23 bp, Homo sapiens
atagtgtgttctgattagaaatg

SEQ ID NO: 253049 - DNA, 16 bp, Homo sapiens
atagtgttttgtactt

SEQ ID NO: 253050 - DNA, 14 bp, Homo sapiens
atagttagccctca

SEQ ID NO: 253051 - DNA, 14 bp, Homo sapiens
atagttctatttct

SEQ ID NO: 253052 - DNA, 18 bp, Homo sapiens
atagttctatttctatct

SEQ ID NO: 253053 - DNA, 20 bp, Homo sapiens
atagttctatttctatctgc

SEQ ID NO: 253054 - DNA, 22 bp, Homo sapiens
atagttctgttaaatatttttg

SEQ ID NO: 253055 - DNA, 15 bp, Homo sapiens
atagttgctgtcccc

SEQ ID NO: 253056 - DNA, 20 bp, Homo sapiens
atagttgctgtccccttcca

SEQ ID NO: 253057 - DNA, 17 bp, Homo sapiens
atagttggttcttttac

SEQ ID NO: 253058 - DNA, 13 bp, Homo sapiens
atagtttaaaaca

SEQ ID NO: 253059 - DNA, 15 bp, Homo sapiens
atagtttacaatatt

SEQ ID NO: 253060 - DNA, 14 bp, Homo sapiens
atagtttctgtaat

SEQ ID NO: 253061 - DNA, 22 bp, Homo sapiens
atataaaaagaaaagataaaga

SEQ ID NO: 253062 - DNA, 23 bp, Homo sapiens
atataaaaagaaaagataaagat

SEQ ID NO: 253063 - DNA, 20 bp, Homo sapiens
atataaaaataattaaaaca

SEQ ID NO: 253064 - DNA, 15 bp, Homo sapiens
atataaaacaaaaca

SEQ ID NO: 253065 - DNA, 11 bp, Homo sapiens
atataaaataa

SEQ ID NO: 253066 - DNA, 15 bp, Homo sapiens
atataaaataaatat

SEQ ID NO: 253067 - DNA, 16 bp, Homo sapiens
atataaaataaatata

SEQ ID NO: 253068 - DNA, 13 bp, Homo sapiens
atataaacaatgt

SEQ ID NO: 253069 - DNA, 17 bp, Homo sapiens
atataaaccttaaatga

SEQ ID NO: 253070 - DNA, 12 bp, Homo sapiens
atataaactgtg

SEQ ID NO: 253071 - DNA, 14 bp, Homo sapiens
atataaactgtgag

SEQ ID NO: 253072 - DNA, 21 bp, Homo sapiens
atataaagtactactgtagaa

SEQ ID NO: 253073 - DNA, 13 bp, Homo sapiens
atataaagttttg

SEQ ID NO: 253074 - DNA, 15 bp, Homo sapiens
atataaatggctggt

SEQ ID NO: 253075 - DNA, 16 bp, Homo sapiens
atataaattaagactt

SEQ ID NO: 253076 - DNA, 15 bp, Homo sapiens
atataaattaataca

SEQ ID NO: 253077 - DNA, 16 bp, Homo sapiens
atataaattaatacat

SEQ ID NO: 253078 - DNA, 18 bp, Homo sapiens
atataaattaatacataa

SEQ ID NO: 253079 - DNA, 15 bp, Homo sapiens
atataaattattact

SEQ ID NO: 253080 - DNA, 12 bp, Homo sapiens
atataagatttt

SEQ ID NO: 253081 - DNA, 20 bp, Homo sapiens
atataagcttaaaataagtg

SEQ ID NO: 253082 - DNA, 12 bp, Homo sapiens
atataagctttt

SEQ ID NO: 253083 - DNA, 18 bp, Homo sapiens
atataagttaaagagaca

SEQ ID NO: 253084 - DNA, 18 bp, Homo sapiens
atatgatatataaacctt

SEQ ID NO: 253085 - DNA, 16 bp, Homo sapiens
atatgatatatatgta

SEQ ID NO: 253086 - DNA, 12 bp, Homo sapiens
atatgatatgca

SEQ ID NO: 253087 - DNA, 13 bp, Homo sapiens
atatgatatgcat

SEQ ID NO: 253088 - DNA, 23 bp, Homo sapiens
atatgatatgcatgtagcatata

SEQ ID NO: 253089 - DNA, 14 bp, Homo sapiens
atatgatctgtgga

SEQ ID NO: 253090 - DNA, 14 bp, Homo sapiens
atatgatgtttaaa

SEQ ID NO: 253091 - DNA, 18 bp, Homo sapiens
atatgatgtttaaaagca

SEQ ID NO: 253092 - DNA, 16 bp, Homo sapiens
atatgattctcctctc

SEQ ID NO: 253093 - DNA, 14 bp, Homo sapiens
atatgattgaaaag

SEQ ID NO: 253094 - DNA, 20 bp, Homo sapiens
atatgattgaaaagaagaaa

SEQ ID NO: 253095 - DNA, 19 bp, Homo sapiens
atatgattgtaacatattt

SEQ ID NO: 253096 - DNA, 21 bp, Homo sapiens
atatgattgtaacatatttct

SEQ ID NO: 253097 - DNA, 22 bp, Homo sapiens
atatgattttatttgacaaaat

SEQ ID NO: 253098 - DNA, 11 bp, Homo sapiens
atatgcacttt

SEQ ID NO: 253099 - DNA, 17 bp, Homo sapiens
atatgcagttttcctta

SEQ ID NO: 253100 - DNA, 14 bp, Homo sapiens
atatgcataaacaa

SEQ ID NO: 253101 - DNA, 14 bp, Homo sapiens
atatgcatctttga

SEQ ID NO: 253102 - DNA, 18 bp, Homo sapiens
atatgcatctttgagaat

SEQ ID NO: 253103 - DNA, 11 bp, Homo sapiens
atatgcatgta

SEQ ID NO: 253104 - DNA, 17 bp, Homo sapiens
atatgcatgtagcatat

SEQ ID NO: 253105 - DNA, 16 bp, Homo sapiens
atatgcccctccccag

SEQ ID NO: 253106 - DNA, 22 bp, Homo sapiens
atatgctgccaaattttggcca

SEQ ID NO: 253107 - DNA, 22 bp, Homo sapiens
atatgctgtatagcctttgtca

SEQ ID NO: 253108 - DNA, 11 bp, Homo sapiens
atatggagccc

SEQ ID NO: 253109 - DNA, 13 bp, Homo sapiens
atatggcaagaaa

SEQ ID NO: 253110 - DNA, 18 bp, Homo sapiens
atatggcaagaaagctgg

SEQ ID NO: 253111 - DNA, 17 bp, Homo sapiens
atatggggggccaacac

SEQ ID NO: 253112 - DNA, 22 bp, Homo sapiens
atatgggttgcatttggtcaag

SEQ ID NO: 253113 - DNA, 19 bp, Homo sapiens
atatggtactaaggagaat

SEQ ID NO: 253114 - DNA, 19 bp, Homo sapiens
atatggtggccctggggaa

SEQ ID NO: 253115 - DNA, 14 bp, Homo sapiens
atatgtaacagttg

SEQ ID NO: 253116 - DNA, 19 bp, Homo sapiens
atatgtacagttatacata

SEQ ID NO: 253117 - DNA, 14 bp, Homo sapiens
atatgtacataaat

SEQ ID NO: 253118 - DNA, 14 bp, Homo sapiens
atatgtaccatgta

SEQ ID NO: 253119 - DNA, 19 bp, Homo sapiens
atatgtaccatgtacatga

SEQ ID NO: 253120 - DNA, 14 bp, Homo sapiens
atatgtatataaaa

SEQ ID NO: 253121 - DNA, 15 bp, Homo sapiens
atatgtatataaaat

SEQ ID NO: 253122 - DNA, 20 bp, Homo sapiens
atatgtatgctgatttacta

SEQ ID NO: 253123 - DNA, 15 bp, Homo sapiens
atatgtattaatact

SEQ ID NO: 253124 - DNA, 21 bp, Homo sapiens
atatgtattgtaaacatgtgt

SEQ ID NO: 253125 - DNA, 11 bp, Homo sapiens
atatgtcctgg

SEQ ID NO: 253126 - DNA, 13 bp, Homo sapiens
atatgtctttaaa

SEQ ID NO: 253127 - DNA, 19 bp, Homo sapiens
atatgtgagcatgaaacta

SEQ ID NO: 253128 - DNA, 15 bp, Homo sapiens
atatgtggagttcat

SEQ ID NO: 253129 - DNA, 20 bp, Homo sapiens
atatgtggcattcctttctt

SEQ ID NO: 253130 - DNA, 14 bp, Homo sapiens
atatgtgtaaatgt

SEQ ID NO: 253131 - DNA, 16 bp, Homo sapiens
atatgtgtaaatgtta

SEQ ID NO: 253132 - DNA, 20 bp, Homo sapiens
atatgtgtaatatcatttca

SEQ ID NO: 253133 - DNA, 19 bp, Homo sapiens
atatgtgtgtttaaataaa

SEQ ID NO: 253134 - DNA, 23 bp, Homo sapiens
atatgttatggcttattgtgtga

SEQ ID NO: 253135 - DNA, 15 bp, Homo sapiens
atatgttatttttgg

SEQ ID NO: 253136 - DNA, 21 bp, Homo sapiens
atatgttcaccaggagattac

SEQ ID NO: 253137 - DNA, 17 bp, Homo sapiens
atatgttgagtgttcat

SEQ ID NO: 253138 - DNA, 13 bp, Homo sapiens
atatgttgctgaa

SEQ ID NO: 253139 - DNA, 13 bp, Homo sapiens
atatgtttaatat

SEQ ID NO: 253140 - DNA, 14 bp, Homo sapiens
atatgtttatatac

SEQ ID NO: 253141 - DNA, 15 bp, Homo sapiens
atatgtttatatact

SEQ ID NO: 253142 - DNA, 21 bp, Homo sapiens
atatgtttggctgaaattatg

SEQ ID NO: 253143 - DNA, 22 bp, Homo sapiens
atatgttttaaatatagaattt

SEQ ID NO: 253144 - DNA, 15 bp, Homo sapiens
atatgttttgagaaa

SEQ ID NO: 253145 - DNA, 13 bp, Homo sapiens
atattaaaaatat

SEQ ID NO: 253146 - DNA, 14 bp, Homo sapiens
atattaaaaatata

SEQ ID NO: 253147 - DNA, 15 bp, Homo sapiens
atattaaaaatataa

SEQ ID NO: 253148 - DNA, 16 bp, Homo sapiens
atattaaaaatataca

SEQ ID NO: 253149 - DNA, 14 bp, Homo sapiens
atattaaaagaaag

SEQ ID NO: 253150 - DNA, 18 bp, Homo sapiens
atattaaaatgtcggatt

SEQ ID NO: 253151 - DNA, 17 bp, Homo sapiens
atattaaatacagacac

SEQ ID NO: 253152 - DNA, 19 bp, Homo sapiens
atattaaatacagacacta

SEQ ID NO: 253153 - DNA, 17 bp, Homo sapiens
atattacattgcattca

SEQ ID NO: 253154 - DNA, 23 bp, Homo sapiens
atattacattgcattcaaaatct

SEQ ID NO: 253155 - DNA, 20 bp, Homo sapiens
atattactgtttatttctgt

SEQ ID NO: 253156 - DNA, 21 bp, Homo sapiens
atattactgtttatttctgtt

SEQ ID NO: 253157 - DNA, 17 bp, Homo sapiens
atattacttttgtaaat

SEQ ID NO: 253158 - DNA, 23 bp, Homo sapiens
atattacttttgtaaatattctt

SEQ ID NO: 253159 - DNA, 20 bp, Homo sapiens
atattagagtgcccttaaaa

SEQ ID NO: 253160 - DNA, 18 bp, Homo sapiens
atattaggctataaatgt

SEQ ID NO: 253161 - DNA, 13 bp, Homo sapiens
atattataaaaat

SEQ ID NO: 253162 - DNA, 16 bp, Homo sapiens
atattataaaaatatc

SEQ ID NO: 253163 - DNA, 10 bp, Homo sapiens
atattataag

SEQ ID NO: 253164 - DNA, 20 bp, Homo sapiens
atattataagttgaccttta

SEQ ID NO: 253165 - DNA, 19 bp, Homo sapiens
atattataataatgttctc

SEQ ID NO: 253166 - DNA, 22 bp, Homo sapiens
atattataatttttttcaatat

SEQ ID NO: 253167 - DNA, 17 bp, Homo sapiens
atattatattgtattta

SEQ ID NO: 253168 - DNA, 22 bp, Homo sapiens
atattatattgtatttaaccca

SEQ ID NO: 253169 - DNA, 15 bp, Homo sapiens
atattatgattttat

SEQ ID NO: 253170 - DNA, 16 bp, Homo sapiens
atattatgattttatt

SEQ ID NO: 253171 - DNA, 20 bp, Homo sapiens
atattattcaccatgtaaaa

SEQ ID NO: 253172 - DNA, 19 bp, Homo sapiens
atattcagagatgtaccat

SEQ ID NO: 253173 - DNA, 23 bp, Homo sapiens
atattcagagatgtaccatgtta

SEQ ID NO: 253174 - DNA, 21 bp, Homo sapiens
atattcatcaaataaaccttg

SEQ ID NO: 253175 - DNA, 19 bp, Homo sapiens
atattcattaataggaaag

SEQ ID NO: 253176 - DNA, 19 bp, Homo sapiens
atattccagcagtgaaact

SEQ ID NO: 253177 - DNA, 23 bp, Homo sapiens
atattcctgaatgaaatatcaga

SEQ ID NO: 253178 - DNA, 21 bp, Homo sapiens
atattcctgcatttgtgaaat

SEQ ID NO: 253179 - DNA, 18 bp, Homo sapiens
atattctatatgaattta

SEQ ID NO: 253180 - DNA, 15 bp, Homo sapiens
atattctctgatgtt

SEQ ID NO: 253181 - DNA, 17 bp, Homo sapiens
atattctgataatgtat

SEQ ID NO: 253182 - DNA, 14 bp, Homo sapiens
catgtctcatattt

SEQ ID NO: 253183 - DNA, 21 bp, Homo sapiens
catgtctctacccactatgca

SEQ ID NO: 253184 - DNA, 13 bp, Homo sapiens
catgtctctgctt

SEQ ID NO: 253185 - DNA, 14 bp, Homo sapiens
catgtctgcatggc

SEQ ID NO: 253186 - DNA, 17 bp, Homo sapiens
catgtctgcatggcaga

SEQ ID NO: 253187 - DNA, 21 bp, Homo sapiens
catgtctgcatggcagaagcg

SEQ ID NO: 253188 - DNA, 20 bp, Homo sapiens
catgtctttggcttcagaat

SEQ ID NO: 253189 - DNA, 20 bp, Homo sapiens
catgtgagccaccgctgcca

SEQ ID NO: 253190 - DNA, 23 bp, Homo sapiens
catgtgagccaccgctgccagca

SEQ ID NO: 253191 - DNA, 15 bp, Homo sapiens
catgtgatctattac

SEQ ID NO: 253192 - DNA, 17 bp, Homo sapiens
catgtgattatggacat

SEQ ID NO: 253193 - DNA, 22 bp, Homo sapiens
catgtgattggcagcttcaaaa

SEQ ID NO: 253194 - DNA, 20 bp, Homo sapiens
catgtgcaactcttgtattg

SEQ ID NO: 253195 - DNA, 21 bp, Homo sapiens
catgtgcaattgtgagggaca

SEQ ID NO: 253196 - DNA, 24 bp, Homo sapiens
catgtgccaagattctactcttgt

SEQ ID NO: 253197 - DNA, 14 bp, Homo sapiens
catgtgccatctgt

SEQ ID NO: 253198 - DNA, 15 bp, Homo sapiens
catgtgcctgcacca

SEQ ID NO: 253199 - DNA, 17 bp, Homo sapiens
catgtgcctgcaccagg

SEQ ID NO: 253200 - DNA, 23 bp, Homo sapiens
catgtgctctgttttgacataat

SEQ ID NO: 253201 - DNA, 15 bp, Homo sapiens
catgtgctgctgtgg

SEQ ID NO: 253202 - DNA, 17 bp, Homo sapiens
catgtgctgctgtggca

SEQ ID NO: 253203 - DNA, 13 bp, Homo sapiens
catgtgctttgta

SEQ ID NO: 253204 - DNA, 17 bp, Homo sapiens
catgtgctttgtagctt

SEQ ID NO: 253205 - DNA, 21 bp, Homo sapiens
catgtggaaagtgaatttgaa

SEQ ID NO: 253206 - DNA, 23 bp, Homo sapiens
catgtggaaagtgaatttgaatg

SEQ ID NO: 253207 - DNA, 12 bp, Homo sapiens
catgtggccttg

SEQ ID NO: 253208 - DNA, 11 bp, Homo sapiens
catgtggctga

SEQ ID NO: 253209 - DNA, 17 bp, Homo sapiens
catgtggggacagggct

SEQ ID NO: 253210 - DNA, 20 bp, Homo sapiens
catgtggggatgtttgtgct

SEQ ID NO: 253211 - DNA, 15 bp, Homo sapiens
catgtggggccaggt

SEQ ID NO: 253212 - DNA, 17 bp, Homo sapiens
catgtggggccaggtca

SEQ ID NO: 253213 - DNA, 23 bp, Homo sapiens
catgtggggccaggtcacccttt

SEQ ID NO: 253214 - DNA, 16 bp, Homo sapiens
atatttataacagcat

SEQ ID NO: 253215 - DNA, 13 bp, Homo sapiens
atatttataactc

SEQ ID NO: 253216 - DNA, 15 bp, Homo sapiens
atatttataactcat

SEQ ID NO: 253217 - DNA, 20 bp, Homo sapiens
atatttataactcatcataa

SEQ ID NO: 253218 - DNA, 21 bp, Homo sapiens
atatttataactcatcataaa

SEQ ID NO: 253219 - DNA, 23 bp, Homo sapiens
atatttataactcatcataaaat

SEQ ID NO: 253220 - DNA, 15 bp, Homo sapiens
atatttatagggctt

SEQ ID NO: 253221 - DNA, 18 bp, Homo sapiens
atatttatcatatttaat

SEQ ID NO: 253222 - DNA, 20 bp, Homo sapiens
atatttatgtttaagtgctt

SEQ ID NO: 253223 - DNA, 12 bp, Homo sapiens
atatttattgaa

SEQ ID NO: 253224 - DNA, 22 bp, Homo sapiens
atatttattgtttatttatcag

SEQ ID NO: 253225 - DNA, 22 bp, Homo sapiens
atatttcacttaaactttgtca

SEQ ID NO: 253226 - DNA, 15 bp, Homo sapiens
atatttcattgaata

SEQ ID NO: 253227 - DNA, 17 bp, Homo sapiens
atatttcctcttctgta

SEQ ID NO: 253228 - DNA, 20 bp, Homo sapiens
atatttctaagcttatttct

SEQ ID NO: 253229 - DNA, 17 bp, Homo sapiens
atatttctcatttagca

SEQ ID NO: 253230 - DNA, 23 bp, Homo sapiens
atatttcttcaagtgagtggcat

SEQ ID NO: 253231 - DNA, 16 bp, Homo sapiens
atatttctttttcttg

SEQ ID NO: 253232 - DNA, 23 bp, Homo sapiens
atatttgaaactgctaattacac

SEQ ID NO: 253233 - DNA, 12 bp, Homo sapiens
atatttgaaaga

SEQ ID NO: 253234 - DNA, 14 bp, Homo sapiens
atatttgctggagt

SEQ ID NO: 253235 - DNA, 23 bp, Homo sapiens
atatttgctggagtgctggctcc

SEQ ID NO: 253236 - DNA, 14 bp, Homo sapiens
atatttgcttattt

SEQ ID NO: 253237 - DNA, 13 bp, Homo sapiens
atatttgcttttt

SEQ ID NO: 253238 - DNA, 23 bp, Homo sapiens
atatttggggtccttttttatac

SEQ ID NO: 253239 - DNA, 19 bp, Homo sapiens
atatttgtagctagaatat

SEQ ID NO: 253240 - DNA, 20 bp, Homo sapiens
atattttaataaaataaact

SEQ ID NO: 253241 - DNA, 12 bp, Homo sapiens
atattttatact

SEQ ID NO: 253242 - DNA, 14 bp, Homo sapiens
atattttatactgc

SEQ ID NO: 253243 - DNA, 15 bp, Homo sapiens
atattttatactgca

SEQ ID NO: 253244 - DNA, 20 bp, Homo sapiens
atattttatgtgagagaaag

SEQ ID NO: 253245 - DNA, 13 bp, Homo sapiens
atattttccttta

SEQ ID NO: 253246 - DNA, 22 bp, Homo sapiens
atattttctatatttgtaactt

SEQ ID NO: 253247 - DNA, 12 bp, Homo sapiens
atattttgaaag

SEQ ID NO: 253248 - DNA, 13 bp, Homo sapiens
atattttgtatat

SEQ ID NO: 253249 - DNA, 11 bp, Homo sapiens
atatttttaca

SEQ ID NO: 253250 - DNA, 13 bp, Homo sapiens
atatttttacaaa

SEQ ID NO: 253251 - DNA, 15 bp, Homo sapiens
atatttttgtttgtt

SEQ ID NO: 253252 - DNA, 16 bp, Homo sapiens
atatttttgtttgttt

SEQ ID NO: 253253 - DNA, 16 bp, Homo sapiens
atattttttatttcta

SEQ ID NO: 253254 - DNA, 14 bp, Homo sapiens
atatttttttctag

SEQ ID NO: 253255 - DNA, 18 bp, Homo sapiens
atatttttttctagctat

SEQ ID NO: 253256 - DNA, 16 bp, Homo sapiens
atcaaaaaaacaagtt

SEQ ID NO: 253257 - DNA, 11 bp, Homo sapiens
atcaaaaagag

SEQ ID NO: 253258 - DNA, 22 bp, Homo sapiens
atcaaaacctgtgccaggctga

SEQ ID NO: 253259 - DNA, 15 bp, Homo sapiens
atcaaaataaaaagt

SEQ ID NO: 253260 - DNA, 16 bp, Homo sapiens
atcaaacatgaaaaca

SEQ ID NO: 253261 - DNA, 17 bp, Homo sapiens
atcaaacatgaaaacat

SEQ ID NO: 253262 - DNA, 16 bp, Homo sapiens
atcaaactcgtctgat

SEQ ID NO: 253263 - DNA, 20 bp, Homo sapiens
atcaaactcgtctgatgttt

SEQ ID NO: 253264 - DNA, 23 bp, Homo sapiens
atcaaactctttgcccagttcat

SEQ ID NO: 253265 - DNA, 15 bp, Homo sapiens
atcaaagacacacag

SEQ ID NO: 253266 - DNA, 18 bp, Homo sapiens
atcaaagagagaaaataa

SEQ ID NO: 253267 - DNA, 20 bp, Homo sapiens
atcaaagctaggaaaggcag

SEQ ID NO: 253268 - DNA, 22 bp, Homo sapiens
atcaaagctaggaaaggcagaa

SEQ ID NO: 253269 - DNA, 20 bp, Homo sapiens
atcaaagtcaaaaatagcaa

SEQ ID NO: 253270 - DNA, 14 bp, Homo sapiens
atcaaatcattcaa

SEQ ID NO: 253271 - DNA, 23 bp, Homo sapiens
atcaaatcattcaaaactttcag

SEQ ID NO: 253272 - DNA, 21 bp, Homo sapiens
atcaacatctttttcctccct

SEQ ID NO: 253273 - DNA, 13 bp, Homo sapiens
atcaactcatgtt

SEQ ID NO: 253274 - DNA, 13 bp, Homo sapiens
atcaactctaata

SEQ ID NO: 253275 - DNA, 21 bp, Homo sapiens
atcaagatgtgacatgtttta

SEQ ID NO: 253276 - DNA, 14 bp, Homo sapiens
atcaagcccctgtc

SEQ ID NO: 253277 - DNA, 13 bp, Homo sapiens
atcaagcccttta

SEQ ID NO: 253278 - DNA, 13 bp, Homo sapiens
atcaagctaataa

SEQ ID NO: 253279 - DNA, 14 bp, Homo sapiens
atcaaggctgcctg

SEQ ID NO: 253280 - DNA, 15 bp, Homo sapiens
atcaaggctgcctgg

SEQ ID NO: 253281 - DNA, 21 bp, Homo sapiens
atcaaggctgcctggagaaag

SEQ ID NO: 253282 - DNA, 15 bp, Homo sapiens
atcaagtcccgaggc

SEQ ID NO: 253283 - DNA, 17 bp, Homo sapiens
atcaagtcccgaggcag

SEQ ID NO: 253284 - DNA, 17 bp, Homo sapiens
atcaagtggcatgtgct

SEQ ID NO: 253285 - DNA, 16 bp, Homo sapiens
atcaagtgtcttccat

SEQ ID NO: 253286 - DNA, 16 bp, Homo sapiens
atcaagtgtgctttag

SEQ ID NO: 253287 - DNA, 15 bp, Homo sapiens
atcaataaactgtgt

SEQ ID NO: 253288 - DNA, 14 bp, Homo sapiens
atcaatacttttgt

SEQ ID NO: 253289 - DNA, 18 bp, Homo sapiens
atcaatacttttgtgtat

SEQ ID NO: 253290 - DNA, 23 bp, Homo sapiens
atcaatacttttgtgtattctgt

SEQ ID NO: 253291 - DNA, 19 bp, Homo sapiens
atcaatagaaagtcatctt

SEQ ID NO: 253292 - DNA, 19 bp, Homo sapiens
atcaatcatctgtgtgaaa

SEQ ID NO: 253293 - DNA, 22 bp, Homo sapiens
atcaatcatctgtgtgaaaatg

SEQ ID NO: 253294 - DNA, 21 bp, Homo sapiens
atcaatcatgccctgccttgt

SEQ ID NO: 253295 - DNA, 19 bp, Homo sapiens
atcaatctggcttctgcat

SEQ ID NO: 253296 - DNA, 21 bp, Homo sapiens
atcaatctggcttctgcatta

SEQ ID NO: 253297 - DNA, 18 bp, Homo sapiens
atcaatgaatattgaagt

SEQ ID NO: 253298 - DNA, 21 bp, Homo sapiens
atcaatggcgcagtgcctctg

SEQ ID NO: 253299 - DNA, 22 bp, Homo sapiens
atcaatggcgcagtgcctctgg

SEQ ID NO: 253300 - DNA, 17 bp, Homo sapiens
atcaatgttcattgtaa

SEQ ID NO: 253301 - DNA, 18 bp, Homo sapiens
atcaatgttcattgtaat

SEQ ID NO: 253302 - DNA, 19 bp, Homo sapiens
atcaatgtttcttctaggt

SEQ ID NO: 253303 - DNA, 13 bp, Homo sapiens
atcaattaaatgt

SEQ ID NO: 253304 - DNA, 14 bp, Homo sapiens
atcaattaaatgta

SEQ ID NO: 253305 - DNA, 20 bp, Homo sapiens
atcaattaactgagtagctc

SEQ ID NO: 253306 - DNA, 21 bp, Homo sapiens
atcaattctgatacagcctta

SEQ ID NO: 253307 - DNA, 20 bp, Homo sapiens
atcaatttgtaattgcttac

SEQ ID NO: 253308 - DNA, 21 bp, Homo sapiens
atcaattttaacatttgatgt

SEQ ID NO: 253309 - DNA, 14 bp, Homo sapiens
atcaattttttaaa

SEQ ID NO: 253310 - DNA, 23 bp, Homo sapiens
atcacaaaagctgtgtctctgta

SEQ ID NO: 253311 - DNA, 22 bp, Homo sapiens
atcacaaatagtgttgatcaga

SEQ ID NO: 253312 - DNA, 15 bp, Homo sapiens
atcacacagtggcac

SEQ ID NO: 253313 - DNA, 14 bp, Homo sapiens
atcacacctctggg

SEQ ID NO: 253314 - DNA, 15 bp, Homo sapiens
atcacacctctgggc

SEQ ID NO: 253315 - DNA, 14 bp, Homo sapiens
atcacacttctgtg

SEQ ID NO: 253316 - DNA, 21 bp, Homo sapiens
atcacagatgggtattaaact

SEQ ID NO: 253317 - DNA, 14 bp, Homo sapiens
atcacagatgtgcc

SEQ ID NO: 253318 - DNA, 16 bp, Homo sapiens
atcacagatgtgccca

SEQ ID NO: 253319 - DNA, 23 bp, Homo sapiens
cattcaaaagcacaaaccctggg

SEQ ID NO: 253320 - DNA, 20 bp, Homo sapiens
cattcaaaatagttctattt

SEQ ID NO: 253321 - DNA, 15 bp, Homo sapiens
cattcaagcctgtga

SEQ ID NO: 253322 - DNA, 20 bp, Homo sapiens
cattcaatcaacctgcactt

SEQ ID NO: 253323 - DNA, 21 bp, Homo sapiens
cattcaatcaacctgcacttc

SEQ ID NO: 253324 - DNA, 19 bp, Homo sapiens
cattcacacacagcctggc

SEQ ID NO: 253325 - DNA, 13 bp, Homo sapiens
cattcacatttca

SEQ ID NO: 253326 - DNA, 11 bp, Homo sapiens
cattcactgat

SEQ ID NO: 253327 - DNA, 16 bp, Homo sapiens
cattcactgattggaa

SEQ ID NO: 253328 - DNA, 19 bp, Homo sapiens
cattcaggaacctggacca

SEQ ID NO: 253329 - DNA, 18 bp, Homo sapiens
cattcagtactttatgaa

SEQ ID NO: 253330 - DNA, 20 bp, Homo sapiens
cattcatatttgcaataaaa

SEQ ID NO: 253331 - DNA, 16 bp, Homo sapiens
cattcatctgggctgg

SEQ ID NO: 253332 - DNA, 22 bp, Homo sapiens
cattcatctttcctttgctctg

SEQ ID NO: 253333 - DNA, 16 bp, Homo sapiens
cattcatgttttaaaa

SEQ ID NO: 253334 - DNA, 15 bp, Homo sapiens
cattccaaatcatac

SEQ ID NO: 253335 - DNA, 18 bp, Homo sapiens
cattccaacaatggggtg

SEQ ID NO: 253336 - DNA, 23 bp, Homo sapiens
cattccaagggtatgggaagcca

SEQ ID NO: 253337 - DNA, 20 bp, Homo sapiens
cattccaagtcaacactctt

SEQ ID NO: 253338 - DNA, 18 bp, Homo sapiens
cattccactgttggtatt

SEQ ID NO: 253339 - DNA, 12 bp, Homo sapiens
cattccagctct

SEQ ID NO: 253340 - DNA, 14 bp, Homo sapiens
cattccagctctgc

SEQ ID NO: 253341 - DNA, 17 bp, Homo sapiens
cattccatattgggaat

SEQ ID NO: 253342 - DNA, 15 bp, Homo sapiens
cattccatcacagcc

SEQ ID NO: 253343 - DNA, 16 bp, Homo sapiens
cattccatgtgcccag

SEQ ID NO: 253344 - DNA, 18 bp, Homo sapiens
cattccatgtgcccagtt

SEQ ID NO: 253345 - DNA, 22 bp, Homo sapiens
cattcccacataatacattcca

SEQ ID NO: 253346 - DNA, 20 bp, Homo sapiens
cattcccactaagctttctc

SEQ ID NO: 253347 - DNA, 23 bp, Homo sapiens
cattcccactaagctttctcctt

SEQ ID NO: 253348 - DNA, 18 bp, Homo sapiens
cattcccatcactgctgt

SEQ ID NO: 253349 - DNA, 19 bp, Homo sapiens
cattcccccatgtggctga

SEQ ID NO: 253350 - DNA, 23 bp, Homo sapiens
cattccgttaggaataacactgc

SEQ ID NO: 253351 - DNA, 15 bp, Homo sapiens
cattcctcagctgcc

SEQ ID NO: 253352 - DNA, 16 bp, Homo sapiens
cattcctcagctgcca

SEQ ID NO: 253353 - DNA, 15 bp, Homo sapiens
cattcctgagattct

SEQ ID NO: 253354 - DNA, 20 bp, Homo sapiens
cattcctgagattctgggaa

SEQ ID NO: 253355 - DNA, 22 bp, Homo sapiens
cattcctgagattctgggaaag

SEQ ID NO: 253356 - DNA, 24 bp, Homo sapiens
cattcctgatggaattgttatact

SEQ ID NO: 253357 - DNA, 12 bp, Homo sapiens
cattcctggccc

SEQ ID NO: 253358 - DNA, 13 bp, Homo sapiens
cattcctggcccc

SEQ ID NO: 253359 - DNA, 20 bp, Homo sapiens
cattccttagcagctcaggc

SEQ ID NO: 253360 - DNA, 15 bp, Homo sapiens
cattccttgtcacca

SEQ ID NO: 253361 - DNA, 15 bp, Homo sapiens
cattcgtctgtccca

SEQ ID NO: 253362 - DNA, 16 bp, Homo sapiens
cattcgtctgtcccag

SEQ ID NO: 253363 - DNA, 20 bp, Homo sapiens
cattcgtctgtcccagagct

SEQ ID NO: 253364 - DNA, 16 bp, Homo sapiens
cattctacttcagctt

SEQ ID NO: 253365 - DNA, 17 bp, Homo sapiens
cattctacttcagcttt

SEQ ID NO: 253366 - DNA, 23 bp, Homo sapiens
cattctaggtaggggcccacttc

SEQ ID NO: 253367 - DNA, 20 bp, Homo sapiens
cattctatgacaataaattt

SEQ ID NO: 253368 - DNA, 16 bp, Homo sapiens
cattctcactcctacc

SEQ ID NO: 253369 - DNA, 16 bp, Homo sapiens
cattctcactctgctt

SEQ ID NO: 253370 - DNA, 23 bp, Homo sapiens
cattctccctccatggcaggaag

SEQ ID NO: 253371 - DNA, 20 bp, Homo sapiens
cattctcctgcctcagcctt

SEQ ID NO: 253372 - DNA, 21 bp, Homo sapiens
cattctcctgcctcagccttc

SEQ ID NO: 253373 - DNA, 17 bp, Homo sapiens
cattctgcctgcctggg

SEQ ID NO: 253374 - DNA, 17 bp, Homo sapiens
cattctgttgcccaggc

SEQ ID NO: 253375 - DNA, 18 bp, Homo sapiens
cattcttgtcacaataaa

SEQ ID NO: 253376 - DNA, 19 bp, Homo sapiens
cattcttgtcacaataaat

SEQ ID NO: 253377 - DNA, 17 bp, Homo sapiens
cattctttctgataact

SEQ ID NO: 253378 - DNA, 17 bp, Homo sapiens
cattctttcttggtgca

SEQ ID NO: 253379 - DNA, 17 bp, Homo sapiens
cattctttgtatcttaa

SEQ ID NO: 253380 - DNA, 20 bp, Homo sapiens
cattctttgtatcttaaatc

SEQ ID NO: 253381 - DNA, 22 bp, Homo sapiens
cattcttttcagcttgtttcta

SEQ ID NO: 253382 - DNA, 22 bp, Homo sapiens
cattgaaaatgtaagtaaatgt

SEQ ID NO: 253383 - DNA, 18 bp, Homo sapiens
cattgaaagaagagatga

SEQ ID NO: 253384 - DNA, 19 bp, Homo sapiens
cattgaaagagaaccagtt

SEQ ID NO: 253385 - DNA, 22 bp, Homo sapiens
cattgaaagagaaccagtttca

SEQ ID NO: 253386 - DNA, 13 bp, Homo sapiens
cattgaaataata

SEQ ID NO: 253387 - DNA, 18 bp, Homo sapiens
cattgaagtaatgaattt

SEQ ID NO: 253388 - DNA, 15 bp, Homo sapiens
cattgaatactttat

SEQ ID NO: 253389 - DNA, 20 bp, Homo sapiens
cattgaatgcgctttattgc

SEQ ID NO: 253390 - DNA, 21 bp, Homo sapiens
cattgacttcaagatgcctct

SEQ ID NO: 253391 - DNA, 20 bp, Homo sapiens
cattgatgagcactcctgat

SEQ ID NO: 253392 - DNA, 16 bp, Homo sapiens
cattgattgtcagcta

SEQ ID NO: 253393 - DNA, 21 bp, Homo sapiens
cattgcaaaaggttaagccat

SEQ ID NO: 253394 - DNA, 17 bp, Homo sapiens
cattgcactaaaagtga

SEQ ID NO: 253395 - DNA, 18 bp, Homo sapiens
cattgcactctagcctgg

SEQ ID NO: 253396 - DNA, 22 bp, Homo sapiens
cattgcatcatgaaactctttg

SEQ ID NO: 253397 - DNA, 16 bp, Homo sapiens
cattgcatttattgca

SEQ ID NO: 253398 - DNA, 17 bp, Homo sapiens
cattgccaccaggagaa

SEQ ID NO: 253399 - DNA, 13 bp, Homo sapiens
cattgccagtggt

SEQ ID NO: 253400 - DNA, 13 bp, Homo sapiens
cattgccttgagc

SEQ ID NO: 253401 - DNA, 14 bp, Homo sapiens
cattgccttgcatt

SEQ ID NO: 253402 - DNA, 18 bp, Homo sapiens
cattgcttattcttgagc

SEQ ID NO: 253403 - DNA, 11 bp, Homo sapiens
cattgcttcac

SEQ ID NO: 253404 - DNA, 23 bp, Homo sapiens
cattgctttgaagcagttgtgtc

SEQ ID NO: 253405 - DNA, 16 bp, Homo sapiens
cattggaagaccccac

SEQ ID NO: 253406 - DNA, 20 bp, Homo sapiens
cattggaagaccccacccaa

SEQ ID NO: 253407 - DNA, 12 bp, Homo sapiens
cattggatgcag

SEQ ID NO: 253408 - DNA, 17 bp, Homo sapiens
cattgggccatgtttaa

SEQ ID NO: 253409 - DNA, 14 bp, Homo sapiens
cattggtctgcatg

SEQ ID NO: 253410 - DNA, 17 bp, Homo sapiens
cattggttaaaatatta

SEQ ID NO: 253411 - DNA, 19 bp, Homo sapiens
cattgtaaatagtatttga

SEQ ID NO: 253412 - DNA, 22 bp, Homo sapiens
cattgtaatctttcatagccat

SEQ ID NO: 253413 - DNA, 21 bp, Homo sapiens
cattgtaatgttactgatcat

SEQ ID NO: 253414 - DNA, 16 bp, Homo sapiens
cattgtactccagcct

SEQ ID NO: 253415 - DNA, 18 bp, Homo sapiens
cattgtactccagcctgg

SEQ ID NO: 253416 - DNA, 21 bp, Homo sapiens
cattgtagaaacacagttttg

SEQ ID NO: 253417 - DNA, 14 bp, Homo sapiens
cattgtatatatgt

SEQ ID NO: 253418 - DNA, 20 bp, Homo sapiens
cattgtatatatgtgtgttt

SEQ ID NO: 253419 - DNA, 16 bp, Homo sapiens
cattgtatgatgtgtt

SEQ ID NO: 253420 - DNA, 18 bp, Homo sapiens
cattgtatgatgtgttgt

SEQ ID NO: 253421 - DNA, 16 bp, Homo sapiens
cattgtatgtatctat

SEQ ID NO: 253422 - DNA, 20 bp, Homo sapiens
cattgtccatgcctacagat

SEQ ID NO: 253423 - DNA, 14 bp, Homo sapiens
cattgtctttcctc

SEQ ID NO: 253424 - DNA, 15 bp, Homo sapiens
cattgtctttcctcc

SEQ ID NO: 253425 - DNA, 22 bp, Homo sapiens
cattgtctttcctcccttcttt

SEQ ID NO: 253426 - DNA, 20 bp, Homo sapiens
cattgtgaatgttgtcctgt

SEQ ID NO: 253427 - DNA, 16 bp, Homo sapiens
cattgtggctcctatc

SEQ ID NO: 253428 - DNA, 17 bp, Homo sapiens
cattgtgtgagcttcta

SEQ ID NO: 253429 - DNA, 19 bp, Homo sapiens
cattgtgtgagcttctaca

SEQ ID NO: 253430 - DNA, 19 bp, Homo sapiens
cattgttacaggtgtacta

SEQ ID NO: 253431 - DNA, 19 bp, Homo sapiens
cattgttattgtggaagat

SEQ ID NO: 253432 - DNA, 12 bp, Homo sapiens
cattgttccaca

SEQ ID NO: 253433 - DNA, 16 bp, Homo sapiens
cattgttgaggtggtc

SEQ ID NO: 253434 - DNA, 18 bp, Homo sapiens
cattgttgaggtggtctg

SEQ ID NO: 253435 - DNA, 14 bp, Homo sapiens
cattgtttgcttat

SEQ ID NO: 253436 - DNA, 19 bp, Homo sapiens
cattgtttgcttattgttc

SEQ ID NO: 253437 - DNA, 20 bp, Homo sapiens
cattgtttgcttattgttcc

SEQ ID NO: 253438 - DNA, 21 bp, Homo sapiens
cattgtttgcttattgttcca

SEQ ID NO: 253439 - DNA, 22 bp, Homo sapiens
cattgtttgcttattgttccaa

SEQ ID NO: 253440 - DNA, 12 bp, Homo sapiens
catttaaaaaaa

SEQ ID NO: 253441 - DNA, 12 bp, Homo sapiens
catttaaaatga

SEQ ID NO: 253442 - DNA, 17 bp, Homo sapiens
catttaaaatgattaga

SEQ ID NO: 253443 - DNA, 18 bp, Homo sapiens
catttaaactcatttgag

SEQ ID NO: 253444 - DNA, 17 bp, Homo sapiens
catttaataactttgct

SEQ ID NO: 253445 - DNA, 18 bp, Homo sapiens
catttaataactttgctg

SEQ ID NO: 253446 - DNA, 14 bp, Homo sapiens
catttaatcaatat

SEQ ID NO: 253447 - DNA, 19 bp, Homo sapiens
catttaatgtcgaggctct

SEQ ID NO: 253448 - DNA, 14 bp, Homo sapiens
catttacatgttct

SEQ ID NO: 253449 - DNA, 21 bp, Homo sapiens
catttagaatttgaaaggaaa

SEQ ID NO: 253450 - DNA, 16 bp, Homo sapiens
catttaggagaagttg

SEQ ID NO: 253451 - DNA, 16 bp, Homo sapiens
catttaggtgaggaag

SEQ ID NO: 253452 - DNA, 13 bp, Homo sapiens
atcacagcctcca

SEQ ID NO: 253453 - DNA, 15 bp, Homo sapiens
atcacagcctccagg

SEQ ID NO: 253454 - DNA, 18 bp, Homo sapiens
atcacagcctccagggcc

SEQ ID NO: 253455 - DNA, 19 bp, Homo sapiens
atcacagcctccagggccc

SEQ ID NO: 253456 - DNA, 19 bp, Homo sapiens
atcacagggttgggcccag

SEQ ID NO: 253457 - DNA, 20 bp, Homo sapiens
atcacagggttgggcccaga

SEQ ID NO: 253458 - DNA, 23 bp, Homo sapiens
atcacagggttgggcccagatct

SEQ ID NO: 253459 - DNA, 15 bp, Homo sapiens
atcaccacatctttt

SEQ ID NO: 253460 - DNA, 21 bp, Homo sapiens
atcaccagcccggcctgctcc

SEQ ID NO: 253461 - DNA, 16 bp, Homo sapiens
atcacccccctgctta

SEQ ID NO: 253462 - DNA, 15 bp, Homo sapiens
atcaccccttcccca

SEQ ID NO: 253463 - DNA, 12 bp, Homo sapiens
atcacctcccct

SEQ ID NO: 253464 - DNA, 15 bp, Homo sapiens
atcacctcccctcct

SEQ ID NO: 253465 - DNA, 22 bp, Homo sapiens
atcacctctctgtagtttatgg

SEQ ID NO: 253466 - DNA, 14 bp, Homo sapiens
atcacctgtcatca

SEQ ID NO: 253467 - DNA, 15 bp, Homo sapiens
atcaccttttctaaa

SEQ ID NO: 253468 - DNA, 14 bp, Homo sapiens
atcacggcatgttt

SEQ ID NO: 253469 - DNA, 22 bp, Homo sapiens
atcactaataaagtctgtctgc

SEQ ID NO: 253470 - DNA, 14 bp, Homo sapiens
atcactactgcagt

SEQ ID NO: 253471 - DNA, 15 bp, Homo sapiens
atcactataaccatc

SEQ ID NO: 253472 - DNA, 15 bp, Homo sapiens
atcactatccatgca

SEQ ID NO: 253473 - DNA, 21 bp, Homo sapiens
atcactatccatgcaccaaac

SEQ ID NO: 253474 - DNA, 15 bp, Homo sapiens
atcactatgcatttt

SEQ ID NO: 253475 - DNA, 13 bp, Homo sapiens
atcactattctta

SEQ ID NO: 253476 - DNA, 17 bp, Homo sapiens
atcactattcttaagca

SEQ ID NO: 253477 - DNA, 21 bp, Homo sapiens
atcactattcttaagcacttt

SEQ ID NO: 253478 - DNA, 23 bp, Homo sapiens
atcactattcttaagcactttga

SEQ ID NO: 253479 - DNA, 23 bp, Homo sapiens
atcactcaaccataacacttgat

SEQ ID NO: 253480 - DNA, 13 bp, Homo sapiens
atcactccctgga

SEQ ID NO: 253481 - DNA, 16 bp, Homo sapiens
atcactccctggatgt

SEQ ID NO: 253482 - DNA, 16 bp, Homo sapiens
atcactgcacctcttt

SEQ ID NO: 253483 - DNA, 13 bp, Homo sapiens
atcactggatgaa

SEQ ID NO: 253484 - DNA, 21 bp, Homo sapiens
atcactgtctttcctagatgg

SEQ ID NO: 253485 - DNA, 12 bp, Homo sapiens
atcactttgctc

SEQ ID NO: 253486 - DNA, 13 bp, Homo sapiens
atcacttttcagt

SEQ ID NO: 253487 - DNA, 14 bp, Homo sapiens
atcagaaagttggc

SEQ ID NO: 253488 - DNA, 15 bp, Homo sapiens
atcagaaatttttat

SEQ ID NO: 253489 - DNA, 23 bp, Homo sapiens
atcagaactgggaaaacagtgaa

SEQ ID NO: 253490 - DNA, 17 bp, Homo sapiens
atcagaagataacttga

SEQ ID NO: 253491 - DNA, 18 bp, Homo sapiens
atcagaagcctattgtaa

SEQ ID NO: 253492 - DNA, 13 bp, Homo sapiens
atcagacacaatt

SEQ ID NO: 253493 - DNA, 21 bp, Homo sapiens
atcagacctgtcttccaagga

SEQ ID NO: 253494 - DNA, 15 bp, Homo sapiens
atcagataagacata

SEQ ID NO: 253495 - DNA, 19 bp, Homo sapiens
atcagataagacatatctc

SEQ ID NO: 253496 - DNA, 22 bp, Homo sapiens
atcagataagacatatctctaa

SEQ ID NO: 253497 - DNA, 13 bp, Homo sapiens
atcagatcttaca

SEQ ID NO: 253498 - DNA, 23 bp, Homo sapiens
atcagatgactagaaagtgaata

SEQ ID NO: 253499 - DNA, 23 bp, Homo sapiens
atcagatggaaatattttgataa

SEQ ID NO: 253500 - DNA, 12 bp, Homo sapiens
atcagcagagag

SEQ ID NO: 253501 - DNA, 12 bp, Homo sapiens
atcagcagtgat

SEQ ID NO: 253502 - DNA, 22 bp, Homo sapiens
atcagcattcaaaatagttcta

SEQ ID NO: 253503 - DNA, 15 bp, Homo sapiens
atcagccacattcta

SEQ ID NO: 253504 - DNA, 22 bp, Homo sapiens
atcagccccgctcctcccctct

SEQ ID NO: 253505 - DNA, 11 bp, Homo sapiens
atcagcccctg

SEQ ID NO: 253506 - DNA, 15 bp, Homo sapiens
atcagcccctgctgc

SEQ ID NO: 253507 - DNA, 17 bp, Homo sapiens
atcagcccctgctgctc

SEQ ID NO: 253508 - DNA, 24 bp, Homo sapiens
atcagccctgcccttcagcatcct

SEQ ID NO: 253509 - DNA, 11 bp, Homo sapiens
atcagcctctt

SEQ ID NO: 253510 - DNA, 18 bp, Homo sapiens
atcagcctgagtctcctg

SEQ ID NO: 253511 - DNA, 22 bp, Homo sapiens
atcagctatgcaaatcagtctc

SEQ ID NO: 253512 - DNA, 22 bp, Homo sapiens
atcagctcccttcccctgcctg

SEQ ID NO: 253513 - DNA, 13 bp, Homo sapiens
atcagctctctgc

SEQ ID NO: 253514 - DNA, 16 bp, Homo sapiens
atcagctgctttgtta

SEQ ID NO: 253515 - DNA, 15 bp, Homo sapiens
atcagctttccctgg

SEQ ID NO: 253516 - DNA, 18 bp, Homo sapiens
atcagctttccctggctc

SEQ ID NO: 253517 - DNA, 20 bp, Homo sapiens
atcagctttccctggctcag

SEQ ID NO: 253518 - DNA, 21 bp, Homo sapiens
atcagctttccctggctcagg

SEQ ID NO: 253519 - DNA, 23 bp, Homo sapiens
atcagctttccctggctcaggga

SEQ ID NO: 253520 - DNA, 19 bp, Homo sapiens
atcagcttttaataaaatt

SEQ ID NO: 253521 - DNA, 19 bp, Homo sapiens
atcagcttttgttctagac

SEQ ID NO: 253522 - DNA, 20 bp, Homo sapiens
atcagcttttgttctagact

SEQ ID NO: 253523 - DNA, 21 bp, Homo sapiens
atcaggaaatatatatgtgtg

SEQ ID NO: 253524 - DNA, 18 bp, Homo sapiens
atcaggatgaacccagga

SEQ ID NO: 253525 - DNA, 22 bp, Homo sapiens
atcaggcactgcgccacctgct

SEQ ID NO: 253526 - DNA, 16 bp, Homo sapiens
atcaggcactggtggc

SEQ ID NO: 253527 - DNA, 17 bp, Homo sapiens
atcaggcttggaatgaa

SEQ ID NO: 253528 - DNA, 18 bp, Homo sapiens
atcaggcttggaatgaat

SEQ ID NO: 253529 - DNA, 14 bp, Homo sapiens
atcagggaatccag

SEQ ID NO: 253530 - DNA, 19 bp, Homo sapiens
atcagggaatccagctccc

SEQ ID NO: 253531 - DNA, 18 bp, Homo sapiens
atcaggtgatccacctgc

SEQ ID NO: 253532 - DNA, 19 bp, Homo sapiens
atcaggtgatccacctgcc

SEQ ID NO: 253533 - DNA, 14 bp, Homo sapiens
atcagtattgtgta

SEQ ID NO: 253534 - DNA, 16 bp, Homo sapiens
atcagtattgtgtaaa

SEQ ID NO: 253535 - DNA, 22 bp, Homo sapiens
atcagtctttgtcaatgctcta

SEQ ID NO: 253536 - DNA, 21 bp, Homo sapiens
atcagtgggcaggataaactg

SEQ ID NO: 253537 - DNA, 19 bp, Homo sapiens
atcagtgtgtctaaatttg

SEQ ID NO: 253538 - DNA, 17 bp, Homo sapiens
atcagtgttcttctcaa

SEQ ID NO: 253539 - DNA, 22 bp, Homo sapiens
atcagtgttcttctcaaggaca

SEQ ID NO: 253540 - DNA, 13 bp, Homo sapiens
atcagtgtttaaa

SEQ ID NO: 253541 - DNA, 16 bp, Homo sapiens
atcagttattcattct

SEQ ID NO: 253542 - DNA, 20 bp, Homo sapiens
atcagttcccccagtacctc

SEQ ID NO: 253543 - DNA, 16 bp, Homo sapiens
atcagttttgtgtaca

SEQ ID NO: 253544 - DNA, 12 bp, Homo sapiens
atcataaaataa

SEQ ID NO: 253545 - DNA, 20 bp, Homo sapiens
atcataacatagttgaaaaa

SEQ ID NO: 253546 - DNA, 23 bp, Homo sapiens
atcataactggcttctgcttgtc

SEQ ID NO: 253547 - DNA, 23 bp, Homo sapiens
atcatacttgctccttgaataag

SEQ ID NO: 253548 - DNA, 13 bp, Homo sapiens
atcatattgatga

SEQ ID NO: 253549 - DNA, 14 bp, Homo sapiens
atcatattgatgaa

SEQ ID NO: 253550 - DNA, 23 bp, Homo sapiens
atcatatttaataggataaatta

SEQ ID NO: 253551 - DNA, 15 bp, Homo sapiens
atcatcccaacagcc

SEQ ID NO: 253552 - DNA, 18 bp, Homo sapiens
atcatcccaacagccaag

SEQ ID NO: 253553 - DNA, 19 bp, Homo sapiens
atcatctattgagtgtaca

SEQ ID NO: 253554 - DNA, 14 bp, Homo sapiens
atcatctccatcat

SEQ ID NO: 253555 - DNA, 15 bp, Homo sapiens
atcatctctgccttt

SEQ ID NO: 253556 - DNA, 14 bp, Homo sapiens
atcatctctgtaaa

SEQ ID NO: 253557 - DNA, 13 bp, Homo sapiens
atcatctgtgtga

SEQ ID NO: 253558 - DNA, 13 bp, Homo sapiens
atcatgaatttta

SEQ ID NO: 253559 - DNA, 20 bp, Homo sapiens
atcatgacactcgtataagc

SEQ ID NO: 253560 - DNA, 16 bp, Homo sapiens
atcatgacatgttata

SEQ ID NO: 253561 - DNA, 12 bp, Homo sapiens
atcatgcaggaa

SEQ ID NO: 253562 - DNA, 13 bp, Homo sapiens
atcatgcaggaac

SEQ ID NO: 253563 - DNA, 14 bp, Homo sapiens
atcatgcattgttg

SEQ ID NO: 253564 - DNA, 19 bp, Homo sapiens
atcatggaggtttgaagat

SEQ ID NO: 253565 - DNA, 21 bp, Homo sapiens
atcatggcagtgggaccaagc

SEQ ID NO: 253566 - DNA, 23 bp, Homo sapiens
atcatgtgtgagataacttcctt

SEQ ID NO: 253567 - DNA, 19 bp, Homo sapiens
atcatgttaatcctagctg

SEQ ID NO: 253568 - DNA, 13 bp, Homo sapiens
atcattaaacatg

SEQ ID NO: 253569 - DNA, 19 bp, Homo sapiens
atcattaaacatgaattta

SEQ ID NO: 253570 - DNA, 23 bp, Homo sapiens
atcattaaacatgaatttaatgt

SEQ ID NO: 253571 - DNA, 22 bp, Homo sapiens
atcattaaagcctgagtttgct

SEQ ID NO: 253572 - DNA, 18 bp, Homo sapiens
atcattcaatatctgaca

SEQ ID NO: 253573 - DNA, 20 bp, Homo sapiens
atcattctttgtatcttaaa

SEQ ID NO: 253574 - DNA, 18 bp, Homo sapiens
atcattgattgtcagcta

SEQ ID NO: 253575 - DNA, 22 bp, Homo sapiens
atcattgcactctagcctgggc

SEQ ID NO: 253576 - DNA, 13 bp, Homo sapiens
atcattgtagaaa

SEQ ID NO: 253577 - DNA, 23 bp, Homo sapiens
atcatttcagtatcatctccatc

SEQ ID NO: 253578 - DNA, 16 bp, Homo sapiens
atcatttccagcaaaa

SEQ ID NO: 253579 - DNA, 17 bp, Homo sapiens
atcatttccagcaaaat

SEQ ID NO: 253580 - DNA, 19 bp, Homo sapiens
atcatttccagcaaaatat

SEQ ID NO: 253581 - DNA, 20 bp, Homo sapiens
atcatttccagcaaaatata

SEQ ID NO: 253582 - DNA, 15 bp, Homo sapiens
atcatttctcactgt

SEQ ID NO: 253583 - DNA, 22 bp, Homo sapiens
atcatttcttgggccctcctga

SEQ ID NO: 253584 - DNA, 18 bp, Homo sapiens
atcatttgcagctgctgg

SEQ ID NO: 253585 - DNA, 18 bp, Homo sapiens
catttagtcctcaccttc

SEQ ID NO: 253586 - DNA, 22 bp, Homo sapiens
catttataaccccagcctgacc

SEQ ID NO: 253587 - DNA, 17 bp, Homo sapiens
catttataatgtttgct

SEQ ID NO: 253588 - DNA, 15 bp, Homo sapiens
catttatcattcttg

SEQ ID NO: 253589 - DNA, 15 bp, Homo sapiens
catttatcttatcta

SEQ ID NO: 253590 - DNA, 13 bp, Homo sapiens
catttatcttctg

SEQ ID NO: 253591 - DNA, 20 bp, Homo sapiens
catttatcttctgtttttct

SEQ ID NO: 253592 - DNA, 19 bp, Homo sapiens
catttatgagtaactatta

SEQ ID NO: 253593 - DNA, 23 bp, Homo sapiens
catttatgagtaactattattat

SEQ ID NO: 253594 - DNA, 13 bp, Homo sapiens
catttatgcatga

SEQ ID NO: 253595 - DNA, 14 bp, Homo sapiens
catttatgcatgag

SEQ ID NO: 253596 - DNA, 15 bp, Homo sapiens
catttatgcatgaga

SEQ ID NO: 253597 - DNA, 23 bp, Homo sapiens
catttatgcatgagaactaaata

SEQ ID NO: 253598 - DNA, 20 bp, Homo sapiens
catttatggtcaacacttaa

SEQ ID NO: 253599 - DNA, 22 bp, Homo sapiens
catttatgtgtgaagcaaattt

SEQ ID NO: 253600 - DNA, 16 bp, Homo sapiens
catttattattttaat

SEQ ID NO: 253601 - DNA, 17 bp, Homo sapiens
catttattattttaata

SEQ ID NO: 253602 - DNA, 22 bp, Homo sapiens
catttattattttaatatttat

SEQ ID NO: 253603 - DNA, 15 bp, Homo sapiens
catttattttaagca

SEQ ID NO: 253604 - DNA, 17 bp, Homo sapiens
catttattttttacatt

SEQ ID NO: 253605 - DNA, 19 bp, Homo sapiens
catttattttttacattat

SEQ ID NO: 253606 - DNA, 17 bp, Homo sapiens
catttcaagatccaaat

SEQ ID NO: 253607 - DNA, 14 bp, Homo sapiens
catttcatcctgtt

SEQ ID NO: 253608 - DNA, 21 bp, Homo sapiens
catttcattcctaacacagca

SEQ ID NO: 253609 - DNA, 20 bp, Homo sapiens
catttccaacaccacagaca

SEQ ID NO: 253610 - DNA, 21 bp, Homo sapiens
catttccaacaccacagacac

SEQ ID NO: 253611 - DNA, 22 bp, Homo sapiens
catttccaccaagggtatctgc

SEQ ID NO: 253612 - DNA, 20 bp, Homo sapiens
catttccagggcagcagccg

SEQ ID NO: 253613 - DNA, 18 bp, Homo sapiens
catttcccctgtggtttg

SEQ ID NO: 253614 - DNA, 19 bp, Homo sapiens
catttcctcaggcaattcc

SEQ ID NO: 253615 - DNA, 15 bp, Homo sapiens
catttcctctctatc

SEQ ID NO: 253616 - DNA, 21 bp, Homo sapiens
catttcctctctatctttttt

SEQ ID NO: 253617 - DNA, 20 bp, Homo sapiens
catttcctctgagctgttat

SEQ ID NO: 253618 - DNA, 17 bp, Homo sapiens
catttctaaaggcctct

SEQ ID NO: 253619 - DNA, 18 bp, Homo sapiens
catttctaaaggcctctt

SEQ ID NO: 253620 - DNA, 17 bp, Homo sapiens
catttctactttgacta

SEQ ID NO: 253621 - DNA, 12 bp, Homo sapiens
catttctcactg

SEQ ID NO: 253622 - DNA, 13 bp, Homo sapiens
catttctcatgtg

SEQ ID NO: 253623 - DNA, 18 bp, Homo sapiens
catttctcatgtgctttg

SEQ ID NO: 253624 - DNA, 13 bp, Homo sapiens
catttctgccagc

SEQ ID NO: 253625 - DNA, 12 bp, Homo sapiens
catttctgtctc

SEQ ID NO: 253626 - DNA, 22 bp, Homo sapiens
catttcttatggaaaggtcctg

SEQ ID NO: 253627 - DNA, 15 bp, Homo sapiens
catttcttcagaggg

SEQ ID NO: 253628 - DNA, 12 bp, Homo sapiens
catttcttgggc

SEQ ID NO: 253629 - DNA, 17 bp, Homo sapiens
catttcttgggccctcc

SEQ ID NO: 253630 - DNA, 16 bp, Homo sapiens
catttctttatttctg

SEQ ID NO: 253631 - DNA, 13 bp, Homo sapiens
catttgacacata

SEQ ID NO: 253632 - DNA, 14 bp, Homo sapiens
catttgatgctaaa

SEQ ID NO: 253633 - DNA, 15 bp, Homo sapiens
catttgattctgtgt

SEQ ID NO: 253634 - DNA, 14 bp, Homo sapiens
catttgattgtttt

SEQ ID NO: 253635 - DNA, 19 bp, Homo sapiens
catttgcacaggttttcag

SEQ ID NO: 253636 - DNA, 14 bp, Homo sapiens
catttgcagctgct

SEQ ID NO: 253637 - DNA, 16 bp, Homo sapiens
catttgcagctgctgg

SEQ ID NO: 253638 - DNA, 17 bp, Homo sapiens
catttgccatgctgcta

SEQ ID NO: 253639 - DNA, 19 bp, Homo sapiens
catttgcctaattcctggc

SEQ ID NO: 253640 - DNA, 13 bp, Homo sapiens
catttgctaatga

SEQ ID NO: 253641 - DNA, 18 bp, Homo sapiens
catttgctaatgaatttt

SEQ ID NO: 253642 - DNA, 14 bp, Homo sapiens
catttgctcctttc

SEQ ID NO: 253643 - DNA, 19 bp, Homo sapiens
catttgctctttcatctct

SEQ ID NO: 253644 - DNA, 11 bp, Homo sapiens
catttgctgaa

SEQ ID NO: 253645 - DNA, 20 bp, Homo sapiens
catttgctgaataacaacaa

SEQ ID NO: 253646 - DNA, 21 bp, Homo sapiens
catttggagacacaactattt

SEQ ID NO: 253647 - DNA, 18 bp, Homo sapiens
catttggggcctttccca

SEQ ID NO: 253648 - DNA, 23 bp, Homo sapiens
catttggtggcctaatttacaag

SEQ ID NO: 253649 - DNA, 15 bp, Homo sapiens
catttggtggctcta

SEQ ID NO: 253650 - DNA, 22 bp, Homo sapiens
catttggtggtactttattctt

SEQ ID NO: 253651 - DNA, 12 bp, Homo sapiens
catttgtaataa

SEQ ID NO: 253652 - DNA, 14 bp, Homo sapiens
catttgtaataaag

SEQ ID NO: 253653 - DNA, 17 bp, Homo sapiens
catttgtaataaagtat

SEQ ID NO: 253654 - DNA, 18 bp, Homo sapiens
catttgtaataaagtata

SEQ ID NO: 253655 - DNA, 18 bp, Homo sapiens
catttgtaatgtatctta

SEQ ID NO: 253656 - DNA, 15 bp, Homo sapiens
catttgtacattcct

SEQ ID NO: 253657 - DNA, 14 bp, Homo sapiens
catttgtcacagaa

SEQ ID NO: 253658 - DNA, 19 bp, Homo sapiens
catttgtcctgcagagctg

SEQ ID NO: 253659 - DNA, 19 bp, Homo sapiens
catttgtcttagagagaga

SEQ ID NO: 253660 - DNA, 14 bp, Homo sapiens
catttgtgaaatga

SEQ ID NO: 253661 - DNA, 12 bp, Homo sapiens
catttgtgaggc

SEQ ID NO: 253662 - DNA, 14 bp, Homo sapiens
catttgtgtcaatg

SEQ ID NO: 253663 - DNA, 15 bp, Homo sapiens
catttgtgtcaatgg

SEQ ID NO: 253664 - DNA, 15 bp, Homo sapiens
catttgtgtctgcct

SEQ ID NO: 253665 - DNA, 20 bp, Homo sapiens
catttgtgtctgcctgcctc

SEQ ID NO: 253666 - DNA, 16 bp, Homo sapiens
cattttaaaatcaact

SEQ ID NO: 253667 - DNA, 18 bp, Homo sapiens
cattttaaagttaaacat

SEQ ID NO: 253668 - DNA, 16 bp, Homo sapiens
cattttaaataaaaga

SEQ ID NO: 253669 - DNA, 12 bp, Homo sapiens
cattttaacagt

SEQ ID NO: 253670 - DNA, 16 bp, Homo sapiens
cattttaactttatca

SEQ ID NO: 253671 - DNA, 22 bp, Homo sapiens
cattttactgtacagattgctg

SEQ ID NO: 253672 - DNA, 17 bp, Homo sapiens
cattttactgtctgtaa

SEQ ID NO: 253673 - DNA, 17 bp, Homo sapiens
cattttactttttcctg

SEQ ID NO: 253674 - DNA, 20 bp, Homo sapiens
cattttactttttcctggct

SEQ ID NO: 253675 - DNA, 19 bp, Homo sapiens
cattttagacagtaagtat

SEQ ID NO: 253676 - DNA, 14 bp, Homo sapiens
cattttagtgactg

SEQ ID NO: 253677 - DNA, 16 bp, Homo sapiens
cattttagtgactgta

SEQ ID NO: 253678 - DNA, 21 bp, Homo sapiens
cattttattcacatatgtctt

SEQ ID NO: 253679 - DNA, 15 bp, Homo sapiens
cattttatttattag

SEQ ID NO: 253680 - DNA, 23 bp, Homo sapiens
cattttcagcatcaaacatgaaa

SEQ ID NO: 253681 - DNA, 14 bp, Homo sapiens
cattttccccccac

SEQ ID NO: 253682 - DNA, 20 bp, Homo sapiens
cattttccccccactctccc

SEQ ID NO: 253683 - DNA, 13 bp, Homo sapiens
cattttcctggga

SEQ ID NO: 253684 - DNA, 12 bp, Homo sapiens
cattttcctttc

SEQ ID NO: 253685 - DNA, 17 bp, Homo sapiens
cattttctaaactgttt

SEQ ID NO: 253686 - DNA, 18 bp, Homo sapiens
cattttctaaactgtttt

SEQ ID NO: 253687 - DNA, 12 bp, Homo sapiens
cattttctctcc

SEQ ID NO: 253688 - DNA, 21 bp, Homo sapiens
cattttctgggttctgggtgg

SEQ ID NO: 253689 - DNA, 12 bp, Homo sapiens
cattttcttgtc

SEQ ID NO: 253690 - DNA, 22 bp, Homo sapiens
cattttcttgtcaatggaagaa

SEQ ID NO: 253691 - DNA, 15 bp, Homo sapiens
cattttgaaatattc

SEQ ID NO: 253692 - DNA, 15 bp, Homo sapiens
cattttgcagcagtg

SEQ ID NO: 253693 - DNA, 18 bp, Homo sapiens
cattttgcagcagtgagt

SEQ ID NO: 253694 - DNA, 13 bp, Homo sapiens
cattttgcctttc

SEQ ID NO: 253695 - DNA, 18 bp, Homo sapiens
cattttgcgatgtgtttt

SEQ ID NO: 253696 - DNA, 12 bp, Homo sapiens
cattttgcttta

SEQ ID NO: 253697 - DNA, 13 bp, Homo sapiens
cattttgctttat

SEQ ID NO: 253698 - DNA, 12 bp, Homo sapiens
cattttgtaact

SEQ ID NO: 253699 - DNA, 14 bp, Homo sapiens
cattttgtaactgc

SEQ ID NO: 253700 - DNA, 13 bp, Homo sapiens
cattttgtagcta

SEQ ID NO: 253701 - DNA, 14 bp, Homo sapiens
cattttgtatgtat

SEQ ID NO: 253702 - DNA, 19 bp, Homo sapiens
cattttgtatgtatgtgta

SEQ ID NO: 253703 - DNA, 14 bp, Homo sapiens
cattttgtctggct

SEQ ID NO: 253704 - DNA, 21 bp, Homo sapiens
cattttgtctggctgtggccc

SEQ ID NO: 253705 - DNA, 15 bp, Homo sapiens
cattttgttatagaa

SEQ ID NO: 253706 - DNA, 18 bp, Homo sapiens
catttttaatattactgt

SEQ ID NO: 253707 - DNA, 21 bp, Homo sapiens
catttttaatattactgtctt

SEQ ID NO: 253708 - DNA, 15 bp, Homo sapiens
catttttacaataaa

SEQ ID NO: 253709 - DNA, 21 bp, Homo sapiens
catttttactaaagcagtgtt

SEQ ID NO: 253710 - DNA, 13 bp, Homo sapiens
catttttcccagg

SEQ ID NO: 253711 - DNA, 14 bp, Homo sapiens
catttttcccagga

SEQ ID NO: 253712 - DNA, 15 bp, Homo sapiens
catttttcccaggac

SEQ ID NO: 253713 - DNA, 12 bp, Homo sapiens
catttttctggc

SEQ ID NO: 253714 - DNA, 13 bp, Homo sapiens
catttttgtattt

SEQ ID NO: 253715 - DNA, 22 bp, Homo sapiens
catttttgtgggggctagaaaa

SEQ ID NO: 253716 - DNA, 19 bp, Homo sapiens
catttttttcactcagaat

SEQ ID NO: 253717 - DNA, 19 bp, Homo sapiens
ccaaaaacaataaacgaaa

SEQ ID NO: 253718 - DNA, 15 bp, Homo sapiens
ccaaaaccacagccc

SEQ ID NO: 253719 - DNA, 14 bp, Homo sapiens
ccaaaacccatcgt

SEQ ID NO: 253720 - DNA, 12 bp, Homo sapiens
ccaaaatcattc

SEQ ID NO: 253721 - DNA, 13 bp, Homo sapiens
atcatttgctttt

SEQ ID NO: 253722 - DNA, 15 bp, Homo sapiens
atcattttaattatt

SEQ ID NO: 253723 - DNA, 24 bp, Homo sapiens
atcattttattcacatatgtctta

SEQ ID NO: 253724 - DNA, 14 bp, Homo sapiens
atcattttcacctc

SEQ ID NO: 253725 - DNA, 19 bp, Homo sapiens
atcattttgcctcttttct

SEQ ID NO: 253726 - DNA, 22 bp, Homo sapiens
atcattttgggaaattcttgca

SEQ ID NO: 253727 - DNA, 21 bp, Homo sapiens
atccaaagaacttgatttgca

SEQ ID NO: 253728 - DNA, 14 bp, Homo sapiens
atccaaagactgta

SEQ ID NO: 253729 - DNA, 16 bp, Homo sapiens
atccaaagcattgcag

SEQ ID NO: 253730 - DNA, 12 bp, Homo sapiens
atccaaatctag

SEQ ID NO: 253731 - DNA, 19 bp, Homo sapiens
atccaaatgctgtgcaaac

SEQ ID NO: 253732 - DNA, 13 bp, Homo sapiens
atccaactccagg

SEQ ID NO: 253733 - DNA, 14 bp, Homo sapiens
atccaactttgtag

SEQ ID NO: 253734 - DNA, 14 bp, Homo sapiens
atccaaggcaaaca

SEQ ID NO: 253735 - DNA, 17 bp, Homo sapiens
atccaaggcaaacaatc

SEQ ID NO: 253736 - DNA, 18 bp, Homo sapiens
atccaaggcaaacaatcc

SEQ ID NO: 253737 - DNA, 18 bp, Homo sapiens
atccaatcctcactgggt

SEQ ID NO: 253738 - DNA, 13 bp, Homo sapiens
atccaattatgtg

SEQ ID NO: 253739 - DNA, 14 bp, Homo sapiens
atccaattatgtga

SEQ ID NO: 253740 - DNA, 20 bp, Homo sapiens
atccaattgatgtatatgtt

SEQ ID NO: 253741 - DNA, 14 bp, Homo sapiens
atccacagttgtca

SEQ ID NO: 253742 - DNA, 19 bp, Homo sapiens
atccactaggtgcccagtc

SEQ ID NO: 253743 - DNA, 16 bp, Homo sapiens
atccactctaccctcc

SEQ ID NO: 253744 - DNA, 18 bp, Homo sapiens
atccactctaccctccca

SEQ ID NO: 253745 - DNA, 21 bp, Homo sapiens
atccagacatcatgaatttta

SEQ ID NO: 253746 - DNA, 13 bp, Homo sapiens
atccagactgtaa

SEQ ID NO: 253747 - DNA, 21 bp, Homo sapiens
atccagaggtgagggaggcct

SEQ ID NO: 253748 - DNA, 23 bp, Homo sapiens
atccagaggtgagggaggcctga

SEQ ID NO: 253749 - DNA, 14 bp, Homo sapiens
atccagcatgtgtg

SEQ ID NO: 253750 - DNA, 17 bp, Homo sapiens
atccagcatgtgtgtgt

SEQ ID NO: 253751 - DNA, 19 bp, Homo sapiens
atccagccccatagaaaac

SEQ ID NO: 253752 - DNA, 21 bp, Homo sapiens
atccagccgcaaatccatacc

SEQ ID NO: 253753 - DNA, 22 bp, Homo sapiens
atccagccgcaaatccataccc

SEQ ID NO: 253754 - DNA, 11 bp, Homo sapiens
atccagctccc

SEQ ID NO: 253755 - DNA, 15 bp, Homo sapiens
atccagctccctaga

SEQ ID NO: 253756 - DNA, 17 bp, Homo sapiens
atccagctccctagact

SEQ ID NO: 253757 - DNA, 15 bp, Homo sapiens
atccaggcaatggcc

SEQ ID NO: 253758 - DNA, 14 bp, Homo sapiens
atccaggcctgagg

SEQ ID NO: 253759 - DNA, 17 bp, Homo sapiens
atccaggtcctttcctt

SEQ ID NO: 253760 - DNA, 19 bp, Homo sapiens
atccaggtcctttccttct

SEQ ID NO: 253761 - DNA, 14 bp, Homo sapiens
atccagtatcttga

SEQ ID NO: 253762 - DNA, 16 bp, Homo sapiens
atccagtatcttgaag

SEQ ID NO: 253763 - DNA, 21 bp, Homo sapiens
atccagtatcttgaagacttt

SEQ ID NO: 253764 - DNA, 18 bp, Homo sapiens
atccagtggggaaaaaaa

SEQ ID NO: 253765 - DNA, 19 bp, Homo sapiens
atccagtggggaaaaaaag

SEQ ID NO: 253766 - DNA, 13 bp, Homo sapiens
atccataccccct

SEQ ID NO: 253767 - DNA, 19 bp, Homo sapiens
atccataccccctgcccca

SEQ ID NO: 253768 - DNA, 20 bp, Homo sapiens
atccataccccctgccccag

SEQ ID NO: 253769 - DNA, 22 bp, Homo sapiens
atccataccccctgccccagag

SEQ ID NO: 253770 - DNA, 15 bp, Homo sapiens
atccatagacacagt

SEQ ID NO: 253771 - DNA, 13 bp, Homo sapiens
atccatatttctt

SEQ ID NO: 253772 - DNA, 21 bp, Homo sapiens
atccatcagctcccttttctt

SEQ ID NO: 253773 - DNA, 13 bp, Homo sapiens
atccatcctgcga

SEQ ID NO: 253774 - DNA, 19 bp, Homo sapiens
atccatgagtttgccctgg

SEQ ID NO: 253775 - DNA, 19 bp, Homo sapiens
atccatgggggcagggcat

SEQ ID NO: 253776 - DNA, 12 bp, Homo sapiens
atccatgtactg

SEQ ID NO: 253777 - DNA, 17 bp, Homo sapiens
atccatgtgctgctgtg

SEQ ID NO: 253778 - DNA, 19 bp, Homo sapiens
atccatgtgctgctgtggc

SEQ ID NO: 253779 - DNA, 20 bp, Homo sapiens
atccattttctaaactgttt

SEQ ID NO: 253780 - DNA, 15 bp, Homo sapiens
atcccaacagccaag

SEQ ID NO: 253781 - DNA, 13 bp, Homo sapiens
atcccaagtcaaa

SEQ ID NO: 253782 - DNA, 19 bp, Homo sapiens
atcccaagtcaaacagtgt

SEQ ID NO: 253783 - DNA, 20 bp, Homo sapiens
atcccaagtcaaacagtgtg

SEQ ID NO: 253784 - DNA, 17 bp, Homo sapiens
atcccaatattttggga

SEQ ID NO: 253785 - DNA, 14 bp, Homo sapiens
atcccaatctttct

SEQ ID NO: 253786 - DNA, 15 bp, Homo sapiens
atcccaatctttcta

SEQ ID NO: 253787 - DNA, 15 bp, Homo sapiens
atcccacctccagcc

SEQ ID NO: 253788 - DNA, 17 bp, Homo sapiens
atcccacctccagccca

SEQ ID NO: 253789 - DNA, 21 bp, Homo sapiens
atcccacctccagcccacagt

SEQ ID NO: 253790 - DNA, 17 bp, Homo sapiens
atcccacgcactccatg

SEQ ID NO: 253791 - DNA, 21 bp, Homo sapiens
atcccactggatctggcttac

SEQ ID NO: 253792 - DNA, 13 bp, Homo sapiens
atcccacttcagt

SEQ ID NO: 253793 - DNA, 16 bp, Homo sapiens
atcccacttgcccctg

SEQ ID NO: 253794 - DNA, 17 bp, Homo sapiens
atcccagagaacaatca

SEQ ID NO: 253795 - DNA, 21 bp, Homo sapiens
atcccagagaacaatcactat

SEQ ID NO: 253796 - DNA, 14 bp, Homo sapiens
atcccagcacctgc

SEQ ID NO: 253797 - DNA, 20 bp, Homo sapiens
atcccagcacctgccagggc

SEQ ID NO: 253798 - DNA, 17 bp, Homo sapiens
atcccagcactttggga

SEQ ID NO: 253799 - DNA, 22 bp, Homo sapiens
atcccagcactttgggaggctg

SEQ ID NO: 253800 - DNA, 15 bp, Homo sapiens
atcccagcagcccaa

SEQ ID NO: 253801 - DNA, 18 bp, Homo sapiens
atcccagctactcaggag

SEQ ID NO: 253802 - DNA, 20 bp, Homo sapiens
atcccagctacttgggaagc

SEQ ID NO: 253803 - DNA, 22 bp, Homo sapiens
atcccagctacttgggaggctg

SEQ ID NO: 253804 - DNA, 11 bp, Homo sapiens
atcccagctcc

SEQ ID NO: 253805 - DNA, 18 bp, Homo sapiens
atcccataaagaaagtga

SEQ ID NO: 253806 - DNA, 15 bp, Homo sapiens
atcccatctcacttt

SEQ ID NO: 253807 - DNA, 12 bp, Homo sapiens
atccccaactcc

SEQ ID NO: 253808 - DNA, 13 bp, Homo sapiens
atccccaactcca

SEQ ID NO: 253809 - DNA, 13 bp, Homo sapiens
atccccaccagct

SEQ ID NO: 253810 - DNA, 21 bp, Homo sapiens
atccccaggggtcccagccac

SEQ ID NO: 253811 - DNA, 15 bp, Homo sapiens
atccccatcctccag

SEQ ID NO: 253812 - DNA, 19 bp, Homo sapiens
atccccgacagtggctctc

SEQ ID NO: 253813 - DNA, 17 bp, Homo sapiens
atcccctccctgcctgc

SEQ ID NO: 253814 - DNA, 17 bp, Homo sapiens
atcccctcgtcctgtcc

SEQ ID NO: 253815 - DNA, 20 bp, Homo sapiens
atcccctcgtcctgtcccag

SEQ ID NO: 253816 - DNA, 21 bp, Homo sapiens
atccccttctcccctgcactg

SEQ ID NO: 253817 - DNA, 22 bp, Homo sapiens
atcccctttattaattcattaa

SEQ ID NO: 253818 - DNA, 20 bp, Homo sapiens
atcccctttggttttactac

SEQ ID NO: 253819 - DNA, 14 bp, Homo sapiens
atcccgaaaatctc

SEQ ID NO: 253820 - DNA, 20 bp, Homo sapiens
atcccgaagccatcacttct

SEQ ID NO: 253821 - DNA, 13 bp, Homo sapiens
atcccggcctctt

SEQ ID NO: 253822 - DNA, 14 bp, Homo sapiens
atcccggcctcttc

SEQ ID NO: 253823 - DNA, 14 bp, Homo sapiens
atcccggggccatg

SEQ ID NO: 253824 - DNA, 15 bp, Homo sapiens
atccctaagaattcc

SEQ ID NO: 253825 - DNA, 18 bp, Homo sapiens
atccctaatgtgtgccat

SEQ ID NO: 253826 - DNA, 21 bp, Homo sapiens
atccctaccccctaagagcca

SEQ ID NO: 253827 - DNA, 22 bp, Homo sapiens
atccctaccccctaagagccat

SEQ ID NO: 253828 - DNA, 21 bp, Homo sapiens
atccctagtccccctgttttc

SEQ ID NO: 253829 - DNA, 20 bp, Homo sapiens
atccctatgtcccagcccct

SEQ ID NO: 253830 - DNA, 21 bp, Homo sapiens
atccctcacacatccagacat

SEQ ID NO: 253831 - DNA, 22 bp, Homo sapiens
atccctgccaagaactctgggc

SEQ ID NO: 253832 - DNA, 17 bp, Homo sapiens
atccctgcttgcccgct

SEQ ID NO: 253833 - DNA, 23 bp, Homo sapiens
atccctgcttgcccgctcccaca

SEQ ID NO: 253834 - DNA, 12 bp, Homo sapiens
atccctgtgagc

SEQ ID NO: 253835 - DNA, 18 bp, Homo sapiens
atccctgtgttgtctcta

SEQ ID NO: 253836 - DNA, 14 bp, Homo sapiens
atccctgttcattg

SEQ ID NO: 253837 - DNA, 16 bp, Homo sapiens
atccctgttcattgta

SEQ ID NO: 253838 - DNA, 17 bp, Homo sapiens
atccctgttcattgtaa

SEQ ID NO: 253839 - DNA, 16 bp, Homo sapiens
atcccttctcacagca

SEQ ID NO: 253840 - DNA, 14 bp, Homo sapiens
atcccttctcagaa

SEQ ID NO: 253841 - DNA, 15 bp, Homo sapiens
atcccttggcccctc

SEQ ID NO: 253842 - DNA, 17 bp, Homo sapiens
atcccttggcccctctc

SEQ ID NO: 253843 - DNA, 18 bp, Homo sapiens
atccgagcgacggctcct

SEQ ID NO: 253844 - DNA, 13 bp, Homo sapiens
atccgcatgtgtc

SEQ ID NO: 253845 - DNA, 16 bp, Homo sapiens
atccgcatgtgtctgt

SEQ ID NO: 253846 - DNA, 17 bp, Homo sapiens
atccgcatgtgtctgta

SEQ ID NO: 253847 - DNA, 12 bp, Homo sapiens
atccgccctggg

SEQ ID NO: 253848 - DNA, 23 bp, Homo sapiens
atccgctgccaccacgtctgcca

SEQ ID NO: 253849 - DNA, 15 bp, Homo sapiens
atcctaccaatgcat

SEQ ID NO: 253850 - DNA, 18 bp, Homo sapiens
atcctaccaatgcatgca

SEQ ID NO: 253851 - DNA, 14 bp, Homo sapiens
atcctagttccatt

SEQ ID NO: 253852 - DNA, 13 bp, Homo sapiens
atcctataaatgt

SEQ ID NO: 253853 - DNA, 14 bp, Homo sapiens
atcctatactggtt

SEQ ID NO: 253854 - DNA, 13 bp, Homo sapiens
atcctcaaaagaa

SEQ ID NO: 253855 - DNA, 13 bp, Homo sapiens
atcctcagcccca

SEQ ID NO: 253856 - DNA, 20 bp, Homo sapiens
ccaaacatagcccctgcccc

SEQ ID NO: 253857 - DNA, 15 bp, Homo sapiens
ccaaacatcagacct

SEQ ID NO: 253858 - DNA, 14 bp, Homo sapiens
ccaaaccacttttt

SEQ ID NO: 253859 - DNA, 22 bp, Homo sapiens
ccaaaccactttttgcagcttt

SEQ ID NO: 253860 - DNA, 23 bp, Homo sapiens
ccaaacccacgcgtgttctgaag

SEQ ID NO: 253861 - DNA, 12 bp, Homo sapiens
ccaaaccccagc

SEQ ID NO: 253862 - DNA, 14 bp, Homo sapiens
ccaaaccccttccc

SEQ ID NO: 253863 - DNA, 17 bp, Homo sapiens
ccaaactcccaggacct

SEQ ID NO: 253864 - DNA, 19 bp, Homo sapiens
ccaaactcccaggacctgg

SEQ ID NO: 253865 - DNA, 13 bp, Homo sapiens
ccaaactcctgcc

SEQ ID NO: 253866 - DNA, 20 bp, Homo sapiens
ccaaactgcacacacagctc

SEQ ID NO: 253867 - DNA, 14 bp, Homo sapiens
ccaaactgtagtaa

SEQ ID NO: 253868 - DNA, 22 bp, Homo sapiens
ccaaacttctgaactttggaag

SEQ ID NO: 253869 - DNA, 14 bp, Homo sapiens
ccaaagaaacacca

SEQ ID NO: 253870 - DNA, 14 bp, Homo sapiens
ccaaagaattctta

SEQ ID NO: 253871 - DNA, 15 bp, Homo sapiens
ccaaagacctgcctg

SEQ ID NO: 253872 - DNA, 20 bp, Homo sapiens
ccaaagactgtactggccag

SEQ ID NO: 253873 - DNA, 14 bp, Homo sapiens
ccaaagagctcttt

SEQ ID NO: 253874 - DNA, 16 bp, Homo sapiens
ccaaagagctgcctaa

SEQ ID NO: 253875 - DNA, 16 bp, Homo sapiens
ccaaagatgcagccgc

SEQ ID NO: 253876 - DNA, 18 bp, Homo sapiens
ccaaagatgcagccgcct

SEQ ID NO: 253877 - DNA, 23 bp, Homo sapiens
ccaaagcaatgtgagtcccagag

SEQ ID NO: 253878 - DNA, 23 bp, Homo sapiens
ccaaagcagtgcatgctgtccct

SEQ ID NO: 253879 - DNA, 18 bp, Homo sapiens
ccaaagcattgcagaaca

SEQ ID NO: 253880 - DNA, 22 bp, Homo sapiens
ccaaagcccagcccggctgacc

SEQ ID NO: 253881 - DNA, 19 bp, Homo sapiens
ccaaagctagggtggccct

SEQ ID NO: 253882 - DNA, 20 bp, Homo sapiens
ccaaagctgacgaggctggg

SEQ ID NO: 253883 - DNA, 17 bp, Homo sapiens
ccaaagctttcctgccc

SEQ ID NO: 253884 - DNA, 19 bp, Homo sapiens
ccaaaggagtgcatggcca

SEQ ID NO: 253885 - DNA, 21 bp, Homo sapiens
ccaaaggagtgcatggccaca

SEQ ID NO: 253886 - DNA, 24 bp, Homo sapiens
ccaaaggagtgcatggccacagcc

SEQ ID NO: 253887 - DNA, 16 bp, Homo sapiens
ccaaaggctctctcct

SEQ ID NO: 253888 - DNA, 16 bp, Homo sapiens
ccaaaggggctgctgg

SEQ ID NO: 253889 - DNA, 17 bp, Homo sapiens
ccaaaggggctgctggg

SEQ ID NO: 253890 - DNA, 20 bp, Homo sapiens
ccaaaggggctgctggggca

SEQ ID NO: 253891 - DNA, 12 bp, Homo sapiens
ccaaagtgctgg

SEQ ID NO: 253892 - DNA, 22 bp, Homo sapiens
ccaaagtgctgggattacaggt

SEQ ID NO: 253893 - DNA, 16 bp, Homo sapiens
ccaaagtggggaggga

SEQ ID NO: 253894 - DNA, 14 bp, Homo sapiens
ccaaatatgcactt

SEQ ID NO: 253895 - DNA, 15 bp, Homo sapiens
ccaaatatgcacttt

SEQ ID NO: 253896 - DNA, 15 bp, Homo sapiens
ccaaatatgtcctgg

SEQ ID NO: 253897 - DNA, 16 bp, Homo sapiens
ccaaatcccagggaag

SEQ ID NO: 253898 - DNA, 13 bp, Homo sapiens
ccaaatcttcctc

SEQ ID NO: 253899 - DNA, 17 bp, Homo sapiens
ccaaatcttcctctgga

SEQ ID NO: 253900 - DNA, 17 bp, Homo sapiens
ccaaatgcctctgcctt

SEQ ID NO: 253901 - DNA, 19 bp, Homo sapiens
ccaaattatcaagctaata

SEQ ID NO: 253902 - DNA, 22 bp, Homo sapiens
ccaaattatcaagctaataaaa

SEQ ID NO: 253903 - DNA, 17 bp, Homo sapiens
ccaaattatttgtgtaa

SEQ ID NO: 253904 - DNA, 18 bp, Homo sapiens
ccaaattatttgtgtaat

SEQ ID NO: 253905 - DNA, 13 bp, Homo sapiens
ccaaattgctgag

SEQ ID NO: 253906 - DNA, 15 bp, Homo sapiens
ccaaattgctgagat

SEQ ID NO: 253907 - DNA, 19 bp, Homo sapiens
ccaaattttccttcctgtt

SEQ ID NO: 253908 - DNA, 21 bp, Homo sapiens
ccaaattttggccaaagtgtt

SEQ ID NO: 253909 - DNA, 14 bp, Homo sapiens
ccaacaacagtcag

SEQ ID NO: 253910 - DNA, 23 bp, Homo sapiens
ccaacaaggttggcaccccagct

SEQ ID NO: 253911 - DNA, 16 bp, Homo sapiens
ccaacaatggggtggg

SEQ ID NO: 253912 - DNA, 21 bp, Homo sapiens
ccaacaatggggtgggcccat

SEQ ID NO: 253913 - DNA, 21 bp, Homo sapiens
ccaacaattaggtctgcattt

SEQ ID NO: 253914 - DNA, 20 bp, Homo sapiens
ccaacacaaggtgggcaggg

SEQ ID NO: 253915 - DNA, 21 bp, Homo sapiens
ccaacaccacagacacacaca

SEQ ID NO: 253916 - DNA, 16 bp, Homo sapiens
ccaacaccaccccttg

SEQ ID NO: 253917 - DNA, 13 bp, Homo sapiens
ccaacaccaggga

SEQ ID NO: 253918 - DNA, 18 bp, Homo sapiens
ccaacagaaggaaggagg

SEQ ID NO: 253919 - DNA, 16 bp, Homo sapiens
ccaacagcccccccct

SEQ ID NO: 253920 - DNA, 22 bp, Homo sapiens
ccaacaggtgctgaactgtgca

SEQ ID NO: 253921 - DNA, 23 bp, Homo sapiens
ccaacaggtgctgaactgtgcat

SEQ ID NO: 253922 - DNA, 23 bp, Homo sapiens
ccaacataaaacaaaaccaagcc

SEQ ID NO: 253923 - DNA, 13 bp, Homo sapiens
ccaacatcaacat

SEQ ID NO: 253924 - DNA, 18 bp, Homo sapiens
ccaacattgccttgcatt

SEQ ID NO: 253925 - DNA, 17 bp, Homo sapiens
ccaacatttaatgagca

SEQ ID NO: 253926 - DNA, 23 bp, Homo sapiens
ccaaccacctctggccctgttgt

SEQ ID NO: 253927 - DNA, 21 bp, Homo sapiens
ccaaccaggaggggtctgcct

SEQ ID NO: 253928 - DNA, 17 bp, Homo sapiens
ccaacccatgcatggcc

SEQ ID NO: 253929 - DNA, 23 bp, Homo sapiens
ccaacccatgcatggcctcccag

SEQ ID NO: 253930 - DNA, 16 bp, Homo sapiens
ccaacccatgccctgc

SEQ ID NO: 253931 - DNA, 13 bp, Homo sapiens
ccaacccccaccc

SEQ ID NO: 253932 - DNA, 18 bp, Homo sapiens
ccaacccccaccccacac

SEQ ID NO: 253933 - DNA, 22 bp, Homo sapiens
ccaaccccgcggtgctctggcg

SEQ ID NO: 253934 - DNA, 12 bp, Homo sapiens
ccaacccctgtg

SEQ ID NO: 253935 - DNA, 15 bp, Homo sapiens
ccaacccctgtggag

SEQ ID NO: 253936 - DNA, 14 bp, Homo sapiens
ccaaccctgcccct

SEQ ID NO: 253937 - DNA, 18 bp, Homo sapiens
ccaacctcaatgccctgc

SEQ ID NO: 253938 - DNA, 19 bp, Homo sapiens
ccaacctcaatgccctgcc

SEQ ID NO: 253939 - DNA, 15 bp, Homo sapiens
ccaacctcactgccc

SEQ ID NO: 253940 - DNA, 16 bp, Homo sapiens
ccaacctctttcctct

SEQ ID NO: 253941 - DNA, 19 bp, Homo sapiens
ccaacctgatgccccttcc

SEQ ID NO: 253942 - DNA, 14 bp, Homo sapiens
ccaacgtcccctcc

SEQ ID NO: 253943 - DNA, 20 bp, Homo sapiens
ccaacgtggggcagcacaga

SEQ ID NO: 253944 - DNA, 15 bp, Homo sapiens
ccaactatgtccaga

SEQ ID NO: 253945 - DNA, 17 bp, Homo sapiens
ccaactcactgtgctcc

SEQ ID NO: 253946 - DNA, 12 bp, Homo sapiens
ccaactccaggg

SEQ ID NO: 253947 - DNA, 18 bp, Homo sapiens
ccaactccatgaccaggc

SEQ ID NO: 253948 - DNA, 19 bp, Homo sapiens
ccaactccatgaccaggcc

SEQ ID NO: 253949 - DNA, 20 bp, Homo sapiens
ccaactccatgaccaggcca

SEQ ID NO: 253950 - DNA, 21 bp, Homo sapiens
ccaactccatgaccaggccac

SEQ ID NO: 253951 - DNA, 22 bp, Homo sapiens
ccaactccatgaccaggccacc

SEQ ID NO: 253952 - DNA, 21 bp, Homo sapiens
ccaactccatggggttcgaga

SEQ ID NO: 253953 - DNA, 14 bp, Homo sapiens
ccaactcccagcca

SEQ ID NO: 253954 - DNA, 14 bp, Homo sapiens
ccaactcccagcct

SEQ ID NO: 253955 - DNA, 12 bp, Homo sapiens
ccaactctcccc

SEQ ID NO: 253956 - DNA, 19 bp, Homo sapiens
ccaactctccccagtgcct

SEQ ID NO: 253957 - DNA, 12 bp, Homo sapiens
ccaactctggcc

SEQ ID NO: 253958 - DNA, 17 bp, Homo sapiens
ccaactctggccttggt

SEQ ID NO: 253959 - DNA, 15 bp, Homo sapiens
ccaactgacttctgc

SEQ ID NO: 253960 - DNA, 14 bp, Homo sapiens
ccaactgagccaaa

SEQ ID NO: 253961 - DNA, 15 bp, Homo sapiens
ccaactgctgcccca

SEQ ID NO: 253962 - DNA, 21 bp, Homo sapiens
ccaacttcatttgatgctaaa

SEQ ID NO: 253963 - DNA, 17 bp, Homo sapiens
ccaacttccctgttctt

SEQ ID NO: 253964 - DNA, 13 bp, Homo sapiens
ccaactttctgta

SEQ ID NO: 253965 - DNA, 14 bp, Homo sapiens
ccaagaaaatgaag

SEQ ID NO: 253966 - DNA, 13 bp, Homo sapiens
ccaagaaagcagg

SEQ ID NO: 253967 - DNA, 18 bp, Homo sapiens
ccaagaacagcaggccca

SEQ ID NO: 253968 - DNA, 21 bp, Homo sapiens
ccaagaactgaaaacataaaa

SEQ ID NO: 253969 - DNA, 13 bp, Homo sapiens
ccaagaagccctc

SEQ ID NO: 253970 - DNA, 20 bp, Homo sapiens
ccaagaagccctccttgcca

SEQ ID NO: 253971 - DNA, 22 bp, Homo sapiens
ccaagaagccctccttgccacc

SEQ ID NO: 253972 - DNA, 21 bp, Homo sapiens
ccaagacagatgccccagagc

SEQ ID NO: 253973 - DNA, 22 bp, Homo sapiens
ccaagacagatgccccagagct

SEQ ID NO: 253974 - DNA, 12 bp, Homo sapiens
ccaagacattgt

SEQ ID NO: 253975 - DNA, 21 bp, Homo sapiens
ccaagacttggtgtcctttcc

SEQ ID NO: 253976 - DNA, 15 bp, Homo sapiens
ccaagagcagagtct

SEQ ID NO: 253977 - DNA, 16 bp, Homo sapiens
ccaagagcagagtctg

SEQ ID NO: 253978 - DNA, 19 bp, Homo sapiens
ccaagagcagagtctgggc

SEQ ID NO: 253979 - DNA, 14 bp, Homo sapiens
ccaagaggctagcc

SEQ ID NO: 253980 - DNA, 17 bp, Homo sapiens
ccaagagtattccattt

SEQ ID NO: 253981 - DNA, 22 bp, Homo sapiens
ccaagatagcatcccatctcag

SEQ ID NO: 253982 - DNA, 17 bp, Homo sapiens
ccaagatcattctacaa

SEQ ID NO: 253983 - DNA, 14 bp, Homo sapiens
ccaagattctactc

SEQ ID NO: 253984 - DNA, 14 bp, Homo sapiens
ccaagcaaaccaat

SEQ ID NO: 253985 - DNA, 14 bp, Homo sapiens
ccaagcagccagcc

SEQ ID NO: 253986 - DNA, 15 bp, Homo sapiens
ccaagcagccagcca

SEQ ID NO: 253987 - DNA, 14 bp, Homo sapiens
ccaagcatgcccca

SEQ ID NO: 253988 - DNA, 15 bp, Homo sapiens
ccaagccaaaaacct

SEQ ID NO: 253989 - DNA, 22 bp, Homo sapiens
ccaagccagggatggggccaca

SEQ ID NO: 253990 - DNA, 21 bp, Homo sapiens
atcctcagccccagggccctg

SEQ ID NO: 253991 - DNA, 19 bp, Homo sapiens
atcctcagttggaatcatt

SEQ ID NO: 253992 - DNA, 20 bp, Homo sapiens
atcctcatatggcccagtgt

SEQ ID NO: 253993 - DNA, 19 bp, Homo sapiens
atcctccaacgttaaaaga

SEQ ID NO: 253994 - DNA, 23 bp, Homo sapiens
atcctccaacgttaaaagacagt

SEQ ID NO: 253995 - DNA, 23 bp, Homo sapiens
atcctccagcttctggtactctc

SEQ ID NO: 253996 - DNA, 19 bp, Homo sapiens
atcctccccttccctgcaa

SEQ ID NO: 253997 - DNA, 17 bp, Homo sapiens
atcctcctggacccagc

SEQ ID NO: 253998 - DNA, 20 bp, Homo sapiens
atcctcctggacccagcagg

SEQ ID NO: 253999 - DNA, 21 bp, Homo sapiens
atcctcctggacccagcaggg

SEQ ID NO: 254000 - DNA, 12 bp, Homo sapiens
atcctctatttt

SEQ ID NO: 254001 - DNA, 19 bp, Homo sapiens
atcctctattttgtgatga

SEQ ID NO: 254002 - DNA, 23 bp, Homo sapiens
atcctctcgccaagccatcacag

SEQ ID NO: 254003 - DNA, 19 bp, Homo sapiens
atcctgaacaagaaagagt

SEQ ID NO: 254004 - DNA, 16 bp, Homo sapiens
atcctgacctcctgga

SEQ ID NO: 254005 - DNA, 12 bp, Homo sapiens
atcctgataaac

SEQ ID NO: 254006 - DNA, 19 bp, Homo sapiens
atcctgataaacattaaac

SEQ ID NO: 254007 - DNA, 19 bp, Homo sapiens
atcctgattattgaatgtt

SEQ ID NO: 254008 - DNA, 16 bp, Homo sapiens
atcctgcaatttctcc

SEQ ID NO: 254009 - DNA, 20 bp, Homo sapiens
atcctgcaggaacgagcact

SEQ ID NO: 254010 - DNA, 15 bp, Homo sapiens
atcctgccaggagca

SEQ ID NO: 254011 - DNA, 20 bp, Homo sapiens
atcctgccaggagcagcctc

SEQ ID NO: 254012 - DNA, 22 bp, Homo sapiens
atcctgccaggagcagcctcca

SEQ ID NO: 254013 - DNA, 14 bp, Homo sapiens
atcctgcccagtgt

SEQ ID NO: 254014 - DNA, 21 bp, Homo sapiens
atcctgcccagtgttgtttgt

SEQ ID NO: 254015 - DNA, 12 bp, Homo sapiens
atcctgctgccg

SEQ ID NO: 254016 - DNA, 15 bp, Homo sapiens
atcctgcttctcttt

SEQ ID NO: 254017 - DNA, 23 bp, Homo sapiens
atcctgcttctcttttcctcgca

SEQ ID NO: 254018 - DNA, 19 bp, Homo sapiens
atcctgcttctgatatgca

SEQ ID NO: 254019 - DNA, 13 bp, Homo sapiens
atcctggagcccc

SEQ ID NO: 254020 - DNA, 16 bp, Homo sapiens
atcctggcaagtgacc

SEQ ID NO: 254021 - DNA, 15 bp, Homo sapiens
atcctggcccctcca

SEQ ID NO: 254022 - DNA, 20 bp, Homo sapiens
atcctggcccctccagaccc

SEQ ID NO: 254023 - DNA, 11 bp, Homo sapiens
atcctggcctc

SEQ ID NO: 254024 - DNA, 18 bp, Homo sapiens
atcctggcctccttttgc

SEQ ID NO: 254025 - DNA, 20 bp, Homo sapiens
atcctgggcatccccagccc

SEQ ID NO: 254026 - DNA, 23 bp, Homo sapiens
atcctgtaaggtctgtaaatcag

SEQ ID NO: 254027 - DNA, 18 bp, Homo sapiens
atcctgtcaatgtttgct

SEQ ID NO: 254028 - DNA, 14 bp, Homo sapiens
atcctgtgctacag

SEQ ID NO: 254029 - DNA, 14 bp, Homo sapiens
atcctgtgtcccct

SEQ ID NO: 254030 - DNA, 15 bp, Homo sapiens
atcctgtgtcccctg

SEQ ID NO: 254031 - DNA, 14 bp, Homo sapiens
atcctgtgtggaga

SEQ ID NO: 254032 - DNA, 19 bp, Homo sapiens
atcctgtgtggagagggaa

SEQ ID NO: 254033 - DNA, 23 bp, Homo sapiens
atcctgtgtggagagggaatgtg

SEQ ID NO: 254034 - DNA, 16 bp, Homo sapiens
atcctgttaacactgt

SEQ ID NO: 254035 - DNA, 17 bp, Homo sapiens
atcctgttaacactgta

SEQ ID NO: 254036 - DNA, 21 bp, Homo sapiens
atcctgttaacactgtaatat

SEQ ID NO: 254037 - DNA, 19 bp, Homo sapiens
atccttaagtatcagaaag

SEQ ID NO: 254038 - DNA, 16 bp, Homo sapiens
atccttatcccaagct

SEQ ID NO: 254039 - DNA, 20 bp, Homo sapiens
atccttccaaaaattattat

SEQ ID NO: 254040 - DNA, 14 bp, Homo sapiens
atccttccaaagaa

SEQ ID NO: 254041 - DNA, 17 bp, Homo sapiens
atccttcccgcagcacc

SEQ ID NO: 254042 - DNA, 18 bp, Homo sapiens
atccttcccgcagcacca

SEQ ID NO: 254043 - DNA, 23 bp, Homo sapiens
atccttcccgcagcaccagcctg

SEQ ID NO: 254044 - DNA, 17 bp, Homo sapiens
atccttggagagcagct

SEQ ID NO: 254045 - DNA, 19 bp, Homo sapiens
atccttggagagcagctgg

SEQ ID NO: 254046 - DNA, 24 bp, Homo sapiens
atccttggagagcagctggctctc

SEQ ID NO: 254047 - DNA, 15 bp, Homo sapiens
atccttggcaccaaa

SEQ ID NO: 254048 - DNA, 21 bp, Homo sapiens
atccttgttttgtgacatttt

SEQ ID NO: 254049 - DNA, 20 bp, Homo sapiens
atccttttttattgaataac

SEQ ID NO: 254050 - DNA, 21 bp, Homo sapiens
atcgaacgcgtgtgtgcctga

SEQ ID NO: 254051 - DNA, 17 bp, Homo sapiens
atcgatatgaaaaataa

SEQ ID NO: 254052 - DNA, 23 bp, Homo sapiens
atcgatgggggatgcttcatgtg

SEQ ID NO: 254053 - DNA, 17 bp, Homo sapiens
atcgatgttaaacgtca

SEQ ID NO: 254054 - DNA, 11 bp, Homo sapiens
atcgattggct

SEQ ID NO: 254055 - DNA, 14 bp, Homo sapiens
atcgcaaggcctgt

SEQ ID NO: 254056 - DNA, 17 bp, Homo sapiens
atcgcaaggcctgtgct

SEQ ID NO: 254057 - DNA, 20 bp, Homo sapiens
atcgcaccactgtgtattta

SEQ ID NO: 254058 - DNA, 21 bp, Homo sapiens
atcgcaggagtctctgccacc

SEQ ID NO: 254059 - DNA, 23 bp, Homo sapiens
atcgcaggagtctctgccaccca

SEQ ID NO: 254060 - DNA, 19 bp, Homo sapiens
atcgccctccacatccctg

SEQ ID NO: 254061 - DNA, 12 bp, Homo sapiens
atcgctgggctc

SEQ ID NO: 254062 - DNA, 23 bp, Homo sapiens
atcgctgtccaagtgtttcttgt

SEQ ID NO: 254063 - DNA, 18 bp, Homo sapiens
atcgcttgaacctgggaa

SEQ ID NO: 254064 - DNA, 14 bp, Homo sapiens
atcgcttgagccca

SEQ ID NO: 254065 - DNA, 17 bp, Homo sapiens
atcgcttgagcccagga

SEQ ID NO: 254066 - DNA, 19 bp, Homo sapiens
atcgcttgagcccaggagt

SEQ ID NO: 254067 - DNA, 22 bp, Homo sapiens
atcggacctcagtttctgttgt

SEQ ID NO: 254068 - DNA, 15 bp, Homo sapiens
atcggagcctcctct

SEQ ID NO: 254069 - DNA, 16 bp, Homo sapiens
atcggagcctcctctc

SEQ ID NO: 254070 - DNA, 21 bp, Homo sapiens
atcggaggcttgtcagagctg

SEQ ID NO: 254071 - DNA, 22 bp, Homo sapiens
atcggaggcttgtcagagctgg

SEQ ID NO: 254072 - DNA, 23 bp, Homo sapiens
atcggaggcttgtcagagctggg

SEQ ID NO: 254073 - DNA, 13 bp, Homo sapiens
atcggcctcctct

SEQ ID NO: 254074 - DNA, 14 bp, Homo sapiens
atcggcctcctctt

SEQ ID NO: 254075 - DNA, 21 bp, Homo sapiens
atcgggaacagtgtttcccat

SEQ ID NO: 254076 - DNA, 20 bp, Homo sapiens
atcgggtccagagaccacac

SEQ ID NO: 254077 - DNA, 13 bp, Homo sapiens
atcggtcagcagg

SEQ ID NO: 254078 - DNA, 21 bp, Homo sapiens
atcggtgaaactaacagataa

SEQ ID NO: 254079 - DNA, 21 bp, Homo sapiens
atcggtgctgtcagccctgct

SEQ ID NO: 254080 - DNA, 15 bp, Homo sapiens
atcgtataaggaaat

SEQ ID NO: 254081 - DNA, 18 bp, Homo sapiens
atcgtctttaaccccaaa

SEQ ID NO: 254082 - DNA, 15 bp, Homo sapiens
atcgtgacagcagca

SEQ ID NO: 254083 - DNA, 19 bp, Homo sapiens
atcgtgacccttcagggcc

SEQ ID NO: 254084 - DNA, 22 bp, Homo sapiens
atcgtgacccttcagggccaga

SEQ ID NO: 254085 - DNA, 15 bp, Homo sapiens
atcgtgcctataaat

SEQ ID NO: 254086 - DNA, 15 bp, Homo sapiens
atcgtgctaaatttt

SEQ ID NO: 254087 - DNA, 17 bp, Homo sapiens
atcgtgtataagctaat

SEQ ID NO: 254088 - DNA, 16 bp, Homo sapiens
atctaaaaaatatctt

SEQ ID NO: 254089 - DNA, 23 bp, Homo sapiens
atctaaaatactcaccaaaatat

SEQ ID NO: 254090 - DNA, 15 bp, Homo sapiens
atctaaagtgtgttg

SEQ ID NO: 254091 - DNA, 20 bp, Homo sapiens
atctaaagtgtgttgttgct

SEQ ID NO: 254092 - DNA, 18 bp, Homo sapiens
atctaaatgattatcttg

SEQ ID NO: 254093 - DNA, 17 bp, Homo sapiens
atctaagcctttccata

SEQ ID NO: 254094 - DNA, 13 bp, Homo sapiens
atctaaggcatgc

SEQ ID NO: 254095 - DNA, 22 bp, Homo sapiens
atctaatcccttcaaggaagtg

SEQ ID NO: 254096 - DNA, 18 bp, Homo sapiens
atctaatctcttattcta

SEQ ID NO: 254097 - DNA, 14 bp, Homo sapiens
atctacctgctcct

SEQ ID NO: 254098 - DNA, 19 bp, Homo sapiens
atctactagaaccttctaa

SEQ ID NO: 254099 - DNA, 16 bp, Homo sapiens
atctactcagaaattt

SEQ ID NO: 254100 - DNA, 17 bp, Homo sapiens
atctactcttaaatata

SEQ ID NO: 254101 - DNA, 19 bp, Homo sapiens
atctagatcaattaattct

SEQ ID NO: 254102 - DNA, 21 bp, Homo sapiens
atctagatcaattaattctta

SEQ ID NO: 254103 - DNA, 22 bp, Homo sapiens
atctagcaagaagattctaaaa

SEQ ID NO: 254104 - DNA, 17 bp, Homo sapiens
atctagccaaagagctc

SEQ ID NO: 254105 - DNA, 22 bp, Homo sapiens
atctagccagagcccttcactg

SEQ ID NO: 254106 - DNA, 15 bp, Homo sapiens
atctagccaggcctc

SEQ ID NO: 254107 - DNA, 17 bp, Homo sapiens
atctagccaggcctccc

SEQ ID NO: 254108 - DNA, 19 bp, Homo sapiens
atctagccaggcctcccgc

SEQ ID NO: 254109 - DNA, 19 bp, Homo sapiens
atctaggtttaactcagat

SEQ ID NO: 254110 - DNA, 13 bp, Homo sapiens
atctagtgcagct

SEQ ID NO: 254111 - DNA, 15 bp, Homo sapiens
atctagtgcagctga

SEQ ID NO: 254112 - DNA, 17 bp, Homo sapiens
atctagtgcagctgatt

SEQ ID NO: 254113 - DNA, 21 bp, Homo sapiens
atctagtgcagctgattttaa

SEQ ID NO: 254114 - DNA, 17 bp, Homo sapiens
atctagtggtctgattt

SEQ ID NO: 254115 - DNA, 15 bp, Homo sapiens
atctatatatacata

SEQ ID NO: 254116 - DNA, 15 bp, Homo sapiens
atctatcacctgtca

SEQ ID NO: 254117 - DNA, 16 bp, Homo sapiens
atctatgactgtgttt

SEQ ID NO: 254118 - DNA, 18 bp, Homo sapiens
atctatgactgtgtttaa

SEQ ID NO: 254119 - DNA, 23 bp, Homo sapiens
atctattcccatcgctggaaaac

SEQ ID NO: 254120 - DNA, 22 bp, Homo sapiens
atctattgggttcattattgga

SEQ ID NO: 254121 - DNA, 20 bp, Homo sapiens
atctatttgtatatatacat

SEQ ID NO: 254122 - DNA, 20 bp, Homo sapiens
ccaagccagggttccagaca

SEQ ID NO: 254123 - DNA, 23 bp, Homo sapiens
ccaagccagggttccagacaggg

SEQ ID NO: 254124 - DNA, 15 bp, Homo sapiens
ccaagccctgcaaat

SEQ ID NO: 254125 - DNA, 11 bp, Homo sapiens
ccaagcccttt

SEQ ID NO: 254126 - DNA, 23 bp, Homo sapiens
ccaagcctgggccactggcatct

SEQ ID NO: 254127 - DNA, 15 bp, Homo sapiens
ccaagcgttcctggc

SEQ ID NO: 254128 - DNA, 19 bp, Homo sapiens
ccaagcgttcctggccttc

SEQ ID NO: 254129 - DNA, 23 bp, Homo sapiens
ccaagctcagagcagcctctgtc

SEQ ID NO: 254130 - DNA, 14 bp, Homo sapiens
ccaagctccatctc

SEQ ID NO: 254131 - DNA, 16 bp, Homo sapiens
ccaagcttaaggagag

SEQ ID NO: 254132 - DNA, 19 bp, Homo sapiens
ccaagcttaaggagaggag

SEQ ID NO: 254133 - DNA, 17 bp, Homo sapiens
ccaagcttccacctgtc

SEQ ID NO: 254134 - DNA, 17 bp, Homo sapiens
ccaagcttgtttccctg

SEQ ID NO: 254135 - DNA, 16 bp, Homo sapiens
ccaaggacccctcacc

SEQ ID NO: 254136 - DNA, 11 bp, Homo sapiens
ccaaggactgc

SEQ ID NO: 254137 - DNA, 13 bp, Homo sapiens
ccaaggactgccg

SEQ ID NO: 254138 - DNA, 12 bp, Homo sapiens
ccaaggagacca

SEQ ID NO: 254139 - DNA, 13 bp, Homo sapiens
ccaaggagaccaa

SEQ ID NO: 254140 - DNA, 21 bp, Homo sapiens
ccaaggagaccaagtcctggc

SEQ ID NO: 254141 - DNA, 21 bp, Homo sapiens
ccaaggagctgatttccaggc

SEQ ID NO: 254142 - DNA, 21 bp, Homo sapiens
ccaaggatcctctccactcca

SEQ ID NO: 254143 - DNA, 22 bp, Homo sapiens
ccaaggatcctctccactccat

SEQ ID NO: 254144 - DNA, 15 bp, Homo sapiens
ccaaggcaaatgtcc

SEQ ID NO: 254145 - DNA, 21 bp, Homo sapiens
ccaaggcaaggggtgcctggg

SEQ ID NO: 254146 - DNA, 13 bp, Homo sapiens
ccaaggcagcctc

SEQ ID NO: 254147 - DNA, 14 bp, Homo sapiens
ccaaggcagcctcc

SEQ ID NO: 254148 - DNA, 18 bp, Homo sapiens
ccaaggcagcctccagag

SEQ ID NO: 254149 - DNA, 18 bp, Homo sapiens
ccaaggcctcaggagagc

SEQ ID NO: 254150 - DNA, 11 bp, Homo sapiens
ccaagggaggc

SEQ ID NO: 254151 - DNA, 17 bp, Homo sapiens
ccaagggcctcccacca

SEQ ID NO: 254152 - DNA, 15 bp, Homo sapiens
ccaaggggccagctg

SEQ ID NO: 254153 - DNA, 19 bp, Homo sapiens
ccaaggggccagctgcccc

SEQ ID NO: 254154 - DNA, 23 bp, Homo sapiens
ccaagggtatccaagttggactg

SEQ ID NO: 254155 - DNA, 20 bp, Homo sapiens
ccaagggtatctgctgcctc

SEQ ID NO: 254156 - DNA, 15 bp, Homo sapiens
ccaaggtcccctcca

SEQ ID NO: 254157 - DNA, 16 bp, Homo sapiens
ccaaggtcccctccac

SEQ ID NO: 254158 - DNA, 16 bp, Homo sapiens
ccaaggtcctgctcaa

SEQ ID NO: 254159 - DNA, 14 bp, Homo sapiens
ccaaggtgctaaaa

SEQ ID NO: 254160 - DNA, 16 bp, Homo sapiens
ccaaggtggtcttgga

SEQ ID NO: 254161 - DNA, 18 bp, Homo sapiens
ccaaggtggtcttggaga

SEQ ID NO: 254162 - DNA, 13 bp, Homo sapiens
ccaagtacagcct

SEQ ID NO: 254163 - DNA, 22 bp, Homo sapiens
ccaagtacagccttcactggag

SEQ ID NO: 254164 - DNA, 22 bp, Homo sapiens
ccaagtaggtgggattacaggt

SEQ ID NO: 254165 - DNA, 18 bp, Homo sapiens
ccaagtcaacactcttct

SEQ ID NO: 254166 - DNA, 23 bp, Homo sapiens
ccaagtcaacactcttcttgagc

SEQ ID NO: 254167 - DNA, 19 bp, Homo sapiens
ccaagtccaacctgcctgt

SEQ ID NO: 254168 - DNA, 22 bp, Homo sapiens
ccaagtccaggtcgggctcagc

SEQ ID NO: 254169 - DNA, 22 bp, Homo sapiens
ccaagtcctggctacatcccag

SEQ ID NO: 254170 - DNA, 18 bp, Homo sapiens
ccaagtctcaggaggagg

SEQ ID NO: 254171 - DNA, 22 bp, Homo sapiens
ccaagtgcatttttatctgtga

SEQ ID NO: 254172 - DNA, 14 bp, Homo sapiens
ccaagtgccttccg

SEQ ID NO: 254173 - DNA, 16 bp, Homo sapiens
ccaagtgccttgagct

SEQ ID NO: 254174 - DNA, 20 bp, Homo sapiens
ccaagtgccttgagctgcct

SEQ ID NO: 254175 - DNA, 20 bp, Homo sapiens
ccaagtggaccttgagacca

SEQ ID NO: 254176 - DNA, 13 bp, Homo sapiens
ccaagtggctccc

SEQ ID NO: 254177 - DNA, 14 bp, Homo sapiens
ccaagtggtcagga

SEQ ID NO: 254178 - DNA, 15 bp, Homo sapiens
ccaagtgtttcttgt

SEQ ID NO: 254179 - DNA, 20 bp, Homo sapiens
ccaagttataaatcaatgtc

SEQ ID NO: 254180 - DNA, 11 bp, Homo sapiens
ccaagttcaaa

SEQ ID NO: 254181 - DNA, 18 bp, Homo sapiens
ccaagttcacagtagagt

SEQ ID NO: 254182 - DNA, 14 bp, Homo sapiens
ccaataaaaatcct

SEQ ID NO: 254183 - DNA, 11 bp, Homo sapiens
ccaataaaagt

SEQ ID NO: 254184 - DNA, 15 bp, Homo sapiens
ccaataaaagtgact

SEQ ID NO: 254185 - DNA, 22 bp, Homo sapiens
ccaataaaagttttctccaact

SEQ ID NO: 254186 - DNA, 23 bp, Homo sapiens
ccaataaagctggacaagaagct

SEQ ID NO: 254187 - DNA, 19 bp, Homo sapiens
ccaataacttcagagaagt

SEQ ID NO: 254188 - DNA, 20 bp, Homo sapiens
ccaatatggtggccctgggg

SEQ ID NO: 254189 - DNA, 22 bp, Homo sapiens
ccaatatgtattgtaaacatgt

SEQ ID NO: 254190 - DNA, 20 bp, Homo sapiens
ccaatattaccatcttaatc

SEQ ID NO: 254191 - DNA, 21 bp, Homo sapiens
ccaatattaccatcttaatct

SEQ ID NO: 254192 - DNA, 12 bp, Homo sapiens
ccaatattataa

SEQ ID NO: 254193 - DNA, 18 bp, Homo sapiens
ccaatatttctcagacat

SEQ ID NO: 254194 - DNA, 20 bp, Homo sapiens
ccaatcacattcaggcatgc

SEQ ID NO: 254195 - DNA, 20 bp, Homo sapiens
ccaatcacgagatcttcctt

SEQ ID NO: 254196 - DNA, 22 bp, Homo sapiens
ccaatcagcttttgttctagac

SEQ ID NO: 254197 - DNA, 12 bp, Homo sapiens
ccaatcatttta

SEQ ID NO: 254198 - DNA, 14 bp, Homo sapiens
ccaatcattttaat

SEQ ID NO: 254199 - DNA, 21 bp, Homo sapiens
ccaatccaacccatgcatggc

SEQ ID NO: 254200 - DNA, 18 bp, Homo sapiens
ccaatcccgtgaaagaat

SEQ ID NO: 254201 - DNA, 16 bp, Homo sapiens
ccaatccctgtgtgtc

SEQ ID NO: 254202 - DNA, 23 bp, Homo sapiens
ccaatcgggtccagagaccacac

SEQ ID NO: 254203 - DNA, 23 bp, Homo sapiens
ccaatctccggtgtgagcccacc

SEQ ID NO: 254204 - DNA, 16 bp, Homo sapiens
ccaatctctgtgactc

SEQ ID NO: 254205 - DNA, 19 bp, Homo sapiens
ccaatcttaccagatgcta

SEQ ID NO: 254206 - DNA, 22 bp, Homo sapiens
ccaatctttctatataaaatgt

SEQ ID NO: 254207 - DNA, 21 bp, Homo sapiens
ccaatgcatgcagccactgtg

SEQ ID NO: 254208 - DNA, 23 bp, Homo sapiens
ccaatgcatgcagccactgtgct

SEQ ID NO: 254209 - DNA, 15 bp, Homo sapiens
ccaatgccacagcca

SEQ ID NO: 254210 - DNA, 21 bp, Homo sapiens
ccaatggagactgtctcaaga

SEQ ID NO: 254211 - DNA, 15 bp, Homo sapiens
ccaatggtgagggct

SEQ ID NO: 254212 - DNA, 20 bp, Homo sapiens
ccaatggtgatcctctattt

SEQ ID NO: 254213 - DNA, 20 bp, Homo sapiens
ccaatggtgtagctgtcctc

SEQ ID NO: 254214 - DNA, 14 bp, Homo sapiens
ccaatgtgaagaca

SEQ ID NO: 254215 - DNA, 22 bp, Homo sapiens
ccaatgtggtggcaataaatgt

SEQ ID NO: 254216 - DNA, 15 bp, Homo sapiens
ccaattaaaattaag

SEQ ID NO: 254217 - DNA, 21 bp, Homo sapiens
ccaattaaaattaaggtctgg

SEQ ID NO: 254218 - DNA, 17 bp, Homo sapiens
ccaattaggaagtgtaa

SEQ ID NO: 254219 - DNA, 22 bp, Homo sapiens
ccaattatatgagacgtttttg

SEQ ID NO: 254220 - DNA, 13 bp, Homo sapiens
ccaattatgtgac

SEQ ID NO: 254221 - DNA, 17 bp, Homo sapiens
ccaattccaaaattcca

SEQ ID NO: 254222 - DNA, 19 bp, Homo sapiens
ccaattccaaaattccatc

SEQ ID NO: 254223 - DNA, 14 bp, Homo sapiens
ccaattccagagct

SEQ ID NO: 254224 - DNA, 15 bp, Homo sapiens
ccaattccagagctg

SEQ ID NO: 254225 - DNA, 14 bp, Homo sapiens
ccaattcctcattt

SEQ ID NO: 254226 - DNA, 14 bp, Homo sapiens
ccaattctgtccca

SEQ ID NO: 254227 - DNA, 15 bp, Homo sapiens
ccaattgatgtatat

SEQ ID NO: 254228 - DNA, 14 bp, Homo sapiens
ccaattgccctgcc

SEQ ID NO: 254229 - DNA, 15 bp, Homo sapiens
ccaattgccctgcca

SEQ ID NO: 254230 - DNA, 14 bp, Homo sapiens
ccaatttatgcaga

SEQ ID NO: 254231 - DNA, 23 bp, Homo sapiens
ccaatttgtctcctactctgtgt

SEQ ID NO: 254232 - DNA, 15 bp, Homo sapiens
ccacaaaaaatactt

SEQ ID NO: 254233 - DNA, 21 bp, Homo sapiens
ccacaaatcaaagcaagggct

SEQ ID NO: 254234 - DNA, 17 bp, Homo sapiens
ccacaaatgtcctcaga

SEQ ID NO: 254235 - DNA, 19 bp, Homo sapiens
ccacaacatgaaaactcca

SEQ ID NO: 254236 - DNA, 13 bp, Homo sapiens
ccacaactaacaa

SEQ ID NO: 254237 - DNA, 15 bp, Homo sapiens
ccacaagaaatttga

SEQ ID NO: 254238 - DNA, 16 bp, Homo sapiens
ccacaagaaatttgat

SEQ ID NO: 254239 - DNA, 17 bp, Homo sapiens
ccacaagccataaacca

SEQ ID NO: 254240 - DNA, 19 bp, Homo sapiens
ccacaagccataaaccaat

SEQ ID NO: 254241 - DNA, 23 bp, Homo sapiens
ccacaaggctgaaaagtgctttg

SEQ ID NO: 254242 - DNA, 20 bp, Homo sapiens
ccacaagttaaataaatcat

SEQ ID NO: 254243 - DNA, 16 bp, Homo sapiens
ccacacaccacagaag

SEQ ID NO: 254244 - DNA, 13 bp, Homo sapiens
ccacacaccccaa

SEQ ID NO: 254245 - DNA, 16 bp, Homo sapiens
ccacacaggcctggcc

SEQ ID NO: 254246 - DNA, 18 bp, Homo sapiens
ccacacaggcctggccca

SEQ ID NO: 254247 - DNA, 22 bp, Homo sapiens
ccacacaggcctggcccagcca

SEQ ID NO: 254248 - DNA, 14 bp, Homo sapiens
ccacacagtgggcc

SEQ ID NO: 254249 - DNA, 20 bp, Homo sapiens
ccacacatgcaagggatgaa

SEQ ID NO: 254250 - DNA, 14 bp, Homo sapiens
ccacaccaaggagg

SEQ ID NO: 254251 - DNA, 17 bp, Homo sapiens
ccacaccaccgccctcc

SEQ ID NO: 254252 - DNA, 13 bp, Homo sapiens
ccacacccaggaa

SEQ ID NO: 254253 - DNA, 14 bp, Homo sapiens
ccacacccaggaag

SEQ ID NO: 254254 - DNA, 15 bp, Homo sapiens
ccacacccaggaagg

SEQ ID NO: 254255 - DNA, 17 bp, Homo sapiens
ccacacccaggaaggga

SEQ ID NO: 254256 - DNA, 22 bp, Homo sapiens
atctatttgtatatatacataa

SEQ ID NO: 254257 - DNA, 17 bp, Homo sapiens
atctattttctcagaat

SEQ ID NO: 254258 - DNA, 14 bp, Homo sapiens
atctcaagtatata

SEQ ID NO: 254259 - DNA, 17 bp, Homo sapiens
atctcaagtatataaag

SEQ ID NO: 254260 - DNA, 16 bp, Homo sapiens
atctcacaaataagta

SEQ ID NO: 254261 - DNA, 15 bp, Homo sapiens
atctcacacagctgg

SEQ ID NO: 254262 - DNA, 14 bp, Homo sapiens
atctcaccccatcc

SEQ ID NO: 254263 - DNA, 16 bp, Homo sapiens
atctcaccccatccca

SEQ ID NO: 254264 - DNA, 18 bp, Homo sapiens
atctcacctctaggcctc

SEQ ID NO: 254265 - DNA, 19 bp, Homo sapiens
atctcacctctaggcctca

SEQ ID NO: 254266 - DNA, 17 bp, Homo sapiens
atctcactttaataata

SEQ ID NO: 254267 - DNA, 17 bp, Homo sapiens
atctcagaacagtctga

SEQ ID NO: 254268 - DNA, 15 bp, Homo sapiens
atctcagaagatggg

SEQ ID NO: 254269 - DNA, 24 bp, Homo sapiens
atctcagcctcctgagcctgtggg

SEQ ID NO: 254270 - DNA, 24 bp, Homo sapiens
atctcaggtgccactccctgagct

SEQ ID NO: 254271 - DNA, 14 bp, Homo sapiens
atctcagtcctcaa

SEQ ID NO: 254272 - DNA, 19 bp, Homo sapiens
atctcataggttgccaata

SEQ ID NO: 254273 - DNA, 20 bp, Homo sapiens
atctcatgtctgtttaatac

SEQ ID NO: 254274 - DNA, 22 bp, Homo sapiens
atctccaaagctttcctggaga

SEQ ID NO: 254275 - DNA, 19 bp, Homo sapiens
atctccacagtcaaagaag

SEQ ID NO: 254276 - DNA, 10 bp, Homo sapiens
atctccaggc

SEQ ID NO: 254277 - DNA, 11 bp, Homo sapiens
atctccaggcc

SEQ ID NO: 254278 - DNA, 13 bp, Homo sapiens
atctccaggccca

SEQ ID NO: 254279 - DNA, 18 bp, Homo sapiens
atctccagggctgcccct

SEQ ID NO: 254280 - DNA, 20 bp, Homo sapiens
atctccagggctgcccctgt

SEQ ID NO: 254281 - DNA, 15 bp, Homo sapiens
atctcccagacttgt

SEQ ID NO: 254282 - DNA, 21 bp, Homo sapiens
atctcccagacttgtttcctg

SEQ ID NO: 254283 - DNA, 22 bp, Homo sapiens
atctcccagacttgtttcctgt

SEQ ID NO: 254284 - DNA, 14 bp, Homo sapiens
atctccccaggcct

SEQ ID NO: 254285 - DNA, 18 bp, Homo sapiens
atctccccaggcctccag

SEQ ID NO: 254286 - DNA, 21 bp, Homo sapiens
atctccccaggcctccagcct

SEQ ID NO: 254287 - DNA, 15 bp, Homo sapiens
atctcccgctgctgc

SEQ ID NO: 254288 - DNA, 14 bp, Homo sapiens
atctccctgcttca

SEQ ID NO: 254289 - DNA, 19 bp, Homo sapiens
atctcccttccacctcaca

SEQ ID NO: 254290 - DNA, 20 bp, Homo sapiens
atctccggtgtgagcccacc

SEQ ID NO: 254291 - DNA, 18 bp, Homo sapiens
atctcctatttttcagaa

SEQ ID NO: 254292 - DNA, 17 bp, Homo sapiens
atctcctcccatggcct

SEQ ID NO: 254293 - DNA, 19 bp, Homo sapiens
atctcctgtaattttgtag

SEQ ID NO: 254294 - DNA, 19 bp, Homo sapiens
atctcctgtgcatgggtga

SEQ ID NO: 254295 - DNA, 23 bp, Homo sapiens
atctccttcccccagcccaataa

SEQ ID NO: 254296 - DNA, 18 bp, Homo sapiens
atctcgagccccctggat

SEQ ID NO: 254297 - DNA, 18 bp, Homo sapiens
atctctaacagctcagga

SEQ ID NO: 254298 - DNA, 22 bp, Homo sapiens
atctctaatatggcaaaaatgg

SEQ ID NO: 254299 - DNA, 21 bp, Homo sapiens
atctctaatgaaattgtgaaa

SEQ ID NO: 254300 - DNA, 15 bp, Homo sapiens
atctctagaatttta

SEQ ID NO: 254301 - DNA, 17 bp, Homo sapiens
atctctagcctctttgt

SEQ ID NO: 254302 - DNA, 13 bp, Homo sapiens
atctctcaggagc

SEQ ID NO: 254303 - DNA, 20 bp, Homo sapiens
atctctccccatatataaat

SEQ ID NO: 254304 - DNA, 22 bp, Homo sapiens
atctctctgaatcctaagggct

SEQ ID NO: 254305 - DNA, 17 bp, Homo sapiens
atctctgaagcatgttt

SEQ ID NO: 254306 - DNA, 21 bp, Homo sapiens
atctctgattaaatttaatat

SEQ ID NO: 254307 - DNA, 15 bp, Homo sapiens
atctctgctgaacat

SEQ ID NO: 254308 - DNA, 16 bp, Homo sapiens
atctctgctgcttctg

SEQ ID NO: 254309 - DNA, 17 bp, Homo sapiens
atctctgctgcttctgg

SEQ ID NO: 254310 - DNA, 16 bp, Homo sapiens
atctctggaaaaataa

SEQ ID NO: 254311 - DNA, 17 bp, Homo sapiens
atctctgtctaccatct

SEQ ID NO: 254312 - DNA, 20 bp, Homo sapiens
atctctgtctaccatctccc

SEQ ID NO: 254313 - DNA, 19 bp, Homo sapiens
atctcttattttacaataa

SEQ ID NO: 254314 - DNA, 11 bp, Homo sapiens
atctctttcat

SEQ ID NO: 254315 - DNA, 12 bp, Homo sapiens
atctgaaaagaa

SEQ ID NO: 254316 - DNA, 14 bp, Homo sapiens
atctgaaaagaaat

SEQ ID NO: 254317 - DNA, 18 bp, Homo sapiens
atctgaacacagtttagt

SEQ ID NO: 254318 - DNA, 13 bp, Homo sapiens
atctgaactttgt

SEQ ID NO: 254319 - DNA, 17 bp, Homo sapiens
atctgaattaaataaat

SEQ ID NO: 254320 - DNA, 13 bp, Homo sapiens
atctgacacaaaa

SEQ ID NO: 254321 - DNA, 22 bp, Homo sapiens
atctgacagttactcttcagtt

SEQ ID NO: 254322 - DNA, 18 bp, Homo sapiens
atctgacatgattccttc

SEQ ID NO: 254323 - DNA, 23 bp, Homo sapiens
atctgacatgattccttcctgtt

SEQ ID NO: 254324 - DNA, 17 bp, Homo sapiens
atctgactgaaattaaa

SEQ ID NO: 254325 - DNA, 21 bp, Homo sapiens
atctgagccctccctcttccc

SEQ ID NO: 254326 - DNA, 18 bp, Homo sapiens
atctgaggatgagacagg

SEQ ID NO: 254327 - DNA, 17 bp, Homo sapiens
atctgagtccagctccc

SEQ ID NO: 254328 - DNA, 22 bp, Homo sapiens
atctgatattcaaacacacagt

SEQ ID NO: 254329 - DNA, 21 bp, Homo sapiens
atctgcaatgtttttgtgtag

SEQ ID NO: 254330 - DNA, 20 bp, Homo sapiens
atctgcagctctttcttctt

SEQ ID NO: 254331 - DNA, 18 bp, Homo sapiens
atctgcatgtaaaatctt

SEQ ID NO: 254332 - DNA, 17 bp, Homo sapiens
atctgcccctcccccaa

SEQ ID NO: 254333 - DNA, 22 bp, Homo sapiens
atctgccctcagatgaaaataa

SEQ ID NO: 254334 - DNA, 19 bp, Homo sapiens
atctgccgcctggggctcc

SEQ ID NO: 254335 - DNA, 11 bp, Homo sapiens
atctgcctggc

SEQ ID NO: 254336 - DNA, 23 bp, Homo sapiens
atctgcctggcctggctccccac

SEQ ID NO: 254337 - DNA, 15 bp, Homo sapiens
atctgcctgggcctg

SEQ ID NO: 254338 - DNA, 20 bp, Homo sapiens
atctgcctgtggccttgccc

SEQ ID NO: 254339 - DNA, 20 bp, Homo sapiens
atctgccttccagcccagac

SEQ ID NO: 254340 - DNA, 14 bp, Homo sapiens
atctgccttgctgc

SEQ ID NO: 254341 - DNA, 15 bp, Homo sapiens
atctgccttgctgca

SEQ ID NO: 254342 - DNA, 17 bp, Homo sapiens
atctgctgcatagctct

SEQ ID NO: 254343 - DNA, 21 bp, Homo sapiens
atctgctgcatagctctattt

SEQ ID NO: 254344 - DNA, 23 bp, Homo sapiens
atctgctgcatagctctatttta

SEQ ID NO: 254345 - DNA, 22 bp, Homo sapiens
atctgctgcctctgaaaatatt

SEQ ID NO: 254346 - DNA, 19 bp, Homo sapiens
atctgcttacaattccctg

SEQ ID NO: 254347 - DNA, 21 bp, Homo sapiens
atctgcttacaattccctgct

SEQ ID NO: 254348 - DNA, 14 bp, Homo sapiens
atctgcttcagtgg

SEQ ID NO: 254349 - DNA, 15 bp, Homo sapiens
atctgctttgttaat

SEQ ID NO: 254350 - DNA, 16 bp, Homo sapiens
atctggaaggcccctc

SEQ ID NO: 254351 - DNA, 16 bp, Homo sapiens
atctggactcctctgt

SEQ ID NO: 254352 - DNA, 17 bp, Homo sapiens
atctggactcctctgtc

SEQ ID NO: 254353 - DNA, 18 bp, Homo sapiens
atctggactcctctgtcc

SEQ ID NO: 254354 - DNA, 12 bp, Homo sapiens
atctggcctggc

SEQ ID NO: 254355 - DNA, 22 bp, Homo sapiens
atctggcctggcctggccctgc

SEQ ID NO: 254356 - DNA, 16 bp, Homo sapiens
atctggctaaggcatc

SEQ ID NO: 254357 - DNA, 15 bp, Homo sapiens
atctggcttctgcat

SEQ ID NO: 254358 - DNA, 12 bp, Homo sapiens
atctgggcctgg

SEQ ID NO: 254359 - DNA, 14 bp, Homo sapiens
atctggggaaggac

SEQ ID NO: 254360 - DNA, 23 bp, Homo sapiens
atctggggaaggaccaacccatg

SEQ ID NO: 254361 - DNA, 23 bp, Homo sapiens
atctggggatggagaatgccagc

SEQ ID NO: 254362 - DNA, 16 bp, Homo sapiens
atctgtaaatttaact

SEQ ID NO: 254363 - DNA, 23 bp, Homo sapiens
atctgtaaatttaactgcatata

SEQ ID NO: 254364 - DNA, 15 bp, Homo sapiens
atctgtaagaagtag

SEQ ID NO: 254365 - DNA, 12 bp, Homo sapiens
atctgtagatac

SEQ ID NO: 254366 - DNA, 13 bp, Homo sapiens
atctgtatctctc

SEQ ID NO: 254367 - DNA, 14 bp, Homo sapiens
atctgtatctctct

SEQ ID NO: 254368 - DNA, 21 bp, Homo sapiens
atctgtatttttaaattctgc

SEQ ID NO: 254369 - DNA, 14 bp, Homo sapiens
atctgtcagcttcc

SEQ ID NO: 254370 - DNA, 23 bp, Homo sapiens
atctgtccaaaggaggctggcag

SEQ ID NO: 254371 - DNA, 21 bp, Homo sapiens
atctgtctagaatcctgcttt

SEQ ID NO: 254372 - DNA, 22 bp, Homo sapiens
atctgtctagaatcctgcttta

SEQ ID NO: 254373 - DNA, 18 bp, Homo sapiens
atctgtctcccagttatg

SEQ ID NO: 254374 - DNA, 16 bp, Homo sapiens
atctgtctgagccctg

SEQ ID NO: 254375 - DNA, 18 bp, Homo sapiens
atctgtctgagccctgcc

SEQ ID NO: 254376 - DNA, 12 bp, Homo sapiens
atctgtctgatt

SEQ ID NO: 254377 - DNA, 15 bp, Homo sapiens
atctgtctgattcta

SEQ ID NO: 254378 - DNA, 17 bp, Homo sapiens
atctgtctgattctatg

SEQ ID NO: 254379 - DNA, 13 bp, Homo sapiens
atctgtctgtcct

SEQ ID NO: 254380 - DNA, 11 bp, Homo sapiens
atctgtcttta

SEQ ID NO: 254381 - DNA, 14 bp, Homo sapiens
atctgtctttatga

SEQ ID NO: 254382 - DNA, 14 bp, Homo sapiens
atctgtgcccagag

SEQ ID NO: 254383 - DNA, 15 bp, Homo sapiens
atctgtgccccatgc

SEQ ID NO: 254384 - DNA, 17 bp, Homo sapiens
atgaactttctcttcat

SEQ ID NO: 254385 - DNA, 19 bp, Homo sapiens
atgaactttttaacaaatg

SEQ ID NO: 254386 - DNA, 20 bp, Homo sapiens
atgaagaaaaaggctggctg

SEQ ID NO: 254387 - DNA, 21 bp, Homo sapiens
atgaagaaaaaggctggctga

SEQ ID NO: 254388 - DNA, 22 bp, Homo sapiens
atgaagaaaagtgggccagtgt

SEQ ID NO: 254389 - DNA, 22 bp, Homo sapiens
atgaagaatgcattcaaaatat

SEQ ID NO: 254390 - DNA, 12 bp, Homo sapiens
atgaagattatt

SEQ ID NO: 254391 - DNA, 20 bp, Homo sapiens
atgaagattattttttatga

SEQ ID NO: 254392 - DNA, 21 bp, Homo sapiens
atgaagccctaagtaaatcta

SEQ ID NO: 254393 - DNA, 14 bp, Homo sapiens
atgaagccttgctg

SEQ ID NO: 254394 - DNA, 17 bp, Homo sapiens
atgaagccttgctgaac

SEQ ID NO: 254395 - DNA, 14 bp, Homo sapiens
atgaagctacctca

SEQ ID NO: 254396 - DNA, 14 bp, Homo sapiens
atgaagctcagttt

SEQ ID NO: 254397 - DNA, 17 bp, Homo sapiens
atgaaggcttttggtct

SEQ ID NO: 254398 - DNA, 16 bp, Homo sapiens
aaacttttataaatta

SEQ ID NO: 254399 - DNA, 20 bp, Homo sapiens
aaacttttcttaaaaagtta

SEQ ID NO: 254400 - DNA, 17 bp, Homo sapiens
aaagaaaaaaatagttt

SEQ ID NO: 254401 - DNA, 23 bp, Homo sapiens
aaagaaaaaccacagatactgaa

SEQ ID NO: 254402 - DNA, 16 bp, Homo sapiens
aaagaaaacattccag

SEQ ID NO: 254403 - DNA, 23 bp, Homo sapiens
aaagaaaagataaagatgatcta

SEQ ID NO: 254404 - DNA, 17 bp, Homo sapiens
aaagaaaaggaatgcaa

SEQ ID NO: 254405 - DNA, 20 bp, Homo sapiens
aaagaaaaggaatgcaagag

SEQ ID NO: 254406 - DNA, 16 bp, Homo sapiens
aaagaaacaccactta

SEQ ID NO: 254407 - DNA, 19 bp, Homo sapiens
aaagaaacaccacttaatc

SEQ ID NO: 254408 - DNA, 14 bp, Homo sapiens
aaagaaacactttc

SEQ ID NO: 254409 - DNA, 13 bp, Homo sapiens
aaagaaacagctt

SEQ ID NO: 254410 - DNA, 16 bp, Homo sapiens
aaagaaagctgtgaaa

SEQ ID NO: 254411 - DNA, 15 bp, Homo sapiens
aaagaaagggaaaag

SEQ ID NO: 254412 - DNA, 14 bp, Homo sapiens
aaagaaatcaattt

SEQ ID NO: 254413 - DNA, 21 bp, Homo sapiens
ccagagagagaagtgcccctg

SEQ ID NO: 254414 - DNA, 22 bp, Homo sapiens
ccagagagagaagtgcccctgc

SEQ ID NO: 254415 - DNA, 19 bp, Homo sapiens
ccagagagaggcgtcctgg

SEQ ID NO: 254416 - DNA, 12 bp, Homo sapiens
ccagagagctga

SEQ ID NO: 254417 - DNA, 17 bp, Homo sapiens
ccagagaggagcacctg

SEQ ID NO: 254418 - DNA, 20 bp, Homo sapiens
ccagagaggagcacctgaac

SEQ ID NO: 254419 - DNA, 16 bp, Homo sapiens
ccagagagggcccagc

SEQ ID NO: 254420 - DNA, 19 bp, Homo sapiens
ccagagagggcccagctgt

SEQ ID NO: 254421 - DNA, 21 bp, Homo sapiens
ccagagagggcccagctgtag

SEQ ID NO: 254422 - DNA, 21 bp, Homo sapiens
ccagagatgggactgggaggg

SEQ ID NO: 254423 - DNA, 21 bp, Homo sapiens
ccagagcatttccaacaccac

SEQ ID NO: 254424 - DNA, 23 bp, Homo sapiens
ccagagcatttccaacaccacag

SEQ ID NO: 254425 - DNA, 12 bp, Homo sapiens
ccagagccagcc

SEQ ID NO: 254426 - DNA, 14 bp, Homo sapiens
ccagagccagcctg

SEQ ID NO: 254427 - DNA, 16 bp, Homo sapiens
ccagagccagcctggg

SEQ ID NO: 254428 - DNA, 11 bp, Homo sapiens
ccagagccagg

SEQ ID NO: 254429 - DNA, 12 bp, Homo sapiens
ccagagccaggg

SEQ ID NO: 254430 - DNA, 21 bp, Homo sapiens
ccagagccccccacaatgatg

SEQ ID NO: 254431 - DNA, 20 bp, Homo sapiens
ccagagcctggtagagacta

SEQ ID NO: 254432 - DNA, 14 bp, Homo sapiens
ccagagctcccagg

SEQ ID NO: 254433 - DNA, 16 bp, Homo sapiens
ccagagctcccaggac

SEQ ID NO: 254434 - DNA, 18 bp, Homo sapiens
ccagagctcccaggacgc

SEQ ID NO: 254435 - DNA, 20 bp, Homo sapiens
ccagagctccgatgcccgcc

SEQ ID NO: 254436 - DNA, 12 bp, Homo sapiens
ccagagctctgg

SEQ ID NO: 254437 - DNA, 13 bp, Homo sapiens
ccagagctctgga

SEQ ID NO: 254438 - DNA, 21 bp, Homo sapiens
ccagagctctggagccacctg

SEQ ID NO: 254439 - DNA, 12 bp, Homo sapiens
ccagagctggaa

SEQ ID NO: 254440 - DNA, 17 bp, Homo sapiens
ccagagctggaaggcag

SEQ ID NO: 254441 - DNA, 14 bp, Homo sapiens
ccagagctgggtga

SEQ ID NO: 254442 - DNA, 20 bp, Homo sapiens
ccagagctgtttatggcctc

SEQ ID NO: 254443 - DNA, 22 bp, Homo sapiens
ccagagctgtttatggcctcag

SEQ ID NO: 254444 - DNA, 23 bp, Homo sapiens
ccagagctgtttatggcctcagc

SEQ ID NO: 254445 - DNA, 17 bp, Homo sapiens
ccagagcttattggcca

SEQ ID NO: 254446 - DNA, 19 bp, Homo sapiens
ccagagcttattggccact

SEQ ID NO: 254447 - DNA, 20 bp, Homo sapiens
ccagagcttattggccactg

SEQ ID NO: 254448 - DNA, 22 bp, Homo sapiens
ccagagcttattggccactggg

SEQ ID NO: 254449 - DNA, 17 bp, Homo sapiens
ccagagcttcagggctg

SEQ ID NO: 254450 - DNA, 15 bp, Homo sapiens
ccagaggagccaagt

SEQ ID NO: 254451 - DNA, 13 bp, Homo sapiens
ccagaggagggga

SEQ ID NO: 254452 - DNA, 21 bp, Homo sapiens
ccagaggcacagccggggcct

SEQ ID NO: 254453 - DNA, 18 bp, Homo sapiens
ccagaggcagaaccctgg

SEQ ID NO: 254454 - DNA, 18 bp, Homo sapiens
ccagaggctcctggagcc

SEQ ID NO: 254455 - DNA, 15 bp, Homo sapiens
ccagagggaccagct

SEQ ID NO: 254456 - DNA, 18 bp, Homo sapiens
ccagaggggcggggccag

SEQ ID NO: 254457 - DNA, 19 bp, Homo sapiens
ccagaggggcggggccagg

SEQ ID NO: 254458 - DNA, 20 bp, Homo sapiens
ccagaggtgagggaggcctg

SEQ ID NO: 254459 - DNA, 18 bp, Homo sapiens
ccagaggtgggaggcccc

SEQ ID NO: 254460 - DNA, 19 bp, Homo sapiens
ccagaggtgggatcctccc

SEQ ID NO: 254461 - DNA, 20 bp, Homo sapiens
ccagaggtgggatcctccct

SEQ ID NO: 254462 - DNA, 13 bp, Homo sapiens
ccagaggtgggga

SEQ ID NO: 254463 - DNA, 14 bp, Homo sapiens
ccagaggtggggaa

SEQ ID NO: 254464 - DNA, 23 bp, Homo sapiens
ccagaggtggggaagagagcctg

SEQ ID NO: 254465 - DNA, 18 bp, Homo sapiens
ccagaggttatctgcctg

SEQ ID NO: 254466 - DNA, 21 bp, Homo sapiens
ccagaggttatctgcctggcc

SEQ ID NO: 254467 - DNA, 17 bp, Homo sapiens
cctccccagcaggtggg

SEQ ID NO: 254468 - DNA, 12 bp, Homo sapiens
cctccccagcca

SEQ ID NO: 254469 - DNA, 13 bp, Homo sapiens
cctccccaggccg

SEQ ID NO: 254470 - DNA, 12 bp, Homo sapiens
cctccccagtgt

SEQ ID NO: 254471 - DNA, 13 bp, Homo sapiens
cctcccccaaagc

SEQ ID NO: 254472 - DNA, 12 bp, Homo sapiens
cctcccccacca

SEQ ID NO: 254473 - DNA, 16 bp, Homo sapiens
cctcccccaccattcc

SEQ ID NO: 254474 - DNA, 22 bp, Homo sapiens
cctcccccaccattccacatcc

SEQ ID NO: 254475 - DNA, 15 bp, Homo sapiens
cctcccccagagcca

SEQ ID NO: 254476 - DNA, 15 bp, Homo sapiens
cctcccccagccagg

SEQ ID NO: 254477 - DNA, 13 bp, Homo sapiens
cctcccccaggct

SEQ ID NO: 254478 - DNA, 14 bp, Homo sapiens
cctcccccaggctg

SEQ ID NO: 254479 - DNA, 22 bp, Homo sapiens
cctcccccaggctgcgcctgcc

SEQ ID NO: 254480 - DNA, 14 bp, Homo sapiens
cctccccccagacc

SEQ ID NO: 254481 - DNA, 20 bp, Homo sapiens
cctcccccgccacctgtgtg

SEQ ID NO: 254482 - DNA, 14 bp, Homo sapiens
cctccccctcaacc

SEQ ID NO: 254483 - DNA, 15 bp, Homo sapiens
cctccccctcaacct

SEQ ID NO: 254484 - DNA, 17 bp, Homo sapiens
cctccccctcttggtcc

SEQ ID NO: 254485 - DNA, 12 bp, Homo sapiens
cctccccctgcc

SEQ ID NO: 254486 - DNA, 14 bp, Homo sapiens
cctccccctgcccc

SEQ ID NO: 254487 - DNA, 18 bp, Homo sapiens
cctccccgggggtccccg

SEQ ID NO: 254488 - DNA, 16 bp, Homo sapiens
cctcccctcccctggg

SEQ ID NO: 254489 - DNA, 15 bp, Homo sapiens
cctcccctcctctcc

SEQ ID NO: 254490 - DNA, 17 bp, Homo sapiens
cctcccctcctcttccc

SEQ ID NO: 254491 - DNA, 15 bp, Homo sapiens
cctcccctctcctga

SEQ ID NO: 254492 - DNA, 13 bp, Homo sapiens
cctcccctgccct

SEQ ID NO: 254493 - DNA, 15 bp, Homo sapiens
cctcccctgccctcg

SEQ ID NO: 254494 - DNA, 15 bp, Homo sapiens
cctcccctgccctgg

SEQ ID NO: 254495 - DNA, 13 bp, Homo sapiens
cctcccctgcgga

SEQ ID NO: 254496 - DNA, 14 bp, Homo sapiens
cctcccctgcggag

SEQ ID NO: 254497 - DNA, 13 bp, Homo sapiens
cctccccttgggc

SEQ ID NO: 254498 - DNA, 16 bp, Homo sapiens
cctccccttgggcggc

SEQ ID NO: 254499 - DNA, 16 bp, Homo sapiens
cctcccgacctaccac

SEQ ID NO: 254500 - DNA, 18 bp, Homo sapiens
cctcccgcatgctgcctg

SEQ ID NO: 254501 - DNA, 20 bp, Homo sapiens
cctcccgcatgctgcctgcc

SEQ ID NO: 254502 - DNA, 19 bp, Homo sapiens
cctcccgggccctcccttg

SEQ ID NO: 254503 - DNA, 18 bp, Homo sapiens
cctccctacctcaacctg

SEQ ID NO: 254504 - DNA, 11 bp, Homo sapiens
cctccctcagc

SEQ ID NO: 254505 - DNA, 14 bp, Homo sapiens
cctccctcagcccc

SEQ ID NO: 254506 - DNA, 22 bp, Homo sapiens
cctccctcagctctctgggacc

SEQ ID NO: 254507 - DNA, 19 bp, Homo sapiens
cctccctccacacctccac

SEQ ID NO: 254508 - DNA, 14 bp, Homo sapiens
cctccctcccggca

SEQ ID NO: 254509 - DNA, 16 bp, Homo sapiens
cctccctccctccaca

SEQ ID NO: 254510 - DNA, 23 bp, Homo sapiens
cctccctccggccatactgcctt

SEQ ID NO: 254511 - DNA, 13 bp, Homo sapiens
cctccctcctcgt

SEQ ID NO: 254512 - DNA, 17 bp, Homo sapiens
ttttctttgctgtgcca

SEQ ID NO: 254513 - DNA, 11 bp, Homo sapiens
ttttcttttct

SEQ ID NO: 254514 - DNA, 15 bp, Homo sapiens
ttttcttttctatgg

SEQ ID NO: 254515 - DNA, 19 bp, Homo sapiens
ttttcttttgaataatgta

SEQ ID NO: 254516 - DNA, 12 bp, Homo sapiens
ttttgaaaacac

SEQ ID NO: 254517 - DNA, 12 bp, Homo sapiens
ttttgaaaaggc

SEQ ID NO: 254518 - DNA, 14 bp, Homo sapiens
ttttgaagaacaaa

SEQ ID NO: 254519 - DNA, 20 bp, Homo sapiens
ttttgaagaagggaaattca

SEQ ID NO: 254520 - DNA, 22 bp, Homo sapiens
ttttgaatgcttcctgacaatc

SEQ ID NO: 254521 - DNA, 14 bp, Homo sapiens
ttttgaatgtcaca

SEQ ID NO: 254522 - DNA, 17 bp, Homo sapiens
ttttgaatgtcacaaat

SEQ ID NO: 254523 - DNA, 13 bp, Homo sapiens
ttttgaatgttat

SEQ ID NO: 254524 - DNA, 19 bp, Homo sapiens
ttttgacataatgagtaat

SEQ ID NO: 254525 - DNA, 15 bp, Homo sapiens
ttttgacggatgatt

SEQ ID NO: 254526 - DNA, 11 bp, Homo sapiens
ttttgagaaaa

SEQ ID NO: 254527 - DNA, 12 bp, Homo sapiens
ttttgagaaaaa

SEQ ID NO: 254528 - DNA, 18 bp, Homo sapiens
ttttgaggcttctccttc

SEQ ID NO: 254529 - DNA, 13 bp, Homo sapiens
ttttacagtgtat

SEQ ID NO: 254530 - DNA, 19 bp, Homo sapiens
ttttacagtgtatctcgaa

SEQ ID NO: 254531 - DNA, 21 bp, Homo sapiens
ttttaccattttgcgatgtgt

SEQ ID NO: 254532 - DNA, 19 bp, Homo sapiens
ttttacctaccacagtgtc

SEQ ID NO: 254533 - DNA, 20 bp, Homo sapiens
ttttacctaccacagtgtct

SEQ ID NO: 254534 - DNA, 19 bp, Homo sapiens
ttttacggtgatattgtgc

SEQ ID NO: 254535 - DNA, 14 bp, Homo sapiens
ttttactaaagcag

SEQ ID NO: 254536 - DNA, 17 bp, Homo sapiens
ttttactaaagcagtgt

SEQ ID NO: 254537 - DNA, 23 bp, Homo sapiens
cctcaagccaggagaccctgtct

SEQ ID NO: 254538 - DNA, 18 bp, Homo sapiens
cctcaagccatcttcccg

SEQ ID NO: 254539 - DNA, 17 bp, Homo sapiens
cctcaagcttctcagac

SEQ ID NO: 254540 - DNA, 12 bp, Homo sapiens
cctcaaggactt

SEQ ID NO: 254541 - DNA, 19 bp, Homo sapiens
cctcaaggacttgaaagca

SEQ ID NO: 254542 - DNA, 18 bp, Homo sapiens
cctcaagggctttcccac

SEQ ID NO: 254543 - DNA, 16 bp, Homo sapiens
cctcaatgccctgcca

SEQ ID NO: 254544 - DNA, 16 bp, Homo sapiens
cctcaatggaggtttg

SEQ ID NO: 254545 - DNA, 20 bp, Homo sapiens
cctcacaactccttccatcc

SEQ ID NO: 254546 - DNA, 21 bp, Homo sapiens
cctcacaactccttccatcct

SEQ ID NO: 254547 - DNA, 12 bp, Homo sapiens
cctcacagcctc

SEQ ID NO: 254548 - DNA, 15 bp, Homo sapiens
cctcacagcctctcc

SEQ ID NO: 254549 - DNA, 17 bp, Homo sapiens
cctcacagcctctccct

SEQ ID NO: 254550 - DNA, 19 bp, Homo sapiens
cctcacagcctctccctta

SEQ ID NO: 254551 - DNA, 16 bp, Homo sapiens
cctcacatctcccttc

SEQ ID NO: 254552 - DNA, 15 bp, Homo sapiens
cctcacatgcccgct

SEQ ID NO: 254553 - DNA, 19 bp, Homo sapiens
cctcacatgcccgctgtcc

SEQ ID NO: 254554 - DNA, 17 bp, Homo sapiens
cctcaccaataacttca

SEQ ID NO: 254555 - DNA, 15 bp, Homo sapiens
cctcaccacccactt

SEQ ID NO: 254556 - DNA, 14 bp, Homo sapiens
cctcacccccaccc

SEQ ID NO: 254557 - DNA, 19 bp, Homo sapiens
cctcacccccacccctgta

SEQ ID NO: 254558 - DNA, 22 bp, Homo sapiens
cctcacccccacccctgtaccc

SEQ ID NO: 254559 - DNA, 15 bp, Homo sapiens
cctcacccgctgccc

SEQ ID NO: 254560 - DNA, 19 bp, Homo sapiens
cctcacccgctgcccagcc

SEQ ID NO: 254561 - DNA, 22 bp, Homo sapiens
cctcacccgctgcccagccctc

SEQ ID NO: 254562 - DNA, 15 bp, Homo sapiens
cctcaccctgcttgg

SEQ ID NO: 254563 - DNA, 23 bp, Homo sapiens
cctcaccctgcttggggcctggc

SEQ ID NO: 254564 - DNA, 13 bp, Homo sapiens
cctcacccttgcg

SEQ ID NO: 254565 - DNA, 17 bp, Homo sapiens
cctcacctccaccccct

SEQ ID NO: 254566 - DNA, 12 bp, Homo sapiens
cctcacctctgg

SEQ ID NO: 254567 - DNA, 15 bp, Homo sapiens
cctcacctggcttcc

SEQ ID NO: 254568 - DNA, 20 bp, Homo sapiens
cctcacctggcttcccagga

SEQ ID NO: 254569 - DNA, 23 bp, Homo sapiens
cctcacctggcttcccaggaccc

SEQ ID NO: 254570 - DNA, 19 bp, Homo sapiens
cctcacctgggcacctggg

SEQ ID NO: 254571 - DNA, 14 bp, Homo sapiens
cctcacctgggcct

SEQ ID NO: 254572 - DNA, 15 bp, Homo sapiens
cctcacctgggcctt

SEQ ID NO: 254573 - DNA, 23 bp, Homo sapiens
cctcacctgggcctttcctgtgc

SEQ ID NO: 254574 - DNA, 16 bp, Homo sapiens
cctcacgctctggaca

SEQ ID NO: 254575 - DNA, 23 bp, Homo sapiens
cctcactatttttttgttgctgt

SEQ ID NO: 254576 - DNA, 18 bp, Homo sapiens
cctcactccactcccctc

SEQ ID NO: 254577 - DNA, 12 bp, Homo sapiens
cctcactcctgt

SEQ ID NO: 254578 - DNA, 13 bp, Homo sapiens
cctcactcctgtt

SEQ ID NO: 254579 - DNA, 12 bp, Homo sapiens
cctcactctgcc

SEQ ID NO: 254580 - DNA, 19 bp, Homo sapiens
cctcactctgccagggcag

SEQ ID NO: 254581 - DNA, 20 bp, Homo sapiens
cctcactcttcctcatcctg

SEQ ID NO: 254582 - DNA, 20 bp, Homo sapiens
cctcactgctggggagtccc

SEQ ID NO: 254583 - DNA, 14 bp, Homo sapiens
cctcactggctggg

SEQ ID NO: 254584 - DNA, 17 bp, Homo sapiens
cctcactggctggggca

SEQ ID NO: 254585 - DNA, 23 bp, Homo sapiens
cctcactggctggggcagagggg

SEQ ID NO: 254586 - DNA, 19 bp, Homo sapiens
cctcacttccatacagctc

SEQ ID NO: 254587 - DNA, 19 bp, Homo sapiens
cctcagaaagtcaccagga

SEQ ID NO: 254588 - DNA, 21 bp, Homo sapiens
cctcagaaagtcaccaggact

SEQ ID NO: 254589 - DNA, 22 bp, Homo sapiens
cctcagaaagtcaccaggactt

SEQ ID NO: 254590 - DNA, 18 bp, Homo sapiens
cctcagaccaactctctc

SEQ ID NO: 254591 - DNA, 22 bp, Homo sapiens
cctcagaccaactctctcctgt

SEQ ID NO: 254592 - DNA, 19 bp, Homo sapiens
cctcagacttaccaggaag

SEQ ID NO: 254593 - DNA, 13 bp, Homo sapiens
cctcagagacagc

SEQ ID NO: 254594 - DNA, 16 bp, Homo sapiens
cctcagagacagcgcg

SEQ ID NO: 254595 - DNA, 16 bp, Homo sapiens
cctcagagccacccct

SEQ ID NO: 254596 - DNA, 19 bp, Homo sapiens
cctcagagccctgccctgc

SEQ ID NO: 254597 - DNA, 20 bp, Homo sapiens
cctcagagccctgccctgca

SEQ ID NO: 254598 - DNA, 18 bp, Homo sapiens
cctcagagggtccctagg

SEQ ID NO: 254599 - DNA, 17 bp, Homo sapiens
cctcagagtccaggccc

SEQ ID NO: 254600 - DNA, 14 bp, Homo sapiens
cctcagatgtgttg

SEQ ID NO: 254601 - DNA, 22 bp, Homo sapiens
cctcagcaagtgctgagtctgt

SEQ ID NO: 254602 - DNA, 14 bp, Homo sapiens
cctcagccagctgc

SEQ ID NO: 254603 - DNA, 16 bp, Homo sapiens
cctcagccagctgccc

SEQ ID NO: 254604 - DNA, 19 bp, Homo sapiens
cctcagccagctgcccaca

SEQ ID NO: 254605 - DNA, 14 bp, Homo sapiens
cctcagcccctctt

SEQ ID NO: 254606 - DNA, 16 bp, Homo sapiens
cctcagcccttgcccc

SEQ ID NO: 254607 - DNA, 18 bp, Homo sapiens
cctcagcccttgccccca

SEQ ID NO: 254608 - DNA, 21 bp, Homo sapiens
cctcagcgctgcccacaccac

SEQ ID NO: 254609 - DNA, 22 bp, Homo sapiens
cctcagcgctgcccacaccacc

SEQ ID NO: 254610 - DNA, 17 bp, Homo sapiens
cctcagctctcagttgc

SEQ ID NO: 254611 - DNA, 15 bp, Homo sapiens
cctcagctctctggg

SEQ ID NO: 254612 - DNA, 16 bp, Homo sapiens
cctcagctctctggga

SEQ ID NO: 254613 - DNA, 11 bp, Homo sapiens
cctcagctctg

SEQ ID NO: 254614 - DNA, 14 bp, Homo sapiens
cctcagctctggga

SEQ ID NO: 254615 - DNA, 15 bp, Homo sapiens
cctcagctctgggag

SEQ ID NO: 254616 - DNA, 14 bp, Homo sapiens
cctcagctgcacat

SEQ ID NO: 254617 - DNA, 12 bp, Homo sapiens
cctcagctgcca

SEQ ID NO: 254618 - DNA, 13 bp, Homo sapiens
cctcagctgccaa

SEQ ID NO: 254619 - DNA, 14 bp, Homo sapiens
cctcagctgccaag

SEQ ID NO: 254620 - DNA, 23 bp, Homo sapiens
cctcaggaactatgggagcctca

SEQ ID NO: 254621 - DNA, 15 bp, Homo sapiens
cctcaggaccccaga

SEQ ID NO: 254622 - DNA, 22 bp, Homo sapiens
cctcaggaccctccccacccac

SEQ ID NO: 254623 - DNA, 13 bp, Homo sapiens
cctcaggcaggaa

SEQ ID NO: 254624 - DNA, 13 bp, Homo sapiens
cctcaggcctccc

SEQ ID NO: 254625 - DNA, 14 bp, Homo sapiens
cctcaggctgctgg

SEQ ID NO: 254626 - DNA, 15 bp, Homo sapiens
cctcaggctgctgga

SEQ ID NO: 254627 - DNA, 23 bp, Homo sapiens
cctcagggatgtgggaatctccc

SEQ ID NO: 254628 - DNA, 15 bp, Homo sapiens
cctcagggcttcctt

SEQ ID NO: 254629 - DNA, 13 bp, Homo sapiens
cctcagggtgggg

SEQ ID NO: 254630 - DNA, 15 bp, Homo sapiens
cctcaggtgaataac

SEQ ID NO: 254631 - DNA, 15 bp, Homo sapiens
cctcaggttccaaat

SEQ ID NO: 254632 - DNA, 21 bp, Homo sapiens
cctcagtcagttcccggagca

SEQ ID NO: 254633 - DNA, 22 bp, Homo sapiens
cctcagtcagttcccggagcac

SEQ ID NO: 254634 - DNA, 23 bp, Homo sapiens
cctcagtcagttcccggagcaca

SEQ ID NO: 254635 - DNA, 23 bp, Homo sapiens
cctcagtccctccctcctggctc

SEQ ID NO: 254636 - DNA, 19 bp, Homo sapiens
cctcagtctttgggggatt

SEQ ID NO: 254637 - DNA, 13 bp, Homo sapiens
cctcagtgccact

SEQ ID NO: 254638 - DNA, 19 bp, Homo sapiens
cctcagtgccacttgacat

SEQ ID NO: 254639 - DNA, 22 bp, Homo sapiens
cctcagtgccacttgacattcc

SEQ ID NO: 254640 - DNA, 23 bp, Homo sapiens
cctcagtgccacttgacattcct

SEQ ID NO: 254641 - DNA, 21 bp, Homo sapiens
cctcagtggactttccacccc

SEQ ID NO: 254642 - DNA, 12 bp, Homo sapiens
cctcagtgtcat

SEQ ID NO: 254643 - DNA, 18 bp, Homo sapiens
cctcagtgtcctcatcta

SEQ ID NO: 254644 - DNA, 16 bp, Homo sapiens
cctcagtgtgaagcct

SEQ ID NO: 254645 - DNA, 18 bp, Homo sapiens
cctcagtgtgaagcctgt

SEQ ID NO: 254646 - DNA, 21 bp, Homo sapiens
cctcagttcccttggcctcag

SEQ ID NO: 254647 - DNA, 19 bp, Homo sapiens
cctcagttttatcattttc

SEQ ID NO: 254648 - DNA, 14 bp, Homo sapiens
cctcatcaggatga

SEQ ID NO: 254649 - DNA, 18 bp, Homo sapiens
cctcatcccctcgtcctg

SEQ ID NO: 254650 - DNA, 11 bp, Homo sapiens
cctcatccctc

SEQ ID NO: 254651 - DNA, 23 bp, Homo sapiens
cctcatcctcctggacccagcag

SEQ ID NO: 254652 - DNA, 15 bp, Homo sapiens
cctcatcctgcttct

SEQ ID NO: 254653 - DNA, 13 bp, Homo sapiens
cctcatctcattc

SEQ ID NO: 254654 - DNA, 13 bp, Homo sapiens
cctcatctccaag

SEQ ID NO: 254655 - DNA, 20 bp, Homo sapiens
cctcatcttgaagggcccag

SEQ ID NO: 254656 - DNA, 19 bp, Homo sapiens
cctcatgaatgtaaatttg

SEQ ID NO: 254657 - DNA, 23 bp, Homo sapiens
cctcatgaatgtaaatttgtact

SEQ ID NO: 254658 - DNA, 17 bp, Homo sapiens
cctcatgcctggccccc

SEQ ID NO: 254659 - DNA, 23 bp, Homo sapiens
cctcatgcctggcccccctccag

SEQ ID NO: 254660 - DNA, 12 bp, Homo sapiens
cctcatggctgt

SEQ ID NO: 254661 - DNA, 13 bp, Homo sapiens
cctcatggctgtt

SEQ ID NO: 254662 - DNA, 15 bp, Homo sapiens
cctcattgcatttat

SEQ ID NO: 254663 - DNA, 20 bp, Homo sapiens
cctcatttatcactctgacc

SEQ ID NO: 254664 - DNA, 22 bp, Homo sapiens
cctcatttatcactctgacctt

SEQ ID NO: 254665 - DNA, 14 bp, Homo sapiens
cctccaaactcctg

SEQ ID NO: 254666 - DNA, 14 bp, Homo sapiens
cctccaaagcctgg

SEQ ID NO: 254667 - DNA, 19 bp, Homo sapiens
cctccaaagcctgggcaga

SEQ ID NO: 254668 - DNA, 20 bp, Homo sapiens
cctccaaagcctgggcagaa

SEQ ID NO: 254669 - DNA, 17 bp, Homo sapiens
cctccaaagtcttgata

SEQ ID NO: 254670 - DNA, 16 bp, Homo sapiens
cctccaagcctgcctc

SEQ ID NO: 254671 - DNA, 21 bp, Homo sapiens
ctgccaatgccacagccaagc

SEQ ID NO: 254672 - DNA, 21 bp, Homo sapiens
ctgccacaatgtgatatgtgt

SEQ ID NO: 254673 - DNA, 24 bp, Homo sapiens
ctgccacacgtctgaccctctcca

SEQ ID NO: 254674 - DNA, 18 bp, Homo sapiens
ctgccacactcagtcccc

SEQ ID NO: 254675 - DNA, 17 bp, Homo sapiens
ctgccacacttcaggct

SEQ ID NO: 254676 - DNA, 22 bp, Homo sapiens
ctgccacacttcaggctcttct

SEQ ID NO: 254677 - DNA, 21 bp, Homo sapiens
ctgccaccacgtctgccaggc

SEQ ID NO: 254678 - DNA, 15 bp, Homo sapiens
ctgccacccactcag

SEQ ID NO: 254679 - DNA, 17 bp, Homo sapiens
ctgccacccactcagga

SEQ ID NO: 254680 - DNA, 18 bp, Homo sapiens
ctgccacccactcaggat

SEQ ID NO: 254681 - DNA, 23 bp, Homo sapiens
ctgccacccgcttcctgtttctt

SEQ ID NO: 254682 - DNA, 18 bp, Homo sapiens
ctgccaccgtcacacagt

SEQ ID NO: 254683 - DNA, 13 bp, Homo sapiens
ctgccacctccct

SEQ ID NO: 254684 - DNA, 16 bp, Homo sapiens
ctgccacctccctgac

SEQ ID NO: 254685 - DNA, 18 bp, Homo sapiens
ctgccacctccctgaccc

SEQ ID NO: 254686 - DNA, 16 bp, Homo sapiens
ctgccacctcctgcct

SEQ ID NO: 254687 - DNA, 14 bp, Homo sapiens
ctgccacctggggc

SEQ ID NO: 254688 - DNA, 15 bp, Homo sapiens
ctgccacctggggca

SEQ ID NO: 254689 - DNA, 11 bp, Homo sapiens
ctgccacctgt

SEQ ID NO: 254690 - DNA, 14 bp, Homo sapiens
ctgccacctgtctg

SEQ ID NO: 254691 - DNA, 22 bp, Homo sapiens
ctgccactaggctgggtgccca

SEQ ID NO: 254692 - DNA, 19 bp, Homo sapiens
ctgccactgactgcaggga

SEQ ID NO: 254693 - DNA, 15 bp, Homo sapiens
ctgccacttgcactg

SEQ ID NO: 254694 - DNA, 18 bp, Homo sapiens
ctgccacttgcactgtgc

SEQ ID NO: 254695 - DNA, 20 bp, Homo sapiens
ctgccacttgcactgtgctt

SEQ ID NO: 254696 - DNA, 22 bp, Homo sapiens
ctgccagacggcacccacccag

SEQ ID NO: 254697 - DNA, 16 bp, Homo sapiens
ctgccagcccctcggc

SEQ ID NO: 254698 - DNA, 13 bp, Homo sapiens
ctgccagctccac

SEQ ID NO: 254699 - DNA, 19 bp, Homo sapiens
ctgccagctccacagggtg

SEQ ID NO: 254700 - DNA, 12 bp, Homo sapiens
ctgccagctgcc

SEQ ID NO: 254701 - DNA, 15 bp, Homo sapiens
ctgccagctgccttc

SEQ ID NO: 254702 - DNA, 17 bp, Homo sapiens
ctgccaggcacctggcc

SEQ ID NO: 254703 - DNA, 19 bp, Homo sapiens
ctgccaggcacctggcctg

SEQ ID NO: 254704 - DNA, 16 bp, Homo sapiens
ctgccaggcccatctc

SEQ ID NO: 254705 - DNA, 18 bp, Homo sapiens
ggacccaccaaactgcac

SEQ ID NO: 254706 - DNA, 20 bp, Homo sapiens
ggacccaccaaactgcacac

SEQ ID NO: 254707 - DNA, 22 bp, Homo sapiens
ggacccacccatcttcctgctg

SEQ ID NO: 254708 - DNA, 12 bp, Homo sapiens
ggacccacccca

SEQ ID NO: 254709 - DNA, 22 bp, Homo sapiens
ggacccaccccaactctcccca

SEQ ID NO: 254710 - DNA, 22 bp, Homo sapiens
ggacccagctactctgtccagg

SEQ ID NO: 254711 - DNA, 11 bp, Homo sapiens
ggacccagctg

SEQ ID NO: 254712 - DNA, 11 bp, Homo sapiens
ggacccaggcc

SEQ ID NO: 254713 - DNA, 12 bp, Homo sapiens
ggacccaggccc

SEQ ID NO: 254714 - DNA, 13 bp, Homo sapiens
ggacccaggccct

SEQ ID NO: 254715 - DNA, 18 bp, Homo sapiens
ggacccaggccctccatg

SEQ ID NO: 254716 - DNA, 22 bp, Homo sapiens
ggacccaggccctccatgggct

SEQ ID NO: 254717 - DNA, 12 bp, Homo sapiens
ggaccccagaga

SEQ ID NO: 254718 - DNA, 21 bp, Homo sapiens
ggaccccagagattcccaagc

SEQ ID NO: 254719 - DNA, 21 bp, Homo sapiens
ggaccccagagggaccagctg

SEQ ID NO: 254720 - DNA, 20 bp, Homo sapiens
ggaccccatctgctgagctc

SEQ ID NO: 254721 - DNA, 19 bp, Homo sapiens
ggacccccggcctccaggc

SEQ ID NO: 254722 - DNA, 13 bp, Homo sapiens
ggacccctcacct

SEQ ID NO: 254723 - DNA, 13 bp, Homo sapiens
ggacccctcccaa

SEQ ID NO: 254724 - DNA, 14 bp, Homo sapiens
ggacccctcccttg

SEQ ID NO: 254725 - DNA, 21 bp, Homo sapiens
ggacccggaggggcctggcag

SEQ ID NO: 254726 - DNA, 11 bp, Homo sapiens
ggaccctgggt

SEQ ID NO: 254727 - DNA, 22 bp, Homo sapiens
ggacccttctactttttccttc

SEQ ID NO: 254728 - DNA, 15 bp, Homo sapiens
ggaccgcatcctcca

SEQ ID NO: 254729 - DNA, 16 bp, Homo sapiens
ggaccgcatcctccag

SEQ ID NO: 254730 - DNA, 17 bp, Homo sapiens
ggaccgcatcctccagg

SEQ ID NO: 254731 - DNA, 17 bp, Homo sapiens
ggaccgccagatggggc

SEQ ID NO: 254732 - DNA, 21 bp, Homo sapiens
ggaccgcgtagagagccgggc

SEQ ID NO: 254733 - DNA, 14 bp, Homo sapiens
ggaccggagcggct

SEQ ID NO: 254734 - DNA, 16 bp, Homo sapiens
ggaccgggtgggcctg

SEQ ID NO: 254735 - DNA, 17 bp, Homo sapiens
ggaccgggtgggcctgg

SEQ ID NO: 254736 - DNA, 22 bp, Homo sapiens
ggacctaacattcgatctcatt

SEQ ID NO: 254737 - DNA, 21 bp, Homo sapiens
ggacctatgtcctaaggacac

SEQ ID NO: 254738 - DNA, 21 bp, Homo sapiens
ggacctcagagtccaggcccc

SEQ ID NO: 254739 - DNA, 19 bp, Homo sapiens
ggacctcagtttctgttgt

SEQ ID NO: 254740 - DNA, 11 bp, Homo sapiens
ggacctcctta

SEQ ID NO: 254741 - DNA, 21 bp, Homo sapiens
ggacctccttagccctgtctg

SEQ ID NO: 254742 - DNA, 15 bp, Homo sapiens
ggacctctcttgtga

SEQ ID NO: 254743 - DNA, 19 bp, Homo sapiens
ggacctgcctcctgcctgc

SEQ ID NO: 254744 - DNA, 22 bp, Homo sapiens
ggacctgcctcctgcctgcccc

SEQ ID NO: 254745 - DNA, 13 bp, Homo sapiens
ggacctgctgctc

SEQ ID NO: 254746 - DNA, 13 bp, Homo sapiens
ggaccttggagag

SEQ ID NO: 254747 - DNA, 15 bp, Homo sapiens
ggacgagactcctcg

SEQ ID NO: 254748 - DNA, 22 bp, Homo sapiens
ggacgagggatgggatttcatg

SEQ ID NO: 254749 - DNA, 14 bp, Homo sapiens
ggacgcagggagac

SEQ ID NO: 254750 - DNA, 13 bp, Homo sapiens
ggacgcattccaa

SEQ ID NO: 254751 - DNA, 14 bp, Homo sapiens
ggacgcctggctcc

SEQ ID NO: 254752 - DNA, 20 bp, Homo sapiens
ggacgcctggctccaggctc

SEQ ID NO: 254753 - DNA, 13 bp, Homo sapiens
ggacgcttctgaa

SEQ ID NO: 254754 - DNA, 18 bp, Homo sapiens
ccttctcccctccagacc

SEQ ID NO: 254755 - DNA, 16 bp, Homo sapiens
ccttctcccctgcact

SEQ ID NO: 254756 - DNA, 24 bp, Homo sapiens
ccttctcccctgcactgtaaaatg

SEQ ID NO: 254757 - DNA, 14 bp, Homo sapiens
ccttctcccctgcc

SEQ ID NO: 254758 - DNA, 18 bp, Homo sapiens
ccttctcctctctgggcc

SEQ ID NO: 254759 - DNA, 19 bp, Homo sapiens
ccttctcctctctgggcct

SEQ ID NO: 254760 - DNA, 18 bp, Homo sapiens
ccttctccttccaactgc

SEQ ID NO: 254761 - DNA, 19 bp, Homo sapiens
ccttctcgtcttcctctct

SEQ ID NO: 254762 - DNA, 12 bp, Homo sapiens
ccttctctactc

SEQ ID NO: 254763 - DNA, 19 bp, Homo sapiens
ccttctctactcatgccag

SEQ ID NO: 254764 - DNA, 16 bp, Homo sapiens
ccttctctcacctcct

SEQ ID NO: 254765 - DNA, 18 bp, Homo sapiens
ccttctctcacctcctaa

SEQ ID NO: 254766 - DNA, 18 bp, Homo sapiens
ccttctcttctatcctgc

SEQ ID NO: 254767 - DNA, 20 bp, Homo sapiens
ccttctgaaaaagtatcctg

SEQ ID NO: 254768 - DNA, 18 bp, Homo sapiens
ccttctgaacatgagtgt

SEQ ID NO: 254769 - DNA, 23 bp, Homo sapiens
ccttctgaacatgagtgtcaact

SEQ ID NO: 254770 - DNA, 13 bp, Homo sapiens
ccttctgaactcc

SEQ ID NO: 254771 - DNA, 15 bp, Homo sapiens
ccttctgaactccat

SEQ ID NO: 254772 - DNA, 15 bp, Homo sapiens
ccttctgacggccct

SEQ ID NO: 254773 - DNA, 18 bp, Homo sapiens
ccttctgacggccctgca

SEQ ID NO: 254774 - DNA, 22 bp, Homo sapiens
ccttctgatgtctctaaagcac

SEQ ID NO: 254775 - DNA, 21 bp, Homo sapiens
ccttctgctggataaaatgag

SEQ ID NO: 254776 - DNA, 13 bp, Homo sapiens
ccttctgctttct

SEQ ID NO: 254777 - DNA, 14 bp, Homo sapiens
ccttctgctttcta

SEQ ID NO: 254778 - DNA, 19 bp, Homo sapiens
ccttctgtccccagccctg

SEQ ID NO: 254779 - DNA, 15 bp, Homo sapiens
ccttctgtgcccagc

SEQ ID NO: 254780 - DNA, 17 bp, Homo sapiens
ccttctgtgcccagctc

SEQ ID NO: 254781 - DNA, 19 bp, Homo sapiens
ccttctgtgcccagctcag

SEQ ID NO: 254782 - DNA, 21 bp, Homo sapiens
ccttctgtgcccagctcagtc

SEQ ID NO: 254783 - DNA, 18 bp, Homo sapiens
ccttctgtttccatagga

SEQ ID NO: 254784 - DNA, 14 bp, Homo sapiens
ccttcttcacccag

SEQ ID NO: 254785 - DNA, 15 bp, Homo sapiens
ccttcttccacagca

SEQ ID NO: 254786 - DNA, 11 bp, Homo sapiens
ccttcttcctc

SEQ ID NO: 254787 - DNA, 22 bp, Homo sapiens
ccttcttcctcaagtcttgaca

SEQ ID NO: 254788 - DNA, 15 bp, Homo sapiens
ccttcttggcttctg

SEQ ID NO: 254789 - DNA, 16 bp, Homo sapiens
ccttcttggcttctgg

SEQ ID NO: 254790 - DNA, 13 bp, Homo sapiens
ccttcttgggccc

SEQ ID NO: 254791 - DNA, 17 bp, Homo sapiens
ccttcttgggccccaga

SEQ ID NO: 254792 - DNA, 15 bp, Homo sapiens
ccttctttaccttca

SEQ ID NO: 254793 - DNA, 19 bp, Homo sapiens
ccttctttaccttcatttc

SEQ ID NO: 254794 - DNA, 20 bp, Homo sapiens
ccttctttctagagagggaa

SEQ ID NO: 254795 - DNA, 16 bp, Homo sapiens
ccttctttgcagggct

SEQ ID NO: 254796 - DNA, 16 bp, Homo sapiens
ccttctttttcttctt

SEQ ID NO: 254797 - DNA, 13 bp, Homo sapiens
ccttgaaaggaag

SEQ ID NO: 254798 - DNA, 16 bp, Homo sapiens
ccttgaacctcattaa

SEQ ID NO: 254799 - DNA, 17 bp, Homo sapiens
ccttgaagaacctctca

SEQ ID NO: 254800 - DNA, 18 bp, Homo sapiens
ccttgaagaacctctcac

SEQ ID NO: 254801 - DNA, 21 bp, Homo sapiens
ccttgaagacatatcatgtgt

SEQ ID NO: 254802 - DNA, 23 bp, Homo sapiens
ccttgacattgtagagcttctgg

SEQ ID NO: 254803 - DNA, 13 bp, Homo sapiens
ccttgaccttcct

SEQ ID NO: 254804 - DNA, 22 bp, Homo sapiens
ccttgaccttcctctggggctc

SEQ ID NO: 254805 - DNA, 14 bp, Homo sapiens
ccttgagaaacctt

SEQ ID NO: 254806 - DNA, 19 bp, Homo sapiens
ccttgagaccctcttctct

SEQ ID NO: 254807 - DNA, 21 bp, Homo sapiens
ccttgagaggcatgacagctg

SEQ ID NO: 254808 - DNA, 20 bp, Homo sapiens
ccttgaggacctccacctgg

SEQ ID NO: 254809 - DNA, 21 bp, Homo sapiens
ccttgaggacctccacctggg

SEQ ID NO: 254810 - DNA, 22 bp, Homo sapiens
ccttgaggacctccacctggga

SEQ ID NO: 254811 - DNA, 23 bp, Homo sapiens
ccttgaggtcttttgacatgtgg

SEQ ID NO: 254812 - DNA, 18 bp, Homo sapiens
ccttgatgtcttgagagc

SEQ ID NO: 254813 - DNA, 19 bp, Homo sapiens
ccttgcacaaaaagcacaa

SEQ ID NO: 254814 - DNA, 15 bp, Homo sapiens
ccttgcacaggccac

SEQ ID NO: 254815 - DNA, 19 bp, Homo sapiens
ccttgcacaggccacttgc

SEQ ID NO: 254816 - DNA, 22 bp, Homo sapiens
ccttgcacaggccacttgctca

SEQ ID NO: 254817 - DNA, 23 bp, Homo sapiens
ccttgcacaggccacttgctcag

SEQ ID NO: 254818 - DNA, 20 bp, Homo sapiens
ccttgcagttcagcaccacc

SEQ ID NO: 254819 - DNA, 19 bp, Homo sapiens
ccttgccaagctttcttct

SEQ ID NO: 254820 - DNA, 13 bp, Homo sapiens
ccttgccaaggcc

SEQ ID NO: 254821 - DNA, 22 bp, Homo sapiens
ccttgccaaggccgcccacctg

SEQ ID NO: 254822 - DNA, 12 bp, Homo sapiens
ccttgccacccc

SEQ ID NO: 254823 - DNA, 22 bp, Homo sapiens
ccttgccaccccccgccggcag

SEQ ID NO: 254824 - DNA, 21 bp, Homo sapiens
ccttgcccaaccaatgcacac

SEQ ID NO: 254825 - DNA, 17 bp, Homo sapiens
ccttgcccgccagcctc

SEQ ID NO: 254826 - DNA, 19 bp, Homo sapiens
ccttgcccgccagcctcag

SEQ ID NO: 254827 - DNA, 20 bp, Homo sapiens
ccttgcccgccagcctcagt

SEQ ID NO: 254828 - DNA, 19 bp, Homo sapiens
ccttgcctcaatgccagta

SEQ ID NO: 254829 - DNA, 12 bp, Homo sapiens
ccttgctacctc

SEQ ID NO: 254830 - DNA, 17 bp, Homo sapiens
ccttgctacctcaaggg

SEQ ID NO: 254831 - DNA, 20 bp, Homo sapiens
ccttgctctcccctgccctg

SEQ ID NO: 254832 - DNA, 22 bp, Homo sapiens
ccttgctctcccctgccctgct

SEQ ID NO: 254833 - DNA, 19 bp, Homo sapiens
ccttgctctccctcttctc

SEQ ID NO: 254834 - DNA, 18 bp, Homo sapiens
ccttgctgcacctgaggc

SEQ ID NO: 254835 - DNA, 17 bp, Homo sapiens
ggagtggtaacaagagg

SEQ ID NO: 254836 - DNA, 24 bp, Homo sapiens
ggagtggtaacaagaggagcagga

SEQ ID NO: 254837 - DNA, 16 bp, Homo sapiens
ggagtgtgtattgttc

SEQ ID NO: 254838 - DNA, 17 bp, Homo sapiens
ggagtgtgtattgttcc

SEQ ID NO: 254839 - DNA, 18 bp, Homo sapiens
ggagtgtgtattgttccc

SEQ ID NO: 254840 - DNA, 19 bp, Homo sapiens
ggagtgtgtattgttccca

SEQ ID NO: 254841 - DNA, 13 bp, Homo sapiens
ggagtgtgtgtct

SEQ ID NO: 254842 - DNA, 19 bp, Homo sapiens
ggagtgttctgtttcccat

SEQ ID NO: 254843 - DNA, 22 bp, Homo sapiens
ggagttattcactctcccagag

SEQ ID NO: 254844 - DNA, 13 bp, Homo sapiens
ggagttcaatgat

SEQ ID NO: 254845 - DNA, 14 bp, Homo sapiens
ggagttcaatgatc

SEQ ID NO: 254846 - DNA, 14 bp, Homo sapiens
ggagttcagagggt

SEQ ID NO: 254847 - DNA, 19 bp, Homo sapiens
ggagttcctaacaggatga

SEQ ID NO: 254848 - DNA, 14 bp, Homo sapiens
ggagttgagtacag

SEQ ID NO: 254849 - DNA, 12 bp, Homo sapiens
ggagttgctcct

SEQ ID NO: 254850 - DNA, 17 bp, Homo sapiens
ggagtttgagacaagcc

SEQ ID NO: 254851 - DNA, 20 bp, Homo sapiens
ggagtttgagacaagccctg

SEQ ID NO: 254852 - DNA, 21 bp, Homo sapiens
ggagtttgagacaagccctgg

SEQ ID NO: 254853 - DNA, 12 bp, Homo sapiens
ggagttttactc

SEQ ID NO: 254854 - DNA, 13 bp, Homo sapiens
ggagttttgttta

SEQ ID NO: 254855 - DNA, 15 bp, Homo sapiens
ggataaaatgaggtt

SEQ ID NO: 254856 - DNA, 14 bp, Homo sapiens
ggataacctatatg

SEQ ID NO: 254857 - DNA, 15 bp, Homo sapiens
ggataattatatcag

SEQ ID NO: 254858 - DNA, 16 bp, Homo sapiens
ggatactgcccggggc

SEQ ID NO: 254859 - DNA, 20 bp, Homo sapiens
ggatacttagtggtatgtct

SEQ ID NO: 254860 - DNA, 23 bp, Homo sapiens
ggatacttagtggtatgtctctt

SEQ ID NO: 254861 - DNA, 22 bp, Homo sapiens
ggatagaaaattatgcagcttg

SEQ ID NO: 254862 - DNA, 15 bp, Homo sapiens
ggatagatgccctgc

SEQ ID NO: 254863 - DNA, 16 bp, Homo sapiens
ggatagcctttgtagg

SEQ ID NO: 254864 - DNA, 21 bp, Homo sapiens
ggatagcttcatcttgagcct

SEQ ID NO: 254865 - DNA, 11 bp, Homo sapiens
ggataggaaaa

SEQ ID NO: 254866 - DNA, 17 bp, Homo sapiens
ggataggagcttccaga

SEQ ID NO: 254867 - DNA, 18 bp, Homo sapiens
ggataggagcttccagat

SEQ ID NO: 254868 - DNA, 14 bp, Homo sapiens
ggatagtagatctg

SEQ ID NO: 254869 - DNA, 22 bp, Homo sapiens
ggatcaaaccccgaccacctgc

SEQ ID NO: 254870 - DNA, 23 bp, Homo sapiens
ggatcaaagctaggaaaggcaga

SEQ ID NO: 254871 - DNA, 20 bp, Homo sapiens
ggatcaagcttgtgtacttg

SEQ ID NO: 254872 - DNA, 22 bp, Homo sapiens
ggatcagaaagagttcagtaag

SEQ ID NO: 254873 - DNA, 20 bp, Homo sapiens
ggatcagagtctggcctgcc

SEQ ID NO: 254874 - DNA, 16 bp, Homo sapiens
ggatcagggaatccag

SEQ ID NO: 254875 - DNA, 21 bp, Homo sapiens
ggatcagggaatccagctccc

SEQ ID NO: 254876 - DNA, 20 bp, Homo sapiens
ggatcagtggggccccaaag

SEQ ID NO: 254877 - DNA, 11 bp, Homo sapiens
ggatccagaga

SEQ ID NO: 254878 - DNA, 12 bp, Homo sapiens
ggatcccctgct

SEQ ID NO: 254879 - DNA, 14 bp, Homo sapiens
ggatccgctgccac

SEQ ID NO: 254880 - DNA, 17 bp, Homo sapiens
ggatccgctgccaccac

SEQ ID NO: 254881 - DNA, 12 bp, Homo sapiens
ggatcctccctc

SEQ ID NO: 254882 - DNA, 17 bp, Homo sapiens
ggatcctccctcatggc

SEQ ID NO: 254883 - DNA, 12 bp, Homo sapiens
ggatcctggagc

SEQ ID NO: 254884 - DNA, 16 bp, Homo sapiens
ggatcctgtgtggaga

SEQ ID NO: 254885 - DNA, 13 bp, Homo sapiens
ggatctaccagca

SEQ ID NO: 254886 - DNA, 17 bp, Homo sapiens
ggatctatcacctgtca

SEQ ID NO: 254887 - DNA, 11 bp, Homo sapiens
ggatctccagg

SEQ ID NO: 254888 - DNA, 16 bp, Homo sapiens
ggatctgctccatgca

SEQ ID NO: 254889 - DNA, 17 bp, Homo sapiens
ggatctgctccatgcag

SEQ ID NO: 254890 - DNA, 18 bp, Homo sapiens
ggatctgctccatgcaga

SEQ ID NO: 254891 - DNA, 18 bp, Homo sapiens
ggatctggggctctggga

SEQ ID NO: 254892 - DNA, 16 bp, Homo sapiens
ggatctgtgcccagag

SEQ ID NO: 254893 - DNA, 18 bp, Homo sapiens
ggatgaaagacaaagaag

SEQ ID NO: 254894 - DNA, 22 bp, Homo sapiens
ggatgaaagacaaagaaggaaa

SEQ ID NO: 254895 - DNA, 17 bp, Homo sapiens
ggatgaaattttctaga

SEQ ID NO: 254896 - DNA, 17 bp, Homo sapiens
ggatgaattgtaaaagc

SEQ ID NO: 254897 - DNA, 19 bp, Homo sapiens
ggatgacaggcgcctgcca

SEQ ID NO: 254898 - DNA, 23 bp, Homo sapiens
ggatgagcctctccttgccccag

SEQ ID NO: 254899 - DNA, 16 bp, Homo sapiens
ggatgaggtgctggga

SEQ ID NO: 254900 - DNA, 14 bp, Homo sapiens
ggatgatttaacat

SEQ ID NO: 254901 - DNA, 15 bp, Homo sapiens
ggatgcactggcctg

SEQ ID NO: 254902 - DNA, 17 bp, Homo sapiens
ggatgccaaggagcccc

SEQ ID NO: 254903 - DNA, 19 bp, Homo sapiens
ggatgccaaggagcccctg

SEQ ID NO: 254904 - DNA, 13 bp, Homo sapiens
ggatgctgtgcct

SEQ ID NO: 254905 - DNA, 21 bp, Homo sapiens
ggatgctgtgcctcccaagct

SEQ ID NO: 254906 - DNA, 11 bp, Homo sapiens
ggatgcttcat

SEQ ID NO: 254907 - DNA, 14 bp, Homo sapiens
ggatggaaggagag

SEQ ID NO: 254908 - DNA, 19 bp, Homo sapiens
ggatggaaggagagaggtt

SEQ ID NO: 254909 - DNA, 12 bp, Homo sapiens
cgcagagcccac

SEQ ID NO: 254910 - DNA, 16 bp, Homo sapiens
cgcagagccccggagc

SEQ ID NO: 254911 - DNA, 20 bp, Homo sapiens
cgcagcaccagcctgagcca

SEQ ID NO: 254912 - DNA, 13 bp, Homo sapiens
cgcagcatgtggg

SEQ ID NO: 254913 - DNA, 12 bp, Homo sapiens
cgcagccaggac

SEQ ID NO: 254914 - DNA, 12 bp, Homo sapiens
cgcagcccgtga

SEQ ID NO: 254915 - DNA, 20 bp, Homo sapiens
cgcagcccgtgaagcagtgc

SEQ ID NO: 254916 - DNA, 23 bp, Homo sapiens
cgcagcccgtgaagcagtgcctc

SEQ ID NO: 254917 - DNA, 14 bp, Homo sapiens
cgcagccctagtgg

SEQ ID NO: 254918 - DNA, 15 bp, Homo sapiens
cgcagccctgctttg

SEQ ID NO: 254919 - DNA, 12 bp, Homo sapiens
cgcaggagagag

SEQ ID NO: 254920 - DNA, 15 bp, Homo sapiens
cgcaggatccgctgc

SEQ ID NO: 254921 - DNA, 19 bp, Homo sapiens
cgcaggatccgctgccacc

SEQ ID NO: 254922 - DNA, 11 bp, Homo sapiens
cgcaggccctc

SEQ ID NO: 254923 - DNA, 14 bp, Homo sapiens
cgcagggagaccct

SEQ ID NO: 254924 - DNA, 17 bp, Homo sapiens
cgcagggagaccctggg

SEQ ID NO: 254925 - DNA, 20 bp, Homo sapiens
cgcagggcgctccggcagag

SEQ ID NO: 254926 - DNA, 22 bp, Homo sapiens
cgcagggcgctccggcagaggc

SEQ ID NO: 254927 - DNA, 15 bp, Homo sapiens
cgcaggttaccttgg

SEQ ID NO: 254928 - DNA, 20 bp, Homo sapiens
cgcaggttatgtcagcagct

SEQ ID NO: 254929 - DNA, 21 bp, Homo sapiens
cgcagtccccagcccttctgc

SEQ ID NO: 254930 - DNA, 16 bp, Homo sapiens
cgcagtcgcaggatcc

SEQ ID NO: 254931 - DNA, 17 bp, Homo sapiens
cgcagtgcccagtgatg

SEQ ID NO: 254932 - DNA, 15 bp, Homo sapiens
cgcagtgcctctggt

SEQ ID NO: 254933 - DNA, 12 bp, Homo sapiens
cgcatatgcatg

SEQ ID NO: 254934 - DNA, 17 bp, Homo sapiens
cgcatatgcatgccagg

SEQ ID NO: 254935 - DNA, 18 bp, Homo sapiens
cgcatatgcatgccaggc

SEQ ID NO: 254936 - DNA, 23 bp, Homo sapiens
cgcatatgtgagtgaaagtactt

SEQ ID NO: 254937 - DNA, 20 bp, Homo sapiens
cgcatccgcctctgagccag

SEQ ID NO: 254938 - DNA, 17 bp, Homo sapiens
cgcatcctccagggggc

SEQ ID NO: 254939 - DNA, 15 bp, Homo sapiens
cgcatgctgcctgcc

SEQ ID NO: 254940 - DNA, 18 bp, Homo sapiens
cgcatgctgcctgcctcc

SEQ ID NO: 254941 - DNA, 22 bp, Homo sapiens
cgcatggagtgtgtattgttcc

SEQ ID NO: 254942 - DNA, 17 bp, Homo sapiens
cgcatgtctgcatggca

SEQ ID NO: 254943 - DNA, 17 bp, Homo sapiens
cgcatgtgtctgtattc

SEQ ID NO: 254944 - DNA, 13 bp, Homo sapiens
cgcattaagaggt

SEQ ID NO: 254945 - DNA, 18 bp, Homo sapiens
cgccaaagaatgccttga

SEQ ID NO: 254946 - DNA, 16 bp, Homo sapiens
cgccaaagtgcagccc

SEQ ID NO: 254947 - DNA, 19 bp, Homo sapiens
cgccaaggaggtgggccac

SEQ ID NO: 254948 - DNA, 22 bp, Homo sapiens
cgccacccgcccgcccccgccc

SEQ ID NO: 254949 - DNA, 18 bp, Homo sapiens
cgccactaggtgtcccca

SEQ ID NO: 254950 - DNA, 22 bp, Homo sapiens
cgccactggctgtgcctccccc

SEQ ID NO: 254951 - DNA, 23 bp, Homo sapiens
cgccagaactgctttatcccacg

SEQ ID NO: 254952 - DNA, 15 bp, Homo sapiens
cgccagatggggcct

SEQ ID NO: 254953 - DNA, 18 bp, Homo sapiens
cgccagatggggcctctg

SEQ ID NO: 254954 - DNA, 22 bp, Homo sapiens
cgccagcacagaaacagaggag

SEQ ID NO: 254955 - DNA, 16 bp, Homo sapiens
cgccagcctcagtgcc

SEQ ID NO: 254956 - DNA, 20 bp, Homo sapiens
cgccagcctcagtgccactt

SEQ ID NO: 254957 - DNA, 20 bp, Homo sapiens
cgccattcactgattggaag

SEQ ID NO: 254958 - DNA, 15 bp, Homo sapiens
cgccattctcctgcc

SEQ ID NO: 254959 - DNA, 20 bp, Homo sapiens
cgccattctcctgcctcagc

SEQ ID NO: 254960 - DNA, 14 bp, Homo sapiens
cgccattgccacca

SEQ ID NO: 254961 - DNA, 16 bp, Homo sapiens
cgccattgccaccagg

SEQ ID NO: 254962 - DNA, 14 bp, Homo sapiens
cgcccacccacacc

SEQ ID NO: 254963 - DNA, 22 bp, Homo sapiens
cgcccacccacaccccgtctgc

SEQ ID NO: 254964 - DNA, 16 bp, Homo sapiens
cgcccaccccgctgcc

SEQ ID NO: 254965 - DNA, 20 bp, Homo sapiens
cgcccaccccgctgcctggc

SEQ ID NO: 254966 - DNA, 14 bp, Homo sapiens
gcctgtctctgttc

SEQ ID NO: 254967 - DNA, 19 bp, Homo sapiens
gcctgtgaccggggtcctg

SEQ ID NO: 254968 - DNA, 13 bp, Homo sapiens
gcctgtgcagcag

SEQ ID NO: 254969 - DNA, 21 bp, Homo sapiens
gcctgtgcagcagcccagctt

SEQ ID NO: 254970 - DNA, 13 bp, Homo sapiens
gcctgtgcccttg

SEQ ID NO: 254971 - DNA, 17 bp, Homo sapiens
gcctgtgcgttcccttc

SEQ ID NO: 254972 - DNA, 15 bp, Homo sapiens
gcctgtgctgcatgc

SEQ ID NO: 254973 - DNA, 23 bp, Homo sapiens
gcctgtgctgcatgcgacagcgt

SEQ ID NO: 254974 - DNA, 16 bp, Homo sapiens
gcctgtgctgggccag

SEQ ID NO: 254975 - DNA, 22 bp, Homo sapiens
gcctgtggcagaaaagaggaga

SEQ ID NO: 254976 - DNA, 12 bp, Homo sapiens
gcctgtggtgaa

SEQ ID NO: 254977 - DNA, 13 bp, Homo sapiens
gcctgtggtgaag

SEQ ID NO: 254978 - DNA, 19 bp, Homo sapiens
gcctgtggtgaagtgtggc

SEQ ID NO: 254979 - DNA, 19 bp, Homo sapiens
gcctgtggttacagtgcag

SEQ ID NO: 254980 - DNA, 15 bp, Homo sapiens
gcctgtgtccagcag

SEQ ID NO: 254981 - DNA, 21 bp, Homo sapiens
gcctgtgtccagcagctgcgg

SEQ ID NO: 254982 - DNA, 22 bp, Homo sapiens
gcctgtgtgacatcagtggcat

SEQ ID NO: 254983 - DNA, 14 bp, Homo sapiens
gcctgtgtgttctg

SEQ ID NO: 254984 - DNA, 21 bp, Homo sapiens
gcctgtgtgttgccaggcagg

SEQ ID NO: 254985 - DNA, 21 bp, Homo sapiens
gcctgtgttagtgtctgtcca

SEQ ID NO: 254986 - DNA, 24 bp, Homo sapiens
gcctgtgttagtgtctgtccatct

SEQ ID NO: 254987 - DNA, 19 bp, Homo sapiens
gcctgttataactctgcac

SEQ ID NO: 254988 - DNA, 23 bp, Homo sapiens
gcctgttcccattcttgcatggc

SEQ ID NO: 254989 - DNA, 17 bp, Homo sapiens
gcctgttcccctcactg

SEQ ID NO: 254990 - DNA, 17 bp, Homo sapiens
gcctgttctgtaggaga

SEQ ID NO: 254991 - DNA, 19 bp, Homo sapiens
gcctgttctgtaggagaga

SEQ ID NO: 254992 - DNA, 19 bp, Homo sapiens
gcctgtttctgcagccctt

SEQ ID NO: 254993 - DNA, 22 bp, Homo sapiens
gcctgtttctgcagcccttggg

SEQ ID NO: 254994 - DNA, 12 bp, Homo sapiens
gccttaaaactt

SEQ ID NO: 254995 - DNA, 14 bp, Homo sapiens
gccttaaaatgcat

SEQ ID NO: 254996 - DNA, 18 bp, Homo sapiens
gccttaagaaagctatat

SEQ ID NO: 254997 - DNA, 20 bp, Homo sapiens
gccttaatgacattcccctc

SEQ ID NO: 254998 - DNA, 15 bp, Homo sapiens
gccttacacaatggt

SEQ ID NO: 254999 - DNA, 16 bp, Homo sapiens
gccttacacaatggtt

SEQ ID NO: 255000 - DNA, 20 bp, Homo sapiens
gccttacacaatggttttct

SEQ ID NO: 255001 - DNA, 23 bp, Homo sapiens
gccttacggtcatgatgtctgca

SEQ ID NO: 255002 - DNA, 20 bp, Homo sapiens
gccttagctgccagtgctgg

SEQ ID NO: 255003 - DNA, 13 bp, Homo sapiens
gccttatcaagtg

SEQ ID NO: 255004 - DNA, 19 bp, Homo sapiens
ccggagctaacactggccc

SEQ ID NO: 255005 - DNA, 10 bp, Homo sapiens
ccggagctgg

SEQ ID NO: 255006 - DNA, 14 bp, Homo sapiens
ccggagctgggaag

SEQ ID NO: 255007 - DNA, 15 bp, Homo sapiens
ccggagctgggaagg

SEQ ID NO: 255008 - DNA, 16 bp, Homo sapiens
ccggaggcgcccacct

SEQ ID NO: 255009 - DNA, 22 bp, Homo sapiens
ccggagggaaccctgactacag

SEQ ID NO: 255010 - DNA, 20 bp, Homo sapiens
ccggatgcccacccctgctg

SEQ ID NO: 255011 - DNA, 14 bp, Homo sapiens
ccggcaacctgtaa

SEQ ID NO: 255012 - DNA, 17 bp, Homo sapiens
ccggcaacctgtaactg

SEQ ID NO: 255013 - DNA, 18 bp, Homo sapiens
ccggcaagcgagcacagt

SEQ ID NO: 255014 - DNA, 19 bp, Homo sapiens
ccggcaagcgagcacagta

SEQ ID NO: 255015 - DNA, 13 bp, Homo sapiens
ccggcaggccctg

SEQ ID NO: 255016 - DNA, 20 bp, Homo sapiens
ccggcaggccctgcagtgtt

SEQ ID NO: 255017 - DNA, 14 bp, Homo sapiens
ccggcatgggaaag

SEQ ID NO: 255018 - DNA, 16 bp, Homo sapiens
ccggccaaggacactg

SEQ ID NO: 255019 - DNA, 18 bp, Homo sapiens
ccggccaaggacactgat

SEQ ID NO: 255020 - DNA, 13 bp, Homo sapiens
ccggccacagctg

SEQ ID NO: 255021 - DNA, 14 bp, Homo sapiens
ccggccacagctgc

SEQ ID NO: 255022 - DNA, 15 bp, Homo sapiens
ccggccacagctgct

SEQ ID NO: 255023 - DNA, 16 bp, Homo sapiens
ccggccacgctccctc

SEQ ID NO: 255024 - DNA, 12 bp, Homo sapiens
ccggccactccc

SEQ ID NO: 255025 - DNA, 16 bp, Homo sapiens
ccggccagctccccct

SEQ ID NO: 255026 - DNA, 22 bp, Homo sapiens
ccggcccaccagggactgcagc

SEQ ID NO: 255027 - DNA, 14 bp, Homo sapiens
ccggcccacgcaga

SEQ ID NO: 255028 - DNA, 16 bp, Homo sapiens
ccggcccacgcagagc

SEQ ID NO: 255029 - DNA, 22 bp, Homo sapiens
ccggcccacgcagagccccgga

SEQ ID NO: 255030 - DNA, 17 bp, Homo sapiens
ccggccccgcgcgtgcc

SEQ ID NO: 255031 - DNA, 20 bp, Homo sapiens
ccggccccgcgcgtgccccc

SEQ ID NO: 255032 - DNA, 19 bp, Homo sapiens
ccggcccctaccagccacg

SEQ ID NO: 255033 - DNA, 12 bp, Homo sapiens
ccggccctggct

SEQ ID NO: 255034 - DNA, 17 bp, Homo sapiens
ccggccctggctgggga

SEQ ID NO: 255035 - DNA, 20 bp, Homo sapiens
ccggccgccccgccccagag

SEQ ID NO: 255036 - DNA, 13 bp, Homo sapiens
ccggcctccaggc

SEQ ID NO: 255037 - DNA, 17 bp, Homo sapiens
ccggcctccaggctggg

SEQ ID NO: 255038 - DNA, 19 bp, Homo sapiens
ccggcctccaggctggggc

SEQ ID NO: 255039 - DNA, 13 bp, Homo sapiens
ccggcctcttcca

SEQ ID NO: 255040 - DNA, 14 bp, Homo sapiens
ccggcgctgcaggt

SEQ ID NO: 255041 - DNA, 19 bp, Homo sapiens
ccggctaatttttttgtat

SEQ ID NO: 255042 - DNA, 21 bp, Homo sapiens
ccggctaatttttttgtattt

SEQ ID NO: 255043 - DNA, 16 bp, Homo sapiens
ccggctccccctgcca

SEQ ID NO: 255044 - DNA, 15 bp, Homo sapiens
ccggctgacacctcc

SEQ ID NO: 255045 - DNA, 16 bp, Homo sapiens
ccggctgacacctccc

SEQ ID NO: 255046 - DNA, 14 bp, Homo sapiens
ccggctgcctgccg

SEQ ID NO: 255047 - DNA, 16 bp, Homo sapiens
ccggctggccggtcca

SEQ ID NO: 255048 - DNA, 18 bp, Homo sapiens
ccggctggccggtccacc

SEQ ID NO: 255049 - DNA, 23 bp, Homo sapiens
cccagccatgggccctctgagca

SEQ ID NO: 255050 - DNA, 14 bp, Homo sapiens
cccagcccaataaa

SEQ ID NO: 255051 - DNA, 15 bp, Homo sapiens
cccagcccagctgct

SEQ ID NO: 255052 - DNA, 16 bp, Homo sapiens
cccagcccagctgctc

SEQ ID NO: 255053 - DNA, 11 bp, Homo sapiens
cccagccccag

SEQ ID NO: 255054 - DNA, 14 bp, Homo sapiens
cccagccccatccc

SEQ ID NO: 255055 - DNA, 13 bp, Homo sapiens
cccagccccctgg

SEQ ID NO: 255056 - DNA, 18 bp, Homo sapiens
cccagccccctggcccct

SEQ ID NO: 255057 - DNA, 15 bp, Homo sapiens
cccagccccttctcc

SEQ ID NO: 255058 - DNA, 17 bp, Homo sapiens
cccagccccttctccca

SEQ ID NO: 255059 - DNA, 18 bp, Homo sapiens
cccagccccttctcccag

SEQ ID NO: 255060 - DNA, 22 bp, Homo sapiens
cccagccccttctcccagcaca

SEQ ID NO: 255061 - DNA, 15 bp, Homo sapiens
cccagccctcccagc

SEQ ID NO: 255062 - DNA, 20 bp, Homo sapiens
cccagccctccccgcagtgg

SEQ ID NO: 255063 - DNA, 14 bp, Homo sapiens
cccagcccttctgc

SEQ ID NO: 255064 - DNA, 15 bp, Homo sapiens
cccagccctttccag

SEQ ID NO: 255065 - DNA, 14 bp, Homo sapiens
cccagccggggtgg

SEQ ID NO: 255066 - DNA, 15 bp, Homo sapiens
cccagccggggtggg

SEQ ID NO: 255067 - DNA, 20 bp, Homo sapiens
cccagcctccaagctccatc

SEQ ID NO: 255068 - DNA, 11 bp, Homo sapiens
cccagcctccc

SEQ ID NO: 255069 - DNA, 15 bp, Homo sapiens
cccagcctcccccag

SEQ ID NO: 255070 - DNA, 22 bp, Homo sapiens
cccagcctctccccgctctgga

SEQ ID NO: 255071 - DNA, 21 bp, Homo sapiens
cccagcctcttgctcagagct

SEQ ID NO: 255072 - DNA, 18 bp, Homo sapiens
cccagcctgacctgagac

SEQ ID NO: 255073 - DNA, 20 bp, Homo sapiens
cccagcctgacctgagactg

SEQ ID NO: 255074 - DNA, 14 bp, Homo sapiens
cccagcctgctgag

SEQ ID NO: 255075 - DNA, 11 bp, Homo sapiens
cccagcctgga

SEQ ID NO: 255076 - DNA, 22 bp, Homo sapiens
cccagcctggccacgcagccag

SEQ ID NO: 255077 - DNA, 14 bp, Homo sapiens
cccagcctggcccc

SEQ ID NO: 255078 - DNA, 20 bp, Homo sapiens
cccagcctggccccaaatgt

SEQ ID NO: 255079 - DNA, 21 bp, Homo sapiens
cccagcctggccccaaatgtt

SEQ ID NO: 255080 - DNA, 13 bp, Homo sapiens
cccagcctgtcct

SEQ ID NO: 255081 - DNA, 15 bp, Homo sapiens
cccagcctgtcctgg

SEQ ID NO: 255082 - DNA, 22 bp, Homo sapiens
cccagcctgtcctggtacagca

SEQ ID NO: 255083 - DNA, 19 bp, Homo sapiens
cccagcctgtggttacagt

SEQ ID NO: 255084 - DNA, 21 bp, Homo sapiens
cccagcgagtctggagaccag

SEQ ID NO: 255085 - DNA, 21 bp, Homo sapiens
cccagcgcctgtgctgaggac

SEQ ID NO: 255086 - DNA, 14 bp, Homo sapiens
cccagcggcccctc

SEQ ID NO: 255087 - DNA, 15 bp, Homo sapiens
cccagcggcccctcc

SEQ ID NO: 255088 - DNA, 18 bp, Homo sapiens
cccagcggcccctcccac

SEQ ID NO: 255089 - DNA, 16 bp, Homo sapiens
cccagcgttcttcagg

SEQ ID NO: 255090 - DNA, 17 bp, Homo sapiens
cccagcgttcttcagga

SEQ ID NO: 255091 - DNA, 15 bp, Homo sapiens
cccagctacattcct

SEQ ID NO: 255092 - DNA, 21 bp, Homo sapiens
cccagctacattcctcagctg

SEQ ID NO: 255093 - DNA, 21 bp, Homo sapiens
cccagctactctgtccaggcc

SEQ ID NO: 255094 - DNA, 22 bp, Homo sapiens
cccagctactctgtccaggcca

SEQ ID NO: 255095 - DNA, 23 bp, Homo sapiens
cccagctactctgtccaggccac

SEQ ID NO: 255096 - DNA, 15 bp, Homo sapiens
cccagctacttggga

SEQ ID NO: 255097 - DNA, 17 bp, Homo sapiens
cccagctacttgggagc

SEQ ID NO: 255098 - DNA, 19 bp, Homo sapiens
cccagctacttgggagcct

SEQ ID NO: 255099 - DNA, 14 bp, Homo sapiens
cccagctcagaggg

SEQ ID NO: 255100 - DNA, 15 bp, Homo sapiens
cccagctcagagggt

SEQ ID NO: 255101 - DNA, 15 bp, Homo sapiens
cccagctccactcag

SEQ ID NO: 255102 - DNA, 19 bp, Homo sapiens
cccagctccactcagggct

SEQ ID NO: 255103 - DNA, 21 bp, Homo sapiens
cccagctccactcagggctgg

SEQ ID NO: 255104 - DNA, 16 bp, Homo sapiens
cccagctccaggggcc

SEQ ID NO: 255105 - DNA, 15 bp, Homo sapiens
cccagctccccaaga

SEQ ID NO: 255106 - DNA, 17 bp, Homo sapiens
cccagctgacatggaaa

SEQ ID NO: 255107 - DNA, 14 bp, Homo sapiens
cccagctgactgtg

SEQ ID NO: 255108 - DNA, 21 bp, Homo sapiens
cccagctgctcccctccctcc

SEQ ID NO: 255109 - DNA, 12 bp, Homo sapiens
cccagctgctct

SEQ ID NO: 255110 - DNA, 19 bp, Homo sapiens
cccagctggctgggtcgcc

SEQ ID NO: 255111 - DNA, 14 bp, Homo sapiens
cccagctgggctct

SEQ ID NO: 255112 - DNA, 19 bp, Homo sapiens
cccagctgggctctgccac

SEQ ID NO: 255113 - DNA, 20 bp, Homo sapiens
cccagctgggctctgccacc

SEQ ID NO: 255114 - DNA, 22 bp, Homo sapiens
cccagctgggctctgccaccct

SEQ ID NO: 255115 - DNA, 13 bp, Homo sapiens
cccagctgggctg

SEQ ID NO: 255116 - DNA, 23 bp, Homo sapiens
cccagctgggctgttggctgggg

SEQ ID NO: 255117 - DNA, 12 bp, Homo sapiens
cccagctggggc

SEQ ID NO: 255118 - DNA, 16 bp, Homo sapiens
cccagctggtgtcact

SEQ ID NO: 255119 - DNA, 21 bp, Homo sapiens
cccagctggtgtcactctgcc

SEQ ID NO: 255120 - DNA, 13 bp, Homo sapiens
cccagctgtagcc

SEQ ID NO: 255121 - DNA, 15 bp, Homo sapiens
cccagctgtagccat

SEQ ID NO: 255122 - DNA, 20 bp, Homo sapiens
cccagctgtagccatggctc

SEQ ID NO: 255123 - DNA, 15 bp, Homo sapiens
cccagctgtgactga

SEQ ID NO: 255124 - DNA, 17 bp, Homo sapiens
cccagctgtgactgagg

SEQ ID NO: 255125 - DNA, 19 bp, Homo sapiens
cccaggaaaaacctgtggg

SEQ ID NO: 255126 - DNA, 15 bp, Homo sapiens
cccaggaagcaggga

SEQ ID NO: 255127 - DNA, 14 bp, Homo sapiens
cccaggaagtccag

SEQ ID NO: 255128 - DNA, 12 bp, Homo sapiens
cccaggaccaag

SEQ ID NO: 255129 - DNA, 23 bp, Homo sapiens
cccaggaccaagcttaaggagag

SEQ ID NO: 255130 - DNA, 15 bp, Homo sapiens
cccaggaccctgagg

SEQ ID NO: 255131 - DNA, 17 bp, Homo sapiens
cccaggaccctgggtca

SEQ ID NO: 255132 - DNA, 18 bp, Homo sapiens
cccaggacctggagacag

SEQ ID NO: 255133 - DNA, 14 bp, Homo sapiens
gaggagcaccccca

SEQ ID NO: 255134 - DNA, 22 bp, Homo sapiens
gaggagcacccccagcctcccc

SEQ ID NO: 255135 - DNA, 23 bp, Homo sapiens
gaggagcacccccagcctccccc

SEQ ID NO: 255136 - DNA, 18 bp, Homo sapiens
gaggagccacctgggctg

SEQ ID NO: 255137 - DNA, 14 bp, Homo sapiens
gaggagcctggagt

SEQ ID NO: 255138 - DNA, 19 bp, Homo sapiens
gaggaggaaggagagaagg

SEQ ID NO: 255139 - DNA, 13 bp, Homo sapiens
gaggaggagatgg

SEQ ID NO: 255140 - DNA, 15 bp, Homo sapiens
gaggaggcagaacca

SEQ ID NO: 255141 - DNA, 21 bp, Homo sapiens
gaggagggcgcatgtgtgtat

SEQ ID NO: 255142 - DNA, 19 bp, Homo sapiens
gaggaggggtaaatatatg

SEQ ID NO: 255143 - DNA, 16 bp, Homo sapiens
gaggaggtgtggagtg

SEQ ID NO: 255144 - DNA, 12 bp, Homo sapiens
gaggagtccaaa

SEQ ID NO: 255145 - DNA, 14 bp, Homo sapiens
gaggagtctgggaa

SEQ ID NO: 255146 - DNA, 17 bp, Homo sapiens
gaggagtggtttttctt

SEQ ID NO: 255147 - DNA, 11 bp, Homo sapiens
gaggagttcaa

SEQ ID NO: 255148 - DNA, 18 bp, Homo sapiens
gaggagttcaatgatcta

SEQ ID NO: 255149 - DNA, 19 bp, Homo sapiens
gaggagttcaatgatctag

SEQ ID NO: 255150 - DNA, 14 bp, Homo sapiens
gaggatcacttgag

SEQ ID NO: 255151 - DNA, 14 bp, Homo sapiens
gaggatccgggctt

SEQ ID NO: 255152 - DNA, 17 bp, Homo sapiens
gaggatgaacatctttt

SEQ ID NO: 255153 - DNA, 18 bp, Homo sapiens
gaggatgaatagatgtga

SEQ ID NO: 255154 - DNA, 22 bp, Homo sapiens
gaggatgaatagatgtgatcac

SEQ ID NO: 255155 - DNA, 21 bp, Homo sapiens
gaggatgaatgtatgtgcact

SEQ ID NO: 255156 - DNA, 13 bp, Homo sapiens
gaggatgagctgg

SEQ ID NO: 255157 - DNA, 12 bp, Homo sapiens
gaggatgcactg

SEQ ID NO: 255158 - DNA, 16 bp, Homo sapiens
gaggatgcactggcct

SEQ ID NO: 255159 - DNA, 14 bp, Homo sapiens
gaggatgctgaagt

SEQ ID NO: 255160 - DNA, 14 bp, Homo sapiens
gaggatgctgtgcc

SEQ ID NO: 255161 - DNA, 17 bp, Homo sapiens
gaggatgctgtgcctcc

SEQ ID NO: 255162 - DNA, 22 bp, Homo sapiens
gaggatgttctggacctccccc

SEQ ID NO: 255163 - DNA, 12 bp, Homo sapiens
gaggattctgtc

SEQ ID NO: 255164 - DNA, 19 bp, Homo sapiens
gaggattctgtcttccagg

SEQ ID NO: 255165 - DNA, 20 bp, Homo sapiens
gaggattctgtcttccaggc

SEQ ID NO: 255166 - DNA, 20 bp, Homo sapiens
gaggattttgggtggccaaa

SEQ ID NO: 255167 - DNA, 17 bp, Homo sapiens
gaggcaaaggccagcag

SEQ ID NO: 255168 - DNA, 15 bp, Homo sapiens
gaggcaagcaagctc

SEQ ID NO: 255169 - DNA, 18 bp, Homo sapiens
gaggcaatgactgtgagc

SEQ ID NO: 255170 - DNA, 16 bp, Homo sapiens
gaggcacagagccaaa

SEQ ID NO: 255171 - DNA, 16 bp, Homo sapiens
gaggcaccagctctgt

SEQ ID NO: 255172 - DNA, 21 bp, Homo sapiens
gaggcaccagctctgtggcct

SEQ ID NO: 255173 - DNA, 18 bp, Homo sapiens
gaggcaccattcaggaac

SEQ ID NO: 255174 - DNA, 21 bp, Homo sapiens
gaggcaccattcaggaacctg

SEQ ID NO: 255175 - DNA, 15 bp, Homo sapiens
gaggcaccggcgctg

SEQ ID NO: 255176 - DNA, 18 bp, Homo sapiens
gaggcaccggcgctgcag

SEQ ID NO: 255177 - DNA, 15 bp, Homo sapiens
gaggcacctgctgga

SEQ ID NO: 255178 - DNA, 17 bp, Homo sapiens
gaggcagaacctggtgg

SEQ ID NO: 255179 - DNA, 17 bp, Homo sapiens
gaggcagactcgagggc

SEQ ID NO: 255180 - DNA, 14 bp, Homo sapiens
gaggcagagtgccc

SEQ ID NO: 255181 - DNA, 21 bp, Homo sapiens
gaggcagcaacaggaccagga

SEQ ID NO: 255182 - DNA, 13 bp, Homo sapiens
gaggcagcaggag

SEQ ID NO: 255183 - DNA, 14 bp, Homo sapiens
gaggcagcaggagc

SEQ ID NO: 255184 - DNA, 16 bp, Homo sapiens
gaggcagcaggagcca

SEQ ID NO: 255185 - DNA, 16 bp, Homo sapiens
gaggcagggccctggg

SEQ ID NO: 255186 - DNA, 17 bp, Homo sapiens
gaggcagggccctgggg

SEQ ID NO: 255187 - DNA, 15 bp, Homo sapiens
gaggcaggggctggg

SEQ ID NO: 255188 - DNA, 19 bp, Homo sapiens
gaggcaggggctgggcaga

SEQ ID NO: 255189 - DNA, 16 bp, Homo sapiens
gaggcagtggcttgga

SEQ ID NO: 255190 - DNA, 21 bp, Homo sapiens
gaggcagtggcttggagcaga

SEQ ID NO: 255191 - DNA, 14 bp, Homo sapiens
gaggcatttgtctt

SEQ ID NO: 255192 - DNA, 22 bp, Homo sapiens
gaggcatttgtcttagagagag

SEQ ID NO: 255193 - DNA, 14 bp, Homo sapiens
gaggccaaggcagg

SEQ ID NO: 255194 - DNA, 16 bp, Homo sapiens
gaggccaaggcaggta

SEQ ID NO: 255195 - DNA, 13 bp, Homo sapiens
gaggccaaggtgg

SEQ ID NO: 255196 - DNA, 18 bp, Homo sapiens
gaggccaaggtgggcgga

SEQ ID NO: 255197 - DNA, 15 bp, Homo sapiens
gaggccaagtgcagg

SEQ ID NO: 255198 - DNA, 16 bp, Homo sapiens
gaggccacatgagtcc

SEQ ID NO: 255199 - DNA, 12 bp, Homo sapiens
gaggccacccca

SEQ ID NO: 255200 - DNA, 23 bp, Homo sapiens
gaggccaccccaaaccccagccc

SEQ ID NO: 255201 - DNA, 16 bp, Homo sapiens
gaggccacgggggagg

SEQ ID NO: 255202 - DNA, 13 bp, Homo sapiens
gaggccagcccca

SEQ ID NO: 255203 - DNA, 18 bp, Homo sapiens
gaggccagccccacccag

SEQ ID NO: 255204 - DNA, 11 bp, Homo sapiens
gaggccaggcc

SEQ ID NO: 255205 - DNA, 19 bp, Homo sapiens
gaggccaggctagaatgga

SEQ ID NO: 255206 - DNA, 16 bp, Homo sapiens
gaggcccagagagctg

SEQ ID NO: 255207 - DNA, 17 bp, Homo sapiens
gaggcccagagagctga

SEQ ID NO: 255208 - DNA, 11 bp, Homo sapiens
gaggcccagca

SEQ ID NO: 255209 - DNA, 14 bp, Homo sapiens
gaggcccagcctgt

SEQ ID NO: 255210 - DNA, 15 bp, Homo sapiens
gaggcccagcctgtc

SEQ ID NO: 255211 - DNA, 13 bp, Homo sapiens
gaggcccagggag

SEQ ID NO: 255212 - DNA, 15 bp, Homo sapiens
gaggcccctggccca

SEQ ID NO: 255213 - DNA, 23 bp, Homo sapiens
gaggcccttaagggaagctactg

SEQ ID NO: 255214 - DNA, 15 bp, Homo sapiens
gaggccgaggcacga

SEQ ID NO: 255215 - DNA, 13 bp, Homo sapiens
gaggccgaggcag

SEQ ID NO: 255216 - DNA, 14 bp, Homo sapiens
gaggccgaggcagg

SEQ ID NO: 255217 - DNA, 18 bp, Homo sapiens
gaggccgaggcaggggct

SEQ ID NO: 255218 - DNA, 18 bp, Homo sapiens
gaggcctcaccctgcttg

SEQ ID NO: 255219 - DNA, 13 bp, Homo sapiens
gaggcctcatccc

SEQ ID NO: 255220 - DNA, 20 bp, Homo sapiens
gaggcctcccccagccagga

SEQ ID NO: 255221 - DNA, 13 bp, Homo sapiens
gaggcctgaggat

SEQ ID NO: 255222 - DNA, 20 bp, Homo sapiens
gaggcctgaggatgagctgg

SEQ ID NO: 255223 - DNA, 21 bp, Homo sapiens
gaggcctgaggatgagctgga

SEQ ID NO: 255224 - DNA, 17 bp, Homo sapiens
gaggcctgatgctgccc

SEQ ID NO: 255225 - DNA, 18 bp, Homo sapiens
gaggcctgatgctgcccc

SEQ ID NO: 255226 - DNA, 12 bp, Homo sapiens
gaggcctgggag

SEQ ID NO: 255227 - DNA, 13 bp, Homo sapiens
gaggcctggtctg

SEQ ID NO: 255228 - DNA, 15 bp, Homo sapiens
gaggcctggtctgga

SEQ ID NO: 255229 - DNA, 20 bp, Homo sapiens
gaggccttcagaaaagacac

SEQ ID NO: 255230 - DNA, 17 bp, Homo sapiens
gaggccttgggggtctg

SEQ ID NO: 255231 - DNA, 18 bp, Homo sapiens
gaggcgaagctgagcggg

SEQ ID NO: 255232 - DNA, 15 bp, Homo sapiens
gaggcgagccaggca

SEQ ID NO: 255233 - DNA, 17 bp, Homo sapiens
gaggcgaggctgcctct

SEQ ID NO: 255234 - DNA, 15 bp, Homo sapiens
gaggcgggagaatca

SEQ ID NO: 255235 - DNA, 15 bp, Homo sapiens
gaggcgggggagcct

SEQ ID NO: 255236 - DNA, 16 bp, Homo sapiens
gaggcgggggagcctg

SEQ ID NO: 255237 - DNA, 18 bp, Homo sapiens
gaggcgggggagcctgga

SEQ ID NO: 255238 - DNA, 17 bp, Homo sapiens
gaggcgggggatcctgg

SEQ ID NO: 255239 - DNA, 18 bp, Homo sapiens
gaggcgggggatcctgga

SEQ ID NO: 255240 - DNA, 22 bp, Homo sapiens
gaggcgggggatcctggagccc

SEQ ID NO: 255241 - DNA, 19 bp, Homo sapiens
gaggcgggtggatcacttg

SEQ ID NO: 255242 - DNA, 15 bp, Homo sapiens
gaggcgtcctggtga

SEQ ID NO: 255243 - DNA, 16 bp, Homo sapiens
gaggcgtcctggtgag

SEQ ID NO: 255244 - DNA, 14 bp, Homo sapiens
gaggcgtcttgtat

SEQ ID NO: 255245 - DNA, 16 bp, Homo sapiens
gaggcgtgcccccctc

SEQ ID NO: 255246 - DNA, 22 bp, Homo sapiens
gaggcgtgcccccctcctccag

SEQ ID NO: 255247 - DNA, 18 bp, Homo sapiens
gaggcgttctcctgcttg

SEQ ID NO: 255248 - DNA, 19 bp, Homo sapiens
gaggctaaaacaaatctca

SEQ ID NO: 255249 - DNA, 19 bp, Homo sapiens
gaggctaagatgagatttg

SEQ ID NO: 255250 - DNA, 13 bp, Homo sapiens
gaggctagcccca

SEQ ID NO: 255251 - DNA, 14 bp, Homo sapiens
gaggctagccccag

SEQ ID NO: 255252 - DNA, 16 bp, Homo sapiens
gaggctcccagaccca

SEQ ID NO: 255253 - DNA, 13 bp, Homo sapiens
gaggctccccgcc

SEQ ID NO: 255254 - DNA, 14 bp, Homo sapiens
gaggctccccgcct

SEQ ID NO: 255255 - DNA, 13 bp, Homo sapiens
gaggctcctggag

SEQ ID NO: 255256 - DNA, 14 bp, Homo sapiens
gaggctctgaagag

SEQ ID NO: 255257 - DNA, 20 bp, Homo sapiens
gaggctgaaagaggccaatg

SEQ ID NO: 255258 - DNA, 20 bp, Homo sapiens
gaggctgagactgcagagga

SEQ ID NO: 255259 - DNA, 21 bp, Homo sapiens
gaggctgagactgcagaggag

SEQ ID NO: 255260 - DNA, 16 bp, Homo sapiens
gaggctgaggcctgga

SEQ ID NO: 255261 - DNA, 18 bp, Homo sapiens
gaggctgaggcctggact

SEQ ID NO: 255262 - DNA, 18 bp, Homo sapiens
gaggctgaggtgggagga

SEQ ID NO: 255263 - DNA, 13 bp, Homo sapiens
gaggctgcctctg

SEQ ID NO: 255264 - DNA, 14 bp, Homo sapiens
gaggctgcctctgg

SEQ ID NO: 255265 - DNA, 13 bp, Homo sapiens
gaggctgctgacg

SEQ ID NO: 255266 - DNA, 23 bp, Homo sapiens
gaggctgctgacgtttgacacca

SEQ ID NO: 255267 - DNA, 15 bp, Homo sapiens
gaggctggagctggc

SEQ ID NO: 255268 - DNA, 16 bp, Homo sapiens
gaggctggcagtacag

SEQ ID NO: 255269 - DNA, 10 bp, Homo sapiens
cctcccttcc

SEQ ID NO: 255270 - DNA, 15 bp, Homo sapiens
cctcccttcccagtg

SEQ ID NO: 255271 - DNA, 17 bp, Homo sapiens
cctcccttcccagtggg

SEQ ID NO: 255272 - DNA, 17 bp, Homo sapiens
cctcccttccccactct

SEQ ID NO: 255273 - DNA, 13 bp, Homo sapiens
cctcccttcctcc

SEQ ID NO: 255274 - DNA, 16 bp, Homo sapiens
cctcccttcgtgtgtg

SEQ ID NO: 255275 - DNA, 12 bp, Homo sapiens
cctcccttgctc

SEQ ID NO: 255276 - DNA, 14 bp, Homo sapiens
cctccgactccaga

SEQ ID NO: 255277 - DNA, 14 bp, Homo sapiens
cctccgaggctccc

SEQ ID NO: 255278 - DNA, 18 bp, Homo sapiens
cctccgaggctccccgcc

SEQ ID NO: 255279 - DNA, 19 bp, Homo sapiens
cctccgaggctccccgcct

SEQ ID NO: 255280 - DNA, 20 bp, Homo sapiens
cctccgaggctccccgcctc

SEQ ID NO: 255281 - DNA, 14 bp, Homo sapiens
cctccggccctgcc

SEQ ID NO: 255282 - DNA, 21 bp, Homo sapiens
cctccgggcaggggagccagg

SEQ ID NO: 255283 - DNA, 22 bp, Homo sapiens
cctccgggcaggggagccaggg

SEQ ID NO: 255284 - DNA, 13 bp, Homo sapiens
cctccgtccccag

SEQ ID NO: 255285 - DNA, 23 bp, Homo sapiens
cctccgtcctggcagggcaggca

SEQ ID NO: 255286 - DNA, 16 bp, Homo sapiens
cctccgtgatccatcc

SEQ ID NO: 255287 - DNA, 17 bp, Homo sapiens
cctccgtgatccatcca

SEQ ID NO: 255288 - DNA, 15 bp, Homo sapiens
cctccgtgtggagca

SEQ ID NO: 255289 - DNA, 18 bp, Homo sapiens
cctccgttcccacctctg

SEQ ID NO: 255290 - DNA, 20 bp, Homo sapiens
cctccgttcccacctctgag

SEQ ID NO: 255291 - DNA, 17 bp, Homo sapiens
cctccgtttatgggcct

SEQ ID NO: 255292 - DNA, 19 bp, Homo sapiens
cctccgtttatgggccttg

SEQ ID NO: 255293 - DNA, 22 bp, Homo sapiens
cctccgtttatgggccttgctt

SEQ ID NO: 255294 - DNA, 13 bp, Homo sapiens
cctcctaccctcc

SEQ ID NO: 255295 - DNA, 15 bp, Homo sapiens
cctcctaccctccca

SEQ ID NO: 255296 - DNA, 18 bp, Homo sapiens
cctcctagaggtgggcag

SEQ ID NO: 255297 - DNA, 19 bp, Homo sapiens
cctcctatcagaagtttct

SEQ ID NO: 255298 - DNA, 16 bp, Homo sapiens
cctcctatccttggag

SEQ ID NO: 255299 - DNA, 20 bp, Homo sapiens
cctcctattttaattggaat

SEQ ID NO: 255300 - DNA, 15 bp, Homo sapiens
cctcctcacctctgg

SEQ ID NO: 255301 - DNA, 21 bp, Homo sapiens
cctcctcacctctggactggc

SEQ ID NO: 255302 - DNA, 19 bp, Homo sapiens
cctcctccaagaagccctc

SEQ ID NO: 255303 - DNA, 20 bp, Homo sapiens
cctcctccaagaagccctcc

SEQ ID NO: 255304 - DNA, 18 bp, Homo sapiens
cctcctccagcccaccca

SEQ ID NO: 255305 - DNA, 21 bp, Homo sapiens
cctcctccagttctgatgagg

SEQ ID NO: 255306 - DNA, 15 bp, Homo sapiens
cctcctcccatccag

SEQ ID NO: 255307 - DNA, 21 bp, Homo sapiens
cctcctcccatccagcgtctg

SEQ ID NO: 255308 - DNA, 15 bp, Homo sapiens
cctcctcctgttcct

SEQ ID NO: 255309 - DNA, 15 bp, Homo sapiens
cctcctcgctgtgcc

SEQ ID NO: 255310 - DNA, 15 bp, Homo sapiens
cctcctcgggcgcct

SEQ ID NO: 255311 - DNA, 17 bp, Homo sapiens
cctcctcgggcgcctgc

SEQ ID NO: 255312 - DNA, 23 bp, Homo sapiens
cctcctcgggcgcctgcgctcct

SEQ ID NO: 255313 - DNA, 23 bp, Homo sapiens
cctcctctcctcgtccggcctgc

SEQ ID NO: 255314 - DNA, 15 bp, Homo sapiens
cctcctctctccctg

SEQ ID NO: 255315 - DNA, 19 bp, Homo sapiens
cctcctctctccctgcctc

SEQ ID NO: 255316 - DNA, 22 bp, Homo sapiens
cctcctctctccctgcctcaca

SEQ ID NO: 255317 - DNA, 17 bp, Homo sapiens
cctcctctgccccctcc

SEQ ID NO: 255318 - DNA, 20 bp, Homo sapiens
cctcctctgccccctccccc

SEQ ID NO: 255319 - DNA, 14 bp, Homo sapiens
cctcctctgtccct

SEQ ID NO: 255320 - DNA, 11 bp, Homo sapiens
cctcctctgtg

SEQ ID NO: 255321 - DNA, 19 bp, Homo sapiens
cctcctctgtgctccctcg

SEQ ID NO: 255322 - DNA, 21 bp, Homo sapiens
cctcctctgtgctccctcggt

SEQ ID NO: 255323 - DNA, 21 bp, Homo sapiens
cctcctcttcccttagcctct

SEQ ID NO: 255324 - DNA, 15 bp, Homo sapiens
cctcctcttcctgta

SEQ ID NO: 255325 - DNA, 17 bp, Homo sapiens
cctcctgaagcctctgc

SEQ ID NO: 255326 - DNA, 19 bp, Homo sapiens
cctcctgaagcctctgccc

SEQ ID NO: 255327 - DNA, 20 bp, Homo sapiens
cctcctgaccctgtgatgcc

SEQ ID NO: 255328 - DNA, 16 bp, Homo sapiens
cctcctgatggccaag

SEQ ID NO: 255329 - DNA, 17 bp, Homo sapiens
cctcctgatgtttttcc

SEQ ID NO: 255330 - DNA, 16 bp, Homo sapiens
cctcctgcaggctggc

SEQ ID NO: 255331 - DNA, 22 bp, Homo sapiens
cctcctgcaggctggctgttgg

SEQ ID NO: 255332 - DNA, 16 bp, Homo sapiens
cctcctgccctgtccc

SEQ ID NO: 255333 - DNA, 20 bp, Homo sapiens
cctcctgccctgtccctgtc

SEQ ID NO: 255334 - DNA, 21 bp, Homo sapiens
cctcctggagcagcagctgag

SEQ ID NO: 255335 - DNA, 20 bp, Homo sapiens
cctcctggagcatcccaggc

SEQ ID NO: 255336 - DNA, 12 bp, Homo sapiens
cctcctggctca

SEQ ID NO: 255337 - DNA, 16 bp, Homo sapiens
cctcctggctcacagc

SEQ ID NO: 255338 - DNA, 17 bp, Homo sapiens
cctcctggctcacagcc

SEQ ID NO: 255339 - DNA, 14 bp, Homo sapiens
cctcctgggcccag

SEQ ID NO: 255340 - DNA, 16 bp, Homo sapiens
cctcctgggcccaggc

SEQ ID NO: 255341 - DNA, 17 bp, Homo sapiens
cctcctgggcccaggca

SEQ ID NO: 255342 - DNA, 13 bp, Homo sapiens
cctcctgtacata

SEQ ID NO: 255343 - DNA, 10 bp, Homo sapiens
cctcctgtct

SEQ ID NO: 255344 - DNA, 17 bp, Homo sapiens
cctcctgtgtagctggg

SEQ ID NO: 255345 - DNA, 19 bp, Homo sapiens
cctcctgttcctgccttct

SEQ ID NO: 255346 - DNA, 21 bp, Homo sapiens
cctcctgttcctgccttctct

SEQ ID NO: 255347 - DNA, 18 bp, Homo sapiens
cctcctgttgccacactt

SEQ ID NO: 255348 - DNA, 15 bp, Homo sapiens
cctccttagaaaaga

SEQ ID NO: 255349 - DNA, 21 bp, Homo sapiens
cctccttcactccctgtcata

SEQ ID NO: 255350 - DNA, 18 bp, Homo sapiens
cctccttccacctccctc

SEQ ID NO: 255351 - DNA, 16 bp, Homo sapiens
cctccttcccgccgcc

SEQ ID NO: 255352 - DNA, 13 bp, Homo sapiens
cctccttctcccc

SEQ ID NO: 255353 - DNA, 14 bp, Homo sapiens
cctccttctcccct

SEQ ID NO: 255354 - DNA, 17 bp, Homo sapiens
cctccttctcccttttt

SEQ ID NO: 255355 - DNA, 17 bp, Homo sapiens
cctccttcttgccctga

SEQ ID NO: 255356 - DNA, 17 bp, Homo sapiens
cctccttgcccagacta

SEQ ID NO: 255357 - DNA, 14 bp, Homo sapiens
cctccttgccgctg

SEQ ID NO: 255358 - DNA, 19 bp, Homo sapiens
cctccttgccgctgggaga

SEQ ID NO: 255359 - DNA, 21 bp, Homo sapiens
cctccttgccgctgggagagc

SEQ ID NO: 255360 - DNA, 14 bp, Homo sapiens
cctccttgcctcct

SEQ ID NO: 255361 - DNA, 18 bp, Homo sapiens
cctccttgcctcctgtgt

SEQ ID NO: 255362 - DNA, 20 bp, Homo sapiens
cctccttgcctcctgtgtaa

SEQ ID NO: 255363 - DNA, 17 bp, Homo sapiens
cctccttgtccaggtct

SEQ ID NO: 255364 - DNA, 13 bp, Homo sapiens
cctcctttgtctt

SEQ ID NO: 255365 - DNA, 13 bp, Homo sapiens
cctcgaggcaccg

SEQ ID NO: 255366 - DNA, 15 bp, Homo sapiens
cctcgaggcaccggc

SEQ ID NO: 255367 - DNA, 20 bp, Homo sapiens
cctcgaggcaccggcgctgc

SEQ ID NO: 255368 - DNA, 22 bp, Homo sapiens
cctcgaggcaccggcgctgcag

SEQ ID NO: 255369 - DNA, 23 bp, Homo sapiens
cctcgaggcaccggcgctgcagg

SEQ ID NO: 255370 - DNA, 20 bp, Homo sapiens
cctcgcatccgcctctgagc

SEQ ID NO: 255371 - DNA, 17 bp, Homo sapiens
cctcgcccctccagtgt

SEQ ID NO: 255372 - DNA, 17 bp, Homo sapiens
cctcgcctaggcctgtg

SEQ ID NO: 255373 - DNA, 20 bp, Homo sapiens
cctcgcggcgcagcccctgg

SEQ ID NO: 255374 - DNA, 12 bp, Homo sapiens
cctcgctgctgc

SEQ ID NO: 255375 - DNA, 21 bp, Homo sapiens
cctcgctgctgctactacccg

SEQ ID NO: 255376 - DNA, 12 bp, Homo sapiens
cctcgctgtgcc

SEQ ID NO: 255377 - DNA, 19 bp, Homo sapiens
cctcgctgtgccaccaccc

SEQ ID NO: 255378 - DNA, 22 bp, Homo sapiens
cctcgctgtgccaccacccctc

SEQ ID NO: 255379 - DNA, 19 bp, Homo sapiens
cctcgcttcataggcagag

SEQ ID NO: 255380 - DNA, 22 bp, Homo sapiens
cctcggaagccgtctgactcca

SEQ ID NO: 255381 - DNA, 18 bp, Homo sapiens
cctcggagccaatgaaca

SEQ ID NO: 255382 - DNA, 14 bp, Homo sapiens
cctcggcagaactc

SEQ ID NO: 255383 - DNA, 19 bp, Homo sapiens
cctcggcagaactctctgt

SEQ ID NO: 255384 - DNA, 20 bp, Homo sapiens
cctcggcagaactctctgtc

SEQ ID NO: 255385 - DNA, 22 bp, Homo sapiens
cctcggcattcacacacagcct

SEQ ID NO: 255386 - DNA, 16 bp, Homo sapiens
cctcggccagagctcc

SEQ ID NO: 255387 - DNA, 17 bp, Homo sapiens
cctcggccagagctccc

SEQ ID NO: 255388 - DNA, 22 bp, Homo sapiens
cctcggccccacccaccctctg

SEQ ID NO: 255389 - DNA, 21 bp, Homo sapiens
cctcggcctcccaaagtgctg

SEQ ID NO: 255390 - DNA, 22 bp, Homo sapiens
cctcggcctccgaggctccccg

SEQ ID NO: 255391 - DNA, 13 bp, Homo sapiens
cctcggctacccc

SEQ ID NO: 255392 - DNA, 16 bp, Homo sapiens
cctcggcttgtgggct

SEQ ID NO: 255393 - DNA, 17 bp, Homo sapiens
cctcggcttgtgggctg

SEQ ID NO: 255394 - DNA, 20 bp, Homo sapiens
cctcggcttgtgggctggtg

SEQ ID NO: 255395 - DNA, 12 bp, Homo sapiens
cctcgggccgcc

SEQ ID NO: 255396 - DNA, 15 bp, Homo sapiens
cctcgggccgcctcc

SEQ ID NO: 255397 - DNA, 21 bp, Homo sapiens
cctcgggccgcctcctccaga

SEQ ID NO: 255398 - DNA, 17 bp, Homo sapiens
cctcgggcgcctgcgct

SEQ ID NO: 255399 - DNA, 18 bp, Homo sapiens
cctcgggcgcctgcgctc

SEQ ID NO: 255400 - DNA, 22 bp, Homo sapiens
cctcggggcaggaagtccctga

SEQ ID NO: 255401 - DNA, 13 bp, Homo sapiens
cctcggggcaggg

SEQ ID NO: 255402 - DNA, 15 bp, Homo sapiens
cctcggggcagggca

SEQ ID NO: 255403 - DNA, 16 bp, Homo sapiens
cctcggggcagggcag

SEQ ID NO: 255404 - DNA, 17 bp, Homo sapiens
cctcggggcagggcagg

SEQ ID NO: 255405 - DNA, 18 bp, Homo sapiens
cctcggtcagcaccgtgg

SEQ ID NO: 255406 - DNA, 13 bp, Homo sapiens
cctcggtcttacc

SEQ ID NO: 255407 - DNA, 20 bp, Homo sapiens
cctcggtggcatttgctgaa

SEQ ID NO: 255408 - DNA, 22 bp, Homo sapiens
cctcgtccacaggggcaggcct

SEQ ID NO: 255409 - DNA, 17 bp, Homo sapiens
cctcgtcccctgcctca

SEQ ID NO: 255410 - DNA, 21 bp, Homo sapiens
cctcgtccggcctgcagccca

SEQ ID NO: 255411 - DNA, 19 bp, Homo sapiens
cctcgtctccctggccacc

SEQ ID NO: 255412 - DNA, 15 bp, Homo sapiens
cctcgtggacacctg

SEQ ID NO: 255413 - DNA, 20 bp, Homo sapiens
cctcgtggacacctgccctg

SEQ ID NO: 255414 - DNA, 19 bp, Homo sapiens
cctctaacaccacactgac

SEQ ID NO: 255415 - DNA, 18 bp, Homo sapiens
cctctaacaggggctggt

SEQ ID NO: 255416 - DNA, 19 bp, Homo sapiens
cctctaaggccaaggcctc

SEQ ID NO: 255417 - DNA, 15 bp, Homo sapiens
cctctaatgctcacg

SEQ ID NO: 255418 - DNA, 14 bp, Homo sapiens
cctctactttccag

SEQ ID NO: 255419 - DNA, 18 bp, Homo sapiens
cctctactttccaggcta

SEQ ID NO: 255420 - DNA, 22 bp, Homo sapiens
cctctactttgtcccctcacct

SEQ ID NO: 255421 - DNA, 16 bp, Homo sapiens
cctctagaacagccag

SEQ ID NO: 255422 - DNA, 14 bp, Homo sapiens
cctctaggcctcag

SEQ ID NO: 255423 - DNA, 15 bp, Homo sapiens
cctctaggcctcagt

SEQ ID NO: 255424 - DNA, 18 bp, Homo sapiens
cctctaggtaaactagca

SEQ ID NO: 255425 - DNA, 23 bp, Homo sapiens
cctctaggtaaactagcaaaagg

SEQ ID NO: 255426 - DNA, 20 bp, Homo sapiens
cctctattgatgtacagtct

SEQ ID NO: 255427 - DNA, 12 bp, Homo sapiens
cctctattttgt

SEQ ID NO: 255428 - DNA, 18 bp, Homo sapiens
cctctcaatattcaataa

SEQ ID NO: 255429 - DNA, 20 bp, Homo sapiens
cctctcaatattcaataaag

SEQ ID NO: 255430 - DNA, 20 bp, Homo sapiens
cctctcagaactcctgtgtg

SEQ ID NO: 255431 - DNA, 18 bp, Homo sapiens
cctctcagatccctcggt

SEQ ID NO: 255432 - DNA, 21 bp, Homo sapiens
cctctcaggcatgcctgtgtg

SEQ ID NO: 255433 - DNA, 16 bp, Homo sapiens
cctctcatcagcccag

SEQ ID NO: 255434 - DNA, 23 bp, Homo sapiens
cctctcatccaggtcctttcctt

SEQ ID NO: 255435 - DNA, 16 bp, Homo sapiens
cctctccaagtctctc

SEQ ID NO: 255436 - DNA, 22 bp, Homo sapiens
cctctccaagtctctctgtgaa

SEQ ID NO: 255437 - DNA, 23 bp, Homo sapiens
cctctccacacccatgactgccc

SEQ ID NO: 255438 - DNA, 19 bp, Homo sapiens
cctctccactgccttcgat

SEQ ID NO: 255439 - DNA, 17 bp, Homo sapiens
cctctcccacccggcca

SEQ ID NO: 255440 - DNA, 16 bp, Homo sapiens
cctctcccaggcccga

SEQ ID NO: 255441 - DNA, 12 bp, Homo sapiens
cctctcccagtt

SEQ ID NO: 255442 - DNA, 12 bp, Homo sapiens
cctctccccaaa

SEQ ID NO: 255443 - DNA, 14 bp, Homo sapiens
cctctccccaagac

SEQ ID NO: 255444 - DNA, 18 bp, Homo sapiens
cctctcccggctgcctgc

SEQ ID NO: 255445 - DNA, 11 bp, Homo sapiens
cctctccctca

SEQ ID NO: 255446 - DNA, 16 bp, Homo sapiens
cctctcctcgtccggc

SEQ ID NO: 255447 - DNA, 19 bp, Homo sapiens
cctctcctcgtccggcctg

SEQ ID NO: 255448 - DNA, 16 bp, Homo sapiens
cctctcctgagcctgt

SEQ ID NO: 255449 - DNA, 14 bp, Homo sapiens
cctctcctgcatcc

SEQ ID NO: 255450 - DNA, 18 bp, Homo sapiens
cctctcctgcccagctct

SEQ ID NO: 255451 - DNA, 20 bp, Homo sapiens
cctctccttgccccagtcct

SEQ ID NO: 255452 - DNA, 21 bp, Homo sapiens
cctctccttgggctcctggct

SEQ ID NO: 255453 - DNA, 23 bp, Homo sapiens
cctctccttgggctcctggctgc

SEQ ID NO: 255454 - DNA, 19 bp, Homo sapiens
cctctcgccccatccctgc

SEQ ID NO: 255455 - DNA, 20 bp, Homo sapiens
cctctcgccccatccctgct

SEQ ID NO: 255456 - DNA, 22 bp, Homo sapiens
cctctcgccccatccctgcttg

SEQ ID NO: 255457 - DNA, 20 bp, Homo sapiens
cctctcgttggtagttgaga

SEQ ID NO: 255458 - DNA, 15 bp, Homo sapiens
cctctctccctgcct

SEQ ID NO: 255459 - DNA, 22 bp, Homo sapiens
cctctctccctgcctcacatct

SEQ ID NO: 255460 - DNA, 23 bp, Homo sapiens
cctctctccttatagacacttgc

SEQ ID NO: 255461 - DNA, 14 bp, Homo sapiens
cctctctctccctc

SEQ ID NO: 255462 - DNA, 21 bp, Homo sapiens
cctctctctctctctctctgt

SEQ ID NO: 255463 - DNA, 13 bp, Homo sapiens
cctctctctgctc

SEQ ID NO: 255464 - DNA, 15 bp, Homo sapiens
cctctctctggaaag

SEQ ID NO: 255465 - DNA, 18 bp, Homo sapiens
cctctctcttctgctcca

SEQ ID NO: 255466 - DNA, 21 bp, Homo sapiens
cctctctgatcttgtgctcag

SEQ ID NO: 255467 - DNA, 12 bp, Homo sapiens
cctctctgctat

SEQ ID NO: 255468 - DNA, 23 bp, Homo sapiens
cctctctgtctttttccttcctg

SEQ ID NO: 255469 - DNA, 20 bp, Homo sapiens
cctctctgtttaccctccct

SEQ ID NO: 255470 - DNA, 18 bp, Homo sapiens
cctctcttaccccgtccc

SEQ ID NO: 255471 - DNA, 16 bp, Homo sapiens
cctctcttccgggagc

SEQ ID NO: 255472 - DNA, 13 bp, Homo sapiens
cctctctttgagt

SEQ ID NO: 255473 - DNA, 18 bp, Homo sapiens
cctctgaaaacggccctc

SEQ ID NO: 255474 - DNA, 17 bp, Homo sapiens
cctctgacagcagcctg

SEQ ID NO: 255475 - DNA, 22 bp, Homo sapiens
cctctgaccctagctctttcct

SEQ ID NO: 255476 - DNA, 22 bp, Homo sapiens
cctctgagcagcctctgccagg

SEQ ID NO: 255477 - DNA, 14 bp, Homo sapiens
cctctgagccagga

SEQ ID NO: 255478 - DNA, 16 bp, Homo sapiens
cctctgagccaggagc

SEQ ID NO: 255479 - DNA, 19 bp, Homo sapiens
cctctgagcccctgggact

SEQ ID NO: 255480 - DNA, 15 bp, Homo sapiens
cctctgatacctcaa

SEQ ID NO: 255481 - DNA, 12 bp, Homo sapiens
cctctgatccct

SEQ ID NO: 255482 - DNA, 20 bp, Homo sapiens
cctctgcactactgacatgt

SEQ ID NO: 255483 - DNA, 16 bp, Homo sapiens
cctctgcagactcgtt

SEQ ID NO: 255484 - DNA, 14 bp, Homo sapiens
cctctgcagcctga

SEQ ID NO: 255485 - DNA, 16 bp, Homo sapiens
cctctgcagcctgagc

SEQ ID NO: 255486 - DNA, 13 bp, Homo sapiens
cctctgcagctga

SEQ ID NO: 255487 - DNA, 15 bp, Homo sapiens
cctctgcaggacaca

SEQ ID NO: 255488 - DNA, 19 bp, Homo sapiens
cctctgcaggacacagatc

SEQ ID NO: 255489 - DNA, 16 bp, Homo sapiens
cctctgcagtgccttg

SEQ ID NO: 255490 - DNA, 16 bp, Homo sapiens
cctctgcataaatatt

SEQ ID NO: 255491 - DNA, 13 bp, Homo sapiens
cctctgccacact

SEQ ID NO: 255492 - DNA, 18 bp, Homo sapiens
cctctgccacactctgac

SEQ ID NO: 255493 - DNA, 16 bp, Homo sapiens
cctctgccaggcctgt

SEQ ID NO: 255494 - DNA, 13 bp, Homo sapiens
cctctgcccagct

SEQ ID NO: 255495 - DNA, 11 bp, Homo sapiens
cctctgcccca

SEQ ID NO: 255496 - DNA, 14 bp, Homo sapiens
cctctgccccaagc

SEQ ID NO: 255497 - DNA, 21 bp, Homo sapiens
cctctgccccaagcagccagc

SEQ ID NO: 255498 - DNA, 22 bp, Homo sapiens
cctctgccccaagcagccagcc

SEQ ID NO: 255499 - DNA, 23 bp, Homo sapiens
cctctgccccaagcagccagcca

SEQ ID NO: 255500 - DNA, 17 bp, Homo sapiens
cctctgcccgcagagcc

SEQ ID NO: 255501 - DNA, 14 bp, Homo sapiens
cctctgccctgcct

SEQ ID NO: 255502 - DNA, 15 bp, Homo sapiens
cctctgccctgcctc

SEQ ID NO: 255503 - DNA, 17 bp, Homo sapiens
cctctgccctgcctccc

SEQ ID NO: 255504 - DNA, 18 bp, Homo sapiens
cctctgccctgcctccct

SEQ ID NO: 255505 - DNA, 19 bp, Homo sapiens
cctctgccgaccgcctgct

SEQ ID NO: 255506 - DNA, 23 bp, Homo sapiens
cctctgccgaccgcctgcttcac

SEQ ID NO: 255507 - DNA, 13 bp, Homo sapiens
cctctgcctccag

SEQ ID NO: 255508 - DNA, 18 bp, Homo sapiens
cctctgcctccaggaggg

SEQ ID NO: 255509 - DNA, 12 bp, Homo sapiens
cctctgcctgtc

SEQ ID NO: 255510 - DNA, 15 bp, Homo sapiens
cctctgcctgtctcc

SEQ ID NO: 255511 - DNA, 18 bp, Homo sapiens
cctctgccttagaggagc

SEQ ID NO: 255512 - DNA, 12 bp, Homo sapiens
cctctgccttgc

SEQ ID NO: 255513 - DNA, 13 bp, Homo sapiens
cctctgctcctgg

SEQ ID NO: 255514 - DNA, 18 bp, Homo sapiens
cctctgctcctggagcct

SEQ ID NO: 255515 - DNA, 18 bp, Homo sapiens
cctctgctgcccacggcc

SEQ ID NO: 255516 - DNA, 20 bp, Homo sapiens
cctctgctgcccacggccac

SEQ ID NO: 255517 - DNA, 22 bp, Homo sapiens
cctctgctgcccacggccaccc

SEQ ID NO: 255518 - DNA, 22 bp, Homo sapiens
cctctgctggccgggcacagct

SEQ ID NO: 255519 - DNA, 14 bp, Homo sapiens
cctctggactggct

SEQ ID NO: 255520 - DNA, 15 bp, Homo sapiens
cctctggactggcta

SEQ ID NO: 255521 - DNA, 17 bp, Homo sapiens
cctctggactggctaga

SEQ ID NO: 255522 - DNA, 17 bp, Homo sapiens
cctctggagctttgcag

SEQ ID NO: 255523 - DNA, 16 bp, Homo sapiens
cctctggaggcctctg

SEQ ID NO: 255524 - DNA, 12 bp, Homo sapiens
cctctggccagg

SEQ ID NO: 255525 - DNA, 15 bp, Homo sapiens
cctctggccaggatg

SEQ ID NO: 255526 - DNA, 17 bp, Homo sapiens
cctctggccctgttgtg

SEQ ID NO: 255527 - DNA, 11 bp, Homo sapiens
cctctggctgc

SEQ ID NO: 255528 - DNA, 13 bp, Homo sapiens
cctctgggccctg

SEQ ID NO: 255529 - DNA, 15 bp, Homo sapiens
cctctgggccctgca

SEQ ID NO: 255530 - DNA, 21 bp, Homo sapiens
cctctggggaagggaaccagc

SEQ ID NO: 255531 - DNA, 23 bp, Homo sapiens
cctctggggaagggaaccagccc

SEQ ID NO: 255532 - DNA, 11 bp, Homo sapiens
cctctggggag

SEQ ID NO: 255533 - DNA, 23 bp, Homo sapiens
cctctggtaaacattcctccagc

SEQ ID NO: 255534 - DNA, 21 bp, Homo sapiens
cctctggtccttctgacccca

SEQ ID NO: 255535 - DNA, 17 bp, Homo sapiens
cctctggttccactcag

SEQ ID NO: 255536 - DNA, 19 bp, Homo sapiens
cctctggttccactcagct

SEQ ID NO: 255537 - DNA, 17 bp, Homo sapiens
gatgtgatttatgcatt

SEQ ID NO: 255538 - DNA, 19 bp, Homo sapiens
gatttatataaatgtaaaa

SEQ ID NO: 255539 - DNA, 19 bp, Homo sapiens
gatttatcacacaaagcag

SEQ ID NO: 255540 - DNA, 15 bp, Homo sapiens
gatttcactgacact

SEQ ID NO: 255541 - DNA, 16 bp, Homo sapiens
cccaggacgcttctga

SEQ ID NO: 255542 - DNA, 18 bp, Homo sapiens
cccaggacgcttctgaat

SEQ ID NO: 255543 - DNA, 19 bp, Homo sapiens
cccaggacgcttctgaatg

SEQ ID NO: 255544 - DNA, 16 bp, Homo sapiens
cccaggagagccccca

SEQ ID NO: 255545 - DNA, 20 bp, Homo sapiens
cccaggagagcccccaccag

SEQ ID NO: 255546 - DNA, 19 bp, Homo sapiens
cccaggaggacctgggggg

SEQ ID NO: 255547 - DNA, 18 bp, Homo sapiens
cccaggagggagggggct

SEQ ID NO: 255548 - DNA, 17 bp, Homo sapiens
cccaggaggggcctctg

SEQ ID NO: 255549 - DNA, 15 bp, Homo sapiens
cccaggatcccctgc

SEQ ID NO: 255550 - DNA, 19 bp, Homo sapiens
cccaggcagcacctggagc

SEQ ID NO: 255551 - DNA, 22 bp, Homo sapiens
cccaggcagggagggaaacccg

SEQ ID NO: 255552 - DNA, 14 bp, Homo sapiens
cccaggcagtcttt

SEQ ID NO: 255553 - DNA, 16 bp, Homo sapiens
cccaggccactgacct

SEQ ID NO: 255554 - DNA, 23 bp, Homo sapiens
cccaggccaggtccctggaccag

SEQ ID NO: 255555 - DNA, 12 bp, Homo sapiens
cccaggccccct

SEQ ID NO: 255556 - DNA, 17 bp, Homo sapiens
cccaggccctagaccct

SEQ ID NO: 255557 - DNA, 23 bp, Homo sapiens
cccaggccctagaccctccccca

SEQ ID NO: 255558 - DNA, 19 bp, Homo sapiens
cccaggccctccatgggct

SEQ ID NO: 255559 - DNA, 19 bp, Homo sapiens
cccaggccgcatggcccct

SEQ ID NO: 255560 - DNA, 22 bp, Homo sapiens
cccaggccgcatggcccctcca

SEQ ID NO: 255561 - DNA, 17 bp, Homo sapiens
cccaggccggccagcct

SEQ ID NO: 255562 - DNA, 23 bp, Homo sapiens
cccaggccggccagcctcaccct

SEQ ID NO: 255563 - DNA, 14 bp, Homo sapiens
cccaggccgttccc

SEQ ID NO: 255564 - DNA, 17 bp, Homo sapiens
cccaggcctccagcctc

SEQ ID NO: 255565 - DNA, 15 bp, Homo sapiens
cccaggcctgccctc

SEQ ID NO: 255566 - DNA, 16 bp, Homo sapiens
cccaggcctgcctgtt

SEQ ID NO: 255567 - DNA, 14 bp, Homo sapiens
cccaggcctggagc

SEQ ID NO: 255568 - DNA, 15 bp, Homo sapiens
cccaggcctggagcg

SEQ ID NO: 255569 - DNA, 19 bp, Homo sapiens
cccaggcctggcctcgggg

SEQ ID NO: 255570 - DNA, 18 bp, Homo sapiens
cccaggcgccccttcccc

SEQ ID NO: 255571 - DNA, 15 bp, Homo sapiens
cccaggcgcctgcgc

SEQ ID NO: 255572 - DNA, 20 bp, Homo sapiens
cccaggctcccctggtctcc

SEQ ID NO: 255573 - DNA, 13 bp, Homo sapiens
cccaggctctgct

SEQ ID NO: 255574 - DNA, 16 bp, Homo sapiens
cccaggctctgctgac

SEQ ID NO: 255575 - DNA, 15 bp, Homo sapiens
cccaggctgcactgc

SEQ ID NO: 255576 - DNA, 14 bp, Homo sapiens
cccaggctgcgcct

SEQ ID NO: 255577 - DNA, 18 bp, Homo sapiens
cccaggctggagtgcagt

SEQ ID NO: 255578 - DNA, 19 bp, Homo sapiens
cccaggctggagtgcagtg

SEQ ID NO: 255579 - DNA, 21 bp, Homo sapiens
cccagggcccctccctctgcc

SEQ ID NO: 255580 - DNA, 16 bp, Homo sapiens
cccagggccctgctca

SEQ ID NO: 255581 - DNA, 13 bp, Homo sapiens
cccagggcctggg

SEQ ID NO: 255582 - DNA, 23 bp, Homo sapiens
cccagggcctgggggcagtgact

SEQ ID NO: 255583 - DNA, 15 bp, Homo sapiens
cccagggctaccctc

SEQ ID NO: 255584 - DNA, 21 bp, Homo sapiens
cccagggctaccctcccccag

SEQ ID NO: 255585 - DNA, 17 bp, Homo sapiens
cccagggctgtgggtgg

SEQ ID NO: 255586 - DNA, 19 bp, Homo sapiens
cccagggctgtgggtgggg

SEQ ID NO: 255587 - DNA, 23 bp, Homo sapiens
cccaggggcatgtattggcctgg

SEQ ID NO: 255588 - DNA, 18 bp, Homo sapiens
cccaggggctttggtggc

SEQ ID NO: 255589 - DNA, 18 bp, Homo sapiens
cccaggggtcccagccac

SEQ ID NO: 255590 - DNA, 19 bp, Homo sapiens
cccaggggtctccctgagc

SEQ ID NO: 255591 - DNA, 16 bp, Homo sapiens
cccagggtcttcccta

SEQ ID NO: 255592 - DNA, 17 bp, Homo sapiens
cccagggtgcagtgtga

SEQ ID NO: 255593 - DNA, 14 bp, Homo sapiens
cccagggttctgta

SEQ ID NO: 255594 - DNA, 15 bp, Homo sapiens
cccaggtataaaacc

SEQ ID NO: 255595 - DNA, 19 bp, Homo sapiens
cccaggtcagctgttactt

SEQ ID NO: 255596 - DNA, 15 bp, Homo sapiens
cccaggtgctggagg

SEQ ID NO: 255597 - DNA, 20 bp, Homo sapiens
cccaggtgctggaggcagac

SEQ ID NO: 255598 - DNA, 17 bp, Homo sapiens
cccaggttggaggccct

SEQ ID NO: 255599 - DNA, 14 bp, Homo sapiens
cccagtagccccaa

SEQ ID NO: 255600 - DNA, 22 bp, Homo sapiens
cccagtagccccaatatggtgg

SEQ ID NO: 255601 - DNA, 23 bp, Homo sapiens
cccagtccccgtgccccgcctcc

SEQ ID NO: 255602 - DNA, 17 bp, Homo sapiens
cccagtctgttccccat

SEQ ID NO: 255603 - DNA, 12 bp, Homo sapiens
cccagtgacact

SEQ ID NO: 255604 - DNA, 13 bp, Homo sapiens
cccagtgacactt

SEQ ID NO: 255605 - DNA, 12 bp, Homo sapiens
cccagtgatggc

SEQ ID NO: 255606 - DNA, 19 bp, Homo sapiens
cccagtgatttacatgctg

SEQ ID NO: 255607 - DNA, 15 bp, Homo sapiens
cccagtgccaaactt

SEQ ID NO: 255608 - DNA, 16 bp, Homo sapiens
cccagtgcctgccact

SEQ ID NO: 255609 - DNA, 17 bp, Homo sapiens
cccagtgcctgccactc

SEQ ID NO: 255610 - DNA, 12 bp, Homo sapiens
cccagtgctgcc

SEQ ID NO: 255611 - DNA, 13 bp, Homo sapiens
cccagtgctgcca

SEQ ID NO: 255612 - DNA, 20 bp, Homo sapiens
cccagtgctgccatgccact

SEQ ID NO: 255613 - DNA, 16 bp, Homo sapiens
cccagtgggaggcgcg

SEQ ID NO: 255614 - DNA, 13 bp, Homo sapiens
cccagtgggctgt

SEQ ID NO: 255615 - DNA, 15 bp, Homo sapiens
cccagtgggctgtgt

SEQ ID NO: 255616 - DNA, 21 bp, Homo sapiens
cccagtgtcaagttgtgcttg

SEQ ID NO: 255617 - DNA, 22 bp, Homo sapiens
cccagtgtcaagttgtgcttgt

SEQ ID NO: 255618 - DNA, 19 bp, Homo sapiens
cccagtgtccccaggggca

SEQ ID NO: 255619 - DNA, 19 bp, Homo sapiens
cccagttagcccggccaag

SEQ ID NO: 255620 - DNA, 14 bp, Homo sapiens
cccagttcatctct

SEQ ID NO: 255621 - DNA, 17 bp, Homo sapiens
cccagttcatctctgct

SEQ ID NO: 255622 - DNA, 19 bp, Homo sapiens
cccagttggggctgcgacc

SEQ ID NO: 255623 - DNA, 21 bp, Homo sapiens
cccataatagttagccctcag

SEQ ID NO: 255624 - DNA, 22 bp, Homo sapiens
cccataattttttttttccttt

SEQ ID NO: 255625 - DNA, 23 bp, Homo sapiens
cccataattttttttttcctttt

SEQ ID NO: 255626 - DNA, 12 bp, Homo sapiens
cccatagaaaac

SEQ ID NO: 255627 - DNA, 22 bp, Homo sapiens
cccatagaaaacaatctgccca

SEQ ID NO: 255628 - DNA, 23 bp, Homo sapiens
cccatagaaaacaatctgcccac

SEQ ID NO: 255629 - DNA, 16 bp, Homo sapiens
cccatagatcttctga

SEQ ID NO: 255630 - DNA, 22 bp, Homo sapiens
cccatagatcttctgaaatgaa

SEQ ID NO: 255631 - DNA, 17 bp, Homo sapiens
cccataggccaccccct

SEQ ID NO: 255632 - DNA, 13 bp, Homo sapiens
cccatagtgctgg

SEQ ID NO: 255633 - DNA, 13 bp, Homo sapiens
cccatatataaat

SEQ ID NO: 255634 - DNA, 15 bp, Homo sapiens
cccatatataaatta

SEQ ID NO: 255635 - DNA, 18 bp, Homo sapiens
cccatatataaattatta

SEQ ID NO: 255636 - DNA, 19 bp, Homo sapiens
cccatattttacttggaaa

SEQ ID NO: 255637 - DNA, 22 bp, Homo sapiens
cccatcacagggttgggcccag

SEQ ID NO: 255638 - DNA, 14 bp, Homo sapiens
cccatcaccccttc

SEQ ID NO: 255639 - DNA, 15 bp, Homo sapiens
cccatcaccccttcc

SEQ ID NO: 255640 - DNA, 17 bp, Homo sapiens
cccatcaccccttcccc

SEQ ID NO: 255641 - DNA, 17 bp, Homo sapiens
cccatcatctctgcctt

SEQ ID NO: 255642 - DNA, 22 bp, Homo sapiens
cccatccagcatgtgtgtgtct

SEQ ID NO: 255643 - DNA, 15 bp, Homo sapiens
cccatccagccaggg

SEQ ID NO: 255644 - DNA, 18 bp, Homo sapiens
cccatccatcagctccct

SEQ ID NO: 255645 - DNA, 14 bp, Homo sapiens
cccatccccaccag

SEQ ID NO: 255646 - DNA, 20 bp, Homo sapiens
cccatcctaccaatgcatgc

SEQ ID NO: 255647 - DNA, 17 bp, Homo sapiens
cccatcctccagcttct

SEQ ID NO: 255648 - DNA, 13 bp, Homo sapiens
cccatcctcccct

SEQ ID NO: 255649 - DNA, 15 bp, Homo sapiens
cccatcgtataagga

SEQ ID NO: 255650 - DNA, 16 bp, Homo sapiens
cccatctcaggtgcca

SEQ ID NO: 255651 - DNA, 17 bp, Homo sapiens
cccatctccccaggcct

SEQ ID NO: 255652 - DNA, 13 bp, Homo sapiens
cccatctcctccc

SEQ ID NO: 255653 - DNA, 15 bp, Homo sapiens
cccatctcctcccat

SEQ ID NO: 255654 - DNA, 13 bp, Homo sapiens
cccatctccttcc

SEQ ID NO: 255655 - DNA, 22 bp, Homo sapiens
cccatctccttcccccagccca

SEQ ID NO: 255656 - DNA, 18 bp, Homo sapiens
cccatctctccctcccct

SEQ ID NO: 255657 - DNA, 21 bp, Homo sapiens
cccatctctccctcccctgcc

SEQ ID NO: 255658 - DNA, 16 bp, Homo sapiens
cccatcttcctgctgc

SEQ ID NO: 255659 - DNA, 18 bp, Homo sapiens
cccatcttcctgctgctg

SEQ ID NO: 255660 - DNA, 24 bp, Homo sapiens
cccatcttgcctccatggtgcctc

SEQ ID NO: 255661 - DNA, 20 bp, Homo sapiens
cccatgactgcacccagctc

SEQ ID NO: 255662 - DNA, 22 bp, Homo sapiens
cccatgactgcacccagctcca

SEQ ID NO: 255663 - DNA, 15 bp, Homo sapiens
cccatgatccctgtg

SEQ ID NO: 255664 - DNA, 20 bp, Homo sapiens
cccatgcacaactctccaaa

SEQ ID NO: 255665 - DNA, 13 bp, Homo sapiens
cccatgcatggcc

SEQ ID NO: 255666 - DNA, 19 bp, Homo sapiens
cccatgcatggcctcccag

SEQ ID NO: 255667 - DNA, 21 bp, Homo sapiens
cccatgcatggcctcccagcc

SEQ ID NO: 255668 - DNA, 21 bp, Homo sapiens
cccatgccaaagctagggtgg

SEQ ID NO: 255669 - DNA, 18 bp, Homo sapiens
cccatgccaccacccacc

SEQ ID NO: 255670 - DNA, 20 bp, Homo sapiens
cccatgccaccacccacccc

SEQ ID NO: 255671 - DNA, 18 bp, Homo sapiens
cccatgcccacctgccca

SEQ ID NO: 255672 - DNA, 23 bp, Homo sapiens
cccatgccctgccaagcctggag

SEQ ID NO: 255673 - DNA, 14 bp, Homo sapiens
cccatgcctgtcca

SEQ ID NO: 255674 - DNA, 19 bp, Homo sapiens
cccatgcctgtccagcctg

SEQ ID NO: 255675 - DNA, 12 bp, Homo sapiens
gatttcagaaac

SEQ ID NO: 255676 - DNA, 13 bp, Homo sapiens
gatttcagatgta

SEQ ID NO: 255677 - DNA, 12 bp, Homo sapiens
gatttccaggcc

SEQ ID NO: 255678 - DNA, 14 bp, Homo sapiens
gatttccaggcccc

SEQ ID NO: 255679 - DNA, 17 bp, Homo sapiens
gatttccaggcccctga

SEQ ID NO: 255680 - DNA, 19 bp, Homo sapiens
gatttcccttttttcttcc

SEQ ID NO: 255681 - DNA, 14 bp, Homo sapiens
gatttcctaagctg

SEQ ID NO: 255682 - DNA, 15 bp, Homo sapiens
gatttcctaagctgt

SEQ ID NO: 255683 - DNA, 23 bp, Homo sapiens
gatttctagaaagcctgttcccc

SEQ ID NO: 255684 - DNA, 12 bp, Homo sapiens
gatttctagaat

SEQ ID NO: 255685 - DNA, 18 bp, Homo sapiens
gatttctagaatggtttt

SEQ ID NO: 255686 - DNA, 16 bp, Homo sapiens
gatttctagcaggcag

SEQ ID NO: 255687 - DNA, 24 bp, Homo sapiens
gatttcttcgctgctctagctggc

SEQ ID NO: 255688 - DNA, 19 bp, Homo sapiens
gatttgaaacttggtgtgt

SEQ ID NO: 255689 - DNA, 21 bp, Homo sapiens
gatttgaaccaggccttctga

SEQ ID NO: 255690 - DNA, 13 bp, Homo sapiens
gatttgaactgag

SEQ ID NO: 255691 - DNA, 22 bp, Homo sapiens
gatttgaggagcagcttcagtt

SEQ ID NO: 255692 - DNA, 22 bp, Homo sapiens
gatttgagtccattgcaaaagg

SEQ ID NO: 255693 - DNA, 15 bp, Homo sapiens
gatttgccaaaaact

SEQ ID NO: 255694 - DNA, 15 bp, Homo sapiens
gatttgcctgtgcca

SEQ ID NO: 255695 - DNA, 11 bp, Homo sapiens
gatttgctgtt

SEQ ID NO: 255696 - DNA, 12 bp, Homo sapiens
gatttggttttt

SEQ ID NO: 255697 - DNA, 17 bp, Homo sapiens
gatttggtttttctctt

SEQ ID NO: 255698 - DNA, 15 bp, Homo sapiens
gatttgtatttatat

SEQ ID NO: 255699 - DNA, 17 bp, Homo sapiens
gatttgtatttatatta

SEQ ID NO: 255700 - DNA, 20 bp, Homo sapiens
gatttgtatttatattagag

SEQ ID NO: 255701 - DNA, 13 bp, Homo sapiens
gatttgtctctga

SEQ ID NO: 255702 - DNA, 15 bp, Homo sapiens
gatttgtctctgagc

SEQ ID NO: 255703 - DNA, 11 bp, Homo sapiens
gatttgttcat

SEQ ID NO: 255704 - DNA, 15 bp, Homo sapiens
gattttaacaataac

SEQ ID NO: 255705 - DNA, 17 bp, Homo sapiens
gattttacaaaagatgt

SEQ ID NO: 255706 - DNA, 20 bp, Homo sapiens
gattttatctgtgaattcag

SEQ ID NO: 255707 - DNA, 15 bp, Homo sapiens
gattttatctgtgga

SEQ ID NO: 255708 - DNA, 13 bp, Homo sapiens
gattttatctgtt

SEQ ID NO: 255709 - DNA, 17 bp, Homo sapiens
gattttatctgttaacc

SEQ ID NO: 255710 - DNA, 15 bp, Homo sapiens
gattttatttgacaa

SEQ ID NO: 255711 - DNA, 18 bp, Homo sapiens
gattttattttcaagcaa

SEQ ID NO: 255712 - DNA, 18 bp, Homo sapiens
gattttcctgaatattaa

SEQ ID NO: 255713 - DNA, 18 bp, Homo sapiens
gattttcctgtgtccaca

SEQ ID NO: 255714 - DNA, 21 bp, Homo sapiens
gattttctgggcctaaaggat

SEQ ID NO: 255715 - DNA, 12 bp, Homo sapiens
gattttctttct

SEQ ID NO: 255716 - DNA, 12 bp, Homo sapiens
gattttgtagtt

SEQ ID NO: 255717 - DNA, 21 bp, Homo sapiens
gatttttgttaagctcaggat

SEQ ID NO: 255718 - DNA, 20 bp, Homo sapiens
gattttttacagctgcctgc

SEQ ID NO: 255719 - DNA, 21 bp, Homo sapiens
gatttttttttagaacagaaa

SEQ ID NO: 255720 - DNA, 15 bp, Homo sapiens
gcaaaaaataaaata

SEQ ID NO: 255721 - DNA, 16 bp, Homo sapiens
gcaaaaaataaaataa

SEQ ID NO: 255722 - DNA, 11 bp, Homo sapiens
gcaaaaatatt

SEQ ID NO: 255723 - DNA, 13 bp, Homo sapiens
gcaaaagaagttg

SEQ ID NO: 255724 - DNA, 12 bp, Homo sapiens
gcaaaaggcagc

SEQ ID NO: 255725 - DNA, 15 bp, Homo sapiens
gcaaaaggcagctca

SEQ ID NO: 255726 - DNA, 19 bp, Homo sapiens
gcaaaaggttaagccatat

SEQ ID NO: 255727 - DNA, 23 bp, Homo sapiens
gcaaaattatagaagtttagatt

SEQ ID NO: 255728 - DNA, 17 bp, Homo sapiens
gcaaaattgatgtgttt

SEQ ID NO: 255729 - DNA, 10 bp, Homo sapiens
gcaaaatttc

SEQ ID NO: 255730 - DNA, 16 bp, Homo sapiens
gcaaaattttatagct

SEQ ID NO: 255731 - DNA, 13 bp, Homo sapiens
gcaaacaataaac

SEQ ID NO: 255732 - DNA, 15 bp, Homo sapiens
gcaaacaatcccaat

SEQ ID NO: 255733 - DNA, 22 bp, Homo sapiens
gcaaacaatcccaatctttcta

SEQ ID NO: 255734 - DNA, 21 bp, Homo sapiens
gcaaacacacagactctgtga

SEQ ID NO: 255735 - DNA, 12 bp, Homo sapiens
gcaaacatcaaa

SEQ ID NO: 255736 - DNA, 13 bp, Homo sapiens
gcaaacatcaaat

SEQ ID NO: 255737 - DNA, 19 bp, Homo sapiens
gcaaacatcaaataaattt

SEQ ID NO: 255738 - DNA, 15 bp, Homo sapiens
gcaaacatttaaaaa

SEQ ID NO: 255739 - DNA, 16 bp, Homo sapiens
gcaaaccaatggtgat

SEQ ID NO: 255740 - DNA, 21 bp, Homo sapiens
gcaaaccaatggtgatcctct

SEQ ID NO: 255741 - DNA, 14 bp, Homo sapiens
gcaaaccaggactc

SEQ ID NO: 255742 - DNA, 22 bp, Homo sapiens
gcaaactttaacaggttttctt

SEQ ID NO: 255743 - DNA, 19 bp, Homo sapiens
gcaaagaaaacacacaaaa

SEQ ID NO: 255744 - DNA, 15 bp, Homo sapiens
gcaaagaaaagaact

SEQ ID NO: 255745 - DNA, 23 bp, Homo sapiens
gcaaagaaaagaactgcttgcat

SEQ ID NO: 255746 - DNA, 17 bp, Homo sapiens
gcaaagaaaattctcaa

SEQ ID NO: 255747 - DNA, 16 bp, Homo sapiens
gcaaagaactgcccca

SEQ ID NO: 255748 - DNA, 18 bp, Homo sapiens
gcaaagaagtaagtttat

SEQ ID NO: 255749 - DNA, 13 bp, Homo sapiens
gcaaagaggtgct

SEQ ID NO: 255750 - DNA, 19 bp, Homo sapiens
gcaaagaggtgctgctttg

SEQ ID NO: 255751 - DNA, 20 bp, Homo sapiens
gcaaagaggtgctgctttgc

SEQ ID NO: 255752 - DNA, 23 bp, Homo sapiens
gcaaagaggtgctgctttgcttc

SEQ ID NO: 255753 - DNA, 14 bp, Homo sapiens
gcaaagatcaaaat

SEQ ID NO: 255754 - DNA, 18 bp, Homo sapiens
gcaaagatcaaaataaaa

SEQ ID NO: 255755 - DNA, 14 bp, Homo sapiens
gcaaagcctttaaa

SEQ ID NO: 255756 - DNA, 22 bp, Homo sapiens
gcaaaggagacaaagcaggagt

SEQ ID NO: 255757 - DNA, 17 bp, Homo sapiens
gcaaaggcaggaggtgg

SEQ ID NO: 255758 - DNA, 22 bp, Homo sapiens
gcaaagtaccaactgagccaaa

SEQ ID NO: 255759 - DNA, 22 bp, Homo sapiens
gcaaagtctaaagtttacagta

SEQ ID NO: 255760 - DNA, 22 bp, Homo sapiens
gcaaagtctctcatttctttca

SEQ ID NO: 255761 - DNA, 16 bp, Homo sapiens
gcaaagtgaagtgatg

SEQ ID NO: 255762 - DNA, 16 bp, Homo sapiens
gcaaatagtttcaaat

SEQ ID NO: 255763 - DNA, 15 bp, Homo sapiens
gcaaatcagaaactt

SEQ ID NO: 255764 - DNA, 22 bp, Homo sapiens
gcaaatccataccccctgcccc

SEQ ID NO: 255765 - DNA, 18 bp, Homo sapiens
gcaaatcctggcaagtga

SEQ ID NO: 255766 - DNA, 14 bp, Homo sapiens
gcaaatgagggagg

SEQ ID NO: 255767 - DNA, 18 bp, Homo sapiens
gcaaatgcacatttgtca

SEQ ID NO: 255768 - DNA, 21 bp, Homo sapiens
gcaaatgccaggacagctgca

SEQ ID NO: 255769 - DNA, 16 bp, Homo sapiens
gcaaattattctagtc

SEQ ID NO: 255770 - DNA, 19 bp, Homo sapiens
gcaaattccacccctcctt

SEQ ID NO: 255771 - DNA, 16 bp, Homo sapiens
gcaaatttcatctttc

SEQ ID NO: 255772 - DNA, 23 bp, Homo sapiens
gcaacaaatacctccattaaatg

SEQ ID NO: 255773 - DNA, 14 bp, Homo sapiens
gcaacaactttgtt

SEQ ID NO: 255774 - DNA, 15 bp, Homo sapiens
gcaacacccaagtcc

SEQ ID NO: 255775 - DNA, 11 bp, Homo sapiens
gcaacagcctg

SEQ ID NO: 255776 - DNA, 12 bp, Homo sapiens
gcaacagcctgt

SEQ ID NO: 255777 - DNA, 21 bp, Homo sapiens
gcaacaggaccaggagccagg

SEQ ID NO: 255778 - DNA, 20 bp, Homo sapiens
gcaacaggttttataatttt

SEQ ID NO: 255779 - DNA, 15 bp, Homo sapiens
gcaacagtgttctga

SEQ ID NO: 255780 - DNA, 17 bp, Homo sapiens
gcaacagtgttctgagc

SEQ ID NO: 255781 - DNA, 21 bp, Homo sapiens
gcaacatctcgagccccctgg

SEQ ID NO: 255782 - DNA, 16 bp, Homo sapiens
gcaacatttccgaaga

SEQ ID NO: 255783 - DNA, 13 bp, Homo sapiens
gcaaccaccacca

SEQ ID NO: 255784 - DNA, 16 bp, Homo sapiens
gcaaccaccaccaacc

SEQ ID NO: 255785 - DNA, 18 bp, Homo sapiens
gcaaccaccaccaaccac

SEQ ID NO: 255786 - DNA, 20 bp, Homo sapiens
gcaaccattcatctttcctt

SEQ ID NO: 255787 - DNA, 20 bp, Homo sapiens
gcaacccctgtacccagctc

SEQ ID NO: 255788 - DNA, 21 bp, Homo sapiens
gcaacccctgtacccagctcc

SEQ ID NO: 255789 - DNA, 17 bp, Homo sapiens
gcaaccctacagtatat

SEQ ID NO: 255790 - DNA, 22 bp, Homo sapiens
gcaacccttagagattgcccca

SEQ ID NO: 255791 - DNA, 15 bp, Homo sapiens
gcaacctatttgact

SEQ ID NO: 255792 - DNA, 12 bp, Homo sapiens
gcaacctcccaa

SEQ ID NO: 255793 - DNA, 17 bp, Homo sapiens
gcaacctcccaacccag

SEQ ID NO: 255794 - DNA, 15 bp, Homo sapiens
gcaacctgtaactgc

SEQ ID NO: 255795 - DNA, 17 bp, Homo sapiens
gcaacctgtaagactga

SEQ ID NO: 255796 - DNA, 14 bp, Homo sapiens
gcaacgaagaaaaa

SEQ ID NO: 255797 - DNA, 18 bp, Homo sapiens
gcaacggggaggccaagt

SEQ ID NO: 255798 - DNA, 23 bp, Homo sapiens
gcaacgtgcgtgtctctgccatg

SEQ ID NO: 255799 - DNA, 12 bp, Homo sapiens
ccccagcccagc

SEQ ID NO: 255800 - DNA, 14 bp, Homo sapiens
ccccagccccaact

SEQ ID NO: 255801 - DNA, 14 bp, Homo sapiens
ccccagccccatcc

SEQ ID NO: 255802 - DNA, 22 bp, Homo sapiens
ccccagccccttctcccagcac

SEQ ID NO: 255803 - DNA, 12 bp, Homo sapiens
ccccagccctgt

SEQ ID NO: 255804 - DNA, 15 bp, Homo sapiens
ccccagccctgtcct

SEQ ID NO: 255805 - DNA, 15 bp, Homo sapiens
ccccagccctgtgga

SEQ ID NO: 255806 - DNA, 16 bp, Homo sapiens
ccccagcccttctgcc

SEQ ID NO: 255807 - DNA, 21 bp, Homo sapiens
ccccagcctaagatgaagagg

SEQ ID NO: 255808 - DNA, 16 bp, Homo sapiens
ccccagcctcccccag

SEQ ID NO: 255809 - DNA, 11 bp, Homo sapiens
ccccagcctga

SEQ ID NO: 255810 - DNA, 20 bp, Homo sapiens
ccccagcctgacctgagact

SEQ ID NO: 255811 - DNA, 21 bp, Homo sapiens
ccccagcctggccacgcagcc

SEQ ID NO: 255812 - DNA, 18 bp, Homo sapiens
ccccagcgtcccagtctc

SEQ ID NO: 255813 - DNA, 15 bp, Homo sapiens
ccccagctgggctgt

SEQ ID NO: 255814 - DNA, 21 bp, Homo sapiens
gcaacttgtctttttctggac

SEQ ID NO: 255815 - DNA, 22 bp, Homo sapiens
gcaacttgtctttttctggact

SEQ ID NO: 255816 - DNA, 15 bp, Homo sapiens
gcaagaaattcatta

SEQ ID NO: 255817 - DNA, 14 bp, Homo sapiens
gcaagaagaatata

SEQ ID NO: 255818 - DNA, 14 bp, Homo sapiens
gcaagaagactgta

SEQ ID NO: 255819 - DNA, 15 bp, Homo sapiens
gcaagaagattctaa

SEQ ID NO: 255820 - DNA, 16 bp, Homo sapiens
gcaagaataaaaaaga

SEQ ID NO: 255821 - DNA, 17 bp, Homo sapiens
gcaagacaatgacactg

SEQ ID NO: 255822 - DNA, 17 bp, Homo sapiens
gcaagacacccagtgga

SEQ ID NO: 255823 - DNA, 22 bp, Homo sapiens
gcaagacacccagtggaaccaa

SEQ ID NO: 255824 - DNA, 19 bp, Homo sapiens
gcaagacagagacgcagga

SEQ ID NO: 255825 - DNA, 17 bp, Homo sapiens
gcaagactctgtctcaa

SEQ ID NO: 255826 - DNA, 18 bp, Homo sapiens
gcaagactgttgctcaaa

SEQ ID NO: 255827 - DNA, 14 bp, Homo sapiens
gcaagagaaatgag

SEQ ID NO: 255828 - DNA, 17 bp, Homo sapiens
gcaagagctcaggagaa

SEQ ID NO: 255829 - DNA, 14 bp, Homo sapiens
gcaagagggaaggt

SEQ ID NO: 255830 - DNA, 16 bp, Homo sapiens
gcaagagggaaggtga

SEQ ID NO: 255831 - DNA, 18 bp, Homo sapiens
gcaagagtatactttgta

SEQ ID NO: 255832 - DNA, 19 bp, Homo sapiens
gcaagatagatttggaata

SEQ ID NO: 255833 - DNA, 13 bp, Homo sapiens
gcaagatatttat

SEQ ID NO: 255834 - DNA, 21 bp, Homo sapiens
gcaagatgatttttaagtaca

SEQ ID NO: 255835 - DNA, 17 bp, Homo sapiens
gcaagattggaaagaca

SEQ ID NO: 255836 - DNA, 18 bp, Homo sapiens
gcaagattggaaagacag

SEQ ID NO: 255837 - DNA, 23 bp, Homo sapiens
gcaagattggaaagacaggaaga

SEQ ID NO: 255838 - DNA, 12 bp, Homo sapiens
gcaagcagggaa

SEQ ID NO: 255839 - DNA, 13 bp, Homo sapiens
gcaagccacagaa

SEQ ID NO: 255840 - DNA, 17 bp, Homo sapiens
gcaagcccactggccag

SEQ ID NO: 255841 - DNA, 18 bp, Homo sapiens
gcaagccccagggcctgg

SEQ ID NO: 255842 - DNA, 20 bp, Homo sapiens
gcaagccccagggcctgggg

SEQ ID NO: 255843 - DNA, 14 bp, Homo sapiens
gcaagcccctcagc

SEQ ID NO: 255844 - DNA, 15 bp, Homo sapiens
gcaagcccctcagcc

SEQ ID NO: 255845 - DNA, 13 bp, Homo sapiens
gcaagctggcagg

SEQ ID NO: 255846 - DNA, 17 bp, Homo sapiens
gcaagctggcaggaggg

SEQ ID NO: 255847 - DNA, 16 bp, Homo sapiens
gcaagcttatttagca

SEQ ID NO: 255848 - DNA, 20 bp, Homo sapiens
gcaaggacattgccccaaga

SEQ ID NO: 255849 - DNA, 14 bp, Homo sapiens
gcaaggaccaggac

SEQ ID NO: 255850 - DNA, 15 bp, Homo sapiens
gcaaggaccaggact

SEQ ID NO: 255851 - DNA, 19 bp, Homo sapiens
gcaaggatgaaagacaaag

SEQ ID NO: 255852 - DNA, 16 bp, Homo sapiens
gcaaggcaagaagtgg

SEQ ID NO: 255853 - DNA, 16 bp, Homo sapiens
gcaaggccagccctgg

SEQ ID NO: 255854 - DNA, 14 bp, Homo sapiens
gcaaggcccacagg

SEQ ID NO: 255855 - DNA, 17 bp, Homo sapiens
gcaaggccttggtgttt

SEQ ID NO: 255856 - DNA, 12 bp, Homo sapiens
gcaaggctgccg

SEQ ID NO: 255857 - DNA, 17 bp, Homo sapiens
gcaaggctgccggctgc

SEQ ID NO: 255858 - DNA, 18 bp, Homo sapiens
gcaaggctgccggctgca

SEQ ID NO: 255859 - DNA, 12 bp, Homo sapiens
gcaagggactgt

SEQ ID NO: 255860 - DNA, 15 bp, Homo sapiens
gcaagggcatcaggc

SEQ ID NO: 255861 - DNA, 13 bp, Homo sapiens
gcaagggctccag

SEQ ID NO: 255862 - DNA, 19 bp, Homo sapiens
gcaagggctccagcatcca

SEQ ID NO: 255863 - DNA, 16 bp, Homo sapiens
gcaaggggctcagaac

SEQ ID NO: 255864 - DNA, 14 bp, Homo sapiens
gcaaggggtgcctg

SEQ ID NO: 255865 - DNA, 18 bp, Homo sapiens
gcaaggggtgcctgggaa

SEQ ID NO: 255866 - DNA, 22 bp, Homo sapiens
gcaaggtctccttactctgagc

SEQ ID NO: 255867 - DNA, 16 bp, Homo sapiens
gcaaggtgagagaggt

SEQ ID NO: 255868 - DNA, 16 bp, Homo sapiens
gcaaggtgggggagcc

SEQ ID NO: 255869 - DNA, 17 bp, Homo sapiens
gcaaggtgggttccagg

SEQ ID NO: 255870 - DNA, 18 bp, Homo sapiens
gcaaggtgggttccaggg

SEQ ID NO: 255871 - DNA, 19 bp, Homo sapiens
gcaaggtgggttccaggga

SEQ ID NO: 255872 - DNA, 22 bp, Homo sapiens
gcaagtcactaaatttctcagt

SEQ ID NO: 255873 - DNA, 18 bp, Homo sapiens
gcaagtccatagctgagc

SEQ ID NO: 255874 - DNA, 21 bp, Homo sapiens
gcaagtcccagacaaggagag

SEQ ID NO: 255875 - DNA, 21 bp, Homo sapiens
gcaagtctgcagcccggcgcc

SEQ ID NO: 255876 - DNA, 18 bp, Homo sapiens
gcaagtgaggcaagagaa

SEQ ID NO: 255877 - DNA, 12 bp, Homo sapiens
gcaagtgattta

SEQ ID NO: 255878 - DNA, 13 bp, Homo sapiens
gcaagtgtacagt

SEQ ID NO: 255879 - DNA, 21 bp, Homo sapiens
gcaagtgtatgcacgtgtgca

SEQ ID NO: 255880 - DNA, 17 bp, Homo sapiens
gcaagtgtctgtgtgca

SEQ ID NO: 255881 - DNA, 12 bp, Homo sapiens
gcaagtgtgtgc

SEQ ID NO: 255882 - DNA, 21 bp, Homo sapiens
gcaagtgtgtgcatgtgtgcg

SEQ ID NO: 255883 - DNA, 12 bp, Homo sapiens
gcaagtgtttct

SEQ ID NO: 255884 - DNA, 15 bp, Homo sapiens
gcaagtgtttctgtt

SEQ ID NO: 255885 - DNA, 16 bp, Homo sapiens
gcaagttcaagactga

SEQ ID NO: 255886 - DNA, 18 bp, Homo sapiens
gcaagttcaagactgaaa

SEQ ID NO: 255887 - DNA, 13 bp, Homo sapiens
gcaataaatggct

SEQ ID NO: 255888 - DNA, 21 bp, Homo sapiens
gcaataagaatttagggagaa

SEQ ID NO: 255889 - DNA, 23 bp, Homo sapiens
gcaataaggggagagtaaccctg

SEQ ID NO: 255890 - DNA, 17 bp, Homo sapiens
gcaatagagactgtaga

SEQ ID NO: 255891 - DNA, 17 bp, Homo sapiens
gcaatagtgtgttctga

SEQ ID NO: 255892 - DNA, 20 bp, Homo sapiens
gcaatagtgtgttctgatta

SEQ ID NO: 255893 - DNA, 21 bp, Homo sapiens
gcaatatattaccagcaagaa

SEQ ID NO: 255894 - DNA, 14 bp, Homo sapiens
gcaatatgtaaata

SEQ ID NO: 255895 - DNA, 12 bp, Homo sapiens
gcaatcctcctg

SEQ ID NO: 255896 - DNA, 17 bp, Homo sapiens
gcaatcctgcaagaaca

SEQ ID NO: 255897 - DNA, 20 bp, Homo sapiens
gcaatctccagggctgcccc

SEQ ID NO: 255898 - DNA, 22 bp, Homo sapiens
gcaatctgggtggtaactgcca

SEQ ID NO: 255899 - DNA, 14 bp, Homo sapiens
gcaatcttctactt

SEQ ID NO: 255900 - DNA, 15 bp, Homo sapiens
gcaatgactgtgagc

SEQ ID NO: 255901 - DNA, 20 bp, Homo sapiens
gcaatgagtgtgttggcttg

SEQ ID NO: 255902 - DNA, 15 bp, Homo sapiens
gcaatgatgtccaga

SEQ ID NO: 255903 - DNA, 15 bp, Homo sapiens
gcaatgtatcccttc

SEQ ID NO: 255904 - DNA, 19 bp, Homo sapiens
gcaatgtcttaaataaaac

SEQ ID NO: 255905 - DNA, 14 bp, Homo sapiens
gcaattaactctgg

SEQ ID NO: 255906 - DNA, 17 bp, Homo sapiens
gcaattccgcatttaat

SEQ ID NO: 255907 - DNA, 21 bp, Homo sapiens
gcaattgcttctctaaaacag

SEQ ID NO: 255908 - DNA, 14 bp, Homo sapiens
gcaattgggatggc

SEQ ID NO: 255909 - DNA, 23 bp, Homo sapiens
gcaatttccattcttttaaatgg

SEQ ID NO: 255910 - DNA, 16 bp, Homo sapiens
gcaatttggcttccct

SEQ ID NO: 255911 - DNA, 19 bp, Homo sapiens
gcaatttgttattctttta

SEQ ID NO: 255912 - DNA, 16 bp, Homo sapiens
gcacaaaccctgggga

SEQ ID NO: 255913 - DNA, 17 bp, Homo sapiens
gcacaaaccctggggac

SEQ ID NO: 255914 - DNA, 23 bp, Homo sapiens
gcacaaagataacgcaggagaga

SEQ ID NO: 255915 - DNA, 12 bp, Homo sapiens
gcacaaatacaa

SEQ ID NO: 255916 - DNA, 15 bp, Homo sapiens
gcacaactctccaaa

SEQ ID NO: 255917 - DNA, 18 bp, Homo sapiens
gcacaagacccctgctcc

SEQ ID NO: 255918 - DNA, 19 bp, Homo sapiens
gcacaagaggaagagagag

SEQ ID NO: 255919 - DNA, 12 bp, Homo sapiens
gcacaagctcag

SEQ ID NO: 255920 - DNA, 23 bp, Homo sapiens
gcacaaggaaagttattttcaga

SEQ ID NO: 255921 - DNA, 16 bp, Homo sapiens
gcacaaggagtgcccg

SEQ ID NO: 255922 - DNA, 17 bp, Homo sapiens
gcacaagttcctggttt

SEQ ID NO: 255923 - DNA, 17 bp, Homo sapiens
gcacaattctgtccctg

SEQ ID NO: 255924 - DNA, 17 bp, Homo sapiens
gcacacaaacacctcct

SEQ ID NO: 255925 - DNA, 14 bp, Homo sapiens
gcacacaatcctat

SEQ ID NO: 255926 - DNA, 14 bp, Homo sapiens
gcacacacacacac

SEQ ID NO: 255927 - DNA, 19 bp, Homo sapiens
gcacacacacacacaggag

SEQ ID NO: 255928 - DNA, 13 bp, Homo sapiens
gcacacacagctc

SEQ ID NO: 255929 - DNA, 19 bp, Homo sapiens
gcacacagctgcagagaca

SEQ ID NO: 255930 - DNA, 21 bp, Homo sapiens
cccccgctgtcagccattcct

SEQ ID NO: 255931 - DNA, 14 bp, Homo sapiens
cccccggaggcgcc

SEQ ID NO: 255932 - DNA, 18 bp, Homo sapiens
cccccggaggcgcccacc

SEQ ID NO: 255933 - DNA, 19 bp, Homo sapiens
cccccggaggcgcccacct

SEQ ID NO: 255934 - DNA, 21 bp, Homo sapiens
cccccggaggcgcccacctgc

SEQ ID NO: 255935 - DNA, 23 bp, Homo sapiens
cccccggaggcgcccacctgccc

SEQ ID NO: 255936 - DNA, 15 bp, Homo sapiens
cccccggcctccagg

SEQ ID NO: 255937 - DNA, 23 bp, Homo sapiens
cccccgtgccaaatcctgggcat

SEQ ID NO: 255938 - DNA, 15 bp, Homo sapiens
cccccgttccagctg

SEQ ID NO: 255939 - DNA, 12 bp, Homo sapiens
ccccctccaggc

SEQ ID NO: 255940 - DNA, 16 bp, Homo sapiens
ccccctccaggcatgc

SEQ ID NO: 255941 - DNA, 14 bp, Homo sapiens
ccccctccagtgct

SEQ ID NO: 255942 - DNA, 18 bp, Homo sapiens
ccccctcccctcccagtc

SEQ ID NO: 255943 - DNA, 10 bp, Homo sapiens
ccccctcctc

SEQ ID NO: 255944 - DNA, 12 bp, Homo sapiens
ccccctcctcca

SEQ ID NO: 255945 - DNA, 14 bp, Homo sapiens
ccccctctcccagt

SEQ ID NO: 255946 - DNA, 10 bp, Homo sapiens
ccccctctct

SEQ ID NO: 255947 - DNA, 16 bp, Homo sapiens
ccccctgccccagaga

SEQ ID NO: 255948 - DNA, 18 bp, Homo sapiens
ccccctggcccctcccac

SEQ ID NO: 255949 - DNA, 23 bp, Homo sapiens
ccccctggggcttctcctgaccc

SEQ ID NO: 255950 - DNA, 18 bp, Homo sapiens
ccccctgtagactagtgc

SEQ ID NO: 255951 - DNA, 13 bp, Homo sapiens
cccccttctccca

SEQ ID NO: 255952 - DNA, 17 bp, Homo sapiens
cccccttctctgctcca

SEQ ID NO: 255953 - DNA, 18 bp, Homo sapiens
ccccctttcagatgtctt

SEQ ID NO: 255954 - DNA, 12 bp, Homo sapiens
gcacagcagcct

SEQ ID NO: 255955 - DNA, 12 bp, Homo sapiens
gcacagcccaac

SEQ ID NO: 255956 - DNA, 19 bp, Homo sapiens
gcacagcccaaccaggagg

SEQ ID NO: 255957 - DNA, 16 bp, Homo sapiens
gcacagccggggcctg

SEQ ID NO: 255958 - DNA, 23 bp, Homo sapiens
gcacagccggggcctgcctagca

SEQ ID NO: 255959 - DNA, 21 bp, Homo sapiens
gcacagcctcacccctgcagg

SEQ ID NO: 255960 - DNA, 19 bp, Homo sapiens
gcacagctaacatggaagt

SEQ ID NO: 255961 - DNA, 10 bp, Homo sapiens
gcacagctct

SEQ ID NO: 255962 - DNA, 19 bp, Homo sapiens
gcacagctctcactggcca

SEQ ID NO: 255963 - DNA, 15 bp, Homo sapiens
gcacagctgctgtgc

SEQ ID NO: 255964 - DNA, 16 bp, Homo sapiens
gcacagctgctgtgcc

SEQ ID NO: 255965 - DNA, 21 bp, Homo sapiens
gcacagctgctgtgccaggac

SEQ ID NO: 255966 - DNA, 12 bp, Homo sapiens
gcacaggcagct

SEQ ID NO: 255967 - DNA, 18 bp, Homo sapiens
gcacaggccacttgctca

SEQ ID NO: 255968 - DNA, 13 bp, Homo sapiens
gcacaggctcctg

SEQ ID NO: 255969 - DNA, 18 bp, Homo sapiens
gcacaggctgccccaccc

SEQ ID NO: 255970 - DNA, 16 bp, Homo sapiens
gcacaggggccccaga

SEQ ID NO: 255971 - DNA, 17 bp, Homo sapiens
gcacagggtctgctctt

SEQ ID NO: 255972 - DNA, 18 bp, Homo sapiens
gcacagggtctgctcttt

SEQ ID NO: 255973 - DNA, 16 bp, Homo sapiens
gcacaggttttcagca

SEQ ID NO: 255974 - DNA, 23 bp, Homo sapiens
gcacagtattatttctccatccc

SEQ ID NO: 255975 - DNA, 15 bp, Homo sapiens
gcacagtgcatctca

SEQ ID NO: 255976 - DNA, 21 bp, Homo sapiens
gcacagtgcatctcagcccac

SEQ ID NO: 255977 - DNA, 22 bp, Homo sapiens
gcacagtgtaatccaggggtgt

SEQ ID NO: 255978 - DNA, 19 bp, Homo sapiens
gcacagttgtctattctga

SEQ ID NO: 255979 - DNA, 21 bp, Homo sapiens
gcacagttgtctattctgagc

SEQ ID NO: 255980 - DNA, 22 bp, Homo sapiens
gcacagttgtctattctgagcc

SEQ ID NO: 255981 - DNA, 15 bp, Homo sapiens
gcacagtttgcaatc

SEQ ID NO: 255982 - DNA, 15 bp, Homo sapiens
gcacatatacatcta

SEQ ID NO: 255983 - DNA, 12 bp, Homo sapiens
gcacatatattt

SEQ ID NO: 255984 - DNA, 17 bp, Homo sapiens
gcacatatattttttac

SEQ ID NO: 255985 - DNA, 18 bp, Homo sapiens
gcacatcatggcagtggg

SEQ ID NO: 255986 - DNA, 19 bp, Homo sapiens
gcacatccaggcaatggcc

SEQ ID NO: 255987 - DNA, 16 bp, Homo sapiens
gcacatctctgcttga

SEQ ID NO: 255988 - DNA, 19 bp, Homo sapiens
gcacatgacaactttgcca

SEQ ID NO: 255989 - DNA, 21 bp, Homo sapiens
gcacatgcactactgaaattt

SEQ ID NO: 255990 - DNA, 14 bp, Homo sapiens
gcacatgctggcca

SEQ ID NO: 255991 - DNA, 19 bp, Homo sapiens
gcacatgctggccagcctg

SEQ ID NO: 255992 - DNA, 21 bp, Homo sapiens
gcacatgctggccagcctggg

SEQ ID NO: 255993 - DNA, 22 bp, Homo sapiens
gcacatgctggccagcctgggg

SEQ ID NO: 255994 - DNA, 23 bp, Homo sapiens
gcacatgtggttttttggtgttt

SEQ ID NO: 255995 - DNA, 20 bp, Homo sapiens
gcacattagagggacagcca

SEQ ID NO: 255996 - DNA, 18 bp, Homo sapiens
gcacattcctggccccgg

SEQ ID NO: 255997 - DNA, 14 bp, Homo sapiens
gcacattctccctt

SEQ ID NO: 255998 - DNA, 16 bp, Homo sapiens
gcacatttccccagac

SEQ ID NO: 255999 - DNA, 19 bp, Homo sapiens
gcacatttccccagacctg

SEQ ID NO: 256000 - DNA, 15 bp, Homo sapiens
gcaccaacctcactg

SEQ ID NO: 256001 - DNA, 17 bp, Homo sapiens
gcaccaacctcactgcc

SEQ ID NO: 256002 - DNA, 22 bp, Homo sapiens
gcaccaacctcactgccctccc

SEQ ID NO: 256003 - DNA, 17 bp, Homo sapiens
gcaccaagcccacaggt

SEQ ID NO: 256004 - DNA, 22 bp, Homo sapiens
gcaccaccctagtcccttcccc

SEQ ID NO: 256005 - DNA, 23 bp, Homo sapiens
gcaccaccctagtcccttcccct

SEQ ID NO: 256006 - DNA, 16 bp, Homo sapiens
gcaccagatgacacat

SEQ ID NO: 256007 - DNA, 21 bp, Homo sapiens
gcaccagcaggtgccatcacg

SEQ ID NO: 256008 - DNA, 14 bp, Homo sapiens
gcaccagccccctg

SEQ ID NO: 256009 - DNA, 15 bp, Homo sapiens
gcaccagccccctgg

SEQ ID NO: 256010 - DNA, 16 bp, Homo sapiens
gcaccagccccctgga

SEQ ID NO: 256011 - DNA, 12 bp, Homo sapiens
gcaccagctgct

SEQ ID NO: 256012 - DNA, 13 bp, Homo sapiens
gcaccagctgctc

SEQ ID NO: 256013 - DNA, 15 bp, Homo sapiens
gcaccagctgctctg

SEQ ID NO: 256014 - DNA, 15 bp, Homo sapiens
gcaccatctctcctc

SEQ ID NO: 256015 - DNA, 15 bp, Homo sapiens
gcaccattcaggaac

SEQ ID NO: 256016 - DNA, 16 bp, Homo sapiens
gcaccattcaggaacc

SEQ ID NO: 256017 - DNA, 22 bp, Homo sapiens
gcaccattctttcttggtgcat

SEQ ID NO: 256018 - DNA, 14 bp, Homo sapiens
gcacccacccctgc

SEQ ID NO: 256019 - DNA, 17 bp, Homo sapiens
gcacccacctccacccc

SEQ ID NO: 256020 - DNA, 17 bp, Homo sapiens
gcacccactcaccaggg

SEQ ID NO: 256021 - DNA, 18 bp, Homo sapiens
gcacccactcaccagggt

SEQ ID NO: 256022 - DNA, 13 bp, Homo sapiens
gcacccagcccaa

SEQ ID NO: 256023 - DNA, 19 bp, Homo sapiens
gcacccagcccaaccggga

SEQ ID NO: 256024 - DNA, 16 bp, Homo sapiens
gcaccccaccacacac

SEQ ID NO: 256025 - DNA, 15 bp, Homo sapiens
gcacccccacccacc

SEQ ID NO: 256026 - DNA, 15 bp, Homo sapiens
gcacccccacccttt

SEQ ID NO: 256027 - DNA, 14 bp, Homo sapiens
gcacccccagcctc

SEQ ID NO: 256028 - DNA, 18 bp, Homo sapiens
gcacccccagcctccccc

SEQ ID NO: 256029 - DNA, 19 bp, Homo sapiens
gcacccccagcctccccca

SEQ ID NO: 256030 - DNA, 21 bp, Homo sapiens
gcacccccagcctcccccagg

SEQ ID NO: 256031 - DNA, 13 bp, Homo sapiens
gcacccccatgct

SEQ ID NO: 256032 - DNA, 22 bp, Homo sapiens
gcacccctccgtgtggagcacg

SEQ ID NO: 256033 - DNA, 16 bp, Homo sapiens
gcacccggcagccccc

SEQ ID NO: 256034 - DNA, 21 bp, Homo sapiens
gcacccggcagccccccagtg

SEQ ID NO: 256035 - DNA, 22 bp, Homo sapiens
gcaccctctgctatgtctgtga

SEQ ID NO: 256036 - DNA, 23 bp, Homo sapiens
gcaccctctgctatgtctgtgat

SEQ ID NO: 256037 - DNA, 22 bp, Homo sapiens
gcaccctggaaaggggagttga

SEQ ID NO: 256038 - DNA, 23 bp, Homo sapiens
gcaccctggaaaggggagttgag

SEQ ID NO: 256039 - DNA, 15 bp, Homo sapiens
gcaccctggggcctg

SEQ ID NO: 256040 - DNA, 20 bp, Homo sapiens
gcaccctggggcctggacct

SEQ ID NO: 256041 - DNA, 21 bp, Homo sapiens
gcaccctggggcctggacctg

SEQ ID NO: 256042 - DNA, 15 bp, Homo sapiens
gcacccttctgctgt

SEQ ID NO: 256043 - DNA, 15 bp, Homo sapiens
gcaccgcagcatgtg

SEQ ID NO: 256044 - DNA, 15 bp, Homo sapiens
gcaccgcagcctgtc

SEQ ID NO: 256045 - DNA, 20 bp, Homo sapiens
gcaccgcccaacccccacct

SEQ ID NO: 256046 - DNA, 23 bp, Homo sapiens
gcaccgcccaacccccacctccc

SEQ ID NO: 256047 - DNA, 16 bp, Homo sapiens
gcaccgcccacccaca

SEQ ID NO: 256048 - DNA, 17 bp, Homo sapiens
gcaccgcccacccacac

SEQ ID NO: 256049 - DNA, 16 bp, Homo sapiens
gcaccggcgctgcagg

SEQ ID NO: 256050 - DNA, 19 bp, Homo sapiens
gcaccgtggtgtgaggccc

SEQ ID NO: 256051 - DNA, 20 bp, Homo sapiens
gcaccgtggtgtgaggcccc

SEQ ID NO: 256052 - DNA, 21 bp, Homo sapiens
gcacctaaaccaccagtgccc

SEQ ID NO: 256053 - DNA, 17 bp, Homo sapiens
gcacctactatgtgctg

SEQ ID NO: 256054 - DNA, 19 bp, Homo sapiens
gcacctactatgtgctggg

SEQ ID NO: 256055 - DNA, 16 bp, Homo sapiens
gcacctagtccagtga

SEQ ID NO: 256056 - DNA, 21 bp, Homo sapiens
gcacctatgagatggccatgc

SEQ ID NO: 256057 - DNA, 22 bp, Homo sapiens
gcacctatgagatggccatgct

SEQ ID NO: 256058 - DNA, 24 bp, Homo sapiens
gcacctatgagatggccatgctca

SEQ ID NO: 256059 - DNA, 10 bp, Homo sapiens
gcacctcaga

SEQ ID NO: 256060 - DNA, 16 bp, Homo sapiens
cccctctcctgcatcc

SEQ ID NO: 256061 - DNA, 12 bp, Homo sapiens
cccctctgccca

SEQ ID NO: 256062 - DNA, 12 bp, Homo sapiens
cccctctgctgg

SEQ ID NO: 256063 - DNA, 14 bp, Homo sapiens
cccctctgctggcc

SEQ ID NO: 256064 - DNA, 16 bp, Homo sapiens
cccctctgctgtcctg

SEQ ID NO: 256065 - DNA, 19 bp, Homo sapiens
cccctctgctgtcctgcag

SEQ ID NO: 256066 - DNA, 16 bp, Homo sapiens
cccctctggccaggat

SEQ ID NO: 256067 - DNA, 18 bp, Homo sapiens
cccctctgtctacaaata

SEQ ID NO: 256068 - DNA, 21 bp, Homo sapiens
cccctcttccctgtcttcccc

SEQ ID NO: 256069 - DNA, 16 bp, Homo sapiens
cccctcttttggcctt

SEQ ID NO: 256070 - DNA, 22 bp, Homo sapiens
cccctgaggacaggggcatctc

SEQ ID NO: 256071 - DNA, 18 bp, Homo sapiens
cccctgaggacctttctg

SEQ ID NO: 256072 - DNA, 12 bp, Homo sapiens
cccctgcaccca

SEQ ID NO: 256073 - DNA, 14 bp, Homo sapiens
cccctgcacccacc

SEQ ID NO: 256074 - DNA, 11 bp, Homo sapiens
cccctgcactg

SEQ ID NO: 256075 - DNA, 14 bp, Homo sapiens
cccctgcactgtaa

SEQ ID NO: 256076 - DNA, 17 bp, Homo sapiens
cccctgcactgtaaaat

SEQ ID NO: 256077 - DNA, 11 bp, Homo sapiens
cccctgcaggg

SEQ ID NO: 256078 - DNA, 17 bp, Homo sapiens
cccctgccacctcctgc

SEQ ID NO: 256079 - DNA, 12 bp, Homo sapiens
cccctgccagca

SEQ ID NO: 256080 - DNA, 13 bp, Homo sapiens
cccctgccccaga

SEQ ID NO: 256081 - DNA, 17 bp, Homo sapiens
cccctgccccagagaag

SEQ ID NO: 256082 - DNA, 23 bp, Homo sapiens
cccctgccccagagaagcctcag

SEQ ID NO: 256083 - DNA, 14 bp, Homo sapiens
cccctgccccgtca

SEQ ID NO: 256084 - DNA, 15 bp, Homo sapiens
cccctgccccgtcac

SEQ ID NO: 256085 - DNA, 19 bp, Homo sapiens
cccctgccccgtcccctgg

SEQ ID NO: 256086 - DNA, 22 bp, Homo sapiens
cccctgcccgaccccatctcat

SEQ ID NO: 256087 - DNA, 17 bp, Homo sapiens
cccctgcccgagagctc

SEQ ID NO: 256088 - DNA, 13 bp, Homo sapiens
cccctgcccgccc

SEQ ID NO: 256089 - DNA, 13 bp, Homo sapiens
cccctgccgcctg

SEQ ID NO: 256090 - DNA, 13 bp, Homo sapiens
cccctgccggcct

SEQ ID NO: 256091 - DNA, 23 bp, Homo sapiens
cccctgccggccttggccttggg

SEQ ID NO: 256092 - DNA, 18 bp, Homo sapiens
gcaccttcccctgaggac

SEQ ID NO: 256093 - DNA, 13 bp, Homo sapiens
gcaccttgggcac

SEQ ID NO: 256094 - DNA, 18 bp, Homo sapiens
gcaccttgtcatgtacca

SEQ ID NO: 256095 - DNA, 21 bp, Homo sapiens
gcaccttttataccagagacc

SEQ ID NO: 256096 - DNA, 13 bp, Homo sapiens
gcacgcacctgta

SEQ ID NO: 256097 - DNA, 15 bp, Homo sapiens
gcacgggagagcgcc

SEQ ID NO: 256098 - DNA, 14 bp, Homo sapiens
gcacgtcgccatcc

SEQ ID NO: 256099 - DNA, 16 bp, Homo sapiens
gcacgtggagagctgg

SEQ ID NO: 256100 - DNA, 18 bp, Homo sapiens
gcacgtggagatagtgcc

SEQ ID NO: 256101 - DNA, 13 bp, Homo sapiens
gcacgtggcctct

SEQ ID NO: 256102 - DNA, 23 bp, Homo sapiens
gcactaaaacccatcttccccgg

SEQ ID NO: 256103 - DNA, 22 bp, Homo sapiens
gcactaaaagtgatgtgattta

SEQ ID NO: 256104 - DNA, 20 bp, Homo sapiens
gcactaaagtatgtaaagta

SEQ ID NO: 256105 - DNA, 16 bp, Homo sapiens
gcactacataaactga

SEQ ID NO: 256106 - DNA, 16 bp, Homo sapiens
gcactaccgattcttt

SEQ ID NO: 256107 - DNA, 13 bp, Homo sapiens
gcactactcctct

SEQ ID NO: 256108 - DNA, 17 bp, Homo sapiens
gcactactgacatgtgg

SEQ ID NO: 256109 - DNA, 19 bp, Homo sapiens
gcactacttacttagagat

SEQ ID NO: 256110 - DNA, 22 bp, Homo sapiens
gcactagcattttcttgaacca

SEQ ID NO: 256111 - DNA, 15 bp, Homo sapiens
gcactatagccattt

SEQ ID NO: 256112 - DNA, 22 bp, Homo sapiens
gcactatagccatttgccccaa

SEQ ID NO: 256113 - DNA, 16 bp, Homo sapiens
gcactccatgagcacc

SEQ ID NO: 256114 - DNA, 13 bp, Homo sapiens
gcactcccagggc

SEQ ID NO: 256115 - DNA, 16 bp, Homo sapiens
gcactcccagggcccg

SEQ ID NO: 256116 - DNA, 19 bp, Homo sapiens
gcactcccagggcccgagc

SEQ ID NO: 256117 - DNA, 21 bp, Homo sapiens
gcactcccagggcccgagcgc

SEQ ID NO: 256118 - DNA, 16 bp, Homo sapiens
gcactcctgattttta

SEQ ID NO: 256119 - DNA, 20 bp, Homo sapiens
gcactcgagaccatcctggc

SEQ ID NO: 256120 - DNA, 21 bp, Homo sapiens
gcactcgagaccatcctggcc

SEQ ID NO: 256121 - DNA, 17 bp, Homo sapiens
gcactctctgccagctc

SEQ ID NO: 256122 - DNA, 18 bp, Homo sapiens
gcactctctgccagctcc

SEQ ID NO: 256123 - DNA, 12 bp, Homo sapiens
gcactctgctgg

SEQ ID NO: 256124 - DNA, 19 bp, Homo sapiens
gcactcttttgagcagtaa

SEQ ID NO: 256125 - DNA, 22 bp, Homo sapiens
gcactgaaggctttcagggcct

SEQ ID NO: 256126 - DNA, 22 bp, Homo sapiens
gcactgacctgctccgccagga

SEQ ID NO: 256127 - DNA, 17 bp, Homo sapiens
gcactgactgggcatag

SEQ ID NO: 256128 - DNA, 15 bp, Homo sapiens
gcactgagatattta

SEQ ID NO: 256129 - DNA, 13 bp, Homo sapiens
gcactgagggcca

SEQ ID NO: 256130 - DNA, 20 bp, Homo sapiens
gcactgagggccacactatt

SEQ ID NO: 256131 - DNA, 24 bp, Homo sapiens
gcactgagggccacactattacca

SEQ ID NO: 256132 - DNA, 18 bp, Homo sapiens
gcactgagggtctggtgc

SEQ ID NO: 256133 - DNA, 19 bp, Homo sapiens
gcactgagggtctggtgcc

SEQ ID NO: 256134 - DNA, 12 bp, Homo sapiens
gcactgatttca

SEQ ID NO: 256135 - DNA, 12 bp, Homo sapiens
gcactgctgccc

SEQ ID NO: 256136 - DNA, 16 bp, Homo sapiens
gcactggaaaacatag

SEQ ID NO: 256137 - DNA, 22 bp, Homo sapiens
gcactggaaaacatagagtaga

SEQ ID NO: 256138 - DNA, 16 bp, Homo sapiens
gcactggccagagagg

SEQ ID NO: 256139 - DNA, 19 bp, Homo sapiens
gcactggccagagagggcc

SEQ ID NO: 256140 - DNA, 13 bp, Homo sapiens
gcactggctgctc

SEQ ID NO: 256141 - DNA, 16 bp, Homo sapiens
gcactgggggaacaga

SEQ ID NO: 256142 - DNA, 17 bp, Homo sapiens
gcactggggtaccacat

SEQ ID NO: 256143 - DNA, 19 bp, Homo sapiens
gcactggtggcccgacagc

SEQ ID NO: 256144 - DNA, 19 bp, Homo sapiens
gcactggtttgtttctcaa

SEQ ID NO: 256145 - DNA, 9 bp, Homo sapiens
gcactgtaa

SEQ ID NO: 256146 - DNA, 14 bp, Homo sapiens
gcactgtaaaatgt

SEQ ID NO: 256147 - DNA, 20 bp, Homo sapiens
gcactgtcactttgctctgg

SEQ ID NO: 256148 - DNA, 19 bp, Homo sapiens
gcactgtctcagtttcact

SEQ ID NO: 256149 - DNA, 17 bp, Homo sapiens
gcactgtgtaaccagca

SEQ ID NO: 256150 - DNA, 17 bp, Homo sapiens
gcactgtgtttatatgt

SEQ ID NO: 256151 - DNA, 19 bp, Homo sapiens
gcacttagctatcagaaga

SEQ ID NO: 256152 - DNA, 12 bp, Homo sapiens
gcacttccaaaa

SEQ ID NO: 256153 - DNA, 18 bp, Homo sapiens
gcacttccaaaattctta

SEQ ID NO: 256154 - DNA, 21 bp, Homo sapiens
gcacttcttttccaaaaatac

SEQ ID NO: 256155 - DNA, 16 bp, Homo sapiens
gcacttgcgtcctgca

SEQ ID NO: 256156 - DNA, 14 bp, Homo sapiens
gcacttggcctctg

SEQ ID NO: 256157 - DNA, 16 bp, Homo sapiens
gcacttggtgctgcgc

SEQ ID NO: 256158 - DNA, 15 bp, Homo sapiens
gcacttggtgctgct

SEQ ID NO: 256159 - DNA, 17 bp, Homo sapiens
gcactttagtgattgct

SEQ ID NO: 256160 - DNA, 16 bp, Homo sapiens
gcactttataaacact

SEQ ID NO: 256161 - DNA, 17 bp, Homo sapiens
gcactttataagccaat

SEQ ID NO: 256162 - DNA, 22 bp, Homo sapiens
gcactttccctagaaagccata

SEQ ID NO: 256163 - DNA, 12 bp, Homo sapiens
gcactttgaaaa

SEQ ID NO: 256164 - DNA, 14 bp, Homo sapiens
gcactttgggaggc

SEQ ID NO: 256165 - DNA, 21 bp, Homo sapiens
gcacttttcctgtctcagcct

SEQ ID NO: 256166 - DNA, 17 bp, Homo sapiens
gcactttttcacataag

SEQ ID NO: 256167 - DNA, 21 bp, Homo sapiens
gcagaaaagaggagaccctgg

SEQ ID NO: 256168 - DNA, 22 bp, Homo sapiens
gcagaaaagaggagaccctgga

SEQ ID NO: 256169 - DNA, 19 bp, Homo sapiens
gcagaaacacaaccactca

SEQ ID NO: 256170 - DNA, 16 bp, Homo sapiens
gcagaaacccccagga

SEQ ID NO: 256171 - DNA, 17 bp, Homo sapiens
gcagaaacccccaggag

SEQ ID NO: 256172 - DNA, 16 bp, Homo sapiens
gcagaaaccttgtttg

SEQ ID NO: 256173 - DNA, 17 bp, Homo sapiens
gcagaaagcagaggctg

SEQ ID NO: 256174 - DNA, 20 bp, Homo sapiens
gcagaaatcccagttcatgt

SEQ ID NO: 256175 - DNA, 12 bp, Homo sapiens
gcagaacacctg

SEQ ID NO: 256176 - DNA, 21 bp, Homo sapiens
gcagaaccagctctttggtgc

SEQ ID NO: 256177 - DNA, 14 bp, Homo sapiens
gcagaaccctggtg

SEQ ID NO: 256178 - DNA, 21 bp, Homo sapiens
gcagaacctggtggctggagg

SEQ ID NO: 256179 - DNA, 15 bp, Homo sapiens
gcagaagcgtctccc

SEQ ID NO: 256180 - DNA, 22 bp, Homo sapiens
gcagaaggaagggcatccttct

SEQ ID NO: 256181 - DNA, 21 bp, Homo sapiens
gcagaaggaggaagggactgg

SEQ ID NO: 256182 - DNA, 13 bp, Homo sapiens
gcagaagggaatt

SEQ ID NO: 256183 - DNA, 16 bp, Homo sapiens
gcagaagtcagcccga

SEQ ID NO: 256184 - DNA, 16 bp, Homo sapiens
gcagaagtgctctttg

SEQ ID NO: 256185 - DNA, 17 bp, Homo sapiens
gcagaatcctggccctc

SEQ ID NO: 256186 - DNA, 23 bp, Homo sapiens
gcagaatctttgcaagaaagtca

SEQ ID NO: 256187 - DNA, 21 bp, Homo sapiens
gcagacaaaaagaacaaaaaa

SEQ ID NO: 256188 - DNA, 17 bp, Homo sapiens
gcagacacacaacatca

SEQ ID NO: 256189 - DNA, 12 bp, Homo sapiens
gcagacacacac

SEQ ID NO: 256190 - DNA, 13 bp, Homo sapiens
gcagacacatgct

SEQ ID NO: 256191 - DNA, 11 bp, Homo sapiens
cccgccaggtc

SEQ ID NO: 256192 - DNA, 13 bp, Homo sapiens
cccgcccaccccg

SEQ ID NO: 256193 - DNA, 16 bp, Homo sapiens
cccgcccaccccgctg

SEQ ID NO: 256194 - DNA, 16 bp, Homo sapiens
cccgcccacctctgct

SEQ ID NO: 256195 - DNA, 19 bp, Homo sapiens
cccgcccacctctgctgcc

SEQ ID NO: 256196 - DNA, 14 bp, Homo sapiens
cccgcccacctggg

SEQ ID NO: 256197 - DNA, 17 bp, Homo sapiens
cccgcccactgtcctgg

SEQ ID NO: 256198 - DNA, 11 bp, Homo sapiens
cccgccccaga

SEQ ID NO: 256199 - DNA, 13 bp, Homo sapiens
cccgccccagaga

SEQ ID NO: 256200 - DNA, 15 bp, Homo sapiens
cccgccccagagact

SEQ ID NO: 256201 - DNA, 16 bp, Homo sapiens
cccgccccagagactg

SEQ ID NO: 256202 - DNA, 21 bp, Homo sapiens
cccgccccagagactgcccac

SEQ ID NO: 256203 - DNA, 14 bp, Homo sapiens
cccgccccagagct

SEQ ID NO: 256204 - DNA, 17 bp, Homo sapiens
cccgccccccagagcca

SEQ ID NO: 256205 - DNA, 22 bp, Homo sapiens
cccgccccccagagccagggct

SEQ ID NO: 256206 - DNA, 23 bp, Homo sapiens
cccgccccccagagccagggctg

SEQ ID NO: 256207 - DNA, 18 bp, Homo sapiens
cccgcccccgccctcgct

SEQ ID NO: 256208 - DNA, 17 bp, Homo sapiens
cccgccccctccctata

SEQ ID NO: 256209 - DNA, 13 bp, Homo sapiens
cccgcccgcgtcc

SEQ ID NO: 256210 - DNA, 17 bp, Homo sapiens
cccgccctcaggctccg

SEQ ID NO: 256211 - DNA, 16 bp, Homo sapiens
cccgccctcctctgcc

SEQ ID NO: 256212 - DNA, 17 bp, Homo sapiens
cccgcccttcttttgac

SEQ ID NO: 256213 - DNA, 18 bp, Homo sapiens
cccgccgcctcgggccgc

SEQ ID NO: 256214 - DNA, 21 bp, Homo sapiens
cccgccggttggccggctggc

SEQ ID NO: 256215 - DNA, 23 bp, Homo sapiens
cccgccggttggccggctggccg

SEQ ID NO: 256216 - DNA, 19 bp, Homo sapiens
cccgcctcccccgcaggtt

SEQ ID NO: 256217 - DNA, 14 bp, Homo sapiens
cccgcctgccgtgc

SEQ ID NO: 256218 - DNA, 18 bp, Homo sapiens
cccgcctgccgtgcatgg

SEQ ID NO: 256219 - DNA, 22 bp, Homo sapiens
cccgcctggcagaactgagctc

SEQ ID NO: 256220 - DNA, 17 bp, Homo sapiens
cccgccttcctcctcca

SEQ ID NO: 256221 - DNA, 15 bp, Homo sapiens
cccgcgcgtgccccc

SEQ ID NO: 256222 - DNA, 16 bp, Homo sapiens
cccgcgcgtgccccca

SEQ ID NO: 256223 - DNA, 18 bp, Homo sapiens
cccgcgcgtgcccccagc

SEQ ID NO: 256224 - DNA, 16 bp, Homo sapiens
cccgcggtgctctggc

SEQ ID NO: 256225 - DNA, 20 bp, Homo sapiens
cccgcggtgctctggcggct

SEQ ID NO: 256226 - DNA, 17 bp, Homo sapiens
cccgcgttcaagacttg

SEQ ID NO: 256227 - DNA, 12 bp, Homo sapiens
cccgctcagccc

SEQ ID NO: 256228 - DNA, 15 bp, Homo sapiens
cccgctcagccctcc

SEQ ID NO: 256229 - DNA, 19 bp, Homo sapiens
cccgctcagccctccctgc

SEQ ID NO: 256230 - DNA, 16 bp, Homo sapiens
gcagaggctgagcagg

SEQ ID NO: 256231 - DNA, 12 bp, Homo sapiens
gcagaggctggc

SEQ ID NO: 256232 - DNA, 18 bp, Homo sapiens
gcagaggctggcctcaga

SEQ ID NO: 256233 - DNA, 19 bp, Homo sapiens
gcagaggggagaggaagca

SEQ ID NO: 256234 - DNA, 14 bp, Homo sapiens
gcagaggggcagcc

SEQ ID NO: 256235 - DNA, 15 bp, Homo sapiens
gcagaggggcagccg

SEQ ID NO: 256236 - DNA, 21 bp, Homo sapiens
gcagaggggcagccgctagga

SEQ ID NO: 256237 - DNA, 17 bp, Homo sapiens
gcagaggtcccctgagg

SEQ ID NO: 256238 - DNA, 19 bp, Homo sapiens
gcagaggtcccctgaggtc

SEQ ID NO: 256239 - DNA, 22 bp, Homo sapiens
gcagagtcagccattcctgttc

SEQ ID NO: 256240 - DNA, 17 bp, Homo sapiens
gcagagtgccccacctg

SEQ ID NO: 256241 - DNA, 14 bp, Homo sapiens
gcagagttctttgc

SEQ ID NO: 256242 - DNA, 16 bp, Homo sapiens
gcagataactggttac

SEQ ID NO: 256243 - DNA, 17 bp, Homo sapiens
gcagatatgtattactt

SEQ ID NO: 256244 - DNA, 15 bp, Homo sapiens
gcagatctagccagg

SEQ ID NO: 256245 - DNA, 16 bp, Homo sapiens
gcagatctagccaggc

SEQ ID NO: 256246 - DNA, 17 bp, Homo sapiens
gcagatctagccaggcc

SEQ ID NO: 256247 - DNA, 14 bp, Homo sapiens
gcagatctgtgccc

SEQ ID NO: 256248 - DNA, 22 bp, Homo sapiens
gcagatctgtgccccatgcctg

SEQ ID NO: 256249 - DNA, 15 bp, Homo sapiens
gcagatgacccctcc

SEQ ID NO: 256250 - DNA, 18 bp, Homo sapiens
gcagatggagaccccttg

SEQ ID NO: 256251 - DNA, 17 bp, Homo sapiens
gcagattcctgggcctg

SEQ ID NO: 256252 - DNA, 21 bp, Homo sapiens
gcagattcctgggcctgtccc

SEQ ID NO: 256253 - DNA, 16 bp, Homo sapiens
gcagatttcagatgta

SEQ ID NO: 256254 - DNA, 23 bp, Homo sapiens
gcagatttcagatgtaagaagcc

SEQ ID NO: 256255 - DNA, 14 bp, Homo sapiens
gcagatttctcacc

SEQ ID NO: 256256 - DNA, 15 bp, Homo sapiens
gcagcaaaggaagac

SEQ ID NO: 256257 - DNA, 20 bp, Homo sapiens
gcagcaacacccaagtccac

SEQ ID NO: 256258 - DNA, 21 bp, Homo sapiens
gcagcaacacccaagtccacc

SEQ ID NO: 256259 - DNA, 14 bp, Homo sapiens
gcagcaacaggacc

SEQ ID NO: 256260 - DNA, 16 bp, Homo sapiens
gcagcaacaggaccag

SEQ ID NO: 256261 - DNA, 21 bp, Homo sapiens
gcagcaacaggaccaggagcc

SEQ ID NO: 256262 - DNA, 15 bp, Homo sapiens
gcagcaaccattcat

SEQ ID NO: 256263 - DNA, 21 bp, Homo sapiens
gcagcacaaagaaacagcctt

SEQ ID NO: 256264 - DNA, 13 bp, Homo sapiens
gcagcacaattct

SEQ ID NO: 256265 - DNA, 14 bp, Homo sapiens
gcagcacagagagg

SEQ ID NO: 256266 - DNA, 20 bp, Homo sapiens
gcagcaccagcctgagccac

SEQ ID NO: 256267 - DNA, 20 bp, Homo sapiens
gcagcaccctttcaccccca

SEQ ID NO: 256268 - DNA, 16 bp, Homo sapiens
gcagcactgaaatatc

SEQ ID NO: 256269 - DNA, 21 bp, Homo sapiens
gcagcactgggaagctggagt

SEQ ID NO: 256270 - DNA, 13 bp, Homo sapiens
gcagcagagcctg

SEQ ID NO: 256271 - DNA, 14 bp, Homo sapiens
gcagcagcccagct

SEQ ID NO: 256272 - DNA, 17 bp, Homo sapiens
gcagcagctaggactga

SEQ ID NO: 256273 - DNA, 20 bp, Homo sapiens
gcagcagctaggactgagga

SEQ ID NO: 256274 - DNA, 18 bp, Homo sapiens
gcagcagctccgcctggc

SEQ ID NO: 256275 - DNA, 21 bp, Homo sapiens
gcagcagctgggacccctccc

SEQ ID NO: 256276 - DNA, 23 bp, Homo sapiens
gcagcagcttttaatacagggta

SEQ ID NO: 256277 - DNA, 15 bp, Homo sapiens
gcagcaggcagagga

SEQ ID NO: 256278 - DNA, 16 bp, Homo sapiens
gcagcaggcagaggag

SEQ ID NO: 256279 - DNA, 18 bp, Homo sapiens
gcagcaggcagaggagag

SEQ ID NO: 256280 - DNA, 20 bp, Homo sapiens
gcagcagtaccatcccactg

SEQ ID NO: 256281 - DNA, 21 bp, Homo sapiens
gcagcagtgagtctcttcaga

SEQ ID NO: 256282 - DNA, 23 bp, Homo sapiens
gcagcatacaaaaatatattaaa

SEQ ID NO: 256283 - DNA, 15 bp, Homo sapiens
gcagcatctgctaat

SEQ ID NO: 256284 - DNA, 17 bp, Homo sapiens
gcagcatgtggggaagc

SEQ ID NO: 256285 - DNA, 14 bp, Homo sapiens
gcagccactattgt

SEQ ID NO: 256286 - DNA, 12 bp, Homo sapiens
gcagccagccag

SEQ ID NO: 256287 - DNA, 15 bp, Homo sapiens
gcagccagccagtct

SEQ ID NO: 256288 - DNA, 20 bp, Homo sapiens
gcagccagccagtcttgcct

SEQ ID NO: 256289 - DNA, 13 bp, Homo sapiens
gcagccagccgtg

SEQ ID NO: 256290 - DNA, 13 bp, Homo sapiens
gcagccaggacac

SEQ ID NO: 256291 - DNA, 15 bp, Homo sapiens
gcagccatgagaaca

SEQ ID NO: 256292 - DNA, 20 bp, Homo sapiens
gcagccatgcctcatgccac

SEQ ID NO: 256293 - DNA, 23 bp, Homo sapiens
gcagccatgcctcatgccacacc

SEQ ID NO: 256294 - DNA, 13 bp, Homo sapiens
gcagcccacagag

SEQ ID NO: 256295 - DNA, 14 bp, Homo sapiens
gcagcccacagagg

SEQ ID NO: 256296 - DNA, 18 bp, Homo sapiens
gcagcccacagaggacag

SEQ ID NO: 256297 - DNA, 11 bp, Homo sapiens
gcagcccagag

SEQ ID NO: 256298 - DNA, 12 bp, Homo sapiens
gcagcccagaga

SEQ ID NO: 256299 - DNA, 13 bp, Homo sapiens
gcagcccagcttc

SEQ ID NO: 256300 - DNA, 17 bp, Homo sapiens
gcagcccaggccggggt

SEQ ID NO: 256301 - DNA, 22 bp, Homo sapiens
gcagcccatgcccacctgccca

SEQ ID NO: 256302 - DNA, 20 bp, Homo sapiens
gcagccccacttcaccccca

SEQ ID NO: 256303 - DNA, 14 bp, Homo sapiens
gcagccccaggacc

SEQ ID NO: 256304 - DNA, 23 bp, Homo sapiens
gcagccccccagtgtccccaggg

SEQ ID NO: 256305 - DNA, 19 bp, Homo sapiens
gcagccccctccacaccag

SEQ ID NO: 256306 - DNA, 12 bp, Homo sapiens
gcagcccctgga

SEQ ID NO: 256307 - DNA, 15 bp, Homo sapiens
gcagcccgggagatc

SEQ ID NO: 256308 - DNA, 15 bp, Homo sapiens
gcagcccgtgaagca

SEQ ID NO: 256309 - DNA, 22 bp, Homo sapiens
gcagcccgtgaagcagtgcctc

SEQ ID NO: 256310 - DNA, 15 bp, Homo sapiens
gcagcccgtgtggcc

SEQ ID NO: 256311 - DNA, 18 bp, Homo sapiens
gcagcccgtgtggcccct

SEQ ID NO: 256312 - DNA, 23 bp, Homo sapiens
gcagccctaaggatctctcagga

SEQ ID NO: 256313 - DNA, 20 bp, Homo sapiens
gcagccctgctgctgcctgc

SEQ ID NO: 256314 - DNA, 13 bp, Homo sapiens
gcagccctgcttt

SEQ ID NO: 256315 - DNA, 14 bp, Homo sapiens
gcagccctgctttg

SEQ ID NO: 256316 - DNA, 16 bp, Homo sapiens
gcagcccttcctcctg

SEQ ID NO: 256317 - DNA, 17 bp, Homo sapiens
gcagcccttcctcctga

SEQ ID NO: 256318 - DNA, 12 bp, Homo sapiens
gcagcccttggg

SEQ ID NO: 256319 - DNA, 16 bp, Homo sapiens
gcagcccttgggcagt

SEQ ID NO: 256320 - DNA, 21 bp, Homo sapiens
gcagccgcgctctgcccctcc

SEQ ID NO: 256321 - DNA, 17 bp, Homo sapiens
gcagccgctaggagaga

SEQ ID NO: 256322 - DNA, 14 bp, Homo sapiens
gcaggcggtcccca

SEQ ID NO: 256323 - DNA, 18 bp, Homo sapiens
gcaggctctgggctcagg

SEQ ID NO: 256324 - DNA, 22 bp, Homo sapiens
gcaggctctgggctcagggctg

SEQ ID NO: 256325 - DNA, 20 bp, Homo sapiens
gcaggctgcagcaggcagag

SEQ ID NO: 256326 - DNA, 16 bp, Homo sapiens
gcaggctggcaccgcc

SEQ ID NO: 256327 - DNA, 23 bp, Homo sapiens
gcaggctggcagctctccagtca

SEQ ID NO: 256328 - DNA, 21 bp, Homo sapiens
gcaggctttgggaacactggc

SEQ ID NO: 256329 - DNA, 23 bp, Homo sapiens
gcaggctttgggaacactggcct

SEQ ID NO: 256330 - DNA, 14 bp, Homo sapiens
gcagggaagagggc

SEQ ID NO: 256331 - DNA, 22 bp, Homo sapiens
gcagggacacgggcagcctggc

SEQ ID NO: 256332 - DNA, 15 bp, Homo sapiens
gcagggagaccctgg

SEQ ID NO: 256333 - DNA, 18 bp, Homo sapiens
gcagggagaccctgggag

SEQ ID NO: 256334 - DNA, 17 bp, Homo sapiens
gcagggagcgcggcagc

SEQ ID NO: 256335 - DNA, 17 bp, Homo sapiens
gcagggagggcttgggg

SEQ ID NO: 256336 - DNA, 15 bp, Homo sapiens
gcagggaggtcaggc

SEQ ID NO: 256337 - DNA, 18 bp, Homo sapiens
gcagggaggtcaggccct

SEQ ID NO: 256338 - DNA, 20 bp, Homo sapiens
gcagggaggtcaggccctgg

SEQ ID NO: 256339 - DNA, 15 bp, Homo sapiens
gcagggagtgtctgc

SEQ ID NO: 256340 - DNA, 14 bp, Homo sapiens
gcagggatttgagg

SEQ ID NO: 256341 - DNA, 12 bp, Homo sapiens
gcagggcagccg

SEQ ID NO: 256342 - DNA, 13 bp, Homo sapiens
gcagggcagcctg

SEQ ID NO: 256343 - DNA, 16 bp, Homo sapiens
gcagggcagggcggct

SEQ ID NO: 256344 - DNA, 16 bp, Homo sapiens
gcagggcctggcctgg

SEQ ID NO: 256345 - DNA, 17 bp, Homo sapiens
gcagggcctggcctggt

SEQ ID NO: 256346 - DNA, 19 bp, Homo sapiens
gcagggcgctccggcagag

SEQ ID NO: 256347 - DNA, 21 bp, Homo sapiens
gcagggcgctccggcagaggc

SEQ ID NO: 256348 - DNA, 19 bp, Homo sapiens
gcagggcggctaggccggc

SEQ ID NO: 256349 - DNA, 13 bp, Homo sapiens
gcaggggagccag

SEQ ID NO: 256350 - DNA, 14 bp, Homo sapiens
gcaggggctctgct

SEQ ID NO: 256351 - DNA, 15 bp, Homo sapiens
gcaggggctgggcag

SEQ ID NO: 256352 - DNA, 21 bp, Homo sapiens
gcagggtcccatttctcactg

SEQ ID NO: 256353 - DNA, 19 bp, Homo sapiens
gcagggtctttgtgtgctg

SEQ ID NO: 256354 - DNA, 17 bp, Homo sapiens
gcagggtgggcagccta

SEQ ID NO: 256355 - DNA, 18 bp, Homo sapiens
gcagggtggtgctgggac

SEQ ID NO: 256356 - DNA, 17 bp, Homo sapiens
gcagggttctagaaggg

SEQ ID NO: 256357 - DNA, 23 bp, Homo sapiens
gcaggtagatcgcttgagcccag

SEQ ID NO: 256358 - DNA, 23 bp, Homo sapiens
gcaggtcccgagccccctgtcct

SEQ ID NO: 256359 - DNA, 19 bp, Homo sapiens
gcaggtcctggggaggctg

SEQ ID NO: 256360 - DNA, 21 bp, Homo sapiens
gcaggtcctggggaggctgag

SEQ ID NO: 256361 - DNA, 14 bp, Homo sapiens
gcaggtctgcaggc

SEQ ID NO: 256362 - DNA, 17 bp, Homo sapiens
gcaggtgaccttctggg

SEQ ID NO: 256363 - DNA, 12 bp, Homo sapiens
gcaggtgccatc

SEQ ID NO: 256364 - DNA, 12 bp, Homo sapiens
gcaggtgctgcc

SEQ ID NO: 256365 - DNA, 12 bp, Homo sapiens
gcaggtggccag

SEQ ID NO: 256366 - DNA, 13 bp, Homo sapiens
gcaggtggccagg

SEQ ID NO: 256367 - DNA, 15 bp, Homo sapiens
gcaggtggccagggc

SEQ ID NO: 256368 - DNA, 13 bp, Homo sapiens
gcaggtggggagg

SEQ ID NO: 256369 - DNA, 18 bp, Homo sapiens
gcaggtgtggtggctcat

SEQ ID NO: 256370 - DNA, 19 bp, Homo sapiens
gcaggttatgtcagcagct

SEQ ID NO: 256371 - DNA, 17 bp, Homo sapiens
gcaggttctctcctgtg

SEQ ID NO: 256372 - DNA, 12 bp, Homo sapiens
ccctccactcct

SEQ ID NO: 256373 - DNA, 13 bp, Homo sapiens
ccctccactcctc

SEQ ID NO: 256374 - DNA, 19 bp, Homo sapiens
ccctccactcctcccaact

SEQ ID NO: 256375 - DNA, 17 bp, Homo sapiens
ccctccactccttcctg

SEQ ID NO: 256376 - DNA, 15 bp, Homo sapiens
ccctccactgccctc

SEQ ID NO: 256377 - DNA, 11 bp, Homo sapiens
ccctccagacc

SEQ ID NO: 256378 - DNA, 17 bp, Homo sapiens
ccctccagacccctacc

SEQ ID NO: 256379 - DNA, 22 bp, Homo sapiens
ccctccagacccctaccctttc

SEQ ID NO: 256380 - DNA, 16 bp, Homo sapiens
ccctccagaccctgcc

SEQ ID NO: 256381 - DNA, 18 bp, Homo sapiens
ccctccagaccctgcctg

SEQ ID NO: 256382 - DNA, 12 bp, Homo sapiens
ccctccagcaca

SEQ ID NO: 256383 - DNA, 21 bp, Homo sapiens
ccctccagtgcttggctgccc

SEQ ID NO: 256384 - DNA, 14 bp, Homo sapiens
ccctcccaacctca

SEQ ID NO: 256385 - DNA, 18 bp, Homo sapiens
ccctcccaacctcaatgc

SEQ ID NO: 256386 - DNA, 21 bp, Homo sapiens
ccctcccaagcgttcctggcc

SEQ ID NO: 256387 - DNA, 14 bp, Homo sapiens
ccctcccacatccc

SEQ ID NO: 256388 - DNA, 13 bp, Homo sapiens
ccctcccaccccc

SEQ ID NO: 256389 - DNA, 13 bp, Homo sapiens
ccctcccagacag

SEQ ID NO: 256390 - DNA, 20 bp, Homo sapiens
ccctcccagacaggccctcc

SEQ ID NO: 256391 - DNA, 21 bp, Homo sapiens
ccctcccagacaggccctccc

SEQ ID NO: 256392 - DNA, 14 bp, Homo sapiens
ccctcccagtcctc

SEQ ID NO: 256393 - DNA, 12 bp, Homo sapiens
ccctcccatggc

SEQ ID NO: 256394 - DNA, 20 bp, Homo sapiens
ccctccccaactccttcctc

SEQ ID NO: 256395 - DNA, 17 bp, Homo sapiens
ccctccccacagtcctc

SEQ ID NO: 256396 - DNA, 18 bp, Homo sapiens
ccctccccagccagccct

SEQ ID NO: 256397 - DNA, 20 bp, Homo sapiens
ccctccccagccagcccttc

SEQ ID NO: 256398 - DNA, 14 bp, Homo sapiens
ccctccccagccct

SEQ ID NO: 256399 - DNA, 11 bp, Homo sapiens
ccctccccagt

SEQ ID NO: 256400 - DNA, 14 bp, Homo sapiens
ccctcccccacggc

SEQ ID NO: 256401 - DNA, 15 bp, Homo sapiens
ccctcccccgcagac

SEQ ID NO: 256402 - DNA, 13 bp, Homo sapiens
ccctccccctcaa

SEQ ID NO: 256403 - DNA, 22 bp, Homo sapiens
ccctccccggccctaccagcgc

SEQ ID NO: 256404 - DNA, 14 bp, Homo sapiens
ccctcccctgccct

SEQ ID NO: 256405 - DNA, 12 bp, Homo sapiens
ccctccctccac

SEQ ID NO: 256406 - DNA, 13 bp, Homo sapiens
ccctccctccaca

SEQ ID NO: 256407 - DNA, 11 bp, Homo sapiens
ccctccctccc

SEQ ID NO: 256408 - DNA, 13 bp, Homo sapiens
ccctccctcctgg

SEQ ID NO: 256409 - DNA, 14 bp, Homo sapiens
ccctccctccttcc

SEQ ID NO: 256410 - DNA, 13 bp, Homo sapiens
ccctccctctgcc

SEQ ID NO: 256411 - DNA, 15 bp, Homo sapiens
ccctccctctgcccc

SEQ ID NO: 256412 - DNA, 16 bp, Homo sapiens
ccctccctctgcccca

SEQ ID NO: 256413 - DNA, 14 bp, Homo sapiens
ccctccctctgctc

SEQ ID NO: 256414 - DNA, 13 bp, Homo sapiens
ccctccctcttcc

SEQ ID NO: 256415 - DNA, 13 bp, Homo sapiens
ccctccctgcagg

SEQ ID NO: 256416 - DNA, 15 bp, Homo sapiens
ccctccctggcctgt

SEQ ID NO: 256417 - DNA, 12 bp, Homo sapiens
ccctccctgggt

SEQ ID NO: 256418 - DNA, 12 bp, Homo sapiens
ccctccctgtcc

SEQ ID NO: 256419 - DNA, 16 bp, Homo sapiens
ccctccctgtcccctg

SEQ ID NO: 256420 - DNA, 16 bp, Homo sapiens
ccctccctgtctccag

SEQ ID NO: 256421 - DNA, 19 bp, Homo sapiens
ccctcccttggaaacctgc

SEQ ID NO: 256422 - DNA, 22 bp, Homo sapiens
ccctcccttggaaacctgccct

SEQ ID NO: 256423 - DNA, 23 bp, Homo sapiens
ccctccgggcaggggagccaggg

SEQ ID NO: 256424 - DNA, 14 bp, Homo sapiens
ccctccgtccccag

SEQ ID NO: 256425 - DNA, 16 bp, Homo sapiens
ccctccgtcctggcag

SEQ ID NO: 256426 - DNA, 17 bp, Homo sapiens
ccctccgtcctggcagg

SEQ ID NO: 256427 - DNA, 17 bp, Homo sapiens
ccctccgtgatccatcc

SEQ ID NO: 256428 - DNA, 16 bp, Homo sapiens
ccctccgtgtggagca

SEQ ID NO: 256429 - DNA, 19 bp, Homo sapiens
ccctcctaaatgtcagctg

SEQ ID NO: 256430 - DNA, 20 bp, Homo sapiens
ccctcctatcacctcccctc

SEQ ID NO: 256431 - DNA, 21 bp, Homo sapiens
ccctcctatcacctcccctcc

SEQ ID NO: 256432 - DNA, 21 bp, Homo sapiens
ccctcctcacagttgccatgt

SEQ ID NO: 256433 - DNA, 12 bp, Homo sapiens
ccctcctcacct

SEQ ID NO: 256434 - DNA, 16 bp, Homo sapiens
ccctcctccactccac

SEQ ID NO: 256435 - DNA, 14 bp, Homo sapiens
ccctcctcgggcgc

SEQ ID NO: 256436 - DNA, 20 bp, Homo sapiens
ccctcctctcctgcccagct

SEQ ID NO: 256437 - DNA, 15 bp, Homo sapiens
ccctcctctgagcag

SEQ ID NO: 256438 - DNA, 18 bp, Homo sapiens
ccctcctctgccccctcc

SEQ ID NO: 256439 - DNA, 14 bp, Homo sapiens
ccctcctcttcctg

SEQ ID NO: 256440 - DNA, 16 bp, Homo sapiens
ccctcctgaacccccc

SEQ ID NO: 256441 - DNA, 16 bp, Homo sapiens
ccctcctgacaaatat

SEQ ID NO: 256442 - DNA, 12 bp, Homo sapiens
ccctcctgagca

SEQ ID NO: 256443 - DNA, 15 bp, Homo sapiens
ccctcctgcaggctg

SEQ ID NO: 256444 - DNA, 14 bp, Homo sapiens
ccctcctgctggct

SEQ ID NO: 256445 - DNA, 15 bp, Homo sapiens
ccctcctgctggctg

SEQ ID NO: 256446 - DNA, 13 bp, Homo sapiens
ccctcctggagca

SEQ ID NO: 256447 - DNA, 16 bp, Homo sapiens
ccctcctggctcacag

SEQ ID NO: 256448 - DNA, 20 bp, Homo sapiens
ccctcctggctcacagccac

SEQ ID NO: 256449 - DNA, 18 bp, Homo sapiens
ccctcctgggcccaggca

SEQ ID NO: 256450 - DNA, 14 bp, Homo sapiens
ccctcctgtaaaat

SEQ ID NO: 256451 - DNA, 18 bp, Homo sapiens
ccctcctgttgccacact

SEQ ID NO: 256452 - DNA, 15 bp, Homo sapiens
ccctccttccctggt

SEQ ID NO: 256453 - DNA, 20 bp, Homo sapiens
ccctccttctcccctccaga

SEQ ID NO: 256454 - DNA, 12 bp, Homo sapiens
ccctgccctccc

SEQ ID NO: 256455 - DNA, 15 bp, Homo sapiens
ccctgccctccccca

SEQ ID NO: 256456 - DNA, 17 bp, Homo sapiens
ccctgccctcccccacg

SEQ ID NO: 256457 - DNA, 15 bp, Homo sapiens
ccctgccctggtcca

SEQ ID NO: 256458 - DNA, 18 bp, Homo sapiens
ccctgcccttccctggtg

SEQ ID NO: 256459 - DNA, 14 bp, Homo sapiens
ccctgccggccttg

SEQ ID NO: 256460 - DNA, 16 bp, Homo sapiens
ccctgccggccttggc

SEQ ID NO: 256461 - DNA, 18 bp, Homo sapiens
ccctgccggccttggcct

SEQ ID NO: 256462 - DNA, 19 bp, Homo sapiens
ccctgccggccttggcctt

SEQ ID NO: 256463 - DNA, 22 bp, Homo sapiens
ccctgcctactctttgttttct

SEQ ID NO: 256464 - DNA, 11 bp, Homo sapiens
ccctgcctcac

SEQ ID NO: 256465 - DNA, 20 bp, Homo sapiens
ccctgcctcacatctccctt

SEQ ID NO: 256466 - DNA, 15 bp, Homo sapiens
ccctgcctcacctct

SEQ ID NO: 256467 - DNA, 23 bp, Homo sapiens
ccctgcctccaccgagccagctt

SEQ ID NO: 256468 - DNA, 13 bp, Homo sapiens
ccctgcctgaggg

SEQ ID NO: 256469 - DNA, 23 bp, Homo sapiens
ccctgcctgagggcccctctgcc

SEQ ID NO: 256470 - DNA, 13 bp, Homo sapiens
ccctgcctgccca

SEQ ID NO: 256471 - DNA, 14 bp, Homo sapiens
ccctgcctgcccac

SEQ ID NO: 256472 - DNA, 15 bp, Homo sapiens
ccctgcctgcccact

SEQ ID NO: 256473 - DNA, 15 bp, Homo sapiens
ccctgcgcaggccct

SEQ ID NO: 256474 - DNA, 17 bp, Homo sapiens
ccctgcgccctccctcc

SEQ ID NO: 256475 - DNA, 24 bp, Homo sapiens
ccctgcggagctgcatggacgcct

SEQ ID NO: 256476 - DNA, 19 bp, Homo sapiens
ccctgcgttggagccactc

SEQ ID NO: 256477 - DNA, 22 bp, Homo sapiens
ccctgcgttggagccactcctg

SEQ ID NO: 256478 - DNA, 19 bp, Homo sapiens
ccctgctactccactgacc

SEQ ID NO: 256479 - DNA, 15 bp, Homo sapiens
ccctgctcagctggc

SEQ ID NO: 256480 - DNA, 18 bp, Homo sapiens
ccctgctcagctggccgg

SEQ ID NO: 256481 - DNA, 14 bp, Homo sapiens
ccctgctcaggcct

SEQ ID NO: 256482 - DNA, 18 bp, Homo sapiens
ccctgctcaggcctcacc

SEQ ID NO: 256483 - DNA, 20 bp, Homo sapiens
ccctgctcaggcctcacctg

SEQ ID NO: 256484 - DNA, 20 bp, Homo sapiens
ccctgctccatgggcacctc

SEQ ID NO: 256485 - DNA, 20 bp, Homo sapiens
ccctgctcccagcctgctga

SEQ ID NO: 256486 - DNA, 19 bp, Homo sapiens
ccctgctcctcctgccctg

SEQ ID NO: 256487 - DNA, 23 bp, Homo sapiens
ccctgctctacccatgagcctgc

SEQ ID NO: 256488 - DNA, 19 bp, Homo sapiens
ccctgctgccgccactggc

SEQ ID NO: 256489 - DNA, 22 bp, Homo sapiens
ccctgctgccgcctcccagcct

SEQ ID NO: 256490 - DNA, 14 bp, Homo sapiens
ccctgctgcctccc

SEQ ID NO: 256491 - DNA, 16 bp, Homo sapiens
ccctgctgcctcccca

SEQ ID NO: 256492 - DNA, 24 bp, Homo sapiens
ccctgctgctcctcggccagagct

SEQ ID NO: 256493 - DNA, 18 bp, Homo sapiens
ccctgctgctgcctgcct

SEQ ID NO: 256494 - DNA, 23 bp, Homo sapiens
ccctgctgcttcctaacttattg

SEQ ID NO: 256495 - DNA, 13 bp, Homo sapiens
ccctgctggccaa

SEQ ID NO: 256496 - DNA, 23 bp, Homo sapiens
ccctgctgggtgggaatgcgctc

SEQ ID NO: 256497 - DNA, 23 bp, Homo sapiens
ccctgcttagaacccttctgctt

SEQ ID NO: 256498 - DNA, 17 bp, Homo sapiens
ccctgcttcccaaactc

SEQ ID NO: 256499 - DNA, 21 bp, Homo sapiens
ccctgcttcccaaactcccag

SEQ ID NO: 256500 - DNA, 22 bp, Homo sapiens
ccctgcttcccaaactcccagg

SEQ ID NO: 256501 - DNA, 20 bp, Homo sapiens
ccctgcttctgctgccctga

SEQ ID NO: 256502 - DNA, 18 bp, Homo sapiens
ccctgctttgggctgccc

SEQ ID NO: 256503 - DNA, 22 bp, Homo sapiens
ccctgctttgggctgccctggt

SEQ ID NO: 256504 - DNA, 19 bp, Homo sapiens
ccctggaaaggggagttga

SEQ ID NO: 256505 - DNA, 19 bp, Homo sapiens
ccctggaattcagcaccct

SEQ ID NO: 256506 - DNA, 20 bp, Homo sapiens
ccctggaattcagcaccctg

SEQ ID NO: 256507 - DNA, 21 bp, Homo sapiens
ccctggaattcagcaccctgg

SEQ ID NO: 256508 - DNA, 22 bp, Homo sapiens
ccctggaattcagcaccctggg

SEQ ID NO: 256509 - DNA, 23 bp, Homo sapiens
ccctggaattcagcaccctgggt

SEQ ID NO: 256510 - DNA, 18 bp, Homo sapiens
ccctggacacccctgctc

SEQ ID NO: 256511 - DNA, 18 bp, Homo sapiens
ccctggaccacacctccg

SEQ ID NO: 256512 - DNA, 21 bp, Homo sapiens
ccctggagccagcagggctgt

SEQ ID NO: 256513 - DNA, 12 bp, Homo sapiens
ccctggagccca

SEQ ID NO: 256514 - DNA, 18 bp, Homo sapiens
gcatctttcatagttctg

SEQ ID NO: 256515 - DNA, 18 bp, Homo sapiens
gcatctttgccttgggct

SEQ ID NO: 256516 - DNA, 22 bp, Homo sapiens
gcatctttgccttgggctgctc

SEQ ID NO: 256517 - DNA, 20 bp, Homo sapiens
gcatgaaactatgcacctat

SEQ ID NO: 256518 - DNA, 15 bp, Homo sapiens
gcatgacaagcccca

SEQ ID NO: 256519 - DNA, 16 bp, Homo sapiens
gcatgacaagccccag

SEQ ID NO: 256520 - DNA, 15 bp, Homo sapiens
gcatgaccctggagc

SEQ ID NO: 256521 - DNA, 19 bp, Homo sapiens
gcatgaccttttggccttt

SEQ ID NO: 256522 - DNA, 22 bp, Homo sapiens
gcatgaccttttggcctttgta

SEQ ID NO: 256523 - DNA, 20 bp, Homo sapiens
gcatgagaatgtcatttgct

SEQ ID NO: 256524 - DNA, 16 bp, Homo sapiens
gcatgatattttcaga

SEQ ID NO: 256525 - DNA, 14 bp, Homo sapiens
gcatgatctgtcaa

SEQ ID NO: 256526 - DNA, 14 bp, Homo sapiens
gcatgattctttaa

SEQ ID NO: 256527 - DNA, 16 bp, Homo sapiens
gcatgcaaaccaggag

SEQ ID NO: 256528 - DNA, 15 bp, Homo sapiens
gcatgcaagctcagg

SEQ ID NO: 256529 - DNA, 20 bp, Homo sapiens
gcatgcagcaacacccaagt

SEQ ID NO: 256530 - DNA, 17 bp, Homo sapiens
gcatgcagcagcttgct

SEQ ID NO: 256531 - DNA, 22 bp, Homo sapiens
gcatgcagcagcttgctgcacc

SEQ ID NO: 256532 - DNA, 15 bp, Homo sapiens
gcatgcattttgcag

SEQ ID NO: 256533 - DNA, 12 bp, Homo sapiens
gcatgccaccct

SEQ ID NO: 256534 - DNA, 16 bp, Homo sapiens
gcatgccaccctcaca

SEQ ID NO: 256535 - DNA, 23 bp, Homo sapiens
gcatgccacgccccgtgtctgga

SEQ ID NO: 256536 - DNA, 15 bp, Homo sapiens
gcatgccaggctggg

SEQ ID NO: 256537 - DNA, 13 bp, Homo sapiens
gcatgccccaccc

SEQ ID NO: 256538 - DNA, 15 bp, Homo sapiens
gcatgccccttggct

SEQ ID NO: 256539 - DNA, 17 bp, Homo sapiens
gcatgccccttggctgg

SEQ ID NO: 256540 - DNA, 13 bp, Homo sapiens
gcatgctcccagc

SEQ ID NO: 256541 - DNA, 13 bp, Homo sapiens
gcatgctgcctgc

SEQ ID NO: 256542 - DNA, 17 bp, Homo sapiens
gcatgctgcctgcctcc

SEQ ID NO: 256543 - DNA, 13 bp, Homo sapiens
gcatgcttagagc

SEQ ID NO: 256544 - DNA, 17 bp, Homo sapiens
gcatgcttagagcatgt

SEQ ID NO: 256545 - DNA, 17 bp, Homo sapiens
gcatgctttgctgctat

SEQ ID NO: 256546 - DNA, 17 bp, Homo sapiens
gcatggaatttgtaagt

SEQ ID NO: 256547 - DNA, 17 bp, Homo sapiens
gcatggacctaacattc

SEQ ID NO: 256548 - DNA, 14 bp, Homo sapiens
gcatggacgcctgg

SEQ ID NO: 256549 - DNA, 18 bp, Homo sapiens
gcatggacgcctggctcc

SEQ ID NO: 256550 - DNA, 23 bp, Homo sapiens
gcatggacgcctggctccaggct

SEQ ID NO: 256551 - DNA, 19 bp, Homo sapiens
gcatggagagcctcttagt

SEQ ID NO: 256552 - DNA, 21 bp, Homo sapiens
gcatggagagcctcttagtga

SEQ ID NO: 256553 - DNA, 23 bp, Homo sapiens
gcatggagtgtgtattgttccca

SEQ ID NO: 256554 - DNA, 24 bp, Homo sapiens
gcatggagtgtgtattgttcccag

SEQ ID NO: 256555 - DNA, 18 bp, Homo sapiens
gcatggattttggataaa

SEQ ID NO: 256556 - DNA, 21 bp, Homo sapiens
gcatggattttggataaatca

SEQ ID NO: 256557 - DNA, 20 bp, Homo sapiens
gcatggcaaggactgcaggg

SEQ ID NO: 256558 - DNA, 14 bp, Homo sapiens
gcatggcagcaggc

SEQ ID NO: 256559 - DNA, 17 bp, Homo sapiens
gcatggccagcagcttg

SEQ ID NO: 256560 - DNA, 17 bp, Homo sapiens
gcatggcccagcctgga

SEQ ID NO: 256561 - DNA, 19 bp, Homo sapiens
gcatggcccagcctggagc

SEQ ID NO: 256562 - DNA, 13 bp, Homo sapiens
gcatggcccctcc

SEQ ID NO: 256563 - DNA, 17 bp, Homo sapiens
gcatggcccctccagga

SEQ ID NO: 256564 - DNA, 13 bp, Homo sapiens
gcatggcctccca

SEQ ID NO: 256565 - DNA, 18 bp, Homo sapiens
gcatggcctcccagccac

SEQ ID NO: 256566 - DNA, 22 bp, Homo sapiens
gcatggctccagtctgctgccc

SEQ ID NO: 256567 - DNA, 15 bp, Homo sapiens
gcatggctcctgtct

SEQ ID NO: 256568 - DNA, 13 bp, Homo sapiens
gcatgggaatgaa

SEQ ID NO: 256569 - DNA, 13 bp, Homo sapiens
gcatgggcctggc

SEQ ID NO: 256570 - DNA, 17 bp, Homo sapiens
gcatgggggaggctctg

SEQ ID NO: 256571 - DNA, 18 bp, Homo sapiens
gcatggtaccagccctgg

SEQ ID NO: 256572 - DNA, 20 bp, Homo sapiens
gcatggtcctggaggatgac

SEQ ID NO: 256573 - DNA, 14 bp, Homo sapiens
gcatggtgcatgcc

SEQ ID NO: 256574 - DNA, 20 bp, Homo sapiens
gcatggtggcacgtgcctgt

SEQ ID NO: 256575 - DNA, 17 bp, Homo sapiens
gcatggttccttccctg

SEQ ID NO: 256576 - DNA, 19 bp, Homo sapiens
gcatgtagctctatggggg

SEQ ID NO: 256577 - DNA, 15 bp, Homo sapiens
gcatgtattggcctg

SEQ ID NO: 256578 - DNA, 17 bp, Homo sapiens
gcatgtctctgcttcca

SEQ ID NO: 256579 - DNA, 11 bp, Homo sapiens
gcatgtctgca

SEQ ID NO: 256580 - DNA, 16 bp, Homo sapiens
gcatgtgaagcatgct

SEQ ID NO: 256581 - DNA, 22 bp, Homo sapiens
gcatgtgaagcatgctttgctg

SEQ ID NO: 256582 - DNA, 12 bp, Homo sapiens
gcatgtgccaag

SEQ ID NO: 256583 - DNA, 22 bp, Homo sapiens
gccacagccacctccaccccca

SEQ ID NO: 256584 - DNA, 18 bp, Homo sapiens
gccacagctgctggagaa

SEQ ID NO: 256585 - DNA, 14 bp, Homo sapiens
gccacaggcagacg

SEQ ID NO: 256586 - DNA, 13 bp, Homo sapiens
gccacagtggggc

SEQ ID NO: 256587 - DNA, 20 bp, Homo sapiens
gccacagtggggcccatggc

SEQ ID NO: 256588 - DNA, 21 bp, Homo sapiens
gccacagtggggcccatggcc

SEQ ID NO: 256589 - DNA, 18 bp, Homo sapiens
gccacatccccgctggct

SEQ ID NO: 256590 - DNA, 17 bp, Homo sapiens
gccaccaaatctgtcta

SEQ ID NO: 256591 - DNA, 15 bp, Homo sapiens
gccaccaagggcctc

SEQ ID NO: 256592 - DNA, 12 bp, Homo sapiens
gccaccaataaa

SEQ ID NO: 256593 - DNA, 17 bp, Homo sapiens
gccaccaccactgtccc

SEQ ID NO: 256594 - DNA, 22 bp, Homo sapiens
gccaccaccggggcactggctg

SEQ ID NO: 256595 - DNA, 15 bp, Homo sapiens
gccaccacgtccagc

SEQ ID NO: 256596 - DNA, 16 bp, Homo sapiens
gccaccacgtccagct

SEQ ID NO: 256597 - DNA, 22 bp, Homo sapiens
gccaccacgtctgccaggccca

SEQ ID NO: 256598 - DNA, 17 bp, Homo sapiens
gccaccagctgctggat

SEQ ID NO: 256599 - DNA, 16 bp, Homo sapiens
gccaccatgcccagct

SEQ ID NO: 256600 - DNA, 22 bp, Homo sapiens
gccaccatgcccagctcagagg

SEQ ID NO: 256601 - DNA, 18 bp, Homo sapiens
gccaccatggccagccaa

SEQ ID NO: 256602 - DNA, 13 bp, Homo sapiens
gccacccaccctt

SEQ ID NO: 256603 - DNA, 22 bp, Homo sapiens
gccacccacccttctcccctgc

SEQ ID NO: 256604 - DNA, 12 bp, Homo sapiens
gccacccactca

SEQ ID NO: 256605 - DNA, 13 bp, Homo sapiens
gccacccactcag

SEQ ID NO: 256606 - DNA, 14 bp, Homo sapiens
gccacccagccagg

SEQ ID NO: 256607 - DNA, 21 bp, Homo sapiens
gccaccccaaaccccagcccc

SEQ ID NO: 256608 - DNA, 12 bp, Homo sapiens
gccaccccactt

SEQ ID NO: 256609 - DNA, 19 bp, Homo sapiens
gccaccccgggctctctgc

SEQ ID NO: 256610 - DNA, 15 bp, Homo sapiens
gccaccccgtgccac

SEQ ID NO: 256611 - DNA, 20 bp, Homo sapiens
gccacccggatctccaggcc

SEQ ID NO: 256612 - DNA, 23 bp, Homo sapiens
gccacccggatctccaggcccag

SEQ ID NO: 256613 - DNA, 21 bp, Homo sapiens
gccacccgttctgctggcctg

SEQ ID NO: 256614 - DNA, 17 bp, Homo sapiens
gccaccctaactgagct

SEQ ID NO: 256615 - DNA, 18 bp, Homo sapiens
gccaccctaactgagctg

SEQ ID NO: 256616 - DNA, 19 bp, Homo sapiens
gccaccctaactgagctgc

SEQ ID NO: 256617 - DNA, 20 bp, Homo sapiens
gccaccctaactgagctgcc

SEQ ID NO: 256618 - DNA, 18 bp, Homo sapiens
gccaccctacctgttcag

SEQ ID NO: 256619 - DNA, 19 bp, Homo sapiens
gccaccctacctgttcagt

SEQ ID NO: 256620 - DNA, 15 bp, Homo sapiens
gccaccctcacacac

SEQ ID NO: 256621 - DNA, 21 bp, Homo sapiens
gccaccctcacacacacagct

SEQ ID NO: 256622 - DNA, 13 bp, Homo sapiens
gccacccttggcc

SEQ ID NO: 256623 - DNA, 14 bp, Homo sapiens
gccacccttggcct

SEQ ID NO: 256624 - DNA, 20 bp, Homo sapiens
gccaccgcgagggcctgcgt

SEQ ID NO: 256625 - DNA, 15 bp, Homo sapiens
gccaccggggcaaga

SEQ ID NO: 256626 - DNA, 15 bp, Homo sapiens
gccaccgtcacacag

SEQ ID NO: 256627 - DNA, 22 bp, Homo sapiens
gccacctatctcgtgggagagc

SEQ ID NO: 256628 - DNA, 15 bp, Homo sapiens
gccacctatgcctgt

SEQ ID NO: 256629 - DNA, 20 bp, Homo sapiens
gccacctatgcctgtggtga

SEQ ID NO: 256630 - DNA, 20 bp, Homo sapiens
gccacctccacccccaagaa

SEQ ID NO: 256631 - DNA, 13 bp, Homo sapiens
gccacctctctcc

SEQ ID NO: 256632 - DNA, 12 bp, Homo sapiens
gccacctgcagg

SEQ ID NO: 256633 - DNA, 16 bp, Homo sapiens
gccacctgcccccttc

SEQ ID NO: 256634 - DNA, 18 bp, Homo sapiens
gccacctgcccccttctc

SEQ ID NO: 256635 - DNA, 21 bp, Homo sapiens
gccacctgcccccttctccca

SEQ ID NO: 256636 - DNA, 23 bp, Homo sapiens
gccacctgcccccttctcccaca

SEQ ID NO: 256637 - DNA, 20 bp, Homo sapiens
gccacctgggctgggagaag

SEQ ID NO: 256638 - DNA, 17 bp, Homo sapiens
gccacctggggcagtca

SEQ ID NO: 256639 - DNA, 18 bp, Homo sapiens
gccacctgtcccacctca

SEQ ID NO: 256640 - DNA, 19 bp, Homo sapiens
gccacctgtcccacctcaa

SEQ ID NO: 256641 - DNA, 15 bp, Homo sapiens
gccacctgtctgtct

SEQ ID NO: 256642 - DNA, 16 bp, Homo sapiens
gccaccttggtcctag

SEQ ID NO: 256643 - DNA, 18 bp, Homo sapiens
gccaccttgtacagaacc

SEQ ID NO: 256644 - DNA, 21 bp, Homo sapiens
gccacgaggtggtagctctga

SEQ ID NO: 256645 - DNA, 13 bp, Homo sapiens
gccacgcagccag

SEQ ID NO: 256646 - DNA, 15 bp, Homo sapiens
gccacgcagccagga

SEQ ID NO: 256647 - DNA, 16 bp, Homo sapiens
gccacgcagccaggac

SEQ ID NO: 256648 - DNA, 15 bp, Homo sapiens
gccacgccccagccc

SEQ ID NO: 256649 - DNA, 18 bp, Homo sapiens
gccacgccccagcccgac

SEQ ID NO: 256650 - DNA, 19 bp, Homo sapiens
gccacgctttgctgctacc

SEQ ID NO: 256651 - DNA, 18 bp, Homo sapiens
gccacggacgctggctcc

SEQ ID NO: 256652 - DNA, 15 bp, Homo sapiens
gccacggccaccctc

SEQ ID NO: 256653 - DNA, 14 bp, Homo sapiens
gccacggcctggga

SEQ ID NO: 256654 - DNA, 21 bp, Homo sapiens
gccacgggggaggccgaggca

SEQ ID NO: 256655 - DNA, 20 bp, Homo sapiens
gccacgtatagtcctagctg

SEQ ID NO: 256656 - DNA, 21 bp, Homo sapiens
cccttcctggactggcccttg

SEQ ID NO: 256657 - DNA, 13 bp, Homo sapiens
cccttcctggcct

SEQ ID NO: 256658 - DNA, 21 bp, Homo sapiens
cccttcctgtcctgctcacgt

SEQ ID NO: 256659 - DNA, 15 bp, Homo sapiens
cccttcctgtctggc

SEQ ID NO: 256660 - DNA, 22 bp, Homo sapiens
cccttcggtattgttcaaagaa

SEQ ID NO: 256661 - DNA, 13 bp, Homo sapiens
cccttcgtgtgtg

SEQ ID NO: 256662 - DNA, 15 bp, Homo sapiens
cccttctacactctc

SEQ ID NO: 256663 - DNA, 13 bp, Homo sapiens
cccttctcacagc

SEQ ID NO: 256664 - DNA, 19 bp, Homo sapiens
cccttctcacagcacatgc

SEQ ID NO: 256665 - DNA, 22 bp, Homo sapiens
cccttctcagaaaacttctctt

SEQ ID NO: 256666 - DNA, 23 bp, Homo sapiens
cccttctcattccaacagtgagt

SEQ ID NO: 256667 - DNA, 15 bp, Homo sapiens
cccttctcccacact

SEQ ID NO: 256668 - DNA, 14 bp, Homo sapiens
cccttctcccctgc

SEQ ID NO: 256669 - DNA, 18 bp, Homo sapiens
cccttctcccctgcactg

SEQ ID NO: 256670 - DNA, 15 bp, Homo sapiens
cccttctccttccaa

SEQ ID NO: 256671 - DNA, 23 bp, Homo sapiens
cccttctctgctccaccacatcc

SEQ ID NO: 256672 - DNA, 14 bp, Homo sapiens
cccttctgctttct

SEQ ID NO: 256673 - DNA, 14 bp, Homo sapiens
cccttctgtgccca

SEQ ID NO: 256674 - DNA, 16 bp, Homo sapiens
cccttctgtgcccagc

SEQ ID NO: 256675 - DNA, 18 bp, Homo sapiens
cccttctgtgcccagctc

SEQ ID NO: 256676 - DNA, 18 bp, Homo sapiens
cccttcttgggccccaga

SEQ ID NO: 256677 - DNA, 19 bp, Homo sapiens
cccttcttgggccccagac

SEQ ID NO: 256678 - DNA, 11 bp, Homo sapiens
cccttcttttt

SEQ ID NO: 256679 - DNA, 13 bp, Homo sapiens
cccttgaacctca

SEQ ID NO: 256680 - DNA, 15 bp, Homo sapiens
cccttgaccccacac

SEQ ID NO: 256681 - DNA, 16 bp, Homo sapiens
cccttgcacaggccac

SEQ ID NO: 256682 - DNA, 22 bp, Homo sapiens
cccttgcaggggtcccccctca

SEQ ID NO: 256683 - DNA, 21 bp, Homo sapiens
cccttgcagttcagcaccacc

SEQ ID NO: 256684 - DNA, 19 bp, Homo sapiens
cccttgcccaactcccagc

SEQ ID NO: 256685 - DNA, 20 bp, Homo sapiens
cccttgcccaactcccagcc

SEQ ID NO: 256686 - DNA, 22 bp, Homo sapiens
cccttgcccgccagccagtggc

SEQ ID NO: 256687 - DNA, 13 bp, Homo sapiens
cccttgctccctt

SEQ ID NO: 256688 - DNA, 18 bp, Homo sapiens
cccttggcactgatgggc

SEQ ID NO: 256689 - DNA, 18 bp, Homo sapiens
cccttggccacggcctgg

SEQ ID NO: 256690 - DNA, 14 bp, Homo sapiens
cccttggcctcaga

SEQ ID NO: 256691 - DNA, 19 bp, Homo sapiens
cccttggcctgtctcatcc

SEQ ID NO: 256692 - DNA, 18 bp, Homo sapiens
cccttggcttcctccgtc

SEQ ID NO: 256693 - DNA, 19 bp, Homo sapiens
cccttgggacagccagagc

SEQ ID NO: 256694 - DNA, 15 bp, Homo sapiens
cccttgggcatccac

SEQ ID NO: 256695 - DNA, 14 bp, Homo sapiens
cccttggggcctgg

SEQ ID NO: 256696 - DNA, 15 bp, Homo sapiens
cccttggggcctggc

SEQ ID NO: 256697 - DNA, 16 bp, Homo sapiens
cccttgtcctgccagc

SEQ ID NO: 256698 - DNA, 17 bp, Homo sapiens
cccttgtcctgccagct

SEQ ID NO: 256699 - DNA, 21 bp, Homo sapiens
cccttgtcctgccagctgcct

SEQ ID NO: 256700 - DNA, 15 bp, Homo sapiens
cccttgtctgctgct

SEQ ID NO: 256701 - DNA, 13 bp, Homo sapiens
cccttgtgccctg

SEQ ID NO: 256702 - DNA, 23 bp, Homo sapiens
cccttgtgcgtgggtgaagccgc

SEQ ID NO: 256703 - DNA, 12 bp, Homo sapiens
cccttgtgtctg

SEQ ID NO: 256704 - DNA, 14 bp, Homo sapiens
cccttgtttttgat

SEQ ID NO: 256705 - DNA, 23 bp, Homo sapiens
ccctttattaattcattaaattt

SEQ ID NO: 256706 - DNA, 18 bp, Homo sapiens
ccctttcactgaagtgaa

SEQ ID NO: 256707 - DNA, 16 bp, Homo sapiens
ccctttccccactcag

SEQ ID NO: 256708 - DNA, 15 bp, Homo sapiens
ccctttccctacctt

SEQ ID NO: 256709 - DNA, 15 bp, Homo sapiens
ccctttccctgcatc

SEQ ID NO: 256710 - DNA, 14 bp, Homo sapiens
ccctttccttgcct

SEQ ID NO: 256711 - DNA, 18 bp, Homo sapiens
ccctttccttgccttctt

SEQ ID NO: 256712 - DNA, 12 bp, Homo sapiens
ccctttctgtgt

SEQ ID NO: 256713 - DNA, 15 bp, Homo sapiens
atttcaaaatgcatg

SEQ ID NO: 256714 - DNA, 17 bp, Homo sapiens
atttcaaaatgcatgtg

SEQ ID NO: 256715 - DNA, 18 bp, Homo sapiens
atttcaaaatgcatgtga

SEQ ID NO: 256716 - DNA, 20 bp, Homo sapiens
atttcaaaatgcatgtgatt

SEQ ID NO: 256717 - DNA, 21 bp, Homo sapiens
atttcaaaatggacgtactgg

SEQ ID NO: 256718 - DNA, 15 bp, Homo sapiens
atttcaacaagaata

SEQ ID NO: 256719 - DNA, 21 bp, Homo sapiens
atttcaacataattatgggaa

SEQ ID NO: 256720 - DNA, 22 bp, Homo sapiens
atttcaagggttgcttctgagt

SEQ ID NO: 256721 - DNA, 17 bp, Homo sapiens
atttcaaggtccgagct

SEQ ID NO: 256722 - DNA, 17 bp, Homo sapiens
atttcaatgattgttta

SEQ ID NO: 256723 - DNA, 20 bp, Homo sapiens
atttcacaacagatcaattt

SEQ ID NO: 256724 - DNA, 20 bp, Homo sapiens
atttcacaatataaagttct

SEQ ID NO: 256725 - DNA, 22 bp, Homo sapiens
atttcacagataatttacttat

SEQ ID NO: 256726 - DNA, 15 bp, Homo sapiens
atttcacctgtgaca

SEQ ID NO: 256727 - DNA, 21 bp, Homo sapiens
atttcactagagacaaatctt

SEQ ID NO: 256728 - DNA, 14 bp, Homo sapiens
atttcactattttt

SEQ ID NO: 256729 - DNA, 21 bp, Homo sapiens
atttcactgacactgcgaact

SEQ ID NO: 256730 - DNA, 17 bp, Homo sapiens
atttcagtatcatctcc

SEQ ID NO: 256731 - DNA, 20 bp, Homo sapiens
atttcatcctgttggctgct

SEQ ID NO: 256732 - DNA, 15 bp, Homo sapiens
atttcatctttccaa

SEQ ID NO: 256733 - DNA, 23 bp, Homo sapiens
atttcatgattagacaatgtgga

SEQ ID NO: 256734 - DNA, 15 bp, Homo sapiens
atttcatgatttcat

SEQ ID NO: 256735 - DNA, 13 bp, Homo sapiens
atttcatgtgatc

SEQ ID NO: 256736 - DNA, 23 bp, Homo sapiens
atttcatgttagtcttaccgaat

SEQ ID NO: 256737 - DNA, 20 bp, Homo sapiens
atttcattgtatgatgtgtt

SEQ ID NO: 256738 - DNA, 20 bp, Homo sapiens
atttcattgtctctatctga

SEQ ID NO: 256739 - DNA, 18 bp, Homo sapiens
atttcatttcaactgttt

SEQ ID NO: 256740 - DNA, 21 bp, Homo sapiens
atttcatttccaactcaggtt

SEQ ID NO: 256741 - DNA, 23 bp, Homo sapiens
atttcatttccaactcaggttaa

SEQ ID NO: 256742 - DNA, 21 bp, Homo sapiens
atttccaacaccacagacaca

SEQ ID NO: 256743 - DNA, 23 bp, Homo sapiens
atttccaacaccacagacacaca

SEQ ID NO: 256744 - DNA, 23 bp, Homo sapiens
atttccacaatagggttcaaatt

SEQ ID NO: 256745 - DNA, 22 bp, Homo sapiens
atttccagagtccggaggcagc

SEQ ID NO: 256746 - DNA, 17 bp, Homo sapiens
atttccagcaaaatata

SEQ ID NO: 256747 - DNA, 22 bp, Homo sapiens
atttccagcaaaatatatgttt

SEQ ID NO: 256748 - DNA, 13 bp, Homo sapiens
atttccaggcccc

SEQ ID NO: 256749 - DNA, 18 bp, Homo sapiens
atttccaggcccctgagg

SEQ ID NO: 256750 - DNA, 22 bp, Homo sapiens
atttccaggcccctgaggactg

SEQ ID NO: 256751 - DNA, 13 bp, Homo sapiens
atttccagtctcc

SEQ ID NO: 256752 - DNA, 17 bp, Homo sapiens
atttccatatggatttt

SEQ ID NO: 256753 - DNA, 17 bp, Homo sapiens
atttccattatttatat

SEQ ID NO: 256754 - DNA, 17 bp, Homo sapiens
atttccattccagaata

SEQ ID NO: 256755 - DNA, 20 bp, Homo sapiens
atttccattcttttaaatgg

SEQ ID NO: 256756 - DNA, 14 bp, Homo sapiens
atttcccaaagcag

SEQ ID NO: 256757 - DNA, 18 bp, Homo sapiens
atttcccaattaggaagt

SEQ ID NO: 256758 - DNA, 15 bp, Homo sapiens
atttccccagacctg

SEQ ID NO: 256759 - DNA, 23 bp, Homo sapiens
atttccccagacctgagctcccc

SEQ ID NO: 256760 - DNA, 20 bp, Homo sapiens
atttcccctttccaattcca

SEQ ID NO: 256761 - DNA, 21 bp, Homo sapiens
atttccctaaaatacatttaa

SEQ ID NO: 256762 - DNA, 21 bp, Homo sapiens
atttccgaagaccttctgaag

SEQ ID NO: 256763 - DNA, 13 bp, Homo sapiens
atttcctatctgt

SEQ ID NO: 256764 - DNA, 16 bp, Homo sapiens
atttcctcttccttct

SEQ ID NO: 256765 - DNA, 15 bp, Homo sapiens
atttcctgctttcta

SEQ ID NO: 256766 - DNA, 13 bp, Homo sapiens
atttcctttggct

SEQ ID NO: 256767 - DNA, 14 bp, Homo sapiens
atttcgatgtacag

SEQ ID NO: 256768 - DNA, 16 bp, Homo sapiens
atttcggaaatacact

SEQ ID NO: 256769 - DNA, 13 bp, Homo sapiens
atttctaaaacat

SEQ ID NO: 256770 - DNA, 13 bp, Homo sapiens
atttctaactatt

SEQ ID NO: 256771 - DNA, 22 bp, Homo sapiens
atttctaagcttatttctaact

SEQ ID NO: 256772 - DNA, 15 bp, Homo sapiens
atttctaagtattta

SEQ ID NO: 256773 - DNA, 16 bp, Homo sapiens
atttctaagtatttaa

SEQ ID NO: 256774 - DNA, 19 bp, Homo sapiens
atttctaagtatttaaatg

SEQ ID NO: 256775 - DNA, 22 bp, Homo sapiens
atttctaagtatttaaatgttc

SEQ ID NO: 256776 - DNA, 14 bp, Homo sapiens
atttctaatttgaa

SEQ ID NO: 256777 - DNA, 17 bp, Homo sapiens
atttctaatttgaatga

SEQ ID NO: 256778 - DNA, 21 bp, Homo sapiens
atttctagacagtattgccac

SEQ ID NO: 256779 - DNA, 23 bp, Homo sapiens
atttctagacagtattgccacct

SEQ ID NO: 256780 - DNA, 16 bp, Homo sapiens
atttctagcaggcagg

SEQ ID NO: 256781 - DNA, 15 bp, Homo sapiens
atttctatatttatt

SEQ ID NO: 256782 - DNA, 13 bp, Homo sapiens
atttctatctgca

SEQ ID NO: 256783 - DNA, 17 bp, Homo sapiens
atttctatctgcaaata

SEQ ID NO: 256784 - DNA, 14 bp, Homo sapiens
atttctatgtaaat

SEQ ID NO: 256785 - DNA, 15 bp, Homo sapiens
atttctatgtaaatt

SEQ ID NO: 256786 - DNA, 16 bp, Homo sapiens
atttctatgtaaatta

SEQ ID NO: 256787 - DNA, 18 bp, Homo sapiens
atttctatgtaaattatt

SEQ ID NO: 256788 - DNA, 13 bp, Homo sapiens
atttctatttatt

SEQ ID NO: 256789 - DNA, 22 bp, Homo sapiens
atttctcaaagtttttacagtg

SEQ ID NO: 256790 - DNA, 20 bp, Homo sapiens
atttctcaacaaagcacagt

SEQ ID NO: 256791 - DNA, 13 bp, Homo sapiens
atttctcatgtgc

SEQ ID NO: 256792 - DNA, 15 bp, Homo sapiens
atttctcatgtgctt

SEQ ID NO: 256793 - DNA, 17 bp, Homo sapiens
atttctcatgtgctttg

SEQ ID NO: 256794 - DNA, 21 bp, Homo sapiens
atttctcatgtgctttgtagc

SEQ ID NO: 256795 - DNA, 18 bp, Homo sapiens
atttctcatttagcattg

SEQ ID NO: 256796 - DNA, 16 bp, Homo sapiens
atttctccatcccctc

SEQ ID NO: 256797 - DNA, 15 bp, Homo sapiens
atttctcccttcaat

SEQ ID NO: 256798 - DNA, 15 bp, Homo sapiens
atttctcctctttct

SEQ ID NO: 256799 - DNA, 17 bp, Homo sapiens
atttctcctttaaagag

SEQ ID NO: 256800 - DNA, 19 bp, Homo sapiens
atttctgatgtctccagat

SEQ ID NO: 256801 - DNA, 12 bp, Homo sapiens
atttctgccagc

SEQ ID NO: 256802 - DNA, 20 bp, Homo sapiens
atttctgtagaatgctgtag

SEQ ID NO: 256803 - DNA, 23 bp, Homo sapiens
atttctgtagaatgctgtagaat

SEQ ID NO: 256804 - DNA, 15 bp, Homo sapiens
atttctgtccagaaa

SEQ ID NO: 256805 - DNA, 13 bp, Homo sapiens
atttctgtctcat

SEQ ID NO: 256806 - DNA, 15 bp, Homo sapiens
atttctgtctcataa

SEQ ID NO: 256807 - DNA, 20 bp, Homo sapiens
atttctgtggaaaacaattt

SEQ ID NO: 256808 - DNA, 20 bp, Homo sapiens
atttcttactaaacattttg

SEQ ID NO: 256809 - DNA, 14 bp, Homo sapiens
atttcttactcaaa

SEQ ID NO: 256810 - DNA, 11 bp, Homo sapiens
atttcttattt

SEQ ID NO: 256811 - DNA, 16 bp, Homo sapiens
atttcttatttgaaag

SEQ ID NO: 256812 - DNA, 16 bp, Homo sapiens
atttcttcagagggaa

SEQ ID NO: 256813 - DNA, 14 bp, Homo sapiens
atttcttcctatta

SEQ ID NO: 256814 - DNA, 17 bp, Homo sapiens
atttcttcgctgctcta

SEQ ID NO: 256815 - DNA, 22 bp, Homo sapiens
atttcttcgctgctctagctgg

SEQ ID NO: 256816 - DNA, 13 bp, Homo sapiens
atttcttctgtag

SEQ ID NO: 256817 - DNA, 18 bp, Homo sapiens
atttcttgctaagctcca

SEQ ID NO: 256818 - DNA, 17 bp, Homo sapiens
atttcttgggccctcct

SEQ ID NO: 256819 - DNA, 20 bp, Homo sapiens
atttcttgggccctcctgaa

SEQ ID NO: 256820 - DNA, 14 bp, Homo sapiens
atttctttgattgt

SEQ ID NO: 256821 - DNA, 15 bp, Homo sapiens
atttctttgattgtg

SEQ ID NO: 256822 - DNA, 18 bp, Homo sapiens
atttctttgatttaactg

SEQ ID NO: 256823 - DNA, 17 bp, Homo sapiens
atttcttttatatataa

SEQ ID NO: 256824 - DNA, 19 bp, Homo sapiens
atttcttttatatataaaa

SEQ ID NO: 256825 - DNA, 22 bp, Homo sapiens
atttcttttatatataaaataa

SEQ ID NO: 256826 - DNA, 21 bp, Homo sapiens
atttctttttgggagagactt

SEQ ID NO: 256827 - DNA, 22 bp, Homo sapiens
atttgaaaacaccaagagtaca

SEQ ID NO: 256828 - DNA, 21 bp, Homo sapiens
atttgaaagaagtcaaatgaa

SEQ ID NO: 256829 - DNA, 13 bp, Homo sapiens
atttgaaaggaaa

SEQ ID NO: 256830 - DNA, 23 bp, Homo sapiens
atttgaaagtgtttttctttaat

SEQ ID NO: 256831 - DNA, 18 bp, Homo sapiens
atttgaaatcaccttttc

SEQ ID NO: 256832 - DNA, 11 bp, Homo sapiens
atttgaaattt

SEQ ID NO: 256833 - DNA, 15 bp, Homo sapiens
atttgaaccaaaaca

SEQ ID NO: 256834 - DNA, 20 bp, Homo sapiens
atttgaaccaaaacattccg

SEQ ID NO: 256835 - DNA, 20 bp, Homo sapiens
atttgaaccaggccttctga

SEQ ID NO: 256836 - DNA, 13 bp, Homo sapiens
atttgaatgttaa

SEQ ID NO: 256837 - DNA, 19 bp, Homo sapiens
atttgacacataaaagtaa

SEQ ID NO: 256838 - DNA, 19 bp, Homo sapiens
atttgacattcttcactgt

SEQ ID NO: 256839 - DNA, 15 bp, Homo sapiens
atttgactgttattt

SEQ ID NO: 256840 - DNA, 13 bp, Homo sapiens
atttgagacattc

SEQ ID NO: 256841 - DNA, 12 bp, Homo sapiens
atttgagagaat

SEQ ID NO: 256842 - DNA, 19 bp, Homo sapiens
atttgaggagcagcttcag

SEQ ID NO: 256843 - DNA, 20 bp, Homo sapiens
atttgatctggtgcgtgtgg

SEQ ID NO: 256844 - DNA, 18 bp, Homo sapiens
atttgatggtgaatatta

SEQ ID NO: 256845 - DNA, 20 bp, Homo sapiens
atttgatggtgaatattaca

SEQ ID NO: 256846 - DNA, 15 bp, Homo sapiens
caagaatattgtatg

SEQ ID NO: 256847 - DNA, 23 bp, Homo sapiens
caagaatattgtatgttaaagca

SEQ ID NO: 256848 - DNA, 13 bp, Homo sapiens
caagacacccagt

SEQ ID NO: 256849 - DNA, 12 bp, Homo sapiens
caagacagagac

SEQ ID NO: 256850 - DNA, 22 bp, Homo sapiens
caagacagagacgcaggaatgg

SEQ ID NO: 256851 - DNA, 21 bp, Homo sapiens
caagacagatgccccagagct

SEQ ID NO: 256852 - DNA, 12 bp, Homo sapiens
caagacagtggc

SEQ ID NO: 256853 - DNA, 23 bp, Homo sapiens
caagacagtggcagcaaaggaag

SEQ ID NO: 256854 - DNA, 17 bp, Homo sapiens
caagacattgtcaataa

SEQ ID NO: 256855 - DNA, 23 bp, Homo sapiens
caagaccttacaaccacatttct

SEQ ID NO: 256856 - DNA, 21 bp, Homo sapiens
caagacggggagtgagactcc

SEQ ID NO: 256857 - DNA, 14 bp, Homo sapiens
caagactgcctccc

SEQ ID NO: 256858 - DNA, 17 bp, Homo sapiens
caagacttttctttgaa

SEQ ID NO: 256859 - DNA, 19 bp, Homo sapiens
caagagcagagtctgggcc

SEQ ID NO: 256860 - DNA, 22 bp, Homo sapiens
caagagcagagtctgggcctct

SEQ ID NO: 256861 - DNA, 14 bp, Homo sapiens
caagagcagcctgt

SEQ ID NO: 256862 - DNA, 17 bp, Homo sapiens
caagagcagcctgtggc

SEQ ID NO: 256863 - DNA, 20 bp, Homo sapiens
caagagcagcctgtggcatc

SEQ ID NO: 256864 - DNA, 22 bp, Homo sapiens
caagagcatcgtgacccttcag

SEQ ID NO: 256865 - DNA, 15 bp, Homo sapiens
caagagctcaggaga

SEQ ID NO: 256866 - DNA, 18 bp, Homo sapiens
caagagctcaggagaagg

SEQ ID NO: 256867 - DNA, 22 bp, Homo sapiens
caagaggagcaggaagcaaggc

SEQ ID NO: 256868 - DNA, 22 bp, Homo sapiens
caagaggccacttagggaaaga

SEQ ID NO: 256869 - DNA, 14 bp, Homo sapiens
caagaggctagccc

SEQ ID NO: 256870 - DNA, 23 bp, Homo sapiens
caagaggctagccccagggtgag

SEQ ID NO: 256871 - DNA, 14 bp, Homo sapiens
caagagggactgta

SEQ ID NO: 256872 - DNA, 20 bp, Homo sapiens
caagagggactgtatttctg

SEQ ID NO: 256873 - DNA, 14 bp, Homo sapiens
caagagggcactgg

SEQ ID NO: 256874 - DNA, 15 bp, Homo sapiens
caagagggcactggt

SEQ ID NO: 256875 - DNA, 19 bp, Homo sapiens
caagagtaaatattgtcac

SEQ ID NO: 256876 - DNA, 17 bp, Homo sapiens
caagagtatactttgta

SEQ ID NO: 256877 - DNA, 15 bp, Homo sapiens
caagagtatgagaaa

SEQ ID NO: 256878 - DNA, 16 bp, Homo sapiens
caagagtatgagaaat

SEQ ID NO: 256879 - DNA, 20 bp, Homo sapiens
caagatacacttgtaaataa

SEQ ID NO: 256880 - DNA, 14 bp, Homo sapiens
caagatacctttgc

SEQ ID NO: 256881 - DNA, 18 bp, Homo sapiens
caagatagcatcccatct

SEQ ID NO: 256882 - DNA, 15 bp, Homo sapiens
caagatcacaaatag

SEQ ID NO: 256883 - DNA, 20 bp, Homo sapiens
caagatccaaatgctgtgca

SEQ ID NO: 256884 - DNA, 14 bp, Homo sapiens
caagatctttacat

SEQ ID NO: 256885 - DNA, 13 bp, Homo sapiens
caagatgcctctt

SEQ ID NO: 256886 - DNA, 22 bp, Homo sapiens
caagatggaaaaaaaaaacaaa

SEQ ID NO: 256887 - DNA, 21 bp, Homo sapiens
caagatggaggggctgactca

SEQ ID NO: 256888 - DNA, 23 bp, Homo sapiens
caagattaagttataccagcaaa

SEQ ID NO: 256889 - DNA, 18 bp, Homo sapiens
caagattggaaagacagg

SEQ ID NO: 256890 - DNA, 18 bp, Homo sapiens
caagcaaacatcaaataa

SEQ ID NO: 256891 - DNA, 23 bp, Homo sapiens
caagcaaacatcaaataaatttc

SEQ ID NO: 256892 - DNA, 16 bp, Homo sapiens
caagcaaaccttctca

SEQ ID NO: 256893 - DNA, 18 bp, Homo sapiens
caagcaaaccttctcagg

SEQ ID NO: 256894 - DNA, 15 bp, Homo sapiens
caagcaatcctcctg

SEQ ID NO: 256895 - DNA, 16 bp, Homo sapiens
caagcaccagggaaga

SEQ ID NO: 256896 - DNA, 18 bp, Homo sapiens
caagcactcgagaccatc

SEQ ID NO: 256897 - DNA, 18 bp, Homo sapiens
caagcagagacctttgtt

SEQ ID NO: 256898 - DNA, 13 bp, Homo sapiens
caagcagccagcc

SEQ ID NO: 256899 - DNA, 21 bp, Homo sapiens
caagcagggaaagctccacgg

SEQ ID NO: 256900 - DNA, 15 bp, Homo sapiens
caagcatcagcaaga

SEQ ID NO: 256901 - DNA, 21 bp, Homo sapiens
caagcattccttagcagctca

SEQ ID NO: 256902 - DNA, 22 bp, Homo sapiens
caagcattccttagcagctcag

SEQ ID NO: 256903 - DNA, 18 bp, Homo sapiens
caagcattctgtgcataa

SEQ ID NO: 256904 - DNA, 20 bp, Homo sapiens
caagccaacttgtaaataca

SEQ ID NO: 256905 - DNA, 14 bp, Homo sapiens
caagccagctggag

SEQ ID NO: 256906 - DNA, 13 bp, Homo sapiens
caagccaggagac

SEQ ID NO: 256907 - DNA, 14 bp, Homo sapiens
caagccagggtgtg

SEQ ID NO: 256908 - DNA, 18 bp, Homo sapiens
caagccagggtgtgtctc

SEQ ID NO: 256909 - DNA, 18 bp, Homo sapiens
caagccagggttccagac

SEQ ID NO: 256910 - DNA, 22 bp, Homo sapiens
caagccataaaccaataaaaca

SEQ ID NO: 256911 - DNA, 13 bp, Homo sapiens
caagccatcacag

SEQ ID NO: 256912 - DNA, 23 bp, Homo sapiens
caagcccacaggtgtccccagcc

SEQ ID NO: 256913 - DNA, 18 bp, Homo sapiens
caagcccactggccagct

SEQ ID NO: 256914 - DNA, 17 bp, Homo sapiens
caagccccaggcaggct

SEQ ID NO: 256915 - DNA, 21 bp, Homo sapiens
caagccccagggcctgggggc

SEQ ID NO: 256916 - DNA, 16 bp, Homo sapiens
caagccccctttgatt

SEQ ID NO: 256917 - DNA, 17 bp, Homo sapiens
caagcccctcagccctt

SEQ ID NO: 256918 - DNA, 19 bp, Homo sapiens
caagcccctcagcccttgc

SEQ ID NO: 256919 - DNA, 10 bp, Homo sapiens
caagccctgg

SEQ ID NO: 256920 - DNA, 18 bp, Homo sapiens
caagcccttccctctgtt

SEQ ID NO: 256921 - DNA, 21 bp, Homo sapiens
caagccggccccccctctttt

SEQ ID NO: 256922 - DNA, 16 bp, Homo sapiens
caagccggtgcccacc

SEQ ID NO: 256923 - DNA, 14 bp, Homo sapiens
caagccgtggcttc

SEQ ID NO: 256924 - DNA, 15 bp, Homo sapiens
caagccgtggcttcc

SEQ ID NO: 256925 - DNA, 16 bp, Homo sapiens
caagccgtggcttccc

SEQ ID NO: 256926 - DNA, 21 bp, Homo sapiens
caagcctgaccacgctttcta

SEQ ID NO: 256927 - DNA, 21 bp, Homo sapiens
caagcctggagcccctgtgtt

SEQ ID NO: 256928 - DNA, 17 bp, Homo sapiens
caagcctgggccactgg

SEQ ID NO: 256929 - DNA, 20 bp, Homo sapiens
caagcctgggccactggcat

SEQ ID NO: 256930 - DNA, 16 bp, Homo sapiens
caagcctgtgaataaa

SEQ ID NO: 256931 - DNA, 16 bp, Homo sapiens
caagctaataaaatat

SEQ ID NO: 256932 - DNA, 19 bp, Homo sapiens
caagctaataaaatatcat

SEQ ID NO: 256933 - DNA, 14 bp, Homo sapiens
caagctcacttgct

SEQ ID NO: 256934 - DNA, 12 bp, Homo sapiens
caagctctcttg

SEQ ID NO: 256935 - DNA, 14 bp, Homo sapiens
caagctctcttgcc

SEQ ID NO: 256936 - DNA, 13 bp, Homo sapiens
caagctgcaggga

SEQ ID NO: 256937 - DNA, 13 bp, Homo sapiens
caagctgcctccc

SEQ ID NO: 256938 - DNA, 19 bp, Homo sapiens
caagctgcctccctgtcca

SEQ ID NO: 256939 - DNA, 15 bp, Homo sapiens
caagctgcctctgac

SEQ ID NO: 256940 - DNA, 20 bp, Homo sapiens
caagctgcctctgacagcag

SEQ ID NO: 256941 - DNA, 17 bp, Homo sapiens
caagctggcaggagggt

SEQ ID NO: 256942 - DNA, 21 bp, Homo sapiens
caagctggccactatcacata

SEQ ID NO: 256943 - DNA, 18 bp, Homo sapiens
caagctgtccagagaaaa

SEQ ID NO: 256944 - DNA, 12 bp, Homo sapiens
caagctgtcccc

SEQ ID NO: 256945 - DNA, 16 bp, Homo sapiens
caagctgtcccctctg

SEQ ID NO: 256946 - DNA, 17 bp, Homo sapiens
caagcttaaggagagga

SEQ ID NO: 256947 - DNA, 22 bp, Homo sapiens
caagcttaatagccctccccct

SEQ ID NO: 256948 - DNA, 16 bp, Homo sapiens
caagcttggcagccga

SEQ ID NO: 256949 - DNA, 20 bp, Homo sapiens
caagcttgtgtacttgaccg

SEQ ID NO: 256950 - DNA, 21 bp, Homo sapiens
caagcttgtttccctgctggc

SEQ ID NO: 256951 - DNA, 12 bp, Homo sapiens
caagctttcttc

SEQ ID NO: 256952 - DNA, 19 bp, Homo sapiens
agctctagacaaccctgca

SEQ ID NO: 256953 - DNA, 16 bp, Homo sapiens
agctctatctgcaatg

SEQ ID NO: 256954 - DNA, 17 bp, Homo sapiens
agctctattttaaagta

SEQ ID NO: 256955 - DNA, 19 bp, Homo sapiens
agctctccagtcaggaggc

SEQ ID NO: 256956 - DNA, 12 bp, Homo sapiens
agctctcccaca

SEQ ID NO: 256957 - DNA, 12 bp, Homo sapiens
agctctcccctg

SEQ ID NO: 256958 - DNA, 11 bp, Homo sapiens
agctctctcag

SEQ ID NO: 256959 - DNA, 12 bp, Homo sapiens
agctctctggga

SEQ ID NO: 256960 - DNA, 18 bp, Homo sapiens
agctctctgggacctcct

SEQ ID NO: 256961 - DNA, 14 bp, Homo sapiens
agctctgaccctga

SEQ ID NO: 256962 - DNA, 16 bp, Homo sapiens
agctctgagacagcag

SEQ ID NO: 256963 - DNA, 12 bp, Homo sapiens
agctctgagccc

SEQ ID NO: 256964 - DNA, 14 bp, Homo sapiens
agctctgagccctc

SEQ ID NO: 256965 - DNA, 17 bp, Homo sapiens
agctctgagccctcctt

SEQ ID NO: 256966 - DNA, 15 bp, Homo sapiens
agctctgcagcaata

SEQ ID NO: 256967 - DNA, 16 bp, Homo sapiens
agctctgcatctcctg

SEQ ID NO: 256968 - DNA, 14 bp, Homo sapiens
agctctgcccccgc

SEQ ID NO: 256969 - DNA, 18 bp, Homo sapiens
agctctggagccacctgt

SEQ ID NO: 256970 - DNA, 19 bp, Homo sapiens
agctctggctcacagactg

SEQ ID NO: 256971 - DNA, 18 bp, Homo sapiens
agctctgggggctccagc

SEQ ID NO: 256972 - DNA, 12 bp, Homo sapiens
agctctggtggg

SEQ ID NO: 256973 - DNA, 21 bp, Homo sapiens
agctctgtcgtggtagcagat

SEQ ID NO: 256974 - DNA, 14 bp, Homo sapiens
agctctgtggcctg

SEQ ID NO: 256975 - DNA, 16 bp, Homo sapiens
agctctgtggcctgtg

SEQ ID NO: 256976 - DNA, 17 bp, Homo sapiens
agctctgtggcctgtgt

SEQ ID NO: 256977 - DNA, 15 bp, Homo sapiens
cctaggtctccaccc

SEQ ID NO: 256978 - DNA, 23 bp, Homo sapiens
cctaggtgggtcaactccaaggc

SEQ ID NO: 256979 - DNA, 16 bp, Homo sapiens
cctagtactctctgct

SEQ ID NO: 256980 - DNA, 19 bp, Homo sapiens
cctagtactctctgctcta

SEQ ID NO: 256981 - DNA, 17 bp, Homo sapiens
cctagtatacccactgc

SEQ ID NO: 256982 - DNA, 21 bp, Homo sapiens
cctagtatacccactgcatcc

SEQ ID NO: 256983 - DNA, 17 bp, Homo sapiens
cctagtcagatggatgt

SEQ ID NO: 256984 - DNA, 14 bp, Homo sapiens
cctagtcagccaca

SEQ ID NO: 256985 - DNA, 16 bp, Homo sapiens
cctagtccagtgacct

SEQ ID NO: 256986 - DNA, 19 bp, Homo sapiens
cctagtggcttcagcccct

SEQ ID NO: 256987 - DNA, 20 bp, Homo sapiens
cctagtgggagcccagcaca

SEQ ID NO: 256988 - DNA, 17 bp, Homo sapiens
cctagtggggaggggcc

SEQ ID NO: 256989 - DNA, 20 bp, Homo sapiens
cctagtggggaggggcctgg

SEQ ID NO: 256990 - DNA, 14 bp, Homo sapiens
cctagttacccacc

SEQ ID NO: 256991 - DNA, 13 bp, Homo sapiens
cctagttcttcat

SEQ ID NO: 256992 - DNA, 18 bp, Homo sapiens
cctagttttatgtttctt

SEQ ID NO: 256993 - DNA, 15 bp, Homo sapiens
cctataaatggactt

SEQ ID NO: 256994 - DNA, 23 bp, Homo sapiens
cctataccccttacttagcatgc

SEQ ID NO: 256995 - DNA, 22 bp, Homo sapiens
cctataccctaggtctccaccc

SEQ ID NO: 256996 - DNA, 15 bp, Homo sapiens
cctatagagaggggg

SEQ ID NO: 256997 - DNA, 18 bp, Homo sapiens
cctatatgatttatagtt

SEQ ID NO: 256998 - DNA, 16 bp, Homo sapiens
cctatatttcctcttc

SEQ ID NO: 256999 - DNA, 17 bp, Homo sapiens
cctatatttcctcttct

SEQ ID NO: 257000 - DNA, 17 bp, Homo sapiens
cctatcagaagtttctc

SEQ ID NO: 257001 - DNA, 14 bp, Homo sapiens
cctatcctctgagt

SEQ ID NO: 257002 - DNA, 22 bp, Homo sapiens
cctatcgatctggaaagagctg

SEQ ID NO: 257003 - DNA, 18 bp, Homo sapiens
cctatctaaccctcccat

SEQ ID NO: 257004 - DNA, 17 bp, Homo sapiens
cctatgagatggccatg

SEQ ID NO: 257005 - DNA, 17 bp, Homo sapiens
cctatgccacctgcagc

SEQ ID NO: 257006 - DNA, 18 bp, Homo sapiens
cctatgccacctgcagcg

SEQ ID NO: 257007 - DNA, 19 bp, Homo sapiens
cctatgccacctgcagcgt

SEQ ID NO: 257008 - DNA, 14 bp, Homo sapiens
cctatgcctgtggt

SEQ ID NO: 257009 - DNA, 18 bp, Homo sapiens
cctatggaaagggtgtgg

SEQ ID NO: 257010 - DNA, 19 bp, Homo sapiens
cctatgtcctaaggacaca

SEQ ID NO: 257011 - DNA, 22 bp, Homo sapiens
cctatgtcctaaggacacacta

SEQ ID NO: 257012 - DNA, 14 bp, Homo sapiens
cctattaatcttca

SEQ ID NO: 257013 - DNA, 21 bp, Homo sapiens
cctattgccaggaatgtttca

SEQ ID NO: 257014 - DNA, 11 bp, Homo sapiens
cctatttaagc

SEQ ID NO: 257015 - DNA, 14 bp, Homo sapiens
cctatttgactgct

SEQ ID NO: 257016 - DNA, 22 bp, Homo sapiens
cctcaaacagtaggttggcagt

SEQ ID NO: 257017 - DNA, 22 bp, Homo sapiens
cctcaaccctccctcagcccct

SEQ ID NO: 257018 - DNA, 23 bp, Homo sapiens
cctcaaccctccctcagcccctc

SEQ ID NO: 257019 - DNA, 14 bp, Homo sapiens
cctcaacctgtaaa

SEQ ID NO: 257020 - DNA, 13 bp, Homo sapiens
cctcaacctgtga

SEQ ID NO: 257021 - DNA, 14 bp, Homo sapiens
cctcaacctgtgat

SEQ ID NO: 257022 - DNA, 19 bp, Homo sapiens
cctcaacgttgctccccat

SEQ ID NO: 257023 - DNA, 19 bp, Homo sapiens
cctcaagcaaggaagcaga

SEQ ID NO: 257024 - DNA, 16 bp, Homo sapiens
cctcaagcttctcaga

SEQ ID NO: 257025 - DNA, 23 bp, Homo sapiens
cctcaaggacttgaaagcatcca

SEQ ID NO: 257026 - DNA, 10 bp, Homo sapiens
cctcaagggc

SEQ ID NO: 257027 - DNA, 22 bp, Homo sapiens
cctcaagggtagggtctgcgtg

SEQ ID NO: 257028 - DNA, 23 bp, Homo sapiens
cctcaagggtagggtctgcgtgt

SEQ ID NO: 257029 - DNA, 16 bp, Homo sapiens
cctcaatacccctagt

SEQ ID NO: 257030 - DNA, 23 bp, Homo sapiens
cctcaatgccagtaacgcgtctt

SEQ ID NO: 257031 - DNA, 17 bp, Homo sapiens
cctcaatgccctgccat

SEQ ID NO: 257032 - DNA, 19 bp, Homo sapiens
cctcaatgccctgccatta

SEQ ID NO: 257033 - DNA, 23 bp, Homo sapiens
cctcaatggggaattttttgatc

SEQ ID NO: 257034 - DNA, 20 bp, Homo sapiens
cctcacacacacagctgggc

SEQ ID NO: 257035 - DNA, 13 bp, Homo sapiens
cctcacagcctag

SEQ ID NO: 257036 - DNA, 13 bp, Homo sapiens
cctcacagcctct

SEQ ID NO: 257037 - DNA, 14 bp, Homo sapiens
cctcacatctccct

SEQ ID NO: 257038 - DNA, 13 bp, Homo sapiens
cctcacatcttta

SEQ ID NO: 257039 - DNA, 14 bp, Homo sapiens
cctcacatgcccgc

SEQ ID NO: 257040 - DNA, 12 bp, Homo sapiens
cctcaccaataa

SEQ ID NO: 257041 - DNA, 24 bp, Homo sapiens
cctcaccaataacttcagagaagt

SEQ ID NO: 257042 - DNA, 16 bp, Homo sapiens
cctcaccattgtgaag

SEQ ID NO: 257043 - DNA, 13 bp, Homo sapiens
cctcacccagaag

SEQ ID NO: 257044 - DNA, 14 bp, Homo sapiens
cctcacccctgcag

SEQ ID NO: 257045 - DNA, 15 bp, Homo sapiens
cctcacccctgcagg

SEQ ID NO: 257046 - DNA, 16 bp, Homo sapiens
cctcacccctgcaggc

SEQ ID NO: 257047 - DNA, 18 bp, Homo sapiens
cctcacccctgcaggcgg

SEQ ID NO: 257048 - DNA, 21 bp, Homo sapiens
cctcacccgctgcccagccct

SEQ ID NO: 257049 - DNA, 13 bp, Homo sapiens
cctcaccctgctt

SEQ ID NO: 257050 - DNA, 21 bp, Homo sapiens
cctcaccctgcttggggcctg

SEQ ID NO: 257051 - DNA, 14 bp, Homo sapiens
cctcacctcaggac

SEQ ID NO: 257052 - DNA, 13 bp, Homo sapiens
cctcacctctgga

SEQ ID NO: 257053 - DNA, 22 bp, Homo sapiens
cctcacctctggactggctaga

SEQ ID NO: 257054 - DNA, 16 bp, Homo sapiens
cctcacctggcttccc

SEQ ID NO: 257055 - DNA, 20 bp, Homo sapiens
caagggaagaaacactctta

SEQ ID NO: 257056 - DNA, 17 bp, Homo sapiens
caagggagagacctcat

SEQ ID NO: 257057 - DNA, 16 bp, Homo sapiens
caagggattctgggaa

SEQ ID NO: 257058 - DNA, 17 bp, Homo sapiens
caagggcatcaggcact

SEQ ID NO: 257059 - DNA, 13 bp, Homo sapiens
caagggcccagag

SEQ ID NO: 257060 - DNA, 16 bp, Homo sapiens
caaggggcagtctgga

SEQ ID NO: 257061 - DNA, 18 bp, Homo sapiens
caaggggccagctgcccc

SEQ ID NO: 257062 - DNA, 14 bp, Homo sapiens
caaggggtgcctgg

SEQ ID NO: 257063 - DNA, 15 bp, Homo sapiens
caagggtagggtctg

SEQ ID NO: 257064 - DNA, 19 bp, Homo sapiens
caagggtatgggaagccat

SEQ ID NO: 257065 - DNA, 18 bp, Homo sapiens
caagggtgcttgtggtca

SEQ ID NO: 257066 - DNA, 21 bp, Homo sapiens
caagggttgcttctgagtggt

SEQ ID NO: 257067 - DNA, 20 bp, Homo sapiens
caaggtatacacccagttct

SEQ ID NO: 257068 - DNA, 18 bp, Homo sapiens
caaggtccactccctgct

SEQ ID NO: 257069 - DNA, 21 bp, Homo sapiens
caaggtccactccctgctcca

SEQ ID NO: 257070 - DNA, 15 bp, Homo sapiens
caaggtcccctccac

SEQ ID NO: 257071 - DNA, 17 bp, Homo sapiens
caaggtcccctccacat

SEQ ID NO: 257072 - DNA, 19 bp, Homo sapiens
caaggtcgtttttttcatt

SEQ ID NO: 257073 - DNA, 21 bp, Homo sapiens
caaggtctccttactctgagc

SEQ ID NO: 257074 - DNA, 22 bp, Homo sapiens
caaggtctccttactctgagcc

SEQ ID NO: 257075 - DNA, 23 bp, Homo sapiens
caaggtgaagatgggaacgcaga

SEQ ID NO: 257076 - DNA, 21 bp, Homo sapiens
caaggtgataggaaaactgaa

SEQ ID NO: 257077 - DNA, 23 bp, Homo sapiens
caaggtgctgttgtcattgcttt

SEQ ID NO: 257078 - DNA, 22 bp, Homo sapiens
caaggtgggccttgctacctca

SEQ ID NO: 257079 - DNA, 15 bp, Homo sapiens
caaggtgggggagcc

SEQ ID NO: 257080 - DNA, 22 bp, Homo sapiens
caaggtgggggagcctggagcc

SEQ ID NO: 257081 - DNA, 20 bp, Homo sapiens
caaggtgggttccagggact

SEQ ID NO: 257082 - DNA, 23 bp, Homo sapiens
caaggttgctgttgtgcagtgtg

SEQ ID NO: 257083 - DNA, 22 bp, Homo sapiens
caaggttggcaccccagctacc

SEQ ID NO: 257084 - DNA, 14 bp, Homo sapiens
caagtaagaagaca

SEQ ID NO: 257085 - DNA, 22 bp, Homo sapiens
caagtaagaagacatgaaccaa

SEQ ID NO: 257086 - DNA, 12 bp, Homo sapiens
caagtaatgaat

SEQ ID NO: 257087 - DNA, 11 bp, Homo sapiens
caagtaattgt

SEQ ID NO: 257088 - DNA, 23 bp, Homo sapiens
caagtaattgtgaaaaagttaaa

SEQ ID NO: 257089 - DNA, 21 bp, Homo sapiens
caagtaggagacacagatggc

SEQ ID NO: 257090 - DNA, 20 bp, Homo sapiens
caagtaggtgggattacagg

SEQ ID NO: 257091 - DNA, 22 bp, Homo sapiens
caagtatccaaccaacttggtt

SEQ ID NO: 257092 - DNA, 23 bp, Homo sapiens
caagtattaggggtaatatattg

SEQ ID NO: 257093 - DNA, 17 bp, Homo sapiens
caagtcaaacagtgtgg

SEQ ID NO: 257094 - DNA, 19 bp, Homo sapiens
caagtcaaacagtgtggct

SEQ ID NO: 257095 - DNA, 20 bp, Homo sapiens
caagtcaacactcttcttga

SEQ ID NO: 257096 - DNA, 14 bp, Homo sapiens
caagtcaatcattt

SEQ ID NO: 257097 - DNA, 16 bp, Homo sapiens
caagtcacagctgcag

SEQ ID NO: 257098 - DNA, 18 bp, Homo sapiens
caagtcacagctgcagct

SEQ ID NO: 257099 - DNA, 22 bp, Homo sapiens
caagtcacagctgcagctgggc

SEQ ID NO: 257100 - DNA, 22 bp, Homo sapiens
caagtcatgatggagacttcag

SEQ ID NO: 257101 - DNA, 20 bp, Homo sapiens
caagtcatggagaatctgct

SEQ ID NO: 257102 - DNA, 13 bp, Homo sapiens
caagtcatgtgca

SEQ ID NO: 257103 - DNA, 16 bp, Homo sapiens
caagtcatgtgcattt

SEQ ID NO: 257104 - DNA, 13 bp, Homo sapiens
caagtccaacctg

SEQ ID NO: 257105 - DNA, 14 bp, Homo sapiens
caagtccaacctgc

SEQ ID NO: 257106 - DNA, 19 bp, Homo sapiens
cctcagctgccaagcactc

SEQ ID NO: 257107 - DNA, 16 bp, Homo sapiens
cctcagctgcctcact

SEQ ID NO: 257108 - DNA, 18 bp, Homo sapiens
cctcagctgcctcacttc

SEQ ID NO: 257109 - DNA, 17 bp, Homo sapiens
cctcaggaccccagagg

SEQ ID NO: 257110 - DNA, 19 bp, Homo sapiens
cctcaggaccccagaggga

SEQ ID NO: 257111 - DNA, 21 bp, Homo sapiens
cctcaggcagaggatgttctg

SEQ ID NO: 257112 - DNA, 15 bp, Homo sapiens
cctcaggcaggaagg

SEQ ID NO: 257113 - DNA, 12 bp, Homo sapiens
cctcaggctgct

SEQ ID NO: 257114 - DNA, 17 bp, Homo sapiens
cctcagggatgtgggaa

SEQ ID NO: 257115 - DNA, 11 bp, Homo sapiens
cctcagggctt

SEQ ID NO: 257116 - DNA, 18 bp, Homo sapiens
cctcagggtccctcagga

SEQ ID NO: 257117 - DNA, 14 bp, Homo sapiens
cctcagggtggggg

SEQ ID NO: 257118 - DNA, 19 bp, Homo sapiens
cctcagggtggggggtgac

SEQ ID NO: 257119 - DNA, 19 bp, Homo sapiens
cctcaggtttgcctgaggg

SEQ ID NO: 257120 - DNA, 20 bp, Homo sapiens
cctcagtccctccctcctgg

SEQ ID NO: 257121 - DNA, 18 bp, Homo sapiens
cctcagtggactttccac

SEQ ID NO: 257122 - DNA, 23 bp, Homo sapiens
cctcagtggactttccaccccct

SEQ ID NO: 257123 - DNA, 17 bp, Homo sapiens
cctcagttcccttggcc

SEQ ID NO: 257124 - DNA, 20 bp, Homo sapiens
cctcagttcccttggcctca

SEQ ID NO: 257125 - DNA, 23 bp, Homo sapiens
cctcatcacacgtcacaatgtcc

SEQ ID NO: 257126 - DNA, 21 bp, Homo sapiens
cctcatcaggatgaacccagg

SEQ ID NO: 257127 - DNA, 23 bp, Homo sapiens
cctcatcaggatgaacccaggac

SEQ ID NO: 257128 - DNA, 15 bp, Homo sapiens
cctcatccatgcaga

SEQ ID NO: 257129 - DNA, 21 bp, Homo sapiens
cctcatcccctcgtcctgtcc

SEQ ID NO: 257130 - DNA, 23 bp, Homo sapiens
cctcatcccctcgtcctgtccca

SEQ ID NO: 257131 - DNA, 14 bp, Homo sapiens
cctcatcctgcttc

SEQ ID NO: 257132 - DNA, 18 bp, Homo sapiens
cctcatcctgcttctctt

SEQ ID NO: 257133 - DNA, 19 bp, Homo sapiens
cctcatcctgcttctcttt

SEQ ID NO: 257134 - DNA, 12 bp, Homo sapiens
cctcatctccaa

SEQ ID NO: 257135 - DNA, 22 bp, Homo sapiens
cctcatcttgaagggcccagga

SEQ ID NO: 257136 - DNA, 13 bp, Homo sapiens
cctcatgaatgta

SEQ ID NO: 257137 - DNA, 20 bp, Homo sapiens
cctcatgaatgtaaatttgt

SEQ ID NO: 257138 - DNA, 22 bp, Homo sapiens
cctcatgaatgtaaatttgtac

SEQ ID NO: 257139 - DNA, 14 bp, Homo sapiens
cctcatgagtgtca

SEQ ID NO: 257140 - DNA, 16 bp, Homo sapiens
cctcatgagtgtcaaa

SEQ ID NO: 257141 - DNA, 15 bp, Homo sapiens
cctcatgccacacct

SEQ ID NO: 257142 - DNA, 17 bp, Homo sapiens
cctcatgccacaccttc

SEQ ID NO: 257143 - DNA, 19 bp, Homo sapiens
cctcatgcctggcccccct

SEQ ID NO: 257144 - DNA, 22 bp, Homo sapiens
cctcatgcctggcccccctcca

SEQ ID NO: 257145 - DNA, 17 bp, Homo sapiens
cctcatggctgttatct

SEQ ID NO: 257146 - DNA, 17 bp, Homo sapiens
cctcatgtcatttctca

SEQ ID NO: 257147 - DNA, 13 bp, Homo sapiens
cctcattcctgaa

SEQ ID NO: 257148 - DNA, 18 bp, Homo sapiens
cctcattctagcaccttg

SEQ ID NO: 257149 - DNA, 14 bp, Homo sapiens
cctcattcttctct

SEQ ID NO: 257150 - DNA, 18 bp, Homo sapiens
cctcatttatcactctga

SEQ ID NO: 257151 - DNA, 17 bp, Homo sapiens
cctcatttctgccagcg

SEQ ID NO: 257152 - DNA, 13 bp, Homo sapiens
cctcatttgcatc

SEQ ID NO: 257153 - DNA, 18 bp, Homo sapiens
cctccaaactcctgcctg

SEQ ID NO: 257154 - DNA, 15 bp, Homo sapiens
cctccaaatgctgtc

SEQ ID NO: 257155 - DNA, 20 bp, Homo sapiens
cctccaagaagccctccttg

SEQ ID NO: 257156 - DNA, 21 bp, Homo sapiens
cctccaagaagccctccttgc

SEQ ID NO: 257157 - DNA, 22 bp, Homo sapiens
cctccaagaagccctccttgcc

SEQ ID NO: 257158 - DNA, 14 bp, Homo sapiens
cctccaagcaagta

SEQ ID NO: 257159 - DNA, 15 bp, Homo sapiens
cctccaatcctttcc

SEQ ID NO: 257160 - DNA, 18 bp, Homo sapiens
cctccacaccagtggcct

SEQ ID NO: 257161 - DNA, 14 bp, Homo sapiens
cctccacacctcca

SEQ ID NO: 257162 - DNA, 17 bp, Homo sapiens
cctccacacctccaccc

SEQ ID NO: 257163 - DNA, 17 bp, Homo sapiens
cctccacagtgctgctt

SEQ ID NO: 257164 - DNA, 18 bp, Homo sapiens
cctccacagtgctgcttc

SEQ ID NO: 257165 - DNA, 21 bp, Homo sapiens
cctccacatcccagcagccca

SEQ ID NO: 257166 - DNA, 21 bp, Homo sapiens
cctccacattaagtggctttt

SEQ ID NO: 257167 - DNA, 19 bp, Homo sapiens
cctccaccacaagagctcc

SEQ ID NO: 257168 - DNA, 12 bp, Homo sapiens
cctccacccagc

SEQ ID NO: 257169 - DNA, 13 bp, Homo sapiens
cctccacccagcc

SEQ ID NO: 257170 - DNA, 14 bp, Homo sapiens
cctccacccagccc

SEQ ID NO: 257171 - DNA, 16 bp, Homo sapiens
cctccacccagcccct

SEQ ID NO: 257172 - DNA, 12 bp, Homo sapiens
cctccaccccag

SEQ ID NO: 257173 - DNA, 16 bp, Homo sapiens
cctccaccccagtccc

SEQ ID NO: 257174 - DNA, 20 bp, Homo sapiens
cctccaccccagtccccggg

SEQ ID NO: 257175 - DNA, 16 bp, Homo sapiens
cctccacccccgccac

SEQ ID NO: 257176 - DNA, 19 bp, Homo sapiens
cctccaccgagccagcttg

SEQ ID NO: 257177 - DNA, 17 bp, Homo sapiens
cctccaccggtgcctcc

SEQ ID NO: 257178 - DNA, 17 bp, Homo sapiens
cctccacctcctctctt

SEQ ID NO: 257179 - DNA, 21 bp, Homo sapiens
cctccactcccccacctgaca

SEQ ID NO: 257180 - DNA, 11 bp, Homo sapiens
cctccactcct

SEQ ID NO: 257181 - DNA, 15 bp, Homo sapiens
cctccactcctccca

SEQ ID NO: 257182 - DNA, 16 bp, Homo sapiens
cctccactccttcctg

SEQ ID NO: 257183 - DNA, 14 bp, Homo sapiens
cctccactgccctc

SEQ ID NO: 257184 - DNA, 16 bp, Homo sapiens
cctccactgccctctg

SEQ ID NO: 257185 - DNA, 12 bp, Homo sapiens
cctccactgtgt

SEQ ID NO: 257186 - DNA, 9 bp, Homo sapiens
cctccagac

SEQ ID NO: 257187 - DNA, 24 bp, Homo sapiens
cctccagacacccagaatgtagca

SEQ ID NO: 257188 - DNA, 14 bp, Homo sapiens
cctccagaccccta

SEQ ID NO: 257189 - DNA, 15 bp, Homo sapiens
cctccagaccctgcc

SEQ ID NO: 257190 - DNA, 21 bp, Homo sapiens
cctccagaccctgcctgagcc

SEQ ID NO: 257191 - DNA, 22 bp, Homo sapiens
caatatgagtaatgtttaagat

SEQ ID NO: 257192 - DNA, 12 bp, Homo sapiens
caatatggagaa

SEQ ID NO: 257193 - DNA, 22 bp, Homo sapiens
caatatgggaggaacaaagaca

SEQ ID NO: 257194 - DNA, 19 bp, Homo sapiens
caatatggtggccctgggg

SEQ ID NO: 257195 - DNA, 13 bp, Homo sapiens
caatatgtattgt

SEQ ID NO: 257196 - DNA, 21 bp, Homo sapiens
caatatgtattgtaaacatgt

SEQ ID NO: 257197 - DNA, 21 bp, Homo sapiens
caatattaaagggtctggaaa

SEQ ID NO: 257198 - DNA, 17 bp, Homo sapiens
caatattaccatcttaa

SEQ ID NO: 257199 - DNA, 14 bp, Homo sapiens
caatattataattt

SEQ ID NO: 257200 - DNA, 14 bp, Homo sapiens
caatattcaataaa

SEQ ID NO: 257201 - DNA, 9 bp, Homo sapiens
caatattta

SEQ ID NO: 257202 - DNA, 17 bp, Homo sapiens
caatatttactcatcag

SEQ ID NO: 257203 - DNA, 14 bp, Homo sapiens
caatatttattatt

SEQ ID NO: 257204 - DNA, 14 bp, Homo sapiens
caatatttattgta

SEQ ID NO: 257205 - DNA, 18 bp, Homo sapiens
caatcaaaggaaaatagt

SEQ ID NO: 257206 - DNA, 16 bp, Homo sapiens
caatcacaaaagctgt

SEQ ID NO: 257207 - DNA, 24 bp, Homo sapiens
caatcacgagatcttccttccgct

SEQ ID NO: 257208 - DNA, 14 bp, Homo sapiens
caatcactattctt

SEQ ID NO: 257209 - DNA, 15 bp, Homo sapiens
caatcactattctta

SEQ ID NO: 257210 - DNA, 22 bp, Homo sapiens
caatcactattcttaagcactt

SEQ ID NO: 257211 - DNA, 16 bp, Homo sapiens
caatcactgagtttgt

SEQ ID NO: 257212 - DNA, 17 bp, Homo sapiens
caatcagctgctttgtt

SEQ ID NO: 257213 - DNA, 13 bp, Homo sapiens
caatcatctagat

SEQ ID NO: 257214 - DNA, 17 bp, Homo sapiens
caatcatgaaatatgca

SEQ ID NO: 257215 - DNA, 13 bp, Homo sapiens
caatcatttctca

SEQ ID NO: 257216 - DNA, 16 bp, Homo sapiens
caatcattttgggaaa

SEQ ID NO: 257217 - DNA, 17 bp, Homo sapiens
caatccaaatgcattca

SEQ ID NO: 257218 - DNA, 15 bp, Homo sapiens
caatcccaattctgt

SEQ ID NO: 257219 - DNA, 17 bp, Homo sapiens
caatcccaccaaccctc

SEQ ID NO: 257220 - DNA, 22 bp, Homo sapiens
caatcccaccaaccctcagagc

SEQ ID NO: 257221 - DNA, 15 bp, Homo sapiens
caatcccgtgaaaga

SEQ ID NO: 257222 - DNA, 18 bp, Homo sapiens
caatcctcactgggtggg

SEQ ID NO: 257223 - DNA, 12 bp, Homo sapiens
caatcctcccca

SEQ ID NO: 257224 - DNA, 13 bp, Homo sapiens
caatcctcctgag

SEQ ID NO: 257225 - DNA, 10 bp, Homo sapiens
caatctaaaa

SEQ ID NO: 257226 - DNA, 12 bp, Homo sapiens
caatctaaaaaa

SEQ ID NO: 257227 - DNA, 19 bp, Homo sapiens
caatctatttattggacat

SEQ ID NO: 257228 - DNA, 18 bp, Homo sapiens
caatctccagggctgccc

SEQ ID NO: 257229 - DNA, 19 bp, Homo sapiens
caatctccagggctgcccc

SEQ ID NO: 257230 - DNA, 18 bp, Homo sapiens
caatctctggaaaaataa

SEQ ID NO: 257231 - DNA, 14 bp, Homo sapiens
caatctctgttctg

SEQ ID NO: 257232 - DNA, 15 bp, Homo sapiens
caatctctgttctgc

SEQ ID NO: 257233 - DNA, 23 bp, Homo sapiens
caatctgggtggtaactgccagc

SEQ ID NO: 257234 - DNA, 16 bp, Homo sapiens
caatcttatgttgatc

SEQ ID NO: 257235 - DNA, 17 bp, Homo sapiens
caatcttgctgtgaaac

SEQ ID NO: 257236 - DNA, 22 bp, Homo sapiens
caatcttgctgtgaaacagtgt

SEQ ID NO: 257237 - DNA, 23 bp, Homo sapiens
caatgaaaccttcctcttgaggg

SEQ ID NO: 257238 - DNA, 22 bp, Homo sapiens
caatgaaatatttgcttattta

SEQ ID NO: 257239 - DNA, 15 bp, Homo sapiens
caatgaacagctcct

SEQ ID NO: 257240 - DNA, 14 bp, Homo sapiens
caatgaatattgaa

SEQ ID NO: 257241 - DNA, 20 bp, Homo sapiens
caatgacactggaagggtcc

SEQ ID NO: 257242 - DNA, 15 bp, Homo sapiens
caatgacatcttcaa

SEQ ID NO: 257243 - DNA, 19 bp, Homo sapiens
caatgacatcttcaaagct

SEQ ID NO: 257244 - DNA, 16 bp, Homo sapiens
caatgatctaggttta

SEQ ID NO: 257245 - DNA, 17 bp, Homo sapiens
caatgatctaggtttaa

SEQ ID NO: 257246 - DNA, 22 bp, Homo sapiens
caatgatctaggtttaactcag

SEQ ID NO: 257247 - DNA, 24 bp, Homo sapiens
caatgatctaggtttaactcagat

SEQ ID NO: 257248 - DNA, 18 bp, Homo sapiens
caatgatgattaaacacc

SEQ ID NO: 257249 - DNA, 20 bp, Homo sapiens
caatgatgcttactacagaa

SEQ ID NO: 257250 - DNA, 19 bp, Homo sapiens
caatgattcataacaatgt

SEQ ID NO: 257251 - DNA, 22 bp, Homo sapiens
caatgattgttaatttacagct

SEQ ID NO: 257252 - DNA, 14 bp, Homo sapiens
caatgcagatgcca

SEQ ID NO: 257253 - DNA, 17 bp, Homo sapiens
caatgcagatgccagag

SEQ ID NO: 257254 - DNA, 18 bp, Homo sapiens
caatgcagatgccagagc

SEQ ID NO: 257255 - DNA, 22 bp, Homo sapiens
caatgcattaccttctgttcct

SEQ ID NO: 257256 - DNA, 19 bp, Homo sapiens
caatgcctcacgagatttg

SEQ ID NO: 257257 - DNA, 19 bp, Homo sapiens
caatgctatggactgcaca

SEQ ID NO: 257258 - DNA, 20 bp, Homo sapiens
caatgcttttatatggccca

SEQ ID NO: 257259 - DNA, 21 bp, Homo sapiens
caatggcgcagtgcctctggt

SEQ ID NO: 257260 - DNA, 22 bp, Homo sapiens
caatggctatatggcaagaaag

SEQ ID NO: 257261 - DNA, 16 bp, Homo sapiens
caatggctatattaat

SEQ ID NO: 257262 - DNA, 15 bp, Homo sapiens
caatggctgggaggg

SEQ ID NO: 257263 - DNA, 15 bp, Homo sapiens
caatgggcaatgaca

SEQ ID NO: 257264 - DNA, 23 bp, Homo sapiens
caatggtgaactgtcattacaga

SEQ ID NO: 257265 - DNA, 15 bp, Homo sapiens
caatggtgagggctg

SEQ ID NO: 257266 - DNA, 21 bp, Homo sapiens
caatggtgagggctgagaggg

SEQ ID NO: 257267 - DNA, 20 bp, Homo sapiens
caatggtgatcctctatttt

SEQ ID NO: 257268 - DNA, 17 bp, Homo sapiens
caatgtatcccttctca

SEQ ID NO: 257269 - DNA, 15 bp, Homo sapiens
caatgtcaaggtgct

SEQ ID NO: 257270 - DNA, 18 bp, Homo sapiens
caatgtcacaacctctct

SEQ ID NO: 257271 - DNA, 21 bp, Homo sapiens
caatgtcgagtatattattat

SEQ ID NO: 257272 - DNA, 11 bp, Homo sapiens
caatgtgaaaa

SEQ ID NO: 257273 - DNA, 18 bp, Homo sapiens
caatgtgagtcccagagc

SEQ ID NO: 257274 - DNA, 15 bp, Homo sapiens
caatgtgattctaat

SEQ ID NO: 257275 - DNA, 12 bp, Homo sapiens
caatgtgcagtg

SEQ ID NO: 257276 - DNA, 13 bp, Homo sapiens
caatgtgcagtgt

SEQ ID NO: 257277 - DNA, 16 bp, Homo sapiens
caatgtgcccagtcat

SEQ ID NO: 257278 - DNA, 13 bp, Homo sapiens
caatgtgccccca

SEQ ID NO: 257279 - DNA, 11 bp, Homo sapiens
caatgtgccct

SEQ ID NO: 257280 - DNA, 12 bp, Homo sapiens
caatgtgctgtt

SEQ ID NO: 257281 - DNA, 16 bp, Homo sapiens
caatgtgctgttgatt

SEQ ID NO: 257282 - DNA, 22 bp, Homo sapiens
caatgtgctgttgattctttca

SEQ ID NO: 257283 - DNA, 22 bp, Homo sapiens
caatgtggaaaaaatattttaa

SEQ ID NO: 257284 - DNA, 23 bp, Homo sapiens
caatgtggaaaaaatattttaaa

SEQ ID NO: 257285 - DNA, 17 bp, Homo sapiens
caatgtggaattacata

SEQ ID NO: 257286 - DNA, 19 bp, Homo sapiens
caatgttcaggagagtaaa

SEQ ID NO: 257287 - DNA, 22 bp, Homo sapiens
caatgttcattgtaatgttact

SEQ ID NO: 257288 - DNA, 23 bp, Homo sapiens
caatgttggcctgtcagagcttg

SEQ ID NO: 257289 - DNA, 13 bp, Homo sapiens
caatgttttcctt

SEQ ID NO: 257290 - DNA, 20 bp, Homo sapiens
caattaaaattaaggtctgg

SEQ ID NO: 257291 - DNA, 17 bp, Homo sapiens
caattaaaggtcctgcc

SEQ ID NO: 257292 - DNA, 14 bp, Homo sapiens
caattaaatgtagg

SEQ ID NO: 257293 - DNA, 22 bp, Homo sapiens
caattaaatgtaggtatgaata

SEQ ID NO: 257294 - DNA, 19 bp, Homo sapiens
caattactaaattgtatac

SEQ ID NO: 257295 - DNA, 20 bp, Homo sapiens
caattagagaagccttttcc

SEQ ID NO: 257296 - DNA, 20 bp, Homo sapiens
caattaggaagtgtaacagc

SEQ ID NO: 257297 - DNA, 23 bp, Homo sapiens
caattaggtctgcattttctcag

SEQ ID NO: 257298 - DNA, 13 bp, Homo sapiens
caattatgtgaca

SEQ ID NO: 257299 - DNA, 14 bp, Homo sapiens
caattatgtgacaa

SEQ ID NO: 257300 - DNA, 15 bp, Homo sapiens
caattatgtgacaac

SEQ ID NO: 257301 - DNA, 21 bp, Homo sapiens
caattatgtgacaacctttgt

SEQ ID NO: 257302 - DNA, 12 bp, Homo sapiens
caattattttgg

SEQ ID NO: 257303 - DNA, 23 bp, Homo sapiens
caattattttggatctatcacct

SEQ ID NO: 257304 - DNA, 13 bp, Homo sapiens
caattcataatat

SEQ ID NO: 257305 - DNA, 15 bp, Homo sapiens
caattccctgctgtc

SEQ ID NO: 257306 - DNA, 15 bp, Homo sapiens
caattcctagataaa

SEQ ID NO: 257307 - DNA, 21 bp, Homo sapiens
caattctcctgcctcagcctc

SEQ ID NO: 257308 - DNA, 18 bp, Homo sapiens
caattctgatacagcctt

SEQ ID NO: 257309 - DNA, 13 bp, Homo sapiens
caattctgtccca

SEQ ID NO: 257310 - DNA, 18 bp, Homo sapiens
caattctgtccctgtccc

SEQ ID NO: 257311 - DNA, 21 bp, Homo sapiens
caattgatgtatatgtttata

SEQ ID NO: 257312 - DNA, 23 bp, Homo sapiens
caattgatgtatatgtttatata

SEQ ID NO: 257313 - DNA, 15 bp, Homo sapiens
caattgcagatgcca

SEQ ID NO: 257314 - DNA, 16 bp, Homo sapiens
caattggttaatcttt

SEQ ID NO: 257315 - DNA, 19 bp, Homo sapiens
caattgtaaaactgaggca

SEQ ID NO: 257316 - DNA, 14 bp, Homo sapiens
caattgtcatttat

SEQ ID NO: 257317 - DNA, 19 bp, Homo sapiens
caattgtgggatgtcctct

SEQ ID NO: 257318 - DNA, 19 bp, Homo sapiens
caattgttctgggtgattt

SEQ ID NO: 257319 - DNA, 22 bp, Homo sapiens
caattgtttggggttgaaaatt

SEQ ID NO: 257320 - DNA, 13 bp, Homo sapiens
caatttaattcct

SEQ ID NO: 257321 - DNA, 19 bp, Homo sapiens
caatttactttttaaacag

SEQ ID NO: 257322 - DNA, 22 bp, Homo sapiens
caatttattaaaatgattgtaa

SEQ ID NO: 257323 - DNA, 23 bp, Homo sapiens
caatttattaaaatgattgtaaa

SEQ ID NO: 257324 - DNA, 15 bp, Homo sapiens
caatttcctttatat

SEQ ID NO: 257325 - DNA, 17 bp, Homo sapiens
cctccagagccagcctg

SEQ ID NO: 257326 - DNA, 15 bp, Homo sapiens
cctccagcccacagt

SEQ ID NO: 257327 - DNA, 16 bp, Homo sapiens
cctccagcccacagtg

SEQ ID NO: 257328 - DNA, 22 bp, Homo sapiens
cctccagccctctcactgtgtc

SEQ ID NO: 257329 - DNA, 11 bp, Homo sapiens
cctccagcctc

SEQ ID NO: 257330 - DNA, 14 bp, Homo sapiens
cctccagcctcccc

SEQ ID NO: 257331 - DNA, 19 bp, Homo sapiens
cctccagctctttcctcct

SEQ ID NO: 257332 - DNA, 20 bp, Homo sapiens
cctccagcttcaggcaggcc

SEQ ID NO: 257333 - DNA, 22 bp, Homo sapiens
cctccaggcatgctggcctccc

SEQ ID NO: 257334 - DNA, 12 bp, Homo sapiens
cctccaggctgg

SEQ ID NO: 257335 - DNA, 16 bp, Homo sapiens
cctccaggctggggcc

SEQ ID NO: 257336 - DNA, 22 bp, Homo sapiens
cctccaggctggggcctggcct

SEQ ID NO: 257337 - DNA, 16 bp, Homo sapiens
cctccagggcccccca

SEQ ID NO: 257338 - DNA, 21 bp, Homo sapiens
cctccagggggcctgcaggcc

SEQ ID NO: 257339 - DNA, 21 bp, Homo sapiens
cctccagtacgtcccgctgct

SEQ ID NO: 257340 - DNA, 22 bp, Homo sapiens
cctccagtacgtcccgctgctg

SEQ ID NO: 257341 - DNA, 12 bp, Homo sapiens
cctccagtccag

SEQ ID NO: 257342 - DNA, 20 bp, Homo sapiens
cctccagtctgttctcacat

SEQ ID NO: 257343 - DNA, 20 bp, Homo sapiens
cctccagtgcttggctgccc

SEQ ID NO: 257344 - DNA, 22 bp, Homo sapiens
cctccagtgttgcctcctccca

SEQ ID NO: 257345 - DNA, 23 bp, Homo sapiens
cctccagtgttgcctcctcccat

SEQ ID NO: 257346 - DNA, 19 bp, Homo sapiens
cctccagttctgatgaggc

SEQ ID NO: 257347 - DNA, 14 bp, Homo sapiens
cctccatcccgaca

SEQ ID NO: 257348 - DNA, 18 bp, Homo sapiens
cctccatcctgccaggag

SEQ ID NO: 257349 - DNA, 19 bp, Homo sapiens
cctccatcctgccaggagc

SEQ ID NO: 257350 - DNA, 14 bp, Homo sapiens
cctccatgctgcct

SEQ ID NO: 257351 - DNA, 15 bp, Homo sapiens
cctccatgctgcctc

SEQ ID NO: 257352 - DNA, 19 bp, Homo sapiens
cctccatgctgcctccaga

SEQ ID NO: 257353 - DNA, 20 bp, Homo sapiens
cctccatggcaggaaggcgg

SEQ ID NO: 257354 - DNA, 17 bp, Homo sapiens
cctccatgtagaagagg

SEQ ID NO: 257355 - DNA, 23 bp, Homo sapiens
cctccatgtagaagagggagaag

SEQ ID NO: 257356 - DNA, 15 bp, Homo sapiens
cctccatgtggcccc

SEQ ID NO: 257357 - DNA, 22 bp, Homo sapiens
cctccatgtggccccaggtgcc

SEQ ID NO: 257358 - DNA, 23 bp, Homo sapiens
cctccatgtggccccaggtgcca

SEQ ID NO: 257359 - DNA, 15 bp, Homo sapiens
cctccatttttgttg

SEQ ID NO: 257360 - DNA, 23 bp, Homo sapiens
cctcccaaagtgctgggattaca

SEQ ID NO: 257361 - DNA, 21 bp, Homo sapiens
cctcccaactctggccttggt

SEQ ID NO: 257362 - DNA, 24 bp, Homo sapiens
cctcccaagcgttcctggccttct

SEQ ID NO: 257363 - DNA, 19 bp, Homo sapiens
cctcccaaggtcctctcag

SEQ ID NO: 257364 - DNA, 16 bp, Homo sapiens
cctcccaataaagctg

SEQ ID NO: 257365 - DNA, 17 bp, Homo sapiens
cctcccaataaagctgg

SEQ ID NO: 257366 - DNA, 18 bp, Homo sapiens
cctcccaataaagctgga

SEQ ID NO: 257367 - DNA, 21 bp, Homo sapiens
cctcccacacttgctggggct

SEQ ID NO: 257368 - DNA, 11 bp, Homo sapiens
cctcccacatc

SEQ ID NO: 257369 - DNA, 11 bp, Homo sapiens
cctcccaccag

SEQ ID NO: 257370 - DNA, 12 bp, Homo sapiens
cctcccaccccc

SEQ ID NO: 257371 - DNA, 13 bp, Homo sapiens
cctcccaccccca

SEQ ID NO: 257372 - DNA, 13 bp, Homo sapiens
cctcccacctcca

SEQ ID NO: 257373 - DNA, 21 bp, Homo sapiens
cctcccacgctgggacacaga

SEQ ID NO: 257374 - DNA, 18 bp, Homo sapiens
cctcccagacaggccctc

SEQ ID NO: 257375 - DNA, 11 bp, Homo sapiens
cctcccagcca

SEQ ID NO: 257376 - DNA, 19 bp, Homo sapiens
cctcccatagtgctgggat

SEQ ID NO: 257377 - DNA, 15 bp, Homo sapiens
cctcccatccagcgt

SEQ ID NO: 257378 - DNA, 16 bp, Homo sapiens
cctcccatccagcgtc

SEQ ID NO: 257379 - DNA, 17 bp, Homo sapiens
cctcccatctccttccc

SEQ ID NO: 257380 - DNA, 12 bp, Homo sapiens
cctcccatggcc

SEQ ID NO: 257381 - DNA, 15 bp, Homo sapiens
cctcccatggcccag

SEQ ID NO: 257382 - DNA, 19 bp, Homo sapiens
cctcccatggcccagcagc

SEQ ID NO: 257383 - DNA, 24 bp, Homo sapiens
cctcccatggcccagcagcttggc

SEQ ID NO: 257384 - DNA, 16 bp, Homo sapiens
cctccccaaccctgcc

SEQ ID NO: 257385 - DNA, 21 bp, Homo sapiens
cctccccaaccctgcccctgc

SEQ ID NO: 257386 - DNA, 13 bp, Homo sapiens
cctccccacccca

SEQ ID NO: 257387 - DNA, 13 bp, Homo sapiens
cctccccacccct

SEQ ID NO: 257388 - DNA, 19 bp, Homo sapiens
cctccccacccctgccttt

SEQ ID NO: 257389 - DNA, 21 bp, Homo sapiens
cctccccacccctgcctttgt

SEQ ID NO: 257390 - DNA, 23 bp, Homo sapiens
cctccccagccagcccttccctg

SEQ ID NO: 257391 - DNA, 16 bp, Homo sapiens
cctcccccaaaccctg

SEQ ID NO: 257392 - DNA, 21 bp, Homo sapiens
cctcccccaaaccctgcttct

SEQ ID NO: 257393 - DNA, 19 bp, Homo sapiens
cctcccccaacccccaccc

SEQ ID NO: 257394 - DNA, 14 bp, Homo sapiens
cctcccccagagcc

SEQ ID NO: 257395 - DNA, 12 bp, Homo sapiens
cctcccccaggc

SEQ ID NO: 257396 - DNA, 15 bp, Homo sapiens
cctcccccaggctgc

SEQ ID NO: 257397 - DNA, 21 bp, Homo sapiens
cctcccccaggctgcgcctgc

SEQ ID NO: 257398 - DNA, 22 bp, Homo sapiens
cctccccccagaccccgcccct

SEQ ID NO: 257399 - DNA, 16 bp, Homo sapiens
cctcccccgcagacag

SEQ ID NO: 257400 - DNA, 18 bp, Homo sapiens
cctccccgatccccgaca

SEQ ID NO: 257401 - DNA, 23 bp, Homo sapiens
cctccccggctcgagcagtcctg

SEQ ID NO: 257402 - DNA, 17 bp, Homo sapiens
cctcccctcacccgctg

SEQ ID NO: 257403 - DNA, 16 bp, Homo sapiens
cctcccctcccagtcc

SEQ ID NO: 257404 - DNA, 14 bp, Homo sapiens
cctcccctcccctg

SEQ ID NO: 257405 - DNA, 14 bp, Homo sapiens
cctcccctcctctt

SEQ ID NO: 257406 - DNA, 22 bp, Homo sapiens
cctcccctcttcttgcggcacc

SEQ ID NO: 257407 - DNA, 21 bp, Homo sapiens
cctcccctgcggagctgcatg

SEQ ID NO: 257408 - DNA, 17 bp, Homo sapiens
cctccccttccctgcaa

SEQ ID NO: 257409 - DNA, 12 bp, Homo sapiens
cctccccttggg

SEQ ID NO: 257410 - DNA, 18 bp, Homo sapiens
cctcccctttgaccctat

SEQ ID NO: 257411 - DNA, 16 bp, Homo sapiens
cctcccgcatgctgcc

SEQ ID NO: 257412 - DNA, 19 bp, Homo sapiens
cctcccgcatgctgcctgc

SEQ ID NO: 257413 - DNA, 21 bp, Homo sapiens
cctcccgcatgctgcctgcct

SEQ ID NO: 257414 - DNA, 14 bp, Homo sapiens
cctcccgccgcctc

SEQ ID NO: 257415 - DNA, 13 bp, Homo sapiens
cctccctacctca

SEQ ID NO: 257416 - DNA, 15 bp, Homo sapiens
cctccctacctcaac

SEQ ID NO: 257417 - DNA, 16 bp, Homo sapiens
cctccctacctcaacc

SEQ ID NO: 257418 - DNA, 22 bp, Homo sapiens
cctccctacctcaacctgtaaa

SEQ ID NO: 257419 - DNA, 19 bp, Homo sapiens
cctccctatatgcacccct

SEQ ID NO: 257420 - DNA, 12 bp, Homo sapiens
cctccctcagcc

SEQ ID NO: 257421 - DNA, 16 bp, Homo sapiens
cctccctcagcccctc

SEQ ID NO: 257422 - DNA, 20 bp, Homo sapiens
cctccctcagcccctcttgc

SEQ ID NO: 257423 - DNA, 18 bp, Homo sapiens
cctccctcccctgccctc

SEQ ID NO: 257424 - DNA, 19 bp, Homo sapiens
cctccctcccggcatggga

SEQ ID NO: 257425 - DNA, 14 bp, Homo sapiens
cctccctccctcca

SEQ ID NO: 257426 - DNA, 15 bp, Homo sapiens
cctccctccctccac

SEQ ID NO: 257427 - DNA, 15 bp, Homo sapiens
cctccctccctgcag

SEQ ID NO: 257428 - DNA, 17 bp, Homo sapiens
cctccctccctgcaggg

SEQ ID NO: 257429 - DNA, 16 bp, Homo sapiens
cctccctcctctgtcc

SEQ ID NO: 257430 - DNA, 14 bp, Homo sapiens
cctccctcctggct

SEQ ID NO: 257431 - DNA, 18 bp, Homo sapiens
cctccctcctggctcaca

SEQ ID NO: 257432 - DNA, 21 bp, Homo sapiens
cctccctcctggctcacagcc

SEQ ID NO: 257433 - DNA, 19 bp, Homo sapiens
cctccctctcccaggcccg

SEQ ID NO: 257434 - DNA, 20 bp, Homo sapiens
cctccctctcttccgggagc

SEQ ID NO: 257435 - DNA, 15 bp, Homo sapiens
cctccctctgcccca

SEQ ID NO: 257436 - DNA, 13 bp, Homo sapiens
cctccctctgctc

SEQ ID NO: 257437 - DNA, 14 bp, Homo sapiens
cctccctcttccca

SEQ ID NO: 257438 - DNA, 22 bp, Homo sapiens
cctccctcttcccagcacaggc

SEQ ID NO: 257439 - DNA, 20 bp, Homo sapiens
cctccctgaaaatgtttttc

SEQ ID NO: 257440 - DNA, 11 bp, Homo sapiens
cctccctgcct

SEQ ID NO: 257441 - DNA, 12 bp, Homo sapiens
cctccctgcctg

SEQ ID NO: 257442 - DNA, 15 bp, Homo sapiens
cctccctgctcagct

SEQ ID NO: 257443 - DNA, 17 bp, Homo sapiens
cctccctgctcagctgg

SEQ ID NO: 257444 - DNA, 14 bp, Homo sapiens
cctccctggcctgt

SEQ ID NO: 257445 - DNA, 16 bp, Homo sapiens
cctccctggctgtgag

SEQ ID NO: 257446 - DNA, 10 bp, Homo sapiens
cctccctggg

SEQ ID NO: 257447 - DNA, 17 bp, Homo sapiens
cctccctgggcctgtct

SEQ ID NO: 257448 - DNA, 18 bp, Homo sapiens
cctccctgggcctgtctc

SEQ ID NO: 257449 - DNA, 20 bp, Homo sapiens
cctccctgggcctgtctcag

SEQ ID NO: 257450 - DNA, 15 bp, Homo sapiens
cctccctggggacca

SEQ ID NO: 257451 - DNA, 24 bp, Homo sapiens
cctccctggggaccaggagctagc

SEQ ID NO: 257452 - DNA, 13 bp, Homo sapiens
cctccctgggttc

SEQ ID NO: 257453 - DNA, 14 bp, Homo sapiens
cctccctgggttca

SEQ ID NO: 257454 - DNA, 19 bp, Homo sapiens
cctccctgtcactcagctg

SEQ ID NO: 257455 - DNA, 21 bp, Homo sapiens
cctccctgtcactcagctgag

SEQ ID NO: 257456 - DNA, 14 bp, Homo sapiens
cctccctgtccacc

SEQ ID NO: 257457 - DNA, 20 bp, Homo sapiens
cctccctgtcccctgaggtt

SEQ ID NO: 257458 - DNA, 16 bp, Homo sapiens
cctccctgtctccagg

SEQ ID NO: 257459 - DNA, 21 bp, Homo sapiens
ccagcacactgcttctcggag

SEQ ID NO: 257460 - DNA, 13 bp, Homo sapiens
ccagcacagactg

SEQ ID NO: 257461 - DNA, 20 bp, Homo sapiens
ccagcacagactgttccctc

SEQ ID NO: 257462 - DNA, 21 bp, Homo sapiens
ccagcacagagcgtccttccc

SEQ ID NO: 257463 - DNA, 17 bp, Homo sapiens
ccagcacaggggcccca

SEQ ID NO: 257464 - DNA, 20 bp, Homo sapiens
ccagcacaggggccccagat

SEQ ID NO: 257465 - DNA, 22 bp, Homo sapiens
ccagcacaggggccccagatct

SEQ ID NO: 257466 - DNA, 16 bp, Homo sapiens
ccagcacatttcctct

SEQ ID NO: 257467 - DNA, 18 bp, Homo sapiens
ccagcaccatctctcctc

SEQ ID NO: 257468 - DNA, 19 bp, Homo sapiens
ccagcacctgccagggccc

SEQ ID NO: 257469 - DNA, 20 bp, Homo sapiens
ccagcacctgccagggcccg

SEQ ID NO: 257470 - DNA, 18 bp, Homo sapiens
ccagcactcccagggccc

SEQ ID NO: 257471 - DNA, 13 bp, Homo sapiens
ccagcactttggg

SEQ ID NO: 257472 - DNA, 21 bp, Homo sapiens
ccagcagagccgttcctggga

SEQ ID NO: 257473 - DNA, 12 bp, Homo sapiens
ccagcagcccta

SEQ ID NO: 257474 - DNA, 17 bp, Homo sapiens
ccagcagcggcccagat

SEQ ID NO: 257475 - DNA, 19 bp, Homo sapiens
ccagcagcggtaccccagg

SEQ ID NO: 257476 - DNA, 24 bp, Homo sapiens
ccagcagctgcgggtctgaaggaa

SEQ ID NO: 257477 - DNA, 16 bp, Homo sapiens
ccagcagggcgggcca

SEQ ID NO: 257478 - DNA, 20 bp, Homo sapiens
ccagcagggcgggccaggag

SEQ ID NO: 257479 - DNA, 21 bp, Homo sapiens
ccagcagggcgggccaggaga

SEQ ID NO: 257480 - DNA, 22 bp, Homo sapiens
ccagcagggcgggccaggagaa

SEQ ID NO: 257481 - DNA, 13 bp, Homo sapiens
ccagcaggtgtgg

SEQ ID NO: 257482 - DNA, 17 bp, Homo sapiens
ccagcagtgctgggccc

SEQ ID NO: 257483 - DNA, 18 bp, Homo sapiens
ccagcagtgctgggccca

SEQ ID NO: 257484 - DNA, 21 bp, Homo sapiens
ccagcagtgctgggcccagcc

SEQ ID NO: 257485 - DNA, 22 bp, Homo sapiens
ccagcagttgaatgacaacaga

SEQ ID NO: 257486 - DNA, 16 bp, Homo sapiens
ccagcatccagcctgt

SEQ ID NO: 257487 - DNA, 17 bp, Homo sapiens
ccagcatccagcctgtg

SEQ ID NO: 257488 - DNA, 11 bp, Homo sapiens
ccagcatgtgt

SEQ ID NO: 257489 - DNA, 22 bp, Homo sapiens
ccagcattccagctctgccccc

SEQ ID NO: 257490 - DNA, 14 bp, Homo sapiens
ccagccaagtgcct

SEQ ID NO: 257491 - DNA, 17 bp, Homo sapiens
ccagccaagtgccttcc

SEQ ID NO: 257492 - DNA, 14 bp, Homo sapiens
ccagccaccaccac

SEQ ID NO: 257493 - DNA, 15 bp, Homo sapiens
ccagccaccaccact

SEQ ID NO: 257494 - DNA, 16 bp, Homo sapiens
ccagccaccaccactg

SEQ ID NO: 257495 - DNA, 18 bp, Homo sapiens
ccagccacccagccagga

SEQ ID NO: 257496 - DNA, 20 bp, Homo sapiens
ccagccacccggatctccag

SEQ ID NO: 257497 - DNA, 21 bp, Homo sapiens
ccagccaccctaactgagctg

SEQ ID NO: 257498 - DNA, 16 bp, Homo sapiens
ccagccaccttcctga

SEQ ID NO: 257499 - DNA, 23 bp, Homo sapiens
ccagccaccttcctgactgggaa

SEQ ID NO: 257500 - DNA, 17 bp, Homo sapiens
ccagccacgttggtggt

SEQ ID NO: 257501 - DNA, 20 bp, Homo sapiens
ccagccagcccttcccaggc

SEQ ID NO: 257502 - DNA, 22 bp, Homo sapiens
ccagccagcgcaggccctggtg

SEQ ID NO: 257503 - DNA, 14 bp, Homo sapiens
ccagccagtcttgc

SEQ ID NO: 257504 - DNA, 21 bp, Homo sapiens
ccagccatgggccctctgagc

SEQ ID NO: 257505 - DNA, 21 bp, Homo sapiens
ccagcccaaccgggaaaggca

SEQ ID NO: 257506 - DNA, 11 bp, Homo sapiens
ccagcccaata

SEQ ID NO: 257507 - DNA, 12 bp, Homo sapiens
ccagcccaataa

SEQ ID NO: 257508 - DNA, 14 bp, Homo sapiens
ccagcccaataaag

SEQ ID NO: 257509 - DNA, 17 bp, Homo sapiens
ccagcccaataaaggtc

SEQ ID NO: 257510 - DNA, 22 bp, Homo sapiens
ccagcccaccctgctcctcctg

SEQ ID NO: 257511 - DNA, 20 bp, Homo sapiens
ccagcccagctccactcagg

SEQ ID NO: 257512 - DNA, 19 bp, Homo sapiens
ccagcccagctgctctgcc

SEQ ID NO: 257513 - DNA, 22 bp, Homo sapiens
ccagcccagctgctctgcccag

SEQ ID NO: 257514 - DNA, 12 bp, Homo sapiens
ccagcccagggt

SEQ ID NO: 257515 - DNA, 13 bp, Homo sapiens
ccagccccaactc

SEQ ID NO: 257516 - DNA, 22 bp, Homo sapiens
ccagccccacccctaagtgccc

SEQ ID NO: 257517 - DNA, 15 bp, Homo sapiens
ccagccccagcaaga

SEQ ID NO: 257518 - DNA, 18 bp, Homo sapiens
ccagccccatagaaaaca

SEQ ID NO: 257519 - DNA, 14 bp, Homo sapiens
ccagccccctggat

SEQ ID NO: 257520 - DNA, 17 bp, Homo sapiens
ccagccccctggcccct

SEQ ID NO: 257521 - DNA, 19 bp, Homo sapiens
ccagcccgagtggtctcct

SEQ ID NO: 257522 - DNA, 13 bp, Homo sapiens
ccagcccggcctg

SEQ ID NO: 257523 - DNA, 19 bp, Homo sapiens
ccagcccggcctgctccca

SEQ ID NO: 257524 - DNA, 18 bp, Homo sapiens
ccagccctaggctaccct

SEQ ID NO: 257525 - DNA, 21 bp, Homo sapiens
ccagccctccctggctgtgag

SEQ ID NO: 257526 - DNA, 19 bp, Homo sapiens
ccagccctgctgcttccta

SEQ ID NO: 257527 - DNA, 22 bp, Homo sapiens
ccagccctggttctccatcccc

SEQ ID NO: 257528 - DNA, 15 bp, Homo sapiens
ccagccctgtggaag

SEQ ID NO: 257529 - DNA, 13 bp, Homo sapiens
ccagcccttccct

SEQ ID NO: 257530 - DNA, 15 bp, Homo sapiens
ccagcccttccctgc

SEQ ID NO: 257531 - DNA, 19 bp, Homo sapiens
ccagcccttccctggcccc

SEQ ID NO: 257532 - DNA, 19 bp, Homo sapiens
ccagcccttctgcctttct

SEQ ID NO: 257533 - DNA, 15 bp, Homo sapiens
ccagccctttccagg

SEQ ID NO: 257534 - DNA, 23 bp, Homo sapiens
ccagccctttgcaggcccagcag

SEQ ID NO: 257535 - DNA, 19 bp, Homo sapiens
ccagccgccatcagcccaa

SEQ ID NO: 257536 - DNA, 20 bp, Homo sapiens
ccagccgccattgccaccag

SEQ ID NO: 257537 - DNA, 23 bp, Homo sapiens
ccagccgccattgccaccaggag

SEQ ID NO: 257538 - DNA, 17 bp, Homo sapiens
ccagccgccccagcccc

SEQ ID NO: 257539 - DNA, 21 bp, Homo sapiens
ccagccggggtggggtgcctg

SEQ ID NO: 257540 - DNA, 17 bp, Homo sapiens
ccagcctaagatgaaga

SEQ ID NO: 257541 - DNA, 17 bp, Homo sapiens
ccagcctatatttcctc

SEQ ID NO: 257542 - DNA, 19 bp, Homo sapiens
ccagcctatatttcctctt

SEQ ID NO: 257543 - DNA, 19 bp, Homo sapiens
ccagcctcatctctttgtt

SEQ ID NO: 257544 - DNA, 12 bp, Homo sapiens
ccagcctccccc

SEQ ID NO: 257545 - DNA, 16 bp, Homo sapiens
ccagcctcccccaggc

SEQ ID NO: 257546 - DNA, 17 bp, Homo sapiens
ccagcctcccccaggct

SEQ ID NO: 257547 - DNA, 18 bp, Homo sapiens
ccagcctcccccaggctg

SEQ ID NO: 257548 - DNA, 18 bp, Homo sapiens
ccagcctcccctcccctg

SEQ ID NO: 257549 - DNA, 20 bp, Homo sapiens
ccagcctctcccggctgcct

SEQ ID NO: 257550 - DNA, 21 bp, Homo sapiens
ccagcctctcccggctgcctg

SEQ ID NO: 257551 - DNA, 22 bp, Homo sapiens
ccagcctctcccggctgcctgc

SEQ ID NO: 257552 - DNA, 24 bp, Homo sapiens
ccagcctctgagcccctgggactg

SEQ ID NO: 257553 - DNA, 20 bp, Homo sapiens
ccagcctcttgctcagagct

SEQ ID NO: 257554 - DNA, 22 bp, Homo sapiens
ccagcctgggcagccaggctgc

SEQ ID NO: 257555 - DNA, 18 bp, Homo sapiens
ccagcctgtcctggtaca

SEQ ID NO: 257556 - DNA, 13 bp, Homo sapiens
ccagcctgtggtt

SEQ ID NO: 257557 - DNA, 16 bp, Homo sapiens
cttttacagcttttct

SEQ ID NO: 257558 - DNA, 16 bp, Homo sapiens
cttttaggccaaaaaa

SEQ ID NO: 257559 - DNA, 20 bp, Homo sapiens
cttttagtacccacctgagc

SEQ ID NO: 257560 - DNA, 22 bp, Homo sapiens
cttttagtacccacctgagctt

SEQ ID NO: 257561 - DNA, 11 bp, Homo sapiens
cttttataaat

SEQ ID NO: 257562 - DNA, 20 bp, Homo sapiens
cttttataaattaaatatat

SEQ ID NO: 257563 - DNA, 24 bp, Homo sapiens
cttttataaattaaatatatgtat

SEQ ID NO: 257564 - DNA, 17 bp, Homo sapiens
cttttatagctattact

SEQ ID NO: 257565 - DNA, 18 bp, Homo sapiens
cttttatagctattactg

SEQ ID NO: 257566 - DNA, 15 bp, Homo sapiens
cttttatatataaaa

SEQ ID NO: 257567 - DNA, 14 bp, Homo sapiens
cttttatcaataaa

SEQ ID NO: 257568 - DNA, 17 bp, Homo sapiens
cttttatcaataaagca

SEQ ID NO: 257569 - DNA, 18 bp, Homo sapiens
cttttatccactggcatt

SEQ ID NO: 257570 - DNA, 21 bp, Homo sapiens
cttttatccactggcattttt

SEQ ID NO: 257571 - DNA, 17 bp, Homo sapiens
cttttattgtaaatgag

SEQ ID NO: 257572 - DNA, 21 bp, Homo sapiens
cttttattgtataaactatca

SEQ ID NO: 257573 - DNA, 12 bp, Homo sapiens
cttttcactgct

SEQ ID NO: 257574 - DNA, 16 bp, Homo sapiens
cttttcactgctggct

SEQ ID NO: 257575 - DNA, 17 bp, Homo sapiens
cttttcactgctggctg

SEQ ID NO: 257576 - DNA, 14 bp, Homo sapiens
cttttcacttgtct

SEQ ID NO: 257577 - DNA, 19 bp, Homo sapiens
cttttcagcttgtttctat

SEQ ID NO: 257578 - DNA, 20 bp, Homo sapiens
cttttcagcttgtttctata

SEQ ID NO: 257579 - DNA, 13 bp, Homo sapiens
cttttcatgtaga

SEQ ID NO: 257580 - DNA, 15 bp, Homo sapiens
cttttcattctcatt

SEQ ID NO: 257581 - DNA, 23 bp, Homo sapiens
cttttcatttatcaagcagagac

SEQ ID NO: 257582 - DNA, 16 bp, Homo sapiens
cttttccaagcccttt

SEQ ID NO: 257583 - DNA, 11 bp, Homo sapiens
cttttccagaa

SEQ ID NO: 257584 - DNA, 22 bp, Homo sapiens
cttttccagaaagaaaatgaat

SEQ ID NO: 257585 - DNA, 19 bp, Homo sapiens
cttttccaggatcctgcag

SEQ ID NO: 257586 - DNA, 20 bp, Homo sapiens
cttttccataaagtgtaatt

SEQ ID NO: 257587 - DNA, 18 bp, Homo sapiens
cttttcccacctctttgg

SEQ ID NO: 257588 - DNA, 17 bp, Homo sapiens
gaaagagttaagaatgt

SEQ ID NO: 257589 - DNA, 22 bp, Homo sapiens
gaaagatggctgtgcctctgcc

SEQ ID NO: 257590 - DNA, 23 bp, Homo sapiens
gaaagatggctgtgcctctgcct

SEQ ID NO: 257591 - DNA, 15 bp, Homo sapiens
gaaagattgtgtctg

SEQ ID NO: 257592 - DNA, 17 bp, Homo sapiens
gaaagcaaaaaataaaa

SEQ ID NO: 257593 - DNA, 18 bp, Homo sapiens
gaaagcaaaaaataaaat

SEQ ID NO: 257594 - DNA, 18 bp, Homo sapiens
gaaagcaaatcagacaca

SEQ ID NO: 257595 - DNA, 19 bp, Homo sapiens
gaaagcaaatcagacacaa

SEQ ID NO: 257596 - DNA, 18 bp, Homo sapiens
gaaagcaccgcagcatgt

SEQ ID NO: 257597 - DNA, 20 bp, Homo sapiens
gaaagcaccgcagcatgtgg

SEQ ID NO: 257598 - DNA, 22 bp, Homo sapiens
gaaagcagcagctaggactgag

SEQ ID NO: 257599 - DNA, 12 bp, Homo sapiens
gaaagcaggagc

SEQ ID NO: 257600 - DNA, 16 bp, Homo sapiens
gaaagcaggagcagct

SEQ ID NO: 257601 - DNA, 18 bp, Homo sapiens
gaaagcaggagcagctgt

SEQ ID NO: 257602 - DNA, 22 bp, Homo sapiens
gaaagcaggagcagctgtgctg

SEQ ID NO: 257603 - DNA, 15 bp, Homo sapiens
gaaagcatccatgtg

SEQ ID NO: 257604 - DNA, 21 bp, Homo sapiens
gaaagcatgtctctgcttcca

SEQ ID NO: 257605 - DNA, 22 bp, Homo sapiens
gaaagcatgtctctgcttccat

SEQ ID NO: 257606 - DNA, 22 bp, Homo sapiens
gaaagcatgtggcatgttcatc

SEQ ID NO: 257607 - DNA, 18 bp, Homo sapiens
gaaagccacctctccctc

SEQ ID NO: 257608 - DNA, 17 bp, Homo sapiens
gaaagccagtgactcca

SEQ ID NO: 257609 - DNA, 19 bp, Homo sapiens
gaaagccagtgactccagg

SEQ ID NO: 257610 - DNA, 19 bp, Homo sapiens
gaaagcccacctgggctgg

SEQ ID NO: 257611 - DNA, 20 bp, Homo sapiens
gaaagcccacctgggctggg

SEQ ID NO: 257612 - DNA, 21 bp, Homo sapiens
gaaagcccctcacctcaggac

SEQ ID NO: 257613 - DNA, 23 bp, Homo sapiens
gaaagcctcctgccccctgccag

SEQ ID NO: 257614 - DNA, 21 bp, Homo sapiens
gaaagcctgtctctttccact

SEQ ID NO: 257615 - DNA, 17 bp, Homo sapiens
gaaagcggagttcctaa

SEQ ID NO: 257616 - DNA, 14 bp, Homo sapiens
gaaagcgggcagcc

SEQ ID NO: 257617 - DNA, 19 bp, Homo sapiens
gaaagctgcttctggggga

SEQ ID NO: 257618 - DNA, 23 bp, Homo sapiens
gaaagctgcttctgggggatttc

SEQ ID NO: 257619 - DNA, 22 bp, Homo sapiens
gaaagctgtgaaattgaagtcc

SEQ ID NO: 257620 - DNA, 22 bp, Homo sapiens
gaaagctttgaacaattgtgtt

SEQ ID NO: 257621 - DNA, 22 bp, Homo sapiens
gaaaggaaagtagtccaggctg

SEQ ID NO: 257622 - DNA, 13 bp, Homo sapiens
gaaaggagactag

SEQ ID NO: 257623 - DNA, 16 bp, Homo sapiens
gaaaggagatcattta

SEQ ID NO: 257624 - DNA, 17 bp, Homo sapiens
gaaaggatatttaagaa

SEQ ID NO: 257625 - DNA, 22 bp, Homo sapiens
gaaaggatatttaagaaaatac

SEQ ID NO: 257626 - DNA, 18 bp, Homo sapiens
gaaagggcagcccctccc

SEQ ID NO: 257627 - DNA, 22 bp, Homo sapiens
gaaagggcagcttcagtctctg

SEQ ID NO: 257628 - DNA, 15 bp, Homo sapiens
gaaaggggaaagaaa

SEQ ID NO: 257629 - DNA, 12 bp, Homo sapiens
gaaaggtgctca

SEQ ID NO: 257630 - DNA, 14 bp, Homo sapiens
gaaaggtgctcaaa

SEQ ID NO: 257631 - DNA, 15 bp, Homo sapiens
gaaaggttgaattaa

SEQ ID NO: 257632 - DNA, 9 bp, Homo sapiens
gaaagtact

SEQ ID NO: 257633 - DNA, 18 bp, Homo sapiens
gaaagtagcagtcatcat

SEQ ID NO: 257634 - DNA, 17 bp, Homo sapiens
gaaagtcaccaggactt

SEQ ID NO: 257635 - DNA, 22 bp, Homo sapiens
gaaagtcttgtgactagtgctg

SEQ ID NO: 257636 - DNA, 19 bp, Homo sapiens
gaaagtgaagcaaatcaga

SEQ ID NO: 257637 - DNA, 19 bp, Homo sapiens
gaaagtgaatttgaatgaa

SEQ ID NO: 257638 - DNA, 21 bp, Homo sapiens
gaaagtgatttgtaatatgat

SEQ ID NO: 257639 - DNA, 18 bp, Homo sapiens
gaaagtgggtttcaattt

SEQ ID NO: 257640 - DNA, 16 bp, Homo sapiens
gaaagtgtaaaataga

SEQ ID NO: 257641 - DNA, 20 bp, Homo sapiens
gaaagtgttttactcttttt

SEQ ID NO: 257642 - DNA, 22 bp, Homo sapiens
gaaagttcccccatcagttccc

SEQ ID NO: 257643 - DNA, 20 bp, Homo sapiens
gaaagtttccccaccagtga

SEQ ID NO: 257644 - DNA, 15 bp, Homo sapiens
gaaagtttgttctgc

SEQ ID NO: 257645 - DNA, 22 bp, Homo sapiens
gaaagttttcagaacctcttcc

SEQ ID NO: 257646 - DNA, 13 bp, Homo sapiens
gaaagttttccag

SEQ ID NO: 257647 - DNA, 14 bp, Homo sapiens
gaaataaaaccttt

SEQ ID NO: 257648 - DNA, 15 bp, Homo sapiens
gaaataaaacctttc

SEQ ID NO: 257649 - DNA, 18 bp, Homo sapiens
gaaataaactagggtttt

SEQ ID NO: 257650 - DNA, 17 bp, Homo sapiens
gaaataaatagctatat

SEQ ID NO: 257651 - DNA, 21 bp, Homo sapiens
gaaataaatagctatatccat

SEQ ID NO: 257652 - DNA, 20 bp, Homo sapiens
gaaataaatgtacctgatgt

SEQ ID NO: 257653 - DNA, 20 bp, Homo sapiens
gaaataaattggtgataagt

SEQ ID NO: 257654 - DNA, 21 bp, Homo sapiens
gaaataaattggtgataagtg

SEQ ID NO: 257655 - DNA, 15 bp, Homo sapiens
gaaataataatattt

SEQ ID NO: 257656 - DNA, 13 bp, Homo sapiens
gaaataatgggaa

SEQ ID NO: 257657 - DNA, 19 bp, Homo sapiens
gaaataatgtacatctggc

SEQ ID NO: 257658 - DNA, 21 bp, Homo sapiens
gaaatacaaggagggcctctg

SEQ ID NO: 257659 - DNA, 23 bp, Homo sapiens
gaaatacaaggagggcctctggt

SEQ ID NO: 257660 - DNA, 21 bp, Homo sapiens
gaaatacaattctacattgtc

SEQ ID NO: 257661 - DNA, 17 bp, Homo sapiens
gaaatacagtgctttat

SEQ ID NO: 257662 - DNA, 19 bp, Homo sapiens
gaaatacctttgcctggat

SEQ ID NO: 257663 - DNA, 19 bp, Homo sapiens
gaaatacgccagaactgct

SEQ ID NO: 257664 - DNA, 15 bp, Homo sapiens
gaaatacttgtgatt

SEQ ID NO: 257665 - DNA, 17 bp, Homo sapiens
gaaatagtctgtgtgaa

SEQ ID NO: 257666 - DNA, 21 bp, Homo sapiens
gaaatagttattttaatacct

SEQ ID NO: 257667 - DNA, 17 bp, Homo sapiens
gaaatataaactgtgag

SEQ ID NO: 257668 - DNA, 13 bp, Homo sapiens
gaaatataattga

SEQ ID NO: 257669 - DNA, 14 bp, Homo sapiens
gaaatatatatgtg

SEQ ID NO: 257670 - DNA, 23 bp, Homo sapiens
gaaatatatatgtgtgtgtatgt

SEQ ID NO: 257671 - DNA, 14 bp, Homo sapiens
gaaatatcatttat

SEQ ID NO: 257672 - DNA, 14 bp, Homo sapiens
gaaatatgatttta

SEQ ID NO: 257673 - DNA, 15 bp, Homo sapiens
gaaatatgattttat

SEQ ID NO: 257674 - DNA, 13 bp, Homo sapiens
gaaatatgcatct

SEQ ID NO: 257675 - DNA, 15 bp, Homo sapiens
gaaatatgcatgtac

SEQ ID NO: 257676 - DNA, 11 bp, Homo sapiens
gaaatattaaa

SEQ ID NO: 257677 - DNA, 18 bp, Homo sapiens
gaaatatttgcttattta

SEQ ID NO: 257678 - DNA, 21 bp, Homo sapiens
gaaatattttgataataaatt

SEQ ID NO: 257679 - DNA, 17 bp, Homo sapiens
gaaatcacaggggcggg

SEQ ID NO: 257680 - DNA, 18 bp, Homo sapiens
gaaatcaccttttctaaa

SEQ ID NO: 257681 - DNA, 16 bp, Homo sapiens
gaaatccaactccagg

SEQ ID NO: 257682 - DNA, 14 bp, Homo sapiens
gaaatcctgttact

SEQ ID NO: 257683 - DNA, 23 bp, Homo sapiens
gaaatcgctgctcaaaaatgatt

SEQ ID NO: 257684 - DNA, 14 bp, Homo sapiens
gaaatcttttaaaa

SEQ ID NO: 257685 - DNA, 16 bp, Homo sapiens
gaaatgaaaacatgta

SEQ ID NO: 257686 - DNA, 19 bp, Homo sapiens
gaaatgaaaacatgtaata

SEQ ID NO: 257687 - DNA, 14 bp, Homo sapiens
gaaatgaccaatat

SEQ ID NO: 257688 - DNA, 14 bp, Homo sapiens
gaaatgaggaagaa

SEQ ID NO: 257689 - DNA, 16 bp, Homo sapiens
gaaatgcataccagta

SEQ ID NO: 257690 - DNA, 19 bp, Homo sapiens
gaaatgcattttattcttt

SEQ ID NO: 257691 - DNA, 15 bp, Homo sapiens
gaaatgctaatgtaa

SEQ ID NO: 257692 - DNA, 17 bp, Homo sapiens
gaaatgctgcctgcctg

SEQ ID NO: 257693 - DNA, 22 bp, Homo sapiens
gaaatgcttgtggattgagggt

SEQ ID NO: 257694 - DNA, 20 bp, Homo sapiens
gaaatggaatcagcttttaa

SEQ ID NO: 257695 - DNA, 19 bp, Homo sapiens
gaaatggaatgtgcccctg

SEQ ID NO: 257696 - DNA, 18 bp, Homo sapiens
gaaatgggagatggtcag

SEQ ID NO: 257697 - DNA, 16 bp, Homo sapiens
gaaatgtatcctgata

SEQ ID NO: 257698 - DNA, 21 bp, Homo sapiens
gaaatgttattttttaattat

SEQ ID NO: 257699 - DNA, 22 bp, Homo sapiens
gaaatgttattttttaattatt

SEQ ID NO: 257700 - DNA, 11 bp, Homo sapiens
gaaattaaata

SEQ ID NO: 257701 - DNA, 13 bp, Homo sapiens
gaaattaaataat

SEQ ID NO: 257702 - DNA, 23 bp, Homo sapiens
gaaattaaattcttattggccaa

SEQ ID NO: 257703 - DNA, 23 bp, Homo sapiens
gaaattacaagtttcagtaatag

SEQ ID NO: 257704 - DNA, 19 bp, Homo sapiens
gaaattaggccttatgtaa

SEQ ID NO: 257705 - DNA, 18 bp, Homo sapiens
gaaattatgtatgtttac

SEQ ID NO: 257706 - DNA, 15 bp, Homo sapiens
gaaattatttaatat

SEQ ID NO: 257707 - DNA, 19 bp, Homo sapiens
gaaattatttaatatgcat

SEQ ID NO: 257708 - DNA, 18 bp, Homo sapiens
gaaattcattaaagaaaa

SEQ ID NO: 257709 - DNA, 13 bp, Homo sapiens
gaaattctgctgc

SEQ ID NO: 257710 - DNA, 15 bp, Homo sapiens
gaaattcttccctgg

SEQ ID NO: 257711 - DNA, 16 bp, Homo sapiens
gaaattcttccctggg

SEQ ID NO: 257712 - DNA, 16 bp, Homo sapiens
gaaattcttgcactgt

SEQ ID NO: 257713 - DNA, 23 bp, Homo sapiens
gaaattgcctccttatttatcaa

SEQ ID NO: 257714 - DNA, 20 bp, Homo sapiens
gaaattgggtgtgccctggc

SEQ ID NO: 257715 - DNA, 22 bp, Homo sapiens
gaaattgggtgtgccctggctc

SEQ ID NO: 257716 - DNA, 17 bp, Homo sapiens
gaaatttaaaaatcttt

SEQ ID NO: 257717 - DNA, 22 bp, Homo sapiens
ccaggagctgagtcacctcctc

SEQ ID NO: 257718 - DNA, 21 bp, Homo sapiens
ccaggaggccggggggagcag

SEQ ID NO: 257719 - DNA, 12 bp, Homo sapiens
ccaggaggcttt

SEQ ID NO: 257720 - DNA, 22 bp, Homo sapiens
ccaggaggctttaagctccagc

SEQ ID NO: 257721 - DNA, 14 bp, Homo sapiens
ccaggaggggcctc

SEQ ID NO: 257722 - DNA, 16 bp, Homo sapiens
ccaggaggggtctgcc

SEQ ID NO: 257723 - DNA, 18 bp, Homo sapiens
ccaggaggggtctgcctc

SEQ ID NO: 257724 - DNA, 19 bp, Homo sapiens
ccaggaggggtctgcctcc

SEQ ID NO: 257725 - DNA, 14 bp, Homo sapiens
ccaggataaggaga

SEQ ID NO: 257726 - DNA, 16 bp, Homo sapiens
ccaggatatttctgag

SEQ ID NO: 257727 - DNA, 17 bp, Homo sapiens
ccaggatccagaagggg

SEQ ID NO: 257728 - DNA, 16 bp, Homo sapiens
ccaggatcccctgcta

SEQ ID NO: 257729 - DNA, 16 bp, Homo sapiens
ccaggatcctgcagga

SEQ ID NO: 257730 - DNA, 17 bp, Homo sapiens
ccaggatcctgcaggaa

SEQ ID NO: 257731 - DNA, 20 bp, Homo sapiens
ccaggatggcgtgtcccctg

SEQ ID NO: 257732 - DNA, 23 bp, Homo sapiens
ccaggattgtacgtgggagaggc

SEQ ID NO: 257733 - DNA, 21 bp, Homo sapiens
ccaggattgtccacaaatgtc

SEQ ID NO: 257734 - DNA, 22 bp, Homo sapiens
ccaggattgtccacaaatgtcc

SEQ ID NO: 257735 - DNA, 20 bp, Homo sapiens
ccaggattttaacaaaagca

SEQ ID NO: 257736 - DNA, 13 bp, Homo sapiens
ccaggcacctggc

SEQ ID NO: 257737 - DNA, 18 bp, Homo sapiens
ccaggcacctggcctgct

SEQ ID NO: 257738 - DNA, 19 bp, Homo sapiens
ccaggcacctggcctgctg

SEQ ID NO: 257739 - DNA, 22 bp, Homo sapiens
ccaggcacctggcctgctggga

SEQ ID NO: 257740 - DNA, 18 bp, Homo sapiens
ccaggcactgccttctcc

SEQ ID NO: 257741 - DNA, 23 bp, Homo sapiens
ccaggcagagacaataaaacatt

SEQ ID NO: 257742 - DNA, 13 bp, Homo sapiens
ccaggcagatctg

SEQ ID NO: 257743 - DNA, 18 bp, Homo sapiens
ccaggcagatctgtgccc

SEQ ID NO: 257744 - DNA, 21 bp, Homo sapiens
ccaggcaggacgagactcctc

SEQ ID NO: 257745 - DNA, 22 bp, Homo sapiens
ccaggcagggagtgtctgcagt

SEQ ID NO: 257746 - DNA, 18 bp, Homo sapiens
ccaggccacccactgtgg

SEQ ID NO: 257747 - DNA, 17 bp, Homo sapiens
ccaggccactctcagag

SEQ ID NO: 257748 - DNA, 15 bp, Homo sapiens
ccaggccactgacct

SEQ ID NO: 257749 - DNA, 14 bp, Homo sapiens
ccaggccactgtgg

SEQ ID NO: 257750 - DNA, 16 bp, Homo sapiens
ccaggccactgtggcc

SEQ ID NO: 257751 - DNA, 17 bp, Homo sapiens
ccaggccactgtggcca

SEQ ID NO: 257752 - DNA, 23 bp, Homo sapiens
ccaggccactgtggccagagctg

SEQ ID NO: 257753 - DNA, 13 bp, Homo sapiens
ccaggccatacca

SEQ ID NO: 257754 - DNA, 14 bp, Homo sapiens
ccaggccatcagag

SEQ ID NO: 257755 - DNA, 14 bp, Homo sapiens
ccaggcccagcctg

SEQ ID NO: 257756 - DNA, 14 bp, Homo sapiens
ccaggcccatctca

SEQ ID NO: 257757 - DNA, 19 bp, Homo sapiens
ccaggcccatctcaggtgc

SEQ ID NO: 257758 - DNA, 23 bp, Homo sapiens
ccaggcccatctcaggtgccact

SEQ ID NO: 257759 - DNA, 16 bp, Homo sapiens
ccaggccccagcctcc

SEQ ID NO: 257760 - DNA, 17 bp, Homo sapiens
ccaggccccagcctcca

SEQ ID NO: 257761 - DNA, 20 bp, Homo sapiens
ccaggccccagcctccaggc

SEQ ID NO: 257762 - DNA, 12 bp, Homo sapiens
ccaggcccctga

SEQ ID NO: 257763 - DNA, 17 bp, Homo sapiens
ccaggcccctgaggact

SEQ ID NO: 257764 - DNA, 22 bp, Homo sapiens
ccaggcccctgaggactggaga

SEQ ID NO: 257765 - DNA, 18 bp, Homo sapiens
ccaggccctagaccctcc

SEQ ID NO: 257766 - DNA, 20 bp, Homo sapiens
ccaggccctccatgggctag

SEQ ID NO: 257767 - DNA, 16 bp, Homo sapiens
ccaggccctcctgctg

SEQ ID NO: 257768 - DNA, 14 bp, Homo sapiens
ccaggccggccagc

SEQ ID NO: 257769 - DNA, 19 bp, Homo sapiens
ccaggccgtcctcccgggc

SEQ ID NO: 257770 - DNA, 14 bp, Homo sapiens
ccaggccgtggctg

SEQ ID NO: 257771 - DNA, 22 bp, Homo sapiens
ccaggccgttccccttggcttc

SEQ ID NO: 257772 - DNA, 13 bp, Homo sapiens
ccaggcctccagc

SEQ ID NO: 257773 - DNA, 14 bp, Homo sapiens
ccaggcctccagcc

SEQ ID NO: 257774 - DNA, 17 bp, Homo sapiens
ccaggcctccagcctct

SEQ ID NO: 257775 - DNA, 18 bp, Homo sapiens
ccaggcctcccgcatgct

SEQ ID NO: 257776 - DNA, 18 bp, Homo sapiens
ccaggcctgaggctgctg

SEQ ID NO: 257777 - DNA, 12 bp, Homo sapiens
ccaggcctgcca

SEQ ID NO: 257778 - DNA, 12 bp, Homo sapiens
ccaggcctgcct

SEQ ID NO: 257779 - DNA, 10 bp, Homo sapiens
ccaggcctgg

SEQ ID NO: 257780 - DNA, 16 bp, Homo sapiens
ccaggcctggagcgtt

SEQ ID NO: 257781 - DNA, 17 bp, Homo sapiens
ccaggcctggcctcggg

SEQ ID NO: 257782 - DNA, 19 bp, Homo sapiens
ccaggcctggcctcggggc

SEQ ID NO: 257783 - DNA, 18 bp, Homo sapiens
ccaggcctgggtctgtgt

SEQ ID NO: 257784 - DNA, 20 bp, Homo sapiens
ccaggcctgggtctgtgtct

SEQ ID NO: 257785 - DNA, 12 bp, Homo sapiens
ccaggccttctg

SEQ ID NO: 257786 - DNA, 13 bp, Homo sapiens
ccaggccttctga

SEQ ID NO: 257787 - DNA, 18 bp, Homo sapiens
ccaggcgatgtgcaagtg

SEQ ID NO: 257788 - DNA, 19 bp, Homo sapiens
ccaggcggaggggcttgga

SEQ ID NO: 257789 - DNA, 23 bp, Homo sapiens
ccaggcggaggggcttggagcag

SEQ ID NO: 257790 - DNA, 24 bp, Homo sapiens
ccaggcggaggggcttggagcaga

SEQ ID NO: 257791 - DNA, 17 bp, Homo sapiens
ccaggcgggagatggac

SEQ ID NO: 257792 - DNA, 14 bp, Homo sapiens
ccaggcgtgggacg

SEQ ID NO: 257793 - DNA, 20 bp, Homo sapiens
ccaggcgttggtgccacttc

SEQ ID NO: 257794 - DNA, 16 bp, Homo sapiens
ccaggctccaggctga

SEQ ID NO: 257795 - DNA, 18 bp, Homo sapiens
ccaggctcccctgcccgc

SEQ ID NO: 257796 - DNA, 12 bp, Homo sapiens
ccaggctctccc

SEQ ID NO: 257797 - DNA, 16 bp, Homo sapiens
ccaggctgaattacag

SEQ ID NO: 257798 - DNA, 14 bp, Homo sapiens
ccaggctgcactgc

SEQ ID NO: 257799 - DNA, 12 bp, Homo sapiens
ccaggctgcgcc

SEQ ID NO: 257800 - DNA, 18 bp, Homo sapiens
ccaggctgcgcctgcccg

SEQ ID NO: 257801 - DNA, 12 bp, Homo sapiens
ccaggctgggca

SEQ ID NO: 257802 - DNA, 13 bp, Homo sapiens
ccaggctggggcc

SEQ ID NO: 257803 - DNA, 17 bp, Homo sapiens
ccaggctggggcctggc

SEQ ID NO: 257804 - DNA, 14 bp, Homo sapiens
ccaggctggtctca

SEQ ID NO: 257805 - DNA, 21 bp, Homo sapiens
ccaggctgtaaatgagggcag

SEQ ID NO: 257806 - DNA, 18 bp, Homo sapiens
ccaggctgtcagcgcctc

SEQ ID NO: 257807 - DNA, 17 bp, Homo sapiens
ccaggctgtgggcctca

SEQ ID NO: 257808 - DNA, 11 bp, Homo sapiens
ccaggctgtgt

SEQ ID NO: 257809 - DNA, 18 bp, Homo sapiens
ccagggaagctggccgag

SEQ ID NO: 257810 - DNA, 17 bp, Homo sapiens
ccagggactgtacctgt

SEQ ID NO: 257811 - DNA, 14 bp, Homo sapiens
ccagggagaggcca

SEQ ID NO: 257812 - DNA, 16 bp, Homo sapiens
ccagggagcaagacag

SEQ ID NO: 257813 - DNA, 17 bp, Homo sapiens
ccagggagcaagacaga

SEQ ID NO: 257814 - DNA, 18 bp, Homo sapiens
ccagggagcaagacagag

SEQ ID NO: 257815 - DNA, 22 bp, Homo sapiens
ccagggagcttgaaagttttca

SEQ ID NO: 257816 - DNA, 14 bp, Homo sapiens
ccagggaggagagg

SEQ ID NO: 257817 - DNA, 15 bp, Homo sapiens
ccagggaggagagga

SEQ ID NO: 257818 - DNA, 23 bp, Homo sapiens
ccagggatgccatctgtgggcac

SEQ ID NO: 257819 - DNA, 17 bp, Homo sapiens
ccagggatggggccaca

SEQ ID NO: 257820 - DNA, 15 bp, Homo sapiens
ccagggcaccaagcc

SEQ ID NO: 257821 - DNA, 14 bp, Homo sapiens
ccagggcagtgcta

SEQ ID NO: 257822 - DNA, 23 bp, Homo sapiens
ccagggcagtgctagtgagctgg

SEQ ID NO: 257823 - DNA, 22 bp, Homo sapiens
ccagggcagtgtggtgggaggg

SEQ ID NO: 257824 - DNA, 19 bp, Homo sapiens
ccagggccagtagagagtg

SEQ ID NO: 257825 - DNA, 14 bp, Homo sapiens
ccagggcccccacc

SEQ ID NO: 257826 - DNA, 15 bp, Homo sapiens
ccagggccctgctca

SEQ ID NO: 257827 - DNA, 18 bp, Homo sapiens
ccagggccctgctcaggc

SEQ ID NO: 257828 - DNA, 21 bp, Homo sapiens
ccagggccctgctcaggcctc

SEQ ID NO: 257829 - DNA, 16 bp, Homo sapiens
ccagggctctggcagg

SEQ ID NO: 257830 - DNA, 14 bp, Homo sapiens
ccagggctgtgggt

SEQ ID NO: 257831 - DNA, 17 bp, Homo sapiens
ccagggctgtgggtggg

SEQ ID NO: 257832 - DNA, 22 bp, Homo sapiens
ccagggcttacctgtacactga

SEQ ID NO: 257833 - DNA, 17 bp, Homo sapiens
ccaggggcacacttccc

SEQ ID NO: 257834 - DNA, 21 bp, Homo sapiens
ccaggggcatgtattggcctg

SEQ ID NO: 257835 - DNA, 14 bp, Homo sapiens
ccaggggcccttgg

SEQ ID NO: 257836 - DNA, 22 bp, Homo sapiens
ccaggggcccttgggacagcca

SEQ ID NO: 257837 - DNA, 18 bp, Homo sapiens
ccagggggcctgcaggcc

SEQ ID NO: 257838 - DNA, 19 bp, Homo sapiens
ccagggggcctgcaggccc

SEQ ID NO: 257839 - DNA, 21 bp, Homo sapiens
ccagggggcctgcaggcccca

SEQ ID NO: 257840 - DNA, 18 bp, Homo sapiens
ccaggggtcaccttgaga

SEQ ID NO: 257841 - DNA, 18 bp, Homo sapiens
ccaggggtcccagccacc

SEQ ID NO: 257842 - DNA, 17 bp, Homo sapiens
ccagggtagaattgttt

SEQ ID NO: 257843 - DNA, 22 bp, Homo sapiens
gaagctgtactcagagcagagc

SEQ ID NO: 257844 - DNA, 23 bp, Homo sapiens
gaagctgtagtagccctttctgt

SEQ ID NO: 257845 - DNA, 14 bp, Homo sapiens
gaagcttattaatg

SEQ ID NO: 257846 - DNA, 15 bp, Homo sapiens
gaagcttattaatgc

SEQ ID NO: 257847 - DNA, 14 bp, Homo sapiens
gaatggatgctgct

SEQ ID NO: 257848 - DNA, 18 bp, Homo sapiens
gaatggccctagaactgt

SEQ ID NO: 257849 - DNA, 19 bp, Homo sapiens
gaatggcggtttttatcca

SEQ ID NO: 257850 - DNA, 22 bp, Homo sapiens
gaatgggagccagaattcacta

SEQ ID NO: 257851 - DNA, 19 bp, Homo sapiens
gaatgggccaagccagggt

SEQ ID NO: 257852 - DNA, 20 bp, Homo sapiens
gaatgggccaagccagggtt

SEQ ID NO: 257853 - DNA, 14 bp, Homo sapiens
gaatggggacctgg

SEQ ID NO: 257854 - DNA, 11 bp, Homo sapiens
gaatggggctt

SEQ ID NO: 257855 - DNA, 20 bp, Homo sapiens
gaatggtaaccgagccagca

SEQ ID NO: 257856 - DNA, 17 bp, Homo sapiens
gaatggtgcaatgaatt

SEQ ID NO: 257857 - DNA, 20 bp, Homo sapiens
gaatggtgcccttggaggca

SEQ ID NO: 257858 - DNA, 19 bp, Homo sapiens
gaatggttccatgcctgag

SEQ ID NO: 257859 - DNA, 14 bp, Homo sapiens
gaatgtaaatttgt

SEQ ID NO: 257860 - DNA, 14 bp, Homo sapiens
gaatgtaagaaaac

SEQ ID NO: 257861 - DNA, 23 bp, Homo sapiens
gaatgtaagaaaacaaaatctaa

SEQ ID NO: 257862 - DNA, 16 bp, Homo sapiens
gaatgtaatcaatgtt

SEQ ID NO: 257863 - DNA, 18 bp, Homo sapiens
gaatgtaatcaatgtttc

SEQ ID NO: 257864 - DNA, 20 bp, Homo sapiens
gaatgtagctggtttcctca

SEQ ID NO: 257865 - DNA, 19 bp, Homo sapiens
gaatgtatctagtggtctg

SEQ ID NO: 257866 - DNA, 16 bp, Homo sapiens
gaatgtattattctgc

SEQ ID NO: 257867 - DNA, 17 bp, Homo sapiens
gaatgtattattctgca

SEQ ID NO: 257868 - DNA, 18 bp, Homo sapiens
gaatgtattattctgcag

SEQ ID NO: 257869 - DNA, 21 bp, Homo sapiens
gaatgtattattctgcagcat

SEQ ID NO: 257870 - DNA, 15 bp, Homo sapiens
gaatgtcacaaattg

SEQ ID NO: 257871 - DNA, 14 bp, Homo sapiens
gaatgtcagtgtga

SEQ ID NO: 257872 - DNA, 22 bp, Homo sapiens
gaatgtcatttgctaatgaatt

SEQ ID NO: 257873 - DNA, 20 bp, Homo sapiens
gaatgtccccattctataaa

SEQ ID NO: 257874 - DNA, 21 bp, Homo sapiens
gaatgtccccattctataaat

SEQ ID NO: 257875 - DNA, 13 bp, Homo sapiens
gaatgtgcccctg

SEQ ID NO: 257876 - DNA, 17 bp, Homo sapiens
gaatgtgcttttccatc

SEQ ID NO: 257877 - DNA, 22 bp, Homo sapiens
gaatgtgcttttccatctaaaa

SEQ ID NO: 257878 - DNA, 12 bp, Homo sapiens
gaatgtgtagga

SEQ ID NO: 257879 - DNA, 17 bp, Homo sapiens
gaatgttacattgtttg

SEQ ID NO: 257880 - DNA, 16 bp, Homo sapiens
gaatgttactttggaa

SEQ ID NO: 257881 - DNA, 20 bp, Homo sapiens
gaatgttccctgcaccctgg

SEQ ID NO: 257882 - DNA, 11 bp, Homo sapiens
gaatgttctga

SEQ ID NO: 257883 - DNA, 16 bp, Homo sapiens
gaatgttctgacatta

SEQ ID NO: 257884 - DNA, 17 bp, Homo sapiens
gaatgttctgacattaa

SEQ ID NO: 257885 - DNA, 18 bp, Homo sapiens
gaatgttgtcctgtgtca

SEQ ID NO: 257886 - DNA, 15 bp, Homo sapiens
gaattaaaacaatgt

SEQ ID NO: 257887 - DNA, 15 bp, Homo sapiens
gaattaaaataaaac

SEQ ID NO: 257888 - DNA, 22 bp, Homo sapiens
gaattaaacccacaagctgcct

SEQ ID NO: 257889 - DNA, 18 bp, Homo sapiens
gaattaaatattgaaaca

SEQ ID NO: 257890 - DNA, 20 bp, Homo sapiens
gaattaaattaggaataaat

SEQ ID NO: 257891 - DNA, 15 bp, Homo sapiens
gaattaacctggtgc

SEQ ID NO: 257892 - DNA, 16 bp, Homo sapiens
gaattaacctggtgct

SEQ ID NO: 257893 - DNA, 12 bp, Homo sapiens
gaattaagaact

SEQ ID NO: 257894 - DNA, 15 bp, Homo sapiens
gaattaagttatctt

SEQ ID NO: 257895 - DNA, 23 bp, Homo sapiens
gaattatacagacctaatatcat

SEQ ID NO: 257896 - DNA, 18 bp, Homo sapiens
gaattatgataaaggctt

SEQ ID NO: 257897 - DNA, 14 bp, Homo sapiens
gaattattttgtta

SEQ ID NO: 257898 - DNA, 22 bp, Homo sapiens
gaattatttttgtgtttctaaa

SEQ ID NO: 257899 - DNA, 16 bp, Homo sapiens
gaattcagattttaaa

SEQ ID NO: 257900 - DNA, 16 bp, Homo sapiens
gaattcagcaccctgg

SEQ ID NO: 257901 - DNA, 23 bp, Homo sapiens
gaattcatactctgttgcctcct

SEQ ID NO: 257902 - DNA, 20 bp, Homo sapiens
gaattcctttacaactaaat

SEQ ID NO: 257903 - DNA, 13 bp, Homo sapiens
gaattctgaactt

SEQ ID NO: 257904 - DNA, 18 bp, Homo sapiens
gaattcttgaaggaaaat

SEQ ID NO: 257905 - DNA, 23 bp, Homo sapiens
gaattcttgaaggaaaatgatac

SEQ ID NO: 257906 - DNA, 17 bp, Homo sapiens
gaattgaagtcatcata

SEQ ID NO: 257907 - DNA, 18 bp, Homo sapiens
gaattgacttcagcaggg

SEQ ID NO: 257908 - DNA, 15 bp, Homo sapiens
gaattgaggtctgct

SEQ ID NO: 257909 - DNA, 14 bp, Homo sapiens
gaattgataataaa

SEQ ID NO: 257910 - DNA, 24 bp, Homo sapiens
gaattgcttgtttgcttcaactgt

SEQ ID NO: 257911 - DNA, 15 bp, Homo sapiens
gaattggtgtatatc

SEQ ID NO: 257912 - DNA, 23 bp, Homo sapiens
gaattgtaaaagcaacatcagct

SEQ ID NO: 257913 - DNA, 22 bp, Homo sapiens
gaattgtttttgaatttaaata

SEQ ID NO: 257914 - DNA, 15 bp, Homo sapiens
gaatttaaatataat

SEQ ID NO: 257915 - DNA, 22 bp, Homo sapiens
gaatttaactactaagaataaa

SEQ ID NO: 257916 - DNA, 13 bp, Homo sapiens
gaatttaagcatg

SEQ ID NO: 257917 - DNA, 23 bp, Homo sapiens
gaatttaatgtctaggataattt

SEQ ID NO: 257918 - DNA, 20 bp, Homo sapiens
gaatttaatttttaaaagac

SEQ ID NO: 257919 - DNA, 20 bp, Homo sapiens
gaatttatcacacttctgtg

SEQ ID NO: 257920 - DNA, 13 bp, Homo sapiens
gaatttattcaat

SEQ ID NO: 257921 - DNA, 22 bp, Homo sapiens
gaatttcccaaagcagtgcatg

SEQ ID NO: 257922 - DNA, 14 bp, Homo sapiens
gaatttcctatctg

SEQ ID NO: 257923 - DNA, 15 bp, Homo sapiens
gaatttcctatctgt

SEQ ID NO: 257924 - DNA, 20 bp, Homo sapiens
gaatttctagacagtattgc

SEQ ID NO: 257925 - DNA, 22 bp, Homo sapiens
gaatttctagacagtattgcca

SEQ ID NO: 257926 - DNA, 19 bp, Homo sapiens
gaatttctatctaaatgat

SEQ ID NO: 257927 - DNA, 20 bp, Homo sapiens
gaatttcttcactgttgaaa

SEQ ID NO: 257928 - DNA, 19 bp, Homo sapiens
gaatttgaatgaaaaattt

SEQ ID NO: 257929 - DNA, 13 bp, Homo sapiens
gaatttgggcctc

SEQ ID NO: 257930 - DNA, 16 bp, Homo sapiens
gaatttgtaacctcag

SEQ ID NO: 257931 - DNA, 19 bp, Homo sapiens
gaatttgtaacctcagctc

SEQ ID NO: 257932 - DNA, 20 bp, Homo sapiens
gaattttaaaaaagatggat

SEQ ID NO: 257933 - DNA, 18 bp, Homo sapiens
gaattttaaaacatggca

SEQ ID NO: 257934 - DNA, 13 bp, Homo sapiens
gaattttcaaagg

SEQ ID NO: 257935 - DNA, 20 bp, Homo sapiens
gaattttggtgatgtaaaac

SEQ ID NO: 257936 - DNA, 16 bp, Homo sapiens
gaattttttttaacat

SEQ ID NO: 257937 - DNA, 19 bp, Homo sapiens
gaattttttttaacattcc

SEQ ID NO: 257938 - DNA, 21 bp, Homo sapiens
gaattttttttaacattcctc

SEQ ID NO: 257939 - DNA, 22 bp, Homo sapiens
gacaaaaacaagactgcctccc

SEQ ID NO: 257940 - DNA, 15 bp, Homo sapiens
gacaaaaagaacaaa

SEQ ID NO: 257941 - DNA, 16 bp, Homo sapiens
gacaaaaagtttccat

SEQ ID NO: 257942 - DNA, 18 bp, Homo sapiens
gacaaaaagtttccatat

SEQ ID NO: 257943 - DNA, 17 bp, Homo sapiens
gacaaaaattatctatt

SEQ ID NO: 257944 - DNA, 13 bp, Homo sapiens
gacaaaatgtttt

SEQ ID NO: 257945 - DNA, 22 bp, Homo sapiens
gacaaaattttagtccaaataa

SEQ ID NO: 257946 - DNA, 12 bp, Homo sapiens
gacaaacccttc

SEQ ID NO: 257947 - DNA, 14 bp, Homo sapiens
gacaaagcaggagt

SEQ ID NO: 257948 - DNA, 14 bp, Homo sapiens
gacaaaggcccaga

SEQ ID NO: 257949 - DNA, 14 bp, Homo sapiens
gacaaaggtgattt

SEQ ID NO: 257950 - DNA, 17 bp, Homo sapiens
gacaaatatttctttct

SEQ ID NO: 257951 - DNA, 19 bp, Homo sapiens
gacaaatattttagaagct

SEQ ID NO: 257952 - DNA, 13 bp, Homo sapiens
gacaaatgggact

SEQ ID NO: 257953 - DNA, 16 bp, Homo sapiens
gacaaatgggactgat

SEQ ID NO: 257954 - DNA, 15 bp, Homo sapiens
gacaaatttaaaaca

SEQ ID NO: 257955 - DNA, 12 bp, Homo sapiens
gacaacacacac

SEQ ID NO: 257956 - DNA, 12 bp, Homo sapiens
gacaacagaagc

SEQ ID NO: 257957 - DNA, 13 bp, Homo sapiens
gacaacatttctg

SEQ ID NO: 257958 - DNA, 22 bp, Homo sapiens
gacaaccaccgctccccagccc

SEQ ID NO: 257959 - DNA, 12 bp, Homo sapiens
gacaaccatgac

SEQ ID NO: 257960 - DNA, 14 bp, Homo sapiens
gacaacctgcccct

SEQ ID NO: 257961 - DNA, 23 bp, Homo sapiens
gacaacctgtgtgagagaattta

SEQ ID NO: 257962 - DNA, 16 bp, Homo sapiens
gacaacctttgtgtaa

SEQ ID NO: 257963 - DNA, 20 bp, Homo sapiens
gacaacctttgtgtaataaa

SEQ ID NO: 257964 - DNA, 23 bp, Homo sapiens
gacaacgaacatggcatgtgaaa

SEQ ID NO: 257965 - DNA, 19 bp, Homo sapiens
gacaactgaagagacacgt

SEQ ID NO: 257966 - DNA, 18 bp, Homo sapiens
gacaactttgccagcttt

SEQ ID NO: 257967 - DNA, 15 bp, Homo sapiens
gacaagaagctgcta

SEQ ID NO: 257968 - DNA, 18 bp, Homo sapiens
gacaagaatggaatagaa

SEQ ID NO: 257969 - DNA, 24 bp, Homo sapiens
gacaagacttcgggaaggtgtctg

SEQ ID NO: 257970 - DNA, 23 bp, Homo sapiens
gacaagccaacttgtaaatacac

SEQ ID NO: 257971 - DNA, 12 bp, Homo sapiens
gacaagccccag

SEQ ID NO: 257972 - DNA, 12 bp, Homo sapiens
gacaagccctgg

SEQ ID NO: 257973 - DNA, 21 bp, Homo sapiens
gacaaggagagcggaggagga

SEQ ID NO: 257974 - DNA, 15 bp, Homo sapiens
gacaaggaggtagag

SEQ ID NO: 257975 - DNA, 13 bp, Homo sapiens
gacaaggccccag

SEQ ID NO: 257976 - DNA, 14 bp, Homo sapiens
gacaaggccccaga

SEQ ID NO: 257977 - DNA, 18 bp, Homo sapiens
gacagttgggtgagaaca

SEQ ID NO: 257978 - DNA, 19 bp, Homo sapiens
gacataaacccatctgtaa

SEQ ID NO: 257979 - DNA, 22 bp, Homo sapiens
gacataaacccatctgtaatat

SEQ ID NO: 257980 - DNA, 13 bp, Homo sapiens
gacataatgtagt

SEQ ID NO: 257981 - DNA, 16 bp, Homo sapiens
gacatagtatggaagt

SEQ ID NO: 257982 - DNA, 15 bp, Homo sapiens
gacatatcatgtgtg

SEQ ID NO: 257983 - DNA, 23 bp, Homo sapiens
gacatcaggtgatccacctgcct

SEQ ID NO: 257984 - DNA, 19 bp, Homo sapiens
gacatcagtggcatggctc

SEQ ID NO: 257985 - DNA, 17 bp, Homo sapiens
gacatccaagcttcctt

SEQ ID NO: 257986 - DNA, 19 bp, Homo sapiens
gacatccccctccttgccg

SEQ ID NO: 257987 - DNA, 17 bp, Homo sapiens
gacatcctgacctcctg

SEQ ID NO: 257988 - DNA, 15 bp, Homo sapiens
gacatcggttcagga

SEQ ID NO: 257989 - DNA, 19 bp, Homo sapiens
gacatctacctcccgacct

SEQ ID NO: 257990 - DNA, 15 bp, Homo sapiens
gacatctctgcaccc

SEQ ID NO: 257991 - DNA, 17 bp, Homo sapiens
gacatctctgcaccctg

SEQ ID NO: 257992 - DNA, 13 bp, Homo sapiens
gacatctctgtaa

SEQ ID NO: 257993 - DNA, 20 bp, Homo sapiens
gacatcttcaaagcttgaag

SEQ ID NO: 257994 - DNA, 21 bp, Homo sapiens
gacatcttcaaagcttgaaga

SEQ ID NO: 257995 - DNA, 14 bp, Homo sapiens
gacatgagattcca

SEQ ID NO: 257996 - DNA, 14 bp, Homo sapiens
gacatgatcttctt

SEQ ID NO: 257997 - DNA, 14 bp, Homo sapiens
gacatgcgggctgg

SEQ ID NO: 257998 - DNA, 18 bp, Homo sapiens
gacatgcgggctgggcag

SEQ ID NO: 257999 - DNA, 21 bp, Homo sapiens
gacatgcgggctgggcagctg

SEQ ID NO: 258000 - DNA, 17 bp, Homo sapiens
gacatggacccggagct

SEQ ID NO: 258001 - DNA, 21 bp, Homo sapiens
gacatgggcctcccactcctg

SEQ ID NO: 258002 - DNA, 21 bp, Homo sapiens
gacatggtgtgccacaggctg

SEQ ID NO: 258003 - DNA, 22 bp, Homo sapiens
gacatgtactgctagtacctgt

SEQ ID NO: 258004 - DNA, 21 bp, Homo sapiens
gacatgtctttggcttcagaa

SEQ ID NO: 258005 - DNA, 19 bp, Homo sapiens
gacatgtggaaagtgaatt

SEQ ID NO: 258006 - DNA, 15 bp, Homo sapiens
gacatgttatatatt

SEQ ID NO: 258007 - DNA, 14 bp, Homo sapiens
gacatgtttttgtt

SEQ ID NO: 258008 - DNA, 18 bp, Homo sapiens
gacatgtttttgttttct

SEQ ID NO: 258009 - DNA, 14 bp, Homo sapiens
gacattaacagttt

SEQ ID NO: 258010 - DNA, 19 bp, Homo sapiens
gacattaacagttttccat

SEQ ID NO: 258011 - DNA, 22 bp, Homo sapiens
gacattaacagttttccatgaa

SEQ ID NO: 258012 - DNA, 15 bp, Homo sapiens
gacattcttcactgt

SEQ ID NO: 258013 - DNA, 14 bp, Homo sapiens
gacattgccccaag

SEQ ID NO: 258014 - DNA, 12 bp, Homo sapiens
gacattgtattt

SEQ ID NO: 258015 - DNA, 14 bp, Homo sapiens
gacattgtcaataa

SEQ ID NO: 258016 - DNA, 18 bp, Homo sapiens
gacatttcaaatctgtag

SEQ ID NO: 258017 - DNA, 13 bp, Homo sapiens
gacatttctcaaa

SEQ ID NO: 258018 - DNA, 19 bp, Homo sapiens
gacatttgggactgtcttg

SEQ ID NO: 258019 - DNA, 20 bp, Homo sapiens
gacatttgggactgtcttga

SEQ ID NO: 258020 - DNA, 14 bp, Homo sapiens
gacatttggtggta

SEQ ID NO: 258021 - DNA, 19 bp, Homo sapiens
gacatttgtcctgcagagc

SEQ ID NO: 258022 - DNA, 15 bp, Homo sapiens
gacattttcttcaga

SEQ ID NO: 258023 - DNA, 13 bp, Homo sapiens
gacattttgtagc

SEQ ID NO: 258024 - DNA, 15 bp, Homo sapiens
gacattttgtagcta

SEQ ID NO: 258025 - DNA, 22 bp, Homo sapiens
gaccaaaagtgagatgggaagg

SEQ ID NO: 258026 - DNA, 14 bp, Homo sapiens
gaccaactgggccc

SEQ ID NO: 258027 - DNA, 18 bp, Homo sapiens
gaccaagccggtgcccac

SEQ ID NO: 258028 - DNA, 16 bp, Homo sapiens
gaccaaggacccctca

SEQ ID NO: 258029 - DNA, 16 bp, Homo sapiens
gaccaagtcctggcta

SEQ ID NO: 258030 - DNA, 21 bp, Homo sapiens
gaccaagttataaatcaatgt

SEQ ID NO: 258031 - DNA, 19 bp, Homo sapiens
gaccaatattaccatctta

SEQ ID NO: 258032 - DNA, 13 bp, Homo sapiens
gaccaatctctgt

SEQ ID NO: 258033 - DNA, 14 bp, Homo sapiens
gaccaatctctgtg

SEQ ID NO: 258034 - DNA, 19 bp, Homo sapiens
gaccaattgccctgccagg

SEQ ID NO: 258035 - DNA, 22 bp, Homo sapiens
gaccacaccactaaccatcccc

SEQ ID NO: 258036 - DNA, 20 bp, Homo sapiens
gaccacacttcctgtccaga

SEQ ID NO: 258037 - DNA, 18 bp, Homo sapiens
gaccacagctgctggcca

SEQ ID NO: 258038 - DNA, 14 bp, Homo sapiens
gaccaccagcccca

SEQ ID NO: 258039 - DNA, 19 bp, Homo sapiens
gaccaccagccccagcaag

SEQ ID NO: 258040 - DNA, 23 bp, Homo sapiens
gaccaccagccgccccagcccct

SEQ ID NO: 258041 - DNA, 16 bp, Homo sapiens
gaccacctctcaatat

SEQ ID NO: 258042 - DNA, 13 bp, Homo sapiens
gaccacctgccca

SEQ ID NO: 258043 - DNA, 16 bp, Homo sapiens
gaccaccttctgtccc

SEQ ID NO: 258044 - DNA, 22 bp, Homo sapiens
gaccacggacgtttccatcagg

SEQ ID NO: 258045 - DNA, 15 bp, Homo sapiens
gaccactgggcctgc

SEQ ID NO: 258046 - DNA, 12 bp, Homo sapiens
gaccagaaaata

SEQ ID NO: 258047 - DNA, 19 bp, Homo sapiens
gaccagaagggaaacagtc

SEQ ID NO: 258048 - DNA, 14 bp, Homo sapiens
gaccagagctctgg

SEQ ID NO: 258049 - DNA, 20 bp, Homo sapiens
gaccagcaccatctctcctc

SEQ ID NO: 258050 - DNA, 16 bp, Homo sapiens
gaccagcctttcttcc

SEQ ID NO: 258051 - DNA, 21 bp, Homo sapiens
gaccaggactccctcctcacc

SEQ ID NO: 258052 - DNA, 23 bp, Homo sapiens
gaccaggactccctcctcacctc

SEQ ID NO: 258053 - DNA, 17 bp, Homo sapiens
gaccaggactctgcctt

SEQ ID NO: 258054 - DNA, 10 bp, Homo sapiens
gaccaggagc

SEQ ID NO: 258055 - DNA, 13 bp, Homo sapiens
gaccaggagccag

SEQ ID NO: 258056 - DNA, 12 bp, Homo sapiens
gaccaggatcag

SEQ ID NO: 258057 - DNA, 23 bp, Homo sapiens
gaccaggcatcctccacaatagc

SEQ ID NO: 258058 - DNA, 17 bp, Homo sapiens
gaccaggctcacaactg

SEQ ID NO: 258059 - DNA, 23 bp, Homo sapiens
gaccaggcttcccaaaccaagtg

SEQ ID NO: 258060 - DNA, 14 bp, Homo sapiens
gaccagtactggga

SEQ ID NO: 258061 - DNA, 15 bp, Homo sapiens
gaccagtactgggaa

SEQ ID NO: 258062 - DNA, 14 bp, Homo sapiens
gaccagtctggcca

SEQ ID NO: 258063 - DNA, 15 bp, Homo sapiens
gaccagtggtgcctt

SEQ ID NO: 258064 - DNA, 22 bp, Homo sapiens
gaccagttgaataaaagtgcac

SEQ ID NO: 258065 - DNA, 14 bp, Homo sapiens
gaccagttgggagc

SEQ ID NO: 258066 - DNA, 15 bp, Homo sapiens
gaccagttgggagca

SEQ ID NO: 258067 - DNA, 17 bp, Homo sapiens
gaccagttgggagcact

SEQ ID NO: 258068 - DNA, 19 bp, Homo sapiens
gaccatccactctaccctc

SEQ ID NO: 258069 - DNA, 23 bp, Homo sapiens
gaccatccactctaccctcccac

SEQ ID NO: 258070 - DNA, 20 bp, Homo sapiens
gaccatcccatgagcagtcc

SEQ ID NO: 258071 - DNA, 21 bp, Homo sapiens
gaccatcctggcccctccaga

SEQ ID NO: 258072 - DNA, 18 bp, Homo sapiens
gaccatttagtcctcacc

SEQ ID NO: 258073 - DNA, 13 bp, Homo sapiens
gaccatttataat

SEQ ID NO: 258074 - DNA, 21 bp, Homo sapiens
gaccatttataatgttagtag

SEQ ID NO: 258075 - DNA, 19 bp, Homo sapiens
gacccacaaactgcctgtt

SEQ ID NO: 258076 - DNA, 12 bp, Homo sapiens
gacccaccagtg

SEQ ID NO: 258077 - DNA, 23 bp, Homo sapiens
gacccacccatcttcctgctgct

SEQ ID NO: 258078 - DNA, 14 bp, Homo sapiens
gacccaccccaact

SEQ ID NO: 258079 - DNA, 16 bp, Homo sapiens
gacccaccccaactct

SEQ ID NO: 258080 - DNA, 23 bp, Homo sapiens
gacccaccccaactctccccagt

SEQ ID NO: 258081 - DNA, 22 bp, Homo sapiens
gacccacctggtggcctctgcc

SEQ ID NO: 258082 - DNA, 23 bp, Homo sapiens
gacccagctactctgtccaggcc

SEQ ID NO: 258083 - DNA, 18 bp, Homo sapiens
gacccaggccctccatgg

SEQ ID NO: 258084 - DNA, 15 bp, Homo sapiens
gacccagggcagtgt

SEQ ID NO: 258085 - DNA, 10 bp, Homo sapiens
gaccccacac

SEQ ID NO: 258086 - DNA, 21 bp, Homo sapiens
gaccccacacgccggggctgg

SEQ ID NO: 258087 - DNA, 22 bp, Homo sapiens
gaccccacacgccggggctggc

SEQ ID NO: 258088 - DNA, 22 bp, Homo sapiens
gaccccacccaagcttggcagc

SEQ ID NO: 258089 - DNA, 20 bp, Homo sapiens
gaccccacttatgctgctgt

SEQ ID NO: 258090 - DNA, 23 bp, Homo sapiens
gaccccagagggaccagctgggg

SEQ ID NO: 258091 - DNA, 15 bp, Homo sapiens
gaccccagagtaggg

SEQ ID NO: 258092 - DNA, 15 bp, Homo sapiens
gaccccagcttttct

SEQ ID NO: 258093 - DNA, 20 bp, Homo sapiens
gaccccagcttttcttgcca

SEQ ID NO: 258094 - DNA, 12 bp, Homo sapiens
gaccccagggca

SEQ ID NO: 258095 - DNA, 18 bp, Homo sapiens
gaccccatccagccaggg

SEQ ID NO: 258096 - DNA, 18 bp, Homo sapiens
gaccccatctctgctgct

SEQ ID NO: 258097 - DNA, 19 bp, Homo sapiens
gacccccaccccttcccca

SEQ ID NO: 258098 - DNA, 18 bp, Homo sapiens
gaccccccccccccccgc

SEQ ID NO: 258099 - DNA, 19 bp, Homo sapiens
gaccccccccccccccgcc

SEQ ID NO: 258100 - DNA, 22 bp, Homo sapiens
gaccccccccccccccgcccac

SEQ ID NO: 258101 - DNA, 20 bp, Homo sapiens
gacccccggcctccaggctg

SEQ ID NO: 258102 - DNA, 23 bp, Homo sapiens
gacccccggcctccaggctgggg

SEQ ID NO: 258103 - DNA, 11 bp, Homo sapiens
gaccccctccc

SEQ ID NO: 258104 - DNA, 18 bp, Homo sapiens
gaccccgacgccacagcc

SEQ ID NO: 258105 - DNA, 12 bp, Homo sapiens
gacccctaccct

SEQ ID NO: 258106 - DNA, 13 bp, Homo sapiens
gacccctcacctt

SEQ ID NO: 258107 - DNA, 15 bp, Homo sapiens
gacggacatccaggc

SEQ ID NO: 258108 - DNA, 19 bp, Homo sapiens
gacggacatccaggcgtgg

SEQ ID NO: 258109 - DNA, 19 bp, Homo sapiens
gacggacgggacagcggcc

SEQ ID NO: 258110 - DNA, 20 bp, Homo sapiens
gacggcctgatgctccctcc

SEQ ID NO: 258111 - DNA, 17 bp, Homo sapiens
gacggcgcccccagtgt

SEQ ID NO: 258112 - DNA, 23 bp, Homo sapiens
gacggctgggtgtttcagtttga

SEQ ID NO: 258113 - DNA, 19 bp, Homo sapiens
gacggctgtgtatttctgt

SEQ ID NO: 258114 - DNA, 18 bp, Homo sapiens
gacgggcatcgcaggagt

SEQ ID NO: 258115 - DNA, 19 bp, Homo sapiens
gacggggacacggcctctg

SEQ ID NO: 258116 - DNA, 14 bp, Homo sapiens
gacggggcagagct

SEQ ID NO: 258117 - DNA, 22 bp, Homo sapiens
gacggggcagagctgagtcggc

SEQ ID NO: 258118 - DNA, 19 bp, Homo sapiens
gacgggggttggggtgggg

SEQ ID NO: 258119 - DNA, 20 bp, Homo sapiens
gacgggggttggggtggggc

SEQ ID NO: 258120 - DNA, 21 bp, Homo sapiens
gacgtccaccctgcagccagg

SEQ ID NO: 258121 - DNA, 14 bp, Homo sapiens
gacgtcctgccacc

SEQ ID NO: 258122 - DNA, 23 bp, Homo sapiens
gacgtcctggaatgaagcatgta

SEQ ID NO: 258123 - DNA, 19 bp, Homo sapiens
gacgtctggggtgtgggga

SEQ ID NO: 258124 - DNA, 21 bp, Homo sapiens
gacgtcttcaagaacttctcg

SEQ ID NO: 258125 - DNA, 19 bp, Homo sapiens
gacgtggtcagggcagggc

SEQ ID NO: 258126 - DNA, 15 bp, Homo sapiens
gacgtgttatgactc

SEQ ID NO: 258127 - DNA, 13 bp, Homo sapiens
gacgttaggcccg

SEQ ID NO: 258128 - DNA, 13 bp, Homo sapiens
gacgtttccatca

SEQ ID NO: 258129 - DNA, 18 bp, Homo sapiens
gactaaagagagaatgta

SEQ ID NO: 258130 - DNA, 13 bp, Homo sapiens
gactaaagcatca

SEQ ID NO: 258131 - DNA, 18 bp, Homo sapiens
gactaacataaaatctgt

SEQ ID NO: 258132 - DNA, 22 bp, Homo sapiens
gactaagccctgtcgagacact

SEQ ID NO: 258133 - DNA, 18 bp, Homo sapiens
gactaagggaagaactct

SEQ ID NO: 258134 - DNA, 16 bp, Homo sapiens
gactaattcacaaaaa

SEQ ID NO: 258135 - DNA, 18 bp, Homo sapiens
gactaccacttatttcta

SEQ ID NO: 258136 - DNA, 23 bp, Homo sapiens
gactagaagggccagtcctgcct

SEQ ID NO: 258137 - DNA, 14 bp, Homo sapiens
gactagacaaataa

SEQ ID NO: 258138 - DNA, 16 bp, Homo sapiens
gactagacaaataact

SEQ ID NO: 258139 - DNA, 13 bp, Homo sapiens
gcccgagctggtg

SEQ ID NO: 258140 - DNA, 17 bp, Homo sapiens
gcccgagtggtctcctc

SEQ ID NO: 258141 - DNA, 21 bp, Homo sapiens
gcccgagtggtctcctctcag

SEQ ID NO: 258142 - DNA, 22 bp, Homo sapiens
gcccgagtggtctcctctcagc

SEQ ID NO: 258143 - DNA, 14 bp, Homo sapiens
gcccgcacaccctc

SEQ ID NO: 258144 - DNA, 22 bp, Homo sapiens
gcccgcacaccctcactctgcc

SEQ ID NO: 258145 - DNA, 13 bp, Homo sapiens
gcccgcacagcag

SEQ ID NO: 258146 - DNA, 16 bp, Homo sapiens
gcccgcacagcagcct

SEQ ID NO: 258147 - DNA, 22 bp, Homo sapiens
gcccgcatgcagcagcttgctg

SEQ ID NO: 258148 - DNA, 23 bp, Homo sapiens
gcccgccaccttgtacagaacca

SEQ ID NO: 258149 - DNA, 12 bp, Homo sapiens
gcccgccagcca

SEQ ID NO: 258150 - DNA, 16 bp, Homo sapiens
gcccgccagccagtgg

SEQ ID NO: 258151 - DNA, 13 bp, Homo sapiens
gcccgccagcctc

SEQ ID NO: 258152 - DNA, 16 bp, Homo sapiens
gcccgccagcctcagt

SEQ ID NO: 258153 - DNA, 18 bp, Homo sapiens
gcccgccagcctcagtgc

SEQ ID NO: 258154 - DNA, 14 bp, Homo sapiens
gcccgcccaccccg

SEQ ID NO: 258155 - DNA, 17 bp, Homo sapiens
gcccgcccaccccgctg

SEQ ID NO: 258156 - DNA, 23 bp, Homo sapiens
gcccgcccaccccgctgcctggc

SEQ ID NO: 258157 - DNA, 15 bp, Homo sapiens
gcccgcccacctggg

SEQ ID NO: 258158 - DNA, 18 bp, Homo sapiens
gcccgcccacctgggccc

SEQ ID NO: 258159 - DNA, 18 bp, Homo sapiens
gcccgcccactgtcctgg

SEQ ID NO: 258160 - DNA, 20 bp, Homo sapiens
gcccgcccactgtcctgggc

SEQ ID NO: 258161 - DNA, 17 bp, Homo sapiens
gcccgccccaagccctg

SEQ ID NO: 258162 - DNA, 12 bp, Homo sapiens
gcccgcccccgc

SEQ ID NO: 258163 - DNA, 14 bp, Homo sapiens
gcccgccctcctct

SEQ ID NO: 258164 - DNA, 15 bp, Homo sapiens
gcccgccctcctctg

SEQ ID NO: 258165 - DNA, 20 bp, Homo sapiens
gcccgccctcctctgccccc

SEQ ID NO: 258166 - DNA, 18 bp, Homo sapiens
gcccgccgtgcctgcatt

SEQ ID NO: 258167 - DNA, 18 bp, Homo sapiens
gcccgctcaacctctcag

SEQ ID NO: 258168 - DNA, 19 bp, Homo sapiens
gcccgctcaacctctcaga

SEQ ID NO: 258169 - DNA, 20 bp, Homo sapiens
gcccgctgcaatgcctagac

SEQ ID NO: 258170 - DNA, 14 bp, Homo sapiens
gcccggaccttggc

SEQ ID NO: 258171 - DNA, 14 bp, Homo sapiens
gcccggatgcttct

SEQ ID NO: 258172 - DNA, 17 bp, Homo sapiens
gcccggcagtgcacccc

SEQ ID NO: 258173 - DNA, 17 bp, Homo sapiens
gcccggccaaggacact

SEQ ID NO: 258174 - DNA, 20 bp, Homo sapiens
gcccggcccacacccgacac

SEQ ID NO: 258175 - DNA, 21 bp, Homo sapiens
gcccggcccaccagggactgc

SEQ ID NO: 258176 - DNA, 20 bp, Homo sapiens
gcccggccgccccgccccag

SEQ ID NO: 258177 - DNA, 17 bp, Homo sapiens
gcccggcgcccctgcca

SEQ ID NO: 258178 - DNA, 21 bp, Homo sapiens
gcccgggagatccgccctggg

SEQ ID NO: 258179 - DNA, 15 bp, Homo sapiens
gcccgggcccagagg

SEQ ID NO: 258180 - DNA, 13 bp, Homo sapiens
gcccgggcccctg

SEQ ID NO: 258181 - DNA, 17 bp, Homo sapiens
gcccggggcagctgcca

SEQ ID NO: 258182 - DNA, 18 bp, Homo sapiens
gcccggggcagctgccag

SEQ ID NO: 258183 - DNA, 22 bp, Homo sapiens
gcccggggcagctgccagagaa

SEQ ID NO: 258184 - DNA, 18 bp, Homo sapiens
gcccgtgaagcagtgcct

SEQ ID NO: 258185 - DNA, 19 bp, Homo sapiens
gcccgtgaagcagtgcctc

SEQ ID NO: 258186 - DNA, 22 bp, Homo sapiens
gcccgtgaagcagtgcctcgag

SEQ ID NO: 258187 - DNA, 19 bp, Homo sapiens
gcccagggttcccccagcc

SEQ ID NO: 258188 - DNA, 20 bp, Homo sapiens
gcccagggttcccccagccc

SEQ ID NO: 258189 - DNA, 18 bp, Homo sapiens
gcccaggtaccacccttc

SEQ ID NO: 258190 - DNA, 13 bp, Homo sapiens
gcccaggtcccag

SEQ ID NO: 258191 - DNA, 14 bp, Homo sapiens
gcccagtagcccca

SEQ ID NO: 258192 - DNA, 15 bp, Homo sapiens
gcccagtagccccaa

SEQ ID NO: 258193 - DNA, 22 bp, Homo sapiens
gcccagtcattgggttttatca

SEQ ID NO: 258194 - DNA, 14 bp, Homo sapiens
gcccagtccactgg

SEQ ID NO: 258195 - DNA, 17 bp, Homo sapiens
gcccagtcttgagtggg

SEQ ID NO: 258196 - DNA, 18 bp, Homo sapiens
gcccagtcttgagtgggc

SEQ ID NO: 258197 - DNA, 23 bp, Homo sapiens
gcccagtcttgagtgggccccct

SEQ ID NO: 258198 - DNA, 15 bp, Homo sapiens
gcccagtgatggcat

SEQ ID NO: 258199 - DNA, 13 bp, Homo sapiens
gcccagtggctgc

SEQ ID NO: 258200 - DNA, 22 bp, Homo sapiens
gcccagtgtcaagttgtgcttg

SEQ ID NO: 258201 - DNA, 17 bp, Homo sapiens
gcccagtgttgtttgta

SEQ ID NO: 258202 - DNA, 19 bp, Homo sapiens
gcccagtgttgtttgtaaa

SEQ ID NO: 258203 - DNA, 15 bp, Homo sapiens
gcccagttaatcttg

SEQ ID NO: 258204 - DNA, 17 bp, Homo sapiens
gcccagttagcccggcc

SEQ ID NO: 258205 - DNA, 15 bp, Homo sapiens
gcccagttcatccca

SEQ ID NO: 258206 - DNA, 13 bp, Homo sapiens
gcccatcacaggg

SEQ ID NO: 258207 - DNA, 17 bp, Homo sapiens
gcccatctcagcctcct

SEQ ID NO: 258208 - DNA, 20 bp, Homo sapiens
gcccatctcagcctcctgag

SEQ ID NO: 258209 - DNA, 18 bp, Homo sapiens
gcccatctcaggtgccac

SEQ ID NO: 258210 - DNA, 24 bp, Homo sapiens
gcccatctcaggtgccactccctg

SEQ ID NO: 258211 - DNA, 20 bp, Homo sapiens
gcccatcttgcctccatggt

SEQ ID NO: 258212 - DNA, 22 bp, Homo sapiens
gcccatgccctccgtcctggca

SEQ ID NO: 258213 - DNA, 13 bp, Homo sapiens
gcccatggaagtc

SEQ ID NO: 258214 - DNA, 13 bp, Homo sapiens
gcccatggcccca

SEQ ID NO: 258215 - DNA, 15 bp, Homo sapiens
gcccatggccccagc

SEQ ID NO: 258216 - DNA, 18 bp, Homo sapiens
gcccatggccccagctgg

SEQ ID NO: 258217 - DNA, 18 bp, Homo sapiens
gcccatgggatatgtggt

SEQ ID NO: 258218 - DNA, 21 bp, Homo sapiens
gcccatggttgagaaatgaat

SEQ ID NO: 258219 - DNA, 13 bp, Homo sapiens
gcccatgtgtgag

SEQ ID NO: 258220 - DNA, 14 bp, Homo sapiens
gcccattcccacca

SEQ ID NO: 258221 - DNA, 21 bp, Homo sapiens
gcccattcgtctgtcccagag

SEQ ID NO: 258222 - DNA, 15 bp, Homo sapiens
cctccatctggggat

SEQ ID NO: 258223 - DNA, 22 bp, Homo sapiens
cctccatgattccaagggccca

SEQ ID NO: 258224 - DNA, 23 bp, Homo sapiens
cctccatgattccaagggcccag

SEQ ID NO: 258225 - DNA, 14 bp, Homo sapiens
cctccatgctcctc

SEQ ID NO: 258226 - DNA, 18 bp, Homo sapiens
cctccatgctcctcacct

SEQ ID NO: 258227 - DNA, 20 bp, Homo sapiens
cctccatgctcctcacctgt

SEQ ID NO: 258228 - DNA, 19 bp, Homo sapiens
cctccatggcaggaaggcg

SEQ ID NO: 258229 - DNA, 13 bp, Homo sapiens
cctccatgggcta

SEQ ID NO: 258230 - DNA, 18 bp, Homo sapiens
cctccatggtgcctctgg

SEQ ID NO: 258231 - DNA, 13 bp, Homo sapiens
cctcccaacctca

SEQ ID NO: 258232 - DNA, 16 bp, Homo sapiens
cctcccaactctggcc

SEQ ID NO: 258233 - DNA, 17 bp, Homo sapiens
cctcccaactctggcct

SEQ ID NO: 258234 - DNA, 18 bp, Homo sapiens
cctcccaagcgttcctgg

SEQ ID NO: 258235 - DNA, 19 bp, Homo sapiens
cctcccaagcgttcctggc

SEQ ID NO: 258236 - DNA, 23 bp, Homo sapiens
cctcccaagcgttcctggccttc

SEQ ID NO: 258237 - DNA, 13 bp, Homo sapiens
cctcccaccccct

SEQ ID NO: 258238 - DNA, 21 bp, Homo sapiens
cctcccacccccttctctgct

SEQ ID NO: 258239 - DNA, 15 bp, Homo sapiens
cctcccacctccagt

SEQ ID NO: 258240 - DNA, 11 bp, Homo sapiens
cctcccacctt

SEQ ID NO: 258241 - DNA, 13 bp, Homo sapiens
cctcccacctttg

SEQ ID NO: 258242 - DNA, 13 bp, Homo sapiens
cctcccagacagg

SEQ ID NO: 258243 - DNA, 14 bp, Homo sapiens
cctcccagacaggc

SEQ ID NO: 258244 - DNA, 23 bp, Homo sapiens
cctcccagacaggccctccctgt

SEQ ID NO: 258245 - DNA, 13 bp, Homo sapiens
cctcccagccacc

SEQ ID NO: 258246 - DNA, 23 bp, Homo sapiens
cctcccagccacccggatctcca

SEQ ID NO: 258247 - DNA, 12 bp, Homo sapiens
cctcccagcctg

SEQ ID NO: 258248 - DNA, 14 bp, Homo sapiens
cctcccaggcgccc

SEQ ID NO: 258249 - DNA, 15 bp, Homo sapiens
cctcccatagtgctg

SEQ ID NO: 258250 - DNA, 13 bp, Homo sapiens
cctcccatccagc

SEQ ID NO: 258251 - DNA, 19 bp, Homo sapiens
cctcccatccagcgtctgc

SEQ ID NO: 258252 - DNA, 13 bp, Homo sapiens
cctcccatggccc

SEQ ID NO: 258253 - DNA, 16 bp, Homo sapiens
cctcccatggcccagc

SEQ ID NO: 258254 - DNA, 17 bp, Homo sapiens
cctcccatggcccagca

SEQ ID NO: 258255 - DNA, 13 bp, Homo sapiens
cctccccacagtc

SEQ ID NO: 258256 - DNA, 21 bp, Homo sapiens
cctccccacgtggcacctcct

SEQ ID NO: 258257 - DNA, 12 bp, Homo sapiens
cctccccagcag

SEQ ID NO: 258258 - DNA, 13 bp, Homo sapiens
cctccccagccag

SEQ ID NO: 258259 - DNA, 17 bp, Homo sapiens
cctccccagccagccct

SEQ ID NO: 258260 - DNA, 11 bp, Homo sapiens
cctccccagta

SEQ ID NO: 258261 - DNA, 17 bp, Homo sapiens
cctcccccaaaccctgc

SEQ ID NO: 258262 - DNA, 18 bp, Homo sapiens
cctcccccaaaccctgct

SEQ ID NO: 258263 - DNA, 18 bp, Homo sapiens
cctcccccaacccccacc

SEQ ID NO: 258264 - DNA, 19 bp, Homo sapiens
cctccccccagaccccgcc

SEQ ID NO: 258265 - DNA, 17 bp, Homo sapiens
cctcccccgcagacaga

SEQ ID NO: 258266 - DNA, 14 bp, Homo sapiens
cctcccccgccacc

SEQ ID NO: 258267 - DNA, 16 bp, Homo sapiens
cctcccccgccacctg

SEQ ID NO: 258268 - DNA, 21 bp, Homo sapiens
cctccccggccctaccagcgc

SEQ ID NO: 258269 - DNA, 14 bp, Homo sapiens
cctcccctctcctg

SEQ ID NO: 258270 - DNA, 19 bp, Homo sapiens
cctcccctcttcctggagc

SEQ ID NO: 258271 - DNA, 14 bp, Homo sapiens
cctcccctcttgag

SEQ ID NO: 258272 - DNA, 16 bp, Homo sapiens
cctcccctgccctggt

SEQ ID NO: 258273 - DNA, 16 bp, Homo sapiens
cctcccctgctgaagg

SEQ ID NO: 258274 - DNA, 14 bp, Homo sapiens
cctcccctggggac

SEQ ID NO: 258275 - DNA, 14 bp, Homo sapiens
cctccccttgggcg

SEQ ID NO: 258276 - DNA, 23 bp, Homo sapiens
cctccccttgggcggctgagagc

SEQ ID NO: 258277 - DNA, 13 bp, Homo sapiens
cctcccgccgcct

SEQ ID NO: 258278 - DNA, 19 bp, Homo sapiens
cctcccggcatgggaaagc

SEQ ID NO: 258279 - DNA, 16 bp, Homo sapiens
cctcccggctttgcag

SEQ ID NO: 258280 - DNA, 17 bp, Homo sapiens
cctcccggctttgcagg

SEQ ID NO: 258281 - DNA, 20 bp, Homo sapiens
cctcccggctttgcagggag

SEQ ID NO: 258282 - DNA, 14 bp, Homo sapiens
cctcccgggccctc

SEQ ID NO: 258283 - DNA, 16 bp, Homo sapiens
cctcccgggccctccc

SEQ ID NO: 258284 - DNA, 13 bp, Homo sapiens
cctcccggtgccc

SEQ ID NO: 258285 - DNA, 16 bp, Homo sapiens
cctcccggtgcccaag

SEQ ID NO: 258286 - DNA, 19 bp, Homo sapiens
cctccctacctcaacctgt

SEQ ID NO: 258287 - DNA, 13 bp, Homo sapiens
cctccctccccag

SEQ ID NO: 258288 - DNA, 14 bp, Homo sapiens
cctccctccctgca

SEQ ID NO: 258289 - DNA, 16 bp, Homo sapiens
cctccctccctgcagg

SEQ ID NO: 258290 - DNA, 12 bp, Homo sapiens
cctccctcctcg

SEQ ID NO: 258291 - DNA, 15 bp, Homo sapiens
cctccctcctgcagg

SEQ ID NO: 258292 - DNA, 19 bp, Homo sapiens
cctccctcctgcaggctgg

SEQ ID NO: 258293 - DNA, 13 bp, Homo sapiens
cctccctcctggc

SEQ ID NO: 258294 - DNA, 12 bp, Homo sapiens
cctccctccttc

SEQ ID NO: 258295 - DNA, 22 bp, Homo sapiens
cctccctctcccaggcccgaga

SEQ ID NO: 258296 - DNA, 11 bp, Homo sapiens
cctccctctct

SEQ ID NO: 258297 - DNA, 13 bp, Homo sapiens
cctccctctctct

SEQ ID NO: 258298 - DNA, 20 bp, Homo sapiens
cctccctctctcttctgctc

SEQ ID NO: 258299 - DNA, 22 bp, Homo sapiens
cctccctctctcttctgctcca

SEQ ID NO: 258300 - DNA, 18 bp, Homo sapiens
cctccctctgccccaagc

SEQ ID NO: 258301 - DNA, 23 bp, Homo sapiens
cctccctctgccccaagcagcca

SEQ ID NO: 258302 - DNA, 16 bp, Homo sapiens
cctccctctgctctca

SEQ ID NO: 258303 - DNA, 15 bp, Homo sapiens
cctccctcttcccag

SEQ ID NO: 258304 - DNA, 19 bp, Homo sapiens
cctccctcttcccagcaca

SEQ ID NO: 258305 - DNA, 17 bp, Homo sapiens
cctccctgaccctgcag

SEQ ID NO: 258306 - DNA, 14 bp, Homo sapiens
cctccctgcccagg

SEQ ID NO: 258307 - DNA, 13 bp, Homo sapiens
cctccctgcccct

SEQ ID NO: 258308 - DNA, 18 bp, Homo sapiens
cctccctgcccctccctt

SEQ ID NO: 258309 - DNA, 16 bp, Homo sapiens
cctccctgcctgctcc

SEQ ID NO: 258310 - DNA, 17 bp, Homo sapiens
cctccctgcctgctcct

SEQ ID NO: 258311 - DNA, 19 bp, Homo sapiens
cctccctgcctgctccttg

SEQ ID NO: 258312 - DNA, 20 bp, Homo sapiens
cctccctgcctgctccttgg

SEQ ID NO: 258313 - DNA, 12 bp, Homo sapiens
cctccctgctca

SEQ ID NO: 258314 - DNA, 15 bp, Homo sapiens
cctccctggcctgtt

SEQ ID NO: 258315 - DNA, 13 bp, Homo sapiens
cctccctgggcct

SEQ ID NO: 258316 - DNA, 16 bp, Homo sapiens
cctccctgggcctgtc

SEQ ID NO: 258317 - DNA, 19 bp, Homo sapiens
cctccctgggcctgtctca

SEQ ID NO: 258318 - DNA, 18 bp, Homo sapiens
cctccctggggaccagga

SEQ ID NO: 258319 - DNA, 21 bp, Homo sapiens
cctccctggggaccaggagct

SEQ ID NO: 258320 - DNA, 23 bp, Homo sapiens
cctccctgtcaaagctgtcactt

SEQ ID NO: 258321 - DNA, 15 bp, Homo sapiens
cctccctgtccaccc

SEQ ID NO: 258322 - DNA, 12 bp, Homo sapiens
cctccctgtccc

SEQ ID NO: 258323 - DNA, 15 bp, Homo sapiens
cctccctgtcccctg

SEQ ID NO: 258324 - DNA, 13 bp, Homo sapiens
cctccctgtctcc

SEQ ID NO: 258325 - DNA, 11 bp, Homo sapiens
cctcccttccc

SEQ ID NO: 258326 - DNA, 16 bp, Homo sapiens
cctcccttcccagtgg

SEQ ID NO: 258327 - DNA, 23 bp, Homo sapiens
cctcccttcgtgtgtgcgcccct

SEQ ID NO: 258328 - DNA, 19 bp, Homo sapiens
cctcccttggaaacctgcc

SEQ ID NO: 258329 - DNA, 23 bp, Homo sapiens
cctcccttggaaacctgccctgc

SEQ ID NO: 258330 - DNA, 15 bp, Homo sapiens
cctcccttggcgtgg

SEQ ID NO: 258331 - DNA, 15 bp, Homo sapiens
cctccgactccagat

SEQ ID NO: 258332 - DNA, 13 bp, Homo sapiens
cctccgaggctcc

SEQ ID NO: 258333 - DNA, 19 bp, Homo sapiens
cctccgccctttttgtcct

SEQ ID NO: 258334 - DNA, 13 bp, Homo sapiens
cctccgccgtgcc

SEQ ID NO: 258335 - DNA, 21 bp, Homo sapiens
cctccgcgggggacaggaaca

SEQ ID NO: 258336 - DNA, 17 bp, Homo sapiens
cctccgctcccctttcc

SEQ ID NO: 258337 - DNA, 18 bp, Homo sapiens
cctccggccagcgagtgg

SEQ ID NO: 258338 - DNA, 18 bp, Homo sapiens
cctccggccatactgcct

SEQ ID NO: 258339 - DNA, 17 bp, Homo sapiens
cctccggccctgcccca

SEQ ID NO: 258340 - DNA, 12 bp, Homo sapiens
cctccggcctcc

SEQ ID NO: 258341 - DNA, 17 bp, Homo sapiens
cctccgtccacccaggc

SEQ ID NO: 258342 - DNA, 14 bp, Homo sapiens
cctccgtccccagg

SEQ ID NO: 258343 - DNA, 23 bp, Homo sapiens
cctccgtgatccatccatctcca

SEQ ID NO: 258344 - DNA, 15 bp, Homo sapiens
cctccgttcccacct

SEQ ID NO: 258345 - DNA, 23 bp, Homo sapiens
cctccgttcccacctctgaggac

SEQ ID NO: 258346 - DNA, 21 bp, Homo sapiens
cctccgtttatgggccttgct

SEQ ID NO: 258347 - DNA, 18 bp, Homo sapiens
cctcctaaatgtcagctg

SEQ ID NO: 258348 - DNA, 14 bp, Homo sapiens
cctcctaccctccc

SEQ ID NO: 258349 - DNA, 23 bp, Homo sapiens
cctcctagaggtgggcagctggg

SEQ ID NO: 258350 - DNA, 17 bp, Homo sapiens
cctcctagcaagacctg

SEQ ID NO: 258351 - DNA, 12 bp, Homo sapiens
cctcctcacctc

SEQ ID NO: 258352 - DNA, 13 bp, Homo sapiens
cctcctcacctct

SEQ ID NO: 258353 - DNA, 14 bp, Homo sapiens
cctcctcacctctg

SEQ ID NO: 258354 - DNA, 22 bp, Homo sapiens
cctcttcaccccggcaggccct

SEQ ID NO: 258355 - DNA, 20 bp, Homo sapiens
cctcttcaggggtcacctcc

SEQ ID NO: 258356 - DNA, 11 bp, Homo sapiens
cctcttcccca

SEQ ID NO: 258357 - DNA, 14 bp, Homo sapiens
cctcttccccagaa

SEQ ID NO: 258358 - DNA, 18 bp, Homo sapiens
gataaaaaagaaaacatt

SEQ ID NO: 258359 - DNA, 19 bp, Homo sapiens
gataaaaaagaaaacattc

SEQ ID NO: 258360 - DNA, 19 bp, Homo sapiens
gataaaacattagaagaaa

SEQ ID NO: 258361 - DNA, 20 bp, Homo sapiens
gataaaacattagaagaaaa

SEQ ID NO: 258362 - DNA, 12 bp, Homo sapiens
gataaaataagt

SEQ ID NO: 258363 - DNA, 13 bp, Homo sapiens
gataaaataagta

SEQ ID NO: 258364 - DNA, 16 bp, Homo sapiens
gataaaataagtaaca

SEQ ID NO: 258365 - DNA, 19 bp, Homo sapiens
gataaaataagtaacatat

SEQ ID NO: 258366 - DNA, 16 bp, Homo sapiens
gataaaatcttcaact

SEQ ID NO: 258367 - DNA, 15 bp, Homo sapiens
gataaacattaaaca

SEQ ID NO: 258368 - DNA, 18 bp, Homo sapiens
gataaacattaaacactg

SEQ ID NO: 258369 - DNA, 20 bp, Homo sapiens
gataaagaaaccttttaaaa

SEQ ID NO: 258370 - DNA, 22 bp, Homo sapiens
gataaagatgcaaggaccagga

SEQ ID NO: 258371 - DNA, 17 bp, Homo sapiens
gataaatatcattatag

SEQ ID NO: 258372 - DNA, 22 bp, Homo sapiens
gataaatatcattatagcatgt

SEQ ID NO: 258373 - DNA, 23 bp, Homo sapiens
gataaatcatttcagtatcatct

SEQ ID NO: 258374 - DNA, 18 bp, Homo sapiens
gataaatccaactctgac

SEQ ID NO: 258375 - DNA, 12 bp, Homo sapiens
gataaattataa

SEQ ID NO: 258376 - DNA, 16 bp, Homo sapiens
gataacactggagtgg

SEQ ID NO: 258377 - DNA, 17 bp, Homo sapiens
gataacctatatgattt

SEQ ID NO: 258378 - DNA, 21 bp, Homo sapiens
gataagacttgtttctttctg

SEQ ID NO: 258379 - DNA, 19 bp, Homo sapiens
gataagtggaaaaaagaga

SEQ ID NO: 258380 - DNA, 15 bp, Homo sapiens
cctgcgctcctctgc

SEQ ID NO: 258381 - DNA, 17 bp, Homo sapiens
cctgcgctcctctgcag

SEQ ID NO: 258382 - DNA, 19 bp, Homo sapiens
cctgcgctcctctgcagcc

SEQ ID NO: 258383 - DNA, 16 bp, Homo sapiens
cctgcggctgctggca

SEQ ID NO: 258384 - DNA, 22 bp, Homo sapiens
cctgcgggctgccccgctttgc

SEQ ID NO: 258385 - DNA, 19 bp, Homo sapiens
cctgcgtcatggctcaagg

SEQ ID NO: 258386 - DNA, 16 bp, Homo sapiens
cctgcgtggcctgggg

SEQ ID NO: 258387 - DNA, 13 bp, Homo sapiens
cctgcgtgggggc

SEQ ID NO: 258388 - DNA, 14 bp, Homo sapiens
cctgcgttggagcc

SEQ ID NO: 258389 - DNA, 19 bp, Homo sapiens
cctgcgttggagccactcc

SEQ ID NO: 258390 - DNA, 23 bp, Homo sapiens
cctgcgttggagccactcctgtc

SEQ ID NO: 258391 - DNA, 19 bp, Homo sapiens
cctgctaaggctcctcctt

SEQ ID NO: 258392 - DNA, 20 bp, Homo sapiens
cctgctacaacttcagcagt

SEQ ID NO: 258393 - DNA, 19 bp, Homo sapiens
cctgctacagtagctgtgg

SEQ ID NO: 258394 - DNA, 14 bp, Homo sapiens
cctgctactccact

SEQ ID NO: 258395 - DNA, 14 bp, Homo sapiens
cctgctagagcaac

SEQ ID NO: 258396 - DNA, 23 bp, Homo sapiens
cctgctagagcaacccctgtacc

SEQ ID NO: 258397 - DNA, 20 bp, Homo sapiens
cctgctatttcccaagctgg

SEQ ID NO: 258398 - DNA, 21 bp, Homo sapiens
cctgctatttcccaagctgga

SEQ ID NO: 258399 - DNA, 17 bp, Homo sapiens
cctgctcaactctaccc

SEQ ID NO: 258400 - DNA, 23 bp, Homo sapiens
cctgctcaactctacccctgctc

SEQ ID NO: 258401 - DNA, 18 bp, Homo sapiens
cctgctcacgtctgtgag

SEQ ID NO: 258402 - DNA, 14 bp, Homo sapiens
cctgctcagctggc

SEQ ID NO: 258403 - DNA, 17 bp, Homo sapiens
cctgctcagctggccgg

SEQ ID NO: 258404 - DNA, 18 bp, Homo sapiens
cctgctcaggcctcacct

SEQ ID NO: 258405 - DNA, 21 bp, Homo sapiens
cctgctcaggcctcacctggc

SEQ ID NO: 258406 - DNA, 12 bp, Homo sapiens
cctgctcccagc

SEQ ID NO: 258407 - DNA, 15 bp, Homo sapiens
cctgctcccagcagc

SEQ ID NO: 258408 - DNA, 20 bp, Homo sapiens
cctgctcccattcctccctc

SEQ ID NO: 258409 - DNA, 12 bp, Homo sapiens
cctgctcctcct

SEQ ID NO: 258410 - DNA, 16 bp, Homo sapiens
cctgctcctcctgccc

SEQ ID NO: 258411 - DNA, 20 bp, Homo sapiens
cctgctcctcctgccctgtc

SEQ ID NO: 258412 - DNA, 21 bp, Homo sapiens
cctgctcctcctgccctgtcc

SEQ ID NO: 258413 - DNA, 22 bp, Homo sapiens
cctgctcctcctgccctgtccc

SEQ ID NO: 258414 - DNA, 23 bp, Homo sapiens
cctgctccttggcacccccatgc

SEQ ID NO: 258415 - DNA, 21 bp, Homo sapiens
cctgctctcctcttgccactg

SEQ ID NO: 258416 - DNA, 17 bp, Homo sapiens
cctgctctccttgccct

SEQ ID NO: 258417 - DNA, 19 bp, Homo sapiens
cctgctctccttgccctgg

SEQ ID NO: 258418 - DNA, 14 bp, Homo sapiens
cctgctctctaccc

SEQ ID NO: 258419 - DNA, 19 bp, Homo sapiens
cctgctctctacccagccc

SEQ ID NO: 258420 - DNA, 14 bp, Homo sapiens
cctgctctgcagcc

SEQ ID NO: 258421 - DNA, 20 bp, Homo sapiens
cctgctctgcagcccacaga

SEQ ID NO: 258422 - DNA, 21 bp, Homo sapiens
cctgctgaaggtggggattgc

SEQ ID NO: 258423 - DNA, 22 bp, Homo sapiens
cctgctgaccttggaggaatga

SEQ ID NO: 258424 - DNA, 16 bp, Homo sapiens
cctgctgagtggtcca

SEQ ID NO: 258425 - DNA, 21 bp, Homo sapiens
cctgctgagtggtccacattc

SEQ ID NO: 258426 - DNA, 14 bp, Homo sapiens
cctgctgccgcctc

SEQ ID NO: 258427 - DNA, 13 bp, Homo sapiens
cctgctgcctccc

SEQ ID NO: 258428 - DNA, 15 bp, Homo sapiens
cctgctgcctcccca

SEQ ID NO: 258429 - DNA, 16 bp, Homo sapiens
cctgctgcctccccaa

SEQ ID NO: 258430 - DNA, 23 bp, Homo sapiens
cctgctgcctccccaaccctgcc

SEQ ID NO: 258431 - DNA, 17 bp, Homo sapiens
cctgctgcgtcagacca

SEQ ID NO: 258432 - DNA, 15 bp, Homo sapiens
cctgctgctccatgg

SEQ ID NO: 258433 - DNA, 21 bp, Homo sapiens
cctgctgctcctcggccagag

SEQ ID NO: 258434 - DNA, 22 bp, Homo sapiens
cctgctgctcctcggccagagc

SEQ ID NO: 258435 - DNA, 19 bp, Homo sapiens
cctgctgctcgggaaggcc

SEQ ID NO: 258436 - DNA, 11 bp, Homo sapiens
cctgctgctgt

SEQ ID NO: 258437 - DNA, 21 bp, Homo sapiens
cctgctgctgtaactgctgag

SEQ ID NO: 258438 - DNA, 19 bp, Homo sapiens
cctgctgcttcctaactta

SEQ ID NO: 258439 - DNA, 22 bp, Homo sapiens
cctgctggaaaccacacttctt

SEQ ID NO: 258440 - DNA, 12 bp, Homo sapiens
cctgctggccaa

SEQ ID NO: 258441 - DNA, 11 bp, Homo sapiens
cctgctggccc

SEQ ID NO: 258442 - DNA, 13 bp, Homo sapiens
cctgctggcccct

SEQ ID NO: 258443 - DNA, 16 bp, Homo sapiens
cctgctggcccctcac

SEQ ID NO: 258444 - DNA, 12 bp, Homo sapiens
cctgctggctga

SEQ ID NO: 258445 - DNA, 13 bp, Homo sapiens
cctgctggctgag

SEQ ID NO: 258446 - DNA, 22 bp, Homo sapiens
cctgctgggaaccccgcagccc

SEQ ID NO: 258447 - DNA, 19 bp, Homo sapiens
cctgctggggggcagggcc

SEQ ID NO: 258448 - DNA, 15 bp, Homo sapiens
cctgcttcacacccc

SEQ ID NO: 258449 - DNA, 21 bp, Homo sapiens
cctgcttcacacccctcagcg

SEQ ID NO: 258450 - DNA, 15 bp, Homo sapiens
cctgcttcatatctc

SEQ ID NO: 258451 - DNA, 19 bp, Homo sapiens
cctgcttcatatctctccc

SEQ ID NO: 258452 - DNA, 22 bp, Homo sapiens
cctgcttcatatctctcccttc

SEQ ID NO: 258453 - DNA, 20 bp, Homo sapiens
cctgcttcccaaactcccag

SEQ ID NO: 258454 - DNA, 21 bp, Homo sapiens
cctgcttcccaaactcccagg

SEQ ID NO: 258455 - DNA, 21 bp, Homo sapiens
cctgcttcccacctccctgcc

SEQ ID NO: 258456 - DNA, 16 bp, Homo sapiens
cctgcttctcttttcc

SEQ ID NO: 258457 - DNA, 21 bp, Homo sapiens
cctgcttctcttttcctcgca

SEQ ID NO: 258458 - DNA, 15 bp, Homo sapiens
cctgcttgcccgctc

SEQ ID NO: 258459 - DNA, 17 bp, Homo sapiens
cctgcttgcccgctccc

SEQ ID NO: 258460 - DNA, 20 bp, Homo sapiens
cctgcttgcccgctcccaca

SEQ ID NO: 258461 - DNA, 22 bp, Homo sapiens
cctgcttgcccgctcccacagc

SEQ ID NO: 258462 - DNA, 17 bp, Homo sapiens
cctgcttggggcctggc

SEQ ID NO: 258463 - DNA, 20 bp, Homo sapiens
cctgcttgtactaagccagg

SEQ ID NO: 258464 - DNA, 21 bp, Homo sapiens
cctgcttgtactaagccagga

SEQ ID NO: 258465 - DNA, 18 bp, Homo sapiens
cctgcttgtgttgggccc

SEQ ID NO: 258466 - DNA, 20 bp, Homo sapiens
cctgcttgtgttgggcccca

SEQ ID NO: 258467 - DNA, 14 bp, Homo sapiens
cctgctttctcttt

SEQ ID NO: 258468 - DNA, 15 bp, Homo sapiens
cctgctttctctttc

SEQ ID NO: 258469 - DNA, 16 bp, Homo sapiens
cctgcttttccaggat

SEQ ID NO: 258470 - DNA, 22 bp, Homo sapiens
cctgcttttccaggatcctgca

SEQ ID NO: 258471 - DNA, 19 bp, Homo sapiens
cctggaaaggggagttgag

SEQ ID NO: 258472 - DNA, 15 bp, Homo sapiens
cctggaaattctgcc

SEQ ID NO: 258473 - DNA, 18 bp, Homo sapiens
cctggaaccagagccaca

SEQ ID NO: 258474 - DNA, 21 bp, Homo sapiens
cctggaaccagcaagtcccag

SEQ ID NO: 258475 - DNA, 14 bp, Homo sapiens
cctggaaccaggga

SEQ ID NO: 258476 - DNA, 15 bp, Homo sapiens
cctggaagagctggg

SEQ ID NO: 258477 - DNA, 18 bp, Homo sapiens
cctggaagagctgggtac

SEQ ID NO: 258478 - DNA, 12 bp, Homo sapiens
gcgagtacccca

SEQ ID NO: 258479 - DNA, 14 bp, Homo sapiens
gcgatatacagatg

SEQ ID NO: 258480 - DNA, 19 bp, Homo sapiens
gcgatatacagatgaaaat

SEQ ID NO: 258481 - DNA, 16 bp, Homo sapiens
gcgatatgagagggat

SEQ ID NO: 258482 - DNA, 21 bp, Homo sapiens
gcgatcatggctcactgcagc

SEQ ID NO: 258483 - DNA, 17 bp, Homo sapiens
gcgatccacctgtctca

SEQ ID NO: 258484 - DNA, 13 bp, Homo sapiens
gcgattgaatgct

SEQ ID NO: 258485 - DNA, 15 bp, Homo sapiens
gcgcacccggcagcc

SEQ ID NO: 258486 - DNA, 12 bp, Homo sapiens
gcgcagcccctg

SEQ ID NO: 258487 - DNA, 15 bp, Homo sapiens
gcgcagccctagtgg

SEQ ID NO: 258488 - DNA, 19 bp, Homo sapiens
gcgcagccgcgctctgccc

SEQ ID NO: 258489 - DNA, 14 bp, Homo sapiens
gcgcagtgcctctg

SEQ ID NO: 258490 - DNA, 16 bp, Homo sapiens
gcgcagtgcctctggt

SEQ ID NO: 258491 - DNA, 21 bp, Homo sapiens
gcgcagtgcctctggtctggg

SEQ ID NO: 258492 - DNA, 15 bp, Homo sapiens
gcgcagtggccctga

SEQ ID NO: 258493 - DNA, 13 bp, Homo sapiens
gcgccacccgccc

SEQ ID NO: 258494 - DNA, 15 bp, Homo sapiens
gcgccacccgcccgc

SEQ ID NO: 258495 - DNA, 18 bp, Homo sapiens
gcgccagccctaggctac

SEQ ID NO: 258496 - DNA, 12 bp, Homo sapiens
gcgcccacctgc

SEQ ID NO: 258497 - DNA, 13 bp, Homo sapiens
gcgcccacctgcc

SEQ ID NO: 258498 - DNA, 14 bp, Homo sapiens
gcgcccacctgccc

SEQ ID NO: 258499 - DNA, 20 bp, Homo sapiens
gcgcccattcgtctgtccca

SEQ ID NO: 258500 - DNA, 13 bp, Homo sapiens
gcgcccctggggt

SEQ ID NO: 258501 - DNA, 14 bp, Homo sapiens
gcgccctccctccc

SEQ ID NO: 258502 - DNA, 16 bp, Homo sapiens
gcgccgagaccgcaga

SEQ ID NO: 258503 - DNA, 14 bp, Homo sapiens
gcgcctcccgccgc

SEQ ID NO: 258504 - DNA, 16 bp, Homo sapiens
gcgcctcccgccgcct

SEQ ID NO: 258505 - DNA, 14 bp, Homo sapiens
gcgcctgcccgccc

SEQ ID NO: 258506 - DNA, 17 bp, Homo sapiens
gcgcctgcccgcccgcc

SEQ ID NO: 258507 - DNA, 22 bp, Homo sapiens
gcgcctgcgctcctctgcagcc

SEQ ID NO: 258508 - DNA, 23 bp, Homo sapiens
gcgcctgcgctcctctgcagcct

SEQ ID NO: 258509 - DNA, 16 bp, Homo sapiens
gcgcctggctctgtca

SEQ ID NO: 258510 - DNA, 18 bp, Homo sapiens
gctattgttgtgggcttt

SEQ ID NO: 258511 - DNA, 22 bp, Homo sapiens
gctattgttgtgggctttctcc

SEQ ID NO: 258512 - DNA, 17 bp, Homo sapiens
gctatttccattccaga

SEQ ID NO: 258513 - DNA, 21 bp, Homo sapiens
gctatttcccaagctggagtg

SEQ ID NO: 258514 - DNA, 13 bp, Homo sapiens
gctatttgttcag

SEQ ID NO: 258515 - DNA, 20 bp, Homo sapiens
gctatttgttgtttttaaca

SEQ ID NO: 258516 - DNA, 15 bp, Homo sapiens
gctcaaagatgtact

SEQ ID NO: 258517 - DNA, 16 bp, Homo sapiens
gctcaaagatgtactg

SEQ ID NO: 258518 - DNA, 21 bp, Homo sapiens
gctcaaagatgtactgagagg

SEQ ID NO: 258519 - DNA, 23 bp, Homo sapiens
gctcaaatctattcagacaagca

SEQ ID NO: 258520 - DNA, 12 bp, Homo sapiens
gctcaaatgtat

SEQ ID NO: 258521 - DNA, 19 bp, Homo sapiens
gctcaacccccctcccaga

SEQ ID NO: 258522 - DNA, 21 bp, Homo sapiens
gctcaacccccctcccagaca

SEQ ID NO: 258523 - DNA, 13 bp, Homo sapiens
gctcaacctctca

SEQ ID NO: 258524 - DNA, 20 bp, Homo sapiens
gctcaacctctcagatccct

SEQ ID NO: 258525 - DNA, 22 bp, Homo sapiens
gctcaagcagtctacccacctc

SEQ ID NO: 258526 - DNA, 17 bp, Homo sapiens
gctcaataaatatttgt

SEQ ID NO: 258527 - DNA, 16 bp, Homo sapiens
gctcaatcaagaaaat

SEQ ID NO: 258528 - DNA, 19 bp, Homo sapiens
gctcaatgaaaccttcctc

SEQ ID NO: 258529 - DNA, 21 bp, Homo sapiens
gctcaatgcattgtcttgtgg

SEQ ID NO: 258530 - DNA, 13 bp, Homo sapiens
gctcaatgtgctg

SEQ ID NO: 258531 - DNA, 14 bp, Homo sapiens
gctcaatgtgctgt

SEQ ID NO: 258532 - DNA, 19 bp, Homo sapiens
gctcaatgtgctgttgatt

SEQ ID NO: 258533 - DNA, 17 bp, Homo sapiens
gctcacaactgtttttg

SEQ ID NO: 258534 - DNA, 14 bp, Homo sapiens
gctcacagccacca

SEQ ID NO: 258535 - DNA, 19 bp, Homo sapiens
gctcacagccaccacctgg

SEQ ID NO: 258536 - DNA, 15 bp, Homo sapiens
gctcacattccctct

SEQ ID NO: 258537 - DNA, 13 bp, Homo sapiens
gctcacccctggg

SEQ ID NO: 258538 - DNA, 14 bp, Homo sapiens
gctcacctctgaag

SEQ ID NO: 258539 - DNA, 13 bp, Homo sapiens
gctcacctgcagc

SEQ ID NO: 258540 - DNA, 17 bp, Homo sapiens
gctcacctgcagcccct

SEQ ID NO: 258541 - DNA, 22 bp, Homo sapiens
gctcacgcctgtaatcccagca

SEQ ID NO: 258542 - DNA, 23 bp, Homo sapiens
gctcacgctcccccgcagtcccc

SEQ ID NO: 258543 - DNA, 15 bp, Homo sapiens
gctcactacaacctc

SEQ ID NO: 258544 - DNA, 13 bp, Homo sapiens
gctcactccaggt

SEQ ID NO: 258545 - DNA, 12 bp, Homo sapiens
gctcactcccta

SEQ ID NO: 258546 - DNA, 23 bp, Homo sapiens
gctcactccctaaagccctcttc

SEQ ID NO: 258547 - DNA, 19 bp, Homo sapiens
gctcactgcaacctctgcc

SEQ ID NO: 258548 - DNA, 23 bp, Homo sapiens
gctcactgcaagctccaactccc

SEQ ID NO: 258549 - DNA, 17 bp, Homo sapiens
gctcactgcagcctctg

SEQ ID NO: 258550 - DNA, 20 bp, Homo sapiens
gctcagaatagatctgatgg

SEQ ID NO: 258551 - DNA, 17 bp, Homo sapiens
gctcagagaaggaaaag

SEQ ID NO: 258552 - DNA, 23 bp, Homo sapiens
gctcagagggttgttctcctaga

SEQ ID NO: 258553 - DNA, 18 bp, Homo sapiens
gctcagatgaagagaaat

SEQ ID NO: 258554 - DNA, 11 bp, Homo sapiens
gctcagcccac

SEQ ID NO: 258555 - DNA, 15 bp, Homo sapiens
gctcagcccaccccc

SEQ ID NO: 258556 - DNA, 18 bp, Homo sapiens
gctcagcccacccccctc

SEQ ID NO: 258557 - DNA, 12 bp, Homo sapiens
gctcagccctcc

SEQ ID NO: 258558 - DNA, 16 bp, Homo sapiens
gctcagccctccctgc

SEQ ID NO: 258559 - DNA, 18 bp, Homo sapiens
gctcagccctccctgccc

SEQ ID NO: 258560 - DNA, 12 bp, Homo sapiens
gctcagctctgg

SEQ ID NO: 258561 - DNA, 15 bp, Homo sapiens
gctcagctctggctc

SEQ ID NO: 258562 - DNA, 16 bp, Homo sapiens
gctcagctctggctca

SEQ ID NO: 258563 - DNA, 13 bp, Homo sapiens
gctcaggacccag

SEQ ID NO: 258564 - DNA, 14 bp, Homo sapiens
gctcaggacccagg

SEQ ID NO: 258565 - DNA, 17 bp, Homo sapiens
gctcaggacccaggccc

SEQ ID NO: 258566 - DNA, 18 bp, Homo sapiens
gctcaggacccaggccct

SEQ ID NO: 258567 - DNA, 19 bp, Homo sapiens
gctcaggacccaggccctc

SEQ ID NO: 258568 - DNA, 18 bp, Homo sapiens
gctcaggatctcttagca

SEQ ID NO: 258569 - DNA, 13 bp, Homo sapiens
gctcaggcaagcc

SEQ ID NO: 258570 - DNA, 18 bp, Homo sapiens
gctcaggcaagcccctca

SEQ ID NO: 258571 - DNA, 21 bp, Homo sapiens
gctcaggcaagcccctcagcc

SEQ ID NO: 258572 - DNA, 13 bp, Homo sapiens
gctcaggcctcac

SEQ ID NO: 258573 - DNA, 16 bp, Homo sapiens
gctcaggcctcacctg

SEQ ID NO: 258574 - DNA, 22 bp, Homo sapiens
gctcaggcgatccacctgtctc

SEQ ID NO: 258575 - DNA, 18 bp, Homo sapiens
gctcagggcccacctcct

SEQ ID NO: 258576 - DNA, 12 bp, Homo sapiens
gctcagggctgg

SEQ ID NO: 258577 - DNA, 15 bp, Homo sapiens
gctcagggctggagt

SEQ ID NO: 258578 - DNA, 19 bp, Homo sapiens
gctcaggggcagctcatag

SEQ ID NO: 258579 - DNA, 18 bp, Homo sapiens
gctcaggggcgtgtggct

SEQ ID NO: 258580 - DNA, 22 bp, Homo sapiens
gctcagtattgagacactgtca

SEQ ID NO: 258581 - DNA, 14 bp, Homo sapiens
gctcagtgccacct

SEQ ID NO: 258582 - DNA, 14 bp, Homo sapiens
gctcagtgcctcct

SEQ ID NO: 258583 - DNA, 17 bp, Homo sapiens
gctcagtggatcacaca

SEQ ID NO: 258584 - DNA, 15 bp, Homo sapiens
gctcagttgtacttt

SEQ ID NO: 258585 - DNA, 16 bp, Homo sapiens
gctcatattcctgcag

SEQ ID NO: 258586 - DNA, 20 bp, Homo sapiens
gctcatattcctgcagcctg

SEQ ID NO: 258587 - DNA, 18 bp, Homo sapiens
gctcatattttgtatata

SEQ ID NO: 258588 - DNA, 15 bp, Homo sapiens
gctcatcagaaacaa

SEQ ID NO: 258589 - DNA, 16 bp, Homo sapiens
gctcattcatattcct

SEQ ID NO: 258590 - DNA, 23 bp, Homo sapiens
gctcattcatattcctgcctttc

SEQ ID NO: 258591 - DNA, 15 bp, Homo sapiens
gctcattttttctta

SEQ ID NO: 258592 - DNA, 21 bp, Homo sapiens
gctccacagaaaccctgtttt

SEQ ID NO: 258593 - DNA, 14 bp, Homo sapiens
gctccacagggtgg

SEQ ID NO: 258594 - DNA, 13 bp, Homo sapiens
gctccaccccact

SEQ ID NO: 258595 - DNA, 16 bp, Homo sapiens
gctccaccctcccctc

SEQ ID NO: 258596 - DNA, 14 bp, Homo sapiens
gctccacccttggc

SEQ ID NO: 258597 - DNA, 23 bp, Homo sapiens
gctccacccttggcctgtctcat

SEQ ID NO: 258598 - DNA, 15 bp, Homo sapiens
gctccacgaagcctt

SEQ ID NO: 258599 - DNA, 20 bp, Homo sapiens
gctccacggtgcgtggctgt

SEQ ID NO: 258600 - DNA, 23 bp, Homo sapiens
gctccacggtgcgtggctgtggc

SEQ ID NO: 258601 - DNA, 14 bp, Homo sapiens
gctccactcagggc

SEQ ID NO: 258602 - DNA, 15 bp, Homo sapiens
gctccactcagggct

SEQ ID NO: 258603 - DNA, 16 bp, Homo sapiens
gctccactcagggctg

SEQ ID NO: 258604 - DNA, 12 bp, Homo sapiens
gctccactctga

SEQ ID NO: 258605 - DNA, 23 bp, Homo sapiens
gctccactctgaagtcccttcct

SEQ ID NO: 258606 - DNA, 15 bp, Homo sapiens
gctccactggcctgc

SEQ ID NO: 258607 - DNA, 19 bp, Homo sapiens
gctccagagtaggtgggtc

SEQ ID NO: 258608 - DNA, 15 bp, Homo sapiens
gctccagcagtgctg

SEQ ID NO: 258609 - DNA, 20 bp, Homo sapiens
gctccagcagtgctgggccc

SEQ ID NO: 258610 - DNA, 14 bp, Homo sapiens
gctccagcatccag

SEQ ID NO: 258611 - DNA, 20 bp, Homo sapiens
gctccaggctgactgggggc

SEQ ID NO: 258612 - DNA, 14 bp, Homo sapiens
gctccagggccagg

SEQ ID NO: 258613 - DNA, 21 bp, Homo sapiens
gctccaggggcccttgggaca

SEQ ID NO: 258614 - DNA, 21 bp, Homo sapiens
gctccagtcctgctctctacc

SEQ ID NO: 258615 - DNA, 23 bp, Homo sapiens
gctccagtcctgctctctaccca

SEQ ID NO: 258616 - DNA, 21 bp, Homo sapiens
gctccagtctgctgccctcca

SEQ ID NO: 258617 - DNA, 12 bp, Homo sapiens
gctccagtggaa

SEQ ID NO: 258618 - DNA, 21 bp, Homo sapiens
gctccagtggaagaagaaaac

SEQ ID NO: 258619 - DNA, 17 bp, Homo sapiens
gctccatgactggctgt

SEQ ID NO: 258620 - DNA, 18 bp, Homo sapiens
gctccatgactggctgtc

SEQ ID NO: 258621 - DNA, 22 bp, Homo sapiens
gctccatttataaccccagcct

SEQ ID NO: 258622 - DNA, 15 bp, Homo sapiens
gctcccaagggaggc

SEQ ID NO: 258623 - DNA, 14 bp, Homo sapiens
gctcccaatcagct

SEQ ID NO: 258624 - DNA, 12 bp, Homo sapiens
gctcccacagct

SEQ ID NO: 258625 - DNA, 15 bp, Homo sapiens
gctcccacaggccct

SEQ ID NO: 258626 - DNA, 16 bp, Homo sapiens
gctcccacaggccctt

SEQ ID NO: 258627 - DNA, 21 bp, Homo sapiens
gctcccacaggcccttcctct

SEQ ID NO: 258628 - DNA, 17 bp, Homo sapiens
cctgtagttaggaaata

SEQ ID NO: 258629 - DNA, 20 bp, Homo sapiens
cctgtataatctctctcctg

SEQ ID NO: 258630 - DNA, 13 bp, Homo sapiens
cctgtatagcaac

SEQ ID NO: 258631 - DNA, 15 bp, Homo sapiens
cctgtcaagttaaca

SEQ ID NO: 258632 - DNA, 16 bp, Homo sapiens
cctgtcaagttaacaa

SEQ ID NO: 258633 - DNA, 15 bp, Homo sapiens
cctgtcacgctctgg

SEQ ID NO: 258634 - DNA, 17 bp, Homo sapiens
cctgtcacgctctggtg

SEQ ID NO: 258635 - DNA, 16 bp, Homo sapiens
cctgtcactcagctga

SEQ ID NO: 258636 - DNA, 15 bp, Homo sapiens
cctgtcagagccgcc

SEQ ID NO: 258637 - DNA, 20 bp, Homo sapiens
cctgtcagccaacattgcct

SEQ ID NO: 258638 - DNA, 16 bp, Homo sapiens
cctgtcagtgcagccc

SEQ ID NO: 258639 - DNA, 19 bp, Homo sapiens
cctgtcagtgcagcccgtg

SEQ ID NO: 258640 - DNA, 19 bp, Homo sapiens
cctgtccacctgtgctgct

SEQ ID NO: 258641 - DNA, 23 bp, Homo sapiens
gctcccatgcacaactctccaaa

SEQ ID NO: 258642 - DNA, 12 bp, Homo sapiens
gctccccacgag

SEQ ID NO: 258643 - DNA, 13 bp, Homo sapiens
gctccccagccca

SEQ ID NO: 258644 - DNA, 15 bp, Homo sapiens
gctccccagcccagg

SEQ ID NO: 258645 - DNA, 13 bp, Homo sapiens
gctccccagtgaa

SEQ ID NO: 258646 - DNA, 14 bp, Homo sapiens
gctcccccatcctc

SEQ ID NO: 258647 - DNA, 15 bp, Homo sapiens
gctccccctgccagc

SEQ ID NO: 258648 - DNA, 17 bp, Homo sapiens
gctccccctgccagcaa

SEQ ID NO: 258649 - DNA, 19 bp, Homo sapiens
gctcccccttgcccgccag

SEQ ID NO: 258650 - DNA, 23 bp, Homo sapiens
gctcccccttgcccgccagccag

SEQ ID NO: 258651 - DNA, 15 bp, Homo sapiens
gctccccgcctccac

SEQ ID NO: 258652 - DNA, 16 bp, Homo sapiens
gctccccgcctccact

SEQ ID NO: 258653 - DNA, 16 bp, Homo sapiens
gctcccctgcccgccc

SEQ ID NO: 258654 - DNA, 19 bp, Homo sapiens
gctcccctggagccagcag

SEQ ID NO: 258655 - DNA, 23 bp, Homo sapiens
gctcccctggagccagcagggct

SEQ ID NO: 258656 - DNA, 15 bp, Homo sapiens
gctcccctggtctcc

SEQ ID NO: 258657 - DNA, 19 bp, Homo sapiens
gctcccgagctactctctt

SEQ ID NO: 258658 - DNA, 20 bp, Homo sapiens
gctccctcccctgccctggt

SEQ ID NO: 258659 - DNA, 23 bp, Homo sapiens
gctccctcccctgccctggtcca

SEQ ID NO: 258660 - DNA, 12 bp, Homo sapiens
gctccctcctcc

SEQ ID NO: 258661 - DNA, 13 bp, Homo sapiens
gctccctcctccc

SEQ ID NO: 258662 - DNA, 14 bp, Homo sapiens
gctccctcctccca

SEQ ID NO: 258663 - DNA, 19 bp, Homo sapiens
gctccctcctcccatctcc

SEQ ID NO: 258664 - DNA, 21 bp, Homo sapiens
gctccctcctcccatctcctt

SEQ ID NO: 258665 - DNA, 13 bp, Homo sapiens
gctccctcctgga

SEQ ID NO: 258666 - DNA, 19 bp, Homo sapiens
gctccctcctggagcatcc

SEQ ID NO: 258667 - DNA, 16 bp, Homo sapiens
gctccctcgctgtatg

SEQ ID NO: 258668 - DNA, 20 bp, Homo sapiens
gctccctggaaagcaggcaa

SEQ ID NO: 258669 - DNA, 13 bp, Homo sapiens
gctccctgggacc

SEQ ID NO: 258670 - DNA, 19 bp, Homo sapiens
gctcccttcaatgctagaa

SEQ ID NO: 258671 - DNA, 21 bp, Homo sapiens
gctcccttcatctccagggag

SEQ ID NO: 258672 - DNA, 15 bp, Homo sapiens
gctcccttgtgcgtg

SEQ ID NO: 258673 - DNA, 17 bp, Homo sapiens
gctccgagggcggccag

SEQ ID NO: 258674 - DNA, 20 bp, Homo sapiens
gctccgagggcggccaggga

SEQ ID NO: 258675 - DNA, 14 bp, Homo sapiens
gctccgatgcccgc

SEQ ID NO: 258676 - DNA, 21 bp, Homo sapiens
gctccgatgcccgcccgggga

SEQ ID NO: 258677 - DNA, 13 bp, Homo sapiens
gctccgccaggaa

SEQ ID NO: 258678 - DNA, 14 bp, Homo sapiens
gctccgccaggaaa

SEQ ID NO: 258679 - DNA, 13 bp, Homo sapiens
gctccgcctctgc

SEQ ID NO: 258680 - DNA, 19 bp, Homo sapiens
gctccgcctggcacccact

SEQ ID NO: 258681 - DNA, 19 bp, Homo sapiens
gctccggcagaggcagggc

SEQ ID NO: 258682 - DNA, 21 bp, Homo sapiens
gctcctaatggtacgtgggta

SEQ ID NO: 258683 - DNA, 20 bp, Homo sapiens
gctcctacaggcgctccagg

SEQ ID NO: 258684 - DNA, 21 bp, Homo sapiens
gctcctacccctgtcctgggg

SEQ ID NO: 258685 - DNA, 17 bp, Homo sapiens
gctcctcacccccaccc

SEQ ID NO: 258686 - DNA, 18 bp, Homo sapiens
gctcctcacccccacccc

SEQ ID NO: 258687 - DNA, 16 bp, Homo sapiens
gctcctcacctgtcta

SEQ ID NO: 258688 - DNA, 18 bp, Homo sapiens
gctcctcactgcccgcac

SEQ ID NO: 258689 - DNA, 16 bp, Homo sapiens
gctcctcccctcttga

SEQ ID NO: 258690 - DNA, 19 bp, Homo sapiens
gctcctcccggtgcccaag

SEQ ID NO: 258691 - DNA, 14 bp, Homo sapiens
gctcctcctctctg

SEQ ID NO: 258692 - DNA, 18 bp, Homo sapiens
gctcctcctctctggact

SEQ ID NO: 258693 - DNA, 20 bp, Homo sapiens
gctcctcctctctggacttt

SEQ ID NO: 258694 - DNA, 20 bp, Homo sapiens
gctcctcctcttggagctga

SEQ ID NO: 258695 - DNA, 14 bp, Homo sapiens
gctcctcctgccct

SEQ ID NO: 258696 - DNA, 20 bp, Homo sapiens
gctcctcctgccctgtccct

SEQ ID NO: 258697 - DNA, 19 bp, Homo sapiens
gctcctccttgcccagact

SEQ ID NO: 258698 - DNA, 16 bp, Homo sapiens
gctcctcggccagagc

SEQ ID NO: 258699 - DNA, 13 bp, Homo sapiens
gctcctctgcagc

SEQ ID NO: 258700 - DNA, 20 bp, Homo sapiens
gctcctctgcagcctgagct

SEQ ID NO: 258701 - DNA, 13 bp, Homo sapiens
gctcctctgccct

SEQ ID NO: 258702 - DNA, 15 bp, Homo sapiens
gctcctctgccttgg

SEQ ID NO: 258703 - DNA, 16 bp, Homo sapiens
gctcctctgccttgga

SEQ ID NO: 258704 - DNA, 17 bp, Homo sapiens
gctcctctgccttggac

SEQ ID NO: 258705 - DNA, 18 bp, Homo sapiens
gctcctctgccttggaca

SEQ ID NO: 258706 - DNA, 19 bp, Homo sapiens
gctcctctgggcaggacct

SEQ ID NO: 258707 - DNA, 15 bp, Homo sapiens
gctcctgaaaaatga

SEQ ID NO: 258708 - DNA, 18 bp, Homo sapiens
gctcctgaggggcatctg

SEQ ID NO: 258709 - DNA, 13 bp, Homo sapiens
gctcctgcatgca

SEQ ID NO: 258710 - DNA, 13 bp, Homo sapiens
gctcctgctgggg

SEQ ID NO: 258711 - DNA, 22 bp, Homo sapiens
gctcctggaaccaatcccgtga

SEQ ID NO: 258712 - DNA, 18 bp, Homo sapiens
gctcctggagcctttgaa

SEQ ID NO: 258713 - DNA, 19 bp, Homo sapiens
gctcctggagcctttgaat

SEQ ID NO: 258714 - DNA, 14 bp, Homo sapiens
gctcctggctgcca

SEQ ID NO: 258715 - DNA, 15 bp, Homo sapiens
gctcctggctgccag

SEQ ID NO: 258716 - DNA, 22 bp, Homo sapiens
gctcctgggaaggctactcacc

SEQ ID NO: 258717 - DNA, 19 bp, Homo sapiens
gctcctggtcttgagatgt

SEQ ID NO: 258718 - DNA, 15 bp, Homo sapiens
gctcctgtctggctc

SEQ ID NO: 258719 - DNA, 20 bp, Homo sapiens
gctcctgtttaactccctag

SEQ ID NO: 258720 - DNA, 14 bp, Homo sapiens
gctccttaaactga

SEQ ID NO: 258721 - DNA, 15 bp, Homo sapiens
gctccttaaactgac

SEQ ID NO: 258722 - DNA, 22 bp, Homo sapiens
gctccttaaagttctgggcagc

SEQ ID NO: 258723 - DNA, 15 bp, Homo sapiens
gctccttccttcacc

SEQ ID NO: 258724 - DNA, 14 bp, Homo sapiens
gctccttgaataag

SEQ ID NO: 258725 - DNA, 15 bp, Homo sapiens
gctccttgattgcct

SEQ ID NO: 258726 - DNA, 19 bp, Homo sapiens
gctccttgcggaggtgaag

SEQ ID NO: 258727 - DNA, 21 bp, Homo sapiens
gctccttggcctagtcagatg

SEQ ID NO: 258728 - DNA, 18 bp, Homo sapiens
gctccttgggtcctgcaa

SEQ ID NO: 258729 - DNA, 16 bp, Homo sapiens
gctcctttctccagcc

SEQ ID NO: 258730 - DNA, 19 bp, Homo sapiens
gctcctttctccagccagc

SEQ ID NO: 258731 - DNA, 16 bp, Homo sapiens
gctccttttctctttg

SEQ ID NO: 258732 - DNA, 17 bp, Homo sapiens
gctccttttgtccccag

SEQ ID NO: 258733 - DNA, 20 bp, Homo sapiens
gctccttttgtccccagggc

SEQ ID NO: 258734 - DNA, 22 bp, Homo sapiens
gctcgccaaccgcatctgctca

SEQ ID NO: 258735 - DNA, 17 bp, Homo sapiens
gctcgccattcactgat

SEQ ID NO: 258736 - DNA, 13 bp, Homo sapiens
gctcggacacagt

SEQ ID NO: 258737 - DNA, 21 bp, Homo sapiens
gctcggccaggcacggaggct

SEQ ID NO: 258738 - DNA, 22 bp, Homo sapiens
gctcggccaggcacggaggctc

SEQ ID NO: 258739 - DNA, 23 bp, Homo sapiens
gctcgggaaggcctgagggaagc

SEQ ID NO: 258740 - DNA, 22 bp, Homo sapiens
gctcgggacggatagtagacag

SEQ ID NO: 258741 - DNA, 14 bp, Homo sapiens
gctcgtgcatgtaa

SEQ ID NO: 258742 - DNA, 22 bp, Homo sapiens
gctcgtggccttccccttttgc

SEQ ID NO: 258743 - DNA, 15 bp, Homo sapiens
gctcgtgtatcctgg

SEQ ID NO: 258744 - DNA, 16 bp, Homo sapiens
gctcgtgtatcctggg

SEQ ID NO: 258745 - DNA, 23 bp, Homo sapiens
gctcgtgtatcctggggctccct

SEQ ID NO: 258746 - DNA, 21 bp, Homo sapiens
gctcgtttttcagcaccccca

SEQ ID NO: 258747 - DNA, 18 bp, Homo sapiens
gctctaacattactgcct

SEQ ID NO: 258748 - DNA, 20 bp, Homo sapiens
gctctaacattactgccttc

SEQ ID NO: 258749 - DNA, 19 bp, Homo sapiens
gctctaccaagacataatg

SEQ ID NO: 258750 - DNA, 22 bp, Homo sapiens
gctctaccaagacataatgcac

SEQ ID NO: 258751 - DNA, 12 bp, Homo sapiens
gctctacccatg

SEQ ID NO: 258752 - DNA, 15 bp, Homo sapiens
gctctacccatgagc

SEQ ID NO: 258753 - DNA, 16 bp, Homo sapiens
gctctacccatgagcc

SEQ ID NO: 258754 - DNA, 15 bp, Homo sapiens
gctctacttcttttt

SEQ ID NO: 258755 - DNA, 13 bp, Homo sapiens
gctctagccagga

SEQ ID NO: 258756 - DNA, 15 bp, Homo sapiens
gctctagccaggagt

SEQ ID NO: 258757 - DNA, 18 bp, Homo sapiens
gctctagctggcaggaca

SEQ ID NO: 258758 - DNA, 20 bp, Homo sapiens
gctctagctggcaggacaca

SEQ ID NO: 258759 - DNA, 22 bp, Homo sapiens
gctctagggttgctggagcctg

SEQ ID NO: 258760 - DNA, 22 bp, Homo sapiens
gctctatttcggaaatacacta

SEQ ID NO: 258761 - DNA, 16 bp, Homo sapiens
gctctcaatatataat

SEQ ID NO: 258762 - DNA, 16 bp, Homo sapiens
gctctcacccccatcc

SEQ ID NO: 258763 - DNA, 17 bp, Homo sapiens
gctctcacccccatccc

SEQ ID NO: 258764 - DNA, 16 bp, Homo sapiens
gctctccaaaccactt

SEQ ID NO: 258765 - DNA, 17 bp, Homo sapiens
gctctccaaaggggctg

SEQ ID NO: 258766 - DNA, 22 bp, Homo sapiens
ccttaatatacctaaatctcca

SEQ ID NO: 258767 - DNA, 12 bp, Homo sapiens
ccttaatggatg

SEQ ID NO: 258768 - DNA, 19 bp, Homo sapiens
ccttacaaccacatttctg

SEQ ID NO: 258769 - DNA, 15 bp, Homo sapiens
ccttaccaactttct

SEQ ID NO: 258770 - DNA, 19 bp, Homo sapiens
ccttaccaactttctgtaa

SEQ ID NO: 258771 - DNA, 13 bp, Homo sapiens
gctctccagaagc

SEQ ID NO: 258772 - DNA, 16 bp, Homo sapiens
gctctcccctgccctg

SEQ ID NO: 258773 - DNA, 14 bp, Homo sapiens
gctctcccctgcgc

SEQ ID NO: 258774 - DNA, 20 bp, Homo sapiens
gctctcccctgcgcaggccc

SEQ ID NO: 258775 - DNA, 23 bp, Homo sapiens
gctctcccctgcgcaggccctcc

SEQ ID NO: 258776 - DNA, 14 bp, Homo sapiens
gctctccctctctg

SEQ ID NO: 258777 - DNA, 22 bp, Homo sapiens
gctctcctaagtttaattacaa

SEQ ID NO: 258778 - DNA, 17 bp, Homo sapiens
gctctcctaccccacct

SEQ ID NO: 258779 - DNA, 19 bp, Homo sapiens
gctctcctcttgccactgc

SEQ ID NO: 258780 - DNA, 22 bp, Homo sapiens
gctctcctcttgccactgcctc

SEQ ID NO: 258781 - DNA, 19 bp, Homo sapiens
gctctcctgggccagggtc

SEQ ID NO: 258782 - DNA, 22 bp, Homo sapiens
gctctcctgggccagggtctcg

SEQ ID NO: 258783 - DNA, 16 bp, Homo sapiens
gctctccttgccctgg

SEQ ID NO: 258784 - DNA, 17 bp, Homo sapiens
gctctccttgccctggg

SEQ ID NO: 258785 - DNA, 19 bp, Homo sapiens
gctctcggaactgcatgct

SEQ ID NO: 258786 - DNA, 13 bp, Homo sapiens
gctctcgtccctc

SEQ ID NO: 258787 - DNA, 13 bp, Homo sapiens
gctctctacccag

SEQ ID NO: 258788 - DNA, 13 bp, Homo sapiens
gctctctcagacc

SEQ ID NO: 258789 - DNA, 13 bp, Homo sapiens
gctctctccagga

SEQ ID NO: 258790 - DNA, 17 bp, Homo sapiens
gctctcttaaatgaagt

SEQ ID NO: 258791 - DNA, 18 bp, Homo sapiens
gctctcttaaatgaagtg

SEQ ID NO: 258792 - DNA, 22 bp, Homo sapiens
gctctcttgccgaggagccagg

SEQ ID NO: 258793 - DNA, 18 bp, Homo sapiens
gctctgaaagctgcttct

SEQ ID NO: 258794 - DNA, 19 bp, Homo sapiens
gctctgaaagctgcttctg

SEQ ID NO: 258795 - DNA, 14 bp, Homo sapiens
gctctgaatctctc

SEQ ID NO: 258796 - DNA, 16 bp, Homo sapiens
gctctgaatctctcaa

SEQ ID NO: 258797 - DNA, 15 bp, Homo sapiens
gctctgacccagtga

SEQ ID NO: 258798 - DNA, 14 bp, Homo sapiens
gctctgagaagagg

SEQ ID NO: 258799 - DNA, 21 bp, Homo sapiens
gctctgagacggatggaagga

SEQ ID NO: 258800 - DNA, 11 bp, Homo sapiens
gctctgagccc

SEQ ID NO: 258801 - DNA, 13 bp, Homo sapiens
gctctgagccctc

SEQ ID NO: 258802 - DNA, 19 bp, Homo sapiens
gctctgaggcaaccccctc

SEQ ID NO: 258803 - DNA, 23 bp, Homo sapiens
gctctgattttttactggctgtg

SEQ ID NO: 258804 - DNA, 11 bp, Homo sapiens
gctctgcacag

SEQ ID NO: 258805 - DNA, 12 bp, Homo sapiens
gctctgcacaga

SEQ ID NO: 258806 - DNA, 22 bp, Homo sapiens
gctctgcagcccacagaggaca

SEQ ID NO: 258807 - DNA, 18 bp, Homo sapiens
gctctgccatcagcccct

SEQ ID NO: 258808 - DNA, 19 bp, Homo sapiens
gctctgccatcagcccctg

SEQ ID NO: 258809 - DNA, 21 bp, Homo sapiens
gctctgccatcagcccctgct

SEQ ID NO: 258810 - DNA, 16 bp, Homo sapiens
gctctgcccagagctg

SEQ ID NO: 258811 - DNA, 17 bp, Homo sapiens
gctctgcccagagctgg

SEQ ID NO: 258812 - DNA, 21 bp, Homo sapiens
gctctgcccagagctgggtga

SEQ ID NO: 258813 - DNA, 18 bp, Homo sapiens
gctctgccccaagccccc

SEQ ID NO: 258814 - DNA, 19 bp, Homo sapiens
gctctgccccaagccccca

SEQ ID NO: 258815 - DNA, 22 bp, Homo sapiens
gctctgcccccgcgggttctag

SEQ ID NO: 258816 - DNA, 23 bp, Homo sapiens
gctctgcccccgcgggttctaga

SEQ ID NO: 258817 - DNA, 13 bp, Homo sapiens
gctctgcccctcc

SEQ ID NO: 258818 - DNA, 14 bp, Homo sapiens
gctctgcccctccg

SEQ ID NO: 258819 - DNA, 22 bp, Homo sapiens
gctctgccccttgggcatccac

SEQ ID NO: 258820 - DNA, 16 bp, Homo sapiens
gctctgcgtcccactg

SEQ ID NO: 258821 - DNA, 15 bp, Homo sapiens
gctctgctgacttct

SEQ ID NO: 258822 - DNA, 12 bp, Homo sapiens
gctctggaagcc

SEQ ID NO: 258823 - DNA, 13 bp, Homo sapiens
gctctggaagcct

SEQ ID NO: 258824 - DNA, 14 bp, Homo sapiens
gctctggaagcctg

SEQ ID NO: 258825 - DNA, 15 bp, Homo sapiens
gctctggagccacct

SEQ ID NO: 258826 - DNA, 18 bp, Homo sapiens
gctctggagccacctgtc

SEQ ID NO: 258827 - DNA, 22 bp, Homo sapiens
gctctggagccacctgtcccac

SEQ ID NO: 258828 - DNA, 17 bp, Homo sapiens
gctctggcaggtggcca

SEQ ID NO: 258829 - DNA, 23 bp, Homo sapiens
gctctggcaggtggccagggctc

SEQ ID NO: 258830 - DNA, 22 bp, Homo sapiens
gctctggccacaatcctcccca

SEQ ID NO: 258831 - DNA, 23 bp, Homo sapiens
gctctggccacaatcctccccac

SEQ ID NO: 258832 - DNA, 13 bp, Homo sapiens
gctctggccaccc

SEQ ID NO: 258833 - DNA, 15 bp, Homo sapiens
gctctggccaccctg

SEQ ID NO: 258834 - DNA, 21 bp, Homo sapiens
gctctgggatagctgacccag

SEQ ID NO: 258835 - DNA, 15 bp, Homo sapiens
gctctgggggctcca

SEQ ID NO: 258836 - DNA, 23 bp, Homo sapiens
gctctgtattctgcaacagcctg

SEQ ID NO: 258837 - DNA, 11 bp, Homo sapiens
gctctgtccaa

SEQ ID NO: 258838 - DNA, 20 bp, Homo sapiens
gctctgtccaattccagagc

SEQ ID NO: 258839 - DNA, 21 bp, Homo sapiens
gctctgtccaattccagagct

SEQ ID NO: 258840 - DNA, 18 bp, Homo sapiens
gctctgtcgcccaggctg

SEQ ID NO: 258841 - DNA, 20 bp, Homo sapiens
gctctgtcgtggtagcagat

SEQ ID NO: 258842 - DNA, 13 bp, Homo sapiens
gctctgtcttcct

SEQ ID NO: 258843 - DNA, 15 bp, Homo sapiens
gctctgtgcctggga

SEQ ID NO: 258844 - DNA, 20 bp, Homo sapiens
gctctgtgcctgggatcagt

SEQ ID NO: 258845 - DNA, 17 bp, Homo sapiens
gctctgtggcctgtgtc

SEQ ID NO: 258846 - DNA, 19 bp, Homo sapiens
gctctgtggcctgtgtcca

SEQ ID NO: 258847 - DNA, 18 bp, Homo sapiens
gctctgttgcaggtgtcc

SEQ ID NO: 258848 - DNA, 19 bp, Homo sapiens
gctctgttgcaggtgtccg

SEQ ID NO: 258849 - DNA, 19 bp, Homo sapiens
gctcttagctttctcaggg

SEQ ID NO: 258850 - DNA, 22 bp, Homo sapiens
gctcttagtgcccgcctaggag

SEQ ID NO: 258851 - DNA, 13 bp, Homo sapiens
gctcttcctggac

SEQ ID NO: 258852 - DNA, 20 bp, Homo sapiens
gctcttcctggacctgagtc

SEQ ID NO: 258853 - DNA, 13 bp, Homo sapiens
gctcttctccttt

SEQ ID NO: 258854 - DNA, 11 bp, Homo sapiens
gctcttctggg

SEQ ID NO: 258855 - DNA, 14 bp, Homo sapiens
gctcttctgggcag

SEQ ID NO: 258856 - DNA, 20 bp, Homo sapiens
gctcttctgggcagagcctg

SEQ ID NO: 258857 - DNA, 14 bp, Homo sapiens
gctcttcttgtgaa

SEQ ID NO: 258858 - DNA, 15 bp, Homo sapiens
gctcttcttgtgaaa

SEQ ID NO: 258859 - DNA, 16 bp, Homo sapiens
gctcttcttgtgaaat

SEQ ID NO: 258860 - DNA, 17 bp, Homo sapiens
gctcttgcatctgggcc

SEQ ID NO: 258861 - DNA, 19 bp, Homo sapiens
gctcttgctttggtcttct

SEQ ID NO: 258862 - DNA, 21 bp, Homo sapiens
gctcttggcattttcctcgcc

SEQ ID NO: 258863 - DNA, 21 bp, Homo sapiens
gctcttggtccctggtccctc

SEQ ID NO: 258864 - DNA, 15 bp, Homo sapiens
gctctttcctgccct

SEQ ID NO: 258865 - DNA, 14 bp, Homo sapiens
gctctttctctgcc

SEQ ID NO: 258866 - DNA, 16 bp, Homo sapiens
gctctttctctgccag

SEQ ID NO: 258867 - DNA, 19 bp, Homo sapiens
gctgaaaaccatctggcct

SEQ ID NO: 258868 - DNA, 22 bp, Homo sapiens
gctgaaaaccatctggcctggc

SEQ ID NO: 258869 - DNA, 17 bp, Homo sapiens
gctgaaacaggagagaa

SEQ ID NO: 258870 - DNA, 18 bp, Homo sapiens
gctgaaacaggagagaaa

SEQ ID NO: 258871 - DNA, 17 bp, Homo sapiens
gctgaaagggagcccct

SEQ ID NO: 258872 - DNA, 20 bp, Homo sapiens
gctgaaataaactagggttt

SEQ ID NO: 258873 - DNA, 12 bp, Homo sapiens
gctgaaattatg

SEQ ID NO: 258874 - DNA, 18 bp, Homo sapiens
gctgaaattatgtcaaat

SEQ ID NO: 258875 - DNA, 16 bp, Homo sapiens
gctgaaggattatatg

SEQ ID NO: 258876 - DNA, 20 bp, Homo sapiens
gctgaatatctgttcacttt

SEQ ID NO: 258877 - DNA, 11 bp, Homo sapiens
gctgaattcct

SEQ ID NO: 258878 - DNA, 21 bp, Homo sapiens
gctgacaaccaccgctcccca

SEQ ID NO: 258879 - DNA, 22 bp, Homo sapiens
gctgacaaccaccgctccccag

SEQ ID NO: 258880 - DNA, 12 bp, Homo sapiens
gctgacacctcc

SEQ ID NO: 258881 - DNA, 18 bp, Homo sapiens
gctgacactgacatttca

SEQ ID NO: 258882 - DNA, 19 bp, Homo sapiens
gctgacagagcaggtctgc

SEQ ID NO: 258883 - DNA, 16 bp, Homo sapiens
gctgacagatgttcca

SEQ ID NO: 258884 - DNA, 14 bp, Homo sapiens
gctgacatcttgca

SEQ ID NO: 258885 - DNA, 15 bp, Homo sapiens
gctgaccccaggaag

SEQ ID NO: 258886 - DNA, 18 bp, Homo sapiens
gctgacctcccagtgacc

SEQ ID NO: 258887 - DNA, 22 bp, Homo sapiens
gctgacctctgttgtcctcccc

SEQ ID NO: 258888 - DNA, 21 bp, Homo sapiens
gctgaccttgaactcctgggc

SEQ ID NO: 258889 - DNA, 23 bp, Homo sapiens
gctgactagaagggccagtcctg

SEQ ID NO: 258890 - DNA, 14 bp, Homo sapiens
gctgactcttacta

SEQ ID NO: 258891 - DNA, 13 bp, Homo sapiens
gctgactgggaac

SEQ ID NO: 258892 - DNA, 16 bp, Homo sapiens
gctgactggggctggg

SEQ ID NO: 258893 - DNA, 13 bp, Homo sapiens
gctgactgggggc

SEQ ID NO: 258894 - DNA, 16 bp, Homo sapiens
gctgactgggggcctc

SEQ ID NO: 258895 - DNA, 23 bp, Homo sapiens
gctgactgtggccccctccgtga

SEQ ID NO: 258896 - DNA, 19 bp, Homo sapiens
gctgagaaggccagccctc

SEQ ID NO: 258897 - DNA, 23 bp, Homo sapiens
gctgagacgcaaggatcacttga

SEQ ID NO: 258898 - DNA, 18 bp, Homo sapiens
gctgagactgcagaggag

SEQ ID NO: 258899 - DNA, 21 bp, Homo sapiens
gctgagactgcagaggagcca

SEQ ID NO: 258900 - DNA, 13 bp, Homo sapiens
gctgagagcccca

SEQ ID NO: 258901 - DNA, 12 bp, Homo sapiens
ctccgtgtgtct

SEQ ID NO: 258902 - DNA, 17 bp, Homo sapiens
ctccgtgtgtctcatgc

SEQ ID NO: 258903 - DNA, 19 bp, Homo sapiens
ctccgtgtgtctcatgcca

SEQ ID NO: 258904 - DNA, 16 bp, Homo sapiens
ctcctaaaggcagcaa

SEQ ID NO: 258905 - DNA, 17 bp, Homo sapiens
ctcctaaagtagacttc

SEQ ID NO: 258906 - DNA, 24 bp, Homo sapiens
ctcctacaggcgctccaggccact

SEQ ID NO: 258907 - DNA, 21 bp, Homo sapiens
ctcctacccctgtcctggggc

SEQ ID NO: 258908 - DNA, 23 bp, Homo sapiens
ctcctacccctgtcctggggctg

SEQ ID NO: 258909 - DNA, 13 bp, Homo sapiens
ctcctaccctccc

SEQ ID NO: 258910 - DNA, 19 bp, Homo sapiens
ctcctaccctcccaccaga

SEQ ID NO: 258911 - DNA, 12 bp, Homo sapiens
ctcctactctgt

SEQ ID NO: 258912 - DNA, 17 bp, Homo sapiens
ctcctagagacagaagc

SEQ ID NO: 258913 - DNA, 16 bp, Homo sapiens
ctcctagaggtgggca

SEQ ID NO: 258914 - DNA, 17 bp, Homo sapiens
ctcctagaggtgggcag

SEQ ID NO: 258915 - DNA, 19 bp, Homo sapiens
ctcctagaggtgggcagct

SEQ ID NO: 258916 - DNA, 23 bp, Homo sapiens
ctcctagaggtgggcagctgggc

SEQ ID NO: 258917 - DNA, 19 bp, Homo sapiens
ctcctaggacatgttccct

SEQ ID NO: 258918 - DNA, 13 bp, Homo sapiens
ctcctaggagagc

SEQ ID NO: 258919 - DNA, 23 bp, Homo sapiens
ctcctaggagagccaacctcggc

SEQ ID NO: 258920 - DNA, 18 bp, Homo sapiens
ctcctatcacctcccctc

SEQ ID NO: 258921 - DNA, 20 bp, Homo sapiens
ctcctatccccaggccaggt

SEQ ID NO: 258922 - DNA, 14 bp, Homo sapiens
ctcctatccttgga

SEQ ID NO: 258923 - DNA, 13 bp, Homo sapiens
ctcctatctgtgt

SEQ ID NO: 258924 - DNA, 15 bp, Homo sapiens
ctcctatctgtgttt

SEQ ID NO: 258925 - DNA, 18 bp, Homo sapiens
ctcctatctgtgttttga

SEQ ID NO: 258926 - DNA, 22 bp, Homo sapiens
ctcctcaccccagtgcctgtct

SEQ ID NO: 258927 - DNA, 13 bp, Homo sapiens
ctcctcaccccca

SEQ ID NO: 258928 - DNA, 22 bp, Homo sapiens
ctcctcacccccacccctgtac

SEQ ID NO: 258929 - DNA, 18 bp, Homo sapiens
ctcctcacctctggactg

SEQ ID NO: 258930 - DNA, 12 bp, Homo sapiens
ctcctcacctgt

SEQ ID NO: 258931 - DNA, 18 bp, Homo sapiens
ctcctcactgcccgcaca

SEQ ID NO: 258932 - DNA, 11 bp, Homo sapiens
ctcctcagggt

SEQ ID NO: 258933 - DNA, 14 bp, Homo sapiens
ctcctcagggtggg

SEQ ID NO: 258934 - DNA, 15 bp, Homo sapiens
ctcctcagggtgggg

SEQ ID NO: 258935 - DNA, 15 bp, Homo sapiens
ctcctccaaatgctg

SEQ ID NO: 258936 - DNA, 19 bp, Homo sapiens
ctcctccaagaagccctcc

SEQ ID NO: 258937 - DNA, 22 bp, Homo sapiens
ctcctccaagaagccctccttg

SEQ ID NO: 258938 - DNA, 17 bp, Homo sapiens
ctcctccacagtgctgc

SEQ ID NO: 258939 - DNA, 12 bp, Homo sapiens
ctcctccactca

SEQ ID NO: 258940 - DNA, 17 bp, Homo sapiens
ctcctccactccacctc

SEQ ID NO: 258941 - DNA, 13 bp, Homo sapiens
ctcctccagactc

SEQ ID NO: 258942 - DNA, 18 bp, Homo sapiens
ctcctccatctttctaca

SEQ ID NO: 258943 - DNA, 13 bp, Homo sapiens
ctcctcccatctc

SEQ ID NO: 258944 - DNA, 13 bp, Homo sapiens
ctcctccccgatc

SEQ ID NO: 258945 - DNA, 15 bp, Homo sapiens
ctcctcccggtgccc

SEQ ID NO: 258946 - DNA, 17 bp, Homo sapiens
ctcctcccggtgcccaa

SEQ ID NO: 258947 - DNA, 16 bp, Homo sapiens
ctcctcctcccctcct

SEQ ID NO: 258948 - DNA, 13 bp, Homo sapiens
ctcctcctcctgt

SEQ ID NO: 258949 - DNA, 13 bp, Homo sapiens
ctcctcctcttgg

SEQ ID NO: 258950 - DNA, 13 bp, Homo sapiens
ctcctcctgccct

SEQ ID NO: 258951 - DNA, 14 bp, Homo sapiens
ctcctcctgccctg

SEQ ID NO: 258952 - DNA, 15 bp, Homo sapiens
ctcctcctgccctgt

SEQ ID NO: 258953 - DNA, 16 bp, Homo sapiens
ctcctcctgccctgtc

SEQ ID NO: 258954 - DNA, 15 bp, Homo sapiens
ctcctcctgttcctg

SEQ ID NO: 258955 - DNA, 14 bp, Homo sapiens
ctcctcgctgtgcc

SEQ ID NO: 258956 - DNA, 17 bp, Homo sapiens
ctcctcgctgtgccacc

SEQ ID NO: 258957 - DNA, 19 bp, Homo sapiens
ctcctcgctgtgccaccac

SEQ ID NO: 258958 - DNA, 13 bp, Homo sapiens
ctcctcggccaga

SEQ ID NO: 258959 - DNA, 15 bp, Homo sapiens
ctcctcggccagagc

SEQ ID NO: 258960 - DNA, 17 bp, Homo sapiens
ctcctcggccagagctc

SEQ ID NO: 258961 - DNA, 20 bp, Homo sapiens
ctcctcggccagagctccca

SEQ ID NO: 258962 - DNA, 18 bp, Homo sapiens
ctcctcggccccctccat

SEQ ID NO: 258963 - DNA, 22 bp, Homo sapiens
ctcctcgggcaagggccgtgcc

SEQ ID NO: 258964 - DNA, 23 bp, Homo sapiens
ctcctcgggcgcctgcgctcctc

SEQ ID NO: 258965 - DNA, 17 bp, Homo sapiens
ctcctcgtccggcctgc

SEQ ID NO: 258966 - DNA, 17 bp, Homo sapiens
ctcctctaacaggggct

SEQ ID NO: 258967 - DNA, 13 bp, Homo sapiens
ctcctctcccaaa

SEQ ID NO: 258968 - DNA, 20 bp, Homo sapiens
ctcctctccttgggctcctg

SEQ ID NO: 258969 - DNA, 13 bp, Homo sapiens
ctcctctctccct

SEQ ID NO: 258970 - DNA, 22 bp, Homo sapiens
ctcctctctccctgcctcacat

SEQ ID NO: 258971 - DNA, 16 bp, Homo sapiens
ctcctctctgctgggt

SEQ ID NO: 258972 - DNA, 17 bp, Homo sapiens
ctcctctctgctgggtt

SEQ ID NO: 258973 - DNA, 12 bp, Homo sapiens
ctcctctctgga

SEQ ID NO: 258974 - DNA, 14 bp, Homo sapiens
ctcctctgagcagc

SEQ ID NO: 258975 - DNA, 16 bp, Homo sapiens
ctcctctgagcagcct

SEQ ID NO: 258976 - DNA, 20 bp, Homo sapiens
ctcctctgcagcctgagctc

SEQ ID NO: 258977 - DNA, 16 bp, Homo sapiens
ctcctctgcagtgcct

SEQ ID NO: 258978 - DNA, 18 bp, Homo sapiens
ctcctctgccccctcccc

SEQ ID NO: 258979 - DNA, 22 bp, Homo sapiens
ctcctctgccccctcccccgca

SEQ ID NO: 258980 - DNA, 15 bp, Homo sapiens
ctcctctgggcagga

SEQ ID NO: 258981 - DNA, 23 bp, Homo sapiens
ctcctctgggcaggacctcagag

SEQ ID NO: 258982 - DNA, 22 bp, Homo sapiens
ctcctctggggaagggaaccag

SEQ ID NO: 258983 - DNA, 18 bp, Homo sapiens
gggtaaaaagagaaggca

SEQ ID NO: 258984 - DNA, 14 bp, Homo sapiens
gggtaaatatatgt

SEQ ID NO: 258985 - DNA, 16 bp, Homo sapiens
gggtaaatatatgttt

SEQ ID NO: 258986 - DNA, 13 bp, Homo sapiens
gggtaaattattc

SEQ ID NO: 258987 - DNA, 17 bp, Homo sapiens
gggtaacaaagtgagac

SEQ ID NO: 258988 - DNA, 17 bp, Homo sapiens
gggtaagtgagagaggg

SEQ ID NO: 258989 - DNA, 12 bp, Homo sapiens
gggtaccacatg

SEQ ID NO: 258990 - DNA, 14 bp, Homo sapiens
gggtaccaggccac

SEQ ID NO: 258991 - DNA, 17 bp, Homo sapiens
gggtacccaggctggtt

SEQ ID NO: 258992 - DNA, 16 bp, Homo sapiens
gggtaggcaaggctgc

SEQ ID NO: 258993 - DNA, 14 bp, Homo sapiens
gggtatcccacctc

SEQ ID NO: 258994 - DNA, 17 bp, Homo sapiens
gggtattagcacctctt

SEQ ID NO: 258995 - DNA, 23 bp, Homo sapiens
gggtattcaccaccctgggaccc

SEQ ID NO: 258996 - DNA, 16 bp, Homo sapiens
gggtcaactccaaggc

SEQ ID NO: 258997 - DNA, 17 bp, Homo sapiens
gggtcaactccaaggca

SEQ ID NO: 258998 - DNA, 12 bp, Homo sapiens
gggtcagctctg

SEQ ID NO: 258999 - DNA, 13 bp, Homo sapiens
gggtcagctctgg

SEQ ID NO: 259000 - DNA, 11 bp, Homo sapiens
gggtcaggaac

SEQ ID NO: 259001 - DNA, 17 bp, Homo sapiens
gggtcaggccacggcag

SEQ ID NO: 259002 - DNA, 12 bp, Homo sapiens
gggtcaggctcc

SEQ ID NO: 259003 - DNA, 12 bp, Homo sapiens
gggtcagggggg

SEQ ID NO: 259004 - DNA, 19 bp, Homo sapiens
gggtcagtgtgccaccctc

SEQ ID NO: 259005 - DNA, 20 bp, Homo sapiens
gggtcatcccagcacctgcc

SEQ ID NO: 259006 - DNA, 17 bp, Homo sapiens
gggtcatttcagagccc

SEQ ID NO: 259007 - DNA, 17 bp, Homo sapiens
gggtcattttcctttct

SEQ ID NO: 259008 - DNA, 18 bp, Homo sapiens
gggtcattttcctttctg

SEQ ID NO: 259009 - DNA, 11 bp, Homo sapiens
gggtccaggaa

SEQ ID NO: 259010 - DNA, 21 bp, Homo sapiens
gggtccaggaaggcagctgct

SEQ ID NO: 259011 - DNA, 16 bp, Homo sapiens
gggtcccagccacccc

SEQ ID NO: 259012 - DNA, 21 bp, Homo sapiens
gggtcccagctaaagaggtgg

SEQ ID NO: 259013 - DNA, 17 bp, Homo sapiens
gggtcccccctgagtgg

SEQ ID NO: 259014 - DNA, 18 bp, Homo sapiens
gggtcccccctgagtggg

SEQ ID NO: 259015 - DNA, 19 bp, Homo sapiens
gggtcccccctgagtgggc

SEQ ID NO: 259016 - DNA, 20 bp, Homo sapiens
gggtccccggacgctggctc

SEQ ID NO: 259017 - DNA, 23 bp, Homo sapiens
gggtccccggacgctggctcggg

SEQ ID NO: 259018 - DNA, 18 bp, Homo sapiens
gggtccctaattctcttc

SEQ ID NO: 259019 - DNA, 18 bp, Homo sapiens
gggtccgcaccagctgct

SEQ ID NO: 259020 - DNA, 21 bp, Homo sapiens
gggtccgcaccagctgctctg

SEQ ID NO: 259021 - DNA, 16 bp, Homo sapiens
gggtcctacggaggga

SEQ ID NO: 259022 - DNA, 18 bp, Homo sapiens
gggtcctacggagggacc

SEQ ID NO: 259023 - DNA, 19 bp, Homo sapiens
gggtcctgcaatctccagg

SEQ ID NO: 259024 - DNA, 16 bp, Homo sapiens
gggtccttccctctcc

SEQ ID NO: 259025 - DNA, 23 bp, Homo sapiens
gggtccttccctctccccaagac

SEQ ID NO: 259026 - DNA, 13 bp, Homo sapiens
gggtcgcccctcc

SEQ ID NO: 259027 - DNA, 15 bp, Homo sapiens
gggtcgcccctcctc

SEQ ID NO: 259028 - DNA, 15 bp, Homo sapiens
gggtcggccctgccc

SEQ ID NO: 259029 - DNA, 20 bp, Homo sapiens
gggtcggcgccttctacctg

SEQ ID NO: 259030 - DNA, 22 bp, Homo sapiens
gggtcggcgccttctacctgca

SEQ ID NO: 259031 - DNA, 21 bp, Homo sapiens
gggtctagaggctattcctag

SEQ ID NO: 259032 - DNA, 19 bp, Homo sapiens
ggtagtgatgaaattataa

SEQ ID NO: 259033 - DNA, 16 bp, Homo sapiens
ggtagttagtagcatg

SEQ ID NO: 259034 - DNA, 17 bp, Homo sapiens
ggtagttctgtgcctcc

SEQ ID NO: 259035 - DNA, 20 bp, Homo sapiens
ggtagttctgtgcctccccc

SEQ ID NO: 259036 - DNA, 23 bp, Homo sapiens
ggtagttttccatggtcacagag

SEQ ID NO: 259037 - DNA, 21 bp, Homo sapiens
ggtatcaaacagctcaggctg

SEQ ID NO: 259038 - DNA, 12 bp, Homo sapiens
ggtatccagagg

SEQ ID NO: 259039 - DNA, 17 bp, Homo sapiens
ggtatcctgcccagtgt

SEQ ID NO: 259040 - DNA, 14 bp, Homo sapiens
ggtatctctttctc

SEQ ID NO: 259041 - DNA, 21 bp, Homo sapiens
ggtatctgcatgtaaaatctt

SEQ ID NO: 259042 - DNA, 23 bp, Homo sapiens
ggtatctgcatgtaaaatcttca

SEQ ID NO: 259043 - DNA, 21 bp, Homo sapiens
ggtatctgctgcctctgaaaa

SEQ ID NO: 259044 - DNA, 23 bp, Homo sapiens
ggtatctttaattgtatctcctt

SEQ ID NO: 259045 - DNA, 12 bp, Homo sapiens
ggtatgatcatt

SEQ ID NO: 259046 - DNA, 22 bp, Homo sapiens
ggtatgcactggttccttaagt

SEQ ID NO: 259047 - DNA, 20 bp, Homo sapiens
ggtatgcagcatacaaaaat

SEQ ID NO: 259048 - DNA, 15 bp, Homo sapiens
ggtatgggacctgct

SEQ ID NO: 259049 - DNA, 21 bp, Homo sapiens
ggtattggccgatgagctggt

SEQ ID NO: 259050 - DNA, 12 bp, Homo sapiens
ggtatttcttat

SEQ ID NO: 259051 - DNA, 16 bp, Homo sapiens
ggtattttgaatacca

SEQ ID NO: 259052 - DNA, 19 bp, Homo sapiens
ggtcaactccaaggcaaat

SEQ ID NO: 259053 - DNA, 22 bp, Homo sapiens
ggtcaacttgagcatgttactg

SEQ ID NO: 259054 - DNA, 20 bp, Homo sapiens
ggtcaagattttgaatgctt

SEQ ID NO: 259055 - DNA, 19 bp, Homo sapiens
ggtcaagcccaggaggact

SEQ ID NO: 259056 - DNA, 11 bp, Homo sapiens
ggtcaaggcct

SEQ ID NO: 259057 - DNA, 18 bp, Homo sapiens
ggtcaaggcctgtccctg

SEQ ID NO: 259058 - DNA, 18 bp, Homo sapiens
ggtcaagttattaatttc

SEQ ID NO: 259059 - DNA, 22 bp, Homo sapiens
ggtcaagttcatagtttctgta

SEQ ID NO: 259060 - DNA, 21 bp, Homo sapiens
ggtcaataattgtggagagga

SEQ ID NO: 259061 - DNA, 22 bp, Homo sapiens
ggtcacaagtaggagacacaga

SEQ ID NO: 259062 - DNA, 20 bp, Homo sapiens
ggtcacactgtggaacacta

SEQ ID NO: 259063 - DNA, 18 bp, Homo sapiens
ggtcacaggactctgcct

SEQ ID NO: 259064 - DNA, 16 bp, Homo sapiens
ggtcaccttcctgggc

SEQ ID NO: 259065 - DNA, 18 bp, Homo sapiens
ggtcaccttcctgggcag

SEQ ID NO: 259066 - DNA, 14 bp, Homo sapiens
ggtcagaggagtga

SEQ ID NO: 259067 - DNA, 23 bp, Homo sapiens
ggtcagagggactgtcagctgag

SEQ ID NO: 259068 - DNA, 23 bp, Homo sapiens
ggtcagattagggcggggagaag

SEQ ID NO: 259069 - DNA, 21 bp, Homo sapiens
ggtcagcagaaacccccagga

SEQ ID NO: 259070 - DNA, 19 bp, Homo sapiens
ggtcaggaacagtggctgg

SEQ ID NO: 259071 - DNA, 21 bp, Homo sapiens
ggtcaggagttcctaaccagc

SEQ ID NO: 259072 - DNA, 16 bp, Homo sapiens
ggtcaggccacggcag

SEQ ID NO: 259073 - DNA, 13 bp, Homo sapiens
ggtcaggccctgg

SEQ ID NO: 259074 - DNA, 14 bp, Homo sapiens
ggtcaggccctgga

SEQ ID NO: 259075 - DNA, 17 bp, Homo sapiens
ggtcagggaccaaggac

SEQ ID NO: 259076 - DNA, 11 bp, Homo sapiens
ggtcagggagg

SEQ ID NO: 259077 - DNA, 14 bp, Homo sapiens
ggtcagggaggggt

SEQ ID NO: 259078 - DNA, 16 bp, Homo sapiens
ggtcaggtgggaaagc

SEQ ID NO: 259079 - DNA, 12 bp, Homo sapiens
ggtcagtaccca

SEQ ID NO: 259080 - DNA, 21 bp, Homo sapiens
ggtcagtgaagcccaggagga

SEQ ID NO: 259081 - DNA, 17 bp, Homo sapiens
ggtcagtgtgccaccct

SEQ ID NO: 259082 - DNA, 23 bp, Homo sapiens
ggtcagtgtgccaccctctgcag

SEQ ID NO: 259083 - DNA, 15 bp, Homo sapiens
ggtcagtgtggagag

SEQ ID NO: 259084 - DNA, 18 bp, Homo sapiens
ggtcatcagtattgtgta

SEQ ID NO: 259085 - DNA, 16 bp, Homo sapiens
ggtcatccaacctctt

SEQ ID NO: 259086 - DNA, 19 bp, Homo sapiens
ggtcatcccagcacctgcc

SEQ ID NO: 259087 - DNA, 22 bp, Homo sapiens
ggtcatgaattcatactctgtt

SEQ ID NO: 259088 - DNA, 15 bp, Homo sapiens
ggtcattaaatacta

SEQ ID NO: 259089 - DNA, 20 bp, Homo sapiens
ggtcattcctaatgcattag

SEQ ID NO: 259090 - DNA, 21 bp, Homo sapiens
ggtcattttcctttctgtatt

SEQ ID NO: 259091 - DNA, 12 bp, Homo sapiens
ggtccacacacc

SEQ ID NO: 259092 - DNA, 17 bp, Homo sapiens
ggtccactccctgctcc

SEQ ID NO: 259093 - DNA, 17 bp, Homo sapiens
ggtccagaagaaattat

SEQ ID NO: 259094 - DNA, 10 bp, Homo sapiens
ggtccagatt

SEQ ID NO: 259095 - DNA, 16 bp, Homo sapiens
ggtccaggccaggcct

SEQ ID NO: 259096 - DNA, 23 bp, Homo sapiens
ggtccaggccaggcctcatcctc

SEQ ID NO: 259097 - DNA, 22 bp, Homo sapiens
ggtcccagctacaggggaggct

SEQ ID NO: 259098 - DNA, 18 bp, Homo sapiens
ggtcccaggaagcaggga

SEQ ID NO: 259099 - DNA, 11 bp, Homo sapiens
ggtcccaggcc

SEQ ID NO: 259100 - DNA, 12 bp, Homo sapiens
ggtcccaggccg

SEQ ID NO: 259101 - DNA, 21 bp, Homo sapiens
ggtccccactcaccccctttg

SEQ ID NO: 259102 - DNA, 15 bp, Homo sapiens
ggtccccactccctg

SEQ ID NO: 259103 - DNA, 22 bp, Homo sapiens
ggtccccatccccaccagctcg

SEQ ID NO: 259104 - DNA, 20 bp, Homo sapiens
ggtcccccatgccaccaccc

SEQ ID NO: 259105 - DNA, 12 bp, Homo sapiens
ggtcccctccac

SEQ ID NO: 259106 - DNA, 19 bp, Homo sapiens
ggtcccctccacatcccag

SEQ ID NO: 259107 - DNA, 24 bp, Homo sapiens
ggtcccggttcagacccctgcctg

SEQ ID NO: 259108 - DNA, 15 bp, Homo sapiens
ggtccctggaccagc

SEQ ID NO: 259109 - DNA, 17 bp, Homo sapiens
ggtccgcaccagctgct

SEQ ID NO: 259110 - DNA, 20 bp, Homo sapiens
ggtccgccttaatctggaag

SEQ ID NO: 259111 - DNA, 14 bp, Homo sapiens
ggtcctacggaggg

SEQ ID NO: 259112 - DNA, 19 bp, Homo sapiens
ggtcctgcaatctccaggg

SEQ ID NO: 259113 - DNA, 23 bp, Homo sapiens
ggtcctgcaatctccagggctgc

SEQ ID NO: 259114 - DNA, 16 bp, Homo sapiens
ggtcctggctcctgag

SEQ ID NO: 259115 - DNA, 18 bp, Homo sapiens
ggtcctgttaaccctcca

SEQ ID NO: 259116 - DNA, 14 bp, Homo sapiens
ggtcgcccctcctc

SEQ ID NO: 259117 - DNA, 22 bp, Homo sapiens
ggtcgcttactttgagtgatcc

SEQ ID NO: 259118 - DNA, 18 bp, Homo sapiens
ggtcggaagcctgtcctc

SEQ ID NO: 259119 - DNA, 22 bp, Homo sapiens
ggtcgggggaggagcaccccca

SEQ ID NO: 259120 - DNA, 13 bp, Homo sapiens
ggtctaacttttg

SEQ ID NO: 259121 - DNA, 22 bp, Homo sapiens
ggtctaggactttagggatctg

SEQ ID NO: 259122 - DNA, 14 bp, Homo sapiens
ggtctatggggaga

SEQ ID NO: 259123 - DNA, 21 bp, Homo sapiens
ggtctcaaactcctgggctca

SEQ ID NO: 259124 - DNA, 18 bp, Homo sapiens
ctcgaaccaaggcagcct

SEQ ID NO: 259125 - DNA, 23 bp, Homo sapiens
ctcgaaccaaggcagcctccaga

SEQ ID NO: 259126 - DNA, 21 bp, Homo sapiens
ctcgaagtcttccatcagcag

SEQ ID NO: 259127 - DNA, 15 bp, Homo sapiens
ctcgaattctcagac

SEQ ID NO: 259128 - DNA, 22 bp, Homo sapiens
ctcgactctgctgctcatggga

SEQ ID NO: 259129 - DNA, 15 bp, Homo sapiens
ctcgagaccatcctg

SEQ ID NO: 259130 - DNA, 21 bp, Homo sapiens
ctcgagaccatcctggcccct

SEQ ID NO: 259131 - DNA, 21 bp, Homo sapiens
ctcgagagggctgagcccctc

SEQ ID NO: 259132 - DNA, 23 bp, Homo sapiens
ctcgagagggctgagcccctcct

SEQ ID NO: 259133 - DNA, 21 bp, Homo sapiens
ctcgaggcaccggcgctgcag

SEQ ID NO: 259134 - DNA, 13 bp, Homo sapiens
ctcgagtgcccct

SEQ ID NO: 259135 - DNA, 15 bp, Homo sapiens
ctcgagtgcccctgc

SEQ ID NO: 259136 - DNA, 22 bp, Homo sapiens
ctcgagtgcccctgcaggggag

SEQ ID NO: 259137 - DNA, 18 bp, Homo sapiens
ctcgatgcaagtgtttct

SEQ ID NO: 259138 - DNA, 19 bp, Homo sapiens
ctcgatgcaagtgtttctg

SEQ ID NO: 259139 - DNA, 20 bp, Homo sapiens
ctcgatgcaagtgtttctgt

SEQ ID NO: 259140 - DNA, 21 bp, Homo sapiens
ctcgatgcaagtgtttctgtt

SEQ ID NO: 259141 - DNA, 14 bp, Homo sapiens
ctcgcactgcaaat

SEQ ID NO: 259142 - DNA, 15 bp, Homo sapiens
ctcgcagtcgcagga

SEQ ID NO: 259143 - DNA, 21 bp, Homo sapiens
ctcgcatttgtcaatgacagt

SEQ ID NO: 259144 - DNA, 12 bp, Homo sapiens
ctcgccccaccc

SEQ ID NO: 259145 - DNA, 15 bp, Homo sapiens
ctcgccccatccctg

SEQ ID NO: 259146 - DNA, 19 bp, Homo sapiens
ctcgcccctccagtgttgc

SEQ ID NO: 259147 - DNA, 14 bp, Homo sapiens
ctcgcccgcccact

SEQ ID NO: 259148 - DNA, 22 bp, Homo sapiens
ctcgcccgcccactgtcctggg

SEQ ID NO: 259149 - DNA, 12 bp, Homo sapiens
ctcgcctaggcc

SEQ ID NO: 259150 - DNA, 18 bp, Homo sapiens
ctcgcctaggcctgtgag

SEQ ID NO: 259151 - DNA, 23 bp, Homo sapiens
ctcgcctgacaaccactggtctg

SEQ ID NO: 259152 - DNA, 14 bp, Homo sapiens
ctcgctgctgctac

SEQ ID NO: 259153 - DNA, 16 bp, Homo sapiens
ctcgctgctgctacta

SEQ ID NO: 259154 - DNA, 16 bp, Homo sapiens
ctcgctgtatgattta

SEQ ID NO: 259155 - DNA, 21 bp, Homo sapiens
ctcgctgtgccaccacccctc

SEQ ID NO: 259156 - DNA, 13 bp, Homo sapiens
ctcgcttctctgt

SEQ ID NO: 259157 - DNA, 14 bp, Homo sapiens
ctcgcttctctgtg

SEQ ID NO: 259158 - DNA, 14 bp, Homo sapiens
ctcgcttgccgggc

SEQ ID NO: 259159 - DNA, 21 bp, Homo sapiens
ctcggaactgcatgctgctgg

SEQ ID NO: 259160 - DNA, 22 bp, Homo sapiens
ctcggaactgcatgctgctgga

SEQ ID NO: 259161 - DNA, 18 bp, Homo sapiens
ctcggaagccgtctgact

SEQ ID NO: 259162 - DNA, 12 bp, Homo sapiens
ctcggacacagt

SEQ ID NO: 259163 - DNA, 23 bp, Homo sapiens
ctcggacccaccaaactgcacac

SEQ ID NO: 259164 - DNA, 16 bp, Homo sapiens
ctcggacccaccccaa

SEQ ID NO: 259165 - DNA, 21 bp, Homo sapiens
ctcggagtatctgggaactgt

SEQ ID NO: 259166 - DNA, 18 bp, Homo sapiens
ctcggcagaactctctgt

SEQ ID NO: 259167 - DNA, 17 bp, Homo sapiens
ctcggcattcacacaca

SEQ ID NO: 259168 - DNA, 18 bp, Homo sapiens
ctcggcattcacacacag

SEQ ID NO: 259169 - DNA, 21 bp, Homo sapiens
ctcggcattcacacacagcct

SEQ ID NO: 259170 - DNA, 16 bp, Homo sapiens
ctcggccagagctccc

SEQ ID NO: 259171 - DNA, 18 bp, Homo sapiens
ctcggccagagctcccag

SEQ ID NO: 259172 - DNA, 20 bp, Homo sapiens
ctcggccccacccaccctct

SEQ ID NO: 259173 - DNA, 21 bp, Homo sapiens
ctcggcctcccaaagtgctgg

SEQ ID NO: 259174 - DNA, 18 bp, Homo sapiens
ctcggctggaagaacatc

SEQ ID NO: 259175 - DNA, 18 bp, Homo sapiens
ctcggcttgtgggctggt

SEQ ID NO: 259176 - DNA, 13 bp, Homo sapiens
ctcgggaaggcct

SEQ ID NO: 259177 - DNA, 15 bp, Homo sapiens
ctcgggaaggcctga

SEQ ID NO: 259178 - DNA, 17 bp, Homo sapiens
ctcgggaaggcctgagg

SEQ ID NO: 259179 - DNA, 21 bp, Homo sapiens
ctcgggccgcctcctccagac

SEQ ID NO: 259180 - DNA, 14 bp, Homo sapiens
ctcgggcgcctgcg

SEQ ID NO: 259181 - DNA, 22 bp, Homo sapiens
ctcgggcgcctgcgctcctctg

SEQ ID NO: 259182 - DNA, 21 bp, Homo sapiens
ctcgggctaagtccagctctc

SEQ ID NO: 259183 - DNA, 17 bp, Homo sapiens
ctcggggcagggcaggg

SEQ ID NO: 259184 - DNA, 20 bp, Homo sapiens
ctcggggcccttggggcctg

SEQ ID NO: 259185 - DNA, 22 bp, Homo sapiens
ctcggggcccttggggcctggc

SEQ ID NO: 259186 - DNA, 16 bp, Homo sapiens
ctcgtcaggaggtgcc

SEQ ID NO: 259187 - DNA, 18 bp, Homo sapiens
ctcgtcaggaggtgcctg

SEQ ID NO: 259188 - DNA, 18 bp, Homo sapiens
ctcgtccacaggggcagg

SEQ ID NO: 259189 - DNA, 20 bp, Homo sapiens
ctcgtccacaggggcaggcc

SEQ ID NO: 259190 - DNA, 16 bp, Homo sapiens
ctcgtccctctgctcc

SEQ ID NO: 259191 - DNA, 18 bp, Homo sapiens
ctcgtccctctgctccgt

SEQ ID NO: 259192 - DNA, 13 bp, Homo sapiens
ctcgtccggcctg

SEQ ID NO: 259193 - DNA, 15 bp, Homo sapiens
ctcgtccggcctgca

SEQ ID NO: 259194 - DNA, 17 bp, Homo sapiens
ctcgtctgactgtgtgt

SEQ ID NO: 259195 - DNA, 16 bp, Homo sapiens
ctcgtctgatgttttg

SEQ ID NO: 259196 - DNA, 15 bp, Homo sapiens
ctcgtcttcctctct

SEQ ID NO: 259197 - DNA, 15 bp, Homo sapiens
ctcgtgacctacagg

SEQ ID NO: 259198 - DNA, 14 bp, Homo sapiens
ctcgtgcatgtaat

SEQ ID NO: 259199 - DNA, 16 bp, Homo sapiens
ctcgtggcggggcagc

SEQ ID NO: 259200 - DNA, 14 bp, Homo sapiens
ctcgtgggctctgg

SEQ ID NO: 259201 - DNA, 17 bp, Homo sapiens
ctcgtgggtaaatatac

SEQ ID NO: 259202 - DNA, 14 bp, Homo sapiens
ctcgtgtatcctgg

SEQ ID NO: 259203 - DNA, 15 bp, Homo sapiens
ctcgtgtatcctggg

SEQ ID NO: 259204 - DNA, 17 bp, Homo sapiens
ctcgtgtatcctggggc

SEQ ID NO: 259205 - DNA, 12 bp, Homo sapiens
ctcgtgtgcatg

SEQ ID NO: 259206 - DNA, 20 bp, Homo sapiens
ctcgttctcgtgacccagtg

SEQ ID NO: 259207 - DNA, 12 bp, Homo sapiens
ctcgtttgatag

SEQ ID NO: 259208 - DNA, 14 bp, Homo sapiens
ctcgtttgggagtg

SEQ ID NO: 259209 - DNA, 19 bp, Homo sapiens
ctcgtttttcagcaccccc

SEQ ID NO: 259210 - DNA, 14 bp, Homo sapiens
ctctaaaaaagaac

SEQ ID NO: 259211 - DNA, 16 bp, Homo sapiens
ctctaaaaataaaatg

SEQ ID NO: 259212 - DNA, 19 bp, Homo sapiens
ctctaaaaataaaatgatg

SEQ ID NO: 259213 - DNA, 15 bp, Homo sapiens
ctctaaaagggggct

SEQ ID NO: 259214 - DNA, 23 bp, Homo sapiens
ctctaaaagggggctattccctg

SEQ ID NO: 259215 - DNA, 15 bp, Homo sapiens
ctctaacaccacact

SEQ ID NO: 259216 - DNA, 19 bp, Homo sapiens
ctctaacaccacactgacc

SEQ ID NO: 259217 - DNA, 22 bp, Homo sapiens
ctctaacaccacactgaccaca

SEQ ID NO: 259218 - DNA, 20 bp, Homo sapiens
ctctaacattactgccttca

SEQ ID NO: 259219 - DNA, 12 bp, Homo sapiens
ctctaactcatt

SEQ ID NO: 259220 - DNA, 20 bp, Homo sapiens
ctctaagaaatggctttcca

SEQ ID NO: 259221 - DNA, 21 bp, Homo sapiens
ctctaagaaatggctttccac

SEQ ID NO: 259222 - DNA, 13 bp, Homo sapiens
ctctaataaaaca

SEQ ID NO: 259223 - DNA, 18 bp, Homo sapiens
ctctaatagaagtccatg

SEQ ID NO: 259224 - DNA, 20 bp, Homo sapiens
ctctaatagagtcacagctt

SEQ ID NO: 259225 - DNA, 22 bp, Homo sapiens
ctctaatgaaattgtgaaagct

SEQ ID NO: 259226 - DNA, 20 bp, Homo sapiens
ctctaattcccattttgcaa

SEQ ID NO: 259227 - DNA, 23 bp, Homo sapiens
ctctacacaacatgtatgtggat

SEQ ID NO: 259228 - DNA, 14 bp, Homo sapiens
ctctacagccgtcc

SEQ ID NO: 259229 - DNA, 20 bp, Homo sapiens
ctctaccaagacataatgca

SEQ ID NO: 259230 - DNA, 18 bp, Homo sapiens
ctctacccagcccatctt

SEQ ID NO: 259231 - DNA, 17 bp, Homo sapiens
ctctacccccaacacca

SEQ ID NO: 259232 - DNA, 15 bp, Homo sapiens
ctctaccctcccacc

SEQ ID NO: 259233 - DNA, 17 bp, Homo sapiens
ctctaccctcccacccc

SEQ ID NO: 259234 - DNA, 22 bp, Homo sapiens
ctctaccctcccacccccttct

SEQ ID NO: 259235 - DNA, 23 bp, Homo sapiens
ctctaccctggtaggaaagcacc

SEQ ID NO: 259236 - DNA, 22 bp, Homo sapiens
ctctacgccaaagtgcagccct

SEQ ID NO: 259237 - DNA, 18 bp, Homo sapiens
ctctactaccacaaggaa

SEQ ID NO: 259238 - DNA, 20 bp, Homo sapiens
ctctactaccacaaggaaaa

SEQ ID NO: 259239 - DNA, 19 bp, Homo sapiens
ctctacttagcatgtccct

SEQ ID NO: 259240 - DNA, 20 bp, Homo sapiens
ctctacttagcatgtcccta

SEQ ID NO: 259241 - DNA, 15 bp, Homo sapiens
ctctactttccaggc

SEQ ID NO: 259242 - DNA, 17 bp, Homo sapiens
ctctactttccaggcta

SEQ ID NO: 259243 - DNA, 18 bp, Homo sapiens
ctctactttccaggctag

SEQ ID NO: 259244 - DNA, 20 bp, Homo sapiens
ctctagaattttaagtgctt

SEQ ID NO: 259245 - DNA, 21 bp, Homo sapiens
ctctagactgactcacattgc

SEQ ID NO: 259246 - DNA, 17 bp, Homo sapiens
ctctagccaggagtctg

SEQ ID NO: 259247 - DNA, 14 bp, Homo sapiens
ctctagctggcagg

SEQ ID NO: 259248 - DNA, 18 bp, Homo sapiens
ctctagctggcaggacac

SEQ ID NO: 259249 - DNA, 22 bp, Homo sapiens
ctctaggcctcagtgtcctcat

SEQ ID NO: 259250 - DNA, 18 bp, Homo sapiens
ctctagggaaggccacct

SEQ ID NO: 259251 - DNA, 19 bp, Homo sapiens
ctctagggaaggccacctg

SEQ ID NO: 259252 - DNA, 20 bp, Homo sapiens
ctctaggggtcaggctccat

SEQ ID NO: 259253 - DNA, 13 bp, Homo sapiens
ctctagtccctgt

SEQ ID NO: 259254 - DNA, 15 bp, Homo sapiens
ctctagtgacttcct

SEQ ID NO: 259255 - DNA, 22 bp, Homo sapiens
ctctataacagatcctttcaaa

SEQ ID NO: 259256 - DNA, 15 bp, Homo sapiens
ctctatatatacatg

SEQ ID NO: 259257 - DNA, 20 bp, Homo sapiens
ggtctcacttataccaaagg

SEQ ID NO: 259258 - DNA, 14 bp, Homo sapiens
ggtctcagaggagg

SEQ ID NO: 259259 - DNA, 11 bp, Homo sapiens
ggtctccaccc

SEQ ID NO: 259260 - DNA, 15 bp, Homo sapiens
ggtctccacccctca

SEQ ID NO: 259261 - DNA, 18 bp, Homo sapiens
ggtctccatatcagctct

SEQ ID NO: 259262 - DNA, 20 bp, Homo sapiens
ggtctccctgagcctgcccc

SEQ ID NO: 259263 - DNA, 23 bp, Homo sapiens
ggtctcctccccgtagccactct

SEQ ID NO: 259264 - DNA, 16 bp, Homo sapiens
ggtctcctctcagctt

SEQ ID NO: 259265 - DNA, 19 bp, Homo sapiens
ggtctccttactctgagcc

SEQ ID NO: 259266 - DNA, 20 bp, Homo sapiens
ggtctccttactctgagccc

SEQ ID NO: 259267 - DNA, 22 bp, Homo sapiens
ggtctccttactctgagcccag

SEQ ID NO: 259268 - DNA, 23 bp, Homo sapiens
ggtctccttactctgagcccagg

SEQ ID NO: 259269 - DNA, 12 bp, Homo sapiens
ggtctctgagca

SEQ ID NO: 259270 - DNA, 23 bp, Homo sapiens
ggtctcttccagcccagacatcc

SEQ ID NO: 259271 - DNA, 15 bp, Homo sapiens
ggtctcttgagggag

SEQ ID NO: 259272 - DNA, 21 bp, Homo sapiens
ggtctcttgagggagcttagc

SEQ ID NO: 259273 - DNA, 13 bp, Homo sapiens
ggtctgaaatgga

SEQ ID NO: 259274 - DNA, 15 bp, Homo sapiens
ggtctgaaggactgg

SEQ ID NO: 259275 - DNA, 11 bp, Homo sapiens
ggtctgaatgt

SEQ ID NO: 259276 - DNA, 17 bp, Homo sapiens
ggtctgaatgttctgac

SEQ ID NO: 259277 - DNA, 12 bp, Homo sapiens
ggtctgcacaca

SEQ ID NO: 259278 - DNA, 22 bp, Homo sapiens
ggtctgcacacataacacacat

SEQ ID NO: 259279 - DNA, 14 bp, Homo sapiens
ggtctgcaggccac

SEQ ID NO: 259280 - DNA, 20 bp, Homo sapiens
ggtctgcattttctcaggca

SEQ ID NO: 259281 - DNA, 16 bp, Homo sapiens
ggtctgctctgtgcct

SEQ ID NO: 259282 - DNA, 18 bp, Homo sapiens
ggtctgctctttctctgc

SEQ ID NO: 259283 - DNA, 19 bp, Homo sapiens
ggtctgctgcctcaggaat

SEQ ID NO: 259284 - DNA, 16 bp, Homo sapiens
ggtctgggacttcctt

SEQ ID NO: 259285 - DNA, 18 bp, Homo sapiens
ggtctgtatatacatttc

SEQ ID NO: 259286 - DNA, 17 bp, Homo sapiens
ggtctgtgctgtgcctg

SEQ ID NO: 259287 - DNA, 13 bp, Homo sapiens
ggtctgtgtctct

SEQ ID NO: 259288 - DNA, 23 bp, Homo sapiens
ggtcttactttgtgcaaaagcag

SEQ ID NO: 259289 - DNA, 19 bp, Homo sapiens
ggtcttcagggggccaggt

SEQ ID NO: 259290 - DNA, 17 bp, Homo sapiens
ggtcttccctacctcag

SEQ ID NO: 259291 - DNA, 20 bp, Homo sapiens
ctctccacacccatgactgc

SEQ ID NO: 259292 - DNA, 22 bp, Homo sapiens
ctctccacttctggtcccctgt

SEQ ID NO: 259293 - DNA, 13 bp, Homo sapiens
ctctccagaagcc

SEQ ID NO: 259294 - DNA, 13 bp, Homo sapiens
ctctccagcccta

SEQ ID NO: 259295 - DNA, 14 bp, Homo sapiens
ctctccagccctat

SEQ ID NO: 259296 - DNA, 23 bp, Homo sapiens
ctctccagcttgggaggaagccc

SEQ ID NO: 259297 - DNA, 19 bp, Homo sapiens
ctctccaggattgtccaca

SEQ ID NO: 259298 - DNA, 14 bp, Homo sapiens
ctctcccaattttc

SEQ ID NO: 259299 - DNA, 13 bp, Homo sapiens
ctctcccaccccg

SEQ ID NO: 259300 - DNA, 15 bp, Homo sapiens
ctctcccacccggcc

SEQ ID NO: 259301 - DNA, 12 bp, Homo sapiens
ctctcccagagg

SEQ ID NO: 259302 - DNA, 13 bp, Homo sapiens
ctctcccaggccc

SEQ ID NO: 259303 - DNA, 14 bp, Homo sapiens
ctctcccaggcccg

SEQ ID NO: 259304 - DNA, 12 bp, Homo sapiens
ctctccccacac

SEQ ID NO: 259305 - DNA, 14 bp, Homo sapiens
ctctccccagtgcc

SEQ ID NO: 259306 - DNA, 15 bp, Homo sapiens
ctctccccagtgcct

SEQ ID NO: 259307 - DNA, 19 bp, Homo sapiens
ctctccccagtgcctgcca

SEQ ID NO: 259308 - DNA, 17 bp, Homo sapiens
ctctcccctgcgcaggc

SEQ ID NO: 259309 - DNA, 20 bp, Homo sapiens
ctctcccctgcgcaggccct

SEQ ID NO: 259310 - DNA, 19 bp, Homo sapiens
ctctcccggctgcctgccg

SEQ ID NO: 259311 - DNA, 23 bp, Homo sapiens
ctctccctcaacaagggagagac

SEQ ID NO: 259312 - DNA, 12 bp, Homo sapiens
ctctccctccac

SEQ ID NO: 259313 - DNA, 14 bp, Homo sapiens
ctctccctccactc

SEQ ID NO: 259314 - DNA, 14 bp, Homo sapiens
ctctccctctctgc

SEQ ID NO: 259315 - DNA, 13 bp, Homo sapiens
ctctccctgcctc

SEQ ID NO: 259316 - DNA, 20 bp, Homo sapiens
ctctcctaccccacctcatg

SEQ ID NO: 259317 - DNA, 14 bp, Homo sapiens
ctctcctagagaca

SEQ ID NO: 259318 - DNA, 12 bp, Homo sapiens
ctctcctcatct

SEQ ID NO: 259319 - DNA, 12 bp, Homo sapiens
ctctcctcctcc

SEQ ID NO: 259320 - DNA, 20 bp, Homo sapiens
ctctcctccttttcacagtt

SEQ ID NO: 259321 - DNA, 17 bp, Homo sapiens
ctctcctcggtggcatt

SEQ ID NO: 259322 - DNA, 17 bp, Homo sapiens
ctctcctcgtccggcct

SEQ ID NO: 259323 - DNA, 22 bp, Homo sapiens
ctctcctcgtccggcctgcagc

SEQ ID NO: 259324 - DNA, 16 bp, Homo sapiens
ctctcctctctctccc

SEQ ID NO: 259325 - DNA, 15 bp, Homo sapiens
ctctcctcttgccac

SEQ ID NO: 259326 - DNA, 17 bp, Homo sapiens
ctctcctcttgccactg

SEQ ID NO: 259327 - DNA, 22 bp, Homo sapiens
ctctcctgcccagctctgaccc

SEQ ID NO: 259328 - DNA, 13 bp, Homo sapiens
ctctcctgggccc

SEQ ID NO: 259329 - DNA, 15 bp, Homo sapiens
ctctcctgggcccct

SEQ ID NO: 259330 - DNA, 19 bp, Homo sapiens
ctctcctgggcccctccct

SEQ ID NO: 259331 - DNA, 20 bp, Homo sapiens
ctctcctgggcccctcccta

SEQ ID NO: 259332 - DNA, 22 bp, Homo sapiens
ctctcctgggcccctccctacc

SEQ ID NO: 259333 - DNA, 14 bp, Homo sapiens
ctctcctgtagcca

SEQ ID NO: 259334 - DNA, 21 bp, Homo sapiens
ctctccttcgtgtctctccca

SEQ ID NO: 259335 - DNA, 18 bp, Homo sapiens
ctctccttgccccagtcc

SEQ ID NO: 259336 - DNA, 18 bp, Homo sapiens
ctctccttgccctgggcc

SEQ ID NO: 259337 - DNA, 13 bp, Homo sapiens
ctctccttgggct

SEQ ID NO: 259338 - DNA, 16 bp, Homo sapiens
ctctccttgggctcct

SEQ ID NO: 259339 - DNA, 16 bp, Homo sapiens
ctctccttttgaggct

SEQ ID NO: 259340 - DNA, 19 bp, Homo sapiens
ctctcgccccatccctgct

SEQ ID NO: 259341 - DNA, 12 bp, Homo sapiens
ctctcggaactg

SEQ ID NO: 259342 - DNA, 20 bp, Homo sapiens
ctctcggagtatctgggaac

SEQ ID NO: 259343 - DNA, 15 bp, Homo sapiens
ctctcggctggaaga

SEQ ID NO: 259344 - DNA, 16 bp, Homo sapiens
ctctctaaaaataaaa

SEQ ID NO: 259345 - DNA, 18 bp, Homo sapiens
ctctctaaaaataaaatg

SEQ ID NO: 259346 - DNA, 21 bp, Homo sapiens
ctctctaaaaataaaatgatg

SEQ ID NO: 259347 - DNA, 15 bp, Homo sapiens
ctctctaatagaagt

SEQ ID NO: 259348 - DNA, 13 bp, Homo sapiens
ctctctacccagc

SEQ ID NO: 259349 - DNA, 17 bp, Homo sapiens
ctctctacccagcccat

SEQ ID NO: 259350 - DNA, 18 bp, Homo sapiens
ctctctacccagcccatc

SEQ ID NO: 259351 - DNA, 22 bp, Homo sapiens
ctctctacccagcccatcttgc

SEQ ID NO: 259352 - DNA, 21 bp, Homo sapiens
ctctctatgcaaaatgtctgt

SEQ ID NO: 259353 - DNA, 12 bp, Homo sapiens
ctctctcagacc

SEQ ID NO: 259354 - DNA, 12 bp, Homo sapiens
ctctctccagga

SEQ ID NO: 259355 - DNA, 12 bp, Homo sapiens
ctctctccctcc

SEQ ID NO: 259356 - DNA, 17 bp, Homo sapiens
ctctctccctccactcc

SEQ ID NO: 259357 - DNA, 19 bp, Homo sapiens
ctctctccctccactcctc

SEQ ID NO: 259358 - DNA, 18 bp, Homo sapiens
ctctctccctgcctcaca

SEQ ID NO: 259359 - DNA, 21 bp, Homo sapiens
ctctctccctgcctcacatct

SEQ ID NO: 259360 - DNA, 18 bp, Homo sapiens
ctctctcctctctctccc

SEQ ID NO: 259361 - DNA, 14 bp, Homo sapiens
ctctctctatatat

SEQ ID NO: 259362 - DNA, 15 bp, Homo sapiens
ctctctctatatata

SEQ ID NO: 259363 - DNA, 17 bp, Homo sapiens
ctctctctatatataca

SEQ ID NO: 259364 - DNA, 20 bp, Homo sapiens
ctctctctatatatacatgt

SEQ ID NO: 259365 - DNA, 15 bp, Homo sapiens
ctctctctctctctg

SEQ ID NO: 259366 - DNA, 14 bp, Homo sapiens
ctctctctctctgt

SEQ ID NO: 259367 - DNA, 12 bp, Homo sapiens
ctctctctctgt

SEQ ID NO: 259368 - DNA, 14 bp, Homo sapiens
ctctctctcttttt

SEQ ID NO: 259369 - DNA, 12 bp, Homo sapiens
ctctctctgggc

SEQ ID NO: 259370 - DNA, 11 bp, Homo sapiens
ctctctctgtt

SEQ ID NO: 259371 - DNA, 12 bp, Homo sapiens
ctctctgccagc

SEQ ID NO: 259372 - DNA, 14 bp, Homo sapiens
ctctctgctctagc

SEQ ID NO: 259373 - DNA, 18 bp, Homo sapiens
ctctctgctctagccagg

SEQ ID NO: 259374 - DNA, 19 bp, Homo sapiens
ctctctggccttttcctat

SEQ ID NO: 259375 - DNA, 21 bp, Homo sapiens
ctctctgggactctcctcctc

SEQ ID NO: 259376 - DNA, 16 bp, Homo sapiens
ctctctgtcttctctc

SEQ ID NO: 259377 - DNA, 15 bp, Homo sapiens
ctctctgtgaataca

SEQ ID NO: 259378 - DNA, 15 bp, Homo sapiens
ctctctgtgtggcaa

SEQ ID NO: 259379 - DNA, 24 bp, Homo sapiens
ctctctgttccaagtgtgtgtgca

SEQ ID NO: 259380 - DNA, 20 bp, Homo sapiens
ctctctgtttaccctccctg

SEQ ID NO: 259381 - DNA, 20 bp, Homo sapiens
ctctcttaccccgtcccttt

SEQ ID NO: 259382 - DNA, 18 bp, Homo sapiens
ctctcttacccttctgtg

SEQ ID NO: 259383 - DNA, 23 bp, Homo sapiens
ctctcttacccttctgtgcccag

SEQ ID NO: 259384 - DNA, 21 bp, Homo sapiens
ctctcttatagaatatttatt

SEQ ID NO: 259385 - DNA, 13 bp, Homo sapiens
ctctcttgccagc

SEQ ID NO: 259386 - DNA, 15 bp, Homo sapiens
ctctcttggtctctt

SEQ ID NO: 259387 - DNA, 23 bp, Homo sapiens
ctctcttggtctctttctttcca

SEQ ID NO: 259388 - DNA, 21 bp, Homo sapiens
ctctcttgtgagccatagaga

SEQ ID NO: 259389 - DNA, 21 bp, Homo sapiens
ctctctttttcttttctatgg

SEQ ID NO: 259390 - DNA, 22 bp, Homo sapiens
ctctgaaaagcaattgccctgt

SEQ ID NO: 259391 - DNA, 16 bp, Homo sapiens
ctctgaaagctgcttc

SEQ ID NO: 259392 - DNA, 14 bp, Homo sapiens
ctctgaaatttccc

SEQ ID NO: 259393 - DNA, 17 bp, Homo sapiens
ctctgaaatttcccaca

SEQ ID NO: 259394 - DNA, 15 bp, Homo sapiens
ctctgaactgctgct

SEQ ID NO: 259395 - DNA, 19 bp, Homo sapiens
ctctgaactgctgctggtc

SEQ ID NO: 259396 - DNA, 14 bp, Homo sapiens
ggtggctaaaggtc

SEQ ID NO: 259397 - DNA, 14 bp, Homo sapiens
ggtggctcacgcct

SEQ ID NO: 259398 - DNA, 20 bp, Homo sapiens
ggtggctggaggcattccca

SEQ ID NO: 259399 - DNA, 16 bp, Homo sapiens
ggtggcttcggcctgc

SEQ ID NO: 259400 - DNA, 23 bp, Homo sapiens
ggtggcttcggcctgcttcccgg

SEQ ID NO: 259401 - DNA, 14 bp, Homo sapiens
ggtgggacacagag

SEQ ID NO: 259402 - DNA, 13 bp, Homo sapiens
ggtgggaggctcc

SEQ ID NO: 259403 - DNA, 14 bp, Homo sapiens
ggtgggcaggaaaa

SEQ ID NO: 259404 - DNA, 16 bp, Homo sapiens
ggtgggcatgccaccc

SEQ ID NO: 259405 - DNA, 20 bp, Homo sapiens
ggtgggcccagaactgcccc

SEQ ID NO: 259406 - DNA, 12 bp, Homo sapiens
ggtgggcctggc

SEQ ID NO: 259407 - DNA, 20 bp, Homo sapiens
ggtgggcggatcacaaggtc

SEQ ID NO: 259408 - DNA, 15 bp, Homo sapiens
ggtgggctccagagt

SEQ ID NO: 259409 - DNA, 18 bp, Homo sapiens
ggtgggctccagagtagg

SEQ ID NO: 259410 - DNA, 12 bp, Homo sapiens
ggtggggaagag

SEQ ID NO: 259411 - DNA, 19 bp, Homo sapiens
ggtggggaagagagcctgc

SEQ ID NO: 259412 - DNA, 20 bp, Homo sapiens
ggtggggagcccaggcctgg

SEQ ID NO: 259413 - DNA, 16 bp, Homo sapiens
ggtggggcgggaaagc

SEQ ID NO: 259414 - DNA, 14 bp, Homo sapiens
ggtggggctgagcc

SEQ ID NO: 259415 - DNA, 15 bp, Homo sapiens
ggtgggggatgctga

SEQ ID NO: 259416 - DNA, 16 bp, Homo sapiens
ggtgggggcctgctgt

SEQ ID NO: 259417 - DNA, 22 bp, Homo sapiens
ggtgggtctatgttccccagga

SEQ ID NO: 259418 - DNA, 17 bp, Homo sapiens
ggtgggtttagcaggct

SEQ ID NO: 259419 - DNA, 17 bp, Homo sapiens
ggtggtaactgccagcc

SEQ ID NO: 259420 - DNA, 22 bp, Homo sapiens
ggtggtattggccgatgagctg

SEQ ID NO: 259421 - DNA, 17 bp, Homo sapiens
ggtggtccaccaagttc

SEQ ID NO: 259422 - DNA, 20 bp, Homo sapiens
gtaaaatggaaaacttagtt

SEQ ID NO: 259423 - DNA, 19 bp, Homo sapiens
gtaaaatgtgaagtgaatg

SEQ ID NO: 259424 - DNA, 22 bp, Homo sapiens
gtaaaatgtgaagtgaatgaaa

SEQ ID NO: 259425 - DNA, 23 bp, Homo sapiens
gtaaaatgtgggattatgggtca

SEQ ID NO: 259426 - DNA, 21 bp, Homo sapiens
gtaaaattagaaaaaaacaaa

SEQ ID NO: 259427 - DNA, 15 bp, Homo sapiens
gtaaaattgtataga

SEQ ID NO: 259428 - DNA, 22 bp, Homo sapiens
gtaaacatgtgttttaattcca

SEQ ID NO: 259429 - DNA, 21 bp, Homo sapiens
gtaaaccacttgtcactacaa

SEQ ID NO: 259430 - DNA, 13 bp, Homo sapiens
gtaaacctggagg

SEQ ID NO: 259431 - DNA, 17 bp, Homo sapiens
gtaaactcttcaccttg

SEQ ID NO: 259432 - DNA, 13 bp, Homo sapiens
gtaaactgccctg

SEQ ID NO: 259433 - DNA, 16 bp, Homo sapiens
gtaaactttttcaatg

SEQ ID NO: 259434 - DNA, 17 bp, Homo sapiens
gtaaagcttaaattgct

SEQ ID NO: 259435 - DNA, 15 bp, Homo sapiens
gtaaaggtaggtgca

SEQ ID NO: 259436 - DNA, 21 bp, Homo sapiens
gtaaagtatgtaaacaggaga

SEQ ID NO: 259437 - DNA, 21 bp, Homo sapiens
gtaaagtatgtttttaaattt

SEQ ID NO: 259438 - DNA, 17 bp, Homo sapiens
gtaaagttgaggggaga

SEQ ID NO: 259439 - DNA, 22 bp, Homo sapiens
gtaaagttgaggggagaggaaa

SEQ ID NO: 259440 - DNA, 15 bp, Homo sapiens
gtaaataaaaatagc

SEQ ID NO: 259441 - DNA, 11 bp, Homo sapiens
gtaaataaact

SEQ ID NO: 259442 - DNA, 18 bp, Homo sapiens
gtaaataaactcttcaag

SEQ ID NO: 259443 - DNA, 22 bp, Homo sapiens
gtaaataaactcttcaaggcca

SEQ ID NO: 259444 - DNA, 23 bp, Homo sapiens
gtaaataaactcttcaaggccaa

SEQ ID NO: 259445 - DNA, 18 bp, Homo sapiens
gtaaataaccacaaggtc

SEQ ID NO: 259446 - DNA, 13 bp, Homo sapiens
gtaaataagagat

SEQ ID NO: 259447 - DNA, 16 bp, Homo sapiens
gtaaataagagatttg

SEQ ID NO: 259448 - DNA, 15 bp, Homo sapiens
gtaaatactgcttga

SEQ ID NO: 259449 - DNA, 22 bp, Homo sapiens
gtaaataggtattatattttgg

SEQ ID NO: 259450 - DNA, 13 bp, Homo sapiens
gtaaatatatgtt

SEQ ID NO: 259451 - DNA, 16 bp, Homo sapiens
gtaaatatatgttttg

SEQ ID NO: 259452 - DNA, 18 bp, Homo sapiens
gtaaatatatgttttgag

SEQ ID NO: 259453 - DNA, 21 bp, Homo sapiens
gtaaatatcccagagaacaat

SEQ ID NO: 259454 - DNA, 17 bp, Homo sapiens
gtaaatattcttgtcca

SEQ ID NO: 259455 - DNA, 15 bp, Homo sapiens
gtaaatattgtcaca

SEQ ID NO: 259456 - DNA, 21 bp, Homo sapiens
gtaaatgaacacatggcagaa

SEQ ID NO: 259457 - DNA, 22 bp, Homo sapiens
gtaaatgaacacatggcagaaa

SEQ ID NO: 259458 - DNA, 12 bp, Homo sapiens
gtaaatgatgtg

SEQ ID NO: 259459 - DNA, 21 bp, Homo sapiens
gtaaatgtctgtggccttgtt

SEQ ID NO: 259460 - DNA, 22 bp, Homo sapiens
gtaaattattcagttaagaaaa

SEQ ID NO: 259461 - DNA, 21 bp, Homo sapiens
gtaaattattttaaattataa

SEQ ID NO: 259462 - DNA, 14 bp, Homo sapiens
gtaaattcctgttg

SEQ ID NO: 259463 - DNA, 19 bp, Homo sapiens
gtaacaattttaatgctat

SEQ ID NO: 259464 - DNA, 18 bp, Homo sapiens
gtaacacataaagtaaat

SEQ ID NO: 259465 - DNA, 15 bp, Homo sapiens
gtaacatataaatta

SEQ ID NO: 259466 - DNA, 14 bp, Homo sapiens
gtaacatatttctt

SEQ ID NO: 259467 - DNA, 19 bp, Homo sapiens
gtaacatcactatccatgc

SEQ ID NO: 259468 - DNA, 20 bp, Homo sapiens
gtaacatcactatccatgca

SEQ ID NO: 259469 - DNA, 20 bp, Homo sapiens
gtaaccaactgaacgacaaa

SEQ ID NO: 259470 - DNA, 15 bp, Homo sapiens
gtaaccaagagtatt

SEQ ID NO: 259471 - DNA, 21 bp, Homo sapiens
gtaaccacctctctgtctttt

SEQ ID NO: 259472 - DNA, 17 bp, Homo sapiens
gtaaccagcagtcacag

SEQ ID NO: 259473 - DNA, 21 bp, Homo sapiens
gtaaccgagccagcagctgaa

SEQ ID NO: 259474 - DNA, 14 bp, Homo sapiens
gtaactcagacatt

SEQ ID NO: 259475 - DNA, 19 bp, Homo sapiens
gtaactctaattcccattt

SEQ ID NO: 259476 - DNA, 12 bp, Homo sapiens
gtaactgccagc

SEQ ID NO: 259477 - DNA, 19 bp, Homo sapiens
gtaactgcccttttaaatg

SEQ ID NO: 259478 - DNA, 22 bp, Homo sapiens
gtaactgcccttttaaatggca

SEQ ID NO: 259479 - DNA, 14 bp, Homo sapiens
gtaactgctgagcc

SEQ ID NO: 259480 - DNA, 16 bp, Homo sapiens
gtaactgctgagccac

SEQ ID NO: 259481 - DNA, 17 bp, Homo sapiens
gtaactgctgagccact

SEQ ID NO: 259482 - DNA, 17 bp, Homo sapiens
gtaactgggttcaaaaa

SEQ ID NO: 259483 - DNA, 23 bp, Homo sapiens
gtaacttaattataagctatgtc

SEQ ID NO: 259484 - DNA, 12 bp, Homo sapiens
gtaactttgcat

SEQ ID NO: 259485 - DNA, 13 bp, Homo sapiens
gtaagaagagact

SEQ ID NO: 259486 - DNA, 23 bp, Homo sapiens
gtaagaagtagagaacccagatg

SEQ ID NO: 259487 - DNA, 17 bp, Homo sapiens
gtaagacacacagcctt

SEQ ID NO: 259488 - DNA, 21 bp, Homo sapiens
gtaagacacacagcctttctg

SEQ ID NO: 259489 - DNA, 11 bp, Homo sapiens
gtaagagggag

SEQ ID NO: 259490 - DNA, 19 bp, Homo sapiens
gtaagatcgttctctgcct

SEQ ID NO: 259491 - DNA, 19 bp, Homo sapiens
gtaagcacctgggctgagg

SEQ ID NO: 259492 - DNA, 15 bp, Homo sapiens
gtaagcattctgagc

SEQ ID NO: 259493 - DNA, 21 bp, Homo sapiens
gtaagcattctgagctgggct

SEQ ID NO: 259494 - DNA, 16 bp, Homo sapiens
gtaagctctatctgca

SEQ ID NO: 259495 - DNA, 11 bp, Homo sapiens
gtaagctcttt

SEQ ID NO: 259496 - DNA, 12 bp, Homo sapiens
gtaagctgactg

SEQ ID NO: 259497 - DNA, 17 bp, Homo sapiens
gtaagctgctctattgt

SEQ ID NO: 259498 - DNA, 14 bp, Homo sapiens
gtaaggaatgcttg

SEQ ID NO: 259499 - DNA, 14 bp, Homo sapiens
gtaaggacttgtgc

SEQ ID NO: 259500 - DNA, 15 bp, Homo sapiens
gtaaggacttgtgcc

SEQ ID NO: 259501 - DNA, 23 bp, Homo sapiens
gtaaggcagggtcccatttctca

SEQ ID NO: 259502 - DNA, 15 bp, Homo sapiens
gtaagttctgaaaac

SEQ ID NO: 259503 - DNA, 14 bp, Homo sapiens
gtaataaagtatat

SEQ ID NO: 259504 - DNA, 15 bp, Homo sapiens
gtaataaagtatata

SEQ ID NO: 259505 - DNA, 15 bp, Homo sapiens
gtaataactgtgaag

SEQ ID NO: 259506 - DNA, 16 bp, Homo sapiens
gtaataactgtgaagt

SEQ ID NO: 259507 - DNA, 15 bp, Homo sapiens
gtaatagcctcacct

SEQ ID NO: 259508 - DNA, 23 bp, Homo sapiens
gtaatataataatgtcctttccc

SEQ ID NO: 259509 - DNA, 12 bp, Homo sapiens
gtaatatattgc

SEQ ID NO: 259510 - DNA, 16 bp, Homo sapiens
gtaatatattgctgct

SEQ ID NO: 259511 - DNA, 15 bp, Homo sapiens
gtaatatcatttcat

SEQ ID NO: 259512 - DNA, 12 bp, Homo sapiens
gtaatatgattt

SEQ ID NO: 259513 - DNA, 13 bp, Homo sapiens
gtaatattaaatt

SEQ ID NO: 259514 - DNA, 18 bp, Homo sapiens
gtaatattctctgatgtt

SEQ ID NO: 259515 - DNA, 19 bp, Homo sapiens
gtaatattctctgatgttt

SEQ ID NO: 259516 - DNA, 12 bp, Homo sapiens
gtaatcaatgaa

SEQ ID NO: 259517 - DNA, 21 bp, Homo sapiens
gtaatcaatgaatattgaagt

SEQ ID NO: 259518 - DNA, 14 bp, Homo sapiens
gtaatcaatgtttc

SEQ ID NO: 259519 - DNA, 22 bp, Homo sapiens
gtaatcagcattattcttcaga

SEQ ID NO: 259520 - DNA, 20 bp, Homo sapiens
gtaatcatttcttgggccct

SEQ ID NO: 259521 - DNA, 22 bp, Homo sapiens
gtaatcatttcttgggccctcc

SEQ ID NO: 259522 - DNA, 20 bp, Homo sapiens
gtaatcccagctacttggga

SEQ ID NO: 259523 - DNA, 18 bp, Homo sapiens
gtaatcccgccacctatc

SEQ ID NO: 259524 - DNA, 23 bp, Homo sapiens
gtaatgacagagagttctggtga

SEQ ID NO: 259525 - DNA, 19 bp, Homo sapiens
gtaatgcagacatttacat

SEQ ID NO: 259526 - DNA, 15 bp, Homo sapiens
gtaatggaggccaag

SEQ ID NO: 259527 - DNA, 22 bp, Homo sapiens
gtaatggaggccaagcctgcag

SEQ ID NO: 259528 - DNA, 14 bp, Homo sapiens
gtaatgtatcttat

SEQ ID NO: 259529 - DNA, 20 bp, Homo sapiens
gtaatgtatcttatttatat

SEQ ID NO: 259530 - DNA, 13 bp, Homo sapiens
gtaatgttactga

SEQ ID NO: 259531 - DNA, 22 bp, Homo sapiens
gtaattacctgtcatctgggcc

SEQ ID NO: 259532 - DNA, 22 bp, Homo sapiens
gtaattatcgggaacagtgttt

SEQ ID NO: 259533 - DNA, 20 bp, Homo sapiens
gtaattcaatttctcacaat

SEQ ID NO: 259534 - DNA, 21 bp, Homo sapiens
gtaattcctctcactaaactt

SEQ ID NO: 259535 - DNA, 15 bp, Homo sapiens
gtaattctaaatgaa

SEQ ID NO: 259536 - DNA, 12 bp, Homo sapiens
gtaattgcttac

SEQ ID NO: 259537 - DNA, 16 bp, Homo sapiens
gtaattgcttacattt

SEQ ID NO: 259538 - DNA, 10 bp, Homo sapiens
ctctgggctt

SEQ ID NO: 259539 - DNA, 14 bp, Homo sapiens
ctctggggctctag

SEQ ID NO: 259540 - DNA, 22 bp, Homo sapiens
ctctggggctctagggttgctg

SEQ ID NO: 259541 - DNA, 21 bp, Homo sapiens
ctctgggtaggtgttgaaaat

SEQ ID NO: 259542 - DNA, 17 bp, Homo sapiens
ctctgggtgagtggctg

SEQ ID NO: 259543 - DNA, 20 bp, Homo sapiens
ctctggtaaacattcctcca

SEQ ID NO: 259544 - DNA, 21 bp, Homo sapiens
ctctggtaaacattcctccag

SEQ ID NO: 259545 - DNA, 14 bp, Homo sapiens
ctctggtccttctg

SEQ ID NO: 259546 - DNA, 19 bp, Homo sapiens
ctctggtctcctctttgtt

SEQ ID NO: 259547 - DNA, 13 bp, Homo sapiens
ctctggttctttg

SEQ ID NO: 259548 - DNA, 16 bp, Homo sapiens
ctctgtaaccacctct

SEQ ID NO: 259549 - DNA, 19 bp, Homo sapiens
ctctgtaaccacctctctg

SEQ ID NO: 259550 - DNA, 21 bp, Homo sapiens
ctctgtagctccctcctccca

SEQ ID NO: 259551 - DNA, 14 bp, Homo sapiens
ctctgtagtttatg

SEQ ID NO: 259552 - DNA, 17 bp, Homo sapiens
gtacaatgtttcagaag

SEQ ID NO: 259553 - DNA, 14 bp, Homo sapiens
gtacaattctttgt

SEQ ID NO: 259554 - DNA, 19 bp, Homo sapiens
gtacaattctttgttgctt

SEQ ID NO: 259555 - DNA, 22 bp, Homo sapiens
gtacaattctttgttgcttaat

SEQ ID NO: 259556 - DNA, 16 bp, Homo sapiens
gtacactgacttgaga

SEQ ID NO: 259557 - DNA, 23 bp, Homo sapiens
gtacagaaccagcactcccaggg

SEQ ID NO: 259558 - DNA, 17 bp, Homo sapiens
gtacagaatcattgctt

SEQ ID NO: 259559 - DNA, 18 bp, Homo sapiens
gtacagaatcattgctta

SEQ ID NO: 259560 - DNA, 16 bp, Homo sapiens
gtacagacaacaaacc

SEQ ID NO: 259561 - DNA, 20 bp, Homo sapiens
gtacagagtggcccctcacc

SEQ ID NO: 259562 - DNA, 20 bp, Homo sapiens
gtacagattgctgcttctgc

SEQ ID NO: 259563 - DNA, 14 bp, Homo sapiens
gtacagcagggtct

SEQ ID NO: 259564 - DNA, 15 bp, Homo sapiens
gtacagcagggtctt

SEQ ID NO: 259565 - DNA, 18 bp, Homo sapiens
gtacagctgtttaagatg

SEQ ID NO: 259566 - DNA, 16 bp, Homo sapiens
gtacagtatgtgtcta

SEQ ID NO: 259567 - DNA, 16 bp, Homo sapiens
gtacagtctcaatttt

SEQ ID NO: 259568 - DNA, 17 bp, Homo sapiens
gtacagtctcaattttg

SEQ ID NO: 259569 - DNA, 22 bp, Homo sapiens
gtacagtctcaattttgtattt

SEQ ID NO: 259570 - DNA, 21 bp, Homo sapiens
gtacagttatttatgcctctg

SEQ ID NO: 259571 - DNA, 19 bp, Homo sapiens
gtacagttcagttcctctt

SEQ ID NO: 259572 - DNA, 23 bp, Homo sapiens
gtacagttcagttcctctttgca

SEQ ID NO: 259573 - DNA, 12 bp, Homo sapiens
gtacagttcttc

SEQ ID NO: 259574 - DNA, 20 bp, Homo sapiens
gtacataaattgcataaagc

SEQ ID NO: 259575 - DNA, 22 bp, Homo sapiens
gtacataatgcttaatttctaa

SEQ ID NO: 259576 - DNA, 14 bp, Homo sapiens
gtacatacattgta

SEQ ID NO: 259577 - DNA, 15 bp, Homo sapiens
gtacatacattgtat

SEQ ID NO: 259578 - DNA, 23 bp, Homo sapiens
gtacatagtgaattttaaaatgt

SEQ ID NO: 259579 - DNA, 16 bp, Homo sapiens
gtacatatggaaatcc

SEQ ID NO: 259580 - DNA, 19 bp, Homo sapiens
gtacatatggaaatcctgt

SEQ ID NO: 259581 - DNA, 21 bp, Homo sapiens
gtacatatggaaatcctgtta

SEQ ID NO: 259582 - DNA, 18 bp, Homo sapiens
gtacatctgcaatatgaa

SEQ ID NO: 259583 - DNA, 20 bp, Homo sapiens
gtacatggaagaagtatatt

SEQ ID NO: 259584 - DNA, 13 bp, Homo sapiens
gtacatggaggaa

SEQ ID NO: 259585 - DNA, 16 bp, Homo sapiens
gtacatggcccgcagt

SEQ ID NO: 259586 - DNA, 21 bp, Homo sapiens
gtacatgtggaaaactcacag

SEQ ID NO: 259587 - DNA, 18 bp, Homo sapiens
gtacattcctgatactgg

SEQ ID NO: 259588 - DNA, 23 bp, Homo sapiens
gtacattcctgatactgggtaca

SEQ ID NO: 259589 - DNA, 15 bp, Homo sapiens
gtacatttatgtgtg

SEQ ID NO: 259590 - DNA, 21 bp, Homo sapiens
gtacatttatgtgtgaagcaa

SEQ ID NO: 259591 - DNA, 19 bp, Homo sapiens
gtaccaaagaaacaccact

SEQ ID NO: 259592 - DNA, 13 bp, Homo sapiens
gtaccaaagtttt

SEQ ID NO: 259593 - DNA, 18 bp, Homo sapiens
gtaccaagatcacaaata

SEQ ID NO: 259594 - DNA, 13 bp, Homo sapiens
gtaccaagcccct

SEQ ID NO: 259595 - DNA, 22 bp, Homo sapiens
gtaccaagccccttggccctct

SEQ ID NO: 259596 - DNA, 15 bp, Homo sapiens
gtaccaatgctgttg

SEQ ID NO: 259597 - DNA, 13 bp, Homo sapiens
gtaccactgctaa

SEQ ID NO: 259598 - DNA, 16 bp, Homo sapiens
gtaccactgctaataa

SEQ ID NO: 259599 - DNA, 19 bp, Homo sapiens
gtaccactgctaataaatg

SEQ ID NO: 259600 - DNA, 16 bp, Homo sapiens
gtaccagcaatatgta

SEQ ID NO: 259601 - DNA, 21 bp, Homo sapiens
gtaccagcgctctaaaagcac

SEQ ID NO: 259602 - DNA, 22 bp, Homo sapiens
gtaccagcgctctaaaagcacc

SEQ ID NO: 259603 - DNA, 13 bp, Homo sapiens
gtaccaggccacc

SEQ ID NO: 259604 - DNA, 18 bp, Homo sapiens
gtaccaggccacccactg

SEQ ID NO: 259605 - DNA, 15 bp, Homo sapiens
gtaccagggctctgt

SEQ ID NO: 259606 - DNA, 19 bp, Homo sapiens
gtaccagtgtactgctttc

SEQ ID NO: 259607 - DNA, 23 bp, Homo sapiens
gtaccagtgttagtgggaagagc

SEQ ID NO: 259608 - DNA, 20 bp, Homo sapiens
gtaccatagcgctgctctta

SEQ ID NO: 259609 - DNA, 16 bp, Homo sapiens
gtaccatcaataaagt

SEQ ID NO: 259610 - DNA, 13 bp, Homo sapiens
gtaccatcccact

SEQ ID NO: 259611 - DNA, 20 bp, Homo sapiens
gtaccatgaaacaaagctgc

SEQ ID NO: 259612 - DNA, 14 bp, Homo sapiens
gtacccagccacct

SEQ ID NO: 259613 - DNA, 16 bp, Homo sapiens
gtacccagccaccttc

SEQ ID NO: 259614 - DNA, 24 bp, Homo sapiens
gtacccagctccttttgtccccag

SEQ ID NO: 259615 - DNA, 17 bp, Homo sapiens
gtacccaggatgatttc

SEQ ID NO: 259616 - DNA, 13 bp, Homo sapiens
gtaccctgcttcc

SEQ ID NO: 259617 - DNA, 18 bp, Homo sapiens
gtaccctgcttcccaaac

SEQ ID NO: 259618 - DNA, 13 bp, Homo sapiens
gtaccctggcaga

SEQ ID NO: 259619 - DNA, 16 bp, Homo sapiens
gtaccctggcagagaa

SEQ ID NO: 259620 - DNA, 18 bp, Homo sapiens
gtaccctggcagagaaga

SEQ ID NO: 259621 - DNA, 22 bp, Homo sapiens
gtaccctggcagagaagagacc

SEQ ID NO: 259622 - DNA, 13 bp, Homo sapiens
gtacctataaagt

SEQ ID NO: 259623 - DNA, 19 bp, Homo sapiens
gtacctataaagtaaagct

SEQ ID NO: 259624 - DNA, 18 bp, Homo sapiens
gtacctgggaaaggaccc

SEQ ID NO: 259625 - DNA, 21 bp, Homo sapiens
gtacctgggaaaggacccacc

SEQ ID NO: 259626 - DNA, 22 bp, Homo sapiens
gtacctgggaaaggacccaccc

SEQ ID NO: 259627 - DNA, 23 bp, Homo sapiens
gtacctgtaggaaacagaaaaga

SEQ ID NO: 259628 - DNA, 19 bp, Homo sapiens
gtaccttattgatctttgc

SEQ ID NO: 259629 - DNA, 19 bp, Homo sapiens
gtaccttcagatcctaccc

SEQ ID NO: 259630 - DNA, 24 bp, Homo sapiens
gtacgtcccgctgctgtgctctgg

SEQ ID NO: 259631 - DNA, 14 bp, Homo sapiens
gtacgtgggagagg

SEQ ID NO: 259632 - DNA, 22 bp, Homo sapiens
gtacgtgggtacccaggctggt

SEQ ID NO: 259633 - DNA, 14 bp, Homo sapiens
gtactaagccagga

SEQ ID NO: 259634 - DNA, 15 bp, Homo sapiens
gtactactagatgtc

SEQ ID NO: 259635 - DNA, 21 bp, Homo sapiens
gtactactagatgtctttagg

SEQ ID NO: 259636 - DNA, 17 bp, Homo sapiens
gtactatatctgtttta

SEQ ID NO: 259637 - DNA, 19 bp, Homo sapiens
gtactatggctgtattttt

SEQ ID NO: 259638 - DNA, 16 bp, Homo sapiens
gtactcacttttcact

SEQ ID NO: 259639 - DNA, 13 bp, Homo sapiens
gtactcagagcag

SEQ ID NO: 259640 - DNA, 14 bp, Homo sapiens
gtactcagagcaga

SEQ ID NO: 259641 - DNA, 16 bp, Homo sapiens
gtactcagagcagagc

SEQ ID NO: 259642 - DNA, 17 bp, Homo sapiens
gtactcagagcagagca

SEQ ID NO: 259643 - DNA, 12 bp, Homo sapiens
gtactccagcct

SEQ ID NO: 259644 - DNA, 17 bp, Homo sapiens
gtactccagcctgggtg

SEQ ID NO: 259645 - DNA, 17 bp, Homo sapiens
gtactcccccagccctc

SEQ ID NO: 259646 - DNA, 14 bp, Homo sapiens
gtactcctcccagg

SEQ ID NO: 259647 - DNA, 16 bp, Homo sapiens
gtactcctgcaaaatt

SEQ ID NO: 259648 - DNA, 19 bp, Homo sapiens
gtactccttggatttgcat

SEQ ID NO: 259649 - DNA, 18 bp, Homo sapiens
gtactctacgccaaagtg

SEQ ID NO: 259650 - DNA, 21 bp, Homo sapiens
gtactgagaggaggggtaaat

SEQ ID NO: 259651 - DNA, 22 bp, Homo sapiens
gtactgagaggaggggtaaata

SEQ ID NO: 259652 - DNA, 21 bp, Homo sapiens
gtactgagttctcatccacag

SEQ ID NO: 259653 - DNA, 16 bp, Homo sapiens
gtactggagaaaatgg

SEQ ID NO: 259654 - DNA, 19 bp, Homo sapiens
gtacttaaatgaaagcatg

SEQ ID NO: 259655 - DNA, 16 bp, Homo sapiens
gtacttcagtcttgga

SEQ ID NO: 259656 - DNA, 17 bp, Homo sapiens
gtacttcagtcttggag

SEQ ID NO: 259657 - DNA, 21 bp, Homo sapiens
gtacttcctcctgatggccaa

SEQ ID NO: 259658 - DNA, 17 bp, Homo sapiens
gtacttgctcaataaag

SEQ ID NO: 259659 - DNA, 16 bp, Homo sapiens
gtacttgtgtttgctt

SEQ ID NO: 259660 - DNA, 22 bp, Homo sapiens
gtactttattcttgctgggcat

SEQ ID NO: 259661 - DNA, 12 bp, Homo sapiens
gtactttgtttt

SEQ ID NO: 259662 - DNA, 11 bp, Homo sapiens
gtacttttaac

SEQ ID NO: 259663 - DNA, 23 bp, Homo sapiens
gtagaaattttacaataggtgct

SEQ ID NO: 259664 - DNA, 20 bp, Homo sapiens
gtagaaattttatctcttct

SEQ ID NO: 259665 - DNA, 13 bp, Homo sapiens
gtagaactcagca

SEQ ID NO: 259666 - DNA, 14 bp, Homo sapiens
gtagaactgttcat

SEQ ID NO: 259667 - DNA, 16 bp, Homo sapiens
gtagaagagggagaag

SEQ ID NO: 259668 - DNA, 21 bp, Homo sapiens
gtagaagagggagaaggagag

SEQ ID NO: 259669 - DNA, 20 bp, Homo sapiens
gtagaagatttgatgctgga

SEQ ID NO: 259670 - DNA, 18 bp, Homo sapiens
gtagaagcaaaggcagga

SEQ ID NO: 259671 - DNA, 15 bp, Homo sapiens
gtagaatctcagcac

SEQ ID NO: 259672 - DNA, 17 bp, Homo sapiens
gtagacactaattctgt

SEQ ID NO: 259673 - DNA, 21 bp, Homo sapiens
gtagacctgtgagaaaacgtt

SEQ ID NO: 259674 - DNA, 18 bp, Homo sapiens
gtagacgaacagctgaca

SEQ ID NO: 259675 - DNA, 16 bp, Homo sapiens
ctcttctgtccatcag

SEQ ID NO: 259676 - DNA, 21 bp, Homo sapiens
ctcttcttactgtatttggga

SEQ ID NO: 259677 - DNA, 12 bp, Homo sapiens
ctcttcttcctt

SEQ ID NO: 259678 - DNA, 16 bp, Homo sapiens
ctcttcttgcggcacc

SEQ ID NO: 259679 - DNA, 23 bp, Homo sapiens
ctcttcttgcggcaccgcccacc

SEQ ID NO: 259680 - DNA, 14 bp, Homo sapiens
ctcttgagggagct

SEQ ID NO: 259681 - DNA, 20 bp, Homo sapiens
gtatccatgggggcagggca

SEQ ID NO: 259682 - DNA, 22 bp, Homo sapiens
gtatccatttaaactaaccttt

SEQ ID NO: 259683 - DNA, 20 bp, Homo sapiens
ctgaaggttggaactgctgc

SEQ ID NO: 259684 - DNA, 23 bp, Homo sapiens
ctgaaggttggaactgctgccat

SEQ ID NO: 259685 - DNA, 17 bp, Homo sapiens
ctgaagtacagtcccag

SEQ ID NO: 259686 - DNA, 19 bp, Homo sapiens
ctgaagtacagtcccagca

SEQ ID NO: 259687 - DNA, 16 bp, Homo sapiens
ctgaagtactgcaccc

SEQ ID NO: 259688 - DNA, 17 bp, Homo sapiens
ctgaagtcactgcacag

SEQ ID NO: 259689 - DNA, 22 bp, Homo sapiens
ctgaagtcattgtcgctcagca

SEQ ID NO: 259690 - DNA, 13 bp, Homo sapiens
ctgaagtcccttc

SEQ ID NO: 259691 - DNA, 20 bp, Homo sapiens
ctgaagtcccttcctgtcct

SEQ ID NO: 259692 - DNA, 13 bp, Homo sapiens
ctgaagtcttgca

SEQ ID NO: 259693 - DNA, 19 bp, Homo sapiens
ctgaagtcttgcattgaat

SEQ ID NO: 259694 - DNA, 21 bp, Homo sapiens
ctgaagtcttgcattgaattt

SEQ ID NO: 259695 - DNA, 24 bp, Homo sapiens
ctgaagtctttgtacagacaacaa

SEQ ID NO: 259696 - DNA, 16 bp, Homo sapiens
ctgaagtcttttctgt

SEQ ID NO: 259697 - DNA, 18 bp, Homo sapiens
ctgaagtcttttctgtca

SEQ ID NO: 259698 - DNA, 15 bp, Homo sapiens
ctgaagttggacagc

SEQ ID NO: 259699 - DNA, 13 bp, Homo sapiens
ctgaagtttcaca

SEQ ID NO: 259700 - DNA, 14 bp, Homo sapiens
ctgaataaagggaa

SEQ ID NO: 259701 - DNA, 22 bp, Homo sapiens
ctgaataacaacaatttaggaa

SEQ ID NO: 259702 - DNA, 22 bp, Homo sapiens
ctgaataatggaattatgtata

SEQ ID NO: 259703 - DNA, 18 bp, Homo sapiens
ctgaatacctctttgaaa

SEQ ID NO: 259704 - DNA, 23 bp, Homo sapiens
ctgaatacttaatatgtgggaaa

SEQ ID NO: 259705 - DNA, 14 bp, Homo sapiens
ctgaatacttgaag

SEQ ID NO: 259706 - DNA, 19 bp, Homo sapiens
ctgaatacttgaagtagga

SEQ ID NO: 259707 - DNA, 21 bp, Homo sapiens
ctgaatatctgttcacttttc

SEQ ID NO: 259708 - DNA, 20 bp, Homo sapiens
ctgaatatttatatttcact

SEQ ID NO: 259709 - DNA, 17 bp, Homo sapiens
ctgaatctctcaaaatg

SEQ ID NO: 259710 - DNA, 21 bp, Homo sapiens
ctgaatgggagccagaattca

SEQ ID NO: 259711 - DNA, 14 bp, Homo sapiens
ctgaatgttctgac

SEQ ID NO: 259712 - DNA, 19 bp, Homo sapiens
ctgaatgttctgacattaa

SEQ ID NO: 259713 - DNA, 23 bp, Homo sapiens
ctgaatgttctgacattaacagt

SEQ ID NO: 259714 - DNA, 14 bp, Homo sapiens
ctgaattaaataaa

SEQ ID NO: 259715 - DNA, 23 bp, Homo sapiens
ctgaattacagtgaaattttggt

SEQ ID NO: 259716 - DNA, 16 bp, Homo sapiens
ctgaattcctttacaa

SEQ ID NO: 259717 - DNA, 20 bp, Homo sapiens
ctgaattcctttacaactaa

SEQ ID NO: 259718 - DNA, 23 bp, Homo sapiens
ctgaattctatttgctgggcttt

SEQ ID NO: 259719 - DNA, 15 bp, Homo sapiens
ctgaatttgggcctc

SEQ ID NO: 259720 - DNA, 22 bp, Homo sapiens
ctgacaaatattttagaagcta

SEQ ID NO: 259721 - DNA, 19 bp, Homo sapiens
ctgacaatgcgtggcacat

SEQ ID NO: 259722 - DNA, 15 bp, Homo sapiens
ctgacaatggcagct

SEQ ID NO: 259723 - DNA, 22 bp, Homo sapiens
ctgacaatggcagctagactgg

SEQ ID NO: 259724 - DNA, 18 bp, Homo sapiens
ctgacacaaaaaaagttg

SEQ ID NO: 259725 - DNA, 11 bp, Homo sapiens
ctgacacatgc

SEQ ID NO: 259726 - DNA, 18 bp, Homo sapiens
ctgacacctaccatgctg

SEQ ID NO: 259727 - DNA, 17 bp, Homo sapiens
ctgacactgagccccac

SEQ ID NO: 259728 - DNA, 22 bp, Homo sapiens
ctgacactgcgaactctcagga

SEQ ID NO: 259729 - DNA, 16 bp, Homo sapiens
ctgacagagcaggtct

SEQ ID NO: 259730 - DNA, 18 bp, Homo sapiens
ctgacagagcaggtctgc

SEQ ID NO: 259731 - DNA, 13 bp, Homo sapiens
ctgacagaggggg

SEQ ID NO: 259732 - DNA, 18 bp, Homo sapiens
ctgacagatgtcagccga

SEQ ID NO: 259733 - DNA, 15 bp, Homo sapiens
ctgacagcagcctgt

SEQ ID NO: 259734 - DNA, 18 bp, Homo sapiens
ctgacagcagcctgtgag

SEQ ID NO: 259735 - DNA, 19 bp, Homo sapiens
ctgacagcagcctgtgagg

SEQ ID NO: 259736 - DNA, 20 bp, Homo sapiens
ctgacagcagcctgtgaggg

SEQ ID NO: 259737 - DNA, 12 bp, Homo sapiens
ctgacagcctcc

SEQ ID NO: 259738 - DNA, 20 bp, Homo sapiens
ctgacagcctcccaccccca

SEQ ID NO: 259739 - DNA, 16 bp, Homo sapiens
ctgacaggaagactgg

SEQ ID NO: 259740 - DNA, 19 bp, Homo sapiens
ctgacaggaagactggaga

SEQ ID NO: 259741 - DNA, 20 bp, Homo sapiens
ctgacaggaagactggagac

SEQ ID NO: 259742 - DNA, 15 bp, Homo sapiens
ctgacagtcttgtgc

SEQ ID NO: 259743 - DNA, 14 bp, Homo sapiens
ctgacataatgtag

SEQ ID NO: 259744 - DNA, 20 bp, Homo sapiens
ctgacataatgtagtgagtg

SEQ ID NO: 259745 - DNA, 20 bp, Homo sapiens
ctgacatcctgacctcctgg

SEQ ID NO: 259746 - DNA, 15 bp, Homo sapiens
ctgacatgattcctt

SEQ ID NO: 259747 - DNA, 14 bp, Homo sapiens
ctgacatggagttc

SEQ ID NO: 259748 - DNA, 19 bp, Homo sapiens
ctgacatgtggggccaggt

SEQ ID NO: 259749 - DNA, 14 bp, Homo sapiens
ctgacattaacagt

SEQ ID NO: 259750 - DNA, 18 bp, Homo sapiens
ctgacattaacagttttc

SEQ ID NO: 259751 - DNA, 21 bp, Homo sapiens
ctgacattaacagttttccat

SEQ ID NO: 259752 - DNA, 21 bp, Homo sapiens
ctgaccaacattcaaaagcac

SEQ ID NO: 259753 - DNA, 13 bp, Homo sapiens
ctgaccacacttc

SEQ ID NO: 259754 - DNA, 22 bp, Homo sapiens
ctgaccacgctttctagctgtt

SEQ ID NO: 259755 - DNA, 21 bp, Homo sapiens
ctgaccagcctccatgctgcc

SEQ ID NO: 259756 - DNA, 22 bp, Homo sapiens
ctgaccccacttatgctgctgt

SEQ ID NO: 259757 - DNA, 23 bp, Homo sapiens
ctgaccccacttatgctgctgtg

SEQ ID NO: 259758 - DNA, 12 bp, Homo sapiens
ctgaccccagga

SEQ ID NO: 259759 - DNA, 14 bp, Homo sapiens
ctgaccccaggaag

SEQ ID NO: 259760 - DNA, 15 bp, Homo sapiens
ctgaccccaggaagt

SEQ ID NO: 259761 - DNA, 17 bp, Homo sapiens
ctgaccccaggaagtgg

SEQ ID NO: 259762 - DNA, 14 bp, Homo sapiens
ctgaccccttgctc

SEQ ID NO: 259763 - DNA, 17 bp, Homo sapiens
ctgaccccttgctccct

SEQ ID NO: 259764 - DNA, 18 bp, Homo sapiens
ctgaccctctccacccca

SEQ ID NO: 259765 - DNA, 19 bp, Homo sapiens
ctgaccctgatgcttaata

SEQ ID NO: 259766 - DNA, 21 bp, Homo sapiens
ctgacctcaggtgatccaccc

SEQ ID NO: 259767 - DNA, 13 bp, Homo sapiens
ctgacctcccact

SEQ ID NO: 259768 - DNA, 21 bp, Homo sapiens
ctgacctccctctaatttatc

SEQ ID NO: 259769 - DNA, 18 bp, Homo sapiens
ctgacctctgaagagctg

SEQ ID NO: 259770 - DNA, 14 bp, Homo sapiens
ctgacctgagactg

SEQ ID NO: 259771 - DNA, 21 bp, Homo sapiens
ctgacctgcccctgccgcctg

SEQ ID NO: 259772 - DNA, 22 bp, Homo sapiens
ctgacctgctccgccaggaaag

SEQ ID NO: 259773 - DNA, 21 bp, Homo sapiens
ctgacctggaagagctgggta

SEQ ID NO: 259774 - DNA, 12 bp, Homo sapiens
ctgacctggcac

SEQ ID NO: 259775 - DNA, 16 bp, Homo sapiens
ctgacctggcacagaa

SEQ ID NO: 259776 - DNA, 13 bp, Homo sapiens
ctgacctgtccag

SEQ ID NO: 259777 - DNA, 15 bp, Homo sapiens
ctgacctgtccaggt

SEQ ID NO: 259778 - DNA, 17 bp, Homo sapiens
ctgaccttagcgttctg

SEQ ID NO: 259779 - DNA, 19 bp, Homo sapiens
ctgaccttagcgttctgga

SEQ ID NO: 259780 - DNA, 21 bp, Homo sapiens
ctgaccttagcgttctggact

SEQ ID NO: 259781 - DNA, 22 bp, Homo sapiens
ctgaccttagcgttctggactc

SEQ ID NO: 259782 - DNA, 20 bp, Homo sapiens
ctgaccttgaactcctgggc

SEQ ID NO: 259783 - DNA, 21 bp, Homo sapiens
ctgaccttgaactcctgggct

SEQ ID NO: 259784 - DNA, 16 bp, Homo sapiens
ctgaccttggaggaat

SEQ ID NO: 259785 - DNA, 21 bp, Homo sapiens
ctgaccttggaggaatgacaa

SEQ ID NO: 259786 - DNA, 21 bp, Homo sapiens
ctgaccttggctgactggggc

SEQ ID NO: 259787 - DNA, 13 bp, Homo sapiens
ctgacgaggctgg

SEQ ID NO: 259788 - DNA, 15 bp, Homo sapiens
ctgacgaggctgggc

SEQ ID NO: 259789 - DNA, 16 bp, Homo sapiens
ctgacgaggctgggcc

SEQ ID NO: 259790 - DNA, 19 bp, Homo sapiens
ctgacgaggctgggccaag

SEQ ID NO: 259791 - DNA, 21 bp, Homo sapiens
ctgacgaggctgggccaagcc

SEQ ID NO: 259792 - DNA, 23 bp, Homo sapiens
ctgacgccaataataaaaaacaa

SEQ ID NO: 259793 - DNA, 21 bp, Homo sapiens
ctgacgccctgcgttggagcc

SEQ ID NO: 259794 - DNA, 22 bp, Homo sapiens
ctgacgccctgcgttggagcca

SEQ ID NO: 259795 - DNA, 14 bp, Homo sapiens
ctgacggctgtgta

SEQ ID NO: 259796 - DNA, 15 bp, Homo sapiens
ctgacggctgtgtat

SEQ ID NO: 259797 - DNA, 21 bp, Homo sapiens
ctgacggctgtgtatttctgt

SEQ ID NO: 259798 - DNA, 15 bp, Homo sapiens
ctgacgtttgacacc

SEQ ID NO: 259799 - DNA, 18 bp, Homo sapiens
ctgactattcttgatgta

SEQ ID NO: 259800 - DNA, 20 bp, Homo sapiens
ctgactattcttgatgtaaa

SEQ ID NO: 259801 - DNA, 17 bp, Homo sapiens
ctgactcacattgcctt

SEQ ID NO: 259802 - DNA, 15 bp, Homo sapiens
ctgactcaggcatca

SEQ ID NO: 259803 - DNA, 21 bp, Homo sapiens
ctgactccagagtctgagccc

SEQ ID NO: 259804 - DNA, 22 bp, Homo sapiens
ctgactcccaaagagctgccta

SEQ ID NO: 259805 - DNA, 13 bp, Homo sapiens
ctgactgaaatta

SEQ ID NO: 259806 - DNA, 20 bp, Homo sapiens
ctgactggccccagggactc

SEQ ID NO: 259807 - DNA, 19 bp, Homo sapiens
ctgactgggaacaccccat

SEQ ID NO: 259808 - DNA, 12 bp, Homo sapiens
ctgactggggct

SEQ ID NO: 259809 - DNA, 17 bp, Homo sapiens
ctgactgtactcctccc

SEQ ID NO: 259810 - DNA, 13 bp, Homo sapiens
ctgaggactccct

SEQ ID NO: 259811 - DNA, 15 bp, Homo sapiens
ctgaggactccctcc

SEQ ID NO: 259812 - DNA, 14 bp, Homo sapiens
ctgaggactggaga

SEQ ID NO: 259813 - DNA, 15 bp, Homo sapiens
ctgaggactggagac

SEQ ID NO: 259814 - DNA, 13 bp, Homo sapiens
ctgaggaggcagt

SEQ ID NO: 259815 - DNA, 20 bp, Homo sapiens
ctgaggagggggaggacgga

SEQ ID NO: 259816 - DNA, 21 bp, Homo sapiens
ctgaggagtattaagaatgca

SEQ ID NO: 259817 - DNA, 13 bp, Homo sapiens
ctgaggagtccaa

SEQ ID NO: 259818 - DNA, 22 bp, Homo sapiens
ctgaggatgacccggggcagct

SEQ ID NO: 259819 - DNA, 23 bp, Homo sapiens
ctgaggatgacccggggcagctg

SEQ ID NO: 259820 - DNA, 13 bp, Homo sapiens
ctgaggatgagct

SEQ ID NO: 259821 - DNA, 17 bp, Homo sapiens
ctgaggatgagctggaa

SEQ ID NO: 259822 - DNA, 18 bp, Homo sapiens
ctgaggatgagctggaag

SEQ ID NO: 259823 - DNA, 16 bp, Homo sapiens
ctgaggcaagagaatt

SEQ ID NO: 259824 - DNA, 19 bp, Homo sapiens
gtcacagccgtttgaatat

SEQ ID NO: 259825 - DNA, 14 bp, Homo sapiens
gtcacagctgcagc

SEQ ID NO: 259826 - DNA, 15 bp, Homo sapiens
gtcacagctgcagct

SEQ ID NO: 259827 - DNA, 19 bp, Homo sapiens
gtcacagctgcagctgggc

SEQ ID NO: 259828 - DNA, 20 bp, Homo sapiens
gtcacagctgcagctgggcc

SEQ ID NO: 259829 - DNA, 21 bp, Homo sapiens
gtcacagctgcagctgggccc

SEQ ID NO: 259830 - DNA, 22 bp, Homo sapiens
gtcacaggacgatttcactgac

SEQ ID NO: 259831 - DNA, 19 bp, Homo sapiens
gtcacatggggcctggccc

SEQ ID NO: 259832 - DNA, 14 bp, Homo sapiens
gtcaccaaatttgt

SEQ ID NO: 259833 - DNA, 23 bp, Homo sapiens
gtcaccaccccagtgaggacctc

SEQ ID NO: 259834 - DNA, 14 bp, Homo sapiens
gtcaccagcaacat

SEQ ID NO: 259835 - DNA, 12 bp, Homo sapiens
gtcaccaggact

SEQ ID NO: 259836 - DNA, 23 bp, Homo sapiens
gtcaccaggacttggggtcagga

SEQ ID NO: 259837 - DNA, 21 bp, Homo sapiens
gtcaccatctcaggccacctg

SEQ ID NO: 259838 - DNA, 18 bp, Homo sapiens
gtcacccagcaaggcaca

SEQ ID NO: 259839 - DNA, 19 bp, Homo sapiens
gtcacccagcaaggcacag

SEQ ID NO: 259840 - DNA, 13 bp, Homo sapiens
gtcaccctgcaga

SEQ ID NO: 259841 - DNA, 14 bp, Homo sapiens
gtcacccttctggg

SEQ ID NO: 259842 - DNA, 15 bp, Homo sapiens
gtcacccttctgggc

SEQ ID NO: 259843 - DNA, 17 bp, Homo sapiens
gtcacccttggtagagt

SEQ ID NO: 259844 - DNA, 20 bp, Homo sapiens
gtcacccttggtagagttta

SEQ ID NO: 259845 - DNA, 16 bp, Homo sapiens
gtcaccgccatgcaac

SEQ ID NO: 259846 - DNA, 24 bp, Homo sapiens
gtcacctcaaatttaagtcgggaa

SEQ ID NO: 259847 - DNA, 13 bp, Homo sapiens
gtcacctcctcca

SEQ ID NO: 259848 - DNA, 14 bp, Homo sapiens
gtcacctcctccac

SEQ ID NO: 259849 - DNA, 23 bp, Homo sapiens
gtcacctgacctctgaagagctg

SEQ ID NO: 259850 - DNA, 14 bp, Homo sapiens
gtcacctgcaagcc

SEQ ID NO: 259851 - DNA, 22 bp, Homo sapiens
gtcacctgcaagccccagggcc

SEQ ID NO: 259852 - DNA, 23 bp, Homo sapiens
gtcacctgcaagccccagggcct

SEQ ID NO: 259853 - DNA, 12 bp, Homo sapiens
gtcacctgctgg

SEQ ID NO: 259854 - DNA, 19 bp, Homo sapiens
gtcaccttccaggacccct

SEQ ID NO: 259855 - DNA, 17 bp, Homo sapiens
gtcaccttcctgggcag

SEQ ID NO: 259856 - DNA, 22 bp, Homo sapiens
gtcaccttcctgggcagcccag

SEQ ID NO: 259857 - DNA, 13 bp, Homo sapiens
gtcacgctttcat

SEQ ID NO: 259858 - DNA, 19 bp, Homo sapiens
gtcacgctttcatgaccac

SEQ ID NO: 259859 - DNA, 17 bp, Homo sapiens
gtcacgtgtaggagtga

SEQ ID NO: 259860 - DNA, 17 bp, Homo sapiens
gtcacgtgtattttcat

SEQ ID NO: 259861 - DNA, 18 bp, Homo sapiens
gtcactacaaaaatacaa

SEQ ID NO: 259862 - DNA, 14 bp, Homo sapiens
gtcactcagctgag

SEQ ID NO: 259863 - DNA, 15 bp, Homo sapiens
gtcactcagctgaga

SEQ ID NO: 259864 - DNA, 23 bp, Homo sapiens
gtcactcagctgagaaggccagc

SEQ ID NO: 259865 - DNA, 12 bp, Homo sapiens
gtcactcctggg

SEQ ID NO: 259866 - DNA, 13 bp, Homo sapiens
gtcactcctgggg

SEQ ID NO: 259867 - DNA, 16 bp, Homo sapiens
gtcactctgcctctaa

SEQ ID NO: 259868 - DNA, 16 bp, Homo sapiens
gtcactgccatggagg

SEQ ID NO: 259869 - DNA, 20 bp, Homo sapiens
gtcactgtactgacttgagg

SEQ ID NO: 259870 - DNA, 15 bp, Homo sapiens
gtcacttatttcata

SEQ ID NO: 259871 - DNA, 12 bp, Homo sapiens
gtcacttctgct

SEQ ID NO: 259872 - DNA, 19 bp, Homo sapiens
gtcacttctgctgtacaga

SEQ ID NO: 259873 - DNA, 16 bp, Homo sapiens
gtcactttgctctggg

SEQ ID NO: 259874 - DNA, 23 bp, Homo sapiens
gtcactttgctctgggtggaagt

SEQ ID NO: 259875 - DNA, 23 bp, Homo sapiens
gtcagaaaccattgttcagaaga

SEQ ID NO: 259876 - DNA, 16 bp, Homo sapiens
gtcagactttaaagaa

SEQ ID NO: 259877 - DNA, 17 bp, Homo sapiens
gtcagagccctggctgg

SEQ ID NO: 259878 - DNA, 23 bp, Homo sapiens
gtcagagccctggctgggttcag

SEQ ID NO: 259879 - DNA, 12 bp, Homo sapiens
gtcagagctggg

SEQ ID NO: 259880 - DNA, 15 bp, Homo sapiens
gtcagagctgggagt

SEQ ID NO: 259881 - DNA, 22 bp, Homo sapiens
gtcagagggactgtcagctgag

SEQ ID NO: 259882 - DNA, 15 bp, Homo sapiens
gtcagatgagcaagg

SEQ ID NO: 259883 - DNA, 19 bp, Homo sapiens
gtcagatgagcaaggacat

SEQ ID NO: 259884 - DNA, 23 bp, Homo sapiens
gtcagatgagcaaggacattgcc

SEQ ID NO: 259885 - DNA, 21 bp, Homo sapiens
gtcagatggaggttctcagag

SEQ ID NO: 259886 - DNA, 22 bp, Homo sapiens
gtcagatggaggttctcagagc

SEQ ID NO: 259887 - DNA, 21 bp, Homo sapiens
gtcagatttccagtctccacc

SEQ ID NO: 259888 - DNA, 14 bp, Homo sapiens
gtcagcagaaaccc

SEQ ID NO: 259889 - DNA, 15 bp, Homo sapiens
gtcagcagagccgcc

SEQ ID NO: 259890 - DNA, 15 bp, Homo sapiens
gtcagccaaatgact

SEQ ID NO: 259891 - DNA, 13 bp, Homo sapiens
gtcagccacatgg

SEQ ID NO: 259892 - DNA, 19 bp, Homo sapiens
gtcagcccgaatgcctgtc

SEQ ID NO: 259893 - DNA, 21 bp, Homo sapiens
gtcagcgcaggtttagtttac

SEQ ID NO: 259894 - DNA, 16 bp, Homo sapiens
gtcagctcccttctct

SEQ ID NO: 259895 - DNA, 16 bp, Homo sapiens
gtcagctctggccaca

SEQ ID NO: 259896 - DNA, 13 bp, Homo sapiens
gtcagctgtagaa

SEQ ID NO: 259897 - DNA, 17 bp, Homo sapiens
gtcagctgtagaaaggt

SEQ ID NO: 259898 - DNA, 13 bp, Homo sapiens
gtcagcttcccaa

SEQ ID NO: 259899 - DNA, 20 bp, Homo sapiens
gtcagcttgctgccctaggc

SEQ ID NO: 259900 - DNA, 18 bp, Homo sapiens
gtcagcttttgttgttta

SEQ ID NO: 259901 - DNA, 16 bp, Homo sapiens
gtcaggaacagtggct

SEQ ID NO: 259902 - DNA, 22 bp, Homo sapiens
gtcaggaacagtggctgggtgg

SEQ ID NO: 259903 - DNA, 13 bp, Homo sapiens
gtcaggaggtgcc

SEQ ID NO: 259904 - DNA, 17 bp, Homo sapiens
gtcaggaggtgcctgag

SEQ ID NO: 259905 - DNA, 21 bp, Homo sapiens
gtcaggagttgtttctgaccc

SEQ ID NO: 259906 - DNA, 17 bp, Homo sapiens
gtcaggctccattagga

SEQ ID NO: 259907 - DNA, 16 bp, Homo sapiens
gtcagggaccaaggac

SEQ ID NO: 259908 - DNA, 15 bp, Homo sapiens
gtcagggagccctgg

SEQ ID NO: 259909 - DNA, 14 bp, Homo sapiens
gtcaggggggagaa

SEQ ID NO: 259910 - DNA, 13 bp, Homo sapiens
gtcagggtggctg

SEQ ID NO: 259911 - DNA, 13 bp, Homo sapiens
gtcagtacccacc

SEQ ID NO: 259912 - DNA, 19 bp, Homo sapiens
gtcagtacccacctgagct

SEQ ID NO: 259913 - DNA, 14 bp, Homo sapiens
gtcagtaggagagg

SEQ ID NO: 259914 - DNA, 20 bp, Homo sapiens
gtcagtaggtccaagggcca

SEQ ID NO: 259915 - DNA, 21 bp, Homo sapiens
gtcagtaggtccaagggccat

SEQ ID NO: 259916 - DNA, 16 bp, Homo sapiens
gtcagtatcaggcctg

SEQ ID NO: 259917 - DNA, 21 bp, Homo sapiens
gtcagtcttcacttgcactgg

SEQ ID NO: 259918 - DNA, 18 bp, Homo sapiens
gtcagtgaagcccaggag

SEQ ID NO: 259919 - DNA, 16 bp, Homo sapiens
gtcagtgcagcccgtg

SEQ ID NO: 259920 - DNA, 16 bp, Homo sapiens
gtcagtgtgccaccct

SEQ ID NO: 259921 - DNA, 19 bp, Homo sapiens
gtcagttcccggagcacag

SEQ ID NO: 259922 - DNA, 20 bp, Homo sapiens
gtcagttcccggagcacagc

SEQ ID NO: 259923 - DNA, 18 bp, Homo sapiens
gtcagttggagaaaatga

SEQ ID NO: 259924 - DNA, 13 bp, Homo sapiens
gtcagtttgtgaa

SEQ ID NO: 259925 - DNA, 19 bp, Homo sapiens
gtcagtttgtgaagtgatt

SEQ ID NO: 259926 - DNA, 18 bp, Homo sapiens
gtcataactaaataaagc

SEQ ID NO: 259927 - DNA, 23 bp, Homo sapiens
gtcatcaatccaggatgttattc

SEQ ID NO: 259928 - DNA, 14 bp, Homo sapiens
gtcatcactccctg

SEQ ID NO: 259929 - DNA, 15 bp, Homo sapiens
gtcatcacttttcag

SEQ ID NO: 259930 - DNA, 16 bp, Homo sapiens
gtcatcacttttcagt

SEQ ID NO: 259931 - DNA, 15 bp, Homo sapiens
gtcatcagtaagtat

SEQ ID NO: 259932 - DNA, 16 bp, Homo sapiens
gtcatcagtattgtgt

SEQ ID NO: 259933 - DNA, 21 bp, Homo sapiens
gtcatcagtattgtgtaaagg

SEQ ID NO: 259934 - DNA, 15 bp, Homo sapiens
gtcatcataaaaggt

SEQ ID NO: 259935 - DNA, 21 bp, Homo sapiens
gtcatcattgtatatatgtgt

SEQ ID NO: 259936 - DNA, 20 bp, Homo sapiens
gtcatccacacaacaccagg

SEQ ID NO: 259937 - DNA, 18 bp, Homo sapiens
gtcatcccagcacctgcc

SEQ ID NO: 259938 - DNA, 17 bp, Homo sapiens
gtcatctcattccactg

SEQ ID NO: 259939 - DNA, 18 bp, Homo sapiens
gtcatctcattccactgt

SEQ ID NO: 259940 - DNA, 22 bp, Homo sapiens
gtcccccaaggttttggagtca

SEQ ID NO: 259941 - DNA, 22 bp, Homo sapiens
gtcccccacgtggactctgtgc

SEQ ID NO: 259942 - DNA, 18 bp, Homo sapiens
gtcccccatgccaccacc

SEQ ID NO: 259943 - DNA, 22 bp, Homo sapiens
gtccccccaggtgctggaggca

SEQ ID NO: 259944 - DNA, 15 bp, Homo sapiens
gtcccccctgagtgg

SEQ ID NO: 259945 - DNA, 19 bp, Homo sapiens
gtcccccctgagtgggctg

SEQ ID NO: 259946 - DNA, 15 bp, Homo sapiens
gtccccctacccacc

SEQ ID NO: 259947 - DNA, 16 bp, Homo sapiens
gtccccctacccaccg

SEQ ID NO: 259948 - DNA, 19 bp, Homo sapiens
gtccccctcccctcccagt

SEQ ID NO: 259949 - DNA, 23 bp, Homo sapiens
gtccccctcccctcccagtcctc

SEQ ID NO: 259950 - DNA, 20 bp, Homo sapiens
gtccccgagccgagctctcc

SEQ ID NO: 259951 - DNA, 15 bp, Homo sapiens
gtccccgccttccct

SEQ ID NO: 259952 - DNA, 16 bp, Homo sapiens
gtccccggacgctggc

SEQ ID NO: 259953 - DNA, 17 bp, Homo sapiens
gtccccggacgctggct

SEQ ID NO: 259954 - DNA, 15 bp, Homo sapiens
gtccccgtgccccgc

SEQ ID NO: 259955 - DNA, 20 bp, Homo sapiens
gtccccgtgtgccccaagag

SEQ ID NO: 259956 - DNA, 17 bp, Homo sapiens
gtcccctccgccgtgcc

SEQ ID NO: 259957 - DNA, 22 bp, Homo sapiens
gtcccctctgtcatcactccct

SEQ ID NO: 259958 - DNA, 23 bp, Homo sapiens
gtcccctctgtcatcactccctg

SEQ ID NO: 259959 - DNA, 14 bp, Homo sapiens
gtcccctgggccac

SEQ ID NO: 259960 - DNA, 18 bp, Homo sapiens
gtcccctgggccaccctt

SEQ ID NO: 259961 - DNA, 16 bp, Homo sapiens
gtccccttccaggggt

SEQ ID NO: 259962 - DNA, 17 bp, Homo sapiens
gtcccgagccccctgtc

SEQ ID NO: 259963 - DNA, 19 bp, Homo sapiens
gtcccgagccccctgtcct

SEQ ID NO: 259964 - DNA, 14 bp, Homo sapiens
gtcccgccttcctc

SEQ ID NO: 259965 - DNA, 22 bp, Homo sapiens
ctgatgttttgatgccatttgt

SEQ ID NO: 259966 - DNA, 15 bp, Homo sapiens
ctgatgtttttccca

SEQ ID NO: 259967 - DNA, 22 bp, Homo sapiens
ctgattaaatttaatatactgc

SEQ ID NO: 259968 - DNA, 20 bp, Homo sapiens
ctgattaatccattttaaca

SEQ ID NO: 259969 - DNA, 11 bp, Homo sapiens
ctgattagaaa

SEQ ID NO: 259970 - DNA, 19 bp, Homo sapiens
ctgattagaaatgaccaat

SEQ ID NO: 259971 - DNA, 14 bp, Homo sapiens
ctgattattgaatg

SEQ ID NO: 259972 - DNA, 21 bp, Homo sapiens
ctgattcaataaaatgcactg

SEQ ID NO: 259973 - DNA, 22 bp, Homo sapiens
ctgattcaataaaatgcactga

SEQ ID NO: 259974 - DNA, 12 bp, Homo sapiens
ctgattcccaga

SEQ ID NO: 259975 - DNA, 14 bp, Homo sapiens
ctgattctccctgg

SEQ ID NO: 259976 - DNA, 12 bp, Homo sapiens
ctgattgctctg

SEQ ID NO: 259977 - DNA, 18 bp, Homo sapiens
ctgattgctctggaagcc

SEQ ID NO: 259978 - DNA, 18 bp, Homo sapiens
ctgattggtccaacagtt

SEQ ID NO: 259979 - DNA, 21 bp, Homo sapiens
ctgattgtggatcttttcatt

SEQ ID NO: 259980 - DNA, 13 bp, Homo sapiens
ctgatttcacaac

SEQ ID NO: 259981 - DNA, 13 bp, Homo sapiens
ctgatttccaggc

SEQ ID NO: 259982 - DNA, 15 bp, Homo sapiens
ctgatttccaggccc

SEQ ID NO: 259983 - DNA, 12 bp, Homo sapiens
ctgatttccctt

SEQ ID NO: 259984 - DNA, 14 bp, Homo sapiens
ctgatttccctttt

SEQ ID NO: 259985 - DNA, 14 bp, Homo sapiens
ctgatttcttgctt

SEQ ID NO: 259986 - DNA, 14 bp, Homo sapiens
ctgattttcaaaat

SEQ ID NO: 259987 - DNA, 16 bp, Homo sapiens
ctgcaaaaagtacata

SEQ ID NO: 259988 - DNA, 13 bp, Homo sapiens
ctgcaaaatctgt

SEQ ID NO: 259989 - DNA, 13 bp, Homo sapiens
ctgcaaaattacc

SEQ ID NO: 259990 - DNA, 22 bp, Homo sapiens
ctgcaaagatgattttgctttt

SEQ ID NO: 259991 - DNA, 16 bp, Homo sapiens
ctgcaaaggacagatc

SEQ ID NO: 259992 - DNA, 13 bp, Homo sapiens
ctgcaaaggaggg

SEQ ID NO: 259993 - DNA, 16 bp, Homo sapiens
ctgcaaaggagggcct

SEQ ID NO: 259994 - DNA, 20 bp, Homo sapiens
ctgcaaaggagggcctcaga

SEQ ID NO: 259995 - DNA, 20 bp, Homo sapiens
ctgcaaatagaaaacaggaa

SEQ ID NO: 259996 - DNA, 14 bp, Homo sapiens
ctgcaacagcctgt

SEQ ID NO: 259997 - DNA, 15 bp, Homo sapiens
ctgcaacagcctgtt

SEQ ID NO: 259998 - DNA, 15 bp, Homo sapiens
ctgcaacctctgcct

SEQ ID NO: 259999 - DNA, 13 bp, Homo sapiens
ctgcaagccccag

SEQ ID NO: 260000 - DNA, 18 bp, Homo sapiens
ctgcaagccccagggcct

SEQ ID NO: 260001 - DNA, 22 bp, Homo sapiens
ctgcaagccccagggcctgggg

SEQ ID NO: 260002 - DNA, 22 bp, Homo sapiens
ctgcaagtccatagctgagctg

SEQ ID NO: 260003 - DNA, 19 bp, Homo sapiens
ctgcaagtgagcaaacctg

SEQ ID NO: 260004 - DNA, 12 bp, Homo sapiens
ctgcaagttcaa

SEQ ID NO: 260005 - DNA, 17 bp, Homo sapiens
ctgcaatacattaaaat

SEQ ID NO: 260006 - DNA, 18 bp, Homo sapiens
ctgcaatagagactgtag

SEQ ID NO: 260007 - DNA, 19 bp, Homo sapiens
ctgcaatagagactgtaga

SEQ ID NO: 260008 - DNA, 20 bp, Homo sapiens
ctgcaatagagactgtagat

SEQ ID NO: 260009 - DNA, 21 bp, Homo sapiens
ctgcaatatcaacaacaagtt

SEQ ID NO: 260010 - DNA, 13 bp, Homo sapiens
ctgcaatctccag

SEQ ID NO: 260011 - DNA, 15 bp, Homo sapiens
ctgcaatctccaggg

SEQ ID NO: 260012 - DNA, 15 bp, Homo sapiens
ctgcaatgcctagac

SEQ ID NO: 260013 - DNA, 16 bp, Homo sapiens
ctgcaatgttttcctt

SEQ ID NO: 260014 - DNA, 15 bp, Homo sapiens
ctgcacacacagctc

SEQ ID NO: 260015 - DNA, 16 bp, Homo sapiens
ctgcacacacagctcc

SEQ ID NO: 260016 - DNA, 15 bp, Homo sapiens
ctgcacacataacac

SEQ ID NO: 260017 - DNA, 19 bp, Homo sapiens
ctgcacacataacacacat

SEQ ID NO: 260018 - DNA, 12 bp, Homo sapiens
ctgcacagatgg

SEQ ID NO: 260019 - DNA, 13 bp, Homo sapiens
ctgcacagatgga

SEQ ID NO: 260020 - DNA, 14 bp, Homo sapiens
ctgcacagcccaac

SEQ ID NO: 260021 - DNA, 18 bp, Homo sapiens
ctgcacagcccaaccagg

SEQ ID NO: 260022 - DNA, 19 bp, Homo sapiens
ctgcacagcccaaccagga

SEQ ID NO: 260023 - DNA, 20 bp, Homo sapiens
ctgcacagcccaaccaggag

SEQ ID NO: 260024 - DNA, 21 bp, Homo sapiens
ctgcacagcccaaccaggagg

SEQ ID NO: 260025 - DNA, 14 bp, Homo sapiens
ctgcacagtgctgt

SEQ ID NO: 260026 - DNA, 18 bp, Homo sapiens
ctgcacagtgctgttggt

SEQ ID NO: 260027 - DNA, 18 bp, Homo sapiens
ctgcacattcctggcccc

SEQ ID NO: 260028 - DNA, 14 bp, Homo sapiens
ctgcaccaggagac

SEQ ID NO: 260029 - DNA, 15 bp, Homo sapiens
ctgcaccaggagaca

SEQ ID NO: 260030 - DNA, 16 bp, Homo sapiens
ctgcacccacccctgc

SEQ ID NO: 260031 - DNA, 18 bp, Homo sapiens
ctgcacccacccctgccc

SEQ ID NO: 260032 - DNA, 22 bp, Homo sapiens
ctgcacccacccctgcccaggc

SEQ ID NO: 260033 - DNA, 15 bp, Homo sapiens
ctgcacccagctcca

SEQ ID NO: 260034 - DNA, 12 bp, Homo sapiens
ctgcaccccagc

SEQ ID NO: 260035 - DNA, 18 bp, Homo sapiens
ctgcaccccagcattcca

SEQ ID NO: 260036 - DNA, 23 bp, Homo sapiens
ctgcaccccagcattccagctct

SEQ ID NO: 260037 - DNA, 16 bp, Homo sapiens
ctgcaccctctgctat

SEQ ID NO: 260038 - DNA, 16 bp, Homo sapiens
ctgcaccctggggcct

SEQ ID NO: 260039 - DNA, 21 bp, Homo sapiens
ctgcaccctggggcctggacc

SEQ ID NO: 260040 - DNA, 22 bp, Homo sapiens
ctgcaccctggggcctggacct

SEQ ID NO: 260041 - DNA, 23 bp, Homo sapiens
ctgcaccctggggcctggacctg

SEQ ID NO: 260042 - DNA, 19 bp, Homo sapiens
ctgcaccctgtatggagct

SEQ ID NO: 260043 - DNA, 13 bp, Homo sapiens
ctgcacctgaggc

SEQ ID NO: 260044 - DNA, 23 bp, Homo sapiens
ctgcacctgtctcatagcctcga

SEQ ID NO: 260045 - DNA, 14 bp, Homo sapiens
ctgcaccttgggca

SEQ ID NO: 260046 - DNA, 15 bp, Homo sapiens
ctgcaccttgggcac

SEQ ID NO: 260047 - DNA, 18 bp, Homo sapiens
ctgcacgccgtggagcat

SEQ ID NO: 260048 - DNA, 16 bp, Homo sapiens
ctgcactactcctctg

SEQ ID NO: 260049 - DNA, 23 bp, Homo sapiens
ctgcactactcctctgcagtgcc

SEQ ID NO: 260050 - DNA, 14 bp, Homo sapiens
ctgcactactgaca

SEQ ID NO: 260051 - DNA, 16 bp, Homo sapiens
ctgcactactgacatg

SEQ ID NO: 260052 - DNA, 21 bp, Homo sapiens
ctgcactatagccatttgccc

SEQ ID NO: 260053 - DNA, 19 bp, Homo sapiens
ctgcactccagcctgggca

SEQ ID NO: 260054 - DNA, 20 bp, Homo sapiens
ctgcactccagcctgggtga

SEQ ID NO: 260055 - DNA, 12 bp, Homo sapiens
ctgcactccatg

SEQ ID NO: 260056 - DNA, 14 bp, Homo sapiens
ctgcactccatggc

SEQ ID NO: 260057 - DNA, 15 bp, Homo sapiens
ctgcactccatggcc

SEQ ID NO: 260058 - DNA, 21 bp, Homo sapiens
ctgcactccatggccaccccg

SEQ ID NO: 260059 - DNA, 12 bp, Homo sapiens
ctgcactgcagt

SEQ ID NO: 260060 - DNA, 18 bp, Homo sapiens
ctgcactgtaaaatgtgg

SEQ ID NO: 260061 - DNA, 15 bp, Homo sapiens
ctgcacttcatatct

SEQ ID NO: 260062 - DNA, 16 bp, Homo sapiens
ctgcacttcatatcta

SEQ ID NO: 260063 - DNA, 17 bp, Homo sapiens
ctgcacttggtgctgct

SEQ ID NO: 260064 - DNA, 18 bp, Homo sapiens
ctgcactttagtgtattt

SEQ ID NO: 260065 - DNA, 13 bp, Homo sapiens
ctgcagagctggg

SEQ ID NO: 260066 - DNA, 21 bp, Homo sapiens
ctgcagagctggggggaaggc

SEQ ID NO: 260067 - DNA, 14 bp, Homo sapiens
ctgcagaggaccac

SEQ ID NO: 260068 - DNA, 14 bp, Homo sapiens
ctgcagaggagcca

SEQ ID NO: 260069 - DNA, 20 bp, Homo sapiens
ctgcagaggcagcaggagcc

SEQ ID NO: 260070 - DNA, 16 bp, Homo sapiens
ctgcagatttctcacc

SEQ ID NO: 260071 - DNA, 20 bp, Homo sapiens
gtctgacatcctgacctcct

SEQ ID NO: 260072 - DNA, 13 bp, Homo sapiens
gtctgactccaga

SEQ ID NO: 260073 - DNA, 17 bp, Homo sapiens
gtctgactccagagtct

SEQ ID NO: 260074 - DNA, 18 bp, Homo sapiens
gtctgactccagagtctg

SEQ ID NO: 260075 - DNA, 21 bp, Homo sapiens
gtctgactccagagtctgagc

SEQ ID NO: 260076 - DNA, 13 bp, Homo sapiens
gtctgagctgctg

SEQ ID NO: 260077 - DNA, 13 bp, Homo sapiens
gtctgaggcctca

SEQ ID NO: 260078 - DNA, 17 bp, Homo sapiens
gtctgatgtgtgcccag

SEQ ID NO: 260079 - DNA, 20 bp, Homo sapiens
gtctgatgtgtgcccagatc

SEQ ID NO: 260080 - DNA, 13 bp, Homo sapiens
gtctgatgttttg

SEQ ID NO: 260081 - DNA, 12 bp, Homo sapiens
gtctgattctat

SEQ ID NO: 260082 - DNA, 13 bp, Homo sapiens
gtctgattctatg

SEQ ID NO: 260083 - DNA, 11 bp, Homo sapiens
gtctgcacaca

SEQ ID NO: 260084 - DNA, 20 bp, Homo sapiens
gtctgcacacataacacaca

SEQ ID NO: 260085 - DNA, 14 bp, Homo sapiens
gtctgcaggccacc

SEQ ID NO: 260086 - DNA, 15 bp, Homo sapiens
gtctgcaggccacca

SEQ ID NO: 260087 - DNA, 17 bp, Homo sapiens
gtctgcaggccaccagc

SEQ ID NO: 260088 - DNA, 17 bp, Homo sapiens
gtctgcatggcagaagc

SEQ ID NO: 260089 - DNA, 18 bp, Homo sapiens
gtctgcatggcagaagcg

SEQ ID NO: 260090 - DNA, 18 bp, Homo sapiens
gtctgcattgttattgtg

SEQ ID NO: 260091 - DNA, 16 bp, Homo sapiens
gtctgcattttctcag

SEQ ID NO: 260092 - DNA, 21 bp, Homo sapiens
gtctgccaggcccatctcagg

SEQ ID NO: 260093 - DNA, 9 bp, Homo sapiens
gtctgcccc

SEQ ID NO: 260094 - DNA, 13 bp, Homo sapiens
gtctgccccaccc

SEQ ID NO: 260095 - DNA, 11 bp, Homo sapiens
gtctgcccctt

SEQ ID NO: 260096 - DNA, 16 bp, Homo sapiens
gtctgccccttgaccc

SEQ ID NO: 260097 - DNA, 21 bp, Homo sapiens
gtctgccccttgaccccacac

SEQ ID NO: 260098 - DNA, 17 bp, Homo sapiens
gtctgcctaggagctgg

SEQ ID NO: 260099 - DNA, 22 bp, Homo sapiens
gtctgcctaggagctggctggc

SEQ ID NO: 260100 - DNA, 13 bp, Homo sapiens
gtctgcctcccac

SEQ ID NO: 260101 - DNA, 13 bp, Homo sapiens
gtctgcctgtatt

SEQ ID NO: 260102 - DNA, 18 bp, Homo sapiens
gtctgcgccgctgtgctg

SEQ ID NO: 260103 - DNA, 17 bp, Homo sapiens
gtctgctatattttcat

SEQ ID NO: 260104 - DNA, 14 bp, Homo sapiens
gtctgctctgtgcc

SEQ ID NO: 260105 - DNA, 17 bp, Homo sapiens
gtctgctctgtgcctgg

SEQ ID NO: 260106 - DNA, 15 bp, Homo sapiens
gtctgctctttctct

SEQ ID NO: 260107 - DNA, 19 bp, Homo sapiens
gtctgctctttctctgcca

SEQ ID NO: 260108 - DNA, 11 bp, Homo sapiens
gtctgctgctc

SEQ ID NO: 260109 - DNA, 16 bp, Homo sapiens
gtctgctgctgcctcc

SEQ ID NO: 260110 - DNA, 21 bp, Homo sapiens
gtctgctgctgcctccctggg

SEQ ID NO: 260111 - DNA, 14 bp, Homo sapiens
gtctgcttaccaaa

SEQ ID NO: 260112 - DNA, 16 bp, Homo sapiens
aaagaatccctgttca

SEQ ID NO: 260113 - DNA, 14 bp, Homo sapiens
aaagaatgagaaag

SEQ ID NO: 260114 - DNA, 21 bp, Homo sapiens
aaagaattaaacccacaagct

SEQ ID NO: 260115 - DNA, 20 bp, Homo sapiens
aaagaattatttttgtgttt

SEQ ID NO: 260116 - DNA, 21 bp, Homo sapiens
aaagaatttcaatttgttcag

SEQ ID NO: 260117 - DNA, 15 bp, Homo sapiens
aaagacaaagaagga

SEQ ID NO: 260118 - DNA, 13 bp, Homo sapiens
aaagacacttcaa

SEQ ID NO: 260119 - DNA, 13 bp, Homo sapiens
aaagacaggaaga

SEQ ID NO: 260120 - DNA, 17 bp, Homo sapiens
aaagaccaaattttgag

SEQ ID NO: 260121 - DNA, 22 bp, Homo sapiens
aaagacctttggagcaaagctg

SEQ ID NO: 260122 - DNA, 22 bp, Homo sapiens
aaagactcctttcctgcatctt

SEQ ID NO: 260123 - DNA, 12 bp, Homo sapiens
aaagactgtact

SEQ ID NO: 260124 - DNA, 11 bp, Homo sapiens
aaagacttaag

SEQ ID NO: 260125 - DNA, 19 bp, Homo sapiens
aaagacttaagattaaatt

SEQ ID NO: 260126 - DNA, 14 bp, Homo sapiens
aaagacttaatcat

SEQ ID NO: 260127 - DNA, 19 bp, Homo sapiens
aaagacttaatcatatcaa

SEQ ID NO: 260128 - DNA, 14 bp, Homo sapiens
aaagacttgatgaa

SEQ ID NO: 260129 - DNA, 19 bp, Homo sapiens
aaagagaaaggggcaagaa

SEQ ID NO: 260130 - DNA, 13 bp, Homo sapiens
aaagagaagaaag

SEQ ID NO: 260131 - DNA, 19 bp, Homo sapiens
aaagagaattagattatat

SEQ ID NO: 260132 - DNA, 11 bp, Homo sapiens
aaagagagagc

SEQ ID NO: 260133 - DNA, 22 bp, Homo sapiens
aaagagcacttcacacagacaa

SEQ ID NO: 260134 - DNA, 15 bp, Homo sapiens
aaagagccaagttca

SEQ ID NO: 260135 - DNA, 11 bp, Homo sapiens
aaagagctgcc

SEQ ID NO: 260136 - DNA, 13 bp, Homo sapiens
aaagagctgccta

SEQ ID NO: 260137 - DNA, 16 bp, Homo sapiens
aaagagctgttttgga

SEQ ID NO: 260138 - DNA, 13 bp, Homo sapiens
aaagaggagaagg

SEQ ID NO: 260139 - DNA, 19 bp, Homo sapiens
aaagaggcgtcttgtattt

SEQ ID NO: 260140 - DNA, 22 bp, Homo sapiens
aaagaggcgtcttgtattttct

SEQ ID NO: 260141 - DNA, 13 bp, Homo sapiens
aaagaggctatgt

SEQ ID NO: 260142 - DNA, 22 bp, Homo sapiens
aaagagtcttaattttctaaaa

SEQ ID NO: 260143 - DNA, 17 bp, Homo sapiens
aaagagtgtgctcggga

SEQ ID NO: 260144 - DNA, 13 bp, Homo sapiens
aaagagttaagaa

SEQ ID NO: 260145 - DNA, 24 bp, Homo sapiens
aaagagttctggaaaagaactgtt

SEQ ID NO: 260146 - DNA, 15 bp, Homo sapiens
aaagagttgagcaca

SEQ ID NO: 260147 - DNA, 17 bp, Homo sapiens
aaagagttgagcacagg

SEQ ID NO: 260148 - DNA, 17 bp, Homo sapiens
aaagataacgcaggaga

SEQ ID NO: 260149 - DNA, 16 bp, Homo sapiens
aaagatacatttgtat

SEQ ID NO: 260150 - DNA, 22 bp, Homo sapiens
aaagatacgactttattttctg

SEQ ID NO: 260151 - DNA, 22 bp, Homo sapiens
aaagatacttgatgcacttatt

SEQ ID NO: 260152 - DNA, 18 bp, Homo sapiens
aaagatatctatgactgt

SEQ ID NO: 260153 - DNA, 14 bp, Homo sapiens
aaagatcaaaataa

SEQ ID NO: 260154 - DNA, 16 bp, Homo sapiens
aaagatcaaaataaaa

SEQ ID NO: 260155 - DNA, 20 bp, Homo sapiens
aaagatcaaaataaaaagtg

SEQ ID NO: 260156 - DNA, 16 bp, Homo sapiens
aaagatgcagccgcct

SEQ ID NO: 260157 - DNA, 20 bp, Homo sapiens
aaagatggatttgacacact

SEQ ID NO: 260158 - DNA, 12 bp, Homo sapiens
aaagatggcctt

SEQ ID NO: 260159 - DNA, 22 bp, Homo sapiens
aaagatggctgtgcctctgcct

SEQ ID NO: 260160 - DNA, 17 bp, Homo sapiens
aaagatgtactgagagg

SEQ ID NO: 260161 - DNA, 17 bp, Homo sapiens
aaagattccattttata

SEQ ID NO: 260162 - DNA, 22 bp, Homo sapiens
aaagattccattttatacaaga

SEQ ID NO: 260163 - DNA, 14 bp, Homo sapiens
aaagattctttaaa

SEQ ID NO: 260164 - DNA, 17 bp, Homo sapiens
aaagatttaatgttaca

SEQ ID NO: 260165 - DNA, 14 bp, Homo sapiens
aaagattttcagaa

SEQ ID NO: 260166 - DNA, 15 bp, Homo sapiens
aaagattttcagaaa

SEQ ID NO: 260167 - DNA, 15 bp, Homo sapiens
aaagatttttgttaa

SEQ ID NO: 260168 - DNA, 15 bp, Homo sapiens
aaagcaaaaaataaa

SEQ ID NO: 260169 - DNA, 21 bp, Homo sapiens
aaagcaaatatatttaggcca

SEQ ID NO: 260170 - DNA, 18 bp, Homo sapiens
aaagcaacatcagcttga

SEQ ID NO: 260171 - DNA, 21 bp, Homo sapiens
aaagcaacgactactttgcta

SEQ ID NO: 260172 - DNA, 19 bp, Homo sapiens
aaagcaattgccctgtaac

SEQ ID NO: 260173 - DNA, 19 bp, Homo sapiens
aaagcacaaaccctgggga

SEQ ID NO: 260174 - DNA, 23 bp, Homo sapiens
aaagcacagctctcactggccag

SEQ ID NO: 260175 - DNA, 20 bp, Homo sapiens
aaagcacagtgttaaatgaa

SEQ ID NO: 260176 - DNA, 19 bp, Homo sapiens
aaagcaccgcagcatgtgg

SEQ ID NO: 260177 - DNA, 22 bp, Homo sapiens
aaagcaccgcagcatgtgggga

SEQ ID NO: 260178 - DNA, 21 bp, Homo sapiens
aaagcacttggactcttgctc

SEQ ID NO: 260179 - DNA, 21 bp, Homo sapiens
aaagcagaggctggcctcaga

SEQ ID NO: 260180 - DNA, 17 bp, Homo sapiens
aaagcagtgcatgctgt

SEQ ID NO: 260181 - DNA, 11 bp, Homo sapiens
aaagcagtgtt

SEQ ID NO: 260182 - DNA, 15 bp, Homo sapiens
aaagcagttgggagt

SEQ ID NO: 260183 - DNA, 18 bp, Homo sapiens
aaagcataagtatacagt

SEQ ID NO: 260184 - DNA, 17 bp, Homo sapiens
aaagcatgccaatttct

SEQ ID NO: 260185 - DNA, 18 bp, Homo sapiens
aaagcatgtctctgcttc

SEQ ID NO: 260186 - DNA, 19 bp, Homo sapiens
aaagcatgtctctgcttcc

SEQ ID NO: 260187 - DNA, 21 bp, Homo sapiens
aaagcatgtctctgcttccat

SEQ ID NO: 260188 - DNA, 10 bp, Homo sapiens
aaagccacat

SEQ ID NO: 260189 - DNA, 18 bp, Homo sapiens
aaagccacataaccagcg

SEQ ID NO: 260190 - DNA, 17 bp, Homo sapiens
aaagccacctctccctc

SEQ ID NO: 260191 - DNA, 19 bp, Homo sapiens
aaagccagtgactccagga

SEQ ID NO: 260192 - DNA, 14 bp, Homo sapiens
aaagccatattcca

SEQ ID NO: 260193 - DNA, 15 bp, Homo sapiens
aaagccatattccag

SEQ ID NO: 260194 - DNA, 18 bp, Homo sapiens
aaagccattgaccaccca

SEQ ID NO: 260195 - DNA, 12 bp, Homo sapiens
aaagcccacctg

SEQ ID NO: 260196 - DNA, 13 bp, Homo sapiens
aaagcccagcccg

SEQ ID NO: 260197 - DNA, 19 bp, Homo sapiens
aaagcccctcacctcagga

SEQ ID NO: 260198 - DNA, 13 bp, Homo sapiens
aaagcctgcaatt

SEQ ID NO: 260199 - DNA, 18 bp, Homo sapiens
aaagccttaaaatgcatt

SEQ ID NO: 260200 - DNA, 14 bp, Homo sapiens
aaagcggggggagg

SEQ ID NO: 260201 - DNA, 23 bp, Homo sapiens
aaagctaaaatgattttatctgt

SEQ ID NO: 260202 - DNA, 17 bp, Homo sapiens
ctgccccgtgcagactg

SEQ ID NO: 260203 - DNA, 19 bp, Homo sapiens
ctgccccgtgcagactgga

SEQ ID NO: 260204 - DNA, 15 bp, Homo sapiens
ctgccccgttccctg

SEQ ID NO: 260205 - DNA, 18 bp, Homo sapiens
ctgccccgttccctgtca

SEQ ID NO: 260206 - DNA, 14 bp, Homo sapiens
ctgcccctcccttc

SEQ ID NO: 260207 - DNA, 17 bp, Homo sapiens
ctgcccctcccttcaac

SEQ ID NO: 260208 - DNA, 19 bp, Homo sapiens
ctgcccctccgtccccagg

SEQ ID NO: 260209 - DNA, 14 bp, Homo sapiens
ctgcccctgcccga

SEQ ID NO: 260210 - DNA, 18 bp, Homo sapiens
ctgcccctgcccgagagc

SEQ ID NO: 260211 - DNA, 18 bp, Homo sapiens
ctgcccctgccgcctgtg

SEQ ID NO: 260212 - DNA, 21 bp, Homo sapiens
ctgcccctgccgcctgtgccc

SEQ ID NO: 260213 - DNA, 17 bp, Homo sapiens
ctgcccctgtaggttgc

SEQ ID NO: 260214 - DNA, 18 bp, Homo sapiens
ctgccccttctacactct

SEQ ID NO: 260215 - DNA, 24 bp, Homo sapiens
ctgccccttctacactctcctggg

SEQ ID NO: 260216 - DNA, 20 bp, Homo sapiens
ctgccccttgaccccacacg

SEQ ID NO: 260217 - DNA, 16 bp, Homo sapiens
ctgcccgagagctctt

SEQ ID NO: 260218 - DNA, 17 bp, Homo sapiens
ctgcccgagctggtgca

SEQ ID NO: 260219 - DNA, 17 bp, Homo sapiens
ctgcccgcacaccctca

SEQ ID NO: 260220 - DNA, 22 bp, Homo sapiens
ctgcccgcacaccctcactctg

SEQ ID NO: 260221 - DNA, 15 bp, Homo sapiens
ctgcccgcacagcag

SEQ ID NO: 260222 - DNA, 16 bp, Homo sapiens
ctgcccgcacagcagc

SEQ ID NO: 260223 - DNA, 20 bp, Homo sapiens
ctgcccgcacagcagcctgc

SEQ ID NO: 260224 - DNA, 13 bp, Homo sapiens
ctgcccgcagagc

SEQ ID NO: 260225 - DNA, 15 bp, Homo sapiens
ctgcccgctgcaatg

SEQ ID NO: 260226 - DNA, 20 bp, Homo sapiens
ctgcccggggcagctgccag

SEQ ID NO: 260227 - DNA, 16 bp, Homo sapiens
ctgcccgttgccgggc

SEQ ID NO: 260228 - DNA, 20 bp, Homo sapiens
ctgcccgttgccgggcctgg

SEQ ID NO: 260229 - DNA, 21 bp, Homo sapiens
ctgccctagcgctctcttcca

SEQ ID NO: 260230 - DNA, 12 bp, Homo sapiens
ctgccctaggct

SEQ ID NO: 260231 - DNA, 19 bp, Homo sapiens
ctgccctcactccactccc

SEQ ID NO: 260232 - DNA, 14 bp, Homo sapiens
ctgccctcccatgt

SEQ ID NO: 260233 - DNA, 14 bp, Homo sapiens
ctgccctcccccac

SEQ ID NO: 260234 - DNA, 16 bp, Homo sapiens
ctgccctcccccacgg

SEQ ID NO: 260235 - DNA, 21 bp, Homo sapiens
ctgccctcccccacggccgtc

SEQ ID NO: 260236 - DNA, 18 bp, Homo sapiens
ctgccctccctccttcct

SEQ ID NO: 260237 - DNA, 16 bp, Homo sapiens
ctgccctccctggagc

SEQ ID NO: 260238 - DNA, 14 bp, Homo sapiens
ctgccctctccaca

SEQ ID NO: 260239 - DNA, 16 bp, Homo sapiens
ctgccctctccacacc

SEQ ID NO: 260240 - DNA, 17 bp, Homo sapiens
ctgccctctccacaccc

SEQ ID NO: 260241 - DNA, 11 bp, Homo sapiens
ctgccctgcca

SEQ ID NO: 260242 - DNA, 14 bp, Homo sapiens
ctgccctgccacct

SEQ ID NO: 260243 - DNA, 15 bp, Homo sapiens
ctgccctgccacctg

SEQ ID NO: 260244 - DNA, 18 bp, Homo sapiens
ctgccctgccacctgtct

SEQ ID NO: 260245 - DNA, 14 bp, Homo sapiens
ctgccctgcctccc

SEQ ID NO: 260246 - DNA, 13 bp, Homo sapiens
ctgccctggtgct

SEQ ID NO: 260247 - DNA, 15 bp, Homo sapiens
ctgccctggtgctgc

SEQ ID NO: 260248 - DNA, 18 bp, Homo sapiens
ctgccctggtgctgccac

SEQ ID NO: 260249 - DNA, 19 bp, Homo sapiens
ctgccctggtgctgccaca

SEQ ID NO: 260250 - DNA, 11 bp, Homo sapiens
ctgccctgtac

SEQ ID NO: 260251 - DNA, 16 bp, Homo sapiens
ctgccctgtccctgtc

SEQ ID NO: 260252 - DNA, 18 bp, Homo sapiens
ctgccctgtccctgtccc

SEQ ID NO: 260253 - DNA, 21 bp, Homo sapiens
ctgccctgttgtgtatagatg

SEQ ID NO: 260254 - DNA, 23 bp, Homo sapiens
gtgaagcagtgcctcgaggcacc

SEQ ID NO: 260255 - DNA, 16 bp, Homo sapiens
gtgaagcccaggagga

SEQ ID NO: 260256 - DNA, 23 bp, Homo sapiens
gtgaagccctttgcctgtagagc

SEQ ID NO: 260257 - DNA, 23 bp, Homo sapiens
gtgaagctggggacagctttcct

SEQ ID NO: 260258 - DNA, 19 bp, Homo sapiens
gtgaaggcccaagagcaga

SEQ ID NO: 260259 - DNA, 16 bp, Homo sapiens
gtgaaggtgacagcag

SEQ ID NO: 260260 - DNA, 16 bp, Homo sapiens
gtgaagtgaatgaaac

SEQ ID NO: 260261 - DNA, 15 bp, Homo sapiens
gtgaagtgattgaca

SEQ ID NO: 260262 - DNA, 14 bp, Homo sapiens
gtgaagtgtggctg

SEQ ID NO: 260263 - DNA, 15 bp, Homo sapiens
gtgaagttgtaaaca

SEQ ID NO: 260264 - DNA, 13 bp, Homo sapiens
gtgaataaaaacc

SEQ ID NO: 260265 - DNA, 15 bp, Homo sapiens
gtgaataaaaaccct

SEQ ID NO: 260266 - DNA, 16 bp, Homo sapiens
gtgaataataaataca

SEQ ID NO: 260267 - DNA, 13 bp, Homo sapiens
gtgaatacaatta

SEQ ID NO: 260268 - DNA, 15 bp, Homo sapiens
gtgaatacaattaaa

SEQ ID NO: 260269 - DNA, 12 bp, Homo sapiens
gtgaatacatgg

SEQ ID NO: 260270 - DNA, 17 bp, Homo sapiens
gtgaatataaatgtact

SEQ ID NO: 260271 - DNA, 13 bp, Homo sapiens
gtgaatccctcaa

SEQ ID NO: 260272 - DNA, 21 bp, Homo sapiens
gtgaatcgcaaggcctgtgct

SEQ ID NO: 260273 - DNA, 23 bp, Homo sapiens
gtgaatctgcattttctgggttc

SEQ ID NO: 260274 - DNA, 20 bp, Homo sapiens
gtgaatcttatggtggaaga

SEQ ID NO: 260275 - DNA, 21 bp, Homo sapiens
gtgaatcttatggtggaagag

SEQ ID NO: 260276 - DNA, 22 bp, Homo sapiens
gtgaatcttatggtggaagagg

SEQ ID NO: 260277 - DNA, 21 bp, Homo sapiens
gtgaatgagtaaataaactct

SEQ ID NO: 260278 - DNA, 14 bp, Homo sapiens
gtgaatgggaaagg

SEQ ID NO: 260279 - DNA, 17 bp, Homo sapiens
gtgaatgttgtcctgtg

SEQ ID NO: 260280 - DNA, 11 bp, Homo sapiens
gtgaattctgc

SEQ ID NO: 260281 - DNA, 18 bp, Homo sapiens
gtgaattcttgaaggaaa

SEQ ID NO: 260282 - DNA, 22 bp, Homo sapiens
gtgaattcttgaaggaaaatga

SEQ ID NO: 260283 - DNA, 19 bp, Homo sapiens
gtgaattgtgaccaagtta

SEQ ID NO: 260284 - DNA, 17 bp, Homo sapiens
gtgaatttaagcatgag

SEQ ID NO: 260285 - DNA, 14 bp, Homo sapiens
gtgaatttgaatga

SEQ ID NO: 260286 - DNA, 12 bp, Homo sapiens
gtgaattttaaa

SEQ ID NO: 260287 - DNA, 14 bp, Homo sapiens
gtgaattttaaaat

SEQ ID NO: 260288 - DNA, 18 bp, Homo sapiens
gtgacaaaggatgaagaa

SEQ ID NO: 260289 - DNA, 18 bp, Homo sapiens
gtgacaacctttgtgtaa

SEQ ID NO: 260290 - DNA, 19 bp, Homo sapiens
gtgacaaggccccagagac

SEQ ID NO: 260291 - DNA, 19 bp, Homo sapiens
gtgacacagcagcttcacc

SEQ ID NO: 260292 - DNA, 22 bp, Homo sapiens
gtgacacttcagagagctggta

SEQ ID NO: 260293 - DNA, 16 bp, Homo sapiens
gtgacagccttgggcc

SEQ ID NO: 260294 - DNA, 15 bp, Homo sapiens
gtgacagtgcctggg

SEQ ID NO: 260295 - DNA, 22 bp, Homo sapiens
gtgacatcccaggaggggcctc

SEQ ID NO: 260296 - DNA, 18 bp, Homo sapiens
gtgacatctacctcccga

SEQ ID NO: 260297 - DNA, 16 bp, Homo sapiens
gtgacatgcgggctgg

SEQ ID NO: 260298 - DNA, 22 bp, Homo sapiens
gtgacatgcgggctgggcagct

SEQ ID NO: 260299 - DNA, 15 bp, Homo sapiens
gtgaccaattgccct

SEQ ID NO: 260300 - DNA, 16 bp, Homo sapiens
gtgaccaattgccctg

SEQ ID NO: 260301 - DNA, 19 bp, Homo sapiens
gtgaccaccttctgtcccc

SEQ ID NO: 260302 - DNA, 17 bp, Homo sapiens
gtgaccaggcatcctcc

SEQ ID NO: 260303 - DNA, 20 bp, Homo sapiens
gtgaccaggctcacaactgt

SEQ ID NO: 260304 - DNA, 16 bp, Homo sapiens
gtgacccaccagtgcc

SEQ ID NO: 260305 - DNA, 13 bp, Homo sapiens
gtgacccagtggc

SEQ ID NO: 260306 - DNA, 20 bp, Homo sapiens
gtgaccccatctctgctgct

SEQ ID NO: 260307 - DNA, 14 bp, Homo sapiens
gtgaccctctcact

SEQ ID NO: 260308 - DNA, 20 bp, Homo sapiens
gtgaccggcccgccaccttg

SEQ ID NO: 260309 - DNA, 23 bp, Homo sapiens
gtgacctgaggatttaagggatg

SEQ ID NO: 260310 - DNA, 19 bp, Homo sapiens
gtgacgggggttggggtgg

SEQ ID NO: 260311 - DNA, 16 bp, Homo sapiens
gtgactaccacttatt

SEQ ID NO: 260312 - DNA, 19 bp, Homo sapiens
gtgactaccacttatttct

SEQ ID NO: 260313 - DNA, 11 bp, Homo sapiens
gtgactagtgc

SEQ ID NO: 260314 - DNA, 14 bp, Homo sapiens
gtgactagtgctga

SEQ ID NO: 260315 - DNA, 21 bp, Homo sapiens
gtgactagtgctgaagcttat

SEQ ID NO: 260316 - DNA, 22 bp, Homo sapiens
gtgactagtgctgaagcttatt

SEQ ID NO: 260317 - DNA, 17 bp, Homo sapiens
gtgactcattcccagta

SEQ ID NO: 260318 - DNA, 12 bp, Homo sapiens
gtgactccagga

SEQ ID NO: 260319 - DNA, 10 bp, Homo sapiens
gtgactcctc

SEQ ID NO: 260320 - DNA, 18 bp, Homo sapiens
gtgactcctcccttcccc

SEQ ID NO: 260321 - DNA, 22 bp, Homo sapiens
gtgactgaaggggcacaccact

SEQ ID NO: 260322 - DNA, 14 bp, Homo sapiens
gtgactgagggcct

SEQ ID NO: 260323 - DNA, 23 bp, Homo sapiens
gtgactgctgccatttttgcaaa

SEQ ID NO: 260324 - DNA, 20 bp, Homo sapiens
gtgacttcagactctctcct

SEQ ID NO: 260325 - DNA, 16 bp, Homo sapiens
gtgacttcagctctgt

SEQ ID NO: 260326 - DNA, 17 bp, Homo sapiens
gtgacttgaatgtacaa

SEQ ID NO: 260327 - DNA, 18 bp, Homo sapiens
gtgacttgaatgtacaaa

SEQ ID NO: 260328 - DNA, 23 bp, Homo sapiens
gtgacttgtgtcccatgatccct

SEQ ID NO: 260329 - DNA, 20 bp, Homo sapiens
gtgagaactgttctcatgga

SEQ ID NO: 260330 - DNA, 18 bp, Homo sapiens
gtgagaataattgtgtac

SEQ ID NO: 260331 - DNA, 19 bp, Homo sapiens
gtgagaataattgtgtaca

SEQ ID NO: 260332 - DNA, 12 bp, Homo sapiens
gtgagacagcaa

SEQ ID NO: 260333 - DNA, 17 bp, Homo sapiens
gtgagacccccacacct

SEQ ID NO: 260334 - DNA, 22 bp, Homo sapiens
gtgagactcctgattgctctgg

SEQ ID NO: 260335 - DNA, 14 bp, Homo sapiens
gtgagactctgagg

SEQ ID NO: 260336 - DNA, 16 bp, Homo sapiens
gtgagagaatctgcct

SEQ ID NO: 260337 - DNA, 17 bp, Homo sapiens
gtgagagaatctgcctg

SEQ ID NO: 260338 - DNA, 13 bp, Homo sapiens
gtgagagaattta

SEQ ID NO: 260339 - DNA, 15 bp, Homo sapiens
gtgagagcacaaaga

SEQ ID NO: 260340 - DNA, 16 bp, Homo sapiens
gtgagagcacaaagat

SEQ ID NO: 260341 - DNA, 14 bp, Homo sapiens
gtgagataaatatc

SEQ ID NO: 260342 - DNA, 15 bp, Homo sapiens
gtgagatgggaaggg

SEQ ID NO: 260343 - DNA, 14 bp, Homo sapiens
gtgagatttgtatt

SEQ ID NO: 260344 - DNA, 23 bp, Homo sapiens
gtgagatttgtatttatattaga

SEQ ID NO: 260345 - DNA, 18 bp, Homo sapiens
gtgagcaaacctgcccca

SEQ ID NO: 260346 - DNA, 17 bp, Homo sapiens
gtgagcaggaaggcctg

SEQ ID NO: 260347 - DNA, 17 bp, Homo sapiens
gtgagcagggccctcag

SEQ ID NO: 260348 - DNA, 20 bp, Homo sapiens
gtgagcagggccctcagagg

SEQ ID NO: 260349 - DNA, 12 bp, Homo sapiens
gtgagcagtgtg

SEQ ID NO: 260350 - DNA, 14 bp, Homo sapiens
gtgagccaccgctg

SEQ ID NO: 260351 - DNA, 18 bp, Homo sapiens
gtgagccaccgctgccag

SEQ ID NO: 260352 - DNA, 20 bp, Homo sapiens
gtgagccaccgctgccagca

SEQ ID NO: 260353 - DNA, 11 bp, Homo sapiens
gtgagcgcccc

SEQ ID NO: 260354 - DNA, 20 bp, Homo sapiens
gtgagcgccccgcccccacc

SEQ ID NO: 260355 - DNA, 15 bp, Homo sapiens
gtgagctcaggagag

SEQ ID NO: 260356 - DNA, 16 bp, Homo sapiens
gtgagctcaggagaga

SEQ ID NO: 260357 - DNA, 14 bp, Homo sapiens
gtgaggagctgctg

SEQ ID NO: 260358 - DNA, 15 bp, Homo sapiens
gtgaggagctgctgg

SEQ ID NO: 260359 - DNA, 22 bp, Homo sapiens
gtgaggaggaggcagaaccagc

SEQ ID NO: 260360 - DNA, 23 bp, Homo sapiens
gtgaggcccagcctgtcctggta

SEQ ID NO: 260361 - DNA, 16 bp, Homo sapiens
gtgaggcccccggagg

SEQ ID NO: 260362 - DNA, 21 bp, Homo sapiens
gtgaggcccccggaggcgccc

SEQ ID NO: 260363 - DNA, 15 bp, Homo sapiens
gtgaggcggcagctg

SEQ ID NO: 260364 - DNA, 19 bp, Homo sapiens
gtgaggcgttctcctgctt

SEQ ID NO: 260365 - DNA, 22 bp, Homo sapiens
gtgagggacatgctcacctcta

SEQ ID NO: 260366 - DNA, 16 bp, Homo sapiens
gtgaggggccactggg

SEQ ID NO: 260367 - DNA, 21 bp, Homo sapiens
gtgaggggtatatctgggctg

SEQ ID NO: 260368 - DNA, 23 bp, Homo sapiens
gtgaggtcatcccggggccatgg

SEQ ID NO: 260369 - DNA, 16 bp, Homo sapiens
gtgaggtttcacctcc

SEQ ID NO: 260370 - DNA, 17 bp, Homo sapiens
gtgagtcccagagcccg

SEQ ID NO: 260371 - DNA, 20 bp, Homo sapiens
gtgagtcctggcatgggaat

SEQ ID NO: 260372 - DNA, 22 bp, Homo sapiens
gtgagtgcttgtcatggaaaat

SEQ ID NO: 260373 - DNA, 17 bp, Homo sapiens
gtgagtggcagccatgc

SEQ ID NO: 260374 - DNA, 12 bp, Homo sapiens
gtgagtggctga

SEQ ID NO: 260375 - DNA, 21 bp, Homo sapiens
gtgagtgggaggagagggcag

SEQ ID NO: 260376 - DNA, 23 bp, Homo sapiens
gtgagtgtccgttgacgtgacca

SEQ ID NO: 260377 - DNA, 21 bp, Homo sapiens
gtgagtgtgacgggggttggg

SEQ ID NO: 260378 - DNA, 16 bp, Homo sapiens
gtgagtgtggctcccc

SEQ ID NO: 260379 - DNA, 15 bp, Homo sapiens
gtgagtgtggcttag

SEQ ID NO: 260380 - DNA, 13 bp, Homo sapiens
gtgagtgtgtgca

SEQ ID NO: 260381 - DNA, 13 bp, Homo sapiens
gtgagttctcact

SEQ ID NO: 260382 - DNA, 13 bp, Homo sapiens
gtgataagtggaa

SEQ ID NO: 260383 - DNA, 14 bp, Homo sapiens
gtgataagtggaaa

SEQ ID NO: 260384 - DNA, 15 bp, Homo sapiens
gtgataagtggaaaa

SEQ ID NO: 260385 - DNA, 12 bp, Homo sapiens
gtgatacactgt

SEQ ID NO: 260386 - DNA, 14 bp, Homo sapiens
gtgatacactgtat

SEQ ID NO: 260387 - DNA, 15 bp, Homo sapiens
gtgatagagcctttg

SEQ ID NO: 260388 - DNA, 16 bp, Homo sapiens
ctgcccttcagcatcc

SEQ ID NO: 260389 - DNA, 17 bp, Homo sapiens
ctgcccttttaaatggc

SEQ ID NO: 260390 - DNA, 13 bp, Homo sapiens
ctgcccttttcct

SEQ ID NO: 260391 - DNA, 19 bp, Homo sapiens
ctgccgaccgcctgcttca

SEQ ID NO: 260392 - DNA, 20 bp, Homo sapiens
ctgccgaccgcctgcttcac

SEQ ID NO: 260393 - DNA, 15 bp, Homo sapiens
ctgccgcctcccagc

SEQ ID NO: 260394 - DNA, 15 bp, Homo sapiens
ctgccgcctggggct

SEQ ID NO: 260395 - DNA, 20 bp, Homo sapiens
ctgccgcctggggctccggt

SEQ ID NO: 260396 - DNA, 23 bp, Homo sapiens
ctgccgcctgtgcccttgctggg

SEQ ID NO: 260397 - DNA, 14 bp, Homo sapiens
ctgccgctggaggc

SEQ ID NO: 260398 - DNA, 20 bp, Homo sapiens
ctgccggctctttccttgct

SEQ ID NO: 260399 - DNA, 22 bp, Homo sapiens
ctgccggctctttccttgctca

SEQ ID NO: 260400 - DNA, 19 bp, Homo sapiens
ctgccgggttctagtctcc

SEQ ID NO: 260401 - DNA, 23 bp, Homo sapiens
ctgccgggttctagtctcctttg

SEQ ID NO: 260402 - DNA, 19 bp, Homo sapiens
ctgccgtgcacggggccag

SEQ ID NO: 260403 - DNA, 21 bp, Homo sapiens
ctgccgtgcacggggccagca

SEQ ID NO: 260404 - DNA, 16 bp, Homo sapiens
ctgccgtgcatggctc

SEQ ID NO: 260405 - DNA, 15 bp, Homo sapiens
ctgcctaagaggcaa

SEQ ID NO: 260406 - DNA, 12 bp, Homo sapiens
ctgcctaccagt

SEQ ID NO: 260407 - DNA, 22 bp, Homo sapiens
ctgcctaccagtcgccctctgt

SEQ ID NO: 260408 - DNA, 23 bp, Homo sapiens
ctgcctacggagggtgggctctg

SEQ ID NO: 260409 - DNA, 21 bp, Homo sapiens
ctgcctactctttgttttctt

SEQ ID NO: 260410 - DNA, 20 bp, Homo sapiens
ctgcctagcactcacatgct

SEQ ID NO: 260411 - DNA, 22 bp, Homo sapiens
ctgcctagcactcacatgctgg

SEQ ID NO: 260412 - DNA, 23 bp, Homo sapiens
ctgcctagcactcacatgctgga

SEQ ID NO: 260413 - DNA, 14 bp, Homo sapiens
ctgcctaggagctg

SEQ ID NO: 260414 - DNA, 17 bp, Homo sapiens
ctgcctaggagctggct

SEQ ID NO: 260415 - DNA, 17 bp, Homo sapiens
ctgcctagggttgcttg

SEQ ID NO: 260416 - DNA, 18 bp, Homo sapiens
ctgcctatccatcctgcg

SEQ ID NO: 260417 - DNA, 23 bp, Homo sapiens
ctgcctcacttcctacaagagca

SEQ ID NO: 260418 - DNA, 14 bp, Homo sapiens
ctgcctcagccttc

SEQ ID NO: 260419 - DNA, 17 bp, Homo sapiens
ctgcctcatgctctcta

SEQ ID NO: 260420 - DNA, 16 bp, Homo sapiens
ctgcctccaccgagcc

SEQ ID NO: 260421 - DNA, 22 bp, Homo sapiens
ctgcctccaccgagccagcttg

SEQ ID NO: 260422 - DNA, 20 bp, Homo sapiens
ctgcctcccacgctgggaca

SEQ ID NO: 260423 - DNA, 22 bp, Homo sapiens
ctgcctcccacgctgggacaca

SEQ ID NO: 260424 - DNA, 16 bp, Homo sapiens
ctgcctcccattctga

SEQ ID NO: 260425 - DNA, 14 bp, Homo sapiens
ctgcctccccaacc

SEQ ID NO: 260426 - DNA, 19 bp, Homo sapiens
ctgcctccccaaccctgcc

SEQ ID NO: 260427 - DNA, 15 bp, Homo sapiens
ctgcctccctctctt

SEQ ID NO: 260428 - DNA, 18 bp, Homo sapiens
ctgcctccctctcttccg

SEQ ID NO: 260429 - DNA, 19 bp, Homo sapiens
ctgcctccctctcttccgg

SEQ ID NO: 260430 - DNA, 13 bp, Homo sapiens
ctgcctccctggg

SEQ ID NO: 260431 - DNA, 23 bp, Homo sapiens
ctgcctccctggggaccaggagc

SEQ ID NO: 260432 - DNA, 16 bp, Homo sapiens
ctgcctccctttctgg

SEQ ID NO: 260433 - DNA, 15 bp, Homo sapiens
ctgcctccggccctg

SEQ ID NO: 260434 - DNA, 17 bp, Homo sapiens
ctgcctccggccctgcc

SEQ ID NO: 260435 - DNA, 20 bp, Homo sapiens
ctgcctccggccctgcccca

SEQ ID NO: 260436 - DNA, 22 bp, Homo sapiens
ctgcctccggccctgccccaca

SEQ ID NO: 260437 - DNA, 13 bp, Homo sapiens
ctgcctcctcttc

SEQ ID NO: 260438 - DNA, 12 bp, Homo sapiens
ctgcctcctgcc

SEQ ID NO: 260439 - DNA, 13 bp, Homo sapiens
ctgcctcctgcct

SEQ ID NO: 260440 - DNA, 13 bp, Homo sapiens
ctgcctctaaggc

SEQ ID NO: 260441 - DNA, 14 bp, Homo sapiens
ctgcctctgaaaat

SEQ ID NO: 260442 - DNA, 16 bp, Homo sapiens
ctgcctctgaaaatat

SEQ ID NO: 260443 - DNA, 18 bp, Homo sapiens
ctgcctctgaaaatattt

SEQ ID NO: 260444 - DNA, 19 bp, Homo sapiens
ctgcctctgaaaatatttt

SEQ ID NO: 260445 - DNA, 12 bp, Homo sapiens
ctgcctctgcca

SEQ ID NO: 260446 - DNA, 13 bp, Homo sapiens
ctgcctctgccac

SEQ ID NO: 260447 - DNA, 16 bp, Homo sapiens
ctgcctctgccacact

SEQ ID NO: 260448 - DNA, 23 bp, Homo sapiens
ctgcctctgccttagaggagccc

SEQ ID NO: 260449 - DNA, 14 bp, Homo sapiens
ctgcctctgggagg

SEQ ID NO: 260450 - DNA, 22 bp, Homo sapiens
ctgcctctgggtgagtggctga

SEQ ID NO: 260451 - DNA, 18 bp, Homo sapiens
ctgcctgaaacagccatg

SEQ ID NO: 260452 - DNA, 12 bp, Homo sapiens
ctgcctgaaagc

SEQ ID NO: 260453 - DNA, 20 bp, Homo sapiens
ctgcctgacactgagcccca

SEQ ID NO: 260454 - DNA, 16 bp, Homo sapiens
ctgcctgagcccagga

SEQ ID NO: 260455 - DNA, 15 bp, Homo sapiens
ctgcctgagggcccc

SEQ ID NO: 260456 - DNA, 18 bp, Homo sapiens
ctgcctgagggcccctct

SEQ ID NO: 260457 - DNA, 21 bp, Homo sapiens
ctgcctgagggcccctctgcc

SEQ ID NO: 260458 - DNA, 14 bp, Homo sapiens
ctgcctgcagagca

SEQ ID NO: 260459 - DNA, 14 bp, Homo sapiens
ctgcctgcccaccc

SEQ ID NO: 260460 - DNA, 15 bp, Homo sapiens
ctgcctgcccacccg

SEQ ID NO: 260461 - DNA, 16 bp, Homo sapiens
ctgcctgccccacacg

SEQ ID NO: 260462 - DNA, 15 bp, Homo sapiens
gtgctcagttgtact

SEQ ID NO: 260463 - DNA, 17 bp, Homo sapiens
gtgctcagttgtacttt

SEQ ID NO: 260464 - DNA, 18 bp, Homo sapiens
gtgctcagttgtactttt

SEQ ID NO: 260465 - DNA, 15 bp, Homo sapiens
gtgctcatcagaaac

SEQ ID NO: 260466 - DNA, 20 bp, Homo sapiens
gtgctcatcggagactgccc

SEQ ID NO: 260467 - DNA, 17 bp, Homo sapiens
gtgctccagcagtgctg

SEQ ID NO: 260468 - DNA, 21 bp, Homo sapiens
gtgctccagcagtgctgggcc

SEQ ID NO: 260469 - DNA, 13 bp, Homo sapiens
gtgctcggacaca

SEQ ID NO: 260470 - DNA, 15 bp, Homo sapiens
gtgctcggacacagt

SEQ ID NO: 260471 - DNA, 17 bp, Homo sapiens
gtgctcggacacagttt

SEQ ID NO: 260472 - DNA, 20 bp, Homo sapiens
gtgctctgaatgggagccag

SEQ ID NO: 260473 - DNA, 21 bp, Homo sapiens
gtgctctgaatgggagccaga

SEQ ID NO: 260474 - DNA, 11 bp, Homo sapiens
gtgctctggcg

SEQ ID NO: 260475 - DNA, 22 bp, Homo sapiens
gtgctctggcggcttcctgtcc

SEQ ID NO: 260476 - DNA, 14 bp, Homo sapiens
gtgctctggctgga

SEQ ID NO: 260477 - DNA, 15 bp, Homo sapiens
gtgctctttcctgcc

SEQ ID NO: 260478 - DNA, 13 bp, Homo sapiens
gtgctctttgaag

SEQ ID NO: 260479 - DNA, 21 bp, Homo sapiens
gtgctgaacagtggaggaaga

SEQ ID NO: 260480 - DNA, 15 bp, Homo sapiens
gtgctgaagcttatt

SEQ ID NO: 260481 - DNA, 17 bp, Homo sapiens
gtgctgaccccaggaag

SEQ ID NO: 260482 - DNA, 13 bp, Homo sapiens
gtgctgagaagct

SEQ ID NO: 260483 - DNA, 11 bp, Homo sapiens
gtgctgagctt

SEQ ID NO: 260484 - DNA, 21 bp, Homo sapiens
gtgctgccacacttcaggctc

SEQ ID NO: 260485 - DNA, 13 bp, Homo sapiens
gtgctgccatgcc

SEQ ID NO: 260486 - DNA, 16 bp, Homo sapiens
gtgctgccatgccact

SEQ ID NO: 260487 - DNA, 19 bp, Homo sapiens
gtgctgccatgccactgcc

SEQ ID NO: 260488 - DNA, 21 bp, Homo sapiens
gtgctgccatgccactgccag

SEQ ID NO: 260489 - DNA, 23 bp, Homo sapiens
gtgctgccttgtagatggagcaa

SEQ ID NO: 260490 - DNA, 20 bp, Homo sapiens
gtgctgcgcccagggaggaa

SEQ ID NO: 260491 - DNA, 15 bp, Homo sapiens
gtgctgctgcaccaa

SEQ ID NO: 260492 - DNA, 17 bp, Homo sapiens
gtgctgctgcaccaacc

SEQ ID NO: 260493 - DNA, 15 bp, Homo sapiens
gtgctgctgctgctg

SEQ ID NO: 260494 - DNA, 18 bp, Homo sapiens
gtgctgcttgtgcctccc

SEQ ID NO: 260495 - DNA, 13 bp, Homo sapiens
gtgctgctttgct

SEQ ID NO: 260496 - DNA, 13 bp, Homo sapiens
gtgctgctttggc

SEQ ID NO: 260497 - DNA, 19 bp, Homo sapiens
gtgctgctttggctgactg

SEQ ID NO: 260498 - DNA, 14 bp, Homo sapiens
gtgctggaggaact

SEQ ID NO: 260499 - DNA, 13 bp, Homo sapiens
gtgctgggactga

SEQ ID NO: 260500 - DNA, 17 bp, Homo sapiens
gtgctgggactgagcca

SEQ ID NO: 260501 - DNA, 11 bp, Homo sapiens
gtgctgggccc

SEQ ID NO: 260502 - DNA, 14 bp, Homo sapiens
gtgctgggcccagc

SEQ ID NO: 260503 - DNA, 19 bp, Homo sapiens
gtgctgtaacctgaagtca

SEQ ID NO: 260504 - DNA, 13 bp, Homo sapiens
gtgctgtgcctgc

SEQ ID NO: 260505 - DNA, 17 bp, Homo sapiens
gtgctgttgattctttc

SEQ ID NO: 260506 - DNA, 17 bp, Homo sapiens
gtgctgttggtggcagt

SEQ ID NO: 260507 - DNA, 19 bp, Homo sapiens
gtgctgttgtcattgcttt

SEQ ID NO: 260508 - DNA, 18 bp, Homo sapiens
gtgctgttgtctgccgtg

SEQ ID NO: 260509 - DNA, 14 bp, Homo sapiens
gtgcttgctgtgtg

SEQ ID NO: 260510 - DNA, 22 bp, Homo sapiens
gtgcttggcacatagtgggcct

SEQ ID NO: 260511 - DNA, 14 bp, Homo sapiens
gtgcttggctgccc

SEQ ID NO: 260512 - DNA, 17 bp, Homo sapiens
gtgctttctgcatgctt

SEQ ID NO: 260513 - DNA, 18 bp, Homo sapiens
gtgctttgtagcttaaaa

SEQ ID NO: 260514 - DNA, 17 bp, Homo sapiens
gtgcttttccatctaaa

SEQ ID NO: 260515 - DNA, 17 bp, Homo sapiens
gtgcttttcctatttgt

SEQ ID NO: 260516 - DNA, 19 bp, Homo sapiens
gtgcttttgcaaaagaagt

SEQ ID NO: 260517 - DNA, 14 bp, Homo sapiens
gtggaaaaaagaga

SEQ ID NO: 260518 - DNA, 14 bp, Homo sapiens
gtggaaaaagaaat

SEQ ID NO: 260519 - DNA, 16 bp, Homo sapiens
gtggaaaaagaaattc

SEQ ID NO: 260520 - DNA, 21 bp, Homo sapiens
gtggaaaaagaaattctgtta

SEQ ID NO: 260521 - DNA, 16 bp, Homo sapiens
gtggaaaactcacaga

SEQ ID NO: 260522 - DNA, 16 bp, Homo sapiens
gtggaaagtgaatttg

SEQ ID NO: 260523 - DNA, 22 bp, Homo sapiens
gtggaacagtcacccttctggg

SEQ ID NO: 260524 - DNA, 14 bp, Homo sapiens
gtggaagagcagcc

SEQ ID NO: 260525 - DNA, 17 bp, Homo sapiens
gtggaagaggttctcag

SEQ ID NO: 260526 - DNA, 15 bp, Homo sapiens
gtggaaggagcctgc

SEQ ID NO: 260527 - DNA, 23 bp, Homo sapiens
gtggaaggagcctgcggctgctg

SEQ ID NO: 260528 - DNA, 23 bp, Homo sapiens
gtggaaggcacccgccctttcct

SEQ ID NO: 260529 - DNA, 18 bp, Homo sapiens
gtggaatataaggaaagc

SEQ ID NO: 260530 - DNA, 18 bp, Homo sapiens
gtggaatgcagggaagag

SEQ ID NO: 260531 - DNA, 12 bp, Homo sapiens
gtggacacctgc

SEQ ID NO: 260532 - DNA, 13 bp, Homo sapiens
gtggacacctgcc

SEQ ID NO: 260533 - DNA, 17 bp, Homo sapiens
gtggacacctgccctgc

SEQ ID NO: 260534 - DNA, 18 bp, Homo sapiens
gtggacacctgccctgcc

SEQ ID NO: 260535 - DNA, 19 bp, Homo sapiens
ctgctgcctccccaaccct

SEQ ID NO: 260536 - DNA, 18 bp, Homo sapiens
ctgctgcctccctgggga

SEQ ID NO: 260537 - DNA, 15 bp, Homo sapiens
ctgctgcctgccggc

SEQ ID NO: 260538 - DNA, 21 bp, Homo sapiens
ctgctgcgcccttaccttccc

SEQ ID NO: 260539 - DNA, 22 bp, Homo sapiens
ctgctgctactacccgagccca

SEQ ID NO: 260540 - DNA, 19 bp, Homo sapiens
ctgctgctcgggaaggcct

SEQ ID NO: 260541 - DNA, 14 bp, Homo sapiens
ctgctgctgctgtg

SEQ ID NO: 260542 - DNA, 22 bp, Homo sapiens
ctgctgctgtaactgctgagcc

SEQ ID NO: 260543 - DNA, 13 bp, Homo sapiens
ctgctgcttccta

SEQ ID NO: 260544 - DNA, 17 bp, Homo sapiens
ctgctgcttctgggcct

SEQ ID NO: 260545 - DNA, 20 bp, Homo sapiens
ctgctggacagtatcactgt

SEQ ID NO: 260546 - DNA, 22 bp, Homo sapiens
ctgctggacagtatcactgtct

SEQ ID NO: 260547 - DNA, 11 bp, Homo sapiens
ctgctggagga

SEQ ID NO: 260548 - DNA, 16 bp, Homo sapiens
ctgctggatgtcacca

SEQ ID NO: 260549 - DNA, 21 bp, Homo sapiens
ctgctggcacatttccccaga

SEQ ID NO: 260550 - DNA, 12 bp, Homo sapiens
ctgctggccagg

SEQ ID NO: 260551 - DNA, 18 bp, Homo sapiens
ctgctggccgggcacagc

SEQ ID NO: 260552 - DNA, 20 bp, Homo sapiens
ctgctggccgggcacagctg

SEQ ID NO: 260553 - DNA, 21 bp, Homo sapiens
ctgctggccgggcacagctgt

SEQ ID NO: 260554 - DNA, 18 bp, Homo sapiens
ctgctggctgaggcttgg

SEQ ID NO: 260555 - DNA, 13 bp, Homo sapiens
ctgctggctgcct

SEQ ID NO: 260556 - DNA, 16 bp, Homo sapiens
ctgctggcttgcagtg

SEQ ID NO: 260557 - DNA, 18 bp, Homo sapiens
ctgctgggaaccccgcag

SEQ ID NO: 260558 - DNA, 21 bp, Homo sapiens
ctgctgggaaccccgcagccc

SEQ ID NO: 260559 - DNA, 14 bp, Homo sapiens
ctgctggggagtcc

SEQ ID NO: 260560 - DNA, 22 bp, Homo sapiens
ctgctgggtttccacacagcct

SEQ ID NO: 260561 - DNA, 23 bp, Homo sapiens
ctgctgggtttccacacagcctg

SEQ ID NO: 260562 - DNA, 15 bp, Homo sapiens
ctgctggtcaccccc

SEQ ID NO: 260563 - DNA, 23 bp, Homo sapiens
ctgctggttgttgccaggttgca

SEQ ID NO: 260564 - DNA, 16 bp, Homo sapiens
ctgctgtaactgctga

SEQ ID NO: 260565 - DNA, 19 bp, Homo sapiens
ctgctgtaactgctgagcc

SEQ ID NO: 260566 - DNA, 21 bp, Homo sapiens
ctgctgtaagacggccttgga

SEQ ID NO: 260567 - DNA, 21 bp, Homo sapiens
ctgctgtcattgtccatgcct

SEQ ID NO: 260568 - DNA, 15 bp, Homo sapiens
ctgctgtccctcctg

SEQ ID NO: 260569 - DNA, 18 bp, Homo sapiens
ctgctgtccctcctgagg

SEQ ID NO: 260570 - DNA, 13 bp, Homo sapiens
ctgctgtcctgca

SEQ ID NO: 260571 - DNA, 14 bp, Homo sapiens
ctgctgtcctgcag

SEQ ID NO: 260572 - DNA, 14 bp, Homo sapiens
ctgctgtgaatttt

SEQ ID NO: 260573 - DNA, 13 bp, Homo sapiens
ctgctgtgcctgc

SEQ ID NO: 260574 - DNA, 15 bp, Homo sapiens
ctgctgtggaaagga

SEQ ID NO: 260575 - DNA, 19 bp, Homo sapiens
ctgctgtgggtcagtgtgc

SEQ ID NO: 260576 - DNA, 16 bp, Homo sapiens
ctgctgttgccatagc

SEQ ID NO: 260577 - DNA, 18 bp, Homo sapiens
ctgctgttgccatagccc

SEQ ID NO: 260578 - DNA, 17 bp, Homo sapiens
ctgctgtttagtgaaca

SEQ ID NO: 260579 - DNA, 14 bp, Homo sapiens
ctgctgttttatgt

SEQ ID NO: 260580 - DNA, 22 bp, Homo sapiens
ctgcttacaattccctgctgtc

SEQ ID NO: 260581 - DNA, 13 bp, Homo sapiens
ctgcttaccaaaa

SEQ ID NO: 260582 - DNA, 19 bp, Homo sapiens
ctgcttactaatgtgcccc

SEQ ID NO: 260583 - DNA, 22 bp, Homo sapiens
ctgcttactgtcggtgtcccct

SEQ ID NO: 260584 - DNA, 18 bp, Homo sapiens
ctgcttaggagagaccga

SEQ ID NO: 260585 - DNA, 12 bp, Homo sapiens
ctgcttagtgtc

SEQ ID NO: 260586 - DNA, 15 bp, Homo sapiens
ctgcttatctgaaac

SEQ ID NO: 260587 - DNA, 17 bp, Homo sapiens
ctgcttatctgaaactt

SEQ ID NO: 260588 - DNA, 13 bp, Homo sapiens
ctgcttcacaccc

SEQ ID NO: 260589 - DNA, 15 bp, Homo sapiens
ctgcttcacacccct

SEQ ID NO: 260590 - DNA, 20 bp, Homo sapiens
ctgcttcacacccctcagcg

SEQ ID NO: 260591 - DNA, 15 bp, Homo sapiens
ctgcttcatatctct

SEQ ID NO: 260592 - DNA, 21 bp, Homo sapiens
ctgcttcatatctctcccttc

SEQ ID NO: 260593 - DNA, 21 bp, Homo sapiens
gtggccaacgtggacctgcct

SEQ ID NO: 260594 - DNA, 22 bp, Homo sapiens
gtggccagagctggaaggcagg

SEQ ID NO: 260595 - DNA, 21 bp, Homo sapiens
gtggccccatccagcatgtgt

SEQ ID NO: 260596 - DNA, 22 bp, Homo sapiens
gtggccccatccagcatgtgtg

SEQ ID NO: 260597 - DNA, 21 bp, Homo sapiens
gtggcccccgccccctcccta

SEQ ID NO: 260598 - DNA, 22 bp, Homo sapiens
gtggcccctccttctcccctcc

SEQ ID NO: 260599 - DNA, 15 bp, Homo sapiens
gtggccgcctggcag

SEQ ID NO: 260600 - DNA, 13 bp, Homo sapiens
gtggccgtctcct

SEQ ID NO: 260601 - DNA, 20 bp, Homo sapiens
gtggccgtctcctccctcag

SEQ ID NO: 260602 - DNA, 9 bp, Homo sapiens
gtggcctca

SEQ ID NO: 260603 - DNA, 19 bp, Homo sapiens
gtggcctcaaccctccctc

SEQ ID NO: 260604 - DNA, 15 bp, Homo sapiens
gtggcctctcagtca

SEQ ID NO: 260605 - DNA, 20 bp, Homo sapiens
gtggcctctgccccgtctca

SEQ ID NO: 260606 - DNA, 24 bp, Homo sapiens
gtggcctctgccccgtctcatgag

SEQ ID NO: 260607 - DNA, 22 bp, Homo sapiens
gtggcctgctaaggctcctcct

SEQ ID NO: 260608 - DNA, 21 bp, Homo sapiens
gtggcctggccaggagctctt

SEQ ID NO: 260609 - DNA, 13 bp, Homo sapiens
gtggcctggctcc

SEQ ID NO: 260610 - DNA, 17 bp, Homo sapiens
gtggcctgtgtccagca

SEQ ID NO: 260611 - DNA, 23 bp, Homo sapiens
gtggcctgtgtccagcagctgcg

SEQ ID NO: 260612 - DNA, 20 bp, Homo sapiens
gtggcctgtttctgcagccc

SEQ ID NO: 260613 - DNA, 21 bp, Homo sapiens
gtggccttccccttttgcctg

SEQ ID NO: 260614 - DNA, 15 bp, Homo sapiens
gtggcgggcgcctgt

SEQ ID NO: 260615 - DNA, 24 bp, Homo sapiens
gtggctaccgatttcagcacatgc

SEQ ID NO: 260616 - DNA, 22 bp, Homo sapiens
gtggctcagtgccacctatgcc

SEQ ID NO: 260617 - DNA, 12 bp, Homo sapiens
gtggctcccctc

SEQ ID NO: 260618 - DNA, 18 bp, Homo sapiens
gtggctcctatctgtgtt

SEQ ID NO: 260619 - DNA, 17 bp, Homo sapiens
gtggctgacagagcagg

SEQ ID NO: 260620 - DNA, 16 bp, Homo sapiens
gtggctgcccacacac

SEQ ID NO: 260621 - DNA, 19 bp, Homo sapiens
gtggctgctcccagcctct

SEQ ID NO: 260622 - DNA, 11 bp, Homo sapiens
gtggctggggg

SEQ ID NO: 260623 - DNA, 17 bp, Homo sapiens
gtggctgggggcaggag

SEQ ID NO: 260624 - DNA, 19 bp, Homo sapiens
gtggctgggtgggcccaga

SEQ ID NO: 260625 - DNA, 16 bp, Homo sapiens
gtggctggtgtcccct

SEQ ID NO: 260626 - DNA, 19 bp, Homo sapiens
gtggcttcccgctcagccc

SEQ ID NO: 260627 - DNA, 21 bp, Homo sapiens
gtggcttcccgctcagccctc

SEQ ID NO: 260628 - DNA, 21 bp, Homo sapiens
gtgggaagaaacaaacccgtt

SEQ ID NO: 260629 - DNA, 23 bp, Homo sapiens
gtgggaaggacttggcgcgccct

SEQ ID NO: 260630 - DNA, 22 bp, Homo sapiens
gtgggacccatagatcttctga

SEQ ID NO: 260631 - DNA, 18 bp, Homo sapiens
gtgggactggcccacccc

SEQ ID NO: 260632 - DNA, 14 bp, Homo sapiens
gtgggagaggaagc

SEQ ID NO: 260633 - DNA, 16 bp, Homo sapiens
gtgggagaggaagcca

SEQ ID NO: 260634 - DNA, 12 bp, Homo sapiens
gtgggagaggca

SEQ ID NO: 260635 - DNA, 12 bp, Homo sapiens
gtgggagccctg

SEQ ID NO: 260636 - DNA, 21 bp, Homo sapiens
gtgggagccctgaccttggct

SEQ ID NO: 260637 - DNA, 13 bp, Homo sapiens
gtgggaggagagg

SEQ ID NO: 260638 - DNA, 13 bp, Homo sapiens
gtgggaggatcac

SEQ ID NO: 260639 - DNA, 19 bp, Homo sapiens
gtgggaggctcccagaccc

SEQ ID NO: 260640 - DNA, 22 bp, Homo sapiens
gtgggagtccactttcctctct

SEQ ID NO: 260641 - DNA, 19 bp, Homo sapiens
gtgggagtgggagaggaag

SEQ ID NO: 260642 - DNA, 15 bp, Homo sapiens
gtgggatcctccctc

SEQ ID NO: 260643 - DNA, 16 bp, Homo sapiens
gtgggatgagcctctc

SEQ ID NO: 260644 - DNA, 13 bp, Homo sapiens
gtgggcacctcag

SEQ ID NO: 260645 - DNA, 20 bp, Homo sapiens
gtgggcacgctgtgggcagg

SEQ ID NO: 260646 - DNA, 16 bp, Homo sapiens
gtgggcagctgggccc

SEQ ID NO: 260647 - DNA, 14 bp, Homo sapiens
gtgggcaggaaaag

SEQ ID NO: 260648 - DNA, 21 bp, Homo sapiens
gtgggccacacccaggaaggg

SEQ ID NO: 260649 - DNA, 17 bp, Homo sapiens
gtgggccagtgtgggaa

SEQ ID NO: 260650 - DNA, 15 bp, Homo sapiens
gtgggccatggcaat

SEQ ID NO: 260651 - DNA, 21 bp, Homo sapiens
gtgggcccagaactgccccca

SEQ ID NO: 260652 - DNA, 23 bp, Homo sapiens
gtgggcccataatagttagccct

SEQ ID NO: 260653 - DNA, 17 bp, Homo sapiens
gtgggccccagccgtgg

SEQ ID NO: 260654 - DNA, 12 bp, Homo sapiens
gtgggcctctgg

SEQ ID NO: 260655 - DNA, 12 bp, Homo sapiens
gtgggcctggcc

SEQ ID NO: 260656 - DNA, 17 bp, Homo sapiens
gtgggcctgtcgtgcca

SEQ ID NO: 260657 - DNA, 22 bp, Homo sapiens
gtgggcctgtcgtgccagtcct

SEQ ID NO: 260658 - DNA, 13 bp, Homo sapiens
gtgggctccagag

SEQ ID NO: 260659 - DNA, 17 bp, Homo sapiens
gtgggctccagagtagg

SEQ ID NO: 260660 - DNA, 14 bp, Homo sapiens
gtgggctctggctc

SEQ ID NO: 260661 - DNA, 18 bp, Homo sapiens
gtgggctggtgccccaca

SEQ ID NO: 260662 - DNA, 19 bp, Homo sapiens
gtgggctttccagggtctt

SEQ ID NO: 260663 - DNA, 22 bp, Homo sapiens
gtggggacgggggctgcttctc

SEQ ID NO: 260664 - DNA, 18 bp, Homo sapiens
gtggggagacacctcaga

SEQ ID NO: 260665 - DNA, 20 bp, Homo sapiens
gtggggagacacctcagagc

SEQ ID NO: 260666 - DNA, 15 bp, Homo sapiens
gtggggagcgggggc

SEQ ID NO: 260667 - DNA, 22 bp, Homo sapiens
gtggggagtccagggctcccgg

SEQ ID NO: 260668 - DNA, 21 bp, Homo sapiens
gtggggatgtttgtgctgcag

SEQ ID NO: 260669 - DNA, 14 bp, Homo sapiens
gtggggccaggtca

SEQ ID NO: 260670 - DNA, 16 bp, Homo sapiens
gtggggcccatggccc

SEQ ID NO: 260671 - DNA, 17 bp, Homo sapiens
ctggaatgaagcatgta

SEQ ID NO: 260672 - DNA, 20 bp, Homo sapiens
ctggaatgaagcatgtagct

SEQ ID NO: 260673 - DNA, 15 bp, Homo sapiens
ctggaatgtaatcaa

SEQ ID NO: 260674 - DNA, 21 bp, Homo sapiens
ctggaatgtaatcaatgtttc

SEQ ID NO: 260675 - DNA, 13 bp, Homo sapiens
ctggaattcaccc

SEQ ID NO: 260676 - DNA, 16 bp, Homo sapiens
ctggaattcagcaccc

SEQ ID NO: 260677 - DNA, 17 bp, Homo sapiens
ctggaattcagcaccct

SEQ ID NO: 260678 - DNA, 15 bp, Homo sapiens
ctggacaagccaact

SEQ ID NO: 260679 - DNA, 21 bp, Homo sapiens
ctggacaagccaacttgtaaa

SEQ ID NO: 260680 - DNA, 23 bp, Homo sapiens
ctggacaagccaacttgtaaata

SEQ ID NO: 260681 - DNA, 16 bp, Homo sapiens
ctggacaggtctggga

SEQ ID NO: 260682 - DNA, 18 bp, Homo sapiens
ctggacattcagaacacc

SEQ ID NO: 260683 - DNA, 22 bp, Homo sapiens
ctggaccaaagctgacgaggct

SEQ ID NO: 260684 - DNA, 16 bp, Homo sapiens
ctggaccaaggtgcgg

SEQ ID NO: 260685 - DNA, 20 bp, Homo sapiens
ctggaccaaggtgcggaccg

SEQ ID NO: 260686 - DNA, 16 bp, Homo sapiens
ctggaccacacctccg

SEQ ID NO: 260687 - DNA, 22 bp, Homo sapiens
ctggaccaccagccccagcaag

SEQ ID NO: 260688 - DNA, 13 bp, Homo sapiens
ctggaccagcctc

SEQ ID NO: 260689 - DNA, 14 bp, Homo sapiens
ctggaccagcctcc

SEQ ID NO: 260690 - DNA, 15 bp, Homo sapiens
ctggaccagcctcct

SEQ ID NO: 260691 - DNA, 16 bp, Homo sapiens
ctggaccagcctcctg

SEQ ID NO: 260692 - DNA, 20 bp, Homo sapiens
ctggacctccccctcttggt

SEQ ID NO: 260693 - DNA, 13 bp, Homo sapiens
ctggacctgagtc

SEQ ID NO: 260694 - DNA, 19 bp, Homo sapiens
ctggactatagcagggctg

SEQ ID NO: 260695 - DNA, 14 bp, Homo sapiens
ctggactcctctgt

SEQ ID NO: 260696 - DNA, 20 bp, Homo sapiens
ctggactcctctgtccaggc

SEQ ID NO: 260697 - DNA, 17 bp, Homo sapiens
ctggactctgccccaat

SEQ ID NO: 260698 - DNA, 18 bp, Homo sapiens
ctggactctgtggggcca

SEQ ID NO: 260699 - DNA, 13 bp, Homo sapiens
ctggactctgtgt

SEQ ID NO: 260700 - DNA, 17 bp, Homo sapiens
ctggactgcaatatcaa

SEQ ID NO: 260701 - DNA, 24 bp, Homo sapiens
ctggactggaggtgggcatgccac

SEQ ID NO: 260702 - DNA, 18 bp, Homo sapiens
ctggactggcccttgccc

SEQ ID NO: 260703 - DNA, 21 bp, Homo sapiens
ctggactggctagagtcctca

SEQ ID NO: 260704 - DNA, 14 bp, Homo sapiens
ctggactgtcctag

SEQ ID NO: 260705 - DNA, 17 bp, Homo sapiens
ctggacttggcccctgc

SEQ ID NO: 260706 - DNA, 16 bp, Homo sapiens
ctggactttcctgcaa

SEQ ID NO: 260707 - DNA, 18 bp, Homo sapiens
ctggacttttgcagcttc

SEQ ID NO: 260708 - DNA, 19 bp, Homo sapiens
ctggagaaaggatggcagc

SEQ ID NO: 260709 - DNA, 17 bp, Homo sapiens
ctggagaccaggactct

SEQ ID NO: 260710 - DNA, 20 bp, Homo sapiens
ctggagaccggaattgagag

SEQ ID NO: 260711 - DNA, 12 bp, Homo sapiens
ctggagactgtc

SEQ ID NO: 260712 - DNA, 23 bp, Homo sapiens
ctggagactgtccacttctagct

SEQ ID NO: 260713 - DNA, 18 bp, Homo sapiens
ctggagacttcctctggt

SEQ ID NO: 260714 - DNA, 19 bp, Homo sapiens
ctggagaggaaaagccagt

SEQ ID NO: 260715 - DNA, 16 bp, Homo sapiens
ctggagagtctcactc

SEQ ID NO: 260716 - DNA, 16 bp, Homo sapiens
ctggagagtggcaaaa

SEQ ID NO: 260717 - DNA, 14 bp, Homo sapiens
ctggagccacctgt

SEQ ID NO: 260718 - DNA, 15 bp, Homo sapiens
ctggagccagcaggg

SEQ ID NO: 260719 - DNA, 21 bp, Homo sapiens
ctggagccagcagggctgtga

SEQ ID NO: 260720 - DNA, 12 bp, Homo sapiens
ctggagcccctg

SEQ ID NO: 260721 - DNA, 14 bp, Homo sapiens
ctggagcccctgtg

SEQ ID NO: 260722 - DNA, 17 bp, Homo sapiens
ctggagcccctgtgtgg

SEQ ID NO: 260723 - DNA, 17 bp, Homo sapiens
gtggtcttggagaggag

SEQ ID NO: 260724 - DNA, 17 bp, Homo sapiens
gtggtctttctggagag

SEQ ID NO: 260725 - DNA, 20 bp, Homo sapiens
gtggtgaagtgtggctggtg

SEQ ID NO: 260726 - DNA, 21 bp, Homo sapiens
gtggtgaagtgtggctggtgt

SEQ ID NO: 260727 - DNA, 23 bp, Homo sapiens
gtggtgaagtgtggctggtgtcc

SEQ ID NO: 260728 - DNA, 18 bp, Homo sapiens
gtggtgcagccccaggac

SEQ ID NO: 260729 - DNA, 21 bp, Homo sapiens
gtggtgcagccccaggaccaa

SEQ ID NO: 260730 - DNA, 22 bp, Homo sapiens
gtggtgcagccccaggaccaag

SEQ ID NO: 260731 - DNA, 17 bp, Homo sapiens
gtggtgcagccttcccc

SEQ ID NO: 260732 - DNA, 20 bp, Homo sapiens
gtggtgcagccttcccctcc

SEQ ID NO: 260733 - DNA, 14 bp, Homo sapiens
gtggtgctgggact

SEQ ID NO: 260734 - DNA, 22 bp, Homo sapiens
gtggtggaaacttttcttaaaa

SEQ ID NO: 260735 - DNA, 12 bp, Homo sapiens
gtggtggctctg

SEQ ID NO: 260736 - DNA, 16 bp, Homo sapiens
gtggtgtgaggccccc

SEQ ID NO: 260737 - DNA, 18 bp, Homo sapiens
gtggtgtgaggcccccgg

SEQ ID NO: 260738 - DNA, 21 bp, Homo sapiens
gtggttacagtgcagacaggc

SEQ ID NO: 260739 - DNA, 16 bp, Homo sapiens
gtggttatgtcccatg

SEQ ID NO: 260740 - DNA, 18 bp, Homo sapiens
gtggttattagcaaggct

SEQ ID NO: 260741 - DNA, 14 bp, Homo sapiens
gtggttatttctca

SEQ ID NO: 260742 - DNA, 16 bp, Homo sapiens
gtggttcagagactgg

SEQ ID NO: 260743 - DNA, 14 bp, Homo sapiens
gtggttctatttta

SEQ ID NO: 260744 - DNA, 16 bp, Homo sapiens
gtggtttgcttgctct

SEQ ID NO: 260745 - DNA, 19 bp, Homo sapiens
gtggttttcccctccctgg

SEQ ID NO: 260746 - DNA, 16 bp, Homo sapiens
gtggttttctgtttct

SEQ ID NO: 260747 - DNA, 23 bp, Homo sapiens
gtgtaaaacgagaatccacccat

SEQ ID NO: 260748 - DNA, 20 bp, Homo sapiens
gtgtaaatatttttccctcc

SEQ ID NO: 260749 - DNA, 21 bp, Homo sapiens
gtgtaacagctgaggtctctt

SEQ ID NO: 260750 - DNA, 21 bp, Homo sapiens
gtgtaaccagcagtcacaggt

SEQ ID NO: 260751 - DNA, 20 bp, Homo sapiens
gtgtaactgcccaaagcagc

SEQ ID NO: 260752 - DNA, 22 bp, Homo sapiens
gtgtaagtgtgagtaagagctg

SEQ ID NO: 260753 - DNA, 21 bp, Homo sapiens
gtgtaatcatttcttgggccc

SEQ ID NO: 260754 - DNA, 14 bp, Homo sapiens
gtgtacagtatgtg

SEQ ID NO: 260755 - DNA, 20 bp, Homo sapiens
gtgtacagtatgtgtctagc

SEQ ID NO: 260756 - DNA, 18 bp, Homo sapiens
gtgtacatttatgtgtga

SEQ ID NO: 260757 - DNA, 13 bp, Homo sapiens
gtgtactgataaa

SEQ ID NO: 260758 - DNA, 17 bp, Homo sapiens
gtgtagatttgttttgt

SEQ ID NO: 260759 - DNA, 17 bp, Homo sapiens
gtgtagccaggaagccc

SEQ ID NO: 260760 - DNA, 23 bp, Homo sapiens
gtgtagccaggaagccccgctca

SEQ ID NO: 260761 - DNA, 20 bp, Homo sapiens
gtgtagccccaagaaggctg

SEQ ID NO: 260762 - DNA, 17 bp, Homo sapiens
gtgtagcgtcctgagga

SEQ ID NO: 260763 - DNA, 13 bp, Homo sapiens
gtgtagctgtcct

SEQ ID NO: 260764 - DNA, 17 bp, Homo sapiens
gtgtagtggaagagcag

SEQ ID NO: 260765 - DNA, 20 bp, Homo sapiens
gtgtataccacctgtacata

SEQ ID NO: 260766 - DNA, 13 bp, Homo sapiens
gtgtatatcagaa

SEQ ID NO: 260767 - DNA, 18 bp, Homo sapiens
gtgtatatcatgaagcct

SEQ ID NO: 260768 - DNA, 21 bp, Homo sapiens
gtgtatattatcttctggtgc

SEQ ID NO: 260769 - DNA, 15 bp, Homo sapiens
gtgtatcctggggct

SEQ ID NO: 260770 - DNA, 20 bp, Homo sapiens
gtgtatcctggggctccctt

SEQ ID NO: 260771 - DNA, 20 bp, Homo sapiens
gtgtatgattttgatgcaca

SEQ ID NO: 260772 - DNA, 22 bp, Homo sapiens
gtgtatgcaagtgggagatgaa

SEQ ID NO: 260773 - DNA, 16 bp, Homo sapiens
gtgtatgtgcgtgtgt

SEQ ID NO: 260774 - DNA, 13 bp, Homo sapiens
gtgtatgtgttta

SEQ ID NO: 260775 - DNA, 22 bp, Homo sapiens
gtgtatgtgtttataattgtta

SEQ ID NO: 260776 - DNA, 18 bp, Homo sapiens
gtgtatgtttgcacactt

SEQ ID NO: 260777 - DNA, 12 bp, Homo sapiens
gtgtattgttcc

SEQ ID NO: 260778 - DNA, 14 bp, Homo sapiens
gtgtatttctgtag

SEQ ID NO: 260779 - DNA, 22 bp, Homo sapiens
gtgtatttttcaggtaggccct

SEQ ID NO: 260780 - DNA, 15 bp, Homo sapiens
gtgtcaactttcatt

SEQ ID NO: 260781 - DNA, 16 bp, Homo sapiens
gtgtcaagttgtgctt

SEQ ID NO: 260782 - DNA, 18 bp, Homo sapiens
gtgtcaagttgtgcttgt

SEQ ID NO: 260783 - DNA, 18 bp, Homo sapiens
gtgtcaccatgagcacct

SEQ ID NO: 260784 - DNA, 15 bp, Homo sapiens
gtgtcaccctgcaga

SEQ ID NO: 260785 - DNA, 23 bp, Homo sapiens
gtgtcactactcacagtctcttt

SEQ ID NO: 260786 - DNA, 19 bp, Homo sapiens
gtgtcatagaatagcatgt

SEQ ID NO: 260787 - DNA, 14 bp, Homo sapiens
gtgtcatctgtcag

SEQ ID NO: 260788 - DNA, 16 bp, Homo sapiens
gtgtcatctgtcagct

SEQ ID NO: 260789 - DNA, 13 bp, Homo sapiens
gtgtcatgatttc

SEQ ID NO: 260790 - DNA, 21 bp, Homo sapiens
gtgtcatggtgatgcaagtca

SEQ ID NO: 260791 - DNA, 21 bp, Homo sapiens
gtgtccagagacatgggcctc

SEQ ID NO: 260792 - DNA, 15 bp, Homo sapiens
gtgtccagcagctgc

SEQ ID NO: 260793 - DNA, 14 bp, Homo sapiens
gtgtccccaacgtc

SEQ ID NO: 260794 - DNA, 12 bp, Homo sapiens
gtgtccccagcc

SEQ ID NO: 260795 - DNA, 15 bp, Homo sapiens
gtgtccccagcccac

SEQ ID NO: 260796 - DNA, 18 bp, Homo sapiens
gtgtcccctgacctgtcc

SEQ ID NO: 260797 - DNA, 15 bp, Homo sapiens
gtgtccccttcccct

SEQ ID NO: 260798 - DNA, 18 bp, Homo sapiens
gtgtccccttcccctgct

SEQ ID NO: 260799 - DNA, 20 bp, Homo sapiens
gtgtccgctctctcatgtgg

SEQ ID NO: 260800 - DNA, 21 bp, Homo sapiens
gtgtccttcttcctcaagtct

SEQ ID NO: 260801 - DNA, 16 bp, Homo sapiens
gtgtcctttccctcca

SEQ ID NO: 260802 - DNA, 17 bp, Homo sapiens
gtgtcctttccctccac

SEQ ID NO: 260803 - DNA, 21 bp, Homo sapiens
gtgtcggggggcgagggaggg

SEQ ID NO: 260804 - DNA, 14 bp, Homo sapiens
gtgtcgtcctgcag

SEQ ID NO: 260805 - DNA, 21 bp, Homo sapiens
gtgtcgtcctgcagtgtgaga

SEQ ID NO: 260806 - DNA, 17 bp, Homo sapiens
gtgtctaagttttgtca

SEQ ID NO: 260807 - DNA, 21 bp, Homo sapiens
gtgtctaatgcattaactttt

SEQ ID NO: 260808 - DNA, 19 bp, Homo sapiens
gtgtctagcaaagccacca

SEQ ID NO: 260809 - DNA, 12 bp, Homo sapiens
ctggcagggcag

SEQ ID NO: 260810 - DNA, 13 bp, Homo sapiens
ctggcagggcagg

SEQ ID NO: 260811 - DNA, 15 bp, Homo sapiens
ctggcagggcaggca

SEQ ID NO: 260812 - DNA, 16 bp, Homo sapiens
ctggcagggcaggcag

SEQ ID NO: 260813 - DNA, 22 bp, Homo sapiens
ctggcagggcaggcagagctca

SEQ ID NO: 260814 - DNA, 12 bp, Homo sapiens
ctggcaggtgca

SEQ ID NO: 260815 - DNA, 14 bp, Homo sapiens
ctggcaggtgcaga

SEQ ID NO: 260816 - DNA, 22 bp, Homo sapiens
ctggcaggtgcagatgggctgt

SEQ ID NO: 260817 - DNA, 16 bp, Homo sapiens
ctggcaggtgccccgt

SEQ ID NO: 260818 - DNA, 11 bp, Homo sapiens
ctggcaggtgg

SEQ ID NO: 260819 - DNA, 14 bp, Homo sapiens
ctggcaggtggcca

SEQ ID NO: 260820 - DNA, 22 bp, Homo sapiens
ctggcaggtgttgggacctgct

SEQ ID NO: 260821 - DNA, 13 bp, Homo sapiens
ctggcagtacaga

SEQ ID NO: 260822 - DNA, 18 bp, Homo sapiens
ctggcagtacagagtgca

SEQ ID NO: 260823 - DNA, 16 bp, Homo sapiens
ctggcatctctggagt

SEQ ID NO: 260824 - DNA, 22 bp, Homo sapiens
ctggcatgggaatgaatgtcag

SEQ ID NO: 260825 - DNA, 19 bp, Homo sapiens
ctggcattctacacctgga

SEQ ID NO: 260826 - DNA, 17 bp, Homo sapiens
ctggcattgtccctgtg

SEQ ID NO: 260827 - DNA, 12 bp, Homo sapiens
ctggccaaagtc

SEQ ID NO: 260828 - DNA, 21 bp, Homo sapiens
ctggccacaatcctccccacc

SEQ ID NO: 260829 - DNA, 12 bp, Homo sapiens
ctggccaccctg

SEQ ID NO: 260830 - DNA, 22 bp, Homo sapiens
ctggccacccttggcctgtcca

SEQ ID NO: 260831 - DNA, 18 bp, Homo sapiens
ctggccacgcagccagga

SEQ ID NO: 260832 - DNA, 21 bp, Homo sapiens
ctggccacgcagccaggacac

SEQ ID NO: 260833 - DNA, 19 bp, Homo sapiens
ctggccagagagggcccag

SEQ ID NO: 260834 - DNA, 20 bp, Homo sapiens
ctggccagagagggcccagc

SEQ ID NO: 260835 - DNA, 19 bp, Homo sapiens
ctggccagcaaggcaggtt

SEQ ID NO: 260836 - DNA, 19 bp, Homo sapiens
ctggccagcctggggcctg

SEQ ID NO: 260837 - DNA, 24 bp, Homo sapiens
ctggccagcctggggcctggcagg

SEQ ID NO: 260838 - DNA, 20 bp, Homo sapiens
ctggccaggagctcttcagg

SEQ ID NO: 260839 - DNA, 22 bp, Homo sapiens
ctggccaggagctcttcaggcc

SEQ ID NO: 260840 - DNA, 14 bp, Homo sapiens
ctggccaggcagat

SEQ ID NO: 260841 - DNA, 12 bp, Homo sapiens
ctggccatctct

SEQ ID NO: 260842 - DNA, 16 bp, Homo sapiens
ctggcccacgccctcc

SEQ ID NO: 260843 - DNA, 11 bp, Homo sapiens
ctggcccagcc

SEQ ID NO: 260844 - DNA, 20 bp, Homo sapiens
ctggcccagccaaaccctgt

SEQ ID NO: 260845 - DNA, 13 bp, Homo sapiens
ctggcccagccag

SEQ ID NO: 260846 - DNA, 14 bp, Homo sapiens
ctggcccagccagc

SEQ ID NO: 260847 - DNA, 17 bp, Homo sapiens
ctggcccagcggcccct

SEQ ID NO: 260848 - DNA, 16 bp, Homo sapiens
ctggcccatctcagcc

SEQ ID NO: 260849 - DNA, 20 bp, Homo sapiens
ctggcccatctcagcctcct

SEQ ID NO: 260850 - DNA, 21 bp, Homo sapiens
ctggccccaaatgttctttcc

SEQ ID NO: 260851 - DNA, 14 bp, Homo sapiens
ctggccccaggcgg

SEQ ID NO: 260852 - DNA, 13 bp, Homo sapiens
ctggcccccctcc

SEQ ID NO: 260853 - DNA, 15 bp, Homo sapiens
gtgtggctcccctct

SEQ ID NO: 260854 - DNA, 12 bp, Homo sapiens
gtgtggcttgga

SEQ ID NO: 260855 - DNA, 14 bp, Homo sapiens
gtgtggcttggaac

SEQ ID NO: 260856 - DNA, 12 bp, Homo sapiens
gtgtgggagggc

SEQ ID NO: 260857 - DNA, 13 bp, Homo sapiens
gtgtgggagggcg

SEQ ID NO: 260858 - DNA, 20 bp, Homo sapiens
gtgtgggagggcgaggcggg

SEQ ID NO: 260859 - DNA, 15 bp, Homo sapiens
gtgtgggatacttag

SEQ ID NO: 260860 - DNA, 14 bp, Homo sapiens
gtgtggggagggtg

SEQ ID NO: 260861 - DNA, 15 bp, Homo sapiens
gtgtggggagggtgg

SEQ ID NO: 260862 - DNA, 13 bp, Homo sapiens
gtgtggggcatgg

SEQ ID NO: 260863 - DNA, 21 bp, Homo sapiens
gtgtggggcccaagcatgccc

SEQ ID NO: 260864 - DNA, 17 bp, Homo sapiens
gtgtgggggtctgggag

SEQ ID NO: 260865 - DNA, 21 bp, Homo sapiens
gtgtgggggtctgggaggcag

SEQ ID NO: 260866 - DNA, 23 bp, Homo sapiens
gtgtgggggtctgggaggcaggt

SEQ ID NO: 260867 - DNA, 14 bp, Homo sapiens
gtgtggggtggggt

SEQ ID NO: 260868 - DNA, 12 bp, Homo sapiens
gtgtggtccctc

SEQ ID NO: 260869 - DNA, 16 bp, Homo sapiens
gtgtgtagccaggaag

SEQ ID NO: 260870 - DNA, 16 bp, Homo sapiens
gtgtgtctcctgcatg

SEQ ID NO: 260871 - DNA, 20 bp, Homo sapiens
gtgtgtctttcctccctgaa

SEQ ID NO: 260872 - DNA, 16 bp, Homo sapiens
gtgtgtgcaatgttcc

SEQ ID NO: 260873 - DNA, 12 bp, Homo sapiens
gtgtgtgtatgt

SEQ ID NO: 260874 - DNA, 14 bp, Homo sapiens
gtgtgtgtgtgtgt

SEQ ID NO: 260875 - DNA, 21 bp, Homo sapiens
gtgtgttctgtaatggaactg

SEQ ID NO: 260876 - DNA, 20 bp, Homo sapiens
gtgttaaatcacagaaaaaa

SEQ ID NO: 260877 - DNA, 19 bp, Homo sapiens
gtgttaaatgaaattgtaa

SEQ ID NO: 260878 - DNA, 20 bp, Homo sapiens
gtgttcaaactactgtacat

SEQ ID NO: 260879 - DNA, 13 bp, Homo sapiens
gtgttcctctttg

SEQ ID NO: 260880 - DNA, 18 bp, Homo sapiens
gtgttcgtggagccacag

SEQ ID NO: 260881 - DNA, 21 bp, Homo sapiens
gtgttcgtggagccacaggca

SEQ ID NO: 260882 - DNA, 11 bp, Homo sapiens
gtgttcgttct

SEQ ID NO: 260883 - DNA, 20 bp, Homo sapiens
gtgttctccactaatactgg

SEQ ID NO: 260884 - DNA, 13 bp, Homo sapiens
gtgttctcctcca

SEQ ID NO: 260885 - DNA, 22 bp, Homo sapiens
gtgttctctccccttgcactgg

SEQ ID NO: 260886 - DNA, 12 bp, Homo sapiens
gtgttctgtttc

SEQ ID NO: 260887 - DNA, 14 bp, Homo sapiens
gtgttctgtttccc

SEQ ID NO: 260888 - DNA, 19 bp, Homo sapiens
gtgttcttgctaactttgc

SEQ ID NO: 260889 - DNA, 17 bp, Homo sapiens
gtgttcttttgatacat

SEQ ID NO: 260890 - DNA, 18 bp, Homo sapiens
gtgttcttttgatacatt

SEQ ID NO: 260891 - DNA, 23 bp, Homo sapiens
gtgttcttttgatacatttatct

SEQ ID NO: 260892 - DNA, 17 bp, Homo sapiens
gtgttctttttaaaaag

SEQ ID NO: 260893 - DNA, 14 bp, Homo sapiens
gtgttgactgctgc

SEQ ID NO: 260894 - DNA, 17 bp, Homo sapiens
gtgttgactttttaaaa

SEQ ID NO: 260895 - DNA, 13 bp, Homo sapiens
gtgttgattgcca

SEQ ID NO: 260896 - DNA, 19 bp, Homo sapiens
gtgttgattttctgttgta

SEQ ID NO: 260897 - DNA, 12 bp, Homo sapiens
gtgttgccaaag

SEQ ID NO: 260898 - DNA, 17 bp, Homo sapiens
gtgttgccaaatatgtc

SEQ ID NO: 260899 - DNA, 20 bp, Homo sapiens
gtgttgccaaatatgtcctg

SEQ ID NO: 260900 - DNA, 15 bp, Homo sapiens
gtgttgccacaggac

SEQ ID NO: 260901 - DNA, 18 bp, Homo sapiens
gtgttgccacaggacaca

SEQ ID NO: 260902 - DNA, 18 bp, Homo sapiens
gtgttggcccaagctctt

SEQ ID NO: 260903 - DNA, 24 bp, Homo sapiens
gtgttggtctttctaatgtagcta

SEQ ID NO: 260904 - DNA, 21 bp, Homo sapiens
gtgttgttatcatttaagatt

SEQ ID NO: 260905 - DNA, 11 bp, Homo sapiens
gtgtttaaata

SEQ ID NO: 260906 - DNA, 12 bp, Homo sapiens
gtgtttacatta

SEQ ID NO: 260907 - DNA, 15 bp, Homo sapiens
gtgtttagttgcaga

SEQ ID NO: 260908 - DNA, 20 bp, Homo sapiens
gtgtttatttttcatattgt

SEQ ID NO: 260909 - DNA, 22 bp, Homo sapiens
gtgtttcaggtggaacaggagg

SEQ ID NO: 260910 - DNA, 23 bp, Homo sapiens
gtgtttcaggtggaacaggagga

SEQ ID NO: 260911 - DNA, 18 bp, Homo sapiens
gtgtttccatattttata

SEQ ID NO: 260912 - DNA, 20 bp, Homo sapiens
gtgtttccctagactctgta

SEQ ID NO: 260913 - DNA, 13 bp, Homo sapiens
gtgtttctgcaga

SEQ ID NO: 260914 - DNA, 17 bp, Homo sapiens
gtgtttctgcagaggca

SEQ ID NO: 260915 - DNA, 19 bp, Homo sapiens
gtgtttctgcagaggcagc

SEQ ID NO: 260916 - DNA, 18 bp, Homo sapiens
gtgtttgcttaaacaaag

SEQ ID NO: 260917 - DNA, 22 bp, Homo sapiens
gtgtttgggaagcaacaaagag

SEQ ID NO: 260918 - DNA, 17 bp, Homo sapiens
gtgtttgtgagtatgtg

SEQ ID NO: 260919 - DNA, 18 bp, Homo sapiens
gtgttttaaagagaatgt

SEQ ID NO: 260920 - DNA, 14 bp, Homo sapiens
gtgttttattcact

SEQ ID NO: 260921 - DNA, 16 bp, Homo sapiens
gttaaaaaaaataata

SEQ ID NO: 260922 - DNA, 18 bp, Homo sapiens
gttaaaaaaaataataaa

SEQ ID NO: 260923 - DNA, 19 bp, Homo sapiens
gttaaaaaaaataataaat

SEQ ID NO: 260924 - DNA, 14 bp, Homo sapiens
gttaaaagacagtg

SEQ ID NO: 260925 - DNA, 23 bp, Homo sapiens
gttaaaatataaattaagacttt

SEQ ID NO: 260926 - DNA, 17 bp, Homo sapiens
gttaaagagacaaatag

SEQ ID NO: 260927 - DNA, 12 bp, Homo sapiens
gttaaaggcagt

SEQ ID NO: 260928 - DNA, 16 bp, Homo sapiens
gttaaaggcagtccag

SEQ ID NO: 260929 - DNA, 17 bp, Homo sapiens
gttaaaggcagtccaga

SEQ ID NO: 260930 - DNA, 22 bp, Homo sapiens
gttaaaggcagtccagagcttt

SEQ ID NO: 260931 - DNA, 19 bp, Homo sapiens
gttaaatagagtatatgca

SEQ ID NO: 260932 - DNA, 13 bp, Homo sapiens
gttaacaaggaat

SEQ ID NO: 260933 - DNA, 15 bp, Homo sapiens
gttaacaaggaatgc

SEQ ID NO: 260934 - DNA, 23 bp, Homo sapiens
gttaacaaggaatgcctgtgcca

SEQ ID NO: 260935 - DNA, 21 bp, Homo sapiens
gttaacattcagtactttatg

SEQ ID NO: 260936 - DNA, 17 bp, Homo sapiens
gttaacctcagtgtcat

SEQ ID NO: 260937 - DNA, 18 bp, Homo sapiens
gttaagacaacaggcatt

SEQ ID NO: 260938 - DNA, 11 bp, Homo sapiens
gttaagagaaa

SEQ ID NO: 260939 - DNA, 14 bp, Homo sapiens
gttaagcagccgcc

SEQ ID NO: 260940 - DNA, 14 bp, Homo sapiens
gttaagtggtttca

SEQ ID NO: 260941 - DNA, 16 bp, Homo sapiens
gttaagtgtcatttct

SEQ ID NO: 260942 - DNA, 16 bp, Homo sapiens
gttaataggaggacag

SEQ ID NO: 260943 - DNA, 21 bp, Homo sapiens
gttaatatatcccagaaatta

SEQ ID NO: 260944 - DNA, 15 bp, Homo sapiens
gttaatattaattta

SEQ ID NO: 260945 - DNA, 18 bp, Homo sapiens
gttaatcatcttctcttt

SEQ ID NO: 260946 - DNA, 13 bp, Homo sapiens
gttaatcttgctt

SEQ ID NO: 260947 - DNA, 19 bp, Homo sapiens
gttaatggctagtactgta

SEQ ID NO: 260948 - DNA, 15 bp, Homo sapiens
ctggctggggcagag

SEQ ID NO: 260949 - DNA, 16 bp, Homo sapiens
ctggctggggcagagg

SEQ ID NO: 260950 - DNA, 18 bp, Homo sapiens
ctggctggggcagagggg

SEQ ID NO: 260951 - DNA, 23 bp, Homo sapiens
ctggctggggcagaggggcagcc

SEQ ID NO: 260952 - DNA, 16 bp, Homo sapiens
ctggctgggggcctca

SEQ ID NO: 260953 - DNA, 19 bp, Homo sapiens
ctggctgggggcctcactc

SEQ ID NO: 260954 - DNA, 19 bp, Homo sapiens
ctggctgggtcgcccctcc

SEQ ID NO: 260955 - DNA, 18 bp, Homo sapiens
ctggctgggttttcaggg

SEQ ID NO: 260956 - DNA, 21 bp, Homo sapiens
ctggctgtgagacgaggcagg

SEQ ID NO: 260957 - DNA, 22 bp, Homo sapiens
ctggctgtgagacgaggcaggg

SEQ ID NO: 260958 - DNA, 13 bp, Homo sapiens
ctggctgtgagca

SEQ ID NO: 260959 - DNA, 15 bp, Homo sapiens
ctggctgtgagcagc

SEQ ID NO: 260960 - DNA, 15 bp, Homo sapiens
ctggctgtggcccct

SEQ ID NO: 260961 - DNA, 16 bp, Homo sapiens
ctggctgttggcccct

SEQ ID NO: 260962 - DNA, 16 bp, Homo sapiens
ctggcttcccaggacc

SEQ ID NO: 260963 - DNA, 19 bp, Homo sapiens
ctggcttcccaggaccctg

SEQ ID NO: 260964 - DNA, 23 bp, Homo sapiens
ctggcttccgctgtcacccagca

SEQ ID NO: 260965 - DNA, 20 bp, Homo sapiens
ctggcttctccctggactct

SEQ ID NO: 260966 - DNA, 16 bp, Homo sapiens
ctggcttgctccaggg

SEQ ID NO: 260967 - DNA, 14 bp, Homo sapiens
ctggcttgcttgcc

SEQ ID NO: 260968 - DNA, 16 bp, Homo sapiens
ctggctttgcccaacc

SEQ ID NO: 260969 - DNA, 19 bp, Homo sapiens
ctggctttgtcccacagct

SEQ ID NO: 260970 - DNA, 18 bp, Homo sapiens
ctggcttttatttaaaga

SEQ ID NO: 260971 - DNA, 23 bp, Homo sapiens
ctggcttttcactgctggctgcc

SEQ ID NO: 260972 - DNA, 13 bp, Homo sapiens
ctggctttttccc

SEQ ID NO: 260973 - DNA, 23 bp, Homo sapiens
ctgggaaaaaagttttgatgaaa

SEQ ID NO: 260974 - DNA, 16 bp, Homo sapiens
ctgggaaaggacccac

SEQ ID NO: 260975 - DNA, 13 bp, Homo sapiens
ctgggaaaggtgc

SEQ ID NO: 260976 - DNA, 15 bp, Homo sapiens
ctgggaaaggtgctc

SEQ ID NO: 260977 - DNA, 20 bp, Homo sapiens
ctgggaaaggtgctcaaaga

SEQ ID NO: 260978 - DNA, 22 bp, Homo sapiens
ctgggaaaggtgctcaaagatg

SEQ ID NO: 260979 - DNA, 13 bp, Homo sapiens
ctgggaaccccgc

SEQ ID NO: 260980 - DNA, 19 bp, Homo sapiens
ctgggaaccccgcagcccg

SEQ ID NO: 260981 - DNA, 20 bp, Homo sapiens
ctgggaagataggctctgca

SEQ ID NO: 260982 - DNA, 21 bp, Homo sapiens
ctgggaagataggctctgcac

SEQ ID NO: 260983 - DNA, 12 bp, Homo sapiens
ctgggaagatgc

SEQ ID NO: 260984 - DNA, 20 bp, Homo sapiens
aaagtataaattcgctgtga

SEQ ID NO: 260985 - DNA, 18 bp, Homo sapiens
aaagtataaatttgtgta

SEQ ID NO: 260986 - DNA, 13 bp, Homo sapiens
aaagtatatatag

SEQ ID NO: 260987 - DNA, 14 bp, Homo sapiens
aaagtatatgttag

SEQ ID NO: 260988 - DNA, 15 bp, Homo sapiens
aaagtatcatgcatt

SEQ ID NO: 260989 - DNA, 21 bp, Homo sapiens
aaagtatcctgcttctgatat

SEQ ID NO: 260990 - DNA, 14 bp, Homo sapiens
aaagtatgtgatat

SEQ ID NO: 260991 - DNA, 14 bp, Homo sapiens
aaagtattccacct

SEQ ID NO: 260992 - DNA, 20 bp, Homo sapiens
aaagtcagctttcagagcca

SEQ ID NO: 260993 - DNA, 15 bp, Homo sapiens
aaagtcatgaagctc

SEQ ID NO: 260994 - DNA, 19 bp, Homo sapiens
aaagtctaaagtttacagt

SEQ ID NO: 260995 - DNA, 13 bp, Homo sapiens
aaagtctattttt

SEQ ID NO: 260996 - DNA, 22 bp, Homo sapiens
aaagtctatttttttaactgaa

SEQ ID NO: 260997 - DNA, 23 bp, Homo sapiens
aaagtctatttttttaactgaaa

SEQ ID NO: 260998 - DNA, 22 bp, Homo sapiens
aaagtctgtgtgatgaactttc

SEQ ID NO: 260999 - DNA, 23 bp, Homo sapiens
aaagtctgtgtgatgaactttct

SEQ ID NO: 261000 - DNA, 13 bp, Homo sapiens
aaagtcttgctgt

SEQ ID NO: 261001 - DNA, 20 bp, Homo sapiens
aaagtcttgctgtggtctct

SEQ ID NO: 261002 - DNA, 22 bp, Homo sapiens
aaagtcttgtgactagtgctga

SEQ ID NO: 261003 - DNA, 22 bp, Homo sapiens
aaagtgaagaagccatcaattt

SEQ ID NO: 261004 - DNA, 19 bp, Homo sapiens
aaagtgaatttgaatgaaa

SEQ ID NO: 261005 - DNA, 20 bp, Homo sapiens
aaagtgaatttgaatgaaaa

SEQ ID NO: 261006 - DNA, 13 bp, Homo sapiens
aaagtgacacagc

SEQ ID NO: 261007 - DNA, 22 bp, Homo sapiens
aaagtgaggaagcctaaataaa

SEQ ID NO: 261008 - DNA, 20 bp, Homo sapiens
aaagtgagtctgaattgttg

SEQ ID NO: 261009 - DNA, 22 bp, Homo sapiens
aaagtgatgtgatttatgcatt

SEQ ID NO: 261010 - DNA, 20 bp, Homo sapiens
aaagtgatttgtaatatgat

SEQ ID NO: 261011 - DNA, 13 bp, Homo sapiens
aaagtgcacacct

SEQ ID NO: 261012 - DNA, 23 bp, Homo sapiens
aaagtgcagctccgtttggcagt

SEQ ID NO: 261013 - DNA, 17 bp, Homo sapiens
aaagtgctacttgagag

SEQ ID NO: 261014 - DNA, 17 bp, Homo sapiens
aaagtggattttcctga

SEQ ID NO: 261015 - DNA, 16 bp, Homo sapiens
aaagtggctaattcaa

SEQ ID NO: 261016 - DNA, 16 bp, Homo sapiens
aaagtgggtttcaatt

SEQ ID NO: 261017 - DNA, 21 bp, Homo sapiens
aaagtgggttttttagttgaa

SEQ ID NO: 261018 - DNA, 12 bp, Homo sapiens
aaagtggtgaga

SEQ ID NO: 261019 - DNA, 17 bp, Homo sapiens
aaagtgtaaaatagaat

SEQ ID NO: 261020 - DNA, 17 bp, Homo sapiens
aaagtgtacaattttca

SEQ ID NO: 261021 - DNA, 18 bp, Homo sapiens
aaagtgtacaattttcat

SEQ ID NO: 261022 - DNA, 19 bp, Homo sapiens
aaagtgtgctttatgctga

SEQ ID NO: 261023 - DNA, 14 bp, Homo sapiens
aaagtgtttttctt

SEQ ID NO: 261024 - DNA, 15 bp, Homo sapiens
aaagttaaaaaaaat

SEQ ID NO: 261025 - DNA, 16 bp, Homo sapiens
aaagttaaacattgaa

SEQ ID NO: 261026 - DNA, 20 bp, Homo sapiens
aaagttaaacgtgatgtgct

SEQ ID NO: 261027 - DNA, 22 bp, Homo sapiens
aaagttaacattcagtacttta

SEQ ID NO: 261028 - DNA, 18 bp, Homo sapiens
aaagttcaaagcaaccac

SEQ ID NO: 261029 - DNA, 18 bp, Homo sapiens
aaagttcacaatgtggcc

SEQ ID NO: 261030 - DNA, 16 bp, Homo sapiens
aaagttccagttttgt

SEQ ID NO: 261031 - DNA, 23 bp, Homo sapiens
aaagttccctacttcctgtgact

SEQ ID NO: 261032 - DNA, 21 bp, Homo sapiens
aaagttgataggagacttgta

SEQ ID NO: 261033 - DNA, 17 bp, Homo sapiens
aaagttgttttgattat

SEQ ID NO: 261034 - DNA, 18 bp, Homo sapiens
aaagtttaaataccagta

SEQ ID NO: 261035 - DNA, 12 bp, Homo sapiens
aaagtttacaac

SEQ ID NO: 261036 - DNA, 21 bp, Homo sapiens
aaagtttacagtaaataaatt

SEQ ID NO: 261037 - DNA, 22 bp, Homo sapiens
aaagtttacagtaaataaattg

SEQ ID NO: 261038 - DNA, 14 bp, Homo sapiens
aaagtttccatatg

SEQ ID NO: 261039 - DNA, 13 bp, Homo sapiens
aaagttttatcaa

SEQ ID NO: 261040 - DNA, 16 bp, Homo sapiens
aaagttttatgtactt

SEQ ID NO: 261041 - DNA, 15 bp, Homo sapiens
aaagttttccagtat

SEQ ID NO: 261042 - DNA, 18 bp, Homo sapiens
aaagttttccagtattga

SEQ ID NO: 261043 - DNA, 21 bp, Homo sapiens
aaagttttgatgaaattcttg

SEQ ID NO: 261044 - DNA, 16 bp, Homo sapiens
aaagtttttacagtgt

SEQ ID NO: 261045 - DNA, 19 bp, Homo sapiens
aaataaaaaaaaaaggatg

SEQ ID NO: 261046 - DNA, 14 bp, Homo sapiens
aaataaaaataaat

SEQ ID NO: 261047 - DNA, 14 bp, Homo sapiens
aaataaaaatattc

SEQ ID NO: 261048 - DNA, 18 bp, Homo sapiens
aaataaaaatattctcca

SEQ ID NO: 261049 - DNA, 22 bp, Homo sapiens
aaataaaaatcaacttgtgtac

SEQ ID NO: 261050 - DNA, 23 bp, Homo sapiens
aaataaaaattattattgatttt

SEQ ID NO: 261051 - DNA, 13 bp, Homo sapiens
aaataaaaccttt

SEQ ID NO: 261052 - DNA, 17 bp, Homo sapiens
aaataaaacctttcaaa

SEQ ID NO: 261053 - DNA, 12 bp, Homo sapiens
aaataaaactat

SEQ ID NO: 261054 - DNA, 13 bp, Homo sapiens
aaataaaactatt

SEQ ID NO: 261055 - DNA, 16 bp, Homo sapiens
aaataaaagagagaga

SEQ ID NO: 261056 - DNA, 13 bp, Homo sapiens
aaataaaagcagc

SEQ ID NO: 261057 - DNA, 16 bp, Homo sapiens
aaataaaagtgatcaa

SEQ ID NO: 261058 - DNA, 12 bp, Homo sapiens
aaataaaatgat

SEQ ID NO: 261059 - DNA, 19 bp, Homo sapiens
aaataaacacatagattca

SEQ ID NO: 261060 - DNA, 23 bp, Homo sapiens
aaataaacacatagattcacctg

SEQ ID NO: 261061 - DNA, 19 bp, Homo sapiens
aaataaacctcaaaatgtc

SEQ ID NO: 261062 - DNA, 14 bp, Homo sapiens
aaataaacgaaaca

SEQ ID NO: 261063 - DNA, 13 bp, Homo sapiens
aaataaactcttc

SEQ ID NO: 261064 - DNA, 20 bp, Homo sapiens
aaataaagcttgcaacaaaa

SEQ ID NO: 261065 - DNA, 21 bp, Homo sapiens
aaataaagtacgtgtttactt

SEQ ID NO: 261066 - DNA, 15 bp, Homo sapiens
aaataaagtatatat

SEQ ID NO: 261067 - DNA, 16 bp, Homo sapiens
aaataaagtatatata

SEQ ID NO: 261068 - DNA, 20 bp, Homo sapiens
aaataaagtatatatagaat

SEQ ID NO: 261069 - DNA, 18 bp, Homo sapiens
aaataaagtatcatgcat

SEQ ID NO: 261070 - DNA, 19 bp, Homo sapiens
aaataaagtatcatgcatt

SEQ ID NO: 261071 - DNA, 20 bp, Homo sapiens
aaataaatagctatatccat

SEQ ID NO: 261072 - DNA, 12 bp, Homo sapiens
aaataaatatac

SEQ ID NO: 261073 - DNA, 23 bp, Homo sapiens
aaataaatatactaataaaaagg

SEQ ID NO: 261074 - DNA, 17 bp, Homo sapiens
aaataaatgtttttatt

SEQ ID NO: 261075 - DNA, 22 bp, Homo sapiens
aaataaattggtgataagtgga

SEQ ID NO: 261076 - DNA, 13 bp, Homo sapiens
aaataaattgttt

SEQ ID NO: 261077 - DNA, 12 bp, Homo sapiens
aaataaatttct

SEQ ID NO: 261078 - DNA, 22 bp, Homo sapiens
aaataacaagtaccaaagtttt

SEQ ID NO: 261079 - DNA, 21 bp, Homo sapiens
aaataacacacatataaacat

SEQ ID NO: 261080 - DNA, 23 bp, Homo sapiens
aaataacacagagagacagactt

SEQ ID NO: 261081 - DNA, 13 bp, Homo sapiens
aaataacacagat

SEQ ID NO: 261082 - DNA, 20 bp, Homo sapiens
aaataacatattcttgcttt

SEQ ID NO: 261083 - DNA, 13 bp, Homo sapiens
aaataacattgca

SEQ ID NO: 261084 - DNA, 14 bp, Homo sapiens
aaataacattgcac

SEQ ID NO: 261085 - DNA, 22 bp, Homo sapiens
aaataacattgcactttataaa

SEQ ID NO: 261086 - DNA, 16 bp, Homo sapiens
aaataaccacaaggtc

SEQ ID NO: 261087 - DNA, 18 bp, Homo sapiens
aaataacttcaagcaaac

SEQ ID NO: 261088 - DNA, 12 bp, Homo sapiens
aaataagagatt

SEQ ID NO: 261089 - DNA, 13 bp, Homo sapiens
gttcccctcactg

SEQ ID NO: 261090 - DNA, 17 bp, Homo sapiens
gttcccctgttcactct

SEQ ID NO: 261091 - DNA, 18 bp, Homo sapiens
gttcccctgttcactcta

SEQ ID NO: 261092 - DNA, 13 bp, Homo sapiens
gttccccttggct

SEQ ID NO: 261093 - DNA, 15 bp, Homo sapiens
gttcccggagcacag

SEQ ID NO: 261094 - DNA, 17 bp, Homo sapiens
gttcccggagcacagcc

SEQ ID NO: 261095 - DNA, 18 bp, Homo sapiens
gttcccggagcacagccc

SEQ ID NO: 261096 - DNA, 15 bp, Homo sapiens
gttccctcttccctg

SEQ ID NO: 261097 - DNA, 20 bp, Homo sapiens
gttccctcttccttggttcc

SEQ ID NO: 261098 - DNA, 11 bp, Homo sapiens
gttccctgcac

SEQ ID NO: 261099 - DNA, 13 bp, Homo sapiens
gttccctgcaccc

SEQ ID NO: 261100 - DNA, 17 bp, Homo sapiens
gttccctgcaccctgga

SEQ ID NO: 261101 - DNA, 13 bp, Homo sapiens
gttcccttctcct

SEQ ID NO: 261102 - DNA, 20 bp, Homo sapiens
gttcccttgtgtctgttgct

SEQ ID NO: 261103 - DNA, 20 bp, Homo sapiens
gttccctttgctccacccca

SEQ ID NO: 261104 - DNA, 20 bp, Homo sapiens
gttccctttgttgctgtctg

SEQ ID NO: 261105 - DNA, 22 bp, Homo sapiens
gttccgtctcctctccagccct

SEQ ID NO: 261106 - DNA, 18 bp, Homo sapiens
gttccgttcatctgagga

SEQ ID NO: 261107 - DNA, 19 bp, Homo sapiens
gttcctaaagaaaaagata

SEQ ID NO: 261108 - DNA, 15 bp, Homo sapiens
gttcctagagtagag

SEQ ID NO: 261109 - DNA, 21 bp, Homo sapiens
gttcctcaccaataacttcag

SEQ ID NO: 261110 - DNA, 19 bp, Homo sapiens
gttcctccagcaatgcctg

SEQ ID NO: 261111 - DNA, 13 bp, Homo sapiens
gttcctctttgca

SEQ ID NO: 261112 - DNA, 16 bp, Homo sapiens
gttcctctttgcatga

SEQ ID NO: 261113 - DNA, 21 bp, Homo sapiens
gttcctgaattctatttgctg

SEQ ID NO: 261114 - DNA, 16 bp, Homo sapiens
ctggtgagcagactgg

SEQ ID NO: 261115 - DNA, 19 bp, Homo sapiens
ctggtgaggaagctccagt

SEQ ID NO: 261116 - DNA, 13 bp, Homo sapiens
ctggtgaggacaa

SEQ ID NO: 261117 - DNA, 17 bp, Homo sapiens
ctggtgaggcccagcct

SEQ ID NO: 261118 - DNA, 18 bp, Homo sapiens
ctggtgaggcccagcctg

SEQ ID NO: 261119 - DNA, 18 bp, Homo sapiens
ctggtgatcactttatgt

SEQ ID NO: 261120 - DNA, 16 bp, Homo sapiens
ctggtgcactggcccc

SEQ ID NO: 261121 - DNA, 22 bp, Homo sapiens
ctggtgcatgttcttttctgga

SEQ ID NO: 261122 - DNA, 19 bp, Homo sapiens
ctggtgcattacagagagg

SEQ ID NO: 261123 - DNA, 22 bp, Homo sapiens
ctggtgcatttaaaatggactt

SEQ ID NO: 261124 - DNA, 16 bp, Homo sapiens
ctggtgccccacagct

SEQ ID NO: 261125 - DNA, 17 bp, Homo sapiens
ctggtgccccacagcta

SEQ ID NO: 261126 - DNA, 20 bp, Homo sapiens
ctggtgccccacagctacct

SEQ ID NO: 261127 - DNA, 14 bp, Homo sapiens
ctggtgcgctgtgc

SEQ ID NO: 261128 - DNA, 15 bp, Homo sapiens
ctggtgcgctgtgct

SEQ ID NO: 261129 - DNA, 12 bp, Homo sapiens
ctggtgctgctg

SEQ ID NO: 261130 - DNA, 16 bp, Homo sapiens
ctggtggatggtgact

SEQ ID NO: 261131 - DNA, 16 bp, Homo sapiens
ctggtggcccctgcct

SEQ ID NO: 261132 - DNA, 14 bp, Homo sapiens
ctggtggcctctgc

SEQ ID NO: 261133 - DNA, 15 bp, Homo sapiens
ctggtggcctctgcc

SEQ ID NO: 261134 - DNA, 14 bp, Homo sapiens
ctggtggctggagg

SEQ ID NO: 261135 - DNA, 16 bp, Homo sapiens
ctggtggctggaggca

SEQ ID NO: 261136 - DNA, 18 bp, Homo sapiens
ctggtgggcagctgagga

SEQ ID NO: 261137 - DNA, 17 bp, Homo sapiens
ctggtggtgcagccttc

SEQ ID NO: 261138 - DNA, 17 bp, Homo sapiens
ctggtgtcactctgcct

SEQ ID NO: 261139 - DNA, 22 bp, Homo sapiens
ctggtgtccccttcccctgctg

SEQ ID NO: 261140 - DNA, 23 bp, Homo sapiens
ctggtgtccccttcccctgctga

SEQ ID NO: 261141 - DNA, 18 bp, Homo sapiens
ctggtgtctagtttgcat

SEQ ID NO: 261142 - DNA, 14 bp, Homo sapiens
ctggtgttacacat

SEQ ID NO: 261143 - DNA, 15 bp, Homo sapiens
ctggtgttacacata

SEQ ID NO: 261144 - DNA, 22 bp, Homo sapiens
ctggttaggttaggacttgccc

SEQ ID NO: 261145 - DNA, 23 bp, Homo sapiens
ctggttatagttgatatgtaaca

SEQ ID NO: 261146 - DNA, 13 bp, Homo sapiens
ctggttccactca

SEQ ID NO: 261147 - DNA, 24 bp, Homo sapiens
ctggttccagaacgtctctcacct

SEQ ID NO: 261148 - DNA, 19 bp, Homo sapiens
ctggttcccccaggaccct

SEQ ID NO: 261149 - DNA, 21 bp, Homo sapiens
ctggttcccccaggaccctga

SEQ ID NO: 261150 - DNA, 13 bp, Homo sapiens
ctggttccctctt

SEQ ID NO: 261151 - DNA, 22 bp, Homo sapiens
ctggttcttcatttattgagca

SEQ ID NO: 261152 - DNA, 19 bp, Homo sapiens
ctggttcttgccttcccct

SEQ ID NO: 261153 - DNA, 20 bp, Homo sapiens
ctggttcttgtgttggctgt

SEQ ID NO: 261154 - DNA, 16 bp, Homo sapiens
ctggttgctgggcctc

SEQ ID NO: 261155 - DNA, 16 bp, Homo sapiens
ctggttgtatttctat

SEQ ID NO: 261156 - DNA, 15 bp, Homo sapiens
ctggtttgtttctca

SEQ ID NO: 261157 - DNA, 13 bp, Homo sapiens
ctggttttaacaa

SEQ ID NO: 261158 - DNA, 18 bp, Homo sapiens
ctggtttttctgttccct

SEQ ID NO: 261159 - DNA, 21 bp, Homo sapiens
ctgtaaaaagagagaaaactt

SEQ ID NO: 261160 - DNA, 23 bp, Homo sapiens
ctgtaaaatacatggtatctctt

SEQ ID NO: 261161 - DNA, 15 bp, Homo sapiens
ctgtaaaatccattt

SEQ ID NO: 261162 - DNA, 20 bp, Homo sapiens
ctgtaaaatccatttaatca

SEQ ID NO: 261163 - DNA, 15 bp, Homo sapiens
ctgtaaaatgaaatt

SEQ ID NO: 261164 - DNA, 16 bp, Homo sapiens
ctgtaaaatgaaatta

SEQ ID NO: 261165 - DNA, 14 bp, Homo sapiens
ctgtaaacccctgg

SEQ ID NO: 261166 - DNA, 12 bp, Homo sapiens
ctgtaaagaatt

SEQ ID NO: 261167 - DNA, 15 bp, Homo sapiens
ctgtaaatacatgtg

SEQ ID NO: 261168 - DNA, 11 bp, Homo sapiens
ctgtaaatatc

SEQ ID NO: 261169 - DNA, 21 bp, Homo sapiens
ctgtaaatatcccagagaaca

SEQ ID NO: 261170 - DNA, 14 bp, Homo sapiens
ctgtaaatcctaga

SEQ ID NO: 261171 - DNA, 20 bp, Homo sapiens
ctgtaaatcctagacttgaa

SEQ ID NO: 261172 - DNA, 21 bp, Homo sapiens
ctgtaaatgaacacatggcag

SEQ ID NO: 261173 - DNA, 22 bp, Homo sapiens
ctgtaaatgaacacatggcaga

SEQ ID NO: 261174 - DNA, 12 bp, Homo sapiens
ctgtaaatggaa

SEQ ID NO: 261175 - DNA, 18 bp, Homo sapiens
ctgtaaattattttaaat

SEQ ID NO: 261176 - DNA, 16 bp, Homo sapiens
ctgtaaatttaactgc

SEQ ID NO: 261177 - DNA, 17 bp, Homo sapiens
ctgtaaatttaactgca

SEQ ID NO: 261178 - DNA, 15 bp, Homo sapiens
ctgtaacacagctga

SEQ ID NO: 261179 - DNA, 15 bp, Homo sapiens
ctgtaaccacctctc

SEQ ID NO: 261180 - DNA, 16 bp, Homo sapiens
ctgtaaccacctctct

SEQ ID NO: 261181 - DNA, 22 bp, Homo sapiens
ctgtaaccacctctctgtcttt

SEQ ID NO: 261182 - DNA, 14 bp, Homo sapiens
ctgtaacccttgaa

SEQ ID NO: 261183 - DNA, 22 bp, Homo sapiens
ctgtaacccttgaatttctaga

SEQ ID NO: 261184 - DNA, 11 bp, Homo sapiens
ctgtaactgcc

SEQ ID NO: 261185 - DNA, 18 bp, Homo sapiens
ctgtaactgctgagccac

SEQ ID NO: 261186 - DNA, 20 bp, Homo sapiens
ctgtaactgctgagccactc

SEQ ID NO: 261187 - DNA, 20 bp, Homo sapiens
ctgtaagaagagactgggaa

SEQ ID NO: 261188 - DNA, 18 bp, Homo sapiens
ctgtaagacggccttgga

SEQ ID NO: 261189 - DNA, 22 bp, Homo sapiens
ctgtaagcattctgagctgggc

SEQ ID NO: 261190 - DNA, 13 bp, Homo sapiens
ctgtaagctcttt

SEQ ID NO: 261191 - DNA, 20 bp, Homo sapiens
ctgtaagctctttgaaacaa

SEQ ID NO: 261192 - DNA, 15 bp, Homo sapiens
ctgtaatatattgcc

SEQ ID NO: 261193 - DNA, 23 bp, Homo sapiens
ctgtaatatattgccagtatata

SEQ ID NO: 261194 - DNA, 13 bp, Homo sapiens
ctgtaatcccagc

SEQ ID NO: 261195 - DNA, 17 bp, Homo sapiens
ctgtaatcccagcactt

SEQ ID NO: 261196 - DNA, 14 bp, Homo sapiens
ctgtaatctatgaa

SEQ ID NO: 261197 - DNA, 20 bp, Homo sapiens
ctgtaatctttttctccacc

SEQ ID NO: 261198 - DNA, 22 bp, Homo sapiens
ctgtacacaccctccagcacag

SEQ ID NO: 261199 - DNA, 20 bp, Homo sapiens
ctgtacaccatagtttacaa

SEQ ID NO: 261200 - DNA, 21 bp, Homo sapiens
ctgtacactgacttgagacca

SEQ ID NO: 261201 - DNA, 22 bp, Homo sapiens
ctgtacagattgctgcttctgc

SEQ ID NO: 261202 - DNA, 16 bp, Homo sapiens
ctgtacatacattgta

SEQ ID NO: 261203 - DNA, 21 bp, Homo sapiens
ctgtacatacattgtataggc

SEQ ID NO: 261204 - DNA, 19 bp, Homo sapiens
ctgtacatattactgttgc

SEQ ID NO: 261205 - DNA, 21 bp, Homo sapiens
ctgtacattttttttcaagtg

SEQ ID NO: 261206 - DNA, 22 bp, Homo sapiens
ctgtaccaagccccttggccct

SEQ ID NO: 261207 - DNA, 19 bp, Homo sapiens
ctgtaccatccatggagca

SEQ ID NO: 261208 - DNA, 23 bp, Homo sapiens
ctgtacccagccaccttcctgac

SEQ ID NO: 261209 - DNA, 23 bp, Homo sapiens
ctgtacccagctccttttgtccc

SEQ ID NO: 261210 - DNA, 13 bp, Homo sapiens
ctgtacccttcca

SEQ ID NO: 261211 - DNA, 16 bp, Homo sapiens
ctgtacccttccacct

SEQ ID NO: 261212 - DNA, 17 bp, Homo sapiens
ctgtacccttccacctc

SEQ ID NO: 261213 - DNA, 15 bp, Homo sapiens
ctgtacctctctctg

SEQ ID NO: 261214 - DNA, 13 bp, Homo sapiens
ctgtacctgtagg

SEQ ID NO: 261215 - DNA, 17 bp, Homo sapiens
ctgtacctgtaggaaac

SEQ ID NO: 261216 - DNA, 23 bp, Homo sapiens
ctgtacctgtaggaaacagaaaa

SEQ ID NO: 261217 - DNA, 15 bp, Homo sapiens
ctgtacctttctgac

SEQ ID NO: 261218 - DNA, 22 bp, Homo sapiens
ctgtactagcttttgaaatcca

SEQ ID NO: 261219 - DNA, 14 bp, Homo sapiens
ctgtactcagagca

SEQ ID NO: 261220 - DNA, 21 bp, Homo sapiens
ctgtactcctcccaggcgccc

SEQ ID NO: 261221 - DNA, 22 bp, Homo sapiens
ctgtagaactgcaatttccatt

SEQ ID NO: 261222 - DNA, 17 bp, Homo sapiens
ctgtagaatgctgtaga

SEQ ID NO: 261223 - DNA, 17 bp, Homo sapiens
ctgtagagacttccgtc

SEQ ID NO: 261224 - DNA, 16 bp, Homo sapiens
ctgtagaggagcctgg

SEQ ID NO: 261225 - DNA, 20 bp, Homo sapiens
ctgtagaggagcctggagtc

SEQ ID NO: 261226 - DNA, 15 bp, Homo sapiens
ctgtagccatggctc

SEQ ID NO: 261227 - DNA, 17 bp, Homo sapiens
ctgtagccatggctcag

SEQ ID NO: 261228 - DNA, 18 bp, Homo sapiens
ctgtagccatggctcagg

SEQ ID NO: 261229 - DNA, 13 bp, Homo sapiens
ctgtagctccctc

SEQ ID NO: 261230 - DNA, 17 bp, Homo sapiens
ctgtagctccctcctcc

SEQ ID NO: 261231 - DNA, 18 bp, Homo sapiens
ctgtagctccctcctccc

SEQ ID NO: 261232 - DNA, 20 bp, Homo sapiens
ctgtagctccctcctcccat

SEQ ID NO: 261233 - DNA, 21 bp, Homo sapiens
ctgtagctccctcctcccatc

SEQ ID NO: 261234 - DNA, 22 bp, Homo sapiens
ctgtagctccctcctcccatct

SEQ ID NO: 261235 - DNA, 19 bp, Homo sapiens
gtttcaatgtgattctaat

SEQ ID NO: 261236 - DNA, 21 bp, Homo sapiens
gtttcaatgtgattctaatgt

SEQ ID NO: 261237 - DNA, 16 bp, Homo sapiens
gtttcaccatgttagc

SEQ ID NO: 261238 - DNA, 21 bp, Homo sapiens
gtttcagaaagggcagcccct

SEQ ID NO: 261239 - DNA, 22 bp, Homo sapiens
gtttcagaaagggcagcccctc

SEQ ID NO: 261240 - DNA, 11 bp, Homo sapiens
gtttcagaagc

SEQ ID NO: 261241 - DNA, 12 bp, Homo sapiens
gtttcagacagg

SEQ ID NO: 261242 - DNA, 13 bp, Homo sapiens
gtttcagacaggg

SEQ ID NO: 261243 - DNA, 14 bp, Homo sapiens
ctgtgcccagctca

SEQ ID NO: 261244 - DNA, 16 bp, Homo sapiens
ctgtgcccagctcagt

SEQ ID NO: 261245 - DNA, 19 bp, Homo sapiens
ctgtgcccagctcagtctt

SEQ ID NO: 261246 - DNA, 18 bp, Homo sapiens
ctgtgccccatcagcagc

SEQ ID NO: 261247 - DNA, 22 bp, Homo sapiens
ctgtgcccttgctgggtccagg

SEQ ID NO: 261248 - DNA, 12 bp, Homo sapiens
ctgtgcctaata

SEQ ID NO: 261249 - DNA, 15 bp, Homo sapiens
ctgtgcctaataaag

SEQ ID NO: 261250 - DNA, 20 bp, Homo sapiens
ctgtgcctaataaagtctct

SEQ ID NO: 261251 - DNA, 15 bp, Homo sapiens
ctgtgcctcccccca

SEQ ID NO: 261252 - DNA, 18 bp, Homo sapiens
ctgtgcctccccccagac

SEQ ID NO: 261253 - DNA, 17 bp, Homo sapiens
taaaatagaaataagtg

SEQ ID NO: 261254 - DNA, 16 bp, Homo sapiens
taaaatataaattaag

SEQ ID NO: 261255 - DNA, 11 bp, Homo sapiens
taaaatataag

SEQ ID NO: 261256 - DNA, 16 bp, Homo sapiens
taaaatatcattcagc

SEQ ID NO: 261257 - DNA, 17 bp, Homo sapiens
taaaatatcattcagca

SEQ ID NO: 261258 - DNA, 19 bp, Homo sapiens
taaaatatcattcagcaac

SEQ ID NO: 261259 - DNA, 13 bp, Homo sapiens
taaaatattactg

SEQ ID NO: 261260 - DNA, 22 bp, Homo sapiens
taaaatattcctgcatttgtga

SEQ ID NO: 261261 - DNA, 18 bp, Homo sapiens
taaaatatttattcatct

SEQ ID NO: 261262 - DNA, 12 bp, Homo sapiens
taaaatcaactt

SEQ ID NO: 261263 - DNA, 18 bp, Homo sapiens
taaaatcactctcagtgc

SEQ ID NO: 261264 - DNA, 15 bp, Homo sapiens
taaaatcatgttttt

SEQ ID NO: 261265 - DNA, 17 bp, Homo sapiens
taaaatctattttgtct

SEQ ID NO: 261266 - DNA, 15 bp, Homo sapiens
taaaatcttcagctg

SEQ ID NO: 261267 - DNA, 18 bp, Homo sapiens
taaaatcttcagctggtg

SEQ ID NO: 261268 - DNA, 14 bp, Homo sapiens
taaaatcttgtcat

SEQ ID NO: 261269 - DNA, 15 bp, Homo sapiens
taaaatcttgtcatg

SEQ ID NO: 261270 - DNA, 18 bp, Homo sapiens
taaaatcttgtcatgtgt

SEQ ID NO: 261271 - DNA, 19 bp, Homo sapiens
taaaatcttgtcatgtgta

SEQ ID NO: 261272 - DNA, 21 bp, Homo sapiens
taaaatcttgtcatgtgtata

SEQ ID NO: 261273 - DNA, 22 bp, Homo sapiens
taaaatcttgtcatgtgtataa

SEQ ID NO: 261274 - DNA, 15 bp, Homo sapiens
taaaatgattgtaaa

SEQ ID NO: 261275 - DNA, 22 bp, Homo sapiens
taaaatgattgtaaaatagctt

SEQ ID NO: 261276 - DNA, 21 bp, Homo sapiens
taaaatgtagaagaaagcaaa

SEQ ID NO: 261277 - DNA, 15 bp, Homo sapiens
taaaatgtattcaag

SEQ ID NO: 261278 - DNA, 20 bp, Homo sapiens
taaaatgtcggatttatctt

SEQ ID NO: 261279 - DNA, 19 bp, Homo sapiens
taaaatgtgatttttctga

SEQ ID NO: 261280 - DNA, 20 bp, Homo sapiens
taaaatgtgggattatgggt

SEQ ID NO: 261281 - DNA, 16 bp, Homo sapiens
taaaatgttccttttg

SEQ ID NO: 261282 - DNA, 19 bp, Homo sapiens
taaaatgttccttttgaca

SEQ ID NO: 261283 - DNA, 19 bp, Homo sapiens
taaaatgttggtgcaatta

SEQ ID NO: 261284 - DNA, 14 bp, Homo sapiens
taaaattatggtga

SEQ ID NO: 261285 - DNA, 15 bp, Homo sapiens
taaaattatggtgaa

SEQ ID NO: 261286 - DNA, 19 bp, Homo sapiens
taaaattcaagaaaataaa

SEQ ID NO: 261287 - DNA, 13 bp, Homo sapiens
taaaattctagtc

SEQ ID NO: 261288 - DNA, 21 bp, Homo sapiens
taaaattctagtctctgattt

SEQ ID NO: 261289 - DNA, 21 bp, Homo sapiens
taaaattgacaacattttatt

SEQ ID NO: 261290 - DNA, 22 bp, Homo sapiens
taaaattgacaacattttatta

SEQ ID NO: 261291 - DNA, 13 bp, Homo sapiens
taaaattgcagca

SEQ ID NO: 261292 - DNA, 22 bp, Homo sapiens
taaaattgcagcagttgctagc

SEQ ID NO: 261293 - DNA, 14 bp, Homo sapiens
taaaattgtaaaat

SEQ ID NO: 261294 - DNA, 15 bp, Homo sapiens
taaaattgtaaaatt

SEQ ID NO: 261295 - DNA, 14 bp, Homo sapiens
taaaattgtataga

SEQ ID NO: 261296 - DNA, 23 bp, Homo sapiens
taaaattgtatagagatatgcag

SEQ ID NO: 261297 - DNA, 16 bp, Homo sapiens
taaaattgtatgaaaa

SEQ ID NO: 261298 - DNA, 17 bp, Homo sapiens
taaaattgtatgaaaat

SEQ ID NO: 261299 - DNA, 14 bp, Homo sapiens
taaacaaaaacttt

SEQ ID NO: 261300 - DNA, 18 bp, Homo sapiens
taaacaaaaactttccat

SEQ ID NO: 261301 - DNA, 23 bp, Homo sapiens
taaacaaaatagaagctgtagta

SEQ ID NO: 261302 - DNA, 18 bp, Homo sapiens
taaacaatttattttatt

SEQ ID NO: 261303 - DNA, 24 bp, Homo sapiens
taaacaatttattttattttagca

SEQ ID NO: 261304 - DNA, 17 bp, Homo sapiens
taaacacatcaataaat

SEQ ID NO: 261305 - DNA, 11 bp, Homo sapiens
taaacacctga

SEQ ID NO: 261306 - DNA, 14 bp, Homo sapiens
taaacacctgacac

SEQ ID NO: 261307 - DNA, 15 bp, Homo sapiens
taaacacctgacaca

SEQ ID NO: 261308 - DNA, 16 bp, Homo sapiens
taaacacctgacacat

SEQ ID NO: 261309 - DNA, 14 bp, Homo sapiens
taaacactcagctg

SEQ ID NO: 261310 - DNA, 17 bp, Homo sapiens
taaacactcagctgttc

SEQ ID NO: 261311 - DNA, 14 bp, Homo sapiens
taaacactgtaatc

SEQ ID NO: 261312 - DNA, 16 bp, Homo sapiens
taaacactgtattgta

SEQ ID NO: 261313 - DNA, 23 bp, Homo sapiens
taaacactgtattgtaagtggaa

SEQ ID NO: 261314 - DNA, 13 bp, Homo sapiens
taaacactttttc

SEQ ID NO: 261315 - DNA, 15 bp, Homo sapiens
taaacactttttctg

SEQ ID NO: 261316 - DNA, 15 bp, Homo sapiens
taaacagagtccctc

SEQ ID NO: 261317 - DNA, 21 bp, Homo sapiens
taaacagatataaatggctgg

SEQ ID NO: 261318 - DNA, 15 bp, Homo sapiens
taaacagctttttta

SEQ ID NO: 261319 - DNA, 18 bp, Homo sapiens
taaacaggagacaggaag

SEQ ID NO: 261320 - DNA, 20 bp, Homo sapiens
taaacagggcatctccagga

SEQ ID NO: 261321 - DNA, 15 bp, Homo sapiens
taaacatcacacaca

SEQ ID NO: 261322 - DNA, 16 bp, Homo sapiens
taaacatgaatttaat

SEQ ID NO: 261323 - DNA, 13 bp, Homo sapiens
taaacatgtgttt

SEQ ID NO: 261324 - DNA, 14 bp, Homo sapiens
taaacattaaaaga

SEQ ID NO: 261325 - DNA, 21 bp, Homo sapiens
taaacattaaaagaagactgg

SEQ ID NO: 261326 - DNA, 13 bp, Homo sapiens
taaacattcatat

SEQ ID NO: 261327 - DNA, 18 bp, Homo sapiens
taaacattgaagtaatga

SEQ ID NO: 261328 - DNA, 20 bp, Homo sapiens
taaacattttttgtttcttg

SEQ ID NO: 261329 - DNA, 19 bp, Homo sapiens
taaaccaaacggaactctt

SEQ ID NO: 261330 - DNA, 20 bp, Homo sapiens
taaaccactaatgcttgcca

SEQ ID NO: 261331 - DNA, 17 bp, Homo sapiens
taaacccatctgtaata

SEQ ID NO: 261332 - DNA, 18 bp, Homo sapiens
taaacctcaaaatgtcta

SEQ ID NO: 261333 - DNA, 16 bp, Homo sapiens
taaaccttgtttcttt

SEQ ID NO: 261334 - DNA, 15 bp, Homo sapiens
taaacgtttcagtaa

SEQ ID NO: 261335 - DNA, 19 bp, Homo sapiens
taaactaattttgtacgta

SEQ ID NO: 261336 - DNA, 14 bp, Homo sapiens
taaactactgaact

SEQ ID NO: 261337 - DNA, 14 bp, Homo sapiens
taaactagatctcc

SEQ ID NO: 261338 - DNA, 17 bp, Homo sapiens
taaactagggttttggc

SEQ ID NO: 261339 - DNA, 19 bp, Homo sapiens
taaactagggttttggcct

SEQ ID NO: 261340 - DNA, 23 bp, Homo sapiens
taaactcctactgcttcctctga

SEQ ID NO: 261341 - DNA, 12 bp, Homo sapiens
taaactcttcaa

SEQ ID NO: 261342 - DNA, 13 bp, Homo sapiens
taaactcttcaag

SEQ ID NO: 261343 - DNA, 12 bp, Homo sapiens
taaactcttcac

SEQ ID NO: 261344 - DNA, 15 bp, Homo sapiens
taaactgactttatc

SEQ ID NO: 261345 - DNA, 20 bp, Homo sapiens
taaactgtatcaaatctgta

SEQ ID NO: 261346 - DNA, 19 bp, Homo sapiens
taaactgtcctctttcaga

SEQ ID NO: 261347 - DNA, 23 bp, Homo sapiens
taaactgtcctctttcagaaaac

SEQ ID NO: 261348 - DNA, 10 bp, Homo sapiens
taaactgtga

SEQ ID NO: 261349 - DNA, 12 bp, Homo sapiens
taaactgtgaga

SEQ ID NO: 261350 - DNA, 19 bp, Homo sapiens
taaactgtgagataaatat

SEQ ID NO: 261351 - DNA, 20 bp, Homo sapiens
taaactgtgtggactgtgat

SEQ ID NO: 261352 - DNA, 22 bp, Homo sapiens
taaactgtgtggactgtgatgc

SEQ ID NO: 261353 - DNA, 16 bp, Homo sapiens
taaactgttttcatgt

SEQ ID NO: 261354 - DNA, 15 bp, Homo sapiens
taaacttagaataaa

SEQ ID NO: 261355 - DNA, 21 bp, Homo sapiens
taaacttagaataaaattgta

SEQ ID NO: 261356 - DNA, 15 bp, Homo sapiens
taaacttataaatca

SEQ ID NO: 261357 - DNA, 12 bp, Homo sapiens
taaacttcagca

SEQ ID NO: 261358 - DNA, 14 bp, Homo sapiens
taaacttcagcaac

SEQ ID NO: 261359 - DNA, 21 bp, Homo sapiens
taaactttcagaactgctacc

SEQ ID NO: 261360 - DNA, 15 bp, Homo sapiens
taaactttgtgcctt

SEQ ID NO: 261361 - DNA, 16 bp, Homo sapiens
taaactttgtgccttt

SEQ ID NO: 261362 - DNA, 17 bp, Homo sapiens
taaactttgtgcctttg

SEQ ID NO: 261363 - DNA, 18 bp, Homo sapiens
taaactttttcaatggtt

SEQ ID NO: 261364 - DNA, 21 bp, Homo sapiens
taaactttttcaatggttggg

SEQ ID NO: 261365 - DNA, 20 bp, Homo sapiens
taaagaaaaaaatagtttta

SEQ ID NO: 261366 - DNA, 13 bp, Homo sapiens
taaagaaaatgtg

SEQ ID NO: 261367 - DNA, 17 bp, Homo sapiens
taaagaaacactttctt

SEQ ID NO: 261368 - DNA, 13 bp, Homo sapiens
taaagaaacagct

SEQ ID NO: 261369 - DNA, 15 bp, Homo sapiens
taaagaaaggcagag

SEQ ID NO: 261370 - DNA, 16 bp, Homo sapiens
taaagaaaggcagaga

SEQ ID NO: 261371 - DNA, 11 bp, Homo sapiens
taaagaaagtc

SEQ ID NO: 261372 - DNA, 22 bp, Homo sapiens
taaagaaagtgagtctgaattg

SEQ ID NO: 261373 - DNA, 19 bp, Homo sapiens
taaagaactccttattttg

SEQ ID NO: 261374 - DNA, 23 bp, Homo sapiens
cttaaaataaacagttgtgaacc

SEQ ID NO: 261375 - DNA, 12 bp, Homo sapiens
cttaaaataagt

SEQ ID NO: 261376 - DNA, 14 bp, Homo sapiens
cttaaacaaaaact

SEQ ID NO: 261377 - DNA, 20 bp, Homo sapiens
cttaaacaaaaactttccat

SEQ ID NO: 261378 - DNA, 23 bp, Homo sapiens
cttaaacaaaaactttccatgac

SEQ ID NO: 261379 - DNA, 11 bp, Homo sapiens
cttaaacaaag

SEQ ID NO: 261380 - DNA, 14 bp, Homo sapiens
cttaaacagggcat

SEQ ID NO: 261381 - DNA, 12 bp, Homo sapiens
cttaaacatttt

SEQ ID NO: 261382 - DNA, 16 bp, Homo sapiens
cttaaacattttttgt

SEQ ID NO: 261383 - DNA, 23 bp, Homo sapiens
cttaaacattttttgtttcttgg

SEQ ID NO: 261384 - DNA, 23 bp, Homo sapiens
cttaaactgtgtggactgtgatg

SEQ ID NO: 261385 - DNA, 16 bp, Homo sapiens
cttaaagaaacagctt

SEQ ID NO: 261386 - DNA, 13 bp, Homo sapiens
cttaaagcttgtt

SEQ ID NO: 261387 - DNA, 14 bp, Homo sapiens
cttaaaggcctgga

SEQ ID NO: 261388 - DNA, 14 bp, Homo sapiens
cttaaataaaacta

SEQ ID NO: 261389 - DNA, 20 bp, Homo sapiens
cttaaataaaactatttaaa

SEQ ID NO: 261390 - DNA, 13 bp, Homo sapiens
cttaaatcactga

SEQ ID NO: 261391 - DNA, 21 bp, Homo sapiens
cttaaatgaaagcatgtggca

SEQ ID NO: 261392 - DNA, 19 bp, Homo sapiens
cttaaatggaattattttg

SEQ ID NO: 261393 - DNA, 21 bp, Homo sapiens
cttaaatggaattattttgaa

SEQ ID NO: 261394 - DNA, 12 bp, Homo sapiens
cttaaattaaac

SEQ ID NO: 261395 - DNA, 14 bp, Homo sapiens
cttaaattaaacaa

SEQ ID NO: 261396 - DNA, 15 bp, Homo sapiens
cttaaattaaacaat

SEQ ID NO: 261397 - DNA, 20 bp, Homo sapiens
cttaaattaaacaatttatt

SEQ ID NO: 261398 - DNA, 21 bp, Homo sapiens
cttaaattaaacaatttattt

SEQ ID NO: 261399 - DNA, 20 bp, Homo sapiens
cttaaatttctaaaaacagt

SEQ ID NO: 261400 - DNA, 13 bp, Homo sapiens
cttaacatattta

SEQ ID NO: 261401 - DNA, 21 bp, Homo sapiens
cttaacatgctgtgtaagctg

SEQ ID NO: 261402 - DNA, 20 bp, Homo sapiens
cttaaccccagtaagccact

SEQ ID NO: 261403 - DNA, 14 bp, Homo sapiens
cttaacctgctttt

SEQ ID NO: 261404 - DNA, 17 bp, Homo sapiens
aaatctcttctttgctg

SEQ ID NO: 261405 - DNA, 15 bp, Homo sapiens
aaatctgaactctca

SEQ ID NO: 261406 - DNA, 14 bp, Homo sapiens
aaatctgtaaaaaa

SEQ ID NO: 261407 - DNA, 17 bp, Homo sapiens
aaatctgtaagctcttt

SEQ ID NO: 261408 - DNA, 23 bp, Homo sapiens
aaatctgtaagctctttgaaaca

SEQ ID NO: 261409 - DNA, 22 bp, Homo sapiens
aaatctgtatatgttgtaataa

SEQ ID NO: 261410 - DNA, 22 bp, Homo sapiens
aaatctgtctagaatcctgctt

SEQ ID NO: 261411 - DNA, 19 bp, Homo sapiens
aaatctgtttgatccctgt

SEQ ID NO: 261412 - DNA, 11 bp, Homo sapiens
aaatcttcagc

SEQ ID NO: 261413 - DNA, 13 bp, Homo sapiens
aaatcttcagctg

SEQ ID NO: 261414 - DNA, 11 bp, Homo sapiens
aaatcttcctc

SEQ ID NO: 261415 - DNA, 14 bp, Homo sapiens
aaatcttgtcatgt

SEQ ID NO: 261416 - DNA, 18 bp, Homo sapiens
aaatcttgtcatgtgtat

SEQ ID NO: 261417 - DNA, 20 bp, Homo sapiens
aaatcttgtcatgtgtataa

SEQ ID NO: 261418 - DNA, 21 bp, Homo sapiens
aaatcttgtcatgtgtataaa

SEQ ID NO: 261419 - DNA, 20 bp, Homo sapiens
aaatctttaagaatagttct

SEQ ID NO: 261420 - DNA, 21 bp, Homo sapiens
aaatctttcagcctgcttctt

SEQ ID NO: 261421 - DNA, 20 bp, Homo sapiens
aaatgaaaaaaatgatctat

SEQ ID NO: 261422 - DNA, 18 bp, Homo sapiens
aaatgaaaacatgtaata

SEQ ID NO: 261423 - DNA, 11 bp, Homo sapiens
aaatgaaaatt

SEQ ID NO: 261424 - DNA, 21 bp, Homo sapiens
aaatgaaacaaataatcacat

SEQ ID NO: 261425 - DNA, 12 bp, Homo sapiens
aaatgaaattgt

SEQ ID NO: 261426 - DNA, 14 bp, Homo sapiens
aaatgaaattgtaa

SEQ ID NO: 261427 - DNA, 15 bp, Homo sapiens
aaatgaaattgtaaa

SEQ ID NO: 261428 - DNA, 14 bp, Homo sapiens
aaatgaactgaagt

SEQ ID NO: 261429 - DNA, 11 bp, Homo sapiens
aaatgaagaaa

SEQ ID NO: 261430 - DNA, 19 bp, Homo sapiens
aaatgaaggttaggattta

SEQ ID NO: 261431 - DNA, 17 bp, Homo sapiens
aaatgaagtttatacag

SEQ ID NO: 261432 - DNA, 17 bp, Homo sapiens
aaatgaataatttccca

SEQ ID NO: 261433 - DNA, 21 bp, Homo sapiens
aaatgaatagtacatgcagaa

SEQ ID NO: 261434 - DNA, 13 bp, Homo sapiens
aaatgaatgaaat

SEQ ID NO: 261435 - DNA, 14 bp, Homo sapiens
aaatgaatgaaata

SEQ ID NO: 261436 - DNA, 17 bp, Homo sapiens
aaatgaatgaaatataa

SEQ ID NO: 261437 - DNA, 23 bp, Homo sapiens
aaatgaatgaaatataaactgtg

SEQ ID NO: 261438 - DNA, 14 bp, Homo sapiens
aaatgaatgcattg

SEQ ID NO: 261439 - DNA, 15 bp, Homo sapiens
aaatgacaatgatga

SEQ ID NO: 261440 - DNA, 15 bp, Homo sapiens
aaatgacagcgggga

SEQ ID NO: 261441 - DNA, 15 bp, Homo sapiens
aaatgacttattgat

SEQ ID NO: 261442 - DNA, 15 bp, Homo sapiens
aaatgacttcatttc

SEQ ID NO: 261443 - DNA, 18 bp, Homo sapiens
aaatgagaattttatatt

SEQ ID NO: 261444 - DNA, 21 bp, Homo sapiens
aaatgagaattttatattcta

SEQ ID NO: 261445 - DNA, 18 bp, Homo sapiens
aaatgaggcagttaaata

SEQ ID NO: 261446 - DNA, 16 bp, Homo sapiens
aaatgagtttaaaaaa

SEQ ID NO: 261447 - DNA, 22 bp, Homo sapiens
aaatgagtttaaaaaaataaca

SEQ ID NO: 261448 - DNA, 17 bp, Homo sapiens
aaatgataaagatgtca

SEQ ID NO: 261449 - DNA, 20 bp, Homo sapiens
aaatgataaagatgtcaaat

SEQ ID NO: 261450 - DNA, 21 bp, Homo sapiens
aaatgataaagatgtcaaata

SEQ ID NO: 261451 - DNA, 22 bp, Homo sapiens
aaatgatgatgtggaagaactt

SEQ ID NO: 261452 - DNA, 17 bp, Homo sapiens
aaatgatgtatgatttg

SEQ ID NO: 261453 - DNA, 13 bp, Homo sapiens
aaatgattcactt

SEQ ID NO: 261454 - DNA, 22 bp, Homo sapiens
aaatgattcacttttattgtat

SEQ ID NO: 261455 - DNA, 14 bp, Homo sapiens
aaatgattccaaat

SEQ ID NO: 261456 - DNA, 21 bp, Homo sapiens
aaatgattttatctgtgaatt

SEQ ID NO: 261457 - DNA, 16 bp, Homo sapiens
aaatgattttcatcaa

SEQ ID NO: 261458 - DNA, 23 bp, Homo sapiens
aaatgatttttacaagttttaaa

SEQ ID NO: 261459 - DNA, 16 bp, Homo sapiens
aaatgcagacacacaa

SEQ ID NO: 261460 - DNA, 15 bp, Homo sapiens
aaatgcagggagggg

SEQ ID NO: 261461 - DNA, 12 bp, Homo sapiens
aaatgcagtgaa

SEQ ID NO: 261462 - DNA, 17 bp, Homo sapiens
aaatgcagttttaagaa

SEQ ID NO: 261463 - DNA, 14 bp, Homo sapiens
aaatgcataaaata

SEQ ID NO: 261464 - DNA, 16 bp, Homo sapiens
aaatgcatgatattgt

SEQ ID NO: 261465 - DNA, 21 bp, Homo sapiens
aaatgcatgatattgtatgta

SEQ ID NO: 261466 - DNA, 14 bp, Homo sapiens
aaatgcatgtgatt

SEQ ID NO: 261467 - DNA, 16 bp, Homo sapiens
aaatgcattgaaagaa

SEQ ID NO: 261468 - DNA, 22 bp, Homo sapiens
aaatgcattttctacatgtatt

SEQ ID NO: 261469 - DNA, 16 bp, Homo sapiens
aaatgcatttttatca

SEQ ID NO: 261470 - DNA, 18 bp, Homo sapiens
aaatgcatttttatcatg

SEQ ID NO: 261471 - DNA, 21 bp, Homo sapiens
aaatgccacattttgctttat

SEQ ID NO: 261472 - DNA, 19 bp, Homo sapiens
aaatgccctcctaaatgtc

SEQ ID NO: 261473 - DNA, 23 bp, Homo sapiens
aaatgccctcctaaatgtcagct

SEQ ID NO: 261474 - DNA, 16 bp, Homo sapiens
aaatgccgctgtgtcc

SEQ ID NO: 261475 - DNA, 14 bp, Homo sapiens
aaatgcctctgcct

SEQ ID NO: 261476 - DNA, 14 bp, Homo sapiens
aaatgctaatgtaa

SEQ ID NO: 261477 - DNA, 15 bp, Homo sapiens
aaatgctacctctga

SEQ ID NO: 261478 - DNA, 20 bp, Homo sapiens
aaatgctacctctgatcaaa

SEQ ID NO: 261479 - DNA, 21 bp, Homo sapiens
aaatgctattgttgtgggctt

SEQ ID NO: 261480 - DNA, 20 bp, Homo sapiens
aaatgctgcgcccttcccca

SEQ ID NO: 261481 - DNA, 21 bp, Homo sapiens
aaatgctgcgcccttccccag

SEQ ID NO: 261482 - DNA, 19 bp, Homo sapiens
aaatgctgtaactttctga

SEQ ID NO: 261483 - DNA, 19 bp, Homo sapiens
aaatgctgtgcaaacagtg

SEQ ID NO: 261484 - DNA, 18 bp, Homo sapiens
aaatggaaaggtcctgct

SEQ ID NO: 261485 - DNA, 15 bp, Homo sapiens
aaatggaacattaac

SEQ ID NO: 261486 - DNA, 21 bp, Homo sapiens
aaatggacgtgttatgactcc

SEQ ID NO: 261487 - DNA, 14 bp, Homo sapiens
aaatggacttttgt

SEQ ID NO: 261488 - DNA, 13 bp, Homo sapiens
aaatggatactgg

SEQ ID NO: 261489 - DNA, 14 bp, Homo sapiens
aaatggcacctgta

SEQ ID NO: 261490 - DNA, 23 bp, Homo sapiens
aaatggcttctatgatcagaact

SEQ ID NO: 261491 - DNA, 21 bp, Homo sapiens
aaatgggactgatgtcatctt

SEQ ID NO: 261492 - DNA, 17 bp, Homo sapiens
aaatgggagacagcctc

SEQ ID NO: 261493 - DNA, 19 bp, Homo sapiens
aaatgggggcggctggaaa

SEQ ID NO: 261494 - DNA, 20 bp, Homo sapiens
aaatgggggcggctggaaag

SEQ ID NO: 261495 - DNA, 21 bp, Homo sapiens
aaatgggggcggctggaaaga

SEQ ID NO: 261496 - DNA, 20 bp, Homo sapiens
aaatgggttggtgcttctaa

SEQ ID NO: 261497 - DNA, 22 bp, Homo sapiens
aaatggtcagtgtgcaaagaaa

SEQ ID NO: 261498 - DNA, 18 bp, Homo sapiens
aaatggtgagaattaaaa

SEQ ID NO: 261499 - DNA, 19 bp, Homo sapiens
aaatggtgagaattaaaat

SEQ ID NO: 261500 - DNA, 14 bp, Homo sapiens
aaatgtaagatcgt

SEQ ID NO: 261501 - DNA, 12 bp, Homo sapiens
aaatgtaattga

SEQ ID NO: 261502 - DNA, 21 bp, Homo sapiens
aaatgtaccatcaaatgttaa

SEQ ID NO: 261503 - DNA, 18 bp, Homo sapiens
aaatgtactacatttgca

SEQ ID NO: 261504 - DNA, 15 bp, Homo sapiens
cttagcagctcaggc

SEQ ID NO: 261505 - DNA, 22 bp, Homo sapiens
cttagcagctcaggcgcagccc

SEQ ID NO: 261506 - DNA, 17 bp, Homo sapiens
cttagcagcttccagat

SEQ ID NO: 261507 - DNA, 14 bp, Homo sapiens
cttagcatgcacaa

SEQ ID NO: 261508 - DNA, 22 bp, Homo sapiens
cttagcccggatgcccacccct

SEQ ID NO: 261509 - DNA, 20 bp, Homo sapiens
cttagccgtccatggcacca

SEQ ID NO: 261510 - DNA, 22 bp, Homo sapiens
cttagccgtccatggcaccagc

SEQ ID NO: 261511 - DNA, 14 bp, Homo sapiens
cttagcctctccca

SEQ ID NO: 261512 - DNA, 18 bp, Homo sapiens
cttagcctctcccacccg

SEQ ID NO: 261513 - DNA, 15 bp, Homo sapiens
cttagccttgtgccc

SEQ ID NO: 261514 - DNA, 18 bp, Homo sapiens
cttagccttgtgccctgc

SEQ ID NO: 261515 - DNA, 23 bp, Homo sapiens
cttagccttgtgccctgccccca

SEQ ID NO: 261516 - DNA, 12 bp, Homo sapiens
cttagcgggaca

SEQ ID NO: 261517 - DNA, 15 bp, Homo sapiens
cttagcgttctgttt

SEQ ID NO: 261518 - DNA, 20 bp, Homo sapiens
cttagctacaatcctacctt

SEQ ID NO: 261519 - DNA, 17 bp, Homo sapiens
cttagctgccaagtaaa

SEQ ID NO: 261520 - DNA, 19 bp, Homo sapiens
cttagctgccagtgctggt

SEQ ID NO: 261521 - DNA, 15 bp, Homo sapiens
cttagcttacaggaa

SEQ ID NO: 261522 - DNA, 15 bp, Homo sapiens
cttagctttacattt

SEQ ID NO: 261523 - DNA, 16 bp, Homo sapiens
cttagctttctcaggg

SEQ ID NO: 261524 - DNA, 17 bp, Homo sapiens
cttaggaagagaaacca

SEQ ID NO: 261525 - DNA, 22 bp, Homo sapiens
cttaggaagagaaaccagggag

SEQ ID NO: 261526 - DNA, 19 bp, Homo sapiens
cttaggacttcaaaaggtg

SEQ ID NO: 261527 - DNA, 14 bp, Homo sapiens
cttaggagtacttt

SEQ ID NO: 261528 - DNA, 14 bp, Homo sapiens
cttagggaaagatg

SEQ ID NO: 261529 - DNA, 15 bp, Homo sapiens
cttaggtcagatgga

SEQ ID NO: 261530 - DNA, 17 bp, Homo sapiens
cttaggtcccgggagga

SEQ ID NO: 261531 - DNA, 14 bp, Homo sapiens
cttaggtgccaggc

SEQ ID NO: 261532 - DNA, 15 bp, Homo sapiens
cttaggtgccaggct

SEQ ID NO: 261533 - DNA, 17 bp, Homo sapiens
cttaggtgccaggctgt

SEQ ID NO: 261534 - DNA, 11 bp, Homo sapiens
cttagtccact

SEQ ID NO: 261535 - DNA, 15 bp, Homo sapiens
cttagtccactctga

SEQ ID NO: 261536 - DNA, 14 bp, Homo sapiens
cttagtcctccctg

SEQ ID NO: 261537 - DNA, 16 bp, Homo sapiens
cttagtcttctcatag

SEQ ID NO: 261538 - DNA, 21 bp, Homo sapiens
cttagtgcccgcctaggagtt

SEQ ID NO: 261539 - DNA, 20 bp, Homo sapiens
cttagtgcggacaagtttta

SEQ ID NO: 261540 - DNA, 16 bp, Homo sapiens
cttagtggtatgtctc

SEQ ID NO: 261541 - DNA, 17 bp, Homo sapiens
cttagtgtcacctttct

SEQ ID NO: 261542 - DNA, 20 bp, Homo sapiens
cttagtgtttagcattaaaa

SEQ ID NO: 261543 - DNA, 13 bp, Homo sapiens
cttagtttttaaa

SEQ ID NO: 261544 - DNA, 15 bp, Homo sapiens
cttagtttttaaaaa

SEQ ID NO: 261545 - DNA, 18 bp, Homo sapiens
cttataagaaaacatgta

SEQ ID NO: 261546 - DNA, 17 bp, Homo sapiens
cttataccaaagggaaa

SEQ ID NO: 261547 - DNA, 13 bp, Homo sapiens
cttatagaatatt

SEQ ID NO: 261548 - DNA, 15 bp, Homo sapiens
cttatagaatattta

SEQ ID NO: 261549 - DNA, 19 bp, Homo sapiens
cttatagacacttgctccc

SEQ ID NO: 261550 - DNA, 16 bp, Homo sapiens
cttatatgcaggctgt

SEQ ID NO: 261551 - DNA, 20 bp, Homo sapiens
cttatattcatctattttct

SEQ ID NO: 261552 - DNA, 11 bp, Homo sapiens
cttatcaagtg

SEQ ID NO: 261553 - DNA, 14 bp, Homo sapiens
cttatcaagtgtct

SEQ ID NO: 261554 - DNA, 15 bp, Homo sapiens
cttatcaagtgtctt

SEQ ID NO: 261555 - DNA, 14 bp, Homo sapiens
cttatcatggtctc

SEQ ID NO: 261556 - DNA, 22 bp, Homo sapiens
cttatctagcaagaagattcta

SEQ ID NO: 261557 - DNA, 17 bp, Homo sapiens
cttatctagccaaagag

SEQ ID NO: 261558 - DNA, 16 bp, Homo sapiens
cttatctccctgcttc

SEQ ID NO: 261559 - DNA, 15 bp, Homo sapiens
cttatgaatatattt

SEQ ID NO: 261560 - DNA, 23 bp, Homo sapiens
cttatgattcagattgttatcta

SEQ ID NO: 261561 - DNA, 14 bp, Homo sapiens
cttatgccacggga

SEQ ID NO: 261562 - DNA, 17 bp, Homo sapiens
cttatgccatttgttta

SEQ ID NO: 261563 - DNA, 15 bp, Homo sapiens
cttatgctgctgtga

SEQ ID NO: 261564 - DNA, 16 bp, Homo sapiens
cttatgctgctgtgaa

SEQ ID NO: 261565 - DNA, 20 bp, Homo sapiens
cttatgttgatcgatgttaa

SEQ ID NO: 261566 - DNA, 14 bp, Homo sapiens
cttattaatgctaa

SEQ ID NO: 261567 - DNA, 16 bp, Homo sapiens
cttattaatgctaagg

SEQ ID NO: 261568 - DNA, 13 bp, Homo sapiens
cttattacaattt

SEQ ID NO: 261569 - DNA, 16 bp, Homo sapiens
cttattagctaaaaat

SEQ ID NO: 261570 - DNA, 20 bp, Homo sapiens
cttattagctaaaaatatat

SEQ ID NO: 261571 - DNA, 21 bp, Homo sapiens
cttattcccaaactacagaat

SEQ ID NO: 261572 - DNA, 15 bp, Homo sapiens
cttattctcaaagca

SEQ ID NO: 261573 - DNA, 19 bp, Homo sapiens
cttattgcctgggcagtgc

SEQ ID NO: 261574 - DNA, 18 bp, Homo sapiens
cttattgtacctctctta

SEQ ID NO: 261575 - DNA, 13 bp, Homo sapiens
cttattgttccaa

SEQ ID NO: 261576 - DNA, 22 bp, Homo sapiens
cttattgttccaagacattgtc

SEQ ID NO: 261577 - DNA, 22 bp, Homo sapiens
cttattgtttttggatggctta

SEQ ID NO: 261578 - DNA, 15 bp, Homo sapiens
cttatttatatatga

SEQ ID NO: 261579 - DNA, 23 bp, Homo sapiens
cttatttcccctttccaattcca

SEQ ID NO: 261580 - DNA, 14 bp, Homo sapiens
cttatttgaaagtg

SEQ ID NO: 261581 - DNA, 15 bp, Homo sapiens
cttatttgaaagtgt

SEQ ID NO: 261582 - DNA, 16 bp, Homo sapiens
cttatttgaaagtgtt

SEQ ID NO: 261583 - DNA, 13 bp, Homo sapiens
cttatttgagtga

SEQ ID NO: 261584 - DNA, 16 bp, Homo sapiens
cttattttacacagca

SEQ ID NO: 261585 - DNA, 15 bp, Homo sapiens
cttattttctctgtg

SEQ ID NO: 261586 - DNA, 11 bp, Homo sapiens
cttattttctg

SEQ ID NO: 261587 - DNA, 13 bp, Homo sapiens
cttattttctgaa

SEQ ID NO: 261588 - DNA, 23 bp, Homo sapiens
cttatttttatttatttttgtac

SEQ ID NO: 261589 - DNA, 13 bp, Homo sapiens
cttatttttccta

SEQ ID NO: 261590 - DNA, 22 bp, Homo sapiens
cttattttttaatgtgagacag

SEQ ID NO: 261591 - DNA, 13 bp, Homo sapiens
cttcaaaacagaa

SEQ ID NO: 261592 - DNA, 19 bp, Homo sapiens
cttcaaaatcagtgatggg

SEQ ID NO: 261593 - DNA, 14 bp, Homo sapiens
cttcaaactttcac

SEQ ID NO: 261594 - DNA, 17 bp, Homo sapiens
cttcaaactttcacttt

SEQ ID NO: 261595 - DNA, 18 bp, Homo sapiens
cttcaaactttcactttg

SEQ ID NO: 261596 - DNA, 20 bp, Homo sapiens
cttcaaaggattttggaaaa

SEQ ID NO: 261597 - DNA, 21 bp, Homo sapiens
cttcaaaggattttggaaaag

SEQ ID NO: 261598 - DNA, 14 bp, Homo sapiens
cttcaaatcagagc

SEQ ID NO: 261599 - DNA, 16 bp, Homo sapiens
cttcaacatcaatgtt

SEQ ID NO: 261600 - DNA, 19 bp, Homo sapiens
cttcaacatcaatgttcat

SEQ ID NO: 261601 - DNA, 20 bp, Homo sapiens
cttcaacatcaatgttcatt

SEQ ID NO: 261602 - DNA, 16 bp, Homo sapiens
cttcaaccattcccca

SEQ ID NO: 261603 - DNA, 18 bp, Homo sapiens
cttcaaccctgccctgca

SEQ ID NO: 261604 - DNA, 16 bp, Homo sapiens
cttcaagatgcctctt

SEQ ID NO: 261605 - DNA, 20 bp, Homo sapiens
cttcaagatgcctcttctac

SEQ ID NO: 261606 - DNA, 18 bp, Homo sapiens
cttcaagcaccagggaag

SEQ ID NO: 261607 - DNA, 21 bp, Homo sapiens
cttcaagcagaatcctcagtt

SEQ ID NO: 261608 - DNA, 18 bp, Homo sapiens
cttcaagggaagaaacac

SEQ ID NO: 261609 - DNA, 18 bp, Homo sapiens
cttcaagtctgtgcctgg

SEQ ID NO: 261610 - DNA, 18 bp, Homo sapiens
cttcaagttaaagtgaat

SEQ ID NO: 261611 - DNA, 20 bp, Homo sapiens
cttcaatctacgatgttaaa

SEQ ID NO: 261612 - DNA, 14 bp, Homo sapiens
cttcaatctctgtt

SEQ ID NO: 261613 - DNA, 16 bp, Homo sapiens
cttcaatggcaccttc

SEQ ID NO: 261614 - DNA, 16 bp, Homo sapiens
cttcacaatgttggcc

SEQ ID NO: 261615 - DNA, 21 bp, Homo sapiens
cttcacaatgttggcctgtca

SEQ ID NO: 261616 - DNA, 19 bp, Homo sapiens
cttcacacagacaagtggc

SEQ ID NO: 261617 - DNA, 20 bp, Homo sapiens
cttcacacccctcagcgctc

SEQ ID NO: 261618 - DNA, 16 bp, Homo sapiens
cttcacagtacttccc

SEQ ID NO: 261619 - DNA, 18 bp, Homo sapiens
cttcacagtacttcccaa

SEQ ID NO: 261620 - DNA, 12 bp, Homo sapiens
cttcacatctcc

SEQ ID NO: 261621 - DNA, 15 bp, Homo sapiens
cttcacatttagaat

SEQ ID NO: 261622 - DNA, 13 bp, Homo sapiens
cttcaccaccccc

SEQ ID NO: 261623 - DNA, 17 bp, Homo sapiens
cttcaccaccccctgtc

SEQ ID NO: 261624 - DNA, 12 bp, Homo sapiens
cttcaccaggaa

SEQ ID NO: 261625 - DNA, 13 bp, Homo sapiens
cttcaccaggaag

SEQ ID NO: 261626 - DNA, 19 bp, Homo sapiens
cttcaccagtctgtctact

SEQ ID NO: 261627 - DNA, 22 bp, Homo sapiens
cttcaccagtctgtctactgtg

SEQ ID NO: 261628 - DNA, 23 bp, Homo sapiens
cttcaccagtctgtctactgtgg

SEQ ID NO: 261629 - DNA, 17 bp, Homo sapiens
cttcaccccggcaggcc

SEQ ID NO: 261630 - DNA, 18 bp, Homo sapiens
cttcaccccggcaggccc

SEQ ID NO: 261631 - DNA, 14 bp, Homo sapiens
cttcacccctgcac

SEQ ID NO: 261632 - DNA, 16 bp, Homo sapiens
cttcacccctgcactt

SEQ ID NO: 261633 - DNA, 15 bp, Homo sapiens
cttcaccctggagcc

SEQ ID NO: 261634 - DNA, 15 bp, Homo sapiens
cttcaccttggttta

SEQ ID NO: 261635 - DNA, 19 bp, Homo sapiens
taaggtcagtgttataaaa

SEQ ID NO: 261636 - DNA, 20 bp, Homo sapiens
taaggtcttcttgtgtcctg

SEQ ID NO: 261637 - DNA, 12 bp, Homo sapiens
taaggtgcagtt

SEQ ID NO: 261638 - DNA, 16 bp, Homo sapiens
taaggtggaaaatgga

SEQ ID NO: 261639 - DNA, 23 bp, Homo sapiens
taaggttgggttagcaatattta

SEQ ID NO: 261640 - DNA, 22 bp, Homo sapiens
taaggtttgttttccatccatt

SEQ ID NO: 261641 - DNA, 14 bp, Homo sapiens
taagtaaagttcca

SEQ ID NO: 261642 - DNA, 16 bp, Homo sapiens
taagtaaatgtctgtg

SEQ ID NO: 261643 - DNA, 18 bp, Homo sapiens
taagtaacatataaatta

SEQ ID NO: 261644 - DNA, 22 bp, Homo sapiens
taagtaaggtgcaatgaagaag

SEQ ID NO: 261645 - DNA, 23 bp, Homo sapiens
taagtaattatcgggaacagtgt

SEQ ID NO: 261646 - DNA, 12 bp, Homo sapiens
taagtagatttg

SEQ ID NO: 261647 - DNA, 19 bp, Homo sapiens
taagtataacaaactatgt

SEQ ID NO: 261648 - DNA, 13 bp, Homo sapiens
taagtatacagtt

SEQ ID NO: 261649 - DNA, 20 bp, Homo sapiens
taagtatacagttcaataaa

SEQ ID NO: 261650 - DNA, 13 bp, Homo sapiens
taagtatatctat

SEQ ID NO: 261651 - DNA, 14 bp, Homo sapiens
taagtatgttattt

SEQ ID NO: 261652 - DNA, 14 bp, Homo sapiens
taagtatttatata

SEQ ID NO: 261653 - DNA, 17 bp, Homo sapiens
taagtccagctctcccc

SEQ ID NO: 261654 - DNA, 15 bp, Homo sapiens
taagtcctaaagtga

SEQ ID NO: 261655 - DNA, 23 bp, Homo sapiens
taagtcctactttacatatgctt

SEQ ID NO: 261656 - DNA, 21 bp, Homo sapiens
taagtcgggaaattctgctgc

SEQ ID NO: 261657 - DNA, 19 bp, Homo sapiens
taagtctgggatgtagaac

SEQ ID NO: 261658 - DNA, 16 bp, Homo sapiens
taagtcttactgtttt

SEQ ID NO: 261659 - DNA, 16 bp, Homo sapiens
taagtgaaaaggtcat

SEQ ID NO: 261660 - DNA, 14 bp, Homo sapiens
taagtgaatctaat

SEQ ID NO: 261661 - DNA, 18 bp, Homo sapiens
taagtgaatctaataaaa

SEQ ID NO: 261662 - DNA, 12 bp, Homo sapiens
taagtgactacc

SEQ ID NO: 261663 - DNA, 12 bp, Homo sapiens
taagtgagagag

SEQ ID NO: 261664 - DNA, 15 bp, Homo sapiens
taagtgagagagaca

SEQ ID NO: 261665 - DNA, 24 bp, Homo sapiens
taagtgagagagacaagaagcaaa

SEQ ID NO: 261666 - DNA, 16 bp, Homo sapiens
taagtgcttggttgaa

SEQ ID NO: 261667 - DNA, 20 bp, Homo sapiens
taagtgcttggttgaaaaga

SEQ ID NO: 261668 - DNA, 15 bp, Homo sapiens
taagtgctttgtaat

SEQ ID NO: 261669 - DNA, 18 bp, Homo sapiens
taagtggaaaaaagagaa

SEQ ID NO: 261670 - DNA, 16 bp, Homo sapiens
taagtggacccagctg

SEQ ID NO: 261671 - DNA, 11 bp, Homo sapiens
taagtggagca

SEQ ID NO: 261672 - DNA, 19 bp, Homo sapiens
taagtggggcaaaaccttg

SEQ ID NO: 261673 - DNA, 20 bp, Homo sapiens
taagtggggttgcaaccact

SEQ ID NO: 261674 - DNA, 15 bp, Homo sapiens
taagttaaagagaca

SEQ ID NO: 261675 - DNA, 19 bp, Homo sapiens
taagttactatcctggctt

SEQ ID NO: 261676 - DNA, 19 bp, Homo sapiens
taagttataccagcaaaag

SEQ ID NO: 261677 - DNA, 15 bp, Homo sapiens
taagttatcaacttt

SEQ ID NO: 261678 - DNA, 16 bp, Homo sapiens
taagttcatgtttgta

SEQ ID NO: 261679 - DNA, 18 bp, Homo sapiens
taagttcatgtttgtaaa

SEQ ID NO: 261680 - DNA, 15 bp, Homo sapiens
taagttcgaggtggc

SEQ ID NO: 261681 - DNA, 13 bp, Homo sapiens
taagttctaagtt

SEQ ID NO: 261682 - DNA, 15 bp, Homo sapiens
taagttgacctttat

SEQ ID NO: 261683 - DNA, 16 bp, Homo sapiens
taagttgattctgtcc

SEQ ID NO: 261684 - DNA, 20 bp, Homo sapiens
taagtttattgtaaaagtga

SEQ ID NO: 261685 - DNA, 16 bp, Homo sapiens
taagtttgatttcatt

SEQ ID NO: 261686 - DNA, 21 bp, Homo sapiens
taagttttgattaatgtttct

SEQ ID NO: 261687 - DNA, 19 bp, Homo sapiens
taagttttgtgtgtatata

SEQ ID NO: 261688 - DNA, 14 bp, Homo sapiens
taagttttttactt

SEQ ID NO: 261689 - DNA, 12 bp, Homo sapiens
taataaaaaggt

SEQ ID NO: 261690 - DNA, 14 bp, Homo sapiens
taataaaaaggttt

SEQ ID NO: 261691 - DNA, 19 bp, Homo sapiens
taataaaactttatgtact

SEQ ID NO: 261692 - DNA, 15 bp, Homo sapiens
taataaaataaactt

SEQ ID NO: 261693 - DNA, 12 bp, Homo sapiens
taataaaatatc

SEQ ID NO: 261694 - DNA, 13 bp, Homo sapiens
taataaaatggct

SEQ ID NO: 261695 - DNA, 21 bp, Homo sapiens
cttctcccctgcactgtaaaa

SEQ ID NO: 261696 - DNA, 22 bp, Homo sapiens
cttctcccctgcactgtaaaat

SEQ ID NO: 261697 - DNA, 15 bp, Homo sapiens
cttctcccctgcccc

SEQ ID NO: 261698 - DNA, 22 bp, Homo sapiens
cttctccctgcacaagccaggg

SEQ ID NO: 261699 - DNA, 16 bp, Homo sapiens
cttctccctggactct

SEQ ID NO: 261700 - DNA, 21 bp, Homo sapiens
cttctccctggactctgtggg

SEQ ID NO: 261701 - DNA, 17 bp, Homo sapiens
cttctcctctctgggcc

SEQ ID NO: 261702 - DNA, 18 bp, Homo sapiens
cttctccttccaactgct

SEQ ID NO: 261703 - DNA, 20 bp, Homo sapiens
cttctccttccaactgctgc

SEQ ID NO: 261704 - DNA, 20 bp, Homo sapiens
cttctcctttcacaaccttc

SEQ ID NO: 261705 - DNA, 20 bp, Homo sapiens
cttctcggaggccaggccct

SEQ ID NO: 261706 - DNA, 17 bp, Homo sapiens
cttctcgtagatgctgc

SEQ ID NO: 261707 - DNA, 18 bp, Homo sapiens
cttctcgtagatgctgcc

SEQ ID NO: 261708 - DNA, 21 bp, Homo sapiens
cttctcgtagatgctgcctag

SEQ ID NO: 261709 - DNA, 14 bp, Homo sapiens
cttctcgtcttcct

SEQ ID NO: 261710 - DNA, 22 bp, Homo sapiens
cttctcgtcttcctctctctca

SEQ ID NO: 261711 - DNA, 15 bp, Homo sapiens
cttctctcacctcct

SEQ ID NO: 261712 - DNA, 16 bp, Homo sapiens
cttctctcacctccta

SEQ ID NO: 261713 - DNA, 15 bp, Homo sapiens
cttctctccacttct

SEQ ID NO: 261714 - DNA, 18 bp, Homo sapiens
cttctctccacttctggt

SEQ ID NO: 261715 - DNA, 13 bp, Homo sapiens
cttctctcttgat

SEQ ID NO: 261716 - DNA, 18 bp, Homo sapiens
cttctctgggcccagaga

SEQ ID NO: 261717 - DNA, 22 bp, Homo sapiens
cttctctgtgaacgatttagaa

SEQ ID NO: 261718 - DNA, 15 bp, Homo sapiens
cttctcttctatcct

SEQ ID NO: 261719 - DNA, 14 bp, Homo sapiens
cttctcttttcctc

SEQ ID NO: 261720 - DNA, 19 bp, Homo sapiens
cttctcttttcctcgcaga

SEQ ID NO: 261721 - DNA, 18 bp, Homo sapiens
cttctctttttccagaat

SEQ ID NO: 261722 - DNA, 16 bp, Homo sapiens
cttctgaactccatac

SEQ ID NO: 261723 - DNA, 19 bp, Homo sapiens
cttctgaactccatacagc

SEQ ID NO: 261724 - DNA, 17 bp, Homo sapiens
cttctgaactttggaag

SEQ ID NO: 261725 - DNA, 21 bp, Homo sapiens
cttctgaagatggaaggcctt

SEQ ID NO: 261726 - DNA, 14 bp, Homo sapiens
cttctgaatatttt

SEQ ID NO: 261727 - DNA, 22 bp, Homo sapiens
cttctgaccccacttatgctgc

SEQ ID NO: 261728 - DNA, 18 bp, Homo sapiens
cttctgacggccctgcaa

SEQ ID NO: 261729 - DNA, 18 bp, Homo sapiens
cttctgcctgtggaactg

SEQ ID NO: 261730 - DNA, 13 bp, Homo sapiens
cttctgccttttt

SEQ ID NO: 261731 - DNA, 18 bp, Homo sapiens
cttctgcggtgaggcagg

SEQ ID NO: 261732 - DNA, 23 bp, Homo sapiens
cttctgctaggtagaggcatttg

SEQ ID NO: 261733 - DNA, 16 bp, Homo sapiens
cttctgctcacattcc

SEQ ID NO: 261734 - DNA, 21 bp, Homo sapiens
cttctgctcacattccctctc

SEQ ID NO: 261735 - DNA, 12 bp, Homo sapiens
cttctgctccac

SEQ ID NO: 261736 - DNA, 13 bp, Homo sapiens
cttctgctccacc

SEQ ID NO: 261737 - DNA, 21 bp, Homo sapiens
cttctgctccacccttggcct

SEQ ID NO: 261738 - DNA, 15 bp, Homo sapiens
cttctgctgccctga

SEQ ID NO: 261739 - DNA, 15 bp, Homo sapiens
cttctgctggataaa

SEQ ID NO: 261740 - DNA, 12 bp, Homo sapiens
cttctgcttcca

SEQ ID NO: 261741 - DNA, 16 bp, Homo sapiens
cttctgcttgtcatcc

SEQ ID NO: 261742 - DNA, 14 bp, Homo sapiens
cttctgcttttcaa

SEQ ID NO: 261743 - DNA, 16 bp, Homo sapiens
cttctggaaggctggc

SEQ ID NO: 261744 - DNA, 17 bp, Homo sapiens
cttctggaaggctggct

SEQ ID NO: 261745 - DNA, 19 bp, Homo sapiens
cttctggaaggctggctga

SEQ ID NO: 261746 - DNA, 22 bp, Homo sapiens
cttctggaaggctggctgagtg

SEQ ID NO: 261747 - DNA, 11 bp, Homo sapiens
cttctggcctt

SEQ ID NO: 261748 - DNA, 21 bp, Homo sapiens
cttctggcctttcctctctcc

SEQ ID NO: 261749 - DNA, 22 bp, Homo sapiens
cttctgggaaggggtttctaac

SEQ ID NO: 261750 - DNA, 16 bp, Homo sapiens
cttctgggacttgaaa

SEQ ID NO: 261751 - DNA, 16 bp, Homo sapiens
cttctgggcagagcct

SEQ ID NO: 261752 - DNA, 18 bp, Homo sapiens
cttctgggcagagcctgt

SEQ ID NO: 261753 - DNA, 18 bp, Homo sapiens
cttctggtactctcctag

SEQ ID NO: 261754 - DNA, 14 bp, Homo sapiens
cttctggtcccctg

SEQ ID NO: 261755 - DNA, 16 bp, Homo sapiens
cttctggtcccctgtg

SEQ ID NO: 261756 - DNA, 20 bp, Homo sapiens
cttctggtcccctgtggtga

SEQ ID NO: 261757 - DNA, 19 bp, Homo sapiens
cttctggtgcatgttcttt

SEQ ID NO: 261758 - DNA, 19 bp, Homo sapiens
cttctggttgtatttctat

SEQ ID NO: 261759 - DNA, 20 bp, Homo sapiens
cttctgtccatcagtgcatg

SEQ ID NO: 261760 - DNA, 16 bp, Homo sapiens
cttctgtccccagccc

SEQ ID NO: 261761 - DNA, 21 bp, Homo sapiens
cttctgtgcatttgtgtctgc

SEQ ID NO: 261762 - DNA, 12 bp, Homo sapiens
cttctgtgccca

SEQ ID NO: 261763 - DNA, 13 bp, Homo sapiens
cttctgtgcccag

SEQ ID NO: 261764 - DNA, 14 bp, Homo sapiens
cttctgtgcccagc

SEQ ID NO: 261765 - DNA, 15 bp, Homo sapiens
cttctgtgcccagct

SEQ ID NO: 261766 - DNA, 16 bp, Homo sapiens
taatattggaagtgaa

SEQ ID NO: 261767 - DNA, 21 bp, Homo sapiens
taatatttaggcatgagctct

SEQ ID NO: 261768 - DNA, 18 bp, Homo sapiens
taatatttattgaattat

SEQ ID NO: 261769 - DNA, 13 bp, Homo sapiens
taatatttcttca

SEQ ID NO: 261770 - DNA, 17 bp, Homo sapiens
taatattttagattaca

SEQ ID NO: 261771 - DNA, 22 bp, Homo sapiens
taatcaaaagtccttagaatga

SEQ ID NO: 261772 - DNA, 17 bp, Homo sapiens
taatcaatcatctgtgt

SEQ ID NO: 261773 - DNA, 18 bp, Homo sapiens
taatcaatgtttcttcta

SEQ ID NO: 261774 - DNA, 13 bp, Homo sapiens
taatcaattatta

SEQ ID NO: 261775 - DNA, 18 bp, Homo sapiens
taatcacactctcttctt

SEQ ID NO: 261776 - DNA, 13 bp, Homo sapiens
taatcaccaaagt

SEQ ID NO: 261777 - DNA, 14 bp, Homo sapiens
taatcaccaaagta

SEQ ID NO: 261778 - DNA, 13 bp, Homo sapiens
taatcagaaaccc

SEQ ID NO: 261779 - DNA, 21 bp, Homo sapiens
taatcagaaaccccacttcca

SEQ ID NO: 261780 - DNA, 22 bp, Homo sapiens
taatcagaaaccccacttccat

SEQ ID NO: 261781 - DNA, 22 bp, Homo sapiens
taatcatataataaatgtacat

SEQ ID NO: 261782 - DNA, 20 bp, Homo sapiens
taatcatccttttttaaaaa

SEQ ID NO: 261783 - DNA, 23 bp, Homo sapiens
taatcatttatcttatctagcaa

SEQ ID NO: 261784 - DNA, 22 bp, Homo sapiens
taatcatttccagcaaaatata

SEQ ID NO: 261785 - DNA, 22 bp, Homo sapiens
taatccatgtgctgctgtggca

SEQ ID NO: 261786 - DNA, 17 bp, Homo sapiens
taatccccttctcccct

SEQ ID NO: 261787 - DNA, 21 bp, Homo sapiens
taatccccttctcccctgcac

SEQ ID NO: 261788 - DNA, 18 bp, Homo sapiens
taatcccggtttcagaag

SEQ ID NO: 261789 - DNA, 21 bp, Homo sapiens
taatcgaacgcgtgtgtgcct

SEQ ID NO: 261790 - DNA, 22 bp, Homo sapiens
taatcgaacgcgtgtgtgcctg

SEQ ID NO: 261791 - DNA, 21 bp, Homo sapiens
taatctagagctatgcacacc

SEQ ID NO: 261792 - DNA, 17 bp, Homo sapiens
taatctagtttacagaa

SEQ ID NO: 261793 - DNA, 20 bp, Homo sapiens
taatctagtttacagaaaaa

SEQ ID NO: 261794 - DNA, 18 bp, Homo sapiens
taatctattgggttcatt

SEQ ID NO: 261795 - DNA, 13 bp, Homo sapiens
taatctccacagt

SEQ ID NO: 261796 - DNA, 18 bp, Homo sapiens
taatctcctcttttatct

SEQ ID NO: 261797 - DNA, 13 bp, Homo sapiens
taatctctaaaat

SEQ ID NO: 261798 - DNA, 18 bp, Homo sapiens
taatctctaaaattctag

SEQ ID NO: 261799 - DNA, 21 bp, Homo sapiens
taatctctaaaattctagtct

SEQ ID NO: 261800 - DNA, 13 bp, Homo sapiens
taatctctgatta

SEQ ID NO: 261801 - DNA, 18 bp, Homo sapiens
taatctgaggatgagaca

SEQ ID NO: 261802 - DNA, 15 bp, Homo sapiens
taatctgctttgtta

SEQ ID NO: 261803 - DNA, 21 bp, Homo sapiens
taatctgctttgttaatgaaa

SEQ ID NO: 261804 - DNA, 17 bp, Homo sapiens
taatctggactcctctg

SEQ ID NO: 261805 - DNA, 20 bp, Homo sapiens
taatctggactcctctgtcc

SEQ ID NO: 261806 - DNA, 20 bp, Homo sapiens
taatctgtagggctggacct

SEQ ID NO: 261807 - DNA, 13 bp, Homo sapiens
taatcttagaaca

SEQ ID NO: 261808 - DNA, 20 bp, Homo sapiens
taatcttcagttttatcttt

SEQ ID NO: 261809 - DNA, 16 bp, Homo sapiens
taatcttctctcttga

SEQ ID NO: 261810 - DNA, 14 bp, Homo sapiens
taatcttgctttct

SEQ ID NO: 261811 - DNA, 15 bp, Homo sapiens
taatcttgctttctt

SEQ ID NO: 261812 - DNA, 12 bp, Homo sapiens
taatctttattt

SEQ ID NO: 261813 - DNA, 16 bp, Homo sapiens
taatctttattttatt

SEQ ID NO: 261814 - DNA, 18 bp, Homo sapiens
taatctttctttacctga

SEQ ID NO: 261815 - DNA, 16 bp, Homo sapiens
taatgaaaaggaagtt

SEQ ID NO: 261816 - DNA, 19 bp, Homo sapiens
taatgaaagggaaagtcag

SEQ ID NO: 261817 - DNA, 23 bp, Homo sapiens
taatgaaataaatcatgttaatc

SEQ ID NO: 261818 - DNA, 13 bp, Homo sapiens
taatgaactgtga

SEQ ID NO: 261819 - DNA, 18 bp, Homo sapiens
taatgaaggtgtgctaca

SEQ ID NO: 261820 - DNA, 19 bp, Homo sapiens
taatgaaggtgtgctacag

SEQ ID NO: 261821 - DNA, 18 bp, Homo sapiens
taatgaattttatgtgac

SEQ ID NO: 261822 - DNA, 21 bp, Homo sapiens
taatgaatttttatgatattc

SEQ ID NO: 261823 - DNA, 16 bp, Homo sapiens
taatgacccggccccc

SEQ ID NO: 261824 - DNA, 17 bp, Homo sapiens
taatgagttttacatta

SEQ ID NO: 261825 - DNA, 19 bp, Homo sapiens
taatgatactgtctaagaa

SEQ ID NO: 261826 - DNA, 22 bp, Homo sapiens
taatgatcaacaatttaatgta

SEQ ID NO: 261827 - DNA, 20 bp, Homo sapiens
taatgatttaagcattttac

SEQ ID NO: 261828 - DNA, 22 bp, Homo sapiens
taatgatttgtgtccatttcaa

SEQ ID NO: 261829 - DNA, 16 bp, Homo sapiens
taatgatttttgtgta

SEQ ID NO: 261830 - DNA, 18 bp, Homo sapiens
taatgatttttgtgtatc

SEQ ID NO: 261831 - DNA, 19 bp, Homo sapiens
taatgcactggggtaccac

SEQ ID NO: 261832 - DNA, 17 bp, Homo sapiens
taatgcagacatttaca

SEQ ID NO: 261833 - DNA, 21 bp, Homo sapiens
taatgcagacatttacatgtt

SEQ ID NO: 261834 - DNA, 16 bp, Homo sapiens
taatgcattaactttt

SEQ ID NO: 261835 - DNA, 19 bp, Homo sapiens
cttggagaggaggtgtgga

SEQ ID NO: 261836 - DNA, 22 bp, Homo sapiens
cttggagatctttgcttccttg

SEQ ID NO: 261837 - DNA, 15 bp, Homo sapiens
cttggagccactggg

SEQ ID NO: 261838 - DNA, 18 bp, Homo sapiens
cttggagcccgtgcagta

SEQ ID NO: 261839 - DNA, 21 bp, Homo sapiens
cttggagccggactttcggag

SEQ ID NO: 261840 - DNA, 21 bp, Homo sapiens
cttggagcttacatagtttta

SEQ ID NO: 261841 - DNA, 17 bp, Homo sapiens
cttggaggagatgggga

SEQ ID NO: 261842 - DNA, 20 bp, Homo sapiens
cttggataggagcttccaga

SEQ ID NO: 261843 - DNA, 22 bp, Homo sapiens
cttggattggtaccagagccta

SEQ ID NO: 261844 - DNA, 16 bp, Homo sapiens
cttggatttgcatttt

SEQ ID NO: 261845 - DNA, 13 bp, Homo sapiens
cttggcaccaaag

SEQ ID NO: 261846 - DNA, 14 bp, Homo sapiens
cttggcacccccat

SEQ ID NO: 261847 - DNA, 21 bp, Homo sapiens
cttggcaggagtgggctctga

SEQ ID NO: 261848 - DNA, 23 bp, Homo sapiens
cttggcaggagtgggctctgagc

SEQ ID NO: 261849 - DNA, 21 bp, Homo sapiens
cttggccacggcctgggaggg

SEQ ID NO: 261850 - DNA, 17 bp, Homo sapiens
cttggccagaagggggc

SEQ ID NO: 261851 - DNA, 18 bp, Homo sapiens
cttggccagttatccctt

SEQ ID NO: 261852 - DNA, 13 bp, Homo sapiens
cttggcccagcag

SEQ ID NO: 261853 - DNA, 14 bp, Homo sapiens
cttggcccagcagc

SEQ ID NO: 261854 - DNA, 13 bp, Homo sapiens
cttggcccaggaa

SEQ ID NO: 261855 - DNA, 18 bp, Homo sapiens
cttggcctagcccaccct

SEQ ID NO: 261856 - DNA, 17 bp, Homo sapiens
cttggcctcaagttcaa

SEQ ID NO: 261857 - DNA, 19 bp, Homo sapiens
cttggcctgacctggcaca

SEQ ID NO: 261858 - DNA, 14 bp, Homo sapiens
cttggcctgtccac

SEQ ID NO: 261859 - DNA, 17 bp, Homo sapiens
cttggcctgtctcatcc

SEQ ID NO: 261860 - DNA, 23 bp, Homo sapiens
cttggcctgtctcatccccaggg

SEQ ID NO: 261861 - DNA, 10 bp, Homo sapiens
cttggccttg

SEQ ID NO: 261862 - DNA, 16 bp, Homo sapiens
cttggccttggggcca

SEQ ID NO: 261863 - DNA, 15 bp, Homo sapiens
cttggcgtggagcag

SEQ ID NO: 261864 - DNA, 21 bp, Homo sapiens
cttggcgtggagccagggagc

SEQ ID NO: 261865 - DNA, 22 bp, Homo sapiens
cttggcgtgtgtccctgtggta

SEQ ID NO: 261866 - DNA, 22 bp, Homo sapiens
cttggctccatgctcctcactg

SEQ ID NO: 261867 - DNA, 16 bp, Homo sapiens
cttggctgactggggc

SEQ ID NO: 261868 - DNA, 17 bp, Homo sapiens
cttggctgactggggct

SEQ ID NO: 261869 - DNA, 19 bp, Homo sapiens
cttggctgagccccctctc

SEQ ID NO: 261870 - DNA, 18 bp, Homo sapiens
cttgggaaaatatcactt

SEQ ID NO: 261871 - DNA, 22 bp, Homo sapiens
cttgggaagctgaggcgggaga

SEQ ID NO: 261872 - DNA, 11 bp, Homo sapiens
cttgggacagc

SEQ ID NO: 261873 - DNA, 19 bp, Homo sapiens
cttgggacagccagagctg

SEQ ID NO: 261874 - DNA, 16 bp, Homo sapiens
cttgggacttgggaga

SEQ ID NO: 261875 - DNA, 17 bp, Homo sapiens
cttgggagagcccctgg

SEQ ID NO: 261876 - DNA, 13 bp, Homo sapiens
cttgggagcctga

SEQ ID NO: 261877 - DNA, 20 bp, Homo sapiens
cttgggagcctgaggcagga

SEQ ID NO: 261878 - DNA, 22 bp, Homo sapiens
cttgggagcctgaggcaggaga

SEQ ID NO: 261879 - DNA, 16 bp, Homo sapiens
cttgggatgggcacag

SEQ ID NO: 261880 - DNA, 19 bp, Homo sapiens
cttgggcacgggagagcgc

SEQ ID NO: 261881 - DNA, 22 bp, Homo sapiens
cttgggcacgggagagcgccac

SEQ ID NO: 261882 - DNA, 19 bp, Homo sapiens
cttgggcatccacccagtg

SEQ ID NO: 261883 - DNA, 23 bp, Homo sapiens
cttgggcatccacccagtgctgc

SEQ ID NO: 261884 - DNA, 14 bp, Homo sapiens
cttgggccactgcc

SEQ ID NO: 261885 - DNA, 13 bp, Homo sapiens
cttgggcccagta

SEQ ID NO: 261886 - DNA, 12 bp, Homo sapiens
cttgggccctcc

SEQ ID NO: 261887 - DNA, 20 bp, Homo sapiens
cttgggctactggcagctcc

SEQ ID NO: 261888 - DNA, 22 bp, Homo sapiens
cttgggctccattcccatcact

SEQ ID NO: 261889 - DNA, 21 bp, Homo sapiens
cttgggctcctggctgccagg

SEQ ID NO: 261890 - DNA, 18 bp, Homo sapiens
cttggggaacaagggtgg

SEQ ID NO: 261891 - DNA, 18 bp, Homo sapiens
cttggggaatttcctcta

SEQ ID NO: 261892 - DNA, 11 bp, Homo sapiens
cttggggaggc

SEQ ID NO: 261893 - DNA, 13 bp, Homo sapiens
cttggggaggcaa

SEQ ID NO: 261894 - DNA, 16 bp, Homo sapiens
cttggggccagactgg

SEQ ID NO: 261895 - DNA, 20 bp, Homo sapiens
gaaaatagggtggacagaag

SEQ ID NO: 261896 - DNA, 20 bp, Homo sapiens
gaaaatagtcctccaaaaca

SEQ ID NO: 261897 - DNA, 22 bp, Homo sapiens
gaaaatagtcctccaaaacaca

SEQ ID NO: 261898 - DNA, 18 bp, Homo sapiens
gaaaatagtttaggagaa

SEQ ID NO: 261899 - DNA, 13 bp, Homo sapiens
gaaaatatgatat

SEQ ID NO: 261900 - DNA, 19 bp, Homo sapiens
gaaaatatgatatatatgt

SEQ ID NO: 261901 - DNA, 21 bp, Homo sapiens
gaaaatattatctttgtaatt

SEQ ID NO: 261902 - DNA, 19 bp, Homo sapiens
gaaaatatttttttctagc

SEQ ID NO: 261903 - DNA, 16 bp, Homo sapiens
gaaaatcaaagcagtc

SEQ ID NO: 261904 - DNA, 16 bp, Homo sapiens
gaaaatcaccattccg

SEQ ID NO: 261905 - DNA, 14 bp, Homo sapiens
gaaaatctaatatt

SEQ ID NO: 261906 - DNA, 23 bp, Homo sapiens
gaaaatctaatattaaaaatatg

SEQ ID NO: 261907 - DNA, 20 bp, Homo sapiens
gaaaatctgtaaaaaagaaa

SEQ ID NO: 261908 - DNA, 17 bp, Homo sapiens
gaaaatgaatttgactg

SEQ ID NO: 261909 - DNA, 22 bp, Homo sapiens
gaaaatgccacattttgcttta

SEQ ID NO: 261910 - DNA, 19 bp, Homo sapiens
gaaaatggatgacaaagaa

SEQ ID NO: 261911 - DNA, 13 bp, Homo sapiens
gaaaatgtaaatt

SEQ ID NO: 261912 - DNA, 12 bp, Homo sapiens
gaaaatgtactg

SEQ ID NO: 261913 - DNA, 23 bp, Homo sapiens
gaaaatgtcagaaaccagttatg

SEQ ID NO: 261914 - DNA, 13 bp, Homo sapiens
gaaaatgtcctgt

SEQ ID NO: 261915 - DNA, 15 bp, Homo sapiens
gaaaatgtcctgtgg

SEQ ID NO: 261916 - DNA, 18 bp, Homo sapiens
gaaaatgtgtctgcaaca

SEQ ID NO: 261917 - DNA, 15 bp, Homo sapiens
gaaaattacaacaga

SEQ ID NO: 261918 - DNA, 18 bp, Homo sapiens
gaaaattaggatttcatg

SEQ ID NO: 261919 - DNA, 22 bp, Homo sapiens
gaaaattaggatttcatgattt

SEQ ID NO: 261920 - DNA, 19 bp, Homo sapiens
gaaaattcaaaaagtgttt

SEQ ID NO: 261921 - DNA, 20 bp, Homo sapiens
gaaaattcaaaaagtgttta

SEQ ID NO: 261922 - DNA, 21 bp, Homo sapiens
gaaaattcaaaaagtgtttat

SEQ ID NO: 261923 - DNA, 12 bp, Homo sapiens
gaaaattcaaca

SEQ ID NO: 261924 - DNA, 18 bp, Homo sapiens
gaaaattccagaaaggat

SEQ ID NO: 261925 - DNA, 17 bp, Homo sapiens
gaaaattctcaagtgat

SEQ ID NO: 261926 - DNA, 19 bp, Homo sapiens
gaaaattctcaagtgatag

SEQ ID NO: 261927 - DNA, 21 bp, Homo sapiens
gaaacaaaaaacaccaaaaat

SEQ ID NO: 261928 - DNA, 14 bp, Homo sapiens
gaaacaaataatca

SEQ ID NO: 261929 - DNA, 17 bp, Homo sapiens
gaaacacacttttgcac

SEQ ID NO: 261930 - DNA, 21 bp, Homo sapiens
gaaacacagaactcagcctta

SEQ ID NO: 261931 - DNA, 13 bp, Homo sapiens
gaaacaccactta

SEQ ID NO: 261932 - DNA, 16 bp, Homo sapiens
gaaacaccacttaatc

SEQ ID NO: 261933 - DNA, 19 bp, Homo sapiens
gaaacaccacttaatcttc

SEQ ID NO: 261934 - DNA, 18 bp, Homo sapiens
gaaacacctagatcagaa

SEQ ID NO: 261935 - DNA, 18 bp, Homo sapiens
gaaacactcgtgtgcatg

SEQ ID NO: 261936 - DNA, 13 bp, Homo sapiens
gaaacagaaaaga

SEQ ID NO: 261937 - DNA, 19 bp, Homo sapiens
gaaacagaggagagtccca

SEQ ID NO: 261938 - DNA, 20 bp, Homo sapiens
gaaacagaggagagtcccag

SEQ ID NO: 261939 - DNA, 18 bp, Homo sapiens
gaaacagctttcaagtgc

SEQ ID NO: 261940 - DNA, 17 bp, Homo sapiens
gaaacaggagagaaagg

SEQ ID NO: 261941 - DNA, 15 bp, Homo sapiens
gaaacagtgtggatg

SEQ ID NO: 261942 - DNA, 20 bp, Homo sapiens
gaaacagtgtggatgtaaat

SEQ ID NO: 261943 - DNA, 15 bp, Homo sapiens
gaaacatggttttga

SEQ ID NO: 261944 - DNA, 22 bp, Homo sapiens
gaaacattcacacagggctctt

SEQ ID NO: 261945 - DNA, 13 bp, Homo sapiens
gaaacatttgaca

SEQ ID NO: 261946 - DNA, 18 bp, Homo sapiens
gaaacatttgacacataa

SEQ ID NO: 261947 - DNA, 13 bp, Homo sapiens
gaaaccacacttc

SEQ ID NO: 261948 - DNA, 18 bp, Homo sapiens
gaaaccagtgcaacagca

SEQ ID NO: 261949 - DNA, 22 bp, Homo sapiens
gaaaccatgactgtgaccacct

SEQ ID NO: 261950 - DNA, 15 bp, Homo sapiens
gaaacccccaggagg

SEQ ID NO: 261951 - DNA, 19 bp, Homo sapiens
gaaacccctggggaccatg

SEQ ID NO: 261952 - DNA, 14 bp, Homo sapiens
gaaaccctgtttta

SEQ ID NO: 261953 - DNA, 21 bp, Homo sapiens
gaaacctccatcctgccagga

SEQ ID NO: 261954 - DNA, 23 bp, Homo sapiens
gaaacctccatcctgccaggagc

SEQ ID NO: 261955 - DNA, 13 bp, Homo sapiens
gaaacctgaaaaa

SEQ ID NO: 261956 - DNA, 17 bp, Homo sapiens
gaaacctgccctgcctg

SEQ ID NO: 261957 - DNA, 16 bp, Homo sapiens
gaaaccttgtttgttt

SEQ ID NO: 261958 - DNA, 17 bp, Homo sapiens
gaaaccttttaaaaaaa

SEQ ID NO: 261959 - DNA, 15 bp, Homo sapiens
gaaacgaatataagc

SEQ ID NO: 261960 - DNA, 15 bp, Homo sapiens
gaaacgtgccctctg

SEQ ID NO: 261961 - DNA, 15 bp, Homo sapiens
gaaactaacagataa

SEQ ID NO: 261962 - DNA, 22 bp, Homo sapiens
gaaactaccagtgggcatgtat

SEQ ID NO: 261963 - DNA, 20 bp, Homo sapiens
gaaactcacctgctggcccc

SEQ ID NO: 261964 - DNA, 17 bp, Homo sapiens
gaaactcagatgtccaa

SEQ ID NO: 261965 - DNA, 18 bp, Homo sapiens
gaaactgaaagtgtttta

SEQ ID NO: 261966 - DNA, 17 bp, Homo sapiens
gaaactgaggcccagag

SEQ ID NO: 261967 - DNA, 17 bp, Homo sapiens
gaaactgttgccagaga

SEQ ID NO: 261968 - DNA, 14 bp, Homo sapiens
gaaacttacacaca

SEQ ID NO: 261969 - DNA, 17 bp, Homo sapiens
gaaacttcaagcaccag

SEQ ID NO: 261970 - DNA, 16 bp, Homo sapiens
gaaagaaaaaacaaaa

SEQ ID NO: 261971 - DNA, 16 bp, Homo sapiens
gaaagaaaagaccctg

SEQ ID NO: 261972 - DNA, 19 bp, Homo sapiens
gaaagaaaagaccctgaga

SEQ ID NO: 261973 - DNA, 14 bp, Homo sapiens
gaaagaaagagaaa

SEQ ID NO: 261974 - DNA, 15 bp, Homo sapiens
gaaagaaataattgt

SEQ ID NO: 261975 - DNA, 16 bp, Homo sapiens
gaaagaagaaaaggtt

SEQ ID NO: 261976 - DNA, 13 bp, Homo sapiens
gaaagaaggaaga

SEQ ID NO: 261977 - DNA, 16 bp, Homo sapiens
gaaagaagtcaaatga

SEQ ID NO: 261978 - DNA, 13 bp, Homo sapiens
gaaagaattattt

SEQ ID NO: 261979 - DNA, 19 bp, Homo sapiens
gaaagagaaagtactcaga

SEQ ID NO: 261980 - DNA, 14 bp, Homo sapiens
gaaagagcattatt

SEQ ID NO: 261981 - DNA, 15 bp, Homo sapiens
gaaagaggagaagga

SEQ ID NO: 261982 - DNA, 20 bp, Homo sapiens
gaaagaggctgaggcctgga

SEQ ID NO: 261983 - DNA, 16 bp, Homo sapiens
gaaagattatcctgtt

SEQ ID NO: 261984 - DNA, 19 bp, Homo sapiens
gaaagcaaaaaataaaata

SEQ ID NO: 261985 - DNA, 22 bp, Homo sapiens
gaaagcaaaaaataaaataagt

SEQ ID NO: 261986 - DNA, 18 bp, Homo sapiens
gaaagcagaggctggcct

SEQ ID NO: 261987 - DNA, 17 bp, Homo sapiens
gaaagcatccatgtgtg

SEQ ID NO: 261988 - DNA, 20 bp, Homo sapiens
gaaagcccctcacctcagga

SEQ ID NO: 261989 - DNA, 16 bp, Homo sapiens
gaaagcccgctagaag

SEQ ID NO: 261990 - DNA, 19 bp, Homo sapiens
gaaagcctcctgccccctg

SEQ ID NO: 261991 - DNA, 21 bp, Homo sapiens
gaaagcctcctgccccctgcc

SEQ ID NO: 261992 - DNA, 15 bp, Homo sapiens
gaaagcctgtctctt

SEQ ID NO: 261993 - DNA, 20 bp, Homo sapiens
gaaagcctgttcccctcact

SEQ ID NO: 261994 - DNA, 16 bp, Homo sapiens
gaaagcgggcagcccc

SEQ ID NO: 261995 - DNA, 15 bp, Homo sapiens
gaaagctatatatga

SEQ ID NO: 261996 - DNA, 23 bp, Homo sapiens
gaaagctgattactgtcaataaa

SEQ ID NO: 261997 - DNA, 15 bp, Homo sapiens
gaaagctgcttctgg

SEQ ID NO: 261998 - DNA, 14 bp, Homo sapiens
gaaagctgtgaaat

SEQ ID NO: 261999 - DNA, 15 bp, Homo sapiens
gaaagctgtgaaatt

SEQ ID NO: 262000 - DNA, 14 bp, Homo sapiens
gaaaggaaaaacag

SEQ ID NO: 262001 - DNA, 22 bp, Homo sapiens
gaaaggaaaaacagaacatttc

SEQ ID NO: 262002 - DNA, 13 bp, Homo sapiens
gaaaggaaaagtc

SEQ ID NO: 262003 - DNA, 16 bp, Homo sapiens
gaaaggaaagaggctc

SEQ ID NO: 262004 - DNA, 14 bp, Homo sapiens
gaaaggatatttaa

SEQ ID NO: 262005 - DNA, 21 bp, Homo sapiens
gaaaggatatttaagaaaata

SEQ ID NO: 262006 - DNA, 14 bp, Homo sapiens
gaaaggatgcttct

SEQ ID NO: 262007 - DNA, 17 bp, Homo sapiens
gaaaggatgcttctgct

SEQ ID NO: 262008 - DNA, 19 bp, Homo sapiens
tactttttccttcctgccc

SEQ ID NO: 262009 - DNA, 13 bp, Homo sapiens
tacttttttatag

SEQ ID NO: 262010 - DNA, 18 bp, Homo sapiens
tagaaaaaagtttacaac

SEQ ID NO: 262011 - DNA, 15 bp, Homo sapiens
tagaaaaagcacagc

SEQ ID NO: 262012 - DNA, 17 bp, Homo sapiens
tagaaaaagcacagctc

SEQ ID NO: 262013 - DNA, 19 bp, Homo sapiens
tagaaaacaatctgcccac

SEQ ID NO: 262014 - DNA, 23 bp, Homo sapiens
tagaaaacaggaaaaaaactttt

SEQ ID NO: 262015 - DNA, 16 bp, Homo sapiens
tagaaaactgaaaatc

SEQ ID NO: 262016 - DNA, 20 bp, Homo sapiens
tagaaaactgaaaatctaat

SEQ ID NO: 262017 - DNA, 21 bp, Homo sapiens
tagaaacctttatccctgctt

SEQ ID NO: 262018 - DNA, 22 bp, Homo sapiens
tagaaacctttatccctgctta

SEQ ID NO: 262019 - DNA, 15 bp, Homo sapiens
tagaaactgagtcct

SEQ ID NO: 262020 - DNA, 23 bp, Homo sapiens
tagaaagaagcccaatattataa

SEQ ID NO: 262021 - DNA, 21 bp, Homo sapiens
tagaaagcccctcacctcagg

SEQ ID NO: 262022 - DNA, 22 bp, Homo sapiens
tagaaagcccctcacctcagga

SEQ ID NO: 262023 - DNA, 23 bp, Homo sapiens
tagaaagcccctcacctcaggac

SEQ ID NO: 262024 - DNA, 12 bp, Homo sapiens
tagaaataagtg

SEQ ID NO: 262025 - DNA, 18 bp, Homo sapiens
gaaaggtgctcaaagatg

SEQ ID NO: 262026 - DNA, 21 bp, Homo sapiens
gaaaggttgattctcatgcac

SEQ ID NO: 262027 - DNA, 14 bp, Homo sapiens
gaaagtaaaaagaa

SEQ ID NO: 262028 - DNA, 15 bp, Homo sapiens
gaaagtcaccaggac

SEQ ID NO: 262029 - DNA, 19 bp, Homo sapiens
gaaagtcagctttcagagc

SEQ ID NO: 262030 - DNA, 22 bp, Homo sapiens
gaaagtcgaattaatagctttt

SEQ ID NO: 262031 - DNA, 20 bp, Homo sapiens
gaaagtcttgtgactagtgc

SEQ ID NO: 262032 - DNA, 13 bp, Homo sapiens
gaaagtgaatttg

SEQ ID NO: 262033 - DNA, 23 bp, Homo sapiens
gaaagtgaatttgaatgaaaaat

SEQ ID NO: 262034 - DNA, 22 bp, Homo sapiens
gaaagtgatttctagaaagcct

SEQ ID NO: 262035 - DNA, 18 bp, Homo sapiens
gaaagtgatttgtaatat

SEQ ID NO: 262036 - DNA, 17 bp, Homo sapiens
gaaagtggcagagccag

SEQ ID NO: 262037 - DNA, 18 bp, Homo sapiens
gaaagtggcagagccagg

SEQ ID NO: 262038 - DNA, 17 bp, Homo sapiens
gaaagtgtaaaatagaa

SEQ ID NO: 262039 - DNA, 23 bp, Homo sapiens
gaaagtttccccaccagtgaatg

SEQ ID NO: 262040 - DNA, 22 bp, Homo sapiens
gaaagtttggggacatgtgatt

SEQ ID NO: 262041 - DNA, 21 bp, Homo sapiens
gaaagttttccagtattgaaa

SEQ ID NO: 262042 - DNA, 17 bp, Homo sapiens
gaaataaaacctttcaa

SEQ ID NO: 262043 - DNA, 22 bp, Homo sapiens
gaaataaataaattgcctccct

SEQ ID NO: 262044 - DNA, 23 bp, Homo sapiens
gaaataaatagctatatccatgt

SEQ ID NO: 262045 - DNA, 12 bp, Homo sapiens
gaaataaatgta

SEQ ID NO: 262046 - DNA, 14 bp, Homo sapiens
gaaataaattggtg

SEQ ID NO: 262047 - DNA, 23 bp, Homo sapiens
gaaataaattggtgataagtgga

SEQ ID NO: 262048 - DNA, 21 bp, Homo sapiens
gaaataacattgcactttata

SEQ ID NO: 262049 - DNA, 23 bp, Homo sapiens
gaaataacattgcactttataaa

SEQ ID NO: 262050 - DNA, 17 bp, Homo sapiens
gaaataataaattaaca

SEQ ID NO: 262051 - DNA, 13 bp, Homo sapiens
gaaataatatgca

SEQ ID NO: 262052 - DNA, 14 bp, Homo sapiens
gaaataatatgcat

SEQ ID NO: 262053 - DNA, 18 bp, Homo sapiens
gaaatacactacaaatgt

SEQ ID NO: 262054 - DNA, 20 bp, Homo sapiens
gaaatacactacaaatgtta

SEQ ID NO: 262055 - DNA, 16 bp, Homo sapiens
gaaatacagtgcttta

SEQ ID NO: 262056 - DNA, 19 bp, Homo sapiens
gaaatataaaaataattaa

SEQ ID NO: 262057 - DNA, 14 bp, Homo sapiens
gaaatataaactgt

SEQ ID NO: 262058 - DNA, 15 bp, Homo sapiens
gaaatataaactgtg

SEQ ID NO: 262059 - DNA, 12 bp, Homo sapiens
gaaatatcattt

SEQ ID NO: 262060 - DNA, 17 bp, Homo sapiens
gaaatatgcacaatagc

SEQ ID NO: 262061 - DNA, 13 bp, Homo sapiens
gaaatatgcatgt

SEQ ID NO: 262062 - DNA, 17 bp, Homo sapiens
gaaatatgcatgtactt

SEQ ID NO: 262063 - DNA, 21 bp, Homo sapiens
gaaatatttgcttatttatat

SEQ ID NO: 262064 - DNA, 22 bp, Homo sapiens
gaaatattttgataataaattg

SEQ ID NO: 262065 - DNA, 22 bp, Homo sapiens
gaaatcacaggggcggggcagg

SEQ ID NO: 262066 - DNA, 19 bp, Homo sapiens
gaaatcaccttttctaaaa

SEQ ID NO: 262067 - DNA, 16 bp, Homo sapiens
gaaatcattgtagaaa

SEQ ID NO: 262068 - DNA, 17 bp, Homo sapiens
gaaatcattgtgtgtct

SEQ ID NO: 262069 - DNA, 20 bp, Homo sapiens
gaaatccaaactactttctt

SEQ ID NO: 262070 - DNA, 17 bp, Homo sapiens
gaaatccagaagtttta

SEQ ID NO: 262071 - DNA, 12 bp, Homo sapiens
gaaatccagatc

SEQ ID NO: 262072 - DNA, 11 bp, Homo sapiens
gaaatccagta

SEQ ID NO: 262073 - DNA, 19 bp, Homo sapiens
gaaatcgccttatgagaac

SEQ ID NO: 262074 - DNA, 14 bp, Homo sapiens
gaaatgaataattt

SEQ ID NO: 262075 - DNA, 18 bp, Homo sapiens
gaaatgaataatttccca

SEQ ID NO: 262076 - DNA, 20 bp, Homo sapiens
gaaatgcattattttgaatg

SEQ ID NO: 262077 - DNA, 18 bp, Homo sapiens
gaaatgctgatggataac

SEQ ID NO: 262078 - DNA, 15 bp, Homo sapiens
gaaatgctgcctgcc

SEQ ID NO: 262079 - DNA, 16 bp, Homo sapiens
gaaatgctgcctgcct

SEQ ID NO: 262080 - DNA, 18 bp, Homo sapiens
gaaatgctgttggtgaga

SEQ ID NO: 262081 - DNA, 15 bp, Homo sapiens
gaaatgggagatggt

SEQ ID NO: 262082 - DNA, 22 bp, Homo sapiens
gaaatgtaccatcaaatgttaa

SEQ ID NO: 262083 - DNA, 22 bp, Homo sapiens
gaaatgtattttgaaaacactt

SEQ ID NO: 262084 - DNA, 19 bp, Homo sapiens
gaaatgtctgttccagctg

SEQ ID NO: 262085 - DNA, 16 bp, Homo sapiens
gaaatgtgctgcaaag

SEQ ID NO: 262086 - DNA, 13 bp, Homo sapiens
gaaatgtttccag

SEQ ID NO: 262087 - DNA, 13 bp, Homo sapiens
gaaattacaagtt

SEQ ID NO: 262088 - DNA, 16 bp, Homo sapiens
gaaattacaagtttca

SEQ ID NO: 262089 - DNA, 17 bp, Homo sapiens
gaaattacaagtttcag

SEQ ID NO: 262090 - DNA, 20 bp, Homo sapiens
gaaattacaagtttcagtaa

SEQ ID NO: 262091 - DNA, 18 bp, Homo sapiens
gaaattactacaaaattt

SEQ ID NO: 262092 - DNA, 21 bp, Homo sapiens
gaaattataagtagatttgta

SEQ ID NO: 262093 - DNA, 16 bp, Homo sapiens
gaaattatttaatatg

SEQ ID NO: 262094 - DNA, 15 bp, Homo sapiens
gaaattcacactgtg

SEQ ID NO: 262095 - DNA, 20 bp, Homo sapiens
gaaattcattaaagaaaaac

SEQ ID NO: 262096 - DNA, 13 bp, Homo sapiens
gaaattccctgga

SEQ ID NO: 262097 - DNA, 17 bp, Homo sapiens
gaaattctgctgcttga

SEQ ID NO: 262098 - DNA, 21 bp, Homo sapiens
gaaattcttatttcccctttc

SEQ ID NO: 262099 - DNA, 12 bp, Homo sapiens
gaaattgattga

SEQ ID NO: 262100 - DNA, 15 bp, Homo sapiens
gaaattgcaaagaaa

SEQ ID NO: 262101 - DNA, 13 bp, Homo sapiens
gaaattgggtgtg

SEQ ID NO: 262102 - DNA, 17 bp, Homo sapiens
gaaattgggtgtgccct

SEQ ID NO: 262103 - DNA, 19 bp, Homo sapiens
gaaattgggtgtgccctgg

SEQ ID NO: 262104 - DNA, 18 bp, Homo sapiens
gaaatttacagttactgc

SEQ ID NO: 262105 - DNA, 21 bp, Homo sapiens
gaaatttattagttaatatat

SEQ ID NO: 262106 - DNA, 19 bp, Homo sapiens
gaaatttcccacaccccag

SEQ ID NO: 262107 - DNA, 14 bp, Homo sapiens
gaaatttgttaata

SEQ ID NO: 262108 - DNA, 20 bp, Homo sapiens
gaaatttgttatacttcaaa

SEQ ID NO: 262109 - DNA, 15 bp, Homo sapiens
gaaattttatctctt

SEQ ID NO: 262110 - DNA, 16 bp, Homo sapiens
gaaattttatctcttc

SEQ ID NO: 262111 - DNA, 21 bp, Homo sapiens
gaaattttctagactttctgt

SEQ ID NO: 262112 - DNA, 13 bp, Homo sapiens
gaaatttttatca

SEQ ID NO: 262113 - DNA, 17 bp, Homo sapiens
gaacaaaaattgggttt

SEQ ID NO: 262114 - DNA, 20 bp, Homo sapiens
gaacaaacaaaacttaaaag

SEQ ID NO: 262115 - DNA, 13 bp, Homo sapiens
gaacaaagacaac

SEQ ID NO: 262116 - DNA, 22 bp, Homo sapiens
gaacaaatcacacctctgggct

SEQ ID NO: 262117 - DNA, 21 bp, Homo sapiens
gaacaaggcaaggctgtcaat

SEQ ID NO: 262118 - DNA, 20 bp, Homo sapiens
gaacaagtcacagctgcagc

SEQ ID NO: 262119 - DNA, 14 bp, Homo sapiens
gaacaatcaaagca

SEQ ID NO: 262120 - DNA, 15 bp, Homo sapiens
gaacaatcactattc

SEQ ID NO: 262121 - DNA, 19 bp, Homo sapiens
gaacaatcactattcttaa

SEQ ID NO: 262122 - DNA, 22 bp, Homo sapiens
gaacacaaagcggggggagggt

SEQ ID NO: 262123 - DNA, 11 bp, Homo sapiens
gaacacaggca

SEQ ID NO: 262124 - DNA, 20 bp, Homo sapiens
gaacacagtttagtgcttta

SEQ ID NO: 262125 - DNA, 18 bp, Homo sapiens
gaacacatactagaaagc

SEQ ID NO: 262126 - DNA, 14 bp, Homo sapiens
gaacacccagcccc

SEQ ID NO: 262127 - DNA, 20 bp, Homo sapiens
gaacaccccataactacaga

SEQ ID NO: 262128 - DNA, 19 bp, Homo sapiens
gaacacccggaaagactga

SEQ ID NO: 262129 - DNA, 15 bp, Homo sapiens
gaacacctggccggg

SEQ ID NO: 262130 - DNA, 23 bp, Homo sapiens
gaacacctggccgggtcaccctg

SEQ ID NO: 262131 - DNA, 16 bp, Homo sapiens
gaacacttattgcttt

SEQ ID NO: 262132 - DNA, 12 bp, Homo sapiens
gaacagaaaaca

SEQ ID NO: 262133 - DNA, 13 bp, Homo sapiens
gaacagaaaacaa

SEQ ID NO: 262134 - DNA, 14 bp, Homo sapiens
gaacagaaaacaac

SEQ ID NO: 262135 - DNA, 19 bp, Homo sapiens
gaacagaaaacaacaaaaa

SEQ ID NO: 262136 - DNA, 13 bp, Homo sapiens
gaacagagtatat

SEQ ID NO: 262137 - DNA, 18 bp, Homo sapiens
gaacagataatcagtgtg

SEQ ID NO: 262138 - DNA, 15 bp, Homo sapiens
gaacagatggctgtg

SEQ ID NO: 262139 - DNA, 15 bp, Homo sapiens
gaacagattgctaca

SEQ ID NO: 262140 - DNA, 21 bp, Homo sapiens
gaacagattgctacacacaca

SEQ ID NO: 262141 - DNA, 14 bp, Homo sapiens
gaacagcaggccca

SEQ ID NO: 262142 - DNA, 16 bp, Homo sapiens
gaacagcgggagacct

SEQ ID NO: 262143 - DNA, 21 bp, Homo sapiens
gaacagcgggagacctgtgct

SEQ ID NO: 262144 - DNA, 19 bp, Homo sapiens
tagagtggcgattgaatgc

SEQ ID NO: 262145 - DNA, 23 bp, Homo sapiens
tagagtttatttttttgatggct

SEQ ID NO: 262146 - DNA, 14 bp, Homo sapiens
tagagtttgatcat

SEQ ID NO: 262147 - DNA, 21 bp, Homo sapiens
tagataactgctcttttacta

SEQ ID NO: 262148 - DNA, 17 bp, Homo sapiens
tagataacttaaataat

SEQ ID NO: 262149 - DNA, 13 bp, Homo sapiens
tagatacaatcag

SEQ ID NO: 262150 - DNA, 16 bp, Homo sapiens
tagatacaatcagctg

SEQ ID NO: 262151 - DNA, 17 bp, Homo sapiens
tagatacaatcagctgc

SEQ ID NO: 262152 - DNA, 21 bp, Homo sapiens
tagatacagatccgcatgtgt

SEQ ID NO: 262153 - DNA, 22 bp, Homo sapiens
tagatacagatccgcatgtgtc

SEQ ID NO: 262154 - DNA, 16 bp, Homo sapiens
tagatacttttgataa

SEQ ID NO: 262155 - DNA, 17 bp, Homo sapiens
gaagctggggacagctt

SEQ ID NO: 262156 - DNA, 23 bp, Homo sapiens
gaagctggggacagctttcctgg

SEQ ID NO: 262157 - DNA, 19 bp, Homo sapiens
gaagctgtactcagagcag

SEQ ID NO: 262158 - DNA, 16 bp, Homo sapiens
gaagcttattaatgct

SEQ ID NO: 262159 - DNA, 22 bp, Homo sapiens
taggtgaccccatctctgctgc

SEQ ID NO: 262160 - DNA, 15 bp, Homo sapiens
taggtgccaggctgt

SEQ ID NO: 262161 - DNA, 11 bp, Homo sapiens
taggtgctggc

SEQ ID NO: 262162 - DNA, 12 bp, Homo sapiens
taggtgctggcc

SEQ ID NO: 262163 - DNA, 15 bp, Homo sapiens
taggtgctggcctca

SEQ ID NO: 262164 - DNA, 19 bp, Homo sapiens
taggtgggccagcccctcc

SEQ ID NO: 262165 - DNA, 20 bp, Homo sapiens
taggtgggccagcccctccc

SEQ ID NO: 262166 - DNA, 16 bp, Homo sapiens
taggtgggtcttggat

SEQ ID NO: 262167 - DNA, 13 bp, Homo sapiens
taggtgtccccaa

SEQ ID NO: 262168 - DNA, 13 bp, Homo sapiens
taggtgtctttta

SEQ ID NO: 262169 - DNA, 12 bp, Homo sapiens
taggttctaaaa

SEQ ID NO: 262170 - DNA, 14 bp, Homo sapiens
taggttctgtctgt

SEQ ID NO: 262171 - DNA, 15 bp, Homo sapiens
taggttgtctaaaaa

SEQ ID NO: 262172 - DNA, 22 bp, Homo sapiens
taggttgtttttaaaaccacta

SEQ ID NO: 262173 - DNA, 17 bp, Homo sapiens
taggtttaactcagatc

SEQ ID NO: 262174 - DNA, 18 bp, Homo sapiens
taggtttgagttcaaatt

SEQ ID NO: 262175 - DNA, 19 bp, Homo sapiens
tagtaaaaagattctctgc

SEQ ID NO: 262176 - DNA, 21 bp, Homo sapiens
tagtaaatattatgattttat

SEQ ID NO: 262177 - DNA, 21 bp, Homo sapiens
tagtaacacataaagtaaatg

SEQ ID NO: 262178 - DNA, 16 bp, Homo sapiens
tagtacatgcagaaat

SEQ ID NO: 262179 - DNA, 13 bp, Homo sapiens
tagtacccacctg

SEQ ID NO: 262180 - DNA, 14 bp, Homo sapiens
tagtacccacctga

SEQ ID NO: 262181 - DNA, 19 bp, Homo sapiens
tagtaccctatagagaggg

SEQ ID NO: 262182 - DNA, 14 bp, Homo sapiens
tagtacctttgctc

SEQ ID NO: 262183 - DNA, 23 bp, Homo sapiens
tagtactatatctgttttactgc

SEQ ID NO: 262184 - DNA, 17 bp, Homo sapiens
tagtactcctgcaaaat

SEQ ID NO: 262185 - DNA, 20 bp, Homo sapiens
tagtactcctgcaaaatttt

SEQ ID NO: 262186 - DNA, 16 bp, Homo sapiens
tagtactgtattggct

SEQ ID NO: 262187 - DNA, 22 bp, Homo sapiens
tagtacttgaaatctaggatta

SEQ ID NO: 262188 - DNA, 15 bp, Homo sapiens
tagtagaaattttac

SEQ ID NO: 262189 - DNA, 20 bp, Homo sapiens
tagtagaaattttacaatag

SEQ ID NO: 262190 - DNA, 17 bp, Homo sapiens
tagtagacactaattct

SEQ ID NO: 262191 - DNA, 21 bp, Homo sapiens
tagtagagcaaagacttaatc

SEQ ID NO: 262192 - DNA, 16 bp, Homo sapiens
tagtagctgataaaga

SEQ ID NO: 262193 - DNA, 14 bp, Homo sapiens
tagtagtaaatgct

SEQ ID NO: 262194 - DNA, 16 bp, Homo sapiens
tagtatacccactgca

SEQ ID NO: 262195 - DNA, 15 bp, Homo sapiens
tagtatagaatgaac

SEQ ID NO: 262196 - DNA, 13 bp, Homo sapiens
tagtatcctgtta

SEQ ID NO: 262197 - DNA, 15 bp, Homo sapiens
tagtatctaacatgt

SEQ ID NO: 262198 - DNA, 13 bp, Homo sapiens
tagtatcttcaaa

SEQ ID NO: 262199 - DNA, 14 bp, Homo sapiens
tagtattaactatt

SEQ ID NO: 262200 - DNA, 15 bp, Homo sapiens
tagtcaagattgtgt

SEQ ID NO: 262201 - DNA, 16 bp, Homo sapiens
tagtcaatttctactt

SEQ ID NO: 262202 - DNA, 19 bp, Homo sapiens
tagtcaatttctacttctg

SEQ ID NO: 262203 - DNA, 18 bp, Homo sapiens
tagtcattccaaatatga

SEQ ID NO: 262204 - DNA, 21 bp, Homo sapiens
tagtccccctgttttctgttt

SEQ ID NO: 262205 - DNA, 14 bp, Homo sapiens
tagtcccttcccct

SEQ ID NO: 262206 - DNA, 23 bp, Homo sapiens
tagtcccttcccctccctggctc

SEQ ID NO: 262207 - DNA, 23 bp, Homo sapiens
tagtcctagctgacgccaataat

SEQ ID NO: 262208 - DNA, 22 bp, Homo sapiens
tagtcctattctattgcagtta

SEQ ID NO: 262209 - DNA, 13 bp, Homo sapiens
tagtcctcacagc

SEQ ID NO: 262210 - DNA, 19 bp, Homo sapiens
tagtcgtggagatgtcttc

SEQ ID NO: 262211 - DNA, 21 bp, Homo sapiens
tagtctcattacttttgaagt

SEQ ID NO: 262212 - DNA, 19 bp, Homo sapiens
tagtctcctttgcactgag

SEQ ID NO: 262213 - DNA, 22 bp, Homo sapiens
tagtctcctttgcactgagggc

SEQ ID NO: 262214 - DNA, 19 bp, Homo sapiens
tagtctctgatttgcaaat

SEQ ID NO: 262215 - DNA, 12 bp, Homo sapiens
tagtctttcaca

SEQ ID NO: 262216 - DNA, 24 bp, Homo sapiens
tagtctttgtttacatgagttcaa

SEQ ID NO: 262217 - DNA, 19 bp, Homo sapiens
tagtgaaaattttattgaa

SEQ ID NO: 262218 - DNA, 17 bp, Homo sapiens
tagtgaattttaaaatg

SEQ ID NO: 262219 - DNA, 14 bp, Homo sapiens
tagtgacttcctgg

SEQ ID NO: 262220 - DNA, 15 bp, Homo sapiens
tagtgagatttgtat

SEQ ID NO: 262221 - DNA, 17 bp, Homo sapiens
tagtgagatttgtattt

SEQ ID NO: 262222 - DNA, 20 bp, Homo sapiens
tagtgagatttgtatttata

SEQ ID NO: 262223 - DNA, 14 bp, Homo sapiens
tagtgagtgtagac

SEQ ID NO: 262224 - DNA, 22 bp, Homo sapiens
tagtgagtgtggcttagtaata

SEQ ID NO: 262225 - DNA, 12 bp, Homo sapiens
tagtgatgaaat

SEQ ID NO: 262226 - DNA, 18 bp, Homo sapiens
tagtgatggttcccctgt

SEQ ID NO: 262227 - DNA, 14 bp, Homo sapiens
tagtgattgctttt

SEQ ID NO: 262228 - DNA, 13 bp, Homo sapiens
tagtgatttgcta

SEQ ID NO: 262229 - DNA, 13 bp, Homo sapiens
tagtgcaatttct

SEQ ID NO: 262230 - DNA, 16 bp, Homo sapiens
tagtgcaatttcttct

SEQ ID NO: 262231 - DNA, 12 bp, Homo sapiens
tagtgcagctga

SEQ ID NO: 262232 - DNA, 23 bp, Homo sapiens
tagtgccagaaagagagaaccaa

SEQ ID NO: 262233 - DNA, 11 bp, Homo sapiens
tagtgccaggc

SEQ ID NO: 262234 - DNA, 23 bp, Homo sapiens
tagtgccaggtggctcagtgcca

SEQ ID NO: 262235 - DNA, 23 bp, Homo sapiens
tagtgccgtagggagtacctgct

SEQ ID NO: 262236 - DNA, 16 bp, Homo sapiens
tagtgcctcagcgctg

SEQ ID NO: 262237 - DNA, 22 bp, Homo sapiens
tagtgcctgtgatcgtgtgttg

SEQ ID NO: 262238 - DNA, 14 bp, Homo sapiens
tagtgcggacaagt

SEQ ID NO: 262239 - DNA, 12 bp, Homo sapiens
tagtgctgaagc

SEQ ID NO: 262240 - DNA, 17 bp, Homo sapiens
tagtgctgaagcttatt

SEQ ID NO: 262241 - DNA, 18 bp, Homo sapiens
tagtgctgaagcttatta

SEQ ID NO: 262242 - DNA, 19 bp, Homo sapiens
tagtgctgaagcttattaa

SEQ ID NO: 262243 - DNA, 17 bp, Homo sapiens
tagtggaagagcagcct

SEQ ID NO: 262244 - DNA, 19 bp, Homo sapiens
tagtggaagagcagcctga

SEQ ID NO: 262245 - DNA, 17 bp, Homo sapiens
tagtggccagaccagag

SEQ ID NO: 262246 - DNA, 19 bp, Homo sapiens
tagtggccagaccagagct

SEQ ID NO: 262247 - DNA, 17 bp, Homo sapiens
tagtggcttcagcccct

SEQ ID NO: 262248 - DNA, 19 bp, Homo sapiens
tagtggcttcagcccctgg

SEQ ID NO: 262249 - DNA, 17 bp, Homo sapiens
tagtgggccttcattaa

SEQ ID NO: 262250 - DNA, 21 bp, Homo sapiens
tagtgggccttcattaaatgt

SEQ ID NO: 262251 - DNA, 23 bp, Homo sapiens
tagtggggaggggcctggcctgg

SEQ ID NO: 262252 - DNA, 11 bp, Homo sapiens
tagtgggtgag

SEQ ID NO: 262253 - DNA, 13 bp, Homo sapiens
tagtggtatgtct

SEQ ID NO: 262254 - DNA, 11 bp, Homo sapiens
tagtgtaaaat

SEQ ID NO: 262255 - DNA, 22 bp, Homo sapiens
tagtgtaaaataagaatgattt

SEQ ID NO: 262256 - DNA, 18 bp, Homo sapiens
tagtgtataccacctgta

SEQ ID NO: 262257 - DNA, 21 bp, Homo sapiens
tagtgtcacctttcttcttgt

SEQ ID NO: 262258 - DNA, 17 bp, Homo sapiens
tagtgtcacttacctag

SEQ ID NO: 262259 - DNA, 20 bp, Homo sapiens
tagtgtcccttacctggctt

SEQ ID NO: 262260 - DNA, 12 bp, Homo sapiens
tagtgtctgtcc

SEQ ID NO: 262261 - DNA, 22 bp, Homo sapiens
tagtgtctgtccatctgtctgt

SEQ ID NO: 262262 - DNA, 17 bp, Homo sapiens
tagtgtgagtggcagcc

SEQ ID NO: 262263 - DNA, 22 bp, Homo sapiens
tagtgtgagtggcagccatgcc

SEQ ID NO: 262264 - DNA, 13 bp, Homo sapiens
tagtgtgtccatg

SEQ ID NO: 262265 - DNA, 22 bp, Homo sapiens
tagtgtttagcattaaaaataa

SEQ ID NO: 262266 - DNA, 17 bp, Homo sapiens
tagtgtttctgcagagg

SEQ ID NO: 262267 - DNA, 13 bp, Homo sapiens
tagttaaaagcct

SEQ ID NO: 262268 - DNA, 19 bp, Homo sapiens
tagttaagtcgctgaacaa

SEQ ID NO: 262269 - DNA, 22 bp, Homo sapiens
tagttaatgaaggtgtgctaca

SEQ ID NO: 262270 - DNA, 13 bp, Homo sapiens
tagttacccaccc

SEQ ID NO: 262271 - DNA, 16 bp, Homo sapiens
tagttacctactgagt

SEQ ID NO: 262272 - DNA, 16 bp, Homo sapiens
tagttagcaggaaata

SEQ ID NO: 262273 - DNA, 20 bp, Homo sapiens
tagttagccatctaatgctt

SEQ ID NO: 262274 - DNA, 21 bp, Homo sapiens
tagttaggaaataaaaccttt

SEQ ID NO: 262275 - DNA, 23 bp, Homo sapiens
tagttaggaaataaaacctttca

SEQ ID NO: 262276 - DNA, 16 bp, Homo sapiens
tagttatagtttcaga

SEQ ID NO: 262277 - DNA, 22 bp, Homo sapiens
tagttattttaatacctttaaa

SEQ ID NO: 262278 - DNA, 20 bp, Homo sapiens
tagttcatccaatcctcact

SEQ ID NO: 262279 - DNA, 16 bp, Homo sapiens
tagttcctgctacaac

SEQ ID NO: 262280 - DNA, 13 bp, Homo sapiens
tagttctaaaatt

SEQ ID NO: 262281 - DNA, 18 bp, Homo sapiens
tagttctgtgcctccccc

SEQ ID NO: 262282 - DNA, 13 bp, Homo sapiens
tagttctttgttc

SEQ ID NO: 262283 - DNA, 15 bp, Homo sapiens
tagttctttgttcct

SEQ ID NO: 262284 - DNA, 19 bp, Homo sapiens
tagttctttgttcctgctt

SEQ ID NO: 262285 - DNA, 17 bp, Homo sapiens
aacagccttagctgcca

SEQ ID NO: 262286 - DNA, 22 bp, Homo sapiens
aacagccttagctgccagtgct

SEQ ID NO: 262287 - DNA, 20 bp, Homo sapiens
aacagcgggagacctgtgct

SEQ ID NO: 262288 - DNA, 17 bp, Homo sapiens
aacagctgttcctgtgt

SEQ ID NO: 262289 - DNA, 18 bp, Homo sapiens
aacagctgttcctgtgtt

SEQ ID NO: 262290 - DNA, 21 bp, Homo sapiens
aacagcttcatgcctttgtaa

SEQ ID NO: 262291 - DNA, 14 bp, Homo sapiens
aacagcttcttgct

SEQ ID NO: 262292 - DNA, 20 bp, Homo sapiens
aacagctttctccagaacca

SEQ ID NO: 262293 - DNA, 17 bp, Homo sapiens
aacaggaaaaaaacttt

SEQ ID NO: 262294 - DNA, 17 bp, Homo sapiens
aacaggaccaggagcca

SEQ ID NO: 262295 - DNA, 20 bp, Homo sapiens
aacaggaccaggagccaggt

SEQ ID NO: 262296 - DNA, 17 bp, Homo sapiens
aacaggagacaggaagg

SEQ ID NO: 262297 - DNA, 14 bp, Homo sapiens
aacaggaggaactg

SEQ ID NO: 262298 - DNA, 21 bp, Homo sapiens
aacaggaggaactggtccagg

SEQ ID NO: 262299 - DNA, 22 bp, Homo sapiens
aacaggaggaactggtccaggc

SEQ ID NO: 262300 - DNA, 18 bp, Homo sapiens
aacaggctactctcctcg

SEQ ID NO: 262301 - DNA, 20 bp, Homo sapiens
aacagggacactacaaacat

SEQ ID NO: 262302 - DNA, 17 bp, Homo sapiens
aacagggcatctccagg

SEQ ID NO: 262303 - DNA, 18 bp, Homo sapiens
aacagggcatctccagga

SEQ ID NO: 262304 - DNA, 18 bp, Homo sapiens
aacagggcccaggcctgg

SEQ ID NO: 262305 - DNA, 21 bp, Homo sapiens
aacagggcccaggcctggagc

SEQ ID NO: 262306 - DNA, 15 bp, Homo sapiens
aacagggccttgcta

SEQ ID NO: 262307 - DNA, 19 bp, Homo sapiens
aacaggttttcctgaagaa

SEQ ID NO: 262308 - DNA, 14 bp, Homo sapiens
aacagtaatcagtt

SEQ ID NO: 262309 - DNA, 15 bp, Homo sapiens
aacagtatttccaca

SEQ ID NO: 262310 - DNA, 21 bp, Homo sapiens
gaatgtgggtagtcattctta

SEQ ID NO: 262311 - DNA, 14 bp, Homo sapiens
gaatgttccctgca

SEQ ID NO: 262312 - DNA, 15 bp, Homo sapiens
gaatgttccctgcac

SEQ ID NO: 262313 - DNA, 19 bp, Homo sapiens
gaatgttgtcctgtgtcat

SEQ ID NO: 262314 - DNA, 20 bp, Homo sapiens
gaatgtttacactctttgta

SEQ ID NO: 262315 - DNA, 12 bp, Homo sapiens
gaattaaaacaa

SEQ ID NO: 262316 - DNA, 11 bp, Homo sapiens
gaattaaaata

SEQ ID NO: 262317 - DNA, 20 bp, Homo sapiens
gaattaaacccacaagctgc

SEQ ID NO: 262318 - DNA, 18 bp, Homo sapiens
gaattaaactaaaataca

SEQ ID NO: 262319 - DNA, 19 bp, Homo sapiens
gaattaacctggtgctgga

SEQ ID NO: 262320 - DNA, 22 bp, Homo sapiens
gaattaacctggtgctggatat

SEQ ID NO: 262321 - DNA, 16 bp, Homo sapiens
gaattaagaggataca

SEQ ID NO: 262322 - DNA, 15 bp, Homo sapiens
gaattaatagctttt

SEQ ID NO: 262323 - DNA, 13 bp, Homo sapiens
gaattacagtgaa

SEQ ID NO: 262324 - DNA, 17 bp, Homo sapiens
gaattacataacaggca

SEQ ID NO: 262325 - DNA, 16 bp, Homo sapiens
gaattacttatattca

SEQ ID NO: 262326 - DNA, 15 bp, Homo sapiens
gaattagaagaaaat

SEQ ID NO: 262327 - DNA, 15 bp, Homo sapiens
gaattagattatatt

SEQ ID NO: 262328 - DNA, 16 bp, Homo sapiens
gaattagtcctcacag

SEQ ID NO: 262329 - DNA, 20 bp, Homo sapiens
gaattatacagacctaatat

SEQ ID NO: 262330 - DNA, 22 bp, Homo sapiens
gaattatcatcccaacagccaa

SEQ ID NO: 262331 - DNA, 20 bp, Homo sapiens
gaattattacatctttatta

SEQ ID NO: 262332 - DNA, 13 bp, Homo sapiens
gaattattttgaa

SEQ ID NO: 262333 - DNA, 15 bp, Homo sapiens
gaattattttgttac

SEQ ID NO: 262334 - DNA, 17 bp, Homo sapiens
gaattcaagaaaggaaa

SEQ ID NO: 262335 - DNA, 17 bp, Homo sapiens
gaattcagcaccctggg

SEQ ID NO: 262336 - DNA, 19 bp, Homo sapiens
gaattcagcaccctgggtg

SEQ ID NO: 262337 - DNA, 20 bp, Homo sapiens
gaattccttggagccactgg

SEQ ID NO: 262338 - DNA, 22 bp, Homo sapiens
gaattcctttacaactaaataa

SEQ ID NO: 262339 - DNA, 23 bp, Homo sapiens
gaattcctttacaactaaataac

SEQ ID NO: 262340 - DNA, 19 bp, Homo sapiens
gaattctaagattgtacat

SEQ ID NO: 262341 - DNA, 14 bp, Homo sapiens
gaattgaagtcatc

SEQ ID NO: 262342 - DNA, 15 bp, Homo sapiens
gaattgaatgctcta

SEQ ID NO: 262343 - DNA, 16 bp, Homo sapiens
gaattgacttcagcag

SEQ ID NO: 262344 - DNA, 23 bp, Homo sapiens
gaattgagaggtgggggatgctg

SEQ ID NO: 262345 - DNA, 13 bp, Homo sapiens
gaattggtgtata

SEQ ID NO: 262346 - DNA, 18 bp, Homo sapiens
gaattgtgaccaagttat

SEQ ID NO: 262347 - DNA, 12 bp, Homo sapiens
gaattgtgcaaa

SEQ ID NO: 262348 - DNA, 16 bp, Homo sapiens
gaattgtgtgatgttt

SEQ ID NO: 262349 - DNA, 16 bp, Homo sapiens
gaattgttgaaactaa

SEQ ID NO: 262350 - DNA, 18 bp, Homo sapiens
gaattgttgaaactaaag

SEQ ID NO: 262351 - DNA, 22 bp, Homo sapiens
gaattgtttggcaatgcactga

SEQ ID NO: 262352 - DNA, 22 bp, Homo sapiens
gaattgtttttagaaatttatt

SEQ ID NO: 262353 - DNA, 12 bp, Homo sapiens
gaatttaaataa

SEQ ID NO: 262354 - DNA, 13 bp, Homo sapiens
gaatttaaatata

SEQ ID NO: 262355 - DNA, 22 bp, Homo sapiens
gaatttaagcatgagtggcctt

SEQ ID NO: 262356 - DNA, 19 bp, Homo sapiens
gaatttagggagaaatgtt

SEQ ID NO: 262357 - DNA, 17 bp, Homo sapiens
gaatttattcaattcct

SEQ ID NO: 262358 - DNA, 23 bp, Homo sapiens
gaatttattcaattcctctggga

SEQ ID NO: 262359 - DNA, 13 bp, Homo sapiens
gaatttcctctat

SEQ ID NO: 262360 - DNA, 16 bp, Homo sapiens
gaatttctagacagta

SEQ ID NO: 262361 - DNA, 19 bp, Homo sapiens
gaatttcttcactgttgaa

SEQ ID NO: 262362 - DNA, 19 bp, Homo sapiens
gaatttctttgatttaact

SEQ ID NO: 262363 - DNA, 20 bp, Homo sapiens
gaatttctttgtcattcaag

SEQ ID NO: 262364 - DNA, 14 bp, Homo sapiens
gaatttgaagaatt

SEQ ID NO: 262365 - DNA, 14 bp, Homo sapiens
gaatttgaatgaaa

SEQ ID NO: 262366 - DNA, 14 bp, Homo sapiens
gaatttgactggtt

SEQ ID NO: 262367 - DNA, 14 bp, Homo sapiens
gaatttgtaagttt

SEQ ID NO: 262368 - DNA, 22 bp, Homo sapiens
gaatttgtaagtttatgtctaa

SEQ ID NO: 262369 - DNA, 15 bp, Homo sapiens
gaattttacatggta

SEQ ID NO: 262370 - DNA, 21 bp, Homo sapiens
gaattttggtgatgtaaaaca

SEQ ID NO: 262371 - DNA, 15 bp, Homo sapiens
gaatttttgttttgt

SEQ ID NO: 262372 - DNA, 15 bp, Homo sapiens
gaattttttttaaca

SEQ ID NO: 262373 - DNA, 17 bp, Homo sapiens
gaattttttttaacatt

SEQ ID NO: 262374 - DNA, 22 bp, Homo sapiens
gaattttttttttaaatgattc

SEQ ID NO: 262375 - DNA, 20 bp, Homo sapiens
gacaaaaacaagactgcctc

SEQ ID NO: 262376 - DNA, 21 bp, Homo sapiens
gacaaaaacaagactgcctcc

SEQ ID NO: 262377 - DNA, 19 bp, Homo sapiens
gacaaaaattgaataatgt

SEQ ID NO: 262378 - DNA, 17 bp, Homo sapiens
gacaaaacctaacttgc

SEQ ID NO: 262379 - DNA, 18 bp, Homo sapiens
gacaaaacctaacttgcg

SEQ ID NO: 262380 - DNA, 18 bp, Homo sapiens
gacaaaacgggttactaa

SEQ ID NO: 262381 - DNA, 14 bp, Homo sapiens
gacaaacagtgaat

SEQ ID NO: 262382 - DNA, 12 bp, Homo sapiens
gacaaagaaaat

SEQ ID NO: 262383 - DNA, 20 bp, Homo sapiens
gacaaagaaatagcaagaga

SEQ ID NO: 262384 - DNA, 16 bp, Homo sapiens
gacaaagaaggaaaag

SEQ ID NO: 262385 - DNA, 13 bp, Homo sapiens
gacaaagcaggag

SEQ ID NO: 262386 - DNA, 16 bp, Homo sapiens
gacaaagcaggagtgg

SEQ ID NO: 262387 - DNA, 17 bp, Homo sapiens
gacaaaggacatttgtt

SEQ ID NO: 262388 - DNA, 13 bp, Homo sapiens
gacaaaggcccag

SEQ ID NO: 262389 - DNA, 17 bp, Homo sapiens
gacaaaggcccagaaat

SEQ ID NO: 262390 - DNA, 14 bp, Homo sapiens
gacaaaggccttaa

SEQ ID NO: 262391 - DNA, 22 bp, Homo sapiens
gacaaataactactgcaaaaag

SEQ ID NO: 262392 - DNA, 23 bp, Homo sapiens
gacaaatagtaggctaaaaacat

SEQ ID NO: 262393 - DNA, 21 bp, Homo sapiens
gacaaatgctgcgcccttccc

SEQ ID NO: 262394 - DNA, 22 bp, Homo sapiens
gacaaatgggactgatgtcatc

SEQ ID NO: 262395 - DNA, 17 bp, Homo sapiens
gacaaatttaaaacaaa

SEQ ID NO: 262396 - DNA, 23 bp, Homo sapiens
gacaacaaaagggaaaaaagcaa

SEQ ID NO: 262397 - DNA, 13 bp, Homo sapiens
gacaacacacaca

SEQ ID NO: 262398 - DNA, 17 bp, Homo sapiens
gacaaccaccgctcccc

SEQ ID NO: 262399 - DNA, 17 bp, Homo sapiens
gacaaccactggtctgt

SEQ ID NO: 262400 - DNA, 19 bp, Homo sapiens
gacaaccactggtctgtag

SEQ ID NO: 262401 - DNA, 18 bp, Homo sapiens
gacaaccgatgctccagc

SEQ ID NO: 262402 - DNA, 21 bp, Homo sapiens
gacaaccgatgctccagccaa

SEQ ID NO: 262403 - DNA, 14 bp, Homo sapiens
gacaactgaagaga

SEQ ID NO: 262404 - DNA, 13 bp, Homo sapiens
gacaagaagcaaa

SEQ ID NO: 262405 - DNA, 14 bp, Homo sapiens
gacaagaagctgct

SEQ ID NO: 262406 - DNA, 19 bp, Homo sapiens
gacaagccaacttgtaaat

SEQ ID NO: 262407 - DNA, 15 bp, Homo sapiens
gacaagccccaggca

SEQ ID NO: 262408 - DNA, 16 bp, Homo sapiens
gacaagccccaggcag

SEQ ID NO: 262409 - DNA, 14 bp, Homo sapiens
gacaagccctggca

SEQ ID NO: 262410 - DNA, 18 bp, Homo sapiens
gacaagggattctgggaa

SEQ ID NO: 262411 - DNA, 19 bp, Homo sapiens
gacaagggattctgggaag

SEQ ID NO: 262412 - DNA, 21 bp, Homo sapiens
gacaaggtagccctggccaga

SEQ ID NO: 262413 - DNA, 15 bp, Homo sapiens
gacaaggttgctgtt

SEQ ID NO: 262414 - DNA, 19 bp, Homo sapiens
gacaataagtttgaacctt

SEQ ID NO: 262415 - DNA, 16 bp, Homo sapiens
gacccaccagtgcctt

SEQ ID NO: 262416 - DNA, 18 bp, Homo sapiens
gacccacccatcttcctg

SEQ ID NO: 262417 - DNA, 20 bp, Homo sapiens
gacccacccatcttcctgct

SEQ ID NO: 262418 - DNA, 15 bp, Homo sapiens
gacccaccccaactc

SEQ ID NO: 262419 - DNA, 21 bp, Homo sapiens
gacccaccccaactctcccca

SEQ ID NO: 262420 - DNA, 16 bp, Homo sapiens
gacccacctcaccccg

SEQ ID NO: 262421 - DNA, 19 bp, Homo sapiens
gacccagctactctgtcca

SEQ ID NO: 262422 - DNA, 21 bp, Homo sapiens
gacccagctactctgtccagg

SEQ ID NO: 262423 - DNA, 23 bp, Homo sapiens
gacccagtgagattacagaggaa

SEQ ID NO: 262424 - DNA, 18 bp, Homo sapiens
gacccatagatcttctga

SEQ ID NO: 262425 - DNA, 22 bp, Homo sapiens
gacccatgtaaataccagactg

SEQ ID NO: 262426 - DNA, 13 bp, Homo sapiens
gaccccacacgcc

SEQ ID NO: 262427 - DNA, 19 bp, Homo sapiens
gaccccacacgccggggct

SEQ ID NO: 262428 - DNA, 12 bp, Homo sapiens
gaccccacccaa

SEQ ID NO: 262429 - DNA, 14 bp, Homo sapiens
gaccccacccaagc

SEQ ID NO: 262430 - DNA, 19 bp, Homo sapiens
gaccccacccaagcttggc

SEQ ID NO: 262431 - DNA, 19 bp, Homo sapiens
gaccccacttatgctgctg

SEQ ID NO: 262432 - DNA, 23 bp, Homo sapiens
gaccccagcttttcttgccagct

SEQ ID NO: 262433 - DNA, 14 bp, Homo sapiens
gaccccatctcatt

SEQ ID NO: 262434 - DNA, 14 bp, Homo sapiens
gaccccatctgctg

SEQ ID NO: 262435 - DNA, 13 bp, Homo sapiens
gacccccacacct

SEQ ID NO: 262436 - DNA, 14 bp, Homo sapiens
gacccccacccctt

SEQ ID NO: 262437 - DNA, 17 bp, Homo sapiens
gacccccaccccttccc

SEQ ID NO: 262438 - DNA, 21 bp, Homo sapiens
gacccccaccccttccccact

SEQ ID NO: 262439 - DNA, 22 bp, Homo sapiens
gacccccaccccttccccactg

SEQ ID NO: 262440 - DNA, 21 bp, Homo sapiens
gacccccatggtaatgtaact

SEQ ID NO: 262441 - DNA, 18 bp, Homo sapiens
gacccccggcctccaggc

SEQ ID NO: 262442 - DNA, 22 bp, Homo sapiens
gacccccggcctccaggctggg

SEQ ID NO: 262443 - DNA, 17 bp, Homo sapiens
gaccccgacgccacagc

SEQ ID NO: 262444 - DNA, 16 bp, Homo sapiens
gacccctaccctttcc

SEQ ID NO: 262445 - DNA, 12 bp, Homo sapiens
gacccctcacct

SEQ ID NO: 262446 - DNA, 22 bp, Homo sapiens
gacccctcaccttgcaacacac

SEQ ID NO: 262447 - DNA, 15 bp, Homo sapiens
gacccctctggccag

SEQ ID NO: 262448 - DNA, 18 bp, Homo sapiens
gacccctctggccaggat

SEQ ID NO: 262449 - DNA, 20 bp, Homo sapiens
gacccctctggccaggatgg

SEQ ID NO: 262450 - DNA, 23 bp, Homo sapiens
gacccctgcaccagcccttccct

SEQ ID NO: 262451 - DNA, 20 bp, Homo sapiens
gacccctggaccaccagccc

SEQ ID NO: 262452 - DNA, 12 bp, Homo sapiens
gaccccttcctg

SEQ ID NO: 262453 - DNA, 11 bp, Homo sapiens
gaccccttgct

SEQ ID NO: 262454 - DNA, 20 bp, Homo sapiens
aacccataactaccaggaat

SEQ ID NO: 262455 - DNA, 23 bp, Homo sapiens
aacccatgcatggcctcccagcc

SEQ ID NO: 262456 - DNA, 22 bp, Homo sapiens
aacccatgccctgccaagcctg

SEQ ID NO: 262457 - DNA, 14 bp, Homo sapiens
aacccattattcct

SEQ ID NO: 262458 - DNA, 11 bp, Homo sapiens
aaccccagccc

SEQ ID NO: 262459 - DNA, 12 bp, Homo sapiens
aaccccagcctg

SEQ ID NO: 262460 - DNA, 18 bp, Homo sapiens
aaccccagcctgacctga

SEQ ID NO: 262461 - DNA, 10 bp, Homo sapiens
aacccccacc

SEQ ID NO: 262462 - DNA, 11 bp, Homo sapiens
aacccccaccc

SEQ ID NO: 262463 - DNA, 15 bp, Homo sapiens
aacccccaccccaca

SEQ ID NO: 262464 - DNA, 17 bp, Homo sapiens
aacccccaccccacact

SEQ ID NO: 262465 - DNA, 12 bp, Homo sapiens
aacccccctccc

SEQ ID NO: 262466 - DNA, 16 bp, Homo sapiens
aaccccctcggagcct

SEQ ID NO: 262467 - DNA, 15 bp, Homo sapiens
aaccccgcagcccgt

SEQ ID NO: 262468 - DNA, 19 bp, Homo sapiens
aaccccgcggtgctctggc

SEQ ID NO: 262469 - DNA, 22 bp, Homo sapiens
aaccccgcggtgctctggcggc

SEQ ID NO: 262470 - DNA, 12 bp, Homo sapiens
aacccctgggta

SEQ ID NO: 262471 - DNA, 13 bp, Homo sapiens
aacccctgtggag

SEQ ID NO: 262472 - DNA, 12 bp, Homo sapiens
aaccccttccca

SEQ ID NO: 262473 - DNA, 15 bp, Homo sapiens
aacccggtcccaggc

SEQ ID NO: 262474 - DNA, 16 bp, Homo sapiens
aaccctacactcggaa

SEQ ID NO: 262475 - DNA, 19 bp, Homo sapiens
aaccctcagagccacccct

SEQ ID NO: 262476 - DNA, 23 bp, Homo sapiens
aaccctccctcagcccctcttgc

SEQ ID NO: 262477 - DNA, 17 bp, Homo sapiens
aaccctgcaaaggactg

SEQ ID NO: 262478 - DNA, 11 bp, Homo sapiens
aaccctgccct

SEQ ID NO: 262479 - DNA, 13 bp, Homo sapiens
aaccctgcttctg

SEQ ID NO: 262480 - DNA, 21 bp, Homo sapiens
aaccctgcttctgctgccctg

SEQ ID NO: 262481 - DNA, 19 bp, Homo sapiens
aaccctggcacttaagggg

SEQ ID NO: 262482 - DNA, 22 bp, Homo sapiens
aaccctggcttgcttgccgagc

SEQ ID NO: 262483 - DNA, 22 bp, Homo sapiens
aaccctgttgagtatttgctgt

SEQ ID NO: 262484 - DNA, 23 bp, Homo sapiens
aaccctgttgagtatttgctgtt

SEQ ID NO: 262485 - DNA, 21 bp, Homo sapiens
aacccttaccccttagcctcc

SEQ ID NO: 262486 - DNA, 23 bp, Homo sapiens
aacccttaccccttagcctccct

SEQ ID NO: 262487 - DNA, 14 bp, Homo sapiens
aacccttctgcttt

SEQ ID NO: 262488 - DNA, 17 bp, Homo sapiens
aacccttctgctttcta

SEQ ID NO: 262489 - DNA, 14 bp, Homo sapiens
aacccttcttttaa

SEQ ID NO: 262490 - DNA, 21 bp, Homo sapiens
aacccttgaatttctagacag

SEQ ID NO: 262491 - DNA, 21 bp, Homo sapiens
aacccttggagccaatggaga

SEQ ID NO: 262492 - DNA, 22 bp, Homo sapiens
aaccgagcaaagatcaaaataa

SEQ ID NO: 262493 - DNA, 19 bp, Homo sapiens
aaccgagccagcagctgaa

SEQ ID NO: 262494 - DNA, 15 bp, Homo sapiens
aaccgatgctccagc

SEQ ID NO: 262495 - DNA, 21 bp, Homo sapiens
aaccgatgctccagccaaccc

SEQ ID NO: 262496 - DNA, 12 bp, Homo sapiens
aaccgtccctga

SEQ ID NO: 262497 - DNA, 20 bp, Homo sapiens
aacctaaaataattggttct

SEQ ID NO: 262498 - DNA, 21 bp, Homo sapiens
aacctaaaataattggttctt

SEQ ID NO: 262499 - DNA, 12 bp, Homo sapiens
aacctacctgtg

SEQ ID NO: 262500 - DNA, 15 bp, Homo sapiens
aacctacgaccccag

SEQ ID NO: 262501 - DNA, 23 bp, Homo sapiens
aacctagaaacctttatccctgc

SEQ ID NO: 262502 - DNA, 20 bp, Homo sapiens
aacctagatgtttaacaaat

SEQ ID NO: 262503 - DNA, 23 bp, Homo sapiens
aacctagatgtttaacaaatcta

SEQ ID NO: 262504 - DNA, 18 bp, Homo sapiens
aacctagtactctctgct

SEQ ID NO: 262505 - DNA, 22 bp, Homo sapiens
aacctcaaaatattttttttaa

SEQ ID NO: 262506 - DNA, 16 bp, Homo sapiens
aacctcaatgccctgc

SEQ ID NO: 262507 - DNA, 18 bp, Homo sapiens
aacctcaatgccctgcca

SEQ ID NO: 262508 - DNA, 23 bp, Homo sapiens
aacctcaccattgtgaagcacct

SEQ ID NO: 262509 - DNA, 15 bp, Homo sapiens
aacctcagcaacctg

SEQ ID NO: 262510 - DNA, 18 bp, Homo sapiens
aacctcagcatttacttt

SEQ ID NO: 262511 - DNA, 14 bp, Homo sapiens
aacctcagctctgg

SEQ ID NO: 262512 - DNA, 15 bp, Homo sapiens
aacctcagctctggg

SEQ ID NO: 262513 - DNA, 16 bp, Homo sapiens
aacctcagctctggga

SEQ ID NO: 262514 - DNA, 15 bp, Homo sapiens
aacctcccaacccag

SEQ ID NO: 262515 - DNA, 21 bp, Homo sapiens
aacctccctgggcctgtctca

SEQ ID NO: 262516 - DNA, 17 bp, Homo sapiens
aacctcgttgacatgca

SEQ ID NO: 262517 - DNA, 19 bp, Homo sapiens
aacctcgttgacatgcaca

SEQ ID NO: 262518 - DNA, 17 bp, Homo sapiens
aacctcttagcttttct

SEQ ID NO: 262519 - DNA, 11 bp, Homo sapiens
aacctcttccc

SEQ ID NO: 262520 - DNA, 12 bp, Homo sapiens
aacctcttcccc

SEQ ID NO: 262521 - DNA, 14 bp, Homo sapiens
aacctcttccccag

SEQ ID NO: 262522 - DNA, 16 bp, Homo sapiens
aacctcttttctgcat

SEQ ID NO: 262523 - DNA, 21 bp, Homo sapiens
aacctgaaaagatgttgtgtc

SEQ ID NO: 262524 - DNA, 14 bp, Homo sapiens
aacctgaaagacaa

SEQ ID NO: 262525 - DNA, 23 bp, Homo sapiens
aacctgacagatgtcagccgagc

SEQ ID NO: 262526 - DNA, 11 bp, Homo sapiens
aacctgcattt

SEQ ID NO: 262527 - DNA, 23 bp, Homo sapiens
aacctgcatttttaaaggacaaa

SEQ ID NO: 262528 - DNA, 20 bp, Homo sapiens
aacctgccacaatgtgatat

SEQ ID NO: 262529 - DNA, 22 bp, Homo sapiens
aacctgccacaatgtgatatgt

SEQ ID NO: 262530 - DNA, 13 bp, Homo sapiens
aacctgcttttgt

SEQ ID NO: 262531 - DNA, 17 bp, Homo sapiens
aacctggaccaaagctg

SEQ ID NO: 262532 - DNA, 18 bp, Homo sapiens
aacctggaccaaagctga

SEQ ID NO: 262533 - DNA, 15 bp, Homo sapiens
aacctggagacagta

SEQ ID NO: 262534 - DNA, 10 bp, Homo sapiens
aacctggagg

SEQ ID NO: 262535 - DNA, 11 bp, Homo sapiens
aacctggctgc

SEQ ID NO: 262536 - DNA, 21 bp, Homo sapiens
aacctggctgcgaactgtgca

SEQ ID NO: 262537 - DNA, 11 bp, Homo sapiens
aacctggtgct

SEQ ID NO: 262538 - DNA, 12 bp, Homo sapiens
aacctgtaactg

SEQ ID NO: 262539 - DNA, 14 bp, Homo sapiens
aacctgtgccaggc

SEQ ID NO: 262540 - DNA, 10 bp, Homo sapiens
aacctgtggg

SEQ ID NO: 262541 - DNA, 19 bp, Homo sapiens
aacctgttcaaaatgttaa

SEQ ID NO: 262542 - DNA, 20 bp, Homo sapiens
aaccttaagataatggataa

SEQ ID NO: 262543 - DNA, 21 bp, Homo sapiens
aaccttcctgtcttcatcctt

SEQ ID NO: 262544 - DNA, 15 bp, Homo sapiens
aaccttgagacagct

SEQ ID NO: 262545 - DNA, 19 bp, Homo sapiens
tataagcttaaaataagtg

SEQ ID NO: 262546 - DNA, 22 bp, Homo sapiens
tataaggaaatatcataatgta

SEQ ID NO: 262547 - DNA, 13 bp, Homo sapiens
tataaggactgca

SEQ ID NO: 262548 - DNA, 18 bp, Homo sapiens
tataagggagtaggctgt

SEQ ID NO: 262549 - DNA, 23 bp, Homo sapiens
tataaggttgggttagcaatatt

SEQ ID NO: 262550 - DNA, 22 bp, Homo sapiens
tataataaatgggaaatgtcga

SEQ ID NO: 262551 - DNA, 16 bp, Homo sapiens
tataataaatgtacat

SEQ ID NO: 262552 - DNA, 17 bp, Homo sapiens
tataatatactatattt

SEQ ID NO: 262553 - DNA, 22 bp, Homo sapiens
tataatggcctcttaaaaatta

SEQ ID NO: 262554 - DNA, 19 bp, Homo sapiens
tataatggtttactgctgt

SEQ ID NO: 262555 - DNA, 18 bp, Homo sapiens
tataatgttgttatttaa

SEQ ID NO: 262556 - DNA, 19 bp, Homo sapiens
tataatgttgttatttaaa

SEQ ID NO: 262557 - DNA, 12 bp, Homo sapiens
tataattctgta

SEQ ID NO: 262558 - DNA, 21 bp, Homo sapiens
tataatttacctgaagtcttt

SEQ ID NO: 262559 - DNA, 18 bp, Homo sapiens
tataatttcacagataat

SEQ ID NO: 262560 - DNA, 15 bp, Homo sapiens
tataatttctaccca

SEQ ID NO: 262561 - DNA, 18 bp, Homo sapiens
tataattttattgctgga

SEQ ID NO: 262562 - DNA, 22 bp, Homo sapiens
tataatttttttatgttttgtt

SEQ ID NO: 262563 - DNA, 16 bp, Homo sapiens
tatacaaacaggtgct

SEQ ID NO: 262564 - DNA, 17 bp, Homo sapiens
tatacaaataaacttgt

SEQ ID NO: 262565 - DNA, 20 bp, Homo sapiens
tatacaaattttcagaaggt

SEQ ID NO: 262566 - DNA, 23 bp, Homo sapiens
tatacaaattttcagaaggttat

SEQ ID NO: 262567 - DNA, 18 bp, Homo sapiens
tatacaattcagagaata

SEQ ID NO: 262568 - DNA, 17 bp, Homo sapiens
tatacagacctaatatc

SEQ ID NO: 262569 - DNA, 18 bp, Homo sapiens
tatacagatgaaaatttg

SEQ ID NO: 262570 - DNA, 14 bp, Homo sapiens
tatacatacctctc

SEQ ID NO: 262571 - DNA, 18 bp, Homo sapiens
tatacatatacacaaaga

SEQ ID NO: 262572 - DNA, 17 bp, Homo sapiens
tatacatctagcacagc

SEQ ID NO: 262573 - DNA, 16 bp, Homo sapiens
tatacatgtatagtga

SEQ ID NO: 262574 - DNA, 16 bp, Homo sapiens
tatacattctttatct

SEQ ID NO: 262575 - DNA, 14 bp, Homo sapiens
tatacatttgataa

SEQ ID NO: 262576 - DNA, 21 bp, Homo sapiens
tatacattttgttatagaata

SEQ ID NO: 262577 - DNA, 13 bp, Homo sapiens
tatacccactgca

SEQ ID NO: 262578 - DNA, 16 bp, Homo sapiens
tataccccatttgatt

SEQ ID NO: 262579 - DNA, 11 bp, Homo sapiens
tatactaataa

SEQ ID NO: 262580 - DNA, 12 bp, Homo sapiens
tatactaataaa

SEQ ID NO: 262581 - DNA, 20 bp, Homo sapiens
tatactaataaaaaggttta

SEQ ID NO: 262582 - DNA, 19 bp, Homo sapiens
tatactggttatagttgat

SEQ ID NO: 262583 - DNA, 21 bp, Homo sapiens
tatactggttatagttgatat

SEQ ID NO: 262584 - DNA, 14 bp, Homo sapiens
tatactgtcttgtc

SEQ ID NO: 262585 - DNA, 18 bp, Homo sapiens
tatactgtcttgtctcac

SEQ ID NO: 262586 - DNA, 18 bp, Homo sapiens
tatacttaaacagctttt

SEQ ID NO: 262587 - DNA, 18 bp, Homo sapiens
tatagaaaaagcacagct

SEQ ID NO: 262588 - DNA, 17 bp, Homo sapiens
tatagaatttttaatgt

SEQ ID NO: 262589 - DNA, 17 bp, Homo sapiens
tatagagacttctaaat

SEQ ID NO: 262590 - DNA, 23 bp, Homo sapiens
tatagagagggggctctccaaag

SEQ ID NO: 262591 - DNA, 21 bp, Homo sapiens
tatagagatatgcagaaggaa

SEQ ID NO: 262592 - DNA, 22 bp, Homo sapiens
tatagatgcaagatatttatat

SEQ ID NO: 262593 - DNA, 11 bp, Homo sapiens
tatagccattt

SEQ ID NO: 262594 - DNA, 22 bp, Homo sapiens
tatagctacaggaagcacccca

SEQ ID NO: 262595 - DNA, 22 bp, Homo sapiens
tatagctagctatttctatgta

SEQ ID NO: 262596 - DNA, 14 bp, Homo sapiens
tatagctattactg

SEQ ID NO: 262597 - DNA, 22 bp, Homo sapiens
tatagctattactgtctggttt

SEQ ID NO: 262598 - DNA, 20 bp, Homo sapiens
tataggccatctgtaaatat

SEQ ID NO: 262599 - DNA, 23 bp, Homo sapiens
tatagggcttttattttttaagt

SEQ ID NO: 262600 - DNA, 17 bp, Homo sapiens
tatagggtttgtttgct

SEQ ID NO: 262601 - DNA, 20 bp, Homo sapiens
tatagtacctttgctcttgc

SEQ ID NO: 262602 - DNA, 14 bp, Homo sapiens
aactgtttatggta

SEQ ID NO: 262603 - DNA, 16 bp, Homo sapiens
aactgtttttgaagaa

SEQ ID NO: 262604 - DNA, 13 bp, Homo sapiens
aacttaagtttag

SEQ ID NO: 262605 - DNA, 16 bp, Homo sapiens
aacttaagtttagaaa

SEQ ID NO: 262606 - DNA, 17 bp, Homo sapiens
aacttaagtttagaaat

SEQ ID NO: 262607 - DNA, 15 bp, Homo sapiens
aacttaattctgtta

SEQ ID NO: 262608 - DNA, 13 bp, Homo sapiens
aacttacacacaa

SEQ ID NO: 262609 - DNA, 20 bp, Homo sapiens
aacttactgtcagagaatat

SEQ ID NO: 262610 - DNA, 14 bp, Homo sapiens
aacttactgtgtaa

SEQ ID NO: 262611 - DNA, 16 bp, Homo sapiens
aacttagaataaaatt

SEQ ID NO: 262612 - DNA, 18 bp, Homo sapiens
aacttagaataaaattgt

SEQ ID NO: 262613 - DNA, 20 bp, Homo sapiens
aacttagatcatcagtcacc

SEQ ID NO: 262614 - DNA, 13 bp, Homo sapiens
aacttagtatttt

SEQ ID NO: 262615 - DNA, 23 bp, Homo sapiens
aacttagtgcggacaagttttaa

SEQ ID NO: 262616 - DNA, 15 bp, Homo sapiens
aacttagtttgtgaa

SEQ ID NO: 262617 - DNA, 16 bp, Homo sapiens
aacttagtttgtgaat

SEQ ID NO: 262618 - DNA, 12 bp, Homo sapiens
aacttagttttg

SEQ ID NO: 262619 - DNA, 19 bp, Homo sapiens
aacttataaatcatattga

SEQ ID NO: 262620 - DNA, 23 bp, Homo sapiens
aacttatattaaataaatgtgca

SEQ ID NO: 262621 - DNA, 19 bp, Homo sapiens
aacttatcctaaaacaaat

SEQ ID NO: 262622 - DNA, 19 bp, Homo sapiens
aacttattgcctgggcagt

SEQ ID NO: 262623 - DNA, 23 bp, Homo sapiens
aacttattgcctgggcagtgccc

SEQ ID NO: 262624 - DNA, 17 bp, Homo sapiens
aacttattttatttcca

SEQ ID NO: 262625 - DNA, 13 bp, Homo sapiens
aacttcaagaagt

SEQ ID NO: 262626 - DNA, 14 bp, Homo sapiens
aacttcaccacccc

SEQ ID NO: 262627 - DNA, 22 bp, Homo sapiens
aacttcagcaaccctacagtat

SEQ ID NO: 262628 - DNA, 22 bp, Homo sapiens
aacttcattctaaaccaaaaca

SEQ ID NO: 262629 - DNA, 12 bp, Homo sapiens
aacttcatttga

SEQ ID NO: 262630 - DNA, 23 bp, Homo sapiens
aacttccaggttccatccaccac

SEQ ID NO: 262631 - DNA, 18 bp, Homo sapiens
aacttcccagtgaattct

SEQ ID NO: 262632 - DNA, 19 bp, Homo sapiens
aacttccttcacatctccc

SEQ ID NO: 262633 - DNA, 20 bp, Homo sapiens
aacttccttcacatctccca

SEQ ID NO: 262634 - DNA, 15 bp, Homo sapiens
aacttctcttctgag

SEQ ID NO: 262635 - DNA, 18 bp, Homo sapiens
aacttctcttctgagcct

SEQ ID NO: 262636 - DNA, 19 bp, Homo sapiens
aacttctgaactttggaag

SEQ ID NO: 262637 - DNA, 22 bp, Homo sapiens
aacttgagatgtatgaaggctt

SEQ ID NO: 262638 - DNA, 12 bp, Homo sapiens
aacttgaggaca

SEQ ID NO: 262639 - DNA, 13 bp, Homo sapiens
aacttgaggacac

SEQ ID NO: 262640 - DNA, 17 bp, Homo sapiens
aacttgaggacacatgt

SEQ ID NO: 262641 - DNA, 18 bp, Homo sapiens
aacttgaggacacatgtc

SEQ ID NO: 262642 - DNA, 19 bp, Homo sapiens
aacttgagggtaataaact

SEQ ID NO: 262643 - DNA, 22 bp, Homo sapiens
aacttgattgttgagacgcctt

SEQ ID NO: 262644 - DNA, 23 bp, Homo sapiens
aacttggaatttgtaacctcagc

SEQ ID NO: 262645 - DNA, 15 bp, Homo sapiens
aacttggggaggcaa

SEQ ID NO: 262646 - DNA, 17 bp, Homo sapiens
aacttggtatttttcag

SEQ ID NO: 262647 - DNA, 16 bp, Homo sapiens
aacttggttctgcttc

SEQ ID NO: 262648 - DNA, 15 bp, Homo sapiens
aacttgtaactaaag

SEQ ID NO: 262649 - DNA, 17 bp, Homo sapiens
aacttgtattaaagaca

SEQ ID NO: 262650 - DNA, 15 bp, Homo sapiens
aacttgtgctatagt

SEQ ID NO: 262651 - DNA, 20 bp, Homo sapiens
aacttgtgctatagtgtata

SEQ ID NO: 262652 - DNA, 20 bp, Homo sapiens
aacttgtgtactgataaaat

SEQ ID NO: 262653 - DNA, 18 bp, Homo sapiens
aacttgtgttcaatctgt

SEQ ID NO: 262654 - DNA, 23 bp, Homo sapiens
aactttaacaggttttcttctaa

SEQ ID NO: 262655 - DNA, 22 bp, Homo sapiens
aactttaaccacagtgaaagtt

SEQ ID NO: 262656 - DNA, 20 bp, Homo sapiens
aactttacccaaaaactaaa

SEQ ID NO: 262657 - DNA, 14 bp, Homo sapiens
aactttatgtactg

SEQ ID NO: 262658 - DNA, 15 bp, Homo sapiens
aactttatgtactgc

SEQ ID NO: 262659 - DNA, 17 bp, Homo sapiens
aactttcacctcagatt

SEQ ID NO: 262660 - DNA, 12 bp, Homo sapiens
aactttcacttt

SEQ ID NO: 262661 - DNA, 16 bp, Homo sapiens
aactttcactttgaaa

SEQ ID NO: 262662 - DNA, 15 bp, Homo sapiens
aactttccatgacag

SEQ ID NO: 262663 - DNA, 16 bp, Homo sapiens
aactttccatgacagt

SEQ ID NO: 262664 - DNA, 20 bp, Homo sapiens
aactttgaggaggaagcaga

SEQ ID NO: 262665 - DNA, 22 bp, Homo sapiens
aactttgaggaggaagcagaat

SEQ ID NO: 262666 - DNA, 17 bp, Homo sapiens
aactttgatctctgctt

SEQ ID NO: 262667 - DNA, 12 bp, Homo sapiens
aactttgcatgt

SEQ ID NO: 262668 - DNA, 17 bp, Homo sapiens
aactttgcatgttcttg

SEQ ID NO: 262669 - DNA, 21 bp, Homo sapiens
aactttgcatgttcttgtttt

SEQ ID NO: 262670 - DNA, 15 bp, Homo sapiens
aactttgctggaaaa

SEQ ID NO: 262671 - DNA, 10 bp, Homo sapiens
aactttgtca

SEQ ID NO: 262672 - DNA, 19 bp, Homo sapiens
aactttgtggatgtcttcc

SEQ ID NO: 262673 - DNA, 15 bp, Homo sapiens
aactttgtttccaga

SEQ ID NO: 262674 - DNA, 15 bp, Homo sapiens
aactttgtttctcat

SEQ ID NO: 262675 - DNA, 22 bp, Homo sapiens
aagacgtcctggaatgaagcat

SEQ ID NO: 262676 - DNA, 12 bp, Homo sapiens
aagactaacctt

SEQ ID NO: 262677 - DNA, 16 bp, Homo sapiens
aagactaatttaaaaa

SEQ ID NO: 262678 - DNA, 19 bp, Homo sapiens
aagactaatttaaaaaata

SEQ ID NO: 262679 - DNA, 11 bp, Homo sapiens
aagactcagcc

SEQ ID NO: 262680 - DNA, 12 bp, Homo sapiens
aagactcagcca

SEQ ID NO: 262681 - DNA, 17 bp, Homo sapiens
aagactctgtctcaaaa

SEQ ID NO: 262682 - DNA, 14 bp, Homo sapiens
aagactgaaagaat

SEQ ID NO: 262683 - DNA, 18 bp, Homo sapiens
aagactgaaatggcttct

SEQ ID NO: 262684 - DNA, 11 bp, Homo sapiens
aagactgtact

SEQ ID NO: 262685 - DNA, 17 bp, Homo sapiens
aagactgttgctcaaat

SEQ ID NO: 262686 - DNA, 17 bp, Homo sapiens
aagacttaatcatatca

SEQ ID NO: 262687 - DNA, 17 bp, Homo sapiens
aagacttaatctttgct

SEQ ID NO: 262688 - DNA, 18 bp, Homo sapiens
aagacttaatctttgctg

SEQ ID NO: 262689 - DNA, 22 bp, Homo sapiens
aagacttcaaatgttattcaat

SEQ ID NO: 262690 - DNA, 16 bp, Homo sapiens
aagacttttctttcct

SEQ ID NO: 262691 - DNA, 19 bp, Homo sapiens
aagagaaaaaccaatgatt

SEQ ID NO: 262692 - DNA, 21 bp, Homo sapiens
aagagaaccgagcaaagatca

SEQ ID NO: 262693 - DNA, 22 bp, Homo sapiens
aagagaaccgagcaaagatcaa

SEQ ID NO: 262694 - DNA, 21 bp, Homo sapiens
aagagaactgatgacactgag

SEQ ID NO: 262695 - DNA, 15 bp, Homo sapiens
aagagaagaaagaag

SEQ ID NO: 262696 - DNA, 20 bp, Homo sapiens
aagagaaggcctggtcagca

SEQ ID NO: 262697 - DNA, 20 bp, Homo sapiens
aagagaatacaggaaaatcc

SEQ ID NO: 262698 - DNA, 13 bp, Homo sapiens
aagagacaaatag

SEQ ID NO: 262699 - DNA, 14 bp, Homo sapiens
aagagaccaagctt

SEQ ID NO: 262700 - DNA, 18 bp, Homo sapiens
aagagagaaaacttattt

SEQ ID NO: 262701 - DNA, 23 bp, Homo sapiens
aagagagaaccaagcttgtcttt

SEQ ID NO: 262702 - DNA, 12 bp, Homo sapiens
aagagagaatgt

SEQ ID NO: 262703 - DNA, 15 bp, Homo sapiens
aagagagatgttttg

SEQ ID NO: 262704 - DNA, 16 bp, Homo sapiens
aagagagccttggttc

SEQ ID NO: 262705 - DNA, 17 bp, Homo sapiens
aagagaggagttcaatg

SEQ ID NO: 262706 - DNA, 19 bp, Homo sapiens
aagagaggcacctgctgga

SEQ ID NO: 262707 - DNA, 17 bp, Homo sapiens
aagagagtaccatgctg

SEQ ID NO: 262708 - DNA, 17 bp, Homo sapiens
aagagatgagaaatgat

SEQ ID NO: 262709 - DNA, 17 bp, Homo sapiens
aagagatgggcttgttt

SEQ ID NO: 262710 - DNA, 18 bp, Homo sapiens
aagagatgggcttgtttt

SEQ ID NO: 262711 - DNA, 19 bp, Homo sapiens
aagagcaccttcctcactt

SEQ ID NO: 262712 - DNA, 17 bp, Homo sapiens
aagagcacttcacacag

SEQ ID NO: 262713 - DNA, 17 bp, Homo sapiens
aagagcagagtctgggc

SEQ ID NO: 262714 - DNA, 18 bp, Homo sapiens
aagagcagagtctgggcc

SEQ ID NO: 262715 - DNA, 22 bp, Homo sapiens
aagagcagagtctgggcctctg

SEQ ID NO: 262716 - DNA, 14 bp, Homo sapiens
aagagcagcctgat

SEQ ID NO: 262717 - DNA, 13 bp, Homo sapiens
aagagcagcctgg

SEQ ID NO: 262718 - DNA, 14 bp, Homo sapiens
aagagcagcctgtg

SEQ ID NO: 262719 - DNA, 19 bp, Homo sapiens
aagagcatgtaagaaataa

SEQ ID NO: 262720 - DNA, 17 bp, Homo sapiens
aagagcattattcctgg

SEQ ID NO: 262721 - DNA, 20 bp, Homo sapiens
aagagccctggacacccctg

SEQ ID NO: 262722 - DNA, 21 bp, Homo sapiens
aagagctcaggagaaggcctg

SEQ ID NO: 262723 - DNA, 22 bp, Homo sapiens
aagagctgggtaccaggccacc

SEQ ID NO: 262724 - DNA, 17 bp, Homo sapiens
aagagctgttttggatg

SEQ ID NO: 262725 - DNA, 15 bp, Homo sapiens
aagaggaactgggcc

SEQ ID NO: 262726 - DNA, 16 bp, Homo sapiens
aagaggaactgggcct

SEQ ID NO: 262727 - DNA, 13 bp, Homo sapiens
aagaggagaagga

SEQ ID NO: 262728 - DNA, 15 bp, Homo sapiens
aagaggagaccctgg

SEQ ID NO: 262729 - DNA, 16 bp, Homo sapiens
aagaggagaccctgga

SEQ ID NO: 262730 - DNA, 13 bp, Homo sapiens
aagaggagcactt

SEQ ID NO: 262731 - DNA, 16 bp, Homo sapiens
aagaggctgaaagagg

SEQ ID NO: 262732 - DNA, 18 bp, Homo sapiens
aagaggctgaaagaggcc

SEQ ID NO: 262733 - DNA, 18 bp, Homo sapiens
aagaggctgaggcctgga

SEQ ID NO: 262734 - DNA, 20 bp, Homo sapiens
aagaggctgaggcctggact

SEQ ID NO: 262735 - DNA, 12 bp, Homo sapiens
aagaggctgctg

SEQ ID NO: 262736 - DNA, 19 bp, Homo sapiens
aagagggaaggtgaccgcc

SEQ ID NO: 262737 - DNA, 12 bp, Homo sapiens
aagagggactgt

SEQ ID NO: 262738 - DNA, 13 bp, Homo sapiens
aagagggactgta

SEQ ID NO: 262739 - DNA, 18 bp, Homo sapiens
aagagggagaagcatgaa

SEQ ID NO: 262740 - DNA, 15 bp, Homo sapiens
aagagggagaggagg

SEQ ID NO: 262741 - DNA, 18 bp, Homo sapiens
aagagggagatggagact

SEQ ID NO: 262742 - DNA, 14 bp, Homo sapiens
aagagggctgagct

SEQ ID NO: 262743 - DNA, 15 bp, Homo sapiens
aagagggctgagctg

SEQ ID NO: 262744 - DNA, 19 bp, Homo sapiens
aagaggggaggggcctagg

SEQ ID NO: 262745 - DNA, 18 bp, Homo sapiens
aagaggttctcagcaagt

SEQ ID NO: 262746 - DNA, 14 bp, Homo sapiens
aagagtaaatattg

SEQ ID NO: 262747 - DNA, 16 bp, Homo sapiens
aagagtagtaatagag

SEQ ID NO: 262748 - DNA, 17 bp, Homo sapiens
tatgatgtgttgtgata

SEQ ID NO: 262749 - DNA, 18 bp, Homo sapiens
tatgatgtgttgtgatag

SEQ ID NO: 262750 - DNA, 18 bp, Homo sapiens
tatgattctcctctccca

SEQ ID NO: 262751 - DNA, 14 bp, Homo sapiens
tatgattgaaaaga

SEQ ID NO: 262752 - DNA, 21 bp, Homo sapiens
tatgatttcatgattagacaa

SEQ ID NO: 262753 - DNA, 20 bp, Homo sapiens
tatgatttgtagctctaggt

SEQ ID NO: 262754 - DNA, 16 bp, Homo sapiens
tatgattttatttgac

SEQ ID NO: 262755 - DNA, 19 bp, Homo sapiens
tatgattttccctaaaaga

SEQ ID NO: 262756 - DNA, 18 bp, Homo sapiens
tatgattttgatgcacaa

SEQ ID NO: 262757 - DNA, 23 bp, Homo sapiens
tatgcaaagtctctcatttcttt

SEQ ID NO: 262758 - DNA, 19 bp, Homo sapiens
tatgcaagtcgccaggcag

SEQ ID NO: 262759 - DNA, 13 bp, Homo sapiens
tatgcaagtggga

SEQ ID NO: 262760 - DNA, 15 bp, Homo sapiens
tatgcaagtgggaga

SEQ ID NO: 262761 - DNA, 20 bp, Homo sapiens
tatgcacaccaaattgctga

SEQ ID NO: 262762 - DNA, 21 bp, Homo sapiens
tatgcacaccaaattgctgag

SEQ ID NO: 262763 - DNA, 18 bp, Homo sapiens
tatgcacatttgtgcata

SEQ ID NO: 262764 - DNA, 16 bp, Homo sapiens
tatgcacctataaata

SEQ ID NO: 262765 - DNA, 15 bp, Homo sapiens
tatgcacgttaacag

SEQ ID NO: 262766 - DNA, 23 bp, Homo sapiens
tatgcacgttaacagcgtgtcaa

SEQ ID NO: 262767 - DNA, 11 bp, Homo sapiens
tatgcactttc

SEQ ID NO: 262768 - DNA, 17 bp, Homo sapiens
tatgcagatagaatcaa

SEQ ID NO: 262769 - DNA, 17 bp, Homo sapiens
tatgcagcatacaaaaa

SEQ ID NO: 262770 - DNA, 22 bp, Homo sapiens
tatgcatatattttagggctgt

SEQ ID NO: 262771 - DNA, 16 bp, Homo sapiens
tatgcatgagaactaa

SEQ ID NO: 262772 - DNA, 20 bp, Homo sapiens
tatgcatggaaacctgaaaa

SEQ ID NO: 262773 - DNA, 21 bp, Homo sapiens
tatgcatgtagcatataaatg

SEQ ID NO: 262774 - DNA, 15 bp, Homo sapiens
tatgcattcacaagg

SEQ ID NO: 262775 - DNA, 12 bp, Homo sapiens
tatgcatttatg

SEQ ID NO: 262776 - DNA, 15 bp, Homo sapiens
tatgcatttatgcat

SEQ ID NO: 262777 - DNA, 15 bp, Homo sapiens
tatgccacctgcagc

SEQ ID NO: 262778 - DNA, 16 bp, Homo sapiens
tatgcccctccccagt

SEQ ID NO: 262779 - DNA, 20 bp, Homo sapiens
tatgccccttcttgggcccc

SEQ ID NO: 262780 - DNA, 13 bp, Homo sapiens
tatgcctgacccc

SEQ ID NO: 262781 - DNA, 12 bp, Homo sapiens
tatgcctgtatt

SEQ ID NO: 262782 - DNA, 17 bp, Homo sapiens
tatgcctgtatttccaa

SEQ ID NO: 262783 - DNA, 12 bp, Homo sapiens
tatgcctgtggt

SEQ ID NO: 262784 - DNA, 15 bp, Homo sapiens
tatgcctgtggtgaa

SEQ ID NO: 262785 - DNA, 19 bp, Homo sapiens
tatgcctgtggtgaagtgt

SEQ ID NO: 262786 - DNA, 19 bp, Homo sapiens
tatgccttcttattgcttt

SEQ ID NO: 262787 - DNA, 16 bp, Homo sapiens
tatgcctttaaatctg

SEQ ID NO: 262788 - DNA, 20 bp, Homo sapiens
tatgcctttaaatctgtgat

SEQ ID NO: 262789 - DNA, 13 bp, Homo sapiens
tatgctaatcagg

SEQ ID NO: 262790 - DNA, 16 bp, Homo sapiens
tatgctgccaaatttt

SEQ ID NO: 262791 - DNA, 20 bp, Homo sapiens
tatgctgccaaattttggcc

SEQ ID NO: 262792 - DNA, 11 bp, Homo sapiens
tatgctgctgt

SEQ ID NO: 262793 - DNA, 21 bp, Homo sapiens
tatgctggggtacacagtgag

SEQ ID NO: 262794 - DNA, 22 bp, Homo sapiens
tatgctggggtacacagtgaga

SEQ ID NO: 262795 - DNA, 19 bp, Homo sapiens
tatgcttaggccagtcagt

SEQ ID NO: 262796 - DNA, 15 bp, Homo sapiens
tatggaaatcctgtt

SEQ ID NO: 262797 - DNA, 22 bp, Homo sapiens
tatggaattacatgtaaaacat

SEQ ID NO: 262798 - DNA, 19 bp, Homo sapiens
tatggacatcgatatgaaa

SEQ ID NO: 262799 - DNA, 16 bp, Homo sapiens
tatggattcacttcta

SEQ ID NO: 262800 - DNA, 15 bp, Homo sapiens
tatggattttctaag

SEQ ID NO: 262801 - DNA, 19 bp, Homo sapiens
tatggattttctaaggaag

SEQ ID NO: 262802 - DNA, 21 bp, Homo sapiens
tatggattttctattgttact

SEQ ID NO: 262803 - DNA, 11 bp, Homo sapiens
tatggcaaggg

SEQ ID NO: 262804 - DNA, 23 bp, Homo sapiens
tatggcagaagggaattgctcag

SEQ ID NO: 262805 - DNA, 14 bp, Homo sapiens
tatggcccagcctt

SEQ ID NO: 262806 - DNA, 22 bp, Homo sapiens
gactgtcggagaggctgtctgg

SEQ ID NO: 262807 - DNA, 11 bp, Homo sapiens
gactgtgaaag

SEQ ID NO: 262808 - DNA, 21 bp, Homo sapiens
gactgtgagcgagcctggcag

SEQ ID NO: 262809 - DNA, 16 bp, Homo sapiens
gactgtgaggcggcag

SEQ ID NO: 262810 - DNA, 21 bp, Homo sapiens
gactgtgaggcggcagctggg

SEQ ID NO: 262811 - DNA, 13 bp, Homo sapiens
gactgtgatgcca

SEQ ID NO: 262812 - DNA, 18 bp, Homo sapiens
gactgtgatttatttgga

SEQ ID NO: 262813 - DNA, 19 bp, Homo sapiens
gactgtgatttatttggag

SEQ ID NO: 262814 - DNA, 17 bp, Homo sapiens
gactgttccctccaagg

SEQ ID NO: 262815 - DNA, 19 bp, Homo sapiens
gactgttttttcctgagct

SEQ ID NO: 262816 - DNA, 13 bp, Homo sapiens
gacttaaagcaga

SEQ ID NO: 262817 - DNA, 14 bp, Homo sapiens
gacttaaaggacag

SEQ ID NO: 262818 - DNA, 20 bp, Homo sapiens
gacttaaaggacaggaggag

SEQ ID NO: 262819 - DNA, 17 bp, Homo sapiens
gacttagatctgagccc

SEQ ID NO: 262820 - DNA, 22 bp, Homo sapiens
gacttagttgcgttacaccctt

SEQ ID NO: 262821 - DNA, 19 bp, Homo sapiens
gacttatatatttgaaaga

SEQ ID NO: 262822 - DNA, 16 bp, Homo sapiens
gacttcaaaaggtgat

SEQ ID NO: 262823 - DNA, 21 bp, Homo sapiens
gacttcaagatgcctcttcta

SEQ ID NO: 262824 - DNA, 17 bp, Homo sapiens
gacttcacacagcacct

SEQ ID NO: 262825 - DNA, 20 bp, Homo sapiens
gacttcagactctctcctct

SEQ ID NO: 262826 - DNA, 20 bp, Homo sapiens
gacttcagcaggggtgggag

SEQ ID NO: 262827 - DNA, 16 bp, Homo sapiens
gacttcagctgcctga

SEQ ID NO: 262828 - DNA, 21 bp, Homo sapiens
gacttcagctgcctgaaacag

SEQ ID NO: 262829 - DNA, 22 bp, Homo sapiens
gacttcagggcagggctctgat

SEQ ID NO: 262830 - DNA, 15 bp, Homo sapiens
gacttcatttttcct

SEQ ID NO: 262831 - DNA, 19 bp, Homo sapiens
gacttcccaacagccttag

SEQ ID NO: 262832 - DNA, 23 bp, Homo sapiens
gacttcctggtgaggcccagcct

SEQ ID NO: 262833 - DNA, 15 bp, Homo sapiens
gacttcgactcagga

SEQ ID NO: 262834 - DNA, 16 bp, Homo sapiens
gacttcgactcaggat

SEQ ID NO: 262835 - DNA, 21 bp, Homo sapiens
gacttcgctattcccaggcag

SEQ ID NO: 262836 - DNA, 13 bp, Homo sapiens
gacttctggaagg

SEQ ID NO: 262837 - DNA, 16 bp, Homo sapiens
gacttctggaaggctg

SEQ ID NO: 262838 - DNA, 19 bp, Homo sapiens
gacttctggaaggctggct

SEQ ID NO: 262839 - DNA, 21 bp, Homo sapiens
gacttctggaaggctggctga

SEQ ID NO: 262840 - DNA, 19 bp, Homo sapiens
gacttcttcggaggtggca

SEQ ID NO: 262841 - DNA, 16 bp, Homo sapiens
gacttgaaagaaaggg

SEQ ID NO: 262842 - DNA, 17 bp, Homo sapiens
gacttgaaagcatccat

SEQ ID NO: 262843 - DNA, 19 bp, Homo sapiens
gacttgaaagcatccatgt

SEQ ID NO: 262844 - DNA, 14 bp, Homo sapiens
gacttgaatgtaca

SEQ ID NO: 262845 - DNA, 19 bp, Homo sapiens
gacttgaatgtacaaagat

SEQ ID NO: 262846 - DNA, 19 bp, Homo sapiens
gacttgaggattttgagta

SEQ ID NO: 262847 - DNA, 23 bp, Homo sapiens
gacttgaggattttgagtatctc

SEQ ID NO: 262848 - DNA, 22 bp, Homo sapiens
gacttgatgaataaacactttt

SEQ ID NO: 262849 - DNA, 16 bp, Homo sapiens
gacttggagctgtcct

SEQ ID NO: 262850 - DNA, 16 bp, Homo sapiens
gacttggataggagct

SEQ ID NO: 262851 - DNA, 15 bp, Homo sapiens
gacttggcccaggaa

SEQ ID NO: 262852 - DNA, 17 bp, Homo sapiens
gacttgggggcagagca

SEQ ID NO: 262853 - DNA, 18 bp, Homo sapiens
gacttgggggcagagcag

SEQ ID NO: 262854 - DNA, 23 bp, Homo sapiens
gacttgggggcagagcagcacaa

SEQ ID NO: 262855 - DNA, 16 bp, Homo sapiens
gacttggggtcaggaa

SEQ ID NO: 262856 - DNA, 21 bp, Homo sapiens
gacttgtaggaatctgccttc

SEQ ID NO: 262857 - DNA, 22 bp, Homo sapiens
gacttgtaggaatctgccttcc

SEQ ID NO: 262858 - DNA, 14 bp, Homo sapiens
gacttgtgcctctt

SEQ ID NO: 262859 - DNA, 20 bp, Homo sapiens
gacttgtgcctcttgggaga

SEQ ID NO: 262860 - DNA, 14 bp, Homo sapiens
gacttgtttcctgt

SEQ ID NO: 262861 - DNA, 17 bp, Homo sapiens
gacttgtttctttctgt

SEQ ID NO: 262862 - DNA, 18 bp, Homo sapiens
gacttgtttctttctgtc

SEQ ID NO: 262863 - DNA, 18 bp, Homo sapiens
gacttgttttatgctcag

SEQ ID NO: 262864 - DNA, 23 bp, Homo sapiens
gactttagggatctggggaagga

SEQ ID NO: 262865 - DNA, 23 bp, Homo sapiens
gactttatttaatttcataaatt

SEQ ID NO: 262866 - DNA, 18 bp, Homo sapiens
gactttccaccccctccc

SEQ ID NO: 262867 - DNA, 16 bp, Homo sapiens
gactttcctatgacac

SEQ ID NO: 262868 - DNA, 11 bp, Homo sapiens
gactttcctgc

SEQ ID NO: 262869 - DNA, 12 bp, Homo sapiens
gactttcctgca

SEQ ID NO: 262870 - DNA, 19 bp, Homo sapiens
gactttcggagttgggggt

SEQ ID NO: 262871 - DNA, 15 bp, Homo sapiens
gactttgttacactg

SEQ ID NO: 262872 - DNA, 20 bp, Homo sapiens
gacttttacagcttttctct

SEQ ID NO: 262873 - DNA, 14 bp, Homo sapiens
gacttttattatgg

SEQ ID NO: 262874 - DNA, 17 bp, Homo sapiens
gacttttccatgtatct

SEQ ID NO: 262875 - DNA, 18 bp, Homo sapiens
gacttttccatgtatcta

SEQ ID NO: 262876 - DNA, 23 bp, Homo sapiens
gacttttctttcagccaagaatt

SEQ ID NO: 262877 - DNA, 18 bp, Homo sapiens
gactttttaaaatataag

SEQ ID NO: 262878 - DNA, 13 bp, Homo sapiens
gagaaaaaaacag

SEQ ID NO: 262879 - DNA, 12 bp, Homo sapiens
gagaaaaaccaa

SEQ ID NO: 262880 - DNA, 16 bp, Homo sapiens
gagaaaaagagagagc

SEQ ID NO: 262881 - DNA, 18 bp, Homo sapiens
gagaaaaagagagagcag

SEQ ID NO: 262882 - DNA, 18 bp, Homo sapiens
gagaaaataaatttaact

SEQ ID NO: 262883 - DNA, 13 bp, Homo sapiens
gagaaagaaggct

SEQ ID NO: 262884 - DNA, 22 bp, Homo sapiens
gagaaagcccacctgggctggg

SEQ ID NO: 262885 - DNA, 20 bp, Homo sapiens
gagaaaggattaagatacac

SEQ ID NO: 262886 - DNA, 20 bp, Homo sapiens
gagaaagtgatttctagaaa

SEQ ID NO: 262887 - DNA, 16 bp, Homo sapiens
gagaaatacagtgctt

SEQ ID NO: 262888 - DNA, 15 bp, Homo sapiens
gagaaatatgcagaa

SEQ ID NO: 262889 - DNA, 19 bp, Homo sapiens
tattctttgaccaaactgt

SEQ ID NO: 262890 - DNA, 20 bp, Homo sapiens
tattctttgaccaaactgtg

SEQ ID NO: 262891 - DNA, 15 bp, Homo sapiens
tattgaaaacttcaa

SEQ ID NO: 262892 - DNA, 21 bp, Homo sapiens
tattgaaggaattagaaatga

SEQ ID NO: 262893 - DNA, 22 bp, Homo sapiens
tattgaaggaattagaaatgaa

SEQ ID NO: 262894 - DNA, 15 bp, Homo sapiens
tattgaattattttg

SEQ ID NO: 262895 - DNA, 17 bp, Homo sapiens
tattgagacaaaaatta

SEQ ID NO: 262896 - DNA, 15 bp, Homo sapiens
tattgagacactgtc

SEQ ID NO: 262897 - DNA, 16 bp, Homo sapiens
tattgagacactgtca

SEQ ID NO: 262898 - DNA, 17 bp, Homo sapiens
tattgagacactgtcaa

SEQ ID NO: 262899 - DNA, 21 bp, Homo sapiens
tattgatatgcttatacactt

SEQ ID NO: 262900 - DNA, 14 bp, Homo sapiens
tattgatctttgcc

SEQ ID NO: 262901 - DNA, 18 bp, Homo sapiens
tattgatgaaaagattta

SEQ ID NO: 262902 - DNA, 21 bp, Homo sapiens
tattgatgataatacccacat

SEQ ID NO: 262903 - DNA, 20 bp, Homo sapiens
tattgatgtacagtctgtca

SEQ ID NO: 262904 - DNA, 19 bp, Homo sapiens
tattgccaggaatgtttca

SEQ ID NO: 262905 - DNA, 19 bp, Homo sapiens
tattgccagtatataagct

SEQ ID NO: 262906 - DNA, 19 bp, Homo sapiens
tattgcctgggcagtgccc

SEQ ID NO: 262907 - DNA, 13 bp, Homo sapiens
tattgcttaatcc

SEQ ID NO: 262908 - DNA, 17 bp, Homo sapiens
tattggaagtgaaatta

SEQ ID NO: 262909 - DNA, 20 bp, Homo sapiens
tattggaggtgagatcacag

SEQ ID NO: 262910 - DNA, 14 bp, Homo sapiens
tattgggttcatta

SEQ ID NO: 262911 - DNA, 18 bp, Homo sapiens
tattgggttcattattgg

SEQ ID NO: 262912 - DNA, 20 bp, Homo sapiens
tattgggttcattattggaa

SEQ ID NO: 262913 - DNA, 18 bp, Homo sapiens
tattggtggttctcagca

SEQ ID NO: 262914 - DNA, 13 bp, Homo sapiens
tattgtaaataca

SEQ ID NO: 262915 - DNA, 16 bp, Homo sapiens
tattgtaaatacaagt

SEQ ID NO: 262916 - DNA, 14 bp, Homo sapiens
tattgtacctctct

SEQ ID NO: 262917 - DNA, 17 bp, Homo sapiens
tattgtagcatttcttg

SEQ ID NO: 262918 - DNA, 16 bp, Homo sapiens
tattgtataaactatc

SEQ ID NO: 262919 - DNA, 21 bp, Homo sapiens
tattgtataaactatcagttt

SEQ ID NO: 262920 - DNA, 22 bp, Homo sapiens
tattgtcagtatctgtatctct

SEQ ID NO: 262921 - DNA, 20 bp, Homo sapiens
tattgtgggacttattacaa

SEQ ID NO: 262922 - DNA, 21 bp, Homo sapiens
tattgttaactcttgtctatt

SEQ ID NO: 262923 - DNA, 15 bp, Homo sapiens
tattgttactctggt

SEQ ID NO: 262924 - DNA, 18 bp, Homo sapiens
tattgttccaagacattg

SEQ ID NO: 262925 - DNA, 19 bp, Homo sapiens
tattgttccaagacattgt

SEQ ID NO: 262926 - DNA, 23 bp, Homo sapiens
tattgttccaagacattgtcaat

SEQ ID NO: 262927 - DNA, 13 bp, Homo sapiens
tattgttcccagt

SEQ ID NO: 262928 - DNA, 23 bp, Homo sapiens
tattgttcttgtaaaactgtgac

SEQ ID NO: 262929 - DNA, 16 bp, Homo sapiens
tattgttgctgctttg

SEQ ID NO: 262930 - DNA, 14 bp, Homo sapiens
tattgttttctgta

SEQ ID NO: 262931 - DNA, 14 bp, Homo sapiens
tatttaaaagacaa

SEQ ID NO: 262932 - DNA, 15 bp, Homo sapiens
tatttaaaattggca

SEQ ID NO: 262933 - DNA, 16 bp, Homo sapiens
tatttaaaattggcac

SEQ ID NO: 262934 - DNA, 20 bp, Homo sapiens
tatttaaacttataaatcat

SEQ ID NO: 262935 - DNA, 16 bp, Homo sapiens
tatttttttgttgctg

SEQ ID NO: 262936 - DNA, 20 bp, Homo sapiens
tatttttttgttgctgttgt

SEQ ID NO: 262937 - DNA, 15 bp, Homo sapiens
tattttttttaactg

SEQ ID NO: 262938 - DNA, 21 bp, Homo sapiens
tattttttttttccattagta

SEQ ID NO: 262939 - DNA, 19 bp, Homo sapiens
tcaaaaaaaaaaaaatgca

SEQ ID NO: 262940 - DNA, 16 bp, Homo sapiens
tcaaaaaaacactagt

SEQ ID NO: 262941 - DNA, 13 bp, Homo sapiens
tcaaaaaatgagc

SEQ ID NO: 262942 - DNA, 16 bp, Homo sapiens
tcaaaaacatggccac

SEQ ID NO: 262943 - DNA, 11 bp, Homo sapiens
tcaaaaagaaa

SEQ ID NO: 262944 - DNA, 21 bp, Homo sapiens
tcaaaaagagtcttaattttc

SEQ ID NO: 262945 - DNA, 22 bp, Homo sapiens
tcaaaaagagtcttaattttct

SEQ ID NO: 262946 - DNA, 13 bp, Homo sapiens
tcaaaaagtcatt

SEQ ID NO: 262947 - DNA, 12 bp, Homo sapiens
tcaaaaagtgtt

SEQ ID NO: 262948 - DNA, 15 bp, Homo sapiens
tcaaaaatataactt

SEQ ID NO: 262949 - DNA, 14 bp, Homo sapiens
tcaaaacacttgta

SEQ ID NO: 262950 - DNA, 17 bp, Homo sapiens
tcaaaacctgtgccagg

SEQ ID NO: 262951 - DNA, 16 bp, Homo sapiens
tcaaaactttcagctg

SEQ ID NO: 262952 - DNA, 22 bp, Homo sapiens
tcaaaagcacaaaccctgggga

SEQ ID NO: 262953 - DNA, 23 bp, Homo sapiens
tcaaaagcacaaaccctggggac

SEQ ID NO: 262954 - DNA, 13 bp, Homo sapiens
tcaaaagcattta

SEQ ID NO: 262955 - DNA, 17 bp, Homo sapiens
tcaaaagcatttatcat

SEQ ID NO: 262956 - DNA, 15 bp, Homo sapiens
tcaaaaggaaaccaa

SEQ ID NO: 262957 - DNA, 15 bp, Homo sapiens
tcaaaaggtgattaa

SEQ ID NO: 262958 - DNA, 22 bp, Homo sapiens
tcaaaaggtgattaaatattta

SEQ ID NO: 262959 - DNA, 23 bp, Homo sapiens
tcaaaatacaacttcattgctac

SEQ ID NO: 262960 - DNA, 14 bp, Homo sapiens
tcaaaatacttctt

SEQ ID NO: 262961 - DNA, 17 bp, Homo sapiens
tcaaaatagttctattt

SEQ ID NO: 262962 - DNA, 19 bp, Homo sapiens
tcaaaatccttccaaagaa

SEQ ID NO: 262963 - DNA, 23 bp, Homo sapiens
tcaaaatcttcactgaatatcat

SEQ ID NO: 262964 - DNA, 12 bp, Homo sapiens
tcaaaatgtgcc

SEQ ID NO: 262965 - DNA, 18 bp, Homo sapiens
tcaaaatgttaacaactt

SEQ ID NO: 262966 - DNA, 14 bp, Homo sapiens
tcaaaattaaatct

SEQ ID NO: 262967 - DNA, 21 bp, Homo sapiens
tcaaacacacagtattcgtga

SEQ ID NO: 262968 - DNA, 22 bp, Homo sapiens
tcaaacagggacactacaaaca

SEQ ID NO: 262969 - DNA, 13 bp, Homo sapiens
tcaaaccaggatt

SEQ ID NO: 262970 - DNA, 23 bp, Homo sapiens
tcaaaccccgaccacctgcccaa

SEQ ID NO: 262971 - DNA, 20 bp, Homo sapiens
tcaaacgtgccccccagttc

SEQ ID NO: 262972 - DNA, 14 bp, Homo sapiens
tcaaactaaaagac

SEQ ID NO: 262973 - DNA, 17 bp, Homo sapiens
tcaaactaaaagacatt

SEQ ID NO: 262974 - DNA, 17 bp, Homo sapiens
tcaaactactgtacatt

SEQ ID NO: 262975 - DNA, 19 bp, Homo sapiens
tcaaactactgtacatttt

SEQ ID NO: 262976 - DNA, 20 bp, Homo sapiens
tcaaactcctgacctcaggt

SEQ ID NO: 262977 - DNA, 23 bp, Homo sapiens
tcaaactcgtctgatgttttgat

SEQ ID NO: 262978 - DNA, 21 bp, Homo sapiens
tcaaactctttgcccagttca

SEQ ID NO: 262979 - DNA, 20 bp, Homo sapiens
tcaaactgtagaaatgatga

SEQ ID NO: 262980 - DNA, 16 bp, Homo sapiens
tcaaactttcactttg

SEQ ID NO: 262981 - DNA, 22 bp, Homo sapiens
tcaaagaaagaaagtttagaag

SEQ ID NO: 262982 - DNA, 15 bp, Homo sapiens
tcaaagaacccccct

SEQ ID NO: 262983 - DNA, 16 bp, Homo sapiens
tcaaagaaggatggca

SEQ ID NO: 262984 - DNA, 23 bp, Homo sapiens
tcaaagaatcacctaattaattt

SEQ ID NO: 262985 - DNA, 15 bp, Homo sapiens
tcaaagagagaaaat

SEQ ID NO: 262986 - DNA, 21 bp, Homo sapiens
tcaaagaggcacagagccaaa

SEQ ID NO: 262987 - DNA, 16 bp, Homo sapiens
tcaaagagtaaaacat

SEQ ID NO: 262988 - DNA, 15 bp, Homo sapiens
tcaaagatgtactga

SEQ ID NO: 262989 - DNA, 16 bp, Homo sapiens
tcaaagatgtactgag

SEQ ID NO: 262990 - DNA, 19 bp, Homo sapiens
tcaaagatgtactgagagg

SEQ ID NO: 262991 - DNA, 21 bp, Homo sapiens
tcaaagatgtactgagaggag

SEQ ID NO: 262992 - DNA, 22 bp, Homo sapiens
tcaaagatgtactgagaggagg

SEQ ID NO: 262993 - DNA, 18 bp, Homo sapiens
tcaaagcaagggctccag

SEQ ID NO: 262994 - DNA, 23 bp, Homo sapiens
tcaaagcaccttgaatggaaggt

SEQ ID NO: 262995 - DNA, 18 bp, Homo sapiens
tcaaagccggttgcagag

SEQ ID NO: 262996 - DNA, 15 bp, Homo sapiens
tcaaagctaggaaag

SEQ ID NO: 262997 - DNA, 15 bp, Homo sapiens
tcaaagctttttgaa

SEQ ID NO: 262998 - DNA, 18 bp, Homo sapiens
tcaaaggattttggaaaa

SEQ ID NO: 262999 - DNA, 11 bp, Homo sapiens
tcaaaggcaga

SEQ ID NO: 263000 - DNA, 16 bp, Homo sapiens
tcaaaggcagaaagga

SEQ ID NO: 263001 - DNA, 21 bp, Homo sapiens
tcaaaggcagaaaggagatca

SEQ ID NO: 263002 - DNA, 16 bp, Homo sapiens
tcaaagtactaaaact

SEQ ID NO: 263003 - DNA, 17 bp, Homo sapiens
tcaaagtactaaaacta

SEQ ID NO: 263004 - DNA, 18 bp, Homo sapiens
tcaaagtaggtatacaaa

SEQ ID NO: 263005 - DNA, 19 bp, Homo sapiens
tcaaagtgaaagacatttc

SEQ ID NO: 263006 - DNA, 20 bp, Homo sapiens
tcaaagtgaaagacatttca

SEQ ID NO: 263007 - DNA, 17 bp, Homo sapiens
tcaaagtggtacaggaa

SEQ ID NO: 263008 - DNA, 20 bp, Homo sapiens
tcaaatatctcagaggctat

SEQ ID NO: 263009 - DNA, 16 bp, Homo sapiens
tcaaatcattcaaaac

SEQ ID NO: 263010 - DNA, 18 bp, Homo sapiens
tcaaatcattcaaaactt

SEQ ID NO: 263011 - DNA, 19 bp, Homo sapiens
tcaaatccttccaaaaatt

SEQ ID NO: 263012 - DNA, 21 bp, Homo sapiens
tcaaatccttccaaaaattat

SEQ ID NO: 263013 - DNA, 18 bp, Homo sapiens
tcaaatctattcagacaa

SEQ ID NO: 263014 - DNA, 12 bp, Homo sapiens
tcaaatctgtat

SEQ ID NO: 263015 - DNA, 20 bp, Homo sapiens
tcaaatgagtttaaaaaaat

SEQ ID NO: 263016 - DNA, 12 bp, Homo sapiens
tcaaatgcatga

SEQ ID NO: 263017 - DNA, 20 bp, Homo sapiens
tcaaatgcatgatattgtat

SEQ ID NO: 263018 - DNA, 16 bp, Homo sapiens
tcaaatggatgtaata

SEQ ID NO: 263019 - DNA, 19 bp, Homo sapiens
tcaaatgtcattatgtaga

SEQ ID NO: 263020 - DNA, 21 bp, Homo sapiens
tcaaatgtcattatgtagaaa

SEQ ID NO: 263021 - DNA, 22 bp, Homo sapiens
tcaaattcctgcaaaattacct

SEQ ID NO: 263022 - DNA, 23 bp, Homo sapiens
tcaaatttgtagggtttctaggt

SEQ ID NO: 263023 - DNA, 22 bp, Homo sapiens
tcaacaagggagagacctcatc

SEQ ID NO: 263024 - DNA, 18 bp, Homo sapiens
tcaacacttattttctga

SEQ ID NO: 263025 - DNA, 17 bp, Homo sapiens
tcaacagcaaagcttgg

SEQ ID NO: 263026 - DNA, 17 bp, Homo sapiens
tcaacagcatgtctact

SEQ ID NO: 263027 - DNA, 15 bp, Homo sapiens
tcaacagctgatgcc

SEQ ID NO: 263028 - DNA, 17 bp, Homo sapiens
tcaacagtgaacagctt

SEQ ID NO: 263029 - DNA, 13 bp, Homo sapiens
gagagagagagaa

SEQ ID NO: 263030 - DNA, 14 bp, Homo sapiens
gagagagagagaaa

SEQ ID NO: 263031 - DNA, 14 bp, Homo sapiens
gagagagagtgaga

SEQ ID NO: 263032 - DNA, 18 bp, Homo sapiens
gagagagatgctgctccc

SEQ ID NO: 263033 - DNA, 22 bp, Homo sapiens
gagagagcaatcttgctgtgaa

SEQ ID NO: 263034 - DNA, 18 bp, Homo sapiens
gagagagcgcgggagaga

SEQ ID NO: 263035 - DNA, 19 bp, Homo sapiens
gagagaggcgtcctggtga

SEQ ID NO: 263036 - DNA, 13 bp, Homo sapiens
gagagcagaatga

SEQ ID NO: 263037 - DNA, 13 bp, Homo sapiens
gagagcaggctgg

SEQ ID NO: 263038 - DNA, 14 bp, Homo sapiens
gagagcaggctggc

SEQ ID NO: 263039 - DNA, 17 bp, Homo sapiens
gagagcaggctggcagc

SEQ ID NO: 263040 - DNA, 14 bp, Homo sapiens
gagagcccattccc

SEQ ID NO: 263041 - DNA, 13 bp, Homo sapiens
gagagccccagct

SEQ ID NO: 263042 - DNA, 15 bp, Homo sapiens
gagagccccagctga

SEQ ID NO: 263043 - DNA, 16 bp, Homo sapiens
gagagcccccaccagc

SEQ ID NO: 263044 - DNA, 20 bp, Homo sapiens
gagagcccccaccagcagca

SEQ ID NO: 263045 - DNA, 23 bp, Homo sapiens
gagagcccccaccagcagcacaa

SEQ ID NO: 263046 - DNA, 17 bp, Homo sapiens
gagagcccctggggcct

SEQ ID NO: 263047 - DNA, 20 bp, Homo sapiens
gagagcccctggggcctaga

SEQ ID NO: 263048 - DNA, 20 bp, Homo sapiens
gagagcccggcgcccctgcc

SEQ ID NO: 263049 - DNA, 18 bp, Homo sapiens
gagagccctctgctgctt

SEQ ID NO: 263050 - DNA, 16 bp, Homo sapiens
gagagcccttcatttg

SEQ ID NO: 263051 - DNA, 19 bp, Homo sapiens
gagagcctcttagtgattg

SEQ ID NO: 263052 - DNA, 13 bp, Homo sapiens
gagagcctggtgc

SEQ ID NO: 263053 - DNA, 17 bp, Homo sapiens
gagagcctggtgctgct

SEQ ID NO: 263054 - DNA, 14 bp, Homo sapiens
gagagcgccacccg

SEQ ID NO: 263055 - DNA, 18 bp, Homo sapiens
gagagctcttagttttta

SEQ ID NO: 263056 - DNA, 20 bp, Homo sapiens
gagagctcttagtttttaaa

SEQ ID NO: 263057 - DNA, 22 bp, Homo sapiens
gagagctcttagtttttaaaaa

SEQ ID NO: 263058 - DNA, 14 bp, Homo sapiens
gagagctgctgagg

SEQ ID NO: 263059 - DNA, 15 bp, Homo sapiens
gagaggaaaaaggct

SEQ ID NO: 263060 - DNA, 14 bp, Homo sapiens
gagaggaaaagcca

SEQ ID NO: 263061 - DNA, 19 bp, Homo sapiens
gagaggaagccacgtgctg

SEQ ID NO: 263062 - DNA, 14 bp, Homo sapiens
gagaggagaaacac

SEQ ID NO: 263063 - DNA, 15 bp, Homo sapiens
gagaggagagaatga

SEQ ID NO: 263064 - DNA, 12 bp, Homo sapiens
gagaggagcacc

SEQ ID NO: 263065 - DNA, 15 bp, Homo sapiens
gagcctgcggctgct

SEQ ID NO: 263066 - DNA, 17 bp, Homo sapiens
gagcctgcggctgctgg

SEQ ID NO: 263067 - DNA, 19 bp, Homo sapiens
gagcctgcggctgctggca

SEQ ID NO: 263068 - DNA, 21 bp, Homo sapiens
gagcctgcggctgctggcaca

SEQ ID NO: 263069 - DNA, 10 bp, Homo sapiens
gagcctggag

SEQ ID NO: 263070 - DNA, 19 bp, Homo sapiens
gagcctggagcccctgtgt

SEQ ID NO: 263071 - DNA, 15 bp, Homo sapiens
gagcctggtcctggc

SEQ ID NO: 263072 - DNA, 16 bp, Homo sapiens
gagcctggtgctgctg

SEQ ID NO: 263073 - DNA, 11 bp, Homo sapiens
gagcctgtccc

SEQ ID NO: 263074 - DNA, 22 bp, Homo sapiens
gagcctgtccccgccttccctc

SEQ ID NO: 263075 - DNA, 20 bp, Homo sapiens
gagccttcgtgccccccctt

SEQ ID NO: 263076 - DNA, 14 bp, Homo sapiens
gagccttgctgcca

SEQ ID NO: 263077 - DNA, 18 bp, Homo sapiens
gagccttggttcatcagt

SEQ ID NO: 263078 - DNA, 20 bp, Homo sapiens
gagccttgtgagatccttca

SEQ ID NO: 263079 - DNA, 22 bp, Homo sapiens
gagccttgtgagatccttcaca

SEQ ID NO: 263080 - DNA, 21 bp, Homo sapiens
gagcctttggaagtctgcgcc

SEQ ID NO: 263081 - DNA, 16 bp, Homo sapiens
gagcgacggctcctcc

SEQ ID NO: 263082 - DNA, 16 bp, Homo sapiens
gagcgagcatccccca

SEQ ID NO: 263083 - DNA, 12 bp, Homo sapiens
gagcgccacccg

SEQ ID NO: 263084 - DNA, 13 bp, Homo sapiens
gagcgccacccgc

SEQ ID NO: 263085 - DNA, 12 bp, Homo sapiens
gagcgcccctcc

SEQ ID NO: 263086 - DNA, 13 bp, Homo sapiens
gagcgcgggagag

SEQ ID NO: 263087 - DNA, 15 bp, Homo sapiens
gagcgcgggagagag

SEQ ID NO: 263088 - DNA, 15 bp, Homo sapiens
gagcgcgtgccttcc

SEQ ID NO: 263089 - DNA, 17 bp, Homo sapiens
gagcgctggcctcttcc

SEQ ID NO: 263090 - DNA, 17 bp, Homo sapiens
gagcggagaaaggaagg

SEQ ID NO: 263091 - DNA, 17 bp, Homo sapiens
gagcggaggaggaagtc

SEQ ID NO: 263092 - DNA, 12 bp, Homo sapiens
gagcggccgcct

SEQ ID NO: 263093 - DNA, 19 bp, Homo sapiens
gagcggccgcctgtccttg

SEQ ID NO: 263094 - DNA, 14 bp, Homo sapiens
gagcggctgaggac

SEQ ID NO: 263095 - DNA, 23 bp, Homo sapiens
gagcggctgaggacggggcagag

SEQ ID NO: 263096 - DNA, 21 bp, Homo sapiens
gagcgggggctaactggcccc

SEQ ID NO: 263097 - DNA, 22 bp, Homo sapiens
gagcgtgtagcgtcctgaggaa

SEQ ID NO: 263098 - DNA, 21 bp, Homo sapiens
gagctaaattacaattgtcat

SEQ ID NO: 263099 - DNA, 19 bp, Homo sapiens
gagctaacactggccccta

SEQ ID NO: 263100 - DNA, 13 bp, Homo sapiens
gagctataacatt

SEQ ID NO: 263101 - DNA, 14 bp, Homo sapiens
gagctatgcacacc

SEQ ID NO: 263102 - DNA, 15 bp, Homo sapiens
gagctatgcacacca

SEQ ID NO: 263103 - DNA, 22 bp, Homo sapiens
gagctatgcacaccaaattgct

SEQ ID NO: 263104 - DNA, 18 bp, Homo sapiens
gagctcacagtacaatgt

SEQ ID NO: 263105 - DNA, 22 bp, Homo sapiens
gagctcagcacagcctcacccc

SEQ ID NO: 263106 - DNA, 17 bp, Homo sapiens
gagctcaggagaaggcc

SEQ ID NO: 263107 - DNA, 18 bp, Homo sapiens
gagctcaggatggctcag

SEQ ID NO: 263108 - DNA, 15 bp, Homo sapiens
gagctccaccctccc

SEQ ID NO: 263109 - DNA, 18 bp, Homo sapiens
gagctccaccctcccctc

SEQ ID NO: 263110 - DNA, 19 bp, Homo sapiens
gagctccagacccccagca

SEQ ID NO: 263111 - DNA, 22 bp, Homo sapiens
gagctccagacccccagcaacc

SEQ ID NO: 263112 - DNA, 14 bp, Homo sapiens
gagctccagtggaa

SEQ ID NO: 263113 - DNA, 14 bp, Homo sapiens
gagctcccaggacg

SEQ ID NO: 263114 - DNA, 20 bp, Homo sapiens
gagctcccaggacgcaggga

SEQ ID NO: 263115 - DNA, 18 bp, Homo sapiens
gagctcccccttcccagt

SEQ ID NO: 263116 - DNA, 22 bp, Homo sapiens
gagctcccctggagccagcagg

SEQ ID NO: 263117 - DNA, 19 bp, Homo sapiens
gagctccctcgctgtatga

SEQ ID NO: 263118 - DNA, 22 bp, Homo sapiens
gagctcctctgggcaggacctc

SEQ ID NO: 263119 - DNA, 22 bp, Homo sapiens
gagctcctgctggggggcaggg

SEQ ID NO: 263120 - DNA, 13 bp, Homo sapiens
gagctcctgggaa

SEQ ID NO: 263121 - DNA, 16 bp, Homo sapiens
gagctcgtgtatcctg

SEQ ID NO: 263122 - DNA, 21 bp, Homo sapiens
gagctcgtgtatcctggggct

SEQ ID NO: 263123 - DNA, 17 bp, Homo sapiens
gagctctcctgggccag

SEQ ID NO: 263124 - DNA, 17 bp, Homo sapiens
gagctctgacctgcccc

SEQ ID NO: 263125 - DNA, 16 bp, Homo sapiens
gagctctgcagagcag

SEQ ID NO: 263126 - DNA, 19 bp, Homo sapiens
gagctctggagccacctgt

SEQ ID NO: 263127 - DNA, 11 bp, Homo sapiens
gagctctgtcc

SEQ ID NO: 263128 - DNA, 21 bp, Homo sapiens
gagctcttagtttttaaaaag

SEQ ID NO: 263129 - DNA, 19 bp, Homo sapiens
gagctcttcaggcctccct

SEQ ID NO: 263130 - DNA, 16 bp, Homo sapiens
gagctgagtcacctcc

SEQ ID NO: 263131 - DNA, 17 bp, Homo sapiens
gagctgagtcacctcct

SEQ ID NO: 263132 - DNA, 18 bp, Homo sapiens
gagctgagtcggctgggc

SEQ ID NO: 263133 - DNA, 20 bp, Homo sapiens
gagctgagtcggctgggcag

SEQ ID NO: 263134 - DNA, 14 bp, Homo sapiens
gagctgatgaaact

SEQ ID NO: 263135 - DNA, 15 bp, Homo sapiens
gagctgatttccagg

SEQ ID NO: 263136 - DNA, 20 bp, Homo sapiens
gagctgatttccaggcccct

SEQ ID NO: 263137 - DNA, 14 bp, Homo sapiens
gagctgcagccccc

SEQ ID NO: 263138 - DNA, 24 bp, Homo sapiens
gagctgcatggacgcctggctcca

SEQ ID NO: 263139 - DNA, 17 bp, Homo sapiens
gagctgcctgctctgca

SEQ ID NO: 263140 - DNA, 18 bp, Homo sapiens
gagctgcctgctctgcag

SEQ ID NO: 263141 - DNA, 19 bp, Homo sapiens
gagctgcctgctctgcagc

SEQ ID NO: 263142 - DNA, 14 bp, Homo sapiens
gagctgctgaggga

SEQ ID NO: 263143 - DNA, 21 bp, Homo sapiens
gagctgctggcttgcagtgcg

SEQ ID NO: 263144 - DNA, 20 bp, Homo sapiens
gagctggaaggcagggcaga

SEQ ID NO: 263145 - DNA, 15 bp, Homo sapiens
gagctggaccagtgg

SEQ ID NO: 263146 - DNA, 13 bp, Homo sapiens
gagctggctggca

SEQ ID NO: 263147 - DNA, 13 bp, Homo sapiens
gagctgggagccg

SEQ ID NO: 263148 - DNA, 14 bp, Homo sapiens
gagctgggagccgg

SEQ ID NO: 263149 - DNA, 22 bp, Homo sapiens
gagctgggagccgggccgcaga

SEQ ID NO: 263150 - DNA, 20 bp, Homo sapiens
gagctggggaatcccctcgc

SEQ ID NO: 263151 - DNA, 18 bp, Homo sapiens
gagctgggggccatgagc

SEQ ID NO: 263152 - DNA, 18 bp, Homo sapiens
gagctgggtaccaggcca

SEQ ID NO: 263153 - DNA, 19 bp, Homo sapiens
gagctgggtaccaggccac

SEQ ID NO: 263154 - DNA, 12 bp, Homo sapiens
gagctgggtggc

SEQ ID NO: 263155 - DNA, 24 bp, Homo sapiens
gagctgggtggcctgtttctgcag

SEQ ID NO: 263156 - DNA, 21 bp, Homo sapiens
gagctggtagttagtagcatg

SEQ ID NO: 263157 - DNA, 15 bp, Homo sapiens
gagctggtgacagcc

SEQ ID NO: 263158 - DNA, 16 bp, Homo sapiens
gagctggtgcattaca

SEQ ID NO: 263159 - DNA, 16 bp, Homo sapiens
gagctggtgcccggag

SEQ ID NO: 263160 - DNA, 22 bp, Homo sapiens
gagctgtcaggcagtagcagct

SEQ ID NO: 263161 - DNA, 20 bp, Homo sapiens
gagctgtttatggcctcagc

SEQ ID NO: 263162 - DNA, 19 bp, Homo sapiens
gagctgttttggatgaatg

SEQ ID NO: 263163 - DNA, 20 bp, Homo sapiens
gagctgttttggatgaatgc

SEQ ID NO: 263164 - DNA, 21 bp, Homo sapiens
gagcttagccttgtgccctgc

SEQ ID NO: 263165 - DNA, 15 bp, Homo sapiens
gagcttattggccac

SEQ ID NO: 263166 - DNA, 18 bp, Homo sapiens
gagcttattggccactgg

SEQ ID NO: 263167 - DNA, 22 bp, Homo sapiens
gagcttcaagtctgtgcctgga

SEQ ID NO: 263168 - DNA, 13 bp, Homo sapiens
gagcttcagggct

SEQ ID NO: 263169 - DNA, 15 bp, Homo sapiens
gagcttcattgggag

SEQ ID NO: 263170 - DNA, 18 bp, Homo sapiens
gagcttcggttctccaga

SEQ ID NO: 263171 - DNA, 10 bp, Homo sapiens
gagcttctct

SEQ ID NO: 263172 - DNA, 16 bp, Homo sapiens
gagcttctctgtgaac

SEQ ID NO: 263173 - DNA, 21 bp, Homo sapiens
gagcttgattctaaaggggac

SEQ ID NO: 263174 - DNA, 14 bp, Homo sapiens
gagcttggccagaa

SEQ ID NO: 263175 - DNA, 20 bp, Homo sapiens
gagctttccggggaggagcc

SEQ ID NO: 263176 - DNA, 22 bp, Homo sapiens
gagctttccggggaggagcctt

SEQ ID NO: 263177 - DNA, 21 bp, Homo sapiens
gagctttggacacacacagct

SEQ ID NO: 263178 - DNA, 15 bp, Homo sapiens
gaggaaaaacagagg

SEQ ID NO: 263179 - DNA, 13 bp, Homo sapiens
tcacccccaaggg

SEQ ID NO: 263180 - DNA, 13 bp, Homo sapiens
tcacccccacccc

SEQ ID NO: 263181 - DNA, 18 bp, Homo sapiens
tcacccccacccctgtac

SEQ ID NO: 263182 - DNA, 12 bp, Homo sapiens
tcacccccatcc

SEQ ID NO: 263183 - DNA, 14 bp, Homo sapiens
tcacccccatccct

SEQ ID NO: 263184 - DNA, 15 bp, Homo sapiens
tcacccccctgctta

SEQ ID NO: 263185 - DNA, 20 bp, Homo sapiens
tcaccccctttgctgtgagg

SEQ ID NO: 263186 - DNA, 17 bp, Homo sapiens
tcaccccggcaggccct

SEQ ID NO: 263187 - DNA, 13 bp, Homo sapiens
tcacccctgcact

SEQ ID NO: 263188 - DNA, 12 bp, Homo sapiens
tcacccctgggc

SEQ ID NO: 263189 - DNA, 16 bp, Homo sapiens
tcacccgctgcccagc

SEQ ID NO: 263190 - DNA, 15 bp, Homo sapiens
tcaccctcagctggc

SEQ ID NO: 263191 - DNA, 19 bp, Homo sapiens
tcaccctgcttggggcctg

SEQ ID NO: 263192 - DNA, 21 bp, Homo sapiens
tcaccctgcttggggcctggc

SEQ ID NO: 263193 - DNA, 12 bp, Homo sapiens
tcaccctgtgac

SEQ ID NO: 263194 - DNA, 19 bp, Homo sapiens
tcaccctgtgaccctctca

SEQ ID NO: 263195 - DNA, 12 bp, Homo sapiens
gaggcgcccacc

SEQ ID NO: 263196 - DNA, 13 bp, Homo sapiens
gaggcgcccacct

SEQ ID NO: 263197 - DNA, 14 bp, Homo sapiens
gaggcgcccacctg

SEQ ID NO: 263198 - DNA, 16 bp, Homo sapiens
gaggcgcccacctgcc

SEQ ID NO: 263199 - DNA, 19 bp, Homo sapiens
gaggcgcccacctgcccag

SEQ ID NO: 263200 - DNA, 13 bp, Homo sapiens
gaggcggcagctg

SEQ ID NO: 263201 - DNA, 20 bp, Homo sapiens
gaggcgggagaatcatgtga

SEQ ID NO: 263202 - DNA, 14 bp, Homo sapiens
gaggcgggggagcc

SEQ ID NO: 263203 - DNA, 19 bp, Homo sapiens
gaggcgggggagcctggag

SEQ ID NO: 263204 - DNA, 19 bp, Homo sapiens
gaggcgggggatcctggag

SEQ ID NO: 263205 - DNA, 20 bp, Homo sapiens
gaggcgggggatcctggagc

SEQ ID NO: 263206 - DNA, 19 bp, Homo sapiens
gaggcggtttgggagaaca

SEQ ID NO: 263207 - DNA, 20 bp, Homo sapiens
gaggcgtcctggtgaggaca

SEQ ID NO: 263208 - DNA, 13 bp, Homo sapiens
gaggcgtcttgta

SEQ ID NO: 263209 - DNA, 16 bp, Homo sapiens
gaggcgtcttgtattt

SEQ ID NO: 263210 - DNA, 18 bp, Homo sapiens
gaggcgtgcccccctcct

SEQ ID NO: 263211 - DNA, 20 bp, Homo sapiens
gaggcgtgcccccctcctcc

SEQ ID NO: 263212 - DNA, 16 bp, Homo sapiens
gaggcgtgggatccag

SEQ ID NO: 263213 - DNA, 18 bp, Homo sapiens
gaggctaaaacaaatctc

SEQ ID NO: 263214 - DNA, 15 bp, Homo sapiens
gaggctagccccagg

SEQ ID NO: 263215 - DNA, 19 bp, Homo sapiens
gaggctagccccagggtga

SEQ ID NO: 263216 - DNA, 22 bp, Homo sapiens
gaggctattcctaggcctcagg

SEQ ID NO: 263217 - DNA, 21 bp, Homo sapiens
gaggctcccagacccagggca

SEQ ID NO: 263218 - DNA, 20 bp, Homo sapiens
gaggctccccgcctccactc

SEQ ID NO: 263219 - DNA, 11 bp, Homo sapiens
gaggctcctgg

SEQ ID NO: 263220 - DNA, 16 bp, Homo sapiens
gaggctcctggagcca

SEQ ID NO: 263221 - DNA, 17 bp, Homo sapiens
gaggctcctggagccag

SEQ ID NO: 263222 - DNA, 15 bp, Homo sapiens
gaggctctgaagaga

SEQ ID NO: 263223 - DNA, 19 bp, Homo sapiens
gaggctgagactgcagagg

SEQ ID NO: 263224 - DNA, 22 bp, Homo sapiens
gaggctgagcctacagatgaac

SEQ ID NO: 263225 - DNA, 12 bp, Homo sapiens
gaggctgcctct

SEQ ID NO: 263226 - DNA, 17 bp, Homo sapiens
gaggctgcctctgggtg

SEQ ID NO: 263227 - DNA, 15 bp, Homo sapiens
gaggctggaggaagg

SEQ ID NO: 263228 - DNA, 12 bp, Homo sapiens
gaggctggcagg

SEQ ID NO: 263229 - DNA, 15 bp, Homo sapiens
gaggctgggccaagc

SEQ ID NO: 263230 - DNA, 21 bp, Homo sapiens
gaggctggggcttttgtgcca

SEQ ID NO: 263231 - DNA, 14 bp, Homo sapiens
gaggctgtcctgta

SEQ ID NO: 263232 - DNA, 15 bp, Homo sapiens
gaggcttaacaatgt

SEQ ID NO: 263233 - DNA, 16 bp, Homo sapiens
gaggcttagagagagg

SEQ ID NO: 263234 - DNA, 16 bp, Homo sapiens
gaggcttccaggctct

SEQ ID NO: 263235 - DNA, 18 bp, Homo sapiens
gaggcttgggaccgccag

SEQ ID NO: 263236 - DNA, 22 bp, Homo sapiens
gaggcttgggaccgccagatgg

SEQ ID NO: 263237 - DNA, 20 bp, Homo sapiens
gaggctttaagcgaggcaga

SEQ ID NO: 263238 - DNA, 18 bp, Homo sapiens
gaggctttaagctccagc

SEQ ID NO: 263239 - DNA, 20 bp, Homo sapiens
gaggctttaagctccagctt

SEQ ID NO: 263240 - DNA, 21 bp, Homo sapiens
gagggaaacccggggaactgg

SEQ ID NO: 263241 - DNA, 17 bp, Homo sapiens
gagggaaaggctgaaca

SEQ ID NO: 263242 - DNA, 20 bp, Homo sapiens
gagggaagcccacccgcccc

SEQ ID NO: 263243 - DNA, 20 bp, Homo sapiens
gagggaatgttccctgcacc

SEQ ID NO: 263244 - DNA, 21 bp, Homo sapiens
gagggaccaggtgtctagagg

SEQ ID NO: 263245 - DNA, 22 bp, Homo sapiens
gagggaccttggagagctcagg

SEQ ID NO: 263246 - DNA, 16 bp, Homo sapiens
gagggactgcctctgc

SEQ ID NO: 263247 - DNA, 15 bp, Homo sapiens
gagggactgtcagct

SEQ ID NO: 263248 - DNA, 20 bp, Homo sapiens
gagggactgtcagctgagct

SEQ ID NO: 263249 - DNA, 15 bp, Homo sapiens
gagggagaaggagag

SEQ ID NO: 263250 - DNA, 15 bp, Homo sapiens
gagggagaagggaga

SEQ ID NO: 263251 - DNA, 16 bp, Homo sapiens
gagggagcaagccttc

SEQ ID NO: 263252 - DNA, 15 bp, Homo sapiens
gagggagcttagcca

SEQ ID NO: 263253 - DNA, 12 bp, Homo sapiens
gagggaggcctg

SEQ ID NO: 263254 - DNA, 13 bp, Homo sapiens
gagggaggcctga

SEQ ID NO: 263255 - DNA, 14 bp, Homo sapiens
gagggaggggaggt

SEQ ID NO: 263256 - DNA, 20 bp, Homo sapiens
gagggagggggcgctcagga

SEQ ID NO: 263257 - DNA, 23 bp, Homo sapiens
gagggagggggcgctcaggaccc

SEQ ID NO: 263258 - DNA, 13 bp, Homo sapiens
gagggagggggct

SEQ ID NO: 263259 - DNA, 23 bp, Homo sapiens
gagggaggtgtttaaagagaggt

SEQ ID NO: 263260 - DNA, 20 bp, Homo sapiens
gagggagtacaaagacaggg

SEQ ID NO: 263261 - DNA, 19 bp, Homo sapiens
gagggagtgcagaacacct

SEQ ID NO: 263262 - DNA, 16 bp, Homo sapiens
gagggatcattttctg

SEQ ID NO: 263263 - DNA, 18 bp, Homo sapiens
gagggatgaggtgctggg

SEQ ID NO: 263264 - DNA, 22 bp, Homo sapiens
gagggatgcagtgcctttcccc

SEQ ID NO: 263265 - DNA, 15 bp, Homo sapiens
gagggatgtggagca

SEQ ID NO: 263266 - DNA, 20 bp, Homo sapiens
gagggattgaacacaggcaa

SEQ ID NO: 263267 - DNA, 20 bp, Homo sapiens
gagggcaaggggtttccaca

SEQ ID NO: 263268 - DNA, 19 bp, Homo sapiens
gagggcactctctgccagc

SEQ ID NO: 263269 - DNA, 16 bp, Homo sapiens
gagggcactggtggcc

SEQ ID NO: 263270 - DNA, 18 bp, Homo sapiens
gagggcactggtggcccg

SEQ ID NO: 263271 - DNA, 11 bp, Homo sapiens
gagggcagagc

SEQ ID NO: 263272 - DNA, 16 bp, Homo sapiens
gagggcagagccatgg

SEQ ID NO: 263273 - DNA, 20 bp, Homo sapiens
gagggcagagccatgggcct

SEQ ID NO: 263274 - DNA, 19 bp, Homo sapiens
gagggcagaggtcccctga

SEQ ID NO: 263275 - DNA, 19 bp, Homo sapiens
gagggcagcactgggaagc

SEQ ID NO: 263276 - DNA, 21 bp, Homo sapiens
gagggcagcactgggaagctg

SEQ ID NO: 263277 - DNA, 23 bp, Homo sapiens
gagggcaggggctgcatcctcag

SEQ ID NO: 263278 - DNA, 23 bp, Homo sapiens
gagggcatcagctttccctggct

SEQ ID NO: 263279 - DNA, 12 bp, Homo sapiens
gagggcccagct

SEQ ID NO: 263280 - DNA, 22 bp, Homo sapiens
gagggcccagctgtagccatgg

SEQ ID NO: 263281 - DNA, 15 bp, Homo sapiens
gagggcccctctgcc

SEQ ID NO: 263282 - DNA, 20 bp, Homo sapiens
gagggcccctctgcccagct

SEQ ID NO: 263283 - DNA, 22 bp, Homo sapiens
gagggcccctctgcccagcttg

SEQ ID NO: 263284 - DNA, 22 bp, Homo sapiens
gagggcctctggtgttcctggc

SEQ ID NO: 263285 - DNA, 12 bp, Homo sapiens
gagggcggccag

SEQ ID NO: 263286 - DNA, 14 bp, Homo sapiens
gagggcggccaggg

SEQ ID NO: 263287 - DNA, 12 bp, Homo sapiens
gagggctgagcc

SEQ ID NO: 263288 - DNA, 16 bp, Homo sapiens
gagggctgtggctggg

SEQ ID NO: 263289 - DNA, 14 bp, Homo sapiens
gaggggaagggcca

SEQ ID NO: 263290 - DNA, 15 bp, Homo sapiens
gaggggaagggccag

SEQ ID NO: 263291 - DNA, 16 bp, Homo sapiens
gaggggactgggggac

SEQ ID NO: 263292 - DNA, 15 bp, Homo sapiens
gaggggagaggaaat

SEQ ID NO: 263293 - DNA, 14 bp, Homo sapiens
gaggggagaggaag

SEQ ID NO: 263294 - DNA, 19 bp, Homo sapiens
gaggggaggggcctaggga

SEQ ID NO: 263295 - DNA, 13 bp, Homo sapiens
gaggggcagccgc

SEQ ID NO: 263296 - DNA, 13 bp, Homo sapiens
gaggggcccgagc

SEQ ID NO: 263297 - DNA, 12 bp, Homo sapiens
gaggggcctagg

SEQ ID NO: 263298 - DNA, 14 bp, Homo sapiens
gaggggcctcaggt

SEQ ID NO: 263299 - DNA, 18 bp, Homo sapiens
gaggggcctggcagccgt

SEQ ID NO: 263300 - DNA, 13 bp, Homo sapiens
gaggggcctggcc

SEQ ID NO: 263301 - DNA, 17 bp, Homo sapiens
gaggggcggggccagga

SEQ ID NO: 263302 - DNA, 17 bp, Homo sapiens
gaggggctgagtctggc

SEQ ID NO: 263303 - DNA, 20 bp, Homo sapiens
gaggggctgagtctggctag

SEQ ID NO: 263304 - DNA, 21 bp, Homo sapiens
gaggggcttggagcagagacg

SEQ ID NO: 263305 - DNA, 18 bp, Homo sapiens
gagggggccacctcccca

SEQ ID NO: 263306 - DNA, 12 bp, Homo sapiens
gagggggctctc

SEQ ID NO: 263307 - DNA, 22 bp, Homo sapiens
gaggggggccaaggtcctgctc

SEQ ID NO: 263308 - DNA, 15 bp, Homo sapiens
gagggggttacaaac

SEQ ID NO: 263309 - DNA, 15 bp, Homo sapiens
gaggggtaaatatat

SEQ ID NO: 263310 - DNA, 17 bp, Homo sapiens
gaggggtaaatatatgt

SEQ ID NO: 263311 - DNA, 15 bp, Homo sapiens
gaggggtctagaggc

SEQ ID NO: 263312 - DNA, 12 bp, Homo sapiens
gaggggtctgcc

SEQ ID NO: 263313 - DNA, 15 bp, Homo sapiens
gaggggtctgcctcc

SEQ ID NO: 263314 - DNA, 18 bp, Homo sapiens
gaggggtctgcctcccac

SEQ ID NO: 263315 - DNA, 13 bp, Homo sapiens
gagggtaaggctg

SEQ ID NO: 263316 - DNA, 21 bp, Homo sapiens
gagggtcattttcctttctgt

SEQ ID NO: 263317 - DNA, 17 bp, Homo sapiens
gagggtctatggggaga

SEQ ID NO: 263318 - DNA, 11 bp, Homo sapiens
gagggtgactg

SEQ ID NO: 263319 - DNA, 14 bp, Homo sapiens
gagggtggttcctg

SEQ ID NO: 263320 - DNA, 24 bp, Homo sapiens
gagggttcctcttaggtcagatgg

SEQ ID NO: 263321 - DNA, 15 bp, Homo sapiens
gagggttctaagtgg

SEQ ID NO: 263322 - DNA, 14 bp, Homo sapiens
gagggttggggagg

SEQ ID NO: 263323 - DNA, 17 bp, Homo sapiens
gagggttgttctcctag

SEQ ID NO: 263324 - DNA, 14 bp, Homo sapiens
gaggtagagagggg

SEQ ID NO: 263325 - DNA, 17 bp, Homo sapiens
tcagcattctcactcct

SEQ ID NO: 263326 - DNA, 23 bp, Homo sapiens
gagtgagaataattgtgtacaaa

SEQ ID NO: 263327 - DNA, 19 bp, Homo sapiens
gagtgagacaaaattttag

SEQ ID NO: 263328 - DNA, 17 bp, Homo sapiens
gagtgagactcctgatt

SEQ ID NO: 263329 - DNA, 22 bp, Homo sapiens
gagtgagagagagtgagagcac

SEQ ID NO: 263330 - DNA, 23 bp, Homo sapiens
gagtgagcagtagaagcctgcag

SEQ ID NO: 263331 - DNA, 16 bp, Homo sapiens
gagtgcagaacacctg

SEQ ID NO: 263332 - DNA, 14 bp, Homo sapiens
gagtgccccacctg

SEQ ID NO: 263333 - DNA, 13 bp, Homo sapiens
tcagggcccagag

SEQ ID NO: 263334 - DNA, 17 bp, Homo sapiens
tcagggcccagaggctg

SEQ ID NO: 263335 - DNA, 11 bp, Homo sapiens
tcagggccttg

SEQ ID NO: 263336 - DNA, 12 bp, Homo sapiens
tcagggctggcc

SEQ ID NO: 263337 - DNA, 18 bp, Homo sapiens
tcagggctggcccgggga

SEQ ID NO: 263338 - DNA, 13 bp, Homo sapiens
tcagggctgggca

SEQ ID NO: 263339 - DNA, 12 bp, Homo sapiens
tcagggggccag

SEQ ID NO: 263340 - DNA, 13 bp, Homo sapiens
tcagggtggctgg

SEQ ID NO: 263341 - DNA, 23 bp, Homo sapiens
tcaggtaggcccttgtcctgcca

SEQ ID NO: 263342 - DNA, 14 bp, Homo sapiens
tcaggtagtactgg

SEQ ID NO: 263343 - DNA, 19 bp, Homo sapiens
tcaggtagttgcaattgaa

SEQ ID NO: 263344 - DNA, 12 bp, Homo sapiens
tcaggtccctgc

SEQ ID NO: 263345 - DNA, 13 bp, Homo sapiens
tcaggtgaataac

SEQ ID NO: 263346 - DNA, 16 bp, Homo sapiens
tcaggtgccactccct

SEQ ID NO: 263347 - DNA, 21 bp, Homo sapiens
tcaggtgccactccctgagct

SEQ ID NO: 263348 - DNA, 21 bp, Homo sapiens
tcaggttccagaacagccctc

SEQ ID NO: 263349 - DNA, 18 bp, Homo sapiens
tcaggtttgcctgagggc

SEQ ID NO: 263350 - DNA, 16 bp, Homo sapiens
tcagtaaataatgaaa

SEQ ID NO: 263351 - DNA, 15 bp, Homo sapiens
tcagtaacagggcct

SEQ ID NO: 263352 - DNA, 16 bp, Homo sapiens
tcagtaagtataacaa

SEQ ID NO: 263353 - DNA, 14 bp, Homo sapiens
tcagtaatagctga

SEQ ID NO: 263354 - DNA, 14 bp, Homo sapiens
tcagtaccaaagaa

SEQ ID NO: 263355 - DNA, 16 bp, Homo sapiens
tcagtaggtccaaggg

SEQ ID NO: 263356 - DNA, 17 bp, Homo sapiens
tcagtaggtccaagggc

SEQ ID NO: 263357 - DNA, 22 bp, Homo sapiens
tcagtagtgccagaaagagaga

SEQ ID NO: 263358 - DNA, 13 bp, Homo sapiens
tcagtatactgtg

SEQ ID NO: 263359 - DNA, 14 bp, Homo sapiens
tcagtatactgtgt

SEQ ID NO: 263360 - DNA, 15 bp, Homo sapiens
tcagtatactgtgtg

SEQ ID NO: 263361 - DNA, 20 bp, Homo sapiens
tcagtatcaaggctgcctgg

SEQ ID NO: 263362 - DNA, 21 bp, Homo sapiens
tcagtatcaaggctgcctgga

SEQ ID NO: 263363 - DNA, 14 bp, Homo sapiens
tcagtatcatctcc

SEQ ID NO: 263364 - DNA, 18 bp, Homo sapiens
tcagtatctgtatctctc

SEQ ID NO: 263365 - DNA, 20 bp, Homo sapiens
tcagtatctgtatctctctc

SEQ ID NO: 263366 - DNA, 16 bp, Homo sapiens
tcagtatgtattcttt

SEQ ID NO: 263367 - DNA, 13 bp, Homo sapiens
tcagtattaaact

SEQ ID NO: 263368 - DNA, 16 bp, Homo sapiens
tcagtattaaactctc

SEQ ID NO: 263369 - DNA, 22 bp, Homo sapiens
tcagtattaaaggggggagggg

SEQ ID NO: 263370 - DNA, 20 bp, Homo sapiens
tcagtattcccagccttgag

SEQ ID NO: 263371 - DNA, 19 bp, Homo sapiens
tcagtattgagacactgtc

SEQ ID NO: 263372 - DNA, 22 bp, Homo sapiens
tcagtattgagacactgtcaag

SEQ ID NO: 263373 - DNA, 22 bp, Homo sapiens
tcagtattttggagaaattatt

SEQ ID NO: 263374 - DNA, 23 bp, Homo sapiens
tcagtattttggagaaattattt

SEQ ID NO: 263375 - DNA, 19 bp, Homo sapiens
tcagtcaagttccgtctcc

SEQ ID NO: 263376 - DNA, 22 bp, Homo sapiens
tcagtcaagttccgtctcctct

SEQ ID NO: 263377 - DNA, 23 bp, Homo sapiens
tcagtcaagttccgtctcctctc

SEQ ID NO: 263378 - DNA, 13 bp, Homo sapiens
tcagtcagttccc

SEQ ID NO: 263379 - DNA, 15 bp, Homo sapiens
tcagtcagttcccgg

SEQ ID NO: 263380 - DNA, 21 bp, Homo sapiens
tcagtccacccccattgtgaa

SEQ ID NO: 263381 - DNA, 13 bp, Homo sapiens
tcagtccctgagc

SEQ ID NO: 263382 - DNA, 23 bp, Homo sapiens
tcagtctccctttcccttcttgg

SEQ ID NO: 263383 - DNA, 12 bp, Homo sapiens
tcagtctctgca

SEQ ID NO: 263384 - DNA, 15 bp, Homo sapiens
tcagtctttggggga

SEQ ID NO: 263385 - DNA, 23 bp, Homo sapiens
tcagtctttgggggattcaaatg

SEQ ID NO: 263386 - DNA, 23 bp, Homo sapiens
tcagtgaactaatttggttttta

SEQ ID NO: 263387 - DNA, 17 bp, Homo sapiens
tcagtgaagcccaggag

SEQ ID NO: 263388 - DNA, 16 bp, Homo sapiens
tcagtgaatataaatg

SEQ ID NO: 263389 - DNA, 18 bp, Homo sapiens
tcagtgaatataaatgta

SEQ ID NO: 263390 - DNA, 17 bp, Homo sapiens
tcagtgagcccctcccc

SEQ ID NO: 263391 - DNA, 14 bp, Homo sapiens
tcagtgataaagcg

SEQ ID NO: 263392 - DNA, 12 bp, Homo sapiens
tcagtgatggga

SEQ ID NO: 263393 - DNA, 19 bp, Homo sapiens
tcagtgatgtaccatgaaa

SEQ ID NO: 263394 - DNA, 17 bp, Homo sapiens
tcagtgccacttgacat

SEQ ID NO: 263395 - DNA, 22 bp, Homo sapiens
tcagtgccacttgacattcctt

SEQ ID NO: 263396 - DNA, 13 bp, Homo sapiens
tcagtgcctcctg

SEQ ID NO: 263397 - DNA, 17 bp, Homo sapiens
tcagtgctagcttattt

SEQ ID NO: 263398 - DNA, 12 bp, Homo sapiens
tcagtgcttctt

SEQ ID NO: 263399 - DNA, 11 bp, Homo sapiens
tcagtggatca

SEQ ID NO: 263400 - DNA, 19 bp, Homo sapiens
tcagtgggcaggataaact

SEQ ID NO: 263401 - DNA, 14 bp, Homo sapiens
tcagtggggcccca

SEQ ID NO: 263402 - DNA, 19 bp, Homo sapiens
tcagtgtagccccaagaag

SEQ ID NO: 263403 - DNA, 12 bp, Homo sapiens
tcagtgtatcta

SEQ ID NO: 263404 - DNA, 20 bp, Homo sapiens
tcagtgtcatttatgaaaag

SEQ ID NO: 263405 - DNA, 17 bp, Homo sapiens
tcagtgtcctcagggct

SEQ ID NO: 263406 - DNA, 14 bp, Homo sapiens
tcagtgtcctcatc

SEQ ID NO: 263407 - DNA, 15 bp, Homo sapiens
tcagtgtgaagcctg

SEQ ID NO: 263408 - DNA, 13 bp, Homo sapiens
tcagtgtgactga

SEQ ID NO: 263409 - DNA, 17 bp, Homo sapiens
tcagtgtgactgatctc

SEQ ID NO: 263410 - DNA, 18 bp, Homo sapiens
tcagtgtgactgatctct

SEQ ID NO: 263411 - DNA, 23 bp, Homo sapiens
tcagtgtgccaccctctgcaggg

SEQ ID NO: 263412 - DNA, 24 bp, Homo sapiens
tcagtgtgccaccctctgcagggc

SEQ ID NO: 263413 - DNA, 22 bp, Homo sapiens
tcagtgtggactgggaagcatt

SEQ ID NO: 263414 - DNA, 13 bp, Homo sapiens
tcagtgtggagag

SEQ ID NO: 263415 - DNA, 23 bp, Homo sapiens
tcagtgtggagaggggtgcaccc

SEQ ID NO: 263416 - DNA, 15 bp, Homo sapiens
tcagtgtgttgactt

SEQ ID NO: 263417 - DNA, 16 bp, Homo sapiens
tcagtgttaaaaaatt

SEQ ID NO: 263418 - DNA, 13 bp, Homo sapiens
tcagtgttataaa

SEQ ID NO: 263419 - DNA, 15 bp, Homo sapiens
tcagtgttataaaat

SEQ ID NO: 263420 - DNA, 18 bp, Homo sapiens
tcagtgttataaaatctg

SEQ ID NO: 263421 - DNA, 11 bp, Homo sapiens
tcagtgtttaa

SEQ ID NO: 263422 - DNA, 14 bp, Homo sapiens
tcagttaagaaaaa

SEQ ID NO: 263423 - DNA, 15 bp, Homo sapiens
tcagttaagaaaaaa

SEQ ID NO: 263424 - DNA, 20 bp, Homo sapiens
tcagttcccggagcacagcc

SEQ ID NO: 263425 - DNA, 15 bp, Homo sapiens
tcagttcccttggcc

SEQ ID NO: 263426 - DNA, 17 bp, Homo sapiens
tcagttcccttggcctc

SEQ ID NO: 263427 - DNA, 21 bp, Homo sapiens
tcagttcctctttgcatggaa

SEQ ID NO: 263428 - DNA, 18 bp, Homo sapiens
tcagttggaattgaagac

SEQ ID NO: 263429 - DNA, 12 bp, Homo sapiens
tcagttggagaa

SEQ ID NO: 263430 - DNA, 16 bp, Homo sapiens
tcagttggagaaaatg

SEQ ID NO: 263431 - DNA, 17 bp, Homo sapiens
tcagttgttagtgtgtc

SEQ ID NO: 263432 - DNA, 19 bp, Homo sapiens
tcagttgttagtgtgtctt

SEQ ID NO: 263433 - DNA, 14 bp, Homo sapiens
tcagtttggctgta

SEQ ID NO: 263434 - DNA, 17 bp, Homo sapiens
tcagttttatcattttc

SEQ ID NO: 263435 - DNA, 12 bp, Homo sapiens
tcagttttccta

SEQ ID NO: 263436 - DNA, 20 bp, Homo sapiens
tcagttttcctagtctttgg

SEQ ID NO: 263437 - DNA, 13 bp, Homo sapiens
tcagttttgtgta

SEQ ID NO: 263438 - DNA, 23 bp, Homo sapiens
tcagtttttgctgattgctaagg

SEQ ID NO: 263439 - DNA, 13 bp, Homo sapiens
tcataaaaataac

SEQ ID NO: 263440 - DNA, 12 bp, Homo sapiens
tcataaaataaa

SEQ ID NO: 263441 - DNA, 21 bp, Homo sapiens
tcataaacaacttaatgttct

SEQ ID NO: 263442 - DNA, 23 bp, Homo sapiens
tcataaattggctcctttcccac

SEQ ID NO: 263443 - DNA, 23 bp, Homo sapiens
tcataaatttgttgtcatgtgta

SEQ ID NO: 263444 - DNA, 24 bp, Homo sapiens
tcataaatttgttgtcatgtgtat

SEQ ID NO: 263445 - DNA, 12 bp, Homo sapiens
tcataacaatgt

SEQ ID NO: 263446 - DNA, 21 bp, Homo sapiens
tcataagatattctttacaaa

SEQ ID NO: 263447 - DNA, 13 bp, Homo sapiens
tcataaggcctgc

SEQ ID NO: 263448 - DNA, 18 bp, Homo sapiens
tcataaggcctgccctcc

SEQ ID NO: 263449 - DNA, 19 bp, Homo sapiens
tcatacagcactacttact

SEQ ID NO: 263450 - DNA, 19 bp, Homo sapiens
tcatacatttgtggtctga

SEQ ID NO: 263451 - DNA, 16 bp, Homo sapiens
tcatacgcatggtcct

SEQ ID NO: 263452 - DNA, 16 bp, Homo sapiens
tcatactctgttgcct

SEQ ID NO: 263453 - DNA, 19 bp, Homo sapiens
tcatactctgttgcctcct

SEQ ID NO: 263454 - DNA, 20 bp, Homo sapiens
tcatactctgttgcctcctc

SEQ ID NO: 263455 - DNA, 17 bp, Homo sapiens
tcatactgaaattgttt

SEQ ID NO: 263456 - DNA, 17 bp, Homo sapiens
tcatactgtcatataat

SEQ ID NO: 263457 - DNA, 13 bp, Homo sapiens
tccaagcctgcct

SEQ ID NO: 263458 - DNA, 12 bp, Homo sapiens
tccaagcctggg

SEQ ID NO: 263459 - DNA, 14 bp, Homo sapiens
tccaagcctgggcc

SEQ ID NO: 263460 - DNA, 20 bp, Homo sapiens
tccaagcctgggccactggc

SEQ ID NO: 263461 - DNA, 22 bp, Homo sapiens
tccaagcctgggccactggcat

SEQ ID NO: 263462 - DNA, 14 bp, Homo sapiens
tccaaggagaccaa

SEQ ID NO: 263463 - DNA, 23 bp, Homo sapiens
tccaaggagaccaagtcctggct

SEQ ID NO: 263464 - DNA, 13 bp, Homo sapiens
tccaaggcaaatg

SEQ ID NO: 263465 - DNA, 14 bp, Homo sapiens
tccaaggcaaatgt

SEQ ID NO: 263466 - DNA, 18 bp, Homo sapiens
tccaaggcaaatgtccaa

SEQ ID NO: 263467 - DNA, 22 bp, Homo sapiens
tccaagggtatgggaagccata

SEQ ID NO: 263468 - DNA, 15 bp, Homo sapiens
tccaagtcaacactc

SEQ ID NO: 263469 - DNA, 16 bp, Homo sapiens
tccaagtccaacctgc

SEQ ID NO: 263470 - DNA, 18 bp, Homo sapiens
tccaagtctctctgtgaa

SEQ ID NO: 263471 - DNA, 17 bp, Homo sapiens
tccaagtgtgtgtgcaa

SEQ ID NO: 263472 - DNA, 18 bp, Homo sapiens
tccaagtgtgtgtgcaat

SEQ ID NO: 263473 - DNA, 20 bp, Homo sapiens
tccaagtgtgtgtgcaatgt

SEQ ID NO: 263474 - DNA, 18 bp, Homo sapiens
tccaagtgtgtgtgcgtg

SEQ ID NO: 263475 - DNA, 15 bp, Homo sapiens
tccaagtgtttcttg

SEQ ID NO: 263476 - DNA, 18 bp, Homo sapiens
tccaagttcttcacctct

SEQ ID NO: 263477 - DNA, 19 bp, Homo sapiens
tccaagttcttcacctcta

SEQ ID NO: 263478 - DNA, 16 bp, Homo sapiens
tccaagttggactggg

SEQ ID NO: 263479 - DNA, 18 bp, Homo sapiens
tccaatcctcactgggtg

SEQ ID NO: 263480 - DNA, 15 bp, Homo sapiens
tccaatgtgcccagt

SEQ ID NO: 263481 - DNA, 18 bp, Homo sapiens
tccaatgtgcccagtcat

SEQ ID NO: 263482 - DNA, 20 bp, Homo sapiens
tccaatgtgcccagtcatga

SEQ ID NO: 263483 - DNA, 18 bp, Homo sapiens
gatctgatggtgagctgg

SEQ ID NO: 263484 - DNA, 20 bp, Homo sapiens
gatctgatggtgagctggga

SEQ ID NO: 263485 - DNA, 22 bp, Homo sapiens
gatctgatggtgagctgggaag

SEQ ID NO: 263486 - DNA, 15 bp, Homo sapiens
gatctgcctgggcct

SEQ ID NO: 263487 - DNA, 21 bp, Homo sapiens
gatctgcctgggcctgtgcag

SEQ ID NO: 263488 - DNA, 22 bp, Homo sapiens
gatctgcctgggcctgtgcagc

SEQ ID NO: 263489 - DNA, 15 bp, Homo sapiens
gatctgctccatgca

SEQ ID NO: 263490 - DNA, 17 bp, Homo sapiens
gatctggaaagagctgt

SEQ ID NO: 263491 - DNA, 15 bp, Homo sapiens
gatctggagtctgaa

SEQ ID NO: 263492 - DNA, 17 bp, Homo sapiens
gatctggagtctgaagg

SEQ ID NO: 263493 - DNA, 17 bp, Homo sapiens
gatctgggaactcccaa

SEQ ID NO: 263494 - DNA, 19 bp, Homo sapiens
gatctgggaactcccaaga

SEQ ID NO: 263495 - DNA, 17 bp, Homo sapiens
gatctggggctctggga

SEQ ID NO: 263496 - DNA, 21 bp, Homo sapiens
gatctgtagacttctggttgt

SEQ ID NO: 263497 - DNA, 14 bp, Homo sapiens
gatctgtgccccat

SEQ ID NO: 263498 - DNA, 18 bp, Homo sapiens
gatctgtgccccatgcct

SEQ ID NO: 263499 - DNA, 16 bp, Homo sapiens
gatcttacaagtttat

SEQ ID NO: 263500 - DNA, 15 bp, Homo sapiens
gatcttccttccgct

SEQ ID NO: 263501 - DNA, 23 bp, Homo sapiens
gatcttccttccgctctgaggca

SEQ ID NO: 263502 - DNA, 15 bp, Homo sapiens
gatcttctgaaatga

SEQ ID NO: 263503 - DNA, 18 bp, Homo sapiens
gatcttctgaaatgaaac

SEQ ID NO: 263504 - DNA, 18 bp, Homo sapiens
gatcttgagagctgctga

SEQ ID NO: 263505 - DNA, 11 bp, Homo sapiens
gatctttacat

SEQ ID NO: 263506 - DNA, 21 bp, Homo sapiens
gatctttcgttggttgtttct

SEQ ID NO: 263507 - DNA, 23 bp, Homo sapiens
gatctttcgttggttgtttctct

SEQ ID NO: 263508 - DNA, 19 bp, Homo sapiens
gatgaaaaaaagggaaaac

SEQ ID NO: 263509 - DNA, 16 bp, Homo sapiens
gatgaaaataaaataa

SEQ ID NO: 263510 - DNA, 15 bp, Homo sapiens
gatgaaaatttgaga

SEQ ID NO: 263511 - DNA, 16 bp, Homo sapiens
gatgaaactcacaaat

SEQ ID NO: 263512 - DNA, 20 bp, Homo sapiens
gatgaaagacaaagaaggaa

SEQ ID NO: 263513 - DNA, 16 bp, Homo sapiens
gatgaactgagaaggt

SEQ ID NO: 263514 - DNA, 13 bp, Homo sapiens
gatgaactttctc

SEQ ID NO: 263515 - DNA, 20 bp, Homo sapiens
gatgaagaaaagtgggccag

SEQ ID NO: 263516 - DNA, 22 bp, Homo sapiens
gatgaagaacacagcatgtgcc

SEQ ID NO: 263517 - DNA, 23 bp, Homo sapiens
gatgaaggtcatctttttcccct

SEQ ID NO: 263518 - DNA, 12 bp, Homo sapiens
gatgaataaaca

SEQ ID NO: 263519 - DNA, 21 bp, Homo sapiens
gatgaatcagtatgaagacac

SEQ ID NO: 263520 - DNA, 22 bp, Homo sapiens
gatgaatcagtatgaagacact

SEQ ID NO: 263521 - DNA, 22 bp, Homo sapiens
gatgaattgtaaaagcaacatc

SEQ ID NO: 263522 - DNA, 21 bp, Homo sapiens
gatgacaaagaaaatgagaat

SEQ ID NO: 263523 - DNA, 23 bp, Homo sapiens
gatgacaacctgtgtgagagaat

SEQ ID NO: 263524 - DNA, 17 bp, Homo sapiens
gatgacaacttcccagt

SEQ ID NO: 263525 - DNA, 15 bp, Homo sapiens
gatgacacataaatc

SEQ ID NO: 263526 - DNA, 13 bp, Homo sapiens
gatgacagggagc

SEQ ID NO: 263527 - DNA, 18 bp, Homo sapiens
gatgaccaatctctgtga

SEQ ID NO: 263528 - DNA, 14 bp, Homo sapiens
gatgaccaggacta

SEQ ID NO: 263529 - DNA, 16 bp, Homo sapiens
gatgacccctccccta

SEQ ID NO: 263530 - DNA, 22 bp, Homo sapiens
gatgacctccttagaaaagact

SEQ ID NO: 263531 - DNA, 21 bp, Homo sapiens
gatgacgacgacaacgatgat

SEQ ID NO: 263532 - DNA, 18 bp, Homo sapiens
gatgactcccttaaaata

SEQ ID NO: 263533 - DNA, 21 bp, Homo sapiens
gatgactcccttaaaatagaa

SEQ ID NO: 263534 - DNA, 19 bp, Homo sapiens
gatgagaaacaacagaaac

SEQ ID NO: 263535 - DNA, 18 bp, Homo sapiens
gatgagaagttaagcagc

SEQ ID NO: 263536 - DNA, 17 bp, Homo sapiens
gatgagacagggttttt

SEQ ID NO: 263537 - DNA, 16 bp, Homo sapiens
gatgagatttgccagc

SEQ ID NO: 263538 - DNA, 21 bp, Homo sapiens
gatgagatttgccagcacagg

SEQ ID NO: 263539 - DNA, 12 bp, Homo sapiens
gatgagcagcag

SEQ ID NO: 263540 - DNA, 21 bp, Homo sapiens
gatgagcccagccctgttctg

SEQ ID NO: 263541 - DNA, 16 bp, Homo sapiens
gatgagccccacgtgg

SEQ ID NO: 263542 - DNA, 22 bp, Homo sapiens
gatgagccttcgtgccccccct

SEQ ID NO: 263543 - DNA, 17 bp, Homo sapiens
gatgagctgaaaagtga

SEQ ID NO: 263544 - DNA, 11 bp, Homo sapiens
gatgagctggt

SEQ ID NO: 263545 - DNA, 21 bp, Homo sapiens
gatgaggccgctagaggcctg

SEQ ID NO: 263546 - DNA, 22 bp, Homo sapiens
gatgaggccgctagaggcctga

SEQ ID NO: 263547 - DNA, 19 bp, Homo sapiens
gatgagggtgtccgctgct

SEQ ID NO: 263548 - DNA, 16 bp, Homo sapiens
gatgaggtgctgggag

SEQ ID NO: 263549 - DNA, 22 bp, Homo sapiens
gatgagtgggaggcgtgccccc

SEQ ID NO: 263550 - DNA, 19 bp, Homo sapiens
gatgatcagctgtttgtca

SEQ ID NO: 263551 - DNA, 16 bp, Homo sapiens
gatgatgctgtgacaa

SEQ ID NO: 263552 - DNA, 22 bp, Homo sapiens
gatgatgcttgtaacaagaaaa

SEQ ID NO: 263553 - DNA, 17 bp, Homo sapiens
gatgatgggaattgtgt

SEQ ID NO: 263554 - DNA, 22 bp, Homo sapiens
gatgatggttgcaaaagactaa

SEQ ID NO: 263555 - DNA, 20 bp, Homo sapiens
gatgatgtctcttgtagaag

SEQ ID NO: 263556 - DNA, 21 bp, Homo sapiens
gatgatgtgatggaacacaca

SEQ ID NO: 263557 - DNA, 14 bp, Homo sapiens
gatgattaaacacc

SEQ ID NO: 263558 - DNA, 16 bp, Homo sapiens
gatgattaaacacctg

SEQ ID NO: 263559 - DNA, 17 bp, Homo sapiens
gatgattaaacacctga

SEQ ID NO: 263560 - DNA, 12 bp, Homo sapiens
gatgatttcaga

SEQ ID NO: 263561 - DNA, 15 bp, Homo sapiens
gatgatttgggggag

SEQ ID NO: 263562 - DNA, 14 bp, Homo sapiens
gatgcaaggaccag

SEQ ID NO: 263563 - DNA, 15 bp, Homo sapiens
gatgcaagtgtttct

SEQ ID NO: 263564 - DNA, 19 bp, Homo sapiens
gatgcaagtgtttctgttc

SEQ ID NO: 263565 - DNA, 19 bp, Homo sapiens
gatgcacagatgccatggc

SEQ ID NO: 263566 - DNA, 15 bp, Homo sapiens
gatgcacggtttctg

SEQ ID NO: 263567 - DNA, 17 bp, Homo sapiens
gatgcacggtttctgtt

SEQ ID NO: 263568 - DNA, 19 bp, Homo sapiens
gatgcactcgcactgcaaa

SEQ ID NO: 263569 - DNA, 15 bp, Homo sapiens
gatgcactgacctgc

SEQ ID NO: 263570 - DNA, 21 bp, Homo sapiens
gatgcatcgttttctttgctg

SEQ ID NO: 263571 - DNA, 20 bp, Homo sapiens
gatgcatgatccagctgtgt

SEQ ID NO: 263572 - DNA, 20 bp, Homo sapiens
gatgcatggcctctaagagt

SEQ ID NO: 263573 - DNA, 17 bp, Homo sapiens
gatgccaaggagcccct

SEQ ID NO: 263574 - DNA, 17 bp, Homo sapiens
gatgccatctgtgtcct

SEQ ID NO: 263575 - DNA, 18 bp, Homo sapiens
gatgccatctgtgtcctg

SEQ ID NO: 263576 - DNA, 21 bp, Homo sapiens
gatgccatctgtgtcctggtt

SEQ ID NO: 263577 - DNA, 13 bp, Homo sapiens
gatgcccacccct

SEQ ID NO: 263578 - DNA, 12 bp, Homo sapiens
gatgccctgcta

SEQ ID NO: 263579 - DNA, 17 bp, Homo sapiens
gatgcctcttctacctc

SEQ ID NO: 263580 - DNA, 15 bp, Homo sapiens
gatgcctttgctgtt

SEQ ID NO: 263581 - DNA, 13 bp, Homo sapiens
gatgcgccttgct

SEQ ID NO: 263582 - DNA, 21 bp, Homo sapiens
gatgcggtggctcacgcctgt

SEQ ID NO: 263583 - DNA, 19 bp, Homo sapiens
gatgcgtctacccagactc

SEQ ID NO: 263584 - DNA, 20 bp, Homo sapiens
gatgcgttgttacaggaagt

SEQ ID NO: 263585 - DNA, 18 bp, Homo sapiens
gatgctatggtcaggtta

SEQ ID NO: 263586 - DNA, 12 bp, Homo sapiens
tccaggcccagc

SEQ ID NO: 263587 - DNA, 18 bp, Homo sapiens
tccaggcccagcctggcc

SEQ ID NO: 263588 - DNA, 20 bp, Homo sapiens
tccaggcctgaggctgctga

SEQ ID NO: 263589 - DNA, 16 bp, Homo sapiens
tccaggcgtagggcca

SEQ ID NO: 263590 - DNA, 21 bp, Homo sapiens
tccaggcgtagggccagggct

SEQ ID NO: 263591 - DNA, 20 bp, Homo sapiens
tccaggctagtccggaccca

SEQ ID NO: 263592 - DNA, 17 bp, Homo sapiens
tccaggctccaggctga

SEQ ID NO: 263593 - DNA, 22 bp, Homo sapiens
tccaggctgactgggggcctct

SEQ ID NO: 263594 - DNA, 12 bp, Homo sapiens
tccaggctgggg

SEQ ID NO: 263595 - DNA, 19 bp, Homo sapiens
tccaggctggggcctggcc

SEQ ID NO: 263596 - DNA, 12 bp, Homo sapiens
tccagggaagct

SEQ ID NO: 263597 - DNA, 17 bp, Homo sapiens
tccagggaagctggccg

SEQ ID NO: 263598 - DNA, 18 bp, Homo sapiens
tccagggaagctggccga

SEQ ID NO: 263599 - DNA, 23 bp, Homo sapiens
tccagggaagctggccgagggtc

SEQ ID NO: 263600 - DNA, 14 bp, Homo sapiens
tccagggactgaag

SEQ ID NO: 263601 - DNA, 17 bp, Homo sapiens
tccagggagcaagacag

SEQ ID NO: 263602 - DNA, 15 bp, Homo sapiens
tccagggcccccacc

SEQ ID NO: 263603 - DNA, 15 bp, Homo sapiens
tccagggctcccgga

SEQ ID NO: 263604 - DNA, 13 bp, Homo sapiens
tccagggcttcag

SEQ ID NO: 263605 - DNA, 21 bp, Homo sapiens
tccaggggcccttgggacagc

SEQ ID NO: 263606 - DNA, 17 bp, Homo sapiens
tccagggtctttactgg

SEQ ID NO: 263607 - DNA, 16 bp, Homo sapiens
tccaggtatgggacct

SEQ ID NO: 263608 - DNA, 16 bp, Homo sapiens
tccaggtcctttcctt

SEQ ID NO: 263609 - DNA, 18 bp, Homo sapiens
tccaggtcctttccttct

SEQ ID NO: 263610 - DNA, 19 bp, Homo sapiens
tccaggtcctttccttctc

SEQ ID NO: 263611 - DNA, 20 bp, Homo sapiens
tccaggtcctttccttctcg

SEQ ID NO: 263612 - DNA, 16 bp, Homo sapiens
tccaggtctcactgct

SEQ ID NO: 263613 - DNA, 19 bp, Homo sapiens
tccaggtgccctgtgggag

SEQ ID NO: 263614 - DNA, 23 bp, Homo sapiens
tccaggttcgtatagaaaaagca

SEQ ID NO: 263615 - DNA, 18 bp, Homo sapiens
tccagtacgtcccgctgc

SEQ ID NO: 263616 - DNA, 20 bp, Homo sapiens
tccagtacgtcccgctgctg

SEQ ID NO: 263617 - DNA, 14 bp, Homo sapiens
tccagtatcttgaa

SEQ ID NO: 263618 - DNA, 17 bp, Homo sapiens
tccagtccccctatcct

SEQ ID NO: 263619 - DNA, 22 bp, Homo sapiens
tccagtccccctatccttggca

SEQ ID NO: 263620 - DNA, 23 bp, Homo sapiens
tccagtccccctatccttggcac

SEQ ID NO: 263621 - DNA, 13 bp, Homo sapiens
tccagtcctgctc

SEQ ID NO: 263622 - DNA, 22 bp, Homo sapiens
tccagtctgctgccctccatcc

SEQ ID NO: 263623 - DNA, 15 bp, Homo sapiens
tccagtctgttctca

SEQ ID NO: 263624 - DNA, 17 bp, Homo sapiens
tccagtgcttggctgcc

SEQ ID NO: 263625 - DNA, 18 bp, Homo sapiens
tccagtgcttggctgccc

SEQ ID NO: 263626 - DNA, 19 bp, Homo sapiens
tccagtgcttggctgcccc

SEQ ID NO: 263627 - DNA, 21 bp, Homo sapiens
tccagtgcttggctgccccac

SEQ ID NO: 263628 - DNA, 16 bp, Homo sapiens
gattccggccctggct

SEQ ID NO: 263629 - DNA, 19 bp, Homo sapiens
gattcctacttaaacaaaa

SEQ ID NO: 263630 - DNA, 14 bp, Homo sapiens
gattcctgggcctg

SEQ ID NO: 263631 - DNA, 19 bp, Homo sapiens
gattctaaaacattcttta

SEQ ID NO: 263632 - DNA, 19 bp, Homo sapiens
gattctaaaggggacagat

SEQ ID NO: 263633 - DNA, 19 bp, Homo sapiens
gattctaatttttaagcaa

SEQ ID NO: 263634 - DNA, 17 bp, Homo sapiens
gattctactcttgtcat

SEQ ID NO: 263635 - DNA, 22 bp, Homo sapiens
gattctactttaagcactacat

SEQ ID NO: 263636 - DNA, 18 bp, Homo sapiens
gattctatgcctgtattt

SEQ ID NO: 263637 - DNA, 22 bp, Homo sapiens
gattctatgcctgtatttccaa

SEQ ID NO: 263638 - DNA, 16 bp, Homo sapiens
gattctcctgtgctag

SEQ ID NO: 263639 - DNA, 16 bp, Homo sapiens
gattctgggaaaggtg

SEQ ID NO: 263640 - DNA, 22 bp, Homo sapiens
gattctgggaaaggtgctcaaa

SEQ ID NO: 263641 - DNA, 12 bp, Homo sapiens
gattctgggaag

SEQ ID NO: 263642 - DNA, 14 bp, Homo sapiens
gattctgtccccca

SEQ ID NO: 263643 - DNA, 23 bp, Homo sapiens
gattctgtcttccaggcccagtc

SEQ ID NO: 263644 - DNA, 19 bp, Homo sapiens
gattctgtgtgttttcata

SEQ ID NO: 263645 - DNA, 17 bp, Homo sapiens
gattcttaccctttctt

SEQ ID NO: 263646 - DNA, 18 bp, Homo sapiens
gattctttaaactactga

SEQ ID NO: 263647 - DNA, 13 bp, Homo sapiens
gattctttcccca

SEQ ID NO: 263648 - DNA, 21 bp, Homo sapiens
gattcttttttcttccccctc

SEQ ID NO: 263649 - DNA, 17 bp, Homo sapiens
gattgaaaaaagagaaa

SEQ ID NO: 263650 - DNA, 16 bp, Homo sapiens
gattgaaaagaagaaa

SEQ ID NO: 263651 - DNA, 15 bp, Homo sapiens
gattgaagtctgata

SEQ ID NO: 263652 - DNA, 18 bp, Homo sapiens
gattgacattttgtagct

SEQ ID NO: 263653 - DNA, 19 bp, Homo sapiens
gattgatttgaagtggaaa

SEQ ID NO: 263654 - DNA, 17 bp, Homo sapiens
gattgcacgtggcctct

SEQ ID NO: 263655 - DNA, 19 bp, Homo sapiens
gattgcacgtggcctcttg

SEQ ID NO: 263656 - DNA, 20 bp, Homo sapiens
gattgcacgtggcctcttga

SEQ ID NO: 263657 - DNA, 16 bp, Homo sapiens
gattgccatttcttcc

SEQ ID NO: 263658 - DNA, 16 bp, Homo sapiens
gattgccccagagccc

SEQ ID NO: 263659 - DNA, 21 bp, Homo sapiens
gattgctcagagaaatatgca

SEQ ID NO: 263660 - DNA, 18 bp, Homo sapiens
gattgctctggaagcctg

SEQ ID NO: 263661 - DNA, 11 bp, Homo sapiens
gattgctgcca

SEQ ID NO: 263662 - DNA, 13 bp, Homo sapiens
gattggaaagaca

SEQ ID NO: 263663 - DNA, 16 bp, Homo sapiens
gattggaaagacagga

SEQ ID NO: 263664 - DNA, 23 bp, Homo sapiens
gattggacataactgacttagtt

SEQ ID NO: 263665 - DNA, 14 bp, Homo sapiens
gattggacattttc

SEQ ID NO: 263666 - DNA, 16 bp, Homo sapiens
gattggacggcctgat

SEQ ID NO: 263667 - DNA, 23 bp, Homo sapiens
gattggacggcctgatgctccct

SEQ ID NO: 263668 - DNA, 15 bp, Homo sapiens
gattggattattcat

SEQ ID NO: 263669 - DNA, 13 bp, Homo sapiens
gattggcatggct

SEQ ID NO: 263670 - DNA, 14 bp, Homo sapiens
gattgggggctggt

SEQ ID NO: 263671 - DNA, 17 bp, Homo sapiens
gattgggggggcttggg

SEQ ID NO: 263672 - DNA, 19 bp, Homo sapiens
gattgggtgggcaggaaaa

SEQ ID NO: 263673 - DNA, 20 bp, Homo sapiens
gattgggtgggcaggaaaag

SEQ ID NO: 263674 - DNA, 14 bp, Homo sapiens
gattggtaccagag

SEQ ID NO: 263675 - DNA, 15 bp, Homo sapiens
gattgtaacatattt

SEQ ID NO: 263676 - DNA, 11 bp, Homo sapiens
gattgtaactc

SEQ ID NO: 263677 - DNA, 22 bp, Homo sapiens
gattgtacagaatcattgctta

SEQ ID NO: 263678 - DNA, 20 bp, Homo sapiens
gattgtacatatggaaatcc

SEQ ID NO: 263679 - DNA, 20 bp, Homo sapiens
gattgtaggtgcaagatgga

SEQ ID NO: 263680 - DNA, 21 bp, Homo sapiens
gattgtgaatatttccatatg

SEQ ID NO: 263681 - DNA, 12 bp, Homo sapiens
gattgttttatc

SEQ ID NO: 263682 - DNA, 14 bp, Homo sapiens
gatttaaactctta

SEQ ID NO: 263683 - DNA, 18 bp, Homo sapiens
gatttaacagtcatttaa

SEQ ID NO: 263684 - DNA, 20 bp, Homo sapiens
gatttaccttttctgttgta

SEQ ID NO: 263685 - DNA, 15 bp, Homo sapiens
gatttagaactgtat

SEQ ID NO: 263686 - DNA, 16 bp, Homo sapiens
gatttatataaatgta

SEQ ID NO: 263687 - DNA, 17 bp, Homo sapiens
gatttatcacacaaagc

SEQ ID NO: 263688 - DNA, 14 bp, Homo sapiens
gatttattatgaac

SEQ ID NO: 263689 - DNA, 16 bp, Homo sapiens
gatttatttggagtgg

SEQ ID NO: 263690 - DNA, 14 bp, Homo sapiens
gatttattttgtta

SEQ ID NO: 263691 - DNA, 15 bp, Homo sapiens
gatttcaagggactg

SEQ ID NO: 263692 - DNA, 17 bp, Homo sapiens
gatttcaagggactggg

SEQ ID NO: 263693 - DNA, 19 bp, Homo sapiens
gatttcatgattagacaat

SEQ ID NO: 263694 - DNA, 21 bp, Homo sapiens
gatttcatttcaactgtttgc

SEQ ID NO: 263695 - DNA, 14 bp, Homo sapiens
gatttccatttctg

SEQ ID NO: 263696 - DNA, 15 bp, Homo sapiens
gatttccatttctga

SEQ ID NO: 263697 - DNA, 14 bp, Homo sapiens
gatttctaatcaaa

SEQ ID NO: 263698 - DNA, 16 bp, Homo sapiens
gatttctacaactgat

SEQ ID NO: 263699 - DNA, 22 bp, Homo sapiens
gatttctacaactgatcatttg

SEQ ID NO: 263700 - DNA, 20 bp, Homo sapiens
gatttctagaaaagcttcct

SEQ ID NO: 263701 - DNA, 18 bp, Homo sapiens
gatttctagcaggcagga

SEQ ID NO: 263702 - DNA, 11 bp, Homo sapiens
gatttctccca

SEQ ID NO: 263703 - DNA, 21 bp, Homo sapiens
gatttcttgctaagctccagc

SEQ ID NO: 263704 - DNA, 14 bp, Homo sapiens
gatttgaaaacacc

SEQ ID NO: 263705 - DNA, 16 bp, Homo sapiens
gatttgaactgagccg

SEQ ID NO: 263706 - DNA, 14 bp, Homo sapiens
gatttgagtttcct

SEQ ID NO: 263707 - DNA, 12 bp, Homo sapiens
gatttgccagca

SEQ ID NO: 263708 - DNA, 14 bp, Homo sapiens
gatttgccagcaca

SEQ ID NO: 263709 - DNA, 17 bp, Homo sapiens
gatttgccagcacaggg

SEQ ID NO: 263710 - DNA, 13 bp, Homo sapiens
gatttggaagaga

SEQ ID NO: 263711 - DNA, 21 bp, Homo sapiens
gatttggaagagaggcacctg

SEQ ID NO: 263712 - DNA, 23 bp, Homo sapiens
gatttggaagagaggcacctgct

SEQ ID NO: 263713 - DNA, 21 bp, Homo sapiens
gatttgtaatatgattttata

SEQ ID NO: 263714 - DNA, 22 bp, Homo sapiens
gatttgtatttatattagagtg

SEQ ID NO: 263715 - DNA, 23 bp, Homo sapiens
gattttaaattacacagttcaca

SEQ ID NO: 263716 - DNA, 15 bp, Homo sapiens
gcttaatctagagct

SEQ ID NO: 263717 - DNA, 13 bp, Homo sapiens
gcttaatgtcagt

SEQ ID NO: 263718 - DNA, 17 bp, Homo sapiens
gcttaatgtttattcct

SEQ ID NO: 263719 - DNA, 23 bp, Homo sapiens
gcttaatgtttattcctgataat

SEQ ID NO: 263720 - DNA, 13 bp, Homo sapiens
gcttaattgtgaa

SEQ ID NO: 263721 - DNA, 18 bp, Homo sapiens
gcttaatttctaaagata

SEQ ID NO: 263722 - DNA, 13 bp, Homo sapiens
gcttacaagccag

SEQ ID NO: 263723 - DNA, 19 bp, Homo sapiens
gcttacaagccagctggag

SEQ ID NO: 263724 - DNA, 19 bp, Homo sapiens
gcttacaattccctgctgt

SEQ ID NO: 263725 - DNA, 20 bp, Homo sapiens
gcttacaattccctgctgtc

SEQ ID NO: 263726 - DNA, 15 bp, Homo sapiens
gcttacatagtttta

SEQ ID NO: 263727 - DNA, 11 bp, Homo sapiens
gcttacatttt

SEQ ID NO: 263728 - DNA, 23 bp, Homo sapiens
gcttagacttcgactcaggatcc

SEQ ID NO: 263729 - DNA, 13 bp, Homo sapiens
gcttagagacagt

SEQ ID NO: 263730 - DNA, 21 bp, Homo sapiens
gcttagccttgtgccctgccc

SEQ ID NO: 263731 - DNA, 16 bp, Homo sapiens
gcttaggtgccaggct

SEQ ID NO: 263732 - DNA, 20 bp, Homo sapiens
gcttatacacttacacttta

SEQ ID NO: 263733 - DNA, 20 bp, Homo sapiens
gcttatatttgacattcttc

SEQ ID NO: 263734 - DNA, 20 bp, Homo sapiens
gcttatgtgttgcataaaca

SEQ ID NO: 263735 - DNA, 16 bp, Homo sapiens
gcttattctcaaagca

SEQ ID NO: 263736 - DNA, 13 bp, Homo sapiens
gcttattgtgtga

SEQ ID NO: 263737 - DNA, 14 bp, Homo sapiens
gcttattgttccaa

SEQ ID NO: 263738 - DNA, 17 bp, Homo sapiens
gcttattgttccaagac

SEQ ID NO: 263739 - DNA, 21 bp, Homo sapiens
gcttattgttccaagacattg

SEQ ID NO: 263740 - DNA, 20 bp, Homo sapiens
gcttatttagcacattttga

SEQ ID NO: 263741 - DNA, 13 bp, Homo sapiens
gcttatttatatt

SEQ ID NO: 263742 - DNA, 12 bp, Homo sapiens
gcttatttctaa

SEQ ID NO: 263743 - DNA, 16 bp, Homo sapiens
gcttcaaaatagagaa

SEQ ID NO: 263744 - DNA, 18 bp, Homo sapiens
gcttcaagtctgtgcctg

SEQ ID NO: 263745 - DNA, 22 bp, Homo sapiens
gcttcaagtctgtgcctggagc

SEQ ID NO: 263746 - DNA, 12 bp, Homo sapiens
gcttcacacccc

SEQ ID NO: 263747 - DNA, 18 bp, Homo sapiens
gcttcaccagtctgtcta

SEQ ID NO: 263748 - DNA, 15 bp, Homo sapiens
gcttcacccctgcac

SEQ ID NO: 263749 - DNA, 23 bp, Homo sapiens
gcttcacggacaggaagcacagc

SEQ ID NO: 263750 - DNA, 20 bp, Homo sapiens
gcttcacggactctttgctg

SEQ ID NO: 263751 - DNA, 17 bp, Homo sapiens
gcttcagacctccctcc

SEQ ID NO: 263752 - DNA, 18 bp, Homo sapiens
gcttcagggctgggcagg

SEQ ID NO: 263753 - DNA, 14 bp, Homo sapiens
gcttcataggcaga

SEQ ID NO: 263754 - DNA, 17 bp, Homo sapiens
gcttcataggcagagcc

SEQ ID NO: 263755 - DNA, 15 bp, Homo sapiens
gcttcatatctctcc

SEQ ID NO: 263756 - DNA, 16 bp, Homo sapiens
gcttcatgcctttgta

SEQ ID NO: 263757 - DNA, 20 bp, Homo sapiens
gcttcattctcactctgctt

SEQ ID NO: 263758 - DNA, 22 bp, Homo sapiens
gcttccagattgacgacaagtg

SEQ ID NO: 263759 - DNA, 21 bp, Homo sapiens
gcttccagcgggccctctgcc

SEQ ID NO: 263760 - DNA, 11 bp, Homo sapiens
gcttccaggct

SEQ ID NO: 263761 - DNA, 17 bp, Homo sapiens
gcttccatttgtgtgtg

SEQ ID NO: 263762 - DNA, 23 bp, Homo sapiens
gcttcccacctccctgcccaggc

SEQ ID NO: 263763 - DNA, 12 bp, Homo sapiens
gcttcccaggac

SEQ ID NO: 263764 - DNA, 13 bp, Homo sapiens
gcttcccaggacc

SEQ ID NO: 263765 - DNA, 15 bp, Homo sapiens
gcttcccaggaccct

SEQ ID NO: 263766 - DNA, 20 bp, Homo sapiens
gcttcccaggaccctgggtc

SEQ ID NO: 263767 - DNA, 19 bp, Homo sapiens
gcttcccattgtggctcct

SEQ ID NO: 263768 - DNA, 16 bp, Homo sapiens
gcttcccgctcagccc

SEQ ID NO: 263769 - DNA, 21 bp, Homo sapiens
gcttccctacccacagggcct

SEQ ID NO: 263770 - DNA, 15 bp, Homo sapiens
gcttccctctgcctg

SEQ ID NO: 263771 - DNA, 20 bp, Homo sapiens
gcttccctctgcctgtccct

SEQ ID NO: 263772 - DNA, 16 bp, Homo sapiens
gcttccgcacatgccg

SEQ ID NO: 263773 - DNA, 19 bp, Homo sapiens
gcttccgctgtcacccagc

SEQ ID NO: 263774 - DNA, 16 bp, Homo sapiens
gcttcctaacttattg

SEQ ID NO: 263775 - DNA, 12 bp, Homo sapiens
gcttcctagctt

SEQ ID NO: 263776 - DNA, 21 bp, Homo sapiens
gcttcctagcttatctccctg

SEQ ID NO: 263777 - DNA, 22 bp, Homo sapiens
gcttcctagcttatctccctgc

SEQ ID NO: 263778 - DNA, 23 bp, Homo sapiens
gcttcctagcttatctccctgct

SEQ ID NO: 263779 - DNA, 12 bp, Homo sapiens
gcttcctccaga

SEQ ID NO: 263780 - DNA, 23 bp, Homo sapiens
gcttcctccgtccacccaggctg

SEQ ID NO: 263781 - DNA, 14 bp, Homo sapiens
gcttcctgtccact

SEQ ID NO: 263782 - DNA, 23 bp, Homo sapiens
gcttcctgtccactctcggggcc

SEQ ID NO: 263783 - DNA, 22 bp, Homo sapiens
gcttcctttgtttttttttcct

SEQ ID NO: 263784 - DNA, 23 bp, Homo sapiens
gcttcctttgtttttttttcctg

SEQ ID NO: 263785 - DNA, 16 bp, Homo sapiens
gcttcgcgctggaatc

SEQ ID NO: 263786 - DNA, 16 bp, Homo sapiens
gcttcgtgctggagga

SEQ ID NO: 263787 - DNA, 17 bp, Homo sapiens
gcttctaattttgtgct

SEQ ID NO: 263788 - DNA, 21 bp, Homo sapiens
gcttctaattttgtgctcttt

SEQ ID NO: 263789 - DNA, 18 bp, Homo sapiens
gcttctagaaagcccctc

SEQ ID NO: 263790 - DNA, 20 bp, Homo sapiens
gcttctatcccaggaggtgg

SEQ ID NO: 263791 - DNA, 12 bp, Homo sapiens
gcttctccacct

SEQ ID NO: 263792 - DNA, 13 bp, Homo sapiens
gcttctccacctc

SEQ ID NO: 263793 - DNA, 17 bp, Homo sapiens
gcttctccctggactct

SEQ ID NO: 263794 - DNA, 22 bp, Homo sapiens
gcttctccctggactctgtggg

SEQ ID NO: 263795 - DNA, 19 bp, Homo sapiens
gcttctcctttttagcaag

SEQ ID NO: 263796 - DNA, 19 bp, Homo sapiens
gcttctctgtgaacgattt

SEQ ID NO: 263797 - DNA, 20 bp, Homo sapiens
gcttctcttttcctcgcaga

SEQ ID NO: 263798 - DNA, 15 bp, Homo sapiens
gcttctgacctcagc

SEQ ID NO: 263799 - DNA, 18 bp, Homo sapiens
gcttctgagagcaaaggg

SEQ ID NO: 263800 - DNA, 22 bp, Homo sapiens
gcttctgcggtgaggcagggga

SEQ ID NO: 263801 - DNA, 23 bp, Homo sapiens
gcttctgcggtgaggcaggggag

SEQ ID NO: 263802 - DNA, 19 bp, Homo sapiens
gcttctgctcacattccct

SEQ ID NO: 263803 - DNA, 11 bp, Homo sapiens
gcttctgctgc

SEQ ID NO: 263804 - DNA, 19 bp, Homo sapiens
gcttctgggcctgatggag

SEQ ID NO: 263805 - DNA, 18 bp, Homo sapiens
gcttcttactattaagca

SEQ ID NO: 263806 - DNA, 20 bp, Homo sapiens
gcttcttactattaagcagt

SEQ ID NO: 263807 - DNA, 18 bp, Homo sapiens
gcttcttcaatggcacct

SEQ ID NO: 263808 - DNA, 23 bp, Homo sapiens
gcttcttccccagggttctgtat

SEQ ID NO: 263809 - DNA, 14 bp, Homo sapiens
gcttcttccttctt

SEQ ID NO: 263810 - DNA, 16 bp, Homo sapiens
gcttcttccttcttgt

SEQ ID NO: 263811 - DNA, 15 bp, Homo sapiens
gcttcttgctcctgt

SEQ ID NO: 263812 - DNA, 17 bp, Homo sapiens
gcttcttttgaactgtt

SEQ ID NO: 263813 - DNA, 13 bp, Homo sapiens
gcttgaacccagg

SEQ ID NO: 263814 - DNA, 15 bp, Homo sapiens
gcttgaacctgggaa

SEQ ID NO: 263815 - DNA, 21 bp, Homo sapiens
gcttgaacctgggaagtggag

SEQ ID NO: 263816 - DNA, 21 bp, Homo sapiens
gcttgaagatcgttagtatct

SEQ ID NO: 263817 - DNA, 22 bp, Homo sapiens
gcttgaagatcgttagtatcta

SEQ ID NO: 263818 - DNA, 22 bp, Homo sapiens
gcttgaatgtccccattctata

SEQ ID NO: 263819 - DNA, 19 bp, Homo sapiens
gcttgaccgtactctcaca

SEQ ID NO: 263820 - DNA, 22 bp, Homo sapiens
gcttgaccgtactctcacatgt

SEQ ID NO: 263821 - DNA, 18 bp, Homo sapiens
gcttgacctttaagagaa

SEQ ID NO: 263822 - DNA, 22 bp, Homo sapiens
gcttgacctttaagagaaatga

SEQ ID NO: 263823 - DNA, 15 bp, Homo sapiens
gcttgagcccaggag

SEQ ID NO: 263824 - DNA, 12 bp, Homo sapiens
gcttgagcctcc

SEQ ID NO: 263825 - DNA, 16 bp, Homo sapiens
gcttgagctcccctgg

SEQ ID NO: 263826 - DNA, 20 bp, Homo sapiens
gcttgagctcccctggagcc

SEQ ID NO: 263827 - DNA, 16 bp, Homo sapiens
gcttgccgggcctggg

SEQ ID NO: 263828 - DNA, 17 bp, Homo sapiens
gcttgcctagggcctgg

SEQ ID NO: 263829 - DNA, 21 bp, Homo sapiens
gcttgcctagggcctggtcca

SEQ ID NO: 263830 - DNA, 16 bp, Homo sapiens
gcttgcgtatgtctgt

SEQ ID NO: 263831 - DNA, 12 bp, Homo sapiens
gcttgctgcacc

SEQ ID NO: 263832 - DNA, 12 bp, Homo sapiens
gcttgctgtgtg

SEQ ID NO: 263833 - DNA, 17 bp, Homo sapiens
gcttggacttcctgggg

SEQ ID NO: 263834 - DNA, 11 bp, Homo sapiens
gcttggagcag

SEQ ID NO: 263835 - DNA, 15 bp, Homo sapiens
gcttggagcagagac

SEQ ID NO: 263836 - DNA, 18 bp, Homo sapiens
gcttggccagaagggggc

SEQ ID NO: 263837 - DNA, 15 bp, Homo sapiens
gcttggccttgtgtc

SEQ ID NO: 263838 - DNA, 21 bp, Homo sapiens
gcttggctgccccacaggcca

SEQ ID NO: 263839 - DNA, 15 bp, Homo sapiens
gcttgggccactgcc

SEQ ID NO: 263840 - DNA, 18 bp, Homo sapiens
gcttgggccactgccctc

SEQ ID NO: 263841 - DNA, 22 bp, Homo sapiens
gcttgggccactgccctctcca

SEQ ID NO: 263842 - DNA, 17 bp, Homo sapiens
gcttgggcccagctggg

SEQ ID NO: 263843 - DNA, 23 bp, Homo sapiens
gcttgggcttctgcggtgaggca

SEQ ID NO: 263844 - DNA, 15 bp, Homo sapiens
gcttggggcctggcg

SEQ ID NO: 263845 - DNA, 18 bp, Homo sapiens
gcttggggtagagaggac

SEQ ID NO: 263846 - DNA, 19 bp, Homo sapiens
gcttggtggggctcgtggc

SEQ ID NO: 263847 - DNA, 14 bp, Homo sapiens
gcttgtaacaagaa

SEQ ID NO: 263848 - DNA, 16 bp, Homo sapiens
gcttgtaacaagaaaa

SEQ ID NO: 263849 - DNA, 15 bp, Homo sapiens
gcttgtactaagcca

SEQ ID NO: 263850 - DNA, 19 bp, Homo sapiens
gcttgtactaagccaggag

SEQ ID NO: 263851 - DNA, 20 bp, Homo sapiens
gcttgtactaagccaggagg

SEQ ID NO: 263852 - DNA, 14 bp, Homo sapiens
gcttgtagggtgag

SEQ ID NO: 263853 - DNA, 19 bp, Homo sapiens
gcttgtagggtgaggcgtg

SEQ ID NO: 263854 - DNA, 20 bp, Homo sapiens
gcttgtagggtgaggcgtgg

SEQ ID NO: 263855 - DNA, 14 bp, Homo sapiens
gcttgtatagtgta

SEQ ID NO: 263856 - DNA, 17 bp, Homo sapiens
gcttgtattatcagtga

SEQ ID NO: 263857 - DNA, 13 bp, Homo sapiens
gcttgtcagagct

SEQ ID NO: 263858 - DNA, 16 bp, Homo sapiens
gcttgtcagagctggg

SEQ ID NO: 263859 - DNA, 11 bp, Homo sapiens
gcttgtcatcc

SEQ ID NO: 263860 - DNA, 23 bp, Homo sapiens
gcttgtcatccacacaacaccag

SEQ ID NO: 263861 - DNA, 17 bp, Homo sapiens
gcttgtgatctgggaac

SEQ ID NO: 263862 - DNA, 23 bp, Homo sapiens
gcttgtgatttccatttctgatg

SEQ ID NO: 263863 - DNA, 16 bp, Homo sapiens
gcttgtgcctcccttc

SEQ ID NO: 263864 - DNA, 23 bp, Homo sapiens
gcttgtggattgagggtaggagg

SEQ ID NO: 263865 - DNA, 14 bp, Homo sapiens
gcttgtgggctggt

SEQ ID NO: 263866 - DNA, 16 bp, Homo sapiens
gcttgtgggctggtgc

SEQ ID NO: 263867 - DNA, 17 bp, Homo sapiens
gcttgtgggctggtgcc

SEQ ID NO: 263868 - DNA, 21 bp, Homo sapiens
gcttgtggtcacactgtggaa

SEQ ID NO: 263869 - DNA, 19 bp, Homo sapiens
gcttgtgttgggccccagg

SEQ ID NO: 263870 - DNA, 22 bp, Homo sapiens
gcttgttgtttttaagtcctgt

SEQ ID NO: 263871 - DNA, 20 bp, Homo sapiens
gcttgtttaaggttcttgct

SEQ ID NO: 263872 - DNA, 13 bp, Homo sapiens
gcttgtttacagc

SEQ ID NO: 263873 - DNA, 18 bp, Homo sapiens
gcttgtttccctgctggc

SEQ ID NO: 263874 - DNA, 16 bp, Homo sapiens
gctttaaaaaataaag

SEQ ID NO: 263875 - DNA, 17 bp, Homo sapiens
gctttaaaaaataaagc

SEQ ID NO: 263876 - DNA, 15 bp, Homo sapiens
gctttaatcaatcat

SEQ ID NO: 263877 - DNA, 15 bp, Homo sapiens
gctttacactcattt

SEQ ID NO: 263878 - DNA, 17 bp, Homo sapiens
gctttacatgctgtgct

SEQ ID NO: 263879 - DNA, 14 bp, Homo sapiens
gctttacattttat

SEQ ID NO: 263880 - DNA, 14 bp, Homo sapiens
gctttacctttatt

SEQ ID NO: 263881 - DNA, 23 bp, Homo sapiens
gctttagtcctagaggacctgag

SEQ ID NO: 263882 - DNA, 13 bp, Homo sapiens
gctttatgctgaa

SEQ ID NO: 263883 - DNA, 17 bp, Homo sapiens
gctttattttttaagta

SEQ ID NO: 263884 - DNA, 21 bp, Homo sapiens
gctttattttttaagtattta

SEQ ID NO: 263885 - DNA, 20 bp, Homo sapiens
gctttcaacttaaatcactg

SEQ ID NO: 263886 - DNA, 13 bp, Homo sapiens
gctttcagagcca

SEQ ID NO: 263887 - DNA, 15 bp, Homo sapiens
gctttcatcctgtgt

SEQ ID NO: 263888 - DNA, 22 bp, Homo sapiens
gctttcatcctgtgtcccctga

SEQ ID NO: 263889 - DNA, 22 bp, Homo sapiens
gctttcatgaccactgggcctg

SEQ ID NO: 263890 - DNA, 23 bp, Homo sapiens
gctttcatgaccactgggcctgc

SEQ ID NO: 263891 - DNA, 12 bp, Homo sapiens
gctttcatgatt

SEQ ID NO: 263892 - DNA, 23 bp, Homo sapiens
gctttccagaaggccacaggcca

SEQ ID NO: 263893 - DNA, 19 bp, Homo sapiens
gctttccagggtctttact

SEQ ID NO: 263894 - DNA, 11 bp, Homo sapiens
gctttcccagg

SEQ ID NO: 263895 - DNA, 12 bp, Homo sapiens
gctttcccaggt

SEQ ID NO: 263896 - DNA, 12 bp, Homo sapiens
gctttccctggc

SEQ ID NO: 263897 - DNA, 15 bp, Homo sapiens
gctttccctggctca

SEQ ID NO: 263898 - DNA, 14 bp, Homo sapiens
gctttccggggagg

SEQ ID NO: 263899 - DNA, 23 bp, Homo sapiens
gctttcctggagagtctcactcc

SEQ ID NO: 263900 - DNA, 20 bp, Homo sapiens
gctttctattacccctcatt

SEQ ID NO: 263901 - DNA, 23 bp, Homo sapiens
gctttctccggggtctgtgctgt

SEQ ID NO: 263902 - DNA, 15 bp, Homo sapiens
gctttctctttcagt

SEQ ID NO: 263903 - DNA, 22 bp, Homo sapiens
gctttctctttggtttctcatc

SEQ ID NO: 263904 - DNA, 22 bp, Homo sapiens
gctttcttctacaaccagagcc

SEQ ID NO: 263905 - DNA, 17 bp, Homo sapiens
gctttcttgctggttgt

SEQ ID NO: 263906 - DNA, 15 bp, Homo sapiens
gctttgaaggaacca

SEQ ID NO: 263907 - DNA, 19 bp, Homo sapiens
gctttgaaggaaccaagtg

SEQ ID NO: 263908 - DNA, 15 bp, Homo sapiens
gctttgattgttcat

SEQ ID NO: 263909 - DNA, 18 bp, Homo sapiens
gctttgcaccgtggtcag

SEQ ID NO: 263910 - DNA, 17 bp, Homo sapiens
gctttgcagccaaggtg

SEQ ID NO: 263911 - DNA, 16 bp, Homo sapiens
gctttgcaggctctgg

SEQ ID NO: 263912 - DNA, 17 bp, Homo sapiens
gctttgcaggctctggg

SEQ ID NO: 263913 - DNA, 21 bp, Homo sapiens
gctttgcaggctctgggctca

SEQ ID NO: 263914 - DNA, 14 bp, Homo sapiens
gctttgcagggaga

SEQ ID NO: 263915 - DNA, 22 bp, Homo sapiens
gctttgccttccacgctgtctc

SEQ ID NO: 263916 - DNA, 24 bp, Homo sapiens
gctttgccttccacgctgtctcca

SEQ ID NO: 263917 - DNA, 22 bp, Homo sapiens
gctttgctgctaccgccctggg

SEQ ID NO: 263918 - DNA, 12 bp, Homo sapiens
gctttgcttctt

SEQ ID NO: 263919 - DNA, 19 bp, Homo sapiens
gctttggctgactgggaac

SEQ ID NO: 263920 - DNA, 21 bp, Homo sapiens
gctttgggaacactggcctgg

SEQ ID NO: 263921 - DNA, 22 bp, Homo sapiens
gctttgggaacactggcctggg

SEQ ID NO: 263922 - DNA, 22 bp, Homo sapiens
gctttgggaatgtttttagctg

SEQ ID NO: 263923 - DNA, 17 bp, Homo sapiens
gctttgggaggccaagg

SEQ ID NO: 263924 - DNA, 18 bp, Homo sapiens
gctttgggaggccaaggc

SEQ ID NO: 263925 - DNA, 20 bp, Homo sapiens
gctttgggctttgcaggctc

SEQ ID NO: 263926 - DNA, 22 bp, Homo sapiens
gctttgggctttgcaggctctg

SEQ ID NO: 263927 - DNA, 15 bp, Homo sapiens
gctttgtcccacagc

SEQ ID NO: 263928 - DNA, 16 bp, Homo sapiens
gctttgtgtgattgaa

SEQ ID NO: 263929 - DNA, 12 bp, Homo sapiens
gctttgttaatg

SEQ ID NO: 263930 - DNA, 22 bp, Homo sapiens
gctttgttcttgtcatcagtaa

SEQ ID NO: 263931 - DNA, 20 bp, Homo sapiens
gcttttaaactggagaggct

SEQ ID NO: 263932 - DNA, 12 bp, Homo sapiens
gcttttaagaaa

SEQ ID NO: 263933 - DNA, 14 bp, Homo sapiens
gcttttaataaaat

SEQ ID NO: 263934 - DNA, 13 bp, Homo sapiens
gcttttactttat

SEQ ID NO: 263935 - DNA, 19 bp, Homo sapiens
gcttttagtacccacctga

SEQ ID NO: 263936 - DNA, 22 bp, Homo sapiens
gcttttagtacccacctgagct

SEQ ID NO: 263937 - DNA, 16 bp, Homo sapiens
gcttttatatggccca

SEQ ID NO: 263938 - DNA, 22 bp, Homo sapiens
gcttttatatggcccagccttg

SEQ ID NO: 263939 - DNA, 22 bp, Homo sapiens
gcttttatattctaaattttta

SEQ ID NO: 263940 - DNA, 15 bp, Homo sapiens
gcttttatttcagtg

SEQ ID NO: 263941 - DNA, 18 bp, Homo sapiens
gcttttattttttaagtt

SEQ ID NO: 263942 - DNA, 21 bp, Homo sapiens
gcttttattttttaagttcaa

SEQ ID NO: 263943 - DNA, 22 bp, Homo sapiens
gcttttattttttaagttcaat

SEQ ID NO: 263944 - DNA, 15 bp, Homo sapiens
gcttttccaggatcc

SEQ ID NO: 263945 - DNA, 20 bp, Homo sapiens
gcttttccaggatcctgcag

SEQ ID NO: 263946 - DNA, 20 bp, Homo sapiens
gcttttcccaccagctccca

SEQ ID NO: 263947 - DNA, 15 bp, Homo sapiens
gcttttcttgccagc

SEQ ID NO: 263948 - DNA, 17 bp, Homo sapiens
gcttttcttgccagctc

SEQ ID NO: 263949 - DNA, 14 bp, Homo sapiens
gcttttgatggcta

SEQ ID NO: 263950 - DNA, 13 bp, Homo sapiens
gcttttgtagatg

SEQ ID NO: 263951 - DNA, 15 bp, Homo sapiens
ggaaggaaataacat

SEQ ID NO: 263952 - DNA, 23 bp, Homo sapiens
ggaaggaccaacccatgccctgc

SEQ ID NO: 263953 - DNA, 13 bp, Homo sapiens
ggaaggagagagg

SEQ ID NO: 263954 - DNA, 14 bp, Homo sapiens
ggaaggagagaggt

SEQ ID NO: 263955 - DNA, 13 bp, Homo sapiens
ggaaggagagcct

SEQ ID NO: 263956 - DNA, 17 bp, Homo sapiens
ggaaggagagcctgctg

SEQ ID NO: 263957 - DNA, 14 bp, Homo sapiens
ggaaggagcctgcg

SEQ ID NO: 263958 - DNA, 17 bp, Homo sapiens
ggaaggagcctgcggct

SEQ ID NO: 263959 - DNA, 21 bp, Homo sapiens
ggaaggagcctgcggctgctg

SEQ ID NO: 263960 - DNA, 19 bp, Homo sapiens
ggaaggagggagctgctca

SEQ ID NO: 263961 - DNA, 19 bp, Homo sapiens
ggaaggaggggaagctgca

SEQ ID NO: 263962 - DNA, 14 bp, Homo sapiens
ggaaggccacctgc

SEQ ID NO: 263963 - DNA, 17 bp, Homo sapiens
ggaaggccacctgcagg

SEQ ID NO: 263964 - DNA, 23 bp, Homo sapiens
ggaaggccacctgcaggtcactg

SEQ ID NO: 263965 - DNA, 16 bp, Homo sapiens
ggaaggcctgagggaa

SEQ ID NO: 263966 - DNA, 19 bp, Homo sapiens
ggaaggcggggcttcaacc

SEQ ID NO: 263967 - DNA, 21 bp, Homo sapiens
ggaaggctaagttcagttctg

SEQ ID NO: 263968 - DNA, 12 bp, Homo sapiens
ggaaggctggct

SEQ ID NO: 263969 - DNA, 13 bp, Homo sapiens
ggaaggctggctg

SEQ ID NO: 263970 - DNA, 14 bp, Homo sapiens
ggaaggctggctga

SEQ ID NO: 263971 - DNA, 15 bp, Homo sapiens
ggaaggctggctgag

SEQ ID NO: 263972 - DNA, 18 bp, Homo sapiens
ggaagggactggtccagg

SEQ ID NO: 263973 - DNA, 15 bp, Homo sapiens
ggaagggagaggagg

SEQ ID NO: 263974 - DNA, 12 bp, Homo sapiens
ggaagggcagga

SEQ ID NO: 263975 - DNA, 11 bp, Homo sapiens
ggaagggccag

SEQ ID NO: 263976 - DNA, 17 bp, Homo sapiens
ggaagggccagagcctg

SEQ ID NO: 263977 - DNA, 20 bp, Homo sapiens
ggaaggggctggactggctg

SEQ ID NO: 263978 - DNA, 18 bp, Homo sapiens
ggaagggtttgtggctgg

SEQ ID NO: 263979 - DNA, 20 bp, Homo sapiens
ggaaggtgatgggggcatgg

SEQ ID NO: 263980 - DNA, 15 bp, Homo sapiens
ggaaggtgctgagct

SEQ ID NO: 263981 - DNA, 16 bp, Homo sapiens
ggaagtagcaggccca

SEQ ID NO: 263982 - DNA, 17 bp, Homo sapiens
ggaagtagcaggcccag

SEQ ID NO: 263983 - DNA, 13 bp, Homo sapiens
ggaagtcaggagc

SEQ ID NO: 263984 - DNA, 21 bp, Homo sapiens
ggaagtcaggagccagcaggg

SEQ ID NO: 263985 - DNA, 12 bp, Homo sapiens
ggaagtcatggg

SEQ ID NO: 263986 - DNA, 19 bp, Homo sapiens
ggaagtgggagaagtggcc

SEQ ID NO: 263987 - DNA, 21 bp, Homo sapiens
ggaagtgtaacagctgaggtc

SEQ ID NO: 263988 - DNA, 12 bp, Homo sapiens
ggaagtgttcaa

SEQ ID NO: 263989 - DNA, 16 bp, Homo sapiens
ggaagtgttcaagaaa

SEQ ID NO: 263990 - DNA, 17 bp, Homo sapiens
ggaagttgctgtgcccc

SEQ ID NO: 263991 - DNA, 20 bp, Homo sapiens
ggaataaggccttaatatgt

SEQ ID NO: 263992 - DNA, 20 bp, Homo sapiens
gctgagatgtttagtagctg

SEQ ID NO: 263993 - DNA, 22 bp, Homo sapiens
gctgagcaggacgttaggcccg

SEQ ID NO: 263994 - DNA, 17 bp, Homo sapiens
gctgagccactcgcagt

SEQ ID NO: 263995 - DNA, 21 bp, Homo sapiens
gctgagcccctaccccacacc

SEQ ID NO: 263996 - DNA, 21 bp, Homo sapiens
gctgagcccctcctctcctcg

SEQ ID NO: 263997 - DNA, 23 bp, Homo sapiens
gctgagcctactgtctccttccc

SEQ ID NO: 263998 - DNA, 12 bp, Homo sapiens
gctgagcctgag

SEQ ID NO: 263999 - DNA, 21 bp, Homo sapiens
gctgagcctgaggccttccag

SEQ ID NO: 264000 - DNA, 18 bp, Homo sapiens
gctgagctctgacctgcc

SEQ ID NO: 264001 - DNA, 14 bp, Homo sapiens
gctgagctgagctt

SEQ ID NO: 264002 - DNA, 11 bp, Homo sapiens
gctgagctgga

SEQ ID NO: 264003 - DNA, 14 bp, Homo sapiens
gctgagctggccta

SEQ ID NO: 264004 - DNA, 23 bp, Homo sapiens
gctgagcttagccttgtgccctg

SEQ ID NO: 264005 - DNA, 20 bp, Homo sapiens
gctgagcttcggttctccag

SEQ ID NO: 264006 - DNA, 20 bp, Homo sapiens
gctgaggacggggcagagct

SEQ ID NO: 264007 - DNA, 14 bp, Homo sapiens
gctgaggactccct

SEQ ID NO: 264008 - DNA, 22 bp, Homo sapiens
gctgaggccattccctgtagga

SEQ ID NO: 264009 - DNA, 15 bp, Homo sapiens
gctgagggcagggtt

SEQ ID NO: 264010 - DNA, 11 bp, Homo sapiens
gctgaggggca

SEQ ID NO: 264011 - DNA, 17 bp, Homo sapiens
gctgaggtctcttgagg

SEQ ID NO: 264012 - DNA, 22 bp, Homo sapiens
gctgagtactcaggccactcca

SEQ ID NO: 264013 - DNA, 18 bp, Homo sapiens
gctgagtcacctcctcca

SEQ ID NO: 264014 - DNA, 13 bp, Homo sapiens
gctgagtctggct

SEQ ID NO: 264015 - DNA, 14 bp, Homo sapiens
gctgagtctggcta

SEQ ID NO: 264016 - DNA, 15 bp, Homo sapiens
gctgagtctggctag

SEQ ID NO: 264017 - DNA, 16 bp, Homo sapiens
gctgagtgcagaggct

SEQ ID NO: 264018 - DNA, 15 bp, Homo sapiens
gctgagtggtccaca

SEQ ID NO: 264019 - DNA, 23 bp, Homo sapiens
gctgagttacttgtctgaggcct

SEQ ID NO: 264020 - DNA, 20 bp, Homo sapiens
gctgagttttctctttgtgg

SEQ ID NO: 264021 - DNA, 22 bp, Homo sapiens
gctgataatgtatatgaactta

SEQ ID NO: 264022 - DNA, 12 bp, Homo sapiens
gctgatgaaact

SEQ ID NO: 264023 - DNA, 22 bp, Homo sapiens
gctgatgaaactcctgattttg

SEQ ID NO: 264024 - DNA, 14 bp, Homo sapiens
gctgattcccagag

SEQ ID NO: 264025 - DNA, 16 bp, Homo sapiens
gctgatttccaggccc

SEQ ID NO: 264026 - DNA, 18 bp, Homo sapiens
gctgatttccaggcccct

SEQ ID NO: 264027 - DNA, 19 bp, Homo sapiens
gctgatttcccttttttct

SEQ ID NO: 264028 - DNA, 14 bp, Homo sapiens
gctgattttaacaa

SEQ ID NO: 264029 - DNA, 17 bp, Homo sapiens
gctgattttctctggca

SEQ ID NO: 264030 - DNA, 23 bp, Homo sapiens
gctgcaaaaccggcaacctgtaa

SEQ ID NO: 264031 - DNA, 15 bp, Homo sapiens
gctgcaaaggacaga

SEQ ID NO: 264032 - DNA, 13 bp, Homo sapiens
gctgcaatacatt

SEQ ID NO: 264033 - DNA, 15 bp, Homo sapiens
gctgcaatgcctaga

SEQ ID NO: 264034 - DNA, 17 bp, Homo sapiens
gctgcaatgcctagact

SEQ ID NO: 264035 - DNA, 13 bp, Homo sapiens
gctgcacattcct

SEQ ID NO: 264036 - DNA, 17 bp, Homo sapiens
gctgcacattcctggcc

SEQ ID NO: 264037 - DNA, 22 bp, Homo sapiens
gctgcaccaacctcactgccct

SEQ ID NO: 264038 - DNA, 14 bp, Homo sapiens
gctgcaccagagtg

SEQ ID NO: 264039 - DNA, 16 bp, Homo sapiens
gctgcaccagagtgaa

SEQ ID NO: 264040 - DNA, 23 bp, Homo sapiens
gctgcacctcctaccctcccacc

SEQ ID NO: 264041 - DNA, 17 bp, Homo sapiens
gctgcagacaaaaagaa

SEQ ID NO: 264042 - DNA, 18 bp, Homo sapiens
gctgcagagacagagagg

SEQ ID NO: 264043 - DNA, 17 bp, Homo sapiens
gctgcagcgcctcctgg

SEQ ID NO: 264044 - DNA, 15 bp, Homo sapiens
gctgcagctgggccc

SEQ ID NO: 264045 - DNA, 19 bp, Homo sapiens
gctgcagctgggccccatg

SEQ ID NO: 264046 - DNA, 21 bp, Homo sapiens
gctgcagctgggccccatgct

SEQ ID NO: 264047 - DNA, 22 bp, Homo sapiens
gctgcagctgggccccatgctc

SEQ ID NO: 264048 - DNA, 10 bp, Homo sapiens
gctgcagctt

SEQ ID NO: 264049 - DNA, 18 bp, Homo sapiens
gctgcagttgaagagcct

SEQ ID NO: 264050 - DNA, 18 bp, Homo sapiens
gctgcagttgtgaaagca

SEQ ID NO: 264051 - DNA, 17 bp, Homo sapiens
gctgcatagctctattt

SEQ ID NO: 264052 - DNA, 20 bp, Homo sapiens
gctgcatcctcagccccagg

SEQ ID NO: 264053 - DNA, 22 bp, Homo sapiens
gctgcatcctcagccccagggc

SEQ ID NO: 264054 - DNA, 19 bp, Homo sapiens
gctgcatggacgcctggct

SEQ ID NO: 264055 - DNA, 21 bp, Homo sapiens
gctgcatggacgcctggctcc

SEQ ID NO: 264056 - DNA, 23 bp, Homo sapiens
gctgcatggacgcctggctccag

SEQ ID NO: 264057 - DNA, 14 bp, Homo sapiens
gctgccaaaaagaa

SEQ ID NO: 264058 - DNA, 17 bp, Homo sapiens
gctgccaaggccagagt

SEQ ID NO: 264059 - DNA, 16 bp, Homo sapiens
gctgccaagtgctctt

SEQ ID NO: 264060 - DNA, 17 bp, Homo sapiens
gctgccacacttcaggc

SEQ ID NO: 264061 - DNA, 19 bp, Homo sapiens
gctgccaccaaatctgtct

SEQ ID NO: 264062 - DNA, 20 bp, Homo sapiens
gctgccaccacgtctgccag

SEQ ID NO: 264063 - DNA, 23 bp, Homo sapiens
gctgccaccacgtctgccaggcc

SEQ ID NO: 264064 - DNA, 12 bp, Homo sapiens
gctgccagagaa

SEQ ID NO: 264065 - DNA, 20 bp, Homo sapiens
gctgccaggcgttggtgcca

SEQ ID NO: 264066 - DNA, 16 bp, Homo sapiens
gctgccagtgctggtc

SEQ ID NO: 264067 - DNA, 16 bp, Homo sapiens
gctgccataattctaa

SEQ ID NO: 264068 - DNA, 15 bp, Homo sapiens
gctgccatgccactg

SEQ ID NO: 264069 - DNA, 17 bp, Homo sapiens
gctgccatgtgaagagg

SEQ ID NO: 264070 - DNA, 21 bp, Homo sapiens
gctgccatgtgaagagggaga

SEQ ID NO: 264071 - DNA, 13 bp, Homo sapiens
gctgcccacacca

SEQ ID NO: 264072 - DNA, 19 bp, Homo sapiens
gctgcccacgctcctgccc

SEQ ID NO: 264073 - DNA, 16 bp, Homo sapiens
gctgcccacggccacc

SEQ ID NO: 264074 - DNA, 13 bp, Homo sapiens
gctgcccagccct

SEQ ID NO: 264075 - DNA, 15 bp, Homo sapiens
gctgcccagccctcc

SEQ ID NO: 264076 - DNA, 18 bp, Homo sapiens
gctgcccagccctcccag

SEQ ID NO: 264077 - DNA, 14 bp, Homo sapiens
gctgccccacccct

SEQ ID NO: 264078 - DNA, 21 bp, Homo sapiens
gctgccccagctgactgtggc

SEQ ID NO: 264079 - DNA, 15 bp, Homo sapiens
gctgcccccagaccc

SEQ ID NO: 264080 - DNA, 14 bp, Homo sapiens
gctgcccccgctca

SEQ ID NO: 264081 - DNA, 20 bp, Homo sapiens
gctgccccgttccctgtcag

SEQ ID NO: 264082 - DNA, 19 bp, Homo sapiens
gctgcccctgtaggttgct

SEQ ID NO: 264083 - DNA, 18 bp, Homo sapiens
gctgcccctgtctggaag

SEQ ID NO: 264084 - DNA, 15 bp, Homo sapiens
gctgccctaggctcc

SEQ ID NO: 264085 - DNA, 18 bp, Homo sapiens
gctgccgcctcccagcct

SEQ ID NO: 264086 - DNA, 19 bp, Homo sapiens
gctgccgcctcccagcctg

SEQ ID NO: 264087 - DNA, 20 bp, Homo sapiens
gctgccgcctcccagcctgg

SEQ ID NO: 264088 - DNA, 15 bp, Homo sapiens
gctgccggctgcacc

SEQ ID NO: 264089 - DNA, 20 bp, Homo sapiens
gctgccgtgcacggggccag

SEQ ID NO: 264090 - DNA, 22 bp, Homo sapiens
gctgccgtgcacggggccagca

SEQ ID NO: 264091 - DNA, 12 bp, Homo sapiens
gctgcctccctg

SEQ ID NO: 264092 - DNA, 14 bp, Homo sapiens
gctgcctctgaaaa

SEQ ID NO: 264093 - DNA, 17 bp, Homo sapiens
gctgcctctgaaaatat

SEQ ID NO: 264094 - DNA, 12 bp, Homo sapiens
gctgcctctggg

SEQ ID NO: 264095 - DNA, 21 bp, Homo sapiens
gctgcctgacactgagcccca

SEQ ID NO: 264096 - DNA, 20 bp, Homo sapiens
gctgcctgcccgcacagcag

SEQ ID NO: 264097 - DNA, 15 bp, Homo sapiens
gctgcctgccgccca

SEQ ID NO: 264098 - DNA, 13 bp, Homo sapiens
gctgcctgcctcc

SEQ ID NO: 264099 - DNA, 23 bp, Homo sapiens
gctgcctgcctccggccctgccc

SEQ ID NO: 264100 - DNA, 17 bp, Homo sapiens
gctgcctgctctgcagc

SEQ ID NO: 264101 - DNA, 13 bp, Homo sapiens
gctgcctggagaa

SEQ ID NO: 264102 - DNA, 15 bp, Homo sapiens
gctgcctggagaaag

SEQ ID NO: 264103 - DNA, 15 bp, Homo sapiens
gctgcctggcccagg

SEQ ID NO: 264104 - DNA, 17 bp, Homo sapiens
gctgcctggcgggcagc

SEQ ID NO: 264105 - DNA, 18 bp, Homo sapiens
gctgcctggcgggcagcc

SEQ ID NO: 264106 - DNA, 12 bp, Homo sapiens
gctgcctgtagt

SEQ ID NO: 264107 - DNA, 13 bp, Homo sapiens
gctgcctgtagtt

SEQ ID NO: 264108 - DNA, 14 bp, Homo sapiens
gctgccttcaggga

SEQ ID NO: 264109 - DNA, 16 bp, Homo sapiens
gctgccttcagggaga

SEQ ID NO: 264110 - DNA, 15 bp, Homo sapiens
gctgccttcctcatc

SEQ ID NO: 264111 - DNA, 16 bp, Homo sapiens
gctgccttcctcatcc

SEQ ID NO: 264112 - DNA, 19 bp, Homo sapiens
gctgccttctgacggccct

SEQ ID NO: 264113 - DNA, 20 bp, Homo sapiens
gctgccttctgacggccctg

SEQ ID NO: 264114 - DNA, 21 bp, Homo sapiens
gctgccttctgacggccctgc

SEQ ID NO: 264115 - DNA, 20 bp, Homo sapiens
gctgccttgtagatggagca

SEQ ID NO: 264116 - DNA, 15 bp, Homo sapiens
gctgcgaactgtgca

SEQ ID NO: 264117 - DNA, 13 bp, Homo sapiens
gctgcgcctgccc

SEQ ID NO: 264118 - DNA, 16 bp, Homo sapiens
gctgcgcctgcccgcc

SEQ ID NO: 264119 - DNA, 16 bp, Homo sapiens
gctgcgggtctgaagg

SEQ ID NO: 264120 - DNA, 22 bp, Homo sapiens
gctgcgggtgggtatcccacct

SEQ ID NO: 264121 - DNA, 23 bp, Homo sapiens
gctgcgggtgggtatcccacctc

SEQ ID NO: 264122 - DNA, 14 bp, Homo sapiens
gctgcgtgccatca

SEQ ID NO: 264123 - DNA, 17 bp, Homo sapiens
gctgctactacccgagc

SEQ ID NO: 264124 - DNA, 15 bp, Homo sapiens
gctgctcatttcact

SEQ ID NO: 264125 - DNA, 23 bp, Homo sapiens
gctgctcccagccacgttggtgg

SEQ ID NO: 264126 - DNA, 20 bp, Homo sapiens
gcctcagcgctgcccacacc

SEQ ID NO: 264127 - DNA, 16 bp, Homo sapiens
gcctcagctgcctcac

SEQ ID NO: 264128 - DNA, 17 bp, Homo sapiens
gcctcagtccctccctc

SEQ ID NO: 264129 - DNA, 22 bp, Homo sapiens
gcctcagtccctccctcctggc

SEQ ID NO: 264130 - DNA, 19 bp, Homo sapiens
gcctcagtttctccatcag

SEQ ID NO: 264131 - DNA, 17 bp, Homo sapiens
gcctcatccctcggaag

SEQ ID NO: 264132 - DNA, 12 bp, Homo sapiens
gcctcatcctcc

SEQ ID NO: 264133 - DNA, 18 bp, Homo sapiens
gcctcatgccacaccttc

SEQ ID NO: 264134 - DNA, 13 bp, Homo sapiens
gcctcatgggagt

SEQ ID NO: 264135 - DNA, 20 bp, Homo sapiens
gcctcatgggagtcagggag

SEQ ID NO: 264136 - DNA, 21 bp, Homo sapiens
gcctcatgggagtcagggagc

SEQ ID NO: 264137 - DNA, 16 bp, Homo sapiens
gcctccaagcctgcct

SEQ ID NO: 264138 - DNA, 17 bp, Homo sapiens
gcctccaagctccatct

SEQ ID NO: 264139 - DNA, 21 bp, Homo sapiens
gcctccaccgagccagcttgg

SEQ ID NO: 264140 - DNA, 19 bp, Homo sapiens
gcctccactctagttctag

SEQ ID NO: 264141 - DNA, 20 bp, Homo sapiens
gcctccactctagttctaga

SEQ ID NO: 264142 - DNA, 21 bp, Homo sapiens
gcctccactctagttctagat

SEQ ID NO: 264143 - DNA, 13 bp, Homo sapiens
gcctccagagcca

SEQ ID NO: 264144 - DNA, 14 bp, Homo sapiens
gcctccagagccag

SEQ ID NO: 264145 - DNA, 16 bp, Homo sapiens
gcctccagagccagcc

SEQ ID NO: 264146 - DNA, 17 bp, Homo sapiens
gcctccagagccagcct

SEQ ID NO: 264147 - DNA, 20 bp, Homo sapiens
gcctccagagccagcctggg

SEQ ID NO: 264148 - DNA, 14 bp, Homo sapiens
gcctccagccctct

SEQ ID NO: 264149 - DNA, 21 bp, Homo sapiens
gcctccagccctctcactgtg

SEQ ID NO: 264150 - DNA, 14 bp, Homo sapiens
gcctccagcctctc

SEQ ID NO: 264151 - DNA, 16 bp, Homo sapiens
gcctccagcctctccc

SEQ ID NO: 264152 - DNA, 23 bp, Homo sapiens
gcctccagcctctcccggctgcc

SEQ ID NO: 264153 - DNA, 21 bp, Homo sapiens
gcctccaggcaggacgagact

SEQ ID NO: 264154 - DNA, 14 bp, Homo sapiens
gcctccaggctggg

SEQ ID NO: 264155 - DNA, 15 bp, Homo sapiens
gcctccaggctgggg

SEQ ID NO: 264156 - DNA, 16 bp, Homo sapiens
gcctccaggctggggc

SEQ ID NO: 264157 - DNA, 21 bp, Homo sapiens
gcctccaggctggggcctggc

SEQ ID NO: 264158 - DNA, 11 bp, Homo sapiens
gcctccagggc

SEQ ID NO: 264159 - DNA, 13 bp, Homo sapiens
gcctccagggccc

SEQ ID NO: 264160 - DNA, 16 bp, Homo sapiens
gcctccatggtgcctc

SEQ ID NO: 264161 - DNA, 19 bp, Homo sapiens
gcctccatggtgcctctgg

SEQ ID NO: 264162 - DNA, 20 bp, Homo sapiens
gcctcccaagctcagagcag

SEQ ID NO: 264163 - DNA, 20 bp, Homo sapiens
gcctcccaaggtcctctcag

SEQ ID NO: 264164 - DNA, 15 bp, Homo sapiens
gcctcccaataaagc

SEQ ID NO: 264165 - DNA, 19 bp, Homo sapiens
gcctcccaataaagctgga

SEQ ID NO: 264166 - DNA, 23 bp, Homo sapiens
gcctcccacacttgctggggctc

SEQ ID NO: 264167 - DNA, 16 bp, Homo sapiens
gcctcccacgctggga

SEQ ID NO: 264168 - DNA, 14 bp, Homo sapiens
gcctcccagcctgg

SEQ ID NO: 264169 - DNA, 21 bp, Homo sapiens
gcctccccaaccctgcccctg

SEQ ID NO: 264170 - DNA, 23 bp, Homo sapiens
gcctccccacgtggcacctcctc

SEQ ID NO: 264171 - DNA, 14 bp, Homo sapiens
gcctcccccaaagc

SEQ ID NO: 264172 - DNA, 16 bp, Homo sapiens
gcctcccccagccagg

SEQ ID NO: 264173 - DNA, 14 bp, Homo sapiens
gcctcccccaggct

SEQ ID NO: 264174 - DNA, 13 bp, Homo sapiens
gcctccccccaga

SEQ ID NO: 264175 - DNA, 21 bp, Homo sapiens
gcctccccccagaccccgccc

SEQ ID NO: 264176 - DNA, 21 bp, Homo sapiens
gcctccccgggggtccccgga

SEQ ID NO: 264177 - DNA, 13 bp, Homo sapiens
gcctcccctcccc

SEQ ID NO: 264178 - DNA, 21 bp, Homo sapiens
gcctcccctcccctggggacg

SEQ ID NO: 264179 - DNA, 19 bp, Homo sapiens
gcctcccgcatgctgcctg

SEQ ID NO: 264180 - DNA, 21 bp, Homo sapiens
gcctcccgcatgctgcctgcc

SEQ ID NO: 264181 - DNA, 17 bp, Homo sapiens
gcctcccgcctcccccg

SEQ ID NO: 264182 - DNA, 17 bp, Homo sapiens
gcctcccggctttgcag

SEQ ID NO: 264183 - DNA, 16 bp, Homo sapiens
gcctcccgtccgtccg

SEQ ID NO: 264184 - DNA, 23 bp, Homo sapiens
gcctccctctcttccgggagctg

SEQ ID NO: 264185 - DNA, 22 bp, Homo sapiens
gcctccctgaaaatgtttttct

SEQ ID NO: 264186 - DNA, 23 bp, Homo sapiens
gcctccctgaccctgcagagatg

SEQ ID NO: 264187 - DNA, 20 bp, Homo sapiens
gcctcccttcccagtgggct

SEQ ID NO: 264188 - DNA, 15 bp, Homo sapiens
gcctcccttgggctg

SEQ ID NO: 264189 - DNA, 15 bp, Homo sapiens
gcctccctttctggg

SEQ ID NO: 264190 - DNA, 18 bp, Homo sapiens
gcctccgaggctccccgc

SEQ ID NO: 264191 - DNA, 21 bp, Homo sapiens
gcctccgagggacgcggctcc

SEQ ID NO: 264192 - DNA, 12 bp, Homo sapiens
gcctccggcctc

SEQ ID NO: 264193 - DNA, 16 bp, Homo sapiens
gcctccgttcccacct

SEQ ID NO: 264194 - DNA, 23 bp, Homo sapiens
gcctccgttcccacctctgagga

SEQ ID NO: 264195 - DNA, 13 bp, Homo sapiens
gctgggcagctgt

SEQ ID NO: 264196 - DNA, 14 bp, Homo sapiens
gctgggcagggccg

SEQ ID NO: 264197 - DNA, 17 bp, Homo sapiens
gctgggcagggccgcag

SEQ ID NO: 264198 - DNA, 19 bp, Homo sapiens
gctgggccagtggctgggg

SEQ ID NO: 264199 - DNA, 14 bp, Homo sapiens
gctgggcccagaag

SEQ ID NO: 264200 - DNA, 15 bp, Homo sapiens
gctgggcccagaggc

SEQ ID NO: 264201 - DNA, 20 bp, Homo sapiens
gctgggcccagaggcacagc

SEQ ID NO: 264202 - DNA, 21 bp, Homo sapiens
gctgggcccagaggcacagcc

SEQ ID NO: 264203 - DNA, 22 bp, Homo sapiens
gctgggcccagccggggtgggg

SEQ ID NO: 264204 - DNA, 15 bp, Homo sapiens
gctgggccccaccta

SEQ ID NO: 264205 - DNA, 20 bp, Homo sapiens
gctgggccccatgctctgcc

SEQ ID NO: 264206 - DNA, 21 bp, Homo sapiens
gctgggccccatgctctgccc

SEQ ID NO: 264207 - DNA, 23 bp, Homo sapiens
gctgggccccatgctctgcccca

SEQ ID NO: 264208 - DNA, 22 bp, Homo sapiens
gctgggccccccagctcagggg

SEQ ID NO: 264209 - DNA, 13 bp, Homo sapiens
gctgggccctctg

SEQ ID NO: 264210 - DNA, 22 bp, Homo sapiens
gctgggcctcattctagcacct

SEQ ID NO: 264211 - DNA, 21 bp, Homo sapiens
gctgggctctgccaccctacc

SEQ ID NO: 264212 - DNA, 19 bp, Homo sapiens
ccgtttccaggtgtttata

SEQ ID NO: 264213 - DNA, 23 bp, Homo sapiens
ccgtttggtgtctgatgtgtgcc

SEQ ID NO: 264214 - DNA, 19 bp, Homo sapiens
ccgttttcatcctggcctc

SEQ ID NO: 264215 - DNA, 20 bp, Homo sapiens
ccgttttcatcctggcctcc

SEQ ID NO: 264216 - DNA, 15 bp, Homo sapiens
ccgttttcatgacca

SEQ ID NO: 264217 - DNA, 15 bp, Homo sapiens
ccgttttggggacgt

SEQ ID NO: 264218 - DNA, 18 bp, Homo sapiens
cctaaaataattggttct

SEQ ID NO: 264219 - DNA, 17 bp, Homo sapiens
cctaaaattgtatgaaa

SEQ ID NO: 264220 - DNA, 14 bp, Homo sapiens
cctaaagcagccag

SEQ ID NO: 264221 - DNA, 12 bp, Homo sapiens
cctaaagccctc

SEQ ID NO: 264222 - DNA, 16 bp, Homo sapiens
cctaaagccctcttca

SEQ ID NO: 264223 - DNA, 22 bp, Homo sapiens
cctaaagccctcttcaggggtc

SEQ ID NO: 264224 - DNA, 15 bp, Homo sapiens
cctaaagtgaagaag

SEQ ID NO: 264225 - DNA, 19 bp, Homo sapiens
cctaaataaacacatagat

SEQ ID NO: 264226 - DNA, 23 bp, Homo sapiens
cctaaataaacacatagattcac

SEQ ID NO: 264227 - DNA, 20 bp, Homo sapiens
cctaaataaatctaaagtct

SEQ ID NO: 264228 - DNA, 18 bp, Homo sapiens
cctaaatccattttctaa

SEQ ID NO: 264229 - DNA, 13 bp, Homo sapiens
cctaacaccagcg

SEQ ID NO: 264230 - DNA, 15 bp, Homo sapiens
cctaacatagtgtct

SEQ ID NO: 264231 - DNA, 11 bp, Homo sapiens
cctaaccacta

SEQ ID NO: 264232 - DNA, 13 bp, Homo sapiens
cctaactcttgct

SEQ ID NO: 264233 - DNA, 15 bp, Homo sapiens
cctaactcttgctca

SEQ ID NO: 264234 - DNA, 16 bp, Homo sapiens
cctaactcttgctcac

SEQ ID NO: 264235 - DNA, 17 bp, Homo sapiens
cctaactcttgctcact

SEQ ID NO: 264236 - DNA, 21 bp, Homo sapiens
cctaactcttgctcactccct

SEQ ID NO: 264237 - DNA, 11 bp, Homo sapiens
cctaagaaaaa

SEQ ID NO: 264238 - DNA, 15 bp, Homo sapiens
cctaagactgtgaca

SEQ ID NO: 264239 - DNA, 21 bp, Homo sapiens
cctaagccaagggcctcttgc

SEQ ID NO: 264240 - DNA, 13 bp, Homo sapiens
cctaaggacacac

SEQ ID NO: 264241 - DNA, 11 bp, Homo sapiens
cctaaggctgc

SEQ ID NO: 264242 - DNA, 14 bp, Homo sapiens
cctaagggctaagg

SEQ ID NO: 264243 - DNA, 18 bp, Homo sapiens
cctaagggctaaggcctc

SEQ ID NO: 264244 - DNA, 23 bp, Homo sapiens
cctaagggctaaggcctcttgct

SEQ ID NO: 264245 - DNA, 16 bp, Homo sapiens
cctaagtccctgcccc

SEQ ID NO: 264246 - DNA, 18 bp, Homo sapiens
cctaagtccctgccccct

SEQ ID NO: 264247 - DNA, 14 bp, Homo sapiens
cctaagtgcccaaa

SEQ ID NO: 264248 - DNA, 17 bp, Homo sapiens
cctaagtgcccaaagtg

SEQ ID NO: 264249 - DNA, 18 bp, Homo sapiens
cctaagtggattggcttt

SEQ ID NO: 264250 - DNA, 17 bp, Homo sapiens
cctaagttacctttcta

SEQ ID NO: 264251 - DNA, 16 bp, Homo sapiens
cctaatatcattttat

SEQ ID NO: 264252 - DNA, 16 bp, Homo sapiens
cctaatgctccttgtt

SEQ ID NO: 264253 - DNA, 19 bp, Homo sapiens
cctaatgctccttgttcct

SEQ ID NO: 264254 - DNA, 19 bp, Homo sapiens
cctaatgtttatgagccag

SEQ ID NO: 264255 - DNA, 14 bp, Homo sapiens
cctaattaatttca

SEQ ID NO: 264256 - DNA, 17 bp, Homo sapiens
cctaatttgcccttcag

SEQ ID NO: 264257 - DNA, 13 bp, Homo sapiens
cctacaagatgcc

SEQ ID NO: 264258 - DNA, 19 bp, Homo sapiens
cctacaagatttagaaaaa

SEQ ID NO: 264259 - DNA, 21 bp, Homo sapiens
cctacaagttgatcatgcagg

SEQ ID NO: 264260 - DNA, 21 bp, Homo sapiens
cctacacctctgggccctgca

SEQ ID NO: 264261 - DNA, 15 bp, Homo sapiens
cctacagcctcactc

SEQ ID NO: 264262 - DNA, 16 bp, Homo sapiens
cctacagcctgcacac

SEQ ID NO: 264263 - DNA, 20 bp, Homo sapiens
cctacagcctgcacacacct

SEQ ID NO: 264264 - DNA, 21 bp, Homo sapiens
cctacagcctgcacacacctg

SEQ ID NO: 264265 - DNA, 20 bp, Homo sapiens
cctacagggaactgggaaga

SEQ ID NO: 264266 - DNA, 13 bp, Homo sapiens
cctaccaacctct

SEQ ID NO: 264267 - DNA, 14 bp, Homo sapiens
cctaccacagtgtc

SEQ ID NO: 264268 - DNA, 19 bp, Homo sapiens
cctaccagcgcccgctggg

SEQ ID NO: 264269 - DNA, 23 bp, Homo sapiens
cctaccagcgcccgctgggctga

SEQ ID NO: 264270 - DNA, 19 bp, Homo sapiens
cctaccagtcgccctctgt

SEQ ID NO: 264271 - DNA, 20 bp, Homo sapiens
cctaccagtcgccctctgtg

SEQ ID NO: 264272 - DNA, 23 bp, Homo sapiens
cctaccagtcgccctctgtgcct

SEQ ID NO: 264273 - DNA, 14 bp, Homo sapiens
cctaccatgctgct

SEQ ID NO: 264274 - DNA, 14 bp, Homo sapiens
cctacccacagggc

SEQ ID NO: 264275 - DNA, 13 bp, Homo sapiens
cctaccccacacc

SEQ ID NO: 264276 - DNA, 19 bp, Homo sapiens
cctaccccacaccaggccg

SEQ ID NO: 264277 - DNA, 21 bp, Homo sapiens
cctaccccacaccaggccgtc

SEQ ID NO: 264278 - DNA, 23 bp, Homo sapiens
cctaccccacaccaggccgtcct

SEQ ID NO: 264279 - DNA, 22 bp, Homo sapiens
cctaccccagttcatctctgct

SEQ ID NO: 264280 - DNA, 23 bp, Homo sapiens
cctaccccagttcatctctgctg

SEQ ID NO: 264281 - DNA, 21 bp, Homo sapiens
cctacccccttgtctgctgct

SEQ ID NO: 264282 - DNA, 22 bp, Homo sapiens
cctacccgcccgcgtccaaccc

SEQ ID NO: 264283 - DNA, 16 bp, Homo sapiens
cctaccctcaaagtag

SEQ ID NO: 264284 - DNA, 14 bp, Homo sapiens
cctaccctcccacc

SEQ ID NO: 264285 - DNA, 16 bp, Homo sapiens
cctaccctcttctcag

SEQ ID NO: 264286 - DNA, 17 bp, Homo sapiens
cctaccgagtctcttct

SEQ ID NO: 264287 - DNA, 21 bp, Homo sapiens
cctaccgagtctcttctccac

SEQ ID NO: 264288 - DNA, 20 bp, Homo sapiens
cctaccgggttctcctgatt

SEQ ID NO: 264289 - DNA, 18 bp, Homo sapiens
cctacctcaacctgtaaa

SEQ ID NO: 264290 - DNA, 15 bp, Homo sapiens
cctacctcaggcagg

SEQ ID NO: 264291 - DNA, 12 bp, Homo sapiens
cctacctggtaa

SEQ ID NO: 264292 - DNA, 20 bp, Homo sapiens
cctacctggtcaacccgctg

SEQ ID NO: 264293 - DNA, 23 bp, Homo sapiens
cctacctggtcaacccgctgctt

SEQ ID NO: 264294 - DNA, 15 bp, Homo sapiens
cctaccttcaaagct

SEQ ID NO: 264295 - DNA, 16 bp, Homo sapiens
cctaccttcaaagctg

SEQ ID NO: 264296 - DNA, 12 bp, Homo sapiens
cctacgacccca

SEQ ID NO: 264297 - DNA, 20 bp, Homo sapiens
cctactaaaaaagttattat

SEQ ID NO: 264298 - DNA, 17 bp, Homo sapiens
cctactacatcgccctc

SEQ ID NO: 264299 - DNA, 21 bp, Homo sapiens
cctactatgtgctgggtgcct

SEQ ID NO: 264300 - DNA, 23 bp, Homo sapiens
cctactatgtgctgggtgcctcc

SEQ ID NO: 264301 - DNA, 17 bp, Homo sapiens
cctactcccctgatccc

SEQ ID NO: 264302 - DNA, 17 bp, Homo sapiens
cctactgtctccttccc

SEQ ID NO: 264303 - DNA, 16 bp, Homo sapiens
cctacttcctcctcct

SEQ ID NO: 264304 - DNA, 13 bp, Homo sapiens
cctacttcctgtg

SEQ ID NO: 264305 - DNA, 19 bp, Homo sapiens
cctacttgtgactgaaggg

SEQ ID NO: 264306 - DNA, 17 bp, Homo sapiens
cctagaaagccatattc

SEQ ID NO: 264307 - DNA, 15 bp, Homo sapiens
cctagaactgtgcct

SEQ ID NO: 264308 - DNA, 21 bp, Homo sapiens
cctagactctgtaacatcact

SEQ ID NO: 264309 - DNA, 16 bp, Homo sapiens
cctagagacagaagca

SEQ ID NO: 264310 - DNA, 21 bp, Homo sapiens
cctagagacagaagcaggctg

SEQ ID NO: 264311 - DNA, 20 bp, Homo sapiens
tacaaggagggcctctggtg

SEQ ID NO: 264312 - DNA, 19 bp, Homo sapiens
tacaaggcaggcctttcct

SEQ ID NO: 264313 - DNA, 21 bp, Homo sapiens
tacaaggcaggcctttcctac

SEQ ID NO: 264314 - DNA, 14 bp, Homo sapiens
tacaaggtatgtac

SEQ ID NO: 264315 - DNA, 14 bp, Homo sapiens
tacaagtaatgaat

SEQ ID NO: 264316 - DNA, 18 bp, Homo sapiens
tacaagtgctcagttcca

SEQ ID NO: 264317 - DNA, 13 bp, Homo sapiens
tacaagtgtatat

SEQ ID NO: 264318 - DNA, 12 bp, Homo sapiens
tacaagtttcag

SEQ ID NO: 264319 - DNA, 16 bp, Homo sapiens
tacaagtttcagacag

SEQ ID NO: 264320 - DNA, 17 bp, Homo sapiens
tacaagtttcagacagg

SEQ ID NO: 264321 - DNA, 17 bp, Homo sapiens
tacaagtttcagtaata

SEQ ID NO: 264322 - DNA, 20 bp, Homo sapiens
tacaataaaatcttgaaaat

SEQ ID NO: 264323 - DNA, 11 bp, Homo sapiens
tacaataaact

SEQ ID NO: 264324 - DNA, 13 bp, Homo sapiens
tacaataaataat

SEQ ID NO: 264325 - DNA, 16 bp, Homo sapiens
tacaataataaatcct

SEQ ID NO: 264326 - DNA, 20 bp, Homo sapiens
tacaataataaatcctcagg

SEQ ID NO: 264327 - DNA, 15 bp, Homo sapiens
tacaatatatattct

SEQ ID NO: 264328 - DNA, 20 bp, Homo sapiens
tacaatatcattttcctggg

SEQ ID NO: 264329 - DNA, 21 bp, Homo sapiens
tacaatatcattttcctggga

SEQ ID NO: 264330 - DNA, 18 bp, Homo sapiens
tacaatattatgtttcct

SEQ ID NO: 264331 - DNA, 18 bp, Homo sapiens
tacaatcagctgctttgt

SEQ ID NO: 264332 - DNA, 19 bp, Homo sapiens
tacaatcagctgctttgtt

SEQ ID NO: 264333 - DNA, 16 bp, Homo sapiens
tacaatctatttattg

SEQ ID NO: 264334 - DNA, 13 bp, Homo sapiens
tacaatggccatg

SEQ ID NO: 264335 - DNA, 17 bp, Homo sapiens
tacaattccctgctgtc

SEQ ID NO: 264336 - DNA, 21 bp, Homo sapiens
tacaattctttgttgcttaat

SEQ ID NO: 264337 - DNA, 14 bp, Homo sapiens
tacaattgcactgc

SEQ ID NO: 264338 - DNA, 19 bp, Homo sapiens
tacaattgcactgctgttc

SEQ ID NO: 264339 - DNA, 20 bp, Homo sapiens
tacaattttcatcccacaat

SEQ ID NO: 264340 - DNA, 17 bp, Homo sapiens
tacacaaaaagaaagct

SEQ ID NO: 264341 - DNA, 20 bp, Homo sapiens
tacacaagagggactgtatt

SEQ ID NO: 264342 - DNA, 17 bp, Homo sapiens
tacacaatggttttctt

SEQ ID NO: 264343 - DNA, 13 bp, Homo sapiens
tacacacacacac

SEQ ID NO: 264344 - DNA, 20 bp, Homo sapiens
tacacacgtgtgatgtatgt

SEQ ID NO: 264345 - DNA, 19 bp, Homo sapiens
tacacagcagtatgaatga

SEQ ID NO: 264346 - DNA, 21 bp, Homo sapiens
tacacataagaccgtgtccca

SEQ ID NO: 264347 - DNA, 22 bp, Homo sapiens
tacacataagaccgtgtcccaa

SEQ ID NO: 264348 - DNA, 20 bp, Homo sapiens
tacaccatagtttacaatat

SEQ ID NO: 264349 - DNA, 15 bp, Homo sapiens
tacaccgggcctgga

SEQ ID NO: 264350 - DNA, 13 bp, Homo sapiens
tacacctctgggc

SEQ ID NO: 264351 - DNA, 23 bp, Homo sapiens
tacacggattattatttgtactt

SEQ ID NO: 264352 - DNA, 20 bp, Homo sapiens
tacactaagggtgtaagtaa

SEQ ID NO: 264353 - DNA, 15 bp, Homo sapiens
tacactcctgctgtg

SEQ ID NO: 264354 - DNA, 14 bp, Homo sapiens
tacactctcctggg

SEQ ID NO: 264355 - DNA, 22 bp, Homo sapiens
tacactctcctgggcccctccc

SEQ ID NO: 264356 - DNA, 16 bp, Homo sapiens
tacactctttgtaaga

SEQ ID NO: 264357 - DNA, 16 bp, Homo sapiens
tacactgtatctaaaa

SEQ ID NO: 264358 - DNA, 22 bp, Homo sapiens
tacactgtattacataaataaa

SEQ ID NO: 264359 - DNA, 16 bp, Homo sapiens
tacactgtatttgtat

SEQ ID NO: 264360 - DNA, 12 bp, Homo sapiens
tacactgtgaac

SEQ ID NO: 264361 - DNA, 22 bp, Homo sapiens
tacactgtgacttaagaagcct

SEQ ID NO: 264362 - DNA, 15 bp, Homo sapiens
tacactgttattttc

SEQ ID NO: 264363 - DNA, 21 bp, Homo sapiens
tacactgttattttcagcatg

SEQ ID NO: 264364 - DNA, 20 bp, Homo sapiens
tacacttctcaaatgctact

SEQ ID NO: 264365 - DNA, 14 bp, Homo sapiens
tacagaaaaatctt

SEQ ID NO: 264366 - DNA, 15 bp, Homo sapiens
tacagaaaaatcttg

SEQ ID NO: 264367 - DNA, 14 bp, Homo sapiens
tacagaaagcaaat

SEQ ID NO: 264368 - DNA, 22 bp, Homo sapiens
tacagaaagcaaatcagacaca

SEQ ID NO: 264369 - DNA, 14 bp, Homo sapiens
tacagaaatactat

SEQ ID NO: 264370 - DNA, 14 bp, Homo sapiens
tacagaacaaagaa

SEQ ID NO: 264371 - DNA, 21 bp, Homo sapiens
tacagaaccagcactcccagg

SEQ ID NO: 264372 - DNA, 18 bp, Homo sapiens
tacagaataatgtgttaa

SEQ ID NO: 264373 - DNA, 13 bp, Homo sapiens
tacagacaaagcg

SEQ ID NO: 264374 - DNA, 22 bp, Homo sapiens
tacagacaacaaacctgtttct

SEQ ID NO: 264375 - DNA, 17 bp, Homo sapiens
tacagacctaatatcat

SEQ ID NO: 264376 - DNA, 23 bp, Homo sapiens
tacagacctaatatcattttatt

SEQ ID NO: 264377 - DNA, 19 bp, Homo sapiens
tacagagaaattctgtggt

SEQ ID NO: 264378 - DNA, 16 bp, Homo sapiens
tacagagaggagaaac

SEQ ID NO: 264379 - DNA, 21 bp, Homo sapiens
tacagagaggagaaacacatc

SEQ ID NO: 264380 - DNA, 18 bp, Homo sapiens
tacagagcagctccccag

SEQ ID NO: 264381 - DNA, 13 bp, Homo sapiens
tacagaggattct

SEQ ID NO: 264382 - DNA, 17 bp, Homo sapiens
tacagaggattctgtct

SEQ ID NO: 264383 - DNA, 23 bp, Homo sapiens
tacagaggtctctgccggctctt

SEQ ID NO: 264384 - DNA, 18 bp, Homo sapiens
tacagagtctgacaggaa

SEQ ID NO: 264385 - DNA, 20 bp, Homo sapiens
tacagagtctgacaggaaga

SEQ ID NO: 264386 - DNA, 20 bp, Homo sapiens
tacagagtggcccctcacct

SEQ ID NO: 264387 - DNA, 15 bp, Homo sapiens
tacagataacattag

SEQ ID NO: 264388 - DNA, 19 bp, Homo sapiens
tacagataaggaaactgag

SEQ ID NO: 264389 - DNA, 16 bp, Homo sapiens
tacagataatttattt

SEQ ID NO: 264390 - DNA, 19 bp, Homo sapiens
tacagataatttattttgt

SEQ ID NO: 264391 - DNA, 17 bp, Homo sapiens
tacagatccgcatgtgt

SEQ ID NO: 264392 - DNA, 18 bp, Homo sapiens
tacagatccgcatgtgtc

SEQ ID NO: 264393 - DNA, 21 bp, Homo sapiens
tacagatccgcatgtgtctgt

SEQ ID NO: 264394 - DNA, 12 bp, Homo sapiens
tacagatgaaaa

SEQ ID NO: 264395 - DNA, 17 bp, Homo sapiens
tacagattgctgcttct

SEQ ID NO: 264396 - DNA, 15 bp, Homo sapiens
tacagcactactctg

SEQ ID NO: 264397 - DNA, 15 bp, Homo sapiens
tacagcactacttac

SEQ ID NO: 264398 - DNA, 22 bp, Homo sapiens
tacagcatcaatagaaagtcat

SEQ ID NO: 264399 - DNA, 18 bp, Homo sapiens
tacagccagtaaggcagc

SEQ ID NO: 264400 - DNA, 23 bp, Homo sapiens
tacagccgtcccgcgttcaagac

SEQ ID NO: 264401 - DNA, 16 bp, Homo sapiens
tacagctaatcagcat

SEQ ID NO: 264402 - DNA, 15 bp, Homo sapiens
tacagctccccaagt

SEQ ID NO: 264403 - DNA, 17 bp, Homo sapiens
tacagctcttggcattt

SEQ ID NO: 264404 - DNA, 21 bp, Homo sapiens
tacagctcttggcattttcct

SEQ ID NO: 264405 - DNA, 14 bp, Homo sapiens
tacagctgcctgca

SEQ ID NO: 264406 - DNA, 15 bp, Homo sapiens
tacagcttcaccctg

SEQ ID NO: 264407 - DNA, 16 bp, Homo sapiens
tacaggcctttcagga

SEQ ID NO: 264408 - DNA, 19 bp, Homo sapiens
tacaggcctttcaggaagg

SEQ ID NO: 264409 - DNA, 21 bp, Homo sapiens
tacaggggggtcggaagcctg

SEQ ID NO: 264410 - DNA, 15 bp, Homo sapiens
tacaggtgcccacca

SEQ ID NO: 264411 - DNA, 22 bp, Homo sapiens
tacaggtgtgagccaccacgcc

SEQ ID NO: 264412 - DNA, 17 bp, Homo sapiens
tacagtaaataaattgt

SEQ ID NO: 264413 - DNA, 14 bp, Homo sapiens
tacagtaagctgct

SEQ ID NO: 264414 - DNA, 18 bp, Homo sapiens
tacagtaagctgctctat

SEQ ID NO: 264415 - DNA, 18 bp, Homo sapiens
tacagtacacagatacct

SEQ ID NO: 264416 - DNA, 23 bp, Homo sapiens
tacagtagctgtggggagctggt

SEQ ID NO: 264417 - DNA, 12 bp, Homo sapiens
tacagtatgtgt

SEQ ID NO: 264418 - DNA, 13 bp, Homo sapiens
tacagtatgtgtc

SEQ ID NO: 264419 - DNA, 15 bp, Homo sapiens
tacagtatgtgtcta

SEQ ID NO: 264420 - DNA, 22 bp, Homo sapiens
tacagtatttaccttcctttgt

SEQ ID NO: 264421 - DNA, 16 bp, Homo sapiens
tacagtcaggacacat

SEQ ID NO: 264422 - DNA, 16 bp, Homo sapiens
tacagtcccagcacat

SEQ ID NO: 264423 - DNA, 15 bp, Homo sapiens
tacagtccttcaaaa

SEQ ID NO: 264424 - DNA, 19 bp, Homo sapiens
tacagtctcaattttgtat

SEQ ID NO: 264425 - DNA, 14 bp, Homo sapiens
tacagtctgtcatg

SEQ ID NO: 264426 - DNA, 15 bp, Homo sapiens
tacagtctgtcatga

SEQ ID NO: 264427 - DNA, 13 bp, Homo sapiens
tacagtgaggagg

SEQ ID NO: 264428 - DNA, 20 bp, Homo sapiens
tacagtgcagacaggccatg

SEQ ID NO: 264429 - DNA, 22 bp, Homo sapiens
tacagttcagttcctctttgca

SEQ ID NO: 264430 - DNA, 17 bp, Homo sapiens
tacagttcataaatttg

SEQ ID NO: 264431 - DNA, 15 bp, Homo sapiens
tacagttgatgtcga

SEQ ID NO: 264432 - DNA, 15 bp, Homo sapiens
tacagttgttggcct

SEQ ID NO: 264433 - DNA, 21 bp, Homo sapiens
tacataaattgcataaagcat

SEQ ID NO: 264434 - DNA, 15 bp, Homo sapiens
tactctgagcccagg

SEQ ID NO: 264435 - DNA, 17 bp, Homo sapiens
tactctgagcccaggcc

SEQ ID NO: 264436 - DNA, 14 bp, Homo sapiens
tactctgtccaggc

SEQ ID NO: 264437 - DNA, 15 bp, Homo sapiens
tactctgtccaggcc

SEQ ID NO: 264438 - DNA, 15 bp, Homo sapiens
tactctgtgtaaata

SEQ ID NO: 264439 - DNA, 19 bp, Homo sapiens
tactctgttgcctcctctc

SEQ ID NO: 264440 - DNA, 22 bp, Homo sapiens
tactctgttgcctcctctctcc

SEQ ID NO: 264441 - DNA, 18 bp, Homo sapiens
tactcttaggaagagaaa

SEQ ID NO: 264442 - DNA, 16 bp, Homo sapiens
tactcttgatgtgaag

SEQ ID NO: 264443 - DNA, 18 bp, Homo sapiens
tactcttggtcacctcaa

SEQ ID NO: 264444 - DNA, 22 bp, Homo sapiens
tactcttgtcatttttaatatt

SEQ ID NO: 264445 - DNA, 17 bp, Homo sapiens
tactcttgttgagttct

SEQ ID NO: 264446 - DNA, 15 bp, Homo sapiens
tactgaactgttacc

SEQ ID NO: 264447 - DNA, 19 bp, Homo sapiens
tactgaagtcttttctgtc

SEQ ID NO: 264448 - DNA, 16 bp, Homo sapiens
tactgaatttctttga

SEQ ID NO: 264449 - DNA, 17 bp, Homo sapiens
tactgaatttctttgat

SEQ ID NO: 264450 - DNA, 21 bp, Homo sapiens
tactgagaggaggggtaaata

SEQ ID NO: 264451 - DNA, 15 bp, Homo sapiens
tactgagccttgtaa

SEQ ID NO: 264452 - DNA, 18 bp, Homo sapiens
tactgagccttgtaattc

SEQ ID NO: 264453 - DNA, 19 bp, Homo sapiens
tactgagccttgtaattct

SEQ ID NO: 264454 - DNA, 23 bp, Homo sapiens
tactgagggaccaactgggccca

SEQ ID NO: 264455 - DNA, 15 bp, Homo sapiens
tactgagtgcctgca

SEQ ID NO: 264456 - DNA, 11 bp, Homo sapiens
tactgatcaca

SEQ ID NO: 264457 - DNA, 21 bp, Homo sapiens
tactgatgagacaacacacac

SEQ ID NO: 264458 - DNA, 14 bp, Homo sapiens
tactgcaaaaagta

SEQ ID NO: 264459 - DNA, 20 bp, Homo sapiens
tactgcaaaaagtacatagt

SEQ ID NO: 264460 - DNA, 17 bp, Homo sapiens
tactgcacccagcatca

SEQ ID NO: 264461 - DNA, 20 bp, Homo sapiens
tactgcagcctttgcctccc

SEQ ID NO: 264462 - DNA, 23 bp, Homo sapiens
tactgcagctttacatgcaattt

SEQ ID NO: 264463 - DNA, 20 bp, Homo sapiens
tactgcccaggcctgcctgt

SEQ ID NO: 264464 - DNA, 21 bp, Homo sapiens
tactgcccaggcctgcctgtt

SEQ ID NO: 264465 - DNA, 15 bp, Homo sapiens
tactggaaataacct

SEQ ID NO: 264466 - DNA, 18 bp, Homo sapiens
tactggaagttttgcatt

SEQ ID NO: 264467 - DNA, 22 bp, Homo sapiens
tactggacttgaatggttaata

SEQ ID NO: 264468 - DNA, 18 bp, Homo sapiens
tactgggtacaagagcca

SEQ ID NO: 264469 - DNA, 15 bp, Homo sapiens
tactgggttcttgtt

SEQ ID NO: 264470 - DNA, 14 bp, Homo sapiens
tactggtctgtact

SEQ ID NO: 264471 - DNA, 22 bp, Homo sapiens
tactggttatcctgtgctacag

SEQ ID NO: 264472 - DNA, 23 bp, Homo sapiens
tactggttatcctgtgctacaga

SEQ ID NO: 264473 - DNA, 18 bp, Homo sapiens
tactgtacagattgctgc

SEQ ID NO: 264474 - DNA, 19 bp, Homo sapiens
tactgtacagattgctgct

SEQ ID NO: 264475 - DNA, 17 bp, Homo sapiens
tactgtagctgatgaaa

SEQ ID NO: 264476 - DNA, 12 bp, Homo sapiens
tactgtagtttt

SEQ ID NO: 264477 - DNA, 13 bp, Homo sapiens
tactgtagttttt

SEQ ID NO: 264478 - DNA, 16 bp, Homo sapiens
tactgtcaataaacag

SEQ ID NO: 264479 - DNA, 16 bp, Homo sapiens
tactgtcagagaatat

SEQ ID NO: 264480 - DNA, 15 bp, Homo sapiens
tactgtcagtgtcct

SEQ ID NO: 264481 - DNA, 13 bp, Homo sapiens
tactgtctccttc

SEQ ID NO: 264482 - DNA, 18 bp, Homo sapiens
tactgtctccttcccact

SEQ ID NO: 264483 - DNA, 20 bp, Homo sapiens
tactgtctggttttaacaat

SEQ ID NO: 264484 - DNA, 22 bp, Homo sapiens
tactgtctggttttaacaattt

SEQ ID NO: 264485 - DNA, 14 bp, Homo sapiens
tactgtctgtagtg

SEQ ID NO: 264486 - DNA, 19 bp, Homo sapiens
tactgtctttattcttatt

SEQ ID NO: 264487 - DNA, 16 bp, Homo sapiens
tactgtggaggtggct

SEQ ID NO: 264488 - DNA, 12 bp, Homo sapiens
tactgtgttcct

SEQ ID NO: 264489 - DNA, 14 bp, Homo sapiens
tactgtgttcctgg

SEQ ID NO: 264490 - DNA, 16 bp, Homo sapiens
tactgtgttcctggca

SEQ ID NO: 264491 - DNA, 22 bp, Homo sapiens
tactgtgttcctggcaatagtg

SEQ ID NO: 264492 - DNA, 16 bp, Homo sapiens
tactgttaaaggaaaa

SEQ ID NO: 264493 - DNA, 15 bp, Homo sapiens
tactgtttatttctg

SEQ ID NO: 264494 - DNA, 23 bp, Homo sapiens
tactgtttatttctgtttctcat

SEQ ID NO: 264495 - DNA, 17 bp, Homo sapiens
tactgtttgtaatatac

SEQ ID NO: 264496 - DNA, 23 bp, Homo sapiens
tactgttttgtgcggtgtgtctc

SEQ ID NO: 264497 - DNA, 23 bp, Homo sapiens
tacttaaaaatagtcttccacaa

SEQ ID NO: 264498 - DNA, 15 bp, Homo sapiens
tacttaaaaatatgt

SEQ ID NO: 264499 - DNA, 17 bp, Homo sapiens
tacttaaacaaaaactt

SEQ ID NO: 264500 - DNA, 18 bp, Homo sapiens
tacttaaacaaaaacttt

SEQ ID NO: 264501 - DNA, 20 bp, Homo sapiens
tacttaaacaaaaactttcc

SEQ ID NO: 264502 - DNA, 21 bp, Homo sapiens
tacttaaacaaaaactttcca

SEQ ID NO: 264503 - DNA, 15 bp, Homo sapiens
tacttaagagtggca

SEQ ID NO: 264504 - DNA, 11 bp, Homo sapiens
tacttaataaa

SEQ ID NO: 264505 - DNA, 19 bp, Homo sapiens
tacttaatactgaatttct

SEQ ID NO: 264506 - DNA, 20 bp, Homo sapiens
tacttaatactgaatttctt

SEQ ID NO: 264507 - DNA, 21 bp, Homo sapiens
tacttaatatactcagggatt

SEQ ID NO: 264508 - DNA, 16 bp, Homo sapiens
tacttagtggtatgtc

SEQ ID NO: 264509 - DNA, 20 bp, Homo sapiens
tacttatgcacatttgtgca

SEQ ID NO: 264510 - DNA, 22 bp, Homo sapiens
tacttatgcacatttgtgcata

SEQ ID NO: 264511 - DNA, 17 bp, Homo sapiens
tacttatttaaaaatgc

SEQ ID NO: 264512 - DNA, 15 bp, Homo sapiens
tacttcagctttgga

SEQ ID NO: 264513 - DNA, 23 bp, Homo sapiens
tacttcataagatattctttaca

SEQ ID NO: 264514 - DNA, 19 bp, Homo sapiens
tacttcatcgcagtggact

SEQ ID NO: 264515 - DNA, 21 bp, Homo sapiens
tacttccaaagagtcatcatg

SEQ ID NO: 264516 - DNA, 14 bp, Homo sapiens
tacttccaagaaaa

SEQ ID NO: 264517 - DNA, 21 bp, Homo sapiens
tacttccataggacatactgc

SEQ ID NO: 264518 - DNA, 21 bp, Homo sapiens
tacttccctcaggcctatgca

SEQ ID NO: 264519 - DNA, 14 bp, Homo sapiens
tacttcctcctcct

SEQ ID NO: 264520 - DNA, 21 bp, Homo sapiens
tacttcctcctcctcctcctg

SEQ ID NO: 264521 - DNA, 18 bp, Homo sapiens
tacttcctcctgatggcc

SEQ ID NO: 264522 - DNA, 18 bp, Homo sapiens
tacttctgtgtctgtcac

SEQ ID NO: 264523 - DNA, 18 bp, Homo sapiens
tacttgagggaccaatat

SEQ ID NO: 264524 - DNA, 15 bp, Homo sapiens
tacttgagtgtgcaa

SEQ ID NO: 264525 - DNA, 18 bp, Homo sapiens
tacttgatatttccttca

SEQ ID NO: 264526 - DNA, 12 bp, Homo sapiens
tacttgatcatt

SEQ ID NO: 264527 - DNA, 14 bp, Homo sapiens
tacttgatcattct

SEQ ID NO: 264528 - DNA, 21 bp, Homo sapiens
tacttgggagacctgtaatca

SEQ ID NO: 264529 - DNA, 15 bp, Homo sapiens
tacttgggagcctga

SEQ ID NO: 264530 - DNA, 19 bp, Homo sapiens
tacttgggagcctgaggca

SEQ ID NO: 264531 - DNA, 20 bp, Homo sapiens
tacttgggagcctgaggcag

SEQ ID NO: 264532 - DNA, 17 bp, Homo sapiens
tacttggtaagagggag

SEQ ID NO: 264533 - DNA, 15 bp, Homo sapiens
tacttgtaaattgat

SEQ ID NO: 264534 - DNA, 18 bp, Homo sapiens
tacttgtggttttcaaat

SEQ ID NO: 264535 - DNA, 15 bp, Homo sapiens
tacttgtgtttgctt

SEQ ID NO: 264536 - DNA, 14 bp, Homo sapiens
cggggcagggcagc

SEQ ID NO: 264537 - DNA, 19 bp, Homo sapiens
cggggcatggacagggcca

SEQ ID NO: 264538 - DNA, 21 bp, Homo sapiens
cggggcatggacagggccagg

SEQ ID NO: 264539 - DNA, 22 bp, Homo sapiens
cggggcatggacagggccaggg

SEQ ID NO: 264540 - DNA, 11 bp, Homo sapiens
cggggccatgg

SEQ ID NO: 264541 - DNA, 14 bp, Homo sapiens
cggggccccagggc

SEQ ID NO: 264542 - DNA, 15 bp, Homo sapiens
cggggccccagggct

SEQ ID NO: 264543 - DNA, 18 bp, Homo sapiens
cggggcccttggggcctg

SEQ ID NO: 264544 - DNA, 17 bp, Homo sapiens
cggggcctcgggacctc

SEQ ID NO: 264545 - DNA, 23 bp, Homo sapiens
cggggccttgtctcttcctctgc

SEQ ID NO: 264546 - DNA, 11 bp, Homo sapiens
cggggctggca

SEQ ID NO: 264547 - DNA, 13 bp, Homo sapiens
cggggctggccct

SEQ ID NO: 264548 - DNA, 16 bp, Homo sapiens
cggggctggccctgcc

SEQ ID NO: 264549 - DNA, 23 bp, Homo sapiens
cggggcttcaaccttgagacagc

SEQ ID NO: 264550 - DNA, 13 bp, Homo sapiens
cgggggacaggaa

SEQ ID NO: 264551 - DNA, 13 bp, Homo sapiens
cgggggagcctgg

SEQ ID NO: 264552 - DNA, 17 bp, Homo sapiens
cgggggagcctggagcc

SEQ ID NO: 264553 - DNA, 22 bp, Homo sapiens
cgggggaggagcacccccagcc

SEQ ID NO: 264554 - DNA, 19 bp, Homo sapiens
cgggggatcctggagcccc

SEQ ID NO: 264555 - DNA, 17 bp, Homo sapiens
cgggggctaactggccc

SEQ ID NO: 264556 - DNA, 16 bp, Homo sapiens
cgggggctgaggggca

SEQ ID NO: 264557 - DNA, 14 bp, Homo sapiens
cgggggctgcttct

SEQ ID NO: 264558 - DNA, 15 bp, Homo sapiens
cgggggctgcttctc

SEQ ID NO: 264559 - DNA, 17 bp, Homo sapiens
cgggggctgcttctcca

SEQ ID NO: 264560 - DNA, 13 bp, Homo sapiens
cggggggagggtt

SEQ ID NO: 264561 - DNA, 18 bp, Homo sapiens
cgggggtctatacattcc

SEQ ID NO: 264562 - DNA, 19 bp, Homo sapiens
cgggggtctatacattcct

SEQ ID NO: 264563 - DNA, 20 bp, Homo sapiens
cgggggtgggggcctgctgt

SEQ ID NO: 264564 - DNA, 17 bp, Homo sapiens
cggggtcctgaggctgg

SEQ ID NO: 264565 - DNA, 13 bp, Homo sapiens
cggggtctgtgct

SEQ ID NO: 264566 - DNA, 14 bp, Homo sapiens
cggggtctgtgctg

SEQ ID NO: 264567 - DNA, 18 bp, Homo sapiens
cggggtggacgagggagt

SEQ ID NO: 264568 - DNA, 16 bp, Homo sapiens
cgggtctagtggaaag

SEQ ID NO: 264569 - DNA, 22 bp, Homo sapiens
cgggtctcacttataccaaagg

SEQ ID NO: 264570 - DNA, 19 bp, Homo sapiens
cgggtgccaaataaatgct

SEQ ID NO: 264571 - DNA, 15 bp, Homo sapiens
cgggtgcctgtgacc

SEQ ID NO: 264572 - DNA, 22 bp, Homo sapiens
cgggtgcctgtgaccggggtcc

SEQ ID NO: 264573 - DNA, 21 bp, Homo sapiens
cgggtgcgtgaccggcccgcc

SEQ ID NO: 264574 - DNA, 23 bp, Homo sapiens
cgggtgcgtgaccggcccgccac

SEQ ID NO: 264575 - DNA, 15 bp, Homo sapiens
cgggtgggcctggcc

SEQ ID NO: 264576 - DNA, 18 bp, Homo sapiens
cgggtgggcctggcctga

SEQ ID NO: 264577 - DNA, 21 bp, Homo sapiens
cgggtgggtatcccacctcca

SEQ ID NO: 264578 - DNA, 14 bp, Homo sapiens
cgggttagcctggt

SEQ ID NO: 264579 - DNA, 22 bp, Homo sapiens
cgggttagcctggtgacaggca

SEQ ID NO: 264580 - DNA, 19 bp, Homo sapiens
cgggttggaggcctcaccc

SEQ ID NO: 264581 - DNA, 19 bp, Homo sapiens
cgggtttggcgggccaagg

SEQ ID NO: 264582 - DNA, 23 bp, Homo sapiens
cgggtttggcgggccaaggactg

SEQ ID NO: 264583 - DNA, 15 bp, Homo sapiens
cggtagctgtgcgtg

SEQ ID NO: 264584 - DNA, 12 bp, Homo sapiens
cggtaggtgctg

SEQ ID NO: 264585 - DNA, 15 bp, Homo sapiens
cggtaggtgctggcc

SEQ ID NO: 264586 - DNA, 19 bp, Homo sapiens
cggtcaataattgtggaga

SEQ ID NO: 264587 - DNA, 22 bp, Homo sapiens
cggtcaataattgtggagagga

SEQ ID NO: 264588 - DNA, 12 bp, Homo sapiens
cggtccaccccg

SEQ ID NO: 264589 - DNA, 15 bp, Homo sapiens
cggtccaccccgtcc

SEQ ID NO: 264590 - DNA, 13 bp, Homo sapiens
cggtcccaggccg

SEQ ID NO: 264591 - DNA, 16 bp, Homo sapiens
cggtcccaggccgcat

SEQ ID NO: 264592 - DNA, 17 bp, Homo sapiens
cggtccccatccccacc

SEQ ID NO: 264593 - DNA, 19 bp, Homo sapiens
cggtccccatccccaccag

SEQ ID NO: 264594 - DNA, 20 bp, Homo sapiens
cggtccccatccccaccagc

SEQ ID NO: 264595 - DNA, 18 bp, Homo sapiens
cggtcccccatgccacca

SEQ ID NO: 264596 - DNA, 21 bp, Homo sapiens
cggtcccggctgacacctccc

SEQ ID NO: 264597 - DNA, 17 bp, Homo sapiens
cggtcctttaggcagcc

SEQ ID NO: 264598 - DNA, 18 bp, Homo sapiens
cggtcctttaggcagcct

SEQ ID NO: 264599 - DNA, 18 bp, Homo sapiens
cggtgaaggtgacagcag

SEQ ID NO: 264600 - DNA, 13 bp, Homo sapiens
cggtgagactctg

SEQ ID NO: 264601 - DNA, 24 bp, Homo sapiens
cggtgcgtggctgtggcacagact

SEQ ID NO: 264602 - DNA, 12 bp, Homo sapiens
cggtgctctggc

SEQ ID NO: 264603 - DNA, 18 bp, Homo sapiens
cggtggaaggagcctgcg

SEQ ID NO: 264604 - DNA, 19 bp, Homo sapiens
cggtgggcatttgtgaggc

SEQ ID NO: 264605 - DNA, 21 bp, Homo sapiens
cggtgtccatttatagaataa

SEQ ID NO: 264606 - DNA, 22 bp, Homo sapiens
cggtgtgtggccgcctggcagg

SEQ ID NO: 264607 - DNA, 18 bp, Homo sapiens
cggttccacgtccccctg

SEQ ID NO: 264608 - DNA, 15 bp, Homo sapiens
cggttgcttctggga

SEQ ID NO: 264609 - DNA, 21 bp, Homo sapiens
cggttggagcgagcatccccc

SEQ ID NO: 264610 - DNA, 18 bp, Homo sapiens
cggttggccggctggccg

SEQ ID NO: 264611 - DNA, 13 bp, Homo sapiens
cggtttcagaagc

SEQ ID NO: 264612 - DNA, 18 bp, Homo sapiens
cggtttccaaggtgcaca

SEQ ID NO: 264613 - DNA, 17 bp, Homo sapiens
cggtttctgttctgccc

SEQ ID NO: 264614 - DNA, 16 bp, Homo sapiens
cggttttagttgagtc

SEQ ID NO: 264615 - DNA, 15 bp, Homo sapiens
cgtaagctctatctg

SEQ ID NO: 264616 - DNA, 13 bp, Homo sapiens
cgtaatgggcctg

SEQ ID NO: 264617 - DNA, 17 bp, Homo sapiens
cgtaatgggcctgccca

SEQ ID NO: 264618 - DNA, 12 bp, Homo sapiens
cgtaattttatt

SEQ ID NO: 264619 - DNA, 14 bp, Homo sapiens
cgtaattttattat

SEQ ID NO: 264620 - DNA, 18 bp, Homo sapiens
cgtaattttattattaga

SEQ ID NO: 264621 - DNA, 14 bp, Homo sapiens
cgtacatctgcaat

SEQ ID NO: 264622 - DNA, 20 bp, Homo sapiens
cgtacatctgcaatatgaat

SEQ ID NO: 264623 - DNA, 14 bp, Homo sapiens
cgtacccaaggtca

SEQ ID NO: 264624 - DNA, 21 bp, Homo sapiens
cgtacctcttcccatgactgc

SEQ ID NO: 264625 - DNA, 14 bp, Homo sapiens
cgtagatgctgcct

SEQ ID NO: 264626 - DNA, 19 bp, Homo sapiens
cgtagctatccggacagag

SEQ ID NO: 264627 - DNA, 22 bp, Homo sapiens
tagtttagtgtggttttctgtt

SEQ ID NO: 264628 - DNA, 15 bp, Homo sapiens
tagtttcaaaatgtt

SEQ ID NO: 264629 - DNA, 18 bp, Homo sapiens
tagtttcagatatatatc

SEQ ID NO: 264630 - DNA, 17 bp, Homo sapiens
tagtttctagaggcctc

SEQ ID NO: 264631 - DNA, 12 bp, Homo sapiens
tagtttctgtaa

SEQ ID NO: 264632 - DNA, 14 bp, Homo sapiens
tagtttgtataact

SEQ ID NO: 264633 - DNA, 15 bp, Homo sapiens
tagttttacactcta

SEQ ID NO: 264634 - DNA, 17 bp, Homo sapiens
tagttttagttgcagaa

SEQ ID NO: 264635 - DNA, 21 bp, Homo sapiens
tagttttatgtttcttgggaa

SEQ ID NO: 264636 - DNA, 15 bp, Homo sapiens
tagttttgtcaaact

SEQ ID NO: 264637 - DNA, 20 bp, Homo sapiens
tagtttttaaaaaggccttt

SEQ ID NO: 264638 - DNA, 23 bp, Homo sapiens
tagtttttaaaaaggcctttggg

SEQ ID NO: 264639 - DNA, 18 bp, Homo sapiens
tagtttttacctaccaca

SEQ ID NO: 264640 - DNA, 16 bp, Homo sapiens
tagtttttgctgaagg

SEQ ID NO: 264641 - DNA, 22 bp, Homo sapiens
tataaaaaagaaaacttgtgtt

SEQ ID NO: 264642 - DNA, 13 bp, Homo sapiens
tataaaaaataag

SEQ ID NO: 264643 - DNA, 20 bp, Homo sapiens
tataaaaaccccaaactgtt

SEQ ID NO: 264644 - DNA, 11 bp, Homo sapiens
tataaaaataa

SEQ ID NO: 264645 - DNA, 19 bp, Homo sapiens
tataaaaataaaaaagatc

SEQ ID NO: 264646 - DNA, 20 bp, Homo sapiens
tataaaaataattaaaacaa

SEQ ID NO: 264647 - DNA, 19 bp, Homo sapiens
tataaaacaaaacaaacaa

SEQ ID NO: 264648 - DNA, 18 bp, Homo sapiens
tataaaataaatatacta

SEQ ID NO: 264649 - DNA, 22 bp, Homo sapiens
tataaaataaatatactaataa

SEQ ID NO: 264650 - DNA, 15 bp, Homo sapiens
tataaaatctttcca

SEQ ID NO: 264651 - DNA, 19 bp, Homo sapiens
tataaaatgcaaaataaat

SEQ ID NO: 264652 - DNA, 15 bp, Homo sapiens
tataaaattaagcaa

SEQ ID NO: 264653 - DNA, 16 bp, Homo sapiens
tataaacatatgcaaa

SEQ ID NO: 264654 - DNA, 12 bp, Homo sapiens
tataaactgtga

SEQ ID NO: 264655 - DNA, 23 bp, Homo sapiens
tataaagatttttgttaagctca

SEQ ID NO: 264656 - DNA, 16 bp, Homo sapiens
tataaagtaaagctaa

SEQ ID NO: 264657 - DNA, 14 bp, Homo sapiens
tataaataaaattg

SEQ ID NO: 264658 - DNA, 12 bp, Homo sapiens
tataaataatga

SEQ ID NO: 264659 - DNA, 23 bp, Homo sapiens
tataaatactaaatatgaaattt

SEQ ID NO: 264660 - DNA, 15 bp, Homo sapiens
tataaatatatttaa

SEQ ID NO: 264661 - DNA, 16 bp, Homo sapiens
tataaatatgaaatga

SEQ ID NO: 264662 - DNA, 21 bp, Homo sapiens
tataaatcatattgatgaaaa

SEQ ID NO: 264663 - DNA, 20 bp, Homo sapiens
tataaatgaagtttatacag

SEQ ID NO: 264664 - DNA, 15 bp, Homo sapiens
tataaatgaatgaaa

SEQ ID NO: 264665 - DNA, 16 bp, Homo sapiens
tataaatggacttgct

SEQ ID NO: 264666 - DNA, 15 bp, Homo sapiens
tataaatgggaagaa

SEQ ID NO: 264667 - DNA, 13 bp, Homo sapiens
tataaatggtgag

SEQ ID NO: 264668 - DNA, 15 bp, Homo sapiens
tataaatggtgagaa

SEQ ID NO: 264669 - DNA, 19 bp, Homo sapiens
tataaatggtgagaattaa

SEQ ID NO: 264670 - DNA, 22 bp, Homo sapiens
tataaatggtgagaattaaaat

SEQ ID NO: 264671 - DNA, 16 bp, Homo sapiens
tataaatgtaaaaatg

SEQ ID NO: 264672 - DNA, 19 bp, Homo sapiens
tataaatgtaaaaatgaag

SEQ ID NO: 264673 - DNA, 22 bp, Homo sapiens
tataaatgtactacatttgcat

SEQ ID NO: 264674 - DNA, 12 bp, Homo sapiens
tataaatgttta

SEQ ID NO: 264675 - DNA, 18 bp, Homo sapiens
tataaatgtttatattgt

SEQ ID NO: 264676 - DNA, 12 bp, Homo sapiens
tataaattaaat

SEQ ID NO: 264677 - DNA, 11 bp, Homo sapiens
tataaattaag

SEQ ID NO: 264678 - DNA, 16 bp, Homo sapiens
tataaattaagacttt

SEQ ID NO: 264679 - DNA, 16 bp, Homo sapiens
tataaattaatacata

SEQ ID NO: 264680 - DNA, 15 bp, Homo sapiens
tataaattattactt

SEQ ID NO: 264681 - DNA, 16 bp, Homo sapiens
tataaatttgtgtaat

SEQ ID NO: 264682 - DNA, 18 bp, Homo sapiens
tataacaacactaataca

SEQ ID NO: 264683 - DNA, 17 bp, Homo sapiens
tataacaactctatttt

SEQ ID NO: 264684 - DNA, 17 bp, Homo sapiens
tataacaagccaaacat

SEQ ID NO: 264685 - DNA, 18 bp, Homo sapiens
tataacaagccaaacatt

SEQ ID NO: 264686 - DNA, 19 bp, Homo sapiens
tataacattgtaaatgata

SEQ ID NO: 264687 - DNA, 22 bp, Homo sapiens
tataacatttgctgaatatgca

SEQ ID NO: 264688 - DNA, 23 bp, Homo sapiens
tataacatttgctgaatatgcaa

SEQ ID NO: 264689 - DNA, 16 bp, Homo sapiens
tataacccctgcctgg

SEQ ID NO: 264690 - DNA, 21 bp, Homo sapiens
tataactcatcataaaataaa

SEQ ID NO: 264691 - DNA, 23 bp, Homo sapiens
tataactctgcactactcctctg

SEQ ID NO: 264692 - DNA, 19 bp, Homo sapiens
tataactgccttaaaactt

SEQ ID NO: 264693 - DNA, 16 bp, Homo sapiens
tataagaaaacatgta

SEQ ID NO: 264694 - DNA, 17 bp, Homo sapiens
tataagacactttgcca

SEQ ID NO: 264695 - DNA, 16 bp, Homo sapiens
tataagatttaattgt

SEQ ID NO: 264696 - DNA, 16 bp, Homo sapiens
tataagcaacatgaat

SEQ ID NO: 264697 - DNA, 15 bp, Homo sapiens
tataagccaatgaag

SEQ ID NO: 264698 - DNA, 17 bp, Homo sapiens
tataagcttaaaataag

SEQ ID NO: 264699 - DNA, 17 bp, Homo sapiens
tatcttttcatttatca

SEQ ID NO: 264700 - DNA, 14 bp, Homo sapiens
tatcttttgagaac

SEQ ID NO: 264701 - DNA, 18 bp, Homo sapiens
tatgaaaaaaatatattt

SEQ ID NO: 264702 - DNA, 23 bp, Homo sapiens
tatgaaagatggctgtgcctctg

SEQ ID NO: 264703 - DNA, 15 bp, Homo sapiens
tatgaactgcatgta

SEQ ID NO: 264704 - DNA, 23 bp, Homo sapiens
tatgaacttgaggacacatgtcc

SEQ ID NO: 264705 - DNA, 23 bp, Homo sapiens
tatgaagccctaagtaaatctaa

SEQ ID NO: 264706 - DNA, 14 bp, Homo sapiens
tatgaagtactttt

SEQ ID NO: 264707 - DNA, 16 bp, Homo sapiens
tatgaataattatgtt

SEQ ID NO: 264708 - DNA, 18 bp, Homo sapiens
tatgaataattatgttta

SEQ ID NO: 264709 - DNA, 21 bp, Homo sapiens
tatgaataattatgtttacct

SEQ ID NO: 264710 - DNA, 22 bp, Homo sapiens
tatgaatgatgttttagaatga

SEQ ID NO: 264711 - DNA, 20 bp, Homo sapiens
tatgaatgtactgcatgtta

SEQ ID NO: 264712 - DNA, 23 bp, Homo sapiens
tatgaatgtactgcatgttacca

SEQ ID NO: 264713 - DNA, 21 bp, Homo sapiens
tatgaattcaagaaaggaaat

SEQ ID NO: 264714 - DNA, 15 bp, Homo sapiens
tatgaatttaaatat

SEQ ID NO: 264715 - DNA, 20 bp, Homo sapiens
tatgacaatttcaaaatgca

SEQ ID NO: 264716 - DNA, 22 bp, Homo sapiens
tatgacaatttcaaaatgcatg

SEQ ID NO: 264717 - DNA, 21 bp, Homo sapiens
tatgacctaaatccattttct

SEQ ID NO: 264718 - DNA, 20 bp, Homo sapiens
tatgacgcggctcaaaagga

SEQ ID NO: 264719 - DNA, 19 bp, Homo sapiens
tatgacggaagaacataga

SEQ ID NO: 264720 - DNA, 20 bp, Homo sapiens
tatgacggaagaacatagaa

SEQ ID NO: 264721 - DNA, 12 bp, Homo sapiens
tatgactaaaga

SEQ ID NO: 264722 - DNA, 23 bp, Homo sapiens
tatgactccagaatttcccaaag

SEQ ID NO: 264723 - DNA, 20 bp, Homo sapiens
tatgagaaaaaaacagcagg

SEQ ID NO: 264724 - DNA, 17 bp, Homo sapiens
tatgagaagtactttgt

SEQ ID NO: 264725 - DNA, 18 bp, Homo sapiens
tatgaggagtgaacattt

SEQ ID NO: 264726 - DNA, 16 bp, Homo sapiens
tatgaggggactgcat

SEQ ID NO: 264727 - DNA, 19 bp, Homo sapiens
tatgaggggactgcatgca

SEQ ID NO: 264728 - DNA, 23 bp, Homo sapiens
tatgagtaggtttggccccctca

SEQ ID NO: 264729 - DNA, 16 bp, Homo sapiens
tatgagtcaatgtgca

SEQ ID NO: 264730 - DNA, 22 bp, Homo sapiens
tatgagtttttgatagctttat

SEQ ID NO: 264731 - DNA, 14 bp, Homo sapiens
tatgataggcagca

SEQ ID NO: 264732 - DNA, 14 bp, Homo sapiens
tatgatatatatgt

SEQ ID NO: 264733 - DNA, 12 bp, Homo sapiens
tatgatatgcat

SEQ ID NO: 264734 - DNA, 14 bp, Homo sapiens
tatgatatgcatgt

SEQ ID NO: 264735 - DNA, 14 bp, Homo sapiens
tatgatctgtggag

SEQ ID NO: 264736 - DNA, 20 bp, Homo sapiens
tatgatctgtggagaatgta

SEQ ID NO: 264737 - DNA, 21 bp, Homo sapiens
tatgatctgtggagaatgtac

SEQ ID NO: 264738 - DNA, 15 bp, Homo sapiens
tatgatgtgttgtga

SEQ ID NO: 264739 - DNA, 13 bp, Homo sapiens
tatgatgtttaaa

SEQ ID NO: 264740 - DNA, 21 bp, Homo sapiens
tatgattcagattgttatcta

SEQ ID NO: 264741 - DNA, 14 bp, Homo sapiens
tatgattctcctct

SEQ ID NO: 264742 - DNA, 15 bp, Homo sapiens
tatgattgatttgaa

SEQ ID NO: 264743 - DNA, 14 bp, Homo sapiens
tatgattgtaacat

SEQ ID NO: 264744 - DNA, 15 bp, Homo sapiens
tatgattgtaacata

SEQ ID NO: 264745 - DNA, 17 bp, Homo sapiens
tatgatttaggcttcta

SEQ ID NO: 264746 - DNA, 18 bp, Homo sapiens
tatgatttatagtttgta

SEQ ID NO: 264747 - DNA, 12 bp, Homo sapiens
tatgatttgtag

SEQ ID NO: 264748 - DNA, 16 bp, Homo sapiens
tatgcaaaatgtctgt

SEQ ID NO: 264749 - DNA, 15 bp, Homo sapiens
tatgcaaagaactca

SEQ ID NO: 264750 - DNA, 16 bp, Homo sapiens
tatgcaagaagaatat

SEQ ID NO: 264751 - DNA, 17 bp, Homo sapiens
tatgcaagaagaatata

SEQ ID NO: 264752 - DNA, 22 bp, Homo sapiens
tatgcaatttgttattctttta

SEQ ID NO: 264753 - DNA, 13 bp, Homo sapiens
tatgcacatttgt

SEQ ID NO: 264754 - DNA, 12 bp, Homo sapiens
tatgcacccctg

SEQ ID NO: 264755 - DNA, 17 bp, Homo sapiens
tatgcacctataaatac

SEQ ID NO: 264756 - DNA, 17 bp, Homo sapiens
tatgcactttccctaga

SEQ ID NO: 264757 - DNA, 22 bp, Homo sapiens
tatgcagcatacaaaaatatat

SEQ ID NO: 264758 - DNA, 14 bp, Homo sapiens
tatgcagtgctgct

SEQ ID NO: 264759 - DNA, 17 bp, Homo sapiens
tcaatattaaatacaga

SEQ ID NO: 264760 - DNA, 19 bp, Homo sapiens
tcaatattaaatacagaca

SEQ ID NO: 264761 - DNA, 21 bp, Homo sapiens
tcaatattaaatacagacact

SEQ ID NO: 264762 - DNA, 16 bp, Homo sapiens
tcaatattcaataaag

SEQ ID NO: 264763 - DNA, 18 bp, Homo sapiens
tcaatattcctgaatgaa

SEQ ID NO: 264764 - DNA, 22 bp, Homo sapiens
tcaatattcctgaatgaaatat

SEQ ID NO: 264765 - DNA, 10 bp, Homo sapiens
tcaatattta

SEQ ID NO: 264766 - DNA, 19 bp, Homo sapiens
tcaatcatctgtgtgaaaa

SEQ ID NO: 264767 - DNA, 20 bp, Homo sapiens
tcaatcatctgtgtgaaaat

SEQ ID NO: 264768 - DNA, 13 bp, Homo sapiens
tcaatcatgccct

SEQ ID NO: 264769 - DNA, 12 bp, Homo sapiens
tcaatcatttct

SEQ ID NO: 264770 - DNA, 13 bp, Homo sapiens
tcaatcatttctc

SEQ ID NO: 264771 - DNA, 14 bp, Homo sapiens
tcaatcatttctca

SEQ ID NO: 264772 - DNA, 19 bp, Homo sapiens
tcaatcatttctcactgtg

SEQ ID NO: 264773 - DNA, 20 bp, Homo sapiens
tcaatccacagtattgttct

SEQ ID NO: 264774 - DNA, 20 bp, Homo sapiens
tcaatcccaattctgtccca

SEQ ID NO: 264775 - DNA, 14 bp, Homo sapiens
tcaatcctgtcaat

SEQ ID NO: 264776 - DNA, 20 bp, Homo sapiens
tcaatctcccgctgctgctg

SEQ ID NO: 264777 - DNA, 15 bp, Homo sapiens
tcaatctctgttctg

SEQ ID NO: 264778 - DNA, 19 bp, Homo sapiens
tcaatctctgttctgctcc

SEQ ID NO: 264779 - DNA, 17 bp, Homo sapiens
tcaatgaaaccttcctc

SEQ ID NO: 264780 - DNA, 19 bp, Homo sapiens
tcaatgaaaccttcctctt

SEQ ID NO: 264781 - DNA, 16 bp, Homo sapiens
tcaatgaaatatttgc

SEQ ID NO: 264782 - DNA, 15 bp, Homo sapiens
tcaatgacctgtatt

SEQ ID NO: 264783 - DNA, 17 bp, Homo sapiens
tcaatgaggttatgaga

SEQ ID NO: 264784 - DNA, 10 bp, Homo sapiens
tcaatgatct

SEQ ID NO: 264785 - DNA, 12 bp, Homo sapiens
tcaatgatctag

SEQ ID NO: 264786 - DNA, 13 bp, Homo sapiens
tcaatgatctagg

SEQ ID NO: 264787 - DNA, 17 bp, Homo sapiens
tcaatgatctaggttta

SEQ ID NO: 264788 - DNA, 22 bp, Homo sapiens
tcaatgatctaggtttaactca

SEQ ID NO: 264789 - DNA, 16 bp, Homo sapiens
tcaatgcattgtcttg

SEQ ID NO: 264790 - DNA, 14 bp, Homo sapiens
tcaatgcattttta

SEQ ID NO: 264791 - DNA, 13 bp, Homo sapiens
tcaatgccctgcc

SEQ ID NO: 264792 - DNA, 15 bp, Homo sapiens
tcaatgccctgccat

SEQ ID NO: 264793 - DNA, 16 bp, Homo sapiens
tcaatgctagaaaatc

SEQ ID NO: 264794 - DNA, 20 bp, Homo sapiens
tcaatggcaccttcattctc

SEQ ID NO: 264795 - DNA, 21 bp, Homo sapiens
tcaatggttgggacaatggca

SEQ ID NO: 264796 - DNA, 11 bp, Homo sapiens
tcaatgtcact

SEQ ID NO: 264797 - DNA, 13 bp, Homo sapiens
tcaatgtgcagtg

SEQ ID NO: 264798 - DNA, 22 bp, Homo sapiens
tcaatgtggaaaaaatatttta

SEQ ID NO: 264799 - DNA, 24 bp, Homo sapiens
acctggagggttgatatattcttt

SEQ ID NO: 264800 - DNA, 19 bp, Homo sapiens
acctggatggatctgctcc

SEQ ID NO: 264801 - DNA, 20 bp, Homo sapiens
acctggatggatctgctcca

SEQ ID NO: 264802 - DNA, 24 bp, Homo sapiens
acctggatggatctgctccatgca

SEQ ID NO: 264803 - DNA, 13 bp, Homo sapiens
acctggatgtact

SEQ ID NO: 264804 - DNA, 12 bp, Homo sapiens
acctggcctgct

SEQ ID NO: 264805 - DNA, 20 bp, Homo sapiens
acctggctgcgaactgtgca

SEQ ID NO: 264806 - DNA, 14 bp, Homo sapiens
acctggcttcccag

SEQ ID NO: 264807 - DNA, 15 bp, Homo sapiens
acctggcttcccagg

SEQ ID NO: 264808 - DNA, 17 bp, Homo sapiens
acctggcttcccaggac

SEQ ID NO: 264809 - DNA, 17 bp, Homo sapiens
acctggcttttacttta

SEQ ID NO: 264810 - DNA, 23 bp, Homo sapiens
acctgggaaaggacccacccatc

SEQ ID NO: 264811 - DNA, 22 bp, Homo sapiens
acctgggagatgctgggaccct

SEQ ID NO: 264812 - DNA, 14 bp, Homo sapiens
acctgggcacctgg

SEQ ID NO: 264813 - DNA, 18 bp, Homo sapiens
acctgggcccgggcaggc

SEQ ID NO: 264814 - DNA, 19 bp, Homo sapiens
acctgggcccgggcaggcc

SEQ ID NO: 264815 - DNA, 23 bp, Homo sapiens
acctgggcccgggcaggccagct

SEQ ID NO: 264816 - DNA, 13 bp, Homo sapiens
acctgggccctag

SEQ ID NO: 264817 - DNA, 14 bp, Homo sapiens
acctgggccctggt

SEQ ID NO: 264818 - DNA, 23 bp, Homo sapiens
acctgggcctcccatagtgctgg

SEQ ID NO: 264819 - DNA, 17 bp, Homo sapiens
acctgggctgggagaag

SEQ ID NO: 264820 - DNA, 14 bp, Homo sapiens
acctgggctgggcg

SEQ ID NO: 264821 - DNA, 13 bp, Homo sapiens
acctgggctttct

SEQ ID NO: 264822 - DNA, 19 bp, Homo sapiens
acctggggcagtcacctgc

SEQ ID NO: 264823 - DNA, 14 bp, Homo sapiens
acctggtggctgga

SEQ ID NO: 264824 - DNA, 18 bp, Homo sapiens
acctggtggctggaggca

SEQ ID NO: 264825 - DNA, 21 bp, Homo sapiens
acctgtaaaactttattttat

SEQ ID NO: 264826 - DNA, 17 bp, Homo sapiens
acctgtaatctcagcac

SEQ ID NO: 264827 - DNA, 16 bp, Homo sapiens
acctgtacactgactt

SEQ ID NO: 264828 - DNA, 20 bp, Homo sapiens
acctgtaggaaacagaaaag

SEQ ID NO: 264829 - DNA, 21 bp, Homo sapiens
acctgtaggaaacagaaaaga

SEQ ID NO: 264830 - DNA, 13 bp, Homo sapiens
acctgtcatctgg

SEQ ID NO: 264831 - DNA, 15 bp, Homo sapiens
acctgtcatctgggc

SEQ ID NO: 264832 - DNA, 18 bp, Homo sapiens
acctgtcatctgggccac

SEQ ID NO: 264833 - DNA, 12 bp, Homo sapiens
acctgtccaggt

SEQ ID NO: 264834 - DNA, 12 bp, Homo sapiens
acctgtctgtct

SEQ ID NO: 264835 - DNA, 20 bp, Homo sapiens
acctgtctgtctgtctgtcc

SEQ ID NO: 264836 - DNA, 17 bp, Homo sapiens
acctgtcttccaaggag

SEQ ID NO: 264837 - DNA, 13 bp, Homo sapiens
acctgtgaccagc

SEQ ID NO: 264838 - DNA, 15 bp, Homo sapiens
acctgtgagcatcct

SEQ ID NO: 264839 - DNA, 18 bp, Homo sapiens
acctgtgagtttaaagca

SEQ ID NO: 264840 - DNA, 14 bp, Homo sapiens
acctgtgccaggct

SEQ ID NO: 264841 - DNA, 21 bp, Homo sapiens
acctgtggggatttctcccag

SEQ ID NO: 264842 - DNA, 15 bp, Homo sapiens
acctgtgtgttcttt

SEQ ID NO: 264843 - DNA, 20 bp, Homo sapiens
acctgtgtgttcttttgata

SEQ ID NO: 264844 - DNA, 23 bp, Homo sapiens
acctgtgtgttcttttgatacat

SEQ ID NO: 264845 - DNA, 22 bp, Homo sapiens
acctgttaaggtggaaaatgga

SEQ ID NO: 264846 - DNA, 17 bp, Homo sapiens
acctgttcagtgtcccg

SEQ ID NO: 264847 - DNA, 20 bp, Homo sapiens
acctgttggttagctggaca

SEQ ID NO: 264848 - DNA, 19 bp, Homo sapiens
acctgtttctgcagccact

SEQ ID NO: 264849 - DNA, 16 bp, Homo sapiens
acctgtttttaagctg

SEQ ID NO: 264850 - DNA, 20 bp, Homo sapiens
acctgtttttaagctgtttc

SEQ ID NO: 264851 - DNA, 13 bp, Homo sapiens
accttaaattaaa

SEQ ID NO: 264852 - DNA, 21 bp, Homo sapiens
accttacaaccacatttctgg

SEQ ID NO: 264853 - DNA, 23 bp, Homo sapiens
accttatctgtgcgtgaaacaca

SEQ ID NO: 264854 - DNA, 23 bp, Homo sapiens
accttattagctaaaaatatata

SEQ ID NO: 264855 - DNA, 22 bp, Homo sapiens
accttattgtacctctcttata

SEQ ID NO: 264856 - DNA, 14 bp, Homo sapiens
accttcaaagctga

SEQ ID NO: 264857 - DNA, 20 bp, Homo sapiens
accttcaccaagcttagaag

SEQ ID NO: 264858 - DNA, 17 bp, Homo sapiens
accttcagatcctaccc

SEQ ID NO: 264859 - DNA, 14 bp, Homo sapiens
accttcagcagtta

SEQ ID NO: 264860 - DNA, 18 bp, Homo sapiens
accttcatttcaggaggg

SEQ ID NO: 264861 - DNA, 19 bp, Homo sapiens
accttccatggctcttttt

SEQ ID NO: 264862 - DNA, 17 bp, Homo sapiens
accttccctccacctgc

SEQ ID NO: 264863 - DNA, 15 bp, Homo sapiens
accttcctctggggc

SEQ ID NO: 264864 - DNA, 12 bp, Homo sapiens
accttcctgact

SEQ ID NO: 264865 - DNA, 20 bp, Homo sapiens
accttctaatccatgtgctg

SEQ ID NO: 264866 - DNA, 17 bp, Homo sapiens
accttctgaagatctca

SEQ ID NO: 264867 - DNA, 19 bp, Homo sapiens
accttctgtccccagccct

SEQ ID NO: 264868 - DNA, 20 bp, Homo sapiens
accttctgtccccagccctg

SEQ ID NO: 264869 - DNA, 14 bp, Homo sapiens
accttcttggcttc

SEQ ID NO: 264870 - DNA, 18 bp, Homo sapiens
accttcttggcttctggg

SEQ ID NO: 264871 - DNA, 18 bp, Homo sapiens
accttgagaccctcttct

SEQ ID NO: 264872 - DNA, 20 bp, Homo sapiens
accttgagaccctcttctct

SEQ ID NO: 264873 - DNA, 22 bp, Homo sapiens
accttgagaccctcttctctgg

SEQ ID NO: 264874 - DNA, 22 bp, Homo sapiens
accttgaggtcttttgacatgt

SEQ ID NO: 264875 - DNA, 16 bp, Homo sapiens
accttgatgtcttgag

SEQ ID NO: 264876 - DNA, 20 bp, Homo sapiens
accttgcactattggacttt

SEQ ID NO: 264877 - DNA, 21 bp, Homo sapiens
accttggaggaatgacaataa

SEQ ID NO: 264878 - DNA, 20 bp, Homo sapiens
accttgtcatgtaccatcaa

SEQ ID NO: 264879 - DNA, 23 bp, Homo sapiens
accttgtgactcagtgtatttta

SEQ ID NO: 264880 - DNA, 15 bp, Homo sapiens
accttgttggagcct

SEQ ID NO: 264881 - DNA, 17 bp, Homo sapiens
accttgttggagcctgc

SEQ ID NO: 264882 - DNA, 11 bp, Homo sapiens
acctttaaata

SEQ ID NO: 264883 - DNA, 12 bp, Homo sapiens
acctttaaatat

SEQ ID NO: 264884 - DNA, 20 bp, Homo sapiens
acctttaaatatcattcttt

SEQ ID NO: 264885 - DNA, 22 bp, Homo sapiens
acctttaaatatcattctttgt

SEQ ID NO: 264886 - DNA, 15 bp, Homo sapiens
acctttaagagaaat

SEQ ID NO: 264887 - DNA, 22 bp, Homo sapiens
acctttattaatgaactgtgac

SEQ ID NO: 264888 - DNA, 13 bp, Homo sapiens
acctttattcttt

SEQ ID NO: 264889 - DNA, 19 bp, Homo sapiens
acctttatttattaaactt

SEQ ID NO: 264890 - DNA, 20 bp, Homo sapiens
acctttatttattaaacttc

SEQ ID NO: 264891 - DNA, 22 bp, Homo sapiens
acctttatttattaaacttcag

SEQ ID NO: 264892 - DNA, 14 bp, Homo sapiens
acctttccactccc

SEQ ID NO: 264893 - DNA, 15 bp, Homo sapiens
acctttccactccca

SEQ ID NO: 264894 - DNA, 14 bp, Homo sapiens
acctttcccatttc

SEQ ID NO: 264895 - DNA, 21 bp, Homo sapiens
acctttgggatcagcctccgc

SEQ ID NO: 264896 - DNA, 14 bp, Homo sapiens
acctttgtgtaata

SEQ ID NO: 264897 - DNA, 14 bp, Homo sapiens
tcaccagctcagcc

SEQ ID NO: 264898 - DNA, 21 bp, Homo sapiens
tcaccagctcagccccggcca

SEQ ID NO: 264899 - DNA, 22 bp, Homo sapiens
tcaccaggaagaaggcccggga

SEQ ID NO: 264900 - DNA, 16 bp, Homo sapiens
tcaccaggagattaca

SEQ ID NO: 264901 - DNA, 22 bp, Homo sapiens
tcaccagggtccgcaccagctg

SEQ ID NO: 264902 - DNA, 19 bp, Homo sapiens
tcaccagtctgtctactgt

SEQ ID NO: 264903 - DNA, 15 bp, Homo sapiens
tcaccatcttggcca

SEQ ID NO: 264904 - DNA, 17 bp, Homo sapiens
tcaccatgtaaaacaaa

SEQ ID NO: 264905 - DNA, 20 bp, Homo sapiens
tcaccatttaatcatttcca

SEQ ID NO: 264906 - DNA, 21 bp, Homo sapiens
tcaccatttcatccatatttc

SEQ ID NO: 264907 - DNA, 23 bp, Homo sapiens
tcaccatttcatccatatttctt

SEQ ID NO: 264908 - DNA, 16 bp, Homo sapiens
tcaccatttggatcct

SEQ ID NO: 264909 - DNA, 17 bp, Homo sapiens
tcacccattgtctcatt

SEQ ID NO: 264910 - DNA, 12 bp, Homo sapiens
tcaccccaccct

SEQ ID NO: 264911 - DNA, 23 bp, Homo sapiens
tcaccccagtgcctgtctggagc

SEQ ID NO: 264912 - DNA, 15 bp, Homo sapiens
tcaccccggcaggcc

SEQ ID NO: 264913 - DNA, 19 bp, Homo sapiens
tcaccccggcaggccctgc

SEQ ID NO: 264914 - DNA, 20 bp, Homo sapiens
tcaccccggcaggccctgca

SEQ ID NO: 264915 - DNA, 21 bp, Homo sapiens
tcaccccggcaggccctgcag

SEQ ID NO: 264916 - DNA, 17 bp, Homo sapiens
tcaccccgttacagctc

SEQ ID NO: 264917 - DNA, 17 bp, Homo sapiens
tcacccctccacccttg

SEQ ID NO: 264918 - DNA, 15 bp, Homo sapiens
tcacccctgggcagg

SEQ ID NO: 264919 - DNA, 13 bp, Homo sapiens
tcaccccttcccc

SEQ ID NO: 264920 - DNA, 13 bp, Homo sapiens
tcacccgctgccc

SEQ ID NO: 264921 - DNA, 15 bp, Homo sapiens
tcaccctgccttatc

SEQ ID NO: 264922 - DNA, 20 bp, Homo sapiens
tcaccctgcttggggcctgg

SEQ ID NO: 264923 - DNA, 12 bp, Homo sapiens
tcacccttctgg

SEQ ID NO: 264924 - DNA, 23 bp, Homo sapiens
tcaccgagaggaaaaaggcttct

SEQ ID NO: 264925 - DNA, 14 bp, Homo sapiens
acgtctggggtgtg

SEQ ID NO: 264926 - DNA, 14 bp, Homo sapiens
acgtctgtcttcac

SEQ ID NO: 264927 - DNA, 15 bp, Homo sapiens
acgtctgtcttcaca

SEQ ID NO: 264928 - DNA, 16 bp, Homo sapiens
acgtcttggtgccttt

SEQ ID NO: 264929 - DNA, 18 bp, Homo sapiens
acgtgagagaatctgcct

SEQ ID NO: 264930 - DNA, 16 bp, Homo sapiens
acgtgagagaccctcg

SEQ ID NO: 264931 - DNA, 13 bp, Homo sapiens
acgtgccccccag

SEQ ID NO: 264932 - DNA, 16 bp, Homo sapiens
acgtgccccccagttc

SEQ ID NO: 264933 - DNA, 14 bp, Homo sapiens
acgtggacctgcct

SEQ ID NO: 264934 - DNA, 17 bp, Homo sapiens
acgtggacgtttttaat

SEQ ID NO: 264935 - DNA, 14 bp, Homo sapiens
acgtggagagctgg

SEQ ID NO: 264936 - DNA, 16 bp, Homo sapiens
acgtggagagctggtg

SEQ ID NO: 264937 - DNA, 18 bp, Homo sapiens
acgtggagagctggtgcc

SEQ ID NO: 264938 - DNA, 13 bp, Homo sapiens
acgtggagaggga

SEQ ID NO: 264939 - DNA, 15 bp, Homo sapiens
acgtggagagggatg

SEQ ID NO: 264940 - DNA, 19 bp, Homo sapiens
acgtggagatagtgccagg

SEQ ID NO: 264941 - DNA, 21 bp, Homo sapiens
acgtggaggaatgctccccca

SEQ ID NO: 264942 - DNA, 16 bp, Homo sapiens
acgtggcctcttgagc

SEQ ID NO: 264943 - DNA, 13 bp, Homo sapiens
acgtgggagaggc

SEQ ID NO: 264944 - DNA, 18 bp, Homo sapiens
acgtgggagaggcagaaa

SEQ ID NO: 264945 - DNA, 20 bp, Homo sapiens
acgtggggcagcacagagag

SEQ ID NO: 264946 - DNA, 19 bp, Homo sapiens
acgtgggtacccaggctgg

SEQ ID NO: 264947 - DNA, 14 bp, Homo sapiens
acgtggttcagaga

SEQ ID NO: 264948 - DNA, 14 bp, Homo sapiens
acgtgtaacttgtg

SEQ ID NO: 264949 - DNA, 22 bp, Homo sapiens
acgtgtcagaagcctccaagcc

SEQ ID NO: 264950 - DNA, 22 bp, Homo sapiens
acgtgtctggaatcccagctcc

SEQ ID NO: 264951 - DNA, 15 bp, Homo sapiens
acgtgtgatgtatgt

SEQ ID NO: 264952 - DNA, 14 bp, Homo sapiens
acgttatctcattg

SEQ ID NO: 264953 - DNA, 23 bp, Homo sapiens
acgttatctcattgcaaaaatat

SEQ ID NO: 264954 - DNA, 16 bp, Homo sapiens
acgttcacccctccac

SEQ ID NO: 264955 - DNA, 15 bp, Homo sapiens
acgttgatctcctgg

SEQ ID NO: 264956 - DNA, 13 bp, Homo sapiens
acgttgctcccca

SEQ ID NO: 264957 - DNA, 19 bp, Homo sapiens
acgttggacttttcgttaa

SEQ ID NO: 264958 - DNA, 16 bp, Homo sapiens
acgtttacttatctta

SEQ ID NO: 264959 - DNA, 19 bp, Homo sapiens
acgtttcagtaataaaaca

SEQ ID NO: 264960 - DNA, 12 bp, Homo sapiens
acgtttccatca

SEQ ID NO: 264961 - DNA, 15 bp, Homo sapiens
acgttttattgtgtt

SEQ ID NO: 264962 - DNA, 16 bp, Homo sapiens
acgttttattgtgttt

SEQ ID NO: 264963 - DNA, 21 bp, Homo sapiens
actaaaaagtggctaattcaa

SEQ ID NO: 264964 - DNA, 17 bp, Homo sapiens
actaaaagacatttgtt

SEQ ID NO: 264965 - DNA, 12 bp, Homo sapiens
actaaaattcaa

SEQ ID NO: 264966 - DNA, 13 bp, Homo sapiens
actaaaattcaac

SEQ ID NO: 264967 - DNA, 14 bp, Homo sapiens
actaaaattcaaca

SEQ ID NO: 264968 - DNA, 17 bp, Homo sapiens
actaaagcaggcctttt

SEQ ID NO: 264969 - DNA, 20 bp, Homo sapiens
actaaagcaggccttttgat

SEQ ID NO: 264970 - DNA, 19 bp, Homo sapiens
actaaagcagtgttttcac

SEQ ID NO: 264971 - DNA, 16 bp, Homo sapiens
actaaagtatttaaag

SEQ ID NO: 264972 - DNA, 21 bp, Homo sapiens
actaaataacacagatattgt

SEQ ID NO: 264973 - DNA, 17 bp, Homo sapiens
actaaatagatttttag

SEQ ID NO: 264974 - DNA, 18 bp, Homo sapiens
actaaatagatttttaga

SEQ ID NO: 264975 - DNA, 16 bp, Homo sapiens
actaaatctctaatat

SEQ ID NO: 264976 - DNA, 19 bp, Homo sapiens
actaaatctgtaagctctt

SEQ ID NO: 264977 - DNA, 15 bp, Homo sapiens
actaaatttctcagt

SEQ ID NO: 264978 - DNA, 17 bp, Homo sapiens
actaacagataagcaag

SEQ ID NO: 264979 - DNA, 12 bp, Homo sapiens
actaacatccca

SEQ ID NO: 264980 - DNA, 14 bp, Homo sapiens
actaaccatcccca

SEQ ID NO: 264981 - DNA, 16 bp, Homo sapiens
actaaccatccccaac

SEQ ID NO: 264982 - DNA, 11 bp, Homo sapiens
actaaccattt

SEQ ID NO: 264983 - DNA, 18 bp, Homo sapiens
actaacctggagacagta

SEQ ID NO: 264984 - DNA, 14 bp, Homo sapiens
actaagaaaagata

SEQ ID NO: 264985 - DNA, 20 bp, Homo sapiens
actaagaagatgttttgaaa

SEQ ID NO: 264986 - DNA, 22 bp, Homo sapiens
actaagaagtggtgttccatga

SEQ ID NO: 264987 - DNA, 15 bp, Homo sapiens
actaagatgaaattg

SEQ ID NO: 264988 - DNA, 15 bp, Homo sapiens
actaagccacaagaa

SEQ ID NO: 264989 - DNA, 12 bp, Homo sapiens
actaagccagga

SEQ ID NO: 264990 - DNA, 13 bp, Homo sapiens
actaagccaggag

SEQ ID NO: 264991 - DNA, 22 bp, Homo sapiens
actaagccctgtcgagacactt

SEQ ID NO: 264992 - DNA, 16 bp, Homo sapiens
actaagctttctcctt

SEQ ID NO: 264993 - DNA, 22 bp, Homo sapiens
actaaggtacggtgagactctg

SEQ ID NO: 264994 - DNA, 23 bp, Homo sapiens
actaataaaaaactgtgaaccct

SEQ ID NO: 264995 - DNA, 15 bp, Homo sapiens
actaatagagtactt

SEQ ID NO: 264996 - DNA, 20 bp, Homo sapiens
actaatagagtacttaatat

SEQ ID NO: 264997 - DNA, 22 bp, Homo sapiens
actaatatgggcattgtagtta

SEQ ID NO: 264998 - DNA, 18 bp, Homo sapiens
actaatctattgggttca

SEQ ID NO: 264999 - DNA, 14 bp, Homo sapiens
actaatctttctgc

SEQ ID NO: 265000 - DNA, 22 bp, Homo sapiens
actaatgaccacacctgcctct

SEQ ID NO: 265001 - DNA, 13 bp, Homo sapiens
actaatgatgttt

SEQ ID NO: 265002 - DNA, 14 bp, Homo sapiens
actaattaaaaaat

SEQ ID NO: 265003 - DNA, 16 bp, Homo sapiens
actaattaacatataa

SEQ ID NO: 265004 - DNA, 18 bp, Homo sapiens
actaattaacatataata

SEQ ID NO: 265005 - DNA, 14 bp, Homo sapiens
actaatttggtttt

SEQ ID NO: 265006 - DNA, 16 bp, Homo sapiens
actacaaaatttgaaa

SEQ ID NO: 265007 - DNA, 13 bp, Homo sapiens
actacaacctcca

SEQ ID NO: 265008 - DNA, 20 bp, Homo sapiens
actacacatccctaatgtgt

SEQ ID NO: 265009 - DNA, 23 bp, Homo sapiens
actacacatccctaatgtgtgcc

SEQ ID NO: 265010 - DNA, 18 bp, Homo sapiens
actacagaaagcaaatca

SEQ ID NO: 265011 - DNA, 14 bp, Homo sapiens
actacagagcagct

SEQ ID NO: 265012 - DNA, 19 bp, Homo sapiens
actacagagcagctcccca

SEQ ID NO: 265013 - DNA, 22 bp, Homo sapiens
actacagagcagctccccagga

SEQ ID NO: 265014 - DNA, 15 bp, Homo sapiens
actacagaggattct

SEQ ID NO: 265015 - DNA, 19 bp, Homo sapiens
actacaggtattttcatca

SEQ ID NO: 265016 - DNA, 13 bp, Homo sapiens
actacatttatga

SEQ ID NO: 265017 - DNA, 15 bp, Homo sapiens
actacatttgcatgc

SEQ ID NO: 265018 - DNA, 16 bp, Homo sapiens
actacatttgcatgcc

SEQ ID NO: 265019 - DNA, 14 bp, Homo sapiens
actaccacaaggaa

SEQ ID NO: 265020 - DNA, 15 bp, Homo sapiens
actaccacaaggaaa

SEQ ID NO: 265021 - DNA, 14 bp, Homo sapiens
actaccagatgacc

SEQ ID NO: 265022 - DNA, 16 bp, Homo sapiens
actacccgagcccagc

SEQ ID NO: 265023 - DNA, 21 bp, Homo sapiens
actacccgagcccagctacat

SEQ ID NO: 265024 - DNA, 20 bp, Homo sapiens
actaccctacacctctgggc

SEQ ID NO: 265025 - DNA, 13 bp, Homo sapiens
actacctataaat

SEQ ID NO: 265026 - DNA, 15 bp, Homo sapiens
actacctataaatgg

SEQ ID NO: 265027 - DNA, 18 bp, Homo sapiens
actacctataaatggact

SEQ ID NO: 265028 - DNA, 19 bp, Homo sapiens
actacctttggcttaattc

SEQ ID NO: 265029 - DNA, 20 bp, Homo sapiens
actacctttgtccaggcctg

SEQ ID NO: 265030 - DNA, 14 bp, Homo sapiens
actactattctgtt

SEQ ID NO: 265031 - DNA, 13 bp, Homo sapiens
actactctgtgcc

SEQ ID NO: 265032 - DNA, 13 bp, Homo sapiens
actactgaaattt

SEQ ID NO: 265033 - DNA, 14 bp, Homo sapiens
actactgaactgtt

SEQ ID NO: 265034 - DNA, 16 bp, Homo sapiens
actactgcaaaaagta

SEQ ID NO: 265035 - DNA, 14 bp, Homo sapiens
actactggtctgta

SEQ ID NO: 265036 - DNA, 15 bp, Homo sapiens
actactgtacatttt

SEQ ID NO: 265037 - DNA, 18 bp, Homo sapiens
actactgtgttcctggca

SEQ ID NO: 265038 - DNA, 16 bp, Homo sapiens
actacttacttagaga

SEQ ID NO: 265039 - DNA, 19 bp, Homo sapiens
actagaaagtgaataaaaa

SEQ ID NO: 265040 - DNA, 20 bp, Homo sapiens
actagaagctgatctgattg

SEQ ID NO: 265041 - DNA, 14 bp, Homo sapiens
actagaagggccag

SEQ ID NO: 265042 - DNA, 23 bp, Homo sapiens
actagaagggccagtcctgcctg

SEQ ID NO: 265043 - DNA, 16 bp, Homo sapiens
actagacaaataacta

SEQ ID NO: 265044 - DNA, 16 bp, Homo sapiens
actagacgttcatttg

SEQ ID NO: 265045 - DNA, 15 bp, Homo sapiens
actagactactcaat

SEQ ID NO: 265046 - DNA, 11 bp, Homo sapiens
actagactctt

SEQ ID NO: 265047 - DNA, 19 bp, Homo sapiens
actagactcttcactgtta

SEQ ID NO: 265048 - DNA, 20 bp, Homo sapiens
actagacttgaggaaaccag

SEQ ID NO: 265049 - DNA, 16 bp, Homo sapiens
actagagacaaatctt

SEQ ID NO: 265050 - DNA, 15 bp, Homo sapiens
actagagtctgaaca

SEQ ID NO: 265051 - DNA, 20 bp, Homo sapiens
actagagtctgaacagctgt

SEQ ID NO: 265052 - DNA, 13 bp, Homo sapiens
actagatctcctg

SEQ ID NO: 265053 - DNA, 14 bp, Homo sapiens
actagatctcctgt

SEQ ID NO: 265054 - DNA, 16 bp, Homo sapiens
actagatctcctgtaa

SEQ ID NO: 265055 - DNA, 18 bp, Homo sapiens
actagatcttacatctgc

SEQ ID NO: 265056 - DNA, 15 bp, Homo sapiens
actagatggtgctga

SEQ ID NO: 265057 - DNA, 21 bp, Homo sapiens
tatcactctgaccttcacagg

SEQ ID NO: 265058 - DNA, 12 bp, Homo sapiens
tatcactttgta

SEQ ID NO: 265059 - DNA, 17 bp, Homo sapiens
tatcagagtatgtcagt

SEQ ID NO: 265060 - DNA, 15 bp, Homo sapiens
tatcagattgctttt

SEQ ID NO: 265061 - DNA, 19 bp, Homo sapiens
tatcagcagacactccagt

SEQ ID NO: 265062 - DNA, 19 bp, Homo sapiens
tatcagtacaattctttgt

SEQ ID NO: 265063 - DNA, 20 bp, Homo sapiens
tatcagtgacagagttcact

SEQ ID NO: 265064 - DNA, 23 bp, Homo sapiens
tatcagtgatggtctcacagagc

SEQ ID NO: 265065 - DNA, 13 bp, Homo sapiens
tatcagtgttctt

SEQ ID NO: 265066 - DNA, 14 bp, Homo sapiens
tatcagttggacag

SEQ ID NO: 265067 - DNA, 15 bp, Homo sapiens
tatcagttggacagt

SEQ ID NO: 265068 - DNA, 15 bp, Homo sapiens
tatcatattggtatt

SEQ ID NO: 265069 - DNA, 13 bp, Homo sapiens
tatcatatttaat

SEQ ID NO: 265070 - DNA, 18 bp, Homo sapiens
tatcatgaagccttgctg

SEQ ID NO: 265071 - DNA, 21 bp, Homo sapiens
tatcatgaagccttgctgaac

SEQ ID NO: 265072 - DNA, 12 bp, Homo sapiens
tatcattaaaca

SEQ ID NO: 265073 - DNA, 12 bp, Homo sapiens
tatcattcagca

SEQ ID NO: 265074 - DNA, 13 bp, Homo sapiens
tatcattcagcaa

SEQ ID NO: 265075 - DNA, 14 bp, Homo sapiens
tatcattctttgta

SEQ ID NO: 265076 - DNA, 20 bp, Homo sapiens
tatcatttattttttacatt

SEQ ID NO: 265077 - DNA, 13 bp, Homo sapiens
tatcatttctact

SEQ ID NO: 265078 - DNA, 20 bp, Homo sapiens
tatccaaagaacttgatttg

SEQ ID NO: 265079 - DNA, 23 bp, Homo sapiens
tatccaaagaacttgatttgcat

SEQ ID NO: 265080 - DNA, 14 bp, Homo sapiens
tatccaaagactgt

SEQ ID NO: 265081 - DNA, 21 bp, Homo sapiens
tatccaaagactgtactggcc

SEQ ID NO: 265082 - DNA, 16 bp, Homo sapiens
tatccaaagcattgca

SEQ ID NO: 265083 - DNA, 18 bp, Homo sapiens
tatccaaccaacttggtt

SEQ ID NO: 265084 - DNA, 20 bp, Homo sapiens
tatccaagtaccaatgctgt

SEQ ID NO: 265085 - DNA, 18 bp, Homo sapiens
tatccaattaaaattaag

SEQ ID NO: 265086 - DNA, 14 bp, Homo sapiens
tatccaattatgtg

SEQ ID NO: 265087 - DNA, 21 bp, Homo sapiens
tatccaattatgtgacaacct

SEQ ID NO: 265088 - DNA, 18 bp, Homo sapiens
tatccatgtactgtagtt

SEQ ID NO: 265089 - DNA, 22 bp, Homo sapiens
tatccatttaaactaacctttt

SEQ ID NO: 265090 - DNA, 15 bp, Homo sapiens
tatcccacctccagc

SEQ ID NO: 265091 - DNA, 17 bp, Homo sapiens
tatcccacctccagccc

SEQ ID NO: 265092 - DNA, 13 bp, Homo sapiens
tatccccaagctg

SEQ ID NO: 265093 - DNA, 13 bp, Homo sapiens
tatccccaggcca

SEQ ID NO: 265094 - DNA, 19 bp, Homo sapiens
tatcccccccctgtatagt

SEQ ID NO: 265095 - DNA, 21 bp, Homo sapiens
tatcccccccctgtatagtta

SEQ ID NO: 265096 - DNA, 18 bp, Homo sapiens
tatcccttctcacagcac

SEQ ID NO: 265097 - DNA, 17 bp, Homo sapiens
tatcccttctcagaaaa

SEQ ID NO: 265098 - DNA, 22 bp, Homo sapiens
tatccctttctctcttgtccaa

SEQ ID NO: 265099 - DNA, 15 bp, Homo sapiens
tatcctacaacaaga

SEQ ID NO: 265100 - DNA, 19 bp, Homo sapiens
tatcctacaacaagagttt

SEQ ID NO: 265101 - DNA, 18 bp, Homo sapiens
tatcctaggggtgcgctc

SEQ ID NO: 265102 - DNA, 14 bp, Homo sapiens
tatcctagttccat

SEQ ID NO: 265103 - DNA, 19 bp, Homo sapiens
tatcctcctgcaagagtgg

SEQ ID NO: 265104 - DNA, 14 bp, Homo sapiens
tatcctgataaaca

SEQ ID NO: 265105 - DNA, 13 bp, Homo sapiens
tatcctgcaccct

SEQ ID NO: 265106 - DNA, 16 bp, Homo sapiens
tatcctgcaccctctg

SEQ ID NO: 265107 - DNA, 18 bp, Homo sapiens
tatcctgccaaaatcatt

SEQ ID NO: 265108 - DNA, 16 bp, Homo sapiens
tatcctgcccagtgtt

SEQ ID NO: 265109 - DNA, 18 bp, Homo sapiens
tatcctgctagctgtaga

SEQ ID NO: 265110 - DNA, 15 bp, Homo sapiens
tatcctggtgtctag

SEQ ID NO: 265111 - DNA, 18 bp, Homo sapiens
tatcctggtgtctagttt

SEQ ID NO: 265112 - DNA, 14 bp, Homo sapiens
tatcctgtgctaca

SEQ ID NO: 265113 - DNA, 18 bp, Homo sapiens
tatcctgtgctacagaga

SEQ ID NO: 265114 - DNA, 22 bp, Homo sapiens
tatcctgtgctacagagaaaat

SEQ ID NO: 265115 - DNA, 15 bp, Homo sapiens
tatcctgttactgaa

SEQ ID NO: 265116 - DNA, 16 bp, Homo sapiens
tatccttggagagcag

SEQ ID NO: 265117 - DNA, 18 bp, Homo sapiens
tatccttggagagcagct

SEQ ID NO: 265118 - DNA, 19 bp, Homo sapiens
tatccttggagagcagctg

SEQ ID NO: 265119 - DNA, 20 bp, Homo sapiens
tatccttggagagcagctgg

SEQ ID NO: 265120 - DNA, 17 bp, Homo sapiens
tatcctttctaacaaaa

SEQ ID NO: 265121 - DNA, 12 bp, Homo sapiens
actctccccaca

SEQ ID NO: 265122 - DNA, 19 bp, Homo sapiens
actctccccagtgcctgcc

SEQ ID NO: 265123 - DNA, 12 bp, Homo sapiens
actctcctagag

SEQ ID NO: 265124 - DNA, 13 bp, Homo sapiens
actctcctagaga

SEQ ID NO: 265125 - DNA, 18 bp, Homo sapiens
actctcctcctcccctcc

SEQ ID NO: 265126 - DNA, 19 bp, Homo sapiens
actctcctcctcccctcct

SEQ ID NO: 265127 - DNA, 20 bp, Homo sapiens
actctcctcctcccctcctc

SEQ ID NO: 265128 - DNA, 13 bp, Homo sapiens
actctcctctttt

SEQ ID NO: 265129 - DNA, 20 bp, Homo sapiens
actctcctgctcctcaggaa

SEQ ID NO: 265130 - DNA, 11 bp, Homo sapiens
actctcctggg

SEQ ID NO: 265131 - DNA, 17 bp, Homo sapiens
actctcctgggcccctc

SEQ ID NO: 265132 - DNA, 18 bp, Homo sapiens
actctcctgggcccctcc

SEQ ID NO: 265133 - DNA, 23 bp, Homo sapiens
tcactggaacctccctgggcctg

SEQ ID NO: 265134 - DNA, 13 bp, Homo sapiens
tcactggatgaaa

SEQ ID NO: 265135 - DNA, 11 bp, Homo sapiens
tcactgggtgg

SEQ ID NO: 265136 - DNA, 15 bp, Homo sapiens
tcactgtcctggctt

SEQ ID NO: 265137 - DNA, 12 bp, Homo sapiens
tcactgtctttc

SEQ ID NO: 265138 - DNA, 14 bp, Homo sapiens
tcactgtctttcct

SEQ ID NO: 265139 - DNA, 15 bp, Homo sapiens
tcactgtctttccta

SEQ ID NO: 265140 - DNA, 16 bp, Homo sapiens
tcactgtctttcctag

SEQ ID NO: 265141 - DNA, 14 bp, Homo sapiens
tcactgtgctccta

SEQ ID NO: 265142 - DNA, 15 bp, Homo sapiens
tcactgtgtacataa

SEQ ID NO: 265143 - DNA, 17 bp, Homo sapiens
tcactgtgtacataatg

SEQ ID NO: 265144 - DNA, 21 bp, Homo sapiens
tcactgttccctctgctcctg

SEQ ID NO: 265145 - DNA, 19 bp, Homo sapiens
tcactgttgaaaattattt

SEQ ID NO: 265146 - DNA, 17 bp, Homo sapiens
tcactgtttctctgctg

SEQ ID NO: 265147 - DNA, 23 bp, Homo sapiens
tcacttaaaatcaaatttttctg

SEQ ID NO: 265148 - DNA, 21 bp, Homo sapiens
tcacttaaactttgtcacttc

SEQ ID NO: 265149 - DNA, 17 bp, Homo sapiens
tcacttaaatgttacca

SEQ ID NO: 265150 - DNA, 15 bp, Homo sapiens
tcacttcaccctgga

SEQ ID NO: 265151 - DNA, 16 bp, Homo sapiens
tcacttccccttccaa

SEQ ID NO: 265152 - DNA, 17 bp, Homo sapiens
tcacttcctacaagagc

SEQ ID NO: 265153 - DNA, 22 bp, Homo sapiens
tcacttcgcgtgccctcgctgc

SEQ ID NO: 265154 - DNA, 13 bp, Homo sapiens
tcacttctaaatg

SEQ ID NO: 265155 - DNA, 17 bp, Homo sapiens
tcacttctatttattta

SEQ ID NO: 265156 - DNA, 13 bp, Homo sapiens
tcacttctccccg

SEQ ID NO: 265157 - DNA, 17 bp, Homo sapiens
tcacttctccccgcagc

SEQ ID NO: 265158 - DNA, 16 bp, Homo sapiens
tcacttgactcttgaa

SEQ ID NO: 265159 - DNA, 18 bp, Homo sapiens
tcacttgactcttgaata

SEQ ID NO: 265160 - DNA, 16 bp, Homo sapiens
tcacttgagcccagga

SEQ ID NO: 265161 - DNA, 17 bp, Homo sapiens
tcacttgtgcagtgttg

SEQ ID NO: 265162 - DNA, 18 bp, Homo sapiens
tcacttgtgtttgtatat

SEQ ID NO: 265163 - DNA, 21 bp, Homo sapiens
tcactttaccttcagcagtta

SEQ ID NO: 265164 - DNA, 12 bp, Homo sapiens
tcactttgctct

SEQ ID NO: 265165 - DNA, 13 bp, Homo sapiens
tcacttttcagtg

SEQ ID NO: 265166 - DNA, 14 bp, Homo sapiens
tcacttttcagtga

SEQ ID NO: 265167 - DNA, 16 bp, Homo sapiens
tcacttttcagtgatg

SEQ ID NO: 265168 - DNA, 13 bp, Homo sapiens
tcacttttttcct

SEQ ID NO: 265169 - DNA, 11 bp, Homo sapiens
tcagaaaagac

SEQ ID NO: 265170 - DNA, 15 bp, Homo sapiens
tcagaaaagacactt

SEQ ID NO: 265171 - DNA, 19 bp, Homo sapiens
tcagaaaatattatgtgtt

SEQ ID NO: 265172 - DNA, 20 bp, Homo sapiens
tcagaaaatattatgtgttt

SEQ ID NO: 265173 - DNA, 22 bp, Homo sapiens
tcagaaacaaagcatttgactt

SEQ ID NO: 265174 - DNA, 19 bp, Homo sapiens
tcagaaaccattgttcaga

SEQ ID NO: 265175 - DNA, 22 bp, Homo sapiens
tcagaaaccattgttcagaaga

SEQ ID NO: 265176 - DNA, 15 bp, Homo sapiens
tcagaaacttgtgaa

SEQ ID NO: 265177 - DNA, 22 bp, Homo sapiens
tcagaaagggcagcccctcccc

SEQ ID NO: 265178 - DNA, 19 bp, Homo sapiens
tcagaaatgctgcctgcct

SEQ ID NO: 265179 - DNA, 15 bp, Homo sapiens
tcagaacatgaaatg

SEQ ID NO: 265180 - DNA, 15 bp, Homo sapiens
tcagaacctcttccc

SEQ ID NO: 265181 - DNA, 16 bp, Homo sapiens
tcagaacctcttcccc

SEQ ID NO: 265182 - DNA, 17 bp, Homo sapiens
tcagaacctcttcccca

SEQ ID NO: 265183 - DNA, 20 bp, Homo sapiens
tcagaacctcttccccagaa

SEQ ID NO: 265184 - DNA, 14 bp, Homo sapiens
tcagaactcctgtg

SEQ ID NO: 265185 - DNA, 13 bp, Homo sapiens
tcagaactctcag

SEQ ID NO: 265186 - DNA, 14 bp, Homo sapiens
tcagaactgggaaa

SEQ ID NO: 265187 - DNA, 22 bp, Homo sapiens
tcagaactgttggctgctcccc

SEQ ID NO: 265188 - DNA, 19 bp, Homo sapiens
tcagaacttgtaactaaag

SEQ ID NO: 265189 - DNA, 19 bp, Homo sapiens
tcagaagagggagaggagg

SEQ ID NO: 265190 - DNA, 12 bp, Homo sapiens
tcagaagataac

SEQ ID NO: 265191 - DNA, 20 bp, Homo sapiens
tcagaagcctattgtaaata

SEQ ID NO: 265192 - DNA, 17 bp, Homo sapiens
tcagaagtgaaaaagac

SEQ ID NO: 265193 - DNA, 18 bp, Homo sapiens
tcagaagtgaaaaagact

SEQ ID NO: 265194 - DNA, 23 bp, Homo sapiens
tcagaataaatgggtaacactga

SEQ ID NO: 265195 - DNA, 19 bp, Homo sapiens
tcagaccccagttctaggg

SEQ ID NO: 265196 - DNA, 16 bp, Homo sapiens
tcagacccctgcctgg

SEQ ID NO: 265197 - DNA, 17 bp, Homo sapiens
tcagacccttgaagatg

SEQ ID NO: 265198 - DNA, 16 bp, Homo sapiens
tcagacctgtcttcca

SEQ ID NO: 265199 - DNA, 15 bp, Homo sapiens
tcagaccttcttcca

SEQ ID NO: 265200 - DNA, 20 bp, Homo sapiens
tcagacgagacaccctaact

SEQ ID NO: 265201 - DNA, 16 bp, Homo sapiens
tcagactctaaacaca

SEQ ID NO: 265202 - DNA, 21 bp, Homo sapiens
tcagactctaaacacacaagt

SEQ ID NO: 265203 - DNA, 14 bp, Homo sapiens
tcagactctctcct

SEQ ID NO: 265204 - DNA, 17 bp, Homo sapiens
tcagactctctcctctc

SEQ ID NO: 265205 - DNA, 14 bp, Homo sapiens
tcagagaaaacact

SEQ ID NO: 265206 - DNA, 20 bp, Homo sapiens
tcagagaaggaaaagactga

SEQ ID NO: 265207 - DNA, 14 bp, Homo sapiens
tcagagactggcag

SEQ ID NO: 265208 - DNA, 16 bp, Homo sapiens
tcagagactggcagcc

SEQ ID NO: 265209 - DNA, 18 bp, Homo sapiens
tcagagactggcagccag

SEQ ID NO: 265210 - DNA, 22 bp, Homo sapiens
tcagagactggcagccagggag

SEQ ID NO: 265211 - DNA, 22 bp, Homo sapiens
tcagagaggccttttgtttaaa

SEQ ID NO: 265212 - DNA, 17 bp, Homo sapiens
tcagagaggtctcaggt

SEQ ID NO: 265213 - DNA, 21 bp, Homo sapiens
tcagagagtgtacatcatgtt

SEQ ID NO: 265214 - DNA, 18 bp, Homo sapiens
tcagagatgtaccatgtt

SEQ ID NO: 265215 - DNA, 15 bp, Homo sapiens
tcagagcagagcaaa

SEQ ID NO: 265216 - DNA, 14 bp, Homo sapiens
tcagagcatgtgtc

SEQ ID NO: 265217 - DNA, 15 bp, Homo sapiens
tcagagcatgtgtca

SEQ ID NO: 265218 - DNA, 22 bp, Homo sapiens
tcagagccacccaggccactga

SEQ ID NO: 265219 - DNA, 14 bp, Homo sapiens
tcagagccagtgaa

SEQ ID NO: 265220 - DNA, 18 bp, Homo sapiens
tcagagccagtgaaggag

SEQ ID NO: 265221 - DNA, 18 bp, Homo sapiens
tcagagcccacatggccg

SEQ ID NO: 265222 - DNA, 21 bp, Homo sapiens
tcagagcccacatggccgggc

SEQ ID NO: 265223 - DNA, 13 bp, Homo sapiens
tcagagctcttaa

SEQ ID NO: 265224 - DNA, 16 bp, Homo sapiens
tcagagctcttaatgt

SEQ ID NO: 265225 - DNA, 14 bp, Homo sapiens
tcagagctgggagt

SEQ ID NO: 265226 - DNA, 21 bp, Homo sapiens
tcagagcttgattagaagcca

SEQ ID NO: 265227 - DNA, 21 bp, Homo sapiens
tcagagggactgtcagctgag

SEQ ID NO: 265228 - DNA, 23 bp, Homo sapiens
tcagagggtgtcgtcctgcagtg

SEQ ID NO: 265229 - DNA, 17 bp, Homo sapiens
tcagaggtggctctgga

SEQ ID NO: 265230 - DNA, 22 bp, Homo sapiens
tcagagtggccaatccctgtgt

SEQ ID NO: 265231 - DNA, 22 bp, Homo sapiens
tcagagtggtttcattgccttc

SEQ ID NO: 265232 - DNA, 17 bp, Homo sapiens
tcagagttccacagttg

SEQ ID NO: 265233 - DNA, 14 bp, Homo sapiens
tcagagttctctgt

SEQ ID NO: 265234 - DNA, 15 bp, Homo sapiens
tcagataatcggtgc

SEQ ID NO: 265235 - DNA, 18 bp, Homo sapiens
tcagatatatatcatatt

SEQ ID NO: 265236 - DNA, 16 bp, Homo sapiens
tcagatattttgcacg

SEQ ID NO: 265237 - DNA, 15 bp, Homo sapiens
tcagatcactactgc

SEQ ID NO: 265238 - DNA, 16 bp, Homo sapiens
tcagatcactactgca

SEQ ID NO: 265239 - DNA, 17 bp, Homo sapiens
tcagatcactactgcag

SEQ ID NO: 265240 - DNA, 18 bp, Homo sapiens
tcagatcactactgcagt

SEQ ID NO: 265241 - DNA, 16 bp, Homo sapiens
tcagatccctcggtca

SEQ ID NO: 265242 - DNA, 12 bp, Homo sapiens
tcagatcctacc

SEQ ID NO: 265243 - DNA, 14 bp, Homo sapiens
tcagatcctgctgc

SEQ ID NO: 265244 - DNA, 18 bp, Homo sapiens
tcagatcctgctgccgcg

SEQ ID NO: 265245 - DNA, 13 bp, Homo sapiens
tcagatcttacaa

SEQ ID NO: 265246 - DNA, 13 bp, Homo sapiens
tcagatgaaaata

SEQ ID NO: 265247 - DNA, 22 bp, Homo sapiens
tcagatgagcaaggacattgcc

SEQ ID NO: 265248 - DNA, 21 bp, Homo sapiens
tcagatggaggttctcagagc

SEQ ID NO: 265249 - DNA, 17 bp, Homo sapiens
tcagatggatgtagata

SEQ ID NO: 265250 - DNA, 13 bp, Homo sapiens
tcagatgtcttct

SEQ ID NO: 265251 - DNA, 14 bp, Homo sapiens
tcagatgtcttctg

SEQ ID NO: 265252 - DNA, 22 bp, Homo sapiens
tcagatgtcttctgcctgttat

SEQ ID NO: 265253 - DNA, 15 bp, Homo sapiens
tcagatttccagtct

SEQ ID NO: 265254 - DNA, 17 bp, Homo sapiens
tcagatttccagtctcc

SEQ ID NO: 265255 - DNA, 21 bp, Homo sapiens
tcagattttaaaaagtcttca

SEQ ID NO: 265256 - DNA, 18 bp, Homo sapiens
tcagcaagacaatgacac

SEQ ID NO: 265257 - DNA, 12 bp, Homo sapiens
tcagcaagagaa

SEQ ID NO: 265258 - DNA, 16 bp, Homo sapiens
tcagcaagtgtacagt

SEQ ID NO: 265259 - DNA, 17 bp, Homo sapiens
tcagcaagtgtacagta

SEQ ID NO: 265260 - DNA, 18 bp, Homo sapiens
tcagcaagtgtacagtat

SEQ ID NO: 265261 - DNA, 18 bp, Homo sapiens
tcagcacagcctcacccc

SEQ ID NO: 265262 - DNA, 17 bp, Homo sapiens
tcagcacccccacccac

SEQ ID NO: 265263 - DNA, 13 bp, Homo sapiens
tcagcaccctggg

SEQ ID NO: 265264 - DNA, 14 bp, Homo sapiens
tcagcaccctgggt

SEQ ID NO: 265265 - DNA, 21 bp, Homo sapiens
tcagcactgtcccttgcctca

SEQ ID NO: 265266 - DNA, 17 bp, Homo sapiens
tcagcagacactccagt

SEQ ID NO: 265267 - DNA, 14 bp, Homo sapiens
tcagcagccccctg

SEQ ID NO: 265268 - DNA, 16 bp, Homo sapiens
tcagcagcgtgcaata

SEQ ID NO: 265269 - DNA, 17 bp, Homo sapiens
tcagcaggggtgggagg

SEQ ID NO: 265270 - DNA, 20 bp, Homo sapiens
tcagcagtacctataaagta

SEQ ID NO: 265271 - DNA, 16 bp, Homo sapiens
tccagaacgtctctca

SEQ ID NO: 265272 - DNA, 18 bp, Homo sapiens
tccagaagaatattcagg

SEQ ID NO: 265273 - DNA, 20 bp, Homo sapiens
tccagaagaatattcaggac

SEQ ID NO: 265274 - DNA, 18 bp, Homo sapiens
tccagaagatgccctcca

SEQ ID NO: 265275 - DNA, 16 bp, Homo sapiens
tccagaagcctctggc

SEQ ID NO: 265276 - DNA, 17 bp, Homo sapiens
tccagaagcctctggct

SEQ ID NO: 265277 - DNA, 15 bp, Homo sapiens
tccagaatgtaagaa

SEQ ID NO: 265278 - DNA, 18 bp, Homo sapiens
tccagaatgtaagaaaac

SEQ ID NO: 265279 - DNA, 22 bp, Homo sapiens
tccagaatgtaagaaaacaaaa

SEQ ID NO: 265280 - DNA, 23 bp, Homo sapiens
tccagaatgtaagaaaacaaaat

SEQ ID NO: 265281 - DNA, 16 bp, Homo sapiens
tccagaattgaccttt

SEQ ID NO: 265282 - DNA, 13 bp, Homo sapiens
tccagaattgaga

SEQ ID NO: 265283 - DNA, 14 bp, Homo sapiens
tccagaatttccca

SEQ ID NO: 265284 - DNA, 16 bp, Homo sapiens
tccagaatttcccaaa

SEQ ID NO: 265285 - DNA, 22 bp, Homo sapiens
tccagaatttcccaaagcagtg

SEQ ID NO: 265286 - DNA, 19 bp, Homo sapiens
tccagaatttggaagctag

SEQ ID NO: 265287 - DNA, 10 bp, Homo sapiens
tccagacaga

SEQ ID NO: 265288 - DNA, 16 bp, Homo sapiens
tccagacagggtgggg

SEQ ID NO: 265289 - DNA, 18 bp, Homo sapiens
tccagacagggtggggct

SEQ ID NO: 265290 - DNA, 14 bp, Homo sapiens
tccagacattgtat

SEQ ID NO: 265291 - DNA, 16 bp, Homo sapiens
tccagacattgtattt

SEQ ID NO: 265292 - DNA, 16 bp, Homo sapiens
tccagaccaaaataat

SEQ ID NO: 265293 - DNA, 12 bp, Homo sapiens
tccagaccccca

SEQ ID NO: 265294 - DNA, 16 bp, Homo sapiens
tccagacccccagcaa

SEQ ID NO: 265295 - DNA, 21 bp, Homo sapiens
tccagacccccagcaaccctc

SEQ ID NO: 265296 - DNA, 14 bp, Homo sapiens
tccagacccctacc

SEQ ID NO: 265297 - DNA, 20 bp, Homo sapiens
tccagacccctaccctttcc

SEQ ID NO: 265298 - DNA, 19 bp, Homo sapiens
tccagaccctgcctgagcc

SEQ ID NO: 265299 - DNA, 16 bp, Homo sapiens
tccagacctgggccct

SEQ ID NO: 265300 - DNA, 19 bp, Homo sapiens
tccagacctgggccctggt

SEQ ID NO: 265301 - DNA, 16 bp, Homo sapiens
tccagactcgagaggg

SEQ ID NO: 265302 - DNA, 14 bp, Homo sapiens
tccagacttcgcta

SEQ ID NO: 265303 - DNA, 22 bp, Homo sapiens
tccagacttcgctattcccagg

SEQ ID NO: 265304 - DNA, 20 bp, Homo sapiens
tccagagacatgggcctccc

SEQ ID NO: 265305 - DNA, 21 bp, Homo sapiens
tccagagagaagcaccccacc

SEQ ID NO: 265306 - DNA, 19 bp, Homo sapiens
tccagagagtggctcctcc

SEQ ID NO: 265307 - DNA, 13 bp, Homo sapiens
tccagagccagcc

SEQ ID NO: 265308 - DNA, 17 bp, Homo sapiens
tccagagccagcctggg

SEQ ID NO: 265309 - DNA, 18 bp, Homo sapiens
tccagagccagcctggga

SEQ ID NO: 265310 - DNA, 19 bp, Homo sapiens
tccagagccagcctgggac

SEQ ID NO: 265311 - DNA, 18 bp, Homo sapiens
tccagagcctaagaaaat

SEQ ID NO: 265312 - DNA, 10 bp, Homo sapiens
tccagagctt

SEQ ID NO: 265313 - DNA, 22 bp, Homo sapiens
tccagagcttcagggctgggca

SEQ ID NO: 265314 - DNA, 14 bp, Homo sapiens
tccagaggtgaggg

SEQ ID NO: 265315 - DNA, 22 bp, Homo sapiens
tccagagtaggtgggtcttgga

SEQ ID NO: 265316 - DNA, 23 bp, Homo sapiens
tccagagtaggtgggtcttggat

SEQ ID NO: 265317 - DNA, 20 bp, Homo sapiens
tccagagtccggaggcagca

SEQ ID NO: 265318 - DNA, 14 bp, Homo sapiens
tccagagtctgagc

SEQ ID NO: 265319 - DNA, 22 bp, Homo sapiens
tccagattgggggccctggggt

SEQ ID NO: 265320 - DNA, 13 bp, Homo sapiens
tccagattgtagc

SEQ ID NO: 265321 - DNA, 11 bp, Homo sapiens
tccagcaaaat

SEQ ID NO: 265322 - DNA, 14 bp, Homo sapiens
tccagcaatgcctg

SEQ ID NO: 265323 - DNA, 17 bp, Homo sapiens
tccagcaatgcctgcct

SEQ ID NO: 265324 - DNA, 19 bp, Homo sapiens
tccagcaattctcctgcct

SEQ ID NO: 265325 - DNA, 12 bp, Homo sapiens
tccagcagctgc

SEQ ID NO: 265326 - DNA, 23 bp, Homo sapiens
tccagcagctgcgggtctgaagg

SEQ ID NO: 265327 - DNA, 16 bp, Homo sapiens
tccagcagtgaaactt

SEQ ID NO: 265328 - DNA, 20 bp, Homo sapiens
tccagcagtgaaacttgtgc

SEQ ID NO: 265329 - DNA, 23 bp, Homo sapiens
tccagcagtgaaacttgtgctat

SEQ ID NO: 265330 - DNA, 15 bp, Homo sapiens
tccagcagtgctggg

SEQ ID NO: 265331 - DNA, 17 bp, Homo sapiens
tccagcatccagcctgt

SEQ ID NO: 265332 - DNA, 18 bp, Homo sapiens
tccagcatccagcctgtg

SEQ ID NO: 265333 - DNA, 19 bp, Homo sapiens
tccagcatccagcctgtgt

SEQ ID NO: 265334 - DNA, 16 bp, Homo sapiens
tccagcatcccaagat

SEQ ID NO: 265335 - DNA, 16 bp, Homo sapiens
tccagcatgtgtgtgt

SEQ ID NO: 265336 - DNA, 19 bp, Homo sapiens
tccagcatgtgtgtgtctc

SEQ ID NO: 265337 - DNA, 14 bp, Homo sapiens
tccagccaacccct

SEQ ID NO: 265338 - DNA, 22 bp, Homo sapiens
tccagcccacagtgctcagttg

SEQ ID NO: 265339 - DNA, 12 bp, Homo sapiens
tccagcccagac

SEQ ID NO: 265340 - DNA, 21 bp, Homo sapiens
tccagccccatagaaaacaat

SEQ ID NO: 265341 - DNA, 16 bp, Homo sapiens
tccagccgccattgcc

SEQ ID NO: 265342 - DNA, 23 bp, Homo sapiens
tccagccgccattgccaccagga

SEQ ID NO: 265343 - DNA, 14 bp, Homo sapiens
tccagcctcagctc

SEQ ID NO: 265344 - DNA, 12 bp, Homo sapiens
tccagcctcccc

SEQ ID NO: 265345 - DNA, 17 bp, Homo sapiens
tccagcctctcccggct

SEQ ID NO: 265346 - DNA, 22 bp, Homo sapiens
tccagcctctcccggctgcctg

SEQ ID NO: 265347 - DNA, 13 bp, Homo sapiens
tccagcctgtgtg

SEQ ID NO: 265348 - DNA, 15 bp, Homo sapiens
tccagcgagtacccc

SEQ ID NO: 265349 - DNA, 10 bp, Homo sapiens
tccagctccc

SEQ ID NO: 265350 - DNA, 18 bp, Homo sapiens
tccagctccccccaagat

SEQ ID NO: 265351 - DNA, 19 bp, Homo sapiens
tccagctccctagactgca

SEQ ID NO: 265352 - DNA, 18 bp, Homo sapiens
tccagctctttcctcctt

SEQ ID NO: 265353 - DNA, 11 bp, Homo sapiens
tccagctgcca

SEQ ID NO: 265354 - DNA, 11 bp, Homo sapiens
tccagctgctc

SEQ ID NO: 265355 - DNA, 14 bp, Homo sapiens
tccagctgtgtgtt

SEQ ID NO: 265356 - DNA, 20 bp, Homo sapiens
tccagctgttgagcccctcc

SEQ ID NO: 265357 - DNA, 21 bp, Homo sapiens
tccagcttctggtactctcct

SEQ ID NO: 265358 - DNA, 23 bp, Homo sapiens
tccagcttttgtagatggcactt

SEQ ID NO: 265359 - DNA, 12 bp, Homo sapiens
tccaggaaggca

SEQ ID NO: 265360 - DNA, 13 bp, Homo sapiens
tccaggaaggcag

SEQ ID NO: 265361 - DNA, 18 bp, Homo sapiens
tccaggaaggcagctgct

SEQ ID NO: 265362 - DNA, 21 bp, Homo sapiens
tccaggaaggcagctgctctt

SEQ ID NO: 265363 - DNA, 13 bp, Homo sapiens
tccaggagaggag

SEQ ID NO: 265364 - DNA, 16 bp, Homo sapiens
tccaggagccccagcc

SEQ ID NO: 265365 - DNA, 18 bp, Homo sapiens
tccaggagccccagccag

SEQ ID NO: 265366 - DNA, 20 bp, Homo sapiens
tccaggagccccagccagcc

SEQ ID NO: 265367 - DNA, 19 bp, Homo sapiens
tccaggataaggagactga

SEQ ID NO: 265368 - DNA, 23 bp, Homo sapiens
tccaggataaggagactgaggct

SEQ ID NO: 265369 - DNA, 14 bp, Homo sapiens
tccaggatcctcct

SEQ ID NO: 265370 - DNA, 15 bp, Homo sapiens
tccaggatcctcctg

SEQ ID NO: 265371 - DNA, 15 bp, Homo sapiens
tccaggatcctgcag

SEQ ID NO: 265372 - DNA, 18 bp, Homo sapiens
tccaggatcctgcaggaa

SEQ ID NO: 265373 - DNA, 22 bp, Homo sapiens
tccaggcaatggcctaaacttc

SEQ ID NO: 265374 - DNA, 22 bp, Homo sapiens
tccaggcagagacaataaaaca

SEQ ID NO: 265375 - DNA, 22 bp, Homo sapiens
tccaggcaggacgagactcctc

SEQ ID NO: 265376 - DNA, 23 bp, Homo sapiens
tccaggcaggacgagactcctcg

SEQ ID NO: 265377 - DNA, 15 bp, Homo sapiens
tccaggcatgaccct

SEQ ID NO: 265378 - DNA, 21 bp, Homo sapiens
tccaggcatgaccctggagcc

SEQ ID NO: 265379 - DNA, 18 bp, Homo sapiens
tccatgggattttatctg

SEQ ID NO: 265380 - DNA, 17 bp, Homo sapiens
tccatgggcacctctgc

SEQ ID NO: 265381 - DNA, 15 bp, Homo sapiens
tccatgggggcaggg

SEQ ID NO: 265382 - DNA, 13 bp, Homo sapiens
tccatgtactgta

SEQ ID NO: 265383 - DNA, 16 bp, Homo sapiens
tccatgtactgtagtt

SEQ ID NO: 265384 - DNA, 18 bp, Homo sapiens
tccatgtagaagagggag

SEQ ID NO: 265385 - DNA, 19 bp, Homo sapiens
tccatgtcgcctctgcatt

SEQ ID NO: 265386 - DNA, 17 bp, Homo sapiens
tccatgtgaaatttaca

SEQ ID NO: 265387 - DNA, 17 bp, Homo sapiens
tccatgtgctgctgtgg

SEQ ID NO: 265388 - DNA, 18 bp, Homo sapiens
tccatgtggccccaggtg

SEQ ID NO: 265389 - DNA, 21 bp, Homo sapiens
tccatgtggccccaggtgcca

SEQ ID NO: 265390 - DNA, 22 bp, Homo sapiens
tccatgtggccccaggtgccac

SEQ ID NO: 265391 - DNA, 17 bp, Homo sapiens
tccatgtgtggactcaa

SEQ ID NO: 265392 - DNA, 11 bp, Homo sapiens
tccatgtgtgt

SEQ ID NO: 265393 - DNA, 18 bp, Homo sapiens
tccatgtgttttgctttt

SEQ ID NO: 265394 - DNA, 22 bp, Homo sapiens
tccatgtttagaaataaatgaa

SEQ ID NO: 265395 - DNA, 13 bp, Homo sapiens
tccatgtttgtaa

SEQ ID NO: 265396 - DNA, 15 bp, Homo sapiens
tccattatgattctt

SEQ ID NO: 265397 - DNA, 21 bp, Homo sapiens
tccattattcaagaaagatat

SEQ ID NO: 265398 - DNA, 12 bp, Homo sapiens
tccattatttat

SEQ ID NO: 265399 - DNA, 15 bp, Homo sapiens
tccattatttatatt

SEQ ID NO: 265400 - DNA, 22 bp, Homo sapiens
tccattatttgagtttgacatt

SEQ ID NO: 265401 - DNA, 14 bp, Homo sapiens
tccattctttctga

SEQ ID NO: 265402 - DNA, 13 bp, Homo sapiens
tccattctttctt

SEQ ID NO: 265403 - DNA, 16 bp, Homo sapiens
tccattctttcttcct

SEQ ID NO: 265404 - DNA, 18 bp, Homo sapiens
tccattctttcttcctcc

SEQ ID NO: 265405 - DNA, 12 bp, Homo sapiens
tccattgcaaaa

SEQ ID NO: 265406 - DNA, 19 bp, Homo sapiens
tccattgctcccagtgcca

SEQ ID NO: 265407 - DNA, 20 bp, Homo sapiens
tccatttaaactaacctttt

SEQ ID NO: 265408 - DNA, 23 bp, Homo sapiens
tccatttaatggggtgcacctgt

SEQ ID NO: 265409 - DNA, 14 bp, Homo sapiens
tccatttagttctt

SEQ ID NO: 265410 - DNA, 17 bp, Homo sapiens
tccatttataaccccag

SEQ ID NO: 265411 - DNA, 23 bp, Homo sapiens
tccatttataaccccagcctgac

SEQ ID NO: 265412 - DNA, 15 bp, Homo sapiens
tcccagcacctgcca

SEQ ID NO: 265413 - DNA, 19 bp, Homo sapiens
tcccagcacctgccagggc

SEQ ID NO: 265414 - DNA, 13 bp, Homo sapiens
tcccagcactttg

SEQ ID NO: 265415 - DNA, 18 bp, Homo sapiens
tcccagcactttgggagg

SEQ ID NO: 265416 - DNA, 18 bp, Homo sapiens
tcccagcagccctaagga

SEQ ID NO: 265417 - DNA, 21 bp, Homo sapiens
tcccagcagccctaaggatct

SEQ ID NO: 265418 - DNA, 20 bp, Homo sapiens
tcccagcatgttgagaggct

SEQ ID NO: 265419 - DNA, 17 bp, Homo sapiens
tcccagccaccaccact

SEQ ID NO: 265420 - DNA, 24 bp, Homo sapiens
tcccagccaccaccactgtcccta

SEQ ID NO: 265421 - DNA, 12 bp, Homo sapiens
tcccagccaccc

SEQ ID NO: 265422 - DNA, 14 bp, Homo sapiens
tcccagccaccccg

SEQ ID NO: 265423 - DNA, 24 bp, Homo sapiens
tcccagccaccccgggctctctgc

SEQ ID NO: 265424 - DNA, 22 bp, Homo sapiens
tcccagccacccggatctccag

SEQ ID NO: 265425 - DNA, 14 bp, Homo sapiens
tcccagcccctacc

SEQ ID NO: 265426 - DNA, 23 bp, Homo sapiens
tcccagcccctggtactccccca

SEQ ID NO: 265427 - DNA, 18 bp, Homo sapiens
tcccagccctttccaggg

SEQ ID NO: 265428 - DNA, 12 bp, Homo sapiens
tcccagcctgct

SEQ ID NO: 265429 - DNA, 13 bp, Homo sapiens
tcccagcctgctg

SEQ ID NO: 265430 - DNA, 16 bp, Homo sapiens
tcccagcctgctgaga

SEQ ID NO: 265431 - DNA, 23 bp, Homo sapiens
tcccagcctgctgagagccccca

SEQ ID NO: 265432 - DNA, 22 bp, Homo sapiens
tcccagctacaggggaggctga

SEQ ID NO: 265433 - DNA, 18 bp, Homo sapiens
tcccagctacttgggagc

SEQ ID NO: 265434 - DNA, 21 bp, Homo sapiens
tcccagctacttgggagcctg

SEQ ID NO: 265435 - DNA, 15 bp, Homo sapiens
tcccagctggcagcg

SEQ ID NO: 265436 - DNA, 17 bp, Homo sapiens
tcccagctggcagcgcc

SEQ ID NO: 265437 - DNA, 23 bp, Homo sapiens
tcccagctggtgtcactctgcct

SEQ ID NO: 265438 - DNA, 15 bp, Homo sapiens
tcccaggacaggaaa

SEQ ID NO: 265439 - DNA, 13 bp, Homo sapiens
tcccaggaccctg

SEQ ID NO: 265440 - DNA, 14 bp, Homo sapiens
tcccaggaccctgg

SEQ ID NO: 265441 - DNA, 18 bp, Homo sapiens
tcccaggaccctgggtca

SEQ ID NO: 265442 - DNA, 17 bp, Homo sapiens
tcccaggatcccctgct

SEQ ID NO: 265443 - DNA, 19 bp, Homo sapiens
tcccaggatcccctgctac

SEQ ID NO: 265444 - DNA, 11 bp, Homo sapiens
tcccaggccag

SEQ ID NO: 265445 - DNA, 15 bp, Homo sapiens
tcccaggccagcgag

SEQ ID NO: 265446 - DNA, 16 bp, Homo sapiens
tcccaggcgccccttc

SEQ ID NO: 265447 - DNA, 16 bp, Homo sapiens
tcccagggaaggactt

SEQ ID NO: 265448 - DNA, 15 bp, Homo sapiens
tcccagggcccgagc

SEQ ID NO: 265449 - DNA, 22 bp, Homo sapiens
tcccagggcccgagcgcgtgcc

SEQ ID NO: 265450 - DNA, 23 bp, Homo sapiens
tcccagggcccgagcgcgtgcct

SEQ ID NO: 265451 - DNA, 19 bp, Homo sapiens
tcccagtgacacttcagag

SEQ ID NO: 265452 - DNA, 14 bp, Homo sapiens
tcccagtgggctgt

SEQ ID NO: 265453 - DNA, 14 bp, Homo sapiens
tcccagttcatgtt

SEQ ID NO: 265454 - DNA, 14 bp, Homo sapiens
tcccatagtgctgg

SEQ ID NO: 265455 - DNA, 18 bp, Homo sapiens
tcccatcaccccttcccc

SEQ ID NO: 265456 - DNA, 17 bp, Homo sapiens
tcccatccagcgtctgc

SEQ ID NO: 265457 - DNA, 14 bp, Homo sapiens
tcccatcggaagtt

SEQ ID NO: 265458 - DNA, 15 bp, Homo sapiens
tcccatctcagaaga

SEQ ID NO: 265459 - DNA, 14 bp, Homo sapiens
tcccatctccttcc

SEQ ID NO: 265460 - DNA, 16 bp, Homo sapiens
tcccatctccttcccc

SEQ ID NO: 265461 - DNA, 14 bp, Homo sapiens
tcccatctcttcct

SEQ ID NO: 265462 - DNA, 20 bp, Homo sapiens
tcccatgcacaactctccaa

SEQ ID NO: 265463 - DNA, 15 bp, Homo sapiens
tcccatgcctgtctc

SEQ ID NO: 265464 - DNA, 17 bp, Homo sapiens
tcccatgcctgtctctg

SEQ ID NO: 265465 - DNA, 13 bp, Homo sapiens
tcccatggccttc

SEQ ID NO: 265466 - DNA, 16 bp, Homo sapiens
tcccatggccttccct

SEQ ID NO: 265467 - DNA, 20 bp, Homo sapiens
tcccatgggggctccagaca

SEQ ID NO: 265468 - DNA, 20 bp, Homo sapiens
tcccatggtagactgtgaca

SEQ ID NO: 265469 - DNA, 14 bp, Homo sapiens
tcccattcctccct

SEQ ID NO: 265470 - DNA, 15 bp, Homo sapiens
tcccattcctccctc

SEQ ID NO: 265471 - DNA, 14 bp, Homo sapiens
tcccattgaaaatg

SEQ ID NO: 265472 - DNA, 15 bp, Homo sapiens
tcccatttctcactg

SEQ ID NO: 265473 - DNA, 18 bp, Homo sapiens
tcccatttctcactgaga

SEQ ID NO: 265474 - DNA, 19 bp, Homo sapiens
tcccatttgtaatgtatct

SEQ ID NO: 265475 - DNA, 15 bp, Homo sapiens
tcccatttgtgtttc

SEQ ID NO: 265476 - DNA, 13 bp, Homo sapiens
tcccattttgcaa

SEQ ID NO: 265477 - DNA, 21 bp, Homo sapiens
tcccattttgcaaaatttcca

SEQ ID NO: 265478 - DNA, 18 bp, Homo sapiens
tccccaaccctgcccctg

SEQ ID NO: 265479 - DNA, 16 bp, Homo sapiens
tccccaacgtcccctc

SEQ ID NO: 265480 - DNA, 20 bp, Homo sapiens
tccccacagtcctcacagcc

SEQ ID NO: 265481 - DNA, 21 bp, Homo sapiens
tccccacagtcctcacagcct

SEQ ID NO: 265482 - DNA, 23 bp, Homo sapiens
tccccacagtcctcacagcctct

SEQ ID NO: 265483 - DNA, 16 bp, Homo sapiens
tccccaccagctcgtt

SEQ ID NO: 265484 - DNA, 14 bp, Homo sapiens
tccccaccagtctc

SEQ ID NO: 265485 - DNA, 23 bp, Homo sapiens
tccccacccaccaaatgcctctg

SEQ ID NO: 265486 - DNA, 17 bp, Homo sapiens
tccccaccccaaccact

SEQ ID NO: 265487 - DNA, 15 bp, Homo sapiens
tccccaccctcccct

SEQ ID NO: 265488 - DNA, 21 bp, Homo sapiens
tccccaccctcccctctcctg

SEQ ID NO: 265489 - DNA, 22 bp, Homo sapiens
tccccaccctcccctctcctga

SEQ ID NO: 265490 - DNA, 13 bp, Homo sapiens
tccccaccttccc

SEQ ID NO: 265491 - DNA, 22 bp, Homo sapiens
tccccacgagtcacctgcaagc

SEQ ID NO: 265492 - DNA, 23 bp, Homo sapiens
tccccacgagtcacctgcaagcc

SEQ ID NO: 265493 - DNA, 14 bp, Homo sapiens
tccccactccctgt

SEQ ID NO: 265494 - DNA, 18 bp, Homo sapiens
tccccactctgctcccag

SEQ ID NO: 265495 - DNA, 20 bp, Homo sapiens
tccccactctgctcccagcc

SEQ ID NO: 265496 - DNA, 14 bp, Homo sapiens
tccccactgcctgc

SEQ ID NO: 265497 - DNA, 18 bp, Homo sapiens
tccccactgcctgcccac

SEQ ID NO: 265498 - DNA, 13 bp, Homo sapiens
tccccagacctga

SEQ ID NO: 265499 - DNA, 10 bp, Homo sapiens
tccccagcag

SEQ ID NO: 265500 - DNA, 15 bp, Homo sapiens
tccccagcaggtggg

SEQ ID NO: 265501 - DNA, 19 bp, Homo sapiens
tccccagccagcccttccc

SEQ ID NO: 265502 - DNA, 22 bp, Homo sapiens
tccccagcccagggttccccca

SEQ ID NO: 265503 - DNA, 23 bp, Homo sapiens
tccccagcccagggttcccccag

SEQ ID NO: 265504 - DNA, 15 bp, Homo sapiens
tccccagccccaccc

SEQ ID NO: 265505 - DNA, 17 bp, Homo sapiens
tccccagccccctggcc

SEQ ID NO: 265506 - DNA, 22 bp, Homo sapiens
tccccagccctgtcctggttcc

SEQ ID NO: 265507 - DNA, 19 bp, Homo sapiens
tccccaggccgtggctgcc

SEQ ID NO: 265508 - DNA, 23 bp, Homo sapiens
tccccaggccgtggctgcccaca

SEQ ID NO: 265509 - DNA, 16 bp, Homo sapiens
tccccaggcctccagc

SEQ ID NO: 265510 - DNA, 17 bp, Homo sapiens
tccccaggcctccagcc

SEQ ID NO: 265511 - DNA, 21 bp, Homo sapiens
tccccagggcccctccctctg

SEQ ID NO: 265512 - DNA, 19 bp, Homo sapiens
tccccaggggaaaatgaag

SEQ ID NO: 265513 - DNA, 13 bp, Homo sapiens
tccccaggggcac

SEQ ID NO: 265514 - DNA, 17 bp, Homo sapiens
tccccaggggtcccagc

SEQ ID NO: 265515 - DNA, 18 bp, Homo sapiens
tccccaggggtcccagcc

SEQ ID NO: 265516 - DNA, 23 bp, Homo sapiens
tccccaggggtcccagccacccc

SEQ ID NO: 265517 - DNA, 17 bp, Homo sapiens
tccccagtgcctgccac

SEQ ID NO: 265518 - DNA, 21 bp, Homo sapiens
tccccagtgcctgccactctc

SEQ ID NO: 265519 - DNA, 16 bp, Homo sapiens
tccccatactctgtct

SEQ ID NO: 265520 - DNA, 19 bp, Homo sapiens
tccccatactctgtctccc

SEQ ID NO: 265521 - DNA, 17 bp, Homo sapiens
tccccatatataaatta

SEQ ID NO: 265522 - DNA, 19 bp, Homo sapiens
tccccatatataaattatt

SEQ ID NO: 265523 - DNA, 18 bp, Homo sapiens
tccccatatttgtgttca

SEQ ID NO: 265524 - DNA, 19 bp, Homo sapiens
tccccatatttgtgttcag

SEQ ID NO: 265525 - DNA, 21 bp, Homo sapiens
tccccatcatccacgccaagt

SEQ ID NO: 265526 - DNA, 19 bp, Homo sapiens
tccccatcctccagcttct

SEQ ID NO: 265527 - DNA, 18 bp, Homo sapiens
tccccattcattcctgat

SEQ ID NO: 265528 - DNA, 13 bp, Homo sapiens
tccccattctata

SEQ ID NO: 265529 - DNA, 18 bp, Homo sapiens
tccccatttcctcttcct

SEQ ID NO: 265530 - DNA, 21 bp, Homo sapiens
tccccatttcctcttccttct

SEQ ID NO: 265531 - DNA, 22 bp, Homo sapiens
tccccatttcctcttccttctc

SEQ ID NO: 265532 - DNA, 19 bp, Homo sapiens
tcccccaaaccctgcttct

SEQ ID NO: 265533 - DNA, 12 bp, Homo sapiens
tcccccaaagtt

SEQ ID NO: 265534 - DNA, 16 bp, Homo sapiens
tcccccaacccccacc

SEQ ID NO: 265535 - DNA, 19 bp, Homo sapiens
tcccccaacccccacccca

SEQ ID NO: 265536 - DNA, 22 bp, Homo sapiens
tcccccaacccccaccccacac

SEQ ID NO: 265537 - DNA, 17 bp, Homo sapiens
tcccccaacctcagact

SEQ ID NO: 265538 - DNA, 14 bp, Homo sapiens
tcccccaacttgag

SEQ ID NO: 265539 - DNA, 17 bp, Homo sapiens
tcccccaccacactgaa

SEQ ID NO: 265540 - DNA, 17 bp, Homo sapiens
tcccccaccattccaca

SEQ ID NO: 265541 - DNA, 17 bp, Homo sapiens
tccccgcctccactcta

SEQ ID NO: 265542 - DNA, 14 bp, Homo sapiens
tccccgctctggat

SEQ ID NO: 265543 - DNA, 17 bp, Homo sapiens
tccccgctggctggggg

SEQ ID NO: 265544 - DNA, 18 bp, Homo sapiens
tccccgcttctgcctgca

SEQ ID NO: 265545 - DNA, 15 bp, Homo sapiens
tccccggagctggga

SEQ ID NO: 265546 - DNA, 17 bp, Homo sapiens
tccccgtagccactctc

SEQ ID NO: 265547 - DNA, 15 bp, Homo sapiens
tccccgtgtgcccca

SEQ ID NO: 265548 - DNA, 14 bp, Homo sapiens
tcccctaacctcat

SEQ ID NO: 265549 - DNA, 19 bp, Homo sapiens
tcccctatggggatggtcc

SEQ ID NO: 265550 - DNA, 19 bp, Homo sapiens
tcccctcacccgctgccca

SEQ ID NO: 265551 - DNA, 20 bp, Homo sapiens
tcccctcacccgctgcccag

SEQ ID NO: 265552 - DNA, 23 bp, Homo sapiens
tcccctcacccgctgcccagccc

SEQ ID NO: 265553 - DNA, 12 bp, Homo sapiens
tcccctcactgg

SEQ ID NO: 265554 - DNA, 13 bp, Homo sapiens
tcccctcactgga

SEQ ID NO: 265555 - DNA, 19 bp, Homo sapiens
tcccctccacatcccagca

SEQ ID NO: 265556 - DNA, 12 bp, Homo sapiens
tcccctccagac

SEQ ID NO: 265557 - DNA, 14 bp, Homo sapiens
tcccctccatctgg

SEQ ID NO: 265558 - DNA, 14 bp, Homo sapiens
tcccctccctgcct

SEQ ID NO: 265559 - DNA, 15 bp, Homo sapiens
tcccctccctgcctg

SEQ ID NO: 265560 - DNA, 12 bp, Homo sapiens
tcccctccctgg

SEQ ID NO: 265561 - DNA, 19 bp, Homo sapiens
tcccctccctggctcccat

SEQ ID NO: 265562 - DNA, 14 bp, Homo sapiens
tcccctccctgggt

SEQ ID NO: 265563 - DNA, 16 bp, Homo sapiens
tcccctccctgggttc

SEQ ID NO: 265564 - DNA, 18 bp, Homo sapiens
tcccctccttctcccttt

SEQ ID NO: 265565 - DNA, 23 bp, Homo sapiens
tcccctccttgcctcctgtgtaa

SEQ ID NO: 265566 - DNA, 15 bp, Homo sapiens
tcccctcctttgtct

SEQ ID NO: 265567 - DNA, 18 bp, Homo sapiens
tcccctcctttgtctttt

SEQ ID NO: 265568 - DNA, 19 bp, Homo sapiens
tcccctcgcttcataggca

SEQ ID NO: 265569 - DNA, 20 bp, Homo sapiens
tcccctcgtcctgtcccaga

SEQ ID NO: 265570 - DNA, 17 bp, Homo sapiens
tcccctctatttagcat

SEQ ID NO: 265571 - DNA, 12 bp, Homo sapiens
tcccctctcctg

SEQ ID NO: 265572 - DNA, 18 bp, Homo sapiens
tcccctctcgccccatcc

SEQ ID NO: 265573 - DNA, 20 bp, Homo sapiens
tcccctctgccggtccccca

SEQ ID NO: 265574 - DNA, 21 bp, Homo sapiens
tcccctctgccggtcccccat

SEQ ID NO: 265575 - DNA, 13 bp, Homo sapiens
tcccctctgctgg

SEQ ID NO: 265576 - DNA, 19 bp, Homo sapiens
tcccctctgtcatcactcc

SEQ ID NO: 265577 - DNA, 16 bp, Homo sapiens
tcccctgcactgtaaa

SEQ ID NO: 265578 - DNA, 18 bp, Homo sapiens
tcccctgcactgtaaaat

SEQ ID NO: 265579 - DNA, 13 bp, Homo sapiens
tcccctgccattt

SEQ ID NO: 265580 - DNA, 23 bp, Homo sapiens
tcccctgccccgtcccctgggcc

SEQ ID NO: 265581 - DNA, 12 bp, Homo sapiens
tcccctgccctg

SEQ ID NO: 265582 - DNA, 23 bp, Homo sapiens
tcccctgccctgctgccgcctcc

SEQ ID NO: 265583 - DNA, 15 bp, Homo sapiens
tcccctgcgcaggcc

SEQ ID NO: 265584 - DNA, 20 bp, Homo sapiens
tcccctgctactccactgac

SEQ ID NO: 265585 - DNA, 19 bp, Homo sapiens
tcccctgctgaccttggag

SEQ ID NO: 265586 - DNA, 23 bp, Homo sapiens
tcccctgctgaccttggaggaat

SEQ ID NO: 265587 - DNA, 13 bp, Homo sapiens
tcccctgggccac

SEQ ID NO: 265588 - DNA, 16 bp, Homo sapiens
tcccctgggccaccct

SEQ ID NO: 265589 - DNA, 21 bp, Homo sapiens
tcccctgggccacccttcacg

SEQ ID NO: 265590 - DNA, 12 bp, Homo sapiens
tcccctgtccca

SEQ ID NO: 265591 - DNA, 18 bp, Homo sapiens
tcccctgtcccaccaact

SEQ ID NO: 265592 - DNA, 19 bp, Homo sapiens
tcccctgtcccaccaactc

SEQ ID NO: 265593 - DNA, 14 bp, Homo sapiens
tccccttccagggg

SEQ ID NO: 265594 - DNA, 15 bp, Homo sapiens
tccccttccctgcaa

SEQ ID NO: 265595 - DNA, 21 bp, Homo sapiens
tccccttcctaaatatccaaa

SEQ ID NO: 265596 - DNA, 14 bp, Homo sapiens
tccccttctcccct

SEQ ID NO: 265597 - DNA, 18 bp, Homo sapiens
tccccttctcccctgcac

SEQ ID NO: 265598 - DNA, 14 bp, Homo sapiens
tccccttgagctga

SEQ ID NO: 265599 - DNA, 22 bp, Homo sapiens
tccccttggcttcctccgtcca

SEQ ID NO: 265600 - DNA, 17 bp, Homo sapiens
tccccttgggatgggca

SEQ ID NO: 265601 - DNA, 22 bp, Homo sapiens
tccccttgggatgggcacaggc

SEQ ID NO: 265602 - DNA, 17 bp, Homo sapiens
tccccttgggcggctga

SEQ ID NO: 265603 - DNA, 13 bp, Homo sapiens
tccccttgttcta

SEQ ID NO: 265604 - DNA, 13 bp, Homo sapiens
tcccctttattaa

SEQ ID NO: 265605 - DNA, 11 bp, Homo sapiens
tcccctttcca

SEQ ID NO: 265606 - DNA, 14 bp, Homo sapiens
tcccctttccaatt

SEQ ID NO: 265607 - DNA, 15 bp, Homo sapiens
tccccttttgcctgg

SEQ ID NO: 265608 - DNA, 20 bp, Homo sapiens
tccccttttgcctggctgtg

SEQ ID NO: 265609 - DNA, 19 bp, Homo sapiens
tcccgaagccatcacttct

SEQ ID NO: 265610 - DNA, 19 bp, Homo sapiens
tcccgagcaaagtctaaag

SEQ ID NO: 265611 - DNA, 20 bp, Homo sapiens
tcccgagcaaagtctaaagt

SEQ ID NO: 265612 - DNA, 13 bp, Homo sapiens
tcccgagccccct

SEQ ID NO: 265613 - DNA, 23 bp, Homo sapiens
tcccgaggaagggccagagcctg

SEQ ID NO: 265614 - DNA, 12 bp, Homo sapiens
tcccgaggcagc

SEQ ID NO: 265615 - DNA, 16 bp, Homo sapiens
tcccgaggcagcaaca

SEQ ID NO: 265616 - DNA, 23 bp, Homo sapiens
tcccgaggcagcaacaggaccag

SEQ ID NO: 265617 - DNA, 15 bp, Homo sapiens
tcccgattgtaactc

SEQ ID NO: 265618 - DNA, 15 bp, Homo sapiens
tcccgcagcaccagc

SEQ ID NO: 265619 - DNA, 17 bp, Homo sapiens
tcccgcagcaccagcct

SEQ ID NO: 265620 - DNA, 22 bp, Homo sapiens
tcccgcagcaccagcctgagcc

SEQ ID NO: 265621 - DNA, 12 bp, Homo sapiens
tcccgcatgctg

SEQ ID NO: 265622 - DNA, 17 bp, Homo sapiens
tcccgcatgctgcctgc

SEQ ID NO: 265623 - DNA, 15 bp, Homo sapiens
tcccgccacacgctc

SEQ ID NO: 265624 - DNA, 16 bp, Homo sapiens
tcccgccacacgctca

SEQ ID NO: 265625 - DNA, 18 bp, Homo sapiens
tcccgccagactgttaga

SEQ ID NO: 265626 - DNA, 14 bp, Homo sapiens
tcccgcctcagcct

SEQ ID NO: 265627 - DNA, 16 bp, Homo sapiens
tcccgcctcagcctct

SEQ ID NO: 265628 - DNA, 23 bp, Homo sapiens
tcccgcctgattggggcctcacc

SEQ ID NO: 265629 - DNA, 22 bp, Homo sapiens
tcccagtgacacttcagagagc

SEQ ID NO: 265630 - DNA, 14 bp, Homo sapiens
tcccagtggcctca

SEQ ID NO: 265631 - DNA, 18 bp, Homo sapiens
tcccagtggcctcaaccc

SEQ ID NO: 265632 - DNA, 19 bp, Homo sapiens
tcccagtggcctcaaccct

SEQ ID NO: 265633 - DNA, 20 bp, Homo sapiens
tcccagtggcctcaaccctc

SEQ ID NO: 265634 - DNA, 17 bp, Homo sapiens
tcccagttctctaggga

SEQ ID NO: 265635 - DNA, 16 bp, Homo sapiens
tcccataaagaaagtg

SEQ ID NO: 265636 - DNA, 22 bp, Homo sapiens
tcccataattttcttcatgcaa

SEQ ID NO: 265637 - DNA, 14 bp, Homo sapiens
tcccatcaaaactc

SEQ ID NO: 265638 - DNA, 14 bp, Homo sapiens
tcccatcacccctt

SEQ ID NO: 265639 - DNA, 20 bp, Homo sapiens
tcccatcaccccttccccat

SEQ ID NO: 265640 - DNA, 16 bp, Homo sapiens
tcccatcactgctgtc

SEQ ID NO: 265641 - DNA, 22 bp, Homo sapiens
tcccatcactgctgtccctcct

SEQ ID NO: 265642 - DNA, 11 bp, Homo sapiens
tcccatccagc

SEQ ID NO: 265643 - DNA, 15 bp, Homo sapiens
tcccatccagcgtct

SEQ ID NO: 265644 - DNA, 18 bp, Homo sapiens
tcccatctcacctctagg

SEQ ID NO: 265645 - DNA, 16 bp, Homo sapiens
tcccatctcagaagat

SEQ ID NO: 265646 - DNA, 21 bp, Homo sapiens
tcccatctccttcccccagcc

SEQ ID NO: 265647 - DNA, 23 bp, Homo sapiens
tcccatctccttcccccagccca

SEQ ID NO: 265648 - DNA, 15 bp, Homo sapiens
tcccatgactgcacc

SEQ ID NO: 265649 - DNA, 20 bp, Homo sapiens
tcccatgactgcacccagct

SEQ ID NO: 265650 - DNA, 12 bp, Homo sapiens
tcccatgccctg

SEQ ID NO: 265651 - DNA, 21 bp, Homo sapiens
tcccatggatgtttcttcttt

SEQ ID NO: 265652 - DNA, 15 bp, Homo sapiens
tcccatggcccagca

SEQ ID NO: 265653 - DNA, 16 bp, Homo sapiens
tcccatggcccagcag

SEQ ID NO: 265654 - DNA, 17 bp, Homo sapiens
tcccatgggggctccag

SEQ ID NO: 265655 - DNA, 23 bp, Homo sapiens
tcccatggtagactgtgacacag

SEQ ID NO: 265656 - DNA, 20 bp, Homo sapiens
tcccatgttgcatgcctatg

SEQ ID NO: 265657 - DNA, 12 bp, Homo sapiens
tcccattctaga

SEQ ID NO: 265658 - DNA, 13 bp, Homo sapiens
tcccattctagat

SEQ ID NO: 265659 - DNA, 14 bp, Homo sapiens
tcccattctagatc

SEQ ID NO: 265660 - DNA, 20 bp, Homo sapiens
tcccattctagatcctgcac

SEQ ID NO: 265661 - DNA, 22 bp, Homo sapiens
tcccattctagatcctgcaccc

SEQ ID NO: 265662 - DNA, 19 bp, Homo sapiens
tcccattctccactcactg

SEQ ID NO: 265663 - DNA, 20 bp, Homo sapiens
tcccattgaaaatgtaagta

SEQ ID NO: 265664 - DNA, 17 bp, Homo sapiens
tcccattggtctgcatg

SEQ ID NO: 265665 - DNA, 19 bp, Homo sapiens
tcccatttattattttaat

SEQ ID NO: 265666 - DNA, 24 bp, Homo sapiens
tcccatttctaaaggcctcttcct

SEQ ID NO: 265667 - DNA, 16 bp, Homo sapiens
tcccatttctcactga

SEQ ID NO: 265668 - DNA, 14 bp, Homo sapiens
tcccatttcttaat

SEQ ID NO: 265669 - DNA, 18 bp, Homo sapiens
tcccattttagatgttta

SEQ ID NO: 265670 - DNA, 15 bp, Homo sapiens
tccccaaaggcatcc

SEQ ID NO: 265671 - DNA, 14 bp, Homo sapiens
tccccaaagggtgt

SEQ ID NO: 265672 - DNA, 20 bp, Homo sapiens
tccccaaccctgcccctgcc

SEQ ID NO: 265673 - DNA, 20 bp, Homo sapiens
tccccaacgtcccctccgcc

SEQ ID NO: 265674 - DNA, 11 bp, Homo sapiens
tccccaactcc

SEQ ID NO: 265675 - DNA, 15 bp, Homo sapiens
tccccaactccttcc

SEQ ID NO: 265676 - DNA, 17 bp, Homo sapiens
tccccaactccttcctc

SEQ ID NO: 265677 - DNA, 12 bp, Homo sapiens
tccccaccagct

SEQ ID NO: 265678 - DNA, 22 bp, Homo sapiens
tccccaccagtctcacccacta

SEQ ID NO: 265679 - DNA, 17 bp, Homo sapiens
tccccacccctgccttt

SEQ ID NO: 265680 - DNA, 17 bp, Homo sapiens
tccccaccttccaagga

SEQ ID NO: 265681 - DNA, 20 bp, Homo sapiens
tccccacgagtcacctgcaa

SEQ ID NO: 265682 - DNA, 23 bp, Homo sapiens
tccccacggggcctcgggacctc

SEQ ID NO: 265683 - DNA, 20 bp, Homo sapiens
tccccacgtggcacctcctc

SEQ ID NO: 265684 - DNA, 12 bp, Homo sapiens
tccccactccct

SEQ ID NO: 265685 - DNA, 19 bp, Homo sapiens
tccccactctgctcccagc

SEQ ID NO: 265686 - DNA, 18 bp, Homo sapiens
gcaatttgtttaaagaat

SEQ ID NO: 265687 - DNA, 21 bp, Homo sapiens
gcaattttgtatccatttaaa

SEQ ID NO: 265688 - DNA, 17 bp, Homo sapiens
gcaatttttttatacta

SEQ ID NO: 265689 - DNA, 13 bp, Homo sapiens
gcacaaaaagcac

SEQ ID NO: 265690 - DNA, 16 bp, Homo sapiens
gcacaaaaagcacaag

SEQ ID NO: 265691 - DNA, 15 bp, Homo sapiens
gcacaaaatgataat

SEQ ID NO: 265692 - DNA, 15 bp, Homo sapiens
gcacaaaccctgggg

SEQ ID NO: 265693 - DNA, 17 bp, Homo sapiens
gcacaagaagtgggagt

SEQ ID NO: 265694 - DNA, 23 bp, Homo sapiens
gcacaagaagtgggagtgggaga

SEQ ID NO: 265695 - DNA, 17 bp, Homo sapiens
gcacaagaagtttcttc

SEQ ID NO: 265696 - DNA, 17 bp, Homo sapiens
gcacaagacccctgctc

SEQ ID NO: 265697 - DNA, 21 bp, Homo sapiens
gcacaagaggaagagagagac

SEQ ID NO: 265698 - DNA, 18 bp, Homo sapiens
gcacaagcattccttagc

SEQ ID NO: 265699 - DNA, 22 bp, Homo sapiens
gcacaaggagtgcccgccttga

SEQ ID NO: 265700 - DNA, 14 bp, Homo sapiens
gcacaagttcctgg

SEQ ID NO: 265701 - DNA, 16 bp, Homo sapiens
gcacaattctgtccct

SEQ ID NO: 265702 - DNA, 21 bp, Homo sapiens
gcacaattctgtccctgtccc

SEQ ID NO: 265703 - DNA, 20 bp, Homo sapiens
gcacacaactgtggtcccag

SEQ ID NO: 265704 - DNA, 23 bp, Homo sapiens
gcacacacacacacacatacaca

SEQ ID NO: 265705 - DNA, 20 bp, Homo sapiens
gcacacacacacacaggagg

SEQ ID NO: 265706 - DNA, 14 bp, Homo sapiens
gcacacacctgcct

SEQ ID NO: 265707 - DNA, 13 bp, Homo sapiens
gcacacataacac

SEQ ID NO: 265708 - DNA, 12 bp, Homo sapiens
gcacaccactgc

SEQ ID NO: 265709 - DNA, 13 bp, Homo sapiens
gcacaccactgcc

SEQ ID NO: 265710 - DNA, 15 bp, Homo sapiens
gcacaccactgccct

SEQ ID NO: 265711 - DNA, 16 bp, Homo sapiens
gcacaccactgccctg

SEQ ID NO: 265712 - DNA, 20 bp, Homo sapiens
gcacaccactgccctgcctg

SEQ ID NO: 265713 - DNA, 12 bp, Homo sapiens
gcacactacaga

SEQ ID NO: 265714 - DNA, 23 bp, Homo sapiens
gcacactacagagcagctcccca

SEQ ID NO: 265715 - DNA, 19 bp, Homo sapiens
gcacactgacataatgtag

SEQ ID NO: 265716 - DNA, 17 bp, Homo sapiens
gcacagaaagggcagct

SEQ ID NO: 265717 - DNA, 19 bp, Homo sapiens
gcacagaaagggcagcttc

SEQ ID NO: 265718 - DNA, 21 bp, Homo sapiens
gcacagaaagggcagcttcag

SEQ ID NO: 265719 - DNA, 23 bp, Homo sapiens
gcacagacatctcctcaccccag

SEQ ID NO: 265720 - DNA, 15 bp, Homo sapiens
gcacagacttctgga

SEQ ID NO: 265721 - DNA, 23 bp, Homo sapiens
gcacagacttctggaaggctggc

SEQ ID NO: 265722 - DNA, 17 bp, Homo sapiens
gcacagagagggggcca

SEQ ID NO: 265723 - DNA, 13 bp, Homo sapiens
gcacagagtcctt

SEQ ID NO: 265724 - DNA, 18 bp, Homo sapiens
gcacagattaaacttcac

SEQ ID NO: 265725 - DNA, 13 bp, Homo sapiens
gcacagcagcatc

SEQ ID NO: 265726 - DNA, 13 bp, Homo sapiens
gcacagcagcctg

SEQ ID NO: 265727 - DNA, 20 bp, Homo sapiens
gcacagcagcctgcttccca

SEQ ID NO: 265728 - DNA, 12 bp, Homo sapiens
gcacagccagaa

SEQ ID NO: 265729 - DNA, 13 bp, Homo sapiens
gcacagccagaaa

SEQ ID NO: 265730 - DNA, 14 bp, Homo sapiens
gcacagccagaaac

SEQ ID NO: 265731 - DNA, 14 bp, Homo sapiens
gcacagccctggga

SEQ ID NO: 265732 - DNA, 23 bp, Homo sapiens
gcacagcctagggtcttgggggt

SEQ ID NO: 265733 - DNA, 18 bp, Homo sapiens
gcacagctgtgaggacag

SEQ ID NO: 265734 - DNA, 14 bp, Homo sapiens
gcacagctgtggtg

SEQ ID NO: 265735 - DNA, 14 bp, Homo sapiens
gcacaggcagctgg

SEQ ID NO: 265736 - DNA, 16 bp, Homo sapiens
gcacaggccacttgct

SEQ ID NO: 265737 - DNA, 19 bp, Homo sapiens
gcacaggctgccccacccc

SEQ ID NO: 265738 - DNA, 20 bp, Homo sapiens
gcacaggggccccagatctg

SEQ ID NO: 265739 - DNA, 23 bp, Homo sapiens
gcacagggtctgctctttctctg

SEQ ID NO: 265740 - DNA, 16 bp, Homo sapiens
gcacagtccctcctgt

SEQ ID NO: 265741 - DNA, 19 bp, Homo sapiens
gcacagtgcatctcagccc

SEQ ID NO: 265742 - DNA, 18 bp, Homo sapiens
gcacagtgtaatccaggg

SEQ ID NO: 265743 - DNA, 20 bp, Homo sapiens
gcacagtgttaaatgaaatt

SEQ ID NO: 265744 - DNA, 22 bp, Homo sapiens
gcacagtttgcaatcttatgtt

SEQ ID NO: 265745 - DNA, 20 bp, Homo sapiens
gcacatagtgggccttcatt

SEQ ID NO: 265746 - DNA, 23 bp, Homo sapiens
gcacatctaaattgatcattcat

SEQ ID NO: 265747 - DNA, 23 bp, Homo sapiens
gcacatgacatttgtcctgcaga

SEQ ID NO: 265748 - DNA, 16 bp, Homo sapiens
gcacatgccagggaaa

SEQ ID NO: 265749 - DNA, 15 bp, Homo sapiens
gcacatgctggccag

SEQ ID NO: 265750 - DNA, 12 bp, Homo sapiens
gcacatgtgtgc

SEQ ID NO: 265751 - DNA, 13 bp, Homo sapiens
gcacattcctggc

SEQ ID NO: 265752 - DNA, 22 bp, Homo sapiens
gcacatttccccagacctgagc

SEQ ID NO: 265753 - DNA, 21 bp, Homo sapiens
gcacatttgtcactgaataat

SEQ ID NO: 265754 - DNA, 21 bp, Homo sapiens
gcaccaaagatgcagccgcct

SEQ ID NO: 265755 - DNA, 18 bp, Homo sapiens
gcaccaacctcactgccc

SEQ ID NO: 265756 - DNA, 13 bp, Homo sapiens
gcaccaagcccac

SEQ ID NO: 265757 - DNA, 14 bp, Homo sapiens
gcaccaagcccaca

SEQ ID NO: 265758 - DNA, 11 bp, Homo sapiens
gcaccacccta

SEQ ID NO: 265759 - DNA, 12 bp, Homo sapiens
tgttttgctaat

SEQ ID NO: 265760 - DNA, 15 bp, Homo sapiens
tgttttgctaatgct

SEQ ID NO: 265761 - DNA, 17 bp, Homo sapiens
tgttttggactttgtta

SEQ ID NO: 265762 - DNA, 19 bp, Homo sapiens
tgttttggactttgttaca

SEQ ID NO: 265763 - DNA, 15 bp, Homo sapiens
tgttttggttaataa

SEQ ID NO: 265764 - DNA, 17 bp, Homo sapiens
tgttttgtacaattact

SEQ ID NO: 265765 - DNA, 22 bp, Homo sapiens
tgttttgtacaattactaaatt

SEQ ID NO: 265766 - DNA, 14 bp, Homo sapiens
tgttttgttatata

SEQ ID NO: 265767 - DNA, 17 bp, Homo sapiens
tgttttgtttttttcct

SEQ ID NO: 265768 - DNA, 23 bp, Homo sapiens
tgtttttaagaaaaacatgtcat

SEQ ID NO: 265769 - DNA, 17 bp, Homo sapiens
tgtttttaagctgtttc

SEQ ID NO: 265770 - DNA, 11 bp, Homo sapiens
tgtttttctca

SEQ ID NO: 265771 - DNA, 14 bp, Homo sapiens
tgtttttctcaaat

SEQ ID NO: 265772 - DNA, 17 bp, Homo sapiens
tgtttttctcaaataaa

SEQ ID NO: 265773 - DNA, 13 bp, Homo sapiens
tgtttttgaattt

SEQ ID NO: 265774 - DNA, 18 bp, Homo sapiens
tgttttttcatagtgcct

SEQ ID NO: 265775 - DNA, 14 bp, Homo sapiens
tgttttttttcctt

SEQ ID NO: 265776 - DNA, 19 bp, Homo sapiens
tgttttttttttttgtatt

SEQ ID NO: 265777 - DNA, 20 bp, Homo sapiens
tgttttttttttttgtattt

SEQ ID NO: 265778 - DNA, 14 bp, Homo sapiens
ttaaaaaaaataat

SEQ ID NO: 265779 - DNA, 17 bp, Homo sapiens
ttaaaaaaaataataaa

SEQ ID NO: 265780 - DNA, 13 bp, Homo sapiens
ttaaaaaaaggaa

SEQ ID NO: 265781 - DNA, 22 bp, Homo sapiens
ttaaaaaaataacatctgaaaa

SEQ ID NO: 265782 - DNA, 15 bp, Homo sapiens
ttaaaaaaataatat

SEQ ID NO: 265783 - DNA, 23 bp, Homo sapiens
ttaaaaaacaaaaaccagcaggt

SEQ ID NO: 265784 - DNA, 15 bp, Homo sapiens
ttaaaaaagatggat

SEQ ID NO: 265785 - DNA, 19 bp, Homo sapiens
ttaaaaaataacatattct

SEQ ID NO: 265786 - DNA, 20 bp, Homo sapiens
ttaaaaaataacatattctt

SEQ ID NO: 265787 - DNA, 13 bp, Homo sapiens
ttaaaaaatgtcc

SEQ ID NO: 265788 - DNA, 14 bp, Homo sapiens
ttaaaaacacctaa

SEQ ID NO: 265789 - DNA, 20 bp, Homo sapiens
ttaaaaagatggaatgtagt

SEQ ID NO: 265790 - DNA, 23 bp, Homo sapiens
ttaaaaagggcagggcatctcct

SEQ ID NO: 265791 - DNA, 21 bp, Homo sapiens
ttaaaaagtctgcattacatt

SEQ ID NO: 265792 - DNA, 22 bp, Homo sapiens
ttaaaaagtctgcattacattc

SEQ ID NO: 265793 - DNA, 20 bp, Homo sapiens
ttaaaaagttataaccaact

SEQ ID NO: 265794 - DNA, 17 bp, Homo sapiens
ttaaaaataaatctaaa

SEQ ID NO: 265795 - DNA, 13 bp, Homo sapiens
ttaaaaatataaa

SEQ ID NO: 265796 - DNA, 22 bp, Homo sapiens
ttaaaaatatggaacttctaat

SEQ ID NO: 265797 - DNA, 18 bp, Homo sapiens
ttaaaaatgcatgataat

SEQ ID NO: 265798 - DNA, 14 bp, Homo sapiens
ttaaaaatgtaaat

SEQ ID NO: 265799 - DNA, 19 bp, Homo sapiens
ttaaaaatgtaaatattct

SEQ ID NO: 265800 - DNA, 13 bp, Homo sapiens
ttaaaaattatag

SEQ ID NO: 265801 - DNA, 13 bp, Homo sapiens
ttaaaaattgcat

SEQ ID NO: 265802 - DNA, 13 bp, Homo sapiens
ttaaaacaaaatc

SEQ ID NO: 265803 - DNA, 18 bp, Homo sapiens
ttaaaacaaattaaaaac

SEQ ID NO: 265804 - DNA, 11 bp, Homo sapiens
ttaaaacaaga

SEQ ID NO: 265805 - DNA, 16 bp, Homo sapiens
ttaaaacgaaaataaa

SEQ ID NO: 265806 - DNA, 23 bp, Homo sapiens
ttaaaactaggcatttgtaaata

SEQ ID NO: 265807 - DNA, 15 bp, Homo sapiens
ttaaaactatccaat

SEQ ID NO: 265808 - DNA, 22 bp, Homo sapiens
ttaaaactatccaattaaaatt

SEQ ID NO: 265809 - DNA, 17 bp, Homo sapiens
ttaaaagaagactggaa

SEQ ID NO: 265810 - DNA, 14 bp, Homo sapiens
ttaaaagacaaaca

SEQ ID NO: 265811 - DNA, 16 bp, Homo sapiens
ttaaaagacaaacacc

SEQ ID NO: 265812 - DNA, 11 bp, Homo sapiens
ttaaaagacag

SEQ ID NO: 265813 - DNA, 23 bp, Homo sapiens
ttaaaagacatttttatttagtt

SEQ ID NO: 265814 - DNA, 21 bp, Homo sapiens
ttaaaagaggaaattaaataa

SEQ ID NO: 265815 - DNA, 12 bp, Homo sapiens
ttaaaagcatac

SEQ ID NO: 265816 - DNA, 16 bp, Homo sapiens
ttaaaataaaaattct

SEQ ID NO: 265817 - DNA, 12 bp, Homo sapiens
ttaaaataagtg

SEQ ID NO: 265818 - DNA, 16 bp, Homo sapiens
ttaaaatataaattaa

SEQ ID NO: 265819 - DNA, 13 bp, Homo sapiens
ttaaaatcaactt

SEQ ID NO: 265820 - DNA, 23 bp, Homo sapiens
ttaaaatcaggattttagtgctt

SEQ ID NO: 265821 - DNA, 22 bp, Homo sapiens
ttaaaattaaagtatacatttt

SEQ ID NO: 265822 - DNA, 11 bp, Homo sapiens
ttaaaattggc

SEQ ID NO: 265823 - DNA, 13 bp, Homo sapiens
ttaaaattggcac

SEQ ID NO: 265824 - DNA, 16 bp, Homo sapiens
ttaaacaatttatttt

SEQ ID NO: 265825 - DNA, 22 bp, Homo sapiens
ttaaacatgctaaatagttcta

SEQ ID NO: 265826 - DNA, 19 bp, Homo sapiens
ttaaacccacaagctgcct

SEQ ID NO: 265827 - DNA, 20 bp, Homo sapiens
ttaaacccacaagctgcctc

SEQ ID NO: 265828 - DNA, 21 bp, Homo sapiens
ttaaacccacaagctgcctct

SEQ ID NO: 265829 - DNA, 17 bp, Homo sapiens
ttaaacgtcacagcagt

SEQ ID NO: 265830 - DNA, 15 bp, Homo sapiens
ttaaactaacctttt

SEQ ID NO: 265831 - DNA, 12 bp, Homo sapiens
ttaaactactga

SEQ ID NO: 265832 - DNA, 21 bp, Homo sapiens
ttaaactgtgtggactgtgat

SEQ ID NO: 265833 - DNA, 13 bp, Homo sapiens
ttaaacttcacct

SEQ ID NO: 265834 - DNA, 13 bp, Homo sapiens
ttaaacttcagca

SEQ ID NO: 265835 - DNA, 15 bp, Homo sapiens
ttaaacttgcaatga

SEQ ID NO: 265836 - DNA, 17 bp, Homo sapiens
ttaaacttgtcagaatt

SEQ ID NO: 265837 - DNA, 14 bp, Homo sapiens
ttaaactttgtcac

SEQ ID NO: 265838 - DNA, 19 bp, Homo sapiens
ttaaactttgtcacttctg

SEQ ID NO: 265839 - DNA, 13 bp, Homo sapiens
ttaaactttgtgc

SEQ ID NO: 265840 - DNA, 14 bp, Homo sapiens
ttaaagaaacagct

SEQ ID NO: 265841 - DNA, 12 bp, Homo sapiens
ttaaagaaaggc

SEQ ID NO: 265842 - DNA, 12 bp, Homo sapiens
ttaaagaataaa

SEQ ID NO: 265843 - DNA, 23 bp, Homo sapiens
ttaaagaataaagtccaaagtca

SEQ ID NO: 265844 - DNA, 11 bp, Homo sapiens
ttaaagacaga

SEQ ID NO: 265845 - DNA, 16 bp, Homo sapiens
ttaaagacttaagatt

SEQ ID NO: 265846 - DNA, 18 bp, Homo sapiens
ttaaagacttgatgaata

SEQ ID NO: 265847 - DNA, 15 bp, Homo sapiens
ttaaagagacaaata

SEQ ID NO: 265848 - DNA, 16 bp, Homo sapiens
ttaaagagacaaatag

SEQ ID NO: 265849 - DNA, 23 bp, Homo sapiens
ttaaagaggcgtcttgtattttc

SEQ ID NO: 265850 - DNA, 17 bp, Homo sapiens
ttaaagcaaaaaatgaa

SEQ ID NO: 265851 - DNA, 16 bp, Homo sapiens
ttaaaggacaaacagt

SEQ ID NO: 265852 - DNA, 19 bp, Homo sapiens
ttaaaggacaaacagtgaa

SEQ ID NO: 265853 - DNA, 19 bp, Homo sapiens
ttaaaggaccctatatgtg

SEQ ID NO: 265854 - DNA, 19 bp, Homo sapiens
ttaaaggcagtccagagct

SEQ ID NO: 265855 - DNA, 14 bp, Homo sapiens
ttaaagtttaaata

SEQ ID NO: 265856 - DNA, 15 bp, Homo sapiens
ttaaagtttaaatac

SEQ ID NO: 265857 - DNA, 19 bp, Homo sapiens
ttaaagtttaaataccagt

SEQ ID NO: 265858 - DNA, 14 bp, Homo sapiens
ttaaataaaagtga

SEQ ID NO: 265859 - DNA, 12 bp, Homo sapiens
ttaaataaaata

SEQ ID NO: 265860 - DNA, 19 bp, Homo sapiens
ttaaataaagacctatgta

SEQ ID NO: 265861 - DNA, 13 bp, Homo sapiens
ttaaataaagtta

SEQ ID NO: 265862 - DNA, 13 bp, Homo sapiens
ttaaataaatcat

SEQ ID NO: 265863 - DNA, 23 bp, Homo sapiens
ttaaataaatctttcagcctgct

SEQ ID NO: 265864 - DNA, 12 bp, Homo sapiens
ttaaataaatgt

SEQ ID NO: 265865 - DNA, 13 bp, Homo sapiens
ttaaataatttaa

SEQ ID NO: 265866 - DNA, 15 bp, Homo sapiens
ttaaataattttaca

SEQ ID NO: 265867 - DNA, 22 bp, Homo sapiens
ttaaataattttacatgtctca

SEQ ID NO: 265868 - DNA, 16 bp, Homo sapiens
ttaaatacagacacta

SEQ ID NO: 265869 - DNA, 19 bp, Homo sapiens
ttaaatacagacactaagt

SEQ ID NO: 265870 - DNA, 20 bp, Homo sapiens
ttaaatacagacactaagtt

SEQ ID NO: 265871 - DNA, 14 bp, Homo sapiens
ggctgtggcccctc

SEQ ID NO: 265872 - DNA, 15 bp, Homo sapiens
ggctgtggcccctcc

SEQ ID NO: 265873 - DNA, 12 bp, Homo sapiens
ggctgtgggtgg

SEQ ID NO: 265874 - DNA, 15 bp, Homo sapiens
ggctgtgggtgggga

SEQ ID NO: 265875 - DNA, 17 bp, Homo sapiens
ggctgtgtatttctgta

SEQ ID NO: 265876 - DNA, 19 bp, Homo sapiens
ggctgtgttgactgctgct

SEQ ID NO: 265877 - DNA, 18 bp, Homo sapiens
ggctgttatctgtcttta

SEQ ID NO: 265878 - DNA, 13 bp, Homo sapiens
ggctgttccagac

SEQ ID NO: 265879 - DNA, 14 bp, Homo sapiens
ggctgttggctggg

SEQ ID NO: 265880 - DNA, 17 bp, Homo sapiens
ggctgttttaacggcct

SEQ ID NO: 265881 - DNA, 20 bp, Homo sapiens
ggctgttttaacggcctgca

SEQ ID NO: 265882 - DNA, 13 bp, Homo sapiens
ggcttaaacattt

SEQ ID NO: 265883 - DNA, 12 bp, Homo sapiens
ggcttaatgttt

SEQ ID NO: 265884 - DNA, 19 bp, Homo sapiens
ggcttataaacacattgaa

SEQ ID NO: 265885 - DNA, 21 bp, Homo sapiens
ggcttataaacacattgaatg

SEQ ID NO: 265886 - DNA, 17 bp, Homo sapiens
ggcttatctagccaaag

SEQ ID NO: 265887 - DNA, 19 bp, Homo sapiens
ggcttatctagccaaagag

SEQ ID NO: 265888 - DNA, 17 bp, Homo sapiens
ggcttccatggtggttt

SEQ ID NO: 265889 - DNA, 22 bp, Homo sapiens
ggcttccatggtggtttcagaa

SEQ ID NO: 265890 - DNA, 17 bp, Homo sapiens
ggcttccatttgtgtgt

SEQ ID NO: 265891 - DNA, 17 bp, Homo sapiens
ttaatatactcagggat

SEQ ID NO: 265892 - DNA, 14 bp, Homo sapiens
ttaatatactgcat

SEQ ID NO: 265893 - DNA, 22 bp, Homo sapiens
ttaatatatataatacttaaaa

SEQ ID NO: 265894 - DNA, 19 bp, Homo sapiens
ttaatatatcccagaaatt

SEQ ID NO: 265895 - DNA, 23 bp, Homo sapiens
ttaatatcactttggtctccatt

SEQ ID NO: 265896 - DNA, 18 bp, Homo sapiens
ttaatatgatctgtggag

SEQ ID NO: 265897 - DNA, 13 bp, Homo sapiens
ttaatatgcatct

SEQ ID NO: 265898 - DNA, 23 bp, Homo sapiens
ttaatatgttaacctcagtgtca

SEQ ID NO: 265899 - DNA, 19 bp, Homo sapiens
ttaatattactgtctttat

SEQ ID NO: 265900 - DNA, 23 bp, Homo sapiens
ttaatattactgtctttattctt

SEQ ID NO: 265901 - DNA, 18 bp, Homo sapiens
ttaatattgatatgctta

SEQ ID NO: 265902 - DNA, 14 bp, Homo sapiens
ttaatatttattga

SEQ ID NO: 265903 - DNA, 19 bp, Homo sapiens
ttaatcaatatttaagaga

SEQ ID NO: 265904 - DNA, 17 bp, Homo sapiens
ttaatcaccatgggaaa

SEQ ID NO: 265905 - DNA, 20 bp, Homo sapiens
ttaatcacctctctgtagtt

SEQ ID NO: 265906 - DNA, 17 bp, Homo sapiens
ttaatccacacatcagt

SEQ ID NO: 265907 - DNA, 18 bp, Homo sapiens
ttaatcccggtttcagaa

SEQ ID NO: 265908 - DNA, 17 bp, Homo sapiens
ttaatctctaaaattct

SEQ ID NO: 265909 - DNA, 15 bp, Homo sapiens
ttaatctgttgtttg

SEQ ID NO: 265910 - DNA, 21 bp, Homo sapiens
ttaatcttctctcttgattga

SEQ ID NO: 265911 - DNA, 17 bp, Homo sapiens
ttaatctttctttacct

SEQ ID NO: 265912 - DNA, 13 bp, Homo sapiens
ttaatctttgctg

SEQ ID NO: 265913 - DNA, 18 bp, Homo sapiens
ttaatctttgctgaagaa

SEQ ID NO: 265914 - DNA, 16 bp, Homo sapiens
ttaatgaactgtgaca

SEQ ID NO: 265915 - DNA, 21 bp, Homo sapiens
ttaatgataagtaaatgctag

SEQ ID NO: 265916 - DNA, 21 bp, Homo sapiens
ttaatgtacaagttttgtata

SEQ ID NO: 265917 - DNA, 22 bp, Homo sapiens
ttaatgtgtatttactgtacta

SEQ ID NO: 265918 - DNA, 11 bp, Homo sapiens
ttaatgtttct

SEQ ID NO: 265919 - DNA, 16 bp, Homo sapiens
ttaatgtttcttaaat

SEQ ID NO: 265920 - DNA, 13 bp, Homo sapiens
ttaatgttttgta

SEQ ID NO: 265921 - DNA, 21 bp, Homo sapiens
ttaattaaatttcacaatata

SEQ ID NO: 265922 - DNA, 16 bp, Homo sapiens
ttaattattaactaca

SEQ ID NO: 265923 - DNA, 19 bp, Homo sapiens
ttaattccaatatgatgac

SEQ ID NO: 265924 - DNA, 20 bp, Homo sapiens
ttaattctagatcagagagc

SEQ ID NO: 265925 - DNA, 18 bp, Homo sapiens
ttaattcttacctcattt

SEQ ID NO: 265926 - DNA, 17 bp, Homo sapiens
ttaattgatagaataaa

SEQ ID NO: 265927 - DNA, 14 bp, Homo sapiens
ttaattgattaaac

SEQ ID NO: 265928 - DNA, 22 bp, Homo sapiens
ttaattgattaaactgtatgtc

SEQ ID NO: 265929 - DNA, 23 bp, Homo sapiens
ttaattgtaggtcaatgaaatat

SEQ ID NO: 265930 - DNA, 20 bp, Homo sapiens
ttaattgtgaattgataata

SEQ ID NO: 265931 - DNA, 22 bp, Homo sapiens
ttaattgtgaattgataataaa

SEQ ID NO: 265932 - DNA, 18 bp, Homo sapiens
ttaattgtggctttatga

SEQ ID NO: 265933 - DNA, 22 bp, Homo sapiens
ttaatttaagtttgtagttttt

SEQ ID NO: 265934 - DNA, 13 bp, Homo sapiens
ttaatttatcaga

SEQ ID NO: 265935 - DNA, 18 bp, Homo sapiens
ttaatttatgagtttttg

SEQ ID NO: 265936 - DNA, 15 bp, Homo sapiens
ttaatttcataaatt

SEQ ID NO: 265937 - DNA, 18 bp, Homo sapiens
ttaatttgatgaaagctg

SEQ ID NO: 265938 - DNA, 11 bp, Homo sapiens
ttaatttgtgt

SEQ ID NO: 265939 - DNA, 18 bp, Homo sapiens
ttaatttgttttgtttta

SEQ ID NO: 265940 - DNA, 14 bp, Homo sapiens
ttaattttctaaaa

SEQ ID NO: 265941 - DNA, 20 bp, Homo sapiens
ttaattttctaaaacaagtt

SEQ ID NO: 265942 - DNA, 17 bp, Homo sapiens
ttaattttgtgaatcta

SEQ ID NO: 265943 - DNA, 23 bp, Homo sapiens
ttaatttttgtactttgcttctt

SEQ ID NO: 265944 - DNA, 16 bp, Homo sapiens
ttaattttttttggtt

SEQ ID NO: 265945 - DNA, 13 bp, Homo sapiens
ttacaaaagatgt

SEQ ID NO: 265946 - DNA, 14 bp, Homo sapiens
ttacaaaagatgta

SEQ ID NO: 265947 - DNA, 18 bp, Homo sapiens
ttacaaaagatgtatcct

SEQ ID NO: 265948 - DNA, 22 bp, Homo sapiens
ttacaaacaaaggatttgaaaa

SEQ ID NO: 265949 - DNA, 12 bp, Homo sapiens
ttacaaactgca

SEQ ID NO: 265950 - DNA, 15 bp, Homo sapiens
ttacaaactgcaata

SEQ ID NO: 265951 - DNA, 21 bp, Homo sapiens
ttacaaactgcaatagagact

SEQ ID NO: 265952 - DNA, 22 bp, Homo sapiens
ttacaaactgcaatagagactg

SEQ ID NO: 265953 - DNA, 23 bp, Homo sapiens
ttacaaactgcaatagagactgt

SEQ ID NO: 265954 - DNA, 14 bp, Homo sapiens
ttacaaagcagtta

SEQ ID NO: 265955 - DNA, 16 bp, Homo sapiens
ttacaaattttcactg

SEQ ID NO: 265956 - DNA, 18 bp, Homo sapiens
ttacaagataaaaaacga

SEQ ID NO: 265957 - DNA, 20 bp, Homo sapiens
ttacaaggcaggcctttcct

SEQ ID NO: 265958 - DNA, 23 bp, Homo sapiens
ttacaaggcaggcctttcctaca

SEQ ID NO: 265959 - DNA, 15 bp, Homo sapiens
ttacaagtaatgaat

SEQ ID NO: 265960 - DNA, 14 bp, Homo sapiens
ttacaagtgtatat

SEQ ID NO: 265961 - DNA, 16 bp, Homo sapiens
ttacaagtgtatatca

SEQ ID NO: 265962 - DNA, 22 bp, Homo sapiens
ttacaagttgtgcatgcaacca

SEQ ID NO: 265963 - DNA, 19 bp, Homo sapiens
ttacaagtttcagtaatag

SEQ ID NO: 265964 - DNA, 16 bp, Homo sapiens
ttacaatgtgcactga

SEQ ID NO: 265965 - DNA, 20 bp, Homo sapiens
ttacaccctttcttgacaaa

SEQ ID NO: 265966 - DNA, 14 bp, Homo sapiens
ttacactctttgta

SEQ ID NO: 265967 - DNA, 22 bp, Homo sapiens
ttacactgttattttcagcatg

SEQ ID NO: 265968 - DNA, 15 bp, Homo sapiens
ttacacttggagccc

SEQ ID NO: 265969 - DNA, 15 bp, Homo sapiens
ttacagaaaaatctt

SEQ ID NO: 265970 - DNA, 15 bp, Homo sapiens
ttacagaaatactat

SEQ ID NO: 265971 - DNA, 23 bp, Homo sapiens
ttacagaattgcttgtttgcttc

SEQ ID NO: 265972 - DNA, 14 bp, Homo sapiens
ttacagagaggaga

SEQ ID NO: 265973 - DNA, 20 bp, Homo sapiens
ttacagagaggagaaacaca

SEQ ID NO: 265974 - DNA, 19 bp, Homo sapiens
ttacagattgcctccttat

SEQ ID NO: 265975 - DNA, 11 bp, Homo sapiens
ttacagctgaa

SEQ ID NO: 265976 - DNA, 11 bp, Homo sapiens
ttacagctttt

SEQ ID NO: 265977 - DNA, 14 bp, Homo sapiens
ttacagcttttctc

SEQ ID NO: 265978 - DNA, 16 bp, Homo sapiens
ttacaggaaattgcaa

SEQ ID NO: 265979 - DNA, 15 bp, Homo sapiens
ttacaggaagctttt

SEQ ID NO: 265980 - DNA, 14 bp, Homo sapiens
ttacaggatcatgt

SEQ ID NO: 265981 - DNA, 20 bp, Homo sapiens
ttacagggatgagccaccgc

SEQ ID NO: 265982 - DNA, 17 bp, Homo sapiens
ttacagtaaataaattg

SEQ ID NO: 265983 - DNA, 11 bp, Homo sapiens
ttacataacag

SEQ ID NO: 265984 - DNA, 17 bp, Homo sapiens
ttacataacaggcattg

SEQ ID NO: 265985 - DNA, 22 bp, Homo sapiens
ttacatacagtgatatggtact

SEQ ID NO: 265986 - DNA, 13 bp, Homo sapiens
ttacataggatta

SEQ ID NO: 265987 - DNA, 13 bp, Homo sapiens
ttacatcatttct

SEQ ID NO: 265988 - DNA, 14 bp, Homo sapiens
ttacatcatttctt

SEQ ID NO: 265989 - DNA, 13 bp, Homo sapiens
ttacatctaatgc

SEQ ID NO: 265990 - DNA, 17 bp, Homo sapiens
ttacatgaattgcattt

SEQ ID NO: 265991 - DNA, 20 bp, Homo sapiens
ttacatgagttcaaatactt

SEQ ID NO: 265992 - DNA, 21 bp, Homo sapiens
ttacatgagttcaaatacttt

SEQ ID NO: 265993 - DNA, 22 bp, Homo sapiens
ttacatgcaatttattaaaatg

SEQ ID NO: 265994 - DNA, 15 bp, Homo sapiens
ttacatggctgtggt

SEQ ID NO: 265995 - DNA, 16 bp, Homo sapiens
ttacatggctgtggtt

SEQ ID NO: 265996 - DNA, 12 bp, Homo sapiens
ttacatgtttcc

SEQ ID NO: 265997 - DNA, 21 bp, Homo sapiens
ttacattttcagtaccaaaga

SEQ ID NO: 265998 - DNA, 14 bp, Homo sapiens
ttacatttttacaa

SEQ ID NO: 265999 - DNA, 15 bp, Homo sapiens
ttacatttttacaat

SEQ ID NO: 266000 - DNA, 16 bp, Homo sapiens
ttacatttttacaata

SEQ ID NO: 266001 - DNA, 21 bp, Homo sapiens
ttacatttttacaataaataa

SEQ ID NO: 266002 - DNA, 13 bp, Homo sapiens
ttaccaaaacata

SEQ ID NO: 266003 - DNA, 22 bp, Homo sapiens
ttaccaaagaagagtttacaga

SEQ ID NO: 266004 - DNA, 12 bp, Homo sapiens
ttaccagcaaga

SEQ ID NO: 266005 - DNA, 20 bp, Homo sapiens
ttaccatgagaagagggcct

SEQ ID NO: 266006 - DNA, 15 bp, Homo sapiens
ttaccatttgtaata

SEQ ID NO: 266007 - DNA, 21 bp, Homo sapiens
ttaccattttgcgatgtgttt

SEQ ID NO: 266008 - DNA, 21 bp, Homo sapiens
ttacccagagaatatatacat

SEQ ID NO: 266009 - DNA, 23 bp, Homo sapiens
ttaccccagctccatccttgcat

SEQ ID NO: 266010 - DNA, 14 bp, Homo sapiens
ttaccccttagcct

SEQ ID NO: 266011 - DNA, 20 bp, Homo sapiens
ttacccttctgtgcccagct

SEQ ID NO: 266012 - DNA, 22 bp, Homo sapiens
ttacccttctgtgcccagctca

SEQ ID NO: 266013 - DNA, 14 bp, Homo sapiens
ttaccctttctttt

SEQ ID NO: 266014 - DNA, 17 bp, Homo sapiens
ttaccgagtatctgtaa

SEQ ID NO: 266015 - DNA, 15 bp, Homo sapiens
ttaccgtagcctccg

SEQ ID NO: 266016 - DNA, 16 bp, Homo sapiens
ttacctaaacagatat

SEQ ID NO: 266017 - DNA, 17 bp, Homo sapiens
ttacctaaacagatata

SEQ ID NO: 266018 - DNA, 20 bp, Homo sapiens
gggcagggccgcagggcgct

SEQ ID NO: 266019 - DNA, 14 bp, Homo sapiens
gggcagggccgccc

SEQ ID NO: 266020 - DNA, 18 bp, Homo sapiens
gggcagggcggctaggcc

SEQ ID NO: 266021 - DNA, 22 bp, Homo sapiens
ttatccaaggtgtaactctaat

SEQ ID NO: 266022 - DNA, 22 bp, Homo sapiens
ttatcccacggaaaatgccaat

SEQ ID NO: 266023 - DNA, 23 bp, Homo sapiens
ttatcccatctcactttaataat

SEQ ID NO: 266024 - DNA, 13 bp, Homo sapiens
ttatccctgctta

SEQ ID NO: 266025 - DNA, 23 bp, Homo sapiens
ttatcccttccttttagcctagt

SEQ ID NO: 266026 - DNA, 16 bp, Homo sapiens
ttatcctctggtttaa

SEQ ID NO: 266027 - DNA, 21 bp, Homo sapiens
ttatcctgctagctgtagaaa

SEQ ID NO: 266028 - DNA, 15 bp, Homo sapiens
ttatcctgttactga

SEQ ID NO: 266029 - DNA, 14 bp, Homo sapiens
ttatcgggaacagt

SEQ ID NO: 266030 - DNA, 16 bp, Homo sapiens
ttatcgggagcagtgt

SEQ ID NO: 266031 - DNA, 18 bp, Homo sapiens
ttatcgggagcagtgtct

SEQ ID NO: 266032 - DNA, 21 bp, Homo sapiens
ttatcgggagcagtgtcttcc

SEQ ID NO: 266033 - DNA, 20 bp, Homo sapiens
ggggcatgggggaggctctg

SEQ ID NO: 266034 - DNA, 17 bp, Homo sapiens
ggggcatgggtggaggg

SEQ ID NO: 266035 - DNA, 18 bp, Homo sapiens
ggggcatgtattggcctg

SEQ ID NO: 266036 - DNA, 23 bp, Homo sapiens
ggggcatgtattggcctggaggt

SEQ ID NO: 266037 - DNA, 20 bp, Homo sapiens
ggggccacagccagaacccc

SEQ ID NO: 266038 - DNA, 21 bp, Homo sapiens
ggggccacagccagaaccccg

SEQ ID NO: 266039 - DNA, 17 bp, Homo sapiens
ggggccactgggcccca

SEQ ID NO: 266040 - DNA, 19 bp, Homo sapiens
ggggccacttttgactagg

SEQ ID NO: 266041 - DNA, 21 bp, Homo sapiens
ggggccagactggctgcacag

SEQ ID NO: 266042 - DNA, 22 bp, Homo sapiens
ggggccatgagctccagacccc

SEQ ID NO: 266043 - DNA, 14 bp, Homo sapiens
ggggcccatggccc

SEQ ID NO: 266044 - DNA, 15 bp, Homo sapiens
ggggcccatggcccc

SEQ ID NO: 266045 - DNA, 20 bp, Homo sapiens
ggggcccatggccccagctg

SEQ ID NO: 266046 - DNA, 17 bp, Homo sapiens
ggggccccaaagcccag

SEQ ID NO: 266047 - DNA, 20 bp, Homo sapiens
ggggccccaaagcccagccc

SEQ ID NO: 266048 - DNA, 15 bp, Homo sapiens
ggggccccagatctg

SEQ ID NO: 266049 - DNA, 17 bp, Homo sapiens
ggggccccagatctgcc

SEQ ID NO: 266050 - DNA, 18 bp, Homo sapiens
ggggccccagatctgcct

SEQ ID NO: 266051 - DNA, 20 bp, Homo sapiens
ggggccccagatctgcctgg

SEQ ID NO: 266052 - DNA, 21 bp, Homo sapiens
ggggccccagatctgcctggg

SEQ ID NO: 266053 - DNA, 14 bp, Homo sapiens
ggggcccctcggct

SEQ ID NO: 266054 - DNA, 10 bp, Homo sapiens
ggggcccctt

SEQ ID NO: 266055 - DNA, 21 bp, Homo sapiens
ggggcccctttttactcccct

SEQ ID NO: 266056 - DNA, 19 bp, Homo sapiens
ggggcccttggggcctggc

SEQ ID NO: 266057 - DNA, 17 bp, Homo sapiens
ggggccgaggggccagg

SEQ ID NO: 266058 - DNA, 18 bp, Homo sapiens
ggggccgggctggcttct

SEQ ID NO: 266059 - DNA, 23 bp, Homo sapiens
ggggccgggctggcttctccctg

SEQ ID NO: 266060 - DNA, 13 bp, Homo sapiens
ggggcctagggag

SEQ ID NO: 266061 - DNA, 17 bp, Homo sapiens
ggggcctagtggcttca

SEQ ID NO: 266062 - DNA, 18 bp, Homo sapiens
ggggcctcacccagaagg

SEQ ID NO: 266063 - DNA, 12 bp, Homo sapiens
ggggcctcaggt

SEQ ID NO: 266064 - DNA, 22 bp, Homo sapiens
ggggcctccttgtccaggtctc

SEQ ID NO: 266065 - DNA, 11 bp, Homo sapiens
ggggcctggca

SEQ ID NO: 266066 - DNA, 12 bp, Homo sapiens
ggggcctggcct

SEQ ID NO: 266067 - DNA, 14 bp, Homo sapiens
ggggcctggcctat

SEQ ID NO: 266068 - DNA, 22 bp, Homo sapiens
ggggcctggcctatttaagccc

SEQ ID NO: 266069 - DNA, 13 bp, Homo sapiens
ggggcctggcctg

SEQ ID NO: 266070 - DNA, 11 bp, Homo sapiens
ggggcctggct

SEQ ID NO: 266071 - DNA, 13 bp, Homo sapiens
ggggcctggcttg

SEQ ID NO: 266072 - DNA, 13 bp, Homo sapiens
ggggcgaggcaga

SEQ ID NO: 266073 - DNA, 17 bp, Homo sapiens
ggggcgaggcagaggac

SEQ ID NO: 266074 - DNA, 12 bp, Homo sapiens
ggggcgagggag

SEQ ID NO: 266075 - DNA, 20 bp, Homo sapiens
ggggcgctcaggacccaggc

SEQ ID NO: 266076 - DNA, 13 bp, Homo sapiens
ggggcgggaggcc

SEQ ID NO: 266077 - DNA, 17 bp, Homo sapiens
ggggctaacgggcgcct

SEQ ID NO: 266078 - DNA, 17 bp, Homo sapiens
ggggctaactggcccca

SEQ ID NO: 266079 - DNA, 22 bp, Homo sapiens
ggggctctagggttgctggagc

SEQ ID NO: 266080 - DNA, 24 bp, Homo sapiens
ggggctctccaaaggggctgctgg

SEQ ID NO: 266081 - DNA, 23 bp, Homo sapiens
ggggctctgccctccctccttcc

SEQ ID NO: 266082 - DNA, 19 bp, Homo sapiens
ggggctgcacctcctaccc

SEQ ID NO: 266083 - DNA, 22 bp, Homo sapiens
ggggctgcgaccgccagattct

SEQ ID NO: 266084 - DNA, 18 bp, Homo sapiens
ggggctggcaagcaggga

SEQ ID NO: 266085 - DNA, 12 bp, Homo sapiens
ggggctggccct

SEQ ID NO: 266086 - DNA, 15 bp, Homo sapiens
ggggctggccctgcc

SEQ ID NO: 266087 - DNA, 18 bp, Homo sapiens
ggggctggccctgccctc

SEQ ID NO: 266088 - DNA, 20 bp, Homo sapiens
ggggctggccctgccctccc

SEQ ID NO: 266089 - DNA, 22 bp, Homo sapiens
ggggctggccctgccctccccc

SEQ ID NO: 266090 - DNA, 23 bp, Homo sapiens
ggggctggccctgccctccccca

SEQ ID NO: 266091 - DNA, 18 bp, Homo sapiens
ggggctgtacacaccctc

SEQ ID NO: 266092 - DNA, 20 bp, Homo sapiens
ggggctgtacacaccctcca

SEQ ID NO: 266093 - DNA, 19 bp, Homo sapiens
ggggctgtcctgagccccc

SEQ ID NO: 266094 - DNA, 13 bp, Homo sapiens
ggggcttggagca

SEQ ID NO: 266095 - DNA, 19 bp, Homo sapiens
ggggcttggcgtggagcag

SEQ ID NO: 266096 - DNA, 20 bp, Homo sapiens
ggggcttggggtagagagga

SEQ ID NO: 266097 - DNA, 17 bp, Homo sapiens
ggggctttggtggcccc

SEQ ID NO: 266098 - DNA, 13 bp, Homo sapiens
gggggaacagatg

SEQ ID NO: 266099 - DNA, 16 bp, Homo sapiens
gggggaacagatgcta

SEQ ID NO: 266100 - DNA, 13 bp, Homo sapiens
gggggacaggaac

SEQ ID NO: 266101 - DNA, 20 bp, Homo sapiens
gggggactgggagtcagagc

SEQ ID NO: 266102 - DNA, 12 bp, Homo sapiens
gggggagcctgg

SEQ ID NO: 266103 - DNA, 14 bp, Homo sapiens
gggggaggccgagg

SEQ ID NO: 266104 - DNA, 14 bp, Homo sapiens
gggggagggggagg

SEQ ID NO: 266105 - DNA, 13 bp, Homo sapiens
gggggcacagcca

SEQ ID NO: 266106 - DNA, 14 bp, Homo sapiens
gggggcagggcatg

SEQ ID NO: 266107 - DNA, 14 bp, Homo sapiens
gggggcagggggga

SEQ ID NO: 266108 - DNA, 23 bp, Homo sapiens
gggggcatctgagtccagctccc

SEQ ID NO: 266109 - DNA, 14 bp, Homo sapiens
gggggccatgagct

SEQ ID NO: 266110 - DNA, 15 bp, Homo sapiens
gggggccatgagctc

SEQ ID NO: 266111 - DNA, 12 bp, Homo sapiens
gggggcctctgc

SEQ ID NO: 266112 - DNA, 13 bp, Homo sapiens
gggggcctgctgt

SEQ ID NO: 266113 - DNA, 21 bp, Homo sapiens
gggggctatttctctccccac

SEQ ID NO: 266114 - DNA, 20 bp, Homo sapiens
gggggctgcctggcccccag

SEQ ID NO: 266115 - DNA, 23 bp, Homo sapiens
gggggctgctctgcaagcccact

SEQ ID NO: 266116 - DNA, 19 bp, Homo sapiens
gggggctggtgccagcctt

SEQ ID NO: 266117 - DNA, 23 bp, Homo sapiens
ggggggcccgcctggcagaactg

SEQ ID NO: 266118 - DNA, 20 bp, Homo sapiens
gggggtctatacattcctga

SEQ ID NO: 266119 - DNA, 13 bp, Homo sapiens
gggggttcaggga

SEQ ID NO: 266120 - DNA, 22 bp, Homo sapiens
gggggtttgttgcacagtccct

SEQ ID NO: 266121 - DNA, 18 bp, Homo sapiens
ggggtaaatatatgtttt

SEQ ID NO: 266122 - DNA, 17 bp, Homo sapiens
ggggtacacagtgagag

SEQ ID NO: 266123 - DNA, 13 bp, Homo sapiens
ggggtaccacatg

SEQ ID NO: 266124 - DNA, 18 bp, Homo sapiens
ggggtattttaggcaggg

SEQ ID NO: 266125 - DNA, 12 bp, Homo sapiens
ggggtcccagga

SEQ ID NO: 266126 - DNA, 21 bp, Homo sapiens
ggggtcgggggaggagcaccc

SEQ ID NO: 266127 - DNA, 21 bp, Homo sapiens
ggggtctcagtccagtcctca

SEQ ID NO: 266128 - DNA, 18 bp, Homo sapiens
ggggtctccctgagcctg

SEQ ID NO: 266129 - DNA, 15 bp, Homo sapiens
ggggtctctgagcag

SEQ ID NO: 266130 - DNA, 18 bp, Homo sapiens
ggggtctgtgctgtgcct

SEQ ID NO: 266131 - DNA, 15 bp, Homo sapiens
ggggtgcagcagtga

SEQ ID NO: 266132 - DNA, 14 bp, Homo sapiens
ggggtgcctgagcc

SEQ ID NO: 266133 - DNA, 22 bp, Homo sapiens
ggggtgcgctcacctgcagccc

SEQ ID NO: 266134 - DNA, 15 bp, Homo sapiens
ggggtggaataaagg

SEQ ID NO: 266135 - DNA, 11 bp, Homo sapiens
ggggtgggagc

SEQ ID NO: 266136 - DNA, 15 bp, Homo sapiens
ggggtggggcttgga

SEQ ID NO: 266137 - DNA, 22 bp, Homo sapiens
ggggtgggggagaatggctctg

SEQ ID NO: 266138 - DNA, 22 bp, Homo sapiens
ggggtgtctgtatcctgcagga

SEQ ID NO: 266139 - DNA, 21 bp, Homo sapiens
ggggttcagggaactgcttgc

SEQ ID NO: 266140 - DNA, 21 bp, Homo sapiens
ggggttcgagaccagtctggc

SEQ ID NO: 266141 - DNA, 20 bp, Homo sapiens
ggggttctttcttcctctgc

SEQ ID NO: 266142 - DNA, 22 bp, Homo sapiens
ggggttctttcttcctctgctg

SEQ ID NO: 266143 - DNA, 13 bp, Homo sapiens
ggggttggctggg

SEQ ID NO: 266144 - DNA, 18 bp, Homo sapiens
ggggttgggttccagaca

SEQ ID NO: 266145 - DNA, 17 bp, Homo sapiens
ggggtttccacacaggc

SEQ ID NO: 266146 - DNA, 20 bp, Homo sapiens
ggggtttttttcatccctgc

SEQ ID NO: 266147 - DNA, 13 bp, Homo sapiens
gggtaaactgtgg

SEQ ID NO: 266148 - DNA, 11 bp, Homo sapiens
gggtaaatata

SEQ ID NO: 266149 - DNA, 15 bp, Homo sapiens
gggtaaggaggagaa

SEQ ID NO: 266150 - DNA, 18 bp, Homo sapiens
gggtaatgtgaaggccca

SEQ ID NO: 266151 - DNA, 12 bp, Homo sapiens
ttcaccaggaag

SEQ ID NO: 266152 - DNA, 19 bp, Homo sapiens
ttcaccagtctgtctactg

SEQ ID NO: 266153 - DNA, 21 bp, Homo sapiens
ttcaccagtctgtctactgtg

SEQ ID NO: 266154 - DNA, 16 bp, Homo sapiens
ttcaccatgtaaaaca

SEQ ID NO: 266155 - DNA, 20 bp, Homo sapiens
ttcaccatgtaaaacaaaaa

SEQ ID NO: 266156 - DNA, 21 bp, Homo sapiens
ttcaccatgtaaaacaaaaaa

SEQ ID NO: 266157 - DNA, 23 bp, Homo sapiens
ttcaccatgtaaaacaaaaaaca

SEQ ID NO: 266158 - DNA, 22 bp, Homo sapiens
ttcaccatgttggccaggctgg

SEQ ID NO: 266159 - DNA, 23 bp, Homo sapiens
ttcacccccatccacagttgtca

SEQ ID NO: 266160 - DNA, 12 bp, Homo sapiens
ttcacccctgca

SEQ ID NO: 266161 - DNA, 14 bp, Homo sapiens
ttcacccctgcact

SEQ ID NO: 266162 - DNA, 14 bp, Homo sapiens
ttcaccctcctcat

SEQ ID NO: 266163 - DNA, 22 bp, Homo sapiens
ttcaccctgtcaagttaacaag

SEQ ID NO: 266164 - DNA, 17 bp, Homo sapiens
ttcacctgaaacacttt

SEQ ID NO: 266165 - DNA, 11 bp, Homo sapiens
ttcacctgtaa

SEQ ID NO: 266166 - DNA, 14 bp, Homo sapiens
ttcacctgtaaaac

SEQ ID NO: 266167 - DNA, 19 bp, Homo sapiens
ttcacctgtgacaaaggat

SEQ ID NO: 266168 - DNA, 22 bp, Homo sapiens
ttcacctgtttttaagctgttt

SEQ ID NO: 266169 - DNA, 23 bp, Homo sapiens
ttcacctgtttttaagctgtttc

SEQ ID NO: 266170 - DNA, 12 bp, Homo sapiens
ttcacgccattc

SEQ ID NO: 266171 - DNA, 17 bp, Homo sapiens
ttcacgccattctcctg

SEQ ID NO: 266172 - DNA, 17 bp, Homo sapiens
ttcacgctggcttccag

SEQ ID NO: 266173 - DNA, 19 bp, Homo sapiens
ttcacggtttcacttttaa

SEQ ID NO: 266174 - DNA, 16 bp, Homo sapiens
ttcacgtcactgccag

SEQ ID NO: 266175 - DNA, 18 bp, Homo sapiens
ttcacgtcactgccagag

SEQ ID NO: 266176 - DNA, 22 bp, Homo sapiens
ttcacgtgcagcagcaacacaa

SEQ ID NO: 266177 - DNA, 16 bp, Homo sapiens
ttcactaaaataaaat

SEQ ID NO: 266178 - DNA, 14 bp, Homo sapiens
ttcactaaagcagt

SEQ ID NO: 266179 - DNA, 13 bp, Homo sapiens
ttcactagctttg

SEQ ID NO: 266180 - DNA, 21 bp, Homo sapiens
ggtatgaacttgaggacacat

SEQ ID NO: 266181 - DNA, 21 bp, Homo sapiens
ggtatggaagggtttgtggct

SEQ ID NO: 266182 - DNA, 14 bp, Homo sapiens
ggtatgtgcctgcg

SEQ ID NO: 266183 - DNA, 17 bp, Homo sapiens
ggtattatctagtaggt

SEQ ID NO: 266184 - DNA, 17 bp, Homo sapiens
ggtattcaccaccctgg

SEQ ID NO: 266185 - DNA, 15 bp, Homo sapiens
ggtattctctctatg

SEQ ID NO: 266186 - DNA, 20 bp, Homo sapiens
ggtattctctctatgcaaaa

SEQ ID NO: 266187 - DNA, 23 bp, Homo sapiens
ggtattggagggaaaaaacaagc

SEQ ID NO: 266188 - DNA, 19 bp, Homo sapiens
ggtatttggatatctgtta

SEQ ID NO: 266189 - DNA, 22 bp, Homo sapiens
ggtattttaggcagggatttga

SEQ ID NO: 266190 - DNA, 20 bp, Homo sapiens
ggtattttcgtgcatttgtg

SEQ ID NO: 266191 - DNA, 21 bp, Homo sapiens
ggtattttcgtgcatttgtga

SEQ ID NO: 266192 - DNA, 19 bp, Homo sapiens
ggtatttttcagagattta

SEQ ID NO: 266193 - DNA, 20 bp, Homo sapiens
ggtcaaactacattgagccc

SEQ ID NO: 266194 - DNA, 14 bp, Homo sapiens
ggtcaaacttgttt

SEQ ID NO: 266195 - DNA, 23 bp, Homo sapiens
ggtcaacatcttttacattctgc

SEQ ID NO: 266196 - DNA, 19 bp, Homo sapiens
ggtcaacatggtgaaaccc

SEQ ID NO: 266197 - DNA, 17 bp, Homo sapiens
ggtcaacccgctgcttc

SEQ ID NO: 266198 - DNA, 20 bp, Homo sapiens
ggtcaactccaaggcaaatg

SEQ ID NO: 266199 - DNA, 16 bp, Homo sapiens
ggtcaataattgtgga

SEQ ID NO: 266200 - DNA, 20 bp, Homo sapiens
ggtcaataattgtggagagg

SEQ ID NO: 266201 - DNA, 22 bp, Homo sapiens
ggtcacaaatcctaaaagaagc

SEQ ID NO: 266202 - DNA, 18 bp, Homo sapiens
ggtcacaagtaggagaca

SEQ ID NO: 266203 - DNA, 12 bp, Homo sapiens
ggtcaccctgtg

SEQ ID NO: 266204 - DNA, 13 bp, Homo sapiens
ggtcaccctgtga

SEQ ID NO: 266205 - DNA, 15 bp, Homo sapiens
ggtcacctgtgctac

SEQ ID NO: 266206 - DNA, 20 bp, Homo sapiens
ggtcactaaccaacaaggtt

SEQ ID NO: 266207 - DNA, 19 bp, Homo sapiens
ggtcactgaaacttcaagc

SEQ ID NO: 266208 - DNA, 14 bp, Homo sapiens
ggtcagagggactg

SEQ ID NO: 266209 - DNA, 22 bp, Homo sapiens
ggtcagagggactgtcagctga

SEQ ID NO: 266210 - DNA, 12 bp, Homo sapiens
ggtcagatggag

SEQ ID NO: 266211 - DNA, 20 bp, Homo sapiens
ggtcagattagggcggggag

SEQ ID NO: 266212 - DNA, 19 bp, Homo sapiens
ggtcagcagaaacccccag

SEQ ID NO: 266213 - DNA, 12 bp, Homo sapiens
ggtcagctctgg

SEQ ID NO: 266214 - DNA, 22 bp, Homo sapiens
ggtcagcttgctgccctaggct

SEQ ID NO: 266215 - DNA, 20 bp, Homo sapiens
ggtcaggaacagtggctggg

SEQ ID NO: 266216 - DNA, 17 bp, Homo sapiens
ggtcaggccctggaact

SEQ ID NO: 266217 - DNA, 18 bp, Homo sapiens
ggtcaggccctggaactc

SEQ ID NO: 266218 - DNA, 15 bp, Homo sapiens
ggtcaggggggagaa

SEQ ID NO: 266219 - DNA, 21 bp, Homo sapiens
ggtcagtacccacctgagctt

SEQ ID NO: 266220 - DNA, 14 bp, Homo sapiens
ggtcagtggctctt

SEQ ID NO: 266221 - DNA, 20 bp, Homo sapiens
ggtcatcccagcacctgcca

SEQ ID NO: 266222 - DNA, 23 bp, Homo sapiens
ggtcatcccagcacctgccaggg

SEQ ID NO: 266223 - DNA, 21 bp, Homo sapiens
ggtcatgatgtctgcaaagga

SEQ ID NO: 266224 - DNA, 20 bp, Homo sapiens
ggtccacattctgctgcccc

SEQ ID NO: 266225 - DNA, 22 bp, Homo sapiens
ggtccaccccgtcccggccccg

SEQ ID NO: 266226 - DNA, 22 bp, Homo sapiens
ggtccaggaaggcagctgctct

SEQ ID NO: 266227 - DNA, 12 bp, Homo sapiens
ggtccaggccag

SEQ ID NO: 266228 - DNA, 19 bp, Homo sapiens
ggtccaggccaggcctcat

SEQ ID NO: 266229 - DNA, 12 bp, Homo sapiens
ggtccagggcta

SEQ ID NO: 266230 - DNA, 18 bp, Homo sapiens
ggtccatttcatgtgatc

SEQ ID NO: 266231 - DNA, 14 bp, Homo sapiens
ggtcccagccaccc

SEQ ID NO: 266232 - DNA, 15 bp, Homo sapiens
ggtcccagccacccc

SEQ ID NO: 266233 - DNA, 13 bp, Homo sapiens
ggtcccaggaagc

SEQ ID NO: 266234 - DNA, 11 bp, Homo sapiens
ggtcccaggat

SEQ ID NO: 266235 - DNA, 16 bp, Homo sapiens
ggtcccagtgccattg

SEQ ID NO: 266236 - DNA, 16 bp, Homo sapiens
ggtccccactccctgt

SEQ ID NO: 266237 - DNA, 13 bp, Homo sapiens
ggtccccatcccc

SEQ ID NO: 266238 - DNA, 14 bp, Homo sapiens
ggtccccatcccca

SEQ ID NO: 266239 - DNA, 19 bp, Homo sapiens
ggtccccggacgctggctc

SEQ ID NO: 266240 - DNA, 21 bp, Homo sapiens
ggtcccgaatggagtccagac

SEQ ID NO: 266241 - DNA, 20 bp, Homo sapiens
ggtcccgagccccctgtcct

SEQ ID NO: 266242 - DNA, 21 bp, Homo sapiens
ggtcccgagccccctgtcctt

SEQ ID NO: 266243 - DNA, 22 bp, Homo sapiens
ggtcccggttcagacccctgcc

SEQ ID NO: 266244 - DNA, 19 bp, Homo sapiens
ggtccctggaccagcctcc

SEQ ID NO: 266245 - DNA, 18 bp, Homo sapiens
ggtccgagctctgtcctc

SEQ ID NO: 266246 - DNA, 16 bp, Homo sapiens
ggtccgcaccagctgc

SEQ ID NO: 266247 - DNA, 21 bp, Homo sapiens
ggtccgcaccagctgctctgc

SEQ ID NO: 266248 - DNA, 22 bp, Homo sapiens
ggtccgcaccagctgctctgcc

SEQ ID NO: 266249 - DNA, 19 bp, Homo sapiens
ggtcctacggagggaccag

SEQ ID NO: 266250 - DNA, 21 bp, Homo sapiens
ggtcctcttaggtcccgggag

SEQ ID NO: 266251 - DNA, 17 bp, Homo sapiens
ggtcctgaggctggggc

SEQ ID NO: 266252 - DNA, 14 bp, Homo sapiens
ggtcctggccctct

SEQ ID NO: 266253 - DNA, 14 bp, Homo sapiens
ggtcctggctcctg

SEQ ID NO: 266254 - DNA, 22 bp, Homo sapiens
ggtcctgggatggggcatgtgg

SEQ ID NO: 266255 - DNA, 15 bp, Homo sapiens
ggtccttccctctcc

SEQ ID NO: 266256 - DNA, 19 bp, Homo sapiens
ggtccttccctctccccaa

SEQ ID NO: 266257 - DNA, 15 bp, Homo sapiens
ggtccttctgacccc

SEQ ID NO: 266258 - DNA, 16 bp, Homo sapiens
ggtcctttccttctcg

SEQ ID NO: 266259 - DNA, 17 bp, Homo sapiens
ggtcctttgagtgtcag

SEQ ID NO: 266260 - DNA, 20 bp, Homo sapiens
ggtcgaccccaaagcccctt

SEQ ID NO: 266261 - DNA, 13 bp, Homo sapiens
ggtcgcccctcct

SEQ ID NO: 266262 - DNA, 16 bp, Homo sapiens
ggtcggaagcctgtcc

SEQ ID NO: 266263 - DNA, 17 bp, Homo sapiens
ggtcggaagcctgtcct

SEQ ID NO: 266264 - DNA, 16 bp, Homo sapiens
ggtcggaggcttggga

SEQ ID NO: 266265 - DNA, 18 bp, Homo sapiens
ggtcgggggaggagcacc

SEQ ID NO: 266266 - DNA, 13 bp, Homo sapiens
ggtcgggtgttaa

SEQ ID NO: 266267 - DNA, 20 bp, Homo sapiens
ggtctaaacaaataataccc

SEQ ID NO: 266268 - DNA, 15 bp, Homo sapiens
ggtctatacattcct

SEQ ID NO: 266269 - DNA, 16 bp, Homo sapiens
ggtctatacattcctg

SEQ ID NO: 266270 - DNA, 19 bp, Homo sapiens
ggtctatacattcctgaga

SEQ ID NO: 266271 - DNA, 15 bp, Homo sapiens
ggtctatgttcccca

SEQ ID NO: 266272 - DNA, 16 bp, Homo sapiens
ggtctatgttccccag

SEQ ID NO: 266273 - DNA, 17 bp, Homo sapiens
ggtctcaaactcctgac

SEQ ID NO: 266274 - DNA, 23 bp, Homo sapiens
ggtctcaaactcctgacctcagg

SEQ ID NO: 266275 - DNA, 18 bp, Homo sapiens
ggtctcacagtgttgccc

SEQ ID NO: 266276 - DNA, 19 bp, Homo sapiens
ggtctcacagtgttgccca

SEQ ID NO: 266277 - DNA, 20 bp, Homo sapiens
ggtctcacagtgttgcccag

SEQ ID NO: 266278 - DNA, 21 bp, Homo sapiens
ggtctcacagtgttgcccagg

SEQ ID NO: 266279 - DNA, 23 bp, Homo sapiens
ggtctcactcctgagtggggcca

SEQ ID NO: 266280 - DNA, 14 bp, Homo sapiens
ttccacgtgtatgc

SEQ ID NO: 266281 - DNA, 16 bp, Homo sapiens
ttccactaccctccct

SEQ ID NO: 266282 - DNA, 18 bp, Homo sapiens
ttccactaccctccctcg

SEQ ID NO: 266283 - DNA, 16 bp, Homo sapiens
ttccactgcctctgcc

SEQ ID NO: 266284 - DNA, 20 bp, Homo sapiens
ttccactgtcaagaaagagc

SEQ ID NO: 266285 - DNA, 15 bp, Homo sapiens
ttccacttagagaac

SEQ ID NO: 266286 - DNA, 14 bp, Homo sapiens
ttccagaacagccc

SEQ ID NO: 266287 - DNA, 17 bp, Homo sapiens
ttccagaagatgccctc

SEQ ID NO: 266288 - DNA, 19 bp, Homo sapiens
ttccagaagatgccctcca

SEQ ID NO: 266289 - DNA, 22 bp, Homo sapiens
ttccagaaggccacaggccact

SEQ ID NO: 266290 - DNA, 19 bp, Homo sapiens
ttccagaatatctgggatt

SEQ ID NO: 266291 - DNA, 12 bp, Homo sapiens
ttccagaattga

SEQ ID NO: 266292 - DNA, 22 bp, Homo sapiens
ttccagaatttggaagctagaa

SEQ ID NO: 266293 - DNA, 20 bp, Homo sapiens
ttccagacagggtggggctt

SEQ ID NO: 266294 - DNA, 20 bp, Homo sapiens
ttccagagagtggctcctcc

SEQ ID NO: 266295 - DNA, 21 bp, Homo sapiens
ttccagagagtggctcctccc

SEQ ID NO: 266296 - DNA, 19 bp, Homo sapiens
ttccagatgtctaaaagat

SEQ ID NO: 266297 - DNA, 19 bp, Homo sapiens
ttccagattgggggccctg

SEQ ID NO: 266298 - DNA, 16 bp, Homo sapiens
ttccagcgggccctct

SEQ ID NO: 266299 - DNA, 21 bp, Homo sapiens
ttccagctaagcctgatgatg

SEQ ID NO: 266300 - DNA, 15 bp, Homo sapiens
ttccagctctgcccc

SEQ ID NO: 266301 - DNA, 15 bp, Homo sapiens
ttccagcttgaggga

SEQ ID NO: 266302 - DNA, 16 bp, Homo sapiens
ttccaggatcctgcag

SEQ ID NO: 266303 - DNA, 21 bp, Homo sapiens
ttccaggcccctgaggactgg

SEQ ID NO: 266304 - DNA, 18 bp, Homo sapiens
ttccaggcgtagggccag

SEQ ID NO: 266305 - DNA, 21 bp, Homo sapiens
ttccaggcgtagggccagggc

SEQ ID NO: 266306 - DNA, 19 bp, Homo sapiens
ttccagggactgtacctgt

SEQ ID NO: 266307 - DNA, 22 bp, Homo sapiens
ttccaggggtcaccttgagagg

SEQ ID NO: 266308 - DNA, 22 bp, Homo sapiens
ttccaggtagctgaaaggggaa

SEQ ID NO: 266309 - DNA, 18 bp, Homo sapiens
ttccagtacctttgtcac

SEQ ID NO: 266310 - DNA, 15 bp, Homo sapiens
ttccagtattgaaaa

SEQ ID NO: 266311 - DNA, 21 bp, Homo sapiens
ttccagtattgaaaacttcaa

SEQ ID NO: 266312 - DNA, 14 bp, Homo sapiens
ttccagtctcaaaa

SEQ ID NO: 266313 - DNA, 19 bp, Homo sapiens
ttccagtctcaaaaataca

SEQ ID NO: 266314 - DNA, 20 bp, Homo sapiens
ttccagtctccaccaggaac

SEQ ID NO: 266315 - DNA, 18 bp, Homo sapiens
ttccagttggactgtggc

SEQ ID NO: 266316 - DNA, 13 bp, Homo sapiens
ttccataattatg

SEQ ID NO: 266317 - DNA, 16 bp, Homo sapiens
ttccataattatgaca

SEQ ID NO: 266318 - DNA, 15 bp, Homo sapiens
ttccatcacagccag

SEQ ID NO: 266319 - DNA, 19 bp, Homo sapiens
ttccatcacagccagccca

SEQ ID NO: 266320 - DNA, 20 bp, Homo sapiens
ttccatcacagccagcccag

SEQ ID NO: 266321 - DNA, 23 bp, Homo sapiens
ttccatcacagccagcccagctc

SEQ ID NO: 266322 - DNA, 14 bp, Homo sapiens
ttccatccaccacc

SEQ ID NO: 266323 - DNA, 21 bp, Homo sapiens
ggtgttgccaaatatgtcctg

SEQ ID NO: 266324 - DNA, 14 bp, Homo sapiens
ggtgttttcatgta

SEQ ID NO: 266325 - DNA, 20 bp, Homo sapiens
ggtgttttttttaagggcat

SEQ ID NO: 266326 - DNA, 19 bp, Homo sapiens
ggttaaagaaaggcagaga

SEQ ID NO: 266327 - DNA, 12 bp, Homo sapiens
ggttaagccata

SEQ ID NO: 266328 - DNA, 19 bp, Homo sapiens
ggttaaggtgggtccagga

SEQ ID NO: 266329 - DNA, 12 bp, Homo sapiens
ggttaatggcta

SEQ ID NO: 266330 - DNA, 17 bp, Homo sapiens
ggttaatggctagtact

SEQ ID NO: 266331 - DNA, 15 bp, Homo sapiens
ggttacaaactgcaa

SEQ ID NO: 266332 - DNA, 15 bp, Homo sapiens
ggttagcaatattta

SEQ ID NO: 266333 - DNA, 17 bp, Homo sapiens
ggttagcagagctggac

SEQ ID NO: 266334 - DNA, 21 bp, Homo sapiens
ggttagcctggtgacaggcag

SEQ ID NO: 266335 - DNA, 23 bp, Homo sapiens
ggttatctgcctggcctggctcc

SEQ ID NO: 266336 - DNA, 22 bp, Homo sapiens
ggttatgtgtatgtgccattta

SEQ ID NO: 266337 - DNA, 20 bp, Homo sapiens
ggttattagcaaggctgggt

SEQ ID NO: 266338 - DNA, 13 bp, Homo sapiens
ggttcaaattcct

SEQ ID NO: 266339 - DNA, 21 bp, Homo sapiens
ggttcacgccattctcctgcc

SEQ ID NO: 266340 - DNA, 15 bp, Homo sapiens
ggttcactaaagcag

SEQ ID NO: 266341 - DNA, 18 bp, Homo sapiens
ggttcagaaatgctgcct

SEQ ID NO: 266342 - DNA, 22 bp, Homo sapiens
ggttcagaaatgctgcctgcct

SEQ ID NO: 266343 - DNA, 16 bp, Homo sapiens
ggttcagacccctgcc

SEQ ID NO: 266344 - DNA, 18 bp, Homo sapiens
ggttcagacccctgcctg

SEQ ID NO: 266345 - DNA, 22 bp, Homo sapiens
ggttcagggaactgcttgccca

SEQ ID NO: 266346 - DNA, 17 bp, Homo sapiens
ggttcaggtcagggcta

SEQ ID NO: 266347 - DNA, 22 bp, Homo sapiens
ggttcatcagtgttaaaaaatt

SEQ ID NO: 266348 - DNA, 16 bp, Homo sapiens
ggttccaatcctggct

SEQ ID NO: 266349 - DNA, 17 bp, Homo sapiens
ggttccagacagagtgg

SEQ ID NO: 266350 - DNA, 13 bp, Homo sapiens
ggttccagacagg

SEQ ID NO: 266351 - DNA, 14 bp, Homo sapiens
ggttccatgcctga

SEQ ID NO: 266352 - DNA, 18 bp, Homo sapiens
ggttccatgcctgagggt

SEQ ID NO: 266353 - DNA, 16 bp, Homo sapiens
ggttcccaataaaagt

SEQ ID NO: 266354 - DNA, 17 bp, Homo sapiens
ggttcccaataaaagtg

SEQ ID NO: 266355 - DNA, 20 bp, Homo sapiens
ggttcccaataaaagtgact

SEQ ID NO: 266356 - DNA, 17 bp, Homo sapiens
ggttcccatttgctcct

SEQ ID NO: 266357 - DNA, 14 bp, Homo sapiens
ggttcccccagccc

SEQ ID NO: 266358 - DNA, 16 bp, Homo sapiens
ggttcccccagccctg

SEQ ID NO: 266359 - DNA, 21 bp, Homo sapiens
ggttcccccagccctgtggaa

SEQ ID NO: 266360 - DNA, 17 bp, Homo sapiens
ggttcccccaggaccct

SEQ ID NO: 266361 - DNA, 19 bp, Homo sapiens
ggttcccccaggaccctga

SEQ ID NO: 266362 - DNA, 15 bp, Homo sapiens
ggttcccctgttcac

SEQ ID NO: 266363 - DNA, 14 bp, Homo sapiens
ggttccctgcctag

SEQ ID NO: 266364 - DNA, 22 bp, Homo sapiens
ggttccctttccttccatccct

SEQ ID NO: 266365 - DNA, 17 bp, Homo sapiens
ggttcctcttaggtcag

SEQ ID NO: 266366 - DNA, 16 bp, Homo sapiens
ggttccttaagtggct

SEQ ID NO: 266367 - DNA, 20 bp, Homo sapiens
ggttccttcctatgcccagg

SEQ ID NO: 266368 - DNA, 17 bp, Homo sapiens
ggttcgtatagaaaaag

SEQ ID NO: 266369 - DNA, 23 bp, Homo sapiens
ggttcgtggaaagggtgctgctt

SEQ ID NO: 266370 - DNA, 16 bp, Homo sapiens
ggttctaagtgggaga

SEQ ID NO: 266371 - DNA, 11 bp, Homo sapiens
ggttctagaag

SEQ ID NO: 266372 - DNA, 13 bp, Homo sapiens
ggttctagaaggg

SEQ ID NO: 266373 - DNA, 18 bp, Homo sapiens
ggttctagaaggggcgag

SEQ ID NO: 266374 - DNA, 20 bp, Homo sapiens
ggttctagacgcccctccca

SEQ ID NO: 266375 - DNA, 23 bp, Homo sapiens
ggttctagtctcctttgcactga

SEQ ID NO: 266376 - DNA, 11 bp, Homo sapiens
ggttctatttt

SEQ ID NO: 266377 - DNA, 13 bp, Homo sapiens
ggttctcagcaag

SEQ ID NO: 266378 - DNA, 16 bp, Homo sapiens
ggttctccatccccat

SEQ ID NO: 266379 - DNA, 13 bp, Homo sapiens
ggttctcctgatt

SEQ ID NO: 266380 - DNA, 12 bp, Homo sapiens
ggttctggggcc

SEQ ID NO: 266381 - DNA, 18 bp, Homo sapiens
ggttctggttagctcagc

SEQ ID NO: 266382 - DNA, 17 bp, Homo sapiens
ggttcttgccttcccct

SEQ ID NO: 266383 - DNA, 16 bp, Homo sapiens
ggttctttcttcctct

SEQ ID NO: 266384 - DNA, 17 bp, Homo sapiens
ggttctttcttcctctg

SEQ ID NO: 266385 - DNA, 23 bp, Homo sapiens
ggttgaaaagattccattttata

SEQ ID NO: 266386 - DNA, 15 bp, Homo sapiens
ggttgaaggcagtct

SEQ ID NO: 266387 - DNA, 21 bp, Homo sapiens
ggttgaaggcagtctgaaccc

SEQ ID NO: 266388 - DNA, 13 bp, Homo sapiens
ggttgaggacagg

SEQ ID NO: 266389 - DNA, 17 bp, Homo sapiens
ggttgcagctgctcttg

SEQ ID NO: 266390 - DNA, 18 bp, Homo sapiens
ggttgcttgggccactgc

SEQ ID NO: 266391 - DNA, 22 bp, Homo sapiens
ggttggaaaagaaatcaatttt

SEQ ID NO: 266392 - DNA, 17 bp, Homo sapiens
ggttggaactgctgcca

SEQ ID NO: 266393 - DNA, 21 bp, Homo sapiens
ggttggaggcctcaccctgct

SEQ ID NO: 266394 - DNA, 23 bp, Homo sapiens
ggttgggttccagacagagtgga

SEQ ID NO: 266395 - DNA, 22 bp, Homo sapiens
ggttgtacatagtggtcatttg

SEQ ID NO: 266396 - DNA, 13 bp, Homo sapiens
ggttgtcaatatt

SEQ ID NO: 266397 - DNA, 20 bp, Homo sapiens
ggttgtgaaccaactgcctt

SEQ ID NO: 266398 - DNA, 14 bp, Homo sapiens
ggttgttccttttt

SEQ ID NO: 266399 - DNA, 14 bp, Homo sapiens
ggttgttgccaggt

SEQ ID NO: 266400 - DNA, 20 bp, Homo sapiens
ggttgtttaaatataaatct

SEQ ID NO: 266401 - DNA, 21 bp, Homo sapiens
ggttgtttctctgagctttgt

SEQ ID NO: 266402 - DNA, 20 bp, Homo sapiens
ggtttaactcagatcactac

SEQ ID NO: 266403 - DNA, 15 bp, Homo sapiens
ggtttacaacaaaca

SEQ ID NO: 266404 - DNA, 17 bp, Homo sapiens
ggtttacaacaaacact

SEQ ID NO: 266405 - DNA, 19 bp, Homo sapiens
ggtttacaacaaacactgt

SEQ ID NO: 266406 - DNA, 22 bp, Homo sapiens
ggtttactctgtgctaagttgt

SEQ ID NO: 266407 - DNA, 13 bp, Homo sapiens
ggtttactgctgt

SEQ ID NO: 266408 - DNA, 15 bp, Homo sapiens
ggtttagcaggctgc

SEQ ID NO: 266409 - DNA, 12 bp, Homo sapiens
ggtttcaattta

SEQ ID NO: 266410 - DNA, 17 bp, Homo sapiens
gtaatatcatttcataa

SEQ ID NO: 266411 - DNA, 20 bp, Homo sapiens
gtaatatcatttcataaaaa

SEQ ID NO: 266412 - DNA, 13 bp, Homo sapiens
gtaatatctttaa

SEQ ID NO: 266413 - DNA, 19 bp, Homo sapiens
gtaatatttcttcaagtga

SEQ ID NO: 266414 - DNA, 20 bp, Homo sapiens
gtaatcatttatcttatcta

SEQ ID NO: 266415 - DNA, 23 bp, Homo sapiens
gtaatcatttcttgggccctcct

SEQ ID NO: 266416 - DNA, 15 bp, Homo sapiens
gtaatccaggggtgt

SEQ ID NO: 266417 - DNA, 15 bp, Homo sapiens
gtaatcccagcactt

SEQ ID NO: 266418 - DNA, 18 bp, Homo sapiens
gtaatcccagcactttgg

SEQ ID NO: 266419 - DNA, 20 bp, Homo sapiens
gtaatcccagcactttggga

SEQ ID NO: 266420 - DNA, 22 bp, Homo sapiens
gtaatctccacagtcaaagaag

SEQ ID NO: 266421 - DNA, 14 bp, Homo sapiens
gtaatctctgatta

SEQ ID NO: 266422 - DNA, 23 bp, Homo sapiens
gtaatctctgattaaatttaata

SEQ ID NO: 266423 - DNA, 16 bp, Homo sapiens
gtaatgaattttatgt

SEQ ID NO: 266424 - DNA, 21 bp, Homo sapiens
gtaatgaatttttatgatatt

SEQ ID NO: 266425 - DNA, 15 bp, Homo sapiens
gtaatgacagagagt

SEQ ID NO: 266426 - DNA, 18 bp, Homo sapiens
gtaatgcagacatttaca

SEQ ID NO: 266427 - DNA, 16 bp, Homo sapiens
gtaatgcttatgtgtt

SEQ ID NO: 266428 - DNA, 16 bp, Homo sapiens
gtaatggaactgaccc

SEQ ID NO: 266429 - DNA, 13 bp, Homo sapiens
gtaatggaggcca

SEQ ID NO: 266430 - DNA, 12 bp, Homo sapiens
gtaatgggcctg

SEQ ID NO: 266431 - DNA, 15 bp, Homo sapiens
gtaatgggcctgccc

SEQ ID NO: 266432 - DNA, 12 bp, Homo sapiens
gtaatgtatctt

SEQ ID NO: 266433 - DNA, 14 bp, Homo sapiens
gtaatgtgaataaa

SEQ ID NO: 266434 - DNA, 16 bp, Homo sapiens
gtaatgtgaataaatt

SEQ ID NO: 266435 - DNA, 14 bp, Homo sapiens
gtaatgttactgat

SEQ ID NO: 266436 - DNA, 20 bp, Homo sapiens
gtaatgttactgatcatgca

SEQ ID NO: 266437 - DNA, 14 bp, Homo sapiens
gtaatgtttaagat

SEQ ID NO: 266438 - DNA, 23 bp, Homo sapiens
gtaattacctgtcatctgggcca

SEQ ID NO: 266439 - DNA, 14 bp, Homo sapiens
gtaattcaagaaaa

SEQ ID NO: 266440 - DNA, 14 bp, Homo sapiens
gtaattctaaatga

SEQ ID NO: 266441 - DNA, 22 bp, Homo sapiens
gtaattctaaatgaatgtttac

SEQ ID NO: 266442 - DNA, 15 bp, Homo sapiens
gtaattgaacttatc

SEQ ID NO: 266443 - DNA, 15 bp, Homo sapiens
gtaattgcttacatt

SEQ ID NO: 266444 - DNA, 22 bp, Homo sapiens
gtaattgcttacatttttacaa

SEQ ID NO: 266445 - DNA, 19 bp, Homo sapiens
gtaatttaattccccttcc

SEQ ID NO: 266446 - DNA, 13 bp, Homo sapiens
gtaatttgtatct

SEQ ID NO: 266447 - DNA, 21 bp, Homo sapiens
gtaattttgtagtagttgatg

SEQ ID NO: 266448 - DNA, 14 bp, Homo sapiens
gtacaaagtagaga

SEQ ID NO: 266449 - DNA, 18 bp, Homo sapiens
gtacaaagtagagaagta

SEQ ID NO: 266450 - DNA, 18 bp, Homo sapiens
gtacaaggtatgtacagt

SEQ ID NO: 266451 - DNA, 21 bp, Homo sapiens
gtacaagtgctcagttccaat

SEQ ID NO: 266452 - DNA, 21 bp, Homo sapiens
gtacaagttttgtataaataa

SEQ ID NO: 266453 - DNA, 13 bp, Homo sapiens
gtacaatgtttca

SEQ ID NO: 266454 - DNA, 13 bp, Homo sapiens
gtacaattctttg

SEQ ID NO: 266455 - DNA, 23 bp, Homo sapiens
gtacacaccctccagcacagact

SEQ ID NO: 266456 - DNA, 20 bp, Homo sapiens
gtacacccaattttaaaaaa

SEQ ID NO: 266457 - DNA, 15 bp, Homo sapiens
gtacactgaatattt

SEQ ID NO: 266458 - DNA, 21 bp, Homo sapiens
gtacagaatcattgcttatga

SEQ ID NO: 266459 - DNA, 22 bp, Homo sapiens
gtacagagtggcccctcacctg

SEQ ID NO: 266460 - DNA, 20 bp, Homo sapiens
gtacagccttcactggagac

SEQ ID NO: 266461 - DNA, 21 bp, Homo sapiens
gtacaggcaaaacacgcaagg

SEQ ID NO: 266462 - DNA, 15 bp, Homo sapiens
gtacagtgaggaggg

SEQ ID NO: 266463 - DNA, 18 bp, Homo sapiens
gtacagtgaggagggtgg

SEQ ID NO: 266464 - DNA, 14 bp, Homo sapiens
ttcctaaatgcagt

SEQ ID NO: 266465 - DNA, 19 bp, Homo sapiens
ttcctaacaggattagaca

SEQ ID NO: 266466 - DNA, 15 bp, Homo sapiens
ttcctaatgcattag

SEQ ID NO: 266467 - DNA, 17 bp, Homo sapiens
ttcctaattaaaataag

SEQ ID NO: 266468 - DNA, 21 bp, Homo sapiens
ttcctacacccttggacttga

SEQ ID NO: 266469 - DNA, 12 bp, Homo sapiens
ttcctacagccc

SEQ ID NO: 266470 - DNA, 17 bp, Homo sapiens
ttcctacccaaccactc

SEQ ID NO: 266471 - DNA, 20 bp, Homo sapiens
ttcctagagcatctgtccca

SEQ ID NO: 266472 - DNA, 23 bp, Homo sapiens
ttcctagagcatctgtcccactg

SEQ ID NO: 266473 - DNA, 19 bp, Homo sapiens
ttcctagcttatctccctg

SEQ ID NO: 266474 - DNA, 22 bp, Homo sapiens
ttcctagcttatctccctgctt

SEQ ID NO: 266475 - DNA, 23 bp, Homo sapiens
ttcctagcttatctccctgcttc

SEQ ID NO: 266476 - DNA, 19 bp, Homo sapiens
ttcctagtatacccactgc

SEQ ID NO: 266477 - DNA, 18 bp, Homo sapiens
ttcctagttttatgtttc

SEQ ID NO: 266478 - DNA, 19 bp, Homo sapiens
ttcctagttttatgtttct

SEQ ID NO: 266479 - DNA, 21 bp, Homo sapiens
ttcctagttttatgtttcttg

SEQ ID NO: 266480 - DNA, 13 bp, Homo sapiens
ttcctatgcccag

SEQ ID NO: 266481 - DNA, 22 bp, Homo sapiens
ttcctattttcttttccattgc

SEQ ID NO: 266482 - DNA, 17 bp, Homo sapiens
ttcctcaccaataactt

SEQ ID NO: 266483 - DNA, 22 bp, Homo sapiens
ttcctcaccaataacttcagag

SEQ ID NO: 266484 - DNA, 23 bp, Homo sapiens
ttcctcaccaataacttcagaga

SEQ ID NO: 266485 - DNA, 22 bp, Homo sapiens
ttcctcacctaccctcaaagta

SEQ ID NO: 266486 - DNA, 16 bp, Homo sapiens
ttcctcatcctgcttc

SEQ ID NO: 266487 - DNA, 15 bp, Homo sapiens
ttcctcatgaatgta

SEQ ID NO: 266488 - DNA, 18 bp, Homo sapiens
ttcctcatgaatgtaaat

SEQ ID NO: 266489 - DNA, 22 bp, Homo sapiens
ttcctcatgaatgtaaatttgt

SEQ ID NO: 266490 - DNA, 11 bp, Homo sapiens
ttcctcatggc

SEQ ID NO: 266491 - DNA, 12 bp, Homo sapiens
ttcctcatttgt

SEQ ID NO: 266492 - DNA, 19 bp, Homo sapiens
ttcctccagcctcccctcc

SEQ ID NO: 266493 - DNA, 17 bp, Homo sapiens
ttcctccagtctgttct

SEQ ID NO: 266494 - DNA, 18 bp, Homo sapiens
ttcctccagtctgttctc

SEQ ID NO: 266495 - DNA, 10 bp, Homo sapiens
ttcctccctc

SEQ ID NO: 266496 - DNA, 18 bp, Homo sapiens
ttcctccctccctgcagg

SEQ ID NO: 266497 - DNA, 20 bp, Homo sapiens
ttcctcccttctttgcttct

SEQ ID NO: 266498 - DNA, 19 bp, Homo sapiens
ttcctcctcagtcttctca

SEQ ID NO: 266499 - DNA, 16 bp, Homo sapiens
ttcctcctccacagtg

SEQ ID NO: 266500 - DNA, 21 bp, Homo sapiens
ttcctcctccacagtgctgct

SEQ ID NO: 266501 - DNA, 19 bp, Homo sapiens
ttcctcctcctcctcctgt

SEQ ID NO: 266502 - DNA, 16 bp, Homo sapiens
ttcctcctgaagcctc

SEQ ID NO: 266503 - DNA, 23 bp, Homo sapiens
ttcctcctgaagcctctgccctg

SEQ ID NO: 266504 - DNA, 23 bp, Homo sapiens
ttcctctctctctctctctctgt

SEQ ID NO: 266505 - DNA, 21 bp, Homo sapiens
ttcctctgaatattaagaaac

SEQ ID NO: 266506 - DNA, 14 bp, Homo sapiens
ttcctctgagctgt

SEQ ID NO: 266507 - DNA, 17 bp, Homo sapiens
ttcctctgagctgttat

SEQ ID NO: 266508 - DNA, 10 bp, Homo sapiens
ttcctctgca

SEQ ID NO: 266509 - DNA, 13 bp, Homo sapiens
ttcctctgcagct

SEQ ID NO: 266510 - DNA, 22 bp, Homo sapiens
ttcctctgcaggacacagatct

SEQ ID NO: 266511 - DNA, 16 bp, Homo sapiens
ttcctctgtagaattt

SEQ ID NO: 266512 - DNA, 16 bp, Homo sapiens
ttcctcttccttctct

SEQ ID NO: 266513 - DNA, 20 bp, Homo sapiens
ttcctcttccttctctactc

SEQ ID NO: 266514 - DNA, 15 bp, Homo sapiens
ttcctctttgcatgg

SEQ ID NO: 266515 - DNA, 17 bp, Homo sapiens
ttcctctttgcatggaa

SEQ ID NO: 266516 - DNA, 18 bp, Homo sapiens
ttcctgaagaattgaaaa

SEQ ID NO: 266517 - DNA, 14 bp, Homo sapiens
ttcctgaatattaa

SEQ ID NO: 266518 - DNA, 16 bp, Homo sapiens
ttcctgaatattaatc

SEQ ID NO: 266519 - DNA, 20 bp, Homo sapiens
ttcctgagaaagcccacctg

SEQ ID NO: 266520 - DNA, 11 bp, Homo sapiens
ttcctgagctt

SEQ ID NO: 266521 - DNA, 13 bp, Homo sapiens
ttcctgagcttgg

SEQ ID NO: 266522 - DNA, 13 bp, Homo sapiens
ttcctgagggcta

SEQ ID NO: 266523 - DNA, 21 bp, Homo sapiens
ttcctgatactgggtacaaga

SEQ ID NO: 266524 - DNA, 19 bp, Homo sapiens
ttcctgcaactcaaggact

SEQ ID NO: 266525 - DNA, 18 bp, Homo sapiens
ttcctgcagcctggaggc

SEQ ID NO: 266526 - DNA, 16 bp, Homo sapiens
ttcctgcatttgtgaa

SEQ ID NO: 266527 - DNA, 13 bp, Homo sapiens
ttcctgcccccgc

SEQ ID NO: 266528 - DNA, 17 bp, Homo sapiens
ttcctgccctgtacctc

SEQ ID NO: 266529 - DNA, 22 bp, Homo sapiens
ttcctgccctgtacctctctct

SEQ ID NO: 266530 - DNA, 15 bp, Homo sapiens
ttcctgctacagtag

SEQ ID NO: 266531 - DNA, 18 bp, Homo sapiens
ttcctgctacagtagctg

SEQ ID NO: 266532 - DNA, 11 bp, Homo sapiens
ttcctgctggt

SEQ ID NO: 266533 - DNA, 15 bp, Homo sapiens
ttcctgctttctctt

SEQ ID NO: 266534 - DNA, 18 bp, Homo sapiens
ttcctgctttctctttca

SEQ ID NO: 266535 - DNA, 12 bp, Homo sapiens
ttcctggacatc

SEQ ID NO: 266536 - DNA, 20 bp, Homo sapiens
ttcctggacatcctcttctg

SEQ ID NO: 266537 - DNA, 23 bp, Homo sapiens
ttcctggactggcccttgcccaa

SEQ ID NO: 266538 - DNA, 18 bp, Homo sapiens
ttcctggattttctttct

SEQ ID NO: 266539 - DNA, 19 bp, Homo sapiens
ttcctggattttctttcta

SEQ ID NO: 266540 - DNA, 18 bp, Homo sapiens
gtatagttttacactcta

SEQ ID NO: 266541 - DNA, 14 bp, Homo sapiens
gtatataagctgtt

SEQ ID NO: 266542 - DNA, 12 bp, Homo sapiens
gtatataatttt

SEQ ID NO: 266543 - DNA, 20 bp, Homo sapiens
gtatatatatgccatgatgg

SEQ ID NO: 266544 - DNA, 12 bp, Homo sapiens
gtatatatgtgt

SEQ ID NO: 266545 - DNA, 18 bp, Homo sapiens
gtatatatgtgtgtttaa

SEQ ID NO: 266546 - DNA, 19 bp, Homo sapiens
gtatatatgtgtgtttaaa

SEQ ID NO: 266547 - DNA, 21 bp, Homo sapiens
gtatatggtgattcaaatgca

SEQ ID NO: 266548 - DNA, 15 bp, Homo sapiens
gtatatgtctcaggt

SEQ ID NO: 266549 - DNA, 17 bp, Homo sapiens
gtatatgttgtaataaa

SEQ ID NO: 266550 - DNA, 16 bp, Homo sapiens
gtatatgtttatatac

SEQ ID NO: 266551 - DNA, 17 bp, Homo sapiens
gtatatgtttatatact

SEQ ID NO: 266552 - DNA, 17 bp, Homo sapiens
gtatatttatataatta

SEQ ID NO: 266553 - DNA, 18 bp, Homo sapiens
gtatatttcattgaatac

SEQ ID NO: 266554 - DNA, 13 bp, Homo sapiens
gtatcaaaggcag

SEQ ID NO: 266555 - DNA, 15 bp, Homo sapiens
gtatcaaaggcagaa

SEQ ID NO: 266556 - DNA, 14 bp, Homo sapiens
gtatcaaatctgta

SEQ ID NO: 266557 - DNA, 18 bp, Homo sapiens
gtatcaacccagaaacac

SEQ ID NO: 266558 - DNA, 15 bp, Homo sapiens
gtatcaaggctgcct

SEQ ID NO: 266559 - DNA, 16 bp, Homo sapiens
gtatcaaggctgcctg

SEQ ID NO: 266560 - DNA, 19 bp, Homo sapiens
gtatcaagtggcatgtgct

SEQ ID NO: 266561 - DNA, 17 bp, Homo sapiens
gtatcacaggccagatg

SEQ ID NO: 266562 - DNA, 16 bp, Homo sapiens
gtatcacctttcccag

SEQ ID NO: 266563 - DNA, 18 bp, Homo sapiens
gtatcactgtctttccta

SEQ ID NO: 266564 - DNA, 11 bp, Homo sapiens
gtatcatgcat

SEQ ID NO: 266565 - DNA, 21 bp, Homo sapiens
gtatccaactgcatccaggcc

SEQ ID NO: 266566 - DNA, 19 bp, Homo sapiens
gtatccaattatgtgacaa

SEQ ID NO: 266567 - DNA, 13 bp, Homo sapiens
gtatccagaggtg

SEQ ID NO: 266568 - DNA, 19 bp, Homo sapiens
gtatcccaactcctataat

SEQ ID NO: 266569 - DNA, 17 bp, Homo sapiens
gtatcccagacccctct

SEQ ID NO: 266570 - DNA, 13 bp, Homo sapiens
gtatcccttctca

SEQ ID NO: 266571 - DNA, 17 bp, Homo sapiens
gtatcccttctcacagc

SEQ ID NO: 266572 - DNA, 17 bp, Homo sapiens
gtatcctgcccagtgtt

SEQ ID NO: 266573 - DNA, 18 bp, Homo sapiens
gtatcctgcccagtgttg

SEQ ID NO: 266574 - DNA, 13 bp, Homo sapiens
gtatcctgctggt

SEQ ID NO: 266575 - DNA, 17 bp, Homo sapiens
gtatcctggggctccct

SEQ ID NO: 266576 - DNA, 14 bp, Homo sapiens
gtatcggagacagt

SEQ ID NO: 266577 - DNA, 17 bp, Homo sapiens
gtatctaaaaaataact

SEQ ID NO: 266578 - DNA, 19 bp, Homo sapiens
gtatctaaaaaataactgt

SEQ ID NO: 266579 - DNA, 13 bp, Homo sapiens
gtatctaaatgaa

SEQ ID NO: 266580 - DNA, 15 bp, Homo sapiens
gtatctaaatgaaaa

SEQ ID NO: 266581 - DNA, 19 bp, Homo sapiens
gtatctgcatgtaaaatct

SEQ ID NO: 266582 - DNA, 13 bp, Homo sapiens
gtatctgtaaccc

SEQ ID NO: 266583 - DNA, 16 bp, Homo sapiens
gtatctgtatctctct

SEQ ID NO: 266584 - DNA, 17 bp, Homo sapiens
gtatcttaagccaagaa

SEQ ID NO: 266585 - DNA, 16 bp, Homo sapiens
gtatcttatttatata

SEQ ID NO: 266586 - DNA, 18 bp, Homo sapiens
gtatcttatttatatatg

SEQ ID NO: 266587 - DNA, 21 bp, Homo sapiens
gtatcttttattttcctgtct

SEQ ID NO: 266588 - DNA, 22 bp, Homo sapiens
gtatgaaagatggctgtgcctc

SEQ ID NO: 266589 - DNA, 15 bp, Homo sapiens
gtatgaacttgagga

SEQ ID NO: 266590 - DNA, 19 bp, Homo sapiens
gtatgaacttgaggacaca

SEQ ID NO: 266591 - DNA, 18 bp, Homo sapiens
gtatgaagtacttttaac

SEQ ID NO: 266592 - DNA, 21 bp, Homo sapiens
gtatgagaaatacagtgcttt

SEQ ID NO: 266593 - DNA, 16 bp, Homo sapiens
gtatgagtaggtttgg

SEQ ID NO: 266594 - DNA, 20 bp, Homo sapiens
gtatgagtcaatgtgcagtg

SEQ ID NO: 266595 - DNA, 17 bp, Homo sapiens
gtatgatttaggcttct

SEQ ID NO: 266596 - DNA, 20 bp, Homo sapiens
gtatgcaagaagaatataaa

SEQ ID NO: 266597 - DNA, 22 bp, Homo sapiens
gtatgcaagtgggagatgaaaa

SEQ ID NO: 266598 - DNA, 21 bp, Homo sapiens
gtatgcagcatacaaaaatat

SEQ ID NO: 266599 - DNA, 14 bp, Homo sapiens
gtatgtaaacagga

SEQ ID NO: 266600 - DNA, 22 bp, Homo sapiens
gtatgtacagttcataaatttg

SEQ ID NO: 266601 - DNA, 18 bp, Homo sapiens
gtatgtcaactttatgca

SEQ ID NO: 266602 - DNA, 21 bp, Homo sapiens
gtatgtccagaacaaaagata

SEQ ID NO: 266603 - DNA, 23 bp, Homo sapiens
gtatgtgaattgaagtcatcata

SEQ ID NO: 266604 - DNA, 20 bp, Homo sapiens
gtatgtgatatctgaacaca

SEQ ID NO: 266605 - DNA, 16 bp, Homo sapiens
gtatgtgcactgtcac

SEQ ID NO: 266606 - DNA, 11 bp, Homo sapiens
gtatgtgccat

SEQ ID NO: 266607 - DNA, 14 bp, Homo sapiens
gtatgtggaagcag

SEQ ID NO: 266608 - DNA, 12 bp, Homo sapiens
gtatgtggaagg

SEQ ID NO: 266609 - DNA, 14 bp, Homo sapiens
gtatgtttgcacac

SEQ ID NO: 266610 - DNA, 21 bp, Homo sapiens
gtatgtttgcacacttgtgtg

SEQ ID NO: 266611 - DNA, 17 bp, Homo sapiens
ttctcatcccacgcact

SEQ ID NO: 266612 - DNA, 18 bp, Homo sapiens
ttctcatggtattatcta

SEQ ID NO: 266613 - DNA, 17 bp, Homo sapiens
ttctcatgtgctttgta

SEQ ID NO: 266614 - DNA, 17 bp, Homo sapiens
ttctcattatttcatca

SEQ ID NO: 266615 - DNA, 22 bp, Homo sapiens
ttctcattgatcacagatgtgc

SEQ ID NO: 266616 - DNA, 17 bp, Homo sapiens
ttctccaaaggcactga

SEQ ID NO: 266617 - DNA, 21 bp, Homo sapiens
ttctccaaaggcactgaccct

SEQ ID NO: 266618 - DNA, 14 bp, Homo sapiens
ttctccaaatgatt

SEQ ID NO: 266619 - DNA, 16 bp, Homo sapiens
ttctccaacccaaagt

SEQ ID NO: 266620 - DNA, 23 bp, Homo sapiens
ttctccacccaaaccccttccca

SEQ ID NO: 266621 - DNA, 14 bp, Homo sapiens
ttctccagaatgta

SEQ ID NO: 266622 - DNA, 14 bp, Homo sapiens
ttctccagccagca

SEQ ID NO: 266623 - DNA, 19 bp, Homo sapiens
ttctccatcccctccctgc

SEQ ID NO: 266624 - DNA, 20 bp, Homo sapiens
ttctccatcccctccctgcc

SEQ ID NO: 266625 - DNA, 23 bp, Homo sapiens
ttctccatgagacacatctcctc

SEQ ID NO: 266626 - DNA, 20 bp, Homo sapiens
ttctcccccgacactgctgc

SEQ ID NO: 266627 - DNA, 23 bp, Homo sapiens
ttctccccgcagcccgcctgccg

SEQ ID NO: 266628 - DNA, 16 bp, Homo sapiens
ttctcccctgcactgt

SEQ ID NO: 266629 - DNA, 18 bp, Homo sapiens
ttctcccctgcactgtaa

SEQ ID NO: 266630 - DNA, 20 bp, Homo sapiens
ttctcccctgcactgtaaaa

SEQ ID NO: 266631 - DNA, 21 bp, Homo sapiens
ttctcccctgcactgtaaaat

SEQ ID NO: 266632 - DNA, 12 bp, Homo sapiens
ttctccctgacc

SEQ ID NO: 266633 - DNA, 18 bp, Homo sapiens
ttctcccttaaggaattg

SEQ ID NO: 266634 - DNA, 22 bp, Homo sapiens
ttctcccttaggaatatacata

SEQ ID NO: 266635 - DNA, 21 bp, Homo sapiens
ttctccgaaaggcaaaaatgt

SEQ ID NO: 266636 - DNA, 18 bp, Homo sapiens
ttctccggggtctgtgct

SEQ ID NO: 266637 - DNA, 17 bp, Homo sapiens
ttctcctctctgggcct

SEQ ID NO: 266638 - DNA, 18 bp, Homo sapiens
ttctcctgatttgagttt

SEQ ID NO: 266639 - DNA, 14 bp, Homo sapiens
ttctcctgcctcag

SEQ ID NO: 266640 - DNA, 16 bp, Homo sapiens
ttctcctgcctcagcc

SEQ ID NO: 266641 - DNA, 18 bp, Homo sapiens
ttctcctgcctcagcctt

SEQ ID NO: 266642 - DNA, 21 bp, Homo sapiens
ttctcctgtggtttgctccag

SEQ ID NO: 266643 - DNA, 18 bp, Homo sapiens
ttctcctttcacaacctt

SEQ ID NO: 266644 - DNA, 19 bp, Homo sapiens
ttctcgagtccaaaatcat

SEQ ID NO: 266645 - DNA, 17 bp, Homo sapiens
ttctcggaggccaggcc

SEQ ID NO: 266646 - DNA, 19 bp, Homo sapiens
ttctcggaggccaggccct

SEQ ID NO: 266647 - DNA, 16 bp, Homo sapiens
ttctcgtcttcctctc

SEQ ID NO: 266648 - DNA, 21 bp, Homo sapiens
ttctcgtcttcctctctctca

SEQ ID NO: 266649 - DNA, 15 bp, Homo sapiens
ttctcgtgacccagt

SEQ ID NO: 266650 - DNA, 20 bp, Homo sapiens
ttctctagggaaggccacct

SEQ ID NO: 266651 - DNA, 22 bp, Homo sapiens
ttctctcccacacaagcagtct

SEQ ID NO: 266652 - DNA, 17 bp, Homo sapiens
ttctctccccttttcct

SEQ ID NO: 266653 - DNA, 20 bp, Homo sapiens
ttctctcggagtatctggga

SEQ ID NO: 266654 - DNA, 13 bp, Homo sapiens
ttctctctatgca

SEQ ID NO: 266655 - DNA, 15 bp, Homo sapiens
ttctctctatgcaaa

SEQ ID NO: 266656 - DNA, 12 bp, Homo sapiens
ttctctctgtgt

SEQ ID NO: 266657 - DNA, 15 bp, Homo sapiens
ttctctgagctttgt

SEQ ID NO: 266658 - DNA, 10 bp, Homo sapiens
ttctctgcca

SEQ ID NO: 266659 - DNA, 12 bp, Homo sapiens
ttctctgccagt

SEQ ID NO: 266660 - DNA, 17 bp, Homo sapiens
ttctctgcgagcaacag

SEQ ID NO: 266661 - DNA, 21 bp, Homo sapiens
ttctctgtccagggcttcaga

SEQ ID NO: 266662 - DNA, 12 bp, Homo sapiens
ttctctgtgaac

SEQ ID NO: 266663 - DNA, 17 bp, Homo sapiens
ttctctgtgctctgaat

SEQ ID NO: 266664 - DNA, 22 bp, Homo sapiens
ttctcttacgctctctgtctgg

SEQ ID NO: 266665 - DNA, 19 bp, Homo sapiens
ttctcttattctttacaaa

SEQ ID NO: 266666 - DNA, 13 bp, Homo sapiens
ttctcttcagtgt

SEQ ID NO: 266667 - DNA, 20 bp, Homo sapiens
ttctcttcagtgtgttgact

SEQ ID NO: 266668 - DNA, 13 bp, Homo sapiens
ttctcttctatcc

SEQ ID NO: 266669 - DNA, 15 bp, Homo sapiens
ttctcttctatcctg

SEQ ID NO: 266670 - DNA, 18 bp, Homo sapiens
acaggcaacattacaaac

SEQ ID NO: 266671 - DNA, 20 bp, Homo sapiens
acaggcaacattacaaacaa

SEQ ID NO: 266672 - DNA, 20 bp, Homo sapiens
acaggcaccgagaatgttgt

SEQ ID NO: 266673 - DNA, 18 bp, Homo sapiens
acaggcagacacatgctg

SEQ ID NO: 266674 - DNA, 21 bp, Homo sapiens
acaggcagtgcatgtgaagca

SEQ ID NO: 266675 - DNA, 19 bp, Homo sapiens
acaggcattgcactaaaag

SEQ ID NO: 266676 - DNA, 20 bp, Homo sapiens
acaggccacacgctgcccag

SEQ ID NO: 266677 - DNA, 16 bp, Homo sapiens
acaggccacttgctca

SEQ ID NO: 266678 - DNA, 17 bp, Homo sapiens
acaggccaggggatctg

SEQ ID NO: 266679 - DNA, 20 bp, Homo sapiens
acaggccaggggatctgggt

SEQ ID NO: 266680 - DNA, 17 bp, Homo sapiens
acaggccatgtgagcca

SEQ ID NO: 266681 - DNA, 18 bp, Homo sapiens
acaggccatgtgagccac

SEQ ID NO: 266682 - DNA, 15 bp, Homo sapiens
acaggccatttcatt

SEQ ID NO: 266683 - DNA, 23 bp, Homo sapiens
acaggcccggcccagcctaggcc

SEQ ID NO: 266684 - DNA, 13 bp, Homo sapiens
acaggcccttcct

SEQ ID NO: 266685 - DNA, 12 bp, Homo sapiens
acaggcctggcc

SEQ ID NO: 266686 - DNA, 13 bp, Homo sapiens
acaggcctggccc

SEQ ID NO: 266687 - DNA, 17 bp, Homo sapiens
acaggcctggcccagcc

SEQ ID NO: 266688 - DNA, 20 bp, Homo sapiens
acaggcctggcccagccagc

SEQ ID NO: 266689 - DNA, 15 bp, Homo sapiens
acaggctcttagcag

SEQ ID NO: 266690 - DNA, 21 bp, Homo sapiens
acaggctgcaagctgcaggga

SEQ ID NO: 266691 - DNA, 19 bp, Homo sapiens
acaggctgccccacccctc

SEQ ID NO: 266692 - DNA, 20 bp, Homo sapiens
acaggctgccccacccctcc

SEQ ID NO: 266693 - DNA, 22 bp, Homo sapiens
acaggctgccccacccctccat

SEQ ID NO: 266694 - DNA, 17 bp, Homo sapiens
acagggcatctccagga

SEQ ID NO: 266695 - DNA, 21 bp, Homo sapiens
acagggcatctccaggaaggc

SEQ ID NO: 266696 - DNA, 14 bp, Homo sapiens
acagggcctgactt

SEQ ID NO: 266697 - DNA, 22 bp, Homo sapiens
acagggctctttgatggaccca

SEQ ID NO: 266698 - DNA, 15 bp, Homo sapiens
acaggggacactgaa

SEQ ID NO: 266699 - DNA, 18 bp, Homo sapiens
acaggggacactgaacct

SEQ ID NO: 266700 - DNA, 16 bp, Homo sapiens
acaggggaggctgaga

SEQ ID NO: 266701 - DNA, 16 bp, Homo sapiens
acaggggaggtgatag

SEQ ID NO: 266702 - DNA, 23 bp, Homo sapiens
acaggggaggtgatagcattgct

SEQ ID NO: 266703 - DNA, 15 bp, Homo sapiens
acaggggcaggcctg

SEQ ID NO: 266704 - DNA, 17 bp, Homo sapiens
acaggggcatctctggg

SEQ ID NO: 266705 - DNA, 23 bp, Homo sapiens
acaggggccccagatctgcctgg

SEQ ID NO: 266706 - DNA, 12 bp, Homo sapiens
acaggggctggt

SEQ ID NO: 266707 - DNA, 19 bp, Homo sapiens
acaggggctggtgggcacc

SEQ ID NO: 266708 - DNA, 21 bp, Homo sapiens
acaggggggtcggaagcctgt

SEQ ID NO: 266709 - DNA, 23 bp, Homo sapiens
acagggggtggagagaccagcct

SEQ ID NO: 266710 - DNA, 14 bp, Homo sapiens
acagggtctgctct

SEQ ID NO: 266711 - DNA, 22 bp, Homo sapiens
acagggtctgctctttctctgc

SEQ ID NO: 266712 - DNA, 23 bp, Homo sapiens
acagggtctgctctttctctgcc

SEQ ID NO: 266713 - DNA, 17 bp, Homo sapiens
acagggtggggcttaga

SEQ ID NO: 266714 - DNA, 16 bp, Homo sapiens
acaggtctgggagagg

SEQ ID NO: 266715 - DNA, 23 bp, Homo sapiens
acaggtcttctttaaggaagaat

SEQ ID NO: 266716 - DNA, 17 bp, Homo sapiens
acaggtctttgaaatat

SEQ ID NO: 266717 - DNA, 14 bp, Homo sapiens
acaggtgcccacca

SEQ ID NO: 266718 - DNA, 22 bp, Homo sapiens
acaggtgtccccagcccactgg

SEQ ID NO: 266719 - DNA, 13 bp, Homo sapiens
acaggtgtgtgcc

SEQ ID NO: 266720 - DNA, 13 bp, Homo sapiens
acagtaaaaattt

SEQ ID NO: 266721 - DNA, 17 bp, Homo sapiens
acagtaaagaccattta

SEQ ID NO: 266722 - DNA, 14 bp, Homo sapiens
acagtaagctgctc

SEQ ID NO: 266723 - DNA, 13 bp, Homo sapiens
acagtacctgtgc

SEQ ID NO: 266724 - DNA, 21 bp, Homo sapiens
acagtatgagtcaatgtgcag

SEQ ID NO: 266725 - DNA, 21 bp, Homo sapiens
acagtattaacatcaaagact

SEQ ID NO: 266726 - DNA, 17 bp, Homo sapiens
acagtattttggttctt

SEQ ID NO: 266727 - DNA, 16 bp, Homo sapiens
acagtcacccttctgg

SEQ ID NO: 266728 - DNA, 15 bp, Homo sapiens
acagtcagcacagaa

SEQ ID NO: 266729 - DNA, 11 bp, Homo sapiens
acagtcagcca

SEQ ID NO: 266730 - DNA, 20 bp, Homo sapiens
acagtcagccagcttggtgg

SEQ ID NO: 266731 - DNA, 14 bp, Homo sapiens
acagtcattattta

SEQ ID NO: 266732 - DNA, 21 bp, Homo sapiens
acagtcattatttaaagcaca

SEQ ID NO: 266733 - DNA, 14 bp, Homo sapiens
acagtcatttaaaa

SEQ ID NO: 266734 - DNA, 21 bp, Homo sapiens
acagtcatttgcgcacaactt

SEQ ID NO: 266735 - DNA, 15 bp, Homo sapiens
acagtcccagcacat

SEQ ID NO: 266736 - DNA, 17 bp, Homo sapiens
acagtccctaaagaaaa

SEQ ID NO: 266737 - DNA, 13 bp, Homo sapiens
acagtccctcctg

SEQ ID NO: 266738 - DNA, 14 bp, Homo sapiens
acagtccctcctgt

SEQ ID NO: 266739 - DNA, 18 bp, Homo sapiens
acagtcctaactggtata

SEQ ID NO: 266740 - DNA, 16 bp, Homo sapiens
acagtcctcacagcct

SEQ ID NO: 266741 - DNA, 21 bp, Homo sapiens
acagtcctcacagcctctccc

SEQ ID NO: 266742 - DNA, 18 bp, Homo sapiens
acagtctcaagcactaaa

SEQ ID NO: 266743 - DNA, 13 bp, Homo sapiens
acagtctcaattt

SEQ ID NO: 266744 - DNA, 16 bp, Homo sapiens
acagtctcaattttgt

SEQ ID NO: 266745 - DNA, 20 bp, Homo sapiens
acagtctcaattttgtattt

SEQ ID NO: 266746 - DNA, 19 bp, Homo sapiens
acagtctcattacagattt

SEQ ID NO: 266747 - DNA, 16 bp, Homo sapiens
acagtctctccctggg

SEQ ID NO: 266748 - DNA, 13 bp, Homo sapiens
acagtctgtcatg

SEQ ID NO: 266749 - DNA, 17 bp, Homo sapiens
acagtgaatttaagcat

SEQ ID NO: 266750 - DNA, 14 bp, Homo sapiens
acagtgatctccat

SEQ ID NO: 266751 - DNA, 15 bp, Homo sapiens
acagtgatctccata

SEQ ID NO: 266752 - DNA, 13 bp, Homo sapiens
gtattaaagacag

SEQ ID NO: 266753 - DNA, 19 bp, Homo sapiens
gtattaaaggggggagggg

SEQ ID NO: 266754 - DNA, 16 bp, Homo sapiens
gtattaacctacctgt

SEQ ID NO: 266755 - DNA, 15 bp, Homo sapiens
gtattaccagccccc

SEQ ID NO: 266756 - DNA, 17 bp, Homo sapiens
gtattacttttctgcaa

SEQ ID NO: 266757 - DNA, 20 bp, Homo sapiens
gtattacttttctgcaatgt

SEQ ID NO: 266758 - DNA, 20 bp, Homo sapiens
gtattagccagtcattgtaa

SEQ ID NO: 266759 - DNA, 19 bp, Homo sapiens
gtattaggggtaatatatt

SEQ ID NO: 266760 - DNA, 15 bp, Homo sapiens
gtattagtggaaagt

SEQ ID NO: 266761 - DNA, 20 bp, Homo sapiens
gtattatcagtgaatataaa

SEQ ID NO: 266762 - DNA, 19 bp, Homo sapiens
gtattattaacactaataa

SEQ ID NO: 266763 - DNA, 16 bp, Homo sapiens
gtattattctgcagca

SEQ ID NO: 266764 - DNA, 18 bp, Homo sapiens
gtattcaggaccccatct

SEQ ID NO: 266765 - DNA, 21 bp, Homo sapiens
gtattcaggaccccatctgct

SEQ ID NO: 266766 - DNA, 22 bp, Homo sapiens
gtattcagtgagggtcttctta

SEQ ID NO: 266767 - DNA, 16 bp, Homo sapiens
gtattcatacagcact

SEQ ID NO: 266768 - DNA, 22 bp, Homo sapiens
gtattccaccttaaattaaaca

SEQ ID NO: 266769 - DNA, 16 bp, Homo sapiens
gtattccttggcccag

SEQ ID NO: 266770 - DNA, 20 bp, Homo sapiens
gtattccttggcccagcagc

SEQ ID NO: 266771 - DNA, 18 bp, Homo sapiens
gtattctagttttgtcaa

SEQ ID NO: 266772 - DNA, 18 bp, Homo sapiens
gtattctcagagcatgtg

SEQ ID NO: 266773 - DNA, 18 bp, Homo sapiens
gtattctgtggattctat

SEQ ID NO: 266774 - DNA, 18 bp, Homo sapiens
gtattgaaaacttcaaag

SEQ ID NO: 266775 - DNA, 16 bp, Homo sapiens
gtattgcagctaagct

SEQ ID NO: 266776 - DNA, 20 bp, Homo sapiens
gtattgccatcgggtgccaa

SEQ ID NO: 266777 - DNA, 21 bp, Homo sapiens
gtattgccatcgggtgccaaa

SEQ ID NO: 266778 - DNA, 15 bp, Homo sapiens
gtattgctccatttt

SEQ ID NO: 266779 - DNA, 12 bp, Homo sapiens
gtattggcctgg

SEQ ID NO: 266780 - DNA, 14 bp, Homo sapiens
gtattggcctggag

SEQ ID NO: 266781 - DNA, 20 bp, Homo sapiens
gtattggttgggggctcctg

SEQ ID NO: 266782 - DNA, 19 bp, Homo sapiens
gtattggtttctgtttgaa

SEQ ID NO: 266783 - DNA, 17 bp, Homo sapiens
gtattgtaaacatgtgt

SEQ ID NO: 266784 - DNA, 18 bp, Homo sapiens
gtattgtaagtggaaaat

SEQ ID NO: 266785 - DNA, 18 bp, Homo sapiens
gtattgttcccagtgaca

SEQ ID NO: 266786 - DNA, 20 bp, Homo sapiens
gtatttaatgatttttgtgt

SEQ ID NO: 266787 - DNA, 17 bp, Homo sapiens
gtatttaccttcctttg

SEQ ID NO: 266788 - DNA, 20 bp, Homo sapiens
gtatttactgtactaattag

SEQ ID NO: 266789 - DNA, 13 bp, Homo sapiens
gtatttataaata

SEQ ID NO: 266790 - DNA, 12 bp, Homo sapiens
gtatttatatat

SEQ ID NO: 266791 - DNA, 17 bp, Homo sapiens
gtatttatatatttata

SEQ ID NO: 266792 - DNA, 16 bp, Homo sapiens
gtatttatattagagt

SEQ ID NO: 266793 - DNA, 15 bp, Homo sapiens
gtatttccaacaaac

SEQ ID NO: 266794 - DNA, 17 bp, Homo sapiens
gtatttctatatttatt

SEQ ID NO: 266795 - DNA, 12 bp, Homo sapiens
gtatttctgtag

SEQ ID NO: 266796 - DNA, 14 bp, Homo sapiens
gtatttctgtagaa

SEQ ID NO: 266797 - DNA, 16 bp, Homo sapiens
gtatttcttttatata

SEQ ID NO: 266798 - DNA, 22 bp, Homo sapiens
gtatttgagagagagaaccttt

SEQ ID NO: 266799 - DNA, 12 bp, Homo sapiens
gtatttgctgtt

SEQ ID NO: 266800 - DNA, 14 bp, Homo sapiens
gtcccaaggagctg

SEQ ID NO: 266801 - DNA, 22 bp, Homo sapiens
gtcccaaggcaaggggtgcctg

SEQ ID NO: 266802 - DNA, 22 bp, Homo sapiens
gtcccaatcttaccagatgcta

SEQ ID NO: 266803 - DNA, 20 bp, Homo sapiens
gtcccaatttaagagtcctg

SEQ ID NO: 266804 - DNA, 19 bp, Homo sapiens
gtcccacaaaatatttcta

SEQ ID NO: 266805 - DNA, 22 bp, Homo sapiens
gtcccacaaaatatttctaagc

SEQ ID NO: 266806 - DNA, 19 bp, Homo sapiens
gtcccaccaactctgcact

SEQ ID NO: 266807 - DNA, 23 bp, Homo sapiens
gtcccaccggttgcttctgggaa

SEQ ID NO: 266808 - DNA, 17 bp, Homo sapiens
gtcccacgtctggccag

SEQ ID NO: 266809 - DNA, 18 bp, Homo sapiens
gtcccagacaaggagagc

SEQ ID NO: 266810 - DNA, 16 bp, Homo sapiens
gtcccagagcaggagg

SEQ ID NO: 266811 - DNA, 18 bp, Homo sapiens
gtcccagagcaggaggcc

SEQ ID NO: 266812 - DNA, 22 bp, Homo sapiens
gtcccagagcaggaggcccctg

SEQ ID NO: 266813 - DNA, 22 bp, Homo sapiens
gtcccagagcttattggccact

SEQ ID NO: 266814 - DNA, 20 bp, Homo sapiens
gtcccagaggttatctgcct

SEQ ID NO: 266815 - DNA, 24 bp, Homo sapiens
gtcccagaggttatctgcctggcc

SEQ ID NO: 266816 - DNA, 16 bp, Homo sapiens
gtcccagccaccccgg

SEQ ID NO: 266817 - DNA, 21 bp, Homo sapiens
gtcccagccaccccgggctct

SEQ ID NO: 266818 - DNA, 21 bp, Homo sapiens
gtcccagctaaagaggtgggg

SEQ ID NO: 266819 - DNA, 23 bp, Homo sapiens
gtcccagctacaggggaggctga

SEQ ID NO: 266820 - DNA, 12 bp, Homo sapiens
gtcccaggaagt

SEQ ID NO: 266821 - DNA, 19 bp, Homo sapiens
gtcccaggaagtccagctc

SEQ ID NO: 266822 - DNA, 13 bp, Homo sapiens
gtcccaggccgca

SEQ ID NO: 266823 - DNA, 17 bp, Homo sapiens
gtcccaggccgcatggc

SEQ ID NO: 266824 - DNA, 17 bp, Homo sapiens
gtcccaggggtctccct

SEQ ID NO: 266825 - DNA, 15 bp, Homo sapiens
gtcccagtgggaggc

SEQ ID NO: 266826 - DNA, 17 bp, Homo sapiens
gtcccataggagcagcc

SEQ ID NO: 266827 - DNA, 16 bp, Homo sapiens
gtcccatctcacctct

SEQ ID NO: 266828 - DNA, 15 bp, Homo sapiens
gtcccattctagatc

SEQ ID NO: 266829 - DNA, 20 bp, Homo sapiens
gtcccattctagatcctgca

SEQ ID NO: 266830 - DNA, 20 bp, Homo sapiens
gtcccattctccactcactg

SEQ ID NO: 266831 - DNA, 19 bp, Homo sapiens
gtcccatttattattttaa

SEQ ID NO: 266832 - DNA, 22 bp, Homo sapiens
gtcccatttattattttaatat

SEQ ID NO: 266833 - DNA, 13 bp, Homo sapiens
gtccccagcccac

SEQ ID NO: 266834 - DNA, 15 bp, Homo sapiens
gtccccagcccactg

SEQ ID NO: 266835 - DNA, 13 bp, Homo sapiens
gtccccagccctg

SEQ ID NO: 266836 - DNA, 16 bp, Homo sapiens
gtccccagggcccctc

SEQ ID NO: 266837 - DNA, 23 bp, Homo sapiens
gtccccaggggcacacttcccct

SEQ ID NO: 266838 - DNA, 16 bp, Homo sapiens
gtcccccaacttgaga

SEQ ID NO: 266839 - DNA, 23 bp, Homo sapiens
gtccccccaaatctactgagcca

SEQ ID NO: 266840 - DNA, 12 bp, Homo sapiens
gtcccccctgag

SEQ ID NO: 266841 - DNA, 13 bp, Homo sapiens
gtcccccctgagt

SEQ ID NO: 266842 - DNA, 13 bp, Homo sapiens
gtccccctaccca

SEQ ID NO: 266843 - DNA, 17 bp, Homo sapiens
gtccccctatccttggc

SEQ ID NO: 266844 - DNA, 14 bp, Homo sapiens
gtccccgccttccc

SEQ ID NO: 266845 - DNA, 17 bp, Homo sapiens
gtccccgccttccctca

SEQ ID NO: 266846 - DNA, 10 bp, Homo sapiens
gtccccggac

SEQ ID NO: 266847 - DNA, 18 bp, Homo sapiens
gtccccggacgctggctc

SEQ ID NO: 266848 - DNA, 17 bp, Homo sapiens
gtcccctccatctgggg

SEQ ID NO: 266849 - DNA, 19 bp, Homo sapiens
gtcccctgggccacccttc

SEQ ID NO: 266850 - DNA, 12 bp, Homo sapiens
gtcccctgtccc

SEQ ID NO: 266851 - DNA, 13 bp, Homo sapiens
gtcccctgtccca

SEQ ID NO: 266852 - DNA, 15 bp, Homo sapiens
gtcccctgtcccacc

SEQ ID NO: 266853 - DNA, 20 bp, Homo sapiens
gtcccctgtcccaccaactc

SEQ ID NO: 266854 - DNA, 23 bp, Homo sapiens
gtcccctgtggtgatgtgcctgt

SEQ ID NO: 266855 - DNA, 13 bp, Homo sapiens
gtccccttccagg

SEQ ID NO: 266856 - DNA, 17 bp, Homo sapiens
gtcccgaggaagggcca

SEQ ID NO: 266857 - DNA, 22 bp, Homo sapiens
gtcccgccttcctcctccacag

SEQ ID NO: 266858 - DNA, 20 bp, Homo sapiens
gtcccgctgctgtgctctgg

SEQ ID NO: 266859 - DNA, 17 bp, Homo sapiens
gtcccggctgacacctc

SEQ ID NO: 266860 - DNA, 14 bp, Homo sapiens
gtccctaccactga

SEQ ID NO: 266861 - DNA, 22 bp, Homo sapiens
gtccctaccgagtctcttctcc

SEQ ID NO: 266862 - DNA, 14 bp, Homo sapiens
gtccctccctcctg

SEQ ID NO: 266863 - DNA, 15 bp, Homo sapiens
gtccctccctcctgg

SEQ ID NO: 266864 - DNA, 21 bp, Homo sapiens
gtccctccctcctggctcaca

SEQ ID NO: 266865 - DNA, 24 bp, Homo sapiens
gtccctccctcctggctcacagcc

SEQ ID NO: 266866 - DNA, 13 bp, Homo sapiens
gtccctcctgagg

SEQ ID NO: 266867 - DNA, 15 bp, Homo sapiens
gtccctcctgttgcc

SEQ ID NO: 266868 - DNA, 16 bp, Homo sapiens
gtccctcgtccacagg

SEQ ID NO: 266869 - DNA, 17 bp, Homo sapiens
gtccctctcactcccca

SEQ ID NO: 266870 - DNA, 13 bp, Homo sapiens
gtccctctctctg

SEQ ID NO: 266871 - DNA, 15 bp, Homo sapiens
gtccctgacttccca

SEQ ID NO: 266872 - DNA, 19 bp, Homo sapiens
gtccctgacttcccagctg

SEQ ID NO: 266873 - DNA, 23 bp, Homo sapiens
gtccctgacttcccagctggcag

SEQ ID NO: 266874 - DNA, 18 bp, Homo sapiens
gtccctgagaagcctcat

SEQ ID NO: 266875 - DNA, 17 bp, Homo sapiens
gtccctgccacactcag

SEQ ID NO: 266876 - DNA, 14 bp, Homo sapiens
gtccctgccccctc

SEQ ID NO: 266877 - DNA, 16 bp, Homo sapiens
gtccctgccccgcccc

SEQ ID NO: 266878 - DNA, 23 bp, Homo sapiens
gtccctgccccgccccccagagc

SEQ ID NO: 266879 - DNA, 18 bp, Homo sapiens
gtccctggaccagcctcc

SEQ ID NO: 266880 - DNA, 15 bp, Homo sapiens
gtccctggccatctc

SEQ ID NO: 266881 - DNA, 13 bp, Homo sapiens
gtccctggtccct

SEQ ID NO: 266882 - DNA, 24 bp, Homo sapiens
gtccctggtccctcgtccacaggg

SEQ ID NO: 266883 - DNA, 19 bp, Homo sapiens
gtccctgtccctgccccgc

SEQ ID NO: 266884 - DNA, 21 bp, Homo sapiens
gtccctgtggtaccctggcag

SEQ ID NO: 266885 - DNA, 14 bp, Homo sapiens
gtccctgtgttctg

SEQ ID NO: 266886 - DNA, 16 bp, Homo sapiens
gtcccttccccctgct

SEQ ID NO: 266887 - DNA, 20 bp, Homo sapiens
gtcccttcccctccctggct

SEQ ID NO: 266888 - DNA, 22 bp, Homo sapiens
gtcccttcccctccctggctcc

SEQ ID NO: 266889 - DNA, 21 bp, Homo sapiens
gtcccttcctgtcctgctcac

SEQ ID NO: 266890 - DNA, 13 bp, Homo sapiens
gtcccttgcagct

SEQ ID NO: 266891 - DNA, 19 bp, Homo sapiens
gtcccttgcctcaatgcca

SEQ ID NO: 266892 - DNA, 13 bp, Homo sapiens
gtccctttcccta

SEQ ID NO: 266893 - DNA, 22 bp, Homo sapiens
gtccctttcttggccagttatc

SEQ ID NO: 266894 - DNA, 15 bp, Homo sapiens
gtccgcaccagctgc

SEQ ID NO: 266895 - DNA, 23 bp, Homo sapiens
gtccgcaccagctgctctgcccc

SEQ ID NO: 266896 - DNA, 13 bp, Homo sapiens
gtccgcccgccca

SEQ ID NO: 266897 - DNA, 17 bp, Homo sapiens
gtccgcccgcccacccc

SEQ ID NO: 266898 - DNA, 12 bp, Homo sapiens
gtccgccctctt

SEQ ID NO: 266899 - DNA, 12 bp, Homo sapiens
gtccgcctctgc

SEQ ID NO: 266900 - DNA, 16 bp, Homo sapiens
gtccgctgctgctttc

SEQ ID NO: 266901 - DNA, 19 bp, Homo sapiens
acatttgtacattcctgat

SEQ ID NO: 266902 - DNA, 20 bp, Homo sapiens
acatttgtatgttgtgaaga

SEQ ID NO: 266903 - DNA, 15 bp, Homo sapiens
acatttgtcacagaa

SEQ ID NO: 266904 - DNA, 14 bp, Homo sapiens
acatttgtcactga

SEQ ID NO: 266905 - DNA, 18 bp, Homo sapiens
acatttgtcactgaataa

SEQ ID NO: 266906 - DNA, 19 bp, Homo sapiens
acatttgtcctgcagagct

SEQ ID NO: 266907 - DNA, 17 bp, Homo sapiens
acattttaaaatcaact

SEQ ID NO: 266908 - DNA, 14 bp, Homo sapiens
acattttaaataaa

SEQ ID NO: 266909 - DNA, 18 bp, Homo sapiens
acattttactttttcctg

SEQ ID NO: 266910 - DNA, 20 bp, Homo sapiens
acattttccacggaaacaga

SEQ ID NO: 266911 - DNA, 21 bp, Homo sapiens
acattttccacggaaacagaa

SEQ ID NO: 266912 - DNA, 13 bp, Homo sapiens
acattttgccttt

SEQ ID NO: 266913 - DNA, 14 bp, Homo sapiens
acatttttacaata

SEQ ID NO: 266914 - DNA, 15 bp, Homo sapiens
acatttttacaataa

SEQ ID NO: 266915 - DNA, 20 bp, Homo sapiens
acatttttgtctttatctca

SEQ ID NO: 266916 - DNA, 20 bp, Homo sapiens
accaaaaattgcgagccttt

SEQ ID NO: 266917 - DNA, 15 bp, Homo sapiens
accaaaacccatcgt

SEQ ID NO: 266918 - DNA, 16 bp, Homo sapiens
accaaaatgacaatga

SEQ ID NO: 266919 - DNA, 15 bp, Homo sapiens
accaaagaaacacca

SEQ ID NO: 266920 - DNA, 23 bp, Homo sapiens
accaaagaaacaccacttaatct

SEQ ID NO: 266921 - DNA, 13 bp, Homo sapiens
accaaagaagagt

SEQ ID NO: 266922 - DNA, 16 bp, Homo sapiens
accaaagaagagttta

SEQ ID NO: 266923 - DNA, 18 bp, Homo sapiens
accaaatgcctctgcctt

SEQ ID NO: 266924 - DNA, 15 bp, Homo sapiens
accaaattgctgaga

SEQ ID NO: 266925 - DNA, 11 bp, Homo sapiens
accaacaccat

SEQ ID NO: 266926 - DNA, 21 bp, Homo sapiens
accaacataaaacaaaaccaa

SEQ ID NO: 266927 - DNA, 18 bp, Homo sapiens
accaacccatgccctgcc

SEQ ID NO: 266928 - DNA, 15 bp, Homo sapiens
accaacctcactgcc

SEQ ID NO: 266929 - DNA, 23 bp, Homo sapiens
accaacgggtctgtgggactggc

SEQ ID NO: 266930 - DNA, 17 bp, Homo sapiens
accagccgccccagccc

SEQ ID NO: 266931 - DNA, 21 bp, Homo sapiens
accagcctcctgtttgcaggc

SEQ ID NO: 266932 - DNA, 12 bp, Homo sapiens
accagcctgagc

SEQ ID NO: 266933 - DNA, 19 bp, Homo sapiens
accagcgcccgctgggctg

SEQ ID NO: 266934 - DNA, 19 bp, Homo sapiens
accagcgctctaaaagcac

SEQ ID NO: 266935 - DNA, 12 bp, Homo sapiens
accagctcagcc

SEQ ID NO: 266936 - DNA, 13 bp, Homo sapiens
accagctcagccc

SEQ ID NO: 266937 - DNA, 19 bp, Homo sapiens
accagctccactggcctgc

SEQ ID NO: 266938 - DNA, 21 bp, Homo sapiens
accagctcgtttttcagcacc

SEQ ID NO: 266939 - DNA, 23 bp, Homo sapiens
accagctcgtttttcagcacccc

SEQ ID NO: 266940 - DNA, 15 bp, Homo sapiens
accagctctgtggcc

SEQ ID NO: 266941 - DNA, 16 bp, Homo sapiens
accagctctgtggcct

SEQ ID NO: 266942 - DNA, 19 bp, Homo sapiens
accagctctgtggcctgtg

SEQ ID NO: 266943 - DNA, 20 bp, Homo sapiens
accagctctgtggcctgtgt

SEQ ID NO: 266944 - DNA, 19 bp, Homo sapiens
accagctctttggtgccag

SEQ ID NO: 266945 - DNA, 15 bp, Homo sapiens
accaggactccctcc

SEQ ID NO: 266946 - DNA, 18 bp, Homo sapiens
accaggactccctcctca

SEQ ID NO: 266947 - DNA, 21 bp, Homo sapiens
accaggactctgccttccagg

SEQ ID NO: 266948 - DNA, 11 bp, Homo sapiens
accaggactta

SEQ ID NO: 266949 - DNA, 19 bp, Homo sapiens
accaggagaaccactacat

SEQ ID NO: 266950 - DNA, 11 bp, Homo sapiens
accaggagaca

SEQ ID NO: 266951 - DNA, 21 bp, Homo sapiens
accaggagcattttgtgtctt

SEQ ID NO: 266952 - DNA, 11 bp, Homo sapiens
accaggagcca

SEQ ID NO: 266953 - DNA, 20 bp, Homo sapiens
accaggagccaggtgtcctg

SEQ ID NO: 266954 - DNA, 18 bp, Homo sapiens
accaggaggggtctgcct

SEQ ID NO: 266955 - DNA, 20 bp, Homo sapiens
accaggccacccactgtggg

SEQ ID NO: 266956 - DNA, 16 bp, Homo sapiens
accaggccccagcctc

SEQ ID NO: 266957 - DNA, 19 bp, Homo sapiens
accaggctcacaactgttt

SEQ ID NO: 266958 - DNA, 17 bp, Homo sapiens
accagggactgcagctg

SEQ ID NO: 266959 - DNA, 20 bp, Homo sapiens
accagggagcccctttgatg

SEQ ID NO: 266960 - DNA, 22 bp, Homo sapiens
accagggcgaacgacaatagct

SEQ ID NO: 266961 - DNA, 23 bp, Homo sapiens
accagggcgaacgacaatagctt

SEQ ID NO: 266962 - DNA, 17 bp, Homo sapiens
accagggctcagctcct

SEQ ID NO: 266963 - DNA, 13 bp, Homo sapiens
accagggctctgt

SEQ ID NO: 266964 - DNA, 22 bp, Homo sapiens
accagggtccgcaccagctgct

SEQ ID NO: 266965 - DNA, 15 bp, Homo sapiens
accagggtttatctt

SEQ ID NO: 266966 - DNA, 21 bp, Homo sapiens
accaggtgttaaaaaccatta

SEQ ID NO: 266967 - DNA, 20 bp, Homo sapiens
accagtagtcacctctgggc

SEQ ID NO: 266968 - DNA, 17 bp, Homo sapiens
accagtcacacattata

SEQ ID NO: 266969 - DNA, 21 bp, Homo sapiens
accagtcacacattatagaaa

SEQ ID NO: 266970 - DNA, 13 bp, Homo sapiens
accagtcacagcc

SEQ ID NO: 266971 - DNA, 17 bp, Homo sapiens
accagtcacagccattt

SEQ ID NO: 266972 - DNA, 20 bp, Homo sapiens
accagtcacagccatttcaa

SEQ ID NO: 266973 - DNA, 15 bp, Homo sapiens
accagtcagggacag

SEQ ID NO: 266974 - DNA, 16 bp, Homo sapiens
accagtcagggacagc

SEQ ID NO: 266975 - DNA, 15 bp, Homo sapiens
accagtcgccctctg

SEQ ID NO: 266976 - DNA, 17 bp, Homo sapiens
accagtcgccctctgtg

SEQ ID NO: 266977 - DNA, 13 bp, Homo sapiens
accagtctgaagt

SEQ ID NO: 266978 - DNA, 19 bp, Homo sapiens
accagtctgaagtttcatt

SEQ ID NO: 266979 - DNA, 23 bp, Homo sapiens
accagtctgaagtttcatttatg

SEQ ID NO: 266980 - DNA, 13 bp, Homo sapiens
accagtcttctcc

SEQ ID NO: 266981 - DNA, 22 bp, Homo sapiens
accagtgcccaaagtctgtgtg

SEQ ID NO: 266982 - DNA, 16 bp, Homo sapiens
accagtgggcatgtat

SEQ ID NO: 266983 - DNA, 23 bp, Homo sapiens
accagtgttagtgggaagagctg

SEQ ID NO: 266984 - DNA, 16 bp, Homo sapiens
accagttactgttcat

SEQ ID NO: 266985 - DNA, 19 bp, Homo sapiens
accagttctctttgtaagg

SEQ ID NO: 266986 - DNA, 13 bp, Homo sapiens
accagttttgtat

SEQ ID NO: 266987 - DNA, 16 bp, Homo sapiens
accataaaataaataa

SEQ ID NO: 266988 - DNA, 13 bp, Homo sapiens
accataacccagg

SEQ ID NO: 266989 - DNA, 13 bp, Homo sapiens
accataatgttac

SEQ ID NO: 266990 - DNA, 23 bp, Homo sapiens
accatatgattgaaaagaagaaa

SEQ ID NO: 266991 - DNA, 13 bp, Homo sapiens
accatcaataaag

SEQ ID NO: 266992 - DNA, 15 bp, Homo sapiens
accatcatgtaccaa

SEQ ID NO: 266993 - DNA, 13 bp, Homo sapiens
accatcccactga

SEQ ID NO: 266994 - DNA, 14 bp, Homo sapiens
accatccccaactc

SEQ ID NO: 266995 - DNA, 17 bp, Homo sapiens
accatccccaactccat

SEQ ID NO: 266996 - DNA, 13 bp, Homo sapiens
accatcctggccc

SEQ ID NO: 266997 - DNA, 13 bp, Homo sapiens
accatctaatagc

SEQ ID NO: 266998 - DNA, 14 bp, Homo sapiens
accatctcaggcca

SEQ ID NO: 266999 - DNA, 23 bp, Homo sapiens
accatctcctatcttttatttca

SEQ ID NO: 267000 - DNA, 17 bp, Homo sapiens
accatctggcctggcct

SEQ ID NO: 267001 - DNA, 22 bp, Homo sapiens
accatctggcctggcctggccc

SEQ ID NO: 267002 - DNA, 23 bp, Homo sapiens
accatctggcctggcctggccct

SEQ ID NO: 267003 - DNA, 17 bp, Homo sapiens
accatctgtaccctgct

SEQ ID NO: 267004 - DNA, 18 bp, Homo sapiens
accatcttaatctttatt

SEQ ID NO: 267005 - DNA, 21 bp, Homo sapiens
accatcttaatctttatttta

SEQ ID NO: 267006 - DNA, 14 bp, Homo sapiens
accatgaaacaaag

SEQ ID NO: 267007 - DNA, 19 bp, Homo sapiens
accatgaagtgaaaatgcc

SEQ ID NO: 267008 - DNA, 17 bp, Homo sapiens
accatgaggtaaaagag

SEQ ID NO: 267009 - DNA, 20 bp, Homo sapiens
accatgaggtaaaagagcca

SEQ ID NO: 267010 - DNA, 14 bp, Homo sapiens
accatgctggcggc

SEQ ID NO: 267011 - DNA, 20 bp, Homo sapiens
accatgctggcggcgcagag

SEQ ID NO: 267012 - DNA, 20 bp, Homo sapiens
accatgtaaaacaaaaaaca

SEQ ID NO: 267013 - DNA, 22 bp, Homo sapiens
accatgtaaaacaaaaaacaat

SEQ ID NO: 267014 - DNA, 17 bp, Homo sapiens
accatgtacatgaagaa

SEQ ID NO: 267015 - DNA, 21 bp, Homo sapiens
accattaacaggtctttgaaa

SEQ ID NO: 267016 - DNA, 13 bp, Homo sapiens
accattccacatc

SEQ ID NO: 267017 - DNA, 19 bp, Homo sapiens
accattctttcttggtgca

SEQ ID NO: 267018 - DNA, 17 bp, Homo sapiens
accattgacctcagctg

SEQ ID NO: 267019 - DNA, 16 bp, Homo sapiens
accattgcttcactac

SEQ ID NO: 267020 - DNA, 20 bp, Homo sapiens
accattgcttcactacccat

SEQ ID NO: 267021 - DNA, 21 bp, Homo sapiens
accattggttaatctggactt

SEQ ID NO: 267022 - DNA, 18 bp, Homo sapiens
accattgtgaagcaccta

SEQ ID NO: 267023 - DNA, 15 bp, Homo sapiens
accatttaatcattt

SEQ ID NO: 267024 - DNA, 12 bp, Homo sapiens
accatttataat

SEQ ID NO: 267025 - DNA, 23 bp, Homo sapiens
accatttggatcctgtgtggaga

SEQ ID NO: 267026 - DNA, 13 bp, Homo sapiens
accatttgtaata

SEQ ID NO: 267027 - DNA, 15 bp, Homo sapiens
accattttgaaatat

SEQ ID NO: 267028 - DNA, 23 bp, Homo sapiens
accattttgctgtcccttttcct

SEQ ID NO: 267029 - DNA, 17 bp, Homo sapiens
acccaactgacttctgc

SEQ ID NO: 267030 - DNA, 18 bp, Homo sapiens
acccaactgacttctgct

SEQ ID NO: 267031 - DNA, 22 bp, Homo sapiens
acccaagcttggcagccgagct

SEQ ID NO: 267032 - DNA, 19 bp, Homo sapiens
acccaaggtggtcttggag

SEQ ID NO: 267033 - DNA, 12 bp, Homo sapiens
acccaagtccac

SEQ ID NO: 267034 - DNA, 18 bp, Homo sapiens
acccaattttaaaaaata

SEQ ID NO: 267035 - DNA, 17 bp, Homo sapiens
acccacaaactgcctgt

SEQ ID NO: 267036 - DNA, 23 bp, Homo sapiens
acccacaccccgtctgccccttg

SEQ ID NO: 267037 - DNA, 12 bp, Homo sapiens
acccacagggcc

SEQ ID NO: 267038 - DNA, 14 bp, Homo sapiens
acccacagggcctg

SEQ ID NO: 267039 - DNA, 19 bp, Homo sapiens
acccacaggttctatgatt

SEQ ID NO: 267040 - DNA, 18 bp, Homo sapiens
acccaccagggctcagct

SEQ ID NO: 267041 - DNA, 20 bp, Homo sapiens
acccacccatcttcctgctg

SEQ ID NO: 267042 - DNA, 13 bp, Homo sapiens
acccaccccaact

SEQ ID NO: 267043 - DNA, 19 bp, Homo sapiens
acccaccccaactctcccc

SEQ ID NO: 267044 - DNA, 21 bp, Homo sapiens
acccaccccaactctccccag

SEQ ID NO: 267045 - DNA, 21 bp, Homo sapiens
acccaccccctctttgtgtac

SEQ ID NO: 267046 - DNA, 12 bp, Homo sapiens
acccacccctgc

SEQ ID NO: 267047 - DNA, 16 bp, Homo sapiens
gtctgggagaggcaga

SEQ ID NO: 267048 - DNA, 14 bp, Homo sapiens
gtctgggcctctga

SEQ ID NO: 267049 - DNA, 14 bp, Homo sapiens
gtctggtccacaca

SEQ ID NO: 267050 - DNA, 23 bp, Homo sapiens
gtctggtgccaatcctgtaggca

SEQ ID NO: 267051 - DNA, 13 bp, Homo sapiens
gtctggtttctag

SEQ ID NO: 267052 - DNA, 14 bp, Homo sapiens
gtctggtttctaga

SEQ ID NO: 267053 - DNA, 14 bp, Homo sapiens
gtctgtaagagaat

SEQ ID NO: 267054 - DNA, 15 bp, Homo sapiens
gtctgtatatacatt

SEQ ID NO: 267055 - DNA, 17 bp, Homo sapiens
gtctgtatatacatttc

SEQ ID NO: 267056 - DNA, 16 bp, Homo sapiens
gtctgtcaccacatct

SEQ ID NO: 267057 - DNA, 16 bp, Homo sapiens
gtctgtcctacccgcc

SEQ ID NO: 267058 - DNA, 17 bp, Homo sapiens
gtctgtctactgtggtg

SEQ ID NO: 267059 - DNA, 22 bp, Homo sapiens
gtctgtctctccatctgtttgg

SEQ ID NO: 267060 - DNA, 22 bp, Homo sapiens
gtgattatggacatcgatatga

SEQ ID NO: 267061 - DNA, 18 bp, Homo sapiens
gtgattcaaatgcaaaat

SEQ ID NO: 267062 - DNA, 18 bp, Homo sapiens
gtgattccccggagctgg

SEQ ID NO: 267063 - DNA, 16 bp, Homo sapiens
gtgattctaatgtctt

SEQ ID NO: 267064 - DNA, 13 bp, Homo sapiens
gtgattctcctgc

SEQ ID NO: 267065 - DNA, 18 bp, Homo sapiens
gtgattgccatttcttcc

SEQ ID NO: 267066 - DNA, 13 bp, Homo sapiens
gtgattgctgcca

SEQ ID NO: 267067 - DNA, 13 bp, Homo sapiens
gtgattgtgtctg

SEQ ID NO: 267068 - DNA, 12 bp, Homo sapiens
gtgatttacatg

SEQ ID NO: 267069 - DNA, 21 bp, Homo sapiens
gtgatttagaactgtatgtca

SEQ ID NO: 267070 - DNA, 23 bp, Homo sapiens
gtgatttagaactgtatgtcaga

SEQ ID NO: 267071 - DNA, 16 bp, Homo sapiens
gtgatttatttggagt

SEQ ID NO: 267072 - DNA, 13 bp, Homo sapiens
gtgatttcttgct

SEQ ID NO: 267073 - DNA, 17 bp, Homo sapiens
gtgatttgtctctgagc

SEQ ID NO: 267074 - DNA, 17 bp, Homo sapiens
gtgatttttttatataa

SEQ ID NO: 267075 - DNA, 13 bp, Homo sapiens
gtgcaaacagtgt

SEQ ID NO: 267076 - DNA, 20 bp, Homo sapiens
gtgcaaacagtgtaagctta

SEQ ID NO: 267077 - DNA, 15 bp, Homo sapiens
gtgcaaagaaaagaa

SEQ ID NO: 267078 - DNA, 14 bp, Homo sapiens
gtgcaacccttacc

SEQ ID NO: 267079 - DNA, 16 bp, Homo sapiens
gtgcaagacacccagt

SEQ ID NO: 267080 - DNA, 20 bp, Homo sapiens
gtgcaagtatgtgagtgtgt

SEQ ID NO: 267081 - DNA, 17 bp, Homo sapiens
gtgcaagtgtctgtgtg

SEQ ID NO: 267082 - DNA, 22 bp, Homo sapiens
gtgcaagtgtgtgcacatgtgt

SEQ ID NO: 267083 - DNA, 15 bp, Homo sapiens
gtgcaatgagccaga

SEQ ID NO: 267084 - DNA, 22 bp, Homo sapiens
gtgcaattgtaggggtgtgtgt

SEQ ID NO: 267085 - DNA, 16 bp, Homo sapiens
gtgcaatttcttctgt

SEQ ID NO: 267086 - DNA, 22 bp, Homo sapiens
gtgcacagacgtccctccacgt

SEQ ID NO: 267087 - DNA, 14 bp, Homo sapiens
gtgcacattctccc

SEQ ID NO: 267088 - DNA, 15 bp, Homo sapiens
gtgcacattctccct

SEQ ID NO: 267089 - DNA, 13 bp, Homo sapiens
gtgcacccactca

SEQ ID NO: 267090 - DNA, 20 bp, Homo sapiens
gtgcacctctcatcagccca

SEQ ID NO: 267091 - DNA, 21 bp, Homo sapiens
gtgcacctgtggcctctcagt

SEQ ID NO: 267092 - DNA, 20 bp, Homo sapiens
gtgcaccttaccaactttct

SEQ ID NO: 267093 - DNA, 19 bp, Homo sapiens
gtgcacggggccagcatcc

SEQ ID NO: 267094 - DNA, 21 bp, Homo sapiens
gtgcacgtggagagctggtgc

SEQ ID NO: 267095 - DNA, 14 bp, Homo sapiens
gtgcactgaatcgt

SEQ ID NO: 267096 - DNA, 15 bp, Homo sapiens
gtgcactgtcacttt

SEQ ID NO: 267097 - DNA, 23 bp, Homo sapiens
gtgcacttggtgctgcgcccagg

SEQ ID NO: 267098 - DNA, 17 bp, Homo sapiens
gtgcagaaactaccaga

SEQ ID NO: 267099 - DNA, 23 bp, Homo sapiens
gtgcagacaggccatgtgagcca

SEQ ID NO: 267100 - DNA, 20 bp, Homo sapiens
gtgcagaccccttggccagc

SEQ ID NO: 267101 - DNA, 16 bp, Homo sapiens
gtgcagaggctgagca

SEQ ID NO: 267102 - DNA, 15 bp, Homo sapiens
gtgcagatgggctgt

SEQ ID NO: 267103 - DNA, 14 bp, Homo sapiens
gtgcagcagcccag

SEQ ID NO: 267104 - DNA, 15 bp, Homo sapiens
gtgcagcagcccagc

SEQ ID NO: 267105 - DNA, 14 bp, Homo sapiens
gtgcagccccagga

SEQ ID NO: 267106 - DNA, 19 bp, Homo sapiens
gtgcagcccgtgtggcccc

SEQ ID NO: 267107 - DNA, 20 bp, Homo sapiens
gtgcagccttcccctccctg

SEQ ID NO: 267108 - DNA, 23 bp, Homo sapiens
gtgcagcggtggaaggagcctgc

SEQ ID NO: 267109 - DNA, 12 bp, Homo sapiens
gtgcagctgatt

SEQ ID NO: 267110 - DNA, 23 bp, Homo sapiens
gtgcagctgattttaacaataac

SEQ ID NO: 267111 - DNA, 18 bp, Homo sapiens
gtgcaggcgcgcaccgcc

SEQ ID NO: 267112 - DNA, 23 bp, Homo sapiens
gtgcaggctcctcctctctggac

SEQ ID NO: 267113 - DNA, 18 bp, Homo sapiens
gtgcaggctgtctcattt

SEQ ID NO: 267114 - DNA, 18 bp, Homo sapiens
gtgcagtaaccatttaat

SEQ ID NO: 267115 - DNA, 15 bp, Homo sapiens
gtgcagtacaggcaa

SEQ ID NO: 267116 - DNA, 17 bp, Homo sapiens
gtgcagtgtcttgtaac

SEQ ID NO: 267117 - DNA, 23 bp, Homo sapiens
gtgcagtgtcttgtaacaactaa

SEQ ID NO: 267118 - DNA, 15 bp, Homo sapiens
gtgcagtgtgcctgt

SEQ ID NO: 267119 - DNA, 22 bp, Homo sapiens
gtgcagttacgttgcatccaca

SEQ ID NO: 267120 - DNA, 17 bp, Homo sapiens
gtgcataaaagttaaca

SEQ ID NO: 267121 - DNA, 21 bp, Homo sapiens
gtgcatgagaatgtcatttgc

SEQ ID NO: 267122 - DNA, 23 bp, Homo sapiens
gtgcatgagaatgtcatttgcta

SEQ ID NO: 267123 - DNA, 15 bp, Homo sapiens
gtgcatgcaggtctc

SEQ ID NO: 267124 - DNA, 19 bp, Homo sapiens
gtgcatggccacagccacc

SEQ ID NO: 267125 - DNA, 18 bp, Homo sapiens
gtgcatgtgaagcatgct

SEQ ID NO: 267126 - DNA, 19 bp, Homo sapiens
gtgcatgtgtgttcatgca

SEQ ID NO: 267127 - DNA, 23 bp, Homo sapiens
gtgcattacagagaggagaaaca

SEQ ID NO: 267128 - DNA, 20 bp, Homo sapiens
gtgcattggaagaccccacc

SEQ ID NO: 267129 - DNA, 20 bp, Homo sapiens
gtgcatttttggatcatttt

SEQ ID NO: 267130 - DNA, 16 bp, Homo sapiens
gtgcatttttgtgaaa

SEQ ID NO: 267131 - DNA, 17 bp, Homo sapiens
gtgccaaatcctgggca

SEQ ID NO: 267132 - DNA, 17 bp, Homo sapiens
gtgccaaccacctctgg

SEQ ID NO: 267133 - DNA, 15 bp, Homo sapiens
gtgccaatatgtatt

SEQ ID NO: 267134 - DNA, 18 bp, Homo sapiens
gtgccaatcctgtaggca

SEQ ID NO: 267135 - DNA, 12 bp, Homo sapiens
gtgccaattttg

SEQ ID NO: 267136 - DNA, 19 bp, Homo sapiens
gtgccacaggctgcaagct

SEQ ID NO: 267137 - DNA, 20 bp, Homo sapiens
gtgccacccgtaggcagcct

SEQ ID NO: 267138 - DNA, 14 bp, Homo sapiens
gtgccaccctctgc

SEQ ID NO: 267139 - DNA, 16 bp, Homo sapiens
gtgccaccctctgcag

SEQ ID NO: 267140 - DNA, 18 bp, Homo sapiens
gtgccacctatgcctgtg

SEQ ID NO: 267141 - DNA, 20 bp, Homo sapiens
gtgccacctatgcctgtggt

SEQ ID NO: 267142 - DNA, 18 bp, Homo sapiens
gtgccactccctgagctt

SEQ ID NO: 267143 - DNA, 20 bp, Homo sapiens
gtgccactgcccgagctggt

SEQ ID NO: 267144 - DNA, 21 bp, Homo sapiens
gtgccactgcccgagctggtg

SEQ ID NO: 267145 - DNA, 23 bp, Homo sapiens
gtgccactgcccgagctggtgca

SEQ ID NO: 267146 - DNA, 19 bp, Homo sapiens
gtgccagccttcctctgca

SEQ ID NO: 267147 - DNA, 11 bp, Homo sapiens
gtgccaggagc

SEQ ID NO: 267148 - DNA, 16 bp, Homo sapiens
gtgccaggagcaatgg

SEQ ID NO: 267149 - DNA, 17 bp, Homo sapiens
gtgccaggaggcggcag

SEQ ID NO: 267150 - DNA, 14 bp, Homo sapiens
gtgccaggagtggg

SEQ ID NO: 267151 - DNA, 19 bp, Homo sapiens
gtgccaggagtgggtggga

SEQ ID NO: 267152 - DNA, 23 bp, Homo sapiens
gtgccattgtctttcctcccttc

SEQ ID NO: 267153 - DNA, 21 bp, Homo sapiens
gtgccatttttttcactcaga

SEQ ID NO: 267154 - DNA, 17 bp, Homo sapiens
gtgcccaaagtggggag

SEQ ID NO: 267155 - DNA, 20 bp, Homo sapiens
gtgcccaagaatagatgctg

SEQ ID NO: 267156 - DNA, 19 bp, Homo sapiens
gtgcccacagcccgcatgc

SEQ ID NO: 267157 - DNA, 22 bp, Homo sapiens
gtgcccacagcccgcatgcagc

SEQ ID NO: 267158 - DNA, 20 bp, Homo sapiens
gtgcccacatcccaggcttc

SEQ ID NO: 267159 - DNA, 20 bp, Homo sapiens
gtgcccagagatgggactgg

SEQ ID NO: 267160 - DNA, 18 bp, Homo sapiens
gtgcccagagtagcccag

SEQ ID NO: 267161 - DNA, 22 bp, Homo sapiens
gtgcccagatcgttctgccact

SEQ ID NO: 267162 - DNA, 12 bp, Homo sapiens
gtgcccagctca

SEQ ID NO: 267163 - DNA, 20 bp, Homo sapiens
gtgcccagtcttgagtgggc

SEQ ID NO: 267164 - DNA, 15 bp, Homo sapiens
gtgcccagtgatggc

SEQ ID NO: 267165 - DNA, 13 bp, Homo sapiens
gtgccccacagct

SEQ ID NO: 267166 - DNA, 15 bp, Homo sapiens
gtgccccacctgcca

SEQ ID NO: 267167 - DNA, 13 bp, Homo sapiens
gtgccccatgtcc

SEQ ID NO: 267168 - DNA, 13 bp, Homo sapiens
gtgcccccctcct

SEQ ID NO: 267169 - DNA, 12 bp, Homo sapiens
gtgccccctggg

SEQ ID NO: 267170 - DNA, 23 bp, Homo sapiens
gtgccccctggggggcacagcca

SEQ ID NO: 267171 - DNA, 17 bp, Homo sapiens
gtgcccctcccatggcc

SEQ ID NO: 267172 - DNA, 16 bp, Homo sapiens
gtgcccctcctgcccc

SEQ ID NO: 267173 - DNA, 16 bp, Homo sapiens
gtgcccgcccacctct

SEQ ID NO: 267174 - DNA, 22 bp, Homo sapiens
gtgcccggctaatttttttgta

SEQ ID NO: 267175 - DNA, 14 bp, Homo sapiens
gtgccctccactgc

SEQ ID NO: 267176 - DNA, 15 bp, Homo sapiens
gtgccctcgctgctt

SEQ ID NO: 267177 - DNA, 17 bp, Homo sapiens
gtgccctgacccctgca

SEQ ID NO: 267178 - DNA, 18 bp, Homo sapiens
gtgccctgacccctgcac

SEQ ID NO: 267179 - DNA, 12 bp, Homo sapiens
gtgccctgcccc

SEQ ID NO: 267180 - DNA, 10 bp, Homo sapiens
gtgccctggc

SEQ ID NO: 267181 - DNA, 12 bp, Homo sapiens
gtgccctggctc

SEQ ID NO: 267182 - DNA, 14 bp, Homo sapiens
gtgccctggctccc

SEQ ID NO: 267183 - DNA, 23 bp, Homo sapiens
gtgccctggctcccaagggaggc

SEQ ID NO: 267184 - DNA, 13 bp, Homo sapiens
gtgcccttgctgg

SEQ ID NO: 267185 - DNA, 20 bp, Homo sapiens
gtgcccttgctgggtccagg

SEQ ID NO: 267186 - DNA, 22 bp, Homo sapiens
gtgccggcggcagccccacttc

SEQ ID NO: 267187 - DNA, 23 bp, Homo sapiens
gtgccggcggcagccccacttca

SEQ ID NO: 267188 - DNA, 22 bp, Homo sapiens
gtgccgtagggagtacctgctg

SEQ ID NO: 267189 - DNA, 17 bp, Homo sapiens
ttgcatgccttttgggt

SEQ ID NO: 267190 - DNA, 23 bp, Homo sapiens
ttgcattgaatttagtcattatt

SEQ ID NO: 267191 - DNA, 16 bp, Homo sapiens
ttgcattgtgtgagct

SEQ ID NO: 267192 - DNA, 15 bp, Homo sapiens
ttgcatttagaactt

SEQ ID NO: 267193 - DNA, 11 bp, Homo sapiens
ttgcatttctt

SEQ ID NO: 267194 - DNA, 13 bp, Homo sapiens
ttgcatttgtacc

SEQ ID NO: 267195 - DNA, 15 bp, Homo sapiens
ttgccaaaaaggggt

SEQ ID NO: 267196 - DNA, 21 bp, Homo sapiens
ttgccaaataaagttaaaagt

SEQ ID NO: 267197 - DNA, 15 bp, Homo sapiens
ttgccaagaaaatga

SEQ ID NO: 267198 - DNA, 18 bp, Homo sapiens
ttgccaaggccgcccacc

SEQ ID NO: 267199 - DNA, 17 bp, Homo sapiens
ttgccaaggctctcccc

SEQ ID NO: 267200 - DNA, 19 bp, Homo sapiens
ttgccaaggctctcccctc

SEQ ID NO: 267201 - DNA, 23 bp, Homo sapiens
ttgccaatggtgtagctgtcctc

SEQ ID NO: 267202 - DNA, 15 bp, Homo sapiens
gtggcaaagtgctgt

SEQ ID NO: 267203 - DNA, 18 bp, Homo sapiens
gtggcaaagtgctgtacc

SEQ ID NO: 267204 - DNA, 15 bp, Homo sapiens
gtggcaagaccaaaa

SEQ ID NO: 267205 - DNA, 14 bp, Homo sapiens
gtggcacctcctga

SEQ ID NO: 267206 - DNA, 16 bp, Homo sapiens
gtggcacttcgtggat

SEQ ID NO: 267207 - DNA, 22 bp, Homo sapiens
gtggcagaaatcccagttcatg

SEQ ID NO: 267208 - DNA, 17 bp, Homo sapiens
gtggcagaagtgtttca

SEQ ID NO: 267209 - DNA, 19 bp, Homo sapiens
gtggcagccatgcctcatg

SEQ ID NO: 267210 - DNA, 16 bp, Homo sapiens
gtggcatcccagtggc

SEQ ID NO: 267211 - DNA, 21 bp, Homo sapiens
gtggcatctttgccttgggct

SEQ ID NO: 267212 - DNA, 16 bp, Homo sapiens
gtggcatgtgctgtga

SEQ ID NO: 267213 - DNA, 16 bp, Homo sapiens
gtggcatttgctgaat

SEQ ID NO: 267214 - DNA, 18 bp, Homo sapiens
gtggccaacgtggacctg

SEQ ID NO: 267215 - DNA, 15 bp, Homo sapiens
gtggccagaccagag

SEQ ID NO: 267216 - DNA, 18 bp, Homo sapiens
gtggccagaccagagctc

SEQ ID NO: 267217 - DNA, 11 bp, Homo sapiens
gtggccagagc

SEQ ID NO: 267218 - DNA, 14 bp, Homo sapiens
gtggccagagcacc

SEQ ID NO: 267219 - DNA, 18 bp, Homo sapiens
gtggccagagcacctcag

SEQ ID NO: 267220 - DNA, 12 bp, Homo sapiens
gtggccagagct

SEQ ID NO: 267221 - DNA, 13 bp, Homo sapiens
gtggccagagctg

SEQ ID NO: 267222 - DNA, 14 bp, Homo sapiens
gtggccagagctgg

SEQ ID NO: 267223 - DNA, 15 bp, Homo sapiens
gtggccagagctgga

SEQ ID NO: 267224 - DNA, 19 bp, Homo sapiens
gtggccagagctggaaggc

SEQ ID NO: 267225 - DNA, 22 bp, Homo sapiens
gtggccccagctgtgactgagg

SEQ ID NO: 267226 - DNA, 17 bp, Homo sapiens
gtggccccaggtgccac

SEQ ID NO: 267227 - DNA, 11 bp, Homo sapiens
gtggcccctcc

SEQ ID NO: 267228 - DNA, 18 bp, Homo sapiens
gtggcccctccttctccc

SEQ ID NO: 267229 - DNA, 18 bp, Homo sapiens
gtggcccgacagcctggc

SEQ ID NO: 267230 - DNA, 12 bp, Homo sapiens
gtggccctgggg

SEQ ID NO: 267231 - DNA, 13 bp, Homo sapiens
gtggccctgggga

SEQ ID NO: 267232 - DNA, 14 bp, Homo sapiens
gtggccctggggaa

SEQ ID NO: 267233 - DNA, 13 bp, Homo sapiens
gtggccctgtggg

SEQ ID NO: 267234 - DNA, 19 bp, Homo sapiens
gtggcctaaggctgctgta

SEQ ID NO: 267235 - DNA, 16 bp, Homo sapiens
gtggcctaatttacaa

SEQ ID NO: 267236 - DNA, 21 bp, Homo sapiens
gtggcctcaaccctccctcag

SEQ ID NO: 267237 - DNA, 12 bp, Homo sapiens
gtggcctcagaa

SEQ ID NO: 267238 - DNA, 20 bp, Homo sapiens
gtggcctcttgagcagtggc

SEQ ID NO: 267239 - DNA, 14 bp, Homo sapiens
gtggcctgagaaga

SEQ ID NO: 267240 - DNA, 15 bp, Homo sapiens
gtggcctgagaagag

SEQ ID NO: 267241 - DNA, 12 bp, Homo sapiens
gtggcctggcca

SEQ ID NO: 267242 - DNA, 20 bp, Homo sapiens
gtggcctggccaggagctct

SEQ ID NO: 267243 - DNA, 19 bp, Homo sapiens
gtggcctggctccgctgtg

SEQ ID NO: 267244 - DNA, 14 bp, Homo sapiens
gtggcctggggctg

SEQ ID NO: 267245 - DNA, 16 bp, Homo sapiens
gtggcctgtgtccagc

SEQ ID NO: 267246 - DNA, 19 bp, Homo sapiens
gtggcctgtgtccagcagc

SEQ ID NO: 267247 - DNA, 22 bp, Homo sapiens
gtggccttccccttttgcctgg

SEQ ID NO: 267248 - DNA, 24 bp, Homo sapiens
gtggccttccccttttgcctggct

SEQ ID NO: 267249 - DNA, 12 bp, Homo sapiens
gtggccttgccc

SEQ ID NO: 267250 - DNA, 20 bp, Homo sapiens
gtggcgactctatagactct

SEQ ID NO: 267251 - DNA, 22 bp, Homo sapiens
gtggcgccagccctaggctacc

SEQ ID NO: 267252 - DNA, 21 bp, Homo sapiens
gtggcgctttctcctgtgccc

SEQ ID NO: 267253 - DNA, 14 bp, Homo sapiens
gtggctcacgcctg

SEQ ID NO: 267254 - DNA, 20 bp, Homo sapiens
gtggctcacgtgtgtgactc

SEQ ID NO: 267255 - DNA, 14 bp, Homo sapiens
gtggctcccctcta

SEQ ID NO: 267256 - DNA, 22 bp, Homo sapiens
gtggctcccctctatttagcat

SEQ ID NO: 267257 - DNA, 20 bp, Homo sapiens
gtggctcctatctgtgtttt

SEQ ID NO: 267258 - DNA, 17 bp, Homo sapiens
gtggctctaactccttg

SEQ ID NO: 267259 - DNA, 16 bp, Homo sapiens
gtggctctgagaaggg

SEQ ID NO: 267260 - DNA, 22 bp, Homo sapiens
gtggctgacagagcaggtctgc

SEQ ID NO: 267261 - DNA, 13 bp, Homo sapiens
gtggctggaggca

SEQ ID NO: 267262 - DNA, 20 bp, Homo sapiens
gtggctgggtgggcccagaa

SEQ ID NO: 267263 - DNA, 15 bp, Homo sapiens
gtggctggtgtcccc

SEQ ID NO: 267264 - DNA, 19 bp, Homo sapiens
gtggctggtgtccccttcc

SEQ ID NO: 267265 - DNA, 23 bp, Homo sapiens
gtggctggtgtccccttcccctg

SEQ ID NO: 267266 - DNA, 21 bp, Homo sapiens
gtggctgtcctcttaagacac

SEQ ID NO: 267267 - DNA, 15 bp, Homo sapiens
gtggcttaaacattt

SEQ ID NO: 267268 - DNA, 15 bp, Homo sapiens
gtggcttcagcccct

SEQ ID NO: 267269 - DNA, 16 bp, Homo sapiens
gtggcttcagcccctg

SEQ ID NO: 267270 - DNA, 23 bp, Homo sapiens
gtggcttcagcccctggggtact

SEQ ID NO: 267271 - DNA, 18 bp, Homo sapiens
gtggcttcccgctcagcc

SEQ ID NO: 267272 - DNA, 17 bp, Homo sapiens
gtggcttcggcctgctt

SEQ ID NO: 267273 - DNA, 18 bp, Homo sapiens
gtggcttcttttgaactg

SEQ ID NO: 267274 - DNA, 20 bp, Homo sapiens
gtggcttggagcagaggtgg

SEQ ID NO: 267275 - DNA, 17 bp, Homo sapiens
gtggcttttatttcagt

SEQ ID NO: 267276 - DNA, 22 bp, Homo sapiens
gtgggaaaatgtcccccacctc

SEQ ID NO: 267277 - DNA, 15 bp, Homo sapiens
gtgggaagagctggg

SEQ ID NO: 267278 - DNA, 20 bp, Homo sapiens
gtgggaagagggcaggggct

SEQ ID NO: 267279 - DNA, 15 bp, Homo sapiens
gtgggaaggacttgg

SEQ ID NO: 267280 - DNA, 14 bp, Homo sapiens
gtgggacacagaga

SEQ ID NO: 267281 - DNA, 15 bp, Homo sapiens
gtgggagaagggaca

SEQ ID NO: 267282 - DNA, 17 bp, Homo sapiens
gtgggagaagtggcccc

SEQ ID NO: 267283 - DNA, 15 bp, Homo sapiens
gtgggagatgaaaac

SEQ ID NO: 267284 - DNA, 15 bp, Homo sapiens
gtgggagtgggagag

SEQ ID NO: 267285 - DNA, 16 bp, Homo sapiens
gtgggagtgggagagg

SEQ ID NO: 267286 - DNA, 15 bp, Homo sapiens
gtgggatacttagtg

SEQ ID NO: 267287 - DNA, 17 bp, Homo sapiens
gtgggatatccctatgc

SEQ ID NO: 267288 - DNA, 21 bp, Homo sapiens
gtgggatcaaagctaggaaag

SEQ ID NO: 267289 - DNA, 22 bp, Homo sapiens
gtgggatcaaagctaggaaagg

SEQ ID NO: 267290 - DNA, 14 bp, Homo sapiens
gtgggatccagaga

SEQ ID NO: 267291 - DNA, 17 bp, Homo sapiens
gtgggatccagagagaa

SEQ ID NO: 267292 - DNA, 20 bp, Homo sapiens
gtgggatcctccctcatggc

SEQ ID NO: 267293 - DNA, 14 bp, Homo sapiens
gtgggcacctcaga

SEQ ID NO: 267294 - DNA, 23 bp, Homo sapiens
gtgggcagcctatgggggctctc

SEQ ID NO: 267295 - DNA, 15 bp, Homo sapiens
gtgggcagctgggcc

SEQ ID NO: 267296 - DNA, 17 bp, Homo sapiens
gtgggcagctgggcccc

SEQ ID NO: 267297 - DNA, 21 bp, Homo sapiens
gtgggcaggggttccagcttc

SEQ ID NO: 267298 - DNA, 20 bp, Homo sapiens
gtgggcaggtgggagcttga

SEQ ID NO: 267299 - DNA, 19 bp, Homo sapiens
gtgggcatgccaccctcac

SEQ ID NO: 267300 - DNA, 20 bp, Homo sapiens
gtgggcatttcttgcgagcc

SEQ ID NO: 267301 - DNA, 13 bp, Homo sapiens
gtgggccagcccc

SEQ ID NO: 267302 - DNA, 15 bp, Homo sapiens
gtgggccagcccctc

SEQ ID NO: 267303 - DNA, 17 bp, Homo sapiens
gtgggccagcccctccc

SEQ ID NO: 267304 - DNA, 19 bp, Homo sapiens
gtgggcccagaactgcccc

SEQ ID NO: 267305 - DNA, 11 bp, Homo sapiens
gtgggcctctg

SEQ ID NO: 267306 - DNA, 18 bp, Homo sapiens
gtgggcctggcctgagct

SEQ ID NO: 267307 - DNA, 22 bp, Homo sapiens
gtgggcggatcacaaggtcagg

SEQ ID NO: 267308 - DNA, 16 bp, Homo sapiens
gtgggcggcagagagg

SEQ ID NO: 267309 - DNA, 14 bp, Homo sapiens
gtgggctaattaaa

SEQ ID NO: 267310 - DNA, 20 bp, Homo sapiens
gtgggctgggccctctgtcc

SEQ ID NO: 267311 - DNA, 13 bp, Homo sapiens
gtgggctggtgcc

SEQ ID NO: 267312 - DNA, 14 bp, Homo sapiens
gtgggctgtgagtg

SEQ ID NO: 267313 - DNA, 21 bp, Homo sapiens
gtgggctgtgttgactgctgc

SEQ ID NO: 267314 - DNA, 14 bp, Homo sapiens
gtgggcttggcctt

SEQ ID NO: 267315 - DNA, 15 bp, Homo sapiens
gtggggaagagagcc

SEQ ID NO: 267316 - DNA, 23 bp, Homo sapiens
gtggggaagcaagacgtcctgga

SEQ ID NO: 267317 - DNA, 22 bp, Homo sapiens
gtggggacgtcctgccacctgg

SEQ ID NO: 267318 - DNA, 19 bp, Homo sapiens
gtggggagacacctcagag

SEQ ID NO: 267319 - DNA, 12 bp, Homo sapiens
gtggggaggaga

SEQ ID NO: 267320 - DNA, 11 bp, Homo sapiens
ttgggaggctg

SEQ ID NO: 267321 - DNA, 15 bp, Homo sapiens
ttgggatcagcctcc

SEQ ID NO: 267322 - DNA, 15 bp, Homo sapiens
ttgggccactgccct

SEQ ID NO: 267323 - DNA, 23 bp, Homo sapiens
ttgggccatggctttcatcctgt

SEQ ID NO: 267324 - DNA, 18 bp, Homo sapiens
ttgggcccagctgggctc

SEQ ID NO: 267325 - DNA, 22 bp, Homo sapiens
ttgggcccagctgggctctgcc

SEQ ID NO: 267326 - DNA, 18 bp, Homo sapiens
ttgggccccagaccccag

SEQ ID NO: 267327 - DNA, 15 bp, Homo sapiens
ttgggccccagggaa

SEQ ID NO: 267328 - DNA, 12 bp, Homo sapiens
ttgggccctcct

SEQ ID NO: 267329 - DNA, 21 bp, Homo sapiens
ttgggcggctgagagccccag

SEQ ID NO: 267330 - DNA, 12 bp, Homo sapiens
ttgggctctgcg

SEQ ID NO: 267331 - DNA, 16 bp, Homo sapiens
ttgggctgacacctac

SEQ ID NO: 267332 - DNA, 23 bp, Homo sapiens
ttgggctgacacctaccatgctg

SEQ ID NO: 267333 - DNA, 13 bp, Homo sapiens
ttgggctgagact

SEQ ID NO: 267334 - DNA, 15 bp, Homo sapiens
ttgggctgagactgg

SEQ ID NO: 267335 - DNA, 20 bp, Homo sapiens
ttgggcttctgcggtgaggc

SEQ ID NO: 267336 - DNA, 18 bp, Homo sapiens
ttgggctttgcaggctct

SEQ ID NO: 267337 - DNA, 17 bp, Homo sapiens
ttggggaactcaaagga

SEQ ID NO: 267338 - DNA, 15 bp, Homo sapiens
ttggggaatttcctc

SEQ ID NO: 267339 - DNA, 12 bp, Homo sapiens
ttggggaggcaa

SEQ ID NO: 267340 - DNA, 13 bp, Homo sapiens
ttggggaggggcg

SEQ ID NO: 267341 - DNA, 13 bp, Homo sapiens
ttggggcctggct

SEQ ID NO: 267342 - DNA, 21 bp, Homo sapiens
ttggggcctggcttgctccag

SEQ ID NO: 267343 - DNA, 21 bp, Homo sapiens
ttggggcgaggcagaggacag

SEQ ID NO: 267344 - DNA, 18 bp, Homo sapiens
ttgggggttaccaaaaat

SEQ ID NO: 267345 - DNA, 18 bp, Homo sapiens
ttggggtgtggggtgggg

SEQ ID NO: 267346 - DNA, 19 bp, Homo sapiens
ttggggtgtggggtggggt

SEQ ID NO: 267347 - DNA, 16 bp, Homo sapiens
gtgtgcaagtatgtga

SEQ ID NO: 267348 - DNA, 18 bp, Homo sapiens
gtgtgcatgtgtgtgctc

SEQ ID NO: 267349 - DNA, 15 bp, Homo sapiens
gtgtgccctggctcc

SEQ ID NO: 267350 - DNA, 23 bp, Homo sapiens
gtgtgccctggctcccaagggag

SEQ ID NO: 267351 - DNA, 20 bp, Homo sapiens
gtgtgcctgctatccagccg

SEQ ID NO: 267352 - DNA, 19 bp, Homo sapiens
gtgtgcctgtcactactgg

SEQ ID NO: 267353 - DNA, 13 bp, Homo sapiens
gtgtgcctgtggc

SEQ ID NO: 267354 - DNA, 15 bp, Homo sapiens
gtgtgcctgtggcag

SEQ ID NO: 267355 - DNA, 14 bp, Homo sapiens
gtgtgctggcttcc

SEQ ID NO: 267356 - DNA, 16 bp, Homo sapiens
gtgtggactgtgatgc

SEQ ID NO: 267357 - DNA, 12 bp, Homo sapiens
gtgtggagctgc

SEQ ID NO: 267358 - DNA, 20 bp, Homo sapiens
gtgtggagggattgaacaca

SEQ ID NO: 267359 - DNA, 17 bp, Homo sapiens
gtgtggagtggaggggt

SEQ ID NO: 267360 - DNA, 13 bp, Homo sapiens
gtgtggccctgca

SEQ ID NO: 267361 - DNA, 17 bp, Homo sapiens
gtgtggccctgtgggag

SEQ ID NO: 267362 - DNA, 20 bp, Homo sapiens
gtgtggccgcctggcaggtg

SEQ ID NO: 267363 - DNA, 13 bp, Homo sapiens
gtgtggcttggaa

SEQ ID NO: 267364 - DNA, 19 bp, Homo sapiens
gtgtgggatacttagtggt

SEQ ID NO: 267365 - DNA, 13 bp, Homo sapiens
gtgtggggagggt

SEQ ID NO: 267366 - DNA, 16 bp, Homo sapiens
gtgtggggagggtggg

SEQ ID NO: 267367 - DNA, 13 bp, Homo sapiens
gtgtggtggctca

SEQ ID NO: 267368 - DNA, 12 bp, Homo sapiens
gtgtgtatatat

SEQ ID NO: 267369 - DNA, 13 bp, Homo sapiens
gtgtgtatatatt

SEQ ID NO: 267370 - DNA, 18 bp, Homo sapiens
gtgtgtatcaccctcagc

SEQ ID NO: 267371 - DNA, 22 bp, Homo sapiens
gtgtgtatcaccctcagctggc

SEQ ID NO: 267372 - DNA, 15 bp, Homo sapiens
gtgtgtattgttccc

SEQ ID NO: 267373 - DNA, 19 bp, Homo sapiens
gtgtgtctcctgcatgcag

SEQ ID NO: 267374 - DNA, 19 bp, Homo sapiens
gtgtgtgagtgggaggaga

SEQ ID NO: 267375 - DNA, 13 bp, Homo sapiens
gtgtgtgcaatgt

SEQ ID NO: 267376 - DNA, 17 bp, Homo sapiens
gtgtgtgccatcatgcc

SEQ ID NO: 267377 - DNA, 13 bp, Homo sapiens
gtgtgtgtatgtg

SEQ ID NO: 267378 - DNA, 13 bp, Homo sapiens
gtgtgtgtgtgtg

SEQ ID NO: 267379 - DNA, 18 bp, Homo sapiens
gtgtgttccaactgcccc

SEQ ID NO: 267380 - DNA, 18 bp, Homo sapiens
gtgtgttctgattagaaa

SEQ ID NO: 267381 - DNA, 17 bp, Homo sapiens
gtgtgttcttttgatac

SEQ ID NO: 267382 - DNA, 18 bp, Homo sapiens
gtgtgttcttttgataca

SEQ ID NO: 267383 - DNA, 19 bp, Homo sapiens
gtgtgttcttttgatacat

SEQ ID NO: 267384 - DNA, 21 bp, Homo sapiens
gtgtgttcttttgatacattt

SEQ ID NO: 267385 - DNA, 15 bp, Homo sapiens
gtgtgtttaaataaa

SEQ ID NO: 267386 - DNA, 19 bp, Homo sapiens
gtgtgtttaaataaagtat

SEQ ID NO: 267387 - DNA, 22 bp, Homo sapiens
gtgtgtttaaataaagtatcat

SEQ ID NO: 267388 - DNA, 20 bp, Homo sapiens
gtgtgtttcaggacagctgc

SEQ ID NO: 267389 - DNA, 13 bp, Homo sapiens
gtgtgtttcccta

SEQ ID NO: 267390 - DNA, 21 bp, Homo sapiens
gtgttagtgggaagagctggg

SEQ ID NO: 267391 - DNA, 16 bp, Homo sapiens
gtgttagtgtctgtcc

SEQ ID NO: 267392 - DNA, 18 bp, Homo sapiens
gtgttatgactccagaat

SEQ ID NO: 267393 - DNA, 14 bp, Homo sapiens
gtgttcaagaaata

SEQ ID NO: 267394 - DNA, 15 bp, Homo sapiens
gtgttcaatctgtga

SEQ ID NO: 267395 - DNA, 19 bp, Homo sapiens
gtgttcacactgtaaacat

SEQ ID NO: 267396 - DNA, 16 bp, Homo sapiens
gtgttccatgacttca

SEQ ID NO: 267397 - DNA, 19 bp, Homo sapiens
gtgttcctcaccaataact

SEQ ID NO: 267398 - DNA, 14 bp, Homo sapiens
gtgttcgcttggct

SEQ ID NO: 267399 - DNA, 16 bp, Homo sapiens
gtgttcgtggagccac

SEQ ID NO: 267400 - DNA, 15 bp, Homo sapiens
gtgttcgttcttgtt

SEQ ID NO: 267401 - DNA, 21 bp, Homo sapiens
gtgttcgttcttgttctgttt

SEQ ID NO: 267402 - DNA, 19 bp, Homo sapiens
gtgttctcaatgcttttct

SEQ ID NO: 267403 - DNA, 12 bp, Homo sapiens
gtgttctcctcc

SEQ ID NO: 267404 - DNA, 13 bp, Homo sapiens
gtgttctgagccc

SEQ ID NO: 267405 - DNA, 16 bp, Homo sapiens
gtgttctgattagaaa

SEQ ID NO: 267406 - DNA, 19 bp, Homo sapiens
gtgttctgtgggcttggcc

SEQ ID NO: 267407 - DNA, 19 bp, Homo sapiens
gtgttcttttgatacattt

SEQ ID NO: 267408 - DNA, 17 bp, Homo sapiens
gtgttgacgtaagctct

SEQ ID NO: 267409 - DNA, 12 bp, Homo sapiens
gtgttgcaaatt

SEQ ID NO: 267410 - DNA, 21 bp, Homo sapiens
gtgttgcaaattattctagtc

SEQ ID NO: 267411 - DNA, 17 bp, Homo sapiens
gtgttgccacaggacac

SEQ ID NO: 267412 - DNA, 22 bp, Homo sapiens
gtgttgctttggatacacacat

SEQ ID NO: 267413 - DNA, 16 bp, Homo sapiens
gtgttggcccaagctc

SEQ ID NO: 267414 - DNA, 18 bp, Homo sapiens
gtgttgggacctgctgct

SEQ ID NO: 267415 - DNA, 24 bp, Homo sapiens
gtgttgggacctgctgctccatgg

SEQ ID NO: 267416 - DNA, 15 bp, Homo sapiens
gtgttgggccccagg

SEQ ID NO: 267417 - DNA, 14 bp, Homo sapiens
gtgttggtctttct

SEQ ID NO: 267418 - DNA, 18 bp, Homo sapiens
gtgtttaaagagaggtta

SEQ ID NO: 267419 - DNA, 14 bp, Homo sapiens
gtgtttaaataaag

SEQ ID NO: 267420 - DNA, 20 bp, Homo sapiens
gtgtttagcattaaaaataa

SEQ ID NO: 267421 - DNA, 10 bp, Homo sapiens
gtgtttattt

SEQ ID NO: 267422 - DNA, 16 bp, Homo sapiens
gtgtttatttttcata

SEQ ID NO: 267423 - DNA, 22 bp, Homo sapiens
gtgtttgtataccatgatgcat

SEQ ID NO: 267424 - DNA, 12 bp, Homo sapiens
gtgtttgtgagt

SEQ ID NO: 267425 - DNA, 12 bp, Homo sapiens
gtgtttgttcct

SEQ ID NO: 267426 - DNA, 22 bp, Homo sapiens
gtgttttaattccaatatgatg

SEQ ID NO: 267427 - DNA, 14 bp, Homo sapiens
gtgttttactcttt

SEQ ID NO: 267428 - DNA, 11 bp, Homo sapiens
gtgttttgctt

SEQ ID NO: 267429 - DNA, 13 bp, Homo sapiens
gtgttttgctttt

SEQ ID NO: 267430 - DNA, 14 bp, Homo sapiens
gtgttttgctttta

SEQ ID NO: 267431 - DNA, 20 bp, Homo sapiens
gtgttttgcttttatccact

SEQ ID NO: 267432 - DNA, 22 bp, Homo sapiens
gtgtttttttttcgtttgtttg

SEQ ID NO: 267433 - DNA, 14 bp, Homo sapiens
gttaaaaaaaataa

SEQ ID NO: 267434 - DNA, 20 bp, Homo sapiens
gttaaaacaaattaaaaaca

SEQ ID NO: 267435 - DNA, 18 bp, Homo sapiens
gttaaaatataaattaag

SEQ ID NO: 267436 - DNA, 19 bp, Homo sapiens
gttaaaatataaattaaga

SEQ ID NO: 267437 - DNA, 21 bp, Homo sapiens
gttaaaatataaattaagact

SEQ ID NO: 267438 - DNA, 14 bp, Homo sapiens
gttaaagagacaaa

SEQ ID NO: 267439 - DNA, 16 bp, Homo sapiens
gttaaagagacaaata

SEQ ID NO: 267440 - DNA, 17 bp, Homo sapiens
gttaaagcatcagagat

SEQ ID NO: 267441 - DNA, 15 bp, Homo sapiens
gttaaagctgccggc

SEQ ID NO: 267442 - DNA, 19 bp, Homo sapiens
gttaaaggcagtccagagc

SEQ ID NO: 267443 - DNA, 20 bp, Homo sapiens
gttaaaggcagtccagagct

SEQ ID NO: 267444 - DNA, 17 bp, Homo sapiens
gttaaatgaaattgtaa

SEQ ID NO: 267445 - DNA, 21 bp, Homo sapiens
gttaacactgtaatatcttta

SEQ ID NO: 267446 - DNA, 15 bp, Homo sapiens
gttaacattgaccaa

SEQ ID NO: 267447 - DNA, 15 bp, Homo sapiens
gttaaccatttaagt

SEQ ID NO: 267448 - DNA, 15 bp, Homo sapiens
gttaacctttttgta

SEQ ID NO: 267449 - DNA, 21 bp, Homo sapiens
gttaactagtgtttctgcaga

SEQ ID NO: 267450 - DNA, 16 bp, Homo sapiens
gttaagaaaaaaataa

SEQ ID NO: 267451 - DNA, 19 bp, Homo sapiens
ttgtgtccataagagaaat

SEQ ID NO: 267452 - DNA, 18 bp, Homo sapiens
ttgtgtctgcctgcctca

SEQ ID NO: 267453 - DNA, 19 bp, Homo sapiens
ttgtgtgggtttactctgt

SEQ ID NO: 267454 - DNA, 20 bp, Homo sapiens
ttgtgtgggtttactctgtg

SEQ ID NO: 267455 - DNA, 20 bp, Homo sapiens
ttgtgttaagtatgtgtaaa

SEQ ID NO: 267456 - DNA, 23 bp, Homo sapiens
ttgtgttcagttccagcttttgt

SEQ ID NO: 267457 - DNA, 22 bp, Homo sapiens
ttgtgttctgtttgttaaaact

SEQ ID NO: 267458 - DNA, 13 bp, Homo sapiens
ttgtgttgctttc

SEQ ID NO: 267459 - DNA, 21 bp, Homo sapiens
ttgtgtttatatataagccaa

SEQ ID NO: 267460 - DNA, 14 bp, Homo sapiens
ttgtgtttgtatat

SEQ ID NO: 267461 - DNA, 18 bp, Homo sapiens
ttgtgtttgtatataaat

SEQ ID NO: 267462 - DNA, 18 bp, Homo sapiens
ttgtgttttttttccttt

SEQ ID NO: 267463 - DNA, 14 bp, Homo sapiens
ttgttaaaactggc

SEQ ID NO: 267464 - DNA, 22 bp, Homo sapiens
ttgttaactcttgtctattttt

SEQ ID NO: 267465 - DNA, 15 bp, Homo sapiens
ttgttaagttcaccg

SEQ ID NO: 267466 - DNA, 19 bp, Homo sapiens
ttgttaatatatataatac

SEQ ID NO: 267467 - DNA, 23 bp, Homo sapiens
ttgttaatatatataatacttaa

SEQ ID NO: 267468 - DNA, 15 bp, Homo sapiens
ttgttaatattaatt

SEQ ID NO: 267469 - DNA, 17 bp, Homo sapiens
ttgttaatgaaaatgat

SEQ ID NO: 267470 - DNA, 18 bp, Homo sapiens
ttgttaatgaaaatgtca

SEQ ID NO: 267471 - DNA, 19 bp, Homo sapiens
ttgttaatgaaaatgtcag

SEQ ID NO: 267472 - DNA, 15 bp, Homo sapiens
ttgttacaggaagtc

SEQ ID NO: 267473 - DNA, 24 bp, Homo sapiens
ttgttaccttaaaactaggcattt

SEQ ID NO: 267474 - DNA, 14 bp, Homo sapiens
ttgttactgtctgt

SEQ ID NO: 267475 - DNA, 21 bp, Homo sapiens
ttgttactgtctgtagtgttt

SEQ ID NO: 267476 - DNA, 12 bp, Homo sapiens
ttgttataaata

SEQ ID NO: 267477 - DNA, 22 bp, Homo sapiens
ttgttatcagtacaattctttg

SEQ ID NO: 267478 - DNA, 14 bp, Homo sapiens
ttgttatttataac

SEQ ID NO: 267479 - DNA, 15 bp, Homo sapiens
ttgttatttgtacag

SEQ ID NO: 267480 - DNA, 15 bp, Homo sapiens
ttgttattttggaaa

SEQ ID NO: 267481 - DNA, 21 bp, Homo sapiens
ttgttcaaagaacccccctcc

SEQ ID NO: 267482 - DNA, 22 bp, Homo sapiens
ttgttcaataataaatattttt

SEQ ID NO: 267483 - DNA, 17 bp, Homo sapiens
ttgttccaagacattgt

SEQ ID NO: 267484 - DNA, 21 bp, Homo sapiens
ttgttccaagacattgtcaat

SEQ ID NO: 267485 - DNA, 21 bp, Homo sapiens
ttgttccacaagttaaataaa

SEQ ID NO: 267486 - DNA, 12 bp, Homo sapiens
ttgttccagctc

SEQ ID NO: 267487 - DNA, 11 bp, Homo sapiens
ttgttcccagt

SEQ ID NO: 267488 - DNA, 14 bp, Homo sapiens
ttgttccctctccc

SEQ ID NO: 267489 - DNA, 22 bp, Homo sapiens
ttgttcctgctttctctttcag

SEQ ID NO: 267490 - DNA, 20 bp, Homo sapiens
ttgttctagttagcaggaaa

SEQ ID NO: 267491 - DNA, 22 bp, Homo sapiens
ttgttctagttagcaggaaata

SEQ ID NO: 267492 - DNA, 18 bp, Homo sapiens
ttgttctctctatggtaa

SEQ ID NO: 267493 - DNA, 17 bp, Homo sapiens
gttccacacatttaaaa

SEQ ID NO: 267494 - DNA, 21 bp, Homo sapiens
gttccacacatttaaaacatt

SEQ ID NO: 267495 - DNA, 14 bp, Homo sapiens
gttccacagttgat

SEQ ID NO: 267496 - DNA, 15 bp, Homo sapiens
gttccacagttgatt

SEQ ID NO: 267497 - DNA, 18 bp, Homo sapiens
gttccagaacgtctctca

SEQ ID NO: 267498 - DNA, 12 bp, Homo sapiens
gttccagacaga

SEQ ID NO: 267499 - DNA, 13 bp, Homo sapiens
gttccagacagag

SEQ ID NO: 267500 - DNA, 21 bp, Homo sapiens
gttccagacagggtggggctt

SEQ ID NO: 267501 - DNA, 22 bp, Homo sapiens
gttccagactcaggttccagaa

SEQ ID NO: 267502 - DNA, 12 bp, Homo sapiens
gttccagctctt

SEQ ID NO: 267503 - DNA, 15 bp, Homo sapiens
gttccatccaccacc

SEQ ID NO: 267504 - DNA, 16 bp, Homo sapiens
gttccatgaagacaaa

SEQ ID NO: 267505 - DNA, 20 bp, Homo sapiens
gttccatgcctgagggtgga

SEQ ID NO: 267506 - DNA, 15 bp, Homo sapiens
gttcccaataaaagt

SEQ ID NO: 267507 - DNA, 15 bp, Homo sapiens
gttcccactgccctg

SEQ ID NO: 267508 - DNA, 17 bp, Homo sapiens
gttcccccagccctgtg

SEQ ID NO: 267509 - DNA, 19 bp, Homo sapiens
gttcccccaggaccctgag

SEQ ID NO: 267510 - DNA, 17 bp, Homo sapiens
gttccccttggcttcct

SEQ ID NO: 267511 - DNA, 19 bp, Homo sapiens
gttccccttggcttcctcc

SEQ ID NO: 267512 - DNA, 21 bp, Homo sapiens
gttccctcagtgtgaagcctg

SEQ ID NO: 267513 - DNA, 15 bp, Homo sapiens
gttccctctccctgt

SEQ ID NO: 267514 - DNA, 12 bp, Homo sapiens
gttccctctttc

SEQ ID NO: 267515 - DNA, 13 bp, Homo sapiens
gttccctctttcc

SEQ ID NO: 267516 - DNA, 16 bp, Homo sapiens
gttccctgtcagaggc

SEQ ID NO: 267517 - DNA, 20 bp, Homo sapiens
gttccctgtcagaggctaag

SEQ ID NO: 267518 - DNA, 12 bp, Homo sapiens
gttcccttggcc

SEQ ID NO: 267519 - DNA, 13 bp, Homo sapiens
gttcccttggcct

SEQ ID NO: 267520 - DNA, 12 bp, Homo sapiens
gttcccttgtgt

SEQ ID NO: 267521 - DNA, 13 bp, Homo sapiens
gttccctttgctc

SEQ ID NO: 267522 - DNA, 17 bp, Homo sapiens
gttccctttgctccacc

SEQ ID NO: 267523 - DNA, 14 bp, Homo sapiens
gttccgtctcctct

SEQ ID NO: 267524 - DNA, 16 bp, Homo sapiens
gttccgtctcctctcc

SEQ ID NO: 267525 - DNA, 17 bp, Homo sapiens
gttcctaacaggatgaa

SEQ ID NO: 267526 - DNA, 15 bp, Homo sapiens
gttcctctttgcatg

SEQ ID NO: 267527 - DNA, 22 bp, Homo sapiens
gttcctgatagctacccacaga

SEQ ID NO: 267528 - DNA, 14 bp, Homo sapiens
gttcctgccaggct

SEQ ID NO: 267529 - DNA, 15 bp, Homo sapiens
gttcctgcccccgcc

SEQ ID NO: 267530 - DNA, 11 bp, Homo sapiens
gttcctgcctt

SEQ ID NO: 267531 - DNA, 13 bp, Homo sapiens
gttcctgccttct

SEQ ID NO: 267532 - DNA, 17 bp, Homo sapiens
gttcctgccttctcttc

SEQ ID NO: 267533 - DNA, 17 bp, Homo sapiens
gttcctggccttctgaa

SEQ ID NO: 267534 - DNA, 15 bp, Homo sapiens
gttcctggctcagcc

SEQ ID NO: 267535 - DNA, 13 bp, Homo sapiens
gttcctggctttg

SEQ ID NO: 267536 - DNA, 19 bp, Homo sapiens
gttcctggctttgacatga

SEQ ID NO: 267537 - DNA, 20 bp, Homo sapiens
gttcctgtaaaatccattta

SEQ ID NO: 267538 - DNA, 17 bp, Homo sapiens
gttcctgtggccaggag

SEQ ID NO: 267539 - DNA, 15 bp, Homo sapiens
gttcctgttctcagc

SEQ ID NO: 267540 - DNA, 15 bp, Homo sapiens
gttccttccctggga

SEQ ID NO: 267541 - DNA, 19 bp, Homo sapiens
gttccttcctatgcccagg

SEQ ID NO: 267542 - DNA, 13 bp, Homo sapiens
gttcgtagctttc

SEQ ID NO: 267543 - DNA, 15 bp, Homo sapiens
gttcgtatagaaaaa

SEQ ID NO: 267544 - DNA, 16 bp, Homo sapiens
gttcgtggagccacag

SEQ ID NO: 267545 - DNA, 22 bp, Homo sapiens
gttcgtggagccacaggcagac

SEQ ID NO: 267546 - DNA, 19 bp, Homo sapiens
gttctaaaaattgtgatca

SEQ ID NO: 267547 - DNA, 18 bp, Homo sapiens
gttctaaaggactaacat

SEQ ID NO: 267548 - DNA, 16 bp, Homo sapiens
gttctagacttcccca

SEQ ID NO: 267549 - DNA, 17 bp, Homo sapiens
gttctagacttccccat

SEQ ID NO: 267550 - DNA, 14 bp, Homo sapiens
gttctagtctcctt

SEQ ID NO: 267551 - DNA, 14 bp, Homo sapiens
gttctatttctatc

SEQ ID NO: 267552 - DNA, 15 bp, Homo sapiens
gttctatttctatct

SEQ ID NO: 267553 - DNA, 18 bp, Homo sapiens
gttctcaaaccctgttta

SEQ ID NO: 267554 - DNA, 20 bp, Homo sapiens
gttctcaaaccctgtttacg

SEQ ID NO: 267555 - DNA, 16 bp, Homo sapiens
gttctcaatgtgaaaa

SEQ ID NO: 267556 - DNA, 21 bp, Homo sapiens
gttctcactcctaggagagcc

SEQ ID NO: 267557 - DNA, 23 bp, Homo sapiens
gttctcagaactgttggctgctc

SEQ ID NO: 267558 - DNA, 15 bp, Homo sapiens
gttctcagcaagtgt

SEQ ID NO: 267559 - DNA, 17 bp, Homo sapiens
gttctcaggtgttgcca

SEQ ID NO: 267560 - DNA, 14 bp, Homo sapiens
gttctccatcccca

SEQ ID NO: 267561 - DNA, 12 bp, Homo sapiens
gttctcctgatt

SEQ ID NO: 267562 - DNA, 14 bp, Homo sapiens
gttctcgtgaccca

SEQ ID NO: 267563 - DNA, 16 bp, Homo sapiens
gttctcgtgacccagt

SEQ ID NO: 267564 - DNA, 19 bp, Homo sapiens
gttctctccccttgcactg

SEQ ID NO: 267565 - DNA, 13 bp, Homo sapiens
gttctctccttct

SEQ ID NO: 267566 - DNA, 18 bp, Homo sapiens
gttctctctatggtaaag

SEQ ID NO: 267567 - DNA, 14 bp, Homo sapiens
gttctcttcattcc

SEQ ID NO: 267568 - DNA, 16 bp, Homo sapiens
gttctcttcattccca

SEQ ID NO: 267569 - DNA, 18 bp, Homo sapiens
gttctgaaggtgcccagg

SEQ ID NO: 267570 - DNA, 20 bp, Homo sapiens
gttctgagaactgactttct

SEQ ID NO: 267571 - DNA, 23 bp, Homo sapiens
gttctgagaactgactttctccc

SEQ ID NO: 267572 - DNA, 14 bp, Homo sapiens
gttctgatattaat

SEQ ID NO: 267573 - DNA, 14 bp, Homo sapiens
gttctgattagaaa

SEQ ID NO: 267574 - DNA, 18 bp, Homo sapiens
gttctgattagaaatgac

SEQ ID NO: 267575 - DNA, 20 bp, Homo sapiens
gttctgattagaaatgacca

SEQ ID NO: 267576 - DNA, 19 bp, Homo sapiens
gttctgcaaatagaaaaca

SEQ ID NO: 267577 - DNA, 21 bp, Homo sapiens
gttctgcagagacttctagga

SEQ ID NO: 267578 - DNA, 12 bp, Homo sapiens
gttctgccactt

SEQ ID NO: 267579 - DNA, 18 bp, Homo sapiens
gttctgccacttgcactg

SEQ ID NO: 267580 - DNA, 21 bp, Homo sapiens
gttctgctcccagatgccttc

SEQ ID NO: 267581 - DNA, 13 bp, Homo sapiens
gttctgctggcct

SEQ ID NO: 267582 - DNA, 23 bp, Homo sapiens
accctaggtctccacccctcaag

SEQ ID NO: 267583 - DNA, 16 bp, Homo sapiens
accctagtttccctga

SEQ ID NO: 267584 - DNA, 17 bp, Homo sapiens
accctcacacacacagc

SEQ ID NO: 267585 - DNA, 18 bp, Homo sapiens
accctcacacacacagct

SEQ ID NO: 267586 - DNA, 21 bp, Homo sapiens
accctcacacacacagctggg

SEQ ID NO: 267587 - DNA, 15 bp, Homo sapiens
accctcactctgcca

SEQ ID NO: 267588 - DNA, 18 bp, Homo sapiens
accctcactctgccaggg

SEQ ID NO: 267589 - DNA, 21 bp, Homo sapiens
accctcactctgccagggcag

SEQ ID NO: 267590 - DNA, 16 bp, Homo sapiens
accctcagctggcgga

SEQ ID NO: 267591 - DNA, 22 bp, Homo sapiens
accctcaggcataggcctgggt

SEQ ID NO: 267592 - DNA, 16 bp, Homo sapiens
accctccatgctcctc

SEQ ID NO: 267593 - DNA, 20 bp, Homo sapiens
accctccatgctcctcacct

SEQ ID NO: 267594 - DNA, 13 bp, Homo sapiens
accctcccacccc

SEQ ID NO: 267595 - DNA, 14 bp, Homo sapiens
accctcccaccccc

SEQ ID NO: 267596 - DNA, 23 bp, Homo sapiens
accctcccacccccttctctgct

SEQ ID NO: 267597 - DNA, 14 bp, Homo sapiens
accctcccccacca

SEQ ID NO: 267598 - DNA, 23 bp, Homo sapiens
accctcccccaggaggtcgaccc

SEQ ID NO: 267599 - DNA, 13 bp, Homo sapiens
accctcccctctc

SEQ ID NO: 267600 - DNA, 13 bp, Homo sapiens
accctcccctctt

SEQ ID NO: 267601 - DNA, 12 bp, Homo sapiens
accctccctcag

SEQ ID NO: 267602 - DNA, 18 bp, Homo sapiens
accctccctcagcccctc

SEQ ID NO: 267603 - DNA, 20 bp, Homo sapiens
accctccctcagcccctctt

SEQ ID NO: 267604 - DNA, 19 bp, Homo sapiens
accctccctgtcccctgag

SEQ ID NO: 267605 - DNA, 18 bp, Homo sapiens
accctccggccagcgagt

SEQ ID NO: 267606 - DNA, 23 bp, Homo sapiens
accctccggccagcgagtggtca

SEQ ID NO: 267607 - DNA, 14 bp, Homo sapiens
accctcctccactc

SEQ ID NO: 267608 - DNA, 20 bp, Homo sapiens
accctcctctatttctttaa

SEQ ID NO: 267609 - DNA, 18 bp, Homo sapiens
accctcggggcaggaagt

SEQ ID NO: 267610 - DNA, 22 bp, Homo sapiens
accctcgtggacacctgccctg

SEQ ID NO: 267611 - DNA, 15 bp, Homo sapiens
accctctgaccctag

SEQ ID NO: 267612 - DNA, 15 bp, Homo sapiens
accctctgctatgtc

SEQ ID NO: 267613 - DNA, 19 bp, Homo sapiens
accctctgctatgtctgtg

SEQ ID NO: 267614 - DNA, 20 bp, Homo sapiens
accctcttctcagctccact

SEQ ID NO: 267615 - DNA, 19 bp, Homo sapiens
accctcttctctgggccca

SEQ ID NO: 267616 - DNA, 20 bp, Homo sapiens
accctcttctctgggcccag

SEQ ID NO: 267617 - DNA, 22 bp, Homo sapiens
accctgagggtttccaccttgg

SEQ ID NO: 267618 - DNA, 18 bp, Homo sapiens
accctgcaaaggactgtt

SEQ ID NO: 267619 - DNA, 17 bp, Homo sapiens
accctgcaaggcccaca

SEQ ID NO: 267620 - DNA, 14 bp, Homo sapiens
accctgcagagcta

SEQ ID NO: 267621 - DNA, 19 bp, Homo sapiens
accctgccaactttccaga

SEQ ID NO: 267622 - DNA, 19 bp, Homo sapiens
accctgccctgcaccttgg

SEQ ID NO: 267623 - DNA, 11 bp, Homo sapiens
accctgccgag

SEQ ID NO: 267624 - DNA, 18 bp, Homo sapiens
accctgccgagggggctg

SEQ ID NO: 267625 - DNA, 21 bp, Homo sapiens
accctgcctctcagagggttt

SEQ ID NO: 267626 - DNA, 15 bp, Homo sapiens
accctgcctgagccc

SEQ ID NO: 267627 - DNA, 16 bp, Homo sapiens
accctgcctgagccca

SEQ ID NO: 267628 - DNA, 20 bp, Homo sapiens
accctgcctgagcccaggag

SEQ ID NO: 267629 - DNA, 14 bp, Homo sapiens
accctgccttatct

SEQ ID NO: 267630 - DNA, 19 bp, Homo sapiens
accctgctcctcctgccct

SEQ ID NO: 267631 - DNA, 14 bp, Homo sapiens
accctgctgccttc

SEQ ID NO: 267632 - DNA, 14 bp, Homo sapiens
accctgcttctgct

SEQ ID NO: 267633 - DNA, 17 bp, Homo sapiens
accctgcttggggcctg

SEQ ID NO: 267634 - DNA, 21 bp, Homo sapiens
accctgcttggggcctggcgt

SEQ ID NO: 267635 - DNA, 23 bp, Homo sapiens
accctgcttggggcctggcgtgg

SEQ ID NO: 267636 - DNA, 10 bp, Homo sapiens
accctggaat

SEQ ID NO: 267637 - DNA, 22 bp, Homo sapiens
accctggaattcagcaccctgg

SEQ ID NO: 267638 - DNA, 15 bp, Homo sapiens
accctggcagagaag

SEQ ID NO: 267639 - DNA, 18 bp, Homo sapiens
gtttacaagtgtatatca

SEQ ID NO: 267640 - DNA, 23 bp, Homo sapiens
gtttacagcactactctgtgcca

SEQ ID NO: 267641 - DNA, 16 bp, Homo sapiens
gtttaccatttgtaat

SEQ ID NO: 267642 - DNA, 14 bp, Homo sapiens
gtttaccctccctg

SEQ ID NO: 267643 - DNA, 23 bp, Homo sapiens
gtttaccctccctgtcccctgag

SEQ ID NO: 267644 - DNA, 13 bp, Homo sapiens
gtttactctgtgc

SEQ ID NO: 267645 - DNA, 13 bp, Homo sapiens
gtttactgctgtc

SEQ ID NO: 267646 - DNA, 18 bp, Homo sapiens
gtttacttatcttatgcc

SEQ ID NO: 267647 - DNA, 19 bp, Homo sapiens
gtttagaaattacaagttt

SEQ ID NO: 267648 - DNA, 20 bp, Homo sapiens
gtttagaaattacaagtttc

SEQ ID NO: 267649 - DNA, 14 bp, Homo sapiens
gtttagcaggctgc

SEQ ID NO: 267650 - DNA, 18 bp, Homo sapiens
gtttagcattaaaaataa

SEQ ID NO: 267651 - DNA, 14 bp, Homo sapiens
gtttagctgtgaaa

SEQ ID NO: 267652 - DNA, 20 bp, Homo sapiens
gtttagcttcctccagagga

SEQ ID NO: 267653 - DNA, 20 bp, Homo sapiens
gtttagtagctgataaagaa

SEQ ID NO: 267654 - DNA, 21 bp, Homo sapiens
gtttagtgtggttttctgttt

SEQ ID NO: 267655 - DNA, 19 bp, Homo sapiens
gtttagtttctagaggcct

SEQ ID NO: 267656 - DNA, 12 bp, Homo sapiens
gtttagtttttc

SEQ ID NO: 267657 - DNA, 23 bp, Homo sapiens
gtttataatctgacaaagtcatg

SEQ ID NO: 267658 - DNA, 20 bp, Homo sapiens
gtttatagagggccaagact

SEQ ID NO: 267659 - DNA, 21 bp, Homo sapiens
gtttatagagggccaagactt

SEQ ID NO: 267660 - DNA, 12 bp, Homo sapiens
gtttatatactg

SEQ ID NO: 267661 - DNA, 17 bp, Homo sapiens
gtttatatgtcttgcaa

SEQ ID NO: 267662 - DNA, 21 bp, Homo sapiens
gtttatattgtttttatatat

SEQ ID NO: 267663 - DNA, 16 bp, Homo sapiens
gtttatccaaatcttg

SEQ ID NO: 267664 - DNA, 15 bp, Homo sapiens
gtttatgatatttct

SEQ ID NO: 267665 - DNA, 18 bp, Homo sapiens
gtttatgcagtgctgctt

SEQ ID NO: 267666 - DNA, 14 bp, Homo sapiens
gtttatggcagaag

SEQ ID NO: 267667 - DNA, 18 bp, Homo sapiens
gtttatggcctcagctgc

SEQ ID NO: 267668 - DNA, 15 bp, Homo sapiens
gtttatgtctaaaga

SEQ ID NO: 267669 - DNA, 21 bp, Homo sapiens
gtttatttccaaataaaatga

SEQ ID NO: 267670 - DNA, 16 bp, Homo sapiens
gtttatttttcatatt

SEQ ID NO: 267671 - DNA, 19 bp, Homo sapiens
gtttatttttttgatggct

SEQ ID NO: 267672 - DNA, 22 bp, Homo sapiens
gtttatttttttgatggctaag

SEQ ID NO: 267673 - DNA, 21 bp, Homo sapiens
gtttcactttcacatagatgt

SEQ ID NO: 267674 - DNA, 13 bp, Homo sapiens
gtttcagaaaggg

SEQ ID NO: 267675 - DNA, 23 bp, Homo sapiens
gtttcagaaagggcagcccctcc

SEQ ID NO: 267676 - DNA, 21 bp, Homo sapiens
gtttcagatatatatcatatt

SEQ ID NO: 267677 - DNA, 14 bp, Homo sapiens
gtttcagtaaataa

SEQ ID NO: 267678 - DNA, 17 bp, Homo sapiens
gtttcagtaataaaaca

SEQ ID NO: 267679 - DNA, 22 bp, Homo sapiens
gtttcagtaataaaacatcttt

SEQ ID NO: 267680 - DNA, 21 bp, Homo sapiens
gtttcagtaatagctgaacct

SEQ ID NO: 267681 - DNA, 18 bp, Homo sapiens
gtttcatgttttgtgact

SEQ ID NO: 267682 - DNA, 21 bp, Homo sapiens
gtttcatttttcattttctct

SEQ ID NO: 267683 - DNA, 17 bp, Homo sapiens
gtttccaagcctgggcc

SEQ ID NO: 267684 - DNA, 14 bp, Homo sapiens
gtttccaaggtgca

SEQ ID NO: 267685 - DNA, 15 bp, Homo sapiens
gtttccacacagcct

SEQ ID NO: 267686 - DNA, 19 bp, Homo sapiens
gtttccacacaggcccatg

SEQ ID NO: 267687 - DNA, 20 bp, Homo sapiens
gtttccacacaggcccatgc

SEQ ID NO: 267688 - DNA, 23 bp, Homo sapiens
gtttccacacaggcccatgccct

SEQ ID NO: 267689 - DNA, 22 bp, Homo sapiens
gtttccagaaattcttcaattt

SEQ ID NO: 267690 - DNA, 16 bp, Homo sapiens
gtttccatcatttctg

SEQ ID NO: 267691 - DNA, 22 bp, Homo sapiens
gtttccatgggtcaaagccggt

SEQ ID NO: 267692 - DNA, 17 bp, Homo sapiens
gtttccccaccagtgaa

SEQ ID NO: 267693 - DNA, 20 bp, Homo sapiens
gtttccccaccagtgaatga

SEQ ID NO: 267694 - DNA, 20 bp, Homo sapiens
gtttccctactaacatccca

SEQ ID NO: 267695 - DNA, 16 bp, Homo sapiens
gtttcctcaggctgct

SEQ ID NO: 267696 - DNA, 23 bp, Homo sapiens
gtttctaacactagtctgtgtgc

SEQ ID NO: 267697 - DNA, 17 bp, Homo sapiens
gtttctaatttgctgct

SEQ ID NO: 267698 - DNA, 19 bp, Homo sapiens
gtttctacattctctattt

SEQ ID NO: 267699 - DNA, 18 bp, Homo sapiens
gtttctagctagaaatat

SEQ ID NO: 267700 - DNA, 13 bp, Homo sapiens
gtttctatactgt

SEQ ID NO: 267701 - DNA, 14 bp, Homo sapiens
gtttctcccagttc

SEQ ID NO: 267702 - DNA, 15 bp, Homo sapiens
gtttctctgctgttg

SEQ ID NO: 267703 - DNA, 17 bp, Homo sapiens
gtttctctgtgctctga

SEQ ID NO: 267704 - DNA, 19 bp, Homo sapiens
gtttctgacccactgatct

SEQ ID NO: 267705 - DNA, 15 bp, Homo sapiens
gtttctgcagaggca

SEQ ID NO: 267706 - DNA, 19 bp, Homo sapiens
gtttctgcagcccttgggc

SEQ ID NO: 267707 - DNA, 13 bp, Homo sapiens
gtttctgccctgc

SEQ ID NO: 267708 - DNA, 23 bp, Homo sapiens
gtttctgtcctcaggtgaataac

SEQ ID NO: 267709 - DNA, 11 bp, Homo sapiens
gtttctgttct

SEQ ID NO: 267710 - DNA, 14 bp, Homo sapiens
gtttctgttctgcc

SEQ ID NO: 267711 - DNA, 14 bp, Homo sapiens
tttaaagtttaaat

SEQ ID NO: 267712 - DNA, 15 bp, Homo sapiens
tttaaagtttaaata

SEQ ID NO: 267713 - DNA, 22 bp, Homo sapiens
tttaaataaagtatcatgcatt

SEQ ID NO: 267714 - DNA, 13 bp, Homo sapiens
tttaaataaagtt

SEQ ID NO: 267715 - DNA, 20 bp, Homo sapiens
tttaaataaatgttattgtc

SEQ ID NO: 267716 - DNA, 13 bp, Homo sapiens
tttaaatatcatt

SEQ ID NO: 267717 - DNA, 14 bp, Homo sapiens
tttaaatatcattc

SEQ ID NO: 267718 - DNA, 16 bp, Homo sapiens
tttaaatatcattctt

SEQ ID NO: 267719 - DNA, 13 bp, Homo sapiens
tttaaatcatttc

SEQ ID NO: 267720 - DNA, 14 bp, Homo sapiens
tttaaatcatttca

SEQ ID NO: 267721 - DNA, 15 bp, Homo sapiens
tttaaatgattccaa

SEQ ID NO: 267722 - DNA, 17 bp, Homo sapiens
tttaaatgattccaaat

SEQ ID NO: 267723 - DNA, 21 bp, Homo sapiens
tttaaatgctttgttttccca

SEQ ID NO: 267724 - DNA, 16 bp, Homo sapiens
tttaaatggaataatt

SEQ ID NO: 267725 - DNA, 15 bp, Homo sapiens
tttaaattataagga

SEQ ID NO: 267726 - DNA, 21 bp, Homo sapiens
tttaaattataaggactgcat

SEQ ID NO: 267727 - DNA, 16 bp, Homo sapiens
tttaaattatatgata

SEQ ID NO: 267728 - DNA, 21 bp, Homo sapiens
tttaaattatatgatatgcat

SEQ ID NO: 267729 - DNA, 15 bp, Homo sapiens
tttaaattctccaac

SEQ ID NO: 267730 - DNA, 12 bp, Homo sapiens
tttaacaaaaca

SEQ ID NO: 267731 - DNA, 19 bp, Homo sapiens
tttaacaactaatcaagag

SEQ ID NO: 267732 - DNA, 20 bp, Homo sapiens
tttaacaataactactgtgt

SEQ ID NO: 267733 - DNA, 18 bp, Homo sapiens
tttaacaggaagatctta

SEQ ID NO: 267734 - DNA, 15 bp, Homo sapiens
tttaacagtcattta

SEQ ID NO: 267735 - DNA, 17 bp, Homo sapiens
tttaacagtcatttaaa

SEQ ID NO: 267736 - DNA, 22 bp, Homo sapiens
tttaacattcctcatgaatgta

SEQ ID NO: 267737 - DNA, 23 bp, Homo sapiens
tttaacattcctcatgaatgtaa

SEQ ID NO: 267738 - DNA, 21 bp, Homo sapiens
tttaaccacagtgaaagttga

SEQ ID NO: 267739 - DNA, 18 bp, Homo sapiens
tttaactgaaaatgtaaa

SEQ ID NO: 267740 - DNA, 19 bp, Homo sapiens
tttaactgaaaatgtaaat

SEQ ID NO: 267741 - DNA, 14 bp, Homo sapiens
tttaactgcattct

SEQ ID NO: 267742 - DNA, 18 bp, Homo sapiens
tttaacttccagtggctg

SEQ ID NO: 267743 - DNA, 11 bp, Homo sapiens
tttaagaaaat

SEQ ID NO: 267744 - DNA, 12 bp, Homo sapiens
tttaagaaaata

SEQ ID NO: 267745 - DNA, 21 bp, Homo sapiens
tttaagaaaatacaataaact

SEQ ID NO: 267746 - DNA, 19 bp, Homo sapiens
tttaagaatagttctaaaa

SEQ ID NO: 267747 - DNA, 17 bp, Homo sapiens
tttaagaatttattatt

SEQ ID NO: 267748 - DNA, 20 bp, Homo sapiens
tttaagacttaatctttgct

SEQ ID NO: 267749 - DNA, 15 bp, Homo sapiens
tttaagataaattat

SEQ ID NO: 267750 - DNA, 22 bp, Homo sapiens
tttaagcatgagtggccttaat

SEQ ID NO: 267751 - DNA, 18 bp, Homo sapiens
tttaagctgtttccatag

SEQ ID NO: 267752 - DNA, 15 bp, Homo sapiens
tttaaggaagaaaaa

SEQ ID NO: 267753 - DNA, 16 bp, Homo sapiens
tttaaggaagaaaaat

SEQ ID NO: 267754 - DNA, 22 bp, Homo sapiens
tttaagggtttgtggaaaatga

SEQ ID NO: 267755 - DNA, 12 bp, Homo sapiens
tttaagtattta

SEQ ID NO: 267756 - DNA, 22 bp, Homo sapiens
tttaagtcgggaaattctgctg

SEQ ID NO: 267757 - DNA, 19 bp, Homo sapiens
tttaagttttgattaatgt

SEQ ID NO: 267758 - DNA, 16 bp, Homo sapiens
tttaataaagcttgtg

SEQ ID NO: 267759 - DNA, 13 bp, Homo sapiens
tttaataactttg

SEQ ID NO: 267760 - DNA, 16 bp, Homo sapiens
tttaatacctttaaat

SEQ ID NO: 267761 - DNA, 17 bp, Homo sapiens
tttaatagaagttttat

SEQ ID NO: 267762 - DNA, 19 bp, Homo sapiens
tttaatagaatataattat

SEQ ID NO: 267763 - DNA, 21 bp, Homo sapiens
tttaatagaatataattatcg

SEQ ID NO: 267764 - DNA, 21 bp, Homo sapiens
tttaatagaatatactgtctt

SEQ ID NO: 267765 - DNA, 16 bp, Homo sapiens
tttaatatttatgttt

SEQ ID NO: 267766 - DNA, 18 bp, Homo sapiens
tttaatatttatgtttaa

SEQ ID NO: 267767 - DNA, 17 bp, Homo sapiens
tttaatatttattgaat

SEQ ID NO: 267768 - DNA, 17 bp, Homo sapiens
tttaatctgttgtttga

SEQ ID NO: 267769 - DNA, 15 bp, Homo sapiens
tttaatgatcaacaa

SEQ ID NO: 267770 - DNA, 22 bp, Homo sapiens
tttaatgatgtgtcatatgagt

SEQ ID NO: 267771 - DNA, 12 bp, Homo sapiens
tttaattacaac

SEQ ID NO: 267772 - DNA, 18 bp, Homo sapiens
tttaattattaactacat

SEQ ID NO: 267773 - DNA, 23 bp, Homo sapiens
tttaattattatttatatatgta

SEQ ID NO: 267774 - DNA, 16 bp, Homo sapiens
tttaattccaatatga

SEQ ID NO: 267775 - DNA, 21 bp, Homo sapiens
tttaattccaatatgatgact

SEQ ID NO: 267776 - DNA, 22 bp, Homo sapiens
tttaattctaaaagagaaggga

SEQ ID NO: 267777 - DNA, 21 bp, Homo sapiens
tttaattgtaggtcaatgaaa

SEQ ID NO: 267778 - DNA, 16 bp, Homo sapiens
tttaatttatttatta

SEQ ID NO: 267779 - DNA, 19 bp, Homo sapiens
tttaatttatttattaaga

SEQ ID NO: 267780 - DNA, 18 bp, Homo sapiens
tttaatttgatgaaagct

SEQ ID NO: 267781 - DNA, 23 bp, Homo sapiens
tttaatttttaaaagactttgat

SEQ ID NO: 267782 - DNA, 13 bp, Homo sapiens
tttacaaaacata

SEQ ID NO: 267783 - DNA, 13 bp, Homo sapiens
tttacaaaagatg

SEQ ID NO: 267784 - DNA, 14 bp, Homo sapiens
tttacaaaatgaat

SEQ ID NO: 267785 - DNA, 18 bp, Homo sapiens
taaaagaggaaattaaat

SEQ ID NO: 267786 - DNA, 21 bp, Homo sapiens
taaaagatacatttgtatgtt

SEQ ID NO: 267787 - DNA, 20 bp, Homo sapiens
taaaagattcactaaagcag

SEQ ID NO: 267788 - DNA, 16 bp, Homo sapiens
taaaagcaacatcagc

SEQ ID NO: 267789 - DNA, 19 bp, Homo sapiens
taaaagcaacatcagcttg

SEQ ID NO: 267790 - DNA, 21 bp, Homo sapiens
taaaagcagcatctgctaata

SEQ ID NO: 267791 - DNA, 21 bp, Homo sapiens
taaaaggaagtagatgtgaaa

SEQ ID NO: 267792 - DNA, 14 bp, Homo sapiens
taaaaggaggacag

SEQ ID NO: 267793 - DNA, 20 bp, Homo sapiens
taaaaggaggacagggaggg

SEQ ID NO: 267794 - DNA, 16 bp, Homo sapiens
taaaaggataggaaaa

SEQ ID NO: 267795 - DNA, 19 bp, Homo sapiens
taaaaggataggaaaagat

SEQ ID NO: 267796 - DNA, 16 bp, Homo sapiens
taaaagtataacagca

SEQ ID NO: 267797 - DNA, 14 bp, Homo sapiens
taaaagtattcata

SEQ ID NO: 267798 - DNA, 15 bp, Homo sapiens
taaaagtgatcaata

SEQ ID NO: 267799 - DNA, 15 bp, Homo sapiens
taaaagtgatgtgat

SEQ ID NO: 267800 - DNA, 22 bp, Homo sapiens
taaaagttaagtgtcatttctt

SEQ ID NO: 267801 - DNA, 21 bp, Homo sapiens
taaaagttgtgattccagata

SEQ ID NO: 267802 - DNA, 21 bp, Homo sapiens
taaaataaaaattctgaatgt

SEQ ID NO: 267803 - DNA, 15 bp, Homo sapiens
taaaataaacagttg

SEQ ID NO: 267804 - DNA, 14 bp, Homo sapiens
taaaataaacgaaa

SEQ ID NO: 267805 - DNA, 12 bp, Homo sapiens
taaaataaatat

SEQ ID NO: 267806 - DNA, 15 bp, Homo sapiens
taaaataaatatact

SEQ ID NO: 267807 - DNA, 16 bp, Homo sapiens
taaaataaatatacta

SEQ ID NO: 267808 - DNA, 18 bp, Homo sapiens
taaaataaatatactaat

SEQ ID NO: 267809 - DNA, 20 bp, Homo sapiens
taaaataagtaacatataaa

SEQ ID NO: 267810 - DNA, 14 bp, Homo sapiens
taaaataagttaaa

SEQ ID NO: 267811 - DNA, 15 bp, Homo sapiens
taaaataatgattta

SEQ ID NO: 267812 - DNA, 22 bp, Homo sapiens
taaaataatgatttaagcattt

SEQ ID NO: 267813 - DNA, 20 bp, Homo sapiens
taaaatacatggtatctctt

SEQ ID NO: 267814 - DNA, 13 bp, Homo sapiens
taaaatacattta

SEQ ID NO: 267815 - DNA, 18 bp, Homo sapiens
taaaatacatttaaaact

SEQ ID NO: 267816 - DNA, 18 bp, Homo sapiens
taaaatagattatcccac

SEQ ID NO: 267817 - DNA, 21 bp, Homo sapiens
taaaatagtttatttttcaca

SEQ ID NO: 267818 - DNA, 21 bp, Homo sapiens
taaaatcaaatttttctggga

SEQ ID NO: 267819 - DNA, 14 bp, Homo sapiens
taaaatcaactttt

SEQ ID NO: 267820 - DNA, 21 bp, Homo sapiens
taaaatcagtgtgcttgcctt

SEQ ID NO: 267821 - DNA, 15 bp, Homo sapiens
taaaatcattcaata

SEQ ID NO: 267822 - DNA, 19 bp, Homo sapiens
taaaatctattttgtctga

SEQ ID NO: 267823 - DNA, 17 bp, Homo sapiens
taaaatctgtattgcta

SEQ ID NO: 267824 - DNA, 14 bp, Homo sapiens
taaaatctgtgaat

SEQ ID NO: 267825 - DNA, 14 bp, Homo sapiens
taaaatcttcagct

SEQ ID NO: 267826 - DNA, 12 bp, Homo sapiens
taaaatcttgtc

SEQ ID NO: 267827 - DNA, 16 bp, Homo sapiens
taaaatcttgtcatgt

SEQ ID NO: 267828 - DNA, 14 bp, Homo sapiens
taaaatctttccat

SEQ ID NO: 267829 - DNA, 18 bp, Homo sapiens
taaaatctttccatctca

SEQ ID NO: 267830 - DNA, 13 bp, Homo sapiens
taaaatgaggcag

SEQ ID NO: 267831 - DNA, 20 bp, Homo sapiens
taaaatgaggttcaactgtt

SEQ ID NO: 267832 - DNA, 23 bp, Homo sapiens
taaaatgattcacttttattgta

SEQ ID NO: 267833 - DNA, 14 bp, Homo sapiens
taaaatgattgtaa

SEQ ID NO: 267834 - DNA, 20 bp, Homo sapiens
taaaatgattgtaaaatagc

SEQ ID NO: 267835 - DNA, 17 bp, Homo sapiens
taaaatgattttatctg

SEQ ID NO: 267836 - DNA, 13 bp, Homo sapiens
taaaatgcattta

SEQ ID NO: 267837 - DNA, 20 bp, Homo sapiens
taaaatggaaaacttagttt

SEQ ID NO: 267838 - DNA, 21 bp, Homo sapiens
taaaatggaaaggtcctgctg

SEQ ID NO: 267839 - DNA, 17 bp, Homo sapiens
taaaatggacttttgtt

SEQ ID NO: 267840 - DNA, 16 bp, Homo sapiens
taaaatggtttgtcct

SEQ ID NO: 267841 - DNA, 18 bp, Homo sapiens
tttcaatccacagtattg

SEQ ID NO: 267842 - DNA, 13 bp, Homo sapiens
tttcaatgtgatt

SEQ ID NO: 267843 - DNA, 14 bp, Homo sapiens
tttcaatgtgattc

SEQ ID NO: 267844 - DNA, 13 bp, Homo sapiens
tttcaatttactt

SEQ ID NO: 267845 - DNA, 14 bp, Homo sapiens
tttcacatagatgt

SEQ ID NO: 267846 - DNA, 14 bp, Homo sapiens
tttcacatatttgt

SEQ ID NO: 267847 - DNA, 22 bp, Homo sapiens
tttcaccccacccttcccctcc

SEQ ID NO: 267848 - DNA, 16 bp, Homo sapiens
tttcacctgtgacaaa

SEQ ID NO: 267849 - DNA, 23 bp, Homo sapiens
tttcacctgtttttaagctgttt

SEQ ID NO: 267850 - DNA, 15 bp, Homo sapiens
tttcacgggagattt

SEQ ID NO: 267851 - DNA, 20 bp, Homo sapiens
tttcacgtcttggtgccttt

SEQ ID NO: 267852 - DNA, 16 bp, Homo sapiens
tttcactattcctatg

SEQ ID NO: 267853 - DNA, 14 bp, Homo sapiens
tttcactgctggct

SEQ ID NO: 267854 - DNA, 17 bp, Homo sapiens
tttcactgctggctgcc

SEQ ID NO: 267855 - DNA, 18 bp, Homo sapiens
tttcactgctggctgcct

SEQ ID NO: 267856 - DNA, 19 bp, Homo sapiens
tttcactggagttacatta

SEQ ID NO: 267857 - DNA, 12 bp, Homo sapiens
tttcacttctgt

SEQ ID NO: 267858 - DNA, 20 bp, Homo sapiens
tttcacttgtcttgctctta

SEQ ID NO: 267859 - DNA, 13 bp, Homo sapiens
tttcactttgaaa

SEQ ID NO: 267860 - DNA, 22 bp, Homo sapiens
tttcagaaagggcagcccctcc

SEQ ID NO: 267861 - DNA, 23 bp, Homo sapiens
tttcagaaagggcagcccctccc

SEQ ID NO: 267862 - DNA, 23 bp, Homo sapiens
tttcagaacctcttccccagaaa

SEQ ID NO: 267863 - DNA, 19 bp, Homo sapiens
tttcagaatacaattcagt

SEQ ID NO: 267864 - DNA, 11 bp, Homo sapiens
tttcagacagg

SEQ ID NO: 267865 - DNA, 14 bp, Homo sapiens
tttcagacagggtc

SEQ ID NO: 267866 - DNA, 19 bp, Homo sapiens
tttcagagccagtgaagga

SEQ ID NO: 267867 - DNA, 16 bp, Homo sapiens
tttcagatatatatca

SEQ ID NO: 267868 - DNA, 21 bp, Homo sapiens
tttcagatgtcttctgcctgt

SEQ ID NO: 267869 - DNA, 20 bp, Homo sapiens
tttcagcacccccacccacc

SEQ ID NO: 267870 - DNA, 22 bp, Homo sapiens
tttcagcacccccacccacctc

SEQ ID NO: 267871 - DNA, 12 bp, Homo sapiens
tttcagcatcaa

SEQ ID NO: 267872 - DNA, 17 bp, Homo sapiens
tttcagcatcaaacatg

SEQ ID NO: 267873 - DNA, 22 bp, Homo sapiens
tttcagcatcaaacatgaaaac

SEQ ID NO: 267874 - DNA, 16 bp, Homo sapiens
tttcagccaagaattc

SEQ ID NO: 267875 - DNA, 15 bp, Homo sapiens
tttcagcctgcttct

SEQ ID NO: 267876 - DNA, 23 bp, Homo sapiens
tttcaggaagttgctgagaaatg

SEQ ID NO: 267877 - DNA, 16 bp, Homo sapiens
tttcagtaagatcaag

SEQ ID NO: 267878 - DNA, 20 bp, Homo sapiens
tttcagtaatagctgaacct

SEQ ID NO: 267879 - DNA, 15 bp, Homo sapiens
tttcagtatactgtg

SEQ ID NO: 267880 - DNA, 16 bp, Homo sapiens
tttcagtatactgtgt

SEQ ID NO: 267881 - DNA, 23 bp, Homo sapiens
tttcagtcaagttccgtctcctc

SEQ ID NO: 267882 - DNA, 16 bp, Homo sapiens
tttcagtgctttctca

SEQ ID NO: 267883 - DNA, 20 bp, Homo sapiens
tttcagtgctttctcaaaat

SEQ ID NO: 267884 - DNA, 12 bp, Homo sapiens
tttcataaaaat

SEQ ID NO: 267885 - DNA, 17 bp, Homo sapiens
tttcataaattggctcc

SEQ ID NO: 267886 - DNA, 18 bp, Homo sapiens
tttcataaattggctcct

SEQ ID NO: 267887 - DNA, 19 bp, Homo sapiens
tttcataaggcctgccctc

SEQ ID NO: 267888 - DNA, 17 bp, Homo sapiens
tttcatagatgaacttt

SEQ ID NO: 267889 - DNA, 16 bp, Homo sapiens
tttcatagttctgtta

SEQ ID NO: 267890 - DNA, 21 bp, Homo sapiens
tttcatagttctgttaaatat

SEQ ID NO: 267891 - DNA, 13 bp, Homo sapiens
tttcatcctcagc

SEQ ID NO: 267892 - DNA, 13 bp, Homo sapiens
tttcatcctggcc

SEQ ID NO: 267893 - DNA, 14 bp, Homo sapiens
tttcatcctgtgtc

SEQ ID NO: 267894 - DNA, 23 bp, Homo sapiens
tttcatccttttttctcttctgt

SEQ ID NO: 267895 - DNA, 15 bp, Homo sapiens
tttcatggaggggaa

SEQ ID NO: 267896 - DNA, 16 bp, Homo sapiens
tttcatgttttgtgac

SEQ ID NO: 267897 - DNA, 15 bp, Homo sapiens
tttcattggatgcag

SEQ ID NO: 267898 - DNA, 15 bp, Homo sapiens
tttcattgtatgatg

SEQ ID NO: 267899 - DNA, 17 bp, Homo sapiens
tttcattgtatgatgtg

SEQ ID NO: 267900 - DNA, 20 bp, Homo sapiens
tttcattgtatgatgtgttg

SEQ ID NO: 267901 - DNA, 19 bp, Homo sapiens
tttcatttatgatacaaaa

SEQ ID NO: 267902 - DNA, 15 bp, Homo sapiens
tttccaaaaatactt

SEQ ID NO: 267903 - DNA, 14 bp, Homo sapiens
tttccaaaataatt

SEQ ID NO: 267904 - DNA, 15 bp, Homo sapiens
tttccaaataaaatg

SEQ ID NO: 267905 - DNA, 13 bp, Homo sapiens
tttccaaatacat

SEQ ID NO: 267906 - DNA, 14 bp, Homo sapiens
tttccaacacacaa

SEQ ID NO: 267907 - DNA, 22 bp, Homo sapiens
tttccaacaccacagacacaca

SEQ ID NO: 267908 - DNA, 11 bp, Homo sapiens
tttccaagcct

SEQ ID NO: 267909 - DNA, 15 bp, Homo sapiens
tttccacacagcctg

SEQ ID NO: 267910 - DNA, 21 bp, Homo sapiens
tttccagaaagaaaatgaatt

SEQ ID NO: 267911 - DNA, 23 bp, Homo sapiens
tttccagaaagaaaatgaatttg

SEQ ID NO: 267912 - DNA, 21 bp, Homo sapiens
tttccagagtccggaggcagc

SEQ ID NO: 267913 - DNA, 18 bp, Homo sapiens
tttccaggatcctgcagg

SEQ ID NO: 267914 - DNA, 19 bp, Homo sapiens
tttccaggatcctgcagga

SEQ ID NO: 267915 - DNA, 16 bp, Homo sapiens
tttccaggtcagaaac

SEQ ID NO: 267916 - DNA, 15 bp, Homo sapiens
tttccagtacctttg

SEQ ID NO: 267917 - DNA, 19 bp, Homo sapiens
tttccagtattgaaaactt

SEQ ID NO: 267918 - DNA, 20 bp, Homo sapiens
tttccagtattgaaaacttc

SEQ ID NO: 267919 - DNA, 22 bp, Homo sapiens
tttccatagctactatatgcat

SEQ ID NO: 267920 - DNA, 19 bp, Homo sapiens
tttccatgactgcatttta

SEQ ID NO: 267921 - DNA, 20 bp, Homo sapiens
tttccatgactgcattttac

SEQ ID NO: 267922 - DNA, 22 bp, Homo sapiens
tttccatgcagttattagaact

SEQ ID NO: 267923 - DNA, 13 bp, Homo sapiens
tttccatgtatct

SEQ ID NO: 267924 - DNA, 13 bp, Homo sapiens
tttccattattta

SEQ ID NO: 267925 - DNA, 13 bp, Homo sapiens
tttccattccaga

SEQ ID NO: 267926 - DNA, 18 bp, Homo sapiens
tttccattcttttaaatg

SEQ ID NO: 267927 - DNA, 13 bp, Homo sapiens
tttccatttctga

SEQ ID NO: 267928 - DNA, 18 bp, Homo sapiens
tttccatttcttcagagg

SEQ ID NO: 267929 - DNA, 15 bp, Homo sapiens
tttcccacacatatt

SEQ ID NO: 267930 - DNA, 15 bp, Homo sapiens
acctcaacctgtaaa

SEQ ID NO: 267931 - DNA, 21 bp, Homo sapiens
acctcaagggggactgtcttt

SEQ ID NO: 267932 - DNA, 19 bp, Homo sapiens
acctcaatgccctgccatt

SEQ ID NO: 267933 - DNA, 16 bp, Homo sapiens
acctcacaactccttc

SEQ ID NO: 267934 - DNA, 17 bp, Homo sapiens
acctcacaactccttcc

SEQ ID NO: 267935 - DNA, 11 bp, Homo sapiens
acctcaccatt

SEQ ID NO: 267936 - DNA, 19 bp, Homo sapiens
acctcaccattgtgaagca

SEQ ID NO: 267937 - DNA, 22 bp, Homo sapiens
acctcaccattgtgaagcacct

SEQ ID NO: 267938 - DNA, 14 bp, Homo sapiens
acctcactcctgtt

SEQ ID NO: 267939 - DNA, 19 bp, Homo sapiens
acctcactggtgcatttaa

SEQ ID NO: 267940 - DNA, 22 bp, Homo sapiens
acctcactggtgcatttaaaat

SEQ ID NO: 267941 - DNA, 15 bp, Homo sapiens
acctcagagccccgc

SEQ ID NO: 267942 - DNA, 19 bp, Homo sapiens
acctcagagtccaggcccc

SEQ ID NO: 267943 - DNA, 20 bp, Homo sapiens
acctcagagtccaggcccca

SEQ ID NO: 267944 - DNA, 15 bp, Homo sapiens
acctcagcctcctgt

SEQ ID NO: 267945 - DNA, 12 bp, Homo sapiens
acctcagctctg

SEQ ID NO: 267946 - DNA, 17 bp, Homo sapiens
acctcagctctgggaga

SEQ ID NO: 267947 - DNA, 18 bp, Homo sapiens
acctcagctctgggagag

SEQ ID NO: 267948 - DNA, 13 bp, Homo sapiens
acctcagctgcac

SEQ ID NO: 267949 - DNA, 17 bp, Homo sapiens
acctcagctgcacattc

SEQ ID NO: 267950 - DNA, 22 bp, Homo sapiens
acctcagctgcacattcctggc

SEQ ID NO: 267951 - DNA, 23 bp, Homo sapiens
acctcagctgcacattcctggcc

SEQ ID NO: 267952 - DNA, 20 bp, Homo sapiens
acctcagttcccttggcctc

SEQ ID NO: 267953 - DNA, 15 bp, Homo sapiens
acctcagtttctgtt

SEQ ID NO: 267954 - DNA, 18 bp, Homo sapiens
acctcagttttatcattt

SEQ ID NO: 267955 - DNA, 14 bp, Homo sapiens
acctcatcaggatg

SEQ ID NO: 267956 - DNA, 15 bp, Homo sapiens
acctcatcaggatga

SEQ ID NO: 267957 - DNA, 15 bp, Homo sapiens
acctcatgtcatttc

SEQ ID NO: 267958 - DNA, 13 bp, Homo sapiens
acctcatttgcat

SEQ ID NO: 267959 - DNA, 12 bp, Homo sapiens
acctccacccac

SEQ ID NO: 267960 - DNA, 22 bp, Homo sapiens
acctccacccactgtccgcctc

SEQ ID NO: 267961 - DNA, 15 bp, Homo sapiens
acctccacccagccc

SEQ ID NO: 267962 - DNA, 16 bp, Homo sapiens
acctccacccagcccc

SEQ ID NO: 267963 - DNA, 17 bp, Homo sapiens
acctccacccagcccct

SEQ ID NO: 267964 - DNA, 17 bp, Homo sapiens
acctccacccccaagaa

SEQ ID NO: 267965 - DNA, 20 bp, Homo sapiens
acctccacccccaagaaacc

SEQ ID NO: 267966 - DNA, 21 bp, Homo sapiens
acctccacccccaagaaacct

SEQ ID NO: 267967 - DNA, 16 bp, Homo sapiens
acctccagcccacagt

SEQ ID NO: 267968 - DNA, 23 bp, Homo sapiens
acctccagcccacagtgctcagt

SEQ ID NO: 267969 - DNA, 13 bp, Homo sapiens
acctccagctgtt

SEQ ID NO: 267970 - DNA, 18 bp, Homo sapiens
acctccagtccccctatc

SEQ ID NO: 267971 - DNA, 16 bp, Homo sapiens
taacccttgaatttct

SEQ ID NO: 267972 - DNA, 20 bp, Homo sapiens
taaccgagccagcagctgaa

SEQ ID NO: 267973 - DNA, 20 bp, Homo sapiens
taacctatatgatttatagt

SEQ ID NO: 267974 - DNA, 22 bp, Homo sapiens
taacctatatgatttatagttt

SEQ ID NO: 267975 - DNA, 12 bp, Homo sapiens
taacctattttt

SEQ ID NO: 267976 - DNA, 13 bp, Homo sapiens
taacctcagctct

SEQ ID NO: 267977 - DNA, 15 bp, Homo sapiens
taacctcagctctgg

SEQ ID NO: 267978 - DNA, 16 bp, Homo sapiens
taacctcagctctggg

SEQ ID NO: 267979 - DNA, 17 bp, Homo sapiens
taacctctatatcttta

SEQ ID NO: 267980 - DNA, 17 bp, Homo sapiens
taacctcttttctgcat

SEQ ID NO: 267981 - DNA, 12 bp, Homo sapiens
taacctggtgct

SEQ ID NO: 267982 - DNA, 22 bp, Homo sapiens
taacctggtgctggatattttc

SEQ ID NO: 267983 - DNA, 23 bp, Homo sapiens
taacctggtgctggatattttca

SEQ ID NO: 267984 - DNA, 20 bp, Homo sapiens
taacctttttgtaaatactg

SEQ ID NO: 267985 - DNA, 14 bp, Homo sapiens
taacgacttcaggg

SEQ ID NO: 267986 - DNA, 13 bp, Homo sapiens
taacgcaggagag

SEQ ID NO: 267987 - DNA, 17 bp, Homo sapiens
taacgccctatttttgc

SEQ ID NO: 267988 - DNA, 16 bp, Homo sapiens
taacgcgtcttcctga

SEQ ID NO: 267989 - DNA, 19 bp, Homo sapiens
taactaccaggaataatga

SEQ ID NO: 267990 - DNA, 17 bp, Homo sapiens
taactacctttggctta

SEQ ID NO: 267991 - DNA, 21 bp, Homo sapiens
taactacctttggcttaattc

SEQ ID NO: 267992 - DNA, 15 bp, Homo sapiens
taactactaagaata

SEQ ID NO: 267993 - DNA, 16 bp, Homo sapiens
taactactaagaataa

SEQ ID NO: 267994 - DNA, 22 bp, Homo sapiens
taactactaagaataaataaag

SEQ ID NO: 267995 - DNA, 12 bp, Homo sapiens
taactactgtgt

SEQ ID NO: 267996 - DNA, 16 bp, Homo sapiens
taactactgtgttcct

SEQ ID NO: 267997 - DNA, 22 bp, Homo sapiens
taactagtcctgcagaggattt

SEQ ID NO: 267998 - DNA, 19 bp, Homo sapiens
taactagtgtttctgcaga

SEQ ID NO: 267999 - DNA, 21 bp, Homo sapiens
taactagtgtttctgcagagg

SEQ ID NO: 268000 - DNA, 15 bp, Homo sapiens
taactcatcataaaa

SEQ ID NO: 268001 - DNA, 14 bp, Homo sapiens
taactcatctgtta

SEQ ID NO: 268002 - DNA, 16 bp, Homo sapiens
taactccctagttacc

SEQ ID NO: 268003 - DNA, 20 bp, Homo sapiens
taactccctagttacccacc

SEQ ID NO: 268004 - DNA, 15 bp, Homo sapiens
taactctcgggacct

SEQ ID NO: 268005 - DNA, 21 bp, Homo sapiens
taactctgcactactcctctg

SEQ ID NO: 268006 - DNA, 20 bp, Homo sapiens
taactctgcatagacaaagg

SEQ ID NO: 268007 - DNA, 22 bp, Homo sapiens
taactctgcatagacaaaggcc

SEQ ID NO: 268008 - DNA, 13 bp, Homo sapiens
taactgaaaatgt

SEQ ID NO: 268009 - DNA, 15 bp, Homo sapiens
taactgaaaatgtaa

SEQ ID NO: 268010 - DNA, 13 bp, Homo sapiens
taactgaagcaaa

SEQ ID NO: 268011 - DNA, 14 bp, Homo sapiens
taactgaagcaaat

SEQ ID NO: 268012 - DNA, 15 bp, Homo sapiens
taactgaagcaaata

SEQ ID NO: 268013 - DNA, 16 bp, Homo sapiens
taactgaagcaaatac

SEQ ID NO: 268014 - DNA, 22 bp, Homo sapiens
taactgaagcaaataccaaagc

SEQ ID NO: 268015 - DNA, 18 bp, Homo sapiens
taactgacttaacaactg

SEQ ID NO: 268016 - DNA, 13 bp, Homo sapiens
taactgcattcta

SEQ ID NO: 268017 - DNA, 11 bp, Homo sapiens
taactgccagc

SEQ ID NO: 268018 - DNA, 11 bp, Homo sapiens
taactgccctt

SEQ ID NO: 268019 - DNA, 14 bp, Homo sapiens
taactgcctaccag

SEQ ID NO: 268020 - DNA, 16 bp, Homo sapiens
taactgcctaccagtc

SEQ ID NO: 268021 - DNA, 15 bp, Homo sapiens
taactgctgagccac

SEQ ID NO: 268022 - DNA, 12 bp, Homo sapiens
taactggcccca

SEQ ID NO: 268023 - DNA, 14 bp, Homo sapiens
taactggccccagg

SEQ ID NO: 268024 - DNA, 21 bp, Homo sapiens
taactggcttctgcttgtcat

SEQ ID NO: 268025 - DNA, 22 bp, Homo sapiens
taactggcttctgcttgtcatc

SEQ ID NO: 268026 - DNA, 13 bp, Homo sapiens
taactggtataga

SEQ ID NO: 268027 - DNA, 17 bp, Homo sapiens
taactgtgaataataaa

SEQ ID NO: 268028 - DNA, 14 bp, Homo sapiens
taactgtgcagaga

SEQ ID NO: 268029 - DNA, 11 bp, Homo sapiens
taactgtgtat

SEQ ID NO: 268030 - DNA, 19 bp, Homo sapiens
taactgtgtgaagaaatgg

SEQ ID NO: 268031 - DNA, 20 bp, Homo sapiens
taactgtgtgaagaaatgga

SEQ ID NO: 268032 - DNA, 13 bp, Homo sapiens
taacttattgcct

SEQ ID NO: 268033 - DNA, 12 bp, Homo sapiens
taacttcacctt

SEQ ID NO: 268034 - DNA, 19 bp, Homo sapiens
taacttcagagaagtcagt

SEQ ID NO: 268035 - DNA, 20 bp, Homo sapiens
taacttcagagaagtcagtt

SEQ ID NO: 268036 - DNA, 14 bp, Homo sapiens
taacttcagtcact

SEQ ID NO: 268037 - DNA, 16 bp, Homo sapiens
taacttccagtggctg

SEQ ID NO: 268038 - DNA, 18 bp, Homo sapiens
taacttctagttgctctt

SEQ ID NO: 268039 - DNA, 13 bp, Homo sapiens
taacttctgcctg

SEQ ID NO: 268040 - DNA, 18 bp, Homo sapiens
taacttcttaaaagttgt

SEQ ID NO: 268041 - DNA, 14 bp, Homo sapiens
taacttgctgtgaa

SEQ ID NO: 268042 - DNA, 20 bp, Homo sapiens
taacttgctgtgaaatgact

SEQ ID NO: 268043 - DNA, 13 bp, Homo sapiens
taacttggggagg

SEQ ID NO: 268044 - DNA, 21 bp, Homo sapiens
taacttgtgtattagatatca

SEQ ID NO: 268045 - DNA, 15 bp, Homo sapiens
taactttatcacatt

SEQ ID NO: 268046 - DNA, 14 bp, Homo sapiens
taactttgcatgtt

SEQ ID NO: 268047 - DNA, 15 bp, Homo sapiens
taactttgcatgttc

SEQ ID NO: 268048 - DNA, 15 bp, Homo sapiens
taacttttattatct

SEQ ID NO: 268049 - DNA, 16 bp, Homo sapiens
taacttttgtgtgaaa

SEQ ID NO: 268050 - DNA, 15 bp, Homo sapiens
taagaaaaaaataat

SEQ ID NO: 268051 - DNA, 19 bp, Homo sapiens
taagaaaaacaaaatgtta

SEQ ID NO: 268052 - DNA, 15 bp, Homo sapiens
taagaaaaacatgtc

SEQ ID NO: 268053 - DNA, 16 bp, Homo sapiens
taagaaaaacatgtca

SEQ ID NO: 268054 - DNA, 17 bp, Homo sapiens
taagaaaaacatgtcat

SEQ ID NO: 268055 - DNA, 19 bp, Homo sapiens
taagaaaaacatgtcatgt

SEQ ID NO: 268056 - DNA, 16 bp, Homo sapiens
taagaaaacaatcaca

SEQ ID NO: 268057 - DNA, 20 bp, Homo sapiens
taagaaaacaatcacactca

SEQ ID NO: 268058 - DNA, 14 bp, Homo sapiens
taagaaaacatgta

SEQ ID NO: 268059 - DNA, 17 bp, Homo sapiens
taagaaaatacaataaa

SEQ ID NO: 268060 - DNA, 21 bp, Homo sapiens
taagaaacacagggttttgta

SEQ ID NO: 268061 - DNA, 12 bp, Homo sapiens
taagaaacagag

SEQ ID NO: 268062 - DNA, 19 bp, Homo sapiens
taagaaacatgatgtgaga

SEQ ID NO: 268063 - DNA, 13 bp, Homo sapiens
taagaaagctata

SEQ ID NO: 268064 - DNA, 19 bp, Homo sapiens
taagaaagctatatatgaa

SEQ ID NO: 268065 - DNA, 20 bp, Homo sapiens
taagaaatggctttccacat

SEQ ID NO: 268066 - DNA, 22 bp, Homo sapiens
taagaaccttttgagtgcctta

SEQ ID NO: 268067 - DNA, 14 bp, Homo sapiens
taagaagagactgg

SEQ ID NO: 268068 - DNA, 21 bp, Homo sapiens
taagaagagtttttattacaa

SEQ ID NO: 268069 - DNA, 21 bp, Homo sapiens
taagaagtacaataagcagag

SEQ ID NO: 268070 - DNA, 12 bp, Homo sapiens
taagaatagtct

SEQ ID NO: 268071 - DNA, 16 bp, Homo sapiens
taagaatccaaagtgg

SEQ ID NO: 268072 - DNA, 21 bp, Homo sapiens
taagaatgctggttttcctaa

SEQ ID NO: 268073 - DNA, 14 bp, Homo sapiens
taagacaaatggga

SEQ ID NO: 268074 - DNA, 16 bp, Homo sapiens
taagacaaatgggact

SEQ ID NO: 268075 - DNA, 22 bp, Homo sapiens
taagacaaatgggactgatgtc

SEQ ID NO: 268076 - DNA, 16 bp, Homo sapiens
taagacaacaggcatt

SEQ ID NO: 268077 - DNA, 17 bp, Homo sapiens
taagacaacaggcattt

SEQ ID NO: 268078 - DNA, 18 bp, Homo sapiens
taagacacacagcctttc

SEQ ID NO: 268079 - DNA, 19 bp, Homo sapiens
taagacacacagcctttct

SEQ ID NO: 268080 - DNA, 19 bp, Homo sapiens
taagacagtcccatcaaaa

SEQ ID NO: 268081 - DNA, 13 bp, Homo sapiens
tttggacaaggaa

SEQ ID NO: 268082 - DNA, 16 bp, Homo sapiens
tttggacgtgtgagga

SEQ ID NO: 268083 - DNA, 14 bp, Homo sapiens
tttggaggtgctta

SEQ ID NO: 268084 - DNA, 21 bp, Homo sapiens
tttggagtcagtaggtccaag

SEQ ID NO: 268085 - DNA, 20 bp, Homo sapiens
tttggatataggtcagtgag

SEQ ID NO: 268086 - DNA, 22 bp, Homo sapiens
tttggattggatgaattccaaa

SEQ ID NO: 268087 - DNA, 22 bp, Homo sapiens
tttggcaggggcagaaaactct

SEQ ID NO: 268088 - DNA, 21 bp, Homo sapiens
tttggcattatctctttctct

SEQ ID NO: 268089 - DNA, 12 bp, Homo sapiens
tttggcccccga

SEQ ID NO: 268090 - DNA, 20 bp, Homo sapiens
tttggcccccgagctggggg

SEQ ID NO: 268091 - DNA, 21 bp, Homo sapiens
tttggcccccgagctgggggc

SEQ ID NO: 268092 - DNA, 12 bp, Homo sapiens
tttggcctgcct

SEQ ID NO: 268093 - DNA, 17 bp, Homo sapiens
tttggcgctattacaaa

SEQ ID NO: 268094 - DNA, 19 bp, Homo sapiens
tttggcgggccaaggactg

SEQ ID NO: 268095 - DNA, 18 bp, Homo sapiens
tttggctcactgcagcct

SEQ ID NO: 268096 - DNA, 15 bp, Homo sapiens
tttggctctttcaga

SEQ ID NO: 268097 - DNA, 14 bp, Homo sapiens
tttggctgaaatta

SEQ ID NO: 268098 - DNA, 17 bp, Homo sapiens
tttggcttcagaattgt

SEQ ID NO: 268099 - DNA, 20 bp, Homo sapiens
tttgggaagcaacaaagagc

SEQ ID NO: 268100 - DNA, 14 bp, Homo sapiens
tttgggagctctgc

SEQ ID NO: 268101 - DNA, 17 bp, Homo sapiens
tttgggaggccaaggca

SEQ ID NO: 268102 - DNA, 16 bp, Homo sapiens
taataaaatatcattc

SEQ ID NO: 268103 - DNA, 17 bp, Homo sapiens
taataaaatatcattca

SEQ ID NO: 268104 - DNA, 18 bp, Homo sapiens
taataaaatatcattcag

SEQ ID NO: 268105 - DNA, 20 bp, Homo sapiens
taataaaatatcattcagca

SEQ ID NO: 268106 - DNA, 13 bp, Homo sapiens
taataaactgttt

SEQ ID NO: 268107 - DNA, 23 bp, Homo sapiens
taataaacttagaataaaattgt

SEQ ID NO: 268108 - DNA, 22 bp, Homo sapiens
taataaagtattccaccttaaa

SEQ ID NO: 268109 - DNA, 14 bp, Homo sapiens
taataaatacacaa

SEQ ID NO: 268110 - DNA, 15 bp, Homo sapiens
taataaatatttatg

SEQ ID NO: 268111 - DNA, 16 bp, Homo sapiens
taataaatatttatgt

SEQ ID NO: 268112 - DNA, 19 bp, Homo sapiens
taataaatatttttgccat

SEQ ID NO: 268113 - DNA, 18 bp, Homo sapiens
taataaatgaccagttta

SEQ ID NO: 268114 - DNA, 11 bp, Homo sapiens
taataaatggg

SEQ ID NO: 268115 - DNA, 14 bp, Homo sapiens
taataaattaacat

SEQ ID NO: 268116 - DNA, 19 bp, Homo sapiens
taataaattgaaattgtga

SEQ ID NO: 268117 - DNA, 20 bp, Homo sapiens
taataaattgaaattgtgaa

SEQ ID NO: 268118 - DNA, 19 bp, Homo sapiens
taataagaatggttgcctt

SEQ ID NO: 268119 - DNA, 14 bp, Homo sapiens
taataataatgttt

SEQ ID NO: 268120 - DNA, 17 bp, Homo sapiens
taataatgtcctttccc

SEQ ID NO: 268121 - DNA, 16 bp, Homo sapiens
taataatgttctctgg

SEQ ID NO: 268122 - DNA, 15 bp, Homo sapiens
taataatgtttaata

SEQ ID NO: 268123 - DNA, 15 bp, Homo sapiens
taataatttttgctg

SEQ ID NO: 268124 - DNA, 16 bp, Homo sapiens
taataatttttgctga

SEQ ID NO: 268125 - DNA, 20 bp, Homo sapiens
taatacaaaagggtcttgac

SEQ ID NO: 268126 - DNA, 14 bp, Homo sapiens
taatacctttaaat

SEQ ID NO: 268127 - DNA, 21 bp, Homo sapiens
taatacctttaaatatcattc

SEQ ID NO: 268128 - DNA, 19 bp, Homo sapiens
taatactataaatatattg

SEQ ID NO: 268129 - DNA, 15 bp, Homo sapiens
taatactgaatttct

SEQ ID NO: 268130 - DNA, 17 bp, Homo sapiens
taatacttcatttggtg

SEQ ID NO: 268131 - DNA, 19 bp, Homo sapiens
taatacttcatttggtgct

SEQ ID NO: 268132 - DNA, 19 bp, Homo sapiens
taatagaaaactgaaaatc

SEQ ID NO: 268133 - DNA, 14 bp, Homo sapiens
taatagagtactta

SEQ ID NO: 268134 - DNA, 22 bp, Homo sapiens
taatagagtacttaatatactc

SEQ ID NO: 268135 - DNA, 15 bp, Homo sapiens
taatagataactgct

SEQ ID NO: 268136 - DNA, 21 bp, Homo sapiens
taatagcttttattgtataaa

SEQ ID NO: 268137 - DNA, 14 bp, Homo sapiens
taatagtactatta

SEQ ID NO: 268138 - DNA, 21 bp, Homo sapiens
taatagtgcttaaaaatcatt

SEQ ID NO: 268139 - DNA, 12 bp, Homo sapiens
taatataaatga

SEQ ID NO: 268140 - DNA, 16 bp, Homo sapiens
taatataacaatatat

SEQ ID NO: 268141 - DNA, 18 bp, Homo sapiens
taatatatataatactta

SEQ ID NO: 268142 - DNA, 16 bp, Homo sapiens
taatatatgttttaaa

SEQ ID NO: 268143 - DNA, 12 bp, Homo sapiens
taatatattgaa

SEQ ID NO: 268144 - DNA, 14 bp, Homo sapiens
taatatcattcact

SEQ ID NO: 268145 - DNA, 24 bp, Homo sapiens
taatatcattttattcacatatgt

SEQ ID NO: 268146 - DNA, 15 bp, Homo sapiens
taatatcttgaagaa

SEQ ID NO: 268147 - DNA, 22 bp, Homo sapiens
taatatcttgctggattaatgt

SEQ ID NO: 268148 - DNA, 18 bp, Homo sapiens
taatatctttaaatgatg

SEQ ID NO: 268149 - DNA, 21 bp, Homo sapiens
taatatctttaaatgatgtac

SEQ ID NO: 268150 - DNA, 13 bp, Homo sapiens
taatatctttcag

SEQ ID NO: 268151 - DNA, 14 bp, Homo sapiens
taatatctttcagt

SEQ ID NO: 268152 - DNA, 16 bp, Homo sapiens
taatatggcaaaaatg

SEQ ID NO: 268153 - DNA, 20 bp, Homo sapiens
taatatgttaacctcagtgt

SEQ ID NO: 268154 - DNA, 21 bp, Homo sapiens
taatatgttaacctcagtgtc

SEQ ID NO: 268155 - DNA, 23 bp, Homo sapiens
taatatgttaacctcagtgtcat

SEQ ID NO: 268156 - DNA, 23 bp, Homo sapiens
taatattaccgtggtttatgaac

SEQ ID NO: 268157 - DNA, 12 bp, Homo sapiens
taatattctctg

SEQ ID NO: 268158 - DNA, 12 bp, Homo sapiens
taatatttatgt

SEQ ID NO: 268159 - DNA, 13 bp, Homo sapiens
taatatttattga

SEQ ID NO: 268160 - DNA, 23 bp, Homo sapiens
taatcaaatttgtagggtttcta

SEQ ID NO: 268161 - DNA, 22 bp, Homo sapiens
taatcaatacccttggcactga

SEQ ID NO: 268162 - DNA, 17 bp, Homo sapiens
taatcaatgaatattga

SEQ ID NO: 268163 - DNA, 20 bp, Homo sapiens
taatcaatgaatattgaagt

SEQ ID NO: 268164 - DNA, 18 bp, Homo sapiens
taatcagaaatttttatc

SEQ ID NO: 268165 - DNA, 13 bp, Homo sapiens
taatcagcctctt

SEQ ID NO: 268166 - DNA, 18 bp, Homo sapiens
taatcagtgtgtctaaat

SEQ ID NO: 268167 - DNA, 15 bp, Homo sapiens
taatcatataataaa

SEQ ID NO: 268168 - DNA, 20 bp, Homo sapiens
taatcatataataaatgtac

SEQ ID NO: 268169 - DNA, 18 bp, Homo sapiens
taatcatcttctcttttt

SEQ ID NO: 268170 - DNA, 20 bp, Homo sapiens
taatcatgtgggtgagccag

SEQ ID NO: 268171 - DNA, 19 bp, Homo sapiens
taatcatttatcttatcta

SEQ ID NO: 268172 - DNA, 16 bp, Homo sapiens
taatccatgtgctgct

SEQ ID NO: 268173 - DNA, 20 bp, Homo sapiens
taatccatgtgctgctgtgg

SEQ ID NO: 268174 - DNA, 16 bp, Homo sapiens
taatcccagcactttg

SEQ ID NO: 268175 - DNA, 19 bp, Homo sapiens
taatcccagctacttggga

SEQ ID NO: 268176 - DNA, 17 bp, Homo sapiens
taatcctagctgtgtgc

SEQ ID NO: 268177 - DNA, 16 bp, Homo sapiens
taatctagagctatgc

SEQ ID NO: 268178 - DNA, 23 bp, Homo sapiens
taatctagagctatgcacaccaa

SEQ ID NO: 268179 - DNA, 19 bp, Homo sapiens
taatctattgggttcatta

SEQ ID NO: 268180 - DNA, 20 bp, Homo sapiens
taatctattgggttcattat

SEQ ID NO: 268181 - DNA, 22 bp, Homo sapiens
taatctattgggttcattattg

SEQ ID NO: 268182 - DNA, 23 bp, Homo sapiens
taatctctgattaaatttaatat

SEQ ID NO: 268183 - DNA, 14 bp, Homo sapiens
taatctcttattct

SEQ ID NO: 268184 - DNA, 15 bp, Homo sapiens
taatctcttattcta

SEQ ID NO: 268185 - DNA, 20 bp, Homo sapiens
taatctgaggatgagacagg

SEQ ID NO: 268186 - DNA, 22 bp, Homo sapiens
taatctgctttgttaatgaaaa

SEQ ID NO: 268187 - DNA, 19 bp, Homo sapiens
taatctggactcctctgtc

SEQ ID NO: 268188 - DNA, 15 bp, Homo sapiens
taatctgtaaatgaa

SEQ ID NO: 268189 - DNA, 14 bp, Homo sapiens
taatctgttgtttg

SEQ ID NO: 268190 - DNA, 22 bp, Homo sapiens
taatcttagaacagatggctgt

SEQ ID NO: 268191 - DNA, 13 bp, Homo sapiens
taatcttcagttt

SEQ ID NO: 268192 - DNA, 18 bp, Homo sapiens
taatcttctctcttgatt

SEQ ID NO: 268193 - DNA, 15 bp, Homo sapiens
taatctttattttat

SEQ ID NO: 268194 - DNA, 18 bp, Homo sapiens
taatctttattttattat

SEQ ID NO: 268195 - DNA, 16 bp, Homo sapiens
taatgaactgtgacag

SEQ ID NO: 268196 - DNA, 17 bp, Homo sapiens
taatgaactgtgacagg

SEQ ID NO: 268197 - DNA, 20 bp, Homo sapiens
taatgaaggtgtgctacaga

SEQ ID NO: 268198 - DNA, 16 bp, Homo sapiens
taatgaatttttatga

SEQ ID NO: 268199 - DNA, 17 bp, Homo sapiens
taatgacagagagttct

SEQ ID NO: 268200 - DNA, 22 bp, Homo sapiens
taatgacagagagttctggtga

SEQ ID NO: 268201 - DNA, 20 bp, Homo sapiens
taatgaccacacctgcctct

SEQ ID NO: 268202 - DNA, 13 bp, Homo sapiens
taatgaggaaact

SEQ ID NO: 268203 - DNA, 19 bp, Homo sapiens
taatgaggtggtactatga

SEQ ID NO: 268204 - DNA, 21 bp, Homo sapiens
taatgaggtggtactatgatt

SEQ ID NO: 268205 - DNA, 15 bp, Homo sapiens
taatgagtaatgcag

SEQ ID NO: 268206 - DNA, 24 bp, Homo sapiens
taatgatactgtctaagaataatg

SEQ ID NO: 268207 - DNA, 19 bp, Homo sapiens
taatgatttaagcatttta

SEQ ID NO: 268208 - DNA, 20 bp, Homo sapiens
taatgcagacatttacatgt

SEQ ID NO: 268209 - DNA, 20 bp, Homo sapiens
taatgcatgtggtatgagta

SEQ ID NO: 268210 - DNA, 13 bp, Homo sapiens
taatgctccttgt

SEQ ID NO: 268211 - DNA, 23 bp, Homo sapiens
taatgctgcacaccagttactgt

SEQ ID NO: 268212 - DNA, 16 bp, Homo sapiens
taatgcttaatttcta

SEQ ID NO: 268213 - DNA, 16 bp, Homo sapiens
taatgcttcaagtgtt

SEQ ID NO: 268214 - DNA, 23 bp, Homo sapiens
taatgcttcaagtgttgctcttg

SEQ ID NO: 268215 - DNA, 19 bp, Homo sapiens
taatgcttgtttatgatat

SEQ ID NO: 268216 - DNA, 16 bp, Homo sapiens
taatgcttttactaag

SEQ ID NO: 268217 - DNA, 21 bp, Homo sapiens
taatggcccctccatttattt

SEQ ID NO: 268218 - DNA, 16 bp, Homo sapiens
taatggtttactgctg

SEQ ID NO: 268219 - DNA, 17 bp, Homo sapiens
taatggtttactgctgt

SEQ ID NO: 268220 - DNA, 17 bp, Homo sapiens
taatgtaaaattcatag

SEQ ID NO: 268221 - DNA, 18 bp, Homo sapiens
taatgtaataactgtgaa

SEQ ID NO: 268222 - DNA, 15 bp, Homo sapiens
taatgtaatcattta

SEQ ID NO: 268223 - DNA, 21 bp, Homo sapiens
taatgtaatgaggtggtacta

SEQ ID NO: 268224 - DNA, 15 bp, Homo sapiens
taatgtacaagtttt

SEQ ID NO: 268225 - DNA, 19 bp, Homo sapiens
taatgtacaagttttgtat

SEQ ID NO: 268226 - DNA, 21 bp, Homo sapiens
taatgtagacattatcttttg

SEQ ID NO: 268227 - DNA, 16 bp, Homo sapiens
ttttcagtaccaaaga

SEQ ID NO: 268228 - DNA, 23 bp, Homo sapiens
ttttcagtaccaaagaaacacca

SEQ ID NO: 268229 - DNA, 23 bp, Homo sapiens
ttttcagtagggctacaaaacct

SEQ ID NO: 268230 - DNA, 18 bp, Homo sapiens
ttttcagtatactgtgtg

SEQ ID NO: 268231 - DNA, 15 bp, Homo sapiens
tccctcatggctctg

SEQ ID NO: 268232 - DNA, 12 bp, Homo sapiens
tccctccacacc

SEQ ID NO: 268233 - DNA, 23 bp, Homo sapiens
tccctccaccccagtccccggga

SEQ ID NO: 268234 - DNA, 19 bp, Homo sapiens
tccctccacgttcacccct

SEQ ID NO: 268235 - DNA, 14 bp, Homo sapiens
tccctccactcctc

SEQ ID NO: 268236 - DNA, 18 bp, Homo sapiens
tccctccatggcaggaag

SEQ ID NO: 268237 - DNA, 13 bp, Homo sapiens
tccctccccagtg

SEQ ID NO: 268238 - DNA, 16 bp, Homo sapiens
tccctccccagtgttt

SEQ ID NO: 268239 - DNA, 18 bp, Homo sapiens
tccctccccctgcccctt

SEQ ID NO: 268240 - DNA, 13 bp, Homo sapiens
tccctcccctgcc

SEQ ID NO: 268241 - DNA, 14 bp, Homo sapiens
tccctcccctgccc

SEQ ID NO: 268242 - DNA, 16 bp, Homo sapiens
tccctcccctgccctg

SEQ ID NO: 268243 - DNA, 14 bp, Homo sapiens
tccctccctccaca

SEQ ID NO: 268244 - DNA, 14 bp, Homo sapiens
tccctccctcctgg

SEQ ID NO: 268245 - DNA, 13 bp, Homo sapiens
tccctccctgcag

SEQ ID NO: 268246 - DNA, 15 bp, Homo sapiens
tccctccctgcaggg

SEQ ID NO: 268247 - DNA, 17 bp, Homo sapiens
tccctccgactccagat

SEQ ID NO: 268248 - DNA, 15 bp, Homo sapiens
tccctccgggcaggg

SEQ ID NO: 268249 - DNA, 14 bp, Homo sapiens
tccctcctcacctc

SEQ ID NO: 268250 - DNA, 17 bp, Homo sapiens
tccctcctcacctctgg

SEQ ID NO: 268251 - DNA, 18 bp, Homo sapiens
tccctcctcacctctgga

SEQ ID NO: 268252 - DNA, 17 bp, Homo sapiens
tccctcctgacaaatat

SEQ ID NO: 268253 - DNA, 15 bp, Homo sapiens
tccctcctgcaggct

SEQ ID NO: 268254 - DNA, 16 bp, Homo sapiens
tccctcctggctcaca

SEQ ID NO: 268255 - DNA, 22 bp, Homo sapiens
tccctcctggctcacagccacc

SEQ ID NO: 268256 - DNA, 17 bp, Homo sapiens
tccctcgaacccacact

SEQ ID NO: 268257 - DNA, 24 bp, Homo sapiens
tccctcggaagccgtctgactcca

SEQ ID NO: 268258 - DNA, 15 bp, Homo sapiens
tccctcggccccacc

SEQ ID NO: 268259 - DNA, 17 bp, Homo sapiens
tccctcggccccaccca

SEQ ID NO: 268260 - DNA, 23 bp, Homo sapiens
tccctcggtcacctgtgctacct

SEQ ID NO: 268261 - DNA, 18 bp, Homo sapiens
tccctcggtcagcaccgt

SEQ ID NO: 268262 - DNA, 19 bp, Homo sapiens
tccctcgtccacaggggca

SEQ ID NO: 268263 - DNA, 20 bp, Homo sapiens
tccctcgtccacaggggcag

SEQ ID NO: 268264 - DNA, 14 bp, Homo sapiens
tccctctaatttat

SEQ ID NO: 268265 - DNA, 16 bp, Homo sapiens
tccctctaatttatct

SEQ ID NO: 268266 - DNA, 17 bp, Homo sapiens
tccctctcccaggcccg

SEQ ID NO: 268267 - DNA, 12 bp, Homo sapiens
tccctctccctg

SEQ ID NO: 268268 - DNA, 12 bp, Homo sapiens
tccctctcctgc

SEQ ID NO: 268269 - DNA, 19 bp, Homo sapiens
tccctctcttccgggagct

SEQ ID NO: 268270 - DNA, 21 bp, Homo sapiens
tccctctcttccgggagctgg

SEQ ID NO: 268271 - DNA, 15 bp, Homo sapiens
tccctctgctcctgg

SEQ ID NO: 268272 - DNA, 13 bp, Homo sapiens
tccctctgctctc

SEQ ID NO: 268273 - DNA, 13 bp, Homo sapiens
tccctcttcccag

SEQ ID NO: 268274 - DNA, 15 bp, Homo sapiens
tccctcttcccagca

SEQ ID NO: 268275 - DNA, 16 bp, Homo sapiens
tccctcttcccagcac

SEQ ID NO: 268276 - DNA, 13 bp, Homo sapiens
tccctcttccctg

SEQ ID NO: 268277 - DNA, 19 bp, Homo sapiens
tccctcttctcaagtgcct

SEQ ID NO: 268278 - DNA, 15 bp, Homo sapiens
tccctctttcctgtg

SEQ ID NO: 268279 - DNA, 16 bp, Homo sapiens
tccctctttcctgtgc

SEQ ID NO: 268280 - DNA, 17 bp, Homo sapiens
tccctctttcctgtgcc

SEQ ID NO: 268281 - DNA, 16 bp, Homo sapiens
tccctgaagtcttgca

SEQ ID NO: 268282 - DNA, 21 bp, Homo sapiens
tccctgacctccctctaattt

SEQ ID NO: 268283 - DNA, 15 bp, Homo sapiens
tccctgacttcccag

SEQ ID NO: 268284 - DNA, 18 bp, Homo sapiens
tccctgacttcccagctg

SEQ ID NO: 268285 - DNA, 14 bp, Homo sapiens
tccctgacttgctt

SEQ ID NO: 268286 - DNA, 20 bp, Homo sapiens
tccctgagagtgtctctgat

SEQ ID NO: 268287 - DNA, 12 bp, Homo sapiens
tccctgagcctg

SEQ ID NO: 268288 - DNA, 20 bp, Homo sapiens
tccctgagcctgccccagct

SEQ ID NO: 268289 - DNA, 15 bp, Homo sapiens
tccctgcaccctgga

SEQ ID NO: 268290 - DNA, 15 bp, Homo sapiens
tccctgcagggtagg

SEQ ID NO: 268291 - DNA, 22 bp, Homo sapiens
tccctgcagggtagggggcctg

SEQ ID NO: 268292 - DNA, 13 bp, Homo sapiens
tccctgccaactc

SEQ ID NO: 268293 - DNA, 15 bp, Homo sapiens
tccctgccaactcca

SEQ ID NO: 268294 - DNA, 17 bp, Homo sapiens
tccctgccccctcccct

SEQ ID NO: 268295 - DNA, 18 bp, Homo sapiens
tccctgccccgcccccca

SEQ ID NO: 268296 - DNA, 18 bp, Homo sapiens
tccctgcccctcccttca

SEQ ID NO: 268297 - DNA, 12 bp, Homo sapiens
tccctgcctcac

SEQ ID NO: 268298 - DNA, 17 bp, Homo sapiens
tccctgcctcacatctc

SEQ ID NO: 268299 - DNA, 23 bp, Homo sapiens
tccctgcctcacctctgccattt

SEQ ID NO: 268300 - DNA, 19 bp, Homo sapiens
tccctgcctgctccttggc

SEQ ID NO: 268301 - DNA, 12 bp, Homo sapiens
tccctgctggcc

SEQ ID NO: 268302 - DNA, 14 bp, Homo sapiens
tccctgctggccaa

SEQ ID NO: 268303 - DNA, 19 bp, Homo sapiens
tccctgctgtcgtcttagc

SEQ ID NO: 268304 - DNA, 12 bp, Homo sapiens
tccctgcttatc

SEQ ID NO: 268305 - DNA, 20 bp, Homo sapiens
tccctgcttatctgaaactt

SEQ ID NO: 268306 - DNA, 22 bp, Homo sapiens
tccctgcttatctgaaacttcc

SEQ ID NO: 268307 - DNA, 20 bp, Homo sapiens
tccctgcttcacgattctta

SEQ ID NO: 268308 - DNA, 20 bp, Homo sapiens
tccctgcttcatatctctcc

SEQ ID NO: 268309 - DNA, 19 bp, Homo sapiens
tccctgcttgcccgctccc

SEQ ID NO: 268310 - DNA, 11 bp, Homo sapiens
tccctggagac

SEQ ID NO: 268311 - DNA, 21 bp, Homo sapiens
tccctggagcctccactgcct

SEQ ID NO: 268312 - DNA, 13 bp, Homo sapiens
tccctggagctgt

SEQ ID NO: 268313 - DNA, 16 bp, Homo sapiens
tccctggagtcagttt

SEQ ID NO: 268314 - DNA, 16 bp, Homo sapiens
tccctggccatctctg

SEQ ID NO: 268315 - DNA, 21 bp, Homo sapiens
agaatggtgggctccagagta

SEQ ID NO: 268316 - DNA, 23 bp, Homo sapiens
agaatggtttttgttgagtctct

SEQ ID NO: 268317 - DNA, 14 bp, Homo sapiens
agaatgtaagaaaa

SEQ ID NO: 268318 - DNA, 15 bp, Homo sapiens
agaatgtaagaaaac

SEQ ID NO: 268319 - DNA, 16 bp, Homo sapiens
agaatgtacacagttt

SEQ ID NO: 268320 - DNA, 18 bp, Homo sapiens
agaatgtcatttgctaat

SEQ ID NO: 268321 - DNA, 16 bp, Homo sapiens
agaatgtgcagtgtct

SEQ ID NO: 268322 - DNA, 20 bp, Homo sapiens
agaatgtgcagtgtcttgta

SEQ ID NO: 268323 - DNA, 23 bp, Homo sapiens
agaatgttactttggaatgacta

SEQ ID NO: 268324 - DNA, 21 bp, Homo sapiens
agaatgttatccaactattaa

SEQ ID NO: 268325 - DNA, 23 bp, Homo sapiens
agaatgttgaaactgacttgctg

SEQ ID NO: 268326 - DNA, 19 bp, Homo sapiens
agaatgttgaatacttata

SEQ ID NO: 268327 - DNA, 19 bp, Homo sapiens
agaatgttgtattcagtga

SEQ ID NO: 268328 - DNA, 13 bp, Homo sapiens
agaattatatagg

SEQ ID NO: 268329 - DNA, 17 bp, Homo sapiens
agaattatttttgtgtt

SEQ ID NO: 268330 - DNA, 17 bp, Homo sapiens
agaattctcttatccaa

SEQ ID NO: 268331 - DNA, 10 bp, Homo sapiens
agaattgaga

SEQ ID NO: 268332 - DNA, 21 bp, Homo sapiens
agaattgatcattttcccccc

SEQ ID NO: 268333 - DNA, 22 bp, Homo sapiens
agaattgatcattttcccccca

SEQ ID NO: 268334 - DNA, 15 bp, Homo sapiens
agaattgatttccaa

SEQ ID NO: 268335 - DNA, 17 bp, Homo sapiens
agaattgtttttgaatt

SEQ ID NO: 268336 - DNA, 21 bp, Homo sapiens
agaatttatcacacttctgtg

SEQ ID NO: 268337 - DNA, 14 bp, Homo sapiens
agaatttattcaat

SEQ ID NO: 268338 - DNA, 21 bp, Homo sapiens
agaatttattcaattcctctg

SEQ ID NO: 268339 - DNA, 14 bp, Homo sapiens
agaatttcaatttg

SEQ ID NO: 268340 - DNA, 20 bp, Homo sapiens
agaatttcaatttgttcagt

SEQ ID NO: 268341 - DNA, 14 bp, Homo sapiens
agaatttgttcttg

SEQ ID NO: 268342 - DNA, 17 bp, Homo sapiens
agaattttaaaaaagat

SEQ ID NO: 268343 - DNA, 18 bp, Homo sapiens
agaattttaaaaaagatg

SEQ ID NO: 268344 - DNA, 21 bp, Homo sapiens
agaattttatttataaatgag

SEQ ID NO: 268345 - DNA, 19 bp, Homo sapiens
agacaaaaaactatatgta

SEQ ID NO: 268346 - DNA, 18 bp, Homo sapiens
agacaaaaagaacaaaaa

SEQ ID NO: 268347 - DNA, 12 bp, Homo sapiens
agacaaaaatta

SEQ ID NO: 268348 - DNA, 21 bp, Homo sapiens
agacaaaaattatctatttgt

SEQ ID NO: 268349 - DNA, 13 bp, Homo sapiens
agacaaaatttta

SEQ ID NO: 268350 - DNA, 15 bp, Homo sapiens
agacaaagaaggaaa

SEQ ID NO: 268351 - DNA, 15 bp, Homo sapiens
agacaaagcaggagt

SEQ ID NO: 268352 - DNA, 18 bp, Homo sapiens
agacaaagcaggagtgga

SEQ ID NO: 268353 - DNA, 14 bp, Homo sapiens
agacaaaggcccag

SEQ ID NO: 268354 - DNA, 13 bp, Homo sapiens
agacaaataacta

SEQ ID NO: 268355 - DNA, 23 bp, Homo sapiens
agacaaatctttaagaatagttc

SEQ ID NO: 268356 - DNA, 18 bp, Homo sapiens
agacaaatgctgcgccct

SEQ ID NO: 268357 - DNA, 16 bp, Homo sapiens
agacaaatgggactga

SEQ ID NO: 268358 - DNA, 19 bp, Homo sapiens
agacaaatgggactgatgt

SEQ ID NO: 268359 - DNA, 13 bp, Homo sapiens
agacaacacacac

SEQ ID NO: 268360 - DNA, 15 bp, Homo sapiens
agacaacaggcattt

SEQ ID NO: 268361 - DNA, 20 bp, Homo sapiens
agacaaccctgcaaaggact

SEQ ID NO: 268362 - DNA, 15 bp, Homo sapiens
agacaagaagcaaat

SEQ ID NO: 268363 - DNA, 14 bp, Homo sapiens
agacaagcaacagg

SEQ ID NO: 268364 - DNA, 14 bp, Homo sapiens
agacaagccctggc

SEQ ID NO: 268365 - DNA, 17 bp, Homo sapiens
agacaagccctggcaac

SEQ ID NO: 268366 - DNA, 13 bp, Homo sapiens
agacaaggagagc

SEQ ID NO: 268367 - DNA, 16 bp, Homo sapiens
agacaaggtagccctg

SEQ ID NO: 268368 - DNA, 17 bp, Homo sapiens
agacaaggttgctgttg

SEQ ID NO: 268369 - DNA, 22 bp, Homo sapiens
agacaatgcagatgccagagca

SEQ ID NO: 268370 - DNA, 21 bp, Homo sapiens
agacaatgtggaattacataa

SEQ ID NO: 268371 - DNA, 14 bp, Homo sapiens
agacacaactattt

SEQ ID NO: 268372 - DNA, 13 bp, Homo sapiens
agacacacaacat

SEQ ID NO: 268373 - DNA, 10 bp, Homo sapiens
agacacacac

SEQ ID NO: 268374 - DNA, 14 bp, Homo sapiens
agacacacacacgc

SEQ ID NO: 268375 - DNA, 21 bp, Homo sapiens
agacacacacacgcacgcaca

SEQ ID NO: 268376 - DNA, 23 bp, Homo sapiens
agacacacacacgcacgcacaca

SEQ ID NO: 268377 - DNA, 17 bp, Homo sapiens
agacacacagcctttct

SEQ ID NO: 268378 - DNA, 13 bp, Homo sapiens
agacacacaggag

SEQ ID NO: 268379 - DNA, 22 bp, Homo sapiens
agacacacaggagtcctttctt

SEQ ID NO: 268380 - DNA, 17 bp, Homo sapiens
agacacacgcacacaca

SEQ ID NO: 268381 - DNA, 15 bp, Homo sapiens
agacacagggcatcc

SEQ ID NO: 268382 - DNA, 21 bp, Homo sapiens
agacacagggcatccaactga

SEQ ID NO: 268383 - DNA, 14 bp, Homo sapiens
agacaccacagacg

SEQ ID NO: 268384 - DNA, 22 bp, Homo sapiens
agacaccacagacgccacctgg

SEQ ID NO: 268385 - DNA, 18 bp, Homo sapiens
agacacccaagtccaggc

SEQ ID NO: 268386 - DNA, 12 bp, Homo sapiens
agacacctcaga

SEQ ID NO: 268387 - DNA, 16 bp, Homo sapiens
agacacctcagagccc

SEQ ID NO: 268388 - DNA, 19 bp, Homo sapiens
agacacgtgtttttgtatc

SEQ ID NO: 268389 - DNA, 20 bp, Homo sapiens
agacacgtgtttttgtatct

SEQ ID NO: 268390 - DNA, 15 bp, Homo sapiens
agacactaagttata

SEQ ID NO: 268391 - DNA, 16 bp, Homo sapiens
agacactacagaggat

SEQ ID NO: 268392 - DNA, 17 bp, Homo sapiens
agacactccagtttgcc

SEQ ID NO: 268393 - DNA, 19 bp, Homo sapiens
agacactgaccatccactc

SEQ ID NO: 268394 - DNA, 17 bp, Homo sapiens
agacactggtctcagag

SEQ ID NO: 268395 - DNA, 16 bp, Homo sapiens
agacagagacgcagga

SEQ ID NO: 268396 - DNA, 11 bp, Homo sapiens
agacagagtct

SEQ ID NO: 268397 - DNA, 12 bp, Homo sapiens
agacagagtgga

SEQ ID NO: 268398 - DNA, 16 bp, Homo sapiens
agacagagtggatctg

SEQ ID NO: 268399 - DNA, 18 bp, Homo sapiens
agacagagtggatctgga

SEQ ID NO: 268400 - DNA, 21 bp, Homo sapiens
agacagatactcctccaaggt

SEQ ID NO: 268401 - DNA, 16 bp, Homo sapiens
agacagatcccatcca

SEQ ID NO: 268402 - DNA, 22 bp, Homo sapiens
agacagccggatcttggagaca

SEQ ID NO: 268403 - DNA, 14 bp, Homo sapiens
agacaggaaaggga

SEQ ID NO: 268404 - DNA, 18 bp, Homo sapiens
agacaggaaagggaaggc

SEQ ID NO: 268405 - DNA, 22 bp, Homo sapiens
agacaggccatgtgagccaccg

SEQ ID NO: 268406 - DNA, 14 bp, Homo sapiens
agacaggccctccc

SEQ ID NO: 268407 - DNA, 18 bp, Homo sapiens
agacaggccctccctgtc

SEQ ID NO: 268408 - DNA, 20 bp, Homo sapiens
agacaggctcttagcagctt

SEQ ID NO: 268409 - DNA, 19 bp, Homo sapiens
agacagggtttcaccatgt

SEQ ID NO: 268410 - DNA, 13 bp, Homo sapiens
agacagtaagtat

SEQ ID NO: 268411 - DNA, 14 bp, Homo sapiens
agacagtattgcca

SEQ ID NO: 268412 - DNA, 21 bp, Homo sapiens
agacagtattgccacctctgg

SEQ ID NO: 268413 - DNA, 17 bp, Homo sapiens
agacagtcaaggagtgg

SEQ ID NO: 268414 - DNA, 15 bp, Homo sapiens
agacagtcaggaagc

SEQ ID NO: 268415 - DNA, 21 bp, Homo sapiens
agacagtcaggaagcctcctg

SEQ ID NO: 268416 - DNA, 17 bp, Homo sapiens
agacagtgatctccata

SEQ ID NO: 268417 - DNA, 15 bp, Homo sapiens
agacagtggcagcaa

SEQ ID NO: 268418 - DNA, 20 bp, Homo sapiens
agacagtggcagcaaaggaa

SEQ ID NO: 268419 - DNA, 19 bp, Homo sapiens
agacagtgggggtgcctgg

SEQ ID NO: 268420 - DNA, 20 bp, Homo sapiens
agacagtgggggtgcctggt

SEQ ID NO: 268421 - DNA, 20 bp, Homo sapiens
agacagttggttttgcatgt

SEQ ID NO: 268422 - DNA, 13 bp, Homo sapiens
agacatatctcta

SEQ ID NO: 268423 - DNA, 22 bp, Homo sapiens
agacatcaagatacacttgtaa

SEQ ID NO: 268424 - DNA, 18 bp, Homo sapiens
agacatccatgtttgtaa

SEQ ID NO: 268425 - DNA, 16 bp, Homo sapiens
agacatctctgcaccc

SEQ ID NO: 268426 - DNA, 18 bp, Homo sapiens
agacattccaaaacgaag

SEQ ID NO: 268427 - DNA, 14 bp, Homo sapiens
agacattgtatttt

SEQ ID NO: 268428 - DNA, 20 bp, Homo sapiens
agacatttgttattttggaa

SEQ ID NO: 268429 - DNA, 13 bp, Homo sapiens
agacatttttatt

SEQ ID NO: 268430 - DNA, 18 bp, Homo sapiens
agaccaaaataatacaac

SEQ ID NO: 268431 - DNA, 18 bp, Homo sapiens
agaccaaggcctcggcag

SEQ ID NO: 268432 - DNA, 21 bp, Homo sapiens
agaccaaggcctcggcagaac

SEQ ID NO: 268433 - DNA, 19 bp, Homo sapiens
agaccacaaggctgaaaag

SEQ ID NO: 268434 - DNA, 21 bp, Homo sapiens
agaccacagggttcaaaatgt

SEQ ID NO: 268435 - DNA, 15 bp, Homo sapiens
agaccagagctctgg

SEQ ID NO: 268436 - DNA, 14 bp, Homo sapiens
agaccaggactctg

SEQ ID NO: 268437 - DNA, 17 bp, Homo sapiens
agaccaggactctgcct

SEQ ID NO: 268438 - DNA, 16 bp, Homo sapiens
agaccaggcttcccaa

SEQ ID NO: 268439 - DNA, 15 bp, Homo sapiens
agaccagtctggcca

SEQ ID NO: 268440 - DNA, 20 bp, Homo sapiens
agaccagttgggagcactgg

SEQ ID NO: 268441 - DNA, 14 bp, Homo sapiens
agaccatcctggcc

SEQ ID NO: 268442 - DNA, 17 bp, Homo sapiens
agaccatcctggcccct

SEQ ID NO: 268443 - DNA, 21 bp, Homo sapiens
agaccatcctggcccctccag

SEQ ID NO: 268444 - DNA, 21 bp, Homo sapiens
agaccatttagtcctcacctt

SEQ ID NO: 268445 - DNA, 23 bp, Homo sapiens
agacccaataaagaatgcaatcc

SEQ ID NO: 268446 - DNA, 16 bp, Homo sapiens
agaccccacccaagct

SEQ ID NO: 268447 - DNA, 13 bp, Homo sapiens
agaccccagggca

SEQ ID NO: 268448 - DNA, 15 bp, Homo sapiens
agaccccagggcagg

SEQ ID NO: 268449 - DNA, 12 bp, Homo sapiens
agaagatgaaaa

SEQ ID NO: 268450 - DNA, 14 bp, Homo sapiens
agaagatgccctcc

SEQ ID NO: 268451 - DNA, 20 bp, Homo sapiens
agaagatgtattcagagcca

SEQ ID NO: 268452 - DNA, 22 bp, Homo sapiens
agaagatttattatgaaccgca

SEQ ID NO: 268453 - DNA, 16 bp, Homo sapiens
agaagcaccccaccac

SEQ ID NO: 268454 - DNA, 13 bp, Homo sapiens
agaagcatgaaaa

SEQ ID NO: 268455 - DNA, 16 bp, Homo sapiens
agaagcatgaaaaagc

SEQ ID NO: 268456 - DNA, 13 bp, Homo sapiens
agaagccaagaca

SEQ ID NO: 268457 - DNA, 15 bp, Homo sapiens
agaagccatcaattt

SEQ ID NO: 268458 - DNA, 21 bp, Homo sapiens
agaagccctccttgccacccc

SEQ ID NO: 268459 - DNA, 14 bp, Homo sapiens
agaagcctattgta

SEQ ID NO: 268460 - DNA, 21 bp, Homo sapiens
agaagcctccaagcctgcctc

SEQ ID NO: 268461 - DNA, 14 bp, Homo sapiens
agaagcctctggct

SEQ ID NO: 268462 - DNA, 16 bp, Homo sapiens
agaagcctctggctag

SEQ ID NO: 268463 - DNA, 21 bp, Homo sapiens
agaagcgtctcccttggccac

SEQ ID NO: 268464 - DNA, 20 bp, Homo sapiens
agaagctaatgtaggactgt

SEQ ID NO: 268465 - DNA, 13 bp, Homo sapiens
agaagctgcagct

SEQ ID NO: 268466 - DNA, 14 bp, Homo sapiens
agaagctgcagctg

SEQ ID NO: 268467 - DNA, 22 bp, Homo sapiens
agaagctgggactcattcacat

SEQ ID NO: 268468 - DNA, 13 bp, Homo sapiens
agaagctgtagta

SEQ ID NO: 268469 - DNA, 18 bp, Homo sapiens
agaagcttccattccaag

SEQ ID NO: 268470 - DNA, 19 bp, Homo sapiens
agaagcttgtattatcagt

SEQ ID NO: 268471 - DNA, 21 bp, Homo sapiens
agaaggaaaaggctggcaagg

SEQ ID NO: 268472 - DNA, 13 bp, Homo sapiens
agaaggaaagcat

SEQ ID NO: 268473 - DNA, 14 bp, Homo sapiens
agaaggaagacttt

SEQ ID NO: 268474 - DNA, 17 bp, Homo sapiens
agaaggacttcctgcta

SEQ ID NO: 268475 - DNA, 13 bp, Homo sapiens
agaaggagaggct

SEQ ID NO: 268476 - DNA, 23 bp, Homo sapiens
agaaggagatgtaatgacagaga

SEQ ID NO: 268477 - DNA, 13 bp, Homo sapiens
agaaggaggaatt

SEQ ID NO: 268478 - DNA, 12 bp, Homo sapiens
agaaggagggca

SEQ ID NO: 268479 - DNA, 16 bp, Homo sapiens
agaaggagggcagagc

SEQ ID NO: 268480 - DNA, 17 bp, Homo sapiens
agaaggcaagctggcag

SEQ ID NO: 268481 - DNA, 16 bp, Homo sapiens
agaaggccacaggcca

SEQ ID NO: 268482 - DNA, 16 bp, Homo sapiens
agaaggcccgggagga

SEQ ID NO: 268483 - DNA, 19 bp, Homo sapiens
agaaggcctcttgtgctca

SEQ ID NO: 268484 - DNA, 23 bp, Homo sapiens
agaaggctaaagaagacacacag

SEQ ID NO: 268485 - DNA, 14 bp, Homo sapiens
agaagggaaattca

SEQ ID NO: 268486 - DNA, 18 bp, Homo sapiens
agaagggaaggggagagg

SEQ ID NO: 268487 - DNA, 15 bp, Homo sapiens
agaagggagaacagg

SEQ ID NO: 268488 - DNA, 19 bp, Homo sapiens
agaagggccagtcctgcct

SEQ ID NO: 268489 - DNA, 21 bp, Homo sapiens
agaaggggctcgagtgcccct

SEQ ID NO: 268490 - DNA, 22 bp, Homo sapiens
agaaggggctcgagtgcccctg

SEQ ID NO: 268491 - DNA, 17 bp, Homo sapiens
agaagggggccatgagg

SEQ ID NO: 268492 - DNA, 15 bp, Homo sapiens
agaagggtccttccc

SEQ ID NO: 268493 - DNA, 18 bp, Homo sapiens
agaagggtccttccctct

SEQ ID NO: 268494 - DNA, 20 bp, Homo sapiens
agaaggtgccgtgagcaggc

SEQ ID NO: 268495 - DNA, 16 bp, Homo sapiens
agaaggtgcttgggct

SEQ ID NO: 268496 - DNA, 16 bp, Homo sapiens
agaccttgcctcccct

SEQ ID NO: 268497 - DNA, 21 bp, Homo sapiens
agacgacacctggagactgtc

SEQ ID NO: 268498 - DNA, 22 bp, Homo sapiens
agacgacacctggagactgtcc

SEQ ID NO: 268499 - DNA, 21 bp, Homo sapiens
agacgacttatatatttgaaa

SEQ ID NO: 268500 - DNA, 13 bp, Homo sapiens
agacgccacctgg

SEQ ID NO: 268501 - DNA, 13 bp, Homo sapiens
agacgcccctccc

SEQ ID NO: 268502 - DNA, 14 bp, Homo sapiens
agacgctgagtggg

SEQ ID NO: 268503 - DNA, 18 bp, Homo sapiens
agacggatggaaggagag

SEQ ID NO: 268504 - DNA, 20 bp, Homo sapiens
agacggatggaaggagagag

SEQ ID NO: 268505 - DNA, 16 bp, Homo sapiens
agacgggctgagagga

SEQ ID NO: 268506 - DNA, 21 bp, Homo sapiens
agacggtagaattaaagaaga

SEQ ID NO: 268507 - DNA, 14 bp, Homo sapiens
agacgtccaccctg

SEQ ID NO: 268508 - DNA, 17 bp, Homo sapiens
agacgtcctggaatgaa

SEQ ID NO: 268509 - DNA, 22 bp, Homo sapiens
agacgtcctggaatgaagcatg

SEQ ID NO: 268510 - DNA, 13 bp, Homo sapiens
agactaagccctg

SEQ ID NO: 268511 - DNA, 14 bp, Homo sapiens
agactaagccctgt

SEQ ID NO: 268512 - DNA, 14 bp, Homo sapiens
agactaatttaaaa

SEQ ID NO: 268513 - DNA, 19 bp, Homo sapiens
agactagattgcctttgtt

SEQ ID NO: 268514 - DNA, 20 bp, Homo sapiens
agactaggagaccagaagtg

SEQ ID NO: 268515 - DNA, 22 bp, Homo sapiens
agactaggagaccagaagtgaa

SEQ ID NO: 268516 - DNA, 21 bp, Homo sapiens
agactagtgccgtagggagta

SEQ ID NO: 268517 - DNA, 22 bp, Homo sapiens
agactagtttttattccttgtg

SEQ ID NO: 268518 - DNA, 19 bp, Homo sapiens
agactataaagcagtagac

SEQ ID NO: 268519 - DNA, 12 bp, Homo sapiens
agactatgtgtc

SEQ ID NO: 268520 - DNA, 23 bp, Homo sapiens
agactatgtgtcatgatttcaat

SEQ ID NO: 268521 - DNA, 17 bp, Homo sapiens
agactatttaaacttat

SEQ ID NO: 268522 - DNA, 21 bp, Homo sapiens
agactcaaggcctccagccac

SEQ ID NO: 268523 - DNA, 14 bp, Homo sapiens
agactcaatgtgga

SEQ ID NO: 268524 - DNA, 17 bp, Homo sapiens
agactcaggttccagaa

SEQ ID NO: 268525 - DNA, 17 bp, Homo sapiens
agactcagtttgtcaga

SEQ ID NO: 268526 - DNA, 22 bp, Homo sapiens
agactccagaatctgctgttgc

SEQ ID NO: 268527 - DNA, 14 bp, Homo sapiens
agactcccaggagt

SEQ ID NO: 268528 - DNA, 13 bp, Homo sapiens
agactccttctcc

SEQ ID NO: 268529 - DNA, 23 bp, Homo sapiens
agactcctttcctgcatctttca

SEQ ID NO: 268530 - DNA, 15 bp, Homo sapiens
agactcgagagggct

SEQ ID NO: 268531 - DNA, 23 bp, Homo sapiens
agactcgagagggctgagcccct

SEQ ID NO: 268532 - DNA, 22 bp, Homo sapiens
agactcgatgcaagtgtttctg

SEQ ID NO: 268533 - DNA, 15 bp, Homo sapiens
agactcgtcttggca

SEQ ID NO: 268534 - DNA, 19 bp, Homo sapiens
agactctacccatattaca

SEQ ID NO: 268535 - DNA, 15 bp, Homo sapiens
agactctattctcaa

SEQ ID NO: 268536 - DNA, 21 bp, Homo sapiens
agactctctcctctctctccc

SEQ ID NO: 268537 - DNA, 22 bp, Homo sapiens
agactctctcctctctctccct

SEQ ID NO: 268538 - DNA, 17 bp, Homo sapiens
agactctgtaacatcac

SEQ ID NO: 268539 - DNA, 17 bp, Homo sapiens
agactgaaagcagcagc

SEQ ID NO: 268540 - DNA, 14 bp, Homo sapiens
agactgactcacat

SEQ ID NO: 268541 - DNA, 21 bp, Homo sapiens
agactgcaagtgagcaaacct

SEQ ID NO: 268542 - DNA, 21 bp, Homo sapiens
agactgcaggttggaccccag

SEQ ID NO: 268543 - DNA, 11 bp, Homo sapiens
agactgcccac

SEQ ID NO: 268544 - DNA, 12 bp, Homo sapiens
agactgcccacc

SEQ ID NO: 268545 - DNA, 23 bp, Homo sapiens
agactgcccaccctgggcctccc

SEQ ID NO: 268546 - DNA, 11 bp, Homo sapiens
agactgcctcc

SEQ ID NO: 268547 - DNA, 12 bp, Homo sapiens
agactgcctccc

SEQ ID NO: 268548 - DNA, 15 bp, Homo sapiens
agactgcctccctct

SEQ ID NO: 268549 - DNA, 16 bp, Homo sapiens
agactgcctccctctc

SEQ ID NO: 268550 - DNA, 16 bp, Homo sapiens
agactgctttgagaaa

SEQ ID NO: 268551 - DNA, 13 bp, Homo sapiens
agactggagggga

SEQ ID NO: 268552 - DNA, 14 bp, Homo sapiens
agactggagtgagg

SEQ ID NO: 268553 - DNA, 19 bp, Homo sapiens
agactggagtgaggcttcc

SEQ ID NO: 268554 - DNA, 23 bp, Homo sapiens
agactggagtgaggcttccaggc

SEQ ID NO: 268555 - DNA, 18 bp, Homo sapiens
agactggcagccagggag

SEQ ID NO: 268556 - DNA, 15 bp, Homo sapiens
agactggctgcacag

SEQ ID NO: 268557 - DNA, 16 bp, Homo sapiens
agactggctgcacagc

SEQ ID NO: 268558 - DNA, 19 bp, Homo sapiens
agactggctgcacagccca

SEQ ID NO: 268559 - DNA, 21 bp, Homo sapiens
agactgggaagataggctctg

SEQ ID NO: 268560 - DNA, 23 bp, Homo sapiens
agactgggaagataggctctgca

SEQ ID NO: 268561 - DNA, 17 bp, Homo sapiens
agactgggagccacttc

SEQ ID NO: 268562 - DNA, 20 bp, Homo sapiens
agactgggagccacttctcc

SEQ ID NO: 268563 - DNA, 18 bp, Homo sapiens
agactggtcctgtgtgca

SEQ ID NO: 268564 - DNA, 12 bp, Homo sapiens
agactggtctcg

SEQ ID NO: 268565 - DNA, 20 bp, Homo sapiens
agactggtctcgaactcctg

SEQ ID NO: 268566 - DNA, 14 bp, Homo sapiens
agactgtaagatgt

SEQ ID NO: 268567 - DNA, 12 bp, Homo sapiens
agactgtactgg

SEQ ID NO: 268568 - DNA, 22 bp, Homo sapiens
agactgtattttcaggaaggta

SEQ ID NO: 268569 - DNA, 20 bp, Homo sapiens
agactgtcggagaggctgtc

SEQ ID NO: 268570 - DNA, 14 bp, Homo sapiens
agactgtctcaaga

SEQ ID NO: 268571 - DNA, 18 bp, Homo sapiens
agactgtgacaactgtct

SEQ ID NO: 268572 - DNA, 21 bp, Homo sapiens
agactgtgaggcggcagctgg

SEQ ID NO: 268573 - DNA, 15 bp, Homo sapiens
agacttaagattaaa

SEQ ID NO: 268574 - DNA, 14 bp, Homo sapiens
agacttaatcatat

SEQ ID NO: 268575 - DNA, 18 bp, Homo sapiens
agacttagatctgagccc

SEQ ID NO: 268576 - DNA, 19 bp, Homo sapiens
agacttcaggttgttctgt

SEQ ID NO: 268577 - DNA, 20 bp, Homo sapiens
agacttccaaacctgacaga

SEQ ID NO: 268578 - DNA, 21 bp, Homo sapiens
agacttccaaacctgacagat

SEQ ID NO: 268579 - DNA, 19 bp, Homo sapiens
agacttccaccatgtgcat

SEQ ID NO: 268580 - DNA, 20 bp, Homo sapiens
agacttcgactcaggatcca

SEQ ID NO: 268581 - DNA, 18 bp, Homo sapiens
agacttcgctattcccag

SEQ ID NO: 268582 - DNA, 20 bp, Homo sapiens
agacttcgctattcccaggc

SEQ ID NO: 268583 - DNA, 19 bp, Homo sapiens
agacttctaggaggatgct

SEQ ID NO: 268584 - DNA, 18 bp, Homo sapiens
agacttctgcttttcaac

SEQ ID NO: 268585 - DNA, 15 bp, Homo sapiens
agacttgagaacttg

SEQ ID NO: 268586 - DNA, 14 bp, Homo sapiens
agacttgatgaata

SEQ ID NO: 268587 - DNA, 17 bp, Homo sapiens
agacttggagctgtcct

SEQ ID NO: 268588 - DNA, 18 bp, Homo sapiens
agacttggcaacagaagc

SEQ ID NO: 268589 - DNA, 19 bp, Homo sapiens
agacttggcaacagaagca

SEQ ID NO: 268590 - DNA, 19 bp, Homo sapiens
agacttggtgtcctttccc

SEQ ID NO: 268591 - DNA, 16 bp, Homo sapiens
tcgagagggctgagcc

SEQ ID NO: 268592 - DNA, 18 bp, Homo sapiens
tcgagagggctgagcccc

SEQ ID NO: 268593 - DNA, 19 bp, Homo sapiens
tcgagagggctgagcccct

SEQ ID NO: 268594 - DNA, 21 bp, Homo sapiens
tcgagagggctgagcccctcc

SEQ ID NO: 268595 - DNA, 21 bp, Homo sapiens
tcgagcagtcctgcctcagcc

SEQ ID NO: 268596 - DNA, 17 bp, Homo sapiens
tcgaggaaccagagcca

SEQ ID NO: 268597 - DNA, 20 bp, Homo sapiens
tcgaggcaccggcgctgcag

SEQ ID NO: 268598 - DNA, 15 bp, Homo sapiens
tcgaggtgtcaccct

SEQ ID NO: 268599 - DNA, 17 bp, Homo sapiens
tcgaggtgtcaccctgc

SEQ ID NO: 268600 - DNA, 17 bp, Homo sapiens
tcgagtccaaaatcatt

SEQ ID NO: 268601 - DNA, 15 bp, Homo sapiens
tcgagtgcccctgca

SEQ ID NO: 268602 - DNA, 22 bp, Homo sapiens
tcgagttggcaaaatggggttt

SEQ ID NO: 268603 - DNA, 20 bp, Homo sapiens
tcgatctcattcagtattaa

SEQ ID NO: 268604 - DNA, 17 bp, Homo sapiens
tcgatgggggatgcttc

SEQ ID NO: 268605 - DNA, 17 bp, Homo sapiens
tcgcaaggcctgtgctg

SEQ ID NO: 268606 - DNA, 23 bp, Homo sapiens
tcgcacaaggacatttgggactg

SEQ ID NO: 268607 - DNA, 21 bp, Homo sapiens
tcgcaccactgtgtatttaac

SEQ ID NO: 268608 - DNA, 17 bp, Homo sapiens
tcgcaccttttatacca

SEQ ID NO: 268609 - DNA, 12 bp, Homo sapiens
tcgcactgcaaa

SEQ ID NO: 268610 - DNA, 14 bp, Homo sapiens
tcgcagatgataaa

SEQ ID NO: 268611 - DNA, 15 bp, Homo sapiens
tcgcagatgataaaa

SEQ ID NO: 268612 - DNA, 22 bp, Homo sapiens
tcgcagcagctccgcctggcac

SEQ ID NO: 268613 - DNA, 18 bp, Homo sapiens
tcgcagtgcccagtgatg

SEQ ID NO: 268614 - DNA, 20 bp, Homo sapiens
tcgcagtgcccagtgatggc

SEQ ID NO: 268615 - DNA, 20 bp, Homo sapiens
tcgccaagccatcacaggct

SEQ ID NO: 268616 - DNA, 13 bp, Homo sapiens
tcgccccacccag

SEQ ID NO: 268617 - DNA, 12 bp, Homo sapiens
tcgccccatccc

SEQ ID NO: 268618 - DNA, 15 bp, Homo sapiens
tcgcccccacacccc

SEQ ID NO: 268619 - DNA, 16 bp, Homo sapiens
tcgcccctccagtgtt

SEQ ID NO: 268620 - DNA, 14 bp, Homo sapiens
tcgcccctcctcgg

SEQ ID NO: 268621 - DNA, 17 bp, Homo sapiens
tcgcccgcccactgtcc

SEQ ID NO: 268622 - DNA, 12 bp, Homo sapiens
tcgccctctgtg

SEQ ID NO: 268623 - DNA, 18 bp, Homo sapiens
tcgccctctgtgcctaat

SEQ ID NO: 268624 - DNA, 16 bp, Homo sapiens
tcgccgtccctctgcc

SEQ ID NO: 268625 - DNA, 17 bp, Homo sapiens
tcgccgtccctctgcct

SEQ ID NO: 268626 - DNA, 16 bp, Homo sapiens
tcgcctaggcctgtga

SEQ ID NO: 268627 - DNA, 11 bp, Homo sapiens
tcgcctgacaa

SEQ ID NO: 268628 - DNA, 20 bp, Homo sapiens
tcgcctgacaaccactggtc

SEQ ID NO: 268629 - DNA, 23 bp, Homo sapiens
tcgcgctggaatccagaaggaag

SEQ ID NO: 268630 - DNA, 17 bp, Homo sapiens
tcgcggcgcagcccctg

SEQ ID NO: 268631 - DNA, 15 bp, Homo sapiens
tcgctagtgattaaa

SEQ ID NO: 268632 - DNA, 15 bp, Homo sapiens
tcgctattcccaggc

SEQ ID NO: 268633 - DNA, 17 bp, Homo sapiens
tcgctattcccaggcag

SEQ ID NO: 268634 - DNA, 19 bp, Homo sapiens
tcgctattcccaggcaggg

SEQ ID NO: 268635 - DNA, 21 bp, Homo sapiens
tcgctgctctagctggcagga

SEQ ID NO: 268636 - DNA, 16 bp, Homo sapiens
tcgctgtatgatttag

SEQ ID NO: 268637 - DNA, 16 bp, Homo sapiens
tcgctgtccaagtgtt

SEQ ID NO: 268638 - DNA, 22 bp, Homo sapiens
tcgctgtccaagtgtttcttgt

SEQ ID NO: 268639 - DNA, 19 bp, Homo sapiens
tcgctgtgatgcatgagct

SEQ ID NO: 268640 - DNA, 23 bp, Homo sapiens
tcgctgtgatgcatgagctccct

SEQ ID NO: 268641 - DNA, 17 bp, Homo sapiens
tcgcttagctgaaacct

SEQ ID NO: 268642 - DNA, 14 bp, Homo sapiens
tcgcttctttttca

SEQ ID NO: 268643 - DNA, 15 bp, Homo sapiens
tcgcttgaacctggg

SEQ ID NO: 268644 - DNA, 14 bp, Homo sapiens
tcgcttgagcccag

SEQ ID NO: 268645 - DNA, 16 bp, Homo sapiens
tcgcttggctccatgc

SEQ ID NO: 268646 - DNA, 22 bp, Homo sapiens
tcggaaatacactacaaatgtt

SEQ ID NO: 268647 - DNA, 18 bp, Homo sapiens
tcggaactgcatgctgct

SEQ ID NO: 268648 - DNA, 17 bp, Homo sapiens
tcggaagcctgtcctca

SEQ ID NO: 268649 - DNA, 16 bp, Homo sapiens
tcggaagggaaaacag

SEQ ID NO: 268650 - DNA, 17 bp, Homo sapiens
tcggacccaccccaact

SEQ ID NO: 268651 - DNA, 19 bp, Homo sapiens
tcggacccaccccaactct

SEQ ID NO: 268652 - DNA, 23 bp, Homo sapiens
tcggacccaccccaactctcccc

SEQ ID NO: 268653 - DNA, 18 bp, Homo sapiens
tcggacctcagtttctgt

SEQ ID NO: 268654 - DNA, 18 bp, Homo sapiens
tcggaggccaggccctcc

SEQ ID NO: 268655 - DNA, 14 bp, Homo sapiens
tcggaggcttggga

SEQ ID NO: 268656 - DNA, 22 bp, Homo sapiens
tcggagggaattgaggtctgct

SEQ ID NO: 268657 - DNA, 21 bp, Homo sapiens
tcggcaccttcccctgaggac

SEQ ID NO: 268658 - DNA, 17 bp, Homo sapiens
tcggcattcacacacag

SEQ ID NO: 268659 - DNA, 19 bp, Homo sapiens
tcggcattcacacacagcc

SEQ ID NO: 268660 - DNA, 22 bp, Homo sapiens
tcggcattcacacacagcctgg

SEQ ID NO: 268661 - DNA, 22 bp, Homo sapiens
tcggcattggttccctttgctc

SEQ ID NO: 268662 - DNA, 15 bp, Homo sapiens
tcggccagagctccc

SEQ ID NO: 268663 - DNA, 18 bp, Homo sapiens
tcggccagagctcccagg

SEQ ID NO: 268664 - DNA, 19 bp, Homo sapiens
tcggccagagctcccagga

SEQ ID NO: 268665 - DNA, 13 bp, Homo sapiens
tcggccctgccca

SEQ ID NO: 268666 - DNA, 14 bp, Homo sapiens
tcggccctgcccaa

SEQ ID NO: 268667 - DNA, 20 bp, Homo sapiens
tcggcctcccaaagtgctgg

SEQ ID NO: 268668 - DNA, 16 bp, Homo sapiens
tcggctgggcagggcc

SEQ ID NO: 268669 - DNA, 19 bp, Homo sapiens
tcggctgggcagggccgca

SEQ ID NO: 268670 - DNA, 12 bp, Homo sapiens
tcgggaagagag

SEQ ID NO: 268671 - DNA, 21 bp, Homo sapiens
tcgggaagagaggagttcaat

SEQ ID NO: 268672 - DNA, 22 bp, Homo sapiens
tcgggaagagaggagttcaatg

SEQ ID NO: 268673 - DNA, 20 bp, Homo sapiens
tcgggaaggcctgagggaag

SEQ ID NO: 268674 - DNA, 21 bp, Homo sapiens
tcgggaaggcctgagggaagc

SEQ ID NO: 268675 - DNA, 13 bp, Homo sapiens
tcgggagcagtgt

SEQ ID NO: 268676 - DNA, 16 bp, Homo sapiens
tcgggccgcctcctcc

SEQ ID NO: 268677 - DNA, 19 bp, Homo sapiens
tcgggccgcctcctccaga

SEQ ID NO: 268678 - DNA, 20 bp, Homo sapiens
tcgggccgcctcctccagac

SEQ ID NO: 268679 - DNA, 22 bp, Homo sapiens
tcgggcgcctgcgctcctctgc

SEQ ID NO: 268680 - DNA, 18 bp, Homo sapiens
tcgggctaagtccagctc

SEQ ID NO: 268681 - DNA, 20 bp, Homo sapiens
tcgggctaagtccagctctc

SEQ ID NO: 268682 - DNA, 15 bp, Homo sapiens
tcgggctcagctctg

SEQ ID NO: 268683 - DNA, 16 bp, Homo sapiens
tcgggctcagctctgg

SEQ ID NO: 268684 - DNA, 14 bp, Homo sapiens
tcggggcagggcag

SEQ ID NO: 268685 - DNA, 19 bp, Homo sapiens
tcgggggaggagcaccccc

SEQ ID NO: 268686 - DNA, 23 bp, Homo sapiens
tcgggggaggagcacccccagcc

SEQ ID NO: 268687 - DNA, 20 bp, Homo sapiens
tcggggggcgagggagggga

SEQ ID NO: 268688 - DNA, 21 bp, Homo sapiens
tcggggggcgagggaggggag

SEQ ID NO: 268689 - DNA, 12 bp, Homo sapiens
tcggtcagcagg

SEQ ID NO: 268690 - DNA, 23 bp, Homo sapiens
tcggtgcagcggtggaaggagcc

SEQ ID NO: 268691 - DNA, 18 bp, Homo sapiens
tcggtggcatttgctgaa

SEQ ID NO: 268692 - DNA, 15 bp, Homo sapiens
tcggtgtccatttat

SEQ ID NO: 268693 - DNA, 22 bp, Homo sapiens
tcggtgtccatttatagaataa

SEQ ID NO: 268694 - DNA, 14 bp, Homo sapiens
agacttgtttcctg

SEQ ID NO: 268695 - DNA, 17 bp, Homo sapiens
agacttgtttcctgtgc

SEQ ID NO: 268696 - DNA, 19 bp, Homo sapiens
agacttgtttcctgtgccc

SEQ ID NO: 268697 - DNA, 15 bp, Homo sapiens
agacttgtttctttc

SEQ ID NO: 268698 - DNA, 16 bp, Homo sapiens
agacttgtttctttct

SEQ ID NO: 268699 - DNA, 17 bp, Homo sapiens
agacttgttttcccctc

SEQ ID NO: 268700 - DNA, 18 bp, Homo sapiens
agagaaaaaccaatgatt

SEQ ID NO: 268701 - DNA, 24 bp, Homo sapiens
agagaaaaagagagagcagggtgg

SEQ ID NO: 268702 - DNA, 14 bp, Homo sapiens
agagaaaacacttt

SEQ ID NO: 268703 - DNA, 18 bp, Homo sapiens
agagaaacccctggggac

SEQ ID NO: 268704 - DNA, 11 bp, Homo sapiens
agagaaagaat

SEQ ID NO: 268705 - DNA, 13 bp, Homo sapiens
agagaaagtactc

SEQ ID NO: 268706 - DNA, 12 bp, Homo sapiens
agagaaatgaaa

SEQ ID NO: 268707 - DNA, 23 bp, Homo sapiens
agagaacaaagggccaaatagag

SEQ ID NO: 268708 - DNA, 17 bp, Homo sapiens
agagaaccgagcaaaga

SEQ ID NO: 268709 - DNA, 14 bp, Homo sapiens
agagaagccttggt

SEQ ID NO: 268710 - DNA, 13 bp, Homo sapiens
agagaaggaaaag

SEQ ID NO: 268711 - DNA, 20 bp, Homo sapiens
agagaaggcctcttgtgctc

SEQ ID NO: 268712 - DNA, 13 bp, Homo sapiens
agagaaggcctgg

SEQ ID NO: 268713 - DNA, 20 bp, Homo sapiens
agagaaggcctggtcagcag

SEQ ID NO: 268714 - DNA, 12 bp, Homo sapiens
agagaaggggag

SEQ ID NO: 268715 - DNA, 17 bp, Homo sapiens
agagaagtacagaatgt

SEQ ID NO: 268716 - DNA, 19 bp, Homo sapiens
agagaagtcagttggagaa

SEQ ID NO: 268717 - DNA, 22 bp, Homo sapiens
agagaagtcagttggagaaaat

SEQ ID NO: 268718 - DNA, 19 bp, Homo sapiens
agagaataaagacttcatg

SEQ ID NO: 268719 - DNA, 14 bp, Homo sapiens
agagaatcagacct

SEQ ID NO: 268720 - DNA, 14 bp, Homo sapiens
agagaatgagagag

SEQ ID NO: 268721 - DNA, 15 bp, Homo sapiens
agagaatgagagagt

SEQ ID NO: 268722 - DNA, 14 bp, Homo sapiens
agagaattacttat

SEQ ID NO: 268723 - DNA, 16 bp, Homo sapiens
agagaattcactttac

SEQ ID NO: 268724 - DNA, 14 bp, Homo sapiens
agagacaaatagta

SEQ ID NO: 268725 - DNA, 18 bp, Homo sapiens
agagacaaatagtaggct

SEQ ID NO: 268726 - DNA, 15 bp, Homo sapiens
agagacaagacttcg

SEQ ID NO: 268727 - DNA, 16 bp, Homo sapiens
agagacaataaaacat

SEQ ID NO: 268728 - DNA, 13 bp, Homo sapiens
agagacagaagca

SEQ ID NO: 268729 - DNA, 20 bp, Homo sapiens
agagacagaagcaggctgga

SEQ ID NO: 268730 - DNA, 11 bp, Homo sapiens
agagacaggga

SEQ ID NO: 268731 - DNA, 22 bp, Homo sapiens
agagacagttgggtgagaacaa

SEQ ID NO: 268732 - DNA, 23 bp, Homo sapiens
agagacagttgggtgagaacaac

SEQ ID NO: 268733 - DNA, 19 bp, Homo sapiens
agagacatgggcctcccac

SEQ ID NO: 268734 - DNA, 16 bp, Homo sapiens
agagaccaagcttgtt

SEQ ID NO: 268735 - DNA, 17 bp, Homo sapiens
agagaccagcctttctt

SEQ ID NO: 268736 - DNA, 23 bp, Homo sapiens
agagaccctgccaactttccaga

SEQ ID NO: 268737 - DNA, 19 bp, Homo sapiens
agagacctcatcaggatga

SEQ ID NO: 268738 - DNA, 22 bp, Homo sapiens
agagacgaggtgtcttccttcc

SEQ ID NO: 268739 - DNA, 16 bp, Homo sapiens
agagacggcagcccca

SEQ ID NO: 268740 - DNA, 19 bp, Homo sapiens
agagacggcagccccatcc

SEQ ID NO: 268741 - DNA, 20 bp, Homo sapiens
agagacggcagccccatcct

SEQ ID NO: 268742 - DNA, 16 bp, Homo sapiens
agagactgaaagcagc

SEQ ID NO: 268743 - DNA, 18 bp, Homo sapiens
agagactgaaagcagcag

SEQ ID NO: 268744 - DNA, 24 bp, Homo sapiens
agagactgaaagcagcagctagga

SEQ ID NO: 268745 - DNA, 12 bp, Homo sapiens
agagactgccca

SEQ ID NO: 268746 - DNA, 13 bp, Homo sapiens
agagactgcccac

SEQ ID NO: 268747 - DNA, 13 bp, Homo sapiens
agagactggcagc

SEQ ID NO: 268748 - DNA, 17 bp, Homo sapiens
agagactggcagccagg

SEQ ID NO: 268749 - DNA, 20 bp, Homo sapiens
agagactggcagccagggag

SEQ ID NO: 268750 - DNA, 19 bp, Homo sapiens
agagactggccagaggcag

SEQ ID NO: 268751 - DNA, 20 bp, Homo sapiens
agagactggccagaggcagc

SEQ ID NO: 268752 - DNA, 14 bp, Homo sapiens
agagactgtgaggc

SEQ ID NO: 268753 - DNA, 17 bp, Homo sapiens
agagacttctaaatcat

SEQ ID NO: 268754 - DNA, 20 bp, Homo sapiens
agagacttctaggaggatgc

SEQ ID NO: 268755 - DNA, 22 bp, Homo sapiens
agagacttctaggaggatgctg

SEQ ID NO: 268756 - DNA, 17 bp, Homo sapiens
agagacttttaatcaga

SEQ ID NO: 268757 - DNA, 14 bp, Homo sapiens
agagagaaaaagag

SEQ ID NO: 268758 - DNA, 23 bp, Homo sapiens
agagagaaaaagagagagcaggg

SEQ ID NO: 268759 - DNA, 21 bp, Homo sapiens
agagagaaaacttatttgagt

SEQ ID NO: 268760 - DNA, 14 bp, Homo sapiens
agagagaaaataaa

SEQ ID NO: 268761 - DNA, 15 bp, Homo sapiens
agagagaaagaatga

SEQ ID NO: 268762 - DNA, 21 bp, Homo sapiens
agagagaaagaatgagaaaga

SEQ ID NO: 268763 - DNA, 19 bp, Homo sapiens
agagagaagtgcccctgct

SEQ ID NO: 268764 - DNA, 16 bp, Homo sapiens
agagagaatcagacct

SEQ ID NO: 268765 - DNA, 14 bp, Homo sapiens
agagagacaagaag

SEQ ID NO: 268766 - DNA, 14 bp, Homo sapiens
agagagaccctcac

SEQ ID NO: 268767 - DNA, 15 bp, Homo sapiens
agagagagaaagaat

SEQ ID NO: 268768 - DNA, 15 bp, Homo sapiens
agagagagaccctca

SEQ ID NO: 268769 - DNA, 14 bp, Homo sapiens
agagagagagagag

SEQ ID NO: 268770 - DNA, 16 bp, Homo sapiens
agagagagagagagcg

SEQ ID NO: 268771 - DNA, 19 bp, Homo sapiens
agagagagcgcgggagaga

SEQ ID NO: 268772 - DNA, 15 bp, Homo sapiens
agagagagtgagagc

SEQ ID NO: 268773 - DNA, 22 bp, Homo sapiens
agagagagtgagagcacaaaga

SEQ ID NO: 268774 - DNA, 19 bp, Homo sapiens
agagagattgaactttgag

SEQ ID NO: 268775 - DNA, 14 bp, Homo sapiens
agagaggagttcaa

SEQ ID NO: 268776 - DNA, 18 bp, Homo sapiens
agagaggagttcaatgat

SEQ ID NO: 268777 - DNA, 12 bp, Homo sapiens
agagaggcacct

SEQ ID NO: 268778 - DNA, 18 bp, Homo sapiens
agagaggcacctgctgga

SEQ ID NO: 268779 - DNA, 19 bp, Homo sapiens
agagaggcacctgctggaa

SEQ ID NO: 268780 - DNA, 15 bp, Homo sapiens
agagaggcgtcctgg

SEQ ID NO: 268781 - DNA, 20 bp, Homo sapiens
agagaggcgttagtgggcag

SEQ ID NO: 268782 - DNA, 13 bp, Homo sapiens
agagagggcccag

SEQ ID NO: 268783 - DNA, 12 bp, Homo sapiens
agagagggggct

SEQ ID NO: 268784 - DNA, 17 bp, Homo sapiens
agagaggtagcgagctg

SEQ ID NO: 268785 - DNA, 15 bp, Homo sapiens
agagatgagaaatga

SEQ ID NO: 268786 - DNA, 13 bp, Homo sapiens
agagatgcctccc

SEQ ID NO: 268787 - DNA, 12 bp, Homo sapiens
agagatggagga

SEQ ID NO: 268788 - DNA, 14 bp, Homo sapiens
agagatggaggagg

SEQ ID NO: 268789 - DNA, 16 bp, Homo sapiens
agagatgggactggga

SEQ ID NO: 268790 - DNA, 20 bp, Homo sapiens
agagatgtaccatgttaaag

SEQ ID NO: 268791 - DNA, 19 bp, Homo sapiens
agagatgtggcaaagtgct

SEQ ID NO: 268792 - DNA, 13 bp, Homo sapiens
agagattaatttg

SEQ ID NO: 268793 - DNA, 23 bp, Homo sapiens
agagattcccctggaccacacct

SEQ ID NO: 268794 - DNA, 17 bp, Homo sapiens
agagattgaactttgag

SEQ ID NO: 268795 - DNA, 13 bp, Homo sapiens
agagattgggggg

SEQ ID NO: 268796 - DNA, 20 bp, Homo sapiens
agagcaaagatggcttccgt

SEQ ID NO: 268797 - DNA, 15 bp, Homo sapiens
agagcaaagggccag

SEQ ID NO: 268798 - DNA, 16 bp, Homo sapiens
agagcaaatgagggag

SEQ ID NO: 268799 - DNA, 23 bp, Homo sapiens
agagcaaatttcatctttccaaa

SEQ ID NO: 268800 - DNA, 21 bp, Homo sapiens
agagcaacccctgtacccagc

SEQ ID NO: 268801 - DNA, 19 bp, Homo sapiens
agagcaatcttgctgtgaa

SEQ ID NO: 268802 - DNA, 14 bp, Homo sapiens
agagcaccttcctc

SEQ ID NO: 268803 - DNA, 20 bp, Homo sapiens
agagcaccttcctcacttcc

SEQ ID NO: 268804 - DNA, 21 bp, Homo sapiens
agagcactgggttgcagggga

SEQ ID NO: 268805 - DNA, 17 bp, Homo sapiens
agagcactgtgtaacca

SEQ ID NO: 268806 - DNA, 22 bp, Homo sapiens
agagcactgtgtaaccagcagt

SEQ ID NO: 268807 - DNA, 13 bp, Homo sapiens
agagcagcctgat

SEQ ID NO: 268808 - DNA, 16 bp, Homo sapiens
agagcagcctgatggc

SEQ ID NO: 268809 - DNA, 13 bp, Homo sapiens
agagcagctcccc

SEQ ID NO: 268810 - DNA, 17 bp, Homo sapiens
agagcagctccccagga

SEQ ID NO: 268811 - DNA, 11 bp, Homo sapiens
agagcagctgg

SEQ ID NO: 268812 - DNA, 15 bp, Homo sapiens
agagcaggaggcccc

SEQ ID NO: 268813 - DNA, 22 bp, Homo sapiens
agagcaggcaccagcagcagaa

SEQ ID NO: 268814 - DNA, 13 bp, Homo sapiens
agagcaggctggc

SEQ ID NO: 268815 - DNA, 24 bp, Homo sapiens
agagcagggattaacctctgcact

SEQ ID NO: 268816 - DNA, 15 bp, Homo sapiens
agagcaggtctgcag

SEQ ID NO: 268817 - DNA, 16 bp, Homo sapiens
agagcaggtctgcagg

SEQ ID NO: 268818 - DNA, 19 bp, Homo sapiens
agagcaggtctgcaggcca

SEQ ID NO: 268819 - DNA, 16 bp, Homo sapiens
agagcatcgtgaccct

SEQ ID NO: 268820 - DNA, 19 bp, Homo sapiens
agagcatcgtgacccttca

SEQ ID NO: 268821 - DNA, 14 bp, Homo sapiens
agagcatctgctct

SEQ ID NO: 268822 - DNA, 16 bp, Homo sapiens
agagcatctgctctga

SEQ ID NO: 268823 - DNA, 18 bp, Homo sapiens
agagcatctgctctgaga

SEQ ID NO: 268824 - DNA, 18 bp, Homo sapiens
agagcatctgtcccactg

SEQ ID NO: 268825 - DNA, 18 bp, Homo sapiens
agagcatgtgggggaagg

SEQ ID NO: 268826 - DNA, 21 bp, Homo sapiens
agagcatgtgtcagagtgttg

SEQ ID NO: 268827 - DNA, 16 bp, Homo sapiens
agagcattattcctgg

SEQ ID NO: 268828 - DNA, 15 bp, Homo sapiens
agagccaacctcggc

SEQ ID NO: 268829 - DNA, 23 bp, Homo sapiens
tcggttccacgtccccctggggc

SEQ ID NO: 268830 - DNA, 21 bp, Homo sapiens
tcggttgaccctactgtggat

SEQ ID NO: 268831 - DNA, 19 bp, Homo sapiens
tcggtttctaacttggagc

SEQ ID NO: 268832 - DNA, 15 bp, Homo sapiens
tcgtacagttcttcg

SEQ ID NO: 268833 - DNA, 19 bp, Homo sapiens
tcgtacataataagtttca

SEQ ID NO: 268834 - DNA, 16 bp, Homo sapiens
tcgtagatgctgccta

SEQ ID NO: 268835 - DNA, 22 bp, Homo sapiens
tcgtagctttcccaaataaact

SEQ ID NO: 268836 - DNA, 21 bp, Homo sapiens
tcgtataacacaatatgaata

SEQ ID NO: 268837 - DNA, 13 bp, Homo sapiens
tcgtatagaaaaa

SEQ ID NO: 268838 - DNA, 23 bp, Homo sapiens
tcgtatagaaaaagcacagctct

SEQ ID NO: 268839 - DNA, 20 bp, Homo sapiens
tcgtcaggaggtgcctgaga

SEQ ID NO: 268840 - DNA, 14 bp, Homo sapiens
tcgtcccctgcctc

SEQ ID NO: 268841 - DNA, 17 bp, Homo sapiens
tcgtccctctgctccgt

SEQ ID NO: 268842 - DNA, 17 bp, Homo sapiens
tcgtccggcctgcagcc

SEQ ID NO: 268843 - DNA, 18 bp, Homo sapiens
tcgtccggcctgcagccc

SEQ ID NO: 268844 - DNA, 19 bp, Homo sapiens
tcgtccggcctgcagccca

SEQ ID NO: 268845 - DNA, 13 bp, Homo sapiens
tcgtcctgtccca

SEQ ID NO: 268846 - DNA, 14 bp, Homo sapiens
tcgtcctgtcccag

SEQ ID NO: 268847 - DNA, 16 bp, Homo sapiens
tcgtcctgtcccagag

SEQ ID NO: 268848 - DNA, 15 bp, Homo sapiens
tcgtctgactgtgtg

SEQ ID NO: 268849 - DNA, 11 bp, Homo sapiens
tcgtctgatgt

SEQ ID NO: 268850 - DNA, 14 bp, Homo sapiens
tcgtgaaaccctgt

SEQ ID NO: 268851 - DNA, 21 bp, Homo sapiens
tcgtgaataagttgattctgt

SEQ ID NO: 268852 - DNA, 20 bp, Homo sapiens
tctatttttttaactgaaaa

SEQ ID NO: 268853 - DNA, 22 bp, Homo sapiens
tctcaaaaaaaaaaaaatgcac

SEQ ID NO: 268854 - DNA, 16 bp, Homo sapiens
tctcaaaaatacaaaa

SEQ ID NO: 268855 - DNA, 13 bp, Homo sapiens
tctcaaaagcatt

SEQ ID NO: 268856 - DNA, 18 bp, Homo sapiens
tctcaaaagcatttatca

SEQ ID NO: 268857 - DNA, 23 bp, Homo sapiens
tctcaaaagcatttatcattctt

SEQ ID NO: 268858 - DNA, 14 bp, Homo sapiens
tctcaaaatgtgcc

SEQ ID NO: 268859 - DNA, 19 bp, Homo sapiens
tctcaaactaaaagacatt

SEQ ID NO: 268860 - DNA, 20 bp, Homo sapiens
tctcaaagcatcaaataata

SEQ ID NO: 268861 - DNA, 19 bp, Homo sapiens
tctcaaagtttttacagtg

SEQ ID NO: 268862 - DNA, 19 bp, Homo sapiens
tctcaagagggcactggtg

SEQ ID NO: 268863 - DNA, 21 bp, Homo sapiens
tctcaagcactaaaaagtggc

SEQ ID NO: 268864 - DNA, 14 bp, Homo sapiens
tctcaagcactgac

SEQ ID NO: 268865 - DNA, 14 bp, Homo sapiens
tctcaaggacacat

SEQ ID NO: 268866 - DNA, 23 bp, Homo sapiens
tctcaagggctagcatccctgag

SEQ ID NO: 268867 - DNA, 15 bp, Homo sapiens
tctcaagtatataaa

SEQ ID NO: 268868 - DNA, 21 bp, Homo sapiens
tctcaatacttgaatatggaa

SEQ ID NO: 268869 - DNA, 23 bp, Homo sapiens
tctcaatacttgaatatggaaca

SEQ ID NO: 268870 - DNA, 17 bp, Homo sapiens
tctcaatattcaataaa

SEQ ID NO: 268871 - DNA, 16 bp, Homo sapiens
tctcaatgcttttcta

SEQ ID NO: 268872 - DNA, 13 bp, Homo sapiens
tctcaatgtgaaa

SEQ ID NO: 268873 - DNA, 16 bp, Homo sapiens
tctcaattttgtattt

SEQ ID NO: 268874 - DNA, 14 bp, Homo sapiens
tctcacatgtggca

SEQ ID NO: 268875 - DNA, 17 bp, Homo sapiens
tctcaccacacataata

SEQ ID NO: 268876 - DNA, 14 bp, Homo sapiens
tctcaccagctcag

SEQ ID NO: 268877 - DNA, 17 bp, Homo sapiens
tctcaccagctcagccc

SEQ ID NO: 268878 - DNA, 16 bp, Homo sapiens
tctcacccactaggat

SEQ ID NO: 268879 - DNA, 19 bp, Homo sapiens
tctcacctaaaaaaagaga

SEQ ID NO: 268880 - DNA, 16 bp, Homo sapiens
tctcacctagctgctc

SEQ ID NO: 268881 - DNA, 17 bp, Homo sapiens
tctcactatgtttctca

SEQ ID NO: 268882 - DNA, 19 bp, Homo sapiens
tctcactatgtttctcaga

SEQ ID NO: 268883 - DNA, 18 bp, Homo sapiens
tctcactccccagcccca

SEQ ID NO: 268884 - DNA, 21 bp, Homo sapiens
tctcactccccagccccaccc

SEQ ID NO: 268885 - DNA, 23 bp, Homo sapiens
tctcactccccagccccacccct

SEQ ID NO: 268886 - DNA, 22 bp, Homo sapiens
tctcactccctttgtggacttt

SEQ ID NO: 268887 - DNA, 23 bp, Homo sapiens
tctcactccctttgtggacttta

SEQ ID NO: 268888 - DNA, 17 bp, Homo sapiens
tctcactcctacctggt

SEQ ID NO: 268889 - DNA, 14 bp, Homo sapiens
tctcactcctagga

SEQ ID NO: 268890 - DNA, 17 bp, Homo sapiens
tctcactggatgcaaag

SEQ ID NO: 268891 - DNA, 17 bp, Homo sapiens
tctcactgtgtacataa

SEQ ID NO: 268892 - DNA, 21 bp, Homo sapiens
tctcactgtgtccctctctct

SEQ ID NO: 268893 - DNA, 16 bp, Homo sapiens
tctcactgttccctct

SEQ ID NO: 268894 - DNA, 14 bp, Homo sapiens
tctcacttatacca

SEQ ID NO: 268895 - DNA, 23 bp, Homo sapiens
tctcagaaaacttctcttctgag

SEQ ID NO: 268896 - DNA, 16 bp, Homo sapiens
tctcagaacagctgaa

SEQ ID NO: 268897 - DNA, 23 bp, Homo sapiens
tctcagaactcctgtgtgtggaa

SEQ ID NO: 268898 - DNA, 21 bp, Homo sapiens
tctcagacccttgaagatgta

SEQ ID NO: 268899 - DNA, 17 bp, Homo sapiens
tctcagaccctttagcc

SEQ ID NO: 268900 - DNA, 15 bp, Homo sapiens
tctcagacgacacct

SEQ ID NO: 268901 - DNA, 16 bp, Homo sapiens
tctcagacttctctta

SEQ ID NO: 268902 - DNA, 18 bp, Homo sapiens
tctcagagactcccagga

SEQ ID NO: 268903 - DNA, 17 bp, Homo sapiens
tctcagagctccacaga

SEQ ID NO: 268904 - DNA, 18 bp, Homo sapiens
tctcagagctccacagaa

SEQ ID NO: 268905 - DNA, 20 bp, Homo sapiens
tctcagaggctatagctggg

SEQ ID NO: 268906 - DNA, 15 bp, Homo sapiens
tctcagataaagtga

SEQ ID NO: 268907 - DNA, 16 bp, Homo sapiens
tctcagatccctcggt

SEQ ID NO: 268908 - DNA, 22 bp, Homo sapiens
tctcagcaaattcttgaataaa

SEQ ID NO: 268909 - DNA, 14 bp, Homo sapiens
tctcagcaagagaa

SEQ ID NO: 268910 - DNA, 11 bp, Homo sapiens
tctcagcaagt

SEQ ID NO: 268911 - DNA, 13 bp, Homo sapiens
tctcagcaagtgt

SEQ ID NO: 268912 - DNA, 14 bp, Homo sapiens
tctcagcaagtgta

SEQ ID NO: 268913 - DNA, 12 bp, Homo sapiens
tctcagcctccc

SEQ ID NO: 268914 - DNA, 17 bp, Homo sapiens
tctcagcctcctgagcc

SEQ ID NO: 268915 - DNA, 15 bp, Homo sapiens
tctcagccttacatt

SEQ ID NO: 268916 - DNA, 16 bp, Homo sapiens
tctcagctccactctg

SEQ ID NO: 268917 - DNA, 17 bp, Homo sapiens
tctcagctccactctga

SEQ ID NO: 268918 - DNA, 15 bp, Homo sapiens
tctcaggagcacagg

SEQ ID NO: 268919 - DNA, 14 bp, Homo sapiens
tctcaggaggaggg

SEQ ID NO: 268920 - DNA, 21 bp, Homo sapiens
tctcaggcatgcctgtgtgac

SEQ ID NO: 268921 - DNA, 13 bp, Homo sapiens
tctcaggccacct

SEQ ID NO: 268922 - DNA, 18 bp, Homo sapiens
tctcaggccacctgcccc

SEQ ID NO: 268923 - DNA, 20 bp, Homo sapiens
tctcagggggtcagcagagt

SEQ ID NO: 268924 - DNA, 14 bp, Homo sapiens
tctcaggtgccact

SEQ ID NO: 268925 - DNA, 15 bp, Homo sapiens
tctcaggtgccactc

SEQ ID NO: 268926 - DNA, 17 bp, Homo sapiens
tctcaggtgccactccc

SEQ ID NO: 268927 - DNA, 21 bp, Homo sapiens
tctcaggtgccactccctgag

SEQ ID NO: 268928 - DNA, 22 bp, Homo sapiens
tctcaggtgccactccctgagc

SEQ ID NO: 268929 - DNA, 16 bp, Homo sapiens
tctcagttctctccct

SEQ ID NO: 268930 - DNA, 16 bp, Homo sapiens
tctcagtttttgctga

SEQ ID NO: 268931 - DNA, 20 bp, Homo sapiens
tctcatagcattaactaatc

SEQ ID NO: 268932 - DNA, 24 bp, Homo sapiens
tctcatagcattaactaatctatt

SEQ ID NO: 268933 - DNA, 23 bp, Homo sapiens
tctcataggaaaagtacatttaa

SEQ ID NO: 268934 - DNA, 24 bp, Homo sapiens
tctcataggaaaagtacatttaat

SEQ ID NO: 268935 - DNA, 16 bp, Homo sapiens
tctcataggagttagg

SEQ ID NO: 268936 - DNA, 21 bp, Homo sapiens
tctcataggagttaggctgtc

SEQ ID NO: 268937 - DNA, 13 bp, Homo sapiens
tctcatattttca

SEQ ID NO: 268938 - DNA, 19 bp, Homo sapiens
tctcatatttttacaaata

SEQ ID NO: 268939 - DNA, 23 bp, Homo sapiens
tctcatcagcccaggtcccagtg

SEQ ID NO: 268940 - DNA, 19 bp, Homo sapiens
tctcatcccacgcactcca

SEQ ID NO: 268941 - DNA, 21 bp, Homo sapiens
tctcatgcactgcaaatactt

SEQ ID NO: 268942 - DNA, 12 bp, Homo sapiens
tctcatggtatt

SEQ ID NO: 268943 - DNA, 23 bp, Homo sapiens
tctcatggtattatctagtaggt

SEQ ID NO: 268944 - DNA, 16 bp, Homo sapiens
tctcatgtgctttgta

SEQ ID NO: 268945 - DNA, 21 bp, Homo sapiens
tctcattcaggtgttctcttc

SEQ ID NO: 268946 - DNA, 12 bp, Homo sapiens
tctcattcagta

SEQ ID NO: 268947 - DNA, 15 bp, Homo sapiens
tctcattcctctgtc

SEQ ID NO: 268948 - DNA, 15 bp, Homo sapiens
tctcattgatcacag

SEQ ID NO: 268949 - DNA, 18 bp, Homo sapiens
tctcattgatcacagatg

SEQ ID NO: 268950 - DNA, 13 bp, Homo sapiens
tctcattgtgaat

SEQ ID NO: 268951 - DNA, 19 bp, Homo sapiens
tctcatttctttcaagaca

SEQ ID NO: 268952 - DNA, 22 bp, Homo sapiens
tctccaaaggggctgctggggc

SEQ ID NO: 268953 - DNA, 19 bp, Homo sapiens
tctccaaggatcctctcca

SEQ ID NO: 268954 - DNA, 22 bp, Homo sapiens
tctccaaggatcctctccactc

SEQ ID NO: 268955 - DNA, 22 bp, Homo sapiens
tctccaagtctctctgtgaata

SEQ ID NO: 268956 - DNA, 16 bp, Homo sapiens
tctccacaacctcctc

SEQ ID NO: 268957 - DNA, 16 bp, Homo sapiens
tctccaccaggaacct

SEQ ID NO: 268958 - DNA, 19 bp, Homo sapiens
tctccacccaccagtcagg

SEQ ID NO: 268959 - DNA, 21 bp, Homo sapiens
tctccacccctcaagccagga

SEQ ID NO: 268960 - DNA, 22 bp, Homo sapiens
tctccacccctcaagccaggag

SEQ ID NO: 268961 - DNA, 12 bp, Homo sapiens
tctccacctccc

SEQ ID NO: 268962 - DNA, 23 bp, Homo sapiens
tctccacctcccccaaaccctgc

SEQ ID NO: 268963 - DNA, 15 bp, Homo sapiens
tctccagacccccac

SEQ ID NO: 268964 - DNA, 19 bp, Homo sapiens
tctccagacccccacccct

SEQ ID NO: 268965 - DNA, 20 bp, Homo sapiens
tctccagacccccacccctt

SEQ ID NO: 268966 - DNA, 18 bp, Homo sapiens
tctccagcctcagctctc

SEQ ID NO: 268967 - DNA, 12 bp, Homo sapiens
tctccagctgat

SEQ ID NO: 268968 - DNA, 13 bp, Homo sapiens
tctccaggcccag

SEQ ID NO: 268969 - DNA, 19 bp, Homo sapiens
tctccaggcccagcctggc

SEQ ID NO: 268970 - DNA, 20 bp, Homo sapiens
tctccaggcccagcctggcc

SEQ ID NO: 268971 - DNA, 20 bp, Homo sapiens
tctccatggccctgccatgc

SEQ ID NO: 268972 - DNA, 17 bp, Homo sapiens
tctccatttttcccagg

SEQ ID NO: 268973 - DNA, 21 bp, Homo sapiens
tctcccaaataaactccttaa

SEQ ID NO: 268974 - DNA, 23 bp, Homo sapiens
tctcccaaataaactccttaacc

SEQ ID NO: 268975 - DNA, 16 bp, Homo sapiens
tctcccacatcccact

SEQ ID NO: 268976 - DNA, 19 bp, Homo sapiens
tctcccagacttgtttcct

SEQ ID NO: 268977 - DNA, 21 bp, Homo sapiens
tctcccagacttgtttcctgt

SEQ ID NO: 268978 - DNA, 13 bp, Homo sapiens
tctcccagaggct

SEQ ID NO: 268979 - DNA, 20 bp, Homo sapiens
tctcccagaggctcctggag

SEQ ID NO: 268980 - DNA, 16 bp, Homo sapiens
tctcccaggccccctg

SEQ ID NO: 268981 - DNA, 18 bp, Homo sapiens
tctcccatgggggctcca

SEQ ID NO: 268982 - DNA, 20 bp, Homo sapiens
tctccccagtgcctgccact

SEQ ID NO: 268983 - DNA, 23 bp, Homo sapiens
tctccccagtgcctgccactctc

SEQ ID NO: 268984 - DNA, 13 bp, Homo sapiens
tctccccatatat

SEQ ID NO: 268985 - DNA, 18 bp, Homo sapiens
tctccccatatataaatt

SEQ ID NO: 268986 - DNA, 21 bp, Homo sapiens
tctccccatatataaattatt

SEQ ID NO: 268987 - DNA, 21 bp, Homo sapiens
tctccccatccccttcctaaa

SEQ ID NO: 268988 - DNA, 20 bp, Homo sapiens
tctcccccaaacccacgcgt

SEQ ID NO: 268989 - DNA, 20 bp, Homo sapiens
tctccccgcagcccgcctgc

SEQ ID NO: 268990 - DNA, 12 bp, Homo sapiens
tctcccctccag

SEQ ID NO: 268991 - DNA, 13 bp, Homo sapiens
tctcccctccaga

SEQ ID NO: 268992 - DNA, 14 bp, Homo sapiens
tctcccctccagac

SEQ ID NO: 268993 - DNA, 19 bp, Homo sapiens
tctcccctccagaccccta

SEQ ID NO: 268994 - DNA, 14 bp, Homo sapiens
tctcccctctcgcc

SEQ ID NO: 268995 - DNA, 20 bp, Homo sapiens
tctcccctctcgccccatcc

SEQ ID NO: 268996 - DNA, 12 bp, Homo sapiens
tctcccctctgc

SEQ ID NO: 268997 - DNA, 14 bp, Homo sapiens
tctcccctgcactg

SEQ ID NO: 268998 - DNA, 17 bp, Homo sapiens
tctcccctgcactgtaa

SEQ ID NO: 268999 - DNA, 14 bp, Homo sapiens
tctcccctgccctg

SEQ ID NO: 269000 - DNA, 17 bp, Homo sapiens
tctcccctgccctgctg

SEQ ID NO: 269001 - DNA, 17 bp, Homo sapiens
tctcccctgcgcaggcc

SEQ ID NO: 269002 - DNA, 14 bp, Homo sapiens
tctcccggctgcct

SEQ ID NO: 269003 - DNA, 17 bp, Homo sapiens
tctcccggctgcctgcc

SEQ ID NO: 269004 - DNA, 15 bp, Homo sapiens
tctccctaaccacta

SEQ ID NO: 269005 - DNA, 20 bp, Homo sapiens
tctccctaccctcttctcag

SEQ ID NO: 269006 - DNA, 21 bp, Homo sapiens
tctccctaccctcttctcagc

SEQ ID NO: 269007 - DNA, 18 bp, Homo sapiens
tctccctataatgctgga

SEQ ID NO: 269008 - DNA, 14 bp, Homo sapiens
tctccctctctgca

SEQ ID NO: 269009 - DNA, 21 bp, Homo sapiens
tctccctcttctcaagtgcct

SEQ ID NO: 269010 - DNA, 21 bp, Homo sapiens
tctccctgagcctgccccagc

SEQ ID NO: 269011 - DNA, 14 bp, Homo sapiens
tctccctgcctcac

SEQ ID NO: 269012 - DNA, 19 bp, Homo sapiens
tctccctggccacccttgg

SEQ ID NO: 269013 - DNA, 20 bp, Homo sapiens
tctccctggccacccttggc

SEQ ID NO: 269014 - DNA, 22 bp, Homo sapiens
tctccctggccacccttggcct

SEQ ID NO: 269015 - DNA, 19 bp, Homo sapiens
tctcccttctttaccttca

SEQ ID NO: 269016 - DNA, 22 bp, Homo sapiens
tctccggggtctgtgctgtgcc

SEQ ID NO: 269017 - DNA, 13 bp, Homo sapiens
tctccgtatttat

SEQ ID NO: 269018 - DNA, 23 bp, Homo sapiens
tctcctaccccacctcatgcctg

SEQ ID NO: 269019 - DNA, 20 bp, Homo sapiens
tctcctaccctcttattgtt

SEQ ID NO: 269020 - DNA, 15 bp, Homo sapiens
tctcctactctgtgt

SEQ ID NO: 269021 - DNA, 20 bp, Homo sapiens
tctcctagagacagaagcag

SEQ ID NO: 269022 - DNA, 19 bp, Homo sapiens
tctcctatcttttatttca

SEQ ID NO: 269023 - DNA, 14 bp, Homo sapiens
tctcctcaccccag

SEQ ID NO: 269024 - DNA, 18 bp, Homo sapiens
tctcctcaccccagtgcc

SEQ ID NO: 269025 - DNA, 18 bp, Homo sapiens
tctcctcccatggccttc

SEQ ID NO: 269026 - DNA, 15 bp, Homo sapiens
tctcctccccacccg

SEQ ID NO: 269027 - DNA, 14 bp, Homo sapiens
tctcctcggccccc

SEQ ID NO: 269028 - DNA, 22 bp, Homo sapiens
tctcctcggtggcatttgctga

SEQ ID NO: 269029 - DNA, 23 bp, Homo sapiens
tctcctcggtggcatttgctgaa

SEQ ID NO: 269030 - DNA, 14 bp, Homo sapiens
tctcctctcagctt

SEQ ID NO: 269031 - DNA, 15 bp, Homo sapiens
tctcctctcagcttc

SEQ ID NO: 269032 - DNA, 16 bp, Homo sapiens
tctcctctccagccct

SEQ ID NO: 269033 - DNA, 17 bp, Homo sapiens
tctcctctccagcccta

SEQ ID NO: 269034 - DNA, 13 bp, Homo sapiens
tctcctctcccca

SEQ ID NO: 269035 - DNA, 21 bp, Homo sapiens
tctcctctccccaacccttcc

SEQ ID NO: 269036 - DNA, 13 bp, Homo sapiens
tctcctctcccct

SEQ ID NO: 269037 - DNA, 16 bp, Homo sapiens
tctcctctcccctcta

SEQ ID NO: 269038 - DNA, 15 bp, Homo sapiens
tctcctctctctccc

SEQ ID NO: 269039 - DNA, 22 bp, Homo sapiens
tctcctctctctccctccactc

SEQ ID NO: 269040 - DNA, 14 bp, Homo sapiens
tctcctctctgggc

SEQ ID NO: 269041 - DNA, 13 bp, Homo sapiens
tctcctcttgcca

SEQ ID NO: 269042 - DNA, 17 bp, Homo sapiens
tctcctcttgccactgc

SEQ ID NO: 269043 - DNA, 17 bp, Homo sapiens
tctcctgacccagtccc

SEQ ID NO: 269044 - DNA, 17 bp, Homo sapiens
tctcctgagcctgtctc

SEQ ID NO: 269045 - DNA, 19 bp, Homo sapiens
tctcctgagcctgtctctc

SEQ ID NO: 269046 - DNA, 23 bp, Homo sapiens
tctcctgatagtcacctgctggt

SEQ ID NO: 269047 - DNA, 15 bp, Homo sapiens
tctcctgcatccctc

SEQ ID NO: 269048 - DNA, 13 bp, Homo sapiens
tctcctgcatgca

SEQ ID NO: 269049 - DNA, 16 bp, Homo sapiens
tctcctgcccagctct

SEQ ID NO: 269050 - DNA, 22 bp, Homo sapiens
tctcctgcccagctctgaccct

SEQ ID NO: 269051 - DNA, 18 bp, Homo sapiens
tctcctgcctcagccttc

SEQ ID NO: 269052 - DNA, 18 bp, Homo sapiens
tctcctgctctttctaca

SEQ ID NO: 269053 - DNA, 14 bp, Homo sapiens
tctcctgcttgtac

SEQ ID NO: 269054 - DNA, 22 bp, Homo sapiens
tctcctgggcccctccctacct

SEQ ID NO: 269055 - DNA, 23 bp, Homo sapiens
tctcctgggcccctccctacctc

SEQ ID NO: 269056 - DNA, 17 bp, Homo sapiens
tctcctggtagcatgac

SEQ ID NO: 269057 - DNA, 19 bp, Homo sapiens
tctcctggtagcatgacct

SEQ ID NO: 269058 - DNA, 16 bp, Homo sapiens
tctcctgtgagctccc

SEQ ID NO: 269059 - DNA, 10 bp, Homo sapiens
tctcctgtgc

SEQ ID NO: 269060 - DNA, 12 bp, Homo sapiens
tctcctgtgccc

SEQ ID NO: 269061 - DNA, 15 bp, Homo sapiens
tctcctgtgcccaca

SEQ ID NO: 269062 - DNA, 18 bp, Homo sapiens
tctcctgtttcccttccc

SEQ ID NO: 269063 - DNA, 17 bp, Homo sapiens
tctccttactctgagcc

SEQ ID NO: 269064 - DNA, 19 bp, Homo sapiens
tctccttactctgagccca

SEQ ID NO: 269065 - DNA, 19 bp, Homo sapiens
tctccttagtcttctcata

SEQ ID NO: 269066 - DNA, 12 bp, Homo sapiens
tctccttcactc

SEQ ID NO: 269067 - DNA, 22 bp, Homo sapiens
tctccttccaactgctgcccca

SEQ ID NO: 269068 - DNA, 22 bp, Homo sapiens
tctccttccacaatgactgctt

SEQ ID NO: 269069 - DNA, 19 bp, Homo sapiens
tctccttcccactgtcctt

SEQ ID NO: 269070 - DNA, 21 bp, Homo sapiens
tctccttcccatttctctaca

SEQ ID NO: 269071 - DNA, 16 bp, Homo sapiens
tctccttcccccagcc

SEQ ID NO: 269072 - DNA, 19 bp, Homo sapiens
tctccttcccccagcccaa

SEQ ID NO: 269073 - DNA, 19 bp, Homo sapiens
tctccttcgtgtctctccc

SEQ ID NO: 269074 - DNA, 20 bp, Homo sapiens
tctccttcgtgtctctccca

SEQ ID NO: 269075 - DNA, 13 bp, Homo sapiens
tctccttctcctt

SEQ ID NO: 269076 - DNA, 13 bp, Homo sapiens
tctccttgccctg

SEQ ID NO: 269077 - DNA, 18 bp, Homo sapiens
tctccttgccctgggcca

SEQ ID NO: 269078 - DNA, 23 bp, Homo sapiens
tctccttgccctgggccagccca

SEQ ID NO: 269079 - DNA, 16 bp, Homo sapiens
tctccttgggctcctg

SEQ ID NO: 269080 - DNA, 19 bp, Homo sapiens
tctccttgggctcctggct

SEQ ID NO: 269081 - DNA, 16 bp, Homo sapiens
tctcctttcacaacct

SEQ ID NO: 269082 - DNA, 18 bp, Homo sapiens
tctcctttgatattatgt

SEQ ID NO: 269083 - DNA, 23 bp, Homo sapiens
tctcctttgcactgagggccaca

SEQ ID NO: 269084 - DNA, 15 bp, Homo sapiens
tctccttttgaggct

SEQ ID NO: 269085 - DNA, 15 bp, Homo sapiens
tctcgaactcctggc

SEQ ID NO: 269086 - DNA, 22 bp, Homo sapiens
tctcgaagtcttccatcagcag

SEQ ID NO: 269087 - DNA, 23 bp, Homo sapiens
tctcgagccccctggatgtcccc

SEQ ID NO: 269088 - DNA, 14 bp, Homo sapiens
tctcgccccatccc

SEQ ID NO: 269089 - DNA, 17 bp, Homo sapiens
tctcgctctgttgccca

SEQ ID NO: 269090 - DNA, 21 bp, Homo sapiens
tctcggaactgcatgctgctg

SEQ ID NO: 269091 - DNA, 12 bp, Homo sapiens
tctcggaggcca

SEQ ID NO: 269092 - DNA, 15 bp, Homo sapiens
tctcggaggccaggc

SEQ ID NO: 269093 - DNA, 19 bp, Homo sapiens
tctcggctggaagaacatc

SEQ ID NO: 269094 - DNA, 12 bp, Homo sapiens
agagccaagttc

SEQ ID NO: 269095 - DNA, 13 bp, Homo sapiens
agagccagcctgg

SEQ ID NO: 269096 - DNA, 18 bp, Homo sapiens
agagccagcctgggactc

SEQ ID NO: 269097 - DNA, 13 bp, Homo sapiens
agagccagccttg

SEQ ID NO: 269098 - DNA, 12 bp, Homo sapiens
agagccagggct

SEQ ID NO: 269099 - DNA, 17 bp, Homo sapiens
agagccagggctgtcct

SEQ ID NO: 269100 - DNA, 19 bp, Homo sapiens
agagccatggactctacac

SEQ ID NO: 269101 - DNA, 17 bp, Homo sapiens
agagccatgggcctggg

SEQ ID NO: 269102 - DNA, 17 bp, Homo sapiens
agagcccaatcactgcc

SEQ ID NO: 269103 - DNA, 14 bp, Homo sapiens
agagcccaggcctg

SEQ ID NO: 269104 - DNA, 13 bp, Homo sapiens
agagccccactcc

SEQ ID NO: 269105 - DNA, 14 bp, Homo sapiens
agagccccagctga

SEQ ID NO: 269106 - DNA, 19 bp, Homo sapiens
agagcccccaccagcagca

SEQ ID NO: 269107 - DNA, 21 bp, Homo sapiens
agagccccgcaaaacccactg

SEQ ID NO: 269108 - DNA, 17 bp, Homo sapiens
agagccccggagcacca

SEQ ID NO: 269109 - DNA, 19 bp, Homo sapiens
agagccctggacacccctg

SEQ ID NO: 269110 - DNA, 20 bp, Homo sapiens
agagccctggacacccctgc

SEQ ID NO: 269111 - DNA, 17 bp, Homo sapiens
agagcccttcactgcca

SEQ ID NO: 269112 - DNA, 20 bp, Homo sapiens
agagcccttcactgccatga

SEQ ID NO: 269113 - DNA, 21 bp, Homo sapiens
agagccgccccgtgtcccccc

SEQ ID NO: 269114 - DNA, 18 bp, Homo sapiens
agagcctaagaaaatcat

SEQ ID NO: 269115 - DNA, 21 bp, Homo sapiens
agagcctatggaaagggtgtg

SEQ ID NO: 269116 - DNA, 13 bp, Homo sapiens
agagcctcttagt

SEQ ID NO: 269117 - DNA, 10 bp, Homo sapiens
agagcctgcc

SEQ ID NO: 269118 - DNA, 19 bp, Homo sapiens
agagcctgcccggccggag

SEQ ID NO: 269119 - DNA, 20 bp, Homo sapiens
agagcctgcccggccggaga

SEQ ID NO: 269120 - DNA, 12 bp, Homo sapiens
agagcctgctgc

SEQ ID NO: 269121 - DNA, 18 bp, Homo sapiens
agagcctggtgctgctgc

SEQ ID NO: 269122 - DNA, 12 bp, Homo sapiens
agagcctgtccc

SEQ ID NO: 269123 - DNA, 19 bp, Homo sapiens
agagcctgtccccgccttc

SEQ ID NO: 269124 - DNA, 22 bp, Homo sapiens
agagccttctgatgtctctaaa

SEQ ID NO: 269125 - DNA, 14 bp, Homo sapiens
agagcgaggctgag

SEQ ID NO: 269126 - DNA, 16 bp, Homo sapiens
agagcgccacccgccc

SEQ ID NO: 269127 - DNA, 13 bp, Homo sapiens
agagcgcccctcc

SEQ ID NO: 269128 - DNA, 21 bp, Homo sapiens
agagcgcgggagagagtgaga

SEQ ID NO: 269129 - DNA, 16 bp, Homo sapiens
agagcgctcctctgcc

SEQ ID NO: 269130 - DNA, 19 bp, Homo sapiens
agagcgctcctctgccttg

SEQ ID NO: 269131 - DNA, 13 bp, Homo sapiens
agagctatgcaca

SEQ ID NO: 269132 - DNA, 14 bp, Homo sapiens
agagctcaggagaa

SEQ ID NO: 269133 - DNA, 17 bp, Homo sapiens
agagctcagtatactaa

SEQ ID NO: 269134 - DNA, 21 bp, Homo sapiens
agagctcagtatactaatgcc

SEQ ID NO: 269135 - DNA, 13 bp, Homo sapiens
agagctccacaga

SEQ ID NO: 269136 - DNA, 14 bp, Homo sapiens
agagctcccaggac

SEQ ID NO: 269137 - DNA, 14 bp, Homo sapiens
agagctctgcacgt

SEQ ID NO: 269138 - DNA, 20 bp, Homo sapiens
agagctcttagtttttaaaa

SEQ ID NO: 269139 - DNA, 22 bp, Homo sapiens
agagctcttagtttttaaaaag

SEQ ID NO: 269140 - DNA, 22 bp, Homo sapiens
agagctcttttttagctctctt

SEQ ID NO: 269141 - DNA, 23 bp, Homo sapiens
agagctcttttttagctctctta

SEQ ID NO: 269142 - DNA, 18 bp, Homo sapiens
agagctgatccagagcac

SEQ ID NO: 269143 - DNA, 15 bp, Homo sapiens
agagctgcagttgtg

SEQ ID NO: 269144 - DNA, 21 bp, Homo sapiens
agagctgcagttgtgaaagca

SEQ ID NO: 269145 - DNA, 12 bp, Homo sapiens
agagctgctgag

SEQ ID NO: 269146 - DNA, 16 bp, Homo sapiens
agagctggaaggcagg

SEQ ID NO: 269147 - DNA, 21 bp, Homo sapiens
agagctggaaggcagggcaga

SEQ ID NO: 269148 - DNA, 22 bp, Homo sapiens
agagctggaaggcagggcagag

SEQ ID NO: 269149 - DNA, 13 bp, Homo sapiens
agagctgggaggg

SEQ ID NO: 269150 - DNA, 18 bp, Homo sapiens
agagctgggtaccaggcc

SEQ ID NO: 269151 - DNA, 20 bp, Homo sapiens
agagctgggtaccaggccac

SEQ ID NO: 269152 - DNA, 14 bp, Homo sapiens
agagctgggtgggg

SEQ ID NO: 269153 - DNA, 17 bp, Homo sapiens
agagctgtctgaactca

SEQ ID NO: 269154 - DNA, 20 bp, Homo sapiens
agagctgtttatggcctcag

SEQ ID NO: 269155 - DNA, 15 bp, Homo sapiens
agagctgttttggat

SEQ ID NO: 269156 - DNA, 22 bp, Homo sapiens
agagctgttttggatgaatgca

SEQ ID NO: 269157 - DNA, 18 bp, Homo sapiens
agagcttattggccactg

SEQ ID NO: 269158 - DNA, 19 bp, Homo sapiens
agagcttattggccactgg

SEQ ID NO: 269159 - DNA, 19 bp, Homo sapiens
agagcttcagaggtggccc

SEQ ID NO: 269160 - DNA, 22 bp, Homo sapiens
agagcttcagggctgggcaggt

SEQ ID NO: 269161 - DNA, 22 bp, Homo sapiens
agagcttgattagaagccaaga

SEQ ID NO: 269162 - DNA, 15 bp, Homo sapiens
agagcttttaaaaat

SEQ ID NO: 269163 - DNA, 16 bp, Homo sapiens
agagcttttaaaaatg

SEQ ID NO: 269164 - DNA, 19 bp, Homo sapiens
agaggaaaagtaaggtgca

SEQ ID NO: 269165 - DNA, 21 bp, Homo sapiens
agaggaaaagtaaggtgcagt

SEQ ID NO: 269166 - DNA, 23 bp, Homo sapiens
agaggaaattaaataattttaca

SEQ ID NO: 269167 - DNA, 21 bp, Homo sapiens
agaggaactccttggcctagc

SEQ ID NO: 269168 - DNA, 13 bp, Homo sapiens
agaggaactgggc

SEQ ID NO: 269169 - DNA, 20 bp, Homo sapiens
agaggaagcacaagaagtgg

SEQ ID NO: 269170 - DNA, 16 bp, Homo sapiens
agaggaagccttgccc

SEQ ID NO: 269171 - DNA, 21 bp, Homo sapiens
agaggaagccttgcccagcaa

SEQ ID NO: 269172 - DNA, 14 bp, Homo sapiens
agaggaccacagtg

SEQ ID NO: 269173 - DNA, 19 bp, Homo sapiens
agaggaccacagtgggtgg

SEQ ID NO: 269174 - DNA, 14 bp, Homo sapiens
agaggacgtgggcg

SEQ ID NO: 269175 - DNA, 16 bp, Homo sapiens
agaggacgtgggcggc

SEQ ID NO: 269176 - DNA, 14 bp, Homo sapiens
agaggagaaacaca

SEQ ID NO: 269177 - DNA, 15 bp, Homo sapiens
agaggagaaacacat

SEQ ID NO: 269178 - DNA, 14 bp, Homo sapiens
agaggagagcatct

SEQ ID NO: 269179 - DNA, 17 bp, Homo sapiens
agaggagagcatctgct

SEQ ID NO: 269180 - DNA, 22 bp, Homo sapiens
agaggagagcatctgctctgag

SEQ ID NO: 269181 - DNA, 14 bp, Homo sapiens
agaggagcacctga

SEQ ID NO: 269182 - DNA, 15 bp, Homo sapiens
agaggagcaggaagc

SEQ ID NO: 269183 - DNA, 20 bp, Homo sapiens
agaggagcaggaagcaaggc

SEQ ID NO: 269184 - DNA, 15 bp, Homo sapiens
agaggagccacctgg

SEQ ID NO: 269185 - DNA, 20 bp, Homo sapiens
agaggagcgggacctgtggc

SEQ ID NO: 269186 - DNA, 12 bp, Homo sapiens
agaggaggatgg

SEQ ID NO: 269187 - DNA, 19 bp, Homo sapiens
agaggagggatagagacgc

SEQ ID NO: 269188 - DNA, 16 bp, Homo sapiens
agaggaggggtaaata

SEQ ID NO: 269189 - DNA, 14 bp, Homo sapiens
agaggaggtgtgga

SEQ ID NO: 269190 - DNA, 13 bp, Homo sapiens
agaggagttcaat

SEQ ID NO: 269191 - DNA, 18 bp, Homo sapiens
agaggagttcaatgatct

SEQ ID NO: 269192 - DNA, 19 bp, Homo sapiens
agaggagttcaatgatcta

SEQ ID NO: 269193 - DNA, 14 bp, Homo sapiens
agaggatgttctgg

SEQ ID NO: 269194 - DNA, 15 bp, Homo sapiens
agaggattctgtctt

SEQ ID NO: 269195 - DNA, 23 bp, Homo sapiens
agaggcaacagtgttctgagccc

SEQ ID NO: 269196 - DNA, 16 bp, Homo sapiens
agaggcacctgctgga

SEQ ID NO: 269197 - DNA, 19 bp, Homo sapiens
agaggcagaaccctggtga

SEQ ID NO: 269198 - DNA, 21 bp, Homo sapiens
agaggcagagtgccccacctg

SEQ ID NO: 269199 - DNA, 13 bp, Homo sapiens
agaggcagggccc

SEQ ID NO: 269200 - DNA, 14 bp, Homo sapiens
agaggcagggccct

SEQ ID NO: 269201 - DNA, 17 bp, Homo sapiens
agaggcagggccctggg

SEQ ID NO: 269202 - DNA, 16 bp, Homo sapiens
agaggcatgacagctg

SEQ ID NO: 269203 - DNA, 15 bp, Homo sapiens
agaggcatttgtctt

SEQ ID NO: 269204 - DNA, 16 bp, Homo sapiens
agaggcatttgtctta

SEQ ID NO: 269205 - DNA, 23 bp, Homo sapiens
agaggccagccccacccaggagg

SEQ ID NO: 269206 - DNA, 18 bp, Homo sapiens
agaggcctcccccagcca

SEQ ID NO: 269207 - DNA, 23 bp, Homo sapiens
agaggcctccctggctgcctctg

SEQ ID NO: 269208 - DNA, 21 bp, Homo sapiens
agaggccttgggggtctgctc

SEQ ID NO: 269209 - DNA, 22 bp, Homo sapiens
agaggccttgggggtctgctct

SEQ ID NO: 269210 - DNA, 14 bp, Homo sapiens
agaggccttttgtt

SEQ ID NO: 269211 - DNA, 16 bp, Homo sapiens
agaggcgtcctggtga

SEQ ID NO: 269212 - DNA, 17 bp, Homo sapiens
agaggcgtcttgtattt

SEQ ID NO: 269213 - DNA, 19 bp, Homo sapiens
agaggcgtcttgtattttc

SEQ ID NO: 269214 - DNA, 14 bp, Homo sapiens
agaggctagcccca

SEQ ID NO: 269215 - DNA, 23 bp, Homo sapiens
agaggctctgaaagctgcttctg

SEQ ID NO: 269216 - DNA, 17 bp, Homo sapiens
agaggctgaggcctgga

SEQ ID NO: 269217 - DNA, 19 bp, Homo sapiens
agaggctgaggcctggact

SEQ ID NO: 269218 - DNA, 22 bp, Homo sapiens
agaggctgaggtgggcagatca

SEQ ID NO: 269219 - DNA, 21 bp, Homo sapiens
agagggaaggggcctacaccc

SEQ ID NO: 269220 - DNA, 13 bp, Homo sapiens
agagggaatgtga

SEQ ID NO: 269221 - DNA, 14 bp, Homo sapiens
agagggaatgtgaa

SEQ ID NO: 269222 - DNA, 21 bp, Homo sapiens
tctcggctggaagaacatcaa

SEQ ID NO: 269223 - DNA, 22 bp, Homo sapiens
tctcggctggaagaacatcaag

SEQ ID NO: 269224 - DNA, 15 bp, Homo sapiens
tctcgtccctctgct

SEQ ID NO: 269225 - DNA, 20 bp, Homo sapiens
tctctaaaaataaaatgatg

SEQ ID NO: 269226 - DNA, 18 bp, Homo sapiens
tctctaaatcaagtattt

SEQ ID NO: 269227 - DNA, 17 bp, Homo sapiens
tctctaacagctcagga

SEQ ID NO: 269228 - DNA, 18 bp, Homo sapiens
tctctaacagctcaggat

SEQ ID NO: 269229 - DNA, 13 bp, Homo sapiens
tctctaacttatt

SEQ ID NO: 269230 - DNA, 18 bp, Homo sapiens
tctctaacttattttatt

SEQ ID NO: 269231 - DNA, 22 bp, Homo sapiens
tctctaacttcaaggcccatat

SEQ ID NO: 269232 - DNA, 19 bp, Homo sapiens
tctctaattccatccataa

SEQ ID NO: 269233 - DNA, 12 bp, Homo sapiens
tctctacccagc

SEQ ID NO: 269234 - DNA, 20 bp, Homo sapiens
tctctactaaaaataagaaa

SEQ ID NO: 269235 - DNA, 19 bp, Homo sapiens
tctctactaccacaaggaa

SEQ ID NO: 269236 - DNA, 20 bp, Homo sapiens
tctctactaccacaaggaaa

SEQ ID NO: 269237 - DNA, 17 bp, Homo sapiens
tctctagaattttaagt

SEQ ID NO: 269238 - DNA, 13 bp, Homo sapiens
tctctaggaaagt

SEQ ID NO: 269239 - DNA, 21 bp, Homo sapiens
tctctagggaaggccacctgc

SEQ ID NO: 269240 - DNA, 20 bp, Homo sapiens
tctctagtccctgtgttctg

SEQ ID NO: 269241 - DNA, 14 bp, Homo sapiens
tctctagttccctc

SEQ ID NO: 269242 - DNA, 19 bp, Homo sapiens
tctctatatatacatgtat

SEQ ID NO: 269243 - DNA, 20 bp, Homo sapiens
tctctatgcaaaatgtctgt

SEQ ID NO: 269244 - DNA, 21 bp, Homo sapiens
tctctattggaggtgagatca

SEQ ID NO: 269245 - DNA, 16 bp, Homo sapiens
tctctcaatttgggtc

SEQ ID NO: 269246 - DNA, 22 bp, Homo sapiens
tctctcacctacttcctcctcc

SEQ ID NO: 269247 - DNA, 17 bp, Homo sapiens
tctctcagccttacatt

SEQ ID NO: 269248 - DNA, 14 bp, Homo sapiens
tctctcaggagcac

SEQ ID NO: 269249 - DNA, 15 bp, Homo sapiens
tctctcaggagcaca

SEQ ID NO: 269250 - DNA, 19 bp, Homo sapiens
tctctcaggagcacaggca

SEQ ID NO: 269251 - DNA, 11 bp, Homo sapiens
tctctcatgtg

SEQ ID NO: 269252 - DNA, 22 bp, Homo sapiens
tctctcccaccccggcctccac

SEQ ID NO: 269253 - DNA, 21 bp, Homo sapiens
tctctccccaatgctctcctt

SEQ ID NO: 269254 - DNA, 18 bp, Homo sapiens
tctctccccatatataaa

SEQ ID NO: 269255 - DNA, 18 bp, Homo sapiens
tctctccccttgcactgg

SEQ ID NO: 269256 - DNA, 21 bp, Homo sapiens
tctctccccttgcactggtca

SEQ ID NO: 269257 - DNA, 16 bp, Homo sapiens
tctctccccttttcct

SEQ ID NO: 269258 - DNA, 20 bp, Homo sapiens
tctctccctccactcctccc

SEQ ID NO: 269259 - DNA, 14 bp, Homo sapiens
tctctccctcccct

SEQ ID NO: 269260 - DNA, 14 bp, Homo sapiens
tctctccctgcctc

SEQ ID NO: 269261 - DNA, 16 bp, Homo sapiens
tctctccctgcctcac

SEQ ID NO: 269262 - DNA, 13 bp, Homo sapiens
tctctcccttact

SEQ ID NO: 269263 - DNA, 20 bp, Homo sapiens
tctctcccttcctctctcct

SEQ ID NO: 269264 - DNA, 15 bp, Homo sapiens
tctctcccttcttta

SEQ ID NO: 269265 - DNA, 16 bp, Homo sapiens
tctctcctctctctcc

SEQ ID NO: 269266 - DNA, 17 bp, Homo sapiens
tctctcctgtgagctcc

SEQ ID NO: 269267 - DNA, 14 bp, Homo sapiens
tctctcctttcttt

SEQ ID NO: 269268 - DNA, 23 bp, Homo sapiens
tctctcggagtatctgggaactg

SEQ ID NO: 269269 - DNA, 20 bp, Homo sapiens
tctctctaaaaataaaatga

SEQ ID NO: 269270 - DNA, 22 bp, Homo sapiens
tctctctaggagggagccttgt

SEQ ID NO: 269271 - DNA, 21 bp, Homo sapiens
tctctctatatatacatgtat

SEQ ID NO: 269272 - DNA, 11 bp, Homo sapiens
tctctctccct

SEQ ID NO: 269273 - DNA, 13 bp, Homo sapiens
tctctctccctcc

SEQ ID NO: 269274 - DNA, 13 bp, Homo sapiens
tctctctccctta

SEQ ID NO: 269275 - DNA, 15 bp, Homo sapiens
tctctctctctctgt

SEQ ID NO: 269276 - DNA, 16 bp, Homo sapiens
tctctctctctctgtt

SEQ ID NO: 269277 - DNA, 12 bp, Homo sapiens
tctctctctctg

SEQ ID NO: 269278 - DNA, 14 bp, Homo sapiens
tctctctctctgtt

SEQ ID NO: 269279 - DNA, 13 bp, Homo sapiens
tctctctgctcct

SEQ ID NO: 269280 - DNA, 14 bp, Homo sapiens
tctctctgctcctc

SEQ ID NO: 269281 - DNA, 12 bp, Homo sapiens
tctctctggaaa

SEQ ID NO: 269282 - DNA, 9 bp, Homo sapiens
tctctctgt

SEQ ID NO: 269283 - DNA, 20 bp, Homo sapiens
tctctctgtgtggcaaacat

SEQ ID NO: 269284 - DNA, 13 bp, Homo sapiens
tctctctgttgtg

SEQ ID NO: 269285 - DNA, 19 bp, Homo sapiens
tctctcttctgctccaccc

SEQ ID NO: 269286 - DNA, 20 bp, Homo sapiens
tctctcttctgctccaccct

SEQ ID NO: 269287 - DNA, 16 bp, Homo sapiens
tctctcttggtctctt

SEQ ID NO: 269288 - DNA, 15 bp, Homo sapiens
tctctctttccatct

SEQ ID NO: 269289 - DNA, 21 bp, Homo sapiens
tctctctttccatctcccttg

SEQ ID NO: 269290 - DNA, 13 bp, Homo sapiens
tctctctttttct

SEQ ID NO: 269291 - DNA, 21 bp, Homo sapiens
tctctgacaatgcgtggcaca

SEQ ID NO: 269292 - DNA, 17 bp, Homo sapiens
tctctgagatgcccctc

SEQ ID NO: 269293 - DNA, 17 bp, Homo sapiens
tctctgagccccctgtg

SEQ ID NO: 269294 - DNA, 23 bp, Homo sapiens
tctctgagctccagtggaagaag

SEQ ID NO: 269295 - DNA, 15 bp, Homo sapiens
tctctgagctttgtt

SEQ ID NO: 269296 - DNA, 12 bp, Homo sapiens
tctctgaggcta

SEQ ID NO: 269297 - DNA, 15 bp, Homo sapiens
tctctgattaaattt

SEQ ID NO: 269298 - DNA, 11 bp, Homo sapiens
tctctgcaccc

SEQ ID NO: 269299 - DNA, 17 bp, Homo sapiens
tctctgccacccactca

SEQ ID NO: 269300 - DNA, 18 bp, Homo sapiens
tctctgccacccactcag

SEQ ID NO: 269301 - DNA, 15 bp, Homo sapiens
tctctgccagctcca

SEQ ID NO: 269302 - DNA, 15 bp, Homo sapiens
tctctgccagtgaca

SEQ ID NO: 269303 - DNA, 21 bp, Homo sapiens
tctctgccagtgacagacagg

SEQ ID NO: 269304 - DNA, 21 bp, Homo sapiens
tctctgccatgtggcagaagt

SEQ ID NO: 269305 - DNA, 21 bp, Homo sapiens
tctctgccggctctttccttg

SEQ ID NO: 269306 - DNA, 11 bp, Homo sapiens
tctctgctcca

SEQ ID NO: 269307 - DNA, 12 bp, Homo sapiens
tctctgctccac

SEQ ID NO: 269308 - DNA, 13 bp, Homo sapiens
tctctgctccacc

SEQ ID NO: 269309 - DNA, 14 bp, Homo sapiens
tctctgctccacca

SEQ ID NO: 269310 - DNA, 19 bp, Homo sapiens
tctctgctccaccacatcc

SEQ ID NO: 269311 - DNA, 16 bp, Homo sapiens
tctctgctctagccag

SEQ ID NO: 269312 - DNA, 12 bp, Homo sapiens
tctctgctggcc

SEQ ID NO: 269313 - DNA, 16 bp, Homo sapiens
tctctgctggcccagc

SEQ ID NO: 269314 - DNA, 11 bp, Homo sapiens
tctctgctgta

SEQ ID NO: 269315 - DNA, 23 bp, Homo sapiens
tctctggccactctgctctgcac

SEQ ID NO: 269316 - DNA, 14 bp, Homo sapiens
tctctgggactctc

SEQ ID NO: 269317 - DNA, 13 bp, Homo sapiens
tctctgggctgag

SEQ ID NO: 269318 - DNA, 17 bp, Homo sapiens
tctctgggctgagccta

SEQ ID NO: 269319 - DNA, 21 bp, Homo sapiens
tctctgggctgagcctactgt

SEQ ID NO: 269320 - DNA, 15 bp, Homo sapiens
tctctgtaaaaagca

SEQ ID NO: 269321 - DNA, 16 bp, Homo sapiens
tctctgtcgtggacac

SEQ ID NO: 269322 - DNA, 17 bp, Homo sapiens
tctctgtctaccatctc

SEQ ID NO: 269323 - DNA, 19 bp, Homo sapiens
tctctgtcttctctccact

SEQ ID NO: 269324 - DNA, 22 bp, Homo sapiens
tctctgtctttttccttcctga

SEQ ID NO: 269325 - DNA, 22 bp, Homo sapiens
tctctgtgaacgatttagaaag

SEQ ID NO: 269326 - DNA, 18 bp, Homo sapiens
tctctgtgtggcaaacat

SEQ ID NO: 269327 - DNA, 16 bp, Homo sapiens
tctctgttccaagtgt

SEQ ID NO: 269328 - DNA, 18 bp, Homo sapiens
tctctgttccaagtgtgt

SEQ ID NO: 269329 - DNA, 23 bp, Homo sapiens
tctctgttccaagtgtgtgtgca

SEQ ID NO: 269330 - DNA, 21 bp, Homo sapiens
tctctgtttaccctccctgtc

SEQ ID NO: 269331 - DNA, 15 bp, Homo sapiens
tctctgtttggtaag

SEQ ID NO: 269332 - DNA, 14 bp, Homo sapiens
tctcttaccccgtc

SEQ ID NO: 269333 - DNA, 15 bp, Homo sapiens
tctcttacccttctg

SEQ ID NO: 269334 - DNA, 18 bp, Homo sapiens
tctcttacccttctgtgc

SEQ ID NO: 269335 - DNA, 23 bp, Homo sapiens
tctcttacccttctgtgcccagc

SEQ ID NO: 269336 - DNA, 20 bp, Homo sapiens
tctcttaccgcgagactgag

SEQ ID NO: 269337 - DNA, 16 bp, Homo sapiens
tctcttagaaatactt

SEQ ID NO: 269338 - DNA, 21 bp, Homo sapiens
tctcttaggaagccttttatt

SEQ ID NO: 269339 - DNA, 20 bp, Homo sapiens
tctcttatagaatatttatt

SEQ ID NO: 269340 - DNA, 21 bp, Homo sapiens
tctcttatagaatatttatta

SEQ ID NO: 269341 - DNA, 15 bp, Homo sapiens
tctcttcagtgtgtt

SEQ ID NO: 269342 - DNA, 14 bp, Homo sapiens
tctcttcatacttt

SEQ ID NO: 269343 - DNA, 17 bp, Homo sapiens
tctcttcattcccactg

SEQ ID NO: 269344 - DNA, 21 bp, Homo sapiens
tctcttccagaagatgccctc

SEQ ID NO: 269345 - DNA, 16 bp, Homo sapiens
tctcttccagcccaga

SEQ ID NO: 269346 - DNA, 18 bp, Homo sapiens
tctcttctatcctgcaat

SEQ ID NO: 269347 - DNA, 11 bp, Homo sapiens
tctcttctcca

SEQ ID NO: 269348 - DNA, 15 bp, Homo sapiens
tctcttctccactgg

SEQ ID NO: 269349 - DNA, 16 bp, Homo sapiens
tctcttctgctccacc

SEQ ID NO: 269350 - DNA, 14 bp, Homo sapiens
tctcttctgtccat

SEQ ID NO: 269351 - DNA, 13 bp, Homo sapiens
tctcttgagggag

SEQ ID NO: 269352 - DNA, 18 bp, Homo sapiens
tctcttggctggcttcct

SEQ ID NO: 269353 - DNA, 15 bp, Homo sapiens
tctcttgtaaaaaga

SEQ ID NO: 269354 - DNA, 21 bp, Homo sapiens
tctctttcagtattaaactct

SEQ ID NO: 269355 - DNA, 12 bp, Homo sapiens
tctctttcatct

SEQ ID NO: 269356 - DNA, 14 bp, Homo sapiens
tctctttctctcct

SEQ ID NO: 269357 - DNA, 15 bp, Homo sapiens
agagggagaaggaga

SEQ ID NO: 269358 - DNA, 17 bp, Homo sapiens
agagggagaaggagagg

SEQ ID NO: 269359 - DNA, 14 bp, Homo sapiens
agagggagcaagcc

SEQ ID NO: 269360 - DNA, 15 bp, Homo sapiens
agagggagcaagcct

SEQ ID NO: 269361 - DNA, 18 bp, Homo sapiens
agagggagcaagccttcc

SEQ ID NO: 269362 - DNA, 22 bp, Homo sapiens
agagggagtacaaagacaggga

SEQ ID NO: 269363 - DNA, 12 bp, Homo sapiens
agagggagtcag

SEQ ID NO: 269364 - DNA, 15 bp, Homo sapiens
agagggcagtacctg

SEQ ID NO: 269365 - DNA, 16 bp, Homo sapiens
agagggcagtacctgg

SEQ ID NO: 269366 - DNA, 18 bp, Homo sapiens
agagggcagtacctggga

SEQ ID NO: 269367 - DNA, 18 bp, Homo sapiens
agagggccaagacttggc

SEQ ID NO: 269368 - DNA, 14 bp, Homo sapiens
agagggcccagctg

SEQ ID NO: 269369 - DNA, 13 bp, Homo sapiens
agagggctgagcc

SEQ ID NO: 269370 - DNA, 15 bp, Homo sapiens
agagggctgagcccc

SEQ ID NO: 269371 - DNA, 14 bp, Homo sapiens
agagggctgtggct

SEQ ID NO: 269372 - DNA, 20 bp, Homo sapiens
agagggctgtggctgggtgg

SEQ ID NO: 269373 - DNA, 20 bp, Homo sapiens
agaggggacaaaacccacct

SEQ ID NO: 269374 - DNA, 14 bp, Homo sapiens
agaggggactgggg

SEQ ID NO: 269375 - DNA, 14 bp, Homo sapiens
agaggggaggggcc

SEQ ID NO: 269376 - DNA, 20 bp, Homo sapiens
agaggggaggggcctaggga

SEQ ID NO: 269377 - DNA, 14 bp, Homo sapiens
agaggggcagccgc

SEQ ID NO: 269378 - DNA, 15 bp, Homo sapiens
agaggggcagccgct

SEQ ID NO: 269379 - DNA, 13 bp, Homo sapiens
agaggggcctctg

SEQ ID NO: 269380 - DNA, 19 bp, Homo sapiens
agaggggcctctggctgcc

SEQ ID NO: 269381 - DNA, 18 bp, Homo sapiens
agaggggcggggccagga

SEQ ID NO: 269382 - DNA, 14 bp, Homo sapiens
agagggggctctcc

SEQ ID NO: 269383 - DNA, 22 bp, Homo sapiens
agaggggggaagatcaggtcat

SEQ ID NO: 269384 - DNA, 14 bp, Homo sapiens
agaggggggctgcc

SEQ ID NO: 269385 - DNA, 15 bp, Homo sapiens
agaggggtgcaccca

SEQ ID NO: 269386 - DNA, 15 bp, Homo sapiens
agagggtccctaggt

SEQ ID NO: 269387 - DNA, 13 bp, Homo sapiens
agagggttcctgt

SEQ ID NO: 269388 - DNA, 19 bp, Homo sapiens
agaggtagcgagctgctct

SEQ ID NO: 269389 - DNA, 20 bp, Homo sapiens
agaggtagcgagctgctctg

SEQ ID NO: 269390 - DNA, 16 bp, Homo sapiens
agaggtcaagcccagg

SEQ ID NO: 269391 - DNA, 16 bp, Homo sapiens
agaggtgctgctttgc

SEQ ID NO: 269392 - DNA, 17 bp, Homo sapiens
agaggtggaaaatgatc

SEQ ID NO: 269393 - DNA, 21 bp, Homo sapiens
agaggtgggatcctccctcat

SEQ ID NO: 269394 - DNA, 12 bp, Homo sapiens
agaggtgggcag

SEQ ID NO: 269395 - DNA, 13 bp, Homo sapiens
agaggtgggcagc

SEQ ID NO: 269396 - DNA, 17 bp, Homo sapiens
agaggtgggcagctggg

SEQ ID NO: 269397 - DNA, 18 bp, Homo sapiens
agaggtgggcagctgggc

SEQ ID NO: 269398 - DNA, 23 bp, Homo sapiens
agaggtggggaagagagcctgcc

SEQ ID NO: 269399 - DNA, 22 bp, Homo sapiens
agaggtggggtgaagctgggga

SEQ ID NO: 269400 - DNA, 22 bp, Homo sapiens
agaggttatctgcctggcctgg

SEQ ID NO: 269401 - DNA, 20 bp, Homo sapiens
agaggttctcagcaagtgta

SEQ ID NO: 269402 - DNA, 21 bp, Homo sapiens
agaggtttatttgggtacatg

SEQ ID NO: 269403 - DNA, 16 bp, Homo sapiens
agaggttttgttgttt

SEQ ID NO: 269404 - DNA, 16 bp, Homo sapiens
agagtaagctgctttt

SEQ ID NO: 269405 - DNA, 17 bp, Homo sapiens
agagtacagatcctctg

SEQ ID NO: 269406 - DNA, 14 bp, Homo sapiens
agagtaccatgctg

SEQ ID NO: 269407 - DNA, 20 bp, Homo sapiens
agagtactcacttttcactt

SEQ ID NO: 269408 - DNA, 14 bp, Homo sapiens
agagtacttaatat

SEQ ID NO: 269409 - DNA, 17 bp, Homo sapiens
agagtacttaatatact

SEQ ID NO: 269410 - DNA, 15 bp, Homo sapiens
agagtagacatcccc

SEQ ID NO: 269411 - DNA, 15 bp, Homo sapiens
agagtatatatgtac

SEQ ID NO: 269412 - DNA, 17 bp, Homo sapiens
agagtatatatgtacag

SEQ ID NO: 269413 - DNA, 18 bp, Homo sapiens
agagtatcaaaggcagaa

SEQ ID NO: 269414 - DNA, 20 bp, Homo sapiens
agagtatcaaaggcagaaag

SEQ ID NO: 269415 - DNA, 21 bp, Homo sapiens
agagtatcaaaggcagaaagg

SEQ ID NO: 269416 - DNA, 22 bp, Homo sapiens
agagtatcaaaggcagaaagga

SEQ ID NO: 269417 - DNA, 18 bp, Homo sapiens
agagtatgcaagaagaat

SEQ ID NO: 269418 - DNA, 20 bp, Homo sapiens
agagtatgcaagaagaatat

SEQ ID NO: 269419 - DNA, 15 bp, Homo sapiens
agagtcactggaaca

SEQ ID NO: 269420 - DNA, 21 bp, Homo sapiens
agagtcatctccatcagctgt

SEQ ID NO: 269421 - DNA, 15 bp, Homo sapiens
agagtcattgttaca

SEQ ID NO: 269422 - DNA, 16 bp, Homo sapiens
agagtccaggccccaa

SEQ ID NO: 269423 - DNA, 14 bp, Homo sapiens
agagtcgatgctca

SEQ ID NO: 269424 - DNA, 16 bp, Homo sapiens
agagtctgaacagctg

SEQ ID NO: 269425 - DNA, 16 bp, Homo sapiens
agagtctgggcctctg

SEQ ID NO: 269426 - DNA, 21 bp, Homo sapiens
agagtctgtgtgtagccagga

SEQ ID NO: 269427 - DNA, 22 bp, Homo sapiens
agagtctgtgtgtagccaggaa

SEQ ID NO: 269428 - DNA, 17 bp, Homo sapiens
agagtcttaattttcta

SEQ ID NO: 269429 - DNA, 17 bp, Homo sapiens
agagtgaaaccatgact

SEQ ID NO: 269430 - DNA, 21 bp, Homo sapiens
agagtgacctggcatcttgga

SEQ ID NO: 269431 - DNA, 19 bp, Homo sapiens
agagtgagaataattgtgt

SEQ ID NO: 269432 - DNA, 22 bp, Homo sapiens
agagtgagaatctggctcctgt

SEQ ID NO: 269433 - DNA, 22 bp, Homo sapiens
agagtggatctggagtctgaag

SEQ ID NO: 269434 - DNA, 19 bp, Homo sapiens
agagtggcctggccaggag

SEQ ID NO: 269435 - DNA, 19 bp, Homo sapiens
agagtggctcctcccggtg

SEQ ID NO: 269436 - DNA, 23 bp, Homo sapiens
agagtggctcctcccggtgccca

SEQ ID NO: 269437 - DNA, 18 bp, Homo sapiens
agagtgggggagagcagg

SEQ ID NO: 269438 - DNA, 16 bp, Homo sapiens
agagtggtggcagctc

SEQ ID NO: 269439 - DNA, 22 bp, Homo sapiens
agagtggtggcagctcaaaatg

SEQ ID NO: 269440 - DNA, 16 bp, Homo sapiens
agagtggttgttgcca

SEQ ID NO: 269441 - DNA, 17 bp, Homo sapiens
agagtgtacatcatgtt

SEQ ID NO: 269442 - DNA, 13 bp, Homo sapiens
agagttaagaatg

SEQ ID NO: 269443 - DNA, 22 bp, Homo sapiens
agagttactgccacggtccttt

SEQ ID NO: 269444 - DNA, 13 bp, Homo sapiens
agagttcagtaag

SEQ ID NO: 269445 - DNA, 21 bp, Homo sapiens
agagttctatccccaagctgg

SEQ ID NO: 269446 - DNA, 15 bp, Homo sapiens
agagttctggtgaga

SEQ ID NO: 269447 - DNA, 23 bp, Homo sapiens
agagttctttgctgcccctgtct

SEQ ID NO: 269448 - DNA, 15 bp, Homo sapiens
agagttgagcacagg

SEQ ID NO: 269449 - DNA, 17 bp, Homo sapiens
agagttgctttaaagta

SEQ ID NO: 269450 - DNA, 21 bp, Homo sapiens
agagtttatttttttgatggc

SEQ ID NO: 269451 - DNA, 12 bp, Homo sapiens
agagtttgatca

SEQ ID NO: 269452 - DNA, 14 bp, Homo sapiens
agagtttgtagtaa

SEQ ID NO: 269453 - DNA, 15 bp, Homo sapiens
agataaagatgatct

SEQ ID NO: 269454 - DNA, 16 bp, Homo sapiens
agataaagatgatcta

SEQ ID NO: 269455 - DNA, 18 bp, Homo sapiens
agataaatccaactctga

SEQ ID NO: 269456 - DNA, 18 bp, Homo sapiens
agataacgcaggagagag

SEQ ID NO: 269457 - DNA, 18 bp, Homo sapiens
agataactgctcttttac

SEQ ID NO: 269458 - DNA, 18 bp, Homo sapiens
agataacttaaataattt

SEQ ID NO: 269459 - DNA, 19 bp, Homo sapiens
agataactttgactttctt

SEQ ID NO: 269460 - DNA, 18 bp, Homo sapiens
agataaggaaactgaggc

SEQ ID NO: 269461 - DNA, 22 bp, Homo sapiens
agataaggaaactgaggcccag

SEQ ID NO: 269462 - DNA, 13 bp, Homo sapiens
agataatagttta

SEQ ID NO: 269463 - DNA, 15 bp, Homo sapiens
agataatcagcctct

SEQ ID NO: 269464 - DNA, 19 bp, Homo sapiens
agataatcttagctgccaa

SEQ ID NO: 269465 - DNA, 13 bp, Homo sapiens
agataatgctttt

SEQ ID NO: 269466 - DNA, 18 bp, Homo sapiens
agataatggataatcttc

SEQ ID NO: 269467 - DNA, 17 bp, Homo sapiens
agataatgttctttaat

SEQ ID NO: 269468 - DNA, 20 bp, Homo sapiens
agataattaaatgaaatact

SEQ ID NO: 269469 - DNA, 22 bp, Homo sapiens
agataattaaatgaaatacttg

SEQ ID NO: 269470 - DNA, 20 bp, Homo sapiens
agataattatccaggatgtg

SEQ ID NO: 269471 - DNA, 13 bp, Homo sapiens
agataatttactt

SEQ ID NO: 269472 - DNA, 16 bp, Homo sapiens
agataatttattttgt

SEQ ID NO: 269473 - DNA, 23 bp, Homo sapiens
agataatttgcatattctattgt

SEQ ID NO: 269474 - DNA, 17 bp, Homo sapiens
agatacaagtttcagac

SEQ ID NO: 269475 - DNA, 15 bp, Homo sapiens
agatacaatcagctg

SEQ ID NO: 269476 - DNA, 21 bp, Homo sapiens
agatacaatcagctgctttgt

SEQ ID NO: 269477 - DNA, 17 bp, Homo sapiens
agatacatcacagtcac

SEQ ID NO: 269478 - DNA, 23 bp, Homo sapiens
agatacatttgtatgttgtgaag

SEQ ID NO: 269479 - DNA, 23 bp, Homo sapiens
agatacccagagagaaaaagaga

SEQ ID NO: 269480 - DNA, 18 bp, Homo sapiens
agatactgaaacatttga

SEQ ID NO: 269481 - DNA, 14 bp, Homo sapiens
agatacttgatgca

SEQ ID NO: 269482 - DNA, 21 bp, Homo sapiens
agatacttgatgcacttattt

SEQ ID NO: 269483 - DNA, 23 bp, Homo sapiens
agatagagattcccctggaccac

SEQ ID NO: 269484 - DNA, 20 bp, Homo sapiens
agatagagctgggtggcctg

SEQ ID NO: 269485 - DNA, 17 bp, Homo sapiens
tctgctgttgccatagc

SEQ ID NO: 269486 - DNA, 19 bp, Homo sapiens
tctgcttacaattccctgc

SEQ ID NO: 269487 - DNA, 20 bp, Homo sapiens
tctgcttacaattccctgct

SEQ ID NO: 269488 - DNA, 16 bp, Homo sapiens
tctgcttaccacatca

SEQ ID NO: 269489 - DNA, 16 bp, Homo sapiens
tctgcttaggagagac

SEQ ID NO: 269490 - DNA, 18 bp, Homo sapiens
tctgcttcaataaatctt

SEQ ID NO: 269491 - DNA, 13 bp, Homo sapiens
tctgcttcagctt

SEQ ID NO: 269492 - DNA, 19 bp, Homo sapiens
tctgcttcctcagccctag

SEQ ID NO: 269493 - DNA, 14 bp, Homo sapiens
tctgcttctctcac

SEQ ID NO: 269494 - DNA, 16 bp, Homo sapiens
tctgcttctctcacct

SEQ ID NO: 269495 - DNA, 12 bp, Homo sapiens
tctgcttgagtc

SEQ ID NO: 269496 - DNA, 20 bp, Homo sapiens
tctgcttgagtcaggtttga

SEQ ID NO: 269497 - DNA, 14 bp, Homo sapiens
tctgcttgccgact

SEQ ID NO: 269498 - DNA, 20 bp, Homo sapiens
tctgcttgccgactggctgt

SEQ ID NO: 269499 - DNA, 14 bp, Homo sapiens
agatattctttaca

SEQ ID NO: 269500 - DNA, 15 bp, Homo sapiens
agatattctttacaa

SEQ ID NO: 269501 - DNA, 18 bp, Homo sapiens
agatattgtgaagtacat

SEQ ID NO: 269502 - DNA, 21 bp, Homo sapiens
agatattgtgaagtacatatt

SEQ ID NO: 269503 - DNA, 20 bp, Homo sapiens
agatattgttttctgtaaat

SEQ ID NO: 269504 - DNA, 23 bp, Homo sapiens
agatattgttttctgtaaataac

SEQ ID NO: 269505 - DNA, 20 bp, Homo sapiens
agatatttaaaagacaaaca

SEQ ID NO: 269506 - DNA, 12 bp, Homo sapiens
agatcaaaataa

SEQ ID NO: 269507 - DNA, 16 bp, Homo sapiens
agatcaaaataaaaag

SEQ ID NO: 269508 - DNA, 20 bp, Homo sapiens
agatcaattaattcttaata

SEQ ID NO: 269509 - DNA, 14 bp, Homo sapiens
agatcacaaatagt

SEQ ID NO: 269510 - DNA, 18 bp, Homo sapiens
agatcacaccactgtact

SEQ ID NO: 269511 - DNA, 12 bp, Homo sapiens
agatcacagcct

SEQ ID NO: 269512 - DNA, 17 bp, Homo sapiens
agatcacagcctccagg

SEQ ID NO: 269513 - DNA, 20 bp, Homo sapiens
agatcacagcctccagggcc

SEQ ID NO: 269514 - DNA, 21 bp, Homo sapiens
agatcacagcctccagggccc

SEQ ID NO: 269515 - DNA, 14 bp, Homo sapiens
agatcactactgca

SEQ ID NO: 269516 - DNA, 14 bp, Homo sapiens
agatcactttgctc

SEQ ID NO: 269517 - DNA, 12 bp, Homo sapiens
agatcagagagc

SEQ ID NO: 269518 - DNA, 18 bp, Homo sapiens
agatcagagagcaagaaa

SEQ ID NO: 269519 - DNA, 17 bp, Homo sapiens
agatcagcattcaaaat

SEQ ID NO: 269520 - DNA, 15 bp, Homo sapiens
agatcagttttccta

SEQ ID NO: 269521 - DNA, 14 bp, Homo sapiens
agatccagactgta

SEQ ID NO: 269522 - DNA, 22 bp, Homo sapiens
agatccagactgtaagatgttg

SEQ ID NO: 269523 - DNA, 20 bp, Homo sapiens
agatccagatccagactgta

SEQ ID NO: 269524 - DNA, 21 bp, Homo sapiens
agatcccagaaggacctcctg

SEQ ID NO: 269525 - DNA, 15 bp, Homo sapiens
agatccctcggtcag

SEQ ID NO: 269526 - DNA, 22 bp, Homo sapiens
agatccgagcgacggctcctcc

SEQ ID NO: 269527 - DNA, 14 bp, Homo sapiens
agatccgcatgtgt

SEQ ID NO: 269528 - DNA, 20 bp, Homo sapiens
agatccgccctgggctctgg

SEQ ID NO: 269529 - DNA, 21 bp, Homo sapiens
agatccgccctgggctctggg

SEQ ID NO: 269530 - DNA, 15 bp, Homo sapiens
agatcctgcacccca

SEQ ID NO: 269531 - DNA, 17 bp, Homo sapiens
agatcctgcaccccagc

SEQ ID NO: 269532 - DNA, 11 bp, Homo sapiens
agatcctgctg

SEQ ID NO: 269533 - DNA, 14 bp, Homo sapiens
agatcctgctgccg

SEQ ID NO: 269534 - DNA, 20 bp, Homo sapiens
agatcgcttgagcccaggag

SEQ ID NO: 269535 - DNA, 16 bp, Homo sapiens
agatcgttctctgcct

SEQ ID NO: 269536 - DNA, 14 bp, Homo sapiens
agatctagccaggc

SEQ ID NO: 269537 - DNA, 18 bp, Homo sapiens
agatctagccaggcctcc

SEQ ID NO: 269538 - DNA, 14 bp, Homo sapiens
agatctccaaagct

SEQ ID NO: 269539 - DNA, 21 bp, Homo sapiens
agatctccaaagctttcctgg

SEQ ID NO: 269540 - DNA, 13 bp, Homo sapiens
agatctcctattt

SEQ ID NO: 269541 - DNA, 18 bp, Homo sapiens
agatctcctatttttcag

SEQ ID NO: 269542 - DNA, 19 bp, Homo sapiens
agatctcctatttttcaga

SEQ ID NO: 269543 - DNA, 20 bp, Homo sapiens
agatctcctatttttcagaa

SEQ ID NO: 269544 - DNA, 19 bp, Homo sapiens
agatctgaacacagtttag

SEQ ID NO: 269545 - DNA, 18 bp, Homo sapiens
agatctgcctgggcctgt

SEQ ID NO: 269546 - DNA, 20 bp, Homo sapiens
agatctgcctgggcctgtgc

SEQ ID NO: 269547 - DNA, 14 bp, Homo sapiens
agatctgtgcccca

SEQ ID NO: 269548 - DNA, 16 bp, Homo sapiens
agatcttaaattttgt

SEQ ID NO: 269549 - DNA, 16 bp, Homo sapiens
agatcttacaagttta

SEQ ID NO: 269550 - DNA, 11 bp, Homo sapiens
agatcttcctt

SEQ ID NO: 269551 - DNA, 20 bp, Homo sapiens
agatcttgagcaaggcaaga

SEQ ID NO: 269552 - DNA, 22 bp, Homo sapiens
agatctttcgttggttgtttct

SEQ ID NO: 269553 - DNA, 23 bp, Homo sapiens
agatctttcgttggttgtttctc

SEQ ID NO: 269554 - DNA, 11 bp, Homo sapiens
agatgaaaacc

SEQ ID NO: 269555 - DNA, 12 bp, Homo sapiens
agatgaaaataa

SEQ ID NO: 269556 - DNA, 14 bp, Homo sapiens
agatgaaaataaaa

SEQ ID NO: 269557 - DNA, 15 bp, Homo sapiens
agatgaaaggagaca

SEQ ID NO: 269558 - DNA, 22 bp, Homo sapiens
agatgaactttttaacaaatgt

SEQ ID NO: 269559 - DNA, 23 bp, Homo sapiens
agatgaactttttaacaaatgtt

SEQ ID NO: 269560 - DNA, 18 bp, Homo sapiens
agatgaatcagtatgaag

SEQ ID NO: 269561 - DNA, 18 bp, Homo sapiens
agatgacacataaatctg

SEQ ID NO: 269562 - DNA, 23 bp, Homo sapiens
agatgacacataaatctgtctga

SEQ ID NO: 269563 - DNA, 14 bp, Homo sapiens
agatgacccctccc

SEQ ID NO: 269564 - DNA, 19 bp, Homo sapiens
agatgagaattcagctgcc

SEQ ID NO: 269565 - DNA, 20 bp, Homo sapiens
agatgagaattcagctgccc

SEQ ID NO: 269566 - DNA, 13 bp, Homo sapiens
agatgagcaagga

SEQ ID NO: 269567 - DNA, 15 bp, Homo sapiens
agatgagcaaggaca

SEQ ID NO: 269568 - DNA, 22 bp, Homo sapiens
agatgagcaaggacattgcccc

SEQ ID NO: 269569 - DNA, 20 bp, Homo sapiens
agatgagctttctttttaaa

SEQ ID NO: 269570 - DNA, 16 bp, Homo sapiens
agatgagggtgactgt

SEQ ID NO: 269571 - DNA, 17 bp, Homo sapiens
agatgagggtgactgtc

SEQ ID NO: 269572 - DNA, 13 bp, Homo sapiens
agatgagtcctgt

SEQ ID NO: 269573 - DNA, 14 bp, Homo sapiens
agatgagtcctgtt

SEQ ID NO: 269574 - DNA, 15 bp, Homo sapiens
agatgataaaaggaa

SEQ ID NO: 269575 - DNA, 13 bp, Homo sapiens
agatgatccatga

SEQ ID NO: 269576 - DNA, 16 bp, Homo sapiens
agatgatctactcaga

SEQ ID NO: 269577 - DNA, 12 bp, Homo sapiens
agatgatgtgat

SEQ ID NO: 269578 - DNA, 22 bp, Homo sapiens
agatgatgtgatggaacacaca

SEQ ID NO: 269579 - DNA, 13 bp, Homo sapiens
agatgattttgct

SEQ ID NO: 269580 - DNA, 13 bp, Homo sapiens
agatgcaagatat

SEQ ID NO: 269581 - DNA, 20 bp, Homo sapiens
agatgcaaggaccaggactc

SEQ ID NO: 269582 - DNA, 18 bp, Homo sapiens
agatgccaaaaaagatgc

SEQ ID NO: 269583 - DNA, 17 bp, Homo sapiens
agatgccaacagacact

SEQ ID NO: 269584 - DNA, 13 bp, Homo sapiens
agatgccagagca

SEQ ID NO: 269585 - DNA, 17 bp, Homo sapiens
agatgccccagagctgt

SEQ ID NO: 269586 - DNA, 14 bp, Homo sapiens
agatgccctgctag

SEQ ID NO: 269587 - DNA, 21 bp, Homo sapiens
agatgccttctagattcactg

SEQ ID NO: 269588 - DNA, 17 bp, Homo sapiens
agatgctgaatatctgt

SEQ ID NO: 269589 - DNA, 15 bp, Homo sapiens
agatggaaggccttt

SEQ ID NO: 269590 - DNA, 21 bp, Homo sapiens
agatggaaggccttttgcccg

SEQ ID NO: 269591 - DNA, 23 bp, Homo sapiens
agatggacagttcacaccctgca

SEQ ID NO: 269592 - DNA, 14 bp, Homo sapiens
agatggacccctcc

SEQ ID NO: 269593 - DNA, 18 bp, Homo sapiens
agatggacccctcccttg

SEQ ID NO: 269594 - DNA, 15 bp, Homo sapiens
agatggactctgaaa

SEQ ID NO: 269595 - DNA, 14 bp, Homo sapiens
agatggagcccata

SEQ ID NO: 269596 - DNA, 12 bp, Homo sapiens
agatggatgaat

SEQ ID NO: 269597 - DNA, 21 bp, Homo sapiens
agatggatgaattatgataaa

SEQ ID NO: 269598 - DNA, 18 bp, Homo sapiens
agatggatttgacacact

SEQ ID NO: 269599 - DNA, 14 bp, Homo sapiens
agatggcctttgct

SEQ ID NO: 269600 - DNA, 14 bp, Homo sapiens
agatggcgcacccg

SEQ ID NO: 269601 - DNA, 16 bp, Homo sapiens
agatggcgcacccggc

SEQ ID NO: 269602 - DNA, 22 bp, Homo sapiens
agatggcgcacccggcagcccc

SEQ ID NO: 269603 - DNA, 22 bp, Homo sapiens
agatggcggtgatcagcagaga

SEQ ID NO: 269604 - DNA, 13 bp, Homo sapiens
agatggctgtgaa

SEQ ID NO: 269605 - DNA, 21 bp, Homo sapiens
agatggctgtgaaaattacac

SEQ ID NO: 269606 - DNA, 22 bp, Homo sapiens
agatggcttccgtgagacacaa

SEQ ID NO: 269607 - DNA, 15 bp, Homo sapiens
agatgggaagggctt

SEQ ID NO: 269608 - DNA, 16 bp, Homo sapiens
agatgggaagggctta

SEQ ID NO: 269609 - DNA, 15 bp, Homo sapiens
agatgggactgggag

SEQ ID NO: 269610 - DNA, 17 bp, Homo sapiens
agatgggcttgttttct

SEQ ID NO: 269611 - DNA, 18 bp, Homo sapiens
agatgggcttgttttctt

SEQ ID NO: 269612 - DNA, 20 bp, Homo sapiens
agatggtaatctacagctca

SEQ ID NO: 269613 - DNA, 19 bp, Homo sapiens
agatggtatatttggtact

SEQ ID NO: 269614 - DNA, 16 bp, Homo sapiens
agatggtcatattatt

SEQ ID NO: 269615 - DNA, 15 bp, Homo sapiens
agatggtgaaattta

SEQ ID NO: 269616 - DNA, 23 bp, Homo sapiens
agatgtcccccaggggcccaggc

SEQ ID NO: 269617 - DNA, 12 bp, Homo sapiens
agatgtccctga

SEQ ID NO: 269618 - DNA, 21 bp, Homo sapiens
agatgtccctgaagtcttgca

SEQ ID NO: 269619 - DNA, 21 bp, Homo sapiens
agatgtccctttcttggccag

SEQ ID NO: 269620 - DNA, 23 bp, Homo sapiens
agatgtctgagagaccatctcct

SEQ ID NO: 269621 - DNA, 20 bp, Homo sapiens
agatgtcttcgtacagttct

SEQ ID NO: 269622 - DNA, 18 bp, Homo sapiens
agatgtcttctgcctgtt

SEQ ID NO: 269623 - DNA, 19 bp, Homo sapiens
agatgtcttctgcctgtta

SEQ ID NO: 269624 - DNA, 15 bp, Homo sapiens
agatgtctttaggca

SEQ ID NO: 269625 - DNA, 13 bp, Homo sapiens
agatgtgcttctg

SEQ ID NO: 269626 - DNA, 21 bp, Homo sapiens
agatgtggccttccatttata

SEQ ID NO: 269627 - DNA, 18 bp, Homo sapiens
agatgttccatcctgtac

SEQ ID NO: 269628 - DNA, 18 bp, Homo sapiens
agatgtttgttttcaaaa

SEQ ID NO: 269629 - DNA, 20 bp, Homo sapiens
agattaaaaccagagagaaa

SEQ ID NO: 269630 - DNA, 21 bp, Homo sapiens
agattaaaaccagagagaaag

SEQ ID NO: 269631 - DNA, 16 bp, Homo sapiens
agattaaaattagtga

SEQ ID NO: 269632 - DNA, 16 bp, Homo sapiens
agattaaactgagtga

SEQ ID NO: 269633 - DNA, 22 bp, Homo sapiens
agattaagttataccagcaaaa

SEQ ID NO: 269634 - DNA, 23 bp, Homo sapiens
agattaagttataccagcaaaag

SEQ ID NO: 269635 - DNA, 18 bp, Homo sapiens
agattaatttgtgtagat

SEQ ID NO: 269636 - DNA, 19 bp, Homo sapiens
agattaatttgtgtagatt

SEQ ID NO: 269637 - DNA, 21 bp, Homo sapiens
agattacaggattaatatatt

SEQ ID NO: 269638 - DNA, 18 bp, Homo sapiens
agattagagggaggtgtt

SEQ ID NO: 269639 - DNA, 17 bp, Homo sapiens
agattagcatgaaaggt

SEQ ID NO: 269640 - DNA, 21 bp, Homo sapiens
agattcaaaaaaaaaatataa

SEQ ID NO: 269641 - DNA, 16 bp, Homo sapiens
agattcaaagctctaa

SEQ ID NO: 269642 - DNA, 11 bp, Homo sapiens
agattcaattt

SEQ ID NO: 269643 - DNA, 20 bp, Homo sapiens
agattcacctgtaaaacttt

SEQ ID NO: 269644 - DNA, 22 bp, Homo sapiens
agattcatatttacttcttata

SEQ ID NO: 269645 - DNA, 19 bp, Homo sapiens
agattccagagagtggctc

SEQ ID NO: 269646 - DNA, 18 bp, Homo sapiens
agattccattttatacaa

SEQ ID NO: 269647 - DNA, 23 bp, Homo sapiens
agattcctcttgcctctctcagg

SEQ ID NO: 269648 - DNA, 16 bp, Homo sapiens
agattcgctttccatg

SEQ ID NO: 269649 - DNA, 14 bp, Homo sapiens
agattctactcttg

SEQ ID NO: 269650 - DNA, 19 bp, Homo sapiens
agattctactcttgtcatt

SEQ ID NO: 269651 - DNA, 16 bp, Homo sapiens
agattctgggaaaggt

SEQ ID NO: 269652 - DNA, 18 bp, Homo sapiens
agattctgggaaaggtgc

SEQ ID NO: 269653 - DNA, 20 bp, Homo sapiens
agattctgggaaaggtgctc

SEQ ID NO: 269654 - DNA, 16 bp, Homo sapiens
agattctttaaactac

SEQ ID NO: 269655 - DNA, 21 bp, Homo sapiens
agattgactatttatacaaat

SEQ ID NO: 269656 - DNA, 21 bp, Homo sapiens
agattgcctcttgaattaaaa

SEQ ID NO: 269657 - DNA, 16 bp, Homo sapiens
agattgctacacacac

SEQ ID NO: 269658 - DNA, 17 bp, Homo sapiens
agattgctacacacaca

SEQ ID NO: 269659 - DNA, 14 bp, Homo sapiens
agattgctgcttct

SEQ ID NO: 269660 - DNA, 15 bp, Homo sapiens
agattggcatggctt

SEQ ID NO: 269661 - DNA, 13 bp, Homo sapiens
agattgggggccc

SEQ ID NO: 269662 - DNA, 16 bp, Homo sapiens
agattgggggggcttg

SEQ ID NO: 269663 - DNA, 17 bp, Homo sapiens
agattggtcattaaata

SEQ ID NO: 269664 - DNA, 20 bp, Homo sapiens
agattggtcattaaatacta

SEQ ID NO: 269665 - DNA, 20 bp, Homo sapiens
agattgtaaaggtaggtgca

SEQ ID NO: 269666 - DNA, 21 bp, Homo sapiens
agattgtaaaggtaggtgcat

SEQ ID NO: 269667 - DNA, 14 bp, Homo sapiens
agattgtagctctt

SEQ ID NO: 269668 - DNA, 11 bp, Homo sapiens
agatttaagca

SEQ ID NO: 269669 - DNA, 13 bp, Homo sapiens
agatttagtttac

SEQ ID NO: 269670 - DNA, 15 bp, Homo sapiens
agatttccagtctcc

SEQ ID NO: 269671 - DNA, 23 bp, Homo sapiens
agatttccagtctccaccaggaa

SEQ ID NO: 269672 - DNA, 18 bp, Homo sapiens
agatttccctaaaaattc

SEQ ID NO: 269673 - DNA, 16 bp, Homo sapiens
agatttgaaggtctgc

SEQ ID NO: 269674 - DNA, 22 bp, Homo sapiens
agatttgcaaaaagtgaacaga

SEQ ID NO: 269675 - DNA, 13 bp, Homo sapiens
agatttgccagca

SEQ ID NO: 269676 - DNA, 22 bp, Homo sapiens
agatttggaataggaataagct

SEQ ID NO: 269677 - DNA, 16 bp, Homo sapiens
agatttggagcactct

SEQ ID NO: 269678 - DNA, 16 bp, Homo sapiens
agatttgtatttatat

SEQ ID NO: 269679 - DNA, 17 bp, Homo sapiens
agatttgtatttatatt

SEQ ID NO: 269680 - DNA, 18 bp, Homo sapiens
agatttgtatttatatta

SEQ ID NO: 269681 - DNA, 13 bp, Homo sapiens
agatttgttcatt

SEQ ID NO: 269682 - DNA, 14 bp, Homo sapiens
agatttgttttgtg

SEQ ID NO: 269683 - DNA, 17 bp, Homo sapiens
agattttaaaaagtctt

SEQ ID NO: 269684 - DNA, 20 bp, Homo sapiens
agattttaaaacttcatctg

SEQ ID NO: 269685 - DNA, 21 bp, Homo sapiens
agattttaattttgaataaat

SEQ ID NO: 269686 - DNA, 17 bp, Homo sapiens
agattttcagaaaatat

SEQ ID NO: 269687 - DNA, 22 bp, Homo sapiens
agattttctgggcctaaaggat

SEQ ID NO: 269688 - DNA, 13 bp, Homo sapiens
agattttctttct

SEQ ID NO: 269689 - DNA, 16 bp, Homo sapiens
agatttttagattcct

SEQ ID NO: 269690 - DNA, 14 bp, Homo sapiens
agatttttgttaag

SEQ ID NO: 269691 - DNA, 17 bp, Homo sapiens
agcaaaaaataaaataa

SEQ ID NO: 269692 - DNA, 19 bp, Homo sapiens
agcaaaaccattgcttcac

SEQ ID NO: 269693 - DNA, 15 bp, Homo sapiens
agcaaaaggcagctc

SEQ ID NO: 269694 - DNA, 13 bp, Homo sapiens
agcaaaagttctt

SEQ ID NO: 269695 - DNA, 16 bp, Homo sapiens
agcaaaataaggaaga

SEQ ID NO: 269696 - DNA, 17 bp, Homo sapiens
agcaaaatatgcccctt

SEQ ID NO: 269697 - DNA, 18 bp, Homo sapiens
agcaaaatatgccccttc

SEQ ID NO: 269698 - DNA, 13 bp, Homo sapiens
agcaaacatcaaa

SEQ ID NO: 269699 - DNA, 21 bp, Homo sapiens
agcaaacatcaaataaatttc

SEQ ID NO: 269700 - DNA, 11 bp, Homo sapiens
agcaaaccaat

SEQ ID NO: 269701 - DNA, 20 bp, Homo sapiens
agcaaaccaatggtgatcct

SEQ ID NO: 269702 - DNA, 13 bp, Homo sapiens
agcaaaccttctc

SEQ ID NO: 269703 - DNA, 13 bp, Homo sapiens
agcaaacttggaa

SEQ ID NO: 269704 - DNA, 14 bp, Homo sapiens
agcaaagacttaat

SEQ ID NO: 269705 - DNA, 14 bp, Homo sapiens
agcaaagatcaaaa

SEQ ID NO: 269706 - DNA, 20 bp, Homo sapiens
agcaaagcatgccaatttct

SEQ ID NO: 269707 - DNA, 12 bp, Homo sapiens
agcaaaggaaga

SEQ ID NO: 269708 - DNA, 22 bp, Homo sapiens
agcaaaggcaggaggtgggtga

SEQ ID NO: 269709 - DNA, 17 bp, Homo sapiens
agcaaagggaaggactg

SEQ ID NO: 269710 - DNA, 15 bp, Homo sapiens
agcaaagtctaaagt

SEQ ID NO: 269711 - DNA, 14 bp, Homo sapiens
agcaaataccaaag

SEQ ID NO: 269712 - DNA, 15 bp, Homo sapiens
agcaaataccaaagc

SEQ ID NO: 269713 - DNA, 18 bp, Homo sapiens
agcaaataccaaagcagt

SEQ ID NO: 269714 - DNA, 18 bp, Homo sapiens
agcaaatatttatgacct

SEQ ID NO: 269715 - DNA, 16 bp, Homo sapiens
agcaaatcagaaactt

SEQ ID NO: 269716 - DNA, 20 bp, Homo sapiens
agcaaatcagaaacttgtga

SEQ ID NO: 269717 - DNA, 19 bp, Homo sapiens
agcaaatgagatgtatgcc

SEQ ID NO: 269718 - DNA, 20 bp, Homo sapiens
agcaaatttcatctttccaa

SEQ ID NO: 269719 - DNA, 13 bp, Homo sapiens
agcaacaaagagc

SEQ ID NO: 269720 - DNA, 16 bp, Homo sapiens
agcaacaacttactaa

SEQ ID NO: 269721 - DNA, 21 bp, Homo sapiens
agcaacaactttgtttctcat

SEQ ID NO: 269722 - DNA, 13 bp, Homo sapiens
agcaacaggacca

SEQ ID NO: 269723 - DNA, 14 bp, Homo sapiens
agcaacaggaccag

SEQ ID NO: 269724 - DNA, 15 bp, Homo sapiens
agcaacaggaccagg

SEQ ID NO: 269725 - DNA, 16 bp, Homo sapiens
agcaacaggaccagga

SEQ ID NO: 269726 - DNA, 18 bp, Homo sapiens
agcaacaggaccaggagc

SEQ ID NO: 269727 - DNA, 17 bp, Homo sapiens
tctgtatatacatttca

SEQ ID NO: 269728 - DNA, 16 bp, Homo sapiens
tctgtatatagctcta

SEQ ID NO: 269729 - DNA, 16 bp, Homo sapiens
tctgtatcaagcccct

SEQ ID NO: 269730 - DNA, 22 bp, Homo sapiens
tctgtatcaagcccctgtctaa

SEQ ID NO: 269731 - DNA, 12 bp, Homo sapiens
tctgtatctctc

SEQ ID NO: 269732 - DNA, 23 bp, Homo sapiens
tctgtattaattataccagtgtt

SEQ ID NO: 269733 - DNA, 17 bp, Homo sapiens
tctgtattcatacagca

SEQ ID NO: 269734 - DNA, 20 bp, Homo sapiens
tctgtattcatacagcacta

SEQ ID NO: 269735 - DNA, 19 bp, Homo sapiens
tctgtcaccaattggttaa

SEQ ID NO: 269736 - DNA, 21 bp, Homo sapiens
tctgtcaccacatcttgtctt

SEQ ID NO: 269737 - DNA, 16 bp, Homo sapiens
tctgtcaccgccatgc

SEQ ID NO: 269738 - DNA, 15 bp, Homo sapiens
tctgtcagtttgtga

SEQ ID NO: 269739 - DNA, 16 bp, Homo sapiens
tctgtcagtttgtgaa

SEQ ID NO: 269740 - DNA, 18 bp, Homo sapiens
tctgtcagtttgtgaagt

SEQ ID NO: 269741 - DNA, 16 bp, Homo sapiens
tctgtccaaaggaggc

SEQ ID NO: 269742 - DNA, 19 bp, Homo sapiens
tctgtccaattccagagct

SEQ ID NO: 269743 - DNA, 15 bp, Homo sapiens
tctgtccagaaaata

SEQ ID NO: 269744 - DNA, 24 bp, Homo sapiens
tctgtccaggcactgctgcccagc

SEQ ID NO: 269745 - DNA, 12 bp, Homo sapiens
tctgtccaggcc

SEQ ID NO: 269746 - DNA, 13 bp, Homo sapiens
tctgtccaggcca

SEQ ID NO: 269747 - DNA, 23 bp, Homo sapiens
tctgtccaggccactgtggccag

SEQ ID NO: 269748 - DNA, 13 bp, Homo sapiens
tctgtccagggct

SEQ ID NO: 269749 - DNA, 21 bp, Homo sapiens
tctgtcccaatcttaccagat

SEQ ID NO: 269750 - DNA, 15 bp, Homo sapiens
tctgtcccactggga

SEQ ID NO: 269751 - DNA, 20 bp, Homo sapiens
tctgtcccggttcaccttgc

SEQ ID NO: 269752 - DNA, 23 bp, Homo sapiens
tctgtccctgagagtgtctctga

SEQ ID NO: 269753 - DNA, 20 bp, Homo sapiens
tctgtcctatggagcctctg

SEQ ID NO: 269754 - DNA, 13 bp, Homo sapiens
tctgtcctctgtc

SEQ ID NO: 269755 - DNA, 12 bp, Homo sapiens
tctgtcctttcc

SEQ ID NO: 269756 - DNA, 14 bp, Homo sapiens
tctgtcctttccca

SEQ ID NO: 269757 - DNA, 19 bp, Homo sapiens
tctgtccttttggcactga

SEQ ID NO: 269758 - DNA, 21 bp, Homo sapiens
tctgtccttttggcactgaga

SEQ ID NO: 269759 - DNA, 18 bp, Homo sapiens
tctgtctaccatctccct

SEQ ID NO: 269760 - DNA, 15 bp, Homo sapiens
tctgtctactgtggt

SEQ ID NO: 269761 - DNA, 14 bp, Homo sapiens
tctgtctcaaaaaa

SEQ ID NO: 269762 - DNA, 17 bp, Homo sapiens
tctgtctgagccctgcc

SEQ ID NO: 269763 - DNA, 14 bp, Homo sapiens
tctgtctgattcta

SEQ ID NO: 269764 - DNA, 18 bp, Homo sapiens
tctgtctggctgtacgtc

SEQ ID NO: 269765 - DNA, 17 bp, Homo sapiens
tctgtctgtaagatttt

SEQ ID NO: 269766 - DNA, 16 bp, Homo sapiens
tctgtctgtccttcct

SEQ ID NO: 269767 - DNA, 17 bp, Homo sapiens
tctgtcttcactattca

SEQ ID NO: 269768 - DNA, 18 bp, Homo sapiens
tctgtcttctctccactt

SEQ ID NO: 269769 - DNA, 14 bp, Homo sapiens
tctgtcttggtcct

SEQ ID NO: 269770 - DNA, 13 bp, Homo sapiens
tctgtctttatga

SEQ ID NO: 269771 - DNA, 16 bp, Homo sapiens
tctgtctttatgattt

SEQ ID NO: 269772 - DNA, 14 bp, Homo sapiens
tctgtctttttcct

SEQ ID NO: 269773 - DNA, 20 bp, Homo sapiens
tctgtctttttccttcctga

SEQ ID NO: 269774 - DNA, 22 bp, Homo sapiens
tctgtgaaaacatatttgtgaa

SEQ ID NO: 269775 - DNA, 16 bp, Homo sapiens
tctgtgaaagtacatt

SEQ ID NO: 269776 - DNA, 22 bp, Homo sapiens
tctgtgaaagtctcctgtatca

SEQ ID NO: 269777 - DNA, 20 bp, Homo sapiens
tctgtgaaatgctggcattt

SEQ ID NO: 269778 - DNA, 19 bp, Homo sapiens
tctgtgaagccctttgcct

SEQ ID NO: 269779 - DNA, 20 bp, Homo sapiens
tctgtgaagcctttatctat

SEQ ID NO: 269780 - DNA, 21 bp, Homo sapiens
tctgtgaatacaattaaaggt

SEQ ID NO: 269781 - DNA, 22 bp, Homo sapiens
tctgtgaatacaattaaaggtc

SEQ ID NO: 269782 - DNA, 15 bp, Homo sapiens
tctgtgaattcagat

SEQ ID NO: 269783 - DNA, 12 bp, Homo sapiens
tctgtgagattc

SEQ ID NO: 269784 - DNA, 14 bp, Homo sapiens
tctgtgagttctgt

SEQ ID NO: 269785 - DNA, 14 bp, Homo sapiens
tctgtgcaggtgct

SEQ ID NO: 269786 - DNA, 19 bp, Homo sapiens
tctgtgcccagctcagtct

SEQ ID NO: 269787 - DNA, 15 bp, Homo sapiens
tctgtgccccatgcc

SEQ ID NO: 269788 - DNA, 17 bp, Homo sapiens
tctgtgccccatgcctg

SEQ ID NO: 269789 - DNA, 11 bp, Homo sapiens
tctgtgcctaa

SEQ ID NO: 269790 - DNA, 12 bp, Homo sapiens
tctgtgcctccc

SEQ ID NO: 269791 - DNA, 14 bp, Homo sapiens
tctgtgcctccccc

SEQ ID NO: 269792 - DNA, 17 bp, Homo sapiens
tctgtgcctccccccag

SEQ ID NO: 269793 - DNA, 14 bp, Homo sapiens
tctgtgcctggagc

SEQ ID NO: 269794 - DNA, 15 bp, Homo sapiens
tctgtgcctggagct

SEQ ID NO: 269795 - DNA, 12 bp, Homo sapiens
tctgtgcctggg

SEQ ID NO: 269796 - DNA, 12 bp, Homo sapiens
tctgtgctccct

SEQ ID NO: 269797 - DNA, 13 bp, Homo sapiens
tctgtgctgtgcc

SEQ ID NO: 269798 - DNA, 17 bp, Homo sapiens
tctgtgctgtgcctgct

SEQ ID NO: 269799 - DNA, 23 bp, Homo sapiens
tctgtgctgtgcctgctagagca

SEQ ID NO: 269800 - DNA, 16 bp, Homo sapiens
tctgtggaaatgacag

SEQ ID NO: 269801 - DNA, 15 bp, Homo sapiens
tctgtggacactgtg

SEQ ID NO: 269802 - DNA, 19 bp, Homo sapiens
tctgtggacactgtggaaa

SEQ ID NO: 269803 - DNA, 22 bp, Homo sapiens
tctgtggagagtgagaataatt

SEQ ID NO: 269804 - DNA, 16 bp, Homo sapiens
tctgtggattctatat

SEQ ID NO: 269805 - DNA, 12 bp, Homo sapiens
tctgtggcctgt

SEQ ID NO: 269806 - DNA, 22 bp, Homo sapiens
tctgtggccttgttctctctat

SEQ ID NO: 269807 - DNA, 16 bp, Homo sapiens
tctgtgggactggccc

SEQ ID NO: 269808 - DNA, 17 bp, Homo sapiens
tctgtgggcttggcctt

SEQ ID NO: 269809 - DNA, 20 bp, Homo sapiens
tctgtgggcttggccttgtg

SEQ ID NO: 269810 - DNA, 22 bp, Homo sapiens
tctgtggtccagaagaaattat

SEQ ID NO: 269811 - DNA, 22 bp, Homo sapiens
tctgtggttgcagcctgaccaa

SEQ ID NO: 269812 - DNA, 12 bp, Homo sapiens
tctgtgtctgct

SEQ ID NO: 269813 - DNA, 13 bp, Homo sapiens
tctgtgtctgctg

SEQ ID NO: 269814 - DNA, 12 bp, Homo sapiens
tctgtgtctgtg

SEQ ID NO: 269815 - DNA, 13 bp, Homo sapiens
tctgtgtgaaaat

SEQ ID NO: 269816 - DNA, 18 bp, Homo sapiens
tctgtgtgcaccttacca

SEQ ID NO: 269817 - DNA, 14 bp, Homo sapiens
tctgtgtgctgtgg

SEQ ID NO: 269818 - DNA, 12 bp, Homo sapiens
tctgtgtggcaa

SEQ ID NO: 269819 - DNA, 18 bp, Homo sapiens
tctgtgtggcaaacattt

SEQ ID NO: 269820 - DNA, 19 bp, Homo sapiens
tctgtgtgtagccaggaag

SEQ ID NO: 269821 - DNA, 13 bp, Homo sapiens
tctgtgttttaat

SEQ ID NO: 269822 - DNA, 14 bp, Homo sapiens
tctgtgttttgaat

SEQ ID NO: 269823 - DNA, 12 bp, Homo sapiens
tctgttaaatat

SEQ ID NO: 269824 - DNA, 21 bp, Homo sapiens
tctgttaaatatttttgtaca

SEQ ID NO: 269825 - DNA, 22 bp, Homo sapiens
tctgttaaatatttttgtacat

SEQ ID NO: 269826 - DNA, 17 bp, Homo sapiens
tctgttaagtggtttca

SEQ ID NO: 269827 - DNA, 16 bp, Homo sapiens
tctgttaatgttaatt

SEQ ID NO: 269828 - DNA, 13 bp, Homo sapiens
tctgttacacaat

SEQ ID NO: 269829 - DNA, 17 bp, Homo sapiens
tctgttcagatgtgcat

SEQ ID NO: 269830 - DNA, 13 bp, Homo sapiens
tctgttcctggct

SEQ ID NO: 269831 - DNA, 23 bp, Homo sapiens
tctgttcctggctcagcctcaaa

SEQ ID NO: 269832 - DNA, 14 bp, Homo sapiens
tctgttctacttga

SEQ ID NO: 269833 - DNA, 22 bp, Homo sapiens
tctgttctacttgatatttcct

SEQ ID NO: 269834 - DNA, 13 bp, Homo sapiens
tctgttctcacat

SEQ ID NO: 269835 - DNA, 23 bp, Homo sapiens
tctgttctgccccctcagggatg

SEQ ID NO: 269836 - DNA, 22 bp, Homo sapiens
tctgttctgctcccagatgcct

SEQ ID NO: 269837 - DNA, 17 bp, Homo sapiens
tctgttctggtggcccc

SEQ ID NO: 269838 - DNA, 12 bp, Homo sapiens
tctgttgaagtt

SEQ ID NO: 269839 - DNA, 17 bp, Homo sapiens
tctgttgcccaggctgg

SEQ ID NO: 269840 - DNA, 12 bp, Homo sapiens
tctgttgcctcc

SEQ ID NO: 269841 - DNA, 21 bp, Homo sapiens
tctgttgcctcctctctccct

SEQ ID NO: 269842 - DNA, 14 bp, Homo sapiens
tctgttggttagta

SEQ ID NO: 269843 - DNA, 17 bp, Homo sapiens
tctgttgtcctcccctt

SEQ ID NO: 269844 - DNA, 19 bp, Homo sapiens
tctgttgtcctccccttgg

SEQ ID NO: 269845 - DNA, 16 bp, Homo sapiens
tctgtttaccctccct

SEQ ID NO: 269846 - DNA, 24 bp, Homo sapiens
tctgtttaccctccctgtcccctg

SEQ ID NO: 269847 - DNA, 20 bp, Homo sapiens
tctgtttcccctcagaacac

SEQ ID NO: 269848 - DNA, 20 bp, Homo sapiens
tctgtttccttctctttctc

SEQ ID NO: 269849 - DNA, 17 bp, Homo sapiens
tctgtttgaattttcaa

SEQ ID NO: 269850 - DNA, 12 bp, Homo sapiens
tctgtttgttaa

SEQ ID NO: 269851 - DNA, 17 bp, Homo sapiens
tctgttttctgtgcact

SEQ ID NO: 269852 - DNA, 16 bp, Homo sapiens
tctgttttgcctgaag

SEQ ID NO: 269853 - DNA, 17 bp, Homo sapiens
tctgtttttctcaaata

SEQ ID NO: 269854 - DNA, 19 bp, Homo sapiens
tctgttttttttttttgta

SEQ ID NO: 269855 - DNA, 22 bp, Homo sapiens
tcttaaagaaacagctttcaag

SEQ ID NO: 269856 - DNA, 19 bp, Homo sapiens
tcttaaagcaaaaaatgaa

SEQ ID NO: 269857 - DNA, 21 bp, Homo sapiens
tcttaaagctgcctgtagtta

SEQ ID NO: 269858 - DNA, 18 bp, Homo sapiens
tctttcttggtgcattcg

SEQ ID NO: 269859 - DNA, 21 bp, Homo sapiens
tctttctttacctgagaccag

SEQ ID NO: 269860 - DNA, 13 bp, Homo sapiens
tctttctttccaa

SEQ ID NO: 269861 - DNA, 13 bp, Homo sapiens
tctttctttctcc

SEQ ID NO: 269862 - DNA, 15 bp, Homo sapiens
tctttctttgctgct

SEQ ID NO: 269863 - DNA, 16 bp, Homo sapiens
tctttctttgctgctg

SEQ ID NO: 269864 - DNA, 14 bp, Homo sapiens
tctttgaaacaact

SEQ ID NO: 269865 - DNA, 21 bp, Homo sapiens
tctttgaaatagtctgtgtga

SEQ ID NO: 269866 - DNA, 21 bp, Homo sapiens
tctttgaaatatgcatgtact

SEQ ID NO: 269867 - DNA, 19 bp, Homo sapiens
tctttgaatttcctatctg

SEQ ID NO: 269868 - DNA, 14 bp, Homo sapiens
tctttgacctcaat

SEQ ID NO: 269869 - DNA, 17 bp, Homo sapiens
tctttgacctcaatgga

SEQ ID NO: 269870 - DNA, 23 bp, Homo sapiens
tctttgagaactgcttctaagat

SEQ ID NO: 269871 - DNA, 23 bp, Homo sapiens
tctttgagtgaagctgggagaac

SEQ ID NO: 269872 - DNA, 22 bp, Homo sapiens
tctttgcaacaataataaatgt

SEQ ID NO: 269873 - DNA, 13 bp, Homo sapiens
tctttgcagggct

SEQ ID NO: 269874 - DNA, 15 bp, Homo sapiens
tctttgcatggaatt

SEQ ID NO: 269875 - DNA, 14 bp, Homo sapiens
tctttgccttctct

SEQ ID NO: 269876 - DNA, 13 bp, Homo sapiens
tctttgctgcccc

SEQ ID NO: 269877 - DNA, 17 bp, Homo sapiens
tctttgctgcccctgtc

SEQ ID NO: 269878 - DNA, 19 bp, Homo sapiens
tctttgctgcccctgtctg

SEQ ID NO: 269879 - DNA, 21 bp, Homo sapiens
tctttgctgcccctgtctgga

SEQ ID NO: 269880 - DNA, 17 bp, Homo sapiens
tctttgctgctgtggaa

SEQ ID NO: 269881 - DNA, 13 bp, Homo sapiens
tctttgctgtgcc

SEQ ID NO: 269882 - DNA, 20 bp, Homo sapiens
tctttgctgtgccaaagcag

SEQ ID NO: 269883 - DNA, 13 bp, Homo sapiens
tctttgctgttga

SEQ ID NO: 269884 - DNA, 19 bp, Homo sapiens
tctttgctgtttatatata

SEQ ID NO: 269885 - DNA, 15 bp, Homo sapiens
tctttgcttccttgc

SEQ ID NO: 269886 - DNA, 17 bp, Homo sapiens
tctttgcttctttttct

SEQ ID NO: 269887 - DNA, 17 bp, Homo sapiens
tctttgggggattcaaa

SEQ ID NO: 269888 - DNA, 18 bp, Homo sapiens
tctttggttcctcatggc

SEQ ID NO: 269889 - DNA, 15 bp, Homo sapiens
tctttgtacagacaa

SEQ ID NO: 269890 - DNA, 15 bp, Homo sapiens
tctttgtcaatgctc

SEQ ID NO: 269891 - DNA, 24 bp, Homo sapiens
tctttgtcccggataggctaatca

SEQ ID NO: 269892 - DNA, 16 bp, Homo sapiens
tctttgtctcaccagc

SEQ ID NO: 269893 - DNA, 19 bp, Homo sapiens
tctttgtctcaccagctca

SEQ ID NO: 269894 - DNA, 23 bp, Homo sapiens
tctttgtctcaccagctcagccc

SEQ ID NO: 269895 - DNA, 15 bp, Homo sapiens
tctttgtggcagtgg

SEQ ID NO: 269896 - DNA, 22 bp, Homo sapiens
tctttgtggggcttggcgtgga

SEQ ID NO: 269897 - DNA, 13 bp, Homo sapiens
tctttgtgtgctg

SEQ ID NO: 269898 - DNA, 14 bp, Homo sapiens
tctttgtgtgctgt

SEQ ID NO: 269899 - DNA, 18 bp, Homo sapiens
tctttgttaagactgctg

SEQ ID NO: 269900 - DNA, 16 bp, Homo sapiens
tctttgttcctgcttt

SEQ ID NO: 269901 - DNA, 20 bp, Homo sapiens
tctttgttcctgctttctct

SEQ ID NO: 269902 - DNA, 23 bp, Homo sapiens
tctttgttcctgctttctctttc

SEQ ID NO: 269903 - DNA, 12 bp, Homo sapiens
tctttgttgctt

SEQ ID NO: 269904 - DNA, 14 bp, Homo sapiens
tctttgttgcttaa

SEQ ID NO: 269905 - DNA, 15 bp, Homo sapiens
tctttgttgcttaat

SEQ ID NO: 269906 - DNA, 19 bp, Homo sapiens
tcttttaaaaattcaaatg

SEQ ID NO: 269907 - DNA, 22 bp, Homo sapiens
tcttttaaagttttatatgcat

SEQ ID NO: 269908 - DNA, 14 bp, Homo sapiens
tcttttaaatgggt

SEQ ID NO: 269909 - DNA, 12 bp, Homo sapiens
tcttttaactgc

SEQ ID NO: 269910 - DNA, 21 bp, Homo sapiens
tcttttaatgatactgtctaa

SEQ ID NO: 269911 - DNA, 14 bp, Homo sapiens
tcttttacattctg

SEQ ID NO: 269912 - DNA, 20 bp, Homo sapiens
tcttttactgtggaggtggc

SEQ ID NO: 269913 - DNA, 18 bp, Homo sapiens
tcttttagttttagttgc

SEQ ID NO: 269914 - DNA, 21 bp, Homo sapiens
tcttttatatataaaataaat

SEQ ID NO: 269915 - DNA, 22 bp, Homo sapiens
tcttttatatataaaataaata

SEQ ID NO: 269916 - DNA, 21 bp, Homo sapiens
tcttttatgtggtggtttcta

SEQ ID NO: 269917 - DNA, 18 bp, Homo sapiens
tcttttcagcttgtttct

SEQ ID NO: 269918 - DNA, 19 bp, Homo sapiens
tcttttcagcttgtttcta

SEQ ID NO: 269919 - DNA, 24 bp, Homo sapiens
tcttttcagcttgtttctatactg

SEQ ID NO: 269920 - DNA, 14 bp, Homo sapiens
tcttttccagaaag

SEQ ID NO: 269921 - DNA, 15 bp, Homo sapiens
tcttttcccctcatt

SEQ ID NO: 269922 - DNA, 22 bp, Homo sapiens
tcttttcctcgcagatgataaa

SEQ ID NO: 269923 - DNA, 15 bp, Homo sapiens
tcttttcctgttgta

SEQ ID NO: 269924 - DNA, 17 bp, Homo sapiens
tcttttctctgtgcttc

SEQ ID NO: 269925 - DNA, 23 bp, Homo sapiens
tcttttctgcatcatctgtagat

SEQ ID NO: 269926 - DNA, 19 bp, Homo sapiens
tcttttctggtaggttctg

SEQ ID NO: 269927 - DNA, 21 bp, Homo sapiens
tcttttctgtcaccaaatttg

SEQ ID NO: 269928 - DNA, 13 bp, Homo sapiens
tcttttcttggac

SEQ ID NO: 269929 - DNA, 20 bp, Homo sapiens
tcttttgaataatgtagtgc

SEQ ID NO: 269930 - DNA, 20 bp, Homo sapiens
tcttttgacatgtggaaagt

SEQ ID NO: 269931 - DNA, 20 bp, Homo sapiens
tcttttgagttaggttaata

SEQ ID NO: 269932 - DNA, 12 bp, Homo sapiens
tcttttgataca

SEQ ID NO: 269933 - DNA, 13 bp, Homo sapiens
tcttttgccatga

SEQ ID NO: 269934 - DNA, 12 bp, Homo sapiens
tcttttggcctt

SEQ ID NO: 269935 - DNA, 15 bp, Homo sapiens
tcttttggccttgtg

SEQ ID NO: 269936 - DNA, 11 bp, Homo sapiens
tcttttgtagt

SEQ ID NO: 269937 - DNA, 12 bp, Homo sapiens
tcttttgttctc

SEQ ID NO: 269938 - DNA, 13 bp, Homo sapiens
tcttttgttctct

SEQ ID NO: 269939 - DNA, 16 bp, Homo sapiens
tcttttgttctctctt

SEQ ID NO: 269940 - DNA, 13 bp, Homo sapiens
tctttttaaagct

SEQ ID NO: 269941 - DNA, 18 bp, Homo sapiens
tctttttacttggaaata

SEQ ID NO: 269942 - DNA, 16 bp, Homo sapiens
tctttttatactatta

SEQ ID NO: 269943 - DNA, 14 bp, Homo sapiens
tctttttatgcatt

SEQ ID NO: 269944 - DNA, 20 bp, Homo sapiens
tctttttcaaaactagttct

SEQ ID NO: 269945 - DNA, 21 bp, Homo sapiens
tctttttcaaaactagttctt

SEQ ID NO: 269946 - DNA, 10 bp, Homo sapiens
tctttttcct

SEQ ID NO: 269947 - DNA, 12 bp, Homo sapiens
tctttttcttct

SEQ ID NO: 269948 - DNA, 17 bp, Homo sapiens
tctttttcttcttccct

SEQ ID NO: 269949 - DNA, 22 bp, Homo sapiens
tctttttgggagagacttgttt

SEQ ID NO: 269950 - DNA, 17 bp, Homo sapiens
tcttttttagctctctt

SEQ ID NO: 269951 - DNA, 22 bp, Homo sapiens
tctttttttaaaaataaatcta

SEQ ID NO: 269952 - DNA, 16 bp, Homo sapiens
tctttttttagggaga

SEQ ID NO: 269953 - DNA, 19 bp, Homo sapiens
tctttttttagggagaagg

SEQ ID NO: 269954 - DNA, 21 bp, Homo sapiens
tcttttttttttttttttaga

SEQ ID NO: 269955 - DNA, 18 bp, Homo sapiens
tgaaaaaaagggaaaaca

SEQ ID NO: 269956 - DNA, 21 bp, Homo sapiens
tgaaaaaaatgatctattgca

SEQ ID NO: 269957 - DNA, 12 bp, Homo sapiens
tgaaaaaaattg

SEQ ID NO: 269958 - DNA, 12 bp, Homo sapiens
tgaaaaaagaga

SEQ ID NO: 269959 - DNA, 17 bp, Homo sapiens
tgaaaaacacggcagct

SEQ ID NO: 269960 - DNA, 15 bp, Homo sapiens
tgaaaaatatgtgct

SEQ ID NO: 269961 - DNA, 16 bp, Homo sapiens
tgaaaaatatgttgag

SEQ ID NO: 269962 - DNA, 14 bp, Homo sapiens
tgaaaaatggtccc

SEQ ID NO: 269963 - DNA, 15 bp, Homo sapiens
tgaaaacaccaagag

SEQ ID NO: 269964 - DNA, 19 bp, Homo sapiens
tgaaaacacttattttaca

SEQ ID NO: 269965 - DNA, 22 bp, Homo sapiens
tgaaaaccagtcttctccctgt

SEQ ID NO: 269966 - DNA, 22 bp, Homo sapiens
tgaaaaccatccatctgtggaa

SEQ ID NO: 269967 - DNA, 22 bp, Homo sapiens
tgaaaaccatctggcctggcct

SEQ ID NO: 269968 - DNA, 17 bp, Homo sapiens
tgaaaacgttttattgt

SEQ ID NO: 269969 - DNA, 18 bp, Homo sapiens
tgaaaacgttttattgtg

SEQ ID NO: 269970 - DNA, 13 bp, Homo sapiens
tgaaaactgtaaa

SEQ ID NO: 269971 - DNA, 18 bp, Homo sapiens
tgaaaactgtaaatacaa

SEQ ID NO: 269972 - DNA, 17 bp, Homo sapiens
tgaaaactgtttatggt

SEQ ID NO: 269973 - DNA, 16 bp, Homo sapiens
tgaaaagaaatgctaa

SEQ ID NO: 269974 - DNA, 12 bp, Homo sapiens
tgaaaagaagaa

SEQ ID NO: 269975 - DNA, 18 bp, Homo sapiens
tgaaaagagtatgtagtg

SEQ ID NO: 269976 - DNA, 15 bp, Homo sapiens
tgaaaagctaccctg

SEQ ID NO: 269977 - DNA, 16 bp, Homo sapiens
tgaaaaggtgaccttg

SEQ ID NO: 269978 - DNA, 14 bp, Homo sapiens
tgaaaataaaataa

SEQ ID NO: 269979 - DNA, 19 bp, Homo sapiens
tgaaaatacaacttaaata

SEQ ID NO: 269980 - DNA, 14 bp, Homo sapiens
tgaaaatatttcta

SEQ ID NO: 269981 - DNA, 20 bp, Homo sapiens
tgaaaatatttttttctagc

SEQ ID NO: 269982 - DNA, 12 bp, Homo sapiens
tgaaaatcacta

SEQ ID NO: 269983 - DNA, 19 bp, Homo sapiens
tgaaaatgagcatcagaga

SEQ ID NO: 269984 - DNA, 16 bp, Homo sapiens
tgaaaatgagcctgta

SEQ ID NO: 269985 - DNA, 18 bp, Homo sapiens
tgaaaatgagcctgtaat

SEQ ID NO: 269986 - DNA, 21 bp, Homo sapiens
tgaaaatgcatttttatcatg

SEQ ID NO: 269987 - DNA, 21 bp, Homo sapiens
tgaaaatgggttggtgcttct

SEQ ID NO: 269988 - DNA, 18 bp, Homo sapiens
tgaaaatgtcagaaacca

SEQ ID NO: 269989 - DNA, 21 bp, Homo sapiens
tgaaaatgtcagaaaccagtt

SEQ ID NO: 269990 - DNA, 14 bp, Homo sapiens
tgaaaatgtgtgtt

SEQ ID NO: 269991 - DNA, 16 bp, Homo sapiens
tgaaaatgttgttatg

SEQ ID NO: 269992 - DNA, 20 bp, Homo sapiens
tgaaaattacacccatgcac

SEQ ID NO: 269993 - DNA, 20 bp, Homo sapiens
tgaaaattaggatttcatga

SEQ ID NO: 269994 - DNA, 19 bp, Homo sapiens
tgaaaattattttaaacaa

SEQ ID NO: 269995 - DNA, 21 bp, Homo sapiens
tgaaaattattttaaacaaaa

SEQ ID NO: 269996 - DNA, 18 bp, Homo sapiens
tgaaaattcaaaaagtgt

SEQ ID NO: 269997 - DNA, 23 bp, Homo sapiens
tgaaaattcaaaaagtgtttatt

SEQ ID NO: 269998 - DNA, 19 bp, Homo sapiens
tgaaacaactttctcttgt

SEQ ID NO: 269999 - DNA, 12 bp, Homo sapiens
tgaaacacacac

SEQ ID NO: 270000 - DNA, 23 bp, Homo sapiens
tgaaacactcagttgttcaataa

SEQ ID NO: 270001 - DNA, 18 bp, Homo sapiens
tgaaacactcgtgtgcat

SEQ ID NO: 270002 - DNA, 19 bp, Homo sapiens
tgaaacactcgtgtgcatg

SEQ ID NO: 270003 - DNA, 21 bp, Homo sapiens
tgaaacaggagagaaagggga

SEQ ID NO: 270004 - DNA, 16 bp, Homo sapiens
tgaaacctaaggcaac

SEQ ID NO: 270005 - DNA, 18 bp, Homo sapiens
tgaaacgaatataagctt

SEQ ID NO: 270006 - DNA, 15 bp, Homo sapiens
tgaaactagacttga

SEQ ID NO: 270007 - DNA, 17 bp, Homo sapiens
tgaaactcacaaatgat

SEQ ID NO: 270008 - DNA, 22 bp, Homo sapiens
tgaaactcctgattttgtagtt

SEQ ID NO: 270009 - DNA, 18 bp, Homo sapiens
tgaaactgagtctgtgga

SEQ ID NO: 270010 - DNA, 19 bp, Homo sapiens
tgaaactgagtctgtggac

SEQ ID NO: 270011 - DNA, 16 bp, Homo sapiens
tgaaacttacacacaa

SEQ ID NO: 270012 - DNA, 18 bp, Homo sapiens
tgaaacttcaagcaccag

SEQ ID NO: 270013 - DNA, 16 bp, Homo sapiens
tgaaacttgtgctata

SEQ ID NO: 270014 - DNA, 18 bp, Homo sapiens
tgaaacttgtgctatagt

SEQ ID NO: 270015 - DNA, 13 bp, Homo sapiens
tgaaagaagaaaa

SEQ ID NO: 270016 - DNA, 19 bp, Homo sapiens
tgaaagaagaacagctgtt

SEQ ID NO: 270017 - DNA, 21 bp, Homo sapiens
tgaaagaagtcaaatgaatga

SEQ ID NO: 270018 - DNA, 18 bp, Homo sapiens
tgaaagaattatttttgt

SEQ ID NO: 270019 - DNA, 20 bp, Homo sapiens
tgaaagaattatttttgtgt

SEQ ID NO: 270020 - DNA, 11 bp, Homo sapiens
tgaaagacaaa

SEQ ID NO: 270021 - DNA, 14 bp, Homo sapiens
tgaaagacaaagaa

SEQ ID NO: 270022 - DNA, 21 bp, Homo sapiens
tgaaagacaaagaaggaaaag

SEQ ID NO: 270023 - DNA, 12 bp, Homo sapiens
tgaaagaccttc

SEQ ID NO: 270024 - DNA, 19 bp, Homo sapiens
tgaaagaccttctccaaat

SEQ ID NO: 270025 - DNA, 13 bp, Homo sapiens
tgaaagagaacca

SEQ ID NO: 270026 - DNA, 19 bp, Homo sapiens
tgaaagaggctgaggcctg

SEQ ID NO: 270027 - DNA, 14 bp, Homo sapiens
tgaaagcagcagct

SEQ ID NO: 270028 - DNA, 16 bp, Homo sapiens
tgaaagcagcagctag

SEQ ID NO: 270029 - DNA, 17 bp, Homo sapiens
tgaaagcagcagctagg

SEQ ID NO: 270030 - DNA, 17 bp, Homo sapiens
tgaaagcatccatgtgt

SEQ ID NO: 270031 - DNA, 16 bp, Homo sapiens
tgaaagcctgtctctt

SEQ ID NO: 270032 - DNA, 18 bp, Homo sapiens
tgaaagctgattactgtc

SEQ ID NO: 270033 - DNA, 21 bp, Homo sapiens
tgaaagctgattactgtcaat

SEQ ID NO: 270034 - DNA, 20 bp, Homo sapiens
tgaaagctgcttctggggga

SEQ ID NO: 270035 - DNA, 11 bp, Homo sapiens
tgaaagctgtg

SEQ ID NO: 270036 - DNA, 12 bp, Homo sapiens
tgaaaggaaaag

SEQ ID NO: 270037 - DNA, 12 bp, Homo sapiens
tgaaaggaaaga

SEQ ID NO: 270038 - DNA, 15 bp, Homo sapiens
tgaaagggctatggc

SEQ ID NO: 270039 - DNA, 19 bp, Homo sapiens
tgaaagggctatggcaagg

SEQ ID NO: 270040 - DNA, 16 bp, Homo sapiens
tgaaaggtaatctgaa

SEQ ID NO: 270041 - DNA, 17 bp, Homo sapiens
tgaaaggtaatctgaaa

SEQ ID NO: 270042 - DNA, 14 bp, Homo sapiens
tgaaagtatgtgat

SEQ ID NO: 270043 - DNA, 21 bp, Homo sapiens
tgaaagtcagtttaagaggct

SEQ ID NO: 270044 - DNA, 18 bp, Homo sapiens
tgaaagtcttgtgactag

SEQ ID NO: 270045 - DNA, 20 bp, Homo sapiens
tgaaagtcttgtgactagtg

SEQ ID NO: 270046 - DNA, 21 bp, Homo sapiens
tgaaagtcttgtgactagtgc

SEQ ID NO: 270047 - DNA, 17 bp, Homo sapiens
tgaaagtgtaaaataga

SEQ ID NO: 270048 - DNA, 15 bp, Homo sapiens
tgaaagttttccagt

SEQ ID NO: 270049 - DNA, 19 bp, Homo sapiens
tgaaagttttccagtattg

SEQ ID NO: 270050 - DNA, 23 bp, Homo sapiens
tgaaataaaaaaaaaaggatgaa

SEQ ID NO: 270051 - DNA, 12 bp, Homo sapiens
tgaaataaaact

SEQ ID NO: 270052 - DNA, 14 bp, Homo sapiens
tgaaataataatat

SEQ ID NO: 270053 - DNA, 16 bp, Homo sapiens
tgaaatacctttgcct

SEQ ID NO: 270054 - DNA, 18 bp, Homo sapiens
tgaaatagtctgtgtgaa

SEQ ID NO: 270055 - DNA, 22 bp, Homo sapiens
tgaaatagtggttcttggaaaa

SEQ ID NO: 270056 - DNA, 23 bp, Homo sapiens
tgaaatagttattttaatacctt

SEQ ID NO: 270057 - DNA, 21 bp, Homo sapiens
tgaaatataaactgtgagata

SEQ ID NO: 270058 - DNA, 18 bp, Homo sapiens
tgaaatatgcatgtactt

SEQ ID NO: 270059 - DNA, 17 bp, Homo sapiens
tgaaatatttgcttatt

SEQ ID NO: 270060 - DNA, 22 bp, Homo sapiens
tgaaatatttgcttatttatat

SEQ ID NO: 270061 - DNA, 13 bp, Homo sapiens
tgaaatcaaatgt

SEQ ID NO: 270062 - DNA, 19 bp, Homo sapiens
tgaaatgaaaacatgtaat

SEQ ID NO: 270063 - DNA, 22 bp, Homo sapiens
tgaaatgccctcctaaatgtca

SEQ ID NO: 270064 - DNA, 16 bp, Homo sapiens
tgaaatggaggtcctt

SEQ ID NO: 270065 - DNA, 20 bp, Homo sapiens
tgaaattactacaaaatttg

SEQ ID NO: 270066 - DNA, 23 bp, Homo sapiens
tgaaattactacaaaatttgaaa

SEQ ID NO: 270067 - DNA, 13 bp, Homo sapiens
tgaaattatagtt

SEQ ID NO: 270068 - DNA, 21 bp, Homo sapiens
tgaaattatgtatgtttacat

SEQ ID NO: 270069 - DNA, 22 bp, Homo sapiens
tgaaattatgtcaaatggatgt

SEQ ID NO: 270070 - DNA, 19 bp, Homo sapiens
tgaaattcctctgtagaat

SEQ ID NO: 270071 - DNA, 16 bp, Homo sapiens
tgaaattcttgaagtt

SEQ ID NO: 270072 - DNA, 18 bp, Homo sapiens
tgaaattgtgaactcatt

SEQ ID NO: 270073 - DNA, 14 bp, Homo sapiens
tgaaatttaaaaat

SEQ ID NO: 270074 - DNA, 15 bp, Homo sapiens
tgaaatttaaaaatc

SEQ ID NO: 270075 - DNA, 22 bp, Homo sapiens
tgaaatttaaaaatctttcaga

SEQ ID NO: 270076 - DNA, 20 bp, Homo sapiens
tgaaatttgttatacttcaa

SEQ ID NO: 270077 - DNA, 21 bp, Homo sapiens
tgaaatttgttatacttcaaa

SEQ ID NO: 270078 - DNA, 21 bp, Homo sapiens
tgaaattttctagactttctg

SEQ ID NO: 270079 - DNA, 22 bp, Homo sapiens
tgaaatttttaaatcatttcat

SEQ ID NO: 270080 - DNA, 14 bp, Homo sapiens
tgaacaaaaaaatg

SEQ ID NO: 270081 - DNA, 18 bp, Homo sapiens
tgaacaaaatgaagttaa

SEQ ID NO: 270082 - DNA, 14 bp, Homo sapiens
tgaacaagaaagag

SEQ ID NO: 270083 - DNA, 15 bp, Homo sapiens
tgaacaagaaagagt

SEQ ID NO: 270084 - DNA, 18 bp, Homo sapiens
tgaacaagatttccctaa

SEQ ID NO: 270085 - DNA, 16 bp, Homo sapiens
tgaacaagtgaacaca

SEQ ID NO: 270086 - DNA, 22 bp, Homo sapiens
tgaacaatacgtgaaagatgca

SEQ ID NO: 270087 - DNA, 16 bp, Homo sapiens
tgaacaatcaaagcac

SEQ ID NO: 270088 - DNA, 22 bp, Homo sapiens
tgaacacaagcaaaccttctca

SEQ ID NO: 270089 - DNA, 16 bp, Homo sapiens
tgaacacactcagcag

SEQ ID NO: 270090 - DNA, 17 bp, Homo sapiens
tgaacacagatcattct

SEQ ID NO: 270091 - DNA, 22 bp, Homo sapiens
tgaacacaggcaaagaggtgct

SEQ ID NO: 270092 - DNA, 20 bp, Homo sapiens
tgaacagattgctacacaca

SEQ ID NO: 270093 - DNA, 22 bp, Homo sapiens
tgaacagggcccaggcctggag

SEQ ID NO: 270094 - DNA, 23 bp, Homo sapiens
tgaacagggcccaggcctggagc

SEQ ID NO: 270095 - DNA, 12 bp, Homo sapiens
tgaacagtggag

SEQ ID NO: 270096 - DNA, 23 bp, Homo sapiens
tgaacataaatcagttaatggct

SEQ ID NO: 270097 - DNA, 18 bp, Homo sapiens
tgaacataactgtaacat

SEQ ID NO: 270098 - DNA, 22 bp, Homo sapiens
tgaaccaagaactttccaggaa

SEQ ID NO: 270099 - DNA, 18 bp, Homo sapiens
tgaaccaagatctataaa

SEQ ID NO: 270100 - DNA, 22 bp, Homo sapiens
tgaaccagctcatctccaagga

SEQ ID NO: 270101 - DNA, 22 bp, Homo sapiens
tgaacccaggacgcttctgaat

SEQ ID NO: 270102 - DNA, 15 bp, Homo sapiens
tgaaccccatgggct

SEQ ID NO: 270103 - DNA, 15 bp, Homo sapiens
tgaacccttgcttgc

SEQ ID NO: 270104 - DNA, 20 bp, Homo sapiens
tgaacctttttttttgaaac

SEQ ID NO: 270105 - DNA, 21 bp, Homo sapiens
tgaacctttttttttgaaaca

SEQ ID NO: 270106 - DNA, 23 bp, Homo sapiens
tgaacctttttttttgaaacagc

SEQ ID NO: 270107 - DNA, 21 bp, Homo sapiens
tgaacgtacccaaggtcacat

SEQ ID NO: 270108 - DNA, 19 bp, Homo sapiens
tgaactcaccgctcaccct

SEQ ID NO: 270109 - DNA, 18 bp, Homo sapiens
tgaactcacgagccttgc

SEQ ID NO: 270110 - DNA, 18 bp, Homo sapiens
tgaactccatacagcctc

SEQ ID NO: 270111 - DNA, 18 bp, Homo sapiens
tgaactcctgacctcagg

SEQ ID NO: 270112 - DNA, 11 bp, Homo sapiens
tgaactctcaa

SEQ ID NO: 270113 - DNA, 16 bp, Homo sapiens
tgaactctgttccccc

SEQ ID NO: 270114 - DNA, 19 bp, Homo sapiens
tgaactctgttcccccacc

SEQ ID NO: 270115 - DNA, 15 bp, Homo sapiens
tgaactcttcaatct

SEQ ID NO: 270116 - DNA, 22 bp, Homo sapiens
tgaactctttctggcctgcctt

SEQ ID NO: 270117 - DNA, 23 bp, Homo sapiens
tgaactctttctggcctgccttc

SEQ ID NO: 270118 - DNA, 12 bp, Homo sapiens
tgaactgaagtt

SEQ ID NO: 270119 - DNA, 12 bp, Homo sapiens
tgaactgagaag

SEQ ID NO: 270120 - DNA, 14 bp, Homo sapiens
tgaactgctgctgg

SEQ ID NO: 270121 - DNA, 19 bp, Homo sapiens
tgaactggccgctgggaga

SEQ ID NO: 270122 - DNA, 12 bp, Homo sapiens
tgaactgtgaca

SEQ ID NO: 270123 - DNA, 13 bp, Homo sapiens
tgaactgtgacag

SEQ ID NO: 270124 - DNA, 14 bp, Homo sapiens
tgaactgtgacagg

SEQ ID NO: 270125 - DNA, 17 bp, Homo sapiens
agcaagacgtcctggaa

SEQ ID NO: 270126 - DNA, 19 bp, Homo sapiens
agcaagacgtcctggaatg

SEQ ID NO: 270127 - DNA, 12 bp, Homo sapiens
agcaagagagat

SEQ ID NO: 270128 - DNA, 15 bp, Homo sapiens
agcaagagagatgtt

SEQ ID NO: 270129 - DNA, 13 bp, Homo sapiens
agcaaggacattg

SEQ ID NO: 270130 - DNA, 17 bp, Homo sapiens
agcaaggaccagtgaga

SEQ ID NO: 270131 - DNA, 19 bp, Homo sapiens
agcaaggcacaggctcctg

SEQ ID NO: 270132 - DNA, 12 bp, Homo sapiens
agcaaggcaggt

SEQ ID NO: 270133 - DNA, 15 bp, Homo sapiens
agcaaggccagccct

SEQ ID NO: 270134 - DNA, 16 bp, Homo sapiens
agcaagggctccagca

SEQ ID NO: 270135 - DNA, 20 bp, Homo sapiens
agcaagggctccagcatcca

SEQ ID NO: 270136 - DNA, 13 bp, Homo sapiens
agcaagtcccaga

SEQ ID NO: 270137 - DNA, 22 bp, Homo sapiens
agcaagtcccagacaaggagag

SEQ ID NO: 270138 - DNA, 19 bp, Homo sapiens
agcaagtgagcactgaggg

SEQ ID NO: 270139 - DNA, 19 bp, Homo sapiens
agcaagttcactacagcat

SEQ ID NO: 270140 - DNA, 14 bp, Homo sapiens
agcaataaatgaat

SEQ ID NO: 270141 - DNA, 22 bp, Homo sapiens
agcaataagttcattaaacaga

SEQ ID NO: 270142 - DNA, 14 bp, Homo sapiens
agcaatcctcctga

SEQ ID NO: 270143 - DNA, 14 bp, Homo sapiens
agcaatgcctgcct

SEQ ID NO: 270144 - DNA, 16 bp, Homo sapiens
agcaatgggactggag

SEQ ID NO: 270145 - DNA, 22 bp, Homo sapiens
agcaatgtgagtcccagagccc

SEQ ID NO: 270146 - DNA, 19 bp, Homo sapiens
agcaattatttaaagaaag

SEQ ID NO: 270147 - DNA, 23 bp, Homo sapiens
agcaattctcctgcctcagcctc

SEQ ID NO: 270148 - DNA, 16 bp, Homo sapiens
agcaattgtgtggtca

SEQ ID NO: 270149 - DNA, 23 bp, Homo sapiens
agcaattgtgtggtcagtggctc

SEQ ID NO: 270150 - DNA, 21 bp, Homo sapiens
agcaatttcttgctctatctc

SEQ ID NO: 270151 - DNA, 21 bp, Homo sapiens
agcaattttgtatccatttaa

SEQ ID NO: 270152 - DNA, 17 bp, Homo sapiens
agcacaaaccctgggga

SEQ ID NO: 270153 - DNA, 16 bp, Homo sapiens
agcacaaacttctgta

SEQ ID NO: 270154 - DNA, 14 bp, Homo sapiens
agcacaagaagtgg

SEQ ID NO: 270155 - DNA, 19 bp, Homo sapiens
agcacaagaggaagagaga

SEQ ID NO: 270156 - DNA, 23 bp, Homo sapiens
agcacaagcattccttagcagct

SEQ ID NO: 270157 - DNA, 16 bp, Homo sapiens
agcacaaggagtgccc

SEQ ID NO: 270158 - DNA, 17 bp, Homo sapiens
agcacaaggagtgcccg

SEQ ID NO: 270159 - DNA, 12 bp, Homo sapiens
agcacagccctg

SEQ ID NO: 270160 - DNA, 13 bp, Homo sapiens
agcacagccctgg

SEQ ID NO: 270161 - DNA, 17 bp, Homo sapiens
agcacagccctgggagg

SEQ ID NO: 270162 - DNA, 22 bp, Homo sapiens
agcacagccctgggagggggct

SEQ ID NO: 270163 - DNA, 21 bp, Homo sapiens
agcacagcctcacccctgcag

SEQ ID NO: 270164 - DNA, 15 bp, Homo sapiens
agcacagctgtgagg

SEQ ID NO: 270165 - DNA, 12 bp, Homo sapiens
agcacaggcagc

SEQ ID NO: 270166 - DNA, 16 bp, Homo sapiens
agcacaggccagggga

SEQ ID NO: 270167 - DNA, 15 bp, Homo sapiens
agcacaggggcccca

SEQ ID NO: 270168 - DNA, 16 bp, Homo sapiens
agcacaggggccccag

SEQ ID NO: 270169 - DNA, 19 bp, Homo sapiens
agcacaggggccccagatc

SEQ ID NO: 270170 - DNA, 18 bp, Homo sapiens
agcacagtgttaaatgaa

SEQ ID NO: 270171 - DNA, 19 bp, Homo sapiens
agcacatcatggcagtggg

SEQ ID NO: 270172 - DNA, 19 bp, Homo sapiens
agcacatgcactactgaaa

SEQ ID NO: 270173 - DNA, 15 bp, Homo sapiens
agcacatgccaggga

SEQ ID NO: 270174 - DNA, 20 bp, Homo sapiens
agcacatgccagggaaaaag

SEQ ID NO: 270175 - DNA, 23 bp, Homo sapiens
agcacatgccagggaaaaagacc

SEQ ID NO: 270176 - DNA, 20 bp, Homo sapiens
agcacatgctggccagcctg

SEQ ID NO: 270177 - DNA, 18 bp, Homo sapiens
agcacatttcctctctat

SEQ ID NO: 270178 - DNA, 22 bp, Homo sapiens
agcaccacggggtcgggggagg

SEQ ID NO: 270179 - DNA, 16 bp, Homo sapiens
agcaccatctctcctc

SEQ ID NO: 270180 - DNA, 23 bp, Homo sapiens
agcacccacgtgagagaatctgc

SEQ ID NO: 270181 - DNA, 17 bp, Homo sapiens
agcaccccaccacacac

SEQ ID NO: 270182 - DNA, 11 bp, Homo sapiens
agcacccccac

SEQ ID NO: 270183 - DNA, 12 bp, Homo sapiens
agcacccccacc

SEQ ID NO: 270184 - DNA, 14 bp, Homo sapiens
agcacccccaccca

SEQ ID NO: 270185 - DNA, 16 bp, Homo sapiens
agcacccccacccacc

SEQ ID NO: 270186 - DNA, 13 bp, Homo sapiens
agcacccccagcc

SEQ ID NO: 270187 - DNA, 14 bp, Homo sapiens
agcacccccagcct

SEQ ID NO: 270188 - DNA, 18 bp, Homo sapiens
agcacccccagcctcccc

SEQ ID NO: 270189 - DNA, 19 bp, Homo sapiens
agcacccccagcctccccc

SEQ ID NO: 270190 - DNA, 21 bp, Homo sapiens
agcacccccagcctcccccag

SEQ ID NO: 270191 - DNA, 22 bp, Homo sapiens
agcacccccagcctcccccagg

SEQ ID NO: 270192 - DNA, 13 bp, Homo sapiens
agcaccctctccg

SEQ ID NO: 270193 - DNA, 17 bp, Homo sapiens
agcaccctgggtgccat

SEQ ID NO: 270194 - DNA, 16 bp, Homo sapiens
agcacccttctgctgt

SEQ ID NO: 270195 - DNA, 20 bp, Homo sapiens
agcacctactatgtgctggg

SEQ ID NO: 270196 - DNA, 21 bp, Homo sapiens
agcacctactatgtgctgggt

SEQ ID NO: 270197 - DNA, 17 bp, Homo sapiens
agcacctagcctcgctc

SEQ ID NO: 270198 - DNA, 18 bp, Homo sapiens
agcacctagtccagtgac

SEQ ID NO: 270199 - DNA, 14 bp, Homo sapiens
agcacctatgaaag

SEQ ID NO: 270200 - DNA, 15 bp, Homo sapiens
agcacctcaggaccc

SEQ ID NO: 270201 - DNA, 15 bp, Homo sapiens
agcacctcctctctg

SEQ ID NO: 270202 - DNA, 18 bp, Homo sapiens
agcacctcctctctgctg

SEQ ID NO: 270203 - DNA, 19 bp, Homo sapiens
agcacctcctctctgctgg

SEQ ID NO: 270204 - DNA, 12 bp, Homo sapiens
agcacctgccag

SEQ ID NO: 270205 - DNA, 16 bp, Homo sapiens
agcacctgccagggcc

SEQ ID NO: 270206 - DNA, 12 bp, Homo sapiens
agcacctgggct

SEQ ID NO: 270207 - DNA, 20 bp, Homo sapiens
agcacctgggctgaggaggc

SEQ ID NO: 270208 - DNA, 14 bp, Homo sapiens
tgaagtttacattg

SEQ ID NO: 270209 - DNA, 14 bp, Homo sapiens
tgaagtttatacag

SEQ ID NO: 270210 - DNA, 20 bp, Homo sapiens
tgaagtttatacagtacagt

SEQ ID NO: 270211 - DNA, 15 bp, Homo sapiens
tgaagtttcatttat

SEQ ID NO: 270212 - DNA, 23 bp, Homo sapiens
tgaagtttcctatgactaattca

SEQ ID NO: 270213 - DNA, 19 bp, Homo sapiens
tgaataaaaaacatttgta

SEQ ID NO: 270214 - DNA, 23 bp, Homo sapiens
tgaataaaaaacatttgtacatt

SEQ ID NO: 270215 - DNA, 14 bp, Homo sapiens
tgaataaaaatgca

SEQ ID NO: 270216 - DNA, 14 bp, Homo sapiens
tgaataaaaattaa

SEQ ID NO: 270217 - DNA, 15 bp, Homo sapiens
tgaataaaagtgcac

SEQ ID NO: 270218 - DNA, 16 bp, Homo sapiens
tgaataaaagtgcaca

SEQ ID NO: 270219 - DNA, 16 bp, Homo sapiens
tgaataaagacaccta

SEQ ID NO: 270220 - DNA, 21 bp, Homo sapiens
tgaataaagggaacatgcagc

SEQ ID NO: 270221 - DNA, 22 bp, Homo sapiens
tgaataaagggaacatgcagct

SEQ ID NO: 270222 - DNA, 23 bp, Homo sapiens
tgaataaagggaacatgcagctc

SEQ ID NO: 270223 - DNA, 20 bp, Homo sapiens
tgaataagttgattctgtcc

SEQ ID NO: 270224 - DNA, 17 bp, Homo sapiens
tgaataataaatacaca

SEQ ID NO: 270225 - DNA, 22 bp, Homo sapiens
tgaataattatgtttacctcac

SEQ ID NO: 270226 - DNA, 13 bp, Homo sapiens
tgaataatttctt

SEQ ID NO: 270227 - DNA, 12 bp, Homo sapiens
tgaatacaatta

SEQ ID NO: 270228 - DNA, 18 bp, Homo sapiens
tgaatacaattaaaggtc

SEQ ID NO: 270229 - DNA, 21 bp, Homo sapiens
tgaataccattaaaactgctt

SEQ ID NO: 270230 - DNA, 15 bp, Homo sapiens
tgaatacttgaagta

SEQ ID NO: 270231 - DNA, 21 bp, Homo sapiens
tgaatataaatgtactacatt

SEQ ID NO: 270232 - DNA, 16 bp, Homo sapiens
tgaatatattttatct

SEQ ID NO: 270233 - DNA, 19 bp, Homo sapiens
tgaatatcatatgtatcta

SEQ ID NO: 270234 - DNA, 17 bp, Homo sapiens
tgaatattatcatttct

SEQ ID NO: 270235 - DNA, 19 bp, Homo sapiens
tgaatattttttatttcta

SEQ ID NO: 270236 - DNA, 21 bp, Homo sapiens
tgaatattttttatttctaag

SEQ ID NO: 270237 - DNA, 22 bp, Homo sapiens
tgaatcaatctggcttctgcat

SEQ ID NO: 270238 - DNA, 21 bp, Homo sapiens
tgaatcagtatgaagacactg

SEQ ID NO: 270239 - DNA, 14 bp, Homo sapiens
tgaatcatccagac

SEQ ID NO: 270240 - DNA, 16 bp, Homo sapiens
tgaatcccacttcagt

SEQ ID NO: 270241 - DNA, 15 bp, Homo sapiens
tgaatcctaagggct

SEQ ID NO: 270242 - DNA, 17 bp, Homo sapiens
tgaatcgtttcatgtaa

SEQ ID NO: 270243 - DNA, 21 bp, Homo sapiens
tgaatctgaaagagcattatt

SEQ ID NO: 270244 - DNA, 23 bp, Homo sapiens
tgaatctgattggacattttctt

SEQ ID NO: 270245 - DNA, 22 bp, Homo sapiens
tgaatctgcattttctgggttc

SEQ ID NO: 270246 - DNA, 21 bp, Homo sapiens
tgaatgaaaaatttaagcatt

SEQ ID NO: 270247 - DNA, 22 bp, Homo sapiens
tgaatgaaaaatttaagcattg

SEQ ID NO: 270248 - DNA, 15 bp, Homo sapiens
tgaatgaaatataaa

SEQ ID NO: 270249 - DNA, 20 bp, Homo sapiens
tgaatgaaatataaactgtg

SEQ ID NO: 270250 - DNA, 22 bp, Homo sapiens
tgaatgaaatataaactgtgag

SEQ ID NO: 270251 - DNA, 15 bp, Homo sapiens
tgaatgacaacagaa

SEQ ID NO: 270252 - DNA, 21 bp, Homo sapiens
tgaatgaggaacaatcacaaa

SEQ ID NO: 270253 - DNA, 18 bp, Homo sapiens
tgaatgatctctctgaat

SEQ ID NO: 270254 - DNA, 15 bp, Homo sapiens
tgaatgcagtataaa

SEQ ID NO: 270255 - DNA, 22 bp, Homo sapiens
tgaatgcgctttattgcccatg

SEQ ID NO: 270256 - DNA, 21 bp, Homo sapiens
tgaatggttccatgcctgagg

SEQ ID NO: 270257 - DNA, 22 bp, Homo sapiens
tgaatggttccatgcctgaggg

SEQ ID NO: 270258 - DNA, 16 bp, Homo sapiens
tgaatgtacaaagata

SEQ ID NO: 270259 - DNA, 15 bp, Homo sapiens
tgaatgtatcaggaa

SEQ ID NO: 270260 - DNA, 15 bp, Homo sapiens
tgaatgtatgtgcac

SEQ ID NO: 270261 - DNA, 18 bp, Homo sapiens
tgaatgtatgtgcactgt

SEQ ID NO: 270262 - DNA, 13 bp, Homo sapiens
agcagccagccag

SEQ ID NO: 270263 - DNA, 15 bp, Homo sapiens
agcagccagccagtc

SEQ ID NO: 270264 - DNA, 15 bp, Homo sapiens
agcagcctccactgt

SEQ ID NO: 270265 - DNA, 17 bp, Homo sapiens
agcagcctccactgtgt

SEQ ID NO: 270266 - DNA, 14 bp, Homo sapiens
agcagcctccctgt

SEQ ID NO: 270267 - DNA, 14 bp, Homo sapiens
agcagcctctgaag

SEQ ID NO: 270268 - DNA, 16 bp, Homo sapiens
agcagcctgtgaggga

SEQ ID NO: 270269 - DNA, 13 bp, Homo sapiens
agcagcctgtggc

SEQ ID NO: 270270 - DNA, 19 bp, Homo sapiens
agcagccttactattcata

SEQ ID NO: 270271 - DNA, 14 bp, Homo sapiens
agcagcctttctgt

SEQ ID NO: 270272 - DNA, 23 bp, Homo sapiens
agcagcggtaccccagggcctac

SEQ ID NO: 270273 - DNA, 22 bp, Homo sapiens
agcagcggtttggggagcagag

SEQ ID NO: 270274 - DNA, 18 bp, Homo sapiens
agcagctaaattttctga

SEQ ID NO: 270275 - DNA, 11 bp, Homo sapiens
agcagctacca

SEQ ID NO: 270276 - DNA, 18 bp, Homo sapiens
agcagctaggactgagga

SEQ ID NO: 270277 - DNA, 18 bp, Homo sapiens
agcagctcaggcgcagcc

SEQ ID NO: 270278 - DNA, 16 bp, Homo sapiens
agcagctccccaggag

SEQ ID NO: 270279 - DNA, 21 bp, Homo sapiens
agcagctccccaggagctcag

SEQ ID NO: 270280 - DNA, 15 bp, Homo sapiens
agcagctccgcctgg

SEQ ID NO: 270281 - DNA, 18 bp, Homo sapiens
agcagctccgcctggcac

SEQ ID NO: 270282 - DNA, 12 bp, Homo sapiens
agcagctgaagt

SEQ ID NO: 270283 - DNA, 19 bp, Homo sapiens
agcagctgaagtctctttt

SEQ ID NO: 270284 - DNA, 21 bp, Homo sapiens
agcagctgggacccctcccaa

SEQ ID NO: 270285 - DNA, 16 bp, Homo sapiens
agcagcttcagttgtt

SEQ ID NO: 270286 - DNA, 15 bp, Homo sapiens
agcagcttgctgcac

SEQ ID NO: 270287 - DNA, 23 bp, Homo sapiens
agcagcttggctgagccccctct

SEQ ID NO: 270288 - DNA, 17 bp, Homo sapiens
agcaggaaagatcccaa

SEQ ID NO: 270289 - DNA, 17 bp, Homo sapiens
agcaggaagcaaggcca

SEQ ID NO: 270290 - DNA, 17 bp, Homo sapiens
agcaggaaggcctgggt

SEQ ID NO: 270291 - DNA, 14 bp, Homo sapiens
agcaggagcagctg

SEQ ID NO: 270292 - DNA, 23 bp, Homo sapiens
agcaggaggaggaaaggtagccc

SEQ ID NO: 270293 - DNA, 14 bp, Homo sapiens
agcaggagtggaag

SEQ ID NO: 270294 - DNA, 22 bp, Homo sapiens
agcaggcaaaaaagggacagca

SEQ ID NO: 270295 - DNA, 15 bp, Homo sapiens
agcaggcagaggaga

SEQ ID NO: 270296 - DNA, 18 bp, Homo sapiens
agcaggcagaggagagta

SEQ ID NO: 270297 - DNA, 13 bp, Homo sapiens
agcaggcccacct

SEQ ID NO: 270298 - DNA, 14 bp, Homo sapiens
agcaggcccaccta

SEQ ID NO: 270299 - DNA, 15 bp, Homo sapiens
agcaggcccagctgg

SEQ ID NO: 270300 - DNA, 16 bp, Homo sapiens
agcaggcctgttgctt

SEQ ID NO: 270301 - DNA, 16 bp, Homo sapiens
agcaggctggcagctc

SEQ ID NO: 270302 - DNA, 24 bp, Homo sapiens
agcaggctggcagctctccagtca

SEQ ID NO: 270303 - DNA, 17 bp, Homo sapiens
agcagggaaagctccac

SEQ ID NO: 270304 - DNA, 14 bp, Homo sapiens
agcagggacacccc

SEQ ID NO: 270305 - DNA, 18 bp, Homo sapiens
agcagggcgggccaggag

SEQ ID NO: 270306 - DNA, 20 bp, Homo sapiens
agcagggcgggccaggagaa

SEQ ID NO: 270307 - DNA, 23 bp, Homo sapiens
agcaggggtgggaggctcccaga

SEQ ID NO: 270308 - DNA, 19 bp, Homo sapiens
agcagggtctttgtgtgct

SEQ ID NO: 270309 - DNA, 15 bp, Homo sapiens
agcaggtctgcaggc

SEQ ID NO: 270310 - DNA, 17 bp, Homo sapiens
agcaggtctgcaggcca

SEQ ID NO: 270311 - DNA, 18 bp, Homo sapiens
agcaggtctgcaggccac

SEQ ID NO: 270312 - DNA, 13 bp, Homo sapiens
agcaggtggggag

SEQ ID NO: 270313 - DNA, 14 bp, Homo sapiens
agcaggtgtggtgg

SEQ ID NO: 270314 - DNA, 19 bp, Homo sapiens
agcaggtgtggtggctcat

SEQ ID NO: 270315 - DNA, 17 bp, Homo sapiens
agcaggttgcttcaaga

SEQ ID NO: 270316 - DNA, 16 bp, Homo sapiens
agcagtaaatgtatat

SEQ ID NO: 270317 - DNA, 21 bp, Homo sapiens
agcagtaaatgtatattgatg

SEQ ID NO: 270318 - DNA, 21 bp, Homo sapiens
agcagtaccatcccactgata

SEQ ID NO: 270319 - DNA, 16 bp, Homo sapiens
agcagtacttgctcaa

SEQ ID NO: 270320 - DNA, 21 bp, Homo sapiens
agcagtagaaataatatgcat

SEQ ID NO: 270321 - DNA, 22 bp, Homo sapiens
agcagtagaaataatatgcatt

SEQ ID NO: 270322 - DNA, 17 bp, Homo sapiens
agcagtatgaatgatgt

SEQ ID NO: 270323 - DNA, 21 bp, Homo sapiens
agcagtcacaggtcttttctt

SEQ ID NO: 270324 - DNA, 14 bp, Homo sapiens
agcagtccagagct

SEQ ID NO: 270325 - DNA, 23 bp, Homo sapiens
agcagtcccagtattctcagagc

SEQ ID NO: 270326 - DNA, 22 bp, Homo sapiens
agcagtcctgcctcagcctccg

SEQ ID NO: 270327 - DNA, 21 bp, Homo sapiens
agcagtctacccacctcagcc

SEQ ID NO: 270328 - DNA, 23 bp, Homo sapiens
agcagtctacccacctcagcctc

SEQ ID NO: 270329 - DNA, 16 bp, Homo sapiens
agcagtgcatgctgtc

SEQ ID NO: 270330 - DNA, 20 bp, Homo sapiens
agcagtgcatgctgtccctt

SEQ ID NO: 270331 - DNA, 19 bp, Homo sapiens
agcagtgcctcgaggcacc

SEQ ID NO: 270332 - DNA, 17 bp, Homo sapiens
agcagtgccttccataa

SEQ ID NO: 270333 - DNA, 19 bp, Homo sapiens
agcagtgccttccataatt

SEQ ID NO: 270334 - DNA, 20 bp, Homo sapiens
agcagtgccttccataatta

SEQ ID NO: 270335 - DNA, 13 bp, Homo sapiens
agcagtgctgggc

SEQ ID NO: 270336 - DNA, 20 bp, Homo sapiens
agcagtgctgggcccagccg

SEQ ID NO: 270337 - DNA, 18 bp, Homo sapiens
tgaatgtcaatatgagat

SEQ ID NO: 270338 - DNA, 14 bp, Homo sapiens
tgaatgtcagtgtg

SEQ ID NO: 270339 - DNA, 15 bp, Homo sapiens
tgaatgtcagtgtga

SEQ ID NO: 270340 - DNA, 18 bp, Homo sapiens
tgaatgtcattatttgat

SEQ ID NO: 270341 - DNA, 17 bp, Homo sapiens
tgaatgtccccattcta

SEQ ID NO: 270342 - DNA, 18 bp, Homo sapiens
tgaatgtccccattctat

SEQ ID NO: 270343 - DNA, 18 bp, Homo sapiens
tgaatgtctaaaattgtt

SEQ ID NO: 270344 - DNA, 17 bp, Homo sapiens
tgaatgtggttacttcc

SEQ ID NO: 270345 - DNA, 15 bp, Homo sapiens
tgaatgttatttgtt

SEQ ID NO: 270346 - DNA, 20 bp, Homo sapiens
tgaatgttctgacattaaca

SEQ ID NO: 270347 - DNA, 23 bp, Homo sapiens
tgaatgttctgacattaacagtt

SEQ ID NO: 270348 - DNA, 11 bp, Homo sapiens
tgaattaaatt

SEQ ID NO: 270349 - DNA, 22 bp, Homo sapiens
tgaattaaccagctgatttttc

SEQ ID NO: 270350 - DNA, 14 bp, Homo sapiens
tgaattacagtgaa

SEQ ID NO: 270351 - DNA, 15 bp, Homo sapiens
tgaattacagtgaaa

SEQ ID NO: 270352 - DNA, 12 bp, Homo sapiens
tgaattagccaa

SEQ ID NO: 270353 - DNA, 17 bp, Homo sapiens
tgaattcaagaaaggaa

SEQ ID NO: 270354 - DNA, 12 bp, Homo sapiens
tgaattcagatt

SEQ ID NO: 270355 - DNA, 19 bp, Homo sapiens
tgaattcataaaaataacc

SEQ ID NO: 270356 - DNA, 19 bp, Homo sapiens
tgaattctgcaatgttttc

SEQ ID NO: 270357 - DNA, 20 bp, Homo sapiens
tgaattctgtgaagaatgaa

SEQ ID NO: 270358 - DNA, 18 bp, Homo sapiens
tgaattgaagtcatcata

SEQ ID NO: 270359 - DNA, 19 bp, Homo sapiens
tgaattgaagtcatcataa

SEQ ID NO: 270360 - DNA, 21 bp, Homo sapiens
tgaattgaagtcatcataaaa

SEQ ID NO: 270361 - DNA, 13 bp, Homo sapiens
tgaattgaatgct

SEQ ID NO: 270362 - DNA, 17 bp, Homo sapiens
tgaattgataataaact

SEQ ID NO: 270363 - DNA, 13 bp, Homo sapiens
tgaattgattttg

SEQ ID NO: 270364 - DNA, 15 bp, Homo sapiens
tgaattgtaaaagca

SEQ ID NO: 270365 - DNA, 13 bp, Homo sapiens
tgaatttaaataa

SEQ ID NO: 270366 - DNA, 14 bp, Homo sapiens
tgaatttaaataaa

SEQ ID NO: 270367 - DNA, 14 bp, Homo sapiens
tgaatttaaatata

SEQ ID NO: 270368 - DNA, 19 bp, Homo sapiens
tgaatttaaatataattct

SEQ ID NO: 270369 - DNA, 20 bp, Homo sapiens
tgaatttaaatataattctg

SEQ ID NO: 270370 - DNA, 23 bp, Homo sapiens
tgaatttctagacagtattgcca

SEQ ID NO: 270371 - DNA, 11 bp, Homo sapiens
tgaatttctgc

SEQ ID NO: 270372 - DNA, 20 bp, Homo sapiens
tgaatttcttcactgttgaa

SEQ ID NO: 270373 - DNA, 21 bp, Homo sapiens
tgaatttcttcactgttgaaa

SEQ ID NO: 270374 - DNA, 13 bp, Homo sapiens
tgaatttgaatga

SEQ ID NO: 270375 - DNA, 12 bp, Homo sapiens
tgaatttgctaa

SEQ ID NO: 270376 - DNA, 15 bp, Homo sapiens
tgaattttaaaatgt

SEQ ID NO: 270377 - DNA, 23 bp, Homo sapiens
tgaattttaaaatgtagaagaaa

SEQ ID NO: 270378 - DNA, 15 bp, Homo sapiens
tgaattttttttaac

SEQ ID NO: 270379 - DNA, 16 bp, Homo sapiens
tgaattttttttaaca

SEQ ID NO: 270380 - DNA, 17 bp, Homo sapiens
tgaattttttttaacat

SEQ ID NO: 270381 - DNA, 18 bp, Homo sapiens
tgaattttttttaacatt

SEQ ID NO: 270382 - DNA, 20 bp, Homo sapiens
tgaattttttttaacattcc

SEQ ID NO: 270383 - DNA, 19 bp, Homo sapiens
tgacaaaaagtttccatat

SEQ ID NO: 270384 - DNA, 20 bp, Homo sapiens
tgacaaaatatataatggtt

SEQ ID NO: 270385 - DNA, 23 bp, Homo sapiens
tgacaaaatatataatggtttac

SEQ ID NO: 270386 - DNA, 18 bp, Homo sapiens
tgacaaaggatgaagaac

SEQ ID NO: 270387 - DNA, 23 bp, Homo sapiens
tgacaacaaaagggaaaaaagca

SEQ ID NO: 270388 - DNA, 16 bp, Homo sapiens
tgacaaccaccgctcc

SEQ ID NO: 270389 - DNA, 17 bp, Homo sapiens
tgacaaccactggtctg

SEQ ID NO: 270390 - DNA, 21 bp, Homo sapiens
tgacaacctgtgtgagagaat

SEQ ID NO: 270391 - DNA, 14 bp, Homo sapiens
tgacaacctttgtg

SEQ ID NO: 270392 - DNA, 22 bp, Homo sapiens
tgacaacttctaattgccatgt

SEQ ID NO: 270393 - DNA, 23 bp, Homo sapiens
tgacaagaatggaatagaaatgt

SEQ ID NO: 270394 - DNA, 22 bp, Homo sapiens
tgacaagctcctggtcttgaga

SEQ ID NO: 270395 - DNA, 14 bp, Homo sapiens
tgacaaggccccag

SEQ ID NO: 270396 - DNA, 17 bp, Homo sapiens
tgacaaggccccagaga

SEQ ID NO: 270397 - DNA, 15 bp, Homo sapiens
tgacaagtcacaccc

SEQ ID NO: 270398 - DNA, 17 bp, Homo sapiens
tgacaagtttaaaggct

SEQ ID NO: 270399 - DNA, 16 bp, Homo sapiens
tgacaataaataatat

SEQ ID NO: 270400 - DNA, 22 bp, Homo sapiens
tgacaatgcgtggcacatctaa

SEQ ID NO: 270401 - DNA, 16 bp, Homo sapiens
tgacaatggcagctag

SEQ ID NO: 270402 - DNA, 23 bp, Homo sapiens
tgacaattcctagataaaaagat

SEQ ID NO: 270403 - DNA, 17 bp, Homo sapiens
tgacacaaaaaaagttg

SEQ ID NO: 270404 - DNA, 22 bp, Homo sapiens
tgacacagcagcttcaccagag

SEQ ID NO: 270405 - DNA, 23 bp, Homo sapiens
tgacacagtcttggctcactgca

SEQ ID NO: 270406 - DNA, 21 bp, Homo sapiens
tgacacataaaagtaattaat

SEQ ID NO: 270407 - DNA, 15 bp, Homo sapiens
tgacacataaatctg

SEQ ID NO: 270408 - DNA, 12 bp, Homo sapiens
agccacctctcc

SEQ ID NO: 270409 - DNA, 22 bp, Homo sapiens
agccacctctccctcaacaagg

SEQ ID NO: 270410 - DNA, 12 bp, Homo sapiens
agccacctgggc

SEQ ID NO: 270411 - DNA, 13 bp, Homo sapiens
agccacctgtccc

SEQ ID NO: 270412 - DNA, 16 bp, Homo sapiens
agccacctgtcccacc

SEQ ID NO: 270413 - DNA, 13 bp, Homo sapiens
agccaccttcctg

SEQ ID NO: 270414 - DNA, 20 bp, Homo sapiens
agccaccttcctgactggga

SEQ ID NO: 270415 - DNA, 23 bp, Homo sapiens
agccacgaggtggtagctctgag

SEQ ID NO: 270416 - DNA, 21 bp, Homo sapiens
agccacggaccgcatcctcca

SEQ ID NO: 270417 - DNA, 15 bp, Homo sapiens
agccacgtgaatggc

SEQ ID NO: 270418 - DNA, 20 bp, Homo sapiens
agccacgtgctggagagtag

SEQ ID NO: 270419 - DNA, 22 bp, Homo sapiens
agccactagactcttcactgtt

SEQ ID NO: 270420 - DNA, 17 bp, Homo sapiens
agccactcctgtcccgc

SEQ ID NO: 270421 - DNA, 19 bp, Homo sapiens
agccacttatttccatgga

SEQ ID NO: 270422 - DNA, 13 bp, Homo sapiens
agccacttctccc

SEQ ID NO: 270423 - DNA, 18 bp, Homo sapiens
agccacttctccccagaa

SEQ ID NO: 270424 - DNA, 17 bp, Homo sapiens
agccagaaactgaactg

SEQ ID NO: 270425 - DNA, 23 bp, Homo sapiens
agccagaattcactaggaggtca

SEQ ID NO: 270426 - DNA, 15 bp, Homo sapiens
agccagagaggagca

SEQ ID NO: 270427 - DNA, 17 bp, Homo sapiens
agccagagaggagcacc

SEQ ID NO: 270428 - DNA, 19 bp, Homo sapiens
agccagagcccttcactgc

SEQ ID NO: 270429 - DNA, 17 bp, Homo sapiens
agccagatgacagggag

SEQ ID NO: 270430 - DNA, 18 bp, Homo sapiens
agccagatgacagggagc

SEQ ID NO: 270431 - DNA, 20 bp, Homo sapiens
agccagatgacagggagctg

SEQ ID NO: 270432 - DNA, 22 bp, Homo sapiens
agccagcaatgatgtccagaag

SEQ ID NO: 270433 - DNA, 23 bp, Homo sapiens
agccagcagctgaagtctctttt

SEQ ID NO: 270434 - DNA, 24 bp, Homo sapiens
agccagcagggcgggccaggagaa

SEQ ID NO: 270435 - DNA, 22 bp, Homo sapiens
agccagcaggttctctcctgtg

SEQ ID NO: 270436 - DNA, 12 bp, Homo sapiens
agccagccaccc

SEQ ID NO: 270437 - DNA, 23 bp, Homo sapiens
agccagccaccctaactgagctg

SEQ ID NO: 270438 - DNA, 11 bp, Homo sapiens
agccagcccag

SEQ ID NO: 270439 - DNA, 14 bp, Homo sapiens
agccagcccagctc

SEQ ID NO: 270440 - DNA, 18 bp, Homo sapiens
agccagcccttcccaggc

SEQ ID NO: 270441 - DNA, 19 bp, Homo sapiens
agccagcccttccctggcc

SEQ ID NO: 270442 - DNA, 21 bp, Homo sapiens
agccagcccttccctggcccc

SEQ ID NO: 270443 - DNA, 15 bp, Homo sapiens
agccagcctgggact

SEQ ID NO: 270444 - DNA, 23 bp, Homo sapiens
agccagcctgggactcccagtga

SEQ ID NO: 270445 - DNA, 11 bp, Homo sapiens
agccagccttg

SEQ ID NO: 270446 - DNA, 12 bp, Homo sapiens
agccagccttgg

SEQ ID NO: 270447 - DNA, 14 bp, Homo sapiens
agccagctgcccac

SEQ ID NO: 270448 - DNA, 19 bp, Homo sapiens
agccaggagcctcctgacc

SEQ ID NO: 270449 - DNA, 16 bp, Homo sapiens
agccaggagtctgtgc

SEQ ID NO: 270450 - DNA, 17 bp, Homo sapiens
agccaggagtctgtgct

SEQ ID NO: 270451 - DNA, 11 bp, Homo sapiens
agccaggcctc

SEQ ID NO: 270452 - DNA, 18 bp, Homo sapiens
agccaggcctcccgcatg

SEQ ID NO: 270453 - DNA, 22 bp, Homo sapiens
agccaggcctgggtctgtgtct

SEQ ID NO: 270454 - DNA, 21 bp, Homo sapiens
agccaggctgccaaggccaga

SEQ ID NO: 270455 - DNA, 23 bp, Homo sapiens
agccagggatggggccacagcca

SEQ ID NO: 270456 - DNA, 10 bp, Homo sapiens
agccagggct

SEQ ID NO: 270457 - DNA, 11 bp, Homo sapiens
agccagggctg

SEQ ID NO: 270458 - DNA, 16 bp, Homo sapiens
agccagggtagagcaa

SEQ ID NO: 270459 - DNA, 22 bp, Homo sapiens
agccaggtgtcctgactgtcct

SEQ ID NO: 270460 - DNA, 19 bp, Homo sapiens
agccagtaaggcagctctg

SEQ ID NO: 270461 - DNA, 18 bp, Homo sapiens
agccagtcttgcctaggc

SEQ ID NO: 270462 - DNA, 19 bp, Homo sapiens
agccagtcttgcctaggcc

SEQ ID NO: 270463 - DNA, 18 bp, Homo sapiens
agccagtgaaggagccac

SEQ ID NO: 270464 - DNA, 17 bp, Homo sapiens
agccagtgactccagga

SEQ ID NO: 270465 - DNA, 13 bp, Homo sapiens
agccagtgacttt

SEQ ID NO: 270466 - DNA, 15 bp, Homo sapiens
agccagtgacttttt

SEQ ID NO: 270467 - DNA, 11 bp, Homo sapiens
agccagtggcc

SEQ ID NO: 270468 - DNA, 16 bp, Homo sapiens
agccagttttcatttt

SEQ ID NO: 270469 - DNA, 20 bp, Homo sapiens
agccatagagatatttaaaa

SEQ ID NO: 270470 - DNA, 21 bp, Homo sapiens
agccatagcttgattgctcag

SEQ ID NO: 270471 - DNA, 14 bp, Homo sapiens
agccatattccagc

SEQ ID NO: 270472 - DNA, 19 bp, Homo sapiens
agccatcacttctccccgc

SEQ ID NO: 270473 - DNA, 23 bp, Homo sapiens
agccatctaatgcttgtttatga

SEQ ID NO: 270474 - DNA, 14 bp, Homo sapiens
agccatctactgga

SEQ ID NO: 270475 - DNA, 21 bp, Homo sapiens
agccatcttcccgcctcagcc

SEQ ID NO: 270476 - DNA, 16 bp, Homo sapiens
agccatgcctcatgcc

SEQ ID NO: 270477 - DNA, 17 bp, Homo sapiens
agccatgcctcatgcca

SEQ ID NO: 270478 - DNA, 12 bp, Homo sapiens
agccatgctctt

SEQ ID NO: 270479 - DNA, 19 bp, Homo sapiens
agccatggctcaggcaagc

SEQ ID NO: 270480 - DNA, 18 bp, Homo sapiens
agccatgggccctctgag

SEQ ID NO: 270481 - DNA, 15 bp, Homo sapiens
agccatgggcctggg

SEQ ID NO: 270482 - DNA, 17 bp, Homo sapiens
agccatgggcctgggcc

SEQ ID NO: 270483 - DNA, 19 bp, Homo sapiens
agccatgggcctgggcctg

SEQ ID NO: 270484 - DNA, 16 bp, Homo sapiens
agccatgtccaagttc

SEQ ID NO: 270485 - DNA, 23 bp, Homo sapiens
agccatgtccaagttcttcacct

SEQ ID NO: 270486 - DNA, 14 bp, Homo sapiens
agccattcatctgg

SEQ ID NO: 270487 - DNA, 21 bp, Homo sapiens
agccattcatctgggctggca

SEQ ID NO: 270488 - DNA, 16 bp, Homo sapiens
agccattcctgttctc

SEQ ID NO: 270489 - DNA, 17 bp, Homo sapiens
agccattcctgttctct

SEQ ID NO: 270490 - DNA, 19 bp, Homo sapiens
agccattgtcgtttcattc

SEQ ID NO: 270491 - DNA, 20 bp, Homo sapiens
agcccaaagctggagccaat

SEQ ID NO: 270492 - DNA, 13 bp, Homo sapiens
agcccaaccagga

SEQ ID NO: 270493 - DNA, 11 bp, Homo sapiens
agcccaataaa

SEQ ID NO: 270494 - DNA, 16 bp, Homo sapiens
agcccaatcactgcct

SEQ ID NO: 270495 - DNA, 16 bp, Homo sapiens
agcccacaaagcctta

SEQ ID NO: 270496 - DNA, 17 bp, Homo sapiens
agcccacaaagccttat

SEQ ID NO: 270497 - DNA, 17 bp, Homo sapiens
agcccacacttgagagg

SEQ ID NO: 270498 - DNA, 16 bp, Homo sapiens
agcccacagtgctcag

SEQ ID NO: 270499 - DNA, 19 bp, Homo sapiens
agcccacccgccccagaga

SEQ ID NO: 270500 - DNA, 14 bp, Homo sapiens
agcccaccctgctg

SEQ ID NO: 270501 - DNA, 20 bp, Homo sapiens
agcccacctgaaagcctgtc

SEQ ID NO: 270502 - DNA, 20 bp, Homo sapiens
agcccacctgggctgggcgc

SEQ ID NO: 270503 - DNA, 22 bp, Homo sapiens
agcccacgcccgactagcaggc

SEQ ID NO: 270504 - DNA, 23 bp, Homo sapiens
agcccacgcccgactagcaggca

SEQ ID NO: 270505 - DNA, 20 bp, Homo sapiens
agcccacggctaagaggctg

SEQ ID NO: 270506 - DNA, 20 bp, Homo sapiens
agcccagaacgggcctcccc

SEQ ID NO: 270507 - DNA, 21 bp, Homo sapiens
agcccagaagctcaaggctgc

SEQ ID NO: 270508 - DNA, 23 bp, Homo sapiens
agcccagacccccagtgtatttt

SEQ ID NO: 270509 - DNA, 11 bp, Homo sapiens
agcccagagag

SEQ ID NO: 270510 - DNA, 14 bp, Homo sapiens
agcccagagagacc

SEQ ID NO: 270511 - DNA, 20 bp, Homo sapiens
agcccagagagaccctgcca

SEQ ID NO: 270512 - DNA, 11 bp, Homo sapiens
agcccagccac

SEQ ID NO: 270513 - DNA, 15 bp, Homo sapiens
agcccagccacggac

SEQ ID NO: 270514 - DNA, 14 bp, Homo sapiens
agcccagcccagct

SEQ ID NO: 270515 - DNA, 17 bp, Homo sapiens
agcccagcccagctgct

SEQ ID NO: 270516 - DNA, 18 bp, Homo sapiens
agcccagcccagctgctc

SEQ ID NO: 270517 - DNA, 15 bp, Homo sapiens
agcccagccctgttc

SEQ ID NO: 270518 - DNA, 17 bp, Homo sapiens
agcccagccctgttctg

SEQ ID NO: 270519 - DNA, 15 bp, Homo sapiens
agcccagctacattc

SEQ ID NO: 270520 - DNA, 18 bp, Homo sapiens
agcccagctccactcagg

SEQ ID NO: 270521 - DNA, 19 bp, Homo sapiens
agcccagctccactcaggg

SEQ ID NO: 270522 - DNA, 17 bp, Homo sapiens
agcccagcttcctggtg

SEQ ID NO: 270523 - DNA, 16 bp, Homo sapiens
agcccaggagctgagt

SEQ ID NO: 270524 - DNA, 21 bp, Homo sapiens
agcccaggagctgagtcacct

SEQ ID NO: 270525 - DNA, 12 bp, Homo sapiens
agcccaggagga

SEQ ID NO: 270526 - DNA, 17 bp, Homo sapiens
agcccaggaggactgcc

SEQ ID NO: 270527 - DNA, 13 bp, Homo sapiens
agcccaggcctgc

SEQ ID NO: 270528 - DNA, 14 bp, Homo sapiens
agcccaggcctggc

SEQ ID NO: 270529 - DNA, 17 bp, Homo sapiens
agcccaggcctggcctc

SEQ ID NO: 270530 - DNA, 18 bp, Homo sapiens
agcccaggcctggcctcg

SEQ ID NO: 270531 - DNA, 16 bp, Homo sapiens
agcccagggttccccc

SEQ ID NO: 270532 - DNA, 19 bp, Homo sapiens
agcccagggttcccccagc

SEQ ID NO: 270533 - DNA, 21 bp, Homo sapiens
agcccagggttcccccagccc

SEQ ID NO: 270534 - DNA, 15 bp, Homo sapiens
agcccaggtcccagt

SEQ ID NO: 270535 - DNA, 21 bp, Homo sapiens
agcccagtccctggagctgtc

SEQ ID NO: 270536 - DNA, 22 bp, Homo sapiens
agcccatgcccacctgcccatc

SEQ ID NO: 270537 - DNA, 17 bp, Homo sapiens
agccccaatatggtggc

SEQ ID NO: 270538 - DNA, 19 bp, Homo sapiens
tgagagagttgctcctcag

SEQ ID NO: 270539 - DNA, 15 bp, Homo sapiens
tgagagcacaaagat

SEQ ID NO: 270540 - DNA, 16 bp, Homo sapiens
tgagagcacaaagata

SEQ ID NO: 270541 - DNA, 23 bp, Homo sapiens
tgagagcccattcccaccattct

SEQ ID NO: 270542 - DNA, 12 bp, Homo sapiens
tgagagccccag

SEQ ID NO: 270543 - DNA, 15 bp, Homo sapiens
tgagagccccagctg

SEQ ID NO: 270544 - DNA, 19 bp, Homo sapiens
tgagagccccagctgacat

SEQ ID NO: 270545 - DNA, 12 bp, Homo sapiens
tgagagccccca

SEQ ID NO: 270546 - DNA, 16 bp, Homo sapiens
tgagagcccccacctt

SEQ ID NO: 270547 - DNA, 16 bp, Homo sapiens
tgagagcgctggcctc

SEQ ID NO: 270548 - DNA, 23 bp, Homo sapiens
tgagagctgctgagggaccttgg

SEQ ID NO: 270549 - DNA, 17 bp, Homo sapiens
tgagaggaggggtaaat

SEQ ID NO: 270550 - DNA, 18 bp, Homo sapiens
tgagaggatgaacatctt

SEQ ID NO: 270551 - DNA, 23 bp, Homo sapiens
tgagaggatgaatgtatgtgcac

SEQ ID NO: 270552 - DNA, 22 bp, Homo sapiens
tgagagggcaatctttgccttt

SEQ ID NO: 270553 - DNA, 17 bp, Homo sapiens
tgagagggctgtggctg

SEQ ID NO: 270554 - DNA, 21 bp, Homo sapiens
tgagaggtgggggatgctgag

SEQ ID NO: 270555 - DNA, 21 bp, Homo sapiens
tgagagtactcacttttcact

SEQ ID NO: 270556 - DNA, 23 bp, Homo sapiens
tgagagtatttaggcagattgaa

SEQ ID NO: 270557 - DNA, 16 bp, Homo sapiens
tgagagtgtctctgat

SEQ ID NO: 270558 - DNA, 16 bp, Homo sapiens
tgagataaatatcatt

SEQ ID NO: 270559 - DNA, 15 bp, Homo sapiens
tgagataacttcctt

SEQ ID NO: 270560 - DNA, 18 bp, Homo sapiens
tgagatacccagagagaa

SEQ ID NO: 270561 - DNA, 23 bp, Homo sapiens
tgagatacccagagagaaaaaga

SEQ ID NO: 270562 - DNA, 18 bp, Homo sapiens
tgagatagaagatgtttg

SEQ ID NO: 270563 - DNA, 23 bp, Homo sapiens
tgagatagtagcatacatttata

SEQ ID NO: 270564 - DNA, 19 bp, Homo sapiens
tgagatatatctttatact

SEQ ID NO: 270565 - DNA, 19 bp, Homo sapiens
tgagatcagcattcaaaat

SEQ ID NO: 270566 - DNA, 20 bp, Homo sapiens
tgagatccttcacaggcagt

SEQ ID NO: 270567 - DNA, 21 bp, Homo sapiens
tgagatctaagcctttccata

SEQ ID NO: 270568 - DNA, 15 bp, Homo sapiens
tgagatgagccccac

SEQ ID NO: 270569 - DNA, 16 bp, Homo sapiens
tgagatgcaccaagta

SEQ ID NO: 270570 - DNA, 21 bp, Homo sapiens
tgagatggaacccttttggcc

SEQ ID NO: 270571 - DNA, 15 bp, Homo sapiens
tgagatggccatgct

SEQ ID NO: 270572 - DNA, 14 bp, Homo sapiens
tgagatgggaaggg

SEQ ID NO: 270573 - DNA, 17 bp, Homo sapiens
tgagatgtatgaaggct

SEQ ID NO: 270574 - DNA, 12 bp, Homo sapiens
tgagatgtggac

SEQ ID NO: 270575 - DNA, 19 bp, Homo sapiens
tgagatgtttagtagctga

SEQ ID NO: 270576 - DNA, 21 bp, Homo sapiens
tgagatgtttagtagctgata

SEQ ID NO: 270577 - DNA, 15 bp, Homo sapiens
tgagattacagagga

SEQ ID NO: 270578 - DNA, 19 bp, Homo sapiens
tgagattacagaggaagtt

SEQ ID NO: 270579 - DNA, 18 bp, Homo sapiens
tgagattactttgtcccg

SEQ ID NO: 270580 - DNA, 13 bp, Homo sapiens
tgagattctggga

SEQ ID NO: 270581 - DNA, 18 bp, Homo sapiens
tgagattctgggaaaggt

SEQ ID NO: 270582 - DNA, 21 bp, Homo sapiens
tgagattctgggaaaggtgct

SEQ ID NO: 270583 - DNA, 20 bp, Homo sapiens
tgagattggaaaaaattaga

SEQ ID NO: 270584 - DNA, 17 bp, Homo sapiens
tgagattggtcattaaa

SEQ ID NO: 270585 - DNA, 21 bp, Homo sapiens
tgagattggtcattaaatact

SEQ ID NO: 270586 - DNA, 12 bp, Homo sapiens
tgagatttgtat

SEQ ID NO: 270587 - DNA, 20 bp, Homo sapiens
tgagatttgtatttatatta

SEQ ID NO: 270588 - DNA, 18 bp, Homo sapiens
tgagcaaacctgccccat

SEQ ID NO: 270589 - DNA, 15 bp, Homo sapiens
tgagcaaatgtggct

SEQ ID NO: 270590 - DNA, 16 bp, Homo sapiens
tgagcaaatgtggctc

SEQ ID NO: 270591 - DNA, 22 bp, Homo sapiens
tgagcaaggacattgccccaag

SEQ ID NO: 270592 - DNA, 13 bp, Homo sapiens
tgagcaaggcaag

SEQ ID NO: 270593 - DNA, 18 bp, Homo sapiens
tgagcacaggcaacatta

SEQ ID NO: 270594 - DNA, 19 bp, Homo sapiens
tgagcaccgtcatggctta

SEQ ID NO: 270595 - DNA, 20 bp, Homo sapiens
tgagcacgggcaaagaaaac

SEQ ID NO: 270596 - DNA, 19 bp, Homo sapiens
tgagcaggaaggcctgggt

SEQ ID NO: 270597 - DNA, 14 bp, Homo sapiens
tgagcagggccctc

SEQ ID NO: 270598 - DNA, 21 bp, Homo sapiens
tgagcagtaaatgtatattga

SEQ ID NO: 270599 - DNA, 12 bp, Homo sapiens
tgagcagtccag

SEQ ID NO: 270600 - DNA, 14 bp, Homo sapiens
tgagcagtccagag

SEQ ID NO: 270601 - DNA, 21 bp, Homo sapiens
tgagcagtctacttctgtgtc

SEQ ID NO: 270602 - DNA, 13 bp, Homo sapiens
tgagcagtggctg

SEQ ID NO: 270603 - DNA, 14 bp, Homo sapiens
tgagcagtggctgg

SEQ ID NO: 270604 - DNA, 18 bp, Homo sapiens
tgagcagtggctggtcca

SEQ ID NO: 270605 - DNA, 15 bp, Homo sapiens
tgagcagtgtgtctc

SEQ ID NO: 270606 - DNA, 15 bp, Homo sapiens
tgagcatgttactga

SEQ ID NO: 270607 - DNA, 23 bp, Homo sapiens
tgagccaaagagaaaagattaaa

SEQ ID NO: 270608 - DNA, 15 bp, Homo sapiens
tgagccacagtgggg

SEQ ID NO: 270609 - DNA, 23 bp, Homo sapiens
tgagccacagtggggcccatggc

SEQ ID NO: 270610 - DNA, 20 bp, Homo sapiens
tgagccagacaaatggagga

SEQ ID NO: 270611 - DNA, 17 bp, Homo sapiens
tgagccagtcccagggg

SEQ ID NO: 270612 - DNA, 16 bp, Homo sapiens
tgagcccacctcgtcc

SEQ ID NO: 270613 - DNA, 14 bp, Homo sapiens
tgagcccaggaagt

SEQ ID NO: 270614 - DNA, 13 bp, Homo sapiens
tgagcccaggccg

SEQ ID NO: 270615 - DNA, 20 bp, Homo sapiens
tgagccccacctctccaagt

SEQ ID NO: 270616 - DNA, 18 bp, Homo sapiens
tgagccccacgtggagct

SEQ ID NO: 270617 - DNA, 16 bp, Homo sapiens
tcttagtttttaaaaa

SEQ ID NO: 270618 - DNA, 14 bp, Homo sapiens
tcttatacacattg

SEQ ID NO: 270619 - DNA, 20 bp, Homo sapiens
tcttatgccatttgtttatt

SEQ ID NO: 270620 - DNA, 19 bp, Homo sapiens
tcttattactattattgtt

SEQ ID NO: 270621 - DNA, 24 bp, Homo sapiens
tcttattcccaaactacagaataa

SEQ ID NO: 270622 - DNA, 18 bp, Homo sapiens
tcttattctttacaaaat

SEQ ID NO: 270623 - DNA, 21 bp, Homo sapiens
tcttcaaaaggtaaatacaat

SEQ ID NO: 270624 - DNA, 18 bp, Homo sapiens
tcttcaaactttcacttt

SEQ ID NO: 270625 - DNA, 13 bp, Homo sapiens
tcttcaaatcctt

SEQ ID NO: 270626 - DNA, 19 bp, Homo sapiens
tcttcaacatcaatgttca

SEQ ID NO: 270627 - DNA, 20 bp, Homo sapiens
tcttcaacatcaatgttcat

SEQ ID NO: 270628 - DNA, 21 bp, Homo sapiens
tcttcaacatcaatgttcatt

SEQ ID NO: 270629 - DNA, 19 bp, Homo sapiens
tcttcaactgaccagcctc

SEQ ID NO: 270630 - DNA, 22 bp, Homo sapiens
tcttcaagctgtcccctctgtc

SEQ ID NO: 270631 - DNA, 12 bp, Homo sapiens
tcttcaaggcca

SEQ ID NO: 270632 - DNA, 13 bp, Homo sapiens
tcttcaagggctg

SEQ ID NO: 270633 - DNA, 14 bp, Homo sapiens
tcttcaatctctgg

SEQ ID NO: 270634 - DNA, 23 bp, Homo sapiens
tcttcaatggcaccttcattctc

SEQ ID NO: 270635 - DNA, 18 bp, Homo sapiens
tcttcaatttgtataaaa

SEQ ID NO: 270636 - DNA, 20 bp, Homo sapiens
tcttcaatttgtataaaatg

SEQ ID NO: 270637 - DNA, 13 bp, Homo sapiens
tcttcaccaggaa

SEQ ID NO: 270638 - DNA, 14 bp, Homo sapiens
tcttcaccaggaag

SEQ ID NO: 270639 - DNA, 19 bp, Homo sapiens
tcttcacccagctaatctg

SEQ ID NO: 270640 - DNA, 15 bp, Homo sapiens
tcttcaccccggcag

SEQ ID NO: 270641 - DNA, 18 bp, Homo sapiens
tcttcaccccggcaggcc

SEQ ID NO: 270642 - DNA, 20 bp, Homo sapiens
tcttcaccccggcaggccct

SEQ ID NO: 270643 - DNA, 21 bp, Homo sapiens
tcttcaccccggcaggccctg

SEQ ID NO: 270644 - DNA, 22 bp, Homo sapiens
tcttcaccccggcaggccctgc

SEQ ID NO: 270645 - DNA, 17 bp, Homo sapiens
tcttcacctctatccaa

SEQ ID NO: 270646 - DNA, 13 bp, Homo sapiens
tcttcaccttggt

SEQ ID NO: 270647 - DNA, 19 bp, Homo sapiens
tcttcaccttggtttatga

SEQ ID NO: 270648 - DNA, 19 bp, Homo sapiens
tcttcactattcagaactt

SEQ ID NO: 270649 - DNA, 18 bp, Homo sapiens
tcttcactctctgaagat

SEQ ID NO: 270650 - DNA, 21 bp, Homo sapiens
tcttcactgaatatcatatgt

SEQ ID NO: 270651 - DNA, 18 bp, Homo sapiens
tcttcagatcctgctgcc

SEQ ID NO: 270652 - DNA, 18 bp, Homo sapiens
tcttcaggcctccctctc

SEQ ID NO: 270653 - DNA, 18 bp, Homo sapiens
tcttcaggggtcacctcc

SEQ ID NO: 270654 - DNA, 20 bp, Homo sapiens
tcttcaggggtcacctcctc

SEQ ID NO: 270655 - DNA, 22 bp, Homo sapiens
tcttcaggggtcacctcctcca

SEQ ID NO: 270656 - DNA, 12 bp, Homo sapiens
tcttcagtttta

SEQ ID NO: 270657 - DNA, 19 bp, Homo sapiens
tcttcagttttatctttaa

SEQ ID NO: 270658 - DNA, 13 bp, Homo sapiens
tcttcatactttt

SEQ ID NO: 270659 - DNA, 15 bp, Homo sapiens
tcttcatccatagac

SEQ ID NO: 270660 - DNA, 15 bp, Homo sapiens
tcttcatccttagca

SEQ ID NO: 270661 - DNA, 21 bp, Homo sapiens
tcttcatccttagcaacagcc

SEQ ID NO: 270662 - DNA, 20 bp, Homo sapiens
tcttcattcccactgcactt

SEQ ID NO: 270663 - DNA, 15 bp, Homo sapiens
tcttcatttcattgt

SEQ ID NO: 270664 - DNA, 17 bp, Homo sapiens
tcttcatttcattgtat

SEQ ID NO: 270665 - DNA, 21 bp, Homo sapiens
tcttcatttcattgtatgatg

SEQ ID NO: 270666 - DNA, 14 bp, Homo sapiens
tcttccaaagcaca

SEQ ID NO: 270667 - DNA, 19 bp, Homo sapiens
tcttccacagcaaatgaga

SEQ ID NO: 270668 - DNA, 13 bp, Homo sapiens
tcttccagcccag

SEQ ID NO: 270669 - DNA, 13 bp, Homo sapiens
tcttccaggaagc

SEQ ID NO: 270670 - DNA, 22 bp, Homo sapiens
tcttccaggaagcacaggccag

SEQ ID NO: 270671 - DNA, 23 bp, Homo sapiens
tcttccaggaagcacaggccagg

SEQ ID NO: 270672 - DNA, 13 bp, Homo sapiens
tcttccatcagca

SEQ ID NO: 270673 - DNA, 18 bp, Homo sapiens
tcttccatcatggattca

SEQ ID NO: 270674 - DNA, 14 bp, Homo sapiens
tcttcccaaggcca

SEQ ID NO: 270675 - DNA, 20 bp, Homo sapiens
tcttcccaaggccagtctga

SEQ ID NO: 270676 - DNA, 15 bp, Homo sapiens
tcttcccatgactgc

SEQ ID NO: 270677 - DNA, 13 bp, Homo sapiens
tcttcccatttgt

SEQ ID NO: 270678 - DNA, 20 bp, Homo sapiens
tcttccccaacgaaaagcac

SEQ ID NO: 270679 - DNA, 15 bp, Homo sapiens
tcttccccaccttcc

SEQ ID NO: 270680 - DNA, 21 bp, Homo sapiens
tcttccccagggttctgtatt

SEQ ID NO: 270681 - DNA, 18 bp, Homo sapiens
tcttcccccatgtgcctg

SEQ ID NO: 270682 - DNA, 23 bp, Homo sapiens
tcttcccccttcccctgcgccct

SEQ ID NO: 270683 - DNA, 15 bp, Homo sapiens
tcttcccgcctcagc

SEQ ID NO: 270684 - DNA, 14 bp, Homo sapiens
tcttccctacctca

SEQ ID NO: 270685 - DNA, 17 bp, Homo sapiens
tcttccctctcgctccc

SEQ ID NO: 270686 - DNA, 13 bp, Homo sapiens
tcttccctgcttc

SEQ ID NO: 270687 - DNA, 20 bp, Homo sapiens
tcttcccttagcctctccca

SEQ ID NO: 270688 - DNA, 21 bp, Homo sapiens
tcttccggagatgtagcaaaa

SEQ ID NO: 270689 - DNA, 19 bp, Homo sapiens
tcttcctcaagtcttgaca

SEQ ID NO: 270690 - DNA, 16 bp, Homo sapiens
tcttcctccaaagcct

SEQ ID NO: 270691 - DNA, 22 bp, Homo sapiens
tcttcctccaaagcctgggcag

SEQ ID NO: 270692 - DNA, 18 bp, Homo sapiens
tcttcctccagtctgttc

SEQ ID NO: 270693 - DNA, 13 bp, Homo sapiens
tcttcctctctct

SEQ ID NO: 270694 - DNA, 12 bp, Homo sapiens
tcttcctctgct

SEQ ID NO: 270695 - DNA, 12 bp, Homo sapiens
tcttcctctgga

SEQ ID NO: 270696 - DNA, 15 bp, Homo sapiens
tcttccttaaactcc

SEQ ID NO: 270697 - DNA, 18 bp, Homo sapiens
tcttccttggagggggga

SEQ ID NO: 270698 - DNA, 13 bp, Homo sapiens
tcttcgctgtgat

SEQ ID NO: 270699 - DNA, 22 bp, Homo sapiens
tcttcgctgtgatgcatgagct

SEQ ID NO: 270700 - DNA, 15 bp, Homo sapiens
tcttcggaggtggca

SEQ ID NO: 270701 - DNA, 22 bp, Homo sapiens
tcttcggccaatttatgcagag

SEQ ID NO: 270702 - DNA, 13 bp, Homo sapiens
tcttcgggaagag

SEQ ID NO: 270703 - DNA, 22 bp, Homo sapiens
tcttcgggaagagaggagttca

SEQ ID NO: 270704 - DNA, 14 bp, Homo sapiens
tcttcgtacagttc

SEQ ID NO: 270705 - DNA, 15 bp, Homo sapiens
tcttcgtacagttct

SEQ ID NO: 270706 - DNA, 13 bp, Homo sapiens
tcttcgtatatac

SEQ ID NO: 270707 - DNA, 24 bp, Homo sapiens
tcttctaatcataacatagttgaa

SEQ ID NO: 270708 - DNA, 20 bp, Homo sapiens
tcttctaatttcaaaaatat

SEQ ID NO: 270709 - DNA, 18 bp, Homo sapiens
tcttctacgtataaatat

SEQ ID NO: 270710 - DNA, 15 bp, Homo sapiens
tcttctacttcttgt

SEQ ID NO: 270711 - DNA, 20 bp, Homo sapiens
tcttctagagagcttagtgt

SEQ ID NO: 270712 - DNA, 17 bp, Homo sapiens
tcttctaggttctaaaa

SEQ ID NO: 270713 - DNA, 16 bp, Homo sapiens
tcttctcaagtgcctt

SEQ ID NO: 270714 - DNA, 16 bp, Homo sapiens
tcttctcagctccact

SEQ ID NO: 270715 - DNA, 13 bp, Homo sapiens
tctttatttctgt

SEQ ID NO: 270716 - DNA, 23 bp, Homo sapiens
tctttcaattgcagatgccaaaa

SEQ ID NO: 270717 - DNA, 14 bp, Homo sapiens
tctttcagaaaaca

SEQ ID NO: 270718 - DNA, 15 bp, Homo sapiens
tctttcagaaaacag

SEQ ID NO: 270719 - DNA, 20 bp, Homo sapiens
tctttcagccaagaattctt

SEQ ID NO: 270720 - DNA, 21 bp, Homo sapiens
tctttcagccaagaattctta

SEQ ID NO: 270721 - DNA, 14 bp, Homo sapiens
tctttcagcctgct

SEQ ID NO: 270722 - DNA, 23 bp, Homo sapiens
tctttcagtattaaactctcctt

SEQ ID NO: 270723 - DNA, 19 bp, Homo sapiens
tctttcatagttctgttaa

SEQ ID NO: 270724 - DNA, 21 bp, Homo sapiens
tctttccaaattgatgggtgg

SEQ ID NO: 270725 - DNA, 22 bp, Homo sapiens
tctttccaaattgatgggtggg

SEQ ID NO: 270726 - DNA, 13 bp, Homo sapiens
tctttccaggctt

SEQ ID NO: 270727 - DNA, 18 bp, Homo sapiens
tctttccatgcagttatt

SEQ ID NO: 270728 - DNA, 19 bp, Homo sapiens
tctttccattatgattctt

SEQ ID NO: 270729 - DNA, 19 bp, Homo sapiens
tctttcccctcctttgtct

SEQ ID NO: 270730 - DNA, 21 bp, Homo sapiens
tctttcctactctgggaagaa

SEQ ID NO: 270731 - DNA, 16 bp, Homo sapiens
tctttcctccaaactc

SEQ ID NO: 270732 - DNA, 13 bp, Homo sapiens
tctttcctccctt

SEQ ID NO: 270733 - DNA, 15 bp, Homo sapiens
tctttcctcccttct

SEQ ID NO: 270734 - DNA, 17 bp, Homo sapiens
tctttcctgcccttttc

SEQ ID NO: 270735 - DNA, 20 bp, Homo sapiens
tctttcctgcccttttcctg

SEQ ID NO: 270736 - DNA, 14 bp, Homo sapiens
tctttcctgtgcca

SEQ ID NO: 270737 - DNA, 15 bp, Homo sapiens
tctttcctgtgccag

SEQ ID NO: 270738 - DNA, 23 bp, Homo sapiens
tctttcggactgaggccttctca

SEQ ID NO: 270739 - DNA, 10 bp, Homo sapiens
tctttctaat

SEQ ID NO: 270740 - DNA, 15 bp, Homo sapiens
tctttctacagagat

SEQ ID NO: 270741 - DNA, 22 bp, Homo sapiens
tctttctacatgactgggcctc

SEQ ID NO: 270742 - DNA, 10 bp, Homo sapiens
tctttctata

SEQ ID NO: 270743 - DNA, 15 bp, Homo sapiens
tctttctatgcccgt

SEQ ID NO: 270744 - DNA, 14 bp, Homo sapiens
tctttctcctgtgg

SEQ ID NO: 270745 - DNA, 14 bp, Homo sapiens
tctttctctcagcc

SEQ ID NO: 270746 - DNA, 12 bp, Homo sapiens
tctttctctcct

SEQ ID NO: 270747 - DNA, 14 bp, Homo sapiens
tctttctctctgtg

SEQ ID NO: 270748 - DNA, 20 bp, Homo sapiens
tctttctctctttccatctc

SEQ ID NO: 270749 - DNA, 17 bp, Homo sapiens
tctttctctgccagtga

SEQ ID NO: 270750 - DNA, 22 bp, Homo sapiens
tctttctgcagaaacagaaagg

SEQ ID NO: 270751 - DNA, 18 bp, Homo sapiens
tctttcttcctccagtct

SEQ ID NO: 270752 - DNA, 23 bp, Homo sapiens
tctttcttcctccagtctgttct

SEQ ID NO: 270753 - DNA, 18 bp, Homo sapiens
tctttcttcttccacaca

SEQ ID NO: 270754 - DNA, 17 bp, Homo sapiens
tctttcttggtgcattc

SEQ ID NO: 270755 - DNA, 16 bp, Homo sapiens
tgagccccctgcaccc

SEQ ID NO: 270756 - DNA, 22 bp, Homo sapiens
tgagccccctgcacccacccct

SEQ ID NO: 270757 - DNA, 19 bp, Homo sapiens
tgagcccctaccccacacc

SEQ ID NO: 270758 - DNA, 11 bp, Homo sapiens
tgagcccctcc

SEQ ID NO: 270759 - DNA, 17 bp, Homo sapiens
tgagcccctccccagcc

SEQ ID NO: 270760 - DNA, 19 bp, Homo sapiens
tgagcccctccccagccag

SEQ ID NO: 270761 - DNA, 22 bp, Homo sapiens
tgagcccctccccagccagccc

SEQ ID NO: 270762 - DNA, 15 bp, Homo sapiens
tgagcccctgggact

SEQ ID NO: 270763 - DNA, 18 bp, Homo sapiens
tgagcccgaatttctcac

SEQ ID NO: 270764 - DNA, 23 bp, Homo sapiens
tgagccctccctcttcccagcac

SEQ ID NO: 270765 - DNA, 22 bp, Homo sapiens
tgagccctccttcttgccctga

SEQ ID NO: 270766 - DNA, 17 bp, Homo sapiens
tgagccctgccctcact

SEQ ID NO: 270767 - DNA, 15 bp, Homo sapiens
tgagcccttgcacag

SEQ ID NO: 270768 - DNA, 20 bp, Homo sapiens
tgagcccttgcacaggccac

SEQ ID NO: 270769 - DNA, 21 bp, Homo sapiens
tgagcccttgcacaggccact

SEQ ID NO: 270770 - DNA, 23 bp, Homo sapiens
tgagcccttgcacaggccacttg

SEQ ID NO: 270771 - DNA, 18 bp, Homo sapiens
tgagccgtgcagctggga

SEQ ID NO: 270772 - DNA, 16 bp, Homo sapiens
tgagcctacagatgaa

SEQ ID NO: 270773 - DNA, 17 bp, Homo sapiens
tgagcctactgtctcct

SEQ ID NO: 270774 - DNA, 12 bp, Homo sapiens
tgagcctccccc

SEQ ID NO: 270775 - DNA, 14 bp, Homo sapiens
tgagcctcccccaa

SEQ ID NO: 270776 - DNA, 17 bp, Homo sapiens
tgagcctcccccaaagc

SEQ ID NO: 270777 - DNA, 20 bp, Homo sapiens
tgagcctctccttgccccag

SEQ ID NO: 270778 - DNA, 13 bp, Homo sapiens
tgagcctgagcct

SEQ ID NO: 270779 - DNA, 18 bp, Homo sapiens
tgagcctgaggccttcca

SEQ ID NO: 270780 - DNA, 22 bp, Homo sapiens
tgagcctgccccagctgggctg

SEQ ID NO: 270781 - DNA, 15 bp, Homo sapiens
tgagcctggtcctgg

SEQ ID NO: 270782 - DNA, 21 bp, Homo sapiens
tgagcctgtgggtccccactc

SEQ ID NO: 270783 - DNA, 13 bp, Homo sapiens
tgagccttgctgc

SEQ ID NO: 270784 - DNA, 18 bp, Homo sapiens
tgagccttgctgccaagt

SEQ ID NO: 270785 - DNA, 18 bp, Homo sapiens
tgagcgcacgcgcgcaca

SEQ ID NO: 270786 - DNA, 22 bp, Homo sapiens
tgagcgcacgcgcgcacacaca

SEQ ID NO: 270787 - DNA, 23 bp, Homo sapiens
tgagcgcacgcgcgcacacacac

SEQ ID NO: 270788 - DNA, 21 bp, Homo sapiens
tgagcggccgcctgtccttgg

SEQ ID NO: 270789 - DNA, 13 bp, Homo sapiens
tgagcgggtgggg

SEQ ID NO: 270790 - DNA, 14 bp, Homo sapiens
tgagcgggtggggt

SEQ ID NO: 270791 - DNA, 22 bp, Homo sapiens
tgagcgggtggggtgcttgctg

SEQ ID NO: 270792 - DNA, 23 bp, Homo sapiens
tgagcgtgtagcgtcctgaggaa

SEQ ID NO: 270793 - DNA, 18 bp, Homo sapiens
tgagctaactgagagaag

SEQ ID NO: 270794 - DNA, 21 bp, Homo sapiens
tgagctccagacccccagcaa

SEQ ID NO: 270795 - DNA, 19 bp, Homo sapiens
tgagctccccaatccaacc

SEQ ID NO: 270796 - DNA, 15 bp, Homo sapiens
tgagctccccaccac

SEQ ID NO: 270797 - DNA, 23 bp, Homo sapiens
tgagctccccaccaccccagctg

SEQ ID NO: 270798 - DNA, 16 bp, Homo sapiens
tgagctcccctggagc

SEQ ID NO: 270799 - DNA, 19 bp, Homo sapiens
tgagctcccctggagccag

SEQ ID NO: 270800 - DNA, 18 bp, Homo sapiens
tgagctccctcgctgtat

SEQ ID NO: 270801 - DNA, 18 bp, Homo sapiens
tgagctcctctgggcagg

SEQ ID NO: 270802 - DNA, 19 bp, Homo sapiens
tgagctcctctgggcagga

SEQ ID NO: 270803 - DNA, 16 bp, Homo sapiens
tgagctccttgattgc

SEQ ID NO: 270804 - DNA, 21 bp, Homo sapiens
tgagctctcggaactgcatgc

SEQ ID NO: 270805 - DNA, 13 bp, Homo sapiens
tgagctctctcag

SEQ ID NO: 270806 - DNA, 14 bp, Homo sapiens
tgagctctctcaga

SEQ ID NO: 270807 - DNA, 18 bp, Homo sapiens
tgagctctctcagaccct

SEQ ID NO: 270808 - DNA, 18 bp, Homo sapiens
tgagctctgacctgcccc

SEQ ID NO: 270809 - DNA, 18 bp, Homo sapiens
tgagctgcctgctctgca

SEQ ID NO: 270810 - DNA, 21 bp, Homo sapiens
tgagctgcctgctctgcagcc

SEQ ID NO: 270811 - DNA, 22 bp, Homo sapiens
tgagctggaaaggatgcttctg

SEQ ID NO: 270812 - DNA, 23 bp, Homo sapiens
tgagctggaaaggatgcttctgc

SEQ ID NO: 270813 - DNA, 16 bp, Homo sapiens
tgagctgggccctggg

SEQ ID NO: 270814 - DNA, 21 bp, Homo sapiens
tgagctgggccctgggtgagg

SEQ ID NO: 270815 - DNA, 21 bp, Homo sapiens
tgagctgtgttttgtctgagc

SEQ ID NO: 270816 - DNA, 22 bp, Homo sapiens
tgagcttagccttgtgccctgc

SEQ ID NO: 270817 - DNA, 23 bp, Homo sapiens
tgagcttcggttctccagaatgt

SEQ ID NO: 270818 - DNA, 14 bp, Homo sapiens
tgagcttgagctcc

SEQ ID NO: 270819 - DNA, 21 bp, Homo sapiens
tgagcttgattctaaagggga

SEQ ID NO: 270820 - DNA, 14 bp, Homo sapiens
tgagcttggccaga

SEQ ID NO: 270821 - DNA, 21 bp, Homo sapiens
tgagcttggccagaagggggc

SEQ ID NO: 270822 - DNA, 19 bp, Homo sapiens
tgagctttccggggaggag

SEQ ID NO: 270823 - DNA, 20 bp, Homo sapiens
tgagctttccggggaggagc

SEQ ID NO: 270824 - DNA, 21 bp, Homo sapiens
tgagctttggacacacacagc

SEQ ID NO: 270825 - DNA, 23 bp, Homo sapiens
tgagctttggacacacacagctt

SEQ ID NO: 270826 - DNA, 22 bp, Homo sapiens
tgagctttggacgcacacagct

SEQ ID NO: 270827 - DNA, 23 bp, Homo sapiens
tgagctttggggacagttggcag

SEQ ID NO: 270828 - DNA, 17 bp, Homo sapiens
tgagcttttcatggaag

SEQ ID NO: 270829 - DNA, 19 bp, Homo sapiens
tgaggaagaatccatctgt

SEQ ID NO: 270830 - DNA, 23 bp, Homo sapiens
tgaggaagaatccatctgtgagg

SEQ ID NO: 270831 - DNA, 15 bp, Homo sapiens
tgaggaagcaaaagc

SEQ ID NO: 270832 - DNA, 16 bp, Homo sapiens
tgaggaagctccagtc

SEQ ID NO: 270833 - DNA, 20 bp, Homo sapiens
tgaggaagctccagtcctgc

SEQ ID NO: 270834 - DNA, 19 bp, Homo sapiens
tgaggaataattatttatt

SEQ ID NO: 270835 - DNA, 15 bp, Homo sapiens
tgaggacaaagagaa

SEQ ID NO: 270836 - DNA, 15 bp, Homo sapiens
tgaggacacatgtcc

SEQ ID NO: 270837 - DNA, 17 bp, Homo sapiens
tgaggacagacagaagg

SEQ ID NO: 270838 - DNA, 15 bp, Homo sapiens
tgaggacaggagagg

SEQ ID NO: 270839 - DNA, 17 bp, Homo sapiens
tgaggacataaatcttc

SEQ ID NO: 270840 - DNA, 15 bp, Homo sapiens
tgaggacctccacct

SEQ ID NO: 270841 - DNA, 17 bp, Homo sapiens
tgaggacctccacctgg

SEQ ID NO: 270842 - DNA, 20 bp, Homo sapiens
tgaggacctccacctgggag

SEQ ID NO: 270843 - DNA, 14 bp, Homo sapiens
tgaggacctttctg

SEQ ID NO: 270844 - DNA, 20 bp, Homo sapiens
tgaggacggggcagagctga

SEQ ID NO: 270845 - DNA, 13 bp, Homo sapiens
tgaggactctgga

SEQ ID NO: 270846 - DNA, 11 bp, Homo sapiens
tgaggagctgc

SEQ ID NO: 270847 - DNA, 14 bp, Homo sapiens
tgaggagctgctgg

SEQ ID NO: 270848 - DNA, 17 bp, Homo sapiens
tgaggagctgctggctt

SEQ ID NO: 270849 - DNA, 13 bp, Homo sapiens
tgaggaggaagga

SEQ ID NO: 270850 - DNA, 20 bp, Homo sapiens
tgaggaggaggcagaaccag

SEQ ID NO: 270851 - DNA, 23 bp, Homo sapiens
tgaggaggcagaaagcagaggct

SEQ ID NO: 270852 - DNA, 22 bp, Homo sapiens
tgaggatgaaaaaataacactg

SEQ ID NO: 270853 - DNA, 17 bp, Homo sapiens
tgaggatgcactggcct

SEQ ID NO: 270854 - DNA, 18 bp, Homo sapiens
tgaggatgcactggcctg

SEQ ID NO: 270855 - DNA, 23 bp, Homo sapiens
tgaggatgcactggcctgttctg

SEQ ID NO: 270856 - DNA, 18 bp, Homo sapiens
tgaggcaagagaaatgag

SEQ ID NO: 270857 - DNA, 14 bp, Homo sapiens
tgaggcaagagaat

SEQ ID NO: 270858 - DNA, 15 bp, Homo sapiens
tgaggcaggggagtc

SEQ ID NO: 270859 - DNA, 17 bp, Homo sapiens
tgaggccaggagttcaa

SEQ ID NO: 270860 - DNA, 16 bp, Homo sapiens
tgaggccattccctgt

SEQ ID NO: 270861 - DNA, 18 bp, Homo sapiens
tgaggccattccctgtag

SEQ ID NO: 270862 - DNA, 16 bp, Homo sapiens
tgaggcccagagagct

SEQ ID NO: 270863 - DNA, 14 bp, Homo sapiens
tgaggcccagcaga

SEQ ID NO: 270864 - DNA, 18 bp, Homo sapiens
tgaggcccagcagagccg

SEQ ID NO: 270865 - DNA, 13 bp, Homo sapiens
tgaggcccagcct

SEQ ID NO: 270866 - DNA, 17 bp, Homo sapiens
tgaggcccagggagagg

SEQ ID NO: 270867 - DNA, 16 bp, Homo sapiens
tgaggcccccggaggc

SEQ ID NO: 270868 - DNA, 15 bp, Homo sapiens
tgaggcctcagtgga

SEQ ID NO: 270869 - DNA, 14 bp, Homo sapiens
tgaggcctcatccc

SEQ ID NO: 270870 - DNA, 18 bp, Homo sapiens
tgaggcctcatccctcgg

SEQ ID NO: 270871 - DNA, 12 bp, Homo sapiens
tgaggcctggac

SEQ ID NO: 270872 - DNA, 20 bp, Homo sapiens
tgaggcgtgggatccagaga

SEQ ID NO: 270873 - DNA, 13 bp, Homo sapiens
tgaggctggggct

SEQ ID NO: 270874 - DNA, 16 bp, Homo sapiens
tgaggcttagagagag

SEQ ID NO: 270875 - DNA, 17 bp, Homo sapiens
tgaggcttccaggctct

SEQ ID NO: 270876 - DNA, 20 bp, Homo sapiens
tgaggcttccaggctcttcc

SEQ ID NO: 270877 - DNA, 17 bp, Homo sapiens
tgaggcttctccttctc

SEQ ID NO: 270878 - DNA, 20 bp, Homo sapiens
tgagggaagcccacccgccc

SEQ ID NO: 270879 - DNA, 21 bp, Homo sapiens
tgagggacaaatttaaaacaa

SEQ ID NO: 270880 - DNA, 13 bp, Homo sapiens
tgagggacatgct

SEQ ID NO: 270881 - DNA, 18 bp, Homo sapiens
tgagggaccttggagagc

SEQ ID NO: 270882 - DNA, 14 bp, Homo sapiens
tgagggaggcctga

SEQ ID NO: 270883 - DNA, 19 bp, Homo sapiens
tgagggagggggcgctcag

SEQ ID NO: 270884 - DNA, 22 bp, Homo sapiens
tgagggagggggcgctcaggac

SEQ ID NO: 270885 - DNA, 16 bp, Homo sapiens
tgagggataagcaaaa

SEQ ID NO: 270886 - DNA, 18 bp, Homo sapiens
tgagggatggggagcagc

SEQ ID NO: 270887 - DNA, 21 bp, Homo sapiens
tgagggatggggagcagctgg

SEQ ID NO: 270888 - DNA, 13 bp, Homo sapiens
agcccgcttttgt

SEQ ID NO: 270889 - DNA, 22 bp, Homo sapiens
agcccgcttttgttcttcccca

SEQ ID NO: 270890 - DNA, 20 bp, Homo sapiens
agcccggaccttggcagccc

SEQ ID NO: 270891 - DNA, 23 bp, Homo sapiens
agcccggatgcccacccctgctg

SEQ ID NO: 270892 - DNA, 22 bp, Homo sapiens
agcccggccaaggacactgatg

SEQ ID NO: 270893 - DNA, 22 bp, Homo sapiens
agcccggcctgctcccagcagc

SEQ ID NO: 270894 - DNA, 21 bp, Homo sapiens
agcccggcgccaccatcctgc

SEQ ID NO: 270895 - DNA, 16 bp, Homo sapiens
agcccggcgcccctgc

SEQ ID NO: 270896 - DNA, 21 bp, Homo sapiens
agcccggcgcccctgccacct

SEQ ID NO: 270897 - DNA, 17 bp, Homo sapiens
agcccgtgaagcagtgc

SEQ ID NO: 270898 - DNA, 18 bp, Homo sapiens
agccctaaataaatctaa

SEQ ID NO: 270899 - DNA, 16 bp, Homo sapiens
agccctaaggatctct

SEQ ID NO: 270900 - DNA, 18 bp, Homo sapiens
agccctaagtaaatctaa

SEQ ID NO: 270901 - DNA, 19 bp, Homo sapiens
agccctagtgggagcccag

SEQ ID NO: 270902 - DNA, 20 bp, Homo sapiens
agccctagtgggagcccagc

SEQ ID NO: 270903 - DNA, 23 bp, Homo sapiens
agccctagtgggagcccagcaca

SEQ ID NO: 270904 - DNA, 16 bp, Homo sapiens
agccctccagagcagg

SEQ ID NO: 270905 - DNA, 14 bp, Homo sapiens
agccctcccagctg

SEQ ID NO: 270906 - DNA, 16 bp, Homo sapiens
agccctcccagctggt

SEQ ID NO: 270907 - DNA, 23 bp, Homo sapiens
agccctccccctcaacctcacca

SEQ ID NO: 270908 - DNA, 14 bp, Homo sapiens
agccctccctcttc

SEQ ID NO: 270909 - DNA, 15 bp, Homo sapiens
agccctccctcttcc

SEQ ID NO: 270910 - DNA, 21 bp, Homo sapiens
agccctccctcttcccagcac

SEQ ID NO: 270911 - DNA, 12 bp, Homo sapiens
agccctccctgc

SEQ ID NO: 270912 - DNA, 17 bp, Homo sapiens
agccctccctggctgtg

SEQ ID NO: 270913 - DNA, 18 bp, Homo sapiens
agccctccctggctgtga

SEQ ID NO: 270914 - DNA, 14 bp, Homo sapiens
agccctcctggaat

SEQ ID NO: 270915 - DNA, 18 bp, Homo sapiens
agccctccttcttgccct

SEQ ID NO: 270916 - DNA, 21 bp, Homo sapiens
agccctcgaaccaaggcagcc

SEQ ID NO: 270917 - DNA, 23 bp, Homo sapiens
agccctcgaaccaaggcagcctc

SEQ ID NO: 270918 - DNA, 23 bp, Homo sapiens
agccctctttctctctgtgtggc

SEQ ID NO: 270919 - DNA, 12 bp, Homo sapiens
agccctgcaaat

SEQ ID NO: 270920 - DNA, 17 bp, Homo sapiens
agccctgcccctcctgt

SEQ ID NO: 270921 - DNA, 19 bp, Homo sapiens
agccctgccctcactccac

SEQ ID NO: 270922 - DNA, 17 bp, Homo sapiens
agccctgctgcttccta

SEQ ID NO: 270923 - DNA, 19 bp, Homo sapiens
agccctgctttgggctgcc

SEQ ID NO: 270924 - DNA, 23 bp, Homo sapiens
agccctgctttgggctgccctgg

SEQ ID NO: 270925 - DNA, 19 bp, Homo sapiens
agccctggacacccctgct

SEQ ID NO: 270926 - DNA, 21 bp, Homo sapiens
agccctggacacccctgctct

SEQ ID NO: 270927 - DNA, 13 bp, Homo sapiens
agccctggccaga

SEQ ID NO: 270928 - DNA, 13 bp, Homo sapiens
agccctggctggg

SEQ ID NO: 270929 - DNA, 14 bp, Homo sapiens
agccctggggctgg

SEQ ID NO: 270930 - DNA, 15 bp, Homo sapiens
agccctgtaattttt

SEQ ID NO: 270931 - DNA, 19 bp, Homo sapiens
agccctgtcagtgcagccc

SEQ ID NO: 270932 - DNA, 20 bp, Homo sapiens
agccctgtcagtgcagcccg

SEQ ID NO: 270933 - DNA, 15 bp, Homo sapiens
agccctgtcctggtt

SEQ ID NO: 270934 - DNA, 19 bp, Homo sapiens
agccctgtcctggttcctt

SEQ ID NO: 270935 - DNA, 23 bp, Homo sapiens
agccctgtcgagacacttgcctt

SEQ ID NO: 270936 - DNA, 22 bp, Homo sapiens
agccctgtctgctaggcgctgg

SEQ ID NO: 270937 - DNA, 13 bp, Homo sapiens
agcccttcatttg

SEQ ID NO: 270938 - DNA, 11 bp, Homo sapiens
agcccttccct

SEQ ID NO: 270939 - DNA, 16 bp, Homo sapiens
agcccttccctgcttt

SEQ ID NO: 270940 - DNA, 14 bp, Homo sapiens
agcccttcctcctg

SEQ ID NO: 270941 - DNA, 23 bp, Homo sapiens
agcccttctaccttcctgcaaca

SEQ ID NO: 270942 - DNA, 14 bp, Homo sapiens
agcccttctgcctt

SEQ ID NO: 270943 - DNA, 18 bp, Homo sapiens
agcccttctgcctttctc

SEQ ID NO: 270944 - DNA, 18 bp, Homo sapiens
agcccttgcacaggccac

SEQ ID NO: 270945 - DNA, 19 bp, Homo sapiens
agcccttgcacaggccact

SEQ ID NO: 270946 - DNA, 15 bp, Homo sapiens
agcccttgcccccat

SEQ ID NO: 270947 - DNA, 20 bp, Homo sapiens
agcccttgcccccatccctc

SEQ ID NO: 270948 - DNA, 14 bp, Homo sapiens
agcccttgggcagt

SEQ ID NO: 270949 - DNA, 15 bp, Homo sapiens
agccctttccccact

SEQ ID NO: 270950 - DNA, 13 bp, Homo sapiens
agccctttctgtg

SEQ ID NO: 270951 - DNA, 21 bp, Homo sapiens
agcccttttacagctcttggc

SEQ ID NO: 270952 - DNA, 16 bp, Homo sapiens
agccgagccgggcctg

SEQ ID NO: 270953 - DNA, 17 bp, Homo sapiens
agccgagccgggcctgg

SEQ ID NO: 270954 - DNA, 21 bp, Homo sapiens
agccgagctctcctgggccag

SEQ ID NO: 270955 - DNA, 22 bp, Homo sapiens
agccgagctctcctgggccagg

SEQ ID NO: 270956 - DNA, 19 bp, Homo sapiens
agccgccattgccaccagg

SEQ ID NO: 270957 - DNA, 21 bp, Homo sapiens
agccgccattgccaccaggag

SEQ ID NO: 270958 - DNA, 13 bp, Homo sapiens
agccgccccagcc

SEQ ID NO: 270959 - DNA, 19 bp, Homo sapiens
agccgctaggagagactga

SEQ ID NO: 270960 - DNA, 12 bp, Homo sapiens
agccgctgctgg

SEQ ID NO: 270961 - DNA, 23 bp, Homo sapiens
agccggactttcggagttggggg

SEQ ID NO: 270962 - DNA, 14 bp, Homo sapiens
agccggcacagggt

SEQ ID NO: 270963 - DNA, 13 bp, Homo sapiens
agccggcggccca

SEQ ID NO: 270964 - DNA, 15 bp, Homo sapiens
agccggggcctgcct

SEQ ID NO: 270965 - DNA, 13 bp, Homo sapiens
agccggggtgggg

SEQ ID NO: 270966 - DNA, 16 bp, Homo sapiens
agccggtttgggagag

SEQ ID NO: 270967 - DNA, 18 bp, Homo sapiens
agccggtttgggagagac

SEQ ID NO: 270968 - DNA, 19 bp, Homo sapiens
agccggtttgggagagacc

SEQ ID NO: 270969 - DNA, 14 bp, Homo sapiens
agccgtcacccctg

SEQ ID NO: 270970 - DNA, 20 bp, Homo sapiens
agccgtcagccaaatgtaat

SEQ ID NO: 270971 - DNA, 14 bp, Homo sapiens
agccgtccatggca

SEQ ID NO: 270972 - DNA, 15 bp, Homo sapiens
agccgtccatggcac

SEQ ID NO: 270973 - DNA, 21 bp, Homo sapiens
agccgtccatggcaccagccc

SEQ ID NO: 270974 - DNA, 20 bp, Homo sapiens
agccgtcccgcgttcaagac

SEQ ID NO: 270975 - DNA, 17 bp, Homo sapiens
agccgtctgactccaga

SEQ ID NO: 270976 - DNA, 24 bp, Homo sapiens
agccgtctgactccagagtctgag

SEQ ID NO: 270977 - DNA, 22 bp, Homo sapiens
agccgtggccgagggcttccct

SEQ ID NO: 270978 - DNA, 23 bp, Homo sapiens
agccgtggcttcccgctcagccc

SEQ ID NO: 270979 - DNA, 13 bp, Homo sapiens
agccgttcctggg

SEQ ID NO: 270980 - DNA, 19 bp, Homo sapiens
agcctaaataaaaagtata

SEQ ID NO: 270981 - DNA, 17 bp, Homo sapiens
agcctactgtctccttc

SEQ ID NO: 270982 - DNA, 20 bp, Homo sapiens
agcctactgtctccttccca

SEQ ID NO: 270983 - DNA, 21 bp, Homo sapiens
agcctactgtctccttcccac

SEQ ID NO: 270984 - DNA, 19 bp, Homo sapiens
agcctaggaccagttttgt

SEQ ID NO: 270985 - DNA, 20 bp, Homo sapiens
agcctaggaccagttttgta

SEQ ID NO: 270986 - DNA, 14 bp, Homo sapiens
agcctagttcatcc

SEQ ID NO: 270987 - DNA, 22 bp, Homo sapiens
agcctagttcatccaatcctca

SEQ ID NO: 270988 - DNA, 16 bp, Homo sapiens
agcctatatttcctct

SEQ ID NO: 270989 - DNA, 21 bp, Homo sapiens
agcctcaagtcttatttcctc

SEQ ID NO: 270990 - DNA, 16 bp, Homo sapiens
agcctcacccctgcag

SEQ ID NO: 270991 - DNA, 21 bp, Homo sapiens
agcctcacggggttggctgtt

SEQ ID NO: 270992 - DNA, 17 bp, Homo sapiens
agcctcagactcattgt

SEQ ID NO: 270993 - DNA, 15 bp, Homo sapiens
agcctcagccattca

SEQ ID NO: 270994 - DNA, 23 bp, Homo sapiens
agcctcagctctcagttgcagcc

SEQ ID NO: 270995 - DNA, 13 bp, Homo sapiens
agcctcagggctt

SEQ ID NO: 270996 - DNA, 16 bp, Homo sapiens
agcctcagggcttcct

SEQ ID NO: 270997 - DNA, 13 bp, Homo sapiens
agcctcagtgcca

SEQ ID NO: 270998 - DNA, 14 bp, Homo sapiens
agcctcagtgccac

SEQ ID NO: 270999 - DNA, 16 bp, Homo sapiens
agcctcattcactgtc

SEQ ID NO: 271000 - DNA, 13 bp, Homo sapiens
agcctccaagcct

SEQ ID NO: 271001 - DNA, 15 bp, Homo sapiens
agcctccagagccag

SEQ ID NO: 271002 - DNA, 16 bp, Homo sapiens
agcctccagagccagc

SEQ ID NO: 271003 - DNA, 21 bp, Homo sapiens
agcctccagagccagcctggg

SEQ ID NO: 271004 - DNA, 23 bp, Homo sapiens
agcctccagagccagcctgggac

SEQ ID NO: 271005 - DNA, 17 bp, Homo sapiens
agcctccatgctgcctc

SEQ ID NO: 271006 - DNA, 17 bp, Homo sapiens
agcctccatttagttct

SEQ ID NO: 271007 - DNA, 11 bp, Homo sapiens
agcctccccca

SEQ ID NO: 271008 - DNA, 15 bp, Homo sapiens
agcctcccccaaagc

SEQ ID NO: 271009 - DNA, 14 bp, Homo sapiens
agcctcccccaggc

SEQ ID NO: 271010 - DNA, 15 bp, Homo sapiens
agcctcccccaggct

SEQ ID NO: 271011 - DNA, 22 bp, Homo sapiens
agcctcccccaggctgcgcctg

SEQ ID NO: 271012 - DNA, 10 bp, Homo sapiens
agcctcccct

SEQ ID NO: 271013 - DNA, 12 bp, Homo sapiens
agcctcccctcc

SEQ ID NO: 271014 - DNA, 21 bp, Homo sapiens
agcctcccctcccctggggac

SEQ ID NO: 271015 - DNA, 14 bp, Homo sapiens
agcctccctcctcg

SEQ ID NO: 271016 - DNA, 18 bp, Homo sapiens
agcctccctcctcgtccc

SEQ ID NO: 271017 - DNA, 21 bp, Homo sapiens
agcctccctcctcgtcccctg

SEQ ID NO: 271018 - DNA, 15 bp, Homo sapiens
agcctccggaagctg

SEQ ID NO: 271019 - DNA, 23 bp, Homo sapiens
agcctccggagtagctgggacca

SEQ ID NO: 271020 - DNA, 18 bp, Homo sapiens
agcctccgttcccacctc

SEQ ID NO: 271021 - DNA, 21 bp, Homo sapiens
agcctccgtttatgggccttg

SEQ ID NO: 271022 - DNA, 20 bp, Homo sapiens
agcctcctgccccctgccag

SEQ ID NO: 271023 - DNA, 14 bp, Homo sapiens
agcctcctgctgag

SEQ ID NO: 271024 - DNA, 21 bp, Homo sapiens
agcctcctgtgtagctgggat

SEQ ID NO: 271025 - DNA, 16 bp, Homo sapiens
agcctcgaatatctta

SEQ ID NO: 271026 - DNA, 19 bp, Homo sapiens
agcctcgcccctccagtgt

SEQ ID NO: 271027 - DNA, 17 bp, Homo sapiens
agcctctcccacccggc

SEQ ID NO: 271028 - DNA, 18 bp, Homo sapiens
agcctctcccacccggcc

SEQ ID NO: 271029 - DNA, 20 bp, Homo sapiens
agcctctccggcagaaggga

SEQ ID NO: 271030 - DNA, 21 bp, Homo sapiens
agcctctccttgccccagtcc

SEQ ID NO: 271031 - DNA, 19 bp, Homo sapiens
agcctctgaagttggacag

SEQ ID NO: 271032 - DNA, 20 bp, Homo sapiens
agcctctgaagttggacagc

SEQ ID NO: 271033 - DNA, 14 bp, Homo sapiens
agcctctgcagact

SEQ ID NO: 271034 - DNA, 13 bp, Homo sapiens
agcctctgccagg

SEQ ID NO: 271035 - DNA, 13 bp, Homo sapiens
agcctctgccctg

SEQ ID NO: 271036 - DNA, 14 bp, Homo sapiens
agcctctgccctgc

SEQ ID NO: 271037 - DNA, 23 bp, Homo sapiens
agcctctgtcctggctgtgcaca

SEQ ID NO: 271038 - DNA, 21 bp, Homo sapiens
agcctcttgagctgaagtaat

SEQ ID NO: 271039 - DNA, 14 bp, Homo sapiens
agcctctttgtgtt

SEQ ID NO: 271040 - DNA, 19 bp, Homo sapiens
agcctctttgtgtttttgt

SEQ ID NO: 271041 - DNA, 18 bp, Homo sapiens
agcctgaccaaaagtgag

SEQ ID NO: 271042 - DNA, 16 bp, Homo sapiens
agcctgacctgagact

SEQ ID NO: 271043 - DNA, 11 bp, Homo sapiens
agcctgagcct

SEQ ID NO: 271044 - DNA, 12 bp, Homo sapiens
agcctgagctcc

SEQ ID NO: 271045 - DNA, 14 bp, Homo sapiens
agcctgagctccac

SEQ ID NO: 271046 - DNA, 17 bp, Homo sapiens
agcctgagctccaccct

SEQ ID NO: 271047 - DNA, 12 bp, Homo sapiens
agcctgaggcag

SEQ ID NO: 271048 - DNA, 14 bp, Homo sapiens
agcctgaggcagga

SEQ ID NO: 271049 - DNA, 15 bp, Homo sapiens
agcctgaggcaggag

SEQ ID NO: 271050 - DNA, 13 bp, Homo sapiens
agcctgaggcctt

SEQ ID NO: 271051 - DNA, 21 bp, Homo sapiens
agcctgagtcagggcccagag

SEQ ID NO: 271052 - DNA, 15 bp, Homo sapiens
agcctgagtctcctg

SEQ ID NO: 271053 - DNA, 13 bp, Homo sapiens
agcctgagtggtg

SEQ ID NO: 271054 - DNA, 15 bp, Homo sapiens
agcctgagtggtgag

SEQ ID NO: 271055 - DNA, 16 bp, Homo sapiens
agcctgatggccaagg

SEQ ID NO: 271056 - DNA, 19 bp, Homo sapiens
agcctgcaaactcactgct

SEQ ID NO: 271057 - DNA, 12 bp, Homo sapiens
agcctgcacaca

SEQ ID NO: 271058 - DNA, 15 bp, Homo sapiens
agcctgcacacacct

SEQ ID NO: 271059 - DNA, 16 bp, Homo sapiens
agcctgcacacacctg

SEQ ID NO: 271060 - DNA, 18 bp, Homo sapiens
agcctgcacacacctgcc

SEQ ID NO: 271061 - DNA, 21 bp, Homo sapiens
agcctgcacacacctgcctgc

SEQ ID NO: 271062 - DNA, 23 bp, Homo sapiens
agcctgcagggtggtgctgggac

SEQ ID NO: 271063 - DNA, 18 bp, Homo sapiens
agcctgcccggccggaga

SEQ ID NO: 271064 - DNA, 14 bp, Homo sapiens
agcctgcggctgct

SEQ ID NO: 271065 - DNA, 15 bp, Homo sapiens
agcctgcggctgctg

SEQ ID NO: 271066 - DNA, 17 bp, Homo sapiens
agcctgcggctgctggc

SEQ ID NO: 271067 - DNA, 18 bp, Homo sapiens
agcctgcgtcatggctca

SEQ ID NO: 271068 - DNA, 16 bp, Homo sapiens
agcctgcgtggcctgg

SEQ ID NO: 271069 - DNA, 12 bp, Homo sapiens
agcctgctgatt

SEQ ID NO: 271070 - DNA, 11 bp, Homo sapiens
agcctgctgca

SEQ ID NO: 271071 - DNA, 15 bp, Homo sapiens
agcctgcttcccacc

SEQ ID NO: 271072 - DNA, 19 bp, Homo sapiens
agcctgcttcccacctccc

SEQ ID NO: 271073 - DNA, 11 bp, Homo sapiens
agcctggagcc

SEQ ID NO: 271074 - DNA, 13 bp, Homo sapiens
agcctggagcccc

SEQ ID NO: 271075 - DNA, 14 bp, Homo sapiens
agcctggagcccct

SEQ ID NO: 271076 - DNA, 16 bp, Homo sapiens
agcctggagcccctgt

SEQ ID NO: 271077 - DNA, 22 bp, Homo sapiens
agcctggagcccctgtgtggga

SEQ ID NO: 271078 - DNA, 14 bp, Homo sapiens
agcctggagccgtg

SEQ ID NO: 271079 - DNA, 17 bp, Homo sapiens
agcctggcacagggcag

SEQ ID NO: 271080 - DNA, 18 bp, Homo sapiens
agcctggccccaaatgtt

SEQ ID NO: 271081 - DNA, 16 bp, Homo sapiens
agcctggctaacatgg

SEQ ID NO: 271082 - DNA, 17 bp, Homo sapiens
agcctggctcccaggac

SEQ ID NO: 271083 - DNA, 19 bp, Homo sapiens
agcctggctcccaggacac

SEQ ID NO: 271084 - DNA, 15 bp, Homo sapiens
agcctgggcagccag

SEQ ID NO: 271085 - DNA, 18 bp, Homo sapiens
agcctgggcagccaggct

SEQ ID NO: 271086 - DNA, 19 bp, Homo sapiens
agcctgggccactggcatc

SEQ ID NO: 271087 - DNA, 16 bp, Homo sapiens
agcctgggccagagaa

SEQ ID NO: 271088 - DNA, 15 bp, Homo sapiens
agcctggggcctggc

SEQ ID NO: 271089 - DNA, 17 bp, Homo sapiens
agcctggggcctggcag

SEQ ID NO: 271090 - DNA, 17 bp, Homo sapiens
agcctggggcctgggga

SEQ ID NO: 271091 - DNA, 21 bp, Homo sapiens
agcctgggtgagaatcctgcc

SEQ ID NO: 271092 - DNA, 18 bp, Homo sapiens
agcctggtagagactagg

SEQ ID NO: 271093 - DNA, 14 bp, Homo sapiens
agcctggtgacagg

SEQ ID NO: 271094 - DNA, 17 bp, Homo sapiens
agcctggtgacaggcag

SEQ ID NO: 271095 - DNA, 16 bp, Homo sapiens
agcctggttccctctt

SEQ ID NO: 271096 - DNA, 19 bp, Homo sapiens
agcctggttccctctttcc

SEQ ID NO: 271097 - DNA, 20 bp, Homo sapiens
agcctgtagcttatatttga

SEQ ID NO: 271098 - DNA, 15 bp, Homo sapiens
agcctgtcagccaac

SEQ ID NO: 271099 - DNA, 18 bp, Homo sapiens
agcctgtcctcaccgtct

SEQ ID NO: 271100 - DNA, 12 bp, Homo sapiens
agcctgtcctgg

SEQ ID NO: 271101 - DNA, 14 bp, Homo sapiens
agcctgtcctggta

SEQ ID NO: 271102 - DNA, 21 bp, Homo sapiens
agcctgtcctggtacagcagg

SEQ ID NO: 271103 - DNA, 19 bp, Homo sapiens
agcctgtcttcagatcctg

SEQ ID NO: 271104 - DNA, 23 bp, Homo sapiens
agcctgtcttcagatcctgctgc

SEQ ID NO: 271105 - DNA, 14 bp, Homo sapiens
agcctgtgggagaa

SEQ ID NO: 271106 - DNA, 15 bp, Homo sapiens
agcctgtgggagaag

SEQ ID NO: 271107 - DNA, 16 bp, Homo sapiens
agcctgtgggagaagg

SEQ ID NO: 271108 - DNA, 17 bp, Homo sapiens
agcctgtgggagaaggg

SEQ ID NO: 271109 - DNA, 19 bp, Homo sapiens
agcctgtggttacagtgca

SEQ ID NO: 271110 - DNA, 14 bp, Homo sapiens
agcctgtgtgttct

SEQ ID NO: 271111 - DNA, 21 bp, Homo sapiens
agcctgtgttagtgtctgtcc

SEQ ID NO: 271112 - DNA, 17 bp, Homo sapiens
agcctgttcccctcact

SEQ ID NO: 271113 - DNA, 20 bp, Homo sapiens
agcctgtttgggaggctgga

SEQ ID NO: 271114 - DNA, 15 bp, Homo sapiens
agccttaaaatgcat

SEQ ID NO: 271115 - DNA, 15 bp, Homo sapiens
agccttaagaaagct

SEQ ID NO: 271116 - DNA, 17 bp, Homo sapiens
agccttaagaaagctat

SEQ ID NO: 271117 - DNA, 22 bp, Homo sapiens
agccttaagtcttactgttttg

SEQ ID NO: 271118 - DNA, 12 bp, Homo sapiens
agccttaataaa

SEQ ID NO: 271119 - DNA, 20 bp, Homo sapiens
agccttagaatctgtagagg

SEQ ID NO: 271120 - DNA, 20 bp, Homo sapiens
agccttagcccggatgccca

SEQ ID NO: 271121 - DNA, 23 bp, Homo sapiens
agccttagcccggatgcccaccc

SEQ ID NO: 271122 - DNA, 20 bp, Homo sapiens
agccttagctgccagtgctg

SEQ ID NO: 271123 - DNA, 15 bp, Homo sapiens
agccttatccagcat

SEQ ID NO: 271124 - DNA, 17 bp, Homo sapiens
agccttcctctgcagct

SEQ ID NO: 271125 - DNA, 23 bp, Homo sapiens
agccttcctctgcagctgacctc

SEQ ID NO: 271126 - DNA, 11 bp, Homo sapiens
agccttgctgc

SEQ ID NO: 271127 - DNA, 14 bp, Homo sapiens
agccttgctgccaa

SEQ ID NO: 271128 - DNA, 15 bp, Homo sapiens
agccttgctgtagag

SEQ ID NO: 271129 - DNA, 21 bp, Homo sapiens
agccttggcctgacctggcac

SEQ ID NO: 271130 - DNA, 22 bp, Homo sapiens
agccttggctcgttctcttctc

SEQ ID NO: 271131 - DNA, 16 bp, Homo sapiens
agccttgggcctttca

SEQ ID NO: 271132 - DNA, 13 bp, Homo sapiens
agccttgtgagat

SEQ ID NO: 271133 - DNA, 15 bp, Homo sapiens
agccttgtgccctgc

SEQ ID NO: 271134 - DNA, 16 bp, Homo sapiens
agccttgtgccctgcc

SEQ ID NO: 271135 - DNA, 17 bp, Homo sapiens
agccttgtgccctgccc

SEQ ID NO: 271136 - DNA, 21 bp, Homo sapiens
agcctttaaattgttcctctt

SEQ ID NO: 271137 - DNA, 14 bp, Homo sapiens
agcctttccataag

SEQ ID NO: 271138 - DNA, 22 bp, Homo sapiens
agcctttccataaggaatgtag

SEQ ID NO: 271139 - DNA, 23 bp, Homo sapiens
agcctttccataaggaatgtagc

SEQ ID NO: 271140 - DNA, 12 bp, Homo sapiens
agcctttctgta

SEQ ID NO: 271141 - DNA, 13 bp, Homo sapiens
agcctttctgtat

SEQ ID NO: 271142 - DNA, 14 bp, Homo sapiens
agcctttctgtatc

SEQ ID NO: 271143 - DNA, 22 bp, Homo sapiens
agcctttggaagtctgcgccct

SEQ ID NO: 271144 - DNA, 19 bp, Homo sapiens
agcctttggtgaataacct

SEQ ID NO: 271145 - DNA, 12 bp, Homo sapiens
agcctttgtagg

SEQ ID NO: 271146 - DNA, 12 bp, Homo sapiens
agcgaacatctt

SEQ ID NO: 271147 - DNA, 15 bp, Homo sapiens
agcgaacatcttcat

SEQ ID NO: 271148 - DNA, 17 bp, Homo sapiens
agcgaacatcttcatat

SEQ ID NO: 271149 - DNA, 19 bp, Homo sapiens
agcgaagtctttgccttct

SEQ ID NO: 271150 - DNA, 13 bp, Homo sapiens
agcgagactctgt

SEQ ID NO: 271151 - DNA, 21 bp, Homo sapiens
agcgagattccgtctcaaaaa

SEQ ID NO: 271152 - DNA, 21 bp, Homo sapiens
agcgagcaaatcctggcaagt

SEQ ID NO: 271153 - DNA, 16 bp, Homo sapiens
agcgagcaagccggca

SEQ ID NO: 271154 - DNA, 14 bp, Homo sapiens
agcgagcctggcag

SEQ ID NO: 271155 - DNA, 16 bp, Homo sapiens
agcgagcctggcaggt

SEQ ID NO: 271156 - DNA, 22 bp, Homo sapiens
tgagggcagaaaccttgtttgt

SEQ ID NO: 271157 - DNA, 16 bp, Homo sapiens
tgagggcagggttcta

SEQ ID NO: 271158 - DNA, 17 bp, Homo sapiens
tgagggcattaaaaata

SEQ ID NO: 271159 - DNA, 17 bp, Homo sapiens
tgagggcccctctgccc

SEQ ID NO: 271160 - DNA, 15 bp, Homo sapiens
tgaggggactgcatg

SEQ ID NO: 271161 - DNA, 17 bp, Homo sapiens
tgaggggcatctgcccc

SEQ ID NO: 271162 - DNA, 22 bp, Homo sapiens
tgaggggcatctgcccctcccc

SEQ ID NO: 271163 - DNA, 17 bp, Homo sapiens
tgaggggccactgggcc

SEQ ID NO: 271164 - DNA, 16 bp, Homo sapiens
tgaggggccaggccat

SEQ ID NO: 271165 - DNA, 20 bp, Homo sapiens
tgagggtcctgattctccct

SEQ ID NO: 271166 - DNA, 15 bp, Homo sapiens
tgagggtttccacct

SEQ ID NO: 271167 - DNA, 21 bp, Homo sapiens
tgaggtagaggggaaggaaat

SEQ ID NO: 271168 - DNA, 19 bp, Homo sapiens
tgaggtcatcccggggcca

SEQ ID NO: 271169 - DNA, 17 bp, Homo sapiens
tgaggtctaaacaaata

SEQ ID NO: 271170 - DNA, 21 bp, Homo sapiens
tgaggtcttgagtttcatttt

SEQ ID NO: 271171 - DNA, 23 bp, Homo sapiens
tgaggtcttttgacatgtggaaa

SEQ ID NO: 271172 - DNA, 16 bp, Homo sapiens
tgaggtgaaagggagc

SEQ ID NO: 271173 - DNA, 17 bp, Homo sapiens
tgaggtgaaagggagct

SEQ ID NO: 271174 - DNA, 18 bp, Homo sapiens
tgaggtgaaatgggagat

SEQ ID NO: 271175 - DNA, 17 bp, Homo sapiens
tgaggtgataggcaagg

SEQ ID NO: 271176 - DNA, 18 bp, Homo sapiens
tgaggtggtactatgatt

SEQ ID NO: 271177 - DNA, 13 bp, Homo sapiens
tgaggtggtctga

SEQ ID NO: 271178 - DNA, 17 bp, Homo sapiens
tgaggtggtctgaatgt

SEQ ID NO: 271179 - DNA, 18 bp, Homo sapiens
tgaggtggtctgaatgtt

SEQ ID NO: 271180 - DNA, 19 bp, Homo sapiens
tgaggtggtctgaatgttc

SEQ ID NO: 271181 - DNA, 15 bp, Homo sapiens
tgaggttaaaatata

SEQ ID NO: 271182 - DNA, 21 bp, Homo sapiens
tgaggttaaaatataaattaa

SEQ ID NO: 271183 - DNA, 16 bp, Homo sapiens
tgaggttatgagaaaa

SEQ ID NO: 271184 - DNA, 15 bp, Homo sapiens
tgaggttcagcaagg

SEQ ID NO: 271185 - DNA, 21 bp, Homo sapiens
tgaggtttccttcagacagat

SEQ ID NO: 271186 - DNA, 17 bp, Homo sapiens
tgagtaagagctggtgt

SEQ ID NO: 271187 - DNA, 18 bp, Homo sapiens
tgagtaagagctggtgtc

SEQ ID NO: 271188 - DNA, 21 bp, Homo sapiens
tgagtaagagctggtgtctga

SEQ ID NO: 271189 - DNA, 14 bp, Homo sapiens
tgagtaatgtttaa

SEQ ID NO: 271190 - DNA, 15 bp, Homo sapiens
tgagtaattctttga

SEQ ID NO: 271191 - DNA, 19 bp, Homo sapiens
tgagtacagtgaggagggt

SEQ ID NO: 271192 - DNA, 21 bp, Homo sapiens
tgagtacagtgaggagggtgg

SEQ ID NO: 271193 - DNA, 20 bp, Homo sapiens
tgagtattctatgtaaaaat

SEQ ID NO: 271194 - DNA, 16 bp, Homo sapiens
tgagtcaaaagcctgg

SEQ ID NO: 271195 - DNA, 18 bp, Homo sapiens
tgagtcaaaagcctgggt

SEQ ID NO: 271196 - DNA, 15 bp, Homo sapiens
tgagtcaatgtgcag

SEQ ID NO: 271197 - DNA, 14 bp, Homo sapiens
tgagtcacctcctc

SEQ ID NO: 271198 - DNA, 22 bp, Homo sapiens
tgagtcagggcccagaggctga

SEQ ID NO: 271199 - DNA, 17 bp, Homo sapiens
tgagtcatcaaaaagag

SEQ ID NO: 271200 - DNA, 23 bp, Homo sapiens
tgagtcccagagcccgcttttgt

SEQ ID NO: 271201 - DNA, 19 bp, Homo sapiens
tgagtcccagtgggaggcg

SEQ ID NO: 271202 - DNA, 21 bp, Homo sapiens
tgagtccccacctgcggctcc

SEQ ID NO: 271203 - DNA, 14 bp, Homo sapiens
tgagtcccttccag

SEQ ID NO: 271204 - DNA, 21 bp, Homo sapiens
tgagtcctcaagcttctcaga

SEQ ID NO: 271205 - DNA, 12 bp, Homo sapiens
tgagtcctgtta

SEQ ID NO: 271206 - DNA, 12 bp, Homo sapiens
tgagtcctgttc

SEQ ID NO: 271207 - DNA, 23 bp, Homo sapiens
tgagtcggccccacatgggaacc

SEQ ID NO: 271208 - DNA, 16 bp, Homo sapiens
tgagtcggctgggcag

SEQ ID NO: 271209 - DNA, 14 bp, Homo sapiens
tgagtctggctagg

SEQ ID NO: 271210 - DNA, 15 bp, Homo sapiens
tgagtgaaagtactt

SEQ ID NO: 271211 - DNA, 20 bp, Homo sapiens
tgagtgaatgagtaaataaa

SEQ ID NO: 271212 - DNA, 14 bp, Homo sapiens
tgagtgattatttg

SEQ ID NO: 271213 - DNA, 13 bp, Homo sapiens
tgagtgcagaccc

SEQ ID NO: 271214 - DNA, 14 bp, Homo sapiens
tgagtgccacaaaa

SEQ ID NO: 271215 - DNA, 18 bp, Homo sapiens
tgagtgcctgcagcatct

SEQ ID NO: 271216 - DNA, 17 bp, Homo sapiens
tgagtggaatgcaggga

SEQ ID NO: 271217 - DNA, 18 bp, Homo sapiens
tgagtggaatgcagggaa

SEQ ID NO: 271218 - DNA, 18 bp, Homo sapiens
tgagtggcagccatgcct

SEQ ID NO: 271219 - DNA, 12 bp, Homo sapiens
tgagtggcctgc

SEQ ID NO: 271220 - DNA, 19 bp, Homo sapiens
tgagtggggagacacctca

SEQ ID NO: 271221 - DNA, 18 bp, Homo sapiens
tgagtgggtatttcttat

SEQ ID NO: 271222 - DNA, 18 bp, Homo sapiens
tgagtggtccacattctg

SEQ ID NO: 271223 - DNA, 21 bp, Homo sapiens
tgagtggtgaggggccactgg

SEQ ID NO: 271224 - DNA, 14 bp, Homo sapiens
tgagtgtgagggca

SEQ ID NO: 271225 - DNA, 16 bp, Homo sapiens
tgagtgtgagggcagc

SEQ ID NO: 271226 - DNA, 20 bp, Homo sapiens
tgagtgtgagggcagcactg

SEQ ID NO: 271227 - DNA, 15 bp, Homo sapiens
tgagtgtggaagccg

SEQ ID NO: 271228 - DNA, 17 bp, Homo sapiens
tgagtgtgtccaagtgt

SEQ ID NO: 271229 - DNA, 16 bp, Homo sapiens
tgagttggacacactg

SEQ ID NO: 271230 - DNA, 21 bp, Homo sapiens
tgagtttaaaaaaataacatc

SEQ ID NO: 271231 - DNA, 14 bp, Homo sapiens
tgagtttagttttt

SEQ ID NO: 271232 - DNA, 20 bp, Homo sapiens
tgagtttagtttttcacttt

SEQ ID NO: 271233 - DNA, 12 bp, Homo sapiens
tgagtttatggg

SEQ ID NO: 271234 - DNA, 17 bp, Homo sapiens
tgagtttccagctgctc

SEQ ID NO: 271235 - DNA, 17 bp, Homo sapiens
tgagtttcctcaggctg

SEQ ID NO: 271236 - DNA, 19 bp, Homo sapiens
tgagtttcctcaggctgct

SEQ ID NO: 271237 - DNA, 22 bp, Homo sapiens
tgagtttcctcaggctgctgga

SEQ ID NO: 271238 - DNA, 16 bp, Homo sapiens
tgagtttgacatttaa

SEQ ID NO: 271239 - DNA, 14 bp, Homo sapiens
tgagtttgccctgg

SEQ ID NO: 271240 - DNA, 16 bp, Homo sapiens
tgagttttaaagaagt

SEQ ID NO: 271241 - DNA, 23 bp, Homo sapiens
tgagttttctctttgtggggctt

SEQ ID NO: 271242 - DNA, 19 bp, Homo sapiens
tgagttttttctcttgggc

SEQ ID NO: 271243 - DNA, 20 bp, Homo sapiens
tgataaaaaatttattatgt

SEQ ID NO: 271244 - DNA, 13 bp, Homo sapiens
tgataaaataagt

SEQ ID NO: 271245 - DNA, 14 bp, Homo sapiens
tgataaaataagta

SEQ ID NO: 271246 - DNA, 15 bp, Homo sapiens
tgataaaataagtaa

SEQ ID NO: 271247 - DNA, 23 bp, Homo sapiens
tgataaaataagtaacatataaa

SEQ ID NO: 271248 - DNA, 18 bp, Homo sapiens
tgataaaatgttcctttt

SEQ ID NO: 271249 - DNA, 22 bp, Homo sapiens
tgataaacattaaacactgtaa

SEQ ID NO: 271250 - DNA, 15 bp, Homo sapiens
tgataacattttgtt

SEQ ID NO: 271251 - DNA, 19 bp, Homo sapiens
tgataacttggggaggcaa

SEQ ID NO: 271252 - DNA, 20 bp, Homo sapiens
tgataagatgaggaaataat

SEQ ID NO: 271253 - DNA, 15 bp, Homo sapiens
tgataagggagaggg

SEQ ID NO: 271254 - DNA, 18 bp, Homo sapiens
tgataagtggaaaaaaga

SEQ ID NO: 271255 - DNA, 20 bp, Homo sapiens
tgataagtggaaaaaagaga

SEQ ID NO: 271256 - DNA, 18 bp, Homo sapiens
tgataataaattgaaatt

SEQ ID NO: 271257 - DNA, 14 bp, Homo sapiens
tgataatacccaca

SEQ ID NO: 271258 - DNA, 16 bp, Homo sapiens
tgataatacccacatt

SEQ ID NO: 271259 - DNA, 22 bp, Homo sapiens
tgataatcaattattacattta

SEQ ID NO: 271260 - DNA, 21 bp, Homo sapiens
tgataatgttgtggtttgttg

SEQ ID NO: 271261 - DNA, 20 bp, Homo sapiens
tgatacatttatcttctgtt

SEQ ID NO: 271262 - DNA, 22 bp, Homo sapiens
tgatacatttatcttctgtttt

SEQ ID NO: 271263 - DNA, 19 bp, Homo sapiens
tgatacgcaacataattaa

SEQ ID NO: 271264 - DNA, 21 bp, Homo sapiens
tgatacttatttataacattg

SEQ ID NO: 271265 - DNA, 15 bp, Homo sapiens
tgatacttttaagag

SEQ ID NO: 271266 - DNA, 19 bp, Homo sapiens
tgatagctacccacagagc

SEQ ID NO: 271267 - DNA, 16 bp, Homo sapiens
tgataggaattcatct

SEQ ID NO: 271268 - DNA, 18 bp, Homo sapiens
tgataggcaaggatgaaa

SEQ ID NO: 271269 - DNA, 16 bp, Homo sapiens
tgatagtgcttcttgt

SEQ ID NO: 271270 - DNA, 19 bp, Homo sapiens
tgatagtgcttcttgtaat

SEQ ID NO: 271271 - DNA, 20 bp, Homo sapiens
tgatagtgcttcttgtaata

SEQ ID NO: 271272 - DNA, 19 bp, Homo sapiens
tgatatacttgagtgtgca

SEQ ID NO: 271273 - DNA, 20 bp, Homo sapiens
tgatatatatgtataatttc

SEQ ID NO: 271274 - DNA, 15 bp, Homo sapiens
tgatatattctttcc

SEQ ID NO: 271275 - DNA, 17 bp, Homo sapiens
tgatatctgaacacata

SEQ ID NO: 271276 - DNA, 19 bp, Homo sapiens
tgatatctgtttgcttcta

SEQ ID NO: 271277 - DNA, 22 bp, Homo sapiens
tgatatgattgtaacatatttc

SEQ ID NO: 271278 - DNA, 19 bp, Homo sapiens
tgatatgcagttttcctta

SEQ ID NO: 271279 - DNA, 12 bp, Homo sapiens
tgatatgcatgt

SEQ ID NO: 271280 - DNA, 13 bp, Homo sapiens
tgatatgcatgta

SEQ ID NO: 271281 - DNA, 15 bp, Homo sapiens
tgatatgtctttaaa

SEQ ID NO: 271282 - DNA, 16 bp, Homo sapiens
tgatatgtctttaaaa

SEQ ID NO: 271283 - DNA, 20 bp, Homo sapiens
tgatatgtctttaaaatgat

SEQ ID NO: 271284 - DNA, 19 bp, Homo sapiens
tgatattcaaacacacagt

SEQ ID NO: 271285 - DNA, 21 bp, Homo sapiens
tgatattccccccacttaaga

SEQ ID NO: 271286 - DNA, 21 bp, Homo sapiens
tgatattgaccatgtgattat

SEQ ID NO: 271287 - DNA, 17 bp, Homo sapiens
tgatattgtatgtacct

SEQ ID NO: 271288 - DNA, 14 bp, Homo sapiens
tgatatttccttca

SEQ ID NO: 271289 - DNA, 23 bp, Homo sapiens
tgatcaaaacctgtgccaggctg

SEQ ID NO: 271290 - DNA, 15 bp, Homo sapiens
tgatcaaattcattt

SEQ ID NO: 271291 - DNA, 17 bp, Homo sapiens
tgatcaaattcattttt

SEQ ID NO: 271292 - DNA, 22 bp, Homo sapiens
tgatcaaattcatttttttcac

SEQ ID NO: 271293 - DNA, 23 bp, Homo sapiens
tgatcaaattcatttttttcact

SEQ ID NO: 271294 - DNA, 16 bp, Homo sapiens
tgatcaagatattaaa

SEQ ID NO: 271295 - DNA, 12 bp, Homo sapiens
tgatcaaggagt

SEQ ID NO: 271296 - DNA, 17 bp, Homo sapiens
tgatcaattaaatgtag

SEQ ID NO: 271297 - DNA, 18 bp, Homo sapiens
tgatcacagatgtgccca

SEQ ID NO: 271298 - DNA, 21 bp, Homo sapiens
tgatcacagatgtgcccagag

SEQ ID NO: 271299 - DNA, 22 bp, Homo sapiens
tgatcacagatgtgcccagagt

SEQ ID NO: 271300 - DNA, 24 bp, Homo sapiens
tgatcacagatgtgcccagagtag

SEQ ID NO: 271301 - DNA, 22 bp, Homo sapiens
tgatcactttatgtctcacagg

SEQ ID NO: 271302 - DNA, 24 bp, Homo sapiens
tgatcactttctgaaattcacaaa

SEQ ID NO: 271303 - DNA, 18 bp, Homo sapiens
tgatcagaccataatgtt

SEQ ID NO: 271304 - DNA, 19 bp, Homo sapiens
tgatcagatcttacaagtt

SEQ ID NO: 271305 - DNA, 16 bp, Homo sapiens
tgatcagctgtttgtc

SEQ ID NO: 271306 - DNA, 18 bp, Homo sapiens
tgatcagctgtttgtcat

SEQ ID NO: 271307 - DNA, 14 bp, Homo sapiens
tgatcatagaattg

SEQ ID NO: 271308 - DNA, 16 bp, Homo sapiens
tgatcatagaattgtg

SEQ ID NO: 271309 - DNA, 14 bp, Homo sapiens
tgatcatctttgct

SEQ ID NO: 271310 - DNA, 16 bp, Homo sapiens
tgatcatctttgctga

SEQ ID NO: 271311 - DNA, 15 bp, Homo sapiens
tgatcatgcaggaac

SEQ ID NO: 271312 - DNA, 16 bp, Homo sapiens
tgatcatgcaggaact

SEQ ID NO: 271313 - DNA, 21 bp, Homo sapiens
tgatcattacatggctgtggt

SEQ ID NO: 271314 - DNA, 20 bp, Homo sapiens
tgatcatttcacaccctttt

SEQ ID NO: 271315 - DNA, 17 bp, Homo sapiens
tgatcattttcccccca

SEQ ID NO: 271316 - DNA, 19 bp, Homo sapiens
tgatcattttccccccact

SEQ ID NO: 271317 - DNA, 20 bp, Homo sapiens
tgatcattttccccccactc

SEQ ID NO: 271318 - DNA, 15 bp, Homo sapiens
tgatccacccacctc

SEQ ID NO: 271319 - DNA, 19 bp, Homo sapiens
tgatccacccacctcagcc

SEQ ID NO: 271320 - DNA, 20 bp, Homo sapiens
tgatccacccacctcagcct

SEQ ID NO: 271321 - DNA, 15 bp, Homo sapiens
tgatccagagcacag

SEQ ID NO: 271322 - DNA, 16 bp, Homo sapiens
tgatccctgatcaagc

SEQ ID NO: 271323 - DNA, 19 bp, Homo sapiens
tgatccgcctacctcagcc

SEQ ID NO: 271324 - DNA, 17 bp, Homo sapiens
tgatcctctattttgtg

SEQ ID NO: 271325 - DNA, 22 bp, Homo sapiens
tgatcctgaacaagaaagagta

SEQ ID NO: 271326 - DNA, 19 bp, Homo sapiens
tgatcgatgttaaacgtca

SEQ ID NO: 271327 - DNA, 23 bp, Homo sapiens
tgatcgccttatttatattcatc

SEQ ID NO: 271328 - DNA, 11 bp, Homo sapiens
tgatctattgc

SEQ ID NO: 271329 - DNA, 21 bp, Homo sapiens
tgatctattgcagatatttga

SEQ ID NO: 271330 - DNA, 15 bp, Homo sapiens
tgatctccgtggctt

SEQ ID NO: 271331 - DNA, 16 bp, Homo sapiens
tgatctcctgacctca

SEQ ID NO: 271332 - DNA, 18 bp, Homo sapiens
tgatctcctgacctcatg

SEQ ID NO: 271333 - DNA, 12 bp, Homo sapiens
tgatctcctggt

SEQ ID NO: 271334 - DNA, 19 bp, Homo sapiens
tgatctcctggtagcatga

SEQ ID NO: 271335 - DNA, 18 bp, Homo sapiens
tgatctctactaccacaa

SEQ ID NO: 271336 - DNA, 20 bp, Homo sapiens
tgatctctactaccacaagg

SEQ ID NO: 271337 - DNA, 21 bp, Homo sapiens
tgatctctactaccacaagga

SEQ ID NO: 271338 - DNA, 17 bp, Homo sapiens
tgatctctcgtgattga

SEQ ID NO: 271339 - DNA, 12 bp, Homo sapiens
tgatctcttagg

SEQ ID NO: 271340 - DNA, 16 bp, Homo sapiens
tgatctgggaactccc

SEQ ID NO: 271341 - DNA, 22 bp, Homo sapiens
tgatctgggaactcccaagaac

SEQ ID NO: 271342 - DNA, 18 bp, Homo sapiens
tgatctggtgcgtgtggc

SEQ ID NO: 271343 - DNA, 22 bp, Homo sapiens
tgatctggtgcgtgtggccctg

SEQ ID NO: 271344 - DNA, 18 bp, Homo sapiens
tgatcttgtgctcagcat

SEQ ID NO: 271345 - DNA, 22 bp, Homo sapiens
tgatgaaactcctgattttgta

SEQ ID NO: 271346 - DNA, 15 bp, Homo sapiens
tgatgaactttctct

SEQ ID NO: 271347 - DNA, 18 bp, Homo sapiens
tgatgaagaaaagtgggc

SEQ ID NO: 271348 - DNA, 17 bp, Homo sapiens
tgatgaagggaggaggt

SEQ ID NO: 271349 - DNA, 16 bp, Homo sapiens
tgatgaataaacactt

SEQ ID NO: 271350 - DNA, 15 bp, Homo sapiens
tgatgaatgaggaac

SEQ ID NO: 271351 - DNA, 17 bp, Homo sapiens
tgatgaccaatctctgt

SEQ ID NO: 271352 - DNA, 18 bp, Homo sapiens
tgatgaccaatctctgtg

SEQ ID NO: 271353 - DNA, 14 bp, Homo sapiens
tgatgagacaacac

SEQ ID NO: 271354 - DNA, 19 bp, Homo sapiens
tgatgagacaacacacaca

SEQ ID NO: 271355 - DNA, 17 bp, Homo sapiens
tgatgagcactcctgat

SEQ ID NO: 271356 - DNA, 15 bp, Homo sapiens
tgatgagctgaaaag

SEQ ID NO: 271357 - DNA, 18 bp, Homo sapiens
tgatgataatacccacat

SEQ ID NO: 271358 - DNA, 22 bp, Homo sapiens
tgatgatagacttcgaaaacag

SEQ ID NO: 271359 - DNA, 21 bp, Homo sapiens
tgatgatcaaggagtgaagta

SEQ ID NO: 271360 - DNA, 21 bp, Homo sapiens
tgatgatcagctgtttgtcat

SEQ ID NO: 271361 - DNA, 15 bp, Homo sapiens
tgatgatgataatga

SEQ ID NO: 271362 - DNA, 14 bp, Homo sapiens
tgatgatgtctctt

SEQ ID NO: 271363 - DNA, 19 bp, Homo sapiens
tgatgatgtctcttgtaga

SEQ ID NO: 271364 - DNA, 22 bp, Homo sapiens
tgatgattaaacacctgacaca

SEQ ID NO: 271365 - DNA, 15 bp, Homo sapiens
tgatgatttcagaaa

SEQ ID NO: 271366 - DNA, 22 bp, Homo sapiens
tgatgcacttattttttaatgt

SEQ ID NO: 271367 - DNA, 22 bp, Homo sapiens
tgatgcatcgttttctttgctg

SEQ ID NO: 271368 - DNA, 15 bp, Homo sapiens
tgatgcatgagctcc

SEQ ID NO: 271369 - DNA, 18 bp, Homo sapiens
tgatgccacacagagtgg

SEQ ID NO: 271370 - DNA, 21 bp, Homo sapiens
tgatgccagctgtactgagtt

SEQ ID NO: 271371 - DNA, 22 bp, Homo sapiens
tgatgccatttgtcttttgtaa

SEQ ID NO: 271372 - DNA, 15 bp, Homo sapiens
tgatgcctgacacag

SEQ ID NO: 271373 - DNA, 21 bp, Homo sapiens
tgatgcctgacacaggggaca

SEQ ID NO: 271374 - DNA, 18 bp, Homo sapiens
tgatgcgtctacccagac

SEQ ID NO: 271375 - DNA, 20 bp, Homo sapiens
tgatgcgtctacccagactc

SEQ ID NO: 271376 - DNA, 16 bp, Homo sapiens
tgatgctaaataggag

SEQ ID NO: 271377 - DNA, 14 bp, Homo sapiens
tgatgctccctccc

SEQ ID NO: 271378 - DNA, 15 bp, Homo sapiens
tgatgctccctcccc

SEQ ID NO: 271379 - DNA, 21 bp, Homo sapiens
tgatgctccctcccctgccct

SEQ ID NO: 271380 - DNA, 23 bp, Homo sapiens
tgatgctccctcccctgccctgg

SEQ ID NO: 271381 - DNA, 21 bp, Homo sapiens
tgatgctgagattcttcaggc

SEQ ID NO: 271382 - DNA, 13 bp, Homo sapiens
tgatgctgccccg

SEQ ID NO: 271383 - DNA, 14 bp, Homo sapiens
tgatgctgtgacaa

SEQ ID NO: 271384 - DNA, 20 bp, Homo sapiens
tgatgctgtgctatgaattt

SEQ ID NO: 271385 - DNA, 19 bp, Homo sapiens
tgatgcttactacagaaag

SEQ ID NO: 271386 - DNA, 21 bp, Homo sapiens
tgatgcttgtaacaagaaaac

SEQ ID NO: 271387 - DNA, 22 bp, Homo sapiens
tgatgcttgtaacaagaaaaca

SEQ ID NO: 271388 - DNA, 18 bp, Homo sapiens
tgatggaaatatttattt

SEQ ID NO: 271389 - DNA, 13 bp, Homo sapiens
tgatggaacacac

SEQ ID NO: 271390 - DNA, 14 bp, Homo sapiens
tgatggaacacaca

SEQ ID NO: 271391 - DNA, 22 bp, Homo sapiens
tgatggaccgggtgggcctggc

SEQ ID NO: 271392 - DNA, 18 bp, Homo sapiens
tgatggagaaggaaaagg

SEQ ID NO: 271393 - DNA, 22 bp, Homo sapiens
tgatggagaaggaaaaggctgg

SEQ ID NO: 271394 - DNA, 15 bp, Homo sapiens
tgatggagaggagaa

SEQ ID NO: 271395 - DNA, 15 bp, Homo sapiens
tgatggcattactct

SEQ ID NO: 271396 - DNA, 16 bp, Homo sapiens
tgatggcattactctg

SEQ ID NO: 271397 - DNA, 15 bp, Homo sapiens
tgatggccaagagca

SEQ ID NO: 271398 - DNA, 17 bp, Homo sapiens
tgatggccaagagcatc

SEQ ID NO: 271399 - DNA, 15 bp, Homo sapiens
tgatggccaaggggg

SEQ ID NO: 271400 - DNA, 12 bp, Homo sapiens
tgatggcttgac

SEQ ID NO: 271401 - DNA, 11 bp, Homo sapiens
tgatgggagta

SEQ ID NO: 271402 - DNA, 18 bp, Homo sapiens
tgatgggccttcagatta

SEQ ID NO: 271403 - DNA, 13 bp, Homo sapiens
tgatgggtcctgc

SEQ ID NO: 271404 - DNA, 15 bp, Homo sapiens
tgatggtcagctccc

SEQ ID NO: 271405 - DNA, 11 bp, Homo sapiens
tgatgtaaaac

SEQ ID NO: 271406 - DNA, 13 bp, Homo sapiens
tgatgtaaaacag

SEQ ID NO: 271407 - DNA, 21 bp, Homo sapiens
tgatgtaaaatcttgtcatgt

SEQ ID NO: 271408 - DNA, 14 bp, Homo sapiens
tgatgtagaaagat

SEQ ID NO: 271409 - DNA, 15 bp, Homo sapiens
tgatgtatatgttta

SEQ ID NO: 271410 - DNA, 16 bp, Homo sapiens
tgatgtatatgtttat

SEQ ID NO: 271411 - DNA, 21 bp, Homo sapiens
tgatgtattagtagagcaacc

SEQ ID NO: 271412 - DNA, 20 bp, Homo sapiens
tgatgtattctagctaatgt

SEQ ID NO: 271413 - DNA, 13 bp, Homo sapiens
tgatgtcagcctt

SEQ ID NO: 271414 - DNA, 15 bp, Homo sapiens
tgatgtcagccttgc

SEQ ID NO: 271415 - DNA, 16 bp, Homo sapiens
tgatgtcagccttgca

SEQ ID NO: 271416 - DNA, 17 bp, Homo sapiens
tgatgtcagccttgcat

SEQ ID NO: 271417 - DNA, 18 bp, Homo sapiens
tgatgtcagccttgcatc

SEQ ID NO: 271418 - DNA, 12 bp, Homo sapiens
tgatgtccagaa

SEQ ID NO: 271419 - DNA, 21 bp, Homo sapiens
tgatgtcctgtaaacactcag

SEQ ID NO: 271420 - DNA, 17 bp, Homo sapiens
tgatgtctagataacat

SEQ ID NO: 271421 - DNA, 18 bp, Homo sapiens
tgatgtctagataacatt

SEQ ID NO: 271422 - DNA, 18 bp, Homo sapiens
agcgagctgctctgctat

SEQ ID NO: 271423 - DNA, 15 bp, Homo sapiens
agcgaggcagaatgg

SEQ ID NO: 271424 - DNA, 19 bp, Homo sapiens
agcgaggcagaatggtggg

SEQ ID NO: 271425 - DNA, 18 bp, Homo sapiens
agcgaggcgaggctgcct

SEQ ID NO: 271426 - DNA, 21 bp, Homo sapiens
agcgaggcgaggctgcctctg

SEQ ID NO: 271427 - DNA, 24 bp, Homo sapiens
agcgaggctgagcctacagatgaa

SEQ ID NO: 271428 - DNA, 18 bp, Homo sapiens
agcgagtctggagaccag

SEQ ID NO: 271429 - DNA, 21 bp, Homo sapiens
agcgagtctggagaccaggac

SEQ ID NO: 271430 - DNA, 13 bp, Homo sapiens
agcgccacccagt

SEQ ID NO: 271431 - DNA, 11 bp, Homo sapiens
agcgcccctcc

SEQ ID NO: 271432 - DNA, 14 bp, Homo sapiens
agcgcccgctgggc

SEQ ID NO: 271433 - DNA, 15 bp, Homo sapiens
agcgcccgctgggct

SEQ ID NO: 271434 - DNA, 17 bp, Homo sapiens
agcgcctcccgccgcct

SEQ ID NO: 271435 - DNA, 20 bp, Homo sapiens
agcgcctgtgctgaggactc

SEQ ID NO: 271436 - DNA, 16 bp, Homo sapiens
agcgcgggagagagtg

SEQ ID NO: 271437 - DNA, 15 bp, Homo sapiens
agcgcgtgccttccc

SEQ ID NO: 271438 - DNA, 16 bp, Homo sapiens
agcgctcctctgcctt

SEQ ID NO: 271439 - DNA, 20 bp, Homo sapiens
agcgctctcttccagaagat

SEQ ID NO: 271440 - DNA, 16 bp, Homo sapiens
agcgctgcccacacca

SEQ ID NO: 271441 - DNA, 19 bp, Homo sapiens
agcgctgcccacaccaccg

SEQ ID NO: 271442 - DNA, 18 bp, Homo sapiens
agcggcccctcccacaca

SEQ ID NO: 271443 - DNA, 17 bp, Homo sapiens
agcggccgcctgtcctt

SEQ ID NO: 271444 - DNA, 20 bp, Homo sapiens
agcggctgaggacggggcag

SEQ ID NO: 271445 - DNA, 21 bp, Homo sapiens
agcggctgaggacggggcaga

SEQ ID NO: 271446 - DNA, 11 bp, Homo sapiens
agcgggcaggg

SEQ ID NO: 271447 - DNA, 17 bp, Homo sapiens
agcgggcgctgctggga

SEQ ID NO: 271448 - DNA, 13 bp, Homo sapiens
agcgggggctaac

SEQ ID NO: 271449 - DNA, 15 bp, Homo sapiens
agcgggtaaaaagag

SEQ ID NO: 271450 - DNA, 11 bp, Homo sapiens
agcgggtgggg

SEQ ID NO: 271451 - DNA, 20 bp, Homo sapiens
agcggtggaaggagcctgcg

SEQ ID NO: 271452 - DNA, 22 bp, Homo sapiens
agcggtggaaggagcctgcggc

SEQ ID NO: 271453 - DNA, 23 bp, Homo sapiens
agcgtagctaagtgaaaaggtca

SEQ ID NO: 271454 - DNA, 21 bp, Homo sapiens
agcgtcagcgggcgctgctgg

SEQ ID NO: 271455 - DNA, 13 bp, Homo sapiens
agcgtcccagtct

SEQ ID NO: 271456 - DNA, 19 bp, Homo sapiens
agcgtcccagtctctggca

SEQ ID NO: 271457 - DNA, 13 bp, Homo sapiens
agcgtcctgagga

SEQ ID NO: 271458 - DNA, 14 bp, Homo sapiens
agcgtcctgaggaa

SEQ ID NO: 271459 - DNA, 15 bp, Homo sapiens
agcgtcctgaggaat

SEQ ID NO: 271460 - DNA, 21 bp, Homo sapiens
agcgtgcagtagagagcaaag

SEQ ID NO: 271461 - DNA, 23 bp, Homo sapiens
agcgtgtctgtatttatgtgtga

SEQ ID NO: 271462 - DNA, 18 bp, Homo sapiens
agcgttcctggccttctg

SEQ ID NO: 271463 - DNA, 14 bp, Homo sapiens
agcgttctggactc

SEQ ID NO: 271464 - DNA, 17 bp, Homo sapiens
agcgttcttcaggagat

SEQ ID NO: 271465 - DNA, 19 bp, Homo sapiens
agcgttggaattaaaacaa

SEQ ID NO: 271466 - DNA, 20 bp, Homo sapiens
agctaaaatgattttatctg

SEQ ID NO: 271467 - DNA, 15 bp, Homo sapiens
agctaaagaggtggg

SEQ ID NO: 271468 - DNA, 16 bp, Homo sapiens
agctaacactggcccc

SEQ ID NO: 271469 - DNA, 19 bp, Homo sapiens
agctaacatggaagtacta

SEQ ID NO: 271470 - DNA, 15 bp, Homo sapiens
agctaagcctgatga

SEQ ID NO: 271471 - DNA, 17 bp, Homo sapiens
agctaagcctgatgatg

SEQ ID NO: 271472 - DNA, 17 bp, Homo sapiens
agctaagctcaaatgta

SEQ ID NO: 271473 - DNA, 19 bp, Homo sapiens
agctaataaaatatcattc

SEQ ID NO: 271474 - DNA, 16 bp, Homo sapiens
agctaatcagcattct

SEQ ID NO: 271475 - DNA, 23 bp, Homo sapiens
agctaatgtaataactgtgaagt

SEQ ID NO: 271476 - DNA, 17 bp, Homo sapiens
agctaattaggaagctt

SEQ ID NO: 271477 - DNA, 19 bp, Homo sapiens
agctacactcgccttctgc

SEQ ID NO: 271478 - DNA, 19 bp, Homo sapiens
agctacatgggaggctgag

SEQ ID NO: 271479 - DNA, 12 bp, Homo sapiens
agctacattcct

SEQ ID NO: 271480 - DNA, 17 bp, Homo sapiens
agctacattcctcagct

SEQ ID NO: 271481 - DNA, 20 bp, Homo sapiens
agctacattcctcagctgcc

SEQ ID NO: 271482 - DNA, 12 bp, Homo sapiens
agctacctgaga

SEQ ID NO: 271483 - DNA, 17 bp, Homo sapiens
agctactaacctggaga

SEQ ID NO: 271484 - DNA, 19 bp, Homo sapiens
agctactaacctggagaca

SEQ ID NO: 271485 - DNA, 20 bp, Homo sapiens
agctactaacctggagacag

SEQ ID NO: 271486 - DNA, 13 bp, Homo sapiens
agctactaatgat

SEQ ID NO: 271487 - DNA, 18 bp, Homo sapiens
agctactaatgatgtttt

SEQ ID NO: 271488 - DNA, 15 bp, Homo sapiens
agctactatatgcat

SEQ ID NO: 271489 - DNA, 13 bp, Homo sapiens
agctactctcttg

SEQ ID NO: 271490 - DNA, 19 bp, Homo sapiens
agctactctcttgccagca

SEQ ID NO: 271491 - DNA, 12 bp, Homo sapiens
agctactctgtc

SEQ ID NO: 271492 - DNA, 23 bp, Homo sapiens
agctactgatttcctttggagct

SEQ ID NO: 271493 - DNA, 19 bp, Homo sapiens
agctactgcggaaaaggaa

SEQ ID NO: 271494 - DNA, 22 bp, Homo sapiens
agctacttgggaagctgaggcg

SEQ ID NO: 271495 - DNA, 21 bp, Homo sapiens
agctagaaagtggcagagcca

SEQ ID NO: 271496 - DNA, 21 bp, Homo sapiens
agctagacaaaggcccagaaa

SEQ ID NO: 271497 - DNA, 18 bp, Homo sapiens
agctagacgagcaggctt

SEQ ID NO: 271498 - DNA, 15 bp, Homo sapiens
agctagactggagtg

SEQ ID NO: 271499 - DNA, 17 bp, Homo sapiens
agctagactggagtgag

SEQ ID NO: 271500 - DNA, 22 bp, Homo sapiens
agctagaggagattgctctggg

SEQ ID NO: 271501 - DNA, 16 bp, Homo sapiens
agctagctatttctat

SEQ ID NO: 271502 - DNA, 19 bp, Homo sapiens
agctagctatttctatgta

SEQ ID NO: 271503 - DNA, 22 bp, Homo sapiens
agctaggaaagagttgagcaca

SEQ ID NO: 271504 - DNA, 16 bp, Homo sapiens
agctaggaaaggcaga

SEQ ID NO: 271505 - DNA, 22 bp, Homo sapiens
agctagtatcttcaaactttca

SEQ ID NO: 271506 - DNA, 19 bp, Homo sapiens
agctagtggcttcaaaata

SEQ ID NO: 271507 - DNA, 17 bp, Homo sapiens
agctagttaataattct

SEQ ID NO: 271508 - DNA, 19 bp, Homo sapiens
agctagtttaaaattatta

SEQ ID NO: 271509 - DNA, 20 bp, Homo sapiens
agctagtttaaaattattaa

SEQ ID NO: 271510 - DNA, 12 bp, Homo sapiens
agctagttttct

SEQ ID NO: 271511 - DNA, 18 bp, Homo sapiens
agctataacaactctatt

SEQ ID NO: 271512 - DNA, 17 bp, Homo sapiens
agctatatccatgtact

SEQ ID NO: 271513 - DNA, 20 bp, Homo sapiens
agctatatccatgtactgta

SEQ ID NO: 271514 - DNA, 17 bp, Homo sapiens
agctatcaagtgtgctt

SEQ ID NO: 271515 - DNA, 14 bp, Homo sapiens
agctatcaggaaca

SEQ ID NO: 271516 - DNA, 13 bp, Homo sapiens
agctatgagaata

SEQ ID NO: 271517 - DNA, 15 bp, Homo sapiens
agctatgagaataac

SEQ ID NO: 271518 - DNA, 20 bp, Homo sapiens
agctatgagagatgtgtcca

SEQ ID NO: 271519 - DNA, 16 bp, Homo sapiens
agctatgcacaccaaa

SEQ ID NO: 271520 - DNA, 17 bp, Homo sapiens
agctatgggagccccag

SEQ ID NO: 271521 - DNA, 13 bp, Homo sapiens
agctatggtgagg

SEQ ID NO: 271522 - DNA, 17 bp, Homo sapiens
agctattctttgaccaa

SEQ ID NO: 271523 - DNA, 13 bp, Homo sapiens
agctcaaatgtat

SEQ ID NO: 271524 - DNA, 22 bp, Homo sapiens
agctcaaatgtatatttaactt

SEQ ID NO: 271525 - DNA, 15 bp, Homo sapiens
agctcaaggctgcag

SEQ ID NO: 271526 - DNA, 17 bp, Homo sapiens
agctcacccctgggcag

SEQ ID NO: 271527 - DNA, 15 bp, Homo sapiens
agctcacctctgaag

SEQ ID NO: 271528 - DNA, 22 bp, Homo sapiens
agctcagagcagcctctgtcct

SEQ ID NO: 271529 - DNA, 14 bp, Homo sapiens
agctcagcacagcc

SEQ ID NO: 271530 - DNA, 11 bp, Homo sapiens
agctcagccca

SEQ ID NO: 271531 - DNA, 20 bp, Homo sapiens
agctcagcccacccccctca

SEQ ID NO: 271532 - DNA, 17 bp, Homo sapiens
agctcagccccagccca

SEQ ID NO: 271533 - DNA, 18 bp, Homo sapiens
agctcagccccagcccag

SEQ ID NO: 271534 - DNA, 20 bp, Homo sapiens
agctcagccccagcccagcc

SEQ ID NO: 271535 - DNA, 17 bp, Homo sapiens
agctcagccccggccac

SEQ ID NO: 271536 - DNA, 18 bp, Homo sapiens
agctcagccccggccact

SEQ ID NO: 271537 - DNA, 21 bp, Homo sapiens
agctcagctactgatttttgt

SEQ ID NO: 271538 - DNA, 12 bp, Homo sapiens
agctcaggagaa

SEQ ID NO: 271539 - DNA, 18 bp, Homo sapiens
agctcaggagaaggcctg

SEQ ID NO: 271540 - DNA, 21 bp, Homo sapiens
agctcaggagaaggcctgccc

SEQ ID NO: 271541 - DNA, 18 bp, Homo sapiens
agctcaggcgcagcccta

SEQ ID NO: 271542 - DNA, 22 bp, Homo sapiens
agctcagggtgctccctcctca

SEQ ID NO: 271543 - DNA, 23 bp, Homo sapiens
agctcagggtgctccctcctcag

SEQ ID NO: 271544 - DNA, 17 bp, Homo sapiens
agctcagtttggctgta

SEQ ID NO: 271545 - DNA, 23 bp, Homo sapiens
agctcagtttggctgtaatttaa

SEQ ID NO: 271546 - DNA, 14 bp, Homo sapiens
agctcatattttgt

SEQ ID NO: 271547 - DNA, 23 bp, Homo sapiens
agctcatctccaaggatcctctc

SEQ ID NO: 271548 - DNA, 17 bp, Homo sapiens
agctccaccctcccctc

SEQ ID NO: 271549 - DNA, 21 bp, Homo sapiens
agctccacggtgcgtggctgt

SEQ ID NO: 271550 - DNA, 23 bp, Homo sapiens
agctccacggtgcgtggctgtgg

SEQ ID NO: 271551 - DNA, 13 bp, Homo sapiens
agctccactcagg

SEQ ID NO: 271552 - DNA, 15 bp, Homo sapiens
agctccactcagggc

SEQ ID NO: 271553 - DNA, 16 bp, Homo sapiens
agctccactcagggct

SEQ ID NO: 271554 - DNA, 23 bp, Homo sapiens
agctccactcagggctggcccgg

SEQ ID NO: 271555 - DNA, 16 bp, Homo sapiens
tgatgtctcttgtaga

SEQ ID NO: 271556 - DNA, 15 bp, Homo sapiens
tgatgtctgcaaagg

SEQ ID NO: 271557 - DNA, 19 bp, Homo sapiens
tgatgtcttgagagcgctg

SEQ ID NO: 271558 - DNA, 22 bp, Homo sapiens
tgatgtcttgagagcgctggcc

SEQ ID NO: 271559 - DNA, 20 bp, Homo sapiens
tgatgtgaagataatttgca

SEQ ID NO: 271560 - DNA, 13 bp, Homo sapiens
tgatgtgatttat

SEQ ID NO: 271561 - DNA, 15 bp, Homo sapiens
tgatgtgcgtgctgt

SEQ ID NO: 271562 - DNA, 22 bp, Homo sapiens
tgatgtgcgtgctgtctgtcct

SEQ ID NO: 271563 - DNA, 17 bp, Homo sapiens
tgatgtggagtggggca

SEQ ID NO: 271564 - DNA, 13 bp, Homo sapiens
tgatgtggatgaa

SEQ ID NO: 271565 - DNA, 16 bp, Homo sapiens
tgatgtgttatctctt

SEQ ID NO: 271566 - DNA, 18 bp, Homo sapiens
tgatgtgtttatttatag

SEQ ID NO: 271567 - DNA, 14 bp, Homo sapiens
tgatgttaaaattc

SEQ ID NO: 271568 - DNA, 20 bp, Homo sapiens
tgatgttctttcaccctttt

SEQ ID NO: 271569 - DNA, 17 bp, Homo sapiens
tgatgttgggaagctat

SEQ ID NO: 271570 - DNA, 13 bp, Homo sapiens
tgatgtttgtcct

SEQ ID NO: 271571 - DNA, 16 bp, Homo sapiens
tgatgtttgtggcctc

SEQ ID NO: 271572 - DNA, 20 bp, Homo sapiens
tgatgtttgtggcctcagaa

SEQ ID NO: 271573 - DNA, 12 bp, Homo sapiens
tgattaaacacc

SEQ ID NO: 271574 - DNA, 15 bp, Homo sapiens
tgattaaacacctga

SEQ ID NO: 271575 - DNA, 17 bp, Homo sapiens
tgattaaacacctgaca

SEQ ID NO: 271576 - DNA, 19 bp, Homo sapiens
tgattaaacacctgacaca

SEQ ID NO: 271577 - DNA, 14 bp, Homo sapiens
tgattaaactgtat

SEQ ID NO: 271578 - DNA, 12 bp, Homo sapiens
tgattaaatatt

SEQ ID NO: 271579 - DNA, 18 bp, Homo sapiens
tgattaaatttaatatac

SEQ ID NO: 271580 - DNA, 21 bp, Homo sapiens
tgattaactgtgaataataaa

SEQ ID NO: 271581 - DNA, 13 bp, Homo sapiens
tgattaagatttt

SEQ ID NO: 271582 - DNA, 12 bp, Homo sapiens
tgattaagtata

SEQ ID NO: 271583 - DNA, 13 bp, Homo sapiens
tgattaagtatat

SEQ ID NO: 271584 - DNA, 15 bp, Homo sapiens
tgattaatgtttctt

SEQ ID NO: 271585 - DNA, 16 bp, Homo sapiens
tgattactgtcaataa

SEQ ID NO: 271586 - DNA, 17 bp, Homo sapiens
tgattactgtcaataaa

SEQ ID NO: 271587 - DNA, 18 bp, Homo sapiens
tgattactgtcaataaac

SEQ ID NO: 271588 - DNA, 23 bp, Homo sapiens
tgattactgtcaataaacagctt

SEQ ID NO: 271589 - DNA, 13 bp, Homo sapiens
tgattagcaagtt

SEQ ID NO: 271590 - DNA, 18 bp, Homo sapiens
tgattagcaagttacagt

SEQ ID NO: 271591 - DNA, 12 bp, Homo sapiens
tgattagcagtt

SEQ ID NO: 271592 - DNA, 11 bp, Homo sapiens
tgattatcagg

SEQ ID NO: 271593 - DNA, 22 bp, Homo sapiens
tgattatggacatcgatatgaa

SEQ ID NO: 271594 - DNA, 13 bp, Homo sapiens
tgattattgaatg

SEQ ID NO: 271595 - DNA, 20 bp, Homo sapiens
tgattcaataaaatgcactg

SEQ ID NO: 271596 - DNA, 16 bp, Homo sapiens
tgattcactattagag

SEQ ID NO: 271597 - DNA, 12 bp, Homo sapiens
tgattcataaca

SEQ ID NO: 271598 - DNA, 13 bp, Homo sapiens
tgattcataacaa

SEQ ID NO: 271599 - DNA, 17 bp, Homo sapiens
tgattcataacaatgta

SEQ ID NO: 271600 - DNA, 15 bp, Homo sapiens
tgattcataatgact

SEQ ID NO: 271601 - DNA, 16 bp, Homo sapiens
tgattcataatgactt

SEQ ID NO: 271602 - DNA, 11 bp, Homo sapiens
tgattccaaat

SEQ ID NO: 271603 - DNA, 16 bp, Homo sapiens
tgattccaaataaaac

SEQ ID NO: 271604 - DNA, 15 bp, Homo sapiens
tgattccaagggccc

SEQ ID NO: 271605 - DNA, 14 bp, Homo sapiens
tgattcccagagca

SEQ ID NO: 271606 - DNA, 17 bp, Homo sapiens
tgattccccggagctgg

SEQ ID NO: 271607 - DNA, 16 bp, Homo sapiens
tgattctcctctccca

SEQ ID NO: 271608 - DNA, 19 bp, Homo sapiens
tgattctgtcccccacgtg

SEQ ID NO: 271609 - DNA, 13 bp, Homo sapiens
tgattctgttcta

SEQ ID NO: 271610 - DNA, 22 bp, Homo sapiens
tgattctttcaatccacagtat

SEQ ID NO: 271611 - DNA, 19 bp, Homo sapiens
tgattctttgttacaggca

SEQ ID NO: 271612 - DNA, 17 bp, Homo sapiens
tgattgaaaagaagaaa

SEQ ID NO: 271613 - DNA, 16 bp, Homo sapiens
tgattgagtcagtgtt

SEQ ID NO: 271614 - DNA, 15 bp, Homo sapiens
tgattgatttgaagt

SEQ ID NO: 271615 - DNA, 20 bp, Homo sapiens
tgattgccatttcttcccaa

SEQ ID NO: 271616 - DNA, 19 bp, Homo sapiens
tgattggattattcattta

SEQ ID NO: 271617 - DNA, 21 bp, Homo sapiens
tgattggattattcatttaaa

SEQ ID NO: 271618 - DNA, 19 bp, Homo sapiens
tgattggcagcttcaaaac

SEQ ID NO: 271619 - DNA, 22 bp, Homo sapiens
tgattggcagcttcaaaacaga

SEQ ID NO: 271620 - DNA, 19 bp, Homo sapiens
tgattggtgcaacccttac

SEQ ID NO: 271621 - DNA, 12 bp, Homo sapiens
tgattgtaaaat

SEQ ID NO: 271622 - DNA, 13 bp, Homo sapiens
tgattgttttatt

SEQ ID NO: 271623 - DNA, 13 bp, Homo sapiens
tgatttaaacttc

SEQ ID NO: 271624 - DNA, 18 bp, Homo sapiens
tgatttaaatagaacttg

SEQ ID NO: 271625 - DNA, 14 bp, Homo sapiens
tgatttaagcattt

SEQ ID NO: 271626 - DNA, 21 bp, Homo sapiens
tgatttagaactgtatgtcag

SEQ ID NO: 271627 - DNA, 22 bp, Homo sapiens
tgatttataaagatttttgtta

SEQ ID NO: 271628 - DNA, 22 bp, Homo sapiens
tgatttatagtttgtacatgca

SEQ ID NO: 271629 - DNA, 13 bp, Homo sapiens
tgatttatgcatg

SEQ ID NO: 271630 - DNA, 13 bp, Homo sapiens
tgatttatttgga

SEQ ID NO: 271631 - DNA, 22 bp, Homo sapiens
tgatttatttggagtggaggca

SEQ ID NO: 271632 - DNA, 20 bp, Homo sapiens
tgatttcaaggtccgagctc

SEQ ID NO: 271633 - DNA, 18 bp, Homo sapiens
tgatttcatgattagaca

SEQ ID NO: 271634 - DNA, 12 bp, Homo sapiens
tgatttccaggc

SEQ ID NO: 271635 - DNA, 20 bp, Homo sapiens
tgatttccaggcccctgagg

SEQ ID NO: 271636 - DNA, 22 bp, Homo sapiens
tgatttccatttctgatgtctc

SEQ ID NO: 271637 - DNA, 22 bp, Homo sapiens
tgatttcgatgtacagtctcaa

SEQ ID NO: 271638 - DNA, 16 bp, Homo sapiens
tgatttctacaactga

SEQ ID NO: 271639 - DNA, 17 bp, Homo sapiens
tgatttctacaactgat

SEQ ID NO: 271640 - DNA, 14 bp, Homo sapiens
tgatttctattcaa

SEQ ID NO: 271641 - DNA, 20 bp, Homo sapiens
tgatttctattcaaggtggc

SEQ ID NO: 271642 - DNA, 16 bp, Homo sapiens
tgatttgcatggattt

SEQ ID NO: 271643 - DNA, 15 bp, Homo sapiens
tgatttgctgttttc

SEQ ID NO: 271644 - DNA, 15 bp, Homo sapiens
tgatttgtaatatga

SEQ ID NO: 271645 - DNA, 22 bp, Homo sapiens
tgattttaaatgcaaattaaag

SEQ ID NO: 271646 - DNA, 19 bp, Homo sapiens
tgattttaacaataactac

SEQ ID NO: 271647 - DNA, 15 bp, Homo sapiens
tgattttatatccac

SEQ ID NO: 271648 - DNA, 19 bp, Homo sapiens
tgattttcatcaatttaaa

SEQ ID NO: 271649 - DNA, 12 bp, Homo sapiens
tgattttgcttt

SEQ ID NO: 271650 - DNA, 20 bp, Homo sapiens
tgatttttaaagtttaaata

SEQ ID NO: 271651 - DNA, 13 bp, Homo sapiens
tgatttttatcta

SEQ ID NO: 271652 - DNA, 12 bp, Homo sapiens
tgatttttgtgt

SEQ ID NO: 271653 - DNA, 20 bp, Homo sapiens
tgatttttgtgtatccagta

SEQ ID NO: 271654 - DNA, 22 bp, Homo sapiens
tgatttttttttagaacagaaa

SEQ ID NO: 271655 - DNA, 23 bp, Homo sapiens
tgatttttttttagaacagaaaa

SEQ ID NO: 271656 - DNA, 12 bp, Homo sapiens
tgcaaaaagata

SEQ ID NO: 271657 - DNA, 18 bp, Homo sapiens
tgcaaaagaagttgatct

SEQ ID NO: 271658 - DNA, 23 bp, Homo sapiens
tgcaaaaggttcactaaagcagt

SEQ ID NO: 271659 - DNA, 14 bp, Homo sapiens
tgcaaaatgtctgt

SEQ ID NO: 271660 - DNA, 15 bp, Homo sapiens
tgcaaaatttccagt

SEQ ID NO: 271661 - DNA, 16 bp, Homo sapiens
tgcaaaatttccagta

SEQ ID NO: 271662 - DNA, 14 bp, Homo sapiens
tgcaaacatttctt

SEQ ID NO: 271663 - DNA, 14 bp, Homo sapiens
tgcaaagaaaagaa

SEQ ID NO: 271664 - DNA, 19 bp, Homo sapiens
tgcaaagatgattttgctt

SEQ ID NO: 271665 - DNA, 17 bp, Homo sapiens
tgcaaagattgcctctt

SEQ ID NO: 271666 - DNA, 18 bp, Homo sapiens
tgcaaagattgcctcttg

SEQ ID NO: 271667 - DNA, 15 bp, Homo sapiens
tgcaaagcctttaaa

SEQ ID NO: 271668 - DNA, 15 bp, Homo sapiens
tgcaaaggacagatc

SEQ ID NO: 271669 - DNA, 16 bp, Homo sapiens
tgcaaaggagggcctc

SEQ ID NO: 271670 - DNA, 23 bp, Homo sapiens
tgcaaaggagggcctcagagaca

SEQ ID NO: 271671 - DNA, 22 bp, Homo sapiens
tgcaaagtgttttctcagaaca

SEQ ID NO: 271672 - DNA, 16 bp, Homo sapiens
tgcaaataagactctt

SEQ ID NO: 271673 - DNA, 21 bp, Homo sapiens
tgcaaataagactcttaccta

SEQ ID NO: 271674 - DNA, 15 bp, Homo sapiens
tgcaaatgcacattt

SEQ ID NO: 271675 - DNA, 21 bp, Homo sapiens
tgcaaattagggctacattgt

SEQ ID NO: 271676 - DNA, 16 bp, Homo sapiens
tgcaaattattctagt

SEQ ID NO: 271677 - DNA, 12 bp, Homo sapiens
tgcaacacacag

SEQ ID NO: 271678 - DNA, 14 bp, Homo sapiens
tgcaacagcactgg

SEQ ID NO: 271679 - DNA, 24 bp, Homo sapiens
tgcaacagcactggctctctccag

SEQ ID NO: 271680 - DNA, 11 bp, Homo sapiens
tgcaaccactg

SEQ ID NO: 271681 - DNA, 13 bp, Homo sapiens
tgcaaccactgca

SEQ ID NO: 271682 - DNA, 14 bp, Homo sapiens
tgcaacctctgcct

SEQ ID NO: 271683 - DNA, 15 bp, Homo sapiens
tgcaaccttttatgt

SEQ ID NO: 271684 - DNA, 18 bp, Homo sapiens
tgcaacggcatgattttg

SEQ ID NO: 271685 - DNA, 16 bp, Homo sapiens
tgcaacggcttagact

SEQ ID NO: 271686 - DNA, 13 bp, Homo sapiens
tgcaactagccaa

SEQ ID NO: 271687 - DNA, 17 bp, Homo sapiens
tgcaactagccaaggct

SEQ ID NO: 271688 - DNA, 15 bp, Homo sapiens
tgcaactccatgcct

SEQ ID NO: 271689 - DNA, 19 bp, Homo sapiens
tgcaactccatgcctattt

SEQ ID NO: 271690 - DNA, 15 bp, Homo sapiens
tgcaactcttgtatt

SEQ ID NO: 271691 - DNA, 14 bp, Homo sapiens
tgcaacttctgcct

SEQ ID NO: 271692 - DNA, 17 bp, Homo sapiens
tgcaagaagaatataaa

SEQ ID NO: 271693 - DNA, 15 bp, Homo sapiens
tgcaagagaaggaga

SEQ ID NO: 271694 - DNA, 22 bp, Homo sapiens
tgcaagagtgggctttccaggg

SEQ ID NO: 271695 - DNA, 18 bp, Homo sapiens
tgcaagccccagggcctg

SEQ ID NO: 271696 - DNA, 21 bp, Homo sapiens
tgcaagccccagggcctgggg

SEQ ID NO: 271697 - DNA, 23 bp, Homo sapiens
tgcaagccccagggcctgggggc

SEQ ID NO: 271698 - DNA, 14 bp, Homo sapiens
tgcaagctgcaggg

SEQ ID NO: 271699 - DNA, 14 bp, Homo sapiens
tgcaaggaaggaaa

SEQ ID NO: 271700 - DNA, 13 bp, Homo sapiens
tgcaaggaccagg

SEQ ID NO: 271701 - DNA, 15 bp, Homo sapiens
tgcaaggaccaggac

SEQ ID NO: 271702 - DNA, 16 bp, Homo sapiens
tgcaaggcccacagga

SEQ ID NO: 271703 - DNA, 18 bp, Homo sapiens
tgcaagggaatgaatcca

SEQ ID NO: 271704 - DNA, 17 bp, Homo sapiens
tgcaaggtgataggaaa

SEQ ID NO: 271705 - DNA, 23 bp, Homo sapiens
tgcaaggtgataggaaaactgaa

SEQ ID NO: 271706 - DNA, 15 bp, Homo sapiens
tgcaagtatgtgagt

SEQ ID NO: 271707 - DNA, 22 bp, Homo sapiens
tgcaagtatgtgagtgtgtcca

SEQ ID NO: 271708 - DNA, 19 bp, Homo sapiens
tgcaagtatgttttagcat

SEQ ID NO: 271709 - DNA, 21 bp, Homo sapiens
tgcaagtcactaaatttctca

SEQ ID NO: 271710 - DNA, 23 bp, Homo sapiens
tgcaagtcactaaatttctcagt

SEQ ID NO: 271711 - DNA, 19 bp, Homo sapiens
tgcaagtccatagctgagc

SEQ ID NO: 271712 - DNA, 23 bp, Homo sapiens
tgcaagtccatagctgagctgga

SEQ ID NO: 271713 - DNA, 16 bp, Homo sapiens
tgcaagtgtttctgtt

SEQ ID NO: 271714 - DNA, 19 bp, Homo sapiens
tgcaataaaaaagtgagct

SEQ ID NO: 271715 - DNA, 23 bp, Homo sapiens
tgcaataacttgtgtattagata

SEQ ID NO: 271716 - DNA, 16 bp, Homo sapiens
tgcaatagagactgta

SEQ ID NO: 271717 - DNA, 22 bp, Homo sapiens
tgcaatctccagggctgcccct

SEQ ID NO: 271718 - DNA, 14 bp, Homo sapiens
tgcaatcttatgtt

SEQ ID NO: 271719 - DNA, 16 bp, Homo sapiens
tgcaatcttatgttga

SEQ ID NO: 271720 - DNA, 16 bp, Homo sapiens
tgcaatgaaaagaaaa

SEQ ID NO: 271721 - DNA, 17 bp, Homo sapiens
tgcaatgacatcttcaa

SEQ ID NO: 271722 - DNA, 18 bp, Homo sapiens
tgcaatggctatatggca

SEQ ID NO: 271723 - DNA, 24 bp, Homo sapiens
tgcaatgtatcccttctcacagca

SEQ ID NO: 271724 - DNA, 21 bp, Homo sapiens
tgcaatgtcttaaataaaact

SEQ ID NO: 271725 - DNA, 12 bp, Homo sapiens
tgcaatgtggaa

SEQ ID NO: 271726 - DNA, 20 bp, Homo sapiens
tgcaatgttccgttcatctg

SEQ ID NO: 271727 - DNA, 21 bp, Homo sapiens
tgcaatgttccgttcatctga

SEQ ID NO: 271728 - DNA, 15 bp, Homo sapiens
tgcaatgttttcctt

SEQ ID NO: 271729 - DNA, 17 bp, Homo sapiens
tgcaatgtttttgtgta

SEQ ID NO: 271730 - DNA, 18 bp, Homo sapiens
tgcaatgtttttgtgtag

SEQ ID NO: 271731 - DNA, 22 bp, Homo sapiens
tgcaattgtaggggtgtgtgtg

SEQ ID NO: 271732 - DNA, 15 bp, Homo sapiens
tgcaatttattaaaa

SEQ ID NO: 271733 - DNA, 16 bp, Homo sapiens
tgcaatttccattctt

SEQ ID NO: 271734 - DNA, 15 bp, Homo sapiens
tgcaatttctcccga

SEQ ID NO: 271735 - DNA, 17 bp, Homo sapiens
tgcaatttgtttaaaga

SEQ ID NO: 271736 - DNA, 14 bp, Homo sapiens
tgcacaagctcaga

SEQ ID NO: 271737 - DNA, 21 bp, Homo sapiens
tgcacacaaacacctcctagc

SEQ ID NO: 271738 - DNA, 15 bp, Homo sapiens
tgcacacacagctcc

SEQ ID NO: 271739 - DNA, 13 bp, Homo sapiens
tgcacacacctgc

SEQ ID NO: 271740 - DNA, 17 bp, Homo sapiens
tgcacacacctgcctgc

SEQ ID NO: 271741 - DNA, 17 bp, Homo sapiens
tgcacacataacacaca

SEQ ID NO: 271742 - DNA, 20 bp, Homo sapiens
tgcacacataacacacatca

SEQ ID NO: 271743 - DNA, 21 bp, Homo sapiens
tgcacacataacacacatcag

SEQ ID NO: 271744 - DNA, 19 bp, Homo sapiens
tgcacaccaaattgctgag

SEQ ID NO: 271745 - DNA, 21 bp, Homo sapiens
tgcacaccaaattgctgagat

SEQ ID NO: 271746 - DNA, 17 bp, Homo sapiens
tgcacaccagttactgt

SEQ ID NO: 271747 - DNA, 18 bp, Homo sapiens
tgcacaccagttactgtt

SEQ ID NO: 271748 - DNA, 15 bp, Homo sapiens
tgcacagacatctcc

SEQ ID NO: 271749 - DNA, 19 bp, Homo sapiens
tgcacagacgtccctccac

SEQ ID NO: 271750 - DNA, 17 bp, Homo sapiens
tgcacagatgccatggc

SEQ ID NO: 271751 - DNA, 23 bp, Homo sapiens
tgcacagatgccatggcctgtgc

SEQ ID NO: 271752 - DNA, 20 bp, Homo sapiens
tgcacagattaaacttcacc

SEQ ID NO: 271753 - DNA, 21 bp, Homo sapiens
tgcacagcccaaccaggaggg

SEQ ID NO: 271754 - DNA, 17 bp, Homo sapiens
tgcacagctaacatgga

SEQ ID NO: 271755 - DNA, 12 bp, Homo sapiens
tgcacaggccac

SEQ ID NO: 271756 - DNA, 21 bp, Homo sapiens
tgcacaggccacttgctcaga

SEQ ID NO: 271757 - DNA, 17 bp, Homo sapiens
tgcacaggggaaggaaa

SEQ ID NO: 271758 - DNA, 17 bp, Homo sapiens
tgcacagtccctcctgt

SEQ ID NO: 271759 - DNA, 20 bp, Homo sapiens
tgcacagtccctcctgttgc

SEQ ID NO: 271760 - DNA, 15 bp, Homo sapiens
tgcacagtgcatctc

SEQ ID NO: 271761 - DNA, 15 bp, Homo sapiens
tgcacagtgctgttg

SEQ ID NO: 271762 - DNA, 17 bp, Homo sapiens
tgcacagtttgctattt

SEQ ID NO: 271763 - DNA, 14 bp, Homo sapiens
tgcacatatacatc

SEQ ID NO: 271764 - DNA, 15 bp, Homo sapiens
tgcacatctctgctt

SEQ ID NO: 271765 - DNA, 14 bp, Homo sapiens
tgcacattcctggc

SEQ ID NO: 271766 - DNA, 17 bp, Homo sapiens
tgcacattttccacgga

SEQ ID NO: 271767 - DNA, 19 bp, Homo sapiens
tgcaccaacctcactgccc

SEQ ID NO: 271768 - DNA, 17 bp, Homo sapiens
tgcaccaagtacagcct

SEQ ID NO: 271769 - DNA, 17 bp, Homo sapiens
tgcaccagcccttccct

SEQ ID NO: 271770 - DNA, 10 bp, Homo sapiens
tgcaccagga

SEQ ID NO: 271771 - DNA, 12 bp, Homo sapiens
tgcaccaggaga

SEQ ID NO: 271772 - DNA, 14 bp, Homo sapiens
tgcaccaggagaca

SEQ ID NO: 271773 - DNA, 23 bp, Homo sapiens
tgcaccattctttcttggtgcat

SEQ ID NO: 271774 - DNA, 18 bp, Homo sapiens
tgcacccacccaggagtg

SEQ ID NO: 271775 - DNA, 15 bp, Homo sapiens
tgcacccacccctgc

SEQ ID NO: 271776 - DNA, 19 bp, Homo sapiens
tgcacccacccctgcccag

SEQ ID NO: 271777 - DNA, 16 bp, Homo sapiens
tgcacccactcaccag

SEQ ID NO: 271778 - DNA, 20 bp, Homo sapiens
tgcacccactcaccagggtc

SEQ ID NO: 271779 - DNA, 21 bp, Homo sapiens
tgcacccactctgctttgact

SEQ ID NO: 271780 - DNA, 23 bp, Homo sapiens
tgcaccccaaagctttcctgccc

SEQ ID NO: 271781 - DNA, 20 bp, Homo sapiens
tgcaccctctgctatgtctg

SEQ ID NO: 271782 - DNA, 18 bp, Homo sapiens
tgcacctcctaccctccc

SEQ ID NO: 271783 - DNA, 16 bp, Homo sapiens
tgcacctctcatcagc

SEQ ID NO: 271784 - DNA, 12 bp, Homo sapiens
tgcacctgtgca

SEQ ID NO: 271785 - DNA, 20 bp, Homo sapiens
tgcaccttaccaactttctg

SEQ ID NO: 271786 - DNA, 23 bp, Homo sapiens
tgcacgaattttaaaacatggca

SEQ ID NO: 271787 - DNA, 17 bp, Homo sapiens
tgcacgcccatgtgtga

SEQ ID NO: 271788 - DNA, 12 bp, Homo sapiens
tgcacgccgtgg

SEQ ID NO: 271789 - DNA, 12 bp, Homo sapiens
tgcacgtggaga

SEQ ID NO: 271790 - DNA, 18 bp, Homo sapiens
tgcacgtggagagctggt

SEQ ID NO: 271791 - DNA, 23 bp, Homo sapiens
tgcacgttaaaaattaaaagaag

SEQ ID NO: 271792 - DNA, 16 bp, Homo sapiens
tgcacgttaacagcgt

SEQ ID NO: 271793 - DNA, 21 bp, Homo sapiens
tgcacgttaacagcgtgtcaa

SEQ ID NO: 271794 - DNA, 15 bp, Homo sapiens
tgcactaaaagtgat

SEQ ID NO: 271795 - DNA, 16 bp, Homo sapiens
tgcactaaaagtgatg

SEQ ID NO: 271796 - DNA, 15 bp, Homo sapiens
tgcactactcctctg

SEQ ID NO: 271797 - DNA, 14 bp, Homo sapiens
tgcactactgacat

SEQ ID NO: 271798 - DNA, 15 bp, Homo sapiens
tgcactactgacatg

SEQ ID NO: 271799 - DNA, 16 bp, Homo sapiens
tgcactactgacatgt

SEQ ID NO: 271800 - DNA, 13 bp, Homo sapiens
tgcactagcattt

SEQ ID NO: 271801 - DNA, 12 bp, Homo sapiens
tgcactcagtgt

SEQ ID NO: 271802 - DNA, 18 bp, Homo sapiens
tgcactccatggccaccc

SEQ ID NO: 271803 - DNA, 15 bp, Homo sapiens
tgcactcgcactgca

SEQ ID NO: 271804 - DNA, 17 bp, Homo sapiens
tgcactcgcactgcaaa

SEQ ID NO: 271805 - DNA, 16 bp, Homo sapiens
tgcactctaacactcg

SEQ ID NO: 271806 - DNA, 13 bp, Homo sapiens
tgcactgaaaacc

SEQ ID NO: 271807 - DNA, 12 bp, Homo sapiens
tgcactgagggc

SEQ ID NO: 271808 - DNA, 14 bp, Homo sapiens
tgcactgagggcca

SEQ ID NO: 271809 - DNA, 16 bp, Homo sapiens
tgcactgcaaatactt

SEQ ID NO: 271810 - DNA, 17 bp, Homo sapiens
tgcactggccccaccct

SEQ ID NO: 271811 - DNA, 12 bp, Homo sapiens
tgcactggcctg

SEQ ID NO: 271812 - DNA, 23 bp, Homo sapiens
tgcactggcctgttctgtaggag

SEQ ID NO: 271813 - DNA, 17 bp, Homo sapiens
tgcactgggggaacaga

SEQ ID NO: 271814 - DNA, 16 bp, Homo sapiens
tgcactgtatccaagt

SEQ ID NO: 271815 - DNA, 15 bp, Homo sapiens
tgcactgtcactttg

SEQ ID NO: 271816 - DNA, 15 bp, Homo sapiens
tgcacttatttttta

SEQ ID NO: 271817 - DNA, 14 bp, Homo sapiens
tgcacttcatatct

SEQ ID NO: 271818 - DNA, 17 bp, Homo sapiens
tgcacttggcctctgga

SEQ ID NO: 271819 - DNA, 22 bp, Homo sapiens
tgcactttagtgtattttctgt

SEQ ID NO: 271820 - DNA, 18 bp, Homo sapiens
tgcactttccctagaaag

SEQ ID NO: 271821 - DNA, 22 bp, Homo sapiens
tgcactttgtgagtattctatg

SEQ ID NO: 271822 - DNA, 19 bp, Homo sapiens
tgcagaacacctggccggg

SEQ ID NO: 271823 - DNA, 19 bp, Homo sapiens
tgcagaacatgagtgctga

SEQ ID NO: 271824 - DNA, 21 bp, Homo sapiens
tgcagaatacagtaagctgct

SEQ ID NO: 271825 - DNA, 16 bp, Homo sapiens
agctccactggcctgc

SEQ ID NO: 271826 - DNA, 23 bp, Homo sapiens
agctccagacccccagcaaccct

SEQ ID NO: 271827 - DNA, 15 bp, Homo sapiens
agctccaggggccct

SEQ ID NO: 271828 - DNA, 16 bp, Homo sapiens
agctccaggtgccctg

SEQ ID NO: 271829 - DNA, 19 bp, Homo sapiens
agctccagtggaagaagaa

SEQ ID NO: 271830 - DNA, 16 bp, Homo sapiens
agctccatccttgcat

SEQ ID NO: 271831 - DNA, 13 bp, Homo sapiens
agctccatctcca

SEQ ID NO: 271832 - DNA, 19 bp, Homo sapiens
agctcccaacagaggcctc

SEQ ID NO: 271833 - DNA, 19 bp, Homo sapiens
agctcccaggacgcaggga

SEQ ID NO: 271834 - DNA, 21 bp, Homo sapiens
agctccccaccaccccagctg

SEQ ID NO: 271835 - DNA, 22 bp, Homo sapiens
agctcccccttcccagtagctc

SEQ ID NO: 271836 - DNA, 22 bp, Homo sapiens
agctcccccttgcccgccagcc

SEQ ID NO: 271837 - DNA, 16 bp, Homo sapiens
agctccctagactgca

SEQ ID NO: 271838 - DNA, 11 bp, Homo sapiens
agctccctcct

SEQ ID NO: 271839 - DNA, 19 bp, Homo sapiens
agctccctcctcccatctc

SEQ ID NO: 271840 - DNA, 20 bp, Homo sapiens
agctccctcctcccatctcc

SEQ ID NO: 271841 - DNA, 15 bp, Homo sapiens
agctccctcgctgta

SEQ ID NO: 271842 - DNA, 18 bp, Homo sapiens
agctccctcgctgtatga

SEQ ID NO: 271843 - DNA, 20 bp, Homo sapiens
agctcccttcccctgcctgg

SEQ ID NO: 271844 - DNA, 17 bp, Homo sapiens
agctccgatgcccgccc

SEQ ID NO: 271845 - DNA, 17 bp, Homo sapiens
agctccgcctcccgggt

SEQ ID NO: 271846 - DNA, 23 bp, Homo sapiens
agctcctcaactcacctaatgtt

SEQ ID NO: 271847 - DNA, 21 bp, Homo sapiens
agctcctcctcttggagctga

SEQ ID NO: 271848 - DNA, 13 bp, Homo sapiens
agctcctctcctt

SEQ ID NO: 271849 - DNA, 23 bp, Homo sapiens
agctcctctccttgggctcctgg

SEQ ID NO: 271850 - DNA, 14 bp, Homo sapiens
agctcctctgggca

SEQ ID NO: 271851 - DNA, 17 bp, Homo sapiens
agctcctctgggcagga

SEQ ID NO: 271852 - DNA, 12 bp, Homo sapiens
agctcctgctgg

SEQ ID NO: 271853 - DNA, 21 bp, Homo sapiens
agctcctgctggggggcaggg

SEQ ID NO: 271854 - DNA, 23 bp, Homo sapiens
agctcctgggaaggctactcacc

SEQ ID NO: 271855 - DNA, 22 bp, Homo sapiens
agctcctggtcttgagatgtct

SEQ ID NO: 271856 - DNA, 16 bp, Homo sapiens
agctccttttctgtga

SEQ ID NO: 271857 - DNA, 17 bp, Homo sapiens
agctccttttgtcccca

SEQ ID NO: 271858 - DNA, 18 bp, Homo sapiens
agctccttttgtccccag

SEQ ID NO: 271859 - DNA, 21 bp, Homo sapiens
agctccttttgtccccagggc

SEQ ID NO: 271860 - DNA, 22 bp, Homo sapiens
agctcgtttttcagcaccccca

SEQ ID NO: 271861 - DNA, 22 bp, Homo sapiens
agctctaataaaacagctgtct

SEQ ID NO: 271862 - DNA, 18 bp, Homo sapiens
agctctacacaacatgta

SEQ ID NO: 271863 - DNA, 16 bp, Homo sapiens
agctctagacaaccct

SEQ ID NO: 271864 - DNA, 13 bp, Homo sapiens
agctctcactggc

SEQ ID NO: 271865 - DNA, 15 bp, Homo sapiens
agctctccagaagcc

SEQ ID NO: 271866 - DNA, 20 bp, Homo sapiens
agctctcccctgcgcaggcc

SEQ ID NO: 271867 - DNA, 14 bp, Homo sapiens
agctctcctgactt

SEQ ID NO: 271868 - DNA, 18 bp, Homo sapiens
agctctcctgggccaggg

SEQ ID NO: 271869 - DNA, 21 bp, Homo sapiens
agctctcctgggccagggtct

SEQ ID NO: 271870 - DNA, 17 bp, Homo sapiens
agctctcggaactgcat

SEQ ID NO: 271871 - DNA, 18 bp, Homo sapiens
agctctcggaactgcatg

SEQ ID NO: 271872 - DNA, 24 bp, Homo sapiens
agctctctcagacccttgaagatg

SEQ ID NO: 271873 - DNA, 21 bp, Homo sapiens
agctctcttgccgaggagcca

SEQ ID NO: 271874 - DNA, 15 bp, Homo sapiens
agctctgaccctgat

SEQ ID NO: 271875 - DNA, 16 bp, Homo sapiens
agctctgacctgcccc

SEQ ID NO: 271876 - DNA, 13 bp, Homo sapiens
agctctgagccct

SEQ ID NO: 271877 - DNA, 19 bp, Homo sapiens
agctctgcatctcctgtct

SEQ ID NO: 271878 - DNA, 12 bp, Homo sapiens
agctctgccccc

SEQ ID NO: 271879 - DNA, 15 bp, Homo sapiens
agctctgcccccgcg

SEQ ID NO: 271880 - DNA, 14 bp, Homo sapiens
agctctggagccac

SEQ ID NO: 271881 - DNA, 16 bp, Homo sapiens
agctctggagccacct

SEQ ID NO: 271882 - DNA, 19 bp, Homo sapiens
agctctggagccacctgtc

SEQ ID NO: 271883 - DNA, 12 bp, Homo sapiens
agctctggctca

SEQ ID NO: 271884 - DNA, 15 bp, Homo sapiens
agctctggctcacag

SEQ ID NO: 271885 - DNA, 18 bp, Homo sapiens
agctctgggagaggattt

SEQ ID NO: 271886 - DNA, 13 bp, Homo sapiens
agctctgtggcct

SEQ ID NO: 271887 - DNA, 19 bp, Homo sapiens
agctctgtggcctgtgtcc

SEQ ID NO: 271888 - DNA, 19 bp, Homo sapiens
agctcttagtcctccctgc

SEQ ID NO: 271889 - DNA, 20 bp, Homo sapiens
agctcttagtcctccctgct

SEQ ID NO: 271890 - DNA, 18 bp, Homo sapiens
agctcttagtttttaaaa

SEQ ID NO: 271891 - DNA, 20 bp, Homo sapiens
agctcttctccccaggtgtg

SEQ ID NO: 271892 - DNA, 14 bp, Homo sapiens
agctcttctgggca

SEQ ID NO: 271893 - DNA, 20 bp, Homo sapiens
agctcttctgggcagagcct

SEQ ID NO: 271894 - DNA, 19 bp, Homo sapiens
agctcttggcattttcctc

SEQ ID NO: 271895 - DNA, 12 bp, Homo sapiens
agctcttgtttg

SEQ ID NO: 271896 - DNA, 15 bp, Homo sapiens
agctgaaacaaaaat

SEQ ID NO: 271897 - DNA, 24 bp, Homo sapiens
agctgaacagtgttggctttcatg

SEQ ID NO: 271898 - DNA, 15 bp, Homo sapiens
agctgaacctgttca

SEQ ID NO: 271899 - DNA, 12 bp, Homo sapiens
agctgacatgga

SEQ ID NO: 271900 - DNA, 12 bp, Homo sapiens
agctgacctctg

SEQ ID NO: 271901 - DNA, 15 bp, Homo sapiens
agctgacgaggctgg

SEQ ID NO: 271902 - DNA, 18 bp, Homo sapiens
agctgacgccaataataa

SEQ ID NO: 271903 - DNA, 18 bp, Homo sapiens
agctgactggccccaggg

SEQ ID NO: 271904 - DNA, 19 bp, Homo sapiens
agctgactgtggccccctc

SEQ ID NO: 271905 - DNA, 17 bp, Homo sapiens
agctgagatgagcccca

SEQ ID NO: 271906 - DNA, 13 bp, Homo sapiens
agctgagctggcc

SEQ ID NO: 271907 - DNA, 14 bp, Homo sapiens
agctgagctggcct

SEQ ID NO: 271908 - DNA, 17 bp, Homo sapiens
agctgagcttgagctcc

SEQ ID NO: 271909 - DNA, 18 bp, Homo sapiens
agctgagcttgagctccc

SEQ ID NO: 271910 - DNA, 17 bp, Homo sapiens
agctgaggccccagggc

SEQ ID NO: 271911 - DNA, 21 bp, Homo sapiens
agctgaggtctcttgagggag

SEQ ID NO: 271912 - DNA, 14 bp, Homo sapiens
agctgagtcacctc

SEQ ID NO: 271913 - DNA, 19 bp, Homo sapiens
agctgagtcacctcctcca

SEQ ID NO: 271914 - DNA, 20 bp, Homo sapiens
agctgagtcacctcctccac

SEQ ID NO: 271915 - DNA, 23 bp, Homo sapiens
agctgagtcggctgggcagggcc

SEQ ID NO: 271916 - DNA, 18 bp, Homo sapiens
agctgagtgagagggttt

SEQ ID NO: 271917 - DNA, 23 bp, Homo sapiens
agctgagttacttgtctgaggcc

SEQ ID NO: 271918 - DNA, 22 bp, Homo sapiens
agctgataaccgtccttcatca

SEQ ID NO: 271919 - DNA, 13 bp, Homo sapiens
agctgatccagag

SEQ ID NO: 271920 - DNA, 19 bp, Homo sapiens
agctgatccagagcacaga

SEQ ID NO: 271921 - DNA, 12 bp, Homo sapiens
agctgatgaaac

SEQ ID NO: 271922 - DNA, 13 bp, Homo sapiens
agctgatgaaact

SEQ ID NO: 271923 - DNA, 23 bp, Homo sapiens
agctgatgaaactcacaaatgat

SEQ ID NO: 271924 - DNA, 19 bp, Homo sapiens
agctgattactgtcaataa

SEQ ID NO: 271925 - DNA, 15 bp, Homo sapiens
agctgattcccagag

SEQ ID NO: 271926 - DNA, 17 bp, Homo sapiens
agctgattcccagagca

SEQ ID NO: 271927 - DNA, 19 bp, Homo sapiens
agctgattcccagagcaga

SEQ ID NO: 271928 - DNA, 15 bp, Homo sapiens
agctgatttccaggc

SEQ ID NO: 271929 - DNA, 17 bp, Homo sapiens
agctgatttccaggccc

SEQ ID NO: 271930 - DNA, 19 bp, Homo sapiens
agctgatttccaggcccct

SEQ ID NO: 271931 - DNA, 23 bp, Homo sapiens
agctgatttccaggcccctgagg

SEQ ID NO: 271932 - DNA, 15 bp, Homo sapiens
agctgattttaacaa

SEQ ID NO: 271933 - DNA, 13 bp, Homo sapiens
agctgcaaaggac

SEQ ID NO: 271934 - DNA, 15 bp, Homo sapiens
agctgcaaaggacag

SEQ ID NO: 271935 - DNA, 16 bp, Homo sapiens
agctgcaaaggacaga

SEQ ID NO: 271936 - DNA, 18 bp, Homo sapiens
agctgcacattcctggcc

SEQ ID NO: 271937 - DNA, 18 bp, Homo sapiens
agctgcaccagcaggtgc

SEQ ID NO: 271938 - DNA, 17 bp, Homo sapiens
agctgcagagacagaga

SEQ ID NO: 271939 - DNA, 18 bp, Homo sapiens
agctgcagagacagagag

SEQ ID NO: 271940 - DNA, 19 bp, Homo sapiens
agctgcagagacagagagg

SEQ ID NO: 271941 - DNA, 14 bp, Homo sapiens
agctgcagctgggc

SEQ ID NO: 271942 - DNA, 16 bp, Homo sapiens
agctgcaggtgcccat

SEQ ID NO: 271943 - DNA, 19 bp, Homo sapiens
agctgcagttgtgaaagca

SEQ ID NO: 271944 - DNA, 18 bp, Homo sapiens
agctgcatggacgcctgg

SEQ ID NO: 271945 - DNA, 21 bp, Homo sapiens
agctgcatggacgcctggctc

SEQ ID NO: 271946 - DNA, 22 bp, Homo sapiens
agctgcatggacgcctggctcc

SEQ ID NO: 271947 - DNA, 17 bp, Homo sapiens
agctgccaaaaagaaca

SEQ ID NO: 271948 - DNA, 14 bp, Homo sapiens
agctgccaagcact

SEQ ID NO: 271949 - DNA, 14 bp, Homo sapiens
agctgccaagtgct

SEQ ID NO: 271950 - DNA, 13 bp, Homo sapiens
agctgccagagaa

SEQ ID NO: 271951 - DNA, 14 bp, Homo sapiens
agctgccagagaag

SEQ ID NO: 271952 - DNA, 13 bp, Homo sapiens
agctgccagtgct

SEQ ID NO: 271953 - DNA, 19 bp, Homo sapiens
agctgccagtgctggtcac

SEQ ID NO: 271954 - DNA, 22 bp, Homo sapiens
agctgccagtggggtcgtgagg

SEQ ID NO: 271955 - DNA, 16 bp, Homo sapiens
agctgccatttccctt

SEQ ID NO: 271956 - DNA, 13 bp, Homo sapiens
agctgcctaagag

SEQ ID NO: 271957 - DNA, 18 bp, Homo sapiens
agctgcctccctgtccac

SEQ ID NO: 271958 - DNA, 20 bp, Homo sapiens
agctgcctctgacagcagcc

SEQ ID NO: 271959 - DNA, 10 bp, Homo sapiens
tgcagacaca

SEQ ID NO: 271960 - DNA, 12 bp, Homo sapiens
tgcagacacaca

SEQ ID NO: 271961 - DNA, 17 bp, Homo sapiens
tgcagacacacaacatc

SEQ ID NO: 271962 - DNA, 23 bp, Homo sapiens
tgcagacaggccatgtgagccac

SEQ ID NO: 271963 - DNA, 17 bp, Homo sapiens
tgcagacatattttctt

SEQ ID NO: 271964 - DNA, 14 bp, Homo sapiens
tgcagactcagttt

SEQ ID NO: 271965 - DNA, 15 bp, Homo sapiens
tgcagactcagtttg

SEQ ID NO: 271966 - DNA, 14 bp, Homo sapiens
tgcagactcctcag

SEQ ID NO: 271967 - DNA, 20 bp, Homo sapiens
tgcagactcctcagatctga

SEQ ID NO: 271968 - DNA, 19 bp, Homo sapiens
tgcagactcgttctcgtga

SEQ ID NO: 271969 - DNA, 16 bp, Homo sapiens
tgcagactggagggga

SEQ ID NO: 271970 - DNA, 24 bp, Homo sapiens
tgcagagacagagaggacgtgggc

SEQ ID NO: 271971 - DNA, 12 bp, Homo sapiens
tgcagagctggg

SEQ ID NO: 271972 - DNA, 19 bp, Homo sapiens
tgcagaggagccacctggg

SEQ ID NO: 271973 - DNA, 13 bp, Homo sapiens
tgcagaggattta

SEQ ID NO: 271974 - DNA, 16 bp, Homo sapiens
tgcagaggcagcagga

SEQ ID NO: 271975 - DNA, 16 bp, Homo sapiens
tgcagaggcccagcca

SEQ ID NO: 271976 - DNA, 19 bp, Homo sapiens
tgcagagggtactttaaga

SEQ ID NO: 271977 - DNA, 13 bp, Homo sapiens
tgcagatatttga

SEQ ID NO: 271978 - DNA, 14 bp, Homo sapiens
tgcagatctagcca

SEQ ID NO: 271979 - DNA, 19 bp, Homo sapiens
tgcagatctagccaggcct

SEQ ID NO: 271980 - DNA, 14 bp, Homo sapiens
tgcagatgccaaaa

SEQ ID NO: 271981 - DNA, 14 bp, Homo sapiens
tgcagatgggctgt

SEQ ID NO: 271982 - DNA, 14 bp, Homo sapiens
tgcagattcctggg

SEQ ID NO: 271983 - DNA, 19 bp, Homo sapiens
tgcagattcctgggcctgt

SEQ ID NO: 271984 - DNA, 20 bp, Homo sapiens
tgcagattcctgggcctgtc

SEQ ID NO: 271985 - DNA, 17 bp, Homo sapiens
tgcagcaacacccaagt

SEQ ID NO: 271986 - DNA, 13 bp, Homo sapiens
tgcagcagagcct

SEQ ID NO: 271987 - DNA, 13 bp, Homo sapiens
tgcagcagcccag

SEQ ID NO: 271988 - DNA, 15 bp, Homo sapiens
tgcagcagcccagct

SEQ ID NO: 271989 - DNA, 20 bp, Homo sapiens
tgcagcagcttgctgcaccc

SEQ ID NO: 271990 - DNA, 16 bp, Homo sapiens
tgcagcaggcagagga

SEQ ID NO: 271991 - DNA, 19 bp, Homo sapiens
tgcagcagtaccatcccac

SEQ ID NO: 271992 - DNA, 22 bp, Homo sapiens
tgcagcagtaccatcccactga

SEQ ID NO: 271993 - DNA, 13 bp, Homo sapiens
tgcagcatgacct

SEQ ID NO: 271994 - DNA, 23 bp, Homo sapiens
tgcagcatgacctgtgaccagca

SEQ ID NO: 271995 - DNA, 23 bp, Homo sapiens
tgcagccaaggtgctaaaaggaa

SEQ ID NO: 271996 - DNA, 23 bp, Homo sapiens
tgcagcccagaacgggcctcccc

SEQ ID NO: 271997 - DNA, 14 bp, Homo sapiens
tgcagcccatgccc

SEQ ID NO: 271998 - DNA, 14 bp, Homo sapiens
tgcagccctctcca

SEQ ID NO: 271999 - DNA, 23 bp, Homo sapiens
tgcagccctctccaccctccggc

SEQ ID NO: 272000 - DNA, 22 bp, Homo sapiens
tgcagccctgctgctgcctgcc

SEQ ID NO: 272001 - DNA, 13 bp, Homo sapiens
tgcagcccttcct

SEQ ID NO: 272002 - DNA, 12 bp, Homo sapiens
tgcagcccttgg

SEQ ID NO: 272003 - DNA, 16 bp, Homo sapiens
tgcagcccttgggcag

SEQ ID NO: 272004 - DNA, 18 bp, Homo sapiens
tgcagcccttgggcagtt

SEQ ID NO: 272005 - DNA, 19 bp, Homo sapiens
tgcagcctagtaggagctg

SEQ ID NO: 272006 - DNA, 19 bp, Homo sapiens
tgcagcctcctcctgacca

SEQ ID NO: 272007 - DNA, 16 bp, Homo sapiens
tgcagcctctgcctcc

SEQ ID NO: 272008 - DNA, 18 bp, Homo sapiens
tgcagcctctgcctccca

SEQ ID NO: 272009 - DNA, 19 bp, Homo sapiens
tgcagcctctgcctcccag

SEQ ID NO: 272010 - DNA, 20 bp, Homo sapiens
tgcagcctctgcctcccagg

SEQ ID NO: 272011 - DNA, 19 bp, Homo sapiens
tgcagcctgagctccaccc

SEQ ID NO: 272012 - DNA, 14 bp, Homo sapiens
tgcagcctggaggc

SEQ ID NO: 272013 - DNA, 13 bp, Homo sapiens
tgcagccttcccc

SEQ ID NO: 272014 - DNA, 17 bp, Homo sapiens
tgcagccttcccctccc

SEQ ID NO: 272015 - DNA, 19 bp, Homo sapiens
tgcagccttcccctccctg

SEQ ID NO: 272016 - DNA, 16 bp, Homo sapiens
tgcagcgcctcctgga

SEQ ID NO: 272017 - DNA, 21 bp, Homo sapiens
tgcagcggtggaaggagcctg

SEQ ID NO: 272018 - DNA, 22 bp, Homo sapiens
tgcagcggtggaaggagcctgc

SEQ ID NO: 272019 - DNA, 23 bp, Homo sapiens
tgcagcgtctgagcggccgcctg

SEQ ID NO: 272020 - DNA, 19 bp, Homo sapiens
tgcagctattcacacacac

SEQ ID NO: 272021 - DNA, 21 bp, Homo sapiens
tgcagctctttcttctttgaa

SEQ ID NO: 272022 - DNA, 16 bp, Homo sapiens
tgcagctgattttaac

SEQ ID NO: 272023 - DNA, 18 bp, Homo sapiens
tgcagctgattttaacaa

SEQ ID NO: 272024 - DNA, 13 bp, Homo sapiens
tgcagctgggccc

SEQ ID NO: 272025 - DNA, 14 bp, Homo sapiens
tgcagctgggcccc

SEQ ID NO: 272026 - DNA, 20 bp, Homo sapiens
tgcagctgggccccatgctc

SEQ ID NO: 272027 - DNA, 22 bp, Homo sapiens
tgcagctgggccccatgctctg

SEQ ID NO: 272028 - DNA, 24 bp, Homo sapiens
tgcagctgggccccatgctctgcc

SEQ ID NO: 272029 - DNA, 22 bp, Homo sapiens
tgcagctggtctgtttccaggt

SEQ ID NO: 272030 - DNA, 22 bp, Homo sapiens
tgcagcttccttttgagggaca

SEQ ID NO: 272031 - DNA, 18 bp, Homo sapiens
tgcagcttgggagagccc

SEQ ID NO: 272032 - DNA, 23 bp, Homo sapiens
tgcaggaacgagcactggccaga

SEQ ID NO: 272033 - DNA, 15 bp, Homo sapiens
tgcaggaggcctggg

SEQ ID NO: 272034 - DNA, 20 bp, Homo sapiens
tgcaggccagtggacagagg

SEQ ID NO: 272035 - DNA, 16 bp, Homo sapiens
tgcaggcccagcagac

SEQ ID NO: 272036 - DNA, 17 bp, Homo sapiens
tgcaggcccagcagact

SEQ ID NO: 272037 - DNA, 15 bp, Homo sapiens
tgcaggccccagcca

SEQ ID NO: 272038 - DNA, 22 bp, Homo sapiens
tgcaggcggtatccagaggtga

SEQ ID NO: 272039 - DNA, 24 bp, Homo sapiens
tgcaggcggtatccagaggtgagg

SEQ ID NO: 272040 - DNA, 11 bp, Homo sapiens
tgcaggctctg

SEQ ID NO: 272041 - DNA, 17 bp, Homo sapiens
tgcaggctctgggctca

SEQ ID NO: 272042 - DNA, 18 bp, Homo sapiens
tgcaggctctgggctcag

SEQ ID NO: 272043 - DNA, 23 bp, Homo sapiens
tgcaggctctgggctcagggctg

SEQ ID NO: 272044 - DNA, 15 bp, Homo sapiens
tgcagggaagagggc

SEQ ID NO: 272045 - DNA, 20 bp, Homo sapiens
tgcagggaagagggcagtac

SEQ ID NO: 272046 - DNA, 18 bp, Homo sapiens
tgcagggaggggaggcag

SEQ ID NO: 272047 - DNA, 13 bp, Homo sapiens
tgcagggcagcct

SEQ ID NO: 272048 - DNA, 18 bp, Homo sapiens
tgcagggcagcctgtggg

SEQ ID NO: 272049 - DNA, 17 bp, Homo sapiens
tgcagggtggtgctggg

SEQ ID NO: 272050 - DNA, 20 bp, Homo sapiens
tgcagggtggtgctgggact

SEQ ID NO: 272051 - DNA, 15 bp, Homo sapiens
tgcaggtacttcctc

SEQ ID NO: 272052 - DNA, 19 bp, Homo sapiens
tgcaggtacttcctcctga

SEQ ID NO: 272053 - DNA, 22 bp, Homo sapiens
tgcaggtacttcctcctgatgg

SEQ ID NO: 272054 - DNA, 19 bp, Homo sapiens
tgcaggtctccatgaagaa

SEQ ID NO: 272055 - DNA, 20 bp, Homo sapiens
tgcaggtctccatgaagaag

SEQ ID NO: 272056 - DNA, 12 bp, Homo sapiens
tgcaggtgccca

SEQ ID NO: 272057 - DNA, 16 bp, Homo sapiens
tgcaggttggacccca

SEQ ID NO: 272058 - DNA, 15 bp, Homo sapiens
tgcaggtttgttaca

SEQ ID NO: 272059 - DNA, 18 bp, Homo sapiens
tgcagtaaccatttaatg

SEQ ID NO: 272060 - DNA, 14 bp, Homo sapiens
tgcagtacaggcaa

SEQ ID NO: 272061 - DNA, 20 bp, Homo sapiens
tgcagtatgatggcaggaga

SEQ ID NO: 272062 - DNA, 12 bp, Homo sapiens
tgcagtgccttg

SEQ ID NO: 272063 - DNA, 16 bp, Homo sapiens
tgcagtgcctttcccc

SEQ ID NO: 272064 - DNA, 14 bp, Homo sapiens
tgcagtgcggctca

SEQ ID NO: 272065 - DNA, 17 bp, Homo sapiens
tgcagtgggtggggctg

SEQ ID NO: 272066 - DNA, 17 bp, Homo sapiens
tgcagtgtccagaagcg

SEQ ID NO: 272067 - DNA, 13 bp, Homo sapiens
tgcagtgtgcctg

SEQ ID NO: 272068 - DNA, 16 bp, Homo sapiens
tgcagtgttcgcttgg

SEQ ID NO: 272069 - DNA, 16 bp, Homo sapiens
tgcagttaattcttgc

SEQ ID NO: 272070 - DNA, 22 bp, Homo sapiens
tgcagttattagaacttagttt

SEQ ID NO: 272071 - DNA, 18 bp, Homo sapiens
tgcagttcagcaccaccc

SEQ ID NO: 272072 - DNA, 15 bp, Homo sapiens
tgcagttcattattt

SEQ ID NO: 272073 - DNA, 19 bp, Homo sapiens
tgcagttggactctcaggg

SEQ ID NO: 272074 - DNA, 16 bp, Homo sapiens
tgcagttgtgaaagca

SEQ ID NO: 272075 - DNA, 14 bp, Homo sapiens
tgcagttttaagaa

SEQ ID NO: 272076 - DNA, 12 bp, Homo sapiens
tgcagttttcct

SEQ ID NO: 272077 - DNA, 17 bp, Homo sapiens
tgcataaaattggatta

SEQ ID NO: 272078 - DNA, 19 bp, Homo sapiens
tgcataaacaatccaaatg

SEQ ID NO: 272079 - DNA, 18 bp, Homo sapiens
tgcataagtgaaaatctt

SEQ ID NO: 272080 - DNA, 19 bp, Homo sapiens
tgcataatactaatttatt

SEQ ID NO: 272081 - DNA, 21 bp, Homo sapiens
tgcatacttcctggattttct

SEQ ID NO: 272082 - DNA, 19 bp, Homo sapiens
tgcatagaggtaccagcaa

SEQ ID NO: 272083 - DNA, 15 bp, Homo sapiens
tgcatagctctattt

SEQ ID NO: 272084 - DNA, 20 bp, Homo sapiens
tgcatagtaccaatcatttt

SEQ ID NO: 272085 - DNA, 21 bp, Homo sapiens
tgcatagtattccattgtgtg

SEQ ID NO: 272086 - DNA, 21 bp, Homo sapiens
tgcatatcctggtgtctagtt

SEQ ID NO: 272087 - DNA, 22 bp, Homo sapiens
tgcatatctctagtccctgtgt

SEQ ID NO: 272088 - DNA, 18 bp, Homo sapiens
tgcatattctattgtatt

SEQ ID NO: 272089 - DNA, 17 bp, Homo sapiens
tgcatcaaccaggaaga

SEQ ID NO: 272090 - DNA, 14 bp, Homo sapiens
tgcatcaagatgtg

SEQ ID NO: 272091 - DNA, 19 bp, Homo sapiens
tgcatcaagggctttatca

SEQ ID NO: 272092 - DNA, 16 bp, Homo sapiens
tgcatcagcctctggc

SEQ ID NO: 272093 - DNA, 22 bp, Homo sapiens
agctgcctctgacagcagcctg

SEQ ID NO: 272094 - DNA, 19 bp, Homo sapiens
agctgcctctgccactgac

SEQ ID NO: 272095 - DNA, 15 bp, Homo sapiens
agctgcctgaaacag

SEQ ID NO: 272096 - DNA, 22 bp, Homo sapiens
agctgcctgaaacagccatgtc

SEQ ID NO: 272097 - DNA, 14 bp, Homo sapiens
agctgcctgctctg

SEQ ID NO: 272098 - DNA, 20 bp, Homo sapiens
agctgcctgctctgcagccc

SEQ ID NO: 272099 - DNA, 14 bp, Homo sapiens
agctgcctgtagtt

SEQ ID NO: 272100 - DNA, 20 bp, Homo sapiens
agctgcctgtagttaggaaa

SEQ ID NO: 272101 - DNA, 22 bp, Homo sapiens
agctgcctgtagttaggaaata

SEQ ID NO: 272102 - DNA, 14 bp, Homo sapiens
agctgctcccctcc

SEQ ID NO: 272103 - DNA, 15 bp, Homo sapiens
agctgctcccctccc

SEQ ID NO: 272104 - DNA, 23 bp, Homo sapiens
agctgctctccttcactctgaca

SEQ ID NO: 272105 - DNA, 12 bp, Homo sapiens
agctgctctgcc

SEQ ID NO: 272106 - DNA, 18 bp, Homo sapiens
agctgctctgcccagagc

SEQ ID NO: 272107 - DNA, 15 bp, Homo sapiens
agctgctctgcccct

SEQ ID NO: 272108 - DNA, 12 bp, Homo sapiens
agctgctctgct

SEQ ID NO: 272109 - DNA, 13 bp, Homo sapiens
agctgctctgcta

SEQ ID NO: 272110 - DNA, 23 bp, Homo sapiens
agctgctcttgcatctgggccag

SEQ ID NO: 272111 - DNA, 20 bp, Homo sapiens
agctgctgaatgcattcagg

SEQ ID NO: 272112 - DNA, 17 bp, Homo sapiens
agctgctggcttgcagt

SEQ ID NO: 272113 - DNA, 12 bp, Homo sapiens
agctgctgtcag

SEQ ID NO: 272114 - DNA, 14 bp, Homo sapiens
agctgctttgttac

SEQ ID NO: 272115 - DNA, 17 bp, Homo sapiens
agctgctttgttacctt

SEQ ID NO: 272116 - DNA, 15 bp, Homo sapiens
agctggaaagcagcc

SEQ ID NO: 272117 - DNA, 15 bp, Homo sapiens
agctggaaggcaggg

SEQ ID NO: 272118 - DNA, 18 bp, Homo sapiens
agctggaaggcagggcag

SEQ ID NO: 272119 - DNA, 19 bp, Homo sapiens
agctggaaggcagggcaga

SEQ ID NO: 272120 - DNA, 20 bp, Homo sapiens
agctggaaggcagggcagag

SEQ ID NO: 272121 - DNA, 22 bp, Homo sapiens
agctggaaggcagggcagaggg

SEQ ID NO: 272122 - DNA, 19 bp, Homo sapiens
agctggagccaatggtgag

SEQ ID NO: 272123 - DNA, 20 bp, Homo sapiens
agctggagtgctgcttgtgc

SEQ ID NO: 272124 - DNA, 18 bp, Homo sapiens
agctggcaaactgtgaat

SEQ ID NO: 272125 - DNA, 11 bp, Homo sapiens
agctggcagga

SEQ ID NO: 272126 - DNA, 23 bp, Homo sapiens
agctggcaggacacatcccggcc

SEQ ID NO: 272127 - DNA, 15 bp, Homo sapiens
agctggcaggagaca

SEQ ID NO: 272128 - DNA, 17 bp, Homo sapiens
agctggcaggagggtgg

SEQ ID NO: 272129 - DNA, 14 bp, Homo sapiens
agctggccgggttg

SEQ ID NO: 272130 - DNA, 22 bp, Homo sapiens
agctggccgggttggaggcctc

SEQ ID NO: 272131 - DNA, 20 bp, Homo sapiens
agctggcggaacctggctgc

SEQ ID NO: 272132 - DNA, 21 bp, Homo sapiens
agctggcggaacctggctgcg

SEQ ID NO: 272133 - DNA, 23 bp, Homo sapiens
agctggctgggtcgcccctcctc

SEQ ID NO: 272134 - DNA, 22 bp, Homo sapiens
agctgggaaaaaagttttgatg

SEQ ID NO: 272135 - DNA, 21 bp, Homo sapiens
agctgggaacccgactgtgaa

SEQ ID NO: 272136 - DNA, 22 bp, Homo sapiens
agctgggatttgaactgagccg

SEQ ID NO: 272137 - DNA, 23 bp, Homo sapiens
agctgggatttgaactgagccgt

SEQ ID NO: 272138 - DNA, 21 bp, Homo sapiens
agctgggcatggtaccagccc

SEQ ID NO: 272139 - DNA, 17 bp, Homo sapiens
agctgggccccacctac

SEQ ID NO: 272140 - DNA, 22 bp, Homo sapiens
agctgggctctgccaccctacc

SEQ ID NO: 272141 - DNA, 10 bp, Homo sapiens
agctgggctg

SEQ ID NO: 272142 - DNA, 16 bp, Homo sapiens
agctgggctgttggct

SEQ ID NO: 272143 - DNA, 11 bp, Homo sapiens
agctggggaca

SEQ ID NO: 272144 - DNA, 18 bp, Homo sapiens
agctggggagcagctgag

SEQ ID NO: 272145 - DNA, 15 bp, Homo sapiens
agctggggagggaga

SEQ ID NO: 272146 - DNA, 13 bp, Homo sapiens
agctggggcccct

SEQ ID NO: 272147 - DNA, 16 bp, Homo sapiens
agctggggcccctcgg

SEQ ID NO: 272148 - DNA, 20 bp, Homo sapiens
agctgggggccatgagctcc

SEQ ID NO: 272149 - DNA, 15 bp, Homo sapiens
agctggggggctgtc

SEQ ID NO: 272150 - DNA, 17 bp, Homo sapiens
agctgggtaccaggcca

SEQ ID NO: 272151 - DNA, 18 bp, Homo sapiens
agctgggtaccaggccac

SEQ ID NO: 272152 - DNA, 21 bp, Homo sapiens
agctgggtaccaggccaccca

SEQ ID NO: 272153 - DNA, 22 bp, Homo sapiens
agctgggtgagtggggagacac

SEQ ID NO: 272154 - DNA, 19 bp, Homo sapiens
agctggtagttagtagcat

SEQ ID NO: 272155 - DNA, 20 bp, Homo sapiens
agctggtctgtttccaggtc

SEQ ID NO: 272156 - DNA, 12 bp, Homo sapiens
agctggtgcatt

SEQ ID NO: 272157 - DNA, 17 bp, Homo sapiens
agctggtgcattacaga

SEQ ID NO: 272158 - DNA, 21 bp, Homo sapiens
agctggtgcattacagagagg

SEQ ID NO: 272159 - DNA, 14 bp, Homo sapiens
agctggtgcccgga

SEQ ID NO: 272160 - DNA, 21 bp, Homo sapiens
agctggtggtgcagccttccc

SEQ ID NO: 272161 - DNA, 21 bp, Homo sapiens
agctggtttcctcattcctga

SEQ ID NO: 272162 - DNA, 22 bp, Homo sapiens
agctggtttcctcattcctgaa

SEQ ID NO: 272163 - DNA, 19 bp, Homo sapiens
agctgtaaaaagagagaaa

SEQ ID NO: 272164 - DNA, 19 bp, Homo sapiens
agctgtaaatacatgtgtg

SEQ ID NO: 272165 - DNA, 23 bp, Homo sapiens
agctgtaagaagagactgggaag

SEQ ID NO: 272166 - DNA, 16 bp, Homo sapiens
agctgtacccttgaga

SEQ ID NO: 272167 - DNA, 15 bp, Homo sapiens
agctgtactcagagc

SEQ ID NO: 272168 - DNA, 17 bp, Homo sapiens
agctgtactcagagcag

SEQ ID NO: 272169 - DNA, 21 bp, Homo sapiens
agctgtacttcgtcttctaat

SEQ ID NO: 272170 - DNA, 19 bp, Homo sapiens
agctgtagaaatgtatcct

SEQ ID NO: 272171 - DNA, 14 bp, Homo sapiens
agctgtagccatgg

SEQ ID NO: 272172 - DNA, 20 bp, Homo sapiens
agctgtagccatggctcagg

SEQ ID NO: 272173 - DNA, 16 bp, Homo sapiens
agctgtagctcccgag

SEQ ID NO: 272174 - DNA, 20 bp, Homo sapiens
agctgtagtagccctttctg

SEQ ID NO: 272175 - DNA, 23 bp, Homo sapiens
agctgtagtagccctttctgtgt

SEQ ID NO: 272176 - DNA, 19 bp, Homo sapiens
agctgtataactgtgcaga

SEQ ID NO: 272177 - DNA, 22 bp, Homo sapiens
agctgtataactgtgcagagac

SEQ ID NO: 272178 - DNA, 14 bp, Homo sapiens
agctgtccagagaa

SEQ ID NO: 272179 - DNA, 15 bp, Homo sapiens
agctgtcccctctcc

SEQ ID NO: 272180 - DNA, 16 bp, Homo sapiens
agctgtcccctctgtc

SEQ ID NO: 272181 - DNA, 17 bp, Homo sapiens
agctgtcccctctgtca

SEQ ID NO: 272182 - DNA, 15 bp, Homo sapiens
agctgtgaaatgtgc

SEQ ID NO: 272183 - DNA, 12 bp, Homo sapiens
agctgtgaaatt

SEQ ID NO: 272184 - DNA, 17 bp, Homo sapiens
agctgtgaacatggact

SEQ ID NO: 272185 - DNA, 23 bp, Homo sapiens
agctgtgactgagggcctggtca

SEQ ID NO: 272186 - DNA, 14 bp, Homo sapiens
agctgtgtctctgt

SEQ ID NO: 272187 - DNA, 16 bp, Homo sapiens
agctgtgtctctgtat

SEQ ID NO: 272188 - DNA, 22 bp, Homo sapiens
agctgtgttttgtctgagcctc

SEQ ID NO: 272189 - DNA, 23 bp, Homo sapiens
agctgttactttctttcagatgt

SEQ ID NO: 272190 - DNA, 14 bp, Homo sapiens
agctgttccacagg

SEQ ID NO: 272191 - DNA, 13 bp, Homo sapiens
agctgttcctgtg

SEQ ID NO: 272192 - DNA, 16 bp, Homo sapiens
agctgttcctgtgttc

SEQ ID NO: 272193 - DNA, 12 bp, Homo sapiens
agctgtttaaga

SEQ ID NO: 272194 - DNA, 17 bp, Homo sapiens
agctgtttatggcctca

SEQ ID NO: 272195 - DNA, 18 bp, Homo sapiens
agctgtttatggcctcag

SEQ ID NO: 272196 - DNA, 13 bp, Homo sapiens
agctgtttgtcat

SEQ ID NO: 272197 - DNA, 20 bp, Homo sapiens
agctgttttagttaaatttc

SEQ ID NO: 272198 - DNA, 18 bp, Homo sapiens
agctgttttccctgacct

SEQ ID NO: 272199 - DNA, 19 bp, Homo sapiens
agctgttttggatgaatgc

SEQ ID NO: 272200 - DNA, 13 bp, Homo sapiens
agcttaaaaaaag

SEQ ID NO: 272201 - DNA, 18 bp, Homo sapiens
agcttaaaaaaaggaaaa

SEQ ID NO: 272202 - DNA, 23 bp, Homo sapiens
agcttaaattgcttttgttgtga

SEQ ID NO: 272203 - DNA, 15 bp, Homo sapiens
agcttaactaatttg

SEQ ID NO: 272204 - DNA, 17 bp, Homo sapiens
agcttaactaatttgaa

SEQ ID NO: 272205 - DNA, 15 bp, Homo sapiens
agcttaaggagagga

SEQ ID NO: 272206 - DNA, 16 bp, Homo sapiens
agcttaatagccctcc

SEQ ID NO: 272207 - DNA, 13 bp, Homo sapiens
agcttacaggaag

SEQ ID NO: 272208 - DNA, 14 bp, Homo sapiens
agcttacaggaagc

SEQ ID NO: 272209 - DNA, 16 bp, Homo sapiens
agcttacatagtttta

SEQ ID NO: 272210 - DNA, 17 bp, Homo sapiens
agcttacatagttttaa

SEQ ID NO: 272211 - DNA, 22 bp, Homo sapiens
agcttacatagttttaaactca

SEQ ID NO: 272212 - DNA, 14 bp, Homo sapiens
agcttagaagccac

SEQ ID NO: 272213 - DNA, 16 bp, Homo sapiens
agcttagattttctgt

SEQ ID NO: 272214 - DNA, 17 bp, Homo sapiens
agcttagattttctgta

SEQ ID NO: 272215 - DNA, 16 bp, Homo sapiens
agcttagccttgtgcc

SEQ ID NO: 272216 - DNA, 22 bp, Homo sapiens
agcttagccttgtgccctgccc

SEQ ID NO: 272217 - DNA, 21 bp, Homo sapiens
agcttatctccctgcttcata

SEQ ID NO: 272218 - DNA, 20 bp, Homo sapiens
agcttatgggatccttgtct

SEQ ID NO: 272219 - DNA, 22 bp, Homo sapiens
agcttatgggatccttgtcttt

SEQ ID NO: 272220 - DNA, 17 bp, Homo sapiens
agcttattaatgctaag

SEQ ID NO: 272221 - DNA, 19 bp, Homo sapiens
agcttattaatgctaaggg

SEQ ID NO: 272222 - DNA, 22 bp, Homo sapiens
agcttattcatctgtttttctt

SEQ ID NO: 272223 - DNA, 13 bp, Homo sapiens
agcttattggcca

SEQ ID NO: 272224 - DNA, 18 bp, Homo sapiens
agcttatttagcacattt

SEQ ID NO: 272225 - DNA, 16 bp, Homo sapiens
agcttcagaagtttgg

SEQ ID NO: 272226 - DNA, 18 bp, Homo sapiens
tgcatcagcctctggcca

SEQ ID NO: 272227 - DNA, 19 bp, Homo sapiens
tgcatcagcctctggccag

SEQ ID NO: 272228 - DNA, 16 bp, Homo sapiens
tgcatcatctgtagat

SEQ ID NO: 272229 - DNA, 22 bp, Homo sapiens
tgcatccacaggattccagttg

SEQ ID NO: 272230 - DNA, 13 bp, Homo sapiens
tgcatccaggcct

SEQ ID NO: 272231 - DNA, 15 bp, Homo sapiens
tgcatccctccaccc

SEQ ID NO: 272232 - DNA, 17 bp, Homo sapiens
tgcatcccttggcccct

SEQ ID NO: 272233 - DNA, 18 bp, Homo sapiens
tgcatcccttggcccctc

SEQ ID NO: 272234 - DNA, 20 bp, Homo sapiens
tgcatcccttggcccctctc

SEQ ID NO: 272235 - DNA, 20 bp, Homo sapiens
tgcatcctactcctacctgg

SEQ ID NO: 272236 - DNA, 13 bp, Homo sapiens
tgcatcctcagcc

SEQ ID NO: 272237 - DNA, 15 bp, Homo sapiens
tgcatcctcagcccc

SEQ ID NO: 272238 - DNA, 19 bp, Homo sapiens
tgcatcctcagccccaggg

SEQ ID NO: 272239 - DNA, 15 bp, Homo sapiens
tgcatctcagcccac

SEQ ID NO: 272240 - DNA, 13 bp, Homo sapiens
tgcatctgggcca

SEQ ID NO: 272241 - DNA, 20 bp, Homo sapiens
tgcatctttcatagttctgt

SEQ ID NO: 272242 - DNA, 16 bp, Homo sapiens
tgcatgagaactaaat

SEQ ID NO: 272243 - DNA, 14 bp, Homo sapiens
tgcatgatattgta

SEQ ID NO: 272244 - DNA, 15 bp, Homo sapiens
tgcatgatattgtat

SEQ ID NO: 272245 - DNA, 18 bp, Homo sapiens
tgcatgatattgtatgta

SEQ ID NO: 272246 - DNA, 23 bp, Homo sapiens
tgcatgcaactaattcaataaaa

SEQ ID NO: 272247 - DNA, 13 bp, Homo sapiens
tgcatgccaggct

SEQ ID NO: 272248 - DNA, 17 bp, Homo sapiens
tgcatgccaggctgggc

SEQ ID NO: 272249 - DNA, 23 bp, Homo sapiens
tgcatgccctaagagtgtcactg

SEQ ID NO: 272250 - DNA, 17 bp, Homo sapiens
tgcatgctgctttaatt

SEQ ID NO: 272251 - DNA, 19 bp, Homo sapiens
tgcatgctgtcccttacgt

SEQ ID NO: 272252 - DNA, 17 bp, Homo sapiens
tgcatgcttctttataa

SEQ ID NO: 272253 - DNA, 15 bp, Homo sapiens
tgcatggaaacctga

SEQ ID NO: 272254 - DNA, 19 bp, Homo sapiens
tgcatggaaacctgaaaaa

SEQ ID NO: 272255 - DNA, 18 bp, Homo sapiens
tgcatggacctaacattc

SEQ ID NO: 272256 - DNA, 18 bp, Homo sapiens
tgcatggacgcctggctc

SEQ ID NO: 272257 - DNA, 16 bp, Homo sapiens
tgcatggagtgtttga

SEQ ID NO: 272258 - DNA, 13 bp, Homo sapiens
tgcatggccacag

SEQ ID NO: 272259 - DNA, 16 bp, Homo sapiens
tgcatggccacagcca

SEQ ID NO: 272260 - DNA, 14 bp, Homo sapiens
tgcatggcctccca

SEQ ID NO: 272261 - DNA, 15 bp, Homo sapiens
tgcatggcctcccag

SEQ ID NO: 272262 - DNA, 17 bp, Homo sapiens
tgcatggcctcccagcc

SEQ ID NO: 272263 - DNA, 18 bp, Homo sapiens
tgcatggcctcccagcca

SEQ ID NO: 272264 - DNA, 16 bp, Homo sapiens
tgcatgggtgaaggga

SEQ ID NO: 272265 - DNA, 16 bp, Homo sapiens
tgcatggtaatttata

SEQ ID NO: 272266 - DNA, 17 bp, Homo sapiens
tgcatgtaaaatcttca

SEQ ID NO: 272267 - DNA, 21 bp, Homo sapiens
tgcatgtaaaatcttcagctg

SEQ ID NO: 272268 - DNA, 23 bp, Homo sapiens
tgcatgtaaaatcttcagctggt

SEQ ID NO: 272269 - DNA, 23 bp, Homo sapiens
tgcatgtactttatattttctat

SEQ ID NO: 272270 - DNA, 12 bp, Homo sapiens
tgcatgtagcat

SEQ ID NO: 272271 - DNA, 17 bp, Homo sapiens
tgcatgtagcatataaa

SEQ ID NO: 272272 - DNA, 17 bp, Homo sapiens
tgcatgtataaatgaag

SEQ ID NO: 272273 - DNA, 17 bp, Homo sapiens
tgcatgtatattactga

SEQ ID NO: 272274 - DNA, 14 bp, Homo sapiens
tgcatgtctgcatg

SEQ ID NO: 272275 - DNA, 17 bp, Homo sapiens
tgcatgtgaagcatgct

SEQ ID NO: 272276 - DNA, 19 bp, Homo sapiens
tgcatgtgaagcatgcttt

SEQ ID NO: 272277 - DNA, 22 bp, Homo sapiens
tgcatgtgattggcagcttcaa

SEQ ID NO: 272278 - DNA, 13 bp, Homo sapiens
tgcatgtgtgtgc

SEQ ID NO: 272279 - DNA, 18 bp, Homo sapiens
tgcatgttcttttctgga

SEQ ID NO: 272280 - DNA, 17 bp, Homo sapiens
tgcattaaactgtgaat

SEQ ID NO: 272281 - DNA, 14 bp, Homo sapiens
tgcattaacttaaa

SEQ ID NO: 272282 - DNA, 11 bp, Homo sapiens
tgcattacaga

SEQ ID NO: 272283 - DNA, 12 bp, Homo sapiens
tgcattacagag

SEQ ID NO: 272284 - DNA, 16 bp, Homo sapiens
tgcattacagagagga

SEQ ID NO: 272285 - DNA, 17 bp, Homo sapiens
tgcattacagagaggag

SEQ ID NO: 272286 - DNA, 16 bp, Homo sapiens
tgcattcactcagcat

SEQ ID NO: 272287 - DNA, 23 bp, Homo sapiens
tgcattcgcggttaagatactca

SEQ ID NO: 272288 - DNA, 12 bp, Homo sapiens
tgcattctagta

SEQ ID NO: 272289 - DNA, 18 bp, Homo sapiens
tgcattggaagaccccac

SEQ ID NO: 272290 - DNA, 19 bp, Homo sapiens
tgcattggaagaccccacc

SEQ ID NO: 272291 - DNA, 17 bp, Homo sapiens
tgcatttataaatgtgt

SEQ ID NO: 272292 - DNA, 15 bp, Homo sapiens
tgcatttatgcatga

SEQ ID NO: 272293 - DNA, 15 bp, Homo sapiens
tgcatttcacctgtg

SEQ ID NO: 272294 - DNA, 13 bp, Homo sapiens
tgcatttgaggtc

SEQ ID NO: 272295 - DNA, 16 bp, Homo sapiens
tgcatttggtcaagat

SEQ ID NO: 272296 - DNA, 17 bp, Homo sapiens
tgcatttgtaccttatt

SEQ ID NO: 272297 - DNA, 15 bp, Homo sapiens
tgcatttgtgtctgc

SEQ ID NO: 272298 - DNA, 19 bp, Homo sapiens
tgcatttgtgtctgcctgc

SEQ ID NO: 272299 - DNA, 17 bp, Homo sapiens
tgcattttcaccccacc

SEQ ID NO: 272300 - DNA, 13 bp, Homo sapiens
tgcattttctcag

SEQ ID NO: 272301 - DNA, 22 bp, Homo sapiens
tgcatttttaaaggacaaacag

SEQ ID NO: 272302 - DNA, 22 bp, Homo sapiens
tgcatttttatctgtgagttct

SEQ ID NO: 272303 - DNA, 20 bp, Homo sapiens
tgcatttttggatcattttt

SEQ ID NO: 272304 - DNA, 14 bp, Homo sapiens
tgcatttttgtgaa

SEQ ID NO: 272305 - DNA, 15 bp, Homo sapiens
tgcattttttaaaac

SEQ ID NO: 272306 - DNA, 16 bp, Homo sapiens
tgccaaataataaaaa

SEQ ID NO: 272307 - DNA, 17 bp, Homo sapiens
tgccaaatatgtcctgg

SEQ ID NO: 272308 - DNA, 16 bp, Homo sapiens
tgccaaatcctgggca

SEQ ID NO: 272309 - DNA, 23 bp, Homo sapiens
tgccaaatcctgggcatccccag

SEQ ID NO: 272310 - DNA, 19 bp, Homo sapiens
tgccaacagacactacatt

SEQ ID NO: 272311 - DNA, 24 bp, Homo sapiens
tgccaacagacactacattaccct

SEQ ID NO: 272312 - DNA, 22 bp, Homo sapiens
tgccaacctgatgccccttccc

SEQ ID NO: 272313 - DNA, 16 bp, Homo sapiens
tgccaactaagccctc

SEQ ID NO: 272314 - DNA, 18 bp, Homo sapiens
tgccaactccatgaccag

SEQ ID NO: 272315 - DNA, 23 bp, Homo sapiens
tgccaactccatgaccaggccac

SEQ ID NO: 272316 - DNA, 15 bp, Homo sapiens
tgccaactcgggagc

SEQ ID NO: 272317 - DNA, 20 bp, Homo sapiens
tgccaacttttagtgggtga

SEQ ID NO: 272318 - DNA, 14 bp, Homo sapiens
tgccaagaaaatga

SEQ ID NO: 272319 - DNA, 19 bp, Homo sapiens
tgccaagaaatcgccttat

SEQ ID NO: 272320 - DNA, 18 bp, Homo sapiens
tgccaagaactctgggca

SEQ ID NO: 272321 - DNA, 16 bp, Homo sapiens
tgccaagaactgaaaa

SEQ ID NO: 272322 - DNA, 19 bp, Homo sapiens
tgccaagaactgaaaacat

SEQ ID NO: 272323 - DNA, 20 bp, Homo sapiens
tgccaagaactgaaaacata

SEQ ID NO: 272324 - DNA, 18 bp, Homo sapiens
tgccaagattctactctt

SEQ ID NO: 272325 - DNA, 19 bp, Homo sapiens
tgccaagattctactcttg

SEQ ID NO: 272326 - DNA, 14 bp, Homo sapiens
tgccaaggagcccc

SEQ ID NO: 272327 - DNA, 16 bp, Homo sapiens
tgccaaggccagagtg

SEQ ID NO: 272328 - DNA, 19 bp, Homo sapiens
tgccaaggccgcccacctg

SEQ ID NO: 272329 - DNA, 14 bp, Homo sapiens
tgccaaggctctcc

SEQ ID NO: 272330 - DNA, 18 bp, Homo sapiens
tgccaagtaacaatgcat

SEQ ID NO: 272331 - DNA, 23 bp, Homo sapiens
tgccaataaaagttttctccaac

SEQ ID NO: 272332 - DNA, 19 bp, Homo sapiens
tgccaatagttgctgtccc

SEQ ID NO: 272333 - DNA, 16 bp, Homo sapiens
tgccaatctcaacacc

SEQ ID NO: 272334 - DNA, 16 bp, Homo sapiens
tgccaatgccacagcc

SEQ ID NO: 272335 - DNA, 16 bp, Homo sapiens
tgccacaaattgaaag

SEQ ID NO: 272336 - DNA, 17 bp, Homo sapiens
tgccacactcagtcccc

SEQ ID NO: 272337 - DNA, 13 bp, Homo sapiens
tgccacactttca

SEQ ID NO: 272338 - DNA, 17 bp, Homo sapiens
tgccacactttcactgg

SEQ ID NO: 272339 - DNA, 20 bp, Homo sapiens
tgccacactttcactgggga

SEQ ID NO: 272340 - DNA, 13 bp, Homo sapiens
tgccacagccaag

SEQ ID NO: 272341 - DNA, 13 bp, Homo sapiens
tgccaccaataaa

SEQ ID NO: 272342 - DNA, 21 bp, Homo sapiens
tgccaccaccagatgagaagt

SEQ ID NO: 272343 - DNA, 13 bp, Homo sapiens
tgccaccacccac

SEQ ID NO: 272344 - DNA, 17 bp, Homo sapiens
tgccaccacccacccca

SEQ ID NO: 272345 - DNA, 19 bp, Homo sapiens
tgccaccacccctccctct

SEQ ID NO: 272346 - DNA, 22 bp, Homo sapiens
tgccaccacccctccctctgct

SEQ ID NO: 272347 - DNA, 23 bp, Homo sapiens
tgccaccacccctccctctgctc

SEQ ID NO: 272348 - DNA, 19 bp, Homo sapiens
tgccaccccccgccggcag

SEQ ID NO: 272349 - DNA, 12 bp, Homo sapiens
tgccaccctacc

SEQ ID NO: 272350 - DNA, 21 bp, Homo sapiens
tgccaccctcacacacacagc

SEQ ID NO: 272351 - DNA, 19 bp, Homo sapiens
tgccaccctctgcagggca

SEQ ID NO: 272352 - DNA, 17 bp, Homo sapiens
tgccacctatgcctgtg

SEQ ID NO: 272353 - DNA, 19 bp, Homo sapiens
tgccacctatgcctgtggt

SEQ ID NO: 272354 - DNA, 21 bp, Homo sapiens
tgccacctatgcctgtggtga

SEQ ID NO: 272355 - DNA, 21 bp, Homo sapiens
tgccacctctggccaaatatg

SEQ ID NO: 272356 - DNA, 13 bp, Homo sapiens
tgccacctgtctg

SEQ ID NO: 272357 - DNA, 14 bp, Homo sapiens
tgccacctgtctgt

SEQ ID NO: 272358 - DNA, 15 bp, Homo sapiens
tgccacctgtctgtc

SEQ ID NO: 272359 - DNA, 19 bp, Homo sapiens
tgccacgccccgtgtctgg

SEQ ID NO: 272360 - DNA, 20 bp, Homo sapiens
tgcttacatttttacaataa

SEQ ID NO: 272361 - DNA, 15 bp, Homo sapiens
tgcttactacagaaa

SEQ ID NO: 272362 - DNA, 15 bp, Homo sapiens
tgcttactcttgctt

SEQ ID NO: 272363 - DNA, 13 bp, Homo sapiens
tgcttagaaccct

SEQ ID NO: 272364 - DNA, 23 bp, Homo sapiens
tgcttagaacccttctgctttct

SEQ ID NO: 272365 - DNA, 23 bp, Homo sapiens
tgcttagtcacttatttcataaa

SEQ ID NO: 272366 - DNA, 19 bp, Homo sapiens
tgcttatgaatatttataa

SEQ ID NO: 272367 - DNA, 20 bp, Homo sapiens
tgcttatgtatgcctattca

SEQ ID NO: 272368 - DNA, 15 bp, Homo sapiens
tgcttattgttccaa

SEQ ID NO: 272369 - DNA, 21 bp, Homo sapiens
tgcttcaaaaacattcttaca

SEQ ID NO: 272370 - DNA, 21 bp, Homo sapiens
tgcttcaaactcaaacacaga

SEQ ID NO: 272371 - DNA, 15 bp, Homo sapiens
tgcttcaattaataa

SEQ ID NO: 272372 - DNA, 16 bp, Homo sapiens
tgcttcaattaataaa

SEQ ID NO: 272373 - DNA, 23 bp, Homo sapiens
tgcttcaattaataaaaaatgga

SEQ ID NO: 272374 - DNA, 15 bp, Homo sapiens
tgcttcacacccctc

SEQ ID NO: 272375 - DNA, 21 bp, Homo sapiens
tgcttcacggactctttgctg

SEQ ID NO: 272376 - DNA, 14 bp, Homo sapiens
tgcttcagcttgct

SEQ ID NO: 272377 - DNA, 16 bp, Homo sapiens
tgcttcagtggagaat

SEQ ID NO: 272378 - DNA, 11 bp, Homo sapiens
tgcttcatatc

SEQ ID NO: 272379 - DNA, 15 bp, Homo sapiens
tgcttcatatctctc

SEQ ID NO: 272380 - DNA, 17 bp, Homo sapiens
tgcttcatatctctccc

SEQ ID NO: 272381 - DNA, 18 bp, Homo sapiens
tgcttcatatctctccct

SEQ ID NO: 272382 - DNA, 20 bp, Homo sapiens
tgcttcatatctctcccttc

SEQ ID NO: 272383 - DNA, 22 bp, Homo sapiens
tgcttcatatctctcccttctt

SEQ ID NO: 272384 - DNA, 11 bp, Homo sapiens
tgcttccacag

SEQ ID NO: 272385 - DNA, 23 bp, Homo sapiens
tgcttcccaaactcccaggacct

SEQ ID NO: 272386 - DNA, 15 bp, Homo sapiens
tgcttccctctgcct

SEQ ID NO: 272387 - DNA, 13 bp, Homo sapiens
tgcttcctaactt

SEQ ID NO: 272388 - DNA, 22 bp, Homo sapiens
tgcttctcaactaaagaatagt

SEQ ID NO: 272389 - DNA, 17 bp, Homo sapiens
tgcttctcggaggccag

SEQ ID NO: 272390 - DNA, 23 bp, Homo sapiens
tgcttctcggaggccaggccctc

SEQ ID NO: 272391 - DNA, 15 bp, Homo sapiens
tgcttctgggcctga

SEQ ID NO: 272392 - DNA, 16 bp, Homo sapiens
tgcttctgggcctgat

SEQ ID NO: 272393 - DNA, 13 bp, Homo sapiens
tgcttctggggga

SEQ ID NO: 272394 - DNA, 17 bp, Homo sapiens
tgcttcttaaccccagt

SEQ ID NO: 272395 - DNA, 24 bp, Homo sapiens
tgcttcttcaatggcaccttcatt

SEQ ID NO: 272396 - DNA, 15 bp, Homo sapiens
tgcttcttccccagg

SEQ ID NO: 272397 - DNA, 11 bp, Homo sapiens
tgcttcttgta

SEQ ID NO: 272398 - DNA, 12 bp, Homo sapiens
tgcttcttgtaa

SEQ ID NO: 272399 - DNA, 15 bp, Homo sapiens
tgcttcttgtaatat

SEQ ID NO: 272400 - DNA, 13 bp, Homo sapiens
tgcttcttgtgtt

SEQ ID NO: 272401 - DNA, 14 bp, Homo sapiens
tgcttctttataaa

SEQ ID NO: 272402 - DNA, 13 bp, Homo sapiens
tgcttctttttct

SEQ ID NO: 272403 - DNA, 17 bp, Homo sapiens
tgcttgcatttctttat

SEQ ID NO: 272404 - DNA, 23 bp, Homo sapiens
tgcttgccaccaccagatgagaa

SEQ ID NO: 272405 - DNA, 21 bp, Homo sapiens
tgcttgcccagggtgcagtgt

SEQ ID NO: 272406 - DNA, 14 bp, Homo sapiens
tgcttgcctagggc

SEQ ID NO: 272407 - DNA, 16 bp, Homo sapiens
tgcttgcgtgctggga

SEQ ID NO: 272408 - DNA, 21 bp, Homo sapiens
tgcttggaatatctgctgtat

SEQ ID NO: 272409 - DNA, 16 bp, Homo sapiens
tgcttggatccataca

SEQ ID NO: 272410 - DNA, 15 bp, Homo sapiens
tgcttggctgcccca

SEQ ID NO: 272411 - DNA, 15 bp, Homo sapiens
tgcttgggccactgc

SEQ ID NO: 272412 - DNA, 18 bp, Homo sapiens
tgcttgggccactgccct

SEQ ID NO: 272413 - DNA, 19 bp, Homo sapiens
tgcttgggccactgccctc

SEQ ID NO: 272414 - DNA, 13 bp, Homo sapiens
tgcttggggcctg

SEQ ID NO: 272415 - DNA, 17 bp, Homo sapiens
tgcttggggcctggcgt

SEQ ID NO: 272416 - DNA, 15 bp, Homo sapiens
tgcttggggctattt

SEQ ID NO: 272417 - DNA, 19 bp, Homo sapiens
tgcttgtactaagccagga

SEQ ID NO: 272418 - DNA, 12 bp, Homo sapiens
tgcttgtgcctc

SEQ ID NO: 272419 - DNA, 12 bp, Homo sapiens
tgcttgtgttaa

SEQ ID NO: 272420 - DNA, 17 bp, Homo sapiens
tgcttgtgttgggcccc

SEQ ID NO: 272421 - DNA, 22 bp, Homo sapiens
tgcttgtgttgggccccaggga

SEQ ID NO: 272422 - DNA, 14 bp, Homo sapiens
tgcttgtttacagc

SEQ ID NO: 272423 - DNA, 13 bp, Homo sapiens
tgcttgtttatga

SEQ ID NO: 272424 - DNA, 14 bp, Homo sapiens
tgcttgtttatgat

SEQ ID NO: 272425 - DNA, 15 bp, Homo sapiens
tgctttaattgtgaa

SEQ ID NO: 272426 - DNA, 19 bp, Homo sapiens
tgctttacaggatcatgta

SEQ ID NO: 272427 - DNA, 14 bp, Homo sapiens
tgctttagagacag

SEQ ID NO: 272428 - DNA, 15 bp, Homo sapiens
tgctttatgccttct

SEQ ID NO: 272429 - DNA, 19 bp, Homo sapiens
tgctttcacaaatatagtt

SEQ ID NO: 272430 - DNA, 23 bp, Homo sapiens
tgctttccttcggaatccagtgc

SEQ ID NO: 272431 - DNA, 23 bp, Homo sapiens
tgctttcgtagcccctgctaagt

SEQ ID NO: 272432 - DNA, 13 bp, Homo sapiens
tgctttctgactg

SEQ ID NO: 272433 - DNA, 19 bp, Homo sapiens
tgctttgaagcagttgtgt

SEQ ID NO: 272434 - DNA, 20 bp, Homo sapiens
tgctttgactgagcagactg

SEQ ID NO: 272435 - DNA, 13 bp, Homo sapiens
tgctttgctgcta

SEQ ID NO: 272436 - DNA, 15 bp, Homo sapiens
tgctttgctggagtc

SEQ ID NO: 272437 - DNA, 19 bp, Homo sapiens
tgctttgggaggccaaggc

SEQ ID NO: 272438 - DNA, 18 bp, Homo sapiens
tgctttgggctgccctgg

SEQ ID NO: 272439 - DNA, 12 bp, Homo sapiens
tgctttgggctt

SEQ ID NO: 272440 - DNA, 22 bp, Homo sapiens
tgctttgggctttgcaggctct

SEQ ID NO: 272441 - DNA, 17 bp, Homo sapiens
tgctttgtagcttaaaa

SEQ ID NO: 272442 - DNA, 20 bp, Homo sapiens
tgctttgtagcttaaaaaaa

SEQ ID NO: 272443 - DNA, 17 bp, Homo sapiens
tgctttgtgtgattgaa

SEQ ID NO: 272444 - DNA, 20 bp, Homo sapiens
tgcttttacggtgatattgt

SEQ ID NO: 272445 - DNA, 17 bp, Homo sapiens
tgcttttatgtttgtac

SEQ ID NO: 272446 - DNA, 22 bp, Homo sapiens
tgcttttccaggatcctgcagg

SEQ ID NO: 272447 - DNA, 14 bp, Homo sapiens
tgcttttccatcta

SEQ ID NO: 272448 - DNA, 16 bp, Homo sapiens
tgcttttgatggctat

SEQ ID NO: 272449 - DNA, 20 bp, Homo sapiens
tgcttttgatggctatgttt

SEQ ID NO: 272450 - DNA, 16 bp, Homo sapiens
tgcttttgttgtgact

SEQ ID NO: 272451 - DNA, 17 bp, Homo sapiens
tgcttttgttgtgactt

SEQ ID NO: 272452 - DNA, 14 bp, Homo sapiens
tgctttttcactgt

SEQ ID NO: 272453 - DNA, 22 bp, Homo sapiens
tgcttttttttttccagcaagt

SEQ ID NO: 272454 - DNA, 18 bp, Homo sapiens
tggaaaaaaaaaacaaaa

SEQ ID NO: 272455 - DNA, 15 bp, Homo sapiens
tggaaaaaaaaatca

SEQ ID NO: 272456 - DNA, 20 bp, Homo sapiens
tggaaaaaccacccccaaat

SEQ ID NO: 272457 - DNA, 20 bp, Homo sapiens
tggaaaaagaaattctgtta

SEQ ID NO: 272458 - DNA, 12 bp, Homo sapiens
tggaaaagaaac

SEQ ID NO: 272459 - DNA, 13 bp, Homo sapiens
tggaaaagaaatc

SEQ ID NO: 272460 - DNA, 14 bp, Homo sapiens
tggaaaagaaatca

SEQ ID NO: 272461 - DNA, 20 bp, Homo sapiens
tggaaaaggaagactagagg

SEQ ID NO: 272462 - DNA, 21 bp, Homo sapiens
tggaaaatgatctagttcctg

SEQ ID NO: 272463 - DNA, 16 bp, Homo sapiens
tggaaaatgtcctgtg

SEQ ID NO: 272464 - DNA, 15 bp, Homo sapiens
tggaaaccacacttc

SEQ ID NO: 272465 - DNA, 12 bp, Homo sapiens
tggaaaccagaa

SEQ ID NO: 272466 - DNA, 17 bp, Homo sapiens
tggaaacctgccctgcc

SEQ ID NO: 272467 - DNA, 17 bp, Homo sapiens
tggaaactgttggttga

SEQ ID NO: 272468 - DNA, 19 bp, Homo sapiens
tggaaactgttggttgaga

SEQ ID NO: 272469 - DNA, 22 bp, Homo sapiens
tggaaacttttcttaaaaagtt

SEQ ID NO: 272470 - DNA, 16 bp, Homo sapiens
tggaaagacaggaaga

SEQ ID NO: 272471 - DNA, 15 bp, Homo sapiens
tggaaagagctgttt

SEQ ID NO: 272472 - DNA, 19 bp, Homo sapiens
tggaaagaggagaaggaga

SEQ ID NO: 272473 - DNA, 20 bp, Homo sapiens
tggaaagattgtgtctggtc

SEQ ID NO: 272474 - DNA, 18 bp, Homo sapiens
tggaaaggattctaaaca

SEQ ID NO: 272475 - DNA, 23 bp, Homo sapiens
tggaaagggtgctgcttccctct

SEQ ID NO: 272476 - DNA, 16 bp, Homo sapiens
tggaaagggtgtggct

SEQ ID NO: 272477 - DNA, 18 bp, Homo sapiens
tggaaagggtgtggcttg

SEQ ID NO: 272478 - DNA, 18 bp, Homo sapiens
tggaaaggtcctgctgtg

SEQ ID NO: 272479 - DNA, 15 bp, Homo sapiens
tggaaagtgaatttg

SEQ ID NO: 272480 - DNA, 16 bp, Homo sapiens
tggaaagtgaatttga

SEQ ID NO: 272481 - DNA, 16 bp, Homo sapiens
tggaaataaactgtgc

SEQ ID NO: 272482 - DNA, 13 bp, Homo sapiens
tggaaataataaa

SEQ ID NO: 272483 - DNA, 18 bp, Homo sapiens
tggaaatacagttgttgg

SEQ ID NO: 272484 - DNA, 18 bp, Homo sapiens
tggaaattcttccctggg

SEQ ID NO: 272485 - DNA, 19 bp, Homo sapiens
tggaaattcttccctgggg

SEQ ID NO: 272486 - DNA, 20 bp, Homo sapiens
tggaaattcttccctggggg

SEQ ID NO: 272487 - DNA, 23 bp, Homo sapiens
tggaaatttgttataatgaatga

SEQ ID NO: 272488 - DNA, 14 bp, Homo sapiens
tggagaccaggact

SEQ ID NO: 272489 - DNA, 15 bp, Homo sapiens
tggagaccggaattg

SEQ ID NO: 272490 - DNA, 13 bp, Homo sapiens
tggagactcctgc

SEQ ID NO: 272491 - DNA, 19 bp, Homo sapiens
tggagactggtcctgtgtg

SEQ ID NO: 272492 - DNA, 22 bp, Homo sapiens
tggagacttcaggttgttctgt

SEQ ID NO: 272493 - DNA, 14 bp, Homo sapiens
tggagactttctga

SEQ ID NO: 272494 - DNA, 12 bp, Homo sapiens
tggagagaaaac

SEQ ID NO: 272495 - DNA, 22 bp, Homo sapiens
tggagagaactgattgtgagct

SEQ ID NO: 272496 - DNA, 20 bp, Homo sapiens
tggagagaccagcctttctt

SEQ ID NO: 272497 - DNA, 21 bp, Homo sapiens
tggagagaccagcctttcttc

SEQ ID NO: 272498 - DNA, 13 bp, Homo sapiens
tggagagcagctg

SEQ ID NO: 272499 - DNA, 14 bp, Homo sapiens
tggagagcagctgg

SEQ ID NO: 272500 - DNA, 20 bp, Homo sapiens
tggagagcctcttagtgatt

SEQ ID NO: 272501 - DNA, 14 bp, Homo sapiens
tggagagctcagga

SEQ ID NO: 272502 - DNA, 16 bp, Homo sapiens
tggagaggaaaagcca

SEQ ID NO: 272503 - DNA, 13 bp, Homo sapiens
tggagaggagaac

SEQ ID NO: 272504 - DNA, 13 bp, Homo sapiens
tggagaggagaga

SEQ ID NO: 272505 - DNA, 22 bp, Homo sapiens
tggagaggagagaatgagagag

SEQ ID NO: 272506 - DNA, 23 bp, Homo sapiens
tggagaggagagaatgagagagt

SEQ ID NO: 272507 - DNA, 20 bp, Homo sapiens
tggagaggaggtgtggagtg

SEQ ID NO: 272508 - DNA, 23 bp, Homo sapiens
tggagaggaggtgtggagtggag

SEQ ID NO: 272509 - DNA, 19 bp, Homo sapiens
tggagagggaatgtgaaat

SEQ ID NO: 272510 - DNA, 20 bp, Homo sapiens
tggagagggacgaagaaagg

SEQ ID NO: 272511 - DNA, 17 bp, Homo sapiens
tggagaggggacttgga

SEQ ID NO: 272512 - DNA, 20 bp, Homo sapiens
tggagatagtgccaggtggc

SEQ ID NO: 272513 - DNA, 17 bp, Homo sapiens
tggagatgacagaaata

SEQ ID NO: 272514 - DNA, 19 bp, Homo sapiens
tggagatgacagaaatatg

SEQ ID NO: 272515 - DNA, 23 bp, Homo sapiens
tggagatgtcttcgtacagttct

SEQ ID NO: 272516 - DNA, 19 bp, Homo sapiens
tggagatttgaaggtctgc

SEQ ID NO: 272517 - DNA, 15 bp, Homo sapiens
tggagcaaaaggcag

SEQ ID NO: 272518 - DNA, 17 bp, Homo sapiens
tggagcaaaaggcagct

SEQ ID NO: 272519 - DNA, 19 bp, Homo sapiens
tggagcaaaaggcagctca

SEQ ID NO: 272520 - DNA, 20 bp, Homo sapiens
tggagcaaaaggcagctcac

SEQ ID NO: 272521 - DNA, 19 bp, Homo sapiens
tggagcacgtggagatagt

SEQ ID NO: 272522 - DNA, 13 bp, Homo sapiens
tggagcagagacg

SEQ ID NO: 272523 - DNA, 18 bp, Homo sapiens
tggagcagagacggcagc

SEQ ID NO: 272524 - DNA, 18 bp, Homo sapiens
tggagcagcagctgaggc

SEQ ID NO: 272525 - DNA, 12 bp, Homo sapiens
tggagcaggcaa

SEQ ID NO: 272526 - DNA, 17 bp, Homo sapiens
tggagcatgggcctggc

SEQ ID NO: 272527 - DNA, 19 bp, Homo sapiens
tggagcatttggaaggaaa

SEQ ID NO: 272528 - DNA, 15 bp, Homo sapiens
tggagccacaggcag

SEQ ID NO: 272529 - DNA, 18 bp, Homo sapiens
tggagccactcctgtccc

SEQ ID NO: 272530 - DNA, 19 bp, Homo sapiens
tggagccactcctgtcccg

SEQ ID NO: 272531 - DNA, 16 bp, Homo sapiens
tggagccactctgttc

SEQ ID NO: 272532 - DNA, 13 bp, Homo sapiens
tggagccactggg

SEQ ID NO: 272533 - DNA, 16 bp, Homo sapiens
tggagccagcagggct

SEQ ID NO: 272534 - DNA, 20 bp, Homo sapiens
tggagccagcagggctgtga

SEQ ID NO: 272535 - DNA, 15 bp, Homo sapiens
tggagcccctatcct

SEQ ID NO: 272536 - DNA, 14 bp, Homo sapiens
tggagcccctgtgt

SEQ ID NO: 272537 - DNA, 21 bp, Homo sapiens
tggagcccctgtgtgggaggg

SEQ ID NO: 272538 - DNA, 22 bp, Homo sapiens
tggagcccctgtgtgggagggc

SEQ ID NO: 272539 - DNA, 19 bp, Homo sapiens
tggagcccgcacccccacc

SEQ ID NO: 272540 - DNA, 15 bp, Homo sapiens
tggagcccgtgcagt

SEQ ID NO: 272541 - DNA, 22 bp, Homo sapiens
tggagcccgtgcagtacaggca

SEQ ID NO: 272542 - DNA, 22 bp, Homo sapiens
tggagccggactttcggagttg

SEQ ID NO: 272543 - DNA, 23 bp, Homo sapiens
tggagccggactttcggagttgg

SEQ ID NO: 272544 - DNA, 17 bp, Homo sapiens
tggagccgtggccgagg

SEQ ID NO: 272545 - DNA, 13 bp, Homo sapiens
tggagcctgcagg

SEQ ID NO: 272546 - DNA, 19 bp, Homo sapiens
tggagcctttgaataaaaa

SEQ ID NO: 272547 - DNA, 23 bp, Homo sapiens
tggagcgtttgctgtgccaggag

SEQ ID NO: 272548 - DNA, 17 bp, Homo sapiens
tggagctcacccaaggt

SEQ ID NO: 272549 - DNA, 12 bp, Homo sapiens
tggagctcctgg

SEQ ID NO: 272550 - DNA, 18 bp, Homo sapiens
tggagctcctgggaaggc

SEQ ID NO: 272551 - DNA, 21 bp, Homo sapiens
tggagctgaggactctcacga

SEQ ID NO: 272552 - DNA, 14 bp, Homo sapiens
tggagctgcttcca

SEQ ID NO: 272553 - DNA, 16 bp, Homo sapiens
tggagctttgcagcca

SEQ ID NO: 272554 - DNA, 16 bp, Homo sapiens
tggagcttttttcttt

SEQ ID NO: 272555 - DNA, 21 bp, Homo sapiens
tggaggaaaaccaagccgtgg

SEQ ID NO: 272556 - DNA, 19 bp, Homo sapiens
tggaggaaatgttggaact

SEQ ID NO: 272557 - DNA, 23 bp, Homo sapiens
tggaggaacttgctgctgtgcct

SEQ ID NO: 272558 - DNA, 20 bp, Homo sapiens
tggcataatagtcaatttct

SEQ ID NO: 272559 - DNA, 18 bp, Homo sapiens
tggcatcccctttattaa

SEQ ID NO: 272560 - DNA, 18 bp, Homo sapiens
tggcatctctggagtgtg

SEQ ID NO: 272561 - DNA, 19 bp, Homo sapiens
tggcatctctggagtgtgt

SEQ ID NO: 272562 - DNA, 18 bp, Homo sapiens
tggcatctgacacaaaaa

SEQ ID NO: 272563 - DNA, 16 bp, Homo sapiens
tggcatctttgccttg

SEQ ID NO: 272564 - DNA, 23 bp, Homo sapiens
tggcatctttgccttgggctgct

SEQ ID NO: 272565 - DNA, 18 bp, Homo sapiens
tggcatgaagattttctt

SEQ ID NO: 272566 - DNA, 15 bp, Homo sapiens
tggcatggctccagt

SEQ ID NO: 272567 - DNA, 16 bp, Homo sapiens
tggcatggctccagtc

SEQ ID NO: 272568 - DNA, 14 bp, Homo sapiens
tggcatgtaatatt

SEQ ID NO: 272569 - DNA, 12 bp, Homo sapiens
tggcatgtgaaa

SEQ ID NO: 272570 - DNA, 22 bp, Homo sapiens
tggcatgtgctgtgaccattta

SEQ ID NO: 272571 - DNA, 19 bp, Homo sapiens
tggcatgtgggttgtgata

SEQ ID NO: 272572 - DNA, 19 bp, Homo sapiens
tggcattatctctttctct

SEQ ID NO: 272573 - DNA, 15 bp, Homo sapiens
tggcattctacacct

SEQ ID NO: 272574 - DNA, 16 bp, Homo sapiens
tggcattctacacctg

SEQ ID NO: 272575 - DNA, 17 bp, Homo sapiens
tggcattctacacctgg

SEQ ID NO: 272576 - DNA, 20 bp, Homo sapiens
tggcattgtccctgtgccta

SEQ ID NO: 272577 - DNA, 14 bp, Homo sapiens
tggcatttgctgaa

SEQ ID NO: 272578 - DNA, 17 bp, Homo sapiens
tggcattttcctcgcct

SEQ ID NO: 272579 - DNA, 20 bp, Homo sapiens
tggcatttttagctccttga

SEQ ID NO: 272580 - DNA, 14 bp, Homo sapiens
tggccaaaaagaat

SEQ ID NO: 272581 - DNA, 16 bp, Homo sapiens
tggccaaacatcagac

SEQ ID NO: 272582 - DNA, 22 bp, Homo sapiens
tggccaaagtcagtaggagagg

SEQ ID NO: 272583 - DNA, 18 bp, Homo sapiens
tggccaaatatgcacttt

SEQ ID NO: 272584 - DNA, 23 bp, Homo sapiens
tggccaaggggccagctgcccct

SEQ ID NO: 272585 - DNA, 22 bp, Homo sapiens
tggccacaatcctccccaccag

SEQ ID NO: 272586 - DNA, 13 bp, Homo sapiens
tggccacagcagg

SEQ ID NO: 272587 - DNA, 17 bp, Homo sapiens
tggccaccccgtgccac

SEQ ID NO: 272588 - DNA, 19 bp, Homo sapiens
tggccacccgttctgctgg

SEQ ID NO: 272589 - DNA, 22 bp, Homo sapiens
tggccacccgttctgctggcct

SEQ ID NO: 272590 - DNA, 14 bp, Homo sapiens
tggccaccctggcc

SEQ ID NO: 272591 - DNA, 16 bp, Homo sapiens
tggccaccctggcccg

SEQ ID NO: 272592 - DNA, 19 bp, Homo sapiens
tggccacgcagccaggaca

SEQ ID NO: 272593 - DNA, 20 bp, Homo sapiens
tggccacgcagccaggacac

SEQ ID NO: 272594 - DNA, 16 bp, Homo sapiens
tggccacggcctggga

SEQ ID NO: 272595 - DNA, 18 bp, Homo sapiens
tggccacggcctgggagg

SEQ ID NO: 272596 - DNA, 12 bp, Homo sapiens
tggccactctgc

SEQ ID NO: 272597 - DNA, 19 bp, Homo sapiens
tggccactttgcagacctg

SEQ ID NO: 272598 - DNA, 20 bp, Homo sapiens
tggccactttgcagacctgg

SEQ ID NO: 272599 - DNA, 22 bp, Homo sapiens
tggccactttgcagacctggga

SEQ ID NO: 272600 - DNA, 14 bp, Homo sapiens
tggccagaccagag

SEQ ID NO: 272601 - DNA, 16 bp, Homo sapiens
tggccagaccagagct

SEQ ID NO: 272602 - DNA, 20 bp, Homo sapiens
tggccagaccagagctctgg

SEQ ID NO: 272603 - DNA, 23 bp, Homo sapiens
tggccagagagcctggtgctgct

SEQ ID NO: 272604 - DNA, 13 bp, Homo sapiens
tggccagagaggg

SEQ ID NO: 272605 - DNA, 17 bp, Homo sapiens
tggccagagcacctcag

SEQ ID NO: 272606 - DNA, 14 bp, Homo sapiens
tggccagagctgga

SEQ ID NO: 272607 - DNA, 20 bp, Homo sapiens
tggccagagctggaaggcag

SEQ ID NO: 272608 - DNA, 16 bp, Homo sapiens
tggccagcaaggcagg

SEQ ID NO: 272609 - DNA, 19 bp, Homo sapiens
tggccagcctggggcctgg

SEQ ID NO: 272610 - DNA, 15 bp, Homo sapiens
tggccagctctggct

SEQ ID NO: 272611 - DNA, 22 bp, Homo sapiens
tggccaggaggttggtgactga

SEQ ID NO: 272612 - DNA, 18 bp, Homo sapiens
tggccaggcactgccttc

SEQ ID NO: 272613 - DNA, 21 bp, Homo sapiens
tggccaggcactgccttctcc

SEQ ID NO: 272614 - DNA, 23 bp, Homo sapiens
tggccaggcagatctgtgcccca

SEQ ID NO: 272615 - DNA, 16 bp, Homo sapiens
tggccagggctccacg

SEQ ID NO: 272616 - DNA, 22 bp, Homo sapiens
tggccagggtagacttggagct

SEQ ID NO: 272617 - DNA, 19 bp, Homo sapiens
tggccaggtggccactcca

SEQ ID NO: 272618 - DNA, 16 bp, Homo sapiens
tggccagttatccctt

SEQ ID NO: 272619 - DNA, 12 bp, Homo sapiens
tggccatgctca

SEQ ID NO: 272620 - DNA, 18 bp, Homo sapiens
tggccatgctcaaccccc

SEQ ID NO: 272621 - DNA, 20 bp, Homo sapiens
tggccattttgtaccagggc

SEQ ID NO: 272622 - DNA, 13 bp, Homo sapiens
tggcccacccctc

SEQ ID NO: 272623 - DNA, 18 bp, Homo sapiens
tggcccacccctcttccc

SEQ ID NO: 272624 - DNA, 22 bp, Homo sapiens
tggcccacgccctccctctccc

SEQ ID NO: 272625 - DNA, 11 bp, Homo sapiens
tggcccagcag

SEQ ID NO: 272626 - DNA, 21 bp, Homo sapiens
tggcccagcagcggcccagat

SEQ ID NO: 272627 - DNA, 18 bp, Homo sapiens
tggcccagcagcttggct

SEQ ID NO: 272628 - DNA, 22 bp, Homo sapiens
tggcccagcagcttggctgagc

SEQ ID NO: 272629 - DNA, 14 bp, Homo sapiens
tggcccagcctgga

SEQ ID NO: 272630 - DNA, 16 bp, Homo sapiens
tggcccagcctggagc

SEQ ID NO: 272631 - DNA, 12 bp, Homo sapiens
tggcccagcctt

SEQ ID NO: 272632 - DNA, 14 bp, Homo sapiens
tggcccagcggccc

SEQ ID NO: 272633 - DNA, 20 bp, Homo sapiens
tggcccagcggcccctccca

SEQ ID NO: 272634 - DNA, 15 bp, Homo sapiens
tggcccagtcctctc

SEQ ID NO: 272635 - DNA, 13 bp, Homo sapiens
tggcccagtgtca

SEQ ID NO: 272636 - DNA, 15 bp, Homo sapiens
tggcccatctcagcc

SEQ ID NO: 272637 - DNA, 19 bp, Homo sapiens
tggccccagctggctgggt

SEQ ID NO: 272638 - DNA, 23 bp, Homo sapiens
tggccccaggtgccaccaataaa

SEQ ID NO: 272639 - DNA, 19 bp, Homo sapiens
tggccccatccagcatgtg

SEQ ID NO: 272640 - DNA, 12 bp, Homo sapiens
tggcccccctcc

SEQ ID NO: 272641 - DNA, 14 bp, Homo sapiens
tggcccccctccag

SEQ ID NO: 272642 - DNA, 16 bp, Homo sapiens
tggcccccgagctggg

SEQ ID NO: 272643 - DNA, 16 bp, Homo sapiens
tggccccgccctcagg

SEQ ID NO: 272644 - DNA, 13 bp, Homo sapiens
tggcccctcacct

SEQ ID NO: 272645 - DNA, 13 bp, Homo sapiens
tggcccctccagg

SEQ ID NO: 272646 - DNA, 16 bp, Homo sapiens
tggcccctccaggaac

SEQ ID NO: 272647 - DNA, 16 bp, Homo sapiens
tggcccctcccacatc

SEQ ID NO: 272648 - DNA, 17 bp, Homo sapiens
tggcccctcccacatcc

SEQ ID NO: 272649 - DNA, 20 bp, Homo sapiens
tggcccctccttctcccctc

SEQ ID NO: 272650 - DNA, 15 bp, Homo sapiens
tggcccctctgctgt

SEQ ID NO: 272651 - DNA, 11 bp, Homo sapiens
tggccccttca

SEQ ID NO: 272652 - DNA, 21 bp, Homo sapiens
tggccccttcacttctgacca

SEQ ID NO: 272653 - DNA, 14 bp, Homo sapiens
tggcccgacagcct

SEQ ID NO: 272654 - DNA, 15 bp, Homo sapiens
tggcccgcagtggct

SEQ ID NO: 272655 - DNA, 15 bp, Homo sapiens
tggccctgccctgag

SEQ ID NO: 272656 - DNA, 22 bp, Homo sapiens
tggccctggggaagaggccttg

SEQ ID NO: 272657 - DNA, 19 bp, Homo sapiens
tggccctgtgactatggct

SEQ ID NO: 272658 - DNA, 19 bp, Homo sapiens
tggccctgtgggagtccac

SEQ ID NO: 272659 - DNA, 22 bp, Homo sapiens
tggccctgtgggagtccacttt

SEQ ID NO: 272660 - DNA, 14 bp, Homo sapiens
tggcccttccagtg

SEQ ID NO: 272661 - DNA, 15 bp, Homo sapiens
tggcccttccagtgg

SEQ ID NO: 272662 - DNA, 20 bp, Homo sapiens
tggcccttcctggactggcc

SEQ ID NO: 272663 - DNA, 21 bp, Homo sapiens
tggcccttcctggactggccc

SEQ ID NO: 272664 - DNA, 18 bp, Homo sapiens
tggccgaaccccccactc

SEQ ID NO: 272665 - DNA, 19 bp, Homo sapiens
tggccgagggtcctggctc

SEQ ID NO: 272666 - DNA, 16 bp, Homo sapiens
tggccgatgagctggt

SEQ ID NO: 272667 - DNA, 22 bp, Homo sapiens
tggccgcacctaaagcagccag

SEQ ID NO: 272668 - DNA, 14 bp, Homo sapiens
tggccgcctggcag

SEQ ID NO: 272669 - DNA, 16 bp, Homo sapiens
tggccgcctggcaggt

SEQ ID NO: 272670 - DNA, 17 bp, Homo sapiens
tggccgcctggcaggtg

SEQ ID NO: 272671 - DNA, 15 bp, Homo sapiens
tggccgggcacagct

SEQ ID NO: 272672 - DNA, 19 bp, Homo sapiens
tggccgggcacagctgtgg

SEQ ID NO: 272673 - DNA, 18 bp, Homo sapiens
tggccgggctgctgctga

SEQ ID NO: 272674 - DNA, 20 bp, Homo sapiens
tggccgggggtgggggcctg

SEQ ID NO: 272675 - DNA, 22 bp, Homo sapiens
tggccgggggtgggggcctgct

SEQ ID NO: 272676 - DNA, 17 bp, Homo sapiens
tggccgggtcaccctgt

SEQ ID NO: 272677 - DNA, 16 bp, Homo sapiens
tggccggtccaccccg

SEQ ID NO: 272678 - DNA, 14 bp, Homo sapiens
tggccgtctcctcc

SEQ ID NO: 272679 - DNA, 14 bp, Homo sapiens
tggcctaaggctgc

SEQ ID NO: 272680 - DNA, 14 bp, Homo sapiens
tggcctagcccacc

SEQ ID NO: 272681 - DNA, 18 bp, Homo sapiens
tggcctagcccaccctgc

SEQ ID NO: 272682 - DNA, 19 bp, Homo sapiens
tggcctagcccaccctgct

SEQ ID NO: 272683 - DNA, 17 bp, Homo sapiens
tggcctagtcagatgga

SEQ ID NO: 272684 - DNA, 20 bp, Homo sapiens
tggcctattatattaaaata

SEQ ID NO: 272685 - DNA, 21 bp, Homo sapiens
tggctgaaattatgtcaaatg

SEQ ID NO: 272686 - DNA, 22 bp, Homo sapiens
tggctgacagagcaggtctgca

SEQ ID NO: 272687 - DNA, 19 bp, Homo sapiens
tggctgactggggctgggg

SEQ ID NO: 272688 - DNA, 13 bp, Homo sapiens
tggctgagccccc

SEQ ID NO: 272689 - DNA, 13 bp, Homo sapiens
tggctgaggcttg

SEQ ID NO: 272690 - DNA, 20 bp, Homo sapiens
tggctgagtggaatgcaggg

SEQ ID NO: 272691 - DNA, 19 bp, Homo sapiens
tggctgataaaagatacat

SEQ ID NO: 272692 - DNA, 16 bp, Homo sapiens
tggctgcacagcccaa

SEQ ID NO: 272693 - DNA, 23 bp, Homo sapiens
tggctgcccagacccctctggcc

SEQ ID NO: 272694 - DNA, 17 bp, Homo sapiens
tggctgccccaacctgc

SEQ ID NO: 272695 - DNA, 21 bp, Homo sapiens
tggctgccccacaggccacac

SEQ ID NO: 272696 - DNA, 20 bp, Homo sapiens
tggctgctcccagcctcttg

SEQ ID NO: 272697 - DNA, 21 bp, Homo sapiens
tggctgctcccagcctcttgc

SEQ ID NO: 272698 - DNA, 21 bp, Homo sapiens
tggctgctccccacccgcctc

SEQ ID NO: 272699 - DNA, 11 bp, Homo sapiens
tggctgctctg

SEQ ID NO: 272700 - DNA, 13 bp, Homo sapiens
tggctgctgccac

SEQ ID NO: 272701 - DNA, 18 bp, Homo sapiens
tggctggaacactgtact

SEQ ID NO: 272702 - DNA, 19 bp, Homo sapiens
tggctggaggcattcccag

SEQ ID NO: 272703 - DNA, 14 bp, Homo sapiens
tggctggcgcctgt

SEQ ID NO: 272704 - DNA, 18 bp, Homo sapiens
tggctgggagggggccct

SEQ ID NO: 272705 - DNA, 15 bp, Homo sapiens
tggctggggcagagg

SEQ ID NO: 272706 - DNA, 23 bp, Homo sapiens
tggctggggctggcacgggtgtc

SEQ ID NO: 272707 - DNA, 19 bp, Homo sapiens
tggctgggtcgcccctcct

SEQ ID NO: 272708 - DNA, 20 bp, Homo sapiens
tggctgggtcgcccctcctc

SEQ ID NO: 272709 - DNA, 16 bp, Homo sapiens
tggctgggtgggccca

SEQ ID NO: 272710 - DNA, 19 bp, Homo sapiens
tggctgggttcaggtccca

SEQ ID NO: 272711 - DNA, 19 bp, Homo sapiens
tggctgggttttcaggggc

SEQ ID NO: 272712 - DNA, 22 bp, Homo sapiens
tggctggtcaacttgagcatgt

SEQ ID NO: 272713 - DNA, 16 bp, Homo sapiens
tggctggtccagggct

SEQ ID NO: 272714 - DNA, 13 bp, Homo sapiens
tggctgtctgcct

SEQ ID NO: 272715 - DNA, 22 bp, Homo sapiens
tggctgtgagacgaggcagggg

SEQ ID NO: 272716 - DNA, 18 bp, Homo sapiens
tggctgtgagcagcctcc

SEQ ID NO: 272717 - DNA, 14 bp, Homo sapiens
tggctgtgcctccc

SEQ ID NO: 272718 - DNA, 15 bp, Homo sapiens
tggctgtgcctcccc

SEQ ID NO: 272719 - DNA, 18 bp, Homo sapiens
tggctgtgcctctgcctg

SEQ ID NO: 272720 - DNA, 19 bp, Homo sapiens
tggctgtgcctctgcctgt

SEQ ID NO: 272721 - DNA, 21 bp, Homo sapiens
tggctgtggttcctaagcctg

SEQ ID NO: 272722 - DNA, 14 bp, Homo sapiens
tggctgtgtctccc

SEQ ID NO: 272723 - DNA, 14 bp, Homo sapiens
tggctgttccagac

SEQ ID NO: 272724 - DNA, 22 bp, Homo sapiens
tggcttaaaaatacttaataaa

SEQ ID NO: 272725 - DNA, 15 bp, Homo sapiens
tggcttaatgtttat

SEQ ID NO: 272726 - DNA, 11 bp, Homo sapiens
tggcttaattc

SEQ ID NO: 272727 - DNA, 19 bp, Homo sapiens
tggcttataaacacattga

SEQ ID NO: 272728 - DNA, 15 bp, Homo sapiens
tggcttattgtgtga

SEQ ID NO: 272729 - DNA, 20 bp, Homo sapiens
tggcttcaatctacgatgtt

SEQ ID NO: 272730 - DNA, 22 bp, Homo sapiens
tggcttcaatctacgatgttaa

SEQ ID NO: 272731 - DNA, 13 bp, Homo sapiens
tggcttcagaatt

SEQ ID NO: 272732 - DNA, 14 bp, Homo sapiens
tggcttcagcccct

SEQ ID NO: 272733 - DNA, 15 bp, Homo sapiens
tggcttcagcccctg

SEQ ID NO: 272734 - DNA, 22 bp, Homo sapiens
tggcttccagcgggccctctgc

SEQ ID NO: 272735 - DNA, 15 bp, Homo sapiens
tggcttcccgctcag

SEQ ID NO: 272736 - DNA, 17 bp, Homo sapiens
tggcttcccgctcagcc

SEQ ID NO: 272737 - DNA, 16 bp, Homo sapiens
tggcttccgctgtcac

SEQ ID NO: 272738 - DNA, 18 bp, Homo sapiens
tggcttccgtgagacaca

SEQ ID NO: 272739 - DNA, 19 bp, Homo sapiens
tggcttccgtgagacacaa

SEQ ID NO: 272740 - DNA, 16 bp, Homo sapiens
tggcttcctccgtcca

SEQ ID NO: 272741 - DNA, 17 bp, Homo sapiens
tggcttctgcttgtcat

SEQ ID NO: 272742 - DNA, 11 bp, Homo sapiens
tggcttctggg

SEQ ID NO: 272743 - DNA, 12 bp, Homo sapiens
tggcttgacatg

SEQ ID NO: 272744 - DNA, 14 bp, Homo sapiens
tggcttgctccagg

SEQ ID NO: 272745 - DNA, 15 bp, Homo sapiens
tggcttgctccaggg

SEQ ID NO: 272746 - DNA, 18 bp, Homo sapiens
tggcttgggactaaatgc

SEQ ID NO: 272747 - DNA, 20 bp, Homo sapiens
tggcttgggttgaaaagtgt

SEQ ID NO: 272748 - DNA, 18 bp, Homo sapiens
tggcttgtgatctgggaa

SEQ ID NO: 272749 - DNA, 15 bp, Homo sapiens
tggctttcatcctgt

SEQ ID NO: 272750 - DNA, 18 bp, Homo sapiens
tggctttgacatgaaaag

SEQ ID NO: 272751 - DNA, 23 bp, Homo sapiens
tggctttgcccaacctcagcaac

SEQ ID NO: 272752 - DNA, 17 bp, Homo sapiens
tggctttgtcccacagc

SEQ ID NO: 272753 - DNA, 15 bp, Homo sapiens
tggcttttactttat

SEQ ID NO: 272754 - DNA, 20 bp, Homo sapiens
tggcttttactttattaata

SEQ ID NO: 272755 - DNA, 15 bp, Homo sapiens
tggcttttcactgct

SEQ ID NO: 272756 - DNA, 22 bp, Homo sapiens
tggcttttcactgctggctgcc

SEQ ID NO: 272757 - DNA, 18 bp, Homo sapiens
tggctttttaaattttcc

SEQ ID NO: 272758 - DNA, 15 bp, Homo sapiens
tggctttttcccagc

SEQ ID NO: 272759 - DNA, 23 bp, Homo sapiens
tgggaaaaatgcccttaaatcat

SEQ ID NO: 272760 - DNA, 23 bp, Homo sapiens
tgggaaaatgtcccccacctctt

SEQ ID NO: 272761 - DNA, 16 bp, Homo sapiens
tgggaaacgggttgtg

SEQ ID NO: 272762 - DNA, 19 bp, Homo sapiens
tgggaaaggacccacccat

SEQ ID NO: 272763 - DNA, 15 bp, Homo sapiens
tgggaaaggtgctca

SEQ ID NO: 272764 - DNA, 20 bp, Homo sapiens
tgggaaaggttgaattaatt

SEQ ID NO: 272765 - DNA, 14 bp, Homo sapiens
tgggaacaagtgta

SEQ ID NO: 272766 - DNA, 20 bp, Homo sapiens
tgggaacaagtgtacagaag

SEQ ID NO: 272767 - DNA, 13 bp, Homo sapiens
tgggaacactggc

SEQ ID NO: 272768 - DNA, 17 bp, Homo sapiens
tgggaacactggcctgg

SEQ ID NO: 272769 - DNA, 14 bp, Homo sapiens
tgggaaccccgcag

SEQ ID NO: 272770 - DNA, 22 bp, Homo sapiens
tgggaaccccttcatcctctga

SEQ ID NO: 272771 - DNA, 16 bp, Homo sapiens
tgggaaccttcctgtc

SEQ ID NO: 272772 - DNA, 14 bp, Homo sapiens
tgggaacgcagcct

SEQ ID NO: 272773 - DNA, 15 bp, Homo sapiens
tgggaacgcagcctc

SEQ ID NO: 272774 - DNA, 14 bp, Homo sapiens
tgggaagagctggg

SEQ ID NO: 272775 - DNA, 20 bp, Homo sapiens
tgggaagataggctctgcac

SEQ ID NO: 272776 - DNA, 22 bp, Homo sapiens
tgggaagataggctctgcacag

SEQ ID NO: 272777 - DNA, 13 bp, Homo sapiens
tgggaagatgctg

SEQ ID NO: 272778 - DNA, 15 bp, Homo sapiens
tgggaagatgctggc

SEQ ID NO: 272779 - DNA, 11 bp, Homo sapiens
tgggaagccat

SEQ ID NO: 272780 - DNA, 23 bp, Homo sapiens
aggcccttgtcctgccagctgcc

SEQ ID NO: 272781 - DNA, 16 bp, Homo sapiens
aggcccttttctggct

SEQ ID NO: 272782 - DNA, 17 bp, Homo sapiens
aggcccttttctggctc

SEQ ID NO: 272783 - DNA, 18 bp, Homo sapiens
aggccgaagaagggtcct

SEQ ID NO: 272784 - DNA, 22 bp, Homo sapiens
aggccgaagaagggtccttccc

SEQ ID NO: 272785 - DNA, 14 bp, Homo sapiens
aggccgcatggccc

SEQ ID NO: 272786 - DNA, 23 bp, Homo sapiens
aggccgcatggcccctccaggaa

SEQ ID NO: 272787 - DNA, 13 bp, Homo sapiens
aggccgcccacct

SEQ ID NO: 272788 - DNA, 16 bp, Homo sapiens
aggccgcccacctgca

SEQ ID NO: 272789 - DNA, 19 bp, Homo sapiens
aggccgccccagcctctga

SEQ ID NO: 272790 - DNA, 18 bp, Homo sapiens
aggccgctagaggcctga

SEQ ID NO: 272791 - DNA, 15 bp, Homo sapiens
aggccggccagcctc

SEQ ID NO: 272792 - DNA, 13 bp, Homo sapiens
aggccgtcctccc

SEQ ID NO: 272793 - DNA, 17 bp, Homo sapiens
aggccgtcctcccgggc

SEQ ID NO: 272794 - DNA, 21 bp, Homo sapiens
aggccgtcctcccgggccctc

SEQ ID NO: 272795 - DNA, 21 bp, Homo sapiens
aggccgttccccttggcttcc

SEQ ID NO: 272796 - DNA, 23 bp, Homo sapiens
aggccgttccccttggcttcctc

SEQ ID NO: 272797 - DNA, 17 bp, Homo sapiens
aggcctagtcagccaca

SEQ ID NO: 272798 - DNA, 13 bp, Homo sapiens
aggcctcaccctg

SEQ ID NO: 272799 - DNA, 14 bp, Homo sapiens
aggcctcaccctgc

SEQ ID NO: 272800 - DNA, 16 bp, Homo sapiens
aggcctcacctggctt

SEQ ID NO: 272801 - DNA, 17 bp, Homo sapiens
aggcctcaggcctccca

SEQ ID NO: 272802 - DNA, 21 bp, Homo sapiens
aggcctcagtttctccatcag

SEQ ID NO: 272803 - DNA, 13 bp, Homo sapiens
aggcctcatccct

SEQ ID NO: 272804 - DNA, 14 bp, Homo sapiens
aggcctcatccctc

SEQ ID NO: 272805 - DNA, 16 bp, Homo sapiens
aggcctcatccctcgg

SEQ ID NO: 272806 - DNA, 15 bp, Homo sapiens
aggcctccagcctct

SEQ ID NO: 272807 - DNA, 18 bp, Homo sapiens
aggcctccagcctctccc

SEQ ID NO: 272808 - DNA, 18 bp, Homo sapiens
aggcctcccccagccagg

SEQ ID NO: 272809 - DNA, 19 bp, Homo sapiens
aggcctcccccagccagga

SEQ ID NO: 272810 - DNA, 20 bp, Homo sapiens
aggcctcccccagccaggac

SEQ ID NO: 272811 - DNA, 21 bp, Homo sapiens
aggcctcccgcatgctgcctg

SEQ ID NO: 272812 - DNA, 15 bp, Homo sapiens
aggcctccctctctc

SEQ ID NO: 272813 - DNA, 12 bp, Homo sapiens
aggcctctgggc

SEQ ID NO: 272814 - DNA, 13 bp, Homo sapiens
aggcctcttgctg

SEQ ID NO: 272815 - DNA, 16 bp, Homo sapiens
aggcctcttgctggtg

SEQ ID NO: 272816 - DNA, 23 bp, Homo sapiens
aggcctgaaagaggctgaggcct

SEQ ID NO: 272817 - DNA, 19 bp, Homo sapiens
aggcctgaaatgtttccag

SEQ ID NO: 272818 - DNA, 22 bp, Homo sapiens
aggcctgaaatgtttccaggca

SEQ ID NO: 272819 - DNA, 18 bp, Homo sapiens
aggcctgaggatgagctg

SEQ ID NO: 272820 - DNA, 14 bp, Homo sapiens
aggcctgaggctgc

SEQ ID NO: 272821 - DNA, 17 bp, Homo sapiens
aggcctgagggaagccc

SEQ ID NO: 272822 - DNA, 16 bp, Homo sapiens
aggcctgatgctgccc

SEQ ID NO: 272823 - DNA, 15 bp, Homo sapiens
aggcctgccaatgcc

SEQ ID NO: 272824 - DNA, 13 bp, Homo sapiens
aggcctgccagcc

SEQ ID NO: 272825 - DNA, 16 bp, Homo sapiens
aggcctgccccccttc

SEQ ID NO: 272826 - DNA, 17 bp, Homo sapiens
aggcctgccccccttcc

SEQ ID NO: 272827 - DNA, 18 bp, Homo sapiens
aggcctgccccccttccc

SEQ ID NO: 272828 - DNA, 19 bp, Homo sapiens
aggcctgccccccttccca

SEQ ID NO: 272829 - DNA, 22 bp, Homo sapiens
aggcctgccccccttcccaccc

SEQ ID NO: 272830 - DNA, 11 bp, Homo sapiens
aggcctgccct

SEQ ID NO: 272831 - DNA, 22 bp, Homo sapiens
tgggcatggtaccagccctggg

SEQ ID NO: 272832 - DNA, 13 bp, Homo sapiens
tgggcattgggct

SEQ ID NO: 272833 - DNA, 16 bp, Homo sapiens
tgggcattgggctgac

SEQ ID NO: 272834 - DNA, 17 bp, Homo sapiens
tgggcattgggctgaca

SEQ ID NO: 272835 - DNA, 19 bp, Homo sapiens
tgggcattgggttctaaag

SEQ ID NO: 272836 - DNA, 22 bp, Homo sapiens
tgggccaatcactgagtttgtg

SEQ ID NO: 272837 - DNA, 18 bp, Homo sapiens
tgggccacacccaggaag

SEQ ID NO: 272838 - DNA, 13 bp, Homo sapiens
tgggccacccttc

SEQ ID NO: 272839 - DNA, 13 bp, Homo sapiens
tgggccactgccc

SEQ ID NO: 272840 - DNA, 15 bp, Homo sapiens
tgggccagcccctcc

SEQ ID NO: 272841 - DNA, 16 bp, Homo sapiens
tgggccagcccctccc

SEQ ID NO: 272842 - DNA, 20 bp, Homo sapiens
tgggccagcccctcccacca

SEQ ID NO: 272843 - DNA, 22 bp, Homo sapiens
tgggccagcccctcccaccaca

SEQ ID NO: 272844 - DNA, 23 bp, Homo sapiens
tgggccagcccctcccaccacag

SEQ ID NO: 272845 - DNA, 13 bp, Homo sapiens
tgggccagggtct

SEQ ID NO: 272846 - DNA, 17 bp, Homo sapiens
tgggccagtggctgggg

SEQ ID NO: 272847 - DNA, 14 bp, Homo sapiens
tgggcccagaactg

SEQ ID NO: 272848 - DNA, 18 bp, Homo sapiens
tgggcccagaactgcccc

SEQ ID NO: 272849 - DNA, 19 bp, Homo sapiens
tgggcccagaactgccccc

SEQ ID NO: 272850 - DNA, 22 bp, Homo sapiens
tgggcccagaactgcccccact

SEQ ID NO: 272851 - DNA, 17 bp, Homo sapiens
tgggcccagaggcacag

SEQ ID NO: 272852 - DNA, 18 bp, Homo sapiens
tgggcccagaggcacagc

SEQ ID NO: 272853 - DNA, 14 bp, Homo sapiens
tgggcccagccggg

SEQ ID NO: 272854 - DNA, 22 bp, Homo sapiens
tgggcccagccggggtggggtg

SEQ ID NO: 272855 - DNA, 19 bp, Homo sapiens
tgggcccagctgggctctg

SEQ ID NO: 272856 - DNA, 21 bp, Homo sapiens
tgggcccataatagttagccc

SEQ ID NO: 272857 - DNA, 11 bp, Homo sapiens
tgggccccagg

SEQ ID NO: 272858 - DNA, 14 bp, Homo sapiens
tgggccccagggaa

SEQ ID NO: 272859 - DNA, 18 bp, Homo sapiens
tgggccccatgctctgcc

SEQ ID NO: 272860 - DNA, 21 bp, Homo sapiens
tgggccccatgctctgcccca

SEQ ID NO: 272861 - DNA, 19 bp, Homo sapiens
tgggccccattctccctcc

SEQ ID NO: 272862 - DNA, 15 bp, Homo sapiens
tggggccccaaagcc

SEQ ID NO: 272863 - DNA, 18 bp, Homo sapiens
tggggccccaaagcccag

SEQ ID NO: 272864 - DNA, 22 bp, Homo sapiens
tggggcccctttttactcccct

SEQ ID NO: 272865 - DNA, 18 bp, Homo sapiens
tggggcctccttgtccag

SEQ ID NO: 272866 - DNA, 22 bp, Homo sapiens
tggggcctccttgtccaggtct

SEQ ID NO: 272867 - DNA, 20 bp, Homo sapiens
tggggcctggacctgcctcc

SEQ ID NO: 272868 - DNA, 13 bp, Homo sapiens
tggggcctggcct

SEQ ID NO: 272869 - DNA, 21 bp, Homo sapiens
tggggcctggcctatttaagc

SEQ ID NO: 272870 - DNA, 13 bp, Homo sapiens
tggggcctggctt

SEQ ID NO: 272871 - DNA, 14 bp, Homo sapiens
tggggcctggcttg

SEQ ID NO: 272872 - DNA, 20 bp, Homo sapiens
tggggcctggcttgctccag

SEQ ID NO: 272873 - DNA, 23 bp, Homo sapiens
tggggcctggcttgctccagggt

SEQ ID NO: 272874 - DNA, 15 bp, Homo sapiens
tggggcgaggcagag

SEQ ID NO: 272875 - DNA, 18 bp, Homo sapiens
tggggcgaggcagaggac

SEQ ID NO: 272876 - DNA, 20 bp, Homo sapiens
tggggcgggggtctatacat

SEQ ID NO: 272877 - DNA, 20 bp, Homo sapiens
tggggctcgccccacccagg

SEQ ID NO: 272878 - DNA, 22 bp, Homo sapiens
tggggctcgccccacccagggc

SEQ ID NO: 272879 - DNA, 21 bp, Homo sapiens
tggggctcgtggccttcccct

SEQ ID NO: 272880 - DNA, 13 bp, Homo sapiens
tggggctctggga

SEQ ID NO: 272881 - DNA, 14 bp, Homo sapiens
tggggctgagcctg

SEQ ID NO: 272882 - DNA, 16 bp, Homo sapiens
tggggctgagcctgag

SEQ ID NO: 272883 - DNA, 11 bp, Homo sapiens
tggggctgggg

SEQ ID NO: 272884 - DNA, 15 bp, Homo sapiens
tggggcttcaccagt

SEQ ID NO: 272885 - DNA, 21 bp, Homo sapiens
tggggcttcaccagtctgtct

SEQ ID NO: 272886 - DNA, 15 bp, Homo sapiens
tggggcttctcctga

SEQ ID NO: 272887 - DNA, 15 bp, Homo sapiens
tggggcttggaaggg

SEQ ID NO: 272888 - DNA, 19 bp, Homo sapiens
tgggggagaatggctctgg

SEQ ID NO: 272889 - DNA, 13 bp, Homo sapiens
tgggggagagcag

SEQ ID NO: 272890 - DNA, 13 bp, Homo sapiens
tgggggagcctgg

SEQ ID NO: 272891 - DNA, 20 bp, Homo sapiens
tgggggagcctggagcccct

SEQ ID NO: 272892 - DNA, 13 bp, Homo sapiens
tgggggatgctga

SEQ ID NO: 272893 - DNA, 14 bp, Homo sapiens
tgggggatgctgag

SEQ ID NO: 272894 - DNA, 15 bp, Homo sapiens
tgggggatgcttcat

SEQ ID NO: 272895 - DNA, 16 bp, Homo sapiens
tgggggattcaaatgc

SEQ ID NO: 272896 - DNA, 17 bp, Homo sapiens
tgggggattcaaatgca

SEQ ID NO: 272897 - DNA, 22 bp, Homo sapiens
tgggggcaggagggccctacct

SEQ ID NO: 272898 - DNA, 19 bp, Homo sapiens
tgggggcagtgactggcag

SEQ ID NO: 272899 - DNA, 20 bp, Homo sapiens
tgggggcagtgactggcagg

SEQ ID NO: 272900 - DNA, 16 bp, Homo sapiens
tgggggcatgggggag

SEQ ID NO: 272901 - DNA, 18 bp, Homo sapiens
tgggggcatgggggaggc

SEQ ID NO: 272902 - DNA, 21 bp, Homo sapiens
tgggggcctcactccaggaag

SEQ ID NO: 272903 - DNA, 13 bp, Homo sapiens
tgggggctcctgt

SEQ ID NO: 272904 - DNA, 20 bp, Homo sapiens
tggggggcaaggtgggggag

SEQ ID NO: 272905 - DNA, 15 bp, Homo sapiens
tggggggcacagcca

SEQ ID NO: 272906 - DNA, 14 bp, Homo sapiens
tgggggggcttggg

SEQ ID NO: 272907 - DNA, 20 bp, Homo sapiens
tgggggggcttggggtagag

SEQ ID NO: 272908 - DNA, 15 bp, Homo sapiens
tgggggtagagctga

SEQ ID NO: 272909 - DNA, 21 bp, Homo sapiens
tgggggtagagctgatccaga

SEQ ID NO: 272910 - DNA, 16 bp, Homo sapiens
tgggggtctggcctag

SEQ ID NO: 272911 - DNA, 20 bp, Homo sapiens
tgggggtgtcacagaggcag

SEQ ID NO: 272912 - DNA, 21 bp, Homo sapiens
tgggggtgtcacagaggcagt

SEQ ID NO: 272913 - DNA, 15 bp, Homo sapiens
tgggggttggctggg

SEQ ID NO: 272914 - DNA, 16 bp, Homo sapiens
tgggggttggctgggt

SEQ ID NO: 272915 - DNA, 21 bp, Homo sapiens
tggggtactactctccagctt

SEQ ID NO: 272916 - DNA, 22 bp, Homo sapiens
tggggtaggaaaccaccctgag

SEQ ID NO: 272917 - DNA, 23 bp, Homo sapiens
tggggtaggaaaccaccctgagg

SEQ ID NO: 272918 - DNA, 13 bp, Homo sapiens
tggggtagggctg

SEQ ID NO: 272919 - DNA, 18 bp, Homo sapiens
tggggtccccactccctg

SEQ ID NO: 272920 - DNA, 16 bp, Homo sapiens
tggggtcccccctgag

SEQ ID NO: 272921 - DNA, 21 bp, Homo sapiens
tggggtctcacagtgttgccc

SEQ ID NO: 272922 - DNA, 16 bp, Homo sapiens
tggggtctcagtccag

SEQ ID NO: 272923 - DNA, 22 bp, Homo sapiens
tggggtctctgagcagtgggga

SEQ ID NO: 272924 - DNA, 13 bp, Homo sapiens
tggggtgagagag

SEQ ID NO: 272925 - DNA, 17 bp, Homo sapiens
tggggtgcctgagcccg

SEQ ID NO: 272926 - DNA, 15 bp, Homo sapiens
tggggtggcgtctgc

SEQ ID NO: 272927 - DNA, 16 bp, Homo sapiens
tggggtggcgtctgcc

SEQ ID NO: 272928 - DNA, 13 bp, Homo sapiens
tggggtgggccca

SEQ ID NO: 272929 - DNA, 12 bp, Homo sapiens
tggggtgggcct

SEQ ID NO: 272930 - DNA, 15 bp, Homo sapiens
tggggtggggcggga

SEQ ID NO: 272931 - DNA, 23 bp, Homo sapiens
tggggtgggtttagcaggctgca

SEQ ID NO: 272932 - DNA, 14 bp, Homo sapiens
tggggttcgtggaa

SEQ ID NO: 272933 - DNA, 21 bp, Homo sapiens
tggggttggctgggcccagaa

SEQ ID NO: 272934 - DNA, 19 bp, Homo sapiens
tggggttgggattgggggc

SEQ ID NO: 272935 - DNA, 14 bp, Homo sapiens
tgggtaacgtgaga

SEQ ID NO: 272936 - DNA, 14 bp, Homo sapiens
tgggtaactgtcaa

SEQ ID NO: 272937 - DNA, 21 bp, Homo sapiens
tgggtaggtgttgaaaatgag

SEQ ID NO: 272938 - DNA, 15 bp, Homo sapiens
tgggtatcccacctc

SEQ ID NO: 272939 - DNA, 16 bp, Homo sapiens
tgggtatcccacctcc

SEQ ID NO: 272940 - DNA, 20 bp, Homo sapiens
tgggtatcccacctccagcc

SEQ ID NO: 272941 - DNA, 22 bp, Homo sapiens
tgggtatcccacctccagccca

SEQ ID NO: 272942 - DNA, 20 bp, Homo sapiens
tgggtatcctgcccagtgtt

SEQ ID NO: 272943 - DNA, 13 bp, Homo sapiens
tgggtattaaact

SEQ ID NO: 272944 - DNA, 22 bp, Homo sapiens
tgggtattaaacttgtcagaat

SEQ ID NO: 272945 - DNA, 21 bp, Homo sapiens
tgggtatttgcaatattcctt

SEQ ID NO: 272946 - DNA, 17 bp, Homo sapiens
tgggtcaactccaaggc

SEQ ID NO: 272947 - DNA, 23 bp, Homo sapiens
tgggtcatcccagcacctgccag

SEQ ID NO: 272948 - DNA, 21 bp, Homo sapiens
tgggtccaggaaggcagctgc

SEQ ID NO: 272949 - DNA, 22 bp, Homo sapiens
tgggtccaggaaggcagctgct

SEQ ID NO: 272950 - DNA, 21 bp, Homo sapiens
tgggtcctgcaatctccaggg

SEQ ID NO: 272951 - DNA, 23 bp, Homo sapiens
tgggtcctgcaatctccagggct

SEQ ID NO: 272952 - DNA, 13 bp, Homo sapiens
tgggtcctgctgc

SEQ ID NO: 272953 - DNA, 16 bp, Homo sapiens
tgggtcggccctgccc

SEQ ID NO: 272954 - DNA, 17 bp, Homo sapiens
tgggtcggccctgccca

SEQ ID NO: 272955 - DNA, 20 bp, Homo sapiens
tgggtctcgctttgttgccc

SEQ ID NO: 272956 - DNA, 19 bp, Homo sapiens
tgggtctgtgtctcttttc

SEQ ID NO: 272957 - DNA, 15 bp, Homo sapiens
tgggtgaagggagag

SEQ ID NO: 272958 - DNA, 17 bp, Homo sapiens
tgggtgacagagcaaga

SEQ ID NO: 272959 - DNA, 23 bp, Homo sapiens
tgggtgaccagttgcacttggcc

SEQ ID NO: 272960 - DNA, 12 bp, Homo sapiens
tgggtgagaaat

SEQ ID NO: 272961 - DNA, 14 bp, Homo sapiens
tgggtgagaaattt

SEQ ID NO: 272962 - DNA, 19 bp, Homo sapiens
tgggtgagaaattttagtt

SEQ ID NO: 272963 - DNA, 18 bp, Homo sapiens
tgggtgagaatcctgcct

SEQ ID NO: 272964 - DNA, 15 bp, Homo sapiens
tgggtgcccacagcc

SEQ ID NO: 272965 - DNA, 21 bp, Homo sapiens
tgggtgctctggctggagagg

SEQ ID NO: 272966 - DNA, 14 bp, Homo sapiens
tgggtgctggctgc

SEQ ID NO: 272967 - DNA, 18 bp, Homo sapiens
tgggtgctggctgcccag

SEQ ID NO: 272968 - DNA, 16 bp, Homo sapiens
tgggtggcacctcctg

SEQ ID NO: 272969 - DNA, 15 bp, Homo sapiens
tgggtggggtgagga

SEQ ID NO: 272970 - DNA, 20 bp, Homo sapiens
tgggtggggtgaggaccact

SEQ ID NO: 272971 - DNA, 17 bp, Homo sapiens
tgggtggtaactgccag

SEQ ID NO: 272972 - DNA, 14 bp, Homo sapiens
tgggtgtgccctgg

SEQ ID NO: 272973 - DNA, 15 bp, Homo sapiens
tgggtgtgccctggc

SEQ ID NO: 272974 - DNA, 18 bp, Homo sapiens
tgggtgtgccctggctcc

SEQ ID NO: 272975 - DNA, 20 bp, Homo sapiens
tgggtgtgtttcaggacagc

SEQ ID NO: 272976 - DNA, 23 bp, Homo sapiens
tgggttaatggctagtactgtat

SEQ ID NO: 272977 - DNA, 15 bp, Homo sapiens
tgggttcaaaaagaa

SEQ ID NO: 272978 - DNA, 20 bp, Homo sapiens
tgggttcagaaatgctgcct

SEQ ID NO: 272979 - DNA, 24 bp, Homo sapiens
tgggttcaggggactcagccctga

SEQ ID NO: 272980 - DNA, 16 bp, Homo sapiens
tgggttcattattgga

SEQ ID NO: 272981 - DNA, 18 bp, Homo sapiens
tgggttccaatcctggct

SEQ ID NO: 272982 - DNA, 20 bp, Homo sapiens
tgggttccagacagagtgga

SEQ ID NO: 272983 - DNA, 20 bp, Homo sapiens
tgggttccctttccttccat

SEQ ID NO: 272984 - DNA, 13 bp, Homo sapiens
tgggttctcttca

SEQ ID NO: 272985 - DNA, 19 bp, Homo sapiens
tgggttgcgtcctgacggc

SEQ ID NO: 272986 - DNA, 22 bp, Homo sapiens
tgggtttacaacaaacactgtg

SEQ ID NO: 272987 - DNA, 15 bp, Homo sapiens
tgggtttactctgtg

SEQ ID NO: 272988 - DNA, 13 bp, Homo sapiens
tgggtttcaattt

SEQ ID NO: 272989 - DNA, 14 bp, Homo sapiens
tgggtttctctgtg

SEQ ID NO: 272990 - DNA, 21 bp, Homo sapiens
tgggtttgggcagtggagagg

SEQ ID NO: 272991 - DNA, 19 bp, Homo sapiens
tgggttttattgtccttca

SEQ ID NO: 272992 - DNA, 15 bp, Homo sapiens
tgggtttttgttacc

SEQ ID NO: 272993 - DNA, 13 bp, Homo sapiens
tggtaaactattt

SEQ ID NO: 272994 - DNA, 23 bp, Homo sapiens
tggtaacaagaggagcaggaagc

SEQ ID NO: 272995 - DNA, 14 bp, Homo sapiens
tggttggaggcctg

SEQ ID NO: 272996 - DNA, 22 bp, Homo sapiens
tggttggaggcctggtctggag

SEQ ID NO: 272997 - DNA, 15 bp, Homo sapiens
tggttgtatttctat

SEQ ID NO: 272998 - DNA, 17 bp, Homo sapiens
tggttgtcaatattaaa

SEQ ID NO: 272999 - DNA, 12 bp, Homo sapiens
tggttgtgtagg

SEQ ID NO: 273000 - DNA, 15 bp, Homo sapiens
tggttgttgccaact

SEQ ID NO: 273001 - DNA, 22 bp, Homo sapiens
tggttgttgccaggttgcagct

SEQ ID NO: 273002 - DNA, 18 bp, Homo sapiens
tggttgtttctctgagct

SEQ ID NO: 273003 - DNA, 17 bp, Homo sapiens
tggttgtttgctgtttt

SEQ ID NO: 273004 - DNA, 14 bp, Homo sapiens
tggtttactgctgt

SEQ ID NO: 273005 - DNA, 16 bp, Homo sapiens
tggtttactgctgtca

SEQ ID NO: 273006 - DNA, 21 bp, Homo sapiens
tggtttatgagaactggttct

SEQ ID NO: 273007 - DNA, 22 bp, Homo sapiens
tggtttatgagaactggttctt

SEQ ID NO: 273008 - DNA, 16 bp, Homo sapiens
tggtttcactggccca

SEQ ID NO: 273009 - DNA, 14 bp, Homo sapiens
tggtttcagaaagg

SEQ ID NO: 273010 - DNA, 22 bp, Homo sapiens
tggtttcagaaagggcagcccc

SEQ ID NO: 273011 - DNA, 16 bp, Homo sapiens
tggtttctagacttgt

SEQ ID NO: 273012 - DNA, 12 bp, Homo sapiens
tggtttctccag

SEQ ID NO: 273013 - DNA, 13 bp, Homo sapiens
tggtttgccatgt

SEQ ID NO: 273014 - DNA, 21 bp, Homo sapiens
tggtttgggccccattcagaa

SEQ ID NO: 273015 - DNA, 22 bp, Homo sapiens
tggtttggggcgaggcagagga

SEQ ID NO: 273016 - DNA, 23 bp, Homo sapiens
tggtttggggcgaggcagaggac

SEQ ID NO: 273017 - DNA, 13 bp, Homo sapiens
tggtttgtcctga

SEQ ID NO: 273018 - DNA, 22 bp, Homo sapiens
tggtttgtgagccttgctgcca

SEQ ID NO: 273019 - DNA, 20 bp, Homo sapiens
tggttttattctttgagaag

SEQ ID NO: 273020 - DNA, 20 bp, Homo sapiens
tggttttcccctccctgggt

SEQ ID NO: 273021 - DNA, 21 bp, Homo sapiens
tggttttcccctccctgggtt

SEQ ID NO: 273022 - DNA, 22 bp, Homo sapiens
tggttttcccctccctgggttc

SEQ ID NO: 273023 - DNA, 13 bp, Homo sapiens
tggttttctgttt

SEQ ID NO: 273024 - DNA, 19 bp, Homo sapiens
tggttttcttgtgtgttta

SEQ ID NO: 273025 - DNA, 10 bp, Homo sapiens
tggttttttt

SEQ ID NO: 273026 - DNA, 15 bp, Homo sapiens
tgtaaaaaaggaaca

SEQ ID NO: 273027 - DNA, 20 bp, Homo sapiens
tgtaaaaacacaaatgtgta

SEQ ID NO: 273028 - DNA, 22 bp, Homo sapiens
tgtaaaaacacaaatgtgtact

SEQ ID NO: 273029 - DNA, 22 bp, Homo sapiens
tgtaaaaagagagaaaacttat

SEQ ID NO: 273030 - DNA, 11 bp, Homo sapiens
tgtaaaaatat

SEQ ID NO: 273031 - DNA, 17 bp, Homo sapiens
tgtaaaaatgaaggaat

SEQ ID NO: 273032 - DNA, 16 bp, Homo sapiens
tgtaaaactgaggcac

SEQ ID NO: 273033 - DNA, 13 bp, Homo sapiens
tgtaaaactgtga

SEQ ID NO: 273034 - DNA, 14 bp, Homo sapiens
tgtaaaactgtgac

SEQ ID NO: 273035 - DNA, 15 bp, Homo sapiens
tgtaaaactgtgaca

SEQ ID NO: 273036 - DNA, 16 bp, Homo sapiens
tgtaaaactgtgacat

SEQ ID NO: 273037 - DNA, 12 bp, Homo sapiens
tgtaaaacttta

SEQ ID NO: 273038 - DNA, 22 bp, Homo sapiens
tgtaaaagtactctgaaaagca

SEQ ID NO: 273039 - DNA, 14 bp, Homo sapiens
tgtaaaatactatt

SEQ ID NO: 273040 - DNA, 12 bp, Homo sapiens
tgtaaaatagct

SEQ ID NO: 273041 - DNA, 17 bp, Homo sapiens
tgtaaaatagcttgtat

SEQ ID NO: 273042 - DNA, 16 bp, Homo sapiens
tgtaaaatcttcagct

SEQ ID NO: 273043 - DNA, 19 bp, Homo sapiens
tgtaaaatcttcagctggt

SEQ ID NO: 273044 - DNA, 19 bp, Homo sapiens
tgtaaaatcttgtcatgtg

SEQ ID NO: 273045 - DNA, 20 bp, Homo sapiens
tgtaaaatcttgtcatgtgt

SEQ ID NO: 273046 - DNA, 22 bp, Homo sapiens
tgtaaaatcttgtcatgtgtat

SEQ ID NO: 273047 - DNA, 15 bp, Homo sapiens
tgtaaaatgaaatta

SEQ ID NO: 273048 - DNA, 20 bp, Homo sapiens
tgtaaaatgtgaagtgaatg

SEQ ID NO: 273049 - DNA, 14 bp, Homo sapiens
tgtaaaattgtata

SEQ ID NO: 273050 - DNA, 20 bp, Homo sapiens
tgtaaacaggagacaggaag

SEQ ID NO: 273051 - DNA, 22 bp, Homo sapiens
tgtaaacatgtgttttaattcc

SEQ ID NO: 273052 - DNA, 16 bp, Homo sapiens
tgtaaaccacttgtca

SEQ ID NO: 273053 - DNA, 21 bp, Homo sapiens
tgtaaactcaaaacttaacat

SEQ ID NO: 273054 - DNA, 20 bp, Homo sapiens
tgtaaactgtatcaaatctg

SEQ ID NO: 273055 - DNA, 15 bp, Homo sapiens
tgtaaactttttcaa

SEQ ID NO: 273056 - DNA, 20 bp, Homo sapiens
tgtaaactttttcaatggtt

SEQ ID NO: 273057 - DNA, 18 bp, Homo sapiens
tgtaaagccaacaccctg

SEQ ID NO: 273058 - DNA, 17 bp, Homo sapiens
tgtaaaggtaggtgcat

SEQ ID NO: 273059 - DNA, 18 bp, Homo sapiens
tgtaaaggtaggtgcatg

SEQ ID NO: 273060 - DNA, 20 bp, Homo sapiens
tgtaaaggtaggtgcatgcc

SEQ ID NO: 273061 - DNA, 21 bp, Homo sapiens
tgtaaataaccacaaggtcca

SEQ ID NO: 273062 - DNA, 23 bp, Homo sapiens
tgtaaatacaaaataaaattatg

SEQ ID NO: 273063 - DNA, 12 bp, Homo sapiens
tgtaaatacacc

SEQ ID NO: 273064 - DNA, 16 bp, Homo sapiens
tgtaaatacatgtgtg

SEQ ID NO: 273065 - DNA, 20 bp, Homo sapiens
tgtaaataccagactgcagg

SEQ ID NO: 273066 - DNA, 14 bp, Homo sapiens
tgtaaatatcccag

SEQ ID NO: 273067 - DNA, 14 bp, Homo sapiens
tgtaaatattctat

SEQ ID NO: 273068 - DNA, 17 bp, Homo sapiens
tgtaaatattcttgtcc

SEQ ID NO: 273069 - DNA, 22 bp, Homo sapiens
tgtaaatattcttgtccacatt

SEQ ID NO: 273070 - DNA, 22 bp, Homo sapiens
tgtaaatgatatgtctttaaaa

SEQ ID NO: 273071 - DNA, 18 bp, Homo sapiens
tgtaaatgtcttttcaaa

SEQ ID NO: 273072 - DNA, 20 bp, Homo sapiens
tgtaaatgtttaatatctga

SEQ ID NO: 273073 - DNA, 10 bp, Homo sapiens
tgtaaattat

SEQ ID NO: 273074 - DNA, 16 bp, Homo sapiens
tgtaaattatgtaatg

SEQ ID NO: 273075 - DNA, 11 bp, Homo sapiens
tgtaaattatt

SEQ ID NO: 273076 - DNA, 18 bp, Homo sapiens
tgtaaattattgtaaact

SEQ ID NO: 273077 - DNA, 22 bp, Homo sapiens
tgtaaattgatgggagaaatga

SEQ ID NO: 273078 - DNA, 13 bp, Homo sapiens
tgtaaatttgtac

SEQ ID NO: 273079 - DNA, 23 bp, Homo sapiens
tgtaacacagctgagagactttt

SEQ ID NO: 273080 - DNA, 14 bp, Homo sapiens
tgtaacagctgagg

SEQ ID NO: 273081 - DNA, 17 bp, Homo sapiens
tgtaacagttggtgatt

SEQ ID NO: 273082 - DNA, 17 bp, Homo sapiens
tgtaacattctatttca

SEQ ID NO: 273083 - DNA, 23 bp, Homo sapiens
tgtaaccatatgattgaaaagaa

SEQ ID NO: 273084 - DNA, 23 bp, Homo sapiens
tgtaacccttgaatttctagaca

SEQ ID NO: 273085 - DNA, 14 bp, Homo sapiens
tgtaacctcagctc

SEQ ID NO: 273086 - DNA, 15 bp, Homo sapiens
tgtaacctcagctct

SEQ ID NO: 273087 - DNA, 16 bp, Homo sapiens
tgtaacctcagctctg

SEQ ID NO: 273088 - DNA, 19 bp, Homo sapiens
tgtaacctcagctctggga

SEQ ID NO: 273089 - DNA, 13 bp, Homo sapiens
tgtaactgcccaa

SEQ ID NO: 273090 - DNA, 12 bp, Homo sapiens
tgtaactgctga

SEQ ID NO: 273091 - DNA, 16 bp, Homo sapiens
tgtaactgctgagcca

SEQ ID NO: 273092 - DNA, 21 bp, Homo sapiens
tgtaacttaattataagctat

SEQ ID NO: 273093 - DNA, 13 bp, Homo sapiens
tgtaactttgcat

SEQ ID NO: 273094 - DNA, 16 bp, Homo sapiens
tgtaactttgcatgtt

SEQ ID NO: 273095 - DNA, 15 bp, Homo sapiens
tgtaagaaaacaaaa

SEQ ID NO: 273096 - DNA, 19 bp, Homo sapiens
tgtaagaaaacaaaatcta

SEQ ID NO: 273097 - DNA, 14 bp, Homo sapiens
tgtaagaagcccga

SEQ ID NO: 273098 - DNA, 22 bp, Homo sapiens
tgtaagaagctaaaatgaaaaa

SEQ ID NO: 273099 - DNA, 16 bp, Homo sapiens
tgtaagacacacagcc

SEQ ID NO: 273100 - DNA, 22 bp, Homo sapiens
tgtaagagcaccttcctcactt

SEQ ID NO: 273101 - DNA, 20 bp, Homo sapiens
tgtaagcattctgagctggg

SEQ ID NO: 273102 - DNA, 15 bp, Homo sapiens
tgtaagctctttgaa

SEQ ID NO: 273103 - DNA, 17 bp, Homo sapiens
tgtaagctgactggccc

SEQ ID NO: 273104 - DNA, 21 bp, Homo sapiens
tgtaagcttagattttctgta

SEQ ID NO: 273105 - DNA, 22 bp, Homo sapiens
tgtaagcttagattttctgtaa

SEQ ID NO: 273106 - DNA, 19 bp, Homo sapiens
tgtaaggaatgcttggaat

SEQ ID NO: 273107 - DNA, 18 bp, Homo sapiens
tgtaaggatgagcagcag

SEQ ID NO: 273108 - DNA, 23 bp, Homo sapiens
tgtaaggattgcctttgtagtta

SEQ ID NO: 273109 - DNA, 23 bp, Homo sapiens
tgtaaggtcttcttgtgtcctga

SEQ ID NO: 273110 - DNA, 17 bp, Homo sapiens
tgtaagtaaatgtctgt

SEQ ID NO: 273111 - DNA, 12 bp, Homo sapiens
tgtaagtgtgag

SEQ ID NO: 273112 - DNA, 19 bp, Homo sapiens
tgtaataaagtatataatt

SEQ ID NO: 273113 - DNA, 22 bp, Homo sapiens
tgtaatatattgccagtatata

SEQ ID NO: 273114 - DNA, 21 bp, Homo sapiens
tgtataaaaaagaaaacttgt

SEQ ID NO: 273115 - DNA, 20 bp, Homo sapiens
tgtataaaatgcaaaataaa

SEQ ID NO: 273116 - DNA, 15 bp, Homo sapiens
tgtataaacaagcct

SEQ ID NO: 273117 - DNA, 16 bp, Homo sapiens
tgtataactgtgcaga

SEQ ID NO: 273118 - DNA, 16 bp, Homo sapiens
tgtataagctaatgtt

SEQ ID NO: 273119 - DNA, 12 bp, Homo sapiens
tgtataatttca

SEQ ID NO: 273120 - DNA, 19 bp, Homo sapiens
tgtataatttcacagataa

SEQ ID NO: 273121 - DNA, 17 bp, Homo sapiens
tgtatacaaacaggtgc

SEQ ID NO: 273122 - DNA, 19 bp, Homo sapiens
tgtatacaaacaggtgcta

SEQ ID NO: 273123 - DNA, 17 bp, Homo sapiens
tgtatacattttgttat

SEQ ID NO: 273124 - DNA, 18 bp, Homo sapiens
tgtatacattttgttata

SEQ ID NO: 273125 - DNA, 21 bp, Homo sapiens
tgtatacattttgttatagaa

SEQ ID NO: 273126 - DNA, 15 bp, Homo sapiens
tgtataccacctgta

SEQ ID NO: 273127 - DNA, 19 bp, Homo sapiens
tgtataccacctgtacata

SEQ ID NO: 273128 - DNA, 22 bp, Homo sapiens
tgtataccatgatgcatggagt

SEQ ID NO: 273129 - DNA, 23 bp, Homo sapiens
tgtatacttaatactgaatttct

SEQ ID NO: 273130 - DNA, 22 bp, Homo sapiens
tgtatagattagattatattga

SEQ ID NO: 273131 - DNA, 15 bp, Homo sapiens
tgtatagcaacctat

SEQ ID NO: 273132 - DNA, 19 bp, Homo sapiens
tgtataggtagatccagat

SEQ ID NO: 273133 - DNA, 19 bp, Homo sapiens
tgtatagtgagtgtggctt

SEQ ID NO: 273134 - DNA, 15 bp, Homo sapiens
tgtatagtgtaaaat

SEQ ID NO: 273135 - DNA, 20 bp, Homo sapiens
tgtatagttttacactctag

SEQ ID NO: 273136 - DNA, 23 bp, Homo sapiens
tgtatagttttacactctagtgc

SEQ ID NO: 273137 - DNA, 21 bp, Homo sapiens
tgtatagttttataaaactca

SEQ ID NO: 273138 - DNA, 22 bp, Homo sapiens
tgtatatagctctacacaacat

SEQ ID NO: 273139 - DNA, 17 bp, Homo sapiens
tgtatatatattaagag

SEQ ID NO: 273140 - DNA, 18 bp, Homo sapiens
tgtatatatgtgtgttta

SEQ ID NO: 273141 - DNA, 13 bp, Homo sapiens
tgtatatcagaaa

SEQ ID NO: 273142 - DNA, 14 bp, Homo sapiens
tgtatatcagaaaa

SEQ ID NO: 273143 - DNA, 22 bp, Homo sapiens
tgtatatccttccaaaaaatta

SEQ ID NO: 273144 - DNA, 16 bp, Homo sapiens
tgtatatctttgcact

SEQ ID NO: 273145 - DNA, 17 bp, Homo sapiens
tgtatatctttgcactg

SEQ ID NO: 273146 - DNA, 18 bp, Homo sapiens
tgtatatgaacttaacat

SEQ ID NO: 273147 - DNA, 23 bp, Homo sapiens
tgtatatggtgattcaaatgcaa

SEQ ID NO: 273148 - DNA, 13 bp, Homo sapiens
tgtatatgttatt

SEQ ID NO: 273149 - DNA, 22 bp, Homo sapiens
tgtatatttaacttctagttgc

SEQ ID NO: 273150 - DNA, 21 bp, Homo sapiens
tgtatcaaactcgtctgatgt

SEQ ID NO: 273151 - DNA, 15 bp, Homo sapiens
tgtatcaagcccctg

SEQ ID NO: 273152 - DNA, 21 bp, Homo sapiens
tgtatcccccccctgtatagt

SEQ ID NO: 273153 - DNA, 20 bp, Homo sapiens
tgtatcccttctcacagcac

SEQ ID NO: 273154 - DNA, 12 bp, Homo sapiens
tgtatcctgggg

SEQ ID NO: 273155 - DNA, 14 bp, Homo sapiens
tgtatcctggggct

SEQ ID NO: 273156 - DNA, 18 bp, Homo sapiens
tgtatcctggggctccct

SEQ ID NO: 273157 - DNA, 18 bp, Homo sapiens
tgtatctaaaaaataact

SEQ ID NO: 273158 - DNA, 12 bp, Homo sapiens
tgtatctaattc

SEQ ID NO: 273159 - DNA, 20 bp, Homo sapiens
tgtatctagtggtctgattt

SEQ ID NO: 273160 - DNA, 20 bp, Homo sapiens
tgtatctcgaagtcttccat

SEQ ID NO: 273161 - DNA, 19 bp, Homo sapiens
tgtatcttaaatctgtgaa

SEQ ID NO: 273162 - DNA, 15 bp, Homo sapiens
tgtatgactaaagag

SEQ ID NO: 273163 - DNA, 17 bp, Homo sapiens
tgtatgagaagtacttt

SEQ ID NO: 273164 - DNA, 21 bp, Homo sapiens
tgtatgagaagtactttgtgc

SEQ ID NO: 273165 - DNA, 13 bp, Homo sapiens
tgtatgatgtgtt

SEQ ID NO: 273166 - DNA, 20 bp, Homo sapiens
tgtatgccaagtgagaagat

SEQ ID NO: 273167 - DNA, 21 bp, Homo sapiens
tgtatgcctttaaatctgtga

SEQ ID NO: 273168 - DNA, 22 bp, Homo sapiens
tgtatgcctttaaatctgtgat

SEQ ID NO: 273169 - DNA, 17 bp, Homo sapiens
tgtatggatatgtgtaa

SEQ ID NO: 273170 - DNA, 13 bp, Homo sapiens
tgtatgtatgtgt

SEQ ID NO: 273171 - DNA, 16 bp, Homo sapiens
tgtatgtgcactgtca

SEQ ID NO: 273172 - DNA, 16 bp, Homo sapiens
tgtatgtgccatttat

SEQ ID NO: 273173 - DNA, 17 bp, Homo sapiens
tgtatgtggatacagtc

SEQ ID NO: 273174 - DNA, 19 bp, Homo sapiens
tgtatgtggatacagtcat

SEQ ID NO: 273175 - DNA, 20 bp, Homo sapiens
tgtatgtggatacagtcatt

SEQ ID NO: 273176 - DNA, 22 bp, Homo sapiens
tgtatgtggatacagtcattat

SEQ ID NO: 273177 - DNA, 11 bp, Homo sapiens
tgtatgtgtga

SEQ ID NO: 273178 - DNA, 17 bp, Homo sapiens
tgtatgttatgaacatg

SEQ ID NO: 273179 - DNA, 14 bp, Homo sapiens
tgtatgttgtgaag

SEQ ID NO: 273180 - DNA, 22 bp, Homo sapiens
tgtatgttgtgaagatgtttgc

SEQ ID NO: 273181 - DNA, 13 bp, Homo sapiens
tgtatgtttacat

SEQ ID NO: 273182 - DNA, 14 bp, Homo sapiens
tgtatgtttgcaca

SEQ ID NO: 273183 - DNA, 16 bp, Homo sapiens
tgtatgtttgcacact

SEQ ID NO: 273184 - DNA, 21 bp, Homo sapiens
tgtattaacctacctgtgaat

SEQ ID NO: 273185 - DNA, 18 bp, Homo sapiens
tgtattaggactggcttt

SEQ ID NO: 273186 - DNA, 19 bp, Homo sapiens
tgtattaggactggctttg

SEQ ID NO: 273187 - DNA, 17 bp, Homo sapiens
tgtattatcagtgaata

SEQ ID NO: 273188 - DNA, 15 bp, Homo sapiens
tgtattatgcaaagt

SEQ ID NO: 273189 - DNA, 16 bp, Homo sapiens
tgtattatttggagtt

SEQ ID NO: 273190 - DNA, 18 bp, Homo sapiens
tgtattcactaaaataaa

SEQ ID NO: 273191 - DNA, 16 bp, Homo sapiens
tgtattcatacagcac

SEQ ID NO: 273192 - DNA, 23 bp, Homo sapiens
tgtattcccgttttacagataag

SEQ ID NO: 273193 - DNA, 21 bp, Homo sapiens
tgtattctctgtccagggctt

SEQ ID NO: 273194 - DNA, 23 bp, Homo sapiens
tgtattgccatcgggtgccaaat

SEQ ID NO: 273195 - DNA, 13 bp, Homo sapiens
tgtattggcctgg

SEQ ID NO: 273196 - DNA, 20 bp, Homo sapiens
tgtattggtttctgtttgaa

SEQ ID NO: 273197 - DNA, 13 bp, Homo sapiens
tgtattgttccca

SEQ ID NO: 273198 - DNA, 12 bp, Homo sapiens
tgtatttaagaa

SEQ ID NO: 273199 - DNA, 14 bp, Homo sapiens
tgtatttataaata

SEQ ID NO: 273200 - DNA, 20 bp, Homo sapiens
tgtatttattttcctcccca

SEQ ID NO: 273201 - DNA, 15 bp, Homo sapiens
tgtatttccagtgca

SEQ ID NO: 273202 - DNA, 15 bp, Homo sapiens
tgtatttctgtagaa

SEQ ID NO: 273203 - DNA, 16 bp, Homo sapiens
tgtatttctgtggaaa

SEQ ID NO: 273204 - DNA, 20 bp, Homo sapiens
tgtatttcttttatatataa

SEQ ID NO: 273205 - DNA, 22 bp, Homo sapiens
tgtattttcaataaagaaaaaa

SEQ ID NO: 273206 - DNA, 17 bp, Homo sapiens
tgtattttctgtcactg

SEQ ID NO: 273207 - DNA, 21 bp, Homo sapiens
tgtattttctgtgttgttcat

SEQ ID NO: 273208 - DNA, 15 bp, Homo sapiens
tgtattttgaaaaca

SEQ ID NO: 273209 - DNA, 18 bp, Homo sapiens
tgtattttgaaaacactt

SEQ ID NO: 273210 - DNA, 14 bp, Homo sapiens
tgtattttgtccaa

SEQ ID NO: 273211 - DNA, 21 bp, Homo sapiens
tgtattttgtccaagttcaca

SEQ ID NO: 273212 - DNA, 22 bp, Homo sapiens
tgtatttttaaattctgctcct

SEQ ID NO: 273213 - DNA, 13 bp, Homo sapiens
tgtatttttagta

SEQ ID NO: 273214 - DNA, 21 bp, Homo sapiens
tgtatttttcctctttcactt

SEQ ID NO: 273215 - DNA, 17 bp, Homo sapiens
tgtatttttgaataaaa

SEQ ID NO: 273216 - DNA, 14 bp, Homo sapiens
tgtcaaaaaaaaaa

SEQ ID NO: 273217 - DNA, 21 bp, Homo sapiens
tgtcaaacgtgccccccagtt

SEQ ID NO: 273218 - DNA, 17 bp, Homo sapiens
tgtcaaagtgaaagaca

SEQ ID NO: 273219 - DNA, 15 bp, Homo sapiens
tgtcaaagtggtgag

SEQ ID NO: 273220 - DNA, 19 bp, Homo sapiens
tgtcaaagtggtgagaggc

SEQ ID NO: 273221 - DNA, 19 bp, Homo sapiens
tgtcaaatggatgtaatat

SEQ ID NO: 273222 - DNA, 22 bp, Homo sapiens
tgtcaaatgtcattatgtagaa

SEQ ID NO: 273223 - DNA, 19 bp, Homo sapiens
tgtcaaccttgtgtgagtg

SEQ ID NO: 273224 - DNA, 21 bp, Homo sapiens
tgtcaaccttgtgtgagtgtg

SEQ ID NO: 273225 - DNA, 14 bp, Homo sapiens
tgtcaacttcagtt

SEQ ID NO: 273226 - DNA, 21 bp, Homo sapiens
tgtcaacttcagttgaaaaga

SEQ ID NO: 273227 - DNA, 22 bp, Homo sapiens
tgtcaacttcagttgaaaagag

SEQ ID NO: 273228 - DNA, 18 bp, Homo sapiens
tgtcaactttcatttgaa

SEQ ID NO: 273229 - DNA, 16 bp, Homo sapiens
tgtcaaggtgctgttg

SEQ ID NO: 273230 - DNA, 15 bp, Homo sapiens
tgtcaagtacaagca

SEQ ID NO: 273231 - DNA, 18 bp, Homo sapiens
tgtcaagtctctgctggc

SEQ ID NO: 273232 - DNA, 20 bp, Homo sapiens
tgtcaagttaacaaggaatg

SEQ ID NO: 273233 - DNA, 14 bp, Homo sapiens
tgtcaagttgtgct

SEQ ID NO: 273234 - DNA, 18 bp, Homo sapiens
tgtcaatagtattaacta

SEQ ID NO: 273235 - DNA, 15 bp, Homo sapiens
tgtcaatatatagag

SEQ ID NO: 273236 - DNA, 14 bp, Homo sapiens
tgtcaatattaaat

SEQ ID NO: 273237 - DNA, 18 bp, Homo sapiens
tgtcaatattaaatacag

SEQ ID NO: 273238 - DNA, 19 bp, Homo sapiens
tgtcaatattaaatacaga

SEQ ID NO: 273239 - DNA, 23 bp, Homo sapiens
tgtcaatattaaatacagacact

SEQ ID NO: 273240 - DNA, 15 bp, Homo sapiens
tgtcaattacaggaa

SEQ ID NO: 273241 - DNA, 19 bp, Homo sapiens
tgtcacaaattgatcaaga

SEQ ID NO: 273242 - DNA, 21 bp, Homo sapiens
tgtcacaaattgatcaagata

SEQ ID NO: 273243 - DNA, 16 bp, Homo sapiens
tgtctgcaacatggat

SEQ ID NO: 273244 - DNA, 15 bp, Homo sapiens
tgtctgcagtcctgg

SEQ ID NO: 273245 - DNA, 23 bp, Homo sapiens
tgtctgcagtcctggtggggctg

SEQ ID NO: 273246 - DNA, 13 bp, Homo sapiens
tgtctgccccctc

SEQ ID NO: 273247 - DNA, 15 bp, Homo sapiens
tgtctgcctgtattt

SEQ ID NO: 273248 - DNA, 19 bp, Homo sapiens
tgtctgcgccgctgtgctg

SEQ ID NO: 273249 - DNA, 20 bp, Homo sapiens
tgtctggaagacgtggctct

SEQ ID NO: 273250 - DNA, 21 bp, Homo sapiens
tgtctggctcggacccacccc

SEQ ID NO: 273251 - DNA, 15 bp, Homo sapiens
tgtctggctgtacgt

SEQ ID NO: 273252 - DNA, 16 bp, Homo sapiens
tgtctggttttaacaa

SEQ ID NO: 273253 - DNA, 17 bp, Homo sapiens
tgtctgtagctcctcaa

SEQ ID NO: 273254 - DNA, 23 bp, Homo sapiens
tgtctgtagctcctcaactcacc

SEQ ID NO: 273255 - DNA, 17 bp, Homo sapiens
tgtctgtccatctgtct

SEQ ID NO: 273256 - DNA, 15 bp, Homo sapiens
tgtctgtctgtctgt

SEQ ID NO: 273257 - DNA, 16 bp, Homo sapiens
tgtctgtctgtctgtc

SEQ ID NO: 273258 - DNA, 16 bp, Homo sapiens
tgtgagtcccagagcc

SEQ ID NO: 273259 - DNA, 15 bp, Homo sapiens
tgtgagtctgtcctt

SEQ ID NO: 273260 - DNA, 17 bp, Homo sapiens
tgtgagtgaaagtactt

SEQ ID NO: 273261 - DNA, 14 bp, Homo sapiens
tgtgagtggcagcc

SEQ ID NO: 273262 - DNA, 17 bp, Homo sapiens
tgtgagtggcagccatg

SEQ ID NO: 273263 - DNA, 13 bp, Homo sapiens
tgtgagtgggagg

SEQ ID NO: 273264 - DNA, 23 bp, Homo sapiens
tgtgagtgggaggagagggcaga

SEQ ID NO: 273265 - DNA, 20 bp, Homo sapiens
tgtgagtgtaagtgtgagta

SEQ ID NO: 273266 - DNA, 14 bp, Homo sapiens
tgtgagtgtgatgg

SEQ ID NO: 273267 - DNA, 23 bp, Homo sapiens
tgtgagtgtgtccaagtgtgtgt

SEQ ID NO: 273268 - DNA, 16 bp, Homo sapiens
tgtgagtttaaagcaa

SEQ ID NO: 273269 - DNA, 13 bp, Homo sapiens
tgtgatatctgaa

SEQ ID NO: 273270 - DNA, 14 bp, Homo sapiens
tgtgatattaacag

SEQ ID NO: 273271 - DNA, 19 bp, Homo sapiens
tgtgatattgaccatgtga

SEQ ID NO: 273272 - DNA, 22 bp, Homo sapiens
tgtgatattgaccatgtgatta

SEQ ID NO: 273273 - DNA, 16 bp, Homo sapiens
tgtgatcgtgtgttgc

SEQ ID NO: 273274 - DNA, 17 bp, Homo sapiens
tgtgatggaacacacac

SEQ ID NO: 273275 - DNA, 18 bp, Homo sapiens
tgtgatggaacacacaca

SEQ ID NO: 273276 - DNA, 12 bp, Homo sapiens
tgtgatgtatgt

SEQ ID NO: 273277 - DNA, 13 bp, Homo sapiens
tgtgatgtatgtt

SEQ ID NO: 273278 - DNA, 16 bp, Homo sapiens
tgtgatgtatgttggt

SEQ ID NO: 273279 - DNA, 16 bp, Homo sapiens
tgtgatgtattctagc

SEQ ID NO: 273280 - DNA, 12 bp, Homo sapiens
tgtggcagctgg

SEQ ID NO: 273281 - DNA, 16 bp, Homo sapiens
tgtggcagtggccagg

SEQ ID NO: 273282 - DNA, 22 bp, Homo sapiens
tgtggcagtggccaggcaggga

SEQ ID NO: 273283 - DNA, 13 bp, Homo sapiens
tgtggccagagct

SEQ ID NO: 273284 - DNA, 19 bp, Homo sapiens
tgtggccccttttactttt

SEQ ID NO: 273285 - DNA, 23 bp, Homo sapiens
tgtggccccttttacttttttat

SEQ ID NO: 273286 - DNA, 17 bp, Homo sapiens
tgtggccctgtgggagt

SEQ ID NO: 273287 - DNA, 19 bp, Homo sapiens
tgtggccgtctcctccctc

SEQ ID NO: 273288 - DNA, 11 bp, Homo sapiens
tgtggcctcag

SEQ ID NO: 273289 - DNA, 16 bp, Homo sapiens
tgtggcctctcagtca

SEQ ID NO: 273290 - DNA, 13 bp, Homo sapiens
tgtggcctgtgtc

SEQ ID NO: 273291 - DNA, 16 bp, Homo sapiens
tgtggcctgtgtccag

SEQ ID NO: 273292 - DNA, 21 bp, Homo sapiens
tgtggccttgcccgccagcct

SEQ ID NO: 273293 - DNA, 21 bp, Homo sapiens
tgtggctgggggcaggagggc

SEQ ID NO: 273294 - DNA, 20 bp, Homo sapiens
tgtggctgggtggtcagcag

SEQ ID NO: 273295 - DNA, 15 bp, Homo sapiens
tgtggctggtgtccc

SEQ ID NO: 273296 - DNA, 15 bp, Homo sapiens
tgtggcttaaacatt

SEQ ID NO: 273297 - DNA, 14 bp, Homo sapiens
tgtggcttggaaca

SEQ ID NO: 273298 - DNA, 14 bp, Homo sapiens
tgtgggactggccc

SEQ ID NO: 273299 - DNA, 20 bp, Homo sapiens
tgtgggactggcccacccct

SEQ ID NO: 273300 - DNA, 16 bp, Homo sapiens
tgtgggagaagggaca

SEQ ID NO: 273301 - DNA, 17 bp, Homo sapiens
tgtgggagaagggacag

SEQ ID NO: 273302 - DNA, 18 bp, Homo sapiens
tgtgggagaagggacagc

SEQ ID NO: 273303 - DNA, 13 bp, Homo sapiens
tgtgggagcagcg

SEQ ID NO: 273304 - DNA, 13 bp, Homo sapiens
tgtgggagtccac

SEQ ID NO: 273305 - DNA, 20 bp, Homo sapiens
tgtgggagtccactttcctc

SEQ ID NO: 273306 - DNA, 15 bp, Homo sapiens
tgtgggatgtcctct

SEQ ID NO: 273307 - DNA, 22 bp, Homo sapiens
tgtgggatgttcagcactgtcc

SEQ ID NO: 273308 - DNA, 18 bp, Homo sapiens
tgtgggattatgggtcac

SEQ ID NO: 273309 - DNA, 23 bp, Homo sapiens
tgtgggattatgggtcacaggaa

SEQ ID NO: 273310 - DNA, 21 bp, Homo sapiens
tgtgggcatttcttgcgagcc

SEQ ID NO: 273311 - DNA, 16 bp, Homo sapiens
tgtgggcgctgcttcc

SEQ ID NO: 273312 - DNA, 22 bp, Homo sapiens
tgtgggctggtgccccacagct

SEQ ID NO: 273313 - DNA, 15 bp, Homo sapiens
tgtgggcttggcctt

SEQ ID NO: 273314 - DNA, 13 bp, Homo sapiens
tgtggggagggtg

SEQ ID NO: 273315 - DNA, 15 bp, Homo sapiens
tgtggggccaggtca

SEQ ID NO: 273316 - DNA, 15 bp, Homo sapiens
tgtggggcccaagca

SEQ ID NO: 273317 - DNA, 16 bp, Homo sapiens
tgtggggcccaagcat

SEQ ID NO: 273318 - DNA, 23 bp, Homo sapiens
tgtggggcccaagcatgccccac

SEQ ID NO: 273319 - DNA, 18 bp, Homo sapiens
tgtggggcttggcgtgga

SEQ ID NO: 273320 - DNA, 17 bp, Homo sapiens
tgtgggggtctgggagg

SEQ ID NO: 273321 - DNA, 20 bp, Homo sapiens
tgtgggggtctgggaggcag

SEQ ID NO: 273322 - DNA, 22 bp, Homo sapiens
tgtgggggtctgggaggcaggt

SEQ ID NO: 273323 - DNA, 14 bp, Homo sapiens
tgtgggtcagggag

SEQ ID NO: 273324 - DNA, 17 bp, Homo sapiens
tgtgggtgaccaggtcc

SEQ ID NO: 273325 - DNA, 12 bp, Homo sapiens
tgtgggtgggga

SEQ ID NO: 273326 - DNA, 13 bp, Homo sapiens
tgtgggtggggaa

SEQ ID NO: 273327 - DNA, 20 bp, Homo sapiens
tgtgggtttactctgtgcta

SEQ ID NO: 273328 - DNA, 17 bp, Homo sapiens
tgtggtaccctggcaga

SEQ ID NO: 273329 - DNA, 17 bp, Homo sapiens
tgtggtccagaagaaat

SEQ ID NO: 273330 - DNA, 21 bp, Homo sapiens
tgtggtcccataggagcagcc

SEQ ID NO: 273331 - DNA, 16 bp, Homo sapiens
tgtggtctgactcctt

SEQ ID NO: 273332 - DNA, 23 bp, Homo sapiens
tgtggtgaagtgtggctggtgtc

SEQ ID NO: 273333 - DNA, 15 bp, Homo sapiens
tgtggtgacaggccc

SEQ ID NO: 273334 - DNA, 19 bp, Homo sapiens
tgtggtgcctgaggtctgt

SEQ ID NO: 273335 - DNA, 19 bp, Homo sapiens
tgtggttaccgagtatctg

SEQ ID NO: 273336 - DNA, 21 bp, Homo sapiens
tgtggttaccgagtatctgta

SEQ ID NO: 273337 - DNA, 18 bp, Homo sapiens
tgtggttcctaagcctgt

SEQ ID NO: 273338 - DNA, 23 bp, Homo sapiens
tgtggttttcccctccctgggtt

SEQ ID NO: 273339 - DNA, 15 bp, Homo sapiens
tgtggttttctgttt

SEQ ID NO: 273340 - DNA, 18 bp, Homo sapiens
tgtggttttctgtttcta

SEQ ID NO: 273341 - DNA, 19 bp, Homo sapiens
tgtggttttcttttgccat

SEQ ID NO: 273342 - DNA, 20 bp, Homo sapiens
tgtggttttcttttgccatg

SEQ ID NO: 273343 - DNA, 20 bp, Homo sapiens
tgtgtaaaggaacaactgat

SEQ ID NO: 273344 - DNA, 19 bp, Homo sapiens
tgtgtaaatatttttccct

SEQ ID NO: 273345 - DNA, 14 bp, Homo sapiens
tgtgtaaatgttat

SEQ ID NO: 273346 - DNA, 17 bp, Homo sapiens
tgtgtaaatgttatgac

SEQ ID NO: 273347 - DNA, 18 bp, Homo sapiens
tgtgtaaatgttatgact

SEQ ID NO: 273348 - DNA, 16 bp, Homo sapiens
tgtgtaaccagcagtc

SEQ ID NO: 273349 - DNA, 18 bp, Homo sapiens
tgtgtaagagaatgttga

SEQ ID NO: 273350 - DNA, 19 bp, Homo sapiens
tgtgtaagagaatgttgaa

SEQ ID NO: 273351 - DNA, 19 bp, Homo sapiens
tgtgtaaggatgagcagca

SEQ ID NO: 273352 - DNA, 12 bp, Homo sapiens
tgtgtaataaaa

SEQ ID NO: 273353 - DNA, 22 bp, Homo sapiens
tgtgtaataaaaatttgtttaa

SEQ ID NO: 273354 - DNA, 22 bp, Homo sapiens
tgtgtaatcatttcttgggccc

SEQ ID NO: 273355 - DNA, 16 bp, Homo sapiens
tgtgtaatctctgatt

SEQ ID NO: 273356 - DNA, 14 bp, Homo sapiens
tgtgtacagtatgt

SEQ ID NO: 273357 - DNA, 16 bp, Homo sapiens
tgtgtacagtatgtgt

SEQ ID NO: 273358 - DNA, 17 bp, Homo sapiens
tgtgtacagtatgtgtc

SEQ ID NO: 273359 - DNA, 16 bp, Homo sapiens
tgtgtacgtggagagg

SEQ ID NO: 273360 - DNA, 16 bp, Homo sapiens
tgtgtactgataaaat

SEQ ID NO: 273361 - DNA, 21 bp, Homo sapiens
tgtgtagagcctgcatctgtc

SEQ ID NO: 273362 - DNA, 13 bp, Homo sapiens
tgtgtagccagga

SEQ ID NO: 273363 - DNA, 22 bp, Homo sapiens
tgtgtagggagatggagaaaat

SEQ ID NO: 273364 - DNA, 21 bp, Homo sapiens
tgtgtatagatgcaagatatt

SEQ ID NO: 273365 - DNA, 20 bp, Homo sapiens
tgtgtatccagtatgcacgt

SEQ ID NO: 273366 - DNA, 22 bp, Homo sapiens
tgtgtatgagaagtactttgtg

SEQ ID NO: 273367 - DNA, 19 bp, Homo sapiens
tgtgtatggatatgtgtaa

SEQ ID NO: 273368 - DNA, 16 bp, Homo sapiens
tgtgtatgtacatata

SEQ ID NO: 273369 - DNA, 14 bp, Homo sapiens
tgtgtatgtgcgtg

SEQ ID NO: 273370 - DNA, 19 bp, Homo sapiens
tgtgtatgtgtttataatt

SEQ ID NO: 273371 - DNA, 15 bp, Homo sapiens
tgtgtattagatatc

SEQ ID NO: 273372 - DNA, 12 bp, Homo sapiens
tgtgtcagagtg

SEQ ID NO: 273373 - DNA, 13 bp, Homo sapiens
tgtgtcagagtgt

SEQ ID NO: 273374 - DNA, 14 bp, Homo sapiens
tgtgtcatggtgat

SEQ ID NO: 273375 - DNA, 17 bp, Homo sapiens
tgtgtcatggtgatgca

SEQ ID NO: 273376 - DNA, 20 bp, Homo sapiens
tgtgtcatggtgatgcaagt

SEQ ID NO: 273377 - DNA, 19 bp, Homo sapiens
tgtgtccacactaccagtt

SEQ ID NO: 273378 - DNA, 16 bp, Homo sapiens
tgtgtccataagagaa

SEQ ID NO: 273379 - DNA, 20 bp, Homo sapiens
tgttgtagatacaatcagct

SEQ ID NO: 273380 - DNA, 16 bp, Homo sapiens
tgttgtattcctgcct

SEQ ID NO: 273381 - DNA, 13 bp, Homo sapiens
tgttgtattttaa

SEQ ID NO: 273382 - DNA, 14 bp, Homo sapiens
tgttgtcatgtgta

SEQ ID NO: 273383 - DNA, 16 bp, Homo sapiens
tgttgtcatgtgtatg

SEQ ID NO: 273384 - DNA, 17 bp, Homo sapiens
tgttgtcattgctttac

SEQ ID NO: 273385 - DNA, 22 bp, Homo sapiens
tgttgtcctgtgtcatctgtca

SEQ ID NO: 273386 - DNA, 18 bp, Homo sapiens
tgttgtgaagatgtttgc

SEQ ID NO: 273387 - DNA, 14 bp, Homo sapiens
tgttgtgatgtatt

SEQ ID NO: 273388 - DNA, 18 bp, Homo sapiens
tgttgtgcagtgtgcctg

SEQ ID NO: 273389 - DNA, 23 bp, Homo sapiens
tgttgtgcagtgtgcctgtcact

SEQ ID NO: 273390 - DNA, 21 bp, Homo sapiens
tgttgttatcatttaagattt

SEQ ID NO: 273391 - DNA, 22 bp, Homo sapiens
tgttgttcaagcttttcctttc

SEQ ID NO: 273392 - DNA, 14 bp, Homo sapiens
tgttgttcctggct

SEQ ID NO: 273393 - DNA, 12 bp, Homo sapiens
tgttgttgttgt

SEQ ID NO: 273394 - DNA, 16 bp, Homo sapiens
tgttgtttcttttatg

SEQ ID NO: 273395 - DNA, 17 bp, Homo sapiens
tgttgtttgaaaatatt

SEQ ID NO: 273396 - DNA, 14 bp, Homo sapiens
tgttgtttgtaaat

SEQ ID NO: 273397 - DNA, 20 bp, Homo sapiens
tgttgttttgttttaaatac

SEQ ID NO: 273398 - DNA, 12 bp, Homo sapiens
tgtttaaataaa

SEQ ID NO: 273399 - DNA, 21 bp, Homo sapiens
tgtttaaataaagacctatgt

SEQ ID NO: 273400 - DNA, 14 bp, Homo sapiens
tgtttaaataaagt

SEQ ID NO: 273401 - DNA, 13 bp, Homo sapiens
tgtttaaatataa

SEQ ID NO: 273402 - DNA, 21 bp, Homo sapiens
tgtttaacaaatctaatctct

SEQ ID NO: 273403 - DNA, 16 bp, Homo sapiens
tgtttaagatctgttt

SEQ ID NO: 273404 - DNA, 19 bp, Homo sapiens
tgtttaatatctgactgaa

SEQ ID NO: 273405 - DNA, 18 bp, Homo sapiens
tgtttacactctttgtaa

SEQ ID NO: 273406 - DNA, 12 bp, Homo sapiens
tgtttacatgag

SEQ ID NO: 273407 - DNA, 15 bp, Homo sapiens
tgtttaccaaagaag

SEQ ID NO: 273408 - DNA, 17 bp, Homo sapiens
tgtttacctcactggtg

SEQ ID NO: 273409 - DNA, 12 bp, Homo sapiens
tgtttactgaaa

SEQ ID NO: 273410 - DNA, 15 bp, Homo sapiens
tgtttagaaataaat

SEQ ID NO: 273411 - DNA, 19 bp, Homo sapiens
tgtttagcattaaaaataa

SEQ ID NO: 273412 - DNA, 12 bp, Homo sapiens
tgtttagtagct

SEQ ID NO: 273413 - DNA, 15 bp, Homo sapiens
tgtttagtagctgat

SEQ ID NO: 273414 - DNA, 19 bp, Homo sapiens
tgtttagtttgttaattga

SEQ ID NO: 273415 - DNA, 18 bp, Homo sapiens
tgtttatatactgggttc

SEQ ID NO: 273416 - DNA, 15 bp, Homo sapiens
tgtttatatgtcttg

SEQ ID NO: 273417 - DNA, 22 bp, Homo sapiens
tgtttatattgtttttatatat

SEQ ID NO: 273418 - DNA, 22 bp, Homo sapiens
tgtttatgatatttcttgcttt

SEQ ID NO: 273419 - DNA, 23 bp, Homo sapiens
tgtttatgatatttcttgctttc

SEQ ID NO: 273420 - DNA, 13 bp, Homo sapiens
tgtttatggcctc

SEQ ID NO: 273421 - DNA, 23 bp, Homo sapiens
tgtttatggcctcagctgcctca

SEQ ID NO: 273422 - DNA, 13 bp, Homo sapiens
tgtttattcctga

SEQ ID NO: 273423 - DNA, 19 bp, Homo sapiens
tgtttattgtcaaagtggt

SEQ ID NO: 273424 - DNA, 24 bp, Homo sapiens
tgtttatttatagagtgtacttaa

SEQ ID NO: 273425 - DNA, 15 bp, Homo sapiens
tgtttatttttatat

SEQ ID NO: 273426 - DNA, 14 bp, Homo sapiens
tgtttatttttcat

SEQ ID NO: 273427 - DNA, 15 bp, Homo sapiens
tgtttatttttcata

SEQ ID NO: 273428 - DNA, 16 bp, Homo sapiens
tgtttatttttcatat

SEQ ID NO: 273429 - DNA, 23 bp, Homo sapiens
tgtttcaggacagctgcttctgt

SEQ ID NO: 273430 - DNA, 22 bp, Homo sapiens
tgtttcaggtggaacaggagga

SEQ ID NO: 273431 - DNA, 13 bp, Homo sapiens
tgtttcatgtttt

SEQ ID NO: 273432 - DNA, 23 bp, Homo sapiens
tgtttccacggctggatacctgt

SEQ ID NO: 273433 - DNA, 19 bp, Homo sapiens
tgtttccagctgccaagtg

SEQ ID NO: 273434 - DNA, 14 bp, Homo sapiens
tgtttcccataatt

SEQ ID NO: 273435 - DNA, 22 bp, Homo sapiens
tgtttcccataattttcttcat

SEQ ID NO: 273436 - DNA, 20 bp, Homo sapiens
tgtttcccgctccaagagaa

SEQ ID NO: 273437 - DNA, 21 bp, Homo sapiens
tgtttccctcaagaacaaaca

SEQ ID NO: 273438 - DNA, 21 bp, Homo sapiens
tgtttccttgttggtcagagg

SEQ ID NO: 273439 - DNA, 22 bp, Homo sapiens
tgtttccttgttggtcagagga

SEQ ID NO: 273440 - DNA, 17 bp, Homo sapiens
tgtttctaaacagttga

SEQ ID NO: 273441 - DNA, 23 bp, Homo sapiens
tgtttctaaacagttgagtttct

SEQ ID NO: 273442 - DNA, 18 bp, Homo sapiens
tgtttctaatttgctgct

SEQ ID NO: 273443 - DNA, 22 bp, Homo sapiens
tgtttctatactgtttgtaata

SEQ ID NO: 273444 - DNA, 23 bp, Homo sapiens
tgtttctatactgtttgtaatat

SEQ ID NO: 273445 - DNA, 21 bp, Homo sapiens
tgtttctgaaaattccagaaa

SEQ ID NO: 273446 - DNA, 13 bp, Homo sapiens
tgtttctgcagag

SEQ ID NO: 273447 - DNA, 20 bp, Homo sapiens
tgtttctgcagcccttgggc

SEQ ID NO: 273448 - DNA, 14 bp, Homo sapiens
tgtttctgttctgg

SEQ ID NO: 273449 - DNA, 17 bp, Homo sapiens
tgtttcttccaaagcac

SEQ ID NO: 273450 - DNA, 11 bp, Homo sapiens
tgtttcttggt

SEQ ID NO: 273451 - DNA, 12 bp, Homo sapiens
tgtttgagcgca

SEQ ID NO: 273452 - DNA, 12 bp, Homo sapiens
tgtttgatgtgt

SEQ ID NO: 273453 - DNA, 16 bp, Homo sapiens
tgtttgcaatatcgat

SEQ ID NO: 273454 - DNA, 12 bp, Homo sapiens
tgtttgcaatgc

SEQ ID NO: 273455 - DNA, 17 bp, Homo sapiens
tgtttgcttaaacaaag

SEQ ID NO: 273456 - DNA, 20 bp, Homo sapiens
tgtttgcttattgttccaag

SEQ ID NO: 273457 - DNA, 15 bp, Homo sapiens
tgtttgcttcaactg

SEQ ID NO: 273458 - DNA, 17 bp, Homo sapiens
tgtttggcaatgcactg

SEQ ID NO: 273459 - DNA, 12 bp, Homo sapiens
tgtttggctggg

SEQ ID NO: 273460 - DNA, 23 bp, Homo sapiens
tgtttggggtgtttcaaaagtgg

SEQ ID NO: 273461 - DNA, 20 bp, Homo sapiens
tgtttggttctggggcccct

SEQ ID NO: 273462 - DNA, 16 bp, Homo sapiens
tgtttgtaaattaata

SEQ ID NO: 273463 - DNA, 20 bp, Homo sapiens
tgtttgtataccatgatgca

SEQ ID NO: 273464 - DNA, 15 bp, Homo sapiens
tgtttgtatataaat

SEQ ID NO: 273465 - DNA, 16 bp, Homo sapiens
tgtttgtatataaatg

SEQ ID NO: 273466 - DNA, 16 bp, Homo sapiens
tgtttgtgagtatgtg

SEQ ID NO: 273467 - DNA, 12 bp, Homo sapiens
tgtttgtggcct

SEQ ID NO: 273468 - DNA, 12 bp, Homo sapiens
tgtttgttttgt

SEQ ID NO: 273469 - DNA, 14 bp, Homo sapiens
tgttttactgcttt

SEQ ID NO: 273470 - DNA, 16 bp, Homo sapiens
tgttttagttaaattt

SEQ ID NO: 273471 - DNA, 17 bp, Homo sapiens
tgttttagttaaatttc

SEQ ID NO: 273472 - DNA, 15 bp, Homo sapiens
tgttttatatacctg

SEQ ID NO: 273473 - DNA, 12 bp, Homo sapiens
tgttttatcatg

SEQ ID NO: 273474 - DNA, 23 bp, Homo sapiens
tgttttatcatgacatgttatat

SEQ ID NO: 273475 - DNA, 21 bp, Homo sapiens
tgttttatgtcatactctgtg

SEQ ID NO: 273476 - DNA, 18 bp, Homo sapiens
tgttttattttttattgt

SEQ ID NO: 273477 - DNA, 23 bp, Homo sapiens
tgttttattttttattgttttca

SEQ ID NO: 273478 - DNA, 20 bp, Homo sapiens
tgttttcaacctagaaacct

SEQ ID NO: 273479 - DNA, 17 bp, Homo sapiens
tgttttcccacacatat

SEQ ID NO: 273480 - DNA, 21 bp, Homo sapiens
tgttttccccaattatcctcc

SEQ ID NO: 273481 - DNA, 22 bp, Homo sapiens
tgttttcccgagcaaagtctaa

SEQ ID NO: 273482 - DNA, 23 bp, Homo sapiens
tgttttcccgagcaaagtctaaa

SEQ ID NO: 273483 - DNA, 13 bp, Homo sapiens
tgttttgagaaaa

SEQ ID NO: 273484 - DNA, 14 bp, Homo sapiens
tgttttgagaaaaa

SEQ ID NO: 273485 - DNA, 23 bp, Homo sapiens
tgttttgcaagggaatgaatcca

SEQ ID NO: 273486 - DNA, 13 bp, Homo sapiens
tgttttgcacttt

SEQ ID NO: 273487 - DNA, 15 bp, Homo sapiens
tgttttggatgaatg

SEQ ID NO: 273488 - DNA, 20 bp, Homo sapiens
tgttttgtcctttgagaaag

SEQ ID NO: 273489 - DNA, 14 bp, Homo sapiens
tgttttgtgttgtt

SEQ ID NO: 273490 - DNA, 16 bp, Homo sapiens
tgttttgttctgtggt

SEQ ID NO: 273491 - DNA, 13 bp, Homo sapiens
tgttttgtttctg

SEQ ID NO: 273492 - DNA, 16 bp, Homo sapiens
tgtttttaaaaccact

SEQ ID NO: 273493 - DNA, 19 bp, Homo sapiens
tgtttttaaaagtttcaat

SEQ ID NO: 273494 - DNA, 14 bp, Homo sapiens
tgtttttaagctgt

SEQ ID NO: 273495 - DNA, 15 bp, Homo sapiens
tgtttttaagctgtt

SEQ ID NO: 273496 - DNA, 17 bp, Homo sapiens
tgtttttaagtcctgta

SEQ ID NO: 273497 - DNA, 12 bp, Homo sapiens
tgtttttctcaa

SEQ ID NO: 273498 - DNA, 13 bp, Homo sapiens
tgtttttctcaaa

SEQ ID NO: 273499 - DNA, 15 bp, Homo sapiens
tgtttttctcaaata

SEQ ID NO: 273500 - DNA, 19 bp, Homo sapiens
tgtttttctttttccacaa

SEQ ID NO: 273501 - DNA, 20 bp, Homo sapiens
tgtttttgaatttaaataaa

SEQ ID NO: 273502 - DNA, 13 bp, Homo sapiens
tgtttttgttgtg

SEQ ID NO: 273503 - DNA, 15 bp, Homo sapiens
tgttttttaaagtct

SEQ ID NO: 273504 - DNA, 17 bp, Homo sapiens
tgttttttcctgagctt

SEQ ID NO: 273505 - DNA, 21 bp, Homo sapiens
tgtttttttagggtttctgat

SEQ ID NO: 273506 - DNA, 19 bp, Homo sapiens
tgttttttttttccactta

SEQ ID NO: 273507 - DNA, 20 bp, Homo sapiens
ttaacaacttgaattacaac

SEQ ID NO: 273508 - DNA, 21 bp, Homo sapiens
ttaacaaggaatgcctgtgcc

SEQ ID NO: 273509 - DNA, 19 bp, Homo sapiens
ttaacaataactactgtgt

SEQ ID NO: 273510 - DNA, 20 bp, Homo sapiens
ttaacaataactactgtgtt

SEQ ID NO: 273511 - DNA, 15 bp, Homo sapiens
ttaacaatttctgtc

SEQ ID NO: 273512 - DNA, 22 bp, Homo sapiens
ttaacacatgaatttctgccat

SEQ ID NO: 273513 - DNA, 17 bp, Homo sapiens
ttaacactgtaatatct

SEQ ID NO: 273514 - DNA, 23 bp, Homo sapiens
ttaacagagtttgatatgggctt

SEQ ID NO: 273515 - DNA, 20 bp, Homo sapiens
ttaacagctttctccagaac

SEQ ID NO: 273516 - DNA, 22 bp, Homo sapiens
ttaacagtaaaaatttcttcca

SEQ ID NO: 273517 - DNA, 14 bp, Homo sapiens
ttaacagtacctgt

SEQ ID NO: 273518 - DNA, 15 bp, Homo sapiens
ttaacagtacctgtg

SEQ ID NO: 273519 - DNA, 17 bp, Homo sapiens
ttaacagtcatttaaaa

SEQ ID NO: 273520 - DNA, 20 bp, Homo sapiens
ttaacagttttccatgaaaa

SEQ ID NO: 273521 - DNA, 21 bp, Homo sapiens
ttaacagttttccatgaaaac

SEQ ID NO: 273522 - DNA, 13 bp, Homo sapiens
ttaacatataata

SEQ ID NO: 273523 - DNA, 15 bp, Homo sapiens
ttaacatcaaagact

SEQ ID NO: 273524 - DNA, 23 bp, Homo sapiens
ttaacattcctcatgaatgtaaa

SEQ ID NO: 273525 - DNA, 16 bp, Homo sapiens
ttaaccaaataaaaca

SEQ ID NO: 273526 - DNA, 15 bp, Homo sapiens
ttaaccacagtgaaa

SEQ ID NO: 273527 - DNA, 21 bp, Homo sapiens
ttaaccagtctgaagtttcat

SEQ ID NO: 273528 - DNA, 15 bp, Homo sapiens
ttaacctacctgtaa

SEQ ID NO: 273529 - DNA, 12 bp, Homo sapiens
ttaacctctgca

SEQ ID NO: 273530 - DNA, 17 bp, Homo sapiens
ttaacctgcatgcagca

SEQ ID NO: 273531 - DNA, 13 bp, Homo sapiens
ttaacctggtgct

SEQ ID NO: 273532 - DNA, 16 bp, Homo sapiens
ttaacctttaagtctt

SEQ ID NO: 273533 - DNA, 17 bp, Homo sapiens
ttaacgtatgtatttca

SEQ ID NO: 273534 - DNA, 23 bp, Homo sapiens
ttaactaatctattgggttcatt

SEQ ID NO: 273535 - DNA, 17 bp, Homo sapiens
ttaactactaagaataa

SEQ ID NO: 273536 - DNA, 16 bp, Homo sapiens
ttaactagaatttatt

SEQ ID NO: 273537 - DNA, 22 bp, Homo sapiens
ttaactcagatcactactgcag

SEQ ID NO: 273538 - DNA, 14 bp, Homo sapiens
ttaactgaagcaaa

SEQ ID NO: 273539 - DNA, 19 bp, Homo sapiens
ttaactgtgtatgtacata

SEQ ID NO: 273540 - DNA, 14 bp, Homo sapiens
ttaacttctctgga

SEQ ID NO: 273541 - DNA, 15 bp, Homo sapiens
ttaacttgagtttta

SEQ ID NO: 273542 - DNA, 23 bp, Homo sapiens
ttaagaaaaaaataattttatga

SEQ ID NO: 273543 - DNA, 20 bp, Homo sapiens
ttaagaaaaacatgtcatgt

SEQ ID NO: 273544 - DNA, 13 bp, Homo sapiens
ttaagaaaaataa

SEQ ID NO: 273545 - DNA, 18 bp, Homo sapiens
ttaagaaaatacaataaa

SEQ ID NO: 273546 - DNA, 13 bp, Homo sapiens
ttaagaaagctat

SEQ ID NO: 273547 - DNA, 14 bp, Homo sapiens
ttaagaaagctata

SEQ ID NO: 273548 - DNA, 16 bp, Homo sapiens
ttaagaacacaaagcg

SEQ ID NO: 273549 - DNA, 19 bp, Homo sapiens
ttaagaatagtctctgggt

SEQ ID NO: 273550 - DNA, 23 bp, Homo sapiens
ttaagaatgcagattcctgggcc

SEQ ID NO: 273551 - DNA, 13 bp, Homo sapiens
ttaagacaaatgg

SEQ ID NO: 273552 - DNA, 22 bp, Homo sapiens
ttaagacactagtagagcaaag

SEQ ID NO: 273553 - DNA, 19 bp, Homo sapiens
ttaagacttaatctttgct

SEQ ID NO: 273554 - DNA, 10 bp, Homo sapiens
ttaagacttt

SEQ ID NO: 273555 - DNA, 23 bp, Homo sapiens
ttaagagtcctgaggcagaacct

SEQ ID NO: 273556 - DNA, 21 bp, Homo sapiens
ttaagataatagtttacatgt

SEQ ID NO: 273557 - DNA, 16 bp, Homo sapiens
ttaagataattataat

SEQ ID NO: 273558 - DNA, 16 bp, Homo sapiens
ttaagatacactcctg

SEQ ID NO: 273559 - DNA, 18 bp, Homo sapiens
ttaagatacactcctgct

SEQ ID NO: 273560 - DNA, 22 bp, Homo sapiens
ttaagatggattctcagatatt

SEQ ID NO: 273561 - DNA, 23 bp, Homo sapiens
ttaagatggattctcagatattt

SEQ ID NO: 273562 - DNA, 13 bp, Homo sapiens
ttaagattaaatt

SEQ ID NO: 273563 - DNA, 23 bp, Homo sapiens
ttaagattaaattatatctgagg

SEQ ID NO: 273564 - DNA, 16 bp, Homo sapiens
ttaagattttacaaaa

SEQ ID NO: 273565 - DNA, 14 bp, Homo sapiens
ttaagcaacatctt

SEQ ID NO: 273566 - DNA, 19 bp, Homo sapiens
ttaagcaaccttaaagcaa

SEQ ID NO: 273567 - DNA, 20 bp, Homo sapiens
ttaagcactacataaactga

SEQ ID NO: 273568 - DNA, 16 bp, Homo sapiens
ttaattataccagtgt

SEQ ID NO: 273569 - DNA, 17 bp, Homo sapiens
ttaattatgctaacaaa

SEQ ID NO: 273570 - DNA, 21 bp, Homo sapiens
ttaattatgctaacaaactga

SEQ ID NO: 273571 - DNA, 14 bp, Homo sapiens
ttaattattattct

SEQ ID NO: 273572 - DNA, 15 bp, Homo sapiens
ttaattccccttccc

SEQ ID NO: 273573 - DNA, 23 bp, Homo sapiens
ttaattctaaaagagaagggagc

SEQ ID NO: 273574 - DNA, 17 bp, Homo sapiens
ttaattcttacctcatt

SEQ ID NO: 273575 - DNA, 23 bp, Homo sapiens
ttaattcttacctcatttgcatc

SEQ ID NO: 273576 - DNA, 16 bp, Homo sapiens
ttaattgattaaactg

SEQ ID NO: 273577 - DNA, 18 bp, Homo sapiens
ttaattggttaatcactt

SEQ ID NO: 273578 - DNA, 14 bp, Homo sapiens
ttaatttatatttg

SEQ ID NO: 273579 - DNA, 13 bp, Homo sapiens
ttaatttcataaa

SEQ ID NO: 273580 - DNA, 14 bp, Homo sapiens
ttaatttcataaat

SEQ ID NO: 273581 - DNA, 18 bp, Homo sapiens
ttaatttcataaattggc

SEQ ID NO: 273582 - DNA, 13 bp, Homo sapiens
ttaattttctaaa

SEQ ID NO: 273583 - DNA, 16 bp, Homo sapiens
ttaatttttaaaagac

SEQ ID NO: 273584 - DNA, 22 bp, Homo sapiens
ttaatttttaaaagactttgat

SEQ ID NO: 273585 - DNA, 17 bp, Homo sapiens
ttacaaacaaaggattt

SEQ ID NO: 273586 - DNA, 15 bp, Homo sapiens
ttacaacaaacactg

SEQ ID NO: 273587 - DNA, 22 bp, Homo sapiens
ttacaaccggttatcagttgga

SEQ ID NO: 273588 - DNA, 12 bp, Homo sapiens
ttacaactaaat

SEQ ID NO: 273589 - DNA, 20 bp, Homo sapiens
ttacaactaaataacacaga

SEQ ID NO: 273590 - DNA, 16 bp, Homo sapiens
ttacaagtttcagtaa

SEQ ID NO: 273591 - DNA, 21 bp, Homo sapiens
ttacaataaaactttgctgcc

SEQ ID NO: 273592 - DNA, 23 bp, Homo sapiens
ttacaataaaatcttgaaaatgc

SEQ ID NO: 273593 - DNA, 20 bp, Homo sapiens
ttacaataggtgcttattct

SEQ ID NO: 273594 - DNA, 12 bp, Homo sapiens
ttacaatcaaag

SEQ ID NO: 273595 - DNA, 14 bp, Homo sapiens
ttacaatgtgcact

SEQ ID NO: 273596 - DNA, 18 bp, Homo sapiens
ttacaattccctgctgtc

SEQ ID NO: 273597 - DNA, 17 bp, Homo sapiens
ttacaattgcactgctg

SEQ ID NO: 273598 - DNA, 13 bp, Homo sapiens
ttacaattgtcat

SEQ ID NO: 273599 - DNA, 19 bp, Homo sapiens
ttacaatttgttcatccta

SEQ ID NO: 273600 - DNA, 21 bp, Homo sapiens
ttacacacgtgtgatgtatgt

SEQ ID NO: 273601 - DNA, 15 bp, Homo sapiens
ttacactctttgtaa

SEQ ID NO: 273602 - DNA, 14 bp, Homo sapiens
ttacactgtatttg

SEQ ID NO: 273603 - DNA, 17 bp, Homo sapiens
ttacactgtatttgtat

SEQ ID NO: 273604 - DNA, 13 bp, Homo sapiens
ttacactttatgc

SEQ ID NO: 273605 - DNA, 20 bp, Homo sapiens
ttacactttatgcacaaaat

SEQ ID NO: 273606 - DNA, 22 bp, Homo sapiens
ttacagagaggagaaacacatc

SEQ ID NO: 273607 - DNA, 16 bp, Homo sapiens
ttacagaggaagttat

SEQ ID NO: 273608 - DNA, 19 bp, Homo sapiens
ttacagataaggaaactga

SEQ ID NO: 273609 - DNA, 13 bp, Homo sapiens
ttacagctgcctg

SEQ ID NO: 273610 - DNA, 19 bp, Homo sapiens
ttacaggaaattgcaaaga

SEQ ID NO: 273611 - DNA, 14 bp, Homo sapiens
ttacaggaagcttt

SEQ ID NO: 273612 - DNA, 15 bp, Homo sapiens
ttacaggaagtactg

SEQ ID NO: 273613 - DNA, 18 bp, Homo sapiens
ttacaggaagtactggag

SEQ ID NO: 273614 - DNA, 15 bp, Homo sapiens
ttacaggcaccgaga

SEQ ID NO: 273615 - DNA, 17 bp, Homo sapiens
ttacaggcaccgagaat

SEQ ID NO: 273616 - DNA, 24 bp, Homo sapiens
ttacaggcaccgagaatgttgtat

SEQ ID NO: 273617 - DNA, 16 bp, Homo sapiens
ttacaggtgtactatg

SEQ ID NO: 273618 - DNA, 17 bp, Homo sapiens
ttacaggtgtactatgg

SEQ ID NO: 273619 - DNA, 13 bp, Homo sapiens
ttacagtaaataa

SEQ ID NO: 273620 - DNA, 16 bp, Homo sapiens
ttacagtaaataaatt

SEQ ID NO: 273621 - DNA, 18 bp, Homo sapiens
ttacagtaaataaattgt

SEQ ID NO: 273622 - DNA, 17 bp, Homo sapiens
ttacagttacttccttc

SEQ ID NO: 273623 - DNA, 15 bp, Homo sapiens
ttacataacaggcat

SEQ ID NO: 273624 - DNA, 16 bp, Homo sapiens
ttacataggtatatat

SEQ ID NO: 273625 - DNA, 20 bp, Homo sapiens
ttacatcctgctacactcat

SEQ ID NO: 273626 - DNA, 16 bp, Homo sapiens
ttacatctaatgcttc

SEQ ID NO: 273627 - DNA, 13 bp, Homo sapiens
ttacatctgtgtt

SEQ ID NO: 273628 - DNA, 18 bp, Homo sapiens
ttacatcttttgggaagc

SEQ ID NO: 273629 - DNA, 19 bp, Homo sapiens
ttacatgctgtgctctttg

SEQ ID NO: 273630 - DNA, 14 bp, Homo sapiens
ttacattaatgtta

SEQ ID NO: 273631 - DNA, 17 bp, Homo sapiens
ttacattgcattcaaaa

SEQ ID NO: 273632 - DNA, 12 bp, Homo sapiens
ttacattgtaaa

SEQ ID NO: 273633 - DNA, 13 bp, Homo sapiens
ttacattgtaaat

SEQ ID NO: 273634 - DNA, 17 bp, Homo sapiens
ttacattgtttgtctgt

SEQ ID NO: 273635 - DNA, 14 bp, Homo sapiens
ttacatttatacat

SEQ ID NO: 273636 - DNA, 15 bp, Homo sapiens
ttacatttatacatc

SEQ ID NO: 273637 - DNA, 19 bp, Homo sapiens
ttacattttatttattagc

SEQ ID NO: 273638 - DNA, 13 bp, Homo sapiens
ttacatttttaca

SEQ ID NO: 273639 - DNA, 17 bp, Homo sapiens
ttactcattatcgcctt

SEQ ID NO: 273640 - DNA, 16 bp, Homo sapiens
ttactcccttcctggc

SEQ ID NO: 273641 - DNA, 14 bp, Homo sapiens
ttactctgacataa

SEQ ID NO: 273642 - DNA, 13 bp, Homo sapiens
ttactctgagccc

SEQ ID NO: 273643 - DNA, 18 bp, Homo sapiens
ttactctgagcccaggcc

SEQ ID NO: 273644 - DNA, 22 bp, Homo sapiens
ttactctgcactatagccattt

SEQ ID NO: 273645 - DNA, 18 bp, Homo sapiens
ttactgagcttctctgtg

SEQ ID NO: 273646 - DNA, 22 bp, Homo sapiens
ttactgatgtgtgcaacctttt

SEQ ID NO: 273647 - DNA, 14 bp, Homo sapiens
ttactgtctgtaag

SEQ ID NO: 273648 - DNA, 16 bp, Homo sapiens
ttactgtggaggtggc

SEQ ID NO: 273649 - DNA, 19 bp, Homo sapiens
ttactgttgcatttacttt

SEQ ID NO: 273650 - DNA, 15 bp, Homo sapiens
ttactgtttatttct

SEQ ID NO: 273651 - DNA, 18 bp, Homo sapiens
ttacttaaagcttgtttg

SEQ ID NO: 273652 - DNA, 14 bp, Homo sapiens
ttacttaaatagca

SEQ ID NO: 273653 - DNA, 13 bp, Homo sapiens
ttacttacctaaa

SEQ ID NO: 273654 - DNA, 23 bp, Homo sapiens
ttacttcttatacatttgataaa

SEQ ID NO: 273655 - DNA, 16 bp, Homo sapiens
ttacttgaatttcaaa

SEQ ID NO: 273656 - DNA, 19 bp, Homo sapiens
ttacttgaggatcatatga

SEQ ID NO: 273657 - DNA, 18 bp, Homo sapiens
ttacttggaaatattaaa

SEQ ID NO: 273658 - DNA, 17 bp, Homo sapiens
ttacttgttcatttctg

SEQ ID NO: 273659 - DNA, 23 bp, Homo sapiens
ttactttaggtagtagaatctca

SEQ ID NO: 273660 - DNA, 20 bp, Homo sapiens
ttactttgctgccttaatga

SEQ ID NO: 273661 - DNA, 14 bp, Homo sapiens
ttactttgtgcaaa

SEQ ID NO: 273662 - DNA, 23 bp, Homo sapiens
ttacttttaccactatttaagtt

SEQ ID NO: 273663 - DNA, 23 bp, Homo sapiens
ttacttttatttgcaacatttac

SEQ ID NO: 273664 - DNA, 13 bp, Homo sapiens
ttacttttctgca

SEQ ID NO: 273665 - DNA, 14 bp, Homo sapiens
ttacttttgtaaat

SEQ ID NO: 273666 - DNA, 18 bp, Homo sapiens
ttactttttaaacagtgt

SEQ ID NO: 273667 - DNA, 16 bp, Homo sapiens
ttacttttttatagct

SEQ ID NO: 273668 - DNA, 19 bp, Homo sapiens
ttagaaactgagtcctgtt

SEQ ID NO: 273669 - DNA, 15 bp, Homo sapiens
ttagaaataaatgaa

SEQ ID NO: 273670 - DNA, 12 bp, Homo sapiens
ttagaaatactt

SEQ ID NO: 273671 - DNA, 12 bp, Homo sapiens
ttagaaatataa

SEQ ID NO: 273672 - DNA, 19 bp, Homo sapiens
ttagaaatcattgtagaaa

SEQ ID NO: 273673 - DNA, 20 bp, Homo sapiens
ttagaaattacaagtttcag

SEQ ID NO: 273674 - DNA, 22 bp, Homo sapiens
ttagaacagaaaacaacaaaaa

SEQ ID NO: 273675 - DNA, 16 bp, Homo sapiens
ttagaacccttctgct

SEQ ID NO: 273676 - DNA, 19 bp, Homo sapiens
ttagaacttagttttgttc

SEQ ID NO: 273677 - DNA, 11 bp, Homo sapiens
ttagaagccac

SEQ ID NO: 273678 - DNA, 19 bp, Homo sapiens
ttagaagtgcatttctgaa

SEQ ID NO: 273679 - DNA, 13 bp, Homo sapiens
ttagaatgtcagt

SEQ ID NO: 273680 - DNA, 13 bp, Homo sapiens
ttagaatgttgaa

SEQ ID NO: 273681 - DNA, 21 bp, Homo sapiens
ttagacaatggctatattaat

SEQ ID NO: 273682 - DNA, 12 bp, Homo sapiens
ttagacaatgtg

SEQ ID NO: 273683 - DNA, 13 bp, Homo sapiens
ttagacaatgtgg

SEQ ID NO: 273684 - DNA, 21 bp, Homo sapiens
ttagacaatgtggaattacat

SEQ ID NO: 273685 - DNA, 18 bp, Homo sapiens
ttagacctcatctccaag

SEQ ID NO: 273686 - DNA, 12 bp, Homo sapiens
ttagagagagga

SEQ ID NO: 273687 - DNA, 13 bp, Homo sapiens
ttagagatgaatt

SEQ ID NO: 273688 - DNA, 21 bp, Homo sapiens
ttagagcagatgacccctccc

SEQ ID NO: 273689 - DNA, 18 bp, Homo sapiens
ttagagggaggtgtttaa

SEQ ID NO: 273690 - DNA, 17 bp, Homo sapiens
ttagatataacactatg

SEQ ID NO: 273691 - DNA, 18 bp, Homo sapiens
ttagatattcattaatag

SEQ ID NO: 273692 - DNA, 23 bp, Homo sapiens
ttagatcaacaataaaaaaaaac

SEQ ID NO: 273693 - DNA, 14 bp, Homo sapiens
ttagatctgagccc

SEQ ID NO: 273694 - DNA, 19 bp, Homo sapiens
ttagatgctgaatatctgt

SEQ ID NO: 273695 - DNA, 22 bp, Homo sapiens
ttagcaacgcctgccttctggg

SEQ ID NO: 273696 - DNA, 13 bp, Homo sapiens
ttagcaatattta

SEQ ID NO: 273697 - DNA, 17 bp, Homo sapiens
ttagcacaaaaaaaatt

SEQ ID NO: 273698 - DNA, 13 bp, Homo sapiens
ttagcagctcagg

SEQ ID NO: 273699 - DNA, 23 bp, Homo sapiens
ttagcagctcaggcgcagcccta

SEQ ID NO: 273700 - DNA, 21 bp, Homo sapiens
ttagcagttctgcaaatagaa

SEQ ID NO: 273701 - DNA, 16 bp, Homo sapiens
ttagcagtttgctttg

SEQ ID NO: 273702 - DNA, 14 bp, Homo sapiens
ttagcatgaaaggt

SEQ ID NO: 273703 - DNA, 16 bp, Homo sapiens
ttagcatgaaaggtaa

SEQ ID NO: 273704 - DNA, 22 bp, Homo sapiens
ttagcatgacaagccccaggca

SEQ ID NO: 273705 - DNA, 20 bp, Homo sapiens
ttagccatctaatgcttgtt

SEQ ID NO: 273706 - DNA, 14 bp, Homo sapiens
ttagccctgtctgc

SEQ ID NO: 273707 - DNA, 12 bp, Homo sapiens
ttagcctctccc

SEQ ID NO: 273708 - DNA, 17 bp, Homo sapiens
ttagcctctcccacccg

SEQ ID NO: 273709 - DNA, 17 bp, Homo sapiens
ttagccttgtgccctgc

SEQ ID NO: 273710 - DNA, 16 bp, Homo sapiens
ttagctaaaaatatat

SEQ ID NO: 273711 - DNA, 20 bp, Homo sapiens
ttagctgtaaatacatgtgt

SEQ ID NO: 273712 - DNA, 16 bp, Homo sapiens
ttagcttacaggaagc

SEQ ID NO: 273713 - DNA, 20 bp, Homo sapiens
ttagcttcctccagaggagg

SEQ ID NO: 273714 - DNA, 15 bp, Homo sapiens
ttagcttctctgcca

SEQ ID NO: 273715 - DNA, 12 bp, Homo sapiens
ttaggaaattgc

SEQ ID NO: 273716 - DNA, 14 bp, Homo sapiens
ttaggaacagagta

SEQ ID NO: 273717 - DNA, 14 bp, Homo sapiens
ttaggaatgctcaa

SEQ ID NO: 273718 - DNA, 18 bp, Homo sapiens
ttaggaatgctcaatgtg

SEQ ID NO: 273719 - DNA, 20 bp, Homo sapiens
ttaggaatgctcaatgtgct

SEQ ID NO: 273720 - DNA, 19 bp, Homo sapiens
ttaggaattaagttatctt

SEQ ID NO: 273721 - DNA, 16 bp, Homo sapiens
ttaggacacagtgtgt

SEQ ID NO: 273722 - DNA, 18 bp, Homo sapiens
ttaggagaagttggtctt

SEQ ID NO: 273723 - DNA, 21 bp, Homo sapiens
ttaggagagaaggtaggggtt

SEQ ID NO: 273724 - DNA, 15 bp, Homo sapiens
ttaggagttttgaga

SEQ ID NO: 273725 - DNA, 13 bp, Homo sapiens
ttaggcagcagct

SEQ ID NO: 273726 - DNA, 13 bp, Homo sapiens
ttaggcagcctgc

SEQ ID NO: 273727 - DNA, 18 bp, Homo sapiens
ttaggcagggatttgagg

SEQ ID NO: 273728 - DNA, 16 bp, Homo sapiens
ttaggcttttaagaaa

SEQ ID NO: 273729 - DNA, 18 bp, Homo sapiens
ttaggcttttaagaaaca

SEQ ID NO: 273730 - DNA, 21 bp, Homo sapiens
ttagggagaagggcttttctt

SEQ ID NO: 273731 - DNA, 22 bp, Homo sapiens
ttagggagacccaataaagaat

SEQ ID NO: 273732 - DNA, 16 bp, Homo sapiens
ttaggggaaaatagta

SEQ ID NO: 273733 - DNA, 17 bp, Homo sapiens
ttaggggaaaatagtag

SEQ ID NO: 273734 - DNA, 23 bp, Homo sapiens
ttaggtagtagaatctcagcact

SEQ ID NO: 273735 - DNA, 13 bp, Homo sapiens
ttaggtcatccaa

SEQ ID NO: 273736 - DNA, 16 bp, Homo sapiens
ttaggtctgcattttc

SEQ ID NO: 273737 - DNA, 13 bp, Homo sapiens
ttaggtgccaggc

SEQ ID NO: 273738 - DNA, 14 bp, Homo sapiens
ttaggttaggactt

SEQ ID NO: 273739 - DNA, 19 bp, Homo sapiens
ttagtactatatctgtttt

SEQ ID NO: 273740 - DNA, 21 bp, Homo sapiens
ttagtagaaattttacaatag

SEQ ID NO: 273741 - DNA, 15 bp, Homo sapiens
ttagtagctgataaa

SEQ ID NO: 273742 - DNA, 16 bp, Homo sapiens
ttagtagctgataaag

SEQ ID NO: 273743 - DNA, 20 bp, Homo sapiens
ttagtatatttatataatta

SEQ ID NO: 273744 - DNA, 15 bp, Homo sapiens
ttagtatcctgttag

SEQ ID NO: 273745 - DNA, 17 bp, Homo sapiens
ttagtatctaacatgta

SEQ ID NO: 273746 - DNA, 23 bp, Homo sapiens
ttagtatctaacatgtatcccaa

SEQ ID NO: 273747 - DNA, 14 bp, Homo sapiens
ttagtcctcacctt

SEQ ID NO: 273748 - DNA, 19 bp, Homo sapiens
ttagtcctcaccttctgtt

SEQ ID NO: 273749 - DNA, 14 bp, Homo sapiens
ttagtcttctcata

SEQ ID NO: 273750 - DNA, 16 bp, Homo sapiens
ttagtgattgctttta

SEQ ID NO: 273751 - DNA, 17 bp, Homo sapiens
ttagtgcaatttcttct

SEQ ID NO: 273752 - DNA, 20 bp, Homo sapiens
ttagtgcaatttcttctgta

SEQ ID NO: 273753 - DNA, 20 bp, Homo sapiens
ttagtgccggctgtggagca

SEQ ID NO: 273754 - DNA, 14 bp, Homo sapiens
ttagtgctttacat

SEQ ID NO: 273755 - DNA, 13 bp, Homo sapiens
ttagtgggaagag

SEQ ID NO: 273756 - DNA, 15 bp, Homo sapiens
ttagtggtatgtctc

SEQ ID NO: 273757 - DNA, 16 bp, Homo sapiens
ttagtggtatgtctct

SEQ ID NO: 273758 - DNA, 15 bp, Homo sapiens
ttagttaagatgtct

SEQ ID NO: 273759 - DNA, 13 bp, Homo sapiens
ttagttaatatat

SEQ ID NO: 273760 - DNA, 13 bp, Homo sapiens
ttagttatagttt

SEQ ID NO: 273761 - DNA, 17 bp, Homo sapiens
ttagttcttgggggagg

SEQ ID NO: 273762 - DNA, 13 bp, Homo sapiens
ttagttgaaaaat

SEQ ID NO: 273763 - DNA, 17 bp, Homo sapiens
ttagtttaccaatcaac

SEQ ID NO: 273764 - DNA, 14 bp, Homo sapiens
ttagtttcaaaatg

SEQ ID NO: 273765 - DNA, 18 bp, Homo sapiens
ttcaagactgaaatggct

SEQ ID NO: 273766 - DNA, 19 bp, Homo sapiens
ttcaagacttgagcggagc

SEQ ID NO: 273767 - DNA, 14 bp, Homo sapiens
ttcaagatcttcaa

SEQ ID NO: 273768 - DNA, 12 bp, Homo sapiens
ttcaagcaaaca

SEQ ID NO: 273769 - DNA, 13 bp, Homo sapiens
ttcaagcaaacat

SEQ ID NO: 273770 - DNA, 15 bp, Homo sapiens
ttcaagcaaacatca

SEQ ID NO: 273771 - DNA, 17 bp, Homo sapiens
ttcaagcaaacatcaaa

SEQ ID NO: 273772 - DNA, 12 bp, Homo sapiens
ttcaagcaaata

SEQ ID NO: 273773 - DNA, 20 bp, Homo sapiens
ttcaagctgtcccctctgtc

SEQ ID NO: 273774 - DNA, 11 bp, Homo sapiens
ttcaagctttc

SEQ ID NO: 273775 - DNA, 18 bp, Homo sapiens
ttcaaggagaatatgata

SEQ ID NO: 273776 - DNA, 16 bp, Homo sapiens
ttcaagggctgcttca

SEQ ID NO: 273777 - DNA, 18 bp, Homo sapiens
ttcaaggtggccaaatta

SEQ ID NO: 273778 - DNA, 22 bp, Homo sapiens
ttcaagtcatggggagattcct

SEQ ID NO: 273779 - DNA, 20 bp, Homo sapiens
ttcaagtctgtgcctggagc

SEQ ID NO: 273780 - DNA, 21 bp, Homo sapiens
ttcaataaaatgcactgacca

SEQ ID NO: 273781 - DNA, 13 bp, Homo sapiens
ttcaataaagctg

SEQ ID NO: 273782 - DNA, 13 bp, Homo sapiens
ttcaataaatctt

SEQ ID NO: 273783 - DNA, 19 bp, Homo sapiens
ttcaatcattttgggaaat

SEQ ID NO: 273784 - DNA, 12 bp, Homo sapiens
ttcaatctctgg

SEQ ID NO: 273785 - DNA, 12 bp, Homo sapiens
ttcaatctctgt

SEQ ID NO: 273786 - DNA, 15 bp, Homo sapiens
ttcaatgatctaggt

SEQ ID NO: 273787 - DNA, 19 bp, Homo sapiens
ttcaatgatctaggtttaa

SEQ ID NO: 273788 - DNA, 22 bp, Homo sapiens
ttcaatgatctaggtttaactc

SEQ ID NO: 273789 - DNA, 23 bp, Homo sapiens
ttcaatgatctaggtttaactca

SEQ ID NO: 273790 - DNA, 13 bp, Homo sapiens
ttcaatgctttct

SEQ ID NO: 273791 - DNA, 17 bp, Homo sapiens
ttcaatggttgggacaa

SEQ ID NO: 273792 - DNA, 12 bp, Homo sapiens
ttcaattcctct

SEQ ID NO: 273793 - DNA, 18 bp, Homo sapiens
ttcaatttctaaatttgc

SEQ ID NO: 273794 - DNA, 12 bp, Homo sapiens
ttcaatttgttc

SEQ ID NO: 273795 - DNA, 13 bp, Homo sapiens
ttcacaaatatag

SEQ ID NO: 273796 - DNA, 14 bp, Homo sapiens
ttcacaaatatagt

SEQ ID NO: 273797 - DNA, 18 bp, Homo sapiens
ttcacaaatatagttgaa

SEQ ID NO: 273798 - DNA, 21 bp, Homo sapiens
ttcacaaccttctgtggctca

SEQ ID NO: 273799 - DNA, 16 bp, Homo sapiens
ttcacaagctgcctcc

SEQ ID NO: 273800 - DNA, 17 bp, Homo sapiens
ttcacaagctgcctccc

SEQ ID NO: 273801 - DNA, 18 bp, Homo sapiens
ttcacaagtcctgccaag

SEQ ID NO: 273802 - DNA, 13 bp, Homo sapiens
ttcacaatgtggc

SEQ ID NO: 273803 - DNA, 22 bp, Homo sapiens
ttcacaatgttggcctgtcaga

SEQ ID NO: 273804 - DNA, 14 bp, Homo sapiens
ttcacacacacaca

SEQ ID NO: 273805 - DNA, 14 bp, Homo sapiens
ttcacacacagcct

SEQ ID NO: 273806 - DNA, 22 bp, Homo sapiens
ttcacacagcacctcctctctg

SEQ ID NO: 273807 - DNA, 21 bp, Homo sapiens
ttcacacccctcagcgctccc

SEQ ID NO: 273808 - DNA, 23 bp, Homo sapiens
ttcacacccctcagcgctccctg

SEQ ID NO: 273809 - DNA, 11 bp, Homo sapiens
ttcacaccctg

SEQ ID NO: 273810 - DNA, 20 bp, Homo sapiens
ttcacacctcacgctctgga

SEQ ID NO: 273811 - DNA, 14 bp, Homo sapiens
ttcacagcttcttt

SEQ ID NO: 273812 - DNA, 18 bp, Homo sapiens
ttcacaggcagtgcatgt

SEQ ID NO: 273813 - DNA, 13 bp, Homo sapiens
ttcacagttctct

SEQ ID NO: 273814 - DNA, 19 bp, Homo sapiens
ttcacatgagctatttcca

SEQ ID NO: 273815 - DNA, 13 bp, Homo sapiens
ttcaccaacaaca

SEQ ID NO: 273816 - DNA, 24 bp, Homo sapiens
ttcaccaacaacagtcagccagct

SEQ ID NO: 273817 - DNA, 22 bp, Homo sapiens
ttcaccaccctgggaccccccc

SEQ ID NO: 273818 - DNA, 18 bp, Homo sapiens
ttcaccaggaagaaggcc

SEQ ID NO: 273819 - DNA, 20 bp, Homo sapiens
ttcaccaggaagaaggcccg

SEQ ID NO: 273820 - DNA, 16 bp, Homo sapiens
ttcaccagtctgtcta

SEQ ID NO: 273821 - DNA, 20 bp, Homo sapiens
ttcaccatcatgtaccaagt

SEQ ID NO: 273822 - DNA, 17 bp, Homo sapiens
ttcaccatgtaaaacaa

SEQ ID NO: 273823 - DNA, 22 bp, Homo sapiens
ttcaccatgtaaaacaaaaaac

SEQ ID NO: 273824 - DNA, 13 bp, Homo sapiens
ttcaccccaccct

SEQ ID NO: 273825 - DNA, 14 bp, Homo sapiens
ttcaccccaccctt

SEQ ID NO: 273826 - DNA, 22 bp, Homo sapiens
ttcaccccggcaggccctgcag

SEQ ID NO: 273827 - DNA, 13 bp, Homo sapiens
ttcacccctgcac

SEQ ID NO: 273828 - DNA, 12 bp, Homo sapiens
ttcacctctatc

SEQ ID NO: 273829 - DNA, 13 bp, Homo sapiens
ttcacctgtaaaa

SEQ ID NO: 273830 - DNA, 16 bp, Homo sapiens
ttcacctgtaaaactt

SEQ ID NO: 273831 - DNA, 17 bp, Homo sapiens
ttcacctgtaaaacttt

SEQ ID NO: 273832 - DNA, 23 bp, Homo sapiens
ttcacctgttaaggtggaaaatg

SEQ ID NO: 273833 - DNA, 19 bp, Homo sapiens
ttcacctgtttttaagctg

SEQ ID NO: 273834 - DNA, 21 bp, Homo sapiens
ttcacctgtttttaagctgtt

SEQ ID NO: 273835 - DNA, 14 bp, Homo sapiens
ttcaccttgaagaa

SEQ ID NO: 273836 - DNA, 14 bp, Homo sapiens
ttcacgctggcttc

SEQ ID NO: 273837 - DNA, 20 bp, Homo sapiens
ttcacggacaggaagcacag

SEQ ID NO: 273838 - DNA, 15 bp, Homo sapiens
ttcacggactctttg

SEQ ID NO: 273839 - DNA, 14 bp, Homo sapiens
ttcactaaaataaa

SEQ ID NO: 273840 - DNA, 13 bp, Homo sapiens
ttcactaaagcag

SEQ ID NO: 273841 - DNA, 19 bp, Homo sapiens
ttcactagagacaaatctt

SEQ ID NO: 273842 - DNA, 17 bp, Homo sapiens
ttcactattcctatgct

SEQ ID NO: 273843 - DNA, 20 bp, Homo sapiens
ttcactatttttatttatat

SEQ ID NO: 273844 - DNA, 15 bp, Homo sapiens
ttcactcagaattat

SEQ ID NO: 273845 - DNA, 18 bp, Homo sapiens
ttcactctcccagaggct

SEQ ID NO: 273846 - DNA, 20 bp, Homo sapiens
ttcactgaatatcatatgta

SEQ ID NO: 273847 - DNA, 15 bp, Homo sapiens
ttcactgcaattttg

SEQ ID NO: 273848 - DNA, 12 bp, Homo sapiens
ttcactgctgct

SEQ ID NO: 273849 - DNA, 15 bp, Homo sapiens
ttcactgctgctcct

SEQ ID NO: 273850 - DNA, 21 bp, Homo sapiens
ttcactgctgctcctctttcc

SEQ ID NO: 273851 - DNA, 16 bp, Homo sapiens
ttcactgctggctgcc

SEQ ID NO: 273852 - DNA, 18 bp, Homo sapiens
ttcactgctggctgcctt

SEQ ID NO: 273853 - DNA, 17 bp, Homo sapiens
ttcactggagttacatt

SEQ ID NO: 273854 - DNA, 16 bp, Homo sapiens
ttcactgttagctttt

SEQ ID NO: 273855 - DNA, 18 bp, Homo sapiens
ttcacttaaactttgtca

SEQ ID NO: 273856 - DNA, 19 bp, Homo sapiens
ttcacttaaactttgtcac

SEQ ID NO: 273857 - DNA, 14 bp, Homo sapiens
ttcacttcctagag

SEQ ID NO: 273858 - DNA, 18 bp, Homo sapiens
ttcacttttcaatcccaa

SEQ ID NO: 273859 - DNA, 22 bp, Homo sapiens
ttcagaaaacagaaaaaaaaca

SEQ ID NO: 273860 - DNA, 13 bp, Homo sapiens
ttcagaaaatatt

SEQ ID NO: 273861 - DNA, 21 bp, Homo sapiens
ttcagaaaatattatgtgttt

SEQ ID NO: 273862 - DNA, 20 bp, Homo sapiens
ttcagaaagggcagcccctc

SEQ ID NO: 273863 - DNA, 16 bp, Homo sapiens
ttcagaaatgctgcct

SEQ ID NO: 273864 - DNA, 18 bp, Homo sapiens
ttcagaaatgctgcctgc

SEQ ID NO: 273865 - DNA, 19 bp, Homo sapiens
ttcagaaatgctgcctgcc

SEQ ID NO: 273866 - DNA, 15 bp, Homo sapiens
ttcagaacctcttcc

SEQ ID NO: 273867 - DNA, 15 bp, Homo sapiens
ttcagaactctcaga

SEQ ID NO: 273868 - DNA, 17 bp, Homo sapiens
ttcagaactctcagact

SEQ ID NO: 273869 - DNA, 17 bp, Homo sapiens
ttcagaacttgtaacta

SEQ ID NO: 273870 - DNA, 13 bp, Homo sapiens
ttcagaagacctc

SEQ ID NO: 273871 - DNA, 23 bp, Homo sapiens
ttcagaaggttattttctttatc

SEQ ID NO: 273872 - DNA, 12 bp, Homo sapiens
aggcctggtctg

SEQ ID NO: 273873 - DNA, 14 bp, Homo sapiens
aggcctggtctgga

SEQ ID NO: 273874 - DNA, 15 bp, Homo sapiens
aggcctggtctggag

SEQ ID NO: 273875 - DNA, 21 bp, Homo sapiens
aggcctggtctggagccccta

SEQ ID NO: 273876 - DNA, 23 bp, Homo sapiens
aggcctgtccctggccatctctg

SEQ ID NO: 273877 - DNA, 16 bp, Homo sapiens
aggcctgtgctgcatg

SEQ ID NO: 273878 - DNA, 23 bp, Homo sapiens
aggcctgtgctgcatgcgacagc

SEQ ID NO: 273879 - DNA, 23 bp, Homo sapiens
aggccttcagaaaagacacttca

SEQ ID NO: 273880 - DNA, 22 bp, Homo sapiens
aggccttctcctccccacccgc

SEQ ID NO: 273881 - DNA, 18 bp, Homo sapiens
aggccttctgatttcaag

SEQ ID NO: 273882 - DNA, 20 bp, Homo sapiens
aggccttgggggtctgctct

SEQ ID NO: 273883 - DNA, 16 bp, Homo sapiens
aggcctttcaggaagg

SEQ ID NO: 273884 - DNA, 14 bp, Homo sapiens
aggcctttcctaca

SEQ ID NO: 273885 - DNA, 11 bp, Homo sapiens
aggcctttggg

SEQ ID NO: 273886 - DNA, 13 bp, Homo sapiens
aggcctttgggat

SEQ ID NO: 273887 - DNA, 17 bp, Homo sapiens
aggcgaggctgcctctg

SEQ ID NO: 273888 - DNA, 13 bp, Homo sapiens
aggcgcagcccta

SEQ ID NO: 273889 - DNA, 15 bp, Homo sapiens
aggcgcccacctgcc

SEQ ID NO: 273890 - DNA, 16 bp, Homo sapiens
aggcgcccacctgccc

SEQ ID NO: 273891 - DNA, 16 bp, Homo sapiens
aggcgcgcaccgccca

SEQ ID NO: 273892 - DNA, 21 bp, Homo sapiens
aggcgcgcaccgcccaacccc

SEQ ID NO: 273893 - DNA, 16 bp, Homo sapiens
aggcgcgtctgcccca

SEQ ID NO: 273894 - DNA, 23 bp, Homo sapiens
aggcggaggggcttggagcagag

SEQ ID NO: 273895 - DNA, 14 bp, Homo sapiens
aggcggcagctctt

SEQ ID NO: 273896 - DNA, 15 bp, Homo sapiens
aggcgggcggtcagg

SEQ ID NO: 273897 - DNA, 19 bp, Homo sapiens
aggcgggggatcctggagc

SEQ ID NO: 273898 - DNA, 23 bp, Homo sapiens
aggcggtccccatccccaccagc

SEQ ID NO: 273899 - DNA, 13 bp, Homo sapiens
aggcgtagggcca

SEQ ID NO: 273900 - DNA, 16 bp, Homo sapiens
aggcgtagggccaggg

SEQ ID NO: 273901 - DNA, 17 bp, Homo sapiens
aggcgtagggccagggc

SEQ ID NO: 273902 - DNA, 22 bp, Homo sapiens
aggcgtagggccagggctctgg

SEQ ID NO: 273903 - DNA, 21 bp, Homo sapiens
aggcgtccgcgcgccagcaca

SEQ ID NO: 273904 - DNA, 15 bp, Homo sapiens
aggcgtcttgtattt

SEQ ID NO: 273905 - DNA, 16 bp, Homo sapiens
aggcgtcttgtatttt

SEQ ID NO: 273906 - DNA, 17 bp, Homo sapiens
aggcgtcttgtattttc

SEQ ID NO: 273907 - DNA, 23 bp, Homo sapiens
aggcgtgggatccagagagaagc

SEQ ID NO: 273908 - DNA, 16 bp, Homo sapiens
aggcgttagtgggcag

SEQ ID NO: 273909 - DNA, 16 bp, Homo sapiens
aggcgttctcctgctt

SEQ ID NO: 273910 - DNA, 18 bp, Homo sapiens
aggcgttctcctgcttgt

SEQ ID NO: 273911 - DNA, 16 bp, Homo sapiens
aggcgttggtgccact

SEQ ID NO: 273912 - DNA, 13 bp, Homo sapiens
aggctaaaaacat

SEQ ID NO: 273913 - DNA, 16 bp, Homo sapiens
aggctaaaaacatttt

SEQ ID NO: 273914 - DNA, 16 bp, Homo sapiens
aggctaaaacaaatct

SEQ ID NO: 273915 - DNA, 19 bp, Homo sapiens
aggctaaagaagacacaca

SEQ ID NO: 273916 - DNA, 22 bp, Homo sapiens
aggctaaagaagacacacagcc

SEQ ID NO: 273917 - DNA, 21 bp, Homo sapiens
aggctaagttcagttctgttt

SEQ ID NO: 273918 - DNA, 16 bp, Homo sapiens
aggctacccttgccaa

SEQ ID NO: 273919 - DNA, 14 bp, Homo sapiens
aggctacttttcag

SEQ ID NO: 273920 - DNA, 19 bp, Homo sapiens
aggctagaatggaaaactg

SEQ ID NO: 273921 - DNA, 12 bp, Homo sapiens
aggctagcccca

SEQ ID NO: 273922 - DNA, 13 bp, Homo sapiens
aggctagccccag

SEQ ID NO: 273923 - DNA, 14 bp, Homo sapiens
aggctagccccagg

SEQ ID NO: 273924 - DNA, 18 bp, Homo sapiens
aggctagtccggacccac

SEQ ID NO: 273925 - DNA, 17 bp, Homo sapiens
aggctattaaaagaatc

SEQ ID NO: 273926 - DNA, 19 bp, Homo sapiens
aggctatttgttcagagag

SEQ ID NO: 273927 - DNA, 21 bp, Homo sapiens
aggctcacaactgtttttgaa

SEQ ID NO: 273928 - DNA, 23 bp, Homo sapiens
aggctcacaactgtttttgaaga

SEQ ID NO: 273929 - DNA, 14 bp, Homo sapiens
aggctccattagga

SEQ ID NO: 273930 - DNA, 15 bp, Homo sapiens
aggctcccagaccca

SEQ ID NO: 273931 - DNA, 19 bp, Homo sapiens
aggctcccagacccagggc

SEQ ID NO: 273932 - DNA, 22 bp, Homo sapiens
aggctcccagacccagggcagt

SEQ ID NO: 273933 - DNA, 13 bp, Homo sapiens
aggctccccgcct

SEQ ID NO: 273934 - DNA, 15 bp, Homo sapiens
aggctccccgcctcc

SEQ ID NO: 273935 - DNA, 17 bp, Homo sapiens
aggctccccgcctccac

SEQ ID NO: 273936 - DNA, 19 bp, Homo sapiens
aggctccccgcctccactc

SEQ ID NO: 273937 - DNA, 18 bp, Homo sapiens
aggctcccctggtctcct

SEQ ID NO: 273938 - DNA, 16 bp, Homo sapiens
aggctcctacaggcgc

SEQ ID NO: 273939 - DNA, 12 bp, Homo sapiens
aggctcctcctt

SEQ ID NO: 273940 - DNA, 19 bp, Homo sapiens
aggctcctccttgcccaga

SEQ ID NO: 273941 - DNA, 15 bp, Homo sapiens
aggctccttcatgtg

SEQ ID NO: 273942 - DNA, 22 bp, Homo sapiens
aggctctatttcggaaatacac

SEQ ID NO: 273943 - DNA, 24 bp, Homo sapiens
aggctctatttcggaaatacacta

SEQ ID NO: 273944 - DNA, 11 bp, Homo sapiens
aggctctcccc

SEQ ID NO: 273945 - DNA, 14 bp, Homo sapiens
aggctctcccctct

SEQ ID NO: 273946 - DNA, 22 bp, Homo sapiens
aggctctcccctctcgccccat

SEQ ID NO: 273947 - DNA, 15 bp, Homo sapiens
aggctctgaatctct

SEQ ID NO: 273948 - DNA, 13 bp, Homo sapiens
aggctctgctgac

SEQ ID NO: 273949 - DNA, 14 bp, Homo sapiens
aggctctgctgact

SEQ ID NO: 273950 - DNA, 12 bp, Homo sapiens
aggctctgggct

SEQ ID NO: 273951 - DNA, 16 bp, Homo sapiens
aggctctgggctcagg

SEQ ID NO: 273952 - DNA, 17 bp, Homo sapiens
aggctctgggctcaggg

SEQ ID NO: 273953 - DNA, 18 bp, Homo sapiens
aggctctgggctcagggc

SEQ ID NO: 273954 - DNA, 22 bp, Homo sapiens
aggctctgggctcagggctgga

SEQ ID NO: 273955 - DNA, 17 bp, Homo sapiens
aggctcttcctggacct

SEQ ID NO: 273956 - DNA, 18 bp, Homo sapiens
aggctcttcctggacctg

SEQ ID NO: 273957 - DNA, 22 bp, Homo sapiens
aggctcttcctggacctgagtc

SEQ ID NO: 273958 - DNA, 19 bp, Homo sapiens
aggctgactgggggcctct

SEQ ID NO: 273959 - DNA, 20 bp, Homo sapiens
aggctgactgggggcctctg

SEQ ID NO: 273960 - DNA, 22 bp, Homo sapiens
aggctgactgggggcctctgcc

SEQ ID NO: 273961 - DNA, 12 bp, Homo sapiens
aggctgagcagg

SEQ ID NO: 273962 - DNA, 13 bp, Homo sapiens
aggctgagcagga

SEQ ID NO: 273963 - DNA, 17 bp, Homo sapiens
aggctgaggtgggcaga

SEQ ID NO: 273964 - DNA, 13 bp, Homo sapiens
aggctgcactgca

SEQ ID NO: 273965 - DNA, 18 bp, Homo sapiens
aggctgcagaggcacctc

SEQ ID NO: 273966 - DNA, 19 bp, Homo sapiens
aggctgcagaggcacctca

SEQ ID NO: 273967 - DNA, 18 bp, Homo sapiens
aggctgcagcaggcagag

SEQ ID NO: 273968 - DNA, 19 bp, Homo sapiens
aggctgccggctgcaccct

SEQ ID NO: 273969 - DNA, 13 bp, Homo sapiens
aggctgcctctgg

SEQ ID NO: 273970 - DNA, 18 bp, Homo sapiens
aggctgcctctgggtgag

SEQ ID NO: 273971 - DNA, 12 bp, Homo sapiens
aggctgcctgga

SEQ ID NO: 273972 - DNA, 13 bp, Homo sapiens
aggctgcctggag

SEQ ID NO: 273973 - DNA, 16 bp, Homo sapiens
aggctgctggaggaaa

SEQ ID NO: 273974 - DNA, 22 bp, Homo sapiens
aggctggagggcagtggcacga

SEQ ID NO: 273975 - DNA, 20 bp, Homo sapiens
aggctggcaccgccttctct

SEQ ID NO: 273976 - DNA, 15 bp, Homo sapiens
aggctggcagctctc

SEQ ID NO: 273977 - DNA, 20 bp, Homo sapiens
aggctggcagctctccagtc

SEQ ID NO: 273978 - DNA, 20 bp, Homo sapiens
aggctggccagcaaggcagg

SEQ ID NO: 273979 - DNA, 21 bp, Homo sapiens
aggctggccagcaaggcaggt

SEQ ID NO: 273980 - DNA, 15 bp, Homo sapiens
aggctggcctcagac

SEQ ID NO: 273981 - DNA, 13 bp, Homo sapiens
aggctgggccaag

SEQ ID NO: 273982 - DNA, 15 bp, Homo sapiens
aggctgggcccagag

SEQ ID NO: 273983 - DNA, 20 bp, Homo sapiens
aggctgggcccagaggcaca

SEQ ID NO: 273984 - DNA, 22 bp, Homo sapiens
aggctgggcccagaggcacagc

SEQ ID NO: 273985 - DNA, 22 bp, Homo sapiens
aggctggggcctggcctattta

SEQ ID NO: 273986 - DNA, 21 bp, Homo sapiens
aggctggggcttttgtgccag

SEQ ID NO: 273987 - DNA, 19 bp, Homo sapiens
aggctgggtgcccacagcc

SEQ ID NO: 273988 - DNA, 19 bp, Homo sapiens
aggctgtaaatgagggcag

SEQ ID NO: 273989 - DNA, 19 bp, Homo sapiens
aggctgtcaattacaggaa

SEQ ID NO: 273990 - DNA, 14 bp, Homo sapiens
ttcattcaacagct

SEQ ID NO: 273991 - DNA, 12 bp, Homo sapiens
ttcattcatatc

SEQ ID NO: 273992 - DNA, 12 bp, Homo sapiens
ttcattcatttt

SEQ ID NO: 273993 - DNA, 18 bp, Homo sapiens
ttcattcctaacacagca

SEQ ID NO: 273994 - DNA, 16 bp, Homo sapiens
ttcattctaaaccaaa

SEQ ID NO: 273995 - DNA, 21 bp, Homo sapiens
ttcattctcattgcagaataa

SEQ ID NO: 273996 - DNA, 13 bp, Homo sapiens
ttcattcttgaaa

SEQ ID NO: 273997 - DNA, 17 bp, Homo sapiens
ttcattgaatactttat

SEQ ID NO: 273998 - DNA, 23 bp, Homo sapiens
ttcattgctacacttacaagtaa

SEQ ID NO: 273999 - DNA, 13 bp, Homo sapiens
ttcattgggctgt

SEQ ID NO: 274000 - DNA, 14 bp, Homo sapiens
ttcattgtatgatg

SEQ ID NO: 274001 - DNA, 16 bp, Homo sapiens
ttcatttaaaatgatt

SEQ ID NO: 274002 - DNA, 14 bp, Homo sapiens
ttctggctttgttc

SEQ ID NO: 274003 - DNA, 21 bp, Homo sapiens
ttctggctttgttcttgtcat

SEQ ID NO: 274004 - DNA, 20 bp, Homo sapiens
ttctgggaaaggtgctcaaa

SEQ ID NO: 274005 - DNA, 23 bp, Homo sapiens
ttctgggaaatggcttgaagcca

SEQ ID NO: 274006 - DNA, 14 bp, Homo sapiens
ttctgggaagggag

SEQ ID NO: 274007 - DNA, 17 bp, Homo sapiens
ttctgggcaaggtgagg

SEQ ID NO: 274008 - DNA, 14 bp, Homo sapiens
ttctggggcccctt

SEQ ID NO: 274009 - DNA, 23 bp, Homo sapiens
ttctggggcccctttttactccc

SEQ ID NO: 274010 - DNA, 15 bp, Homo sapiens
ttctgggtgatttct

SEQ ID NO: 274011 - DNA, 19 bp, Homo sapiens
ttctggtagatagaaataa

SEQ ID NO: 274012 - DNA, 14 bp, Homo sapiens
ttctggtaggttct

SEQ ID NO: 274013 - DNA, 22 bp, Homo sapiens
ttctggtatgaacttgaggaca

SEQ ID NO: 274014 - DNA, 17 bp, Homo sapiens
ttctggtgcatgttctt

SEQ ID NO: 274015 - DNA, 19 bp, Homo sapiens
ttctggtggggtgtgttcc

SEQ ID NO: 274016 - DNA, 16 bp, Homo sapiens
ttctggttagctcagc

SEQ ID NO: 274017 - DNA, 22 bp, Homo sapiens
ttctggttagctcagccccagc

SEQ ID NO: 274018 - DNA, 21 bp, Homo sapiens
ttctggttcttgtgttggctg

SEQ ID NO: 274019 - DNA, 11 bp, Homo sapiens
ttctgtaaaat

SEQ ID NO: 274020 - DNA, 14 bp, Homo sapiens
ttctgtaaatggaa

SEQ ID NO: 274021 - DNA, 17 bp, Homo sapiens
ttctgtaatggaactga

SEQ ID NO: 274022 - DNA, 21 bp, Homo sapiens
ttctgtaattggcttttgaat

SEQ ID NO: 274023 - DNA, 21 bp, Homo sapiens
ttctgtagaatgctgtagaat

SEQ ID NO: 274024 - DNA, 21 bp, Homo sapiens
ttctgtaggagagactggcca

SEQ ID NO: 274025 - DNA, 21 bp, Homo sapiens
ttctgtagtactccttaagaa

SEQ ID NO: 274026 - DNA, 17 bp, Homo sapiens
ttctgtatcaagcccct

SEQ ID NO: 274027 - DNA, 18 bp, Homo sapiens
ttctgtcaccaaatttgt

SEQ ID NO: 274028 - DNA, 14 bp, Homo sapiens
ttctgtcactgtag

SEQ ID NO: 274029 - DNA, 12 bp, Homo sapiens
ttctgtccatca

SEQ ID NO: 274030 - DNA, 14 bp, Homo sapiens
ttctttccattatg

SEQ ID NO: 274031 - DNA, 14 bp, Homo sapiens
ttctttctgtctct

SEQ ID NO: 274032 - DNA, 17 bp, Homo sapiens
ttctttgagactgggtc

SEQ ID NO: 274033 - DNA, 22 bp, Homo sapiens
ttctttgagggactgcctctgc

SEQ ID NO: 274034 - DNA, 22 bp, Homo sapiens
ttctttgataagatgaggaaat

SEQ ID NO: 274035 - DNA, 16 bp, Homo sapiens
ttctttgatttaactg

SEQ ID NO: 274036 - DNA, 23 bp, Homo sapiens
ttctttgctgcagtcatctactt

SEQ ID NO: 274037 - DNA, 14 bp, Homo sapiens
ttctttgctgcccc

SEQ ID NO: 274038 - DNA, 17 bp, Homo sapiens
ttctttgctgcccctgt

SEQ ID NO: 274039 - DNA, 14 bp, Homo sapiens
ttctttgctgtgcc

SEQ ID NO: 274040 - DNA, 16 bp, Homo sapiens
ttctttgttacaggca

SEQ ID NO: 274041 - DNA, 15 bp, Homo sapiens
ttctttgttcctgct

SEQ ID NO: 274042 - DNA, 17 bp, Homo sapiens
ttctttgttcctgcttt

SEQ ID NO: 274043 - DNA, 12 bp, Homo sapiens
ttctttgttgct

SEQ ID NO: 274044 - DNA, 13 bp, Homo sapiens
ttctttgtttcct

SEQ ID NO: 274045 - DNA, 22 bp, Homo sapiens
ttcttttaccccacgaagacat

SEQ ID NO: 274046 - DNA, 22 bp, Homo sapiens
ttcttttatatataaaataaat

SEQ ID NO: 274047 - DNA, 17 bp, Homo sapiens
ttcttttcagcttgttt

SEQ ID NO: 274048 - DNA, 23 bp, Homo sapiens
ttcttttcagcttgtttctatac

SEQ ID NO: 274049 - DNA, 23 bp, Homo sapiens
ttcttttcgccgtggctgcggca

SEQ ID NO: 274050 - DNA, 22 bp, Homo sapiens
ttcttttgaactgttagatgct

SEQ ID NO: 274051 - DNA, 23 bp, Homo sapiens
ttcttttgaatcaatctggcttc

SEQ ID NO: 274052 - DNA, 18 bp, Homo sapiens
ttcttttgaccccttcct

SEQ ID NO: 274053 - DNA, 12 bp, Homo sapiens
ttcttttgatac

SEQ ID NO: 274054 - DNA, 13 bp, Homo sapiens
ttcttttgataca

SEQ ID NO: 274055 - DNA, 14 bp, Homo sapiens
ttcttttgatacat

SEQ ID NO: 274056 - DNA, 22 bp, Homo sapiens
ttctttttaaaaagttgcacat

SEQ ID NO: 274057 - DNA, 18 bp, Homo sapiens
ttctttttggcattatct

SEQ ID NO: 274058 - DNA, 17 bp, Homo sapiens
ttcttttttaatagaat

SEQ ID NO: 274059 - DNA, 17 bp, Homo sapiens
ttcttttttgtctcaag

SEQ ID NO: 274060 - DNA, 22 bp, Homo sapiens
ttgaaaaaagaaattccctgga

SEQ ID NO: 274061 - DNA, 12 bp, Homo sapiens
ttgaaaaagcag

SEQ ID NO: 274062 - DNA, 17 bp, Homo sapiens
ttgaaaaagtattgttt

SEQ ID NO: 274063 - DNA, 15 bp, Homo sapiens
ttgaaaaatctagtt

SEQ ID NO: 274064 - DNA, 12 bp, Homo sapiens
ttgaaaacactt

SEQ ID NO: 274065 - DNA, 14 bp, Homo sapiens
ttgaaaacacttat

SEQ ID NO: 274066 - DNA, 16 bp, Homo sapiens
ttgaaaacctgacaaa

SEQ ID NO: 274067 - DNA, 13 bp, Homo sapiens
ttgaaaacttcaa

SEQ ID NO: 274068 - DNA, 23 bp, Homo sapiens
ttgagagtgggggagaatggcat

SEQ ID NO: 274069 - DNA, 14 bp, Homo sapiens
ttgagagttctaaa

SEQ ID NO: 274070 - DNA, 18 bp, Homo sapiens
ttgagcaaggcaagaagt

SEQ ID NO: 274071 - DNA, 16 bp, Homo sapiens
ttgagcaagtcccatc

SEQ ID NO: 274072 - DNA, 17 bp, Homo sapiens
ttgagcatttttaaggg

SEQ ID NO: 274073 - DNA, 11 bp, Homo sapiens
ttgagcccagg

SEQ ID NO: 274074 - DNA, 12 bp, Homo sapiens
ttgagcccagga

SEQ ID NO: 274075 - DNA, 15 bp, Homo sapiens
ttgagccccagaggc

SEQ ID NO: 274076 - DNA, 14 bp, Homo sapiens
ttgagcctgagcct

SEQ ID NO: 274077 - DNA, 21 bp, Homo sapiens
ttgagctgcctgctctgcagc

SEQ ID NO: 274078 - DNA, 11 bp, Homo sapiens
ttgaggacaca

SEQ ID NO: 274079 - DNA, 13 bp, Homo sapiens
ttgaggacacatg

SEQ ID NO: 274080 - DNA, 14 bp, Homo sapiens
ttgaggacacatgt

SEQ ID NO: 274081 - DNA, 23 bp, Homo sapiens
ttgaggacctccacctgggagat

SEQ ID NO: 274082 - DNA, 19 bp, Homo sapiens
ttgaggagcagcttcagtt

SEQ ID NO: 274083 - DNA, 16 bp, Homo sapiens
ttgaggatgcactggc

SEQ ID NO: 274084 - DNA, 15 bp, Homo sapiens
ttgaggattttgagt

SEQ ID NO: 274085 - DNA, 15 bp, Homo sapiens
ttgaggctaaaacaa

SEQ ID NO: 274086 - DNA, 17 bp, Homo sapiens
ttgaggcttctccttct

SEQ ID NO: 274087 - DNA, 18 bp, Homo sapiens
ttgagggactgcctctgc

SEQ ID NO: 274088 - DNA, 22 bp, Homo sapiens
ttgagggtcattttcctttctg

SEQ ID NO: 274089 - DNA, 17 bp, Homo sapiens
ttgaggtctgctcggcc

SEQ ID NO: 274090 - DNA, 17 bp, Homo sapiens
ttgaggtcttttgacat

SEQ ID NO: 274091 - DNA, 13 bp, Homo sapiens
ttgagtaatttaa

SEQ ID NO: 274092 - DNA, 16 bp, Homo sapiens
ttgagtaattttctga

SEQ ID NO: 274093 - DNA, 15 bp, Homo sapiens
ttgagtatttgctgt

SEQ ID NO: 274094 - DNA, 12 bp, Homo sapiens
ttgagtctctga

SEQ ID NO: 274095 - DNA, 20 bp, Homo sapiens
ttgagtgaagctgggagaac

SEQ ID NO: 274096 - DNA, 21 bp, Homo sapiens
ttgagtgtgcaagcaaagaac

SEQ ID NO: 274097 - DNA, 19 bp, Homo sapiens
ttgagtgtgggactccagg

SEQ ID NO: 274098 - DNA, 20 bp, Homo sapiens
ttgagtttcttctaaagagg

SEQ ID NO: 274099 - DNA, 13 bp, Homo sapiens
ttgataaaatgtt

SEQ ID NO: 274100 - DNA, 17 bp, Homo sapiens
ttgataataaattgaaa

SEQ ID NO: 274101 - DNA, 22 bp, Homo sapiens
ttgatacatttatcttctgttt

SEQ ID NO: 274102 - DNA, 19 bp, Homo sapiens
ttgatagctttatttttta

SEQ ID NO: 274103 - DNA, 18 bp, Homo sapiens
ttgataggagacttgtac

SEQ ID NO: 274104 - DNA, 17 bp, Homo sapiens
ttgatagtgcttcttgt

SEQ ID NO: 274105 - DNA, 19 bp, Homo sapiens
ttgatagtgcttcttgtaa

SEQ ID NO: 274106 - DNA, 17 bp, Homo sapiens
ttgatatattctttcca

SEQ ID NO: 274107 - DNA, 23 bp, Homo sapiens
ttgatatattctttccatgcagt

SEQ ID NO: 274108 - DNA, 20 bp, Homo sapiens
ttgatatgattgtaacatat

SEQ ID NO: 274109 - DNA, 14 bp, Homo sapiens
ttgatattatgtgg

SEQ ID NO: 274110 - DNA, 14 bp, Homo sapiens
ttgatatttccttc

SEQ ID NO: 274111 - DNA, 18 bp, Homo sapiens
ttgatcagatctgacatg

SEQ ID NO: 274112 - DNA, 12 bp, Homo sapiens
ttgatcatagaa

SEQ ID NO: 274113 - DNA, 12 bp, Homo sapiens
ttgatcatgcag

SEQ ID NO: 274114 - DNA, 15 bp, Homo sapiens
ttgatcatgcaggaa

SEQ ID NO: 274115 - DNA, 18 bp, Homo sapiens
ttgatcattttcccccca

SEQ ID NO: 274116 - DNA, 20 bp, Homo sapiens
ttgatcgatgttaaacgtca

SEQ ID NO: 274117 - DNA, 15 bp, Homo sapiens
ttgatcttcaggatg

SEQ ID NO: 274118 - DNA, 19 bp, Homo sapiens
ttgatgaaaagatttaagc

SEQ ID NO: 274119 - DNA, 20 bp, Homo sapiens
ttgatgaaaagatttaagca

SEQ ID NO: 274120 - DNA, 16 bp, Homo sapiens
ttgatgaaagctgatt

SEQ ID NO: 274121 - DNA, 18 bp, Homo sapiens
ttgatgaccaatctctgt

SEQ ID NO: 274122 - DNA, 20 bp, Homo sapiens
ttgatgaccaatctctgtga

SEQ ID NO: 274123 - DNA, 22 bp, Homo sapiens
ttgatgaccaatctctgtgact

SEQ ID NO: 274124 - DNA, 17 bp, Homo sapiens
ttgatgacccccaacca

SEQ ID NO: 274125 - DNA, 19 bp, Homo sapiens
ttgatgagcactcctgatt

SEQ ID NO: 274126 - DNA, 18 bp, Homo sapiens
ttgatgccatttgtcttt

SEQ ID NO: 274127 - DNA, 20 bp, Homo sapiens
ttgatgccatttgtcttttg

SEQ ID NO: 274128 - DNA, 16 bp, Homo sapiens
ttgatggagaaggaaa

SEQ ID NO: 274129 - DNA, 14 bp, Homo sapiens
ttgatggagatatt

SEQ ID NO: 274130 - DNA, 23 bp, Homo sapiens
ttgatggtagaaattttatctct

SEQ ID NO: 274131 - DNA, 18 bp, Homo sapiens
ttgatggtgaatattaca

SEQ ID NO: 274132 - DNA, 22 bp, Homo sapiens
ttgatgtgtatgtgtttataat

SEQ ID NO: 274133 - DNA, 20 bp, Homo sapiens
ttgatgtgtttatttataga

SEQ ID NO: 274134 - DNA, 17 bp, Homo sapiens
ttgatgtttgtggcctc

SEQ ID NO: 274135 - DNA, 19 bp, Homo sapiens
ttgatgtttgtggcctcag

SEQ ID NO: 274136 - DNA, 20 bp, Homo sapiens
ttgatgtttgtggcctcaga

SEQ ID NO: 274137 - DNA, 13 bp, Homo sapiens
ttgattaaactgt

SEQ ID NO: 274138 - DNA, 14 bp, Homo sapiens
ttgattaaactgta

SEQ ID NO: 274139 - DNA, 20 bp, Homo sapiens
ttgattaaactgtatgtctt

SEQ ID NO: 274140 - DNA, 18 bp, Homo sapiens
ttgattaagattttacaa

SEQ ID NO: 274141 - DNA, 17 bp, Homo sapiens
ttgattataccactgca

SEQ ID NO: 274142 - DNA, 13 bp, Homo sapiens
ttgattcataatg

SEQ ID NO: 274143 - DNA, 17 bp, Homo sapiens
ttgattcccataacata

SEQ ID NO: 274144 - DNA, 15 bp, Homo sapiens
ttgattgtcagctac

SEQ ID NO: 274145 - DNA, 22 bp, Homo sapiens
ttgattgttttattttggaatt

SEQ ID NO: 274146 - DNA, 11 bp, Homo sapiens
ttgatttgcat

SEQ ID NO: 274147 - DNA, 12 bp, Homo sapiens
ttgatttgcatg

SEQ ID NO: 274148 - DNA, 17 bp, Homo sapiens
ttgcaaaaatattttat

SEQ ID NO: 274149 - DNA, 22 bp, Homo sapiens
ttgcaaacagaacactgtaata

SEQ ID NO: 274150 - DNA, 15 bp, Homo sapiens
ttgcaaagcctttaa

SEQ ID NO: 274151 - DNA, 12 bp, Homo sapiens
ttgcaaatagtc

SEQ ID NO: 274152 - DNA, 19 bp, Homo sapiens
ttgcaaattattctagtca

SEQ ID NO: 274153 - DNA, 13 bp, Homo sapiens
ttgcaacacacag

SEQ ID NO: 274154 - DNA, 13 bp, Homo sapiens
ttgcaagggaatg

SEQ ID NO: 274155 - DNA, 19 bp, Homo sapiens
ttgcaatatcgatcagatg

SEQ ID NO: 274156 - DNA, 17 bp, Homo sapiens
ttgcacagacatctcct

SEQ ID NO: 274157 - DNA, 20 bp, Homo sapiens
ttgcacaggttttcagcaac

SEQ ID NO: 274158 - DNA, 14 bp, Homo sapiens
ttgcacatatattt

SEQ ID NO: 274159 - DNA, 15 bp, Homo sapiens
ttgcacatatatttt

SEQ ID NO: 274160 - DNA, 16 bp, Homo sapiens
ttgcaccattctttct

SEQ ID NO: 274161 - DNA, 17 bp, Homo sapiens
ttgcaccattctttctt

SEQ ID NO: 274162 - DNA, 18 bp, Homo sapiens
ttgcaccattctttcttg

SEQ ID NO: 274163 - DNA, 18 bp, Homo sapiens
ttgcacgcccatgtgtga

SEQ ID NO: 274164 - DNA, 15 bp, Homo sapiens
ttgcacgtggcctct

SEQ ID NO: 274165 - DNA, 17 bp, Homo sapiens
ttgcactaaaagtgatg

SEQ ID NO: 274166 - DNA, 17 bp, Homo sapiens
ttgcactctagcctggg

SEQ ID NO: 274167 - DNA, 12 bp, Homo sapiens
ttgcactgaggg

SEQ ID NO: 274168 - DNA, 13 bp, Homo sapiens
ttgcactgagggc

SEQ ID NO: 274169 - DNA, 16 bp, Homo sapiens
ttgcactgagggccac

SEQ ID NO: 274170 - DNA, 13 bp, Homo sapiens
ttgcactgtgctt

SEQ ID NO: 274171 - DNA, 23 bp, Homo sapiens
ttgcactgtgcttgctcctaagc

SEQ ID NO: 274172 - DNA, 15 bp, Homo sapiens
ttgcagaaacatttt

SEQ ID NO: 274173 - DNA, 18 bp, Homo sapiens
ttgcagacctgggacttt

SEQ ID NO: 274174 - DNA, 14 bp, Homo sapiens
ttgcagcagtgagt

SEQ ID NO: 274175 - DNA, 18 bp, Homo sapiens
ttgcagccggcacagggt

SEQ ID NO: 274176 - DNA, 21 bp, Homo sapiens
ttgcagcctgaccaaaagtga

SEQ ID NO: 274177 - DNA, 14 bp, Homo sapiens
ttgcagctgctggt

SEQ ID NO: 274178 - DNA, 21 bp, Homo sapiens
ttgcagctgctggttttggtt

SEQ ID NO: 274179 - DNA, 17 bp, Homo sapiens
ttgcaggaagggaagag

SEQ ID NO: 274180 - DNA, 19 bp, Homo sapiens
ttgcaggccagtggacaga

SEQ ID NO: 274181 - DNA, 17 bp, Homo sapiens
ttgcaggctctgggctc

SEQ ID NO: 274182 - DNA, 19 bp, Homo sapiens
ttgcaggggatactgaaaa

SEQ ID NO: 274183 - DNA, 16 bp, Homo sapiens
ttgcagttcagcacca

SEQ ID NO: 274184 - DNA, 17 bp, Homo sapiens
ttgcataaacaatccaa

SEQ ID NO: 274185 - DNA, 18 bp, Homo sapiens
ttgcataaacaatccaaa

SEQ ID NO: 274186 - DNA, 21 bp, Homo sapiens
ttgcataagtggacccagctg

SEQ ID NO: 274187 - DNA, 20 bp, Homo sapiens
ttgcataataagctaaagag

SEQ ID NO: 274188 - DNA, 17 bp, Homo sapiens
ttgcataatactaattt

SEQ ID NO: 274189 - DNA, 16 bp, Homo sapiens
ttgcatattctattgt

SEQ ID NO: 274190 - DNA, 20 bp, Homo sapiens
ttgcatcctatcgatctgga

SEQ ID NO: 274191 - DNA, 14 bp, Homo sapiens
ttgcatctacctgc

SEQ ID NO: 274192 - DNA, 15 bp, Homo sapiens
ttgcatctacctgct

SEQ ID NO: 274193 - DNA, 16 bp, Homo sapiens
ttgcatctacctgctc

SEQ ID NO: 274194 - DNA, 15 bp, Homo sapiens
ttgcatgctgcttta

SEQ ID NO: 274195 - DNA, 21 bp, Homo sapiens
ttgcatgctgctttaattgtg

SEQ ID NO: 274196 - DNA, 22 bp, Homo sapiens
ttgcatgctgctttaattgtga

SEQ ID NO: 274197 - DNA, 17 bp, Homo sapiens
ttgcatggattttggat

SEQ ID NO: 274198 - DNA, 12 bp, Homo sapiens
ttgcatgtattt

SEQ ID NO: 274199 - DNA, 22 bp, Homo sapiens
ttgcatgttcttgttttgttat

SEQ ID NO: 274200 - DNA, 14 bp, Homo sapiens
ttgcatttactttt

SEQ ID NO: 274201 - DNA, 15 bp, Homo sapiens
ttgcatttatggtca

SEQ ID NO: 274202 - DNA, 22 bp, Homo sapiens
ttgcatttctttatttctgtct

SEQ ID NO: 274203 - DNA, 18 bp, Homo sapiens
ttgccaaatatgtcctgg

SEQ ID NO: 274204 - DNA, 19 bp, Homo sapiens
ttgccaaccgttgctttcg

SEQ ID NO: 274205 - DNA, 17 bp, Homo sapiens
ttgccaactaagccctc

SEQ ID NO: 274206 - DNA, 22 bp, Homo sapiens
ttgccaagaaaatgaagggatt

SEQ ID NO: 274207 - DNA, 20 bp, Homo sapiens
ttgccaagaactgaaaacat

SEQ ID NO: 274208 - DNA, 19 bp, Homo sapiens
ttgccaaggccgcccacct

SEQ ID NO: 274209 - DNA, 12 bp, Homo sapiens
ttgccacacagt

SEQ ID NO: 274210 - DNA, 22 bp, Homo sapiens
ttgccacagctggagctctcaa

SEQ ID NO: 274211 - DNA, 21 bp, Homo sapiens
ttgccaccaccagatgagaag

SEQ ID NO: 274212 - DNA, 13 bp, Homo sapiens
ttgccaccaggag

SEQ ID NO: 274213 - DNA, 15 bp, Homo sapiens
ttgccaccaggagaa

SEQ ID NO: 274214 - DNA, 19 bp, Homo sapiens
ttgccacctctggccaaat

SEQ ID NO: 274215 - DNA, 14 bp, Homo sapiens
ttgccactgcctct

SEQ ID NO: 274216 - DNA, 15 bp, Homo sapiens
ttgccactgcctctt

SEQ ID NO: 274217 - DNA, 20 bp, Homo sapiens
ttgccagcttttcctccctt

SEQ ID NO: 274218 - DNA, 16 bp, Homo sapiens
ttgccaggaatgtttc

SEQ ID NO: 274219 - DNA, 18 bp, Homo sapiens
ttgccaggttgcagctgc

SEQ ID NO: 274220 - DNA, 22 bp, Homo sapiens
ttgccagtatataagctgttta

SEQ ID NO: 274221 - DNA, 15 bp, Homo sapiens
ttgccagtcctgcaa

SEQ ID NO: 274222 - DNA, 21 bp, Homo sapiens
ttgccatcctaaaagccaccc

SEQ ID NO: 274223 - DNA, 15 bp, Homo sapiens
ttgccatgggcctgc

SEQ ID NO: 274224 - DNA, 17 bp, Homo sapiens
ttgccatgggcctgctg

SEQ ID NO: 274225 - DNA, 16 bp, Homo sapiens
ttgccatgtagacccc

SEQ ID NO: 274226 - DNA, 21 bp, Homo sapiens
ttgccatgttggccaggctgg

SEQ ID NO: 274227 - DNA, 13 bp, Homo sapiens
ttgcccaacctca

SEQ ID NO: 274228 - DNA, 15 bp, Homo sapiens
ttgcccaacctcagc

SEQ ID NO: 274229 - DNA, 16 bp, Homo sapiens
ttgcccaacctcagca

SEQ ID NO: 274230 - DNA, 18 bp, Homo sapiens
ttgcccagggtcctgtgc

SEQ ID NO: 274231 - DNA, 20 bp, Homo sapiens
ttgcccagggtcctgtgcct

SEQ ID NO: 274232 - DNA, 14 bp, Homo sapiens
ttgcccatccatct

SEQ ID NO: 274233 - DNA, 20 bp, Homo sapiens
ttgccccagagccccactcc

SEQ ID NO: 274234 - DNA, 14 bp, Homo sapiens
ttgcccccatccct

SEQ ID NO: 274235 - DNA, 22 bp, Homo sapiens
ttgcccgctcccacagcttcct

SEQ ID NO: 274236 - DNA, 11 bp, Homo sapiens
ttgccctgcca

SEQ ID NO: 274237 - DNA, 14 bp, Homo sapiens
ttgccctgccaggc

SEQ ID NO: 274238 - DNA, 21 bp, Homo sapiens
ttgccctgggccagcccagga

SEQ ID NO: 274239 - DNA, 17 bp, Homo sapiens
ttgccctgttcaaagta

SEQ ID NO: 274240 - DNA, 20 bp, Homo sapiens
ttgccctttctgtaccattt

SEQ ID NO: 274241 - DNA, 12 bp, Homo sapiens
ttgccgctggga

SEQ ID NO: 274242 - DNA, 16 bp, Homo sapiens
ttgccgctgggagagc

SEQ ID NO: 274243 - DNA, 23 bp, Homo sapiens
ttgccgggcctggactgtcctag

SEQ ID NO: 274244 - DNA, 17 bp, Homo sapiens
ttgccgggcctgggcct

SEQ ID NO: 274245 - DNA, 20 bp, Homo sapiens
ttgcctccatggtgcctctg

SEQ ID NO: 274246 - DNA, 14 bp, Homo sapiens
ttgcctcccttcct

SEQ ID NO: 274247 - DNA, 16 bp, Homo sapiens
ttgcctcctctctccc

SEQ ID NO: 274248 - DNA, 17 bp, Homo sapiens
ttgcctcctctctccct

SEQ ID NO: 274249 - DNA, 13 bp, Homo sapiens
ttgggttccagac

SEQ ID NO: 274250 - DNA, 19 bp, Homo sapiens
ttggtaacttgctgtgaaa

SEQ ID NO: 274251 - DNA, 15 bp, Homo sapiens
ttggtagagattcat

SEQ ID NO: 274252 - DNA, 13 bp, Homo sapiens
ttggtagagttta

SEQ ID NO: 274253 - DNA, 20 bp, Homo sapiens
ttggtagttctgtgcctccc

SEQ ID NO: 274254 - DNA, 22 bp, Homo sapiens
ttggtcagagtaagctgctttt

SEQ ID NO: 274255 - DNA, 19 bp, Homo sapiens
ttggtctctttctttccaa

SEQ ID NO: 274256 - DNA, 21 bp, Homo sapiens
ttggtctttctaatgtagcta

SEQ ID NO: 274257 - DNA, 15 bp, Homo sapiens
ttggtgataagtgga

SEQ ID NO: 274258 - DNA, 20 bp, Homo sapiens
ttggtgcaattaactctgga

SEQ ID NO: 274259 - DNA, 12 bp, Homo sapiens
ttggtgcattcg

SEQ ID NO: 274260 - DNA, 17 bp, Homo sapiens
ttggtgccttttgtgtg

SEQ ID NO: 274261 - DNA, 21 bp, Homo sapiens
ttggtgcggtaggtgctggcc

SEQ ID NO: 274262 - DNA, 22 bp, Homo sapiens
ttggtgcttacacatctcagac

SEQ ID NO: 274263 - DNA, 18 bp, Homo sapiens
ttggtggccgggggtggg

SEQ ID NO: 274264 - DNA, 13 bp, Homo sapiens
ttggtggtacttt

SEQ ID NO: 274265 - DNA, 20 bp, Homo sapiens
ttggtgtaaagccaacaccc

SEQ ID NO: 274266 - DNA, 20 bp, Homo sapiens
ttggtgtctgatgtgtgccc

SEQ ID NO: 274267 - DNA, 17 bp, Homo sapiens
ttggttagaacctccta

SEQ ID NO: 274268 - DNA, 17 bp, Homo sapiens
ttggttagagaagtaag

SEQ ID NO: 274269 - DNA, 23 bp, Homo sapiens
ttggttatgatggaaaggaagaa

SEQ ID NO: 274270 - DNA, 23 bp, Homo sapiens
ttggttccacaatcatctattga

SEQ ID NO: 274271 - DNA, 16 bp, Homo sapiens
ttggttccctttgctc

SEQ ID NO: 274272 - DNA, 12 bp, Homo sapiens
ttggttcctttt

SEQ ID NO: 274273 - DNA, 19 bp, Homo sapiens
ttggttctgcttcaataaa

SEQ ID NO: 274274 - DNA, 13 bp, Homo sapiens
ttggttctgtgtc

SEQ ID NO: 274275 - DNA, 22 bp, Homo sapiens
ttggttgaaaagattccatttt

SEQ ID NO: 274276 - DNA, 22 bp, Homo sapiens
ttggttgtgaaccaactgcctt

SEQ ID NO: 274277 - DNA, 19 bp, Homo sapiens
ttggttttgcatgtctgca

SEQ ID NO: 274278 - DNA, 22 bp, Homo sapiens
ttgtaaaaaaggaacacccgga

SEQ ID NO: 274279 - DNA, 22 bp, Homo sapiens
ttgtaaaaattaaaagttatgg

SEQ ID NO: 274280 - DNA, 20 bp, Homo sapiens
ttgtaaaacctgtcaatgat

SEQ ID NO: 274281 - DNA, 13 bp, Homo sapiens
ttgtaaaactgtg

SEQ ID NO: 274282 - DNA, 17 bp, Homo sapiens
ttgtaaaactgtgacat

SEQ ID NO: 274283 - DNA, 20 bp, Homo sapiens
ttgtaaaagcaacatcagct

SEQ ID NO: 274284 - DNA, 23 bp, Homo sapiens
ttgtaaacaaactgtgtaactgc

SEQ ID NO: 274285 - DNA, 20 bp, Homo sapiens
ttgtaaacacagtgtggtta

SEQ ID NO: 274286 - DNA, 16 bp, Homo sapiens
ttgtaaacctggaggg

SEQ ID NO: 274287 - DNA, 17 bp, Homo sapiens
ttgtaaaggtaggtgca

SEQ ID NO: 274288 - DNA, 18 bp, Homo sapiens
ttgtaaaggtaggtgcat

SEQ ID NO: 274289 - DNA, 14 bp, Homo sapiens
ttgtaaataagaga

SEQ ID NO: 274290 - DNA, 16 bp, Homo sapiens
ttgtaaataagagatt

SEQ ID NO: 274291 - DNA, 21 bp, Homo sapiens
ttgtaaataagagatttggag

SEQ ID NO: 274292 - DNA, 22 bp, Homo sapiens
ttgtaaatacaagttctattta

SEQ ID NO: 274293 - DNA, 23 bp, Homo sapiens
ttgtaaatacaagttctatttaa

SEQ ID NO: 274294 - DNA, 14 bp, Homo sapiens
ttgtaaatacacat

SEQ ID NO: 274295 - DNA, 13 bp, Homo sapiens
ttgtaaatacacc

SEQ ID NO: 274296 - DNA, 17 bp, Homo sapiens
ttgtaaatactgcttga

SEQ ID NO: 274297 - DNA, 19 bp, Homo sapiens
ttgtaaatactgcttgacc

SEQ ID NO: 274298 - DNA, 17 bp, Homo sapiens
ttgtaaatagtatttga

SEQ ID NO: 274299 - DNA, 23 bp, Homo sapiens
ttgtaaatgtttaatatctgact

SEQ ID NO: 274300 - DNA, 23 bp, Homo sapiens
ttgtaacatatttcttgagtaat

SEQ ID NO: 274301 - DNA, 20 bp, Homo sapiens
ttgtaaccatatgattgaaa

SEQ ID NO: 274302 - DNA, 18 bp, Homo sapiens
ttgtaacctcagctctgg

SEQ ID NO: 274303 - DNA, 15 bp, Homo sapiens
ttgtaatatttcttc

SEQ ID NO: 274304 - DNA, 23 bp, Homo sapiens
ttgtaattctaaatgaatgttta

SEQ ID NO: 274305 - DNA, 17 bp, Homo sapiens
ttgtaatttttttctag

SEQ ID NO: 274306 - DNA, 20 bp, Homo sapiens
ttgtacaaagtaaaaataaa

SEQ ID NO: 274307 - DNA, 19 bp, Homo sapiens
ttgtacagaatcattgctt

SEQ ID NO: 274308 - DNA, 13 bp, Homo sapiens
ttgtacagacaac

SEQ ID NO: 274309 - DNA, 15 bp, Homo sapiens
ttgtacatatggaaa

SEQ ID NO: 274310 - DNA, 17 bp, Homo sapiens
ttgtacatatggaaatc

SEQ ID NO: 274311 - DNA, 22 bp, Homo sapiens
ttgtacatcgcttctttttcaa

SEQ ID NO: 274312 - DNA, 13 bp, Homo sapiens
ttgtacattcctg

SEQ ID NO: 274313 - DNA, 17 bp, Homo sapiens
ttgtacgtaaagcttaa

SEQ ID NO: 274314 - DNA, 17 bp, Homo sapiens
ttgtacgtatgaatgat

SEQ ID NO: 274315 - DNA, 15 bp, Homo sapiens
ttgtacgtgggagag

SEQ ID NO: 274316 - DNA, 13 bp, Homo sapiens
ttgtactatttaa

SEQ ID NO: 274317 - DNA, 19 bp, Homo sapiens
ttgtactatttaactgact

SEQ ID NO: 274318 - DNA, 16 bp, Homo sapiens
ttgtactgtgctgatt

SEQ ID NO: 274319 - DNA, 19 bp, Homo sapiens
ttgtacttgtgtttgctta

SEQ ID NO: 274320 - DNA, 19 bp, Homo sapiens
tttaacaaatctaatctct

SEQ ID NO: 274321 - DNA, 18 bp, Homo sapiens
tttaacaataactactgt

SEQ ID NO: 274322 - DNA, 22 bp, Homo sapiens
tttaacaataactactgtgttc

SEQ ID NO: 274323 - DNA, 14 bp, Homo sapiens
tttaacagctttct

SEQ ID NO: 274324 - DNA, 21 bp, Homo sapiens
tttaacaggttttcttctaat

SEQ ID NO: 274325 - DNA, 24 bp, Homo sapiens
tttaacaggttttcttctaatcat

SEQ ID NO: 274326 - DNA, 11 bp, Homo sapiens
tttaacatgcc

SEQ ID NO: 274327 - DNA, 16 bp, Homo sapiens
tttaacccaaaagatt

SEQ ID NO: 274328 - DNA, 23 bp, Homo sapiens
tttaacctagatgtttaacaaat

SEQ ID NO: 274329 - DNA, 18 bp, Homo sapiens
tttaacgtatgtatttca

SEQ ID NO: 274330 - DNA, 19 bp, Homo sapiens
tttaacgtatgtatttcat

SEQ ID NO: 274331 - DNA, 17 bp, Homo sapiens
tttaactagaatttatt

SEQ ID NO: 274332 - DNA, 23 bp, Homo sapiens
tttaactcagatcactactgcag

SEQ ID NO: 274333 - DNA, 22 bp, Homo sapiens
tttaactctgcggatagcattt

SEQ ID NO: 274334 - DNA, 16 bp, Homo sapiens
tttaactgaaaatgta

SEQ ID NO: 274335 - DNA, 11 bp, Homo sapiens
tttaactgact

SEQ ID NO: 274336 - DNA, 21 bp, Homo sapiens
tttaactgattcttatgatta

SEQ ID NO: 274337 - DNA, 19 bp, Homo sapiens
tttaactttatcacattat

SEQ ID NO: 274338 - DNA, 18 bp, Homo sapiens
tttaagaaaaacatgtca

SEQ ID NO: 274339 - DNA, 15 bp, Homo sapiens
tttaagataatagtt

SEQ ID NO: 274340 - DNA, 23 bp, Homo sapiens
tttaagcactacataaactgact

SEQ ID NO: 274341 - DNA, 20 bp, Homo sapiens
tttaagcactcttaaagcaa

SEQ ID NO: 274342 - DNA, 13 bp, Homo sapiens
tttaagcattgtt

SEQ ID NO: 274343 - DNA, 21 bp, Homo sapiens
tttaagcattgtttgcttatt

SEQ ID NO: 274344 - DNA, 13 bp, Homo sapiens
tttaagcatttta

SEQ ID NO: 274345 - DNA, 20 bp, Homo sapiens
tttaagccaataaataatat

SEQ ID NO: 274346 - DNA, 14 bp, Homo sapiens
tttaagccccctct

SEQ ID NO: 274347 - DNA, 13 bp, Homo sapiens
tttaagctgtaaa

SEQ ID NO: 274348 - DNA, 11 bp, Homo sapiens
tttaagctgtt

SEQ ID NO: 274349 - DNA, 13 bp, Homo sapiens
tttaagctgtttc

SEQ ID NO: 274350 - DNA, 12 bp, Homo sapiens
tttaaggaaaat

SEQ ID NO: 274351 - DNA, 23 bp, Homo sapiens
tttaaggaacaagaattgctaaa

SEQ ID NO: 274352 - DNA, 17 bp, Homo sapiens
tttaagggtttgtggaa

SEQ ID NO: 274353 - DNA, 13 bp, Homo sapiens
tttaagtatttat

SEQ ID NO: 274354 - DNA, 21 bp, Homo sapiens
tttaagttttgattaatgttt

SEQ ID NO: 274355 - DNA, 14 bp, Homo sapiens
tttaataacaattg

SEQ ID NO: 274356 - DNA, 22 bp, Homo sapiens
tttaataactttgctggaaaat

SEQ ID NO: 274357 - DNA, 13 bp, Homo sapiens
tttaataagtaat

SEQ ID NO: 274358 - DNA, 13 bp, Homo sapiens
tttatattttcta

SEQ ID NO: 274359 - DNA, 12 bp, Homo sapiens
tttatattttta

SEQ ID NO: 274360 - DNA, 15 bp, Homo sapiens
tttatcaactttggt

SEQ ID NO: 274361 - DNA, 22 bp, Homo sapiens
tttatcacaaccaccgttacaa

SEQ ID NO: 274362 - DNA, 14 bp, Homo sapiens
tttatcagattgct

SEQ ID NO: 274363 - DNA, 13 bp, Homo sapiens
tttatcattaaac

SEQ ID NO: 274364 - DNA, 14 bp, Homo sapiens
tttatcattaaaca

SEQ ID NO: 274365 - DNA, 19 bp, Homo sapiens
tttatcattaaacatgaat

SEQ ID NO: 274366 - DNA, 12 bp, Homo sapiens
tttatcattgca

SEQ ID NO: 274367 - DNA, 18 bp, Homo sapiens
tttatcatttctactgaa

SEQ ID NO: 274368 - DNA, 17 bp, Homo sapiens
tttatccctgcttatct

SEQ ID NO: 274369 - DNA, 21 bp, Homo sapiens
tttatcctagttccattcttg

SEQ ID NO: 274370 - DNA, 12 bp, Homo sapiens
tttatctcctgc

SEQ ID NO: 274371 - DNA, 14 bp, Homo sapiens
tttatcttctgttt

SEQ ID NO: 274372 - DNA, 15 bp, Homo sapiens
tttatcttctgtttt

SEQ ID NO: 274373 - DNA, 20 bp, Homo sapiens
tttatcttctgtttttctca

SEQ ID NO: 274374 - DNA, 21 bp, Homo sapiens
tttatcttctgtttttctcaa

SEQ ID NO: 274375 - DNA, 17 bp, Homo sapiens
tttatgaaaaaaatata

SEQ ID NO: 274376 - DNA, 13 bp, Homo sapiens
tttatgaaaagag

SEQ ID NO: 274377 - DNA, 15 bp, Homo sapiens
tttatgaagttaaca

SEQ ID NO: 274378 - DNA, 18 bp, Homo sapiens
tttatgagtaactattat

SEQ ID NO: 274379 - DNA, 22 bp, Homo sapiens
tttatgagtaactattattata

SEQ ID NO: 274380 - DNA, 19 bp, Homo sapiens
tttatgatttactcattat

SEQ ID NO: 274381 - DNA, 16 bp, Homo sapiens
tttatgcagtgctgct

SEQ ID NO: 274382 - DNA, 19 bp, Homo sapiens
tttatgcatgagaactaaa

SEQ ID NO: 274383 - DNA, 21 bp, Homo sapiens
tttatgcatgagaactaaata

SEQ ID NO: 274384 - DNA, 23 bp, Homo sapiens
tttatgcatgagaactaaataga

SEQ ID NO: 274385 - DNA, 16 bp, Homo sapiens
tttatgcatttatgca

SEQ ID NO: 274386 - DNA, 19 bp, Homo sapiens
tttatgcatttatgcatga

SEQ ID NO: 274387 - DNA, 12 bp, Homo sapiens
tttatggcctca

SEQ ID NO: 274388 - DNA, 13 bp, Homo sapiens
tttatgggccttg

SEQ ID NO: 274389 - DNA, 16 bp, Homo sapiens
tttatggtttctccag

SEQ ID NO: 274390 - DNA, 12 bp, Homo sapiens
tttatgtacttt

SEQ ID NO: 274391 - DNA, 18 bp, Homo sapiens
tttatgtgtgaggagctg

SEQ ID NO: 274392 - DNA, 22 bp, Homo sapiens
tttatgtgtgaggagctgctgg

SEQ ID NO: 274393 - DNA, 12 bp, Homo sapiens
tttatgttttgt

SEQ ID NO: 274394 - DNA, 18 bp, Homo sapiens
tttatgttttgtttctga

SEQ ID NO: 274395 - DNA, 20 bp, Homo sapiens
tttatgttttgtttctgaaa

SEQ ID NO: 274396 - DNA, 12 bp, Homo sapiens
tttattaagatg

SEQ ID NO: 274397 - DNA, 20 bp, Homo sapiens
tttattaatgaactgtgaca

SEQ ID NO: 274398 - DNA, 14 bp, Homo sapiens
tttattacctctga

SEQ ID NO: 274399 - DNA, 13 bp, Homo sapiens
tttattactgatt

SEQ ID NO: 274400 - DNA, 13 bp, Homo sapiens
tttattagctgta

SEQ ID NO: 274401 - DNA, 16 bp, Homo sapiens
tttattagctgtaaat

SEQ ID NO: 274402 - DNA, 20 bp, Homo sapiens
tttattagctgtaaatacat

SEQ ID NO: 274403 - DNA, 15 bp, Homo sapiens
tttattattaaatca

SEQ ID NO: 274404 - DNA, 14 bp, Homo sapiens
tttattattgaaga

SEQ ID NO: 274405 - DNA, 18 bp, Homo sapiens
tttattcacatatgtctt

SEQ ID NO: 274406 - DNA, 14 bp, Homo sapiens
tttattccttgtga

SEQ ID NO: 274407 - DNA, 17 bp, Homo sapiens
tttattcttattactat

SEQ ID NO: 274408 - DNA, 16 bp, Homo sapiens
tttattctttaattgt

SEQ ID NO: 274409 - DNA, 17 bp, Homo sapiens
tttattctttaattgtt

SEQ ID NO: 274410 - DNA, 23 bp, Homo sapiens
tttattgaattattttgttactg

SEQ ID NO: 274411 - DNA, 13 bp, Homo sapiens
tttattgcagttt

SEQ ID NO: 274412 - DNA, 16 bp, Homo sapiens
tttattgtcaaagtgg

SEQ ID NO: 274413 - DNA, 11 bp, Homo sapiens
tttatttacta

SEQ ID NO: 274414 - DNA, 14 bp, Homo sapiens
tttatttatcagtg

SEQ ID NO: 274415 - DNA, 13 bp, Homo sapiens
tttatttatttat

SEQ ID NO: 274416 - DNA, 14 bp, Homo sapiens
tttatttccagagt

SEQ ID NO: 274417 - DNA, 20 bp, Homo sapiens
tttatttctagcaaacagat

SEQ ID NO: 274418 - DNA, 12 bp, Homo sapiens
tttatttctatc

SEQ ID NO: 274419 - DNA, 16 bp, Homo sapiens
tttattttcctcccca

SEQ ID NO: 274420 - DNA, 22 bp, Homo sapiens
tttattttggaattggtgtata

SEQ ID NO: 274421 - DNA, 23 bp, Homo sapiens
tttattttggaattggtgtatat

SEQ ID NO: 274422 - DNA, 20 bp, Homo sapiens
tttattttgttaaaatctct

SEQ ID NO: 274423 - DNA, 17 bp, Homo sapiens
tttattttttaagtatt

SEQ ID NO: 274424 - DNA, 18 bp, Homo sapiens
tttattttttaagttcaa

SEQ ID NO: 274425 - DNA, 16 bp, Homo sapiens
tttcaaaaatataact

SEQ ID NO: 274426 - DNA, 20 bp, Homo sapiens
tttcaaaacccaaatggcta

SEQ ID NO: 274427 - DNA, 12 bp, Homo sapiens
tttcaaaatgca

SEQ ID NO: 274428 - DNA, 13 bp, Homo sapiens
tttcaaaatgcat

SEQ ID NO: 274429 - DNA, 14 bp, Homo sapiens
tttcaaaatgcatg

SEQ ID NO: 274430 - DNA, 15 bp, Homo sapiens
tttcaaaatgcatgt

SEQ ID NO: 274431 - DNA, 18 bp, Homo sapiens
tttcaaaatgcatgtgat

SEQ ID NO: 274432 - DNA, 20 bp, Homo sapiens
tttcaaaatgttaacaactt

SEQ ID NO: 274433 - DNA, 23 bp, Homo sapiens
tttcaaatgagtttaaaaaaata

SEQ ID NO: 274434 - DNA, 19 bp, Homo sapiens
tttcaacctagaaaccttt

SEQ ID NO: 274435 - DNA, 18 bp, Homo sapiens
tttcaagctttcaaatcc

SEQ ID NO: 274436 - DNA, 20 bp, Homo sapiens
tttcaaggtaatttcttgtg

SEQ ID NO: 274437 - DNA, 15 bp, Homo sapiens
tttcaaggtttgtgc

SEQ ID NO: 274438 - DNA, 23 bp, Homo sapiens
tttcaataaagaaaaaaatagtt

SEQ ID NO: 274439 - DNA, 18 bp, Homo sapiens
tttcaatggttgggacaa

SEQ ID NO: 274440 - DNA, 22 bp, Homo sapiens
tttcaattccacctgcaatcaa

SEQ ID NO: 274441 - DNA, 23 bp, Homo sapiens
tttcaatttactttttaaacagt

SEQ ID NO: 274442 - DNA, 22 bp, Homo sapiens
tttcaatttctaaatttgcagg

SEQ ID NO: 274443 - DNA, 13 bp, Homo sapiens
tttcacaacagat

SEQ ID NO: 274444 - DNA, 23 bp, Homo sapiens
tttcacacctgaaaatgttagtg

SEQ ID NO: 274445 - DNA, 14 bp, Homo sapiens
tttcacataagcca

SEQ ID NO: 274446 - DNA, 17 bp, Homo sapiens
tttcacctactttgtaa

SEQ ID NO: 274447 - DNA, 20 bp, Homo sapiens
tttcacctactttgtaagtg

SEQ ID NO: 274448 - DNA, 16 bp, Homo sapiens
tttcacctatctggaa

SEQ ID NO: 274449 - DNA, 11 bp, Homo sapiens
tttcacctccg

SEQ ID NO: 274450 - DNA, 16 bp, Homo sapiens
tttcacctgaaacact

SEQ ID NO: 274451 - DNA, 18 bp, Homo sapiens
tttcacctgaaacacttt

SEQ ID NO: 274452 - DNA, 21 bp, Homo sapiens
tttcactagagacaaatcttt

SEQ ID NO: 274453 - DNA, 19 bp, Homo sapiens
tttcactatttttatttat

SEQ ID NO: 274454 - DNA, 19 bp, Homo sapiens
tttcactgaagtgaataca

SEQ ID NO: 274455 - DNA, 21 bp, Homo sapiens
tttcactgaagtgaatacatg

SEQ ID NO: 274456 - DNA, 14 bp, Homo sapiens
tttcactgctgctc

SEQ ID NO: 274457 - DNA, 15 bp, Homo sapiens
tttcactgctgctcc

SEQ ID NO: 274458 - DNA, 16 bp, Homo sapiens
tttcactgctgctcct

SEQ ID NO: 274459 - DNA, 14 bp, Homo sapiens
tttcactggggatc

SEQ ID NO: 274460 - DNA, 17 bp, Homo sapiens
tttcacttaaactttgt

SEQ ID NO: 274461 - DNA, 19 bp, Homo sapiens
tttcacttaaactttgtca

SEQ ID NO: 274462 - DNA, 15 bp, Homo sapiens
tttcactttagcaaa

SEQ ID NO: 274463 - DNA, 21 bp, Homo sapiens
ttgtgtaatagaaaactgaaa

SEQ ID NO: 274464 - DNA, 21 bp, Homo sapiens
ttgtgtacaaagtagagaagt

SEQ ID NO: 274465 - DNA, 22 bp, Homo sapiens
ttgtgtacaaagtagagaagta

SEQ ID NO: 274466 - DNA, 23 bp, Homo sapiens
ttgtgtacaaagtagagaagtat

SEQ ID NO: 274467 - DNA, 18 bp, Homo sapiens
ttgtgtacagtatgtgtc

SEQ ID NO: 274468 - DNA, 19 bp, Homo sapiens
ttgtgtacagtatgtgtct

SEQ ID NO: 274469 - DNA, 15 bp, Homo sapiens
ttgtgtacagttatt

SEQ ID NO: 274470 - DNA, 13 bp, Homo sapiens
ttgtgtacttgac

SEQ ID NO: 274471 - DNA, 14 bp, Homo sapiens
ttgtgtagattgtg

SEQ ID NO: 274472 - DNA, 15 bp, Homo sapiens
ttgtgtctgcctgcc

SEQ ID NO: 274473 - DNA, 14 bp, Homo sapiens
ttgtgtcttttgtt

SEQ ID NO: 274474 - DNA, 17 bp, Homo sapiens
ttgtgtgggtttactct

SEQ ID NO: 274475 - DNA, 21 bp, Homo sapiens
ttgtgtgggtttactctgtgc

SEQ ID NO: 274476 - DNA, 23 bp, Homo sapiens
ttgtgtgggtttactctgtgcta

SEQ ID NO: 274477 - DNA, 15 bp, Homo sapiens
ttgtgtggtattcaa

SEQ ID NO: 274478 - DNA, 17 bp, Homo sapiens
ttgtgtgtttattgtca

SEQ ID NO: 274479 - DNA, 17 bp, Homo sapiens
ttgtgttcagttccagc

SEQ ID NO: 274480 - DNA, 18 bp, Homo sapiens
ttgtgttcctctttgcat

SEQ ID NO: 274481 - DNA, 17 bp, Homo sapiens
ttgtgttgggccccagg

SEQ ID NO: 274482 - DNA, 13 bp, Homo sapiens
ttgtgttgtgaat

SEQ ID NO: 274483 - DNA, 21 bp, Homo sapiens
ttgtgttgtttgaaaatatta

SEQ ID NO: 274484 - DNA, 17 bp, Homo sapiens
ttgtgtttttaatttat

SEQ ID NO: 274485 - DNA, 18 bp, Homo sapiens
ttgtgtttttaatttatt

SEQ ID NO: 274486 - DNA, 22 bp, Homo sapiens
ttgttaagtctaaatatttcct

SEQ ID NO: 274487 - DNA, 22 bp, Homo sapiens
ttgttaatttttcctatattgc

SEQ ID NO: 274488 - DNA, 17 bp, Homo sapiens
ttgttacaggtgtacta

SEQ ID NO: 274489 - DNA, 12 bp, Homo sapiens
ttgttaccttta

SEQ ID NO: 274490 - DNA, 17 bp, Homo sapiens
ttgttactctggttctt

SEQ ID NO: 274491 - DNA, 14 bp, Homo sapiens
ttgttactttaggt

SEQ ID NO: 274492 - DNA, 16 bp, Homo sapiens
ttgttagtgatttgct

SEQ ID NO: 274493 - DNA, 14 bp, Homo sapiens
ttgttataaataaa

SEQ ID NO: 274494 - DNA, 19 bp, Homo sapiens
ttgttataacttcataaaa

SEQ ID NO: 274495 - DNA, 15 bp, Homo sapiens
ttgttatacttcaaa

SEQ ID NO: 274496 - DNA, 17 bp, Homo sapiens
ttgttattcttttccag

SEQ ID NO: 274497 - DNA, 23 bp, Homo sapiens
ttgttattgggcaagtgattgaa

SEQ ID NO: 274498 - DNA, 17 bp, Homo sapiens
ttgttattgtggaagat

SEQ ID NO: 274499 - DNA, 13 bp, Homo sapiens
ttgttattttcag

SEQ ID NO: 274500 - DNA, 20 bp, Homo sapiens
ttgttcaaagaacccccctc

SEQ ID NO: 274501 - DNA, 18 bp, Homo sapiens
ttgttcaagcttttcctt

SEQ ID NO: 274502 - DNA, 19 bp, Homo sapiens
ttgttcaataataaatatt

SEQ ID NO: 274503 - DNA, 16 bp, Homo sapiens
ttgttcagaagttgtt

SEQ ID NO: 274504 - DNA, 17 bp, Homo sapiens
ttgttcatttctgtctc

SEQ ID NO: 274505 - DNA, 16 bp, Homo sapiens
ttgttccaagacattg

SEQ ID NO: 274506 - DNA, 22 bp, Homo sapiens
ttgttccaagacattgtcaata

SEQ ID NO: 274507 - DNA, 12 bp, Homo sapiens
ttgttcccacaa

SEQ ID NO: 274508 - DNA, 11 bp, Homo sapiens
ttgttctagac

SEQ ID NO: 274509 - DNA, 13 bp, Homo sapiens
tttctaatcaaaa

SEQ ID NO: 274510 - DNA, 14 bp, Homo sapiens
tttctaatttgctg

SEQ ID NO: 274511 - DNA, 20 bp, Homo sapiens
tttctacactgtattacata

SEQ ID NO: 274512 - DNA, 15 bp, Homo sapiens
tttctacatgactgg

SEQ ID NO: 274513 - DNA, 17 bp, Homo sapiens
tttctagaaaagcttcc

SEQ ID NO: 274514 - DNA, 21 bp, Homo sapiens
tttctagaaaagcttcctagc

SEQ ID NO: 274515 - DNA, 16 bp, Homo sapiens
tttctagaatggtttt

SEQ ID NO: 274516 - DNA, 22 bp, Homo sapiens
tttctagacagtattgccacct

SEQ ID NO: 274517 - DNA, 15 bp, Homo sapiens
tttctagactttctg

SEQ ID NO: 274518 - DNA, 15 bp, Homo sapiens
tttctagcaattgct

SEQ ID NO: 274519 - DNA, 23 bp, Homo sapiens
tttctagctataacaactctatt

SEQ ID NO: 274520 - DNA, 16 bp, Homo sapiens
tttctagttgtaatgt

SEQ ID NO: 274521 - DNA, 14 bp, Homo sapiens
tttctagtttcagt

SEQ ID NO: 274522 - DNA, 16 bp, Homo sapiens
tttgagagttctaaat

SEQ ID NO: 274523 - DNA, 19 bp, Homo sapiens
tttgagataatttaaccct

SEQ ID NO: 274524 - DNA, 19 bp, Homo sapiens
tttgagcgcagagtaaaat

SEQ ID NO: 274525 - DNA, 22 bp, Homo sapiens
tttgagtcccttccaggccatc

SEQ ID NO: 274526 - DNA, 21 bp, Homo sapiens
tttgagtgccttacacaatgg

SEQ ID NO: 274527 - DNA, 18 bp, Homo sapiens
tttgagtgtcaggctctg

SEQ ID NO: 274528 - DNA, 14 bp, Homo sapiens
tttgagtgttttaa

SEQ ID NO: 274529 - DNA, 12 bp, Homo sapiens
tttgataacatt

SEQ ID NO: 274530 - DNA, 22 bp, Homo sapiens
tttgatacatttatcttctgtt

SEQ ID NO: 274531 - DNA, 13 bp, Homo sapiens
tttgatagtgctt

SEQ ID NO: 274532 - DNA, 17 bp, Homo sapiens
tttgatcatagaattgt

SEQ ID NO: 274533 - DNA, 19 bp, Homo sapiens
tttgatgctggagaggtta

SEQ ID NO: 274534 - DNA, 16 bp, Homo sapiens
tttgatggctatgttt

SEQ ID NO: 274535 - DNA, 16 bp, Homo sapiens
tttgatggtgaatatt

SEQ ID NO: 274536 - DNA, 19 bp, Homo sapiens
tttgatggtgaatattaca

SEQ ID NO: 274537 - DNA, 13 bp, Homo sapiens
tttgatgtgtatg

SEQ ID NO: 274538 - DNA, 21 bp, Homo sapiens
tttgatgtgtatgtgtttata

SEQ ID NO: 274539 - DNA, 20 bp, Homo sapiens
tttgatgtgtttttgtatga

SEQ ID NO: 274540 - DNA, 17 bp, Homo sapiens
tttgatgtttgtggcct

SEQ ID NO: 274541 - DNA, 19 bp, Homo sapiens
tttgatgtttgtggcctca

SEQ ID NO: 274542 - DNA, 15 bp, Homo sapiens
tttgattctgtgtgt

SEQ ID NO: 274543 - DNA, 14 bp, Homo sapiens
tttgattgtgaaac

SEQ ID NO: 274544 - DNA, 12 bp, Homo sapiens
tttgatttatgc

SEQ ID NO: 274545 - DNA, 13 bp, Homo sapiens
tttgcaacattta

SEQ ID NO: 274546 - DNA, 15 bp, Homo sapiens
tttgcaatcttatgt

SEQ ID NO: 274547 - DNA, 19 bp, Homo sapiens
tttgcaatggctatatggc

SEQ ID NO: 274548 - DNA, 12 bp, Homo sapiens
tttgcacacttc

SEQ ID NO: 274549 - DNA, 17 bp, Homo sapiens
tttgcacatatattttt

SEQ ID NO: 274550 - DNA, 21 bp, Homo sapiens
tttgcacgaattttaaaacat

SEQ ID NO: 274551 - DNA, 16 bp, Homo sapiens
tttgcagacctgggac

SEQ ID NO: 274552 - DNA, 19 bp, Homo sapiens
tttgcagacctgggacttt

SEQ ID NO: 274553 - DNA, 14 bp, Homo sapiens
tttgcagccaaggt

SEQ ID NO: 274554 - DNA, 21 bp, Homo sapiens
tttgcaggctctgggctcagg

SEQ ID NO: 274555 - DNA, 15 bp, Homo sapiens
tttgcagtgtgcata

SEQ ID NO: 274556 - DNA, 23 bp, Homo sapiens
tttgcatagtaccaatcatttta

SEQ ID NO: 274557 - DNA, 21 bp, Homo sapiens
tttgcatggaatttgtaagtt

SEQ ID NO: 274558 - DNA, 14 bp, Homo sapiens
tttgcatgtctgca

SEQ ID NO: 274559 - DNA, 23 bp, Homo sapiens
tttgcatttttgtattttgtaca

SEQ ID NO: 274560 - DNA, 18 bp, Homo sapiens
tttgccaaggctctcccc

SEQ ID NO: 274561 - DNA, 20 bp, Homo sapiens
tttgccaaggctctcccctc

SEQ ID NO: 274562 - DNA, 16 bp, Homo sapiens
tttgccatgctgctat

SEQ ID NO: 274563 - DNA, 15 bp, Homo sapiens
tttgcccttcactgt

SEQ ID NO: 274564 - DNA, 20 bp, Homo sapiens
tttgcctcttttctctgtgc

SEQ ID NO: 274565 - DNA, 14 bp, Homo sapiens
tttgcctgagggcg

SEQ ID NO: 274566 - DNA, 21 bp, Homo sapiens
tttgcctggatacctctggct

SEQ ID NO: 274567 - DNA, 11 bp, Homo sapiens
tttgcctggct

SEQ ID NO: 274568 - DNA, 12 bp, Homo sapiens
tttgcctggctg

SEQ ID NO: 274569 - DNA, 23 bp, Homo sapiens
tttgcctggctgtggaggcctga

SEQ ID NO: 274570 - DNA, 11 bp, Homo sapiens
tttgcctgtgc

SEQ ID NO: 274571 - DNA, 15 bp, Homo sapiens
tttgccttaggaagt

SEQ ID NO: 274572 - DNA, 16 bp, Homo sapiens
tttgccttaggaagtg

SEQ ID NO: 274573 - DNA, 21 bp, Homo sapiens
tttgccttaggaagtgacttg

SEQ ID NO: 274574 - DNA, 12 bp, Homo sapiens
tttgccttctct

SEQ ID NO: 274575 - DNA, 21 bp, Homo sapiens
tttgccttgggctgctcctca

SEQ ID NO: 274576 - DNA, 12 bp, Homo sapiens
tttgcctttaaa

SEQ ID NO: 274577 - DNA, 17 bp, Homo sapiens
tttgcctttaggcagga

SEQ ID NO: 274578 - DNA, 19 bp, Homo sapiens
tttgcctttaggcaggaag

SEQ ID NO: 274579 - DNA, 20 bp, Homo sapiens
tttgccttttaaattctttt

SEQ ID NO: 274580 - DNA, 13 bp, Homo sapiens
tttgctaatgcac

SEQ ID NO: 274581 - DNA, 19 bp, Homo sapiens
tttgctccaccccactcac

SEQ ID NO: 274582 - DNA, 14 bp, Homo sapiens
tttgctcttataaa

SEQ ID NO: 274583 - DNA, 22 bp, Homo sapiens
tttgctgaaggattatatgtat

SEQ ID NO: 274584 - DNA, 20 bp, Homo sapiens
tttgctgaataacaacaatt

SEQ ID NO: 274585 - DNA, 21 bp, Homo sapiens
tttgctgaatgtcattatttg

SEQ ID NO: 274586 - DNA, 17 bp, Homo sapiens
tttgctgaattccttta

SEQ ID NO: 274587 - DNA, 10 bp, Homo sapiens
tttgctgcca

SEQ ID NO: 274588 - DNA, 18 bp, Homo sapiens
tttgctgcccctgtctgg

SEQ ID NO: 274589 - DNA, 16 bp, Homo sapiens
tttgctgctatgaaaa

SEQ ID NO: 274590 - DNA, 20 bp, Homo sapiens
tttgctgctctatattacaa

SEQ ID NO: 274591 - DNA, 21 bp, Homo sapiens
tttgctgctgtggaaaggatt

SEQ ID NO: 274592 - DNA, 20 bp, Homo sapiens
tttgctggagtcctgttctc

SEQ ID NO: 274593 - DNA, 19 bp, Homo sapiens
tttgctggggccgaaagaa

SEQ ID NO: 274594 - DNA, 22 bp, Homo sapiens
tttgctggggccgaaagaacag

SEQ ID NO: 274595 - DNA, 18 bp, Homo sapiens
tttgctgtatacaaacag

SEQ ID NO: 274596 - DNA, 15 bp, Homo sapiens
tttgctgtgaggaat

SEQ ID NO: 274597 - DNA, 21 bp, Homo sapiens
tttgctgtgaggctgtcctgt

SEQ ID NO: 274598 - DNA, 13 bp, Homo sapiens
tttgctgtgccaa

SEQ ID NO: 274599 - DNA, 13 bp, Homo sapiens
tttgcttatttat

SEQ ID NO: 274600 - DNA, 18 bp, Homo sapiens
tttgcttgcgtgctggga

SEQ ID NO: 274601 - DNA, 19 bp, Homo sapiens
tttgcttgcgtgctgggac

SEQ ID NO: 274602 - DNA, 17 bp, Homo sapiens
tttgctttgggattttc

SEQ ID NO: 274603 - DNA, 16 bp, Homo sapiens
tttgcttttccctagt

SEQ ID NO: 274604 - DNA, 14 bp, Homo sapiens
tttgctttttgcta

SEQ ID NO: 274605 - DNA, 22 bp, Homo sapiens
tttggaaaacataaaaatcact

SEQ ID NO: 274606 - DNA, 21 bp, Homo sapiens
tttggaaaacgatttaattta

SEQ ID NO: 274607 - DNA, 23 bp, Homo sapiens
tttggaagagaggcacctgctgg

SEQ ID NO: 274608 - DNA, 21 bp, Homo sapiens
tttggaaggttttaacattga

SEQ ID NO: 274609 - DNA, 13 bp, Homo sapiens
tttggaataaagt

SEQ ID NO: 274610 - DNA, 22 bp, Homo sapiens
tttggaatcttctctttgacaa

SEQ ID NO: 274611 - DNA, 16 bp, Homo sapiens
tttggacacacacagc

SEQ ID NO: 274612 - DNA, 19 bp, Homo sapiens
tttggagaacgccagtctc

SEQ ID NO: 274613 - DNA, 22 bp, Homo sapiens
tttggagaacgccagtctccca

SEQ ID NO: 274614 - DNA, 21 bp, Homo sapiens
tttggatatctgttagatgct

SEQ ID NO: 274615 - DNA, 21 bp, Homo sapiens
tttggatcatttttaactgat

SEQ ID NO: 274616 - DNA, 22 bp, Homo sapiens
tttggatgaatgcagtataaaa

SEQ ID NO: 274617 - DNA, 21 bp, Homo sapiens
tttggatgggagtgagacaga

SEQ ID NO: 274618 - DNA, 22 bp, Homo sapiens
tttggatgtcctcaaagaagtg

SEQ ID NO: 274619 - DNA, 22 bp, Homo sapiens
tttggcaagaagactgtatttt

SEQ ID NO: 274620 - DNA, 13 bp, Homo sapiens
tttggcattatct

SEQ ID NO: 274621 - DNA, 22 bp, Homo sapiens
tttggcattatctctttctctc

SEQ ID NO: 274622 - DNA, 14 bp, Homo sapiens
tttggcgggccaag

SEQ ID NO: 274623 - DNA, 14 bp, Homo sapiens
tttggctctttcag

SEQ ID NO: 274624 - DNA, 15 bp, Homo sapiens
tttggctgtaattta

SEQ ID NO: 274625 - DNA, 16 bp, Homo sapiens
tttgggaacactggcc

SEQ ID NO: 274626 - DNA, 14 bp, Homo sapiens
tttgggagagactt

SEQ ID NO: 274627 - DNA, 14 bp, Homo sapiens
tttgggaggccaag

SEQ ID NO: 274628 - DNA, 20 bp, Homo sapiens
tttggggagcagagacacta

SEQ ID NO: 274629 - DNA, 14 bp, Homo sapiens
tttggggcgaggca

SEQ ID NO: 274630 - DNA, 17 bp, Homo sapiens
tttgggttgtgacccag

SEQ ID NO: 274631 - DNA, 11 bp, Homo sapiens
tttgggtttct

SEQ ID NO: 274632 - DNA, 16 bp, Homo sapiens
tttgggtttctgccct

SEQ ID NO: 274633 - DNA, 16 bp, Homo sapiens
tttggtcttagcttta

SEQ ID NO: 274634 - DNA, 13 bp, Homo sapiens
tttggtgaataac

SEQ ID NO: 274635 - DNA, 19 bp, Homo sapiens
tttggtggcctaatttaca

SEQ ID NO: 274636 - DNA, 14 bp, Homo sapiens
tttggtgtctgatg

SEQ ID NO: 274637 - DNA, 15 bp, Homo sapiens
tttggttcctcatgg

SEQ ID NO: 274638 - DNA, 12 bp, Homo sapiens
tttggttctgtg

SEQ ID NO: 274639 - DNA, 24 bp, Homo sapiens
tttggttcttctgacacttgtggt

SEQ ID NO: 274640 - DNA, 13 bp, Homo sapiens
tttggttgtttgc

SEQ ID NO: 274641 - DNA, 17 bp, Homo sapiens
tttggttgtttgctgtt

SEQ ID NO: 274642 - DNA, 17 bp, Homo sapiens
tttgtaaactgtatcaa

SEQ ID NO: 274643 - DNA, 22 bp, Homo sapiens
tttgtaaagttaattcattaaa

SEQ ID NO: 274644 - DNA, 17 bp, Homo sapiens
tttgtaaataagagatt

SEQ ID NO: 274645 - DNA, 15 bp, Homo sapiens
tttgtaaatactgct

SEQ ID NO: 274646 - DNA, 17 bp, Homo sapiens
tttgtaaatactgcttg

SEQ ID NO: 274647 - DNA, 22 bp, Homo sapiens
tttgtaaatatcttttcttctc

SEQ ID NO: 274648 - DNA, 23 bp, Homo sapiens
tttgtaaattttggaaagattat

SEQ ID NO: 274649 - DNA, 15 bp, Homo sapiens
tttgtaactttgcat

SEQ ID NO: 274650 - DNA, 16 bp, Homo sapiens
tttgtaactttgcatg

SEQ ID NO: 274651 - DNA, 17 bp, Homo sapiens
tttgtaactttgcatgt

SEQ ID NO: 274652 - DNA, 15 bp, Homo sapiens
agggcatctccagga

SEQ ID NO: 274653 - DNA, 16 bp, Homo sapiens
agggcatctccaggaa

SEQ ID NO: 274654 - DNA, 19 bp, Homo sapiens
agggcatctccaggaaggc

SEQ ID NO: 274655 - DNA, 16 bp, Homo sapiens
agggcatctcctgtgc

SEQ ID NO: 274656 - DNA, 21 bp, Homo sapiens
agggcatctcctgtgcatggg

SEQ ID NO: 274657 - DNA, 23 bp, Homo sapiens
agggcatctcctgtgcatgggtg

SEQ ID NO: 274658 - DNA, 18 bp, Homo sapiens
agggcatgcattttgcag

SEQ ID NO: 274659 - DNA, 17 bp, Homo sapiens
agggcatggccaggtgg

SEQ ID NO: 274660 - DNA, 13 bp, Homo sapiens
agggcatgtgata

SEQ ID NO: 274661 - DNA, 17 bp, Homo sapiens
agggcatgtgatatttt

SEQ ID NO: 274662 - DNA, 16 bp, Homo sapiens
agggccaagacttggc

SEQ ID NO: 274663 - DNA, 16 bp, Homo sapiens
agggccagaaggaggg

SEQ ID NO: 274664 - DNA, 18 bp, Homo sapiens
agggccagaaggagggca

SEQ ID NO: 274665 - DNA, 21 bp, Homo sapiens
agggccagaaggagggcagag

SEQ ID NO: 274666 - DNA, 16 bp, Homo sapiens
agggccagggctctgg

SEQ ID NO: 274667 - DNA, 17 bp, Homo sapiens
agggccagggctctggc

SEQ ID NO: 274668 - DNA, 18 bp, Homo sapiens
agggccagtagagagtgc

SEQ ID NO: 274669 - DNA, 16 bp, Homo sapiens
agggccagtcctgcct

SEQ ID NO: 274670 - DNA, 21 bp, Homo sapiens
agggccagtcctgcctggcca

SEQ ID NO: 274671 - DNA, 22 bp, Homo sapiens
agggccagtcctgcctggccag

SEQ ID NO: 274672 - DNA, 15 bp, Homo sapiens
agggccagtctgggc

SEQ ID NO: 274673 - DNA, 22 bp, Homo sapiens
agggccatacttttgagagggg

SEQ ID NO: 274674 - DNA, 13 bp, Homo sapiens
agggcccacctcc

SEQ ID NO: 274675 - DNA, 18 bp, Homo sapiens
agggcccacctcctccag

SEQ ID NO: 274676 - DNA, 19 bp, Homo sapiens
agggcccacctcctccagc

SEQ ID NO: 274677 - DNA, 15 bp, Homo sapiens
agggcccagctgtag

SEQ ID NO: 274678 - DNA, 22 bp, Homo sapiens
agggcccagctgtagccatggc

SEQ ID NO: 274679 - DNA, 23 bp, Homo sapiens
agggcccatctgccgcctggggc

SEQ ID NO: 274680 - DNA, 22 bp, Homo sapiens
agggcccccggccacgctccct

SEQ ID NO: 274681 - DNA, 16 bp, Homo sapiens
agggcccctccctctg

SEQ ID NO: 274682 - DNA, 19 bp, Homo sapiens
agggcccctccctctgccc

SEQ ID NO: 274683 - DNA, 20 bp, Homo sapiens
agggcccctccctctgcccc

SEQ ID NO: 274684 - DNA, 14 bp, Homo sapiens
agggcccctctgcc

SEQ ID NO: 274685 - DNA, 17 bp, Homo sapiens
agggcccctctgcccag

SEQ ID NO: 274686 - DNA, 19 bp, Homo sapiens
agggcccctctgcccagct

SEQ ID NO: 274687 - DNA, 20 bp, Homo sapiens
agggcccctctgcccagctt

SEQ ID NO: 274688 - DNA, 14 bp, Homo sapiens
agggccctcagagg

SEQ ID NO: 274689 - DNA, 19 bp, Homo sapiens
agggccctgctcaggcctc

SEQ ID NO: 274690 - DNA, 20 bp, Homo sapiens
agggccctgctcaggcctca

SEQ ID NO: 274691 - DNA, 15 bp, Homo sapiens
agggccctggggtct

SEQ ID NO: 274692 - DNA, 22 bp, Homo sapiens
agggccctggggtctctgagca

SEQ ID NO: 274693 - DNA, 16 bp, Homo sapiens
agggccgcagggcgct

SEQ ID NO: 274694 - DNA, 18 bp, Homo sapiens
agggccgcagggcgctcc

SEQ ID NO: 274695 - DNA, 19 bp, Homo sapiens
agggccgcccgggcccaga

SEQ ID NO: 274696 - DNA, 20 bp, Homo sapiens
agggccgcccgggcccagag

SEQ ID NO: 274697 - DNA, 23 bp, Homo sapiens
agggccgctcgatgcctttgctg

SEQ ID NO: 274698 - DNA, 17 bp, Homo sapiens
agggcctcagagacagc

SEQ ID NO: 274699 - DNA, 12 bp, Homo sapiens
agggcctctggt

SEQ ID NO: 274700 - DNA, 19 bp, Homo sapiens
agggcctctggtgttcctg

SEQ ID NO: 274701 - DNA, 21 bp, Homo sapiens
agggcctctggtgttcctggc

SEQ ID NO: 274702 - DNA, 14 bp, Homo sapiens
agggcctggcctgg

SEQ ID NO: 274703 - DNA, 18 bp, Homo sapiens
agggcctgtgggagcctg

SEQ ID NO: 274704 - DNA, 19 bp, Homo sapiens
agggcctgtgggagcctgc

SEQ ID NO: 274705 - DNA, 18 bp, Homo sapiens
agggccttgacaagtaca

SEQ ID NO: 274706 - DNA, 12 bp, Homo sapiens
agggccttgcta

SEQ ID NO: 274707 - DNA, 15 bp, Homo sapiens
agggccttggcccag

SEQ ID NO: 274708 - DNA, 13 bp, Homo sapiens
agggcgagactcc

SEQ ID NO: 274709 - DNA, 21 bp, Homo sapiens
agggcgaggcgggggatcctg

SEQ ID NO: 274710 - DNA, 22 bp, Homo sapiens
agggcgaggcgggggatcctgg

SEQ ID NO: 274711 - DNA, 22 bp, Homo sapiens
agggcgcccattcgtctgtccc

SEQ ID NO: 274712 - DNA, 17 bp, Homo sapiens
agggcgctccggcagag

SEQ ID NO: 274713 - DNA, 18 bp, Homo sapiens
agggcgctccggcagagg

SEQ ID NO: 274714 - DNA, 18 bp, Homo sapiens
agggcggccagggacaga

SEQ ID NO: 274715 - DNA, 15 bp, Homo sapiens
agggcgggccaggag

SEQ ID NO: 274716 - DNA, 20 bp, Homo sapiens
agggctaattctgggaaggg

SEQ ID NO: 274717 - DNA, 23 bp, Homo sapiens
agggctaattctgggaagggaga

SEQ ID NO: 274718 - DNA, 16 bp, Homo sapiens
agggctcagctccttg

SEQ ID NO: 274719 - DNA, 17 bp, Homo sapiens
agggctccacgggggcc

SEQ ID NO: 274720 - DNA, 15 bp, Homo sapiens
agggctccagcatcc

SEQ ID NO: 274721 - DNA, 14 bp, Homo sapiens
agggctccagggcc

SEQ ID NO: 274722 - DNA, 14 bp, Homo sapiens
agggctccctcctg

SEQ ID NO: 274723 - DNA, 16 bp, Homo sapiens
agggctccctcctgga

SEQ ID NO: 274724 - DNA, 17 bp, Homo sapiens
agggctccctcctggag

SEQ ID NO: 274725 - DNA, 15 bp, Homo sapiens
agggctctaaaaaaa

SEQ ID NO: 274726 - DNA, 23 bp, Homo sapiens
agggctctaaaaaaagccccaaa

SEQ ID NO: 274727 - DNA, 15 bp, Homo sapiens
agggctctggcaggt

SEQ ID NO: 274728 - DNA, 20 bp, Homo sapiens
agggctgacacgtccacccc

SEQ ID NO: 274729 - DNA, 16 bp, Homo sapiens
agggctgagagggctg

SEQ ID NO: 274730 - DNA, 21 bp, Homo sapiens
agggctgagagggctgtggct

SEQ ID NO: 274731 - DNA, 16 bp, Homo sapiens
agggctgagcccctcc

SEQ ID NO: 274732 - DNA, 19 bp, Homo sapiens
agggctgagcccctcctct

SEQ ID NO: 274733 - DNA, 12 bp, Homo sapiens
agggctgcccct

SEQ ID NO: 274734 - DNA, 22 bp, Homo sapiens
agggctgcccctgtaggttgct

SEQ ID NO: 274735 - DNA, 12 bp, Homo sapiens
agggctggacct

SEQ ID NO: 274736 - DNA, 16 bp, Homo sapiens
agggctggcccgggga

SEQ ID NO: 274737 - DNA, 22 bp, Homo sapiens
agggctgggctctgtcttcctg

SEQ ID NO: 274738 - DNA, 13 bp, Homo sapiens
agggctgtgggtg

SEQ ID NO: 274739 - DNA, 23 bp, Homo sapiens
agggcttacctgtacactgactt

SEQ ID NO: 274740 - DNA, 16 bp, Homo sapiens
agggcttggggctgca

SEQ ID NO: 274741 - DNA, 13 bp, Homo sapiens
aggggaagctgca

SEQ ID NO: 274742 - DNA, 14 bp, Homo sapiens
aggggaagctgcag

SEQ ID NO: 274743 - DNA, 23 bp, Homo sapiens
aggggaagggccagtctgggctg

SEQ ID NO: 274744 - DNA, 14 bp, Homo sapiens
aggggactcagccc

SEQ ID NO: 274745 - DNA, 17 bp, Homo sapiens
aggggactcagccctga

SEQ ID NO: 274746 - DNA, 16 bp, Homo sapiens
aggggactgcatgcaa

SEQ ID NO: 274747 - DNA, 20 bp, Homo sapiens
aggggactgggggactggga

SEQ ID NO: 274748 - DNA, 21 bp, Homo sapiens
aggggactgggggactgggag

SEQ ID NO: 274749 - DNA, 21 bp, Homo sapiens
aggggagaaactgaaagtgtt

SEQ ID NO: 274750 - DNA, 16 bp, Homo sapiens
aggggagaggaaaagt

SEQ ID NO: 274751 - DNA, 11 bp, Homo sapiens
aggggagccag

SEQ ID NO: 274752 - DNA, 12 bp, Homo sapiens
aggggagccagg

SEQ ID NO: 274753 - DNA, 16 bp, Homo sapiens
aggggagccagggtag

SEQ ID NO: 274754 - DNA, 21 bp, Homo sapiens
aggggaggcagccggcaccca

SEQ ID NO: 274755 - DNA, 16 bp, Homo sapiens
aggggaggggcctagg

SEQ ID NO: 274756 - DNA, 19 bp, Homo sapiens
aggggagggtggcaggtga

SEQ ID NO: 274757 - DNA, 18 bp, Homo sapiens
aggggatataggagagga

SEQ ID NO: 274758 - DNA, 16 bp, Homo sapiens
aggggatctaaaagga

SEQ ID NO: 274759 - DNA, 24 bp, Homo sapiens
aggggatctaaaaggaggacaggg

SEQ ID NO: 274760 - DNA, 22 bp, Homo sapiens
aggggatgtatccatgggggca

SEQ ID NO: 274761 - DNA, 19 bp, Homo sapiens
aggggattgaagccctcca

SEQ ID NO: 274762 - DNA, 22 bp, Homo sapiens
aggggcaatggggtgcctacta

SEQ ID NO: 274763 - DNA, 11 bp, Homo sapiens
aggggcacacc

SEQ ID NO: 274764 - DNA, 15 bp, Homo sapiens
aggggcacaccactg

SEQ ID NO: 274765 - DNA, 20 bp, Homo sapiens
aggggcacaccactgccctg

SEQ ID NO: 274766 - DNA, 21 bp, Homo sapiens
aggggcacaccactgccctgc

SEQ ID NO: 274767 - DNA, 22 bp, Homo sapiens
aggggcacaccactgccctgcc

SEQ ID NO: 274768 - DNA, 23 bp, Homo sapiens
aggggcacaccactgccctgcct

SEQ ID NO: 274769 - DNA, 16 bp, Homo sapiens
aggggcacactacaga

SEQ ID NO: 274770 - DNA, 12 bp, Homo sapiens
aggggcagaagg

SEQ ID NO: 274771 - DNA, 17 bp, Homo sapiens
aggggcagaaggaggaa

SEQ ID NO: 274772 - DNA, 12 bp, Homo sapiens
aggggcaggagc

SEQ ID NO: 274773 - DNA, 19 bp, Homo sapiens
aggggcaggagctcagatg

SEQ ID NO: 274774 - DNA, 17 bp, Homo sapiens
aggggcaggcctgggac

SEQ ID NO: 274775 - DNA, 15 bp, Homo sapiens
aggggcagtctggag

SEQ ID NO: 274776 - DNA, 21 bp, Homo sapiens
aggggcatctgcccctccccc

SEQ ID NO: 274777 - DNA, 13 bp, Homo sapiens
aggggccactggg

SEQ ID NO: 274778 - DNA, 19 bp, Homo sapiens
aggggccactgggccccat

SEQ ID NO: 274779 - DNA, 13 bp, Homo sapiens
aggggccagctgc

SEQ ID NO: 274780 - DNA, 15 bp, Homo sapiens
aggggccaggccatg

SEQ ID NO: 274781 - DNA, 19 bp, Homo sapiens
aggggccccagatctgcct

SEQ ID NO: 274782 - DNA, 16 bp, Homo sapiens
aggggccccggggctg

SEQ ID NO: 274783 - DNA, 21 bp, Homo sapiens
aggggccccggggctggcaag

SEQ ID NO: 274784 - DNA, 22 bp, Homo sapiens
aggggcccctcctctgtgctcc

SEQ ID NO: 274785 - DNA, 14 bp, Homo sapiens
agtttacagtaaat

SEQ ID NO: 274786 - DNA, 16 bp, Homo sapiens
agtttacagtaaataa

SEQ ID NO: 274787 - DNA, 22 bp, Homo sapiens
agtttacagtaaataaattgtt

SEQ ID NO: 274788 - DNA, 22 bp, Homo sapiens
agtttaccatttgtaataaagt

SEQ ID NO: 274789 - DNA, 19 bp, Homo sapiens
agtttagaaattacaagtt

SEQ ID NO: 274790 - DNA, 13 bp, Homo sapiens
agtttaggagaaa

SEQ ID NO: 274791 - DNA, 14 bp, Homo sapiens
agtttaggagaaac

SEQ ID NO: 274792 - DNA, 22 bp, Homo sapiens
agtttagtgtggttttctgttt

SEQ ID NO: 274793 - DNA, 15 bp, Homo sapiens
agtttatacagtaca

SEQ ID NO: 274794 - DNA, 22 bp, Homo sapiens
agtttatacagttttaaagaat

SEQ ID NO: 274795 - DNA, 13 bp, Homo sapiens
agtttatccaaat

SEQ ID NO: 274796 - DNA, 18 bp, Homo sapiens
agtttatgcagtgctgct

SEQ ID NO: 274797 - DNA, 16 bp, Homo sapiens
agtttatttttcacac

SEQ ID NO: 274798 - DNA, 21 bp, Homo sapiens
agtttatttttttgatggcta

SEQ ID NO: 274799 - DNA, 22 bp, Homo sapiens
agtttatttttttgatggctaa

SEQ ID NO: 274800 - DNA, 16 bp, Homo sapiens
agtttcaaaatgttaa

SEQ ID NO: 274801 - DNA, 15 bp, Homo sapiens
agtttcaatgtgatt

SEQ ID NO: 274802 - DNA, 16 bp, Homo sapiens
agtttcaatgtgattc

SEQ ID NO: 274803 - DNA, 14 bp, Homo sapiens
agtttcagaagtac

SEQ ID NO: 274804 - DNA, 13 bp, Homo sapiens
agtttcagacagg

SEQ ID NO: 274805 - DNA, 15 bp, Homo sapiens
agtttcagatatata

SEQ ID NO: 274806 - DNA, 17 bp, Homo sapiens
agtttcagatatatatc

SEQ ID NO: 274807 - DNA, 21 bp, Homo sapiens
agtttcagcttaaaataaaca

SEQ ID NO: 274808 - DNA, 20 bp, Homo sapiens
agtttcaggcaaggcagctc

SEQ ID NO: 274809 - DNA, 17 bp, Homo sapiens
agtttcagtaatagctg

SEQ ID NO: 274810 - DNA, 19 bp, Homo sapiens
agtttcattatagcacgaa

SEQ ID NO: 274811 - DNA, 13 bp, Homo sapiens
agtttcatttatg

SEQ ID NO: 274812 - DNA, 19 bp, Homo sapiens
agtttccagctaagcctga

SEQ ID NO: 274813 - DNA, 17 bp, Homo sapiens
agtttccagtctcaaaa

SEQ ID NO: 274814 - DNA, 22 bp, Homo sapiens
agtttccccaccagtgaatgaa

SEQ ID NO: 274815 - DNA, 23 bp, Homo sapiens
agtttccccaccagtgaatgaaa

SEQ ID NO: 274816 - DNA, 22 bp, Homo sapiens
agtttccgtttccaggtgttta

SEQ ID NO: 274817 - DNA, 13 bp, Homo sapiens
agtttcctcaggc

SEQ ID NO: 274818 - DNA, 16 bp, Homo sapiens
agtttctagaggcctc

SEQ ID NO: 274819 - DNA, 21 bp, Homo sapiens
agtttctagctagaaatatga

SEQ ID NO: 274820 - DNA, 16 bp, Homo sapiens
agtttctatggattca

SEQ ID NO: 274821 - DNA, 21 bp, Homo sapiens
agtttctatggattcacttct

SEQ ID NO: 274822 - DNA, 15 bp, Homo sapiens
agtttctcagctccc

SEQ ID NO: 274823 - DNA, 17 bp, Homo sapiens
agtttctggctgaaaat

SEQ ID NO: 274824 - DNA, 17 bp, Homo sapiens
agtttctgggacctcag

SEQ ID NO: 274825 - DNA, 21 bp, Homo sapiens
agtttctgttgtttcttttat

SEQ ID NO: 274826 - DNA, 21 bp, Homo sapiens
agtttgagacaagccctggca

SEQ ID NO: 274827 - DNA, 19 bp, Homo sapiens
agtttgatatgggctttct

SEQ ID NO: 274828 - DNA, 20 bp, Homo sapiens
agtttgatatgggctttctc

SEQ ID NO: 274829 - DNA, 19 bp, Homo sapiens
agtttgcatacttcctgga

SEQ ID NO: 274830 - DNA, 21 bp, Homo sapiens
agtttgccctggtttcactgg

SEQ ID NO: 274831 - DNA, 16 bp, Homo sapiens
agtttggaaggtgtcc

SEQ ID NO: 274832 - DNA, 17 bp, Homo sapiens
agtttggcaatagtttg

SEQ ID NO: 274833 - DNA, 18 bp, Homo sapiens
agtttgtacatgcattca

SEQ ID NO: 274834 - DNA, 14 bp, Homo sapiens
agtttgtataactt

SEQ ID NO: 274835 - DNA, 17 bp, Homo sapiens
agtttgtataacttctt

SEQ ID NO: 274836 - DNA, 14 bp, Homo sapiens
agtttgtcagactt

SEQ ID NO: 274837 - DNA, 12 bp, Homo sapiens
agtttgtgaagt

SEQ ID NO: 274838 - DNA, 15 bp, Homo sapiens
agtttgtgcaagaca

SEQ ID NO: 274839 - DNA, 12 bp, Homo sapiens
agtttgtggtga

SEQ ID NO: 274840 - DNA, 15 bp, Homo sapiens
agttttaaactcatt

SEQ ID NO: 274841 - DNA, 22 bp, Homo sapiens
agttttaacctcaggttccaaa

SEQ ID NO: 274842 - DNA, 18 bp, Homo sapiens
agttttaactagaattta

SEQ ID NO: 274843 - DNA, 15 bp, Homo sapiens
agttttataaaactc

SEQ ID NO: 274844 - DNA, 20 bp, Homo sapiens
agttttatcattttcaaaat

SEQ ID NO: 274845 - DNA, 12 bp, Homo sapiens
agttttcagatt

SEQ ID NO: 274846 - DNA, 21 bp, Homo sapiens
agttttcatttagaaaataga

SEQ ID NO: 274847 - DNA, 12 bp, Homo sapiens
agttttccatga

SEQ ID NO: 274848 - DNA, 21 bp, Homo sapiens
agttttccatgaaaacgtttt

SEQ ID NO: 274849 - DNA, 23 bp, Homo sapiens
agttttctgtgagaataaagcat

SEQ ID NO: 274850 - DNA, 12 bp, Homo sapiens
agttttcttttt

SEQ ID NO: 274851 - DNA, 21 bp, Homo sapiens
agttttgatgaaattcttgaa

SEQ ID NO: 274852 - DNA, 20 bp, Homo sapiens
agttttgtataaataataaa

SEQ ID NO: 274853 - DNA, 17 bp, Homo sapiens
agttttgtgtacagtat

SEQ ID NO: 274854 - DNA, 18 bp, Homo sapiens
agttttgtgtacagtatg

SEQ ID NO: 274855 - DNA, 15 bp, Homo sapiens
agtttttaaaaaggc

SEQ ID NO: 274856 - DNA, 13 bp, Homo sapiens
agtttttacagtg

SEQ ID NO: 274857 - DNA, 21 bp, Homo sapiens
agtttttacctaccacagtgt

SEQ ID NO: 274858 - DNA, 15 bp, Homo sapiens
agtttttactgaaca

SEQ ID NO: 274859 - DNA, 20 bp, Homo sapiens
agtttttcaggagcgcaaga

SEQ ID NO: 274860 - DNA, 23 bp, Homo sapiens
agtttttggtaatgatgattcaa

SEQ ID NO: 274861 - DNA, 17 bp, Homo sapiens
agttttttctcttgggc

SEQ ID NO: 274862 - DNA, 21 bp, Homo sapiens
ataaaaaaaaaaggatgaaag

SEQ ID NO: 274863 - DNA, 17 bp, Homo sapiens
ataaaaaaacaatcatt

SEQ ID NO: 274864 - DNA, 14 bp, Homo sapiens
ataaaaaacattca

SEQ ID NO: 274865 - DNA, 17 bp, Homo sapiens
ataaaaaagaaaacatt

SEQ ID NO: 274866 - DNA, 21 bp, Homo sapiens
ataaaaaagaaaacttgtgtt

SEQ ID NO: 274867 - DNA, 14 bp, Homo sapiens
ataaaaaagaaatc

SEQ ID NO: 274868 - DNA, 13 bp, Homo sapiens
ataaaaaccctgt

SEQ ID NO: 274869 - DNA, 12 bp, Homo sapiens
ataaaaaggttt

SEQ ID NO: 274870 - DNA, 13 bp, Homo sapiens
ataaaaaggttta

SEQ ID NO: 274871 - DNA, 17 bp, Homo sapiens
ataaaaagtgacacagc

SEQ ID NO: 274872 - DNA, 20 bp, Homo sapiens
ataaaaagtgacacagcagc

SEQ ID NO: 274873 - DNA, 22 bp, Homo sapiens
agtgttcattttagtgactgta

SEQ ID NO: 274874 - DNA, 20 bp, Homo sapiens
agtgttgattgccaaattga

SEQ ID NO: 274875 - DNA, 17 bp, Homo sapiens
agtgttgcctcctccca

SEQ ID NO: 274876 - DNA, 15 bp, Homo sapiens
agtgtttagcattaa

SEQ ID NO: 274877 - DNA, 22 bp, Homo sapiens
agtgtttagcattaaaaataaa

SEQ ID NO: 274878 - DNA, 22 bp, Homo sapiens
agtgtttatttttcatattgtg

SEQ ID NO: 274879 - DNA, 15 bp, Homo sapiens
agtgtttcccataat

SEQ ID NO: 274880 - DNA, 17 bp, Homo sapiens
agtgttttgtacttgtt

SEQ ID NO: 274881 - DNA, 21 bp, Homo sapiens
agtgtttttctttaatcaaaa

SEQ ID NO: 274882 - DNA, 10 bp, Homo sapiens
agttaaaatc

SEQ ID NO: 274883 - DNA, 16 bp, Homo sapiens
agttaaagtgaataac

SEQ ID NO: 274884 - DNA, 13 bp, Homo sapiens
agttaacaaggaa

SEQ ID NO: 274885 - DNA, 16 bp, Homo sapiens
agttaacaaggaatgc

SEQ ID NO: 274886 - DNA, 19 bp, Homo sapiens
agttaacagacaacacgtt

SEQ ID NO: 274887 - DNA, 23 bp, Homo sapiens
agttaacagtctcattacagatt

SEQ ID NO: 274888 - DNA, 21 bp, Homo sapiens
agttaacattcagtactttat

SEQ ID NO: 274889 - DNA, 21 bp, Homo sapiens
agttaacttagtgtttagcat

SEQ ID NO: 274890 - DNA, 18 bp, Homo sapiens
agttaagaaaaaaataat

SEQ ID NO: 274891 - DNA, 19 bp, Homo sapiens
agttaagacaacaggcatt

SEQ ID NO: 274892 - DNA, 19 bp, Homo sapiens
agttaagatgtctgagaga

SEQ ID NO: 274893 - DNA, 15 bp, Homo sapiens
agttaagcagccttt

SEQ ID NO: 274894 - DNA, 19 bp, Homo sapiens
agttaagcagcctttctgt

SEQ ID NO: 274895 - DNA, 15 bp, Homo sapiens
agttaagtgtcattt

SEQ ID NO: 274896 - DNA, 20 bp, Homo sapiens
agttaatatatcccagaaat

SEQ ID NO: 274897 - DNA, 21 bp, Homo sapiens
agttaatatatcccagaaatt

SEQ ID NO: 274898 - DNA, 15 bp, Homo sapiens
agttaatattgtgaa

SEQ ID NO: 274899 - DNA, 14 bp, Homo sapiens
agttaatcttgctt

SEQ ID NO: 274900 - DNA, 16 bp, Homo sapiens
agttaatcttgctttc

SEQ ID NO: 274901 - DNA, 20 bp, Homo sapiens
agttaatgatggttgatggg

SEQ ID NO: 274902 - DNA, 15 bp, Homo sapiens
ataaacacatagatt

SEQ ID NO: 274903 - DNA, 19 bp, Homo sapiens
ataaacagataatgctttt

SEQ ID NO: 274904 - DNA, 14 bp, Homo sapiens
ataaacattaaaca

SEQ ID NO: 274905 - DNA, 21 bp, Homo sapiens
ataaaccttgtttctttctga

SEQ ID NO: 274906 - DNA, 16 bp, Homo sapiens
ataaacgaaacacaga

SEQ ID NO: 274907 - DNA, 15 bp, Homo sapiens
ataaacgaaacattt

SEQ ID NO: 274908 - DNA, 16 bp, Homo sapiens
ataaacgaaacattta

SEQ ID NO: 274909 - DNA, 20 bp, Homo sapiens
ataaactctaagtgtaaaaa

SEQ ID NO: 274910 - DNA, 12 bp, Homo sapiens
ataaactcttca

SEQ ID NO: 274911 - DNA, 19 bp, Homo sapiens
ataaactcttcaaggccaa

SEQ ID NO: 274912 - DNA, 17 bp, Homo sapiens
ataaactgtcctctttc

SEQ ID NO: 274913 - DNA, 16 bp, Homo sapiens
ataaactgtgtttact

SEQ ID NO: 274914 - DNA, 15 bp, Homo sapiens
ataaacttagaataa

SEQ ID NO: 274915 - DNA, 21 bp, Homo sapiens
ataaacttagaataaaattgt

SEQ ID NO: 274916 - DNA, 16 bp, Homo sapiens
ataaagaaacactttc

SEQ ID NO: 274917 - DNA, 15 bp, Homo sapiens
ataaagaaacctttt

SEQ ID NO: 274918 - DNA, 21 bp, Homo sapiens
ataaagaacaaggtagttttt

SEQ ID NO: 274919 - DNA, 22 bp, Homo sapiens
ataaagaactccttattttgta

SEQ ID NO: 274920 - DNA, 13 bp, Homo sapiens
ataaagcaaatat

SEQ ID NO: 274921 - DNA, 15 bp, Homo sapiens
ataaagcagtagaca

SEQ ID NO: 274922 - DNA, 18 bp, Homo sapiens
ataaagcgaatggaccat

SEQ ID NO: 274923 - DNA, 18 bp, Homo sapiens
ataaagcgtgcaccgtgc

SEQ ID NO: 274924 - DNA, 11 bp, Homo sapiens
ataaagctgga

SEQ ID NO: 274925 - DNA, 17 bp, Homo sapiens
ataaagcttgtggcccc

SEQ ID NO: 274926 - DNA, 16 bp, Homo sapiens
ataaagggaacatgca

SEQ ID NO: 274927 - DNA, 16 bp, Homo sapiens
ataaagtactactgta

SEQ ID NO: 274928 - DNA, 18 bp, Homo sapiens
ataaagtatcatgcattc

SEQ ID NO: 274929 - DNA, 16 bp, Homo sapiens
ataaagtattccacct

SEQ ID NO: 274930 - DNA, 18 bp, Homo sapiens
ataaagtattccacctta

SEQ ID NO: 274931 - DNA, 14 bp, Homo sapiens
ataaagttaaaagt

SEQ ID NO: 274932 - DNA, 18 bp, Homo sapiens
ataaagttacttgaattt

SEQ ID NO: 274933 - DNA, 14 bp, Homo sapiens
ataaataaaaatat

SEQ ID NO: 274934 - DNA, 17 bp, Homo sapiens
ataaataaaaatattct

SEQ ID NO: 274935 - DNA, 17 bp, Homo sapiens
ataaataaaaatggata

SEQ ID NO: 274936 - DNA, 18 bp, Homo sapiens
ataaataaagaagaaaat

SEQ ID NO: 274937 - DNA, 12 bp, Homo sapiens
ataaataaatgt

SEQ ID NO: 274938 - DNA, 17 bp, Homo sapiens
ataaataatattatatt

SEQ ID NO: 274939 - DNA, 20 bp, Homo sapiens
ataaataatattatattgta

SEQ ID NO: 274940 - DNA, 21 bp, Homo sapiens
ataaataatattatattgtat

SEQ ID NO: 274941 - DNA, 17 bp, Homo sapiens
ataaatacacaatgaat

SEQ ID NO: 274942 - DNA, 21 bp, Homo sapiens
ataaatactaaatatgaaatt

SEQ ID NO: 274943 - DNA, 19 bp, Homo sapiens
ataaatactttaacttcca

SEQ ID NO: 274944 - DNA, 17 bp, Homo sapiens
ataaatagctaaatggc

SEQ ID NO: 274945 - DNA, 22 bp, Homo sapiens
ataaatagtgaaaattttattg

SEQ ID NO: 274946 - DNA, 15 bp, Homo sapiens
ataaatatactaata

SEQ ID NO: 274947 - DNA, 17 bp, Homo sapiens
ataaatatagttgtctt

SEQ ID NO: 274948 - DNA, 13 bp, Homo sapiens
ataaatatctatt

SEQ ID NO: 274949 - DNA, 24 bp, Homo sapiens
ataaatatctatttatctgtctga

SEQ ID NO: 274950 - DNA, 14 bp, Homo sapiens
ataaatcaatgtca

SEQ ID NO: 274951 - DNA, 14 bp, Homo sapiens
ataaatcatattga

SEQ ID NO: 274952 - DNA, 15 bp, Homo sapiens
ataaatcatattgat

SEQ ID NO: 274953 - DNA, 20 bp, Homo sapiens
ataaatcatattgatgaaaa

SEQ ID NO: 274954 - DNA, 22 bp, Homo sapiens
ataaatctgtctgattctatgc

SEQ ID NO: 274955 - DNA, 16 bp, Homo sapiens
ataaatgaagtttata

SEQ ID NO: 274956 - DNA, 14 bp, Homo sapiens
ataaatgaccagtt

SEQ ID NO: 274957 - DNA, 18 bp, Homo sapiens
ataaatgaccagtttacc

SEQ ID NO: 274958 - DNA, 13 bp, Homo sapiens
ataaatggacttg

SEQ ID NO: 274959 - DNA, 15 bp, Homo sapiens
ataaatggacttgct

SEQ ID NO: 274960 - DNA, 21 bp, Homo sapiens
ataaatggacttgcttcttgt

SEQ ID NO: 274961 - DNA, 20 bp, Homo sapiens
ataaatgggtaacactgatt

SEQ ID NO: 274962 - DNA, 22 bp, Homo sapiens
ataaatggtgagaattaaaata

SEQ ID NO: 274963 - DNA, 17 bp, Homo sapiens
ataaatgtaaaaatgaa

SEQ ID NO: 274964 - DNA, 15 bp, Homo sapiens
ataaatgtacattaa

SEQ ID NO: 274965 - DNA, 21 bp, Homo sapiens
ataaatgtgtggtgctaactg

SEQ ID NO: 274966 - DNA, 20 bp, Homo sapiens
ataaatgtttaaatataaat

SEQ ID NO: 274967 - DNA, 18 bp, Homo sapiens
ataaatgtttatattgtt

SEQ ID NO: 274968 - DNA, 11 bp, Homo sapiens
ataaattaaat

SEQ ID NO: 274969 - DNA, 16 bp, Homo sapiens
ataaattaagaagagt

SEQ ID NO: 274970 - DNA, 13 bp, Homo sapiens
ataaattaagact

SEQ ID NO: 274971 - DNA, 15 bp, Homo sapiens
ataaattaagacttt

SEQ ID NO: 274972 - DNA, 14 bp, Homo sapiens
ataaattaatacat

SEQ ID NO: 274973 - DNA, 21 bp, Homo sapiens
ataaattaatacataagttaa

SEQ ID NO: 274974 - DNA, 16 bp, Homo sapiens
ataaattaatgagttt

SEQ ID NO: 274975 - DNA, 14 bp, Homo sapiens
ataaattatttcta

SEQ ID NO: 274976 - DNA, 20 bp, Homo sapiens
ataaattatttctaaaacat

SEQ ID NO: 274977 - DNA, 24 bp, Homo sapiens
ataaattccccatatttgtgttca

SEQ ID NO: 274978 - DNA, 13 bp, Homo sapiens
ataaattgaaatt

SEQ ID NO: 274979 - DNA, 19 bp, Homo sapiens
ataaattgcatgctgcttt

SEQ ID NO: 274980 - DNA, 16 bp, Homo sapiens
ataaattgcctccctt

SEQ ID NO: 274981 - DNA, 18 bp, Homo sapiens
ataaattgcctcccttcc

SEQ ID NO: 274982 - DNA, 20 bp, Homo sapiens
ataaattgcctcccttcctc

SEQ ID NO: 274983 - DNA, 22 bp, Homo sapiens
atacagatccgcatgtgtctgt

SEQ ID NO: 274984 - DNA, 22 bp, Homo sapiens
atacagatgaaaatttgagact

SEQ ID NO: 274985 - DNA, 13 bp, Homo sapiens
atacagcactact

SEQ ID NO: 274986 - DNA, 11 bp, Homo sapiens
atacagctcta

SEQ ID NO: 274987 - DNA, 21 bp, Homo sapiens
atacagggcatgcattttgca

SEQ ID NO: 274988 - DNA, 17 bp, Homo sapiens
atacagtccctaaagaa

SEQ ID NO: 274989 - DNA, 22 bp, Homo sapiens
atacagtccctaaagaaaaaaa

SEQ ID NO: 274990 - DNA, 19 bp, Homo sapiens
atacatgatgatttcagaa

SEQ ID NO: 274991 - DNA, 14 bp, Homo sapiens
atacatggataaca

SEQ ID NO: 274992 - DNA, 15 bp, Homo sapiens
atacatgtatagtga

SEQ ID NO: 274993 - DNA, 13 bp, Homo sapiens
atacattaaaata

SEQ ID NO: 274994 - DNA, 15 bp, Homo sapiens
atacattaaaataac

SEQ ID NO: 274995 - DNA, 16 bp, Homo sapiens
atacattaaaataact

SEQ ID NO: 274996 - DNA, 23 bp, Homo sapiens
atacattccagtgtattttctgt

SEQ ID NO: 274997 - DNA, 19 bp, Homo sapiens
atacattccatcacagcca

SEQ ID NO: 274998 - DNA, 20 bp, Homo sapiens
atacatttataatgtttgct

SEQ ID NO: 274999 - DNA, 23 bp, Homo sapiens
atacatttataatgtttgctatt

SEQ ID NO: 275000 - DNA, 17 bp, Homo sapiens
atacatttgtatgttgt

SEQ ID NO: 275001 - DNA, 21 bp, Homo sapiens
atacatttgtatgttgtgaag

SEQ ID NO: 275002 - DNA, 18 bp, Homo sapiens
atacattttgttatagaa

SEQ ID NO: 275003 - DNA, 21 bp, Homo sapiens
atacattttgttatagaatac

SEQ ID NO: 275004 - DNA, 14 bp, Homo sapiens
ataccaaagcagtt

SEQ ID NO: 275005 - DNA, 19 bp, Homo sapiens
ataccaagagtatgagaaa

SEQ ID NO: 275006 - DNA, 16 bp, Homo sapiens
ataccacctgtacata

SEQ ID NO: 275007 - DNA, 15 bp, Homo sapiens
ataccagactgcagg

SEQ ID NO: 275008 - DNA, 15 bp, Homo sapiens
ataccagcaaaagtg

SEQ ID NO: 275009 - DNA, 22 bp, Homo sapiens
ataccagcccctgtatggcact

SEQ ID NO: 275010 - DNA, 18 bp, Homo sapiens
ataccagcttagatttta

SEQ ID NO: 275011 - DNA, 14 bp, Homo sapiens
ataccaggttgaaa

SEQ ID NO: 275012 - DNA, 14 bp, Homo sapiens
ataccattttgaaa

SEQ ID NO: 275013 - DNA, 15 bp, Homo sapiens
ataccattttgaaat

SEQ ID NO: 275014 - DNA, 20 bp, Homo sapiens
atacccagagagaaaaagag

SEQ ID NO: 275015 - DNA, 14 bp, Homo sapiens
ataccccctgcccc

SEQ ID NO: 275016 - DNA, 19 bp, Homo sapiens
ataccccttacttagcatg

SEQ ID NO: 275017 - DNA, 20 bp, Homo sapiens
ataccctaggtctccacccc

SEQ ID NO: 275018 - DNA, 18 bp, Homo sapiens
ataccctctaaaaaagaa

SEQ ID NO: 275019 - DNA, 20 bp, Homo sapiens
ataccgtttggtgtctgatg

SEQ ID NO: 275020 - DNA, 13 bp, Homo sapiens
atacctatttcat

SEQ ID NO: 275021 - DNA, 16 bp, Homo sapiens
atacctccattaaatg

SEQ ID NO: 275022 - DNA, 18 bp, Homo sapiens
atacctggcttttacttt

SEQ ID NO: 275023 - DNA, 20 bp, Homo sapiens
atacctggcttttactttat

SEQ ID NO: 275024 - DNA, 22 bp, Homo sapiens
atacctggcttttactttatta

SEQ ID NO: 275025 - DNA, 12 bp, Homo sapiens
atacctttaaat

SEQ ID NO: 275026 - DNA, 18 bp, Homo sapiens
atacctttaaatatcatt

SEQ ID NO: 275027 - DNA, 13 bp, Homo sapiens
atacctttgcctg

SEQ ID NO: 275028 - DNA, 22 bp, Homo sapiens
atacctttgcgtggatcaagct

SEQ ID NO: 275029 - DNA, 17 bp, Homo sapiens
atacgactttattttct

SEQ ID NO: 275030 - DNA, 23 bp, Homo sapiens
atacgcaacataattaaattttg

SEQ ID NO: 275031 - DNA, 17 bp, Homo sapiens
atacgcactacatgtgg

SEQ ID NO: 275032 - DNA, 20 bp, Homo sapiens
atacgccagaactgctttat

SEQ ID NO: 275033 - DNA, 13 bp, Homo sapiens
atactaaatatga

SEQ ID NO: 275034 - DNA, 21 bp, Homo sapiens
atactaagaccctaattcttt

SEQ ID NO: 275035 - DNA, 16 bp, Homo sapiens
atactaataaaaaggt

SEQ ID NO: 275036 - DNA, 17 bp, Homo sapiens
atactaataaaaaggtt

SEQ ID NO: 275037 - DNA, 20 bp, Homo sapiens
atactaatagagtacttaat

SEQ ID NO: 275038 - DNA, 14 bp, Homo sapiens
atactaatttattg

SEQ ID NO: 275039 - DNA, 18 bp, Homo sapiens
atactattggacagacac

SEQ ID NO: 275040 - DNA, 14 bp, Homo sapiens
atactcaagcaggt

SEQ ID NO: 275041 - DNA, 15 bp, Homo sapiens
atactcaccaaaata

SEQ ID NO: 275042 - DNA, 15 bp, Homo sapiens
atactcacctcctcc

SEQ ID NO: 275043 - DNA, 16 bp, Homo sapiens
atactctgcttagaat

SEQ ID NO: 275044 - DNA, 14 bp, Homo sapiens
atactctgtctccc

SEQ ID NO: 275045 - DNA, 18 bp, Homo sapiens
atactctgtgtaatctct

SEQ ID NO: 275046 - DNA, 23 bp, Homo sapiens
atactctgtgtaatctctgatta

SEQ ID NO: 275047 - DNA, 22 bp, Homo sapiens
atactctgttgcctcctctctc

SEQ ID NO: 275048 - DNA, 23 bp, Homo sapiens
atactgaaacatttgacacataa

SEQ ID NO: 275049 - DNA, 14 bp, Homo sapiens
atactgagggacca

SEQ ID NO: 275050 - DNA, 15 bp, Homo sapiens
atactgagtcagttt

SEQ ID NO: 275051 - DNA, 22 bp, Homo sapiens
atactgatgagacaacacacac

SEQ ID NO: 275052 - DNA, 18 bp, Homo sapiens
atactgcactttagtgta

SEQ ID NO: 275053 - DNA, 22 bp, Homo sapiens
atactgcatatcctggtgtcta

SEQ ID NO: 275054 - DNA, 23 bp, Homo sapiens
atactgcttgaccgtactctcac

SEQ ID NO: 275055 - DNA, 20 bp, Homo sapiens
atcacctaattaatttcagt

SEQ ID NO: 275056 - DNA, 13 bp, Homo sapiens
atcacctctctgt

SEQ ID NO: 275057 - DNA, 19 bp, Homo sapiens
atcaccttttctaaaaagt

SEQ ID NO: 275058 - DNA, 20 bp, Homo sapiens
atcaccttttctaaaaagtc

SEQ ID NO: 275059 - DNA, 18 bp, Homo sapiens
atcacctttttgactttt

SEQ ID NO: 275060 - DNA, 20 bp, Homo sapiens
atcacgggcccgctcaacct

SEQ ID NO: 275061 - DNA, 13 bp, Homo sapiens
atcactactgcag

SEQ ID NO: 275062 - DNA, 20 bp, Homo sapiens
atcactataaccatcagtta

SEQ ID NO: 275063 - DNA, 14 bp, Homo sapiens
atcactattcttaa

SEQ ID NO: 275064 - DNA, 12 bp, Homo sapiens
atcactgctccc

SEQ ID NO: 275065 - DNA, 12 bp, Homo sapiens
atcactgtcttt

SEQ ID NO: 275066 - DNA, 16 bp, Homo sapiens
atcactgtctttccta

SEQ ID NO: 275067 - DNA, 21 bp, Homo sapiens
atcactttggtctccattttt

SEQ ID NO: 275068 - DNA, 15 bp, Homo sapiens
atcacttttcagtga

SEQ ID NO: 275069 - DNA, 14 bp, Homo sapiens
atcagaagataact

SEQ ID NO: 275070 - DNA, 17 bp, Homo sapiens
atcagaagcctattgta

SEQ ID NO: 275071 - DNA, 12 bp, Homo sapiens
atcagacacaat

SEQ ID NO: 275072 - DNA, 15 bp, Homo sapiens
atcagacacaattag

SEQ ID NO: 275073 - DNA, 19 bp, Homo sapiens
atcagacacaattagagaa

SEQ ID NO: 275074 - DNA, 13 bp, Homo sapiens
atcagacctctga

SEQ ID NO: 275075 - DNA, 18 bp, Homo sapiens
atcagacctctgatccct

SEQ ID NO: 275076 - DNA, 20 bp, Homo sapiens
atcagacctgggtggaactc

SEQ ID NO: 275077 - DNA, 12 bp, Homo sapiens
atcagacctgtc

SEQ ID NO: 275078 - DNA, 13 bp, Homo sapiens
atcagacctgtct

SEQ ID NO: 275079 - DNA, 16 bp, Homo sapiens
atcagacctgtcttcc

SEQ ID NO: 275080 - DNA, 19 bp, Homo sapiens
atcagagagcaagaaaaaa

SEQ ID NO: 275081 - DNA, 21 bp, Homo sapiens
atcagagctcttaatgttgct

SEQ ID NO: 275082 - DNA, 21 bp, Homo sapiens
atcagatggaaatattttgat

SEQ ID NO: 275083 - DNA, 22 bp, Homo sapiens
atcagatggaaatattttgata

SEQ ID NO: 275084 - DNA, 13 bp, Homo sapiens
atcagattgcttt

SEQ ID NO: 275085 - DNA, 11 bp, Homo sapiens
atcagcagtga

SEQ ID NO: 275086 - DNA, 15 bp, Homo sapiens
atcagcagtgattga

SEQ ID NO: 275087 - DNA, 18 bp, Homo sapiens
atcagcattcaaaatagt

SEQ ID NO: 275088 - DNA, 14 bp, Homo sapiens
atcagcccctgctg

SEQ ID NO: 275089 - DNA, 23 bp, Homo sapiens
atcagccctgcccttcagcatcc

SEQ ID NO: 275090 - DNA, 20 bp, Homo sapiens
atcagcctaggggtcaggga

SEQ ID NO: 275091 - DNA, 20 bp, Homo sapiens
atcagcctccgccattccaa

SEQ ID NO: 275092 - DNA, 14 bp, Homo sapiens
atcagcctctggcc

SEQ ID NO: 275093 - DNA, 12 bp, Homo sapiens
atcagcctgagt

SEQ ID NO: 275094 - DNA, 19 bp, Homo sapiens
atcagcctgagtctcctgt

SEQ ID NO: 275095 - DNA, 17 bp, Homo sapiens
atcagcgtggcagtcac

SEQ ID NO: 275096 - DNA, 23 bp, Homo sapiens
atcagctcccttcccctgcctgg

SEQ ID NO: 275097 - DNA, 16 bp, Homo sapiens
atcagctgtttgtcat

SEQ ID NO: 275098 - DNA, 23 bp, Homo sapiens
atcagcttttaataaaattgaca

SEQ ID NO: 275099 - DNA, 12 bp, Homo sapiens
atcaggatgaac

SEQ ID NO: 275100 - DNA, 13 bp, Homo sapiens
atcaggatgaacc

SEQ ID NO: 275101 - DNA, 13 bp, Homo sapiens
atcaggcactggt

SEQ ID NO: 275102 - DNA, 17 bp, Homo sapiens
atcaggcactggtggca

SEQ ID NO: 275103 - DNA, 18 bp, Homo sapiens
atcagggaatccagctcc

SEQ ID NO: 275104 - DNA, 21 bp, Homo sapiens
atcagggcaatcccaacacat

SEQ ID NO: 275105 - DNA, 18 bp, Homo sapiens
atcaggtaaactgatgct

SEQ ID NO: 275106 - DNA, 21 bp, Homo sapiens
atcaggtcattattttttaca

SEQ ID NO: 275107 - DNA, 18 bp, Homo sapiens
atcagtacaattctttgt

SEQ ID NO: 275108 - DNA, 17 bp, Homo sapiens
atcagtatgaagacact

SEQ ID NO: 275109 - DNA, 22 bp, Homo sapiens
atcagtccacccccattgtgaa

SEQ ID NO: 275110 - DNA, 23 bp, Homo sapiens
atcagtctttgtcaatgctctaa

SEQ ID NO: 275111 - DNA, 14 bp, Homo sapiens
atcagtgaatataa

SEQ ID NO: 275112 - DNA, 16 bp, Homo sapiens
atcagtgaatataaat

SEQ ID NO: 275113 - DNA, 16 bp, Homo sapiens
atcagtgcttaatgtg

SEQ ID NO: 275114 - DNA, 18 bp, Homo sapiens
atcagtgggcaggataaa

SEQ ID NO: 275115 - DNA, 23 bp, Homo sapiens
atcagtggggccccaaagcccag

SEQ ID NO: 275116 - DNA, 20 bp, Homo sapiens
atcagtgtgtctaaatttga

SEQ ID NO: 275117 - DNA, 12 bp, Homo sapiens
atcagtgttaaa

SEQ ID NO: 275118 - DNA, 14 bp, Homo sapiens
atcagtgttaaaaa

SEQ ID NO: 275119 - DNA, 19 bp, Homo sapiens
atcagtgttaaaaaatttt

SEQ ID NO: 275120 - DNA, 14 bp, Homo sapiens
atcagtgttcttct

SEQ ID NO: 275121 - DNA, 18 bp, Homo sapiens
atcagtgtttaaataaag

SEQ ID NO: 275122 - DNA, 14 bp, Homo sapiens
atcagttattcatt

SEQ ID NO: 275123 - DNA, 22 bp, Homo sapiens
atcagttggacagtaagatttt

SEQ ID NO: 275124 - DNA, 14 bp, Homo sapiens
atcagttttcctag

SEQ ID NO: 275125 - DNA, 14 bp, Homo sapiens
atcagttttgtgta

SEQ ID NO: 275126 - DNA, 17 bp, Homo sapiens
atcagttttgtgtacag

SEQ ID NO: 275127 - DNA, 23 bp, Homo sapiens
atcagttttgtgtacagtatgtg

SEQ ID NO: 275128 - DNA, 15 bp, Homo sapiens
atcataaaacttgat

SEQ ID NO: 275129 - DNA, 13 bp, Homo sapiens
atcataatgtaat

SEQ ID NO: 275130 - DNA, 21 bp, Homo sapiens
atcatagaggatgatgtaatt

SEQ ID NO: 275131 - DNA, 13 bp, Homo sapiens
atcatatctgtat

SEQ ID NO: 275132 - DNA, 16 bp, Homo sapiens
atcatatctgtatgcc

SEQ ID NO: 275133 - DNA, 21 bp, Homo sapiens
atcatatgaattagccaaaag

SEQ ID NO: 275134 - DNA, 21 bp, Homo sapiens
atcatatgcctgaccccttgc

SEQ ID NO: 275135 - DNA, 14 bp, Homo sapiens
atcatcaatacttt

SEQ ID NO: 275136 - DNA, 20 bp, Homo sapiens
atcatcaatacttttgtgta

SEQ ID NO: 275137 - DNA, 14 bp, Homo sapiens
atcatctctgcctt

SEQ ID NO: 275138 - DNA, 16 bp, Homo sapiens
atcatctctgcctttg

SEQ ID NO: 275139 - DNA, 19 bp, Homo sapiens
atcatctgtgtgaaaatgg

SEQ ID NO: 275140 - DNA, 13 bp, Homo sapiens
atcatcttctctt

SEQ ID NO: 275141 - DNA, 13 bp, Homo sapiens
atcatctttgctg

SEQ ID NO: 275142 - DNA, 12 bp, Homo sapiens
atcatctttttg

SEQ ID NO: 275143 - DNA, 18 bp, Homo sapiens
atcatgaaatatgcatct

SEQ ID NO: 275144 - DNA, 18 bp, Homo sapiens
atcatgaagccttgctga

SEQ ID NO: 275145 - DNA, 22 bp, Homo sapiens
atcatgaagccttgctgaacta

SEQ ID NO: 275146 - DNA, 12 bp, Homo sapiens
atcatgcattgt

SEQ ID NO: 275147 - DNA, 14 bp, Homo sapiens
atcatgccctgcct

SEQ ID NO: 275148 - DNA, 14 bp, Homo sapiens
atcatgctgttgca

SEQ ID NO: 275149 - DNA, 19 bp, Homo sapiens
atcatggctaagcttaaaa

SEQ ID NO: 275150 - DNA, 22 bp, Homo sapiens
atcatggggtggaataaaggct

SEQ ID NO: 275151 - DNA, 15 bp, Homo sapiens
atcatgtaacattct

SEQ ID NO: 275152 - DNA, 19 bp, Homo sapiens
atcatgtaacattcttcta

SEQ ID NO: 275153 - DNA, 14 bp, Homo sapiens
atcatgtcagagca

SEQ ID NO: 275154 - DNA, 18 bp, Homo sapiens
atcatgtgggtgagccag

SEQ ID NO: 275155 - DNA, 17 bp, Homo sapiens
atcattaaacatgaatt

SEQ ID NO: 275156 - DNA, 21 bp, Homo sapiens
atcattaaacatgaatttaat

SEQ ID NO: 275157 - DNA, 23 bp, Homo sapiens
atcattataaacgtgatgatcag

SEQ ID NO: 275158 - DNA, 12 bp, Homo sapiens
atcattcagcaa

SEQ ID NO: 275159 - DNA, 13 bp, Homo sapiens
atcattcagcaac

SEQ ID NO: 275160 - DNA, 12 bp, Homo sapiens
atcattctacaa

SEQ ID NO: 275161 - DNA, 15 bp, Homo sapiens
atcattctcagtatc

SEQ ID NO: 275162 - DNA, 15 bp, Homo sapiens
atcattctttctgct

SEQ ID NO: 275163 - DNA, 18 bp, Homo sapiens
atcattctttgtatctta

SEQ ID NO: 275164 - DNA, 19 bp, Homo sapiens
atcattctttgtatcttaa

SEQ ID NO: 275165 - DNA, 20 bp, Homo sapiens
atcattgagaaataaagcac

SEQ ID NO: 275166 - DNA, 15 bp, Homo sapiens
atcattgccttgttg

SEQ ID NO: 275167 - DNA, 23 bp, Homo sapiens
atcattgctgctgtagcaacaga

SEQ ID NO: 275168 - DNA, 18 bp, Homo sapiens
atcattgctttgaagcag

SEQ ID NO: 275169 - DNA, 17 bp, Homo sapiens
atcattggaatacagga

SEQ ID NO: 275170 - DNA, 18 bp, Homo sapiens
atcattggaatacaggaa

SEQ ID NO: 275171 - DNA, 21 bp, Homo sapiens
atcatttattttaagcactct

SEQ ID NO: 275172 - DNA, 19 bp, Homo sapiens
atcatttattttttacatt

SEQ ID NO: 275173 - DNA, 23 bp, Homo sapiens
atcatttctgtctttaagaacta

SEQ ID NO: 275174 - DNA, 15 bp, Homo sapiens
atcatttcttgggcc

SEQ ID NO: 275175 - DNA, 19 bp, Homo sapiens
atcatttcttgggccctcc

SEQ ID NO: 275176 - DNA, 14 bp, Homo sapiens
atcattttattcac

SEQ ID NO: 275177 - DNA, 13 bp, Homo sapiens
atcattttccccc

SEQ ID NO: 275178 - DNA, 14 bp, Homo sapiens
atcattttcccccc

SEQ ID NO: 275179 - DNA, 15 bp, Homo sapiens
atcattttcccccca

SEQ ID NO: 275180 - DNA, 17 bp, Homo sapiens
atcattttccccccact

SEQ ID NO: 275181 - DNA, 17 bp, Homo sapiens
atccaaactactttctt

SEQ ID NO: 275182 - DNA, 16 bp, Homo sapiens
atccaaagactgtact

SEQ ID NO: 275183 - DNA, 18 bp, Homo sapiens
atccaaagactgtactgg

SEQ ID NO: 275184 - DNA, 17 bp, Homo sapiens
atccaaagcattgcaga

SEQ ID NO: 275185 - DNA, 15 bp, Homo sapiens
atcgaggaaccagag

SEQ ID NO: 275186 - DNA, 21 bp, Homo sapiens
atcgagtgagacaaaatttta

SEQ ID NO: 275187 - DNA, 20 bp, Homo sapiens
atcgatgggggatgcttcat

SEQ ID NO: 275188 - DNA, 21 bp, Homo sapiens
atcgatgggggatgcttcatg

SEQ ID NO: 275189 - DNA, 18 bp, Homo sapiens
atcgcaccttttatacca

SEQ ID NO: 275190 - DNA, 22 bp, Homo sapiens
atcgcaggagtctctgccaccc

SEQ ID NO: 275191 - DNA, 22 bp, Homo sapiens
atcgcatcattgcactctagcc

SEQ ID NO: 275192 - DNA, 15 bp, Homo sapiens
atcgccttatgagaa

SEQ ID NO: 275193 - DNA, 16 bp, Homo sapiens
atcgcttctttttcaa

SEQ ID NO: 275194 - DNA, 14 bp, Homo sapiens
atcggaagcagtgc

SEQ ID NO: 275195 - DNA, 18 bp, Homo sapiens
atcggaagcagtgccttc

SEQ ID NO: 275196 - DNA, 18 bp, Homo sapiens
atcggaggcttgtcagag

SEQ ID NO: 275197 - DNA, 20 bp, Homo sapiens
atcggaggcttgtcagagct

SEQ ID NO: 275198 - DNA, 21 bp, Homo sapiens
atcggatctggggctctggga

SEQ ID NO: 275199 - DNA, 21 bp, Homo sapiens
atcggcctcctcttcaccccg

SEQ ID NO: 275200 - DNA, 16 bp, Homo sapiens
atcgggaacagtgttt

SEQ ID NO: 275201 - DNA, 16 bp, Homo sapiens
atcggggtagaaatgc

SEQ ID NO: 275202 - DNA, 14 bp, Homo sapiens
atcggggtggcaga

SEQ ID NO: 275203 - DNA, 19 bp, Homo sapiens
atcggtgaaactaacagat

SEQ ID NO: 275204 - DNA, 19 bp, Homo sapiens
atcggtgcagcggtggaag

SEQ ID NO: 275205 - DNA, 15 bp, Homo sapiens
atcggtgtccattta

SEQ ID NO: 275206 - DNA, 17 bp, Homo sapiens
atcggtgtccatttata

SEQ ID NO: 275207 - DNA, 22 bp, Homo sapiens
atcgtataaggaaatccagccc

SEQ ID NO: 275208 - DNA, 14 bp, Homo sapiens
atcgtgacagcagc

SEQ ID NO: 275209 - DNA, 12 bp, Homo sapiens
atcgtgctaaat

SEQ ID NO: 275210 - DNA, 16 bp, Homo sapiens
atcgtgctaaattttc

SEQ ID NO: 275211 - DNA, 22 bp, Homo sapiens
atcgttagtatctaacatgtat

SEQ ID NO: 275212 - DNA, 23 bp, Homo sapiens
atcgttcctatacatttctgttc

SEQ ID NO: 275213 - DNA, 18 bp, Homo sapiens
atcgttttctttgctgtg

SEQ ID NO: 275214 - DNA, 14 bp, Homo sapiens
atctaaaaaataac

SEQ ID NO: 275215 - DNA, 20 bp, Homo sapiens
atctaaaacaaaatctgaac

SEQ ID NO: 275216 - DNA, 21 bp, Homo sapiens
atctaaaacaaaatctgaact

SEQ ID NO: 275217 - DNA, 17 bp, Homo sapiens
atctaaagtgtgttgtt

SEQ ID NO: 275218 - DNA, 17 bp, Homo sapiens
atgaccatactgaggga

SEQ ID NO: 275219 - DNA, 19 bp, Homo sapiens
atgacccggggcagctggc

SEQ ID NO: 275220 - DNA, 14 bp, Homo sapiens
atgacctaaatcca

SEQ ID NO: 275221 - DNA, 21 bp, Homo sapiens
atgacctaaatccattttcta

SEQ ID NO: 275222 - DNA, 14 bp, Homo sapiens
atgacgcggctcaa

SEQ ID NO: 275223 - DNA, 11 bp, Homo sapiens
atgactaaaga

SEQ ID NO: 275224 - DNA, 14 bp, Homo sapiens
atgactaaagagag

SEQ ID NO: 275225 - DNA, 16 bp, Homo sapiens
atgactaaagagagaa

SEQ ID NO: 275226 - DNA, 17 bp, Homo sapiens
atgactaaagagagaat

SEQ ID NO: 275227 - DNA, 23 bp, Homo sapiens
atgactaaagagagaatgtagat

SEQ ID NO: 275228 - DNA, 20 bp, Homo sapiens
atgactagaaagtgaataaa

SEQ ID NO: 275229 - DNA, 15 bp, Homo sapiens
atgactataaacatt

SEQ ID NO: 275230 - DNA, 22 bp, Homo sapiens
atgactcccttaaaatagaaat

SEQ ID NO: 275231 - DNA, 22 bp, Homo sapiens
atgactgcacccagctccaggg

SEQ ID NO: 275232 - DNA, 23 bp, Homo sapiens
atgactgcacccagctccagggg

SEQ ID NO: 275233 - DNA, 13 bp, Homo sapiens
atgactgcatttt

SEQ ID NO: 275234 - DNA, 19 bp, Homo sapiens
atgactgccccttgcttct

SEQ ID NO: 275235 - DNA, 17 bp, Homo sapiens
atgcctacagataattt

SEQ ID NO: 275236 - DNA, 22 bp, Homo sapiens
atgcctaccgggttctcctgat

SEQ ID NO: 275237 - DNA, 14 bp, Homo sapiens
atgcctatttactg

SEQ ID NO: 275238 - DNA, 21 bp, Homo sapiens
atgcctcagcccaggtcagct

SEQ ID NO: 275239 - DNA, 16 bp, Homo sapiens
atgcctcattttattc

SEQ ID NO: 275240 - DNA, 22 bp, Homo sapiens
atgcctccctatccctcacaca

SEQ ID NO: 275241 - DNA, 14 bp, Homo sapiens
atgcctccctgacc

SEQ ID NO: 275242 - DNA, 18 bp, Homo sapiens
atgcctccctgaccctgc

SEQ ID NO: 275243 - DNA, 20 bp, Homo sapiens
atgcctgaccccttgctccc

SEQ ID NO: 275244 - DNA, 20 bp, Homo sapiens
atgcctggcccccctccagg

SEQ ID NO: 275245 - DNA, 21 bp, Homo sapiens
atgcctggcccccctccaggc

SEQ ID NO: 275246 - DNA, 17 bp, Homo sapiens
atgcctgtatttccaac

SEQ ID NO: 275247 - DNA, 19 bp, Homo sapiens
atgcctgtatttccaacaa

SEQ ID NO: 275248 - DNA, 13 bp, Homo sapiens
atgcctgtctctg

SEQ ID NO: 275249 - DNA, 12 bp, Homo sapiens
atgcctgtgcca

SEQ ID NO: 275250 - DNA, 21 bp, Homo sapiens
atgcctgtggtgaagtgtggc

SEQ ID NO: 275251 - DNA, 19 bp, Homo sapiens
atgcctttctagcaattgc

SEQ ID NO: 275252 - DNA, 22 bp, Homo sapiens
atgcctttctagtcctattcta

SEQ ID NO: 275253 - DNA, 13 bp, Homo sapiens
atgcctttgctgt

SEQ ID NO: 275254 - DNA, 17 bp, Homo sapiens
atgcctttgctgtttag

SEQ ID NO: 275255 - DNA, 16 bp, Homo sapiens
atgcgccctggtatgt

SEQ ID NO: 275256 - DNA, 21 bp, Homo sapiens
atgcgccctggtatgtgcctg

SEQ ID NO: 275257 - DNA, 20 bp, Homo sapiens
atgcgccttgctgatggctt

SEQ ID NO: 275258 - DNA, 15 bp, Homo sapiens
atgcgggcattttga

SEQ ID NO: 275259 - DNA, 12 bp, Homo sapiens
atgctaaatgtt

SEQ ID NO: 275260 - DNA, 13 bp, Homo sapiens
atgctaaatgtta

SEQ ID NO: 275261 - DNA, 15 bp, Homo sapiens
atgctaacaaactga

SEQ ID NO: 275262 - DNA, 13 bp, Homo sapiens
atgctaatgtaat

SEQ ID NO: 275263 - DNA, 19 bp, Homo sapiens
atgctagaaaaatgttctt

SEQ ID NO: 275264 - DNA, 22 bp, Homo sapiens
atgctagaaaatcgagttggca

SEQ ID NO: 275265 - DNA, 22 bp, Homo sapiens
atgctagcacaatattcctatg

SEQ ID NO: 275266 - DNA, 12 bp, Homo sapiens
atgctagtttat

SEQ ID NO: 275267 - DNA, 21 bp, Homo sapiens
atgctatctcgctagccatat

SEQ ID NO: 275268 - DNA, 13 bp, Homo sapiens
atgctatggactg

SEQ ID NO: 275269 - DNA, 17 bp, Homo sapiens
atgctatggactgcaca

SEQ ID NO: 275270 - DNA, 21 bp, Homo sapiens
atgctcaacccccctcccaga

SEQ ID NO: 275271 - DNA, 23 bp, Homo sapiens
atgctcaacccccctcccagaca

SEQ ID NO: 275272 - DNA, 13 bp, Homo sapiens
atgctcaatgtgc

SEQ ID NO: 275273 - DNA, 13 bp, Homo sapiens
atgctcacactcc

SEQ ID NO: 275274 - DNA, 16 bp, Homo sapiens
atgctcacgctcccaa

SEQ ID NO: 275275 - DNA, 13 bp, Homo sapiens
atgctcactgctt

SEQ ID NO: 275276 - DNA, 15 bp, Homo sapiens
atgctcactgcttct

SEQ ID NO: 275277 - DNA, 13 bp, Homo sapiens
atgctcagtattg

SEQ ID NO: 275278 - DNA, 19 bp, Homo sapiens
atgctcattcatattcctg

SEQ ID NO: 275279 - DNA, 18 bp, Homo sapiens
atgctccagccaacccct

SEQ ID NO: 275280 - DNA, 21 bp, Homo sapiens
atgctccagccaacccctgtg

SEQ ID NO: 275281 - DNA, 18 bp, Homo sapiens
atgctcccccatcctccc

SEQ ID NO: 275282 - DNA, 20 bp, Homo sapiens
atgctcccccatcctcccct

SEQ ID NO: 275283 - DNA, 21 bp, Homo sapiens
atgctcccccatcctcccctt

SEQ ID NO: 275284 - DNA, 23 bp, Homo sapiens
atgctcccccatcctccccttcc

SEQ ID NO: 275285 - DNA, 14 bp, Homo sapiens
atgctccctcccct

SEQ ID NO: 275286 - DNA, 15 bp, Homo sapiens
atgctctacttcttt

SEQ ID NO: 275287 - DNA, 18 bp, Homo sapiens
atgctctcaatatataat

SEQ ID NO: 275288 - DNA, 21 bp, Homo sapiens
atgctctgccccaagccccca

SEQ ID NO: 275289 - DNA, 16 bp, Homo sapiens
atgctgaaacaggaga

SEQ ID NO: 275290 - DNA, 18 bp, Homo sapiens
atgctgaaacaggagaga

SEQ ID NO: 275291 - DNA, 22 bp, Homo sapiens
atgctgaatatctgttcacttt

SEQ ID NO: 275292 - DNA, 21 bp, Homo sapiens
atgctgactgtactcctccca

SEQ ID NO: 275293 - DNA, 22 bp, Homo sapiens
atgctgagtatgttaagctctt

SEQ ID NO: 275294 - DNA, 22 bp, Homo sapiens
atgctgatgatcaaaacctgtg

SEQ ID NO: 275295 - DNA, 14 bp, Homo sapiens
atgctgccaaattt

SEQ ID NO: 275296 - DNA, 21 bp, Homo sapiens
atgctgcccagggtcagtgta

SEQ ID NO: 275297 - DNA, 24 bp, Homo sapiens
atgctgccccgttccctgtcagag

SEQ ID NO: 275298 - DNA, 15 bp, Homo sapiens
atgctgcctgcctcc

SEQ ID NO: 275299 - DNA, 22 bp, Homo sapiens
atgctgcctgcctccggccctg

SEQ ID NO: 275300 - DNA, 23 bp, Homo sapiens
atgctgcctgcctccggccctgc

SEQ ID NO: 275301 - DNA, 12 bp, Homo sapiens
atgctgccttca

SEQ ID NO: 275302 - DNA, 22 bp, Homo sapiens
atgctgccttcccatgaatctg

SEQ ID NO: 275303 - DNA, 18 bp, Homo sapiens
atgctgcgcccttcccca

SEQ ID NO: 275304 - DNA, 17 bp, Homo sapiens
atgctgctatgaagact

SEQ ID NO: 275305 - DNA, 13 bp, Homo sapiens
atgctgctggaca

SEQ ID NO: 275306 - DNA, 19 bp, Homo sapiens
atgctgctttaattgtgaa

SEQ ID NO: 275307 - DNA, 15 bp, Homo sapiens
atgctggagaggtta

SEQ ID NO: 275308 - DNA, 23 bp, Homo sapiens
atgctggcctcccaataaagctg

SEQ ID NO: 275309 - DNA, 21 bp, Homo sapiens
atgctggttttcctaaatgca

SEQ ID NO: 275310 - DNA, 22 bp, Homo sapiens
atgctggttttcctaaatgcag

SEQ ID NO: 275311 - DNA, 19 bp, Homo sapiens
atgctgtatatcctttcta

SEQ ID NO: 275312 - DNA, 19 bp, Homo sapiens
atgctgtcccttacgtgag

SEQ ID NO: 275313 - DNA, 12 bp, Homo sapiens
atgctgtgcaaa

SEQ ID NO: 275314 - DNA, 18 bp, Homo sapiens
atgctgtgctatgaattt

SEQ ID NO: 275315 - DNA, 14 bp, Homo sapiens
atgctgtgctcttt

SEQ ID NO: 275316 - DNA, 15 bp, Homo sapiens
atgctgtgctctttg

SEQ ID NO: 275317 - DNA, 16 bp, Homo sapiens
atgctgtgctctttga

SEQ ID NO: 275318 - DNA, 14 bp, Homo sapiens
atgctgtgtaagct

SEQ ID NO: 275319 - DNA, 15 bp, Homo sapiens
atgctgttggcctca

SEQ ID NO: 275320 - DNA, 16 bp, Homo sapiens
atgcttaatttctaaa

SEQ ID NO: 275321 - DNA, 16 bp, Homo sapiens
atgcttataagcaaca

SEQ ID NO: 275322 - DNA, 19 bp, Homo sapiens
atgcttcaagtgttgctct

SEQ ID NO: 275323 - DNA, 18 bp, Homo sapiens
atgcttcagttgtacttc

SEQ ID NO: 275324 - DNA, 21 bp, Homo sapiens
atgcttcatgaaaatcctacc

SEQ ID NO: 275325 - DNA, 12 bp, Homo sapiens
atgcttcatgtg

SEQ ID NO: 275326 - DNA, 20 bp, Homo sapiens
atgcttctagaaagcccctc

SEQ ID NO: 275327 - DNA, 15 bp, Homo sapiens
atgcttctgctcaca

SEQ ID NO: 275328 - DNA, 19 bp, Homo sapiens
atgcttctgctcacattcc

SEQ ID NO: 275329 - DNA, 23 bp, Homo sapiens
atgcttctgctcacattccctct

SEQ ID NO: 275330 - DNA, 17 bp, Homo sapiens
atgcttgccaagaaatc

SEQ ID NO: 275331 - DNA, 11 bp, Homo sapiens
atgcttgccta

SEQ ID NO: 275332 - DNA, 16 bp, Homo sapiens
atgcttgcctagggcc

SEQ ID NO: 275333 - DNA, 18 bp, Homo sapiens
atgcttgtaacaagaaaa

SEQ ID NO: 275334 - DNA, 13 bp, Homo sapiens
atgctttctcctt

SEQ ID NO: 275335 - DNA, 22 bp, Homo sapiens
atgctttctgaactcgcttctc

SEQ ID NO: 275336 - DNA, 20 bp, Homo sapiens
atgctttgggaggccaaggc

SEQ ID NO: 275337 - DNA, 21 bp, Homo sapiens
atgctttgggaggccaaggca

SEQ ID NO: 275338 - DNA, 22 bp, Homo sapiens
atgctttgtgtgattgaatctg

SEQ ID NO: 275339 - DNA, 15 bp, Homo sapiens
atgcttttactaagc

SEQ ID NO: 275340 - DNA, 13 bp, Homo sapiens
atgcttttctcat

SEQ ID NO: 275341 - DNA, 13 bp, Homo sapiens
atgcttttgtcta

SEQ ID NO: 275342 - DNA, 16 bp, Homo sapiens
atgctttttgaatgtt

SEQ ID NO: 275343 - DNA, 15 bp, Homo sapiens
atggaaaaaaaaatc

SEQ ID NO: 275344 - DNA, 12 bp, Homo sapiens
atggaaaaggaa

SEQ ID NO: 275345 - DNA, 14 bp, Homo sapiens
atggaaaaggaaga

SEQ ID NO: 275346 - DNA, 16 bp, Homo sapiens
atggaaacctgaaaaa

SEQ ID NO: 275347 - DNA, 22 bp, Homo sapiens
atggaaagaaaagaatgtacat

SEQ ID NO: 275348 - DNA, 11 bp, Homo sapiens
atggaaagaat

SEQ ID NO: 275349 - DNA, 15 bp, Homo sapiens
atggaaagggtgtgg

SEQ ID NO: 275350 - DNA, 18 bp, Homo sapiens
atggaaaggtcctgtggg

SEQ ID NO: 275351 - DNA, 15 bp, Homo sapiens
atggaacatatgcac

SEQ ID NO: 275352 - DNA, 18 bp, Homo sapiens
atggaacctgacgtagct

SEQ ID NO: 275353 - DNA, 19 bp, Homo sapiens
atggaacttctaatatatt

SEQ ID NO: 275354 - DNA, 23 bp, Homo sapiens
atggaagctggcaggagacactg

SEQ ID NO: 275355 - DNA, 15 bp, Homo sapiens
atggaaggaagaaaa

SEQ ID NO: 275356 - DNA, 12 bp, Homo sapiens
atggaaggagag

SEQ ID NO: 275357 - DNA, 19 bp, Homo sapiens
atggaagggccttctccac

SEQ ID NO: 275358 - DNA, 21 bp, Homo sapiens
atgggctagtgtgagtggcag

SEQ ID NO: 275359 - DNA, 22 bp, Homo sapiens
atgggcttggacttcctggggc

SEQ ID NO: 275360 - DNA, 23 bp, Homo sapiens
atgggcttgttttcttgccaatg

SEQ ID NO: 275361 - DNA, 15 bp, Homo sapiens
atgggctttctcttt

SEQ ID NO: 275362 - DNA, 14 bp, Homo sapiens
atggggacctgggg

SEQ ID NO: 275363 - DNA, 16 bp, Homo sapiens
atggggagaggaactc

SEQ ID NO: 275364 - DNA, 23 bp, Homo sapiens
atggggagatcggggccagaggc

SEQ ID NO: 275365 - DNA, 13 bp, Homo sapiens
atggggccacagc

SEQ ID NO: 275366 - DNA, 15 bp, Homo sapiens
atgggggaggctctg

SEQ ID NO: 275367 - DNA, 14 bp, Homo sapiens
atgggggatgcttc

SEQ ID NO: 275368 - DNA, 16 bp, Homo sapiens
atgggggatgcttcat

SEQ ID NO: 275369 - DNA, 21 bp, Homo sapiens
atgggggcggctggaaagagg

SEQ ID NO: 275370 - DNA, 15 bp, Homo sapiens
atggggtgggcctct

SEQ ID NO: 275371 - DNA, 21 bp, Homo sapiens
atggggttggctgggcccaga

SEQ ID NO: 275372 - DNA, 14 bp, Homo sapiens
atggggttgggctc

SEQ ID NO: 275373 - DNA, 16 bp, Homo sapiens
atggggttgggctctg

SEQ ID NO: 275374 - DNA, 17 bp, Homo sapiens
atggggttgggctctgc

SEQ ID NO: 275375 - DNA, 24 bp, Homo sapiens
atggggttgggctctgcgtcccac

SEQ ID NO: 275376 - DNA, 15 bp, Homo sapiens
atgggtagcttctga

SEQ ID NO: 275377 - DNA, 16 bp, Homo sapiens
atgggtatcaaacagc

SEQ ID NO: 275378 - DNA, 20 bp, Homo sapiens
atgggtatgtgttgccaaag

SEQ ID NO: 275379 - DNA, 14 bp, Homo sapiens
atgggtattaaact

SEQ ID NO: 275380 - DNA, 12 bp, Homo sapiens
atgggtcacagg

SEQ ID NO: 275381 - DNA, 20 bp, Homo sapiens
atgggtcccgggttagcctg

SEQ ID NO: 275382 - DNA, 14 bp, Homo sapiens
atgggttgcatttg

SEQ ID NO: 275383 - DNA, 20 bp, Homo sapiens
atggtaatttatagtttata

SEQ ID NO: 275384 - DNA, 23 bp, Homo sapiens
atggtagaaattttatctcttct

SEQ ID NO: 275385 - DNA, 19 bp, Homo sapiens
atggtaggaagaagctctc

SEQ ID NO: 275386 - DNA, 20 bp, Homo sapiens
atggtataaggaaatatcat

SEQ ID NO: 275387 - DNA, 20 bp, Homo sapiens
atggtcagctcccttctctg

SEQ ID NO: 275388 - DNA, 18 bp, Homo sapiens
atggtccatttcatgtga

SEQ ID NO: 275389 - DNA, 14 bp, Homo sapiens
atggtctcagaaac

SEQ ID NO: 275390 - DNA, 18 bp, Homo sapiens
atggtctcagaaaccaaa

SEQ ID NO: 275391 - DNA, 14 bp, Homo sapiens
atggtctcttccag

SEQ ID NO: 275392 - DNA, 12 bp, Homo sapiens
atggtgaaaatg

SEQ ID NO: 275393 - DNA, 16 bp, Homo sapiens
atggtgaaaatgtact

SEQ ID NO: 275394 - DNA, 17 bp, Homo sapiens
atggtgaaatttattag

SEQ ID NO: 275395 - DNA, 16 bp, Homo sapiens
atggtgaactgtcatt

SEQ ID NO: 275396 - DNA, 16 bp, Homo sapiens
atggtgaatattacat

SEQ ID NO: 275397 - DNA, 17 bp, Homo sapiens
atggtgagaattaaaat

SEQ ID NO: 275398 - DNA, 19 bp, Homo sapiens
atggtgagaattaaaataa

SEQ ID NO: 275399 - DNA, 13 bp, Homo sapiens
atggtgagctggg

SEQ ID NO: 275400 - DNA, 18 bp, Homo sapiens
atggtgagtgatttttat

SEQ ID NO: 275401 - DNA, 17 bp, Homo sapiens
atggtgatcctctattt

SEQ ID NO: 275402 - DNA, 19 bp, Homo sapiens
atggtgatcctctattttg

SEQ ID NO: 275403 - DNA, 14 bp, Homo sapiens
atggtgatgcaagt

SEQ ID NO: 275404 - DNA, 15 bp, Homo sapiens
atggtgcaatgaatt

SEQ ID NO: 275405 - DNA, 12 bp, Homo sapiens
atggtgcctctg

SEQ ID NO: 275406 - DNA, 16 bp, Homo sapiens
atggtgctgagaagct

SEQ ID NO: 275407 - DNA, 16 bp, Homo sapiens
atggtggccctgggga

SEQ ID NO: 275408 - DNA, 22 bp, Homo sapiens
atggtggcgctttctcctgtgc

SEQ ID NO: 275409 - DNA, 15 bp, Homo sapiens
atggtgggctccaga

SEQ ID NO: 275410 - DNA, 16 bp, Homo sapiens
atggtgggctccagag

SEQ ID NO: 275411 - DNA, 19 bp, Homo sapiens
atggtgggctccagagtag

SEQ ID NO: 275412 - DNA, 14 bp, Homo sapiens
atggtggtttcaga

SEQ ID NO: 275413 - DNA, 19 bp, Homo sapiens
atggtggtttcagaaaggg

SEQ ID NO: 275414 - DNA, 21 bp, Homo sapiens
atggtggtttcagaaagggca

SEQ ID NO: 275415 - DNA, 16 bp, Homo sapiens
atggtgtgtgtctctg

SEQ ID NO: 275416 - DNA, 21 bp, Homo sapiens
atggtgttttcatgtaaataa

SEQ ID NO: 275417 - DNA, 19 bp, Homo sapiens
atggttaataaaactgcac

SEQ ID NO: 275418 - DNA, 21 bp, Homo sapiens
atggttaataaaactgcacag

SEQ ID NO: 275419 - DNA, 21 bp, Homo sapiens
atggttacctctgcataaata

SEQ ID NO: 275420 - DNA, 18 bp, Homo sapiens
atggttccatgcctgagg

SEQ ID NO: 275421 - DNA, 16 bp, Homo sapiens
atggttcccaataaaa

SEQ ID NO: 275422 - DNA, 18 bp, Homo sapiens
atggttccttccctggga

SEQ ID NO: 275423 - DNA, 18 bp, Homo sapiens
atggttgcacgttaaaaa

SEQ ID NO: 275424 - DNA, 18 bp, Homo sapiens
atggttgccttaaagaaa

SEQ ID NO: 275425 - DNA, 18 bp, Homo sapiens
atggttgggacaatggca

SEQ ID NO: 275426 - DNA, 12 bp, Homo sapiens
atggtttactgc

SEQ ID NO: 275427 - DNA, 16 bp, Homo sapiens
atggtttactgctgtc

SEQ ID NO: 275428 - DNA, 19 bp, Homo sapiens
atggtttactgctgtcatt

SEQ ID NO: 275429 - DNA, 12 bp, Homo sapiens
atggtttggttt

SEQ ID NO: 275430 - DNA, 14 bp, Homo sapiens
atgtaaaaatgaag

SEQ ID NO: 275431 - DNA, 11 bp, Homo sapiens
atgtaaaacaa

SEQ ID NO: 275432 - DNA, 14 bp, Homo sapiens
atgtaaaacaaaaa

SEQ ID NO: 275433 - DNA, 15 bp, Homo sapiens
atgtaaaacaaaaaa

SEQ ID NO: 275434 - DNA, 13 bp, Homo sapiens
atgtaaaacacat

SEQ ID NO: 275435 - DNA, 23 bp, Homo sapiens
atgtaaaacacatacaaaagaat

SEQ ID NO: 275436 - DNA, 13 bp, Homo sapiens
atgtaaaacagaa

SEQ ID NO: 275437 - DNA, 16 bp, Homo sapiens
atgtaaaatcttcagc

SEQ ID NO: 275438 - DNA, 19 bp, Homo sapiens
atgtaaaatcttcagctgg

SEQ ID NO: 275439 - DNA, 16 bp, Homo sapiens
atgtaaaatcttgtca

SEQ ID NO: 275440 - DNA, 22 bp, Homo sapiens
atgtaaaatcttgtcatgtgta

SEQ ID NO: 275441 - DNA, 18 bp, Homo sapiens
atgtaaactcttcacctt

SEQ ID NO: 275442 - DNA, 19 bp, Homo sapiens
atgtaaactcttcaccttg

SEQ ID NO: 275443 - DNA, 17 bp, Homo sapiens
atgtaaatagtgcagaa

SEQ ID NO: 275444 - DNA, 18 bp, Homo sapiens
atgtaaattattgtaaac

SEQ ID NO: 275445 - DNA, 20 bp, Homo sapiens
atgtaaattattgtaaactt

SEQ ID NO: 275446 - DNA, 21 bp, Homo sapiens
atgtaaattattgtaaacttt

SEQ ID NO: 275447 - DNA, 21 bp, Homo sapiens
atgtaaatttataaatatatt

SEQ ID NO: 275448 - DNA, 12 bp, Homo sapiens
atgtaaatttgt

SEQ ID NO: 275449 - DNA, 15 bp, Homo sapiens
atgtaaatttgtact

SEQ ID NO: 275450 - DNA, 19 bp, Homo sapiens
atgtaaatttgtactattt

SEQ ID NO: 275451 - DNA, 22 bp, Homo sapiens
atgtaacagttggtgattttag

SEQ ID NO: 275452 - DNA, 13 bp, Homo sapiens
atgtaaccaagct

SEQ ID NO: 275453 - DNA, 22 bp, Homo sapiens
atgtaacttaattataagctat

SEQ ID NO: 275454 - DNA, 16 bp, Homo sapiens
atgtaagaaaacaaaa

SEQ ID NO: 275455 - DNA, 20 bp, Homo sapiens
atgtaagaatccaaagtgga

SEQ ID NO: 275456 - DNA, 20 bp, Homo sapiens
atgtaaggaatgcttggaat

SEQ ID NO: 275457 - DNA, 16 bp, Homo sapiens
atgtaatattaaattc

SEQ ID NO: 275458 - DNA, 17 bp, Homo sapiens
atgtaatcatttatctt

SEQ ID NO: 275459 - DNA, 17 bp, Homo sapiens
atgtaatgacagagagt

SEQ ID NO: 275460 - DNA, 15 bp, Homo sapiens
atgtacaaggtatgt

SEQ ID NO: 275461 - DNA, 16 bp, Homo sapiens
atgtacaagttttgta

SEQ ID NO: 275462 - DNA, 21 bp, Homo sapiens
atgtacaagttttgtataaat

SEQ ID NO: 275463 - DNA, 13 bp, Homo sapiens
atgtacagagtgg

SEQ ID NO: 275464 - DNA, 16 bp, Homo sapiens
atgtacagtctgtcat

SEQ ID NO: 275465 - DNA, 11 bp, Homo sapiens
atgtacattac

SEQ ID NO: 275466 - DNA, 18 bp, Homo sapiens
atgtaccagtgtactgct

SEQ ID NO: 275467 - DNA, 22 bp, Homo sapiens
atgtaccagtgtactgctttca

SEQ ID NO: 275468 - DNA, 13 bp, Homo sapiens
atgtaccatcaat

SEQ ID NO: 275469 - DNA, 21 bp, Homo sapiens
atgtaccatgtacatgaagaa

SEQ ID NO: 275470 - DNA, 23 bp, Homo sapiens
atgtataaatgtaaaaatgaagg

SEQ ID NO: 275471 - DNA, 23 bp, Homo sapiens
atgtataacaagccaaacattct

SEQ ID NO: 275472 - DNA, 19 bp, Homo sapiens
atgtatagtgagtgtggct

SEQ ID NO: 275473 - DNA, 15 bp, Homo sapiens
atgtatatctttgca

SEQ ID NO: 275474 - DNA, 19 bp, Homo sapiens
atgtatatctttgcactga

SEQ ID NO: 275475 - DNA, 18 bp, Homo sapiens
atgtatatgttatttttg

SEQ ID NO: 275476 - DNA, 21 bp, Homo sapiens
atgtatcaggaaatatatatg

SEQ ID NO: 275477 - DNA, 22 bp, Homo sapiens
atgtatcctgataaacattaaa

SEQ ID NO: 275478 - DNA, 14 bp, Homo sapiens
atgtatctagtggt

SEQ ID NO: 275479 - DNA, 13 bp, Homo sapiens
atgtatcttattt

SEQ ID NO: 275480 - DNA, 21 bp, Homo sapiens
atgtatcttatttatatatga

SEQ ID NO: 275481 - DNA, 13 bp, Homo sapiens
atgtatgaaggct

SEQ ID NO: 275482 - DNA, 13 bp, Homo sapiens
atgtatgtaaaaa

SEQ ID NO: 275483 - DNA, 17 bp, Homo sapiens
atgtatgtgaaagtgta

SEQ ID NO: 275484 - DNA, 23 bp, Homo sapiens
atgtatgtgaaagtgtaaaatag

SEQ ID NO: 275485 - DNA, 20 bp, Homo sapiens
atgtatgtgcactgtcactt

SEQ ID NO: 275486 - DNA, 17 bp, Homo sapiens
atgtatgtgccaatttt

SEQ ID NO: 275487 - DNA, 15 bp, Homo sapiens
atgtatgtggaagca

SEQ ID NO: 275488 - DNA, 17 bp, Homo sapiens
atgtatgtggatacagt

SEQ ID NO: 275489 - DNA, 21 bp, Homo sapiens
atgtatgtggatacagtcatt

SEQ ID NO: 275490 - DNA, 18 bp, Homo sapiens
atgtatgtttacatatca

SEQ ID NO: 275491 - DNA, 12 bp, Homo sapiens
atgtattatgca

SEQ ID NO: 275492 - DNA, 14 bp, Homo sapiens
atgtattcaaatac

SEQ ID NO: 275493 - DNA, 13 bp, Homo sapiens
atgtattcaagca

SEQ ID NO: 275494 - DNA, 18 bp, Homo sapiens
atgtattcaagcaaacat

SEQ ID NO: 275495 - DNA, 20 bp, Homo sapiens
atgtattcaagcaaacatca

SEQ ID NO: 275496 - DNA, 21 bp, Homo sapiens
atgtattcaagcaaacatcaa

SEQ ID NO: 275497 - DNA, 15 bp, Homo sapiens
atgtattcagagcca

SEQ ID NO: 275498 - DNA, 14 bp, Homo sapiens
atgtattggcattt

SEQ ID NO: 275499 - DNA, 17 bp, Homo sapiens
atgtattggcatttatt

SEQ ID NO: 275500 - DNA, 16 bp, Homo sapiens
atgtattggcctggag

SEQ ID NO: 275501 - DNA, 11 bp, Homo sapiens
atgtattgtaa

SEQ ID NO: 275502 - DNA, 20 bp, Homo sapiens
atgtattgtaaacatgtgtt

SEQ ID NO: 275503 - DNA, 15 bp, Homo sapiens
atgtattttcaataa

SEQ ID NO: 275504 - DNA, 19 bp, Homo sapiens
atgtattttgaaaacactt

SEQ ID NO: 275505 - DNA, 20 bp, Homo sapiens
atgtattttgaaaacactta

SEQ ID NO: 275506 - DNA, 22 bp, Homo sapiens
atgtcaaagtgaaagacatttc

SEQ ID NO: 275507 - DNA, 17 bp, Homo sapiens
atgtcaaataaagcaaa

SEQ ID NO: 275508 - DNA, 17 bp, Homo sapiens
atgtcaacttctggctc

SEQ ID NO: 275509 - DNA, 18 bp, Homo sapiens
atgtcaacttctggctcc

SEQ ID NO: 275510 - DNA, 19 bp, Homo sapiens
atgtcaacttctggctcct

SEQ ID NO: 275511 - DNA, 16 bp, Homo sapiens
atgtcaactttatgca

SEQ ID NO: 275512 - DNA, 17 bp, Homo sapiens
atgtcaatgctatggac

SEQ ID NO: 275513 - DNA, 18 bp, Homo sapiens
atgtcacaaattgatcaa

SEQ ID NO: 275514 - DNA, 14 bp, Homo sapiens
atgtcacaacctct

SEQ ID NO: 275515 - DNA, 16 bp, Homo sapiens
atgtcactgtggtcct

SEQ ID NO: 275516 - DNA, 19 bp, Homo sapiens
atgtcagccgagccgggcc

SEQ ID NO: 275517 - DNA, 16 bp, Homo sapiens
atgtcagtagtgcctg

SEQ ID NO: 275518 - DNA, 17 bp, Homo sapiens
atgtcagtagtgcctgt

SEQ ID NO: 275519 - DNA, 14 bp, Homo sapiens
atgtcagtctacag

SEQ ID NO: 275520 - DNA, 13 bp, Homo sapiens
atgtcagtgtgac

SEQ ID NO: 275521 - DNA, 21 bp, Homo sapiens
atgtcagtgtgactgatctct

SEQ ID NO: 275522 - DNA, 21 bp, Homo sapiens
atgtcatactctgtgtaatct

SEQ ID NO: 275523 - DNA, 13 bp, Homo sapiens
atgtcatcttgag

SEQ ID NO: 275524 - DNA, 14 bp, Homo sapiens
atgtcatcttgagc

SEQ ID NO: 275525 - DNA, 23 bp, Homo sapiens
atgtcatgaaagcacctgccctc

SEQ ID NO: 275526 - DNA, 16 bp, Homo sapiens
atgtcattatgtagaa

SEQ ID NO: 275527 - DNA, 23 bp, Homo sapiens
atgtcattatgtagaaatattat

SEQ ID NO: 275528 - DNA, 18 bp, Homo sapiens
atgtccaacagagtggac

SEQ ID NO: 275529 - DNA, 22 bp, Homo sapiens
atgtccaagcatcagcaagaca

SEQ ID NO: 275530 - DNA, 23 bp, Homo sapiens
atgtccaagtccaacctgcctgt

SEQ ID NO: 275531 - DNA, 14 bp, Homo sapiens
atgtccaagttctt

SEQ ID NO: 275532 - DNA, 20 bp, Homo sapiens
atgtcccaacttgtaaaaat

SEQ ID NO: 275533 - DNA, 17 bp, Homo sapiens
atgtcccccacctcttt

SEQ ID NO: 275534 - DNA, 22 bp, Homo sapiens
atgtcccccaggggcccaggct

SEQ ID NO: 275535 - DNA, 22 bp, Homo sapiens
atgtccccccctaactttcttg

SEQ ID NO: 275536 - DNA, 21 bp, Homo sapiens
atgtcccctgtcccaccaact

SEQ ID NO: 275537 - DNA, 20 bp, Homo sapiens
atgtccctgaagtcttgcat

SEQ ID NO: 275538 - DNA, 19 bp, Homo sapiens
atgtcctaaggacacacta

SEQ ID NO: 275539 - DNA, 17 bp, Homo sapiens
atgtcctcaaagaagtg

SEQ ID NO: 275540 - DNA, 14 bp, Homo sapiens
atgtcctcagaggg

SEQ ID NO: 275541 - DNA, 22 bp, Homo sapiens
atgtcctccaccacaagagctc

SEQ ID NO: 275542 - DNA, 15 bp, Homo sapiens
atgtcctgcctttta

SEQ ID NO: 275543 - DNA, 22 bp, Homo sapiens
atgtcctgtaaacactcagctg

SEQ ID NO: 275544 - DNA, 23 bp, Homo sapiens
atgtcctgtaaacactcagctgt

SEQ ID NO: 275545 - DNA, 16 bp, Homo sapiens
atgtcgattttcaata

SEQ ID NO: 275546 - DNA, 13 bp, Homo sapiens
atgtcgcctctgc

SEQ ID NO: 275547 - DNA, 14 bp, Homo sapiens
atgtcgcctctgca

SEQ ID NO: 275548 - DNA, 15 bp, Homo sapiens
atgtcgcctctgcat

SEQ ID NO: 275549 - DNA, 18 bp, Homo sapiens
atgtcgcttttgggcctc

SEQ ID NO: 275550 - DNA, 21 bp, Homo sapiens
atgtctaaaagattctttaaa

SEQ ID NO: 275551 - DNA, 12 bp, Homo sapiens
atgtctaaaatt

SEQ ID NO: 275552 - DNA, 13 bp, Homo sapiens
atgtctagataac

SEQ ID NO: 275553 - DNA, 15 bp, Homo sapiens
atgtctagataacat

SEQ ID NO: 275554 - DNA, 16 bp, Homo sapiens
atgtctaggataattt

SEQ ID NO: 275555 - DNA, 17 bp, Homo sapiens
atgtctaggataatttt

SEQ ID NO: 275556 - DNA, 17 bp, Homo sapiens
atgtctcaggtccctgc

SEQ ID NO: 275557 - DNA, 14 bp, Homo sapiens
atgtctctgcttcc

SEQ ID NO: 275558 - DNA, 15 bp, Homo sapiens
atgtctcttgtagaa

SEQ ID NO: 275559 - DNA, 11 bp, Homo sapiens
atgtctgaaat

SEQ ID NO: 275560 - DNA, 22 bp, Homo sapiens
atgtctgagagaccatctccta

SEQ ID NO: 275561 - DNA, 14 bp, Homo sapiens
atgtctgcaaagga

SEQ ID NO: 275562 - DNA, 20 bp, Homo sapiens
atgtctgcaaaggagggcct

SEQ ID NO: 275563 - DNA, 16 bp, Homo sapiens
atgtctgtagctcctc

SEQ ID NO: 275564 - DNA, 18 bp, Homo sapiens
atgtctgtagctcctcaa

SEQ ID NO: 275565 - DNA, 19 bp, Homo sapiens
atgtctgtagctcctcaac

SEQ ID NO: 275566 - DNA, 21 bp, Homo sapiens
atgtctgtggccttgttctct

SEQ ID NO: 275567 - DNA, 23 bp, Homo sapiens
atgtctgttaccatgtcactgtg

SEQ ID NO: 275568 - DNA, 13 bp, Homo sapiens
atgtctgttccag

SEQ ID NO: 275569 - DNA, 17 bp, Homo sapiens
atgtcttaaataaaact

SEQ ID NO: 275570 - DNA, 20 bp, Homo sapiens
atgtcttactactttaaatc

SEQ ID NO: 275571 - DNA, 22 bp, Homo sapiens
atgtcttactactttaaatcct

SEQ ID NO: 275572 - DNA, 13 bp, Homo sapiens
attaagactttaa

SEQ ID NO: 275573 - DNA, 20 bp, Homo sapiens
attaagcaaccttaaagcaa

SEQ ID NO: 275574 - DNA, 21 bp, Homo sapiens
attaagcaaccttaaagcaat

SEQ ID NO: 275575 - DNA, 19 bp, Homo sapiens
attaagcagtaaaaactgt

SEQ ID NO: 275576 - DNA, 16 bp, Homo sapiens
attaaggcaactgaac

SEQ ID NO: 275577 - DNA, 15 bp, Homo sapiens
attaagggagctgag

SEQ ID NO: 275578 - DNA, 21 bp, Homo sapiens
attaagtattccttggcccag

SEQ ID NO: 275579 - DNA, 18 bp, Homo sapiens
attaagtggctttttaac

SEQ ID NO: 275580 - DNA, 16 bp, Homo sapiens
attaagttattaacat

SEQ ID NO: 275581 - DNA, 21 bp, Homo sapiens
attaataaaactttatgtact

SEQ ID NO: 275582 - DNA, 16 bp, Homo sapiens
attaatacttcatttg

SEQ ID NO: 275583 - DNA, 18 bp, Homo sapiens
attaatagcttttattgt

SEQ ID NO: 275584 - DNA, 20 bp, Homo sapiens
attaataggaaagatttaat

SEQ ID NO: 275585 - DNA, 22 bp, Homo sapiens
attaataggaaagatttaatgt

SEQ ID NO: 275586 - DNA, 14 bp, Homo sapiens
attaatatcttgct

SEQ ID NO: 275587 - DNA, 13 bp, Homo sapiens
attaatattatta

SEQ ID NO: 275588 - DNA, 16 bp, Homo sapiens
attaatccacaaatat

SEQ ID NO: 275589 - DNA, 19 bp, Homo sapiens
attaatccacaaatatgct

SEQ ID NO: 275590 - DNA, 18 bp, Homo sapiens
attaatccattttaacaa

SEQ ID NO: 275591 - DNA, 12 bp, Homo sapiens
attaatctctaa

SEQ ID NO: 275592 - DNA, 14 bp, Homo sapiens
attaatgaactgtg

SEQ ID NO: 275593 - DNA, 15 bp, Homo sapiens
attaatgctaagggc

SEQ ID NO: 275594 - DNA, 23 bp, Homo sapiens
attaatgctaagggcaggcccaa

SEQ ID NO: 275595 - DNA, 18 bp, Homo sapiens
attaatgttaattcagca

SEQ ID NO: 275596 - DNA, 14 bp, Homo sapiens
attaatgtttctta

SEQ ID NO: 275597 - DNA, 20 bp, Homo sapiens
attaatgtttcttaaatgga

SEQ ID NO: 275598 - DNA, 11 bp, Homo sapiens
attaattcatt

SEQ ID NO: 275599 - DNA, 20 bp, Homo sapiens
attaattgttttgcactttt

SEQ ID NO: 275600 - DNA, 19 bp, Homo sapiens
attaatttatatttgtctc

SEQ ID NO: 275601 - DNA, 12 bp, Homo sapiens
attaatttgtgt

SEQ ID NO: 275602 - DNA, 17 bp, Homo sapiens
attacaaacaaaggatt

SEQ ID NO: 275603 - DNA, 14 bp, Homo sapiens
attacaaatttctg

SEQ ID NO: 275604 - DNA, 20 bp, Homo sapiens
attacaaattttcactgctg

SEQ ID NO: 275605 - DNA, 14 bp, Homo sapiens
attacaagataaaa

SEQ ID NO: 275606 - DNA, 16 bp, Homo sapiens
attacaagataaaaaa

SEQ ID NO: 275607 - DNA, 19 bp, Homo sapiens
attacaagataaaaaacga

SEQ ID NO: 275608 - DNA, 14 bp, Homo sapiens
attacaagtttcag

SEQ ID NO: 275609 - DNA, 20 bp, Homo sapiens
attacaagtttcagtaatag

SEQ ID NO: 275610 - DNA, 15 bp, Homo sapiens
attatgtgtgttttg

SEQ ID NO: 275611 - DNA, 14 bp, Homo sapiens
attatgttattgaa

SEQ ID NO: 275612 - DNA, 18 bp, Homo sapiens
attatgttattgaaaaaa

SEQ ID NO: 275613 - DNA, 18 bp, Homo sapiens
attatgtttacctcactg

SEQ ID NO: 275614 - DNA, 17 bp, Homo sapiens
attattaaaaattatag

SEQ ID NO: 275615 - DNA, 14 bp, Homo sapiens
attattaactacat

SEQ ID NO: 275616 - DNA, 15 bp, Homo sapiens
attattaactacatt

SEQ ID NO: 275617 - DNA, 23 bp, Homo sapiens
attattacatctttattaacctc

SEQ ID NO: 275618 - DNA, 14 bp, Homo sapiens
attattactttaaa

SEQ ID NO: 275619 - DNA, 20 bp, Homo sapiens
attattataagcattgaaat

SEQ ID NO: 275620 - DNA, 15 bp, Homo sapiens
attattataggtaat

SEQ ID NO: 275621 - DNA, 14 bp, Homo sapiens
attattattatttg

SEQ ID NO: 275622 - DNA, 15 bp, Homo sapiens
attattattcttcat

SEQ ID NO: 275623 - DNA, 16 bp, Homo sapiens
attattattcttcata

SEQ ID NO: 275624 - DNA, 17 bp, Homo sapiens
attattattttaaaaat

SEQ ID NO: 275625 - DNA, 22 bp, Homo sapiens
attattcaccatgtaaaacaaa

SEQ ID NO: 275626 - DNA, 20 bp, Homo sapiens
attattcatttaaaatgatt

SEQ ID NO: 275627 - DNA, 20 bp, Homo sapiens
attattccctgaattgtttg

SEQ ID NO: 275628 - DNA, 12 bp, Homo sapiens
attattctagtc

SEQ ID NO: 275629 - DNA, 22 bp, Homo sapiens
attattctagtcaactgctgtt

SEQ ID NO: 275630 - DNA, 13 bp, Homo sapiens
attattctgcagc

SEQ ID NO: 275631 - DNA, 12 bp, Homo sapiens
attattcttcag

SEQ ID NO: 275632 - DNA, 18 bp, Homo sapiens
attattggaattaacctg

SEQ ID NO: 275633 - DNA, 14 bp, Homo sapiens
attattgtaaactt

SEQ ID NO: 275634 - DNA, 20 bp, Homo sapiens
attattgtaaactttttcaa

SEQ ID NO: 275635 - DNA, 21 bp, Homo sapiens
attatttaataaaaaaacaat

SEQ ID NO: 275636 - DNA, 12 bp, Homo sapiens
attatttaatat

SEQ ID NO: 275637 - DNA, 14 bp, Homo sapiens
attatttatttaat

SEQ ID NO: 275638 - DNA, 21 bp, Homo sapiens
attatttctccatcccctccc

SEQ ID NO: 275639 - DNA, 17 bp, Homo sapiens
attatttgataacattt

SEQ ID NO: 275640 - DNA, 18 bp, Homo sapiens
attatttgataacatttt

SEQ ID NO: 275641 - DNA, 22 bp, Homo sapiens
attatttgcttttcatgtagaa

SEQ ID NO: 275642 - DNA, 16 bp, Homo sapiens
attatttgtactttgt

SEQ ID NO: 275643 - DNA, 18 bp, Homo sapiens
attatttgtactttgttt

SEQ ID NO: 275644 - DNA, 20 bp, Homo sapiens
attatttgtgtaatagaaaa

SEQ ID NO: 275645 - DNA, 21 bp, Homo sapiens
attattttaaacaaaatagaa

SEQ ID NO: 275646 - DNA, 17 bp, Homo sapiens
attattttaaattataa

SEQ ID NO: 275647 - DNA, 14 bp, Homo sapiens
attattttgtggtt

SEQ ID NO: 275648 - DNA, 13 bp, Homo sapiens
attattttgttac

SEQ ID NO: 275649 - DNA, 18 bp, Homo sapiens
attatttttttaaagaaa

SEQ ID NO: 275650 - DNA, 20 bp, Homo sapiens
attcaaaaaaaaaatataag

SEQ ID NO: 275651 - DNA, 13 bp, Homo sapiens
attcaaaagcaca

SEQ ID NO: 275652 - DNA, 15 bp, Homo sapiens
attcaaaagcacaaa

SEQ ID NO: 275653 - DNA, 23 bp, Homo sapiens
attcaaaagcacaaaccctgggg

SEQ ID NO: 275654 - DNA, 12 bp, Homo sapiens
attcaaaatagt

SEQ ID NO: 275655 - DNA, 17 bp, Homo sapiens
attcaaaatagttctat

SEQ ID NO: 275656 - DNA, 19 bp, Homo sapiens
attcaaaatagttctattt

SEQ ID NO: 275657 - DNA, 16 bp, Homo sapiens
attgcagatatttgat

SEQ ID NO: 275658 - DNA, 18 bp, Homo sapiens
attgcagcagttgctagc

SEQ ID NO: 275659 - DNA, 23 bp, Homo sapiens
attgcagctaagctcaaatgtat

SEQ ID NO: 275660 - DNA, 22 bp, Homo sapiens
attgcaggccagtggacagagg

SEQ ID NO: 275661 - DNA, 15 bp, Homo sapiens
attgcagtgcggctc

SEQ ID NO: 275662 - DNA, 21 bp, Homo sapiens
attgcagtgcggctcacatca

SEQ ID NO: 275663 - DNA, 15 bp, Homo sapiens
attgcataaagcata

SEQ ID NO: 275664 - DNA, 20 bp, Homo sapiens
attgcataagtggacccagc

SEQ ID NO: 275665 - DNA, 15 bp, Homo sapiens
attgcatttattgca

SEQ ID NO: 275666 - DNA, 18 bp, Homo sapiens
attgcattttttaaaaca

SEQ ID NO: 275667 - DNA, 20 bp, Homo sapiens
attgcattttttaaaacaag

SEQ ID NO: 275668 - DNA, 21 bp, Homo sapiens
attgcattttttaaaacaaga

SEQ ID NO: 275669 - DNA, 14 bp, Homo sapiens
attgccaaattgac

SEQ ID NO: 275670 - DNA, 19 bp, Homo sapiens
attgccatcgggtgccaaa

SEQ ID NO: 275671 - DNA, 13 bp, Homo sapiens
attgccccaagat

SEQ ID NO: 275672 - DNA, 16 bp, Homo sapiens
attgccctgccaggct

SEQ ID NO: 275673 - DNA, 22 bp, Homo sapiens
attgccgtcctggactctgtgt

SEQ ID NO: 275674 - DNA, 23 bp, Homo sapiens
attgcctccagtccagtttccca

SEQ ID NO: 275675 - DNA, 20 bp, Homo sapiens
attgcctcccttcctccgct

SEQ ID NO: 275676 - DNA, 15 bp, Homo sapiens
attgcctgggcagtg

SEQ ID NO: 275677 - DNA, 12 bp, Homo sapiens
attgccttcagc

SEQ ID NO: 275678 - DNA, 15 bp, Homo sapiens
attgccttcagccct

SEQ ID NO: 275679 - DNA, 15 bp, Homo sapiens
attgctacacacaca

SEQ ID NO: 275680 - DNA, 19 bp, Homo sapiens
attgctagtactagtacta

SEQ ID NO: 275681 - DNA, 15 bp, Homo sapiens
attgctcccagtgcc

SEQ ID NO: 275682 - DNA, 18 bp, Homo sapiens
attgctccctaagactgt

SEQ ID NO: 275683 - DNA, 19 bp, Homo sapiens
attgctccctaagactgtg

SEQ ID NO: 275684 - DNA, 17 bp, Homo sapiens
attgctgagatgtttag

SEQ ID NO: 275685 - DNA, 22 bp, Homo sapiens
attgctgccataattctaagtt

SEQ ID NO: 275686 - DNA, 20 bp, Homo sapiens
attgctgtaaataaaaatag

SEQ ID NO: 275687 - DNA, 22 bp, Homo sapiens
attgctgtaaataaaaatagct

SEQ ID NO: 275688 - DNA, 13 bp, Homo sapiens
attgcttaatccc

SEQ ID NO: 275689 - DNA, 14 bp, Homo sapiens
attgcttacatttt

SEQ ID NO: 275690 - DNA, 16 bp, Homo sapiens
attgcttattcttgag

SEQ ID NO: 275691 - DNA, 13 bp, Homo sapiens
attgcttctgtag

SEQ ID NO: 275692 - DNA, 15 bp, Homo sapiens
attgctttgaaacta

SEQ ID NO: 275693 - DNA, 14 bp, Homo sapiens
attgctttggtcat

SEQ ID NO: 275694 - DNA, 21 bp, Homo sapiens
attgcttttattacattagtt

SEQ ID NO: 275695 - DNA, 15 bp, Homo sapiens
attgcttttgtgcat

SEQ ID NO: 275696 - DNA, 20 bp, Homo sapiens
attgcttttgtgcattggat

SEQ ID NO: 275697 - DNA, 15 bp, Homo sapiens
attggaaagacagga

SEQ ID NO: 275698 - DNA, 19 bp, Homo sapiens
attggaattaacctggtgc

SEQ ID NO: 275699 - DNA, 20 bp, Homo sapiens
attggaattaacctggtgct

SEQ ID NO: 275700 - DNA, 15 bp, Homo sapiens
attggacagacacag

SEQ ID NO: 275701 - DNA, 13 bp, Homo sapiens
attggacagttgt

SEQ ID NO: 275702 - DNA, 21 bp, Homo sapiens
attggacagttgtctagagat

SEQ ID NO: 275703 - DNA, 22 bp, Homo sapiens
attggagggtaaatgatgtggt

SEQ ID NO: 275704 - DNA, 23 bp, Homo sapiens
attggaggtgagatcacagcctc

SEQ ID NO: 275705 - DNA, 15 bp, Homo sapiens
attggcaccatgtgc

SEQ ID NO: 275706 - DNA, 20 bp, Homo sapiens
attggcagcttcaaaacaga

SEQ ID NO: 275707 - DNA, 19 bp, Homo sapiens
attggccgatgagctggtt

SEQ ID NO: 275708 - DNA, 11 bp, Homo sapiens
attggcctgga

SEQ ID NO: 275709 - DNA, 15 bp, Homo sapiens
attggctcctttccc

SEQ ID NO: 275710 - DNA, 16 bp, Homo sapiens
attggctcctttccca

SEQ ID NO: 275711 - DNA, 17 bp, Homo sapiens
attggctcctttcccac

SEQ ID NO: 275712 - DNA, 20 bp, Homo sapiens
attggctcctttcccacagt

SEQ ID NO: 275713 - DNA, 21 bp, Homo sapiens
attgggattaacataaaagag

SEQ ID NO: 275714 - DNA, 15 bp, Homo sapiens
attgggctgcaggct

SEQ ID NO: 275715 - DNA, 19 bp, Homo sapiens
attgggggctggtgccagc

SEQ ID NO: 275716 - DNA, 15 bp, Homo sapiens
attgggggggcttgg

SEQ ID NO: 275717 - DNA, 18 bp, Homo sapiens
attgggtgggcaggaaaa

SEQ ID NO: 275718 - DNA, 21 bp, Homo sapiens
attggtggcagattttacaaa

SEQ ID NO: 275719 - DNA, 18 bp, Homo sapiens
attggtgtgaatgctgta

SEQ ID NO: 275720 - DNA, 15 bp, Homo sapiens
attggttaatcactt

SEQ ID NO: 275721 - DNA, 18 bp, Homo sapiens
attggttccctttgctcc

SEQ ID NO: 275722 - DNA, 23 bp, Homo sapiens
attggtttctgtttgaattttca

SEQ ID NO: 275723 - DNA, 15 bp, Homo sapiens
attgtaaaatagctt

SEQ ID NO: 275724 - DNA, 23 bp, Homo sapiens
attgtaaacaaactgtgtaactg

SEQ ID NO: 275725 - DNA, 16 bp, Homo sapiens
attgtaaactagtact

SEQ ID NO: 275726 - DNA, 17 bp, Homo sapiens
attgtaaactagtacta

SEQ ID NO: 275727 - DNA, 19 bp, Homo sapiens
attgtaaactttttcaatg

SEQ ID NO: 275728 - DNA, 18 bp, Homo sapiens
attgtaaaggtaggtgca

SEQ ID NO: 275729 - DNA, 20 bp, Homo sapiens
attgtaaatgtttaatatct

SEQ ID NO: 275730 - DNA, 13 bp, Homo sapiens
attgtaacatatt

SEQ ID NO: 275731 - DNA, 13 bp, Homo sapiens
attgtaatctgct

SEQ ID NO: 275732 - DNA, 21 bp, Homo sapiens
attgtaatctgctttgttaat

SEQ ID NO: 275733 - DNA, 16 bp, Homo sapiens
attgtaattgtctcaa

SEQ ID NO: 275734 - DNA, 17 bp, Homo sapiens
attgtacagctgtttaa

SEQ ID NO: 275735 - DNA, 18 bp, Homo sapiens
attgtacctctcttatag

SEQ ID NO: 275736 - DNA, 19 bp, Homo sapiens
attgtacctctcttataga

SEQ ID NO: 275737 - DNA, 15 bp, Homo sapiens
attgtagcccagttg

SEQ ID NO: 275738 - DNA, 21 bp, Homo sapiens
attgtaggtcaatgaaatatt

SEQ ID NO: 275739 - DNA, 15 bp, Homo sapiens
attgtaggtgcaaga

SEQ ID NO: 275740 - DNA, 14 bp, Homo sapiens
attgtagttaatga

SEQ ID NO: 275741 - DNA, 21 bp, Homo sapiens
attgtataaactatcagtttg

SEQ ID NO: 275742 - DNA, 15 bp, Homo sapiens
attgtatagagatat

SEQ ID NO: 275743 - DNA, 22 bp, Homo sapiens
attgtataggccatctgtaaat

SEQ ID NO: 275744 - DNA, 23 bp, Homo sapiens
attgtataggccatctgtaaata

SEQ ID NO: 275745 - DNA, 21 bp, Homo sapiens
attgtatctccttcagaagtt

SEQ ID NO: 275746 - DNA, 17 bp, Homo sapiens
attgtatgaaaatcctt

SEQ ID NO: 275747 - DNA, 22 bp, Homo sapiens
attgtatgaaaatccttttaac

SEQ ID NO: 275748 - DNA, 13 bp, Homo sapiens
attgtatgatgtg

SEQ ID NO: 275749 - DNA, 21 bp, Homo sapiens
attgtattcctcacattcaca

SEQ ID NO: 275750 - DNA, 13 bp, Homo sapiens
attgtattttact

SEQ ID NO: 275751 - DNA, 13 bp, Homo sapiens
attgtcagctact

SEQ ID NO: 275752 - DNA, 16 bp, Homo sapiens
attgtccacaaatgtc

SEQ ID NO: 275753 - DNA, 22 bp, Homo sapiens
attgtccacaaatgtcctcaga

SEQ ID NO: 275754 - DNA, 12 bp, Homo sapiens
attgtccatatc

SEQ ID NO: 275755 - DNA, 19 bp, Homo sapiens
attgtccatgcctacagat

SEQ ID NO: 275756 - DNA, 16 bp, Homo sapiens
attgtccttcagagct

SEQ ID NO: 275757 - DNA, 18 bp, Homo sapiens
attgtctcaaagcatcaa

SEQ ID NO: 275758 - DNA, 16 bp, Homo sapiens
attgtctttcctccct

SEQ ID NO: 275759 - DNA, 15 bp, Homo sapiens
attgtgaaatttgtt

SEQ ID NO: 275760 - DNA, 14 bp, Homo sapiens
attgtgaattgata

SEQ ID NO: 275761 - DNA, 15 bp, Homo sapiens
attgtgcaaatggaa

SEQ ID NO: 275762 - DNA, 17 bp, Homo sapiens
attgtgccaatatgtat

SEQ ID NO: 275763 - DNA, 23 bp, Homo sapiens
attttacttggaaatattaaaag

SEQ ID NO: 275764 - DNA, 15 bp, Homo sapiens
attttactttgtgca

SEQ ID NO: 275765 - DNA, 19 bp, Homo sapiens
attttagcagttctgcaaa

SEQ ID NO: 275766 - DNA, 20 bp, Homo sapiens
attttagcagttctgcaaat

SEQ ID NO: 275767 - DNA, 16 bp, Homo sapiens
attttagctaatttag

SEQ ID NO: 275768 - DNA, 16 bp, Homo sapiens
attttaggagacagtc

SEQ ID NO: 275769 - DNA, 16 bp, Homo sapiens
attttagggctgtaga

SEQ ID NO: 275770 - DNA, 18 bp, Homo sapiens
attttagggctgtagact

SEQ ID NO: 275771 - DNA, 15 bp, Homo sapiens
attttaggtgttgat

SEQ ID NO: 275772 - DNA, 21 bp, Homo sapiens
attttaggtgttgattttctg

SEQ ID NO: 275773 - DNA, 15 bp, Homo sapiens
attttagtgactgta

SEQ ID NO: 275774 - DNA, 20 bp, Homo sapiens
attttataaggctgactctt

SEQ ID NO: 275775 - DNA, 15 bp, Homo sapiens
attttatactgcact

SEQ ID NO: 275776 - DNA, 17 bp, Homo sapiens
attttatataataaagt

SEQ ID NO: 275777 - DNA, 19 bp, Homo sapiens
attttatataataaagtat

SEQ ID NO: 275778 - DNA, 15 bp, Homo sapiens
attttatcagacaat

SEQ ID NO: 275779 - DNA, 13 bp, Homo sapiens
attttatctcttc

SEQ ID NO: 275780 - DNA, 14 bp, Homo sapiens
attttatctcttct

SEQ ID NO: 275781 - DNA, 22 bp, Homo sapiens
attttattaccttgttcctgta

SEQ ID NO: 275782 - DNA, 13 bp, Homo sapiens
attttattattca

SEQ ID NO: 275783 - DNA, 20 bp, Homo sapiens
attttattctttaagttcac

SEQ ID NO: 275784 - DNA, 14 bp, Homo sapiens
attttatttaaact

SEQ ID NO: 275785 - DNA, 19 bp, Homo sapiens
attttatttaaactattca

SEQ ID NO: 275786 - DNA, 16 bp, Homo sapiens
attttatttccatcat

SEQ ID NO: 275787 - DNA, 16 bp, Homo sapiens
attttattttcaagca

SEQ ID NO: 275788 - DNA, 19 bp, Homo sapiens
attttattttcaagcaaat

SEQ ID NO: 275789 - DNA, 19 bp, Homo sapiens
attttattttttccctcct

SEQ ID NO: 275790 - DNA, 20 bp, Homo sapiens
attttcaacgcagccctgct

SEQ ID NO: 275791 - DNA, 12 bp, Homo sapiens
attttcaagtaa

SEQ ID NO: 275792 - DNA, 16 bp, Homo sapiens
attttcaagtaattgt

SEQ ID NO: 275793 - DNA, 16 bp, Homo sapiens
attttcaataaagaaa

SEQ ID NO: 275794 - DNA, 15 bp, Homo sapiens
attttcaccccaccc

SEQ ID NO: 275795 - DNA, 16 bp, Homo sapiens
attttcaccccaccct

SEQ ID NO: 275796 - DNA, 15 bp, Homo sapiens
attttcactgctgct

SEQ ID NO: 275797 - DNA, 18 bp, Homo sapiens
attttcactgctgctcct

SEQ ID NO: 275798 - DNA, 16 bp, Homo sapiens
attttcagcatcaaac

SEQ ID NO: 275799 - DNA, 22 bp, Homo sapiens
attttcagcatcaaacatgaaa

SEQ ID NO: 275800 - DNA, 21 bp, Homo sapiens
attttcagtagggctacaaaa

SEQ ID NO: 275801 - DNA, 22 bp, Homo sapiens
attttcagtagggctacaaaac

SEQ ID NO: 275802 - DNA, 23 bp, Homo sapiens
attttcagtatactgtgtgggat

SEQ ID NO: 275803 - DNA, 16 bp, Homo sapiens
attttcatacttttga

SEQ ID NO: 275804 - DNA, 16 bp, Homo sapiens
attttcatcaagtagc

SEQ ID NO: 275805 - DNA, 13 bp, Homo sapiens
attttcatcccac

SEQ ID NO: 275806 - DNA, 13 bp, Homo sapiens
attttcatgactt

SEQ ID NO: 275807 - DNA, 16 bp, Homo sapiens
attttcattggatgca

SEQ ID NO: 275808 - DNA, 15 bp, Homo sapiens
attttccacggaaac

SEQ ID NO: 275809 - DNA, 16 bp, Homo sapiens
attttccattaatttc

SEQ ID NO: 275810 - DNA, 18 bp, Homo sapiens
attttccattaatttcaa

SEQ ID NO: 275811 - DNA, 19 bp, Homo sapiens
attttccccctaattctta

SEQ ID NO: 275812 - DNA, 13 bp, Homo sapiens
attttcctcccca

SEQ ID NO: 275813 - DNA, 15 bp, Homo sapiens
attttcctccccagc

SEQ ID NO: 275814 - DNA, 16 bp, Homo sapiens
attttcctccccagca

SEQ ID NO: 275815 - DNA, 14 bp, Homo sapiens
attttcctgggagt

SEQ ID NO: 275816 - DNA, 14 bp, Homo sapiens
attttcctgtcttc

SEQ ID NO: 275817 - DNA, 13 bp, Homo sapiens
attttcctttaga

SEQ ID NO: 275818 - DNA, 19 bp, Homo sapiens
attttcctttctgtattaa

SEQ ID NO: 275819 - DNA, 14 bp, Homo sapiens
attttcgtgcattt

SEQ ID NO: 275820 - DNA, 22 bp, Homo sapiens
attttctcaaaagcatttatca

SEQ ID NO: 275821 - DNA, 14 bp, Homo sapiens
attttctctcctcg

SEQ ID NO: 275822 - DNA, 18 bp, Homo sapiens
attttctctcctcggtgg

SEQ ID NO: 275823 - DNA, 22 bp, Homo sapiens
attttctctggcagcataattt

SEQ ID NO: 275824 - DNA, 16 bp, Homo sapiens
attttctgaattcata

SEQ ID NO: 275825 - DNA, 17 bp, Homo sapiens
attttctgagtagcata

SEQ ID NO: 275826 - DNA, 18 bp, Homo sapiens
attttctgagtagcatat

SEQ ID NO: 275827 - DNA, 20 bp, Homo sapiens
attttctgggttctgggtgg

SEQ ID NO: 275828 - DNA, 14 bp, Homo sapiens
attttcttcatgca

SEQ ID NO: 275829 - DNA, 15 bp, Homo sapiens
attttcttcccattt

SEQ ID NO: 275830 - DNA, 18 bp, Homo sapiens
attttcttcccatttgta

SEQ ID NO: 275831 - DNA, 19 bp, Homo sapiens
attttcttgtcaatggaag

SEQ ID NO: 275832 - DNA, 14 bp, Homo sapiens
attttctttctatg

SEQ ID NO: 275833 - DNA, 21 bp, Homo sapiens
attttctttctatgtagaact

SEQ ID NO: 275834 - DNA, 17 bp, Homo sapiens
attttcttttatatctg

SEQ ID NO: 275835 - DNA, 19 bp, Homo sapiens
attttcttttatatctgta

SEQ ID NO: 275836 - DNA, 13 bp, Homo sapiens
attttcttttctg

SEQ ID NO: 275837 - DNA, 15 bp, Homo sapiens
attttgaaaacactt

SEQ ID NO: 275838 - DNA, 21 bp, Homo sapiens
attttgaaaacacttatttta

SEQ ID NO: 275839 - DNA, 19 bp, Homo sapiens
attttgaaaggagaaaaaa

SEQ ID NO: 275840 - DNA, 11 bp, Homo sapiens
attttgaatac

SEQ ID NO: 275841 - DNA, 15 bp, Homo sapiens
attttgaatgtcaca

SEQ ID NO: 275842 - DNA, 18 bp, Homo sapiens
attttgactgtgatttat

SEQ ID NO: 275843 - DNA, 21 bp, Homo sapiens
attttgagtatctcggacctt

SEQ ID NO: 275844 - DNA, 18 bp, Homo sapiens
attttgataataaattga

SEQ ID NO: 275845 - DNA, 14 bp, Homo sapiens
attttgcaaaattt

SEQ ID NO: 275846 - DNA, 19 bp, Homo sapiens
attttgcaaaatttccagt

SEQ ID NO: 275847 - DNA, 15 bp, Homo sapiens
attttgccagactta

SEQ ID NO: 275848 - DNA, 18 bp, Homo sapiens
attttgcctcttttctct

SEQ ID NO: 275849 - DNA, 14 bp, Homo sapiens
attttggagaaatt

SEQ ID NO: 275850 - DNA, 21 bp, Homo sapiens
attttggagaaattatttaat

SEQ ID NO: 275851 - DNA, 19 bp, Homo sapiens
attttggcgctattacaaa

SEQ ID NO: 275852 - DNA, 21 bp, Homo sapiens
attttggcgctattacaaata

SEQ ID NO: 275853 - DNA, 16 bp, Homo sapiens
attttggggaactgtt

SEQ ID NO: 275854 - DNA, 19 bp, Homo sapiens
attttgggttttgggtctt

SEQ ID NO: 275855 - DNA, 22 bp, Homo sapiens
attttggtaaaatacttcttga

SEQ ID NO: 275856 - DNA, 21 bp, Homo sapiens
attttggtattacactgtatt

SEQ ID NO: 275857 - DNA, 18 bp, Homo sapiens
attttggtgatgtaaaac

SEQ ID NO: 275858 - DNA, 12 bp, Homo sapiens
attttgtaactg

SEQ ID NO: 275859 - DNA, 14 bp, Homo sapiens
attttgtatatatc

SEQ ID NO: 275860 - DNA, 15 bp, Homo sapiens
attttgtatttttga

SEQ ID NO: 275861 - DNA, 13 bp, Homo sapiens
attttgtccaagt

SEQ ID NO: 275862 - DNA, 16 bp, Homo sapiens
attttgtgatgatgct

SEQ ID NO: 275863 - DNA, 22 bp, Homo sapiens
attttgtgatgatgctgtgaca

SEQ ID NO: 275864 - DNA, 15 bp, Homo sapiens
attttgtggttctat

SEQ ID NO: 275865 - DNA, 18 bp, Homo sapiens
attttgtggttctatttt

SEQ ID NO: 275866 - DNA, 18 bp, Homo sapiens
attttgttatagaatact

SEQ ID NO: 275867 - DNA, 15 bp, Homo sapiens
atttttaaaagactt

SEQ ID NO: 275868 - DNA, 21 bp, Homo sapiens
atttttaaaggacaaacagtg

SEQ ID NO: 275869 - DNA, 18 bp, Homo sapiens
atttttaaatcatttcat

SEQ ID NO: 275870 - DNA, 19 bp, Homo sapiens
atttttaaatcatttcatg

SEQ ID NO: 275871 - DNA, 13 bp, Homo sapiens
atttttacaataa

SEQ ID NO: 275872 - DNA, 16 bp, Homo sapiens
atttttacagaattgc

SEQ ID NO: 275873 - DNA, 13 bp, Homo sapiens
atttttagagatt

SEQ ID NO: 275874 - DNA, 15 bp, Homo sapiens
atttttagtttgcta

SEQ ID NO: 275875 - DNA, 20 bp, Homo sapiens
atttttatatcagcctgagt

SEQ ID NO: 275876 - DNA, 16 bp, Homo sapiens
atttttatctaattca

SEQ ID NO: 275877 - DNA, 17 bp, Homo sapiens
atttttcccaggacagg

SEQ ID NO: 275878 - DNA, 13 bp, Homo sapiens
atttttccctccg

SEQ ID NO: 275879 - DNA, 20 bp, Homo sapiens
atttttcttagtgtgatgat

SEQ ID NO: 275880 - DNA, 15 bp, Homo sapiens
atttttgtactgtgc

SEQ ID NO: 275881 - DNA, 17 bp, Homo sapiens
atttttgtactgtgctg

SEQ ID NO: 275882 - DNA, 19 bp, Homo sapiens
atttttgtactgtgctgat

SEQ ID NO: 275883 - DNA, 20 bp, Homo sapiens
atttttgtcagtctgagtca

SEQ ID NO: 275884 - DNA, 16 bp, Homo sapiens
atttttgttaagctca

SEQ ID NO: 275885 - DNA, 18 bp, Homo sapiens
atttttgttaagctcagg

SEQ ID NO: 275886 - DNA, 20 bp, Homo sapiens
atttttgttaagctcaggat

SEQ ID NO: 275887 - DNA, 17 bp, Homo sapiens
atttttgtttcttccaa

SEQ ID NO: 275888 - DNA, 13 bp, Homo sapiens
atttttgtttgtt

SEQ ID NO: 275889 - DNA, 23 bp, Homo sapiens
atttttgtttttgtctttttcct

SEQ ID NO: 275890 - DNA, 16 bp, Homo sapiens
attttttaaaaagcaa

SEQ ID NO: 275891 - DNA, 16 bp, Homo sapiens
attttttaagtattta

SEQ ID NO: 275892 - DNA, 17 bp, Homo sapiens
attttttaagtatttat

SEQ ID NO: 275893 - DNA, 22 bp, Homo sapiens
attttttaagtatttatatatt

SEQ ID NO: 275894 - DNA, 16 bp, Homo sapiens
attttttaagttcaat

SEQ ID NO: 275895 - DNA, 13 bp, Homo sapiens
attttttaatgtg

SEQ ID NO: 275896 - DNA, 21 bp, Homo sapiens
attttttaatttgatgaaagc

SEQ ID NO: 275897 - DNA, 23 bp, Homo sapiens
attttttactacataattaaatt

SEQ ID NO: 275898 - DNA, 15 bp, Homo sapiens
attttttccctcctg

SEQ ID NO: 275899 - DNA, 14 bp, Homo sapiens
attttttcctacca

SEQ ID NO: 275900 - DNA, 20 bp, Homo sapiens
attttttcgtgcactctgct

SEQ ID NO: 275901 - DNA, 21 bp, Homo sapiens
attttttcgtgcactctgcta

SEQ ID NO: 275902 - DNA, 17 bp, Homo sapiens
attttttgatcctgtaa

SEQ ID NO: 275903 - DNA, 16 bp, Homo sapiens
atttttttaactgaaa

SEQ ID NO: 275904 - DNA, 22 bp, Homo sapiens
atttttttatataagttaaaga

SEQ ID NO: 275905 - DNA, 13 bp, Homo sapiens
atttttttattct

SEQ ID NO: 275906 - DNA, 13 bp, Homo sapiens
atttttttccaga

SEQ ID NO: 275907 - DNA, 18 bp, Homo sapiens
atttttttccagaattga

SEQ ID NO: 275908 - DNA, 13 bp, Homo sapiens
atttttttctagc

SEQ ID NO: 275909 - DNA, 21 bp, Homo sapiens
atttttttctagctataacaa

SEQ ID NO: 275910 - DNA, 14 bp, Homo sapiens
atttttttgatggc

SEQ ID NO: 275911 - DNA, 18 bp, Homo sapiens
attttttttaacattcct

SEQ ID NO: 275912 - DNA, 15 bp, Homo sapiens
attttttttaatgta

SEQ ID NO: 275913 - DNA, 21 bp, Homo sapiens
atttttttttagaacagaaaa

SEQ ID NO: 275914 - DNA, 17 bp, Homo sapiens
attttttttttaaaact

SEQ ID NO: 275915 - DNA, 16 bp, Homo sapiens
caaaaaaaaaatataa

SEQ ID NO: 275916 - DNA, 15 bp, Homo sapiens
caaaaaaaatttaaa

SEQ ID NO: 275917 - DNA, 13 bp, Homo sapiens
caaaaaaacacta

SEQ ID NO: 275918 - DNA, 14 bp, Homo sapiens
caaaaaataaaata

SEQ ID NO: 275919 - DNA, 15 bp, Homo sapiens
caaaaaataaaataa

SEQ ID NO: 275920 - DNA, 17 bp, Homo sapiens
caaaaaataaaataagt

SEQ ID NO: 275921 - DNA, 12 bp, Homo sapiens
caaaaaatgagc

SEQ ID NO: 275922 - DNA, 14 bp, Homo sapiens
caaaaaattaaaac

SEQ ID NO: 275923 - DNA, 19 bp, Homo sapiens
caaaaacaagactgcctcc

SEQ ID NO: 275924 - DNA, 20 bp, Homo sapiens
caaaaacaagactgcctccc

SEQ ID NO: 275925 - DNA, 15 bp, Homo sapiens
caaaaaccccagtgt

SEQ ID NO: 275926 - DNA, 17 bp, Homo sapiens
caaaaaccccagtgttt

SEQ ID NO: 275927 - DNA, 19 bp, Homo sapiens
caaaaaccccagtgtttta

SEQ ID NO: 275928 - DNA, 16 bp, Homo sapiens
caaaaactttccatga

SEQ ID NO: 275929 - DNA, 21 bp, Homo sapiens
caaaaactttccatgacagta

SEQ ID NO: 275930 - DNA, 20 bp, Homo sapiens
caaaaagaaagctgtgaaat

SEQ ID NO: 275931 - DNA, 23 bp, Homo sapiens
caaaaagaatctgcatttagcac

SEQ ID NO: 275932 - DNA, 12 bp, Homo sapiens
caaaaagtgttt

SEQ ID NO: 275933 - DNA, 13 bp, Homo sapiens
caaaaatacaaaa

SEQ ID NO: 275934 - DNA, 22 bp, Homo sapiens
caaaaatatattaaaaatataa

SEQ ID NO: 275935 - DNA, 17 bp, Homo sapiens
caaaaattagccgggca

SEQ ID NO: 275936 - DNA, 20 bp, Homo sapiens
caaaaattatctatttgtat

SEQ ID NO: 275937 - DNA, 12 bp, Homo sapiens
caaaaattatta

SEQ ID NO: 275938 - DNA, 13 bp, Homo sapiens
caaaaatttgaac

SEQ ID NO: 275939 - DNA, 22 bp, Homo sapiens
caaaaatttgaaccaaaacatt

SEQ ID NO: 275940 - DNA, 13 bp, Homo sapiens
caaaacaaagctg

SEQ ID NO: 275941 - DNA, 15 bp, Homo sapiens
caaaacaacagcaac

SEQ ID NO: 275942 - DNA, 18 bp, Homo sapiens
caaaacacttgtaatttt

SEQ ID NO: 275943 - DNA, 13 bp, Homo sapiens
caaaaccacagcc

SEQ ID NO: 275944 - DNA, 18 bp, Homo sapiens
caaaaccacagccctgtc

SEQ ID NO: 275945 - DNA, 15 bp, Homo sapiens
caaaaccattgcttc

SEQ ID NO: 275946 - DNA, 13 bp, Homo sapiens
caaaacccacctt

SEQ ID NO: 275947 - DNA, 16 bp, Homo sapiens
caaaacctgtgccagg

SEQ ID NO: 275948 - DNA, 17 bp, Homo sapiens
caaaacctgtgccaggc

SEQ ID NO: 275949 - DNA, 23 bp, Homo sapiens
caaaacgcatggagtgtgtattg

SEQ ID NO: 275950 - DNA, 18 bp, Homo sapiens
caaaacttaaaagtattc

SEQ ID NO: 275951 - DNA, 13 bp, Homo sapiens
caaaacttaacat

SEQ ID NO: 275952 - DNA, 16 bp, Homo sapiens
caaaacttcctgtttg

SEQ ID NO: 275953 - DNA, 23 bp, Homo sapiens
caaaagaaaccatgcaaagcaac

SEQ ID NO: 275954 - DNA, 16 bp, Homo sapiens
caaaagaaagagaaat

SEQ ID NO: 275955 - DNA, 20 bp, Homo sapiens
caaaagaagggtaagtgctt

SEQ ID NO: 275956 - DNA, 15 bp, Homo sapiens
caaaagagacaggga

SEQ ID NO: 275957 - DNA, 21 bp, Homo sapiens
caaaagatgtatccttccaat

SEQ ID NO: 275958 - DNA, 15 bp, Homo sapiens
caaaagattatgtat

SEQ ID NO: 275959 - DNA, 19 bp, Homo sapiens
caaaagcaaagtgaagtga

SEQ ID NO: 275960 - DNA, 14 bp, Homo sapiens
caaaagcaagactg

SEQ ID NO: 275961 - DNA, 23 bp, Homo sapiens
caaaagcaagactgttgctcaaa

SEQ ID NO: 275962 - DNA, 21 bp, Homo sapiens
caaaagcacaaaccctgggga

SEQ ID NO: 275963 - DNA, 11 bp, Homo sapiens
caaaagcaggc

SEQ ID NO: 275964 - DNA, 19 bp, Homo sapiens
caaaagcatctatgtgaga

SEQ ID NO: 275965 - DNA, 18 bp, Homo sapiens
caaaagctagaggagatt

SEQ ID NO: 275966 - DNA, 14 bp, Homo sapiens
caaaagctgtgtct

SEQ ID NO: 275967 - DNA, 19 bp, Homo sapiens
caaaaggagaactgtgctc

SEQ ID NO: 275968 - DNA, 21 bp, Homo sapiens
caaaaggatgatttaacatta

SEQ ID NO: 275969 - DNA, 18 bp, Homo sapiens
caaaagggaaaaaagcaa

SEQ ID NO: 275970 - DNA, 22 bp, Homo sapiens
caaaaggtgattaaatatttaa

SEQ ID NO: 275971 - DNA, 23 bp, Homo sapiens
caaaaggtgattaaatatttaat

SEQ ID NO: 275972 - DNA, 20 bp, Homo sapiens
caaaaggttcactaaagcag

SEQ ID NO: 275973 - DNA, 14 bp, Homo sapiens
caaaagtctatttt

SEQ ID NO: 275974 - DNA, 20 bp, Homo sapiens
caaaagtctcaatgttccat

SEQ ID NO: 275975 - DNA, 13 bp, Homo sapiens
caaaagtgctttg

SEQ ID NO: 275976 - DNA, 15 bp, Homo sapiens
caaaagtgctttgga

SEQ ID NO: 275977 - DNA, 19 bp, Homo sapiens
caaaataaaaagtgacaca

SEQ ID NO: 275978 - DNA, 15 bp, Homo sapiens
caaaataaaattatg

SEQ ID NO: 275979 - DNA, 19 bp, Homo sapiens
caaaatacatgatgatttc

SEQ ID NO: 275980 - DNA, 14 bp, Homo sapiens
caaaatacttcttt

SEQ ID NO: 275981 - DNA, 16 bp, Homo sapiens
caaaatagttctattt

SEQ ID NO: 275982 - DNA, 24 bp, Homo sapiens
caaaatagttctatttctatctgc

SEQ ID NO: 275983 - DNA, 21 bp, Homo sapiens
caaaatatgccccttcttggg

SEQ ID NO: 275984 - DNA, 22 bp, Homo sapiens
caaaatatgccccttcttgggc

SEQ ID NO: 275985 - DNA, 20 bp, Homo sapiens
caaaatatttctaagcttat

SEQ ID NO: 275986 - DNA, 16 bp, Homo sapiens
caaaatcattttaatg

SEQ ID NO: 275987 - DNA, 14 bp, Homo sapiens
caaaatctgaactc

SEQ ID NO: 275988 - DNA, 18 bp, Homo sapiens
caaaatctgaactctcaa

SEQ ID NO: 275989 - DNA, 21 bp, Homo sapiens
caaaatctgaactctcaaaag

SEQ ID NO: 275990 - DNA, 22 bp, Homo sapiens
caaaatctgccctcagatgaaa

SEQ ID NO: 275991 - DNA, 13 bp, Homo sapiens
caaaatctgtcca

SEQ ID NO: 275992 - DNA, 13 bp, Homo sapiens
caaaatgtctgta

SEQ ID NO: 275993 - DNA, 21 bp, Homo sapiens
caaaatgtgccgtctttggtt

SEQ ID NO: 275994 - DNA, 19 bp, Homo sapiens
caaaatgtgtgcttggaaa

SEQ ID NO: 275995 - DNA, 18 bp, Homo sapiens
caaaatgttaataaaggt

SEQ ID NO: 275996 - DNA, 21 bp, Homo sapiens
caaaatgttaataaaggtttc

SEQ ID NO: 275997 - DNA, 15 bp, Homo sapiens
caaaattaaatctgt

SEQ ID NO: 275998 - DNA, 17 bp, Homo sapiens
caaaatttccagtacct

SEQ ID NO: 275999 - DNA, 14 bp, Homo sapiens
caaaatttgaaatt

SEQ ID NO: 276000 - DNA, 13 bp, Homo sapiens
caaaatttgtttg

SEQ ID NO: 276001 - DNA, 21 bp, Homo sapiens
caaaattttatagctcagttt

SEQ ID NO: 276002 - DNA, 21 bp, Homo sapiens
caaacaaaaaggttctcaggt

SEQ ID NO: 276003 - DNA, 13 bp, Homo sapiens
caaacaaaactta

SEQ ID NO: 276004 - DNA, 21 bp, Homo sapiens
caaacaaaggatttgaaaaca

SEQ ID NO: 276005 - DNA, 23 bp, Homo sapiens
caaacaaccattttttgttctgt

SEQ ID NO: 276006 - DNA, 12 bp, Homo sapiens
caaacaataaac

SEQ ID NO: 276007 - DNA, 13 bp, Homo sapiens
caaacacacagta

SEQ ID NO: 276008 - DNA, 12 bp, Homo sapiens
caaacaggtgct

SEQ ID NO: 276009 - DNA, 13 bp, Homo sapiens
caaacaggtgcta

SEQ ID NO: 276010 - DNA, 12 bp, Homo sapiens
caaacagtgaat

SEQ ID NO: 276011 - DNA, 12 bp, Homo sapiens
caaacatagccc

SEQ ID NO: 276012 - DNA, 16 bp, Homo sapiens
caaacatagcccctgc

SEQ ID NO: 276013 - DNA, 16 bp, Homo sapiens
caaacatgaaaacatt

SEQ ID NO: 276014 - DNA, 18 bp, Homo sapiens
caaacatgaaaacattga

SEQ ID NO: 276015 - DNA, 23 bp, Homo sapiens
caaacatgtttagagtggataga

SEQ ID NO: 276016 - DNA, 20 bp, Homo sapiens
caaacattaatcaccaaagt

SEQ ID NO: 276017 - DNA, 16 bp, Homo sapiens
caaacattcttatttt

SEQ ID NO: 276018 - DNA, 15 bp, Homo sapiens
caaacatttcaaagt

SEQ ID NO: 276019 - DNA, 15 bp, Homo sapiens
caaaccaaataaaaa

SEQ ID NO: 276020 - DNA, 17 bp, Homo sapiens
caaaccaagtgccttga

SEQ ID NO: 276021 - DNA, 19 bp, Homo sapiens
caaaccactttttgcagct

SEQ ID NO: 276022 - DNA, 18 bp, Homo sapiens
caaaccaggactctgccc

SEQ ID NO: 276023 - DNA, 15 bp, Homo sapiens
caaaccccagcccca

SEQ ID NO: 276024 - DNA, 13 bp, Homo sapiens
caaaccctgctgc

SEQ ID NO: 276025 - DNA, 15 bp, Homo sapiens
caaaccctgcttctg

SEQ ID NO: 276026 - DNA, 14 bp, Homo sapiens
caaaccctggggac

SEQ ID NO: 276027 - DNA, 22 bp, Homo sapiens
caaaccctggggactctgcttg

SEQ ID NO: 276028 - DNA, 23 bp, Homo sapiens
caaaccctgtggggcctgatggt

SEQ ID NO: 276029 - DNA, 18 bp, Homo sapiens
caaacctccaaaagccct

SEQ ID NO: 276030 - DNA, 16 bp, Homo sapiens
caaacctgcatattgt

SEQ ID NO: 276031 - DNA, 18 bp, Homo sapiens
caaacctttattttagaa

SEQ ID NO: 276032 - DNA, 16 bp, Homo sapiens
caaactaaaagacatt

SEQ ID NO: 276033 - DNA, 17 bp, Homo sapiens
caaactacagaataatg

SEQ ID NO: 276034 - DNA, 18 bp, Homo sapiens
caaactacagaataatgt

SEQ ID NO: 276035 - DNA, 16 bp, Homo sapiens
caaactactgtacatt

SEQ ID NO: 276036 - DNA, 19 bp, Homo sapiens
caaactcactgctcaagaa

SEQ ID NO: 276037 - DNA, 13 bp, Homo sapiens
caaactcgtctga

SEQ ID NO: 276038 - DNA, 21 bp, Homo sapiens
caaactctttgcccagttcat

SEQ ID NO: 276039 - DNA, 12 bp, Homo sapiens
caaactgaaaaa

SEQ ID NO: 276040 - DNA, 11 bp, Homo sapiens
caaactgcaat

SEQ ID NO: 276041 - DNA, 20 bp, Homo sapiens
caaactgcaatagagactgt

SEQ ID NO: 276042 - DNA, 21 bp, Homo sapiens
caaactgcctgttaagtctga

SEQ ID NO: 276043 - DNA, 20 bp, Homo sapiens
caaactgtgtaactgcccaa

SEQ ID NO: 276044 - DNA, 13 bp, Homo sapiens
caaactgttgatt

SEQ ID NO: 276045 - DNA, 12 bp, Homo sapiens
caaagaaaatga

SEQ ID NO: 276046 - DNA, 19 bp, Homo sapiens
caaagaaaattctcaagtg

SEQ ID NO: 276047 - DNA, 21 bp, Homo sapiens
caaagaaacaccacttaatct

SEQ ID NO: 276048 - DNA, 22 bp, Homo sapiens
caaagaaacaccacttaatctt

SEQ ID NO: 276049 - DNA, 23 bp, Homo sapiens
caaagaaacaccacttaatcttc

SEQ ID NO: 276050 - DNA, 14 bp, Homo sapiens
caaagaaatagcaa

SEQ ID NO: 276051 - DNA, 18 bp, Homo sapiens
caaagaaatagcaagaga

SEQ ID NO: 276052 - DNA, 17 bp, Homo sapiens
caaagaacccccctccc

SEQ ID NO: 276053 - DNA, 19 bp, Homo sapiens
caaagaacccccctcccca

SEQ ID NO: 276054 - DNA, 19 bp, Homo sapiens
caaagaaccctagcacaaa

SEQ ID NO: 276055 - DNA, 19 bp, Homo sapiens
caaagaacggcatgtgaat

SEQ ID NO: 276056 - DNA, 21 bp, Homo sapiens
caaagaacggcatgtgaattc

SEQ ID NO: 276057 - DNA, 13 bp, Homo sapiens
caaagaaggaaaa

SEQ ID NO: 276058 - DNA, 17 bp, Homo sapiens
caaagaccaatgtgaag

SEQ ID NO: 276059 - DNA, 18 bp, Homo sapiens
caaagaccaatgtgaaga

SEQ ID NO: 276060 - DNA, 23 bp, Homo sapiens
caaagacttaatcatatcaactt

SEQ ID NO: 276061 - DNA, 16 bp, Homo sapiens
caaagacttagtatat

SEQ ID NO: 276062 - DNA, 19 bp, Homo sapiens
caaagacttagtatatttt

SEQ ID NO: 276063 - DNA, 20 bp, Homo sapiens
caaagacttagtatattttc

SEQ ID NO: 276064 - DNA, 20 bp, Homo sapiens
caaagagaaatcacaggggc

SEQ ID NO: 276065 - DNA, 21 bp, Homo sapiens
caaagagaaatcacaggggcg

SEQ ID NO: 276066 - DNA, 13 bp, Homo sapiens
caaagagaaggcc

SEQ ID NO: 276067 - DNA, 19 bp, Homo sapiens
caaagagagaaaataaaga

SEQ ID NO: 276068 - DNA, 13 bp, Homo sapiens
caaagagctgcct

SEQ ID NO: 276069 - DNA, 12 bp, Homo sapiens
caaagaggtgct

SEQ ID NO: 276070 - DNA, 21 bp, Homo sapiens
caaagaggtgctgctttgctt

SEQ ID NO: 276071 - DNA, 23 bp, Homo sapiens
caaagagttatatgacttcttgt

SEQ ID NO: 276072 - DNA, 24 bp, Homo sapiens
caaagagttctggaaaagaactgt

SEQ ID NO: 276073 - DNA, 18 bp, Homo sapiens
caaagataacgcaggaga

SEQ ID NO: 276074 - DNA, 22 bp, Homo sapiens
caaagataagacttgtttcttt

SEQ ID NO: 276075 - DNA, 15 bp, Homo sapiens
caaagatcaaaataa

SEQ ID NO: 276076 - DNA, 16 bp, Homo sapiens
caaagatcaaaataaa

SEQ ID NO: 276077 - DNA, 18 bp, Homo sapiens
caaagatcaaaataaaaa

SEQ ID NO: 276078 - DNA, 16 bp, Homo sapiens
caaagatgagaagcca

SEQ ID NO: 276079 - DNA, 15 bp, Homo sapiens
caaagatgtactgag

SEQ ID NO: 276080 - DNA, 13 bp, Homo sapiens
caaagcaagggct

SEQ ID NO: 276081 - DNA, 16 bp, Homo sapiens
caaatagaagcttctt

SEQ ID NO: 276082 - DNA, 22 bp, Homo sapiens
caaatagagtttttatatttgt

SEQ ID NO: 276083 - DNA, 23 bp, Homo sapiens
caaatagagtttttatatttgtt

SEQ ID NO: 276084 - DNA, 16 bp, Homo sapiens
caaatagggcaaagaa

SEQ ID NO: 276085 - DNA, 23 bp, Homo sapiens
caaatagtgttgatcagatctta

SEQ ID NO: 276086 - DNA, 18 bp, Homo sapiens
caaatatatttaggccag

SEQ ID NO: 276087 - DNA, 17 bp, Homo sapiens
caaatatgattctcctc

SEQ ID NO: 276088 - DNA, 19 bp, Homo sapiens
caaatatgattctcctctc

SEQ ID NO: 276089 - DNA, 21 bp, Homo sapiens
caaatatgattctcctctccc

SEQ ID NO: 276090 - DNA, 20 bp, Homo sapiens
caaatatgcactttccctag

SEQ ID NO: 276091 - DNA, 21 bp, Homo sapiens
caaatatgcactttccctaga

SEQ ID NO: 276092 - DNA, 17 bp, Homo sapiens
caaatatgtcctggggt

SEQ ID NO: 276093 - DNA, 17 bp, Homo sapiens
caaatattgcttggact

SEQ ID NO: 276094 - DNA, 13 bp, Homo sapiens
caaatatttcact

SEQ ID NO: 276095 - DNA, 17 bp, Homo sapiens
caaatcacacctctggg

SEQ ID NO: 276096 - DNA, 18 bp, Homo sapiens
caaatcacacctctgggc

SEQ ID NO: 276097 - DNA, 20 bp, Homo sapiens
caaatcagacacaattagag

SEQ ID NO: 276098 - DNA, 22 bp, Homo sapiens
caaatcagacacaattagagaa

SEQ ID NO: 276099 - DNA, 15 bp, Homo sapiens
caaatcagtctcaca

SEQ ID NO: 276100 - DNA, 18 bp, Homo sapiens
caaatccataccccctgc

SEQ ID NO: 276101 - DNA, 19 bp, Homo sapiens
caaatccataccccctgcc

SEQ ID NO: 276102 - DNA, 18 bp, Homo sapiens
caaatcccagggaaggac

SEQ ID NO: 276103 - DNA, 22 bp, Homo sapiens
caaatcctccctacttccaaga

SEQ ID NO: 276104 - DNA, 14 bp, Homo sapiens
caaatctaatctct

SEQ ID NO: 276105 - DNA, 18 bp, Homo sapiens
caaatctaatctcttatt

SEQ ID NO: 276106 - DNA, 22 bp, Homo sapiens
caaatctaatctcttattctaa

SEQ ID NO: 276107 - DNA, 14 bp, Homo sapiens
caaatctattcaga

SEQ ID NO: 276108 - DNA, 16 bp, Homo sapiens
caaatctattcagaca

SEQ ID NO: 276109 - DNA, 20 bp, Homo sapiens
caaatctattcagacaagca

SEQ ID NO: 276110 - DNA, 22 bp, Homo sapiens
caaatctattcagacaagcaac

SEQ ID NO: 276111 - DNA, 20 bp, Homo sapiens
caaatctgggtatctttcca

SEQ ID NO: 276112 - DNA, 12 bp, Homo sapiens
caaatctgtata

SEQ ID NO: 276113 - DNA, 19 bp, Homo sapiens
caaatctttaagaatagtt

SEQ ID NO: 276114 - DNA, 15 bp, Homo sapiens
caaatgaaagcataa

SEQ ID NO: 276115 - DNA, 22 bp, Homo sapiens
caaatgacttcatttctgatgt

SEQ ID NO: 276116 - DNA, 21 bp, Homo sapiens
caaatgagatgtatgcccaaa

SEQ ID NO: 276117 - DNA, 18 bp, Homo sapiens
caaatgcacaagctcaga

SEQ ID NO: 276118 - DNA, 14 bp, Homo sapiens
caaatgcagacaca

SEQ ID NO: 276119 - DNA, 22 bp, Homo sapiens
caaatgcagggaggggaggcag

SEQ ID NO: 276120 - DNA, 10 bp, Homo sapiens
caaatgcatg

SEQ ID NO: 276121 - DNA, 11 bp, Homo sapiens
caaatgcatga

SEQ ID NO: 276122 - DNA, 21 bp, Homo sapiens
caaatgcatgatattgtatgt

SEQ ID NO: 276123 - DNA, 19 bp, Homo sapiens
caaatgcattcatgtttta

SEQ ID NO: 276124 - DNA, 20 bp, Homo sapiens
caaatgccaggacagctgca

SEQ ID NO: 276125 - DNA, 21 bp, Homo sapiens
caaatgccaggacagctgcag

SEQ ID NO: 276126 - DNA, 12 bp, Homo sapiens
caaatgcctctg

SEQ ID NO: 276127 - DNA, 16 bp, Homo sapiens
caaatgctactcagta

SEQ ID NO: 276128 - DNA, 19 bp, Homo sapiens
caaatgctgcgcccttccc

SEQ ID NO: 276129 - DNA, 21 bp, Homo sapiens
caaatgctgcgcccttcccca

SEQ ID NO: 276130 - DNA, 23 bp, Homo sapiens
caaatgctgtaactttctgaaat

SEQ ID NO: 276131 - DNA, 22 bp, Homo sapiens
caaatgctgtgcaaacagtgta

SEQ ID NO: 276132 - DNA, 14 bp, Homo sapiens
caaatggaggaata

SEQ ID NO: 276133 - DNA, 16 bp, Homo sapiens
caaatggatgtaatat

SEQ ID NO: 276134 - DNA, 18 bp, Homo sapiens
caaatgggactgatgtca

SEQ ID NO: 276135 - DNA, 21 bp, Homo sapiens
caaatgggggcggctggaaag

SEQ ID NO: 276136 - DNA, 21 bp, Homo sapiens
caaatgtaattgaataaagtt

SEQ ID NO: 276137 - DNA, 21 bp, Homo sapiens
caaatgtcattatgtagaaat

SEQ ID NO: 276138 - DNA, 15 bp, Homo sapiens
caaatgtcctcagag

SEQ ID NO: 276139 - DNA, 18 bp, Homo sapiens
caaatgtcctccagaagc

SEQ ID NO: 276140 - DNA, 16 bp, Homo sapiens
caaatgtgatcaactg

SEQ ID NO: 276141 - DNA, 15 bp, Homo sapiens
caaatgttaacagag

SEQ ID NO: 276142 - DNA, 17 bp, Homo sapiens
caaattatcaagctaat

SEQ ID NO: 276143 - DNA, 14 bp, Homo sapiens
caaattattctagt

SEQ ID NO: 276144 - DNA, 14 bp, Homo sapiens
caaattatttgtgt

SEQ ID NO: 276145 - DNA, 15 bp, Homo sapiens
caaattatttgtgta

SEQ ID NO: 276146 - DNA, 16 bp, Homo sapiens
caaattatttgtgtaa

SEQ ID NO: 276147 - DNA, 13 bp, Homo sapiens
caaattcctgcaa

SEQ ID NO: 276148 - DNA, 22 bp, Homo sapiens
caaattctgcttgcttgctttt

SEQ ID NO: 276149 - DNA, 16 bp, Homo sapiens
caaattcttgaataaa

SEQ ID NO: 276150 - DNA, 22 bp, Homo sapiens
caaattcttgaataaactcccc

SEQ ID NO: 276151 - DNA, 20 bp, Homo sapiens
caaattgaaagcttccatgt

SEQ ID NO: 276152 - DNA, 13 bp, Homo sapiens
caaattgccttca

SEQ ID NO: 276153 - DNA, 13 bp, Homo sapiens
caaattgctgaga

SEQ ID NO: 276154 - DNA, 12 bp, Homo sapiens
caaattgtagcc

SEQ ID NO: 276155 - DNA, 18 bp, Homo sapiens
caaattgtatctagtgca

SEQ ID NO: 276156 - DNA, 15 bp, Homo sapiens
caaatttaatgtaga

SEQ ID NO: 276157 - DNA, 17 bp, Homo sapiens
caaatttcatctttcca

SEQ ID NO: 276158 - DNA, 19 bp, Homo sapiens
caaatttcatctttccaaa

SEQ ID NO: 276159 - DNA, 16 bp, Homo sapiens
caaattttcagaaggt

SEQ ID NO: 276160 - DNA, 18 bp, Homo sapiens
caaattttccttcctgtt

SEQ ID NO: 276161 - DNA, 16 bp, Homo sapiens
caaattttgaggtctt

SEQ ID NO: 276162 - DNA, 15 bp, Homo sapiens
caaattttgcattgt

SEQ ID NO: 276163 - DNA, 13 bp, Homo sapiens
caaattttggcca

SEQ ID NO: 276164 - DNA, 15 bp, Homo sapiens
caaattttggccaaa

SEQ ID NO: 276165 - DNA, 10 bp, Homo sapiens
caacaaaaaa

SEQ ID NO: 276166 - DNA, 13 bp, Homo sapiens
caacaaaaaataa

SEQ ID NO: 276167 - DNA, 10 bp, Homo sapiens
caacaaaaat

SEQ ID NO: 276168 - DNA, 12 bp, Homo sapiens
caacaaaaattt

SEQ ID NO: 276169 - DNA, 12 bp, Homo sapiens
caacaaacactg

SEQ ID NO: 276170 - DNA, 15 bp, Homo sapiens
caacaaagcatgctc

SEQ ID NO: 276171 - DNA, 13 bp, Homo sapiens
caacaacaaagca

SEQ ID NO: 276172 - DNA, 15 bp, Homo sapiens
caacaacagaacaac

SEQ ID NO: 276173 - DNA, 17 bp, Homo sapiens
caacaacagtcagccag

SEQ ID NO: 276174 - DNA, 22 bp, Homo sapiens
caacaacagtcagccagcttgg

SEQ ID NO: 276175 - DNA, 23 bp, Homo sapiens
caacaaccacacttaaatccagt

SEQ ID NO: 276176 - DNA, 14 bp, Homo sapiens
caacaactccagga

SEQ ID NO: 276177 - DNA, 15 bp, Homo sapiens
caacaacttactaaa

SEQ ID NO: 276178 - DNA, 18 bp, Homo sapiens
caacaacttactaaatct

SEQ ID NO: 276179 - DNA, 16 bp, Homo sapiens
caacaactttgtttct

SEQ ID NO: 276180 - DNA, 14 bp, Homo sapiens
caacaagagtttat

SEQ ID NO: 276181 - DNA, 12 bp, Homo sapiens
caacaaggaaat

SEQ ID NO: 276182 - DNA, 15 bp, Homo sapiens
caacaagggagagac

SEQ ID NO: 276183 - DNA, 22 bp, Homo sapiens
caacaagttgtttcaaacagca

SEQ ID NO: 276184 - DNA, 13 bp, Homo sapiens
caacaataaaaaa

SEQ ID NO: 276185 - DNA, 15 bp, Homo sapiens
caacaataataaatg

SEQ ID NO: 276186 - DNA, 18 bp, Homo sapiens
caacaatactttgtgtct

SEQ ID NO: 276187 - DNA, 15 bp, Homo sapiens
caacaattaggtctg

SEQ ID NO: 276188 - DNA, 23 bp, Homo sapiens
caacaattgtcccaacaaccaca

SEQ ID NO: 276189 - DNA, 18 bp, Homo sapiens
caacacaatgttattcgt

SEQ ID NO: 276190 - DNA, 11 bp, Homo sapiens
caacacacaga

SEQ ID NO: 276191 - DNA, 13 bp, Homo sapiens
caacaccacagac

SEQ ID NO: 276192 - DNA, 18 bp, Homo sapiens
caacaccacagacacaca

SEQ ID NO: 276193 - DNA, 19 bp, Homo sapiens
caacaccacagacacacac

SEQ ID NO: 276194 - DNA, 14 bp, Homo sapiens
caacaccaggactt

SEQ ID NO: 276195 - DNA, 22 bp, Homo sapiens
caacaccaggacttaagacaaa

SEQ ID NO: 276196 - DNA, 18 bp, Homo sapiens
caacaccatcacagcttg

SEQ ID NO: 276197 - DNA, 22 bp, Homo sapiens
caacaccatcacagcttgtttt

SEQ ID NO: 276198 - DNA, 15 bp, Homo sapiens
caacacccaagtcca

SEQ ID NO: 276199 - DNA, 15 bp, Homo sapiens
caacaccccacagga

SEQ ID NO: 276200 - DNA, 20 bp, Homo sapiens
caacacctgtggataaaaca

SEQ ID NO: 276201 - DNA, 14 bp, Homo sapiens
caacaccttcttgg

SEQ ID NO: 276202 - DNA, 20 bp, Homo sapiens
caacaccttcttggcttctg

SEQ ID NO: 276203 - DNA, 20 bp, Homo sapiens
caacaccttgtttccctctc

SEQ ID NO: 276204 - DNA, 13 bp, Homo sapiens
caacacgttacta

SEQ ID NO: 276205 - DNA, 13 bp, Homo sapiens
caacactaataca

SEQ ID NO: 276206 - DNA, 22 bp, Homo sapiens
caacactcttcttgagcagacc

SEQ ID NO: 276207 - DNA, 15 bp, Homo sapiens
caacacttcagactg

SEQ ID NO: 276208 - DNA, 19 bp, Homo sapiens
caacacttgtgttgctttc

SEQ ID NO: 276209 - DNA, 21 bp, Homo sapiens
caacacttgtgttgctttctg

SEQ ID NO: 276210 - DNA, 15 bp, Homo sapiens
caacactttgagcat

SEQ ID NO: 276211 - DNA, 18 bp, Homo sapiens
caacactttgagcatttt

SEQ ID NO: 276212 - DNA, 12 bp, Homo sapiens
caacagaacaac

SEQ ID NO: 276213 - DNA, 20 bp, Homo sapiens
caacagaacaacaacaaagc

SEQ ID NO: 276214 - DNA, 12 bp, Homo sapiens
caacagaagcag

SEQ ID NO: 276215 - DNA, 15 bp, Homo sapiens
caacagaagcttcca

SEQ ID NO: 276216 - DNA, 22 bp, Homo sapiens
cactgctcaagaagacatggag

SEQ ID NO: 276217 - DNA, 22 bp, Homo sapiens
cactgctccatttataacccca

SEQ ID NO: 276218 - DNA, 15 bp, Homo sapiens
cactgctgcaccaga

SEQ ID NO: 276219 - DNA, 15 bp, Homo sapiens
cactgctggctgcct

SEQ ID NO: 276220 - DNA, 18 bp, Homo sapiens
cactgctgttcctgctcc

SEQ ID NO: 276221 - DNA, 17 bp, Homo sapiens
cactgcttccatttaat

SEQ ID NO: 276222 - DNA, 17 bp, Homo sapiens
cactgcttctcggaggc

SEQ ID NO: 276223 - DNA, 20 bp, Homo sapiens
cactgcttctcggaggccag

SEQ ID NO: 276224 - DNA, 22 bp, Homo sapiens
cactgcttctcggaggccaggc

SEQ ID NO: 276225 - DNA, 22 bp, Homo sapiens
cactgctttgcaccgtggtcag

SEQ ID NO: 276226 - DNA, 16 bp, Homo sapiens
cactggaacctccctg

SEQ ID NO: 276227 - DNA, 18 bp, Homo sapiens
cactggaagggtccggct

SEQ ID NO: 276228 - DNA, 22 bp, Homo sapiens
cactggagaattgaaaaggact

SEQ ID NO: 276229 - DNA, 22 bp, Homo sapiens
cactggagaccggaattgagag

SEQ ID NO: 276230 - DNA, 19 bp, Homo sapiens
cactggatgcaaagaaaat

SEQ ID NO: 276231 - DNA, 18 bp, Homo sapiens
cactggcatctctggagt

SEQ ID NO: 276232 - DNA, 14 bp, Homo sapiens
cactggcattgtcc

SEQ ID NO: 276233 - DNA, 18 bp, Homo sapiens
cactggcattgtccctgt

SEQ ID NO: 276234 - DNA, 15 bp, Homo sapiens
cagaagcgtctccct

SEQ ID NO: 276235 - DNA, 22 bp, Homo sapiens
cagaagcgtctcccttggccac

SEQ ID NO: 276236 - DNA, 15 bp, Homo sapiens
cagaagcttgtatta

SEQ ID NO: 276237 - DNA, 22 bp, Homo sapiens
cagaagcttgtggggtacatgg

SEQ ID NO: 276238 - DNA, 21 bp, Homo sapiens
cagaaggaagggcatccttct

SEQ ID NO: 276239 - DNA, 20 bp, Homo sapiens
cagaaggaggaagggactgg

SEQ ID NO: 276240 - DNA, 23 bp, Homo sapiens
cagaaggaggaagggactggtcc

SEQ ID NO: 276241 - DNA, 21 bp, Homo sapiens
cagaaggagggcagagccatg

SEQ ID NO: 276242 - DNA, 22 bp, Homo sapiens
cagaaggagggcagagccatgg

SEQ ID NO: 276243 - DNA, 15 bp, Homo sapiens
cagaaggccacaggc

SEQ ID NO: 276244 - DNA, 20 bp, Homo sapiens
cagaaggccacaggccactg

SEQ ID NO: 276245 - DNA, 21 bp, Homo sapiens
cagaaggccacaggccactgc

SEQ ID NO: 276246 - DNA, 14 bp, Homo sapiens
cagaaggccttgaa

SEQ ID NO: 276247 - DNA, 11 bp, Homo sapiens
cagaagggaat

SEQ ID NO: 276248 - DNA, 18 bp, Homo sapiens
cagaagggaattgctcag

SEQ ID NO: 276249 - DNA, 18 bp, Homo sapiens
cagaagggggccatgagg

SEQ ID NO: 276250 - DNA, 15 bp, Homo sapiens
cagaagggggtctct

SEQ ID NO: 276251 - DNA, 20 bp, Homo sapiens
cagaagtcactcaattgttt

SEQ ID NO: 276252 - DNA, 23 bp, Homo sapiens
cagaagtcagttgcaaattttag

SEQ ID NO: 276253 - DNA, 20 bp, Homo sapiens
cagaagtcctccctcctgca

SEQ ID NO: 276254 - DNA, 22 bp, Homo sapiens
cagaagtcctccctcctgcagg

SEQ ID NO: 276255 - DNA, 23 bp, Homo sapiens
cagaagtcctccctcctgcaggc

SEQ ID NO: 276256 - DNA, 14 bp, Homo sapiens
cagaagtgctcttt

SEQ ID NO: 276257 - DNA, 22 bp, Homo sapiens
cagaagtgctctttgtggcagt

SEQ ID NO: 276258 - DNA, 15 bp, Homo sapiens
cagaagtggagctgg

SEQ ID NO: 276259 - DNA, 18 bp, Homo sapiens
cagaagttgttagtgatt

SEQ ID NO: 276260 - DNA, 23 bp, Homo sapiens
cagaagttgttagtgatttgcta

SEQ ID NO: 276261 - DNA, 12 bp, Homo sapiens
cagaataaaata

SEQ ID NO: 276262 - DNA, 20 bp, Homo sapiens
cagaatacaattcagtttta

SEQ ID NO: 276263 - DNA, 23 bp, Homo sapiens
cagaatacagtaagctgctctat

SEQ ID NO: 276264 - DNA, 14 bp, Homo sapiens
cagaatagtatttt

SEQ ID NO: 276265 - DNA, 15 bp, Homo sapiens
cagaatatctgggat

SEQ ID NO: 276266 - DNA, 13 bp, Homo sapiens
cagaatattgctt

SEQ ID NO: 276267 - DNA, 22 bp, Homo sapiens
cagaatcaaacctttttatatt

SEQ ID NO: 276268 - DNA, 23 bp, Homo sapiens
cagaatcctcagttggaatcatt

SEQ ID NO: 276269 - DNA, 15 bp, Homo sapiens
cagaatcctggccct

SEQ ID NO: 276270 - DNA, 21 bp, Homo sapiens
cagaatcctggccctctgtgt

SEQ ID NO: 276271 - DNA, 14 bp, Homo sapiens
cagaatctgctgtt

SEQ ID NO: 276272 - DNA, 16 bp, Homo sapiens
cagaatctgctgttgc

SEQ ID NO: 276273 - DNA, 18 bp, Homo sapiens
cagaatctgctgttgcca

SEQ ID NO: 276274 - DNA, 22 bp, Homo sapiens
cagaatctgctgttgccatagc

SEQ ID NO: 276275 - DNA, 23 bp, Homo sapiens
cagaatctgctgttgccatagcc

SEQ ID NO: 276276 - DNA, 19 bp, Homo sapiens
cagaatggtgggctccaga

SEQ ID NO: 276277 - DNA, 15 bp, Homo sapiens
cagagagtggctcct

SEQ ID NO: 276278 - DNA, 13 bp, Homo sapiens
cagagagttctgg

SEQ ID NO: 276279 - DNA, 17 bp, Homo sapiens
cagagagttctggtgag

SEQ ID NO: 276280 - DNA, 19 bp, Homo sapiens
cagagatgggactgggagg

SEQ ID NO: 276281 - DNA, 16 bp, Homo sapiens
cagagattagcctgta

SEQ ID NO: 276282 - DNA, 20 bp, Homo sapiens
cagagattgggggggcttgg

SEQ ID NO: 276283 - DNA, 17 bp, Homo sapiens
cagagcaaagggccagg

SEQ ID NO: 276284 - DNA, 18 bp, Homo sapiens
cagagcactgtgtaacca

SEQ ID NO: 276285 - DNA, 22 bp, Homo sapiens
cagagcagatcagtctttgtca

SEQ ID NO: 276286 - DNA, 18 bp, Homo sapiens
cagagcagcacaaagaaa

SEQ ID NO: 276287 - DNA, 19 bp, Homo sapiens
cagagcagcctctgtcctg

SEQ ID NO: 276288 - DNA, 14 bp, Homo sapiens
cagagcagctcccc

SEQ ID NO: 276289 - DNA, 14 bp, Homo sapiens
cagagcaggaggcc

SEQ ID NO: 276290 - DNA, 23 bp, Homo sapiens
cagagcaggaggcccctggccca

SEQ ID NO: 276291 - DNA, 19 bp, Homo sapiens
cagagcaggtctgcaggcc

SEQ ID NO: 276292 - DNA, 23 bp, Homo sapiens
cagagcaggtctgcaggccacca

SEQ ID NO: 276293 - DNA, 24 bp, Homo sapiens
cagagcaggtctgcaggccaccag

SEQ ID NO: 276294 - DNA, 21 bp, Homo sapiens
cagagcatttccaacaccaca

SEQ ID NO: 276295 - DNA, 12 bp, Homo sapiens
cagagccagcct

SEQ ID NO: 276296 - DNA, 16 bp, Homo sapiens
cagagccagcctggga

SEQ ID NO: 276297 - DNA, 12 bp, Homo sapiens
cagagccagggc

SEQ ID NO: 276298 - DNA, 15 bp, Homo sapiens
cagagccagggctgt

SEQ ID NO: 276299 - DNA, 17 bp, Homo sapiens
cagagccagggctgtcc

SEQ ID NO: 276300 - DNA, 17 bp, Homo sapiens
cagagccagtgaaggag

SEQ ID NO: 276301 - DNA, 15 bp, Homo sapiens
cagagcccagcatcc

SEQ ID NO: 276302 - DNA, 14 bp, Homo sapiens
cagagccccactcc

SEQ ID NO: 276303 - DNA, 15 bp, Homo sapiens
cagagccccactccc

SEQ ID NO: 276304 - DNA, 18 bp, Homo sapiens
cagagccccactcccggc

SEQ ID NO: 276305 - DNA, 23 bp, Homo sapiens
cagagccccactcccggccaggc

SEQ ID NO: 276306 - DNA, 18 bp, Homo sapiens
cagagcccgcccacctgg

SEQ ID NO: 276307 - DNA, 21 bp, Homo sapiens
cagagcccgcccacctgggcc

SEQ ID NO: 276308 - DNA, 15 bp, Homo sapiens
cagagccctcggagc

SEQ ID NO: 276309 - DNA, 16 bp, Homo sapiens
cagagccctgccctgc

SEQ ID NO: 276310 - DNA, 16 bp, Homo sapiens
cagagccctggctggg

SEQ ID NO: 276311 - DNA, 17 bp, Homo sapiens
cagagccctggctgggt

SEQ ID NO: 276312 - DNA, 16 bp, Homo sapiens
cagagcccttcactgc

SEQ ID NO: 276313 - DNA, 12 bp, Homo sapiens
cagagccgccac

SEQ ID NO: 276314 - DNA, 16 bp, Homo sapiens
cagagccgttcctggg

SEQ ID NO: 276315 - DNA, 18 bp, Homo sapiens
cagagccgttcctgggac

SEQ ID NO: 276316 - DNA, 20 bp, Homo sapiens
cagagccgttcctgggactg

SEQ ID NO: 276317 - DNA, 15 bp, Homo sapiens
cagagcctaagaaaa

SEQ ID NO: 276318 - DNA, 18 bp, Homo sapiens
cagagcctatggaaaggg

SEQ ID NO: 276319 - DNA, 14 bp, Homo sapiens
cagagcctgtcccc

SEQ ID NO: 276320 - DNA, 23 bp, Homo sapiens
cagagcctgtccccgccttccct

SEQ ID NO: 276321 - DNA, 20 bp, Homo sapiens
cagagcgagactctgtctca

SEQ ID NO: 276322 - DNA, 20 bp, Homo sapiens
cagagcgagattccgtctca

SEQ ID NO: 276323 - DNA, 14 bp, Homo sapiens
cagagcgtccttcc

SEQ ID NO: 276324 - DNA, 19 bp, Homo sapiens
cagagcgtccttccccctg

SEQ ID NO: 276325 - DNA, 14 bp, Homo sapiens
cagagctaggcccc

SEQ ID NO: 276326 - DNA, 11 bp, Homo sapiens
cagagctcaga

SEQ ID NO: 276327 - DNA, 19 bp, Homo sapiens
cagagctcagcacagcctc

SEQ ID NO: 276328 - DNA, 20 bp, Homo sapiens
cagatctagccaggcctccc

SEQ ID NO: 276329 - DNA, 24 bp, Homo sapiens
cagatctgacatgattccttcctg

SEQ ID NO: 276330 - DNA, 20 bp, Homo sapiens
cagatctgcctgggcctgtg

SEQ ID NO: 276331 - DNA, 22 bp, Homo sapiens
cagatctgcctgggcctgtgca

SEQ ID NO: 276332 - DNA, 23 bp, Homo sapiens
cagatctgcctgggcctgtgcag

SEQ ID NO: 276333 - DNA, 12 bp, Homo sapiens
cagatcttgagc

SEQ ID NO: 276334 - DNA, 16 bp, Homo sapiens
cagatcttgagcaagg

SEQ ID NO: 276335 - DNA, 18 bp, Homo sapiens
cagatgaaaaaagttaac

SEQ ID NO: 276336 - DNA, 13 bp, Homo sapiens
cagatgaaaataa

SEQ ID NO: 276337 - DNA, 18 bp, Homo sapiens
cagatgaaaccaggtcac

SEQ ID NO: 276338 - DNA, 22 bp, Homo sapiens
cagatgaactctttctggcctg

SEQ ID NO: 276339 - DNA, 17 bp, Homo sapiens
cagatgaatgccgtgga

SEQ ID NO: 276340 - DNA, 21 bp, Homo sapiens
cagatgacagggagctgggga

SEQ ID NO: 276341 - DNA, 13 bp, Homo sapiens
cagatgacccctc

SEQ ID NO: 276342 - DNA, 22 bp, Homo sapiens
cagatgagaagactagcagcta

SEQ ID NO: 276343 - DNA, 14 bp, Homo sapiens
cagatgagaagtta

SEQ ID NO: 276344 - DNA, 19 bp, Homo sapiens
cagatgagcaaggacattg

SEQ ID NO: 276345 - DNA, 22 bp, Homo sapiens
cagatgccatggcctgtgctgg

SEQ ID NO: 276346 - DNA, 21 bp, Homo sapiens
cagatgcctcctctgtcctca

SEQ ID NO: 276347 - DNA, 14 bp, Homo sapiens
cagatgccttctag

SEQ ID NO: 276348 - DNA, 16 bp, Homo sapiens
cagatgctaataaact

SEQ ID NO: 276349 - DNA, 17 bp, Homo sapiens
cagatgctaataaactg

SEQ ID NO: 276350 - DNA, 18 bp, Homo sapiens
cagatgctaataaactgt

SEQ ID NO: 276351 - DNA, 14 bp, Homo sapiens
cagatggaaagaaa

SEQ ID NO: 276352 - DNA, 18 bp, Homo sapiens
cagatggaaatattttga

SEQ ID NO: 276353 - DNA, 21 bp, Homo sapiens
cagatggaatgctgtgttaaa

SEQ ID NO: 276354 - DNA, 14 bp, Homo sapiens
cagatggagcccat

SEQ ID NO: 276355 - DNA, 19 bp, Homo sapiens
cagatggaggttctcagag

SEQ ID NO: 276356 - DNA, 22 bp, Homo sapiens
cagatggaggttctcagagcca

SEQ ID NO: 276357 - DNA, 21 bp, Homo sapiens
cagatggatttgcctgtgcca

SEQ ID NO: 276358 - DNA, 17 bp, Homo sapiens
cagatggcacctgtggc

SEQ ID NO: 276359 - DNA, 22 bp, Homo sapiens
cagatggcggtgatcagcagag

SEQ ID NO: 276360 - DNA, 16 bp, Homo sapiens
cagatggctgtgaaaa

SEQ ID NO: 276361 - DNA, 21 bp, Homo sapiens
cagatgggcaaggcctttggc

SEQ ID NO: 276362 - DNA, 12 bp, Homo sapiens
cagatgtccctg

SEQ ID NO: 276363 - DNA, 13 bp, Homo sapiens
cagatgtccctga

SEQ ID NO: 276364 - DNA, 15 bp, Homo sapiens
cagatgtcttctgcc

SEQ ID NO: 276365 - DNA, 14 bp, Homo sapiens
cagatgtgcaggct

SEQ ID NO: 276366 - DNA, 20 bp, Homo sapiens
cagatgtgcaggctcctcct

SEQ ID NO: 276367 - DNA, 23 bp, Homo sapiens
cagattaaaagcacaagcgtgtt

SEQ ID NO: 276368 - DNA, 14 bp, Homo sapiens
cagattactgccca

SEQ ID NO: 276369 - DNA, 18 bp, Homo sapiens
cagattatggaagttttc

SEQ ID NO: 276370 - DNA, 23 bp, Homo sapiens
cagattccaggcgatgtgcaagt

SEQ ID NO: 276371 - DNA, 14 bp, Homo sapiens
cagattcctgggcc

SEQ ID NO: 276372 - DNA, 16 bp, Homo sapiens
cagattcctgggcctg

SEQ ID NO: 276373 - DNA, 18 bp, Homo sapiens
cagattcctgggcctgtc

SEQ ID NO: 276374 - DNA, 13 bp, Homo sapiens
cagattgcctcct

SEQ ID NO: 276375 - DNA, 21 bp, Homo sapiens
cagattggcacccctttctag

SEQ ID NO: 276376 - DNA, 22 bp, Homo sapiens
cagattggcacccctttctagt

SEQ ID NO: 276377 - DNA, 23 bp, Homo sapiens
cagattttaattttgaataaata

SEQ ID NO: 276378 - DNA, 14 bp, Homo sapiens
cagattttacaaaa

SEQ ID NO: 276379 - DNA, 16 bp, Homo sapiens
cagattttacaaaaga

SEQ ID NO: 276380 - DNA, 19 bp, Homo sapiens
cagattttttacagctgcc

SEQ ID NO: 276381 - DNA, 12 bp, Homo sapiens
cagcaaaaccat

SEQ ID NO: 276382 - DNA, 18 bp, Homo sapiens
cagcaaaaccattgcttc

SEQ ID NO: 276383 - DNA, 19 bp, Homo sapiens
cagcaaaaccattgcttca

SEQ ID NO: 276384 - DNA, 14 bp, Homo sapiens
cagcaaaccggggc

SEQ ID NO: 276385 - DNA, 13 bp, Homo sapiens
cagcaaaggaaga

SEQ ID NO: 276386 - DNA, 21 bp, Homo sapiens
cagcaaattcttgaataaact

SEQ ID NO: 276387 - DNA, 16 bp, Homo sapiens
cagcaacacccaagtc

SEQ ID NO: 276388 - DNA, 20 bp, Homo sapiens
cagcaacacccaagtccacc

SEQ ID NO: 276389 - DNA, 18 bp, Homo sapiens
cagcaacatctcgagccc

SEQ ID NO: 276390 - DNA, 10 bp, Homo sapiens
cagcaaccct

SEQ ID NO: 276391 - DNA, 20 bp, Homo sapiens
cagcaacggggaggccaagt

SEQ ID NO: 276392 - DNA, 14 bp, Homo sapiens
cagcaactccaact

SEQ ID NO: 276393 - DNA, 19 bp, Homo sapiens
cagcaacttgtctttttct

SEQ ID NO: 276394 - DNA, 15 bp, Homo sapiens
cagcaaggcacaggc

SEQ ID NO: 276395 - DNA, 13 bp, Homo sapiens
cagcaaggcaggt

SEQ ID NO: 276396 - DNA, 16 bp, Homo sapiens
cagcaaggggctctgc

SEQ ID NO: 276397 - DNA, 17 bp, Homo sapiens
cagcaaggggctctgcc

SEQ ID NO: 276398 - DNA, 20 bp, Homo sapiens
cagcaaggggctctgccctc

SEQ ID NO: 276399 - DNA, 20 bp, Homo sapiens
cagcaagtcccagacaagga

SEQ ID NO: 276400 - DNA, 21 bp, Homo sapiens
cagcaagtcccagacaaggag

SEQ ID NO: 276401 - DNA, 22 bp, Homo sapiens
cagcaagtcccagacaaggaga

SEQ ID NO: 276402 - DNA, 12 bp, Homo sapiens
cagcaagtgtac

SEQ ID NO: 276403 - DNA, 16 bp, Homo sapiens
cagcaagtttataaaa

SEQ ID NO: 276404 - DNA, 23 bp, Homo sapiens
cagcaatatattaccagcaagaa

SEQ ID NO: 276405 - DNA, 15 bp, Homo sapiens
cagcacaattctgtc

SEQ ID NO: 276406 - DNA, 18 bp, Homo sapiens
cagcacaattctgtccct

SEQ ID NO: 276407 - DNA, 19 bp, Homo sapiens
cagcacaattctgtccctg

SEQ ID NO: 276408 - DNA, 20 bp, Homo sapiens
cagcacaattctgtccctgt

SEQ ID NO: 276409 - DNA, 22 bp, Homo sapiens
cagcacaattctgtccctgtcc

SEQ ID NO: 276410 - DNA, 12 bp, Homo sapiens
cagcacagagag

SEQ ID NO: 276411 - DNA, 20 bp, Homo sapiens
cagcacagagagggggccac

SEQ ID NO: 276412 - DNA, 13 bp, Homo sapiens
cagcacagcctca

SEQ ID NO: 276413 - DNA, 18 bp, Homo sapiens
cagcacaggggccccaga

SEQ ID NO: 276414 - DNA, 21 bp, Homo sapiens
cagcacaggggccccagatct

SEQ ID NO: 276415 - DNA, 17 bp, Homo sapiens
cagcacatgctggccag

SEQ ID NO: 276416 - DNA, 18 bp, Homo sapiens
cagcacatgctggccagc

SEQ ID NO: 276417 - DNA, 23 bp, Homo sapiens
cagcacatttcctctctatcttt

SEQ ID NO: 276418 - DNA, 22 bp, Homo sapiens
cagcaccaccctagtcccttcc

SEQ ID NO: 276419 - DNA, 13 bp, Homo sapiens
cagcaccagcctg

SEQ ID NO: 276420 - DNA, 17 bp, Homo sapiens
cagcaccagcctgagcc

SEQ ID NO: 276421 - DNA, 18 bp, Homo sapiens
cagcaccagcctgagcca

SEQ ID NO: 276422 - DNA, 13 bp, Homo sapiens
cagcacccccacc

SEQ ID NO: 276423 - DNA, 19 bp, Homo sapiens
cagcacccccacccacctc

SEQ ID NO: 276424 - DNA, 12 bp, Homo sapiens
cagcaccctggg

SEQ ID NO: 276425 - DNA, 22 bp, Homo sapiens
cagctctttcctccttccatgg

SEQ ID NO: 276426 - DNA, 16 bp, Homo sapiens
cagctctttcttcttt

SEQ ID NO: 276427 - DNA, 21 bp, Homo sapiens
cagctctttggtgccagctgt

SEQ ID NO: 276428 - DNA, 17 bp, Homo sapiens
cagctgaacacaagcaa

SEQ ID NO: 276429 - DNA, 19 bp, Homo sapiens
cagctgaagtctctttttc

SEQ ID NO: 276430 - DNA, 13 bp, Homo sapiens
cagctgacctctg

SEQ ID NO: 276431 - DNA, 16 bp, Homo sapiens
cagctgactgtggccc

SEQ ID NO: 276432 - DNA, 20 bp, Homo sapiens
cagctgagcattctcatttt

SEQ ID NO: 276433 - DNA, 20 bp, Homo sapiens
cagctgagcttgagctcccc

SEQ ID NO: 276434 - DNA, 23 bp, Homo sapiens
cagctgagcttgagctcccctgg

SEQ ID NO: 276435 - DNA, 20 bp, Homo sapiens
cagctgaggacacaccccac

SEQ ID NO: 276436 - DNA, 19 bp, Homo sapiens
cagctgaggtctcttgagg

SEQ ID NO: 276437 - DNA, 13 bp, Homo sapiens
cagctgagtgaga

SEQ ID NO: 276438 - DNA, 15 bp, Homo sapiens
cagctgattttaaca

SEQ ID NO: 276439 - DNA, 18 bp, Homo sapiens
cagctgattttaacaata

SEQ ID NO: 276440 - DNA, 15 bp, Homo sapiens
cagctgcacattcct

SEQ ID NO: 276441 - DNA, 21 bp, Homo sapiens
cagctgcacattcctggcccc

SEQ ID NO: 276442 - DNA, 16 bp, Homo sapiens
cagctgcaccagcagg

SEQ ID NO: 276443 - DNA, 16 bp, Homo sapiens
cagctgcagagacaga

SEQ ID NO: 276444 - DNA, 14 bp, Homo sapiens
cagctgcagctggg

SEQ ID NO: 276445 - DNA, 19 bp, Homo sapiens
cagctgcagctgggcccca

SEQ ID NO: 276446 - DNA, 17 bp, Homo sapiens
cagctgcagctgggctg

SEQ ID NO: 276447 - DNA, 12 bp, Homo sapiens
cagctgccaagc

SEQ ID NO: 276448 - DNA, 21 bp, Homo sapiens
cagctgccaagcactcgagac

SEQ ID NO: 276449 - DNA, 14 bp, Homo sapiens
cagctgccaagtgc

SEQ ID NO: 276450 - DNA, 13 bp, Homo sapiens
cagctgccagaga

SEQ ID NO: 276451 - DNA, 17 bp, Homo sapiens
cagctgcccacaagcca

SEQ ID NO: 276452 - DNA, 20 bp, Homo sapiens
cagctgcccccgctcatggg

SEQ ID NO: 276453 - DNA, 17 bp, Homo sapiens
cagctgcctcacttcct

SEQ ID NO: 276454 - DNA, 20 bp, Homo sapiens
cagctgcctgaaacagccat

SEQ ID NO: 276455 - DNA, 19 bp, Homo sapiens
cagctgcgggtctgaagga

SEQ ID NO: 276456 - DNA, 13 bp, Homo sapiens
cagctgctcccct

SEQ ID NO: 276457 - DNA, 17 bp, Homo sapiens
cagctgctcccctccct

SEQ ID NO: 276458 - DNA, 20 bp, Homo sapiens
cagctgctcccctccctcct

SEQ ID NO: 276459 - DNA, 17 bp, Homo sapiens
cagctgctcctcgcagt

SEQ ID NO: 276460 - DNA, 20 bp, Homo sapiens
cagctgctcctcgcagttcg

SEQ ID NO: 276461 - DNA, 12 bp, Homo sapiens
cagctgctctgc

SEQ ID NO: 276462 - DNA, 15 bp, Homo sapiens
cagctgctctgcccc

SEQ ID NO: 276463 - DNA, 12 bp, Homo sapiens
cagctgctcttg

SEQ ID NO: 276464 - DNA, 23 bp, Homo sapiens
cagctgctcttgcatctgggcca

SEQ ID NO: 276465 - DNA, 13 bp, Homo sapiens
cagctgctggaga

SEQ ID NO: 276466 - DNA, 14 bp, Homo sapiens
cagctgctgtgcca

SEQ ID NO: 276467 - DNA, 13 bp, Homo sapiens
cagctgcttctgt

SEQ ID NO: 276468 - DNA, 15 bp, Homo sapiens
cagctgcttctgtgc

SEQ ID NO: 276469 - DNA, 22 bp, Homo sapiens
cagctgcttctgtgcatttgtg

SEQ ID NO: 276470 - DNA, 13 bp, Homo sapiens
cagctggcagagt

SEQ ID NO: 276471 - DNA, 16 bp, Homo sapiens
cagctggcagcgcctc

SEQ ID NO: 276472 - DNA, 19 bp, Homo sapiens
cagctggcagcgcctcccg

SEQ ID NO: 276473 - DNA, 14 bp, Homo sapiens
cagctggcaggaga

SEQ ID NO: 276474 - DNA, 19 bp, Homo sapiens
cagctggcggaacctggct

SEQ ID NO: 276475 - DNA, 21 bp, Homo sapiens
cagctggcggaacctggctgc

SEQ ID NO: 276476 - DNA, 22 bp, Homo sapiens
cagctggcggaacctggctgcg

SEQ ID NO: 276477 - DNA, 14 bp, Homo sapiens
cagctggctctcca

SEQ ID NO: 276478 - DNA, 16 bp, Homo sapiens
cagctgggacccctcc

SEQ ID NO: 276479 - DNA, 23 bp, Homo sapiens
cagctgggacccctcccaacctc

SEQ ID NO: 276480 - DNA, 21 bp, Homo sapiens
cagctgggccccatgctctgc

SEQ ID NO: 276481 - DNA, 22 bp, Homo sapiens
cagctgggccccatgctctgcc

SEQ ID NO: 276482 - DNA, 11 bp, Homo sapiens
cagctgggctc

SEQ ID NO: 276483 - DNA, 15 bp, Homo sapiens
cagctggggcccctc

SEQ ID NO: 276484 - DNA, 13 bp, Homo sapiens
cagctggggctgt

SEQ ID NO: 276485 - DNA, 18 bp, Homo sapiens
cagctggggggctgtcct

SEQ ID NO: 276486 - DNA, 14 bp, Homo sapiens
cagctggtctgttt

SEQ ID NO: 276487 - DNA, 11 bp, Homo sapiens
cagctggtgga

SEQ ID NO: 276488 - DNA, 18 bp, Homo sapiens
cagctggtggatggtgac

SEQ ID NO: 276489 - DNA, 14 bp, Homo sapiens
cagctggtgtcact

SEQ ID NO: 276490 - DNA, 21 bp, Homo sapiens
cagctggtgtcactctgcctc

SEQ ID NO: 276491 - DNA, 23 bp, Homo sapiens
cagctggtgtcactctgcctcta

SEQ ID NO: 276492 - DNA, 14 bp, Homo sapiens
cagctgtactgagt

SEQ ID NO: 276493 - DNA, 16 bp, Homo sapiens
cagctgtagccatggc

SEQ ID NO: 276494 - DNA, 21 bp, Homo sapiens
cagctgtagccatggctcagg

SEQ ID NO: 276495 - DNA, 18 bp, Homo sapiens
cagctgtcccctctccct

SEQ ID NO: 276496 - DNA, 23 bp, Homo sapiens
cagctgtgctgcaccccatgtgg

SEQ ID NO: 276497 - DNA, 23 bp, Homo sapiens
cagctgtggtgaggttgggcagc

SEQ ID NO: 276498 - DNA, 20 bp, Homo sapiens
cagctgttcagattggacat

SEQ ID NO: 276499 - DNA, 15 bp, Homo sapiens
cagctgttccacagg

SEQ ID NO: 276500 - DNA, 13 bp, Homo sapiens
cagctgttcctgt

SEQ ID NO: 276501 - DNA, 14 bp, Homo sapiens
cagctgtttaagat

SEQ ID NO: 276502 - DNA, 14 bp, Homo sapiens
cagctgtttgtcat

SEQ ID NO: 276503 - DNA, 21 bp, Homo sapiens
cagctgttttagttaaatttc

SEQ ID NO: 276504 - DNA, 22 bp, Homo sapiens
cagcttatgggatccttgtctt

SEQ ID NO: 276505 - DNA, 17 bp, Homo sapiens
cagcttcaaaacagaac

SEQ ID NO: 276506 - DNA, 16 bp, Homo sapiens
cagcttcaccagagca

SEQ ID NO: 276507 - DNA, 14 bp, Homo sapiens
cagcttcacttaaa

SEQ ID NO: 276508 - DNA, 16 bp, Homo sapiens
cagcttcacttaaaat

SEQ ID NO: 276509 - DNA, 22 bp, Homo sapiens
cagcttcacttaaaatcaaatt

SEQ ID NO: 276510 - DNA, 12 bp, Homo sapiens
cagcttcagtct

SEQ ID NO: 276511 - DNA, 13 bp, Homo sapiens
cagcttcagtctc

SEQ ID NO: 276512 - DNA, 18 bp, Homo sapiens
cagcttcagtctctgcag

SEQ ID NO: 276513 - DNA, 12 bp, Homo sapiens
cagcttcagttg

SEQ ID NO: 276514 - DNA, 21 bp, Homo sapiens
cagcttcatgcctttgtaagt

SEQ ID NO: 276515 - DNA, 16 bp, Homo sapiens
cagcttcccaacaata

SEQ ID NO: 276516 - DNA, 20 bp, Homo sapiens
cagcttcggagggcccctgc

SEQ ID NO: 276517 - DNA, 19 bp, Homo sapiens
cagcttctaattttgtgct

SEQ ID NO: 276518 - DNA, 22 bp, Homo sapiens
cagcttctggtactctcctaga

SEQ ID NO: 276519 - DNA, 23 bp, Homo sapiens
cagcttctggtactctcctagag

SEQ ID NO: 276520 - DNA, 21 bp, Homo sapiens
cagcttcttgcttgtaaaaat

SEQ ID NO: 276521 - DNA, 14 bp, Homo sapiens
cagcttgctgcacc

SEQ ID NO: 276522 - DNA, 17 bp, Homo sapiens
cagcttgctgccctagg

SEQ ID NO: 276523 - DNA, 15 bp, Homo sapiens
cagcttggctgagcc

SEQ ID NO: 276524 - DNA, 23 bp, Homo sapiens
cagcttgggagagcccctggggc

SEQ ID NO: 276525 - DNA, 20 bp, Homo sapiens
cagcttgggcccagctgggc

SEQ ID NO: 276526 - DNA, 17 bp, Homo sapiens
cagcttggggccatcgg

SEQ ID NO: 276527 - DNA, 23 bp, Homo sapiens
cagcttgtccaacaactccagga

SEQ ID NO: 276528 - DNA, 23 bp, Homo sapiens
caggagacactggtctcagagga

SEQ ID NO: 276529 - DNA, 14 bp, Homo sapiens
caggagacaggaag

SEQ ID NO: 276530 - DNA, 18 bp, Homo sapiens
caggagactggcaagagc

SEQ ID NO: 276531 - DNA, 14 bp, Homo sapiens
caggagagaaaggg

SEQ ID NO: 276532 - DNA, 11 bp, Homo sapiens
caggagagaga

SEQ ID NO: 276533 - DNA, 19 bp, Homo sapiens
caggagagagagagagaaa

SEQ ID NO: 276534 - DNA, 21 bp, Homo sapiens
caggagagagagagagaaaga

SEQ ID NO: 276535 - DNA, 17 bp, Homo sapiens
caggagagcccccacca

SEQ ID NO: 276536 - DNA, 16 bp, Homo sapiens
caggagcaatgggact

SEQ ID NO: 276537 - DNA, 15 bp, Homo sapiens
caggagcacaggcag

SEQ ID NO: 276538 - DNA, 23 bp, Homo sapiens
caggagcacaggcagctggatga

SEQ ID NO: 276539 - DNA, 13 bp, Homo sapiens
caggagcagctgt

SEQ ID NO: 276540 - DNA, 19 bp, Homo sapiens
caggagcagctgtgctgca

SEQ ID NO: 276541 - DNA, 13 bp, Homo sapiens
caggagccagcag

SEQ ID NO: 276542 - DNA, 14 bp, Homo sapiens
caggagccagcagg

SEQ ID NO: 276543 - DNA, 13 bp, Homo sapiens
caggagccccagc

SEQ ID NO: 276544 - DNA, 14 bp, Homo sapiens
caggagccccagcc

SEQ ID NO: 276545 - DNA, 17 bp, Homo sapiens
caggagccccagccagc

SEQ ID NO: 276546 - DNA, 19 bp, Homo sapiens
caggagccccagccagccc

SEQ ID NO: 276547 - DNA, 21 bp, Homo sapiens
caggagctagcccagtccctg

SEQ ID NO: 276548 - DNA, 13 bp, Homo sapiens
caggagctcaggt

SEQ ID NO: 276549 - DNA, 14 bp, Homo sapiens
caggagctgagtca

SEQ ID NO: 276550 - DNA, 13 bp, Homo sapiens
caggaggaactgg

SEQ ID NO: 276551 - DNA, 14 bp, Homo sapiens
caggaggaactggt

SEQ ID NO: 276552 - DNA, 23 bp, Homo sapiens
caggaggacctggggggggcaag

SEQ ID NO: 276553 - DNA, 13 bp, Homo sapiens
caggaggagacag

SEQ ID NO: 276554 - DNA, 22 bp, Homo sapiens
caggaggagacagtcaggaagc

SEQ ID NO: 276555 - DNA, 14 bp, Homo sapiens
caggaggcagtggc

SEQ ID NO: 276556 - DNA, 22 bp, Homo sapiens
caggaggcagtggcttggagca

SEQ ID NO: 276557 - DNA, 18 bp, Homo sapiens
caggaggcccctggccca

SEQ ID NO: 276558 - DNA, 20 bp, Homo sapiens
caggaggcccctggcccagc

SEQ ID NO: 276559 - DNA, 16 bp, Homo sapiens
caggaggcctgggagg

SEQ ID NO: 276560 - DNA, 19 bp, Homo sapiens
caggaggcctgggagggca

SEQ ID NO: 276561 - DNA, 15 bp, Homo sapiens
caggaggctggcagt

SEQ ID NO: 276562 - DNA, 11 bp, Homo sapiens
caggagggagg

SEQ ID NO: 276563 - DNA, 12 bp, Homo sapiens
caggagggaggg

SEQ ID NO: 276564 - DNA, 12 bp, Homo sapiens
caggagggccct

SEQ ID NO: 276565 - DNA, 19 bp, Homo sapiens
caggaggggtctgcctccc

SEQ ID NO: 276566 - DNA, 20 bp, Homo sapiens
caggagggtctatggggaga

SEQ ID NO: 276567 - DNA, 16 bp, Homo sapiens
caggagggtggcactt

SEQ ID NO: 276568 - DNA, 14 bp, Homo sapiens
caggaggtgcctga

SEQ ID NO: 276569 - DNA, 18 bp, Homo sapiens
caggaggtggctatggcc

SEQ ID NO: 276570 - DNA, 18 bp, Homo sapiens
caggaggttggtgactga

SEQ ID NO: 276571 - DNA, 18 bp, Homo sapiens
caggagtctctgccaccc

SEQ ID NO: 276572 - DNA, 20 bp, Homo sapiens
caggagtctctgccacccac

SEQ ID NO: 276573 - DNA, 14 bp, Homo sapiens
caggagtctgtgct

SEQ ID NO: 276574 - DNA, 18 bp, Homo sapiens
caggagtgggtgggacac

SEQ ID NO: 276575 - DNA, 20 bp, Homo sapiens
caggagtgggtgggacacag

SEQ ID NO: 276576 - DNA, 23 bp, Homo sapiens
caggagtgggtgggacacagaga

SEQ ID NO: 276577 - DNA, 19 bp, Homo sapiens
caggagttaaaaagggcag

SEQ ID NO: 276578 - DNA, 20 bp, Homo sapiens
caggagtttgagacaagccc

SEQ ID NO: 276579 - DNA, 23 bp, Homo sapiens
caggagtttgagacaagccctgg

SEQ ID NO: 276580 - DNA, 18 bp, Homo sapiens
caggataaactgaaaact

SEQ ID NO: 276581 - DNA, 17 bp, Homo sapiens
caggatccgctgccacc

SEQ ID NO: 276582 - DNA, 23 bp, Homo sapiens
caggatgaaagttcccccatcag

SEQ ID NO: 276583 - DNA, 17 bp, Homo sapiens
caggatgaacccaggac

SEQ ID NO: 276584 - DNA, 23 bp, Homo sapiens
caggatgcacggtttctgttctg

SEQ ID NO: 276585 - DNA, 22 bp, Homo sapiens
caggatggaggggtggtcctga

SEQ ID NO: 276586 - DNA, 18 bp, Homo sapiens
caggatggcgtgtcccct

SEQ ID NO: 276587 - DNA, 21 bp, Homo sapiens
caggatggcgtgtcccctgcc

SEQ ID NO: 276588 - DNA, 20 bp, Homo sapiens
caggatggctggaacactgt

SEQ ID NO: 276589 - DNA, 15 bp, Homo sapiens
caggatggctgtgtg

SEQ ID NO: 276590 - DNA, 17 bp, Homo sapiens
caggattcaaccctggc

SEQ ID NO: 276591 - DNA, 20 bp, Homo sapiens
caggattgtccacaaatgtc

SEQ ID NO: 276592 - DNA, 21 bp, Homo sapiens
caggattgtccacaaatgtcc

SEQ ID NO: 276593 - DNA, 20 bp, Homo sapiens
caggattgtctggggccgag

SEQ ID NO: 276594 - DNA, 22 bp, Homo sapiens
cagggttaaagaaaggcagaga

SEQ ID NO: 276595 - DNA, 20 bp, Homo sapiens
cagggttccagacagggtgg

SEQ ID NO: 276596 - DNA, 23 bp, Homo sapiens
cagggttccagacagggtggggc

SEQ ID NO: 276597 - DNA, 20 bp, Homo sapiens
cagggttcccccagccctgt

SEQ ID NO: 276598 - DNA, 19 bp, Homo sapiens
cagggttctagaaggggcg

SEQ ID NO: 276599 - DNA, 13 bp, Homo sapiens
cagggttctgtat

SEQ ID NO: 276600 - DNA, 15 bp, Homo sapiens
cagggttctgtattg

SEQ ID NO: 276601 - DNA, 13 bp, Homo sapiens
cagggttgggccc

SEQ ID NO: 276602 - DNA, 16 bp, Homo sapiens
cagggttgggcccaga

SEQ ID NO: 276603 - DNA, 15 bp, Homo sapiens
cagggtttcaccatg

SEQ ID NO: 276604 - DNA, 19 bp, Homo sapiens
cagggttttatctctgtct

SEQ ID NO: 276605 - DNA, 18 bp, Homo sapiens
cagggttttttcattttt

SEQ ID NO: 276606 - DNA, 17 bp, Homo sapiens
caggtaaattaagacat

SEQ ID NO: 276607 - DNA, 18 bp, Homo sapiens
caggtaccacccttcaga

SEQ ID NO: 276608 - DNA, 20 bp, Homo sapiens
caggtaccacccttcagacc

SEQ ID NO: 276609 - DNA, 21 bp, Homo sapiens
caggtagatcgcttgagccca

SEQ ID NO: 276610 - DNA, 23 bp, Homo sapiens
caggtagatcgcttgagcccagg

SEQ ID NO: 276611 - DNA, 18 bp, Homo sapiens
caggtagctgaaagggga

SEQ ID NO: 276612 - DNA, 22 bp, Homo sapiens
caggtaggcccttgtcctgcca

SEQ ID NO: 276613 - DNA, 23 bp, Homo sapiens
caggtagttgcaattgaattaaa

SEQ ID NO: 276614 - DNA, 16 bp, Homo sapiens
caggtagtttgtacca

SEQ ID NO: 276615 - DNA, 22 bp, Homo sapiens
caggtcagaagagggagaggag

SEQ ID NO: 276616 - DNA, 21 bp, Homo sapiens
caggtcagctgttactttctt

SEQ ID NO: 276617 - DNA, 13 bp, Homo sapiens
caggtcagggcta

SEQ ID NO: 276618 - DNA, 14 bp, Homo sapiens
caggtcccaggttg

SEQ ID NO: 276619 - DNA, 12 bp, Homo sapiens
caggtcccagtg

SEQ ID NO: 276620 - DNA, 15 bp, Homo sapiens
caggtcccagtgcca

SEQ ID NO: 276621 - DNA, 21 bp, Homo sapiens
caggtcccagtgccattggct

SEQ ID NO: 276622 - DNA, 18 bp, Homo sapiens
caggtcccgagccccctg

SEQ ID NO: 276623 - DNA, 22 bp, Homo sapiens
caggtcccgagccccctgtcct

SEQ ID NO: 276624 - DNA, 16 bp, Homo sapiens
caggtccctggaccag

SEQ ID NO: 276625 - DNA, 17 bp, Homo sapiens
caggtccctggaccagc

SEQ ID NO: 276626 - DNA, 12 bp, Homo sapiens
caggtcctgggg

SEQ ID NO: 276627 - DNA, 16 bp, Homo sapiens
caggtcctttccttct

SEQ ID NO: 276628 - DNA, 19 bp, Homo sapiens
caggtcgggctcagctctg

SEQ ID NO: 276629 - DNA, 22 bp, Homo sapiens
caggtcgggctcagctctggct

SEQ ID NO: 276630 - DNA, 20 bp, Homo sapiens
caggtctccatgaagaagct

SEQ ID NO: 276631 - DNA, 17 bp, Homo sapiens
caggtctgcaggccacc

SEQ ID NO: 276632 - DNA, 19 bp, Homo sapiens
caggtctgcaggccaccag

SEQ ID NO: 276633 - DNA, 22 bp, Homo sapiens
caggtctgcaggccaccagctg

SEQ ID NO: 276634 - DNA, 17 bp, Homo sapiens
caggtctgggagaggca

SEQ ID NO: 276635 - DNA, 12 bp, Homo sapiens
caggtctttgaa

SEQ ID NO: 276636 - DNA, 22 bp, Homo sapiens
caggtctttgaaatatgcatgt

SEQ ID NO: 276637 - DNA, 18 bp, Homo sapiens
caggtgaacgctcagcgc

SEQ ID NO: 276638 - DNA, 17 bp, Homo sapiens
caggtgaccttctggga

SEQ ID NO: 276639 - DNA, 14 bp, Homo sapiens
caggtgatccaccc

SEQ ID NO: 276640 - DNA, 15 bp, Homo sapiens
cagtcagggacagca

SEQ ID NO: 276641 - DNA, 22 bp, Homo sapiens
cagtcagggacagcagcctccc

SEQ ID NO: 276642 - DNA, 21 bp, Homo sapiens
cagtcaggtagttgcaattga

SEQ ID NO: 276643 - DNA, 18 bp, Homo sapiens
cagtcagttcccggagca

SEQ ID NO: 276644 - DNA, 16 bp, Homo sapiens
cagtcatgcactcaca

SEQ ID NO: 276645 - DNA, 21 bp, Homo sapiens
cagtcatgcgtccactttccc

SEQ ID NO: 276646 - DNA, 21 bp, Homo sapiens
cagtcattatttaaagcacat

SEQ ID NO: 276647 - DNA, 22 bp, Homo sapiens
cagtcattgtaacctcgtgtct

SEQ ID NO: 276648 - DNA, 12 bp, Homo sapiens
cagtcatttaaa

SEQ ID NO: 276649 - DNA, 12 bp, Homo sapiens
cagtccagagct

SEQ ID NO: 276650 - DNA, 16 bp, Homo sapiens
cagtccagagcttttc

SEQ ID NO: 276651 - DNA, 14 bp, Homo sapiens
cagtccattgaaag

SEQ ID NO: 276652 - DNA, 13 bp, Homo sapiens
cagtcccagcaca

SEQ ID NO: 276653 - DNA, 14 bp, Homo sapiens
cagtcccagcacat

SEQ ID NO: 276654 - DNA, 22 bp, Homo sapiens
cagtcccagtattctcagagca

SEQ ID NO: 276655 - DNA, 21 bp, Homo sapiens
cagtccccctatccttggcac

SEQ ID NO: 276656 - DNA, 23 bp, Homo sapiens
cagtccccctatccttggcacca

SEQ ID NO: 276657 - DNA, 16 bp, Homo sapiens
cagtccccgggaaagg

SEQ ID NO: 276658 - DNA, 20 bp, Homo sapiens
cagtccctccctcctggctc

SEQ ID NO: 276659 - DNA, 12 bp, Homo sapiens
cagtccctcctg

SEQ ID NO: 276660 - DNA, 13 bp, Homo sapiens
cagtccctcctgt

SEQ ID NO: 276661 - DNA, 17 bp, Homo sapiens
cagtccctgagcagtct

SEQ ID NO: 276662 - DNA, 14 bp, Homo sapiens
cagtccctggagct

SEQ ID NO: 276663 - DNA, 17 bp, Homo sapiens
cagtcctcacagcctct

SEQ ID NO: 276664 - DNA, 19 bp, Homo sapiens
cagtcctcacagcctctcc

SEQ ID NO: 276665 - DNA, 18 bp, Homo sapiens
cagtcctccagaccacca

SEQ ID NO: 276666 - DNA, 17 bp, Homo sapiens
cagtcctgcctcagcct

SEQ ID NO: 276667 - DNA, 14 bp, Homo sapiens
cagtcctgcctggc

SEQ ID NO: 276668 - DNA, 15 bp, Homo sapiens
cagtcctgcctggcc

SEQ ID NO: 276669 - DNA, 17 bp, Homo sapiens
cagtcctgcctggccag

SEQ ID NO: 276670 - DNA, 14 bp, Homo sapiens
cagtcctgctctct

SEQ ID NO: 276671 - DNA, 23 bp, Homo sapiens
cagtcctgctctctacccagccc

SEQ ID NO: 276672 - DNA, 14 bp, Homo sapiens
cagtcctggttcag

SEQ ID NO: 276673 - DNA, 18 bp, Homo sapiens
cagtcctggttcagtggg

SEQ ID NO: 276674 - DNA, 20 bp, Homo sapiens
cagtcctggttcagtgggaa

SEQ ID NO: 276675 - DNA, 16 bp, Homo sapiens
cagtcgccctctgtgc

SEQ ID NO: 276676 - DNA, 21 bp, Homo sapiens
cagtcgccctctgtgcctaat

SEQ ID NO: 276677 - DNA, 14 bp, Homo sapiens
cagtctacttctgt

SEQ ID NO: 276678 - DNA, 16 bp, Homo sapiens
cagtctacttctgtgt

SEQ ID NO: 276679 - DNA, 18 bp, Homo sapiens
cagtctcaagcactaaaa

SEQ ID NO: 276680 - DNA, 22 bp, Homo sapiens
cagtctcattacagatttagtt

SEQ ID NO: 276681 - DNA, 16 bp, Homo sapiens
cagtctccaccaggaa

SEQ ID NO: 276682 - DNA, 22 bp, Homo sapiens
cagtctccataaggcagtggct

SEQ ID NO: 276683 - DNA, 21 bp, Homo sapiens
cagtctcccaggccccctgca

SEQ ID NO: 276684 - DNA, 18 bp, Homo sapiens
cagtctccctttcccttc

SEQ ID NO: 276685 - DNA, 14 bp, Homo sapiens
cagtctctccctgg

SEQ ID NO: 276686 - DNA, 20 bp, Homo sapiens
cagtctctttaatcttcagt

SEQ ID NO: 276687 - DNA, 22 bp, Homo sapiens
cagtctgaacccttgtgcttgg

SEQ ID NO: 276688 - DNA, 14 bp, Homo sapiens
cagtctgctgccct

SEQ ID NO: 276689 - DNA, 21 bp, Homo sapiens
cagtctgctgccctccatccc

SEQ ID NO: 276690 - DNA, 18 bp, Homo sapiens
cagtctggaggggcatgg

SEQ ID NO: 276691 - DNA, 12 bp, Homo sapiens
cagtctgtcatg

SEQ ID NO: 276692 - DNA, 24 bp, Homo sapiens
cagtctgtcatgaacatgttcctg

SEQ ID NO: 276693 - DNA, 16 bp, Homo sapiens
cagtctgtctactgtg

SEQ ID NO: 276694 - DNA, 17 bp, Homo sapiens
cagtctgtctactgtgg

SEQ ID NO: 276695 - DNA, 22 bp, Homo sapiens
cagtcttcacttgcactggggg

SEQ ID NO: 276696 - DNA, 17 bp, Homo sapiens
cagtcttgagtgggccc

SEQ ID NO: 276697 - DNA, 23 bp, Homo sapiens
cagtcttgagtgggccccctctc

SEQ ID NO: 276698 - DNA, 13 bp, Homo sapiens
cagtcttgcctag

SEQ ID NO: 276699 - DNA, 22 bp, Homo sapiens
cagtctttgggggattcaaatg

SEQ ID NO: 276700 - DNA, 13 bp, Homo sapiens
cagtgaaaactag

SEQ ID NO: 276701 - DNA, 15 bp, Homo sapiens
cagtgaaacttgtgc

SEQ ID NO: 276702 - DNA, 22 bp, Homo sapiens
cagtgaaattttggtgaatgtg

SEQ ID NO: 276703 - DNA, 16 bp, Homo sapiens
cagtgaacagcttcac

SEQ ID NO: 276704 - DNA, 15 bp, Homo sapiens
cagtgaacataactg

SEQ ID NO: 276705 - DNA, 22 bp, Homo sapiens
cagtgaatagtaacaataaata

SEQ ID NO: 276706 - DNA, 16 bp, Homo sapiens
cagtgaatataaatgt

SEQ ID NO: 276707 - DNA, 15 bp, Homo sapiens
cagtgaatttaagca

SEQ ID NO: 276708 - DNA, 17 bp, Homo sapiens
cagtgacacttcagaga

SEQ ID NO: 276709 - DNA, 22 bp, Homo sapiens
cagtgacacttcagagagctgg

SEQ ID NO: 276710 - DNA, 15 bp, Homo sapiens
cagtgacagacaggc

SEQ ID NO: 276711 - DNA, 17 bp, Homo sapiens
cagtgacagacaggctc

SEQ ID NO: 276712 - DNA, 20 bp, Homo sapiens
cagtgacagagttcactata

SEQ ID NO: 276713 - DNA, 14 bp, Homo sapiens
cagtgactccagga

SEQ ID NO: 276714 - DNA, 15 bp, Homo sapiens
cagtgactccaggag

SEQ ID NO: 276715 - DNA, 16 bp, Homo sapiens
cagtgactccaggaga

SEQ ID NO: 276716 - DNA, 20 bp, Homo sapiens
cagtgagagtactcactttt

SEQ ID NO: 276717 - DNA, 18 bp, Homo sapiens
cagtgagattacagagga

SEQ ID NO: 276718 - DNA, 19 bp, Homo sapiens
cagtgagattacagaggaa

SEQ ID NO: 276719 - DNA, 18 bp, Homo sapiens
cagtgagcccctccccag

SEQ ID NO: 276720 - DNA, 13 bp, Homo sapiens
cagtgaggacctc

SEQ ID NO: 276721 - DNA, 12 bp, Homo sapiens
cagtgaggaggg

SEQ ID NO: 276722 - DNA, 13 bp, Homo sapiens
cagtgaggagggt

SEQ ID NO: 276723 - DNA, 14 bp, Homo sapiens
cagtgaggagggtg

SEQ ID NO: 276724 - DNA, 16 bp, Homo sapiens
cagtgagggtcttctt

SEQ ID NO: 276725 - DNA, 17 bp, Homo sapiens
cagtgagtctcttcaga

SEQ ID NO: 276726 - DNA, 18 bp, Homo sapiens
cagtgagtctcttcagaa

SEQ ID NO: 276727 - DNA, 15 bp, Homo sapiens
cagtgataggcccaa

SEQ ID NO: 276728 - DNA, 23 bp, Homo sapiens
cagtgatatggtactaaggagaa

SEQ ID NO: 276729 - DNA, 22 bp, Homo sapiens
cagtgatggcattactctgcac

SEQ ID NO: 276730 - DNA, 23 bp, Homo sapiens
cagtgatggcgcgggaggcacca

SEQ ID NO: 276731 - DNA, 23 bp, Homo sapiens
cagtgatgtaccatgaaacaaag

SEQ ID NO: 276732 - DNA, 13 bp, Homo sapiens
cagtgatttacat

SEQ ID NO: 276733 - DNA, 17 bp, Homo sapiens
cagtgcaacagcactgg

SEQ ID NO: 276734 - DNA, 16 bp, Homo sapiens
catactctgttgcctc

SEQ ID NO: 276735 - DNA, 20 bp, Homo sapiens
catacttcctggattttctt

SEQ ID NO: 276736 - DNA, 22 bp, Homo sapiens
catagaaaacaatctgcccacc

SEQ ID NO: 276737 - DNA, 15 bp, Homo sapiens
catagaaaataagga

SEQ ID NO: 276738 - DNA, 19 bp, Homo sapiens
catagaaattgcctccagt

SEQ ID NO: 276739 - DNA, 21 bp, Homo sapiens
catagaactgtcccacaaaat

SEQ ID NO: 276740 - DNA, 18 bp, Homo sapiens
catagaagaacagcagat

SEQ ID NO: 276741 - DNA, 15 bp, Homo sapiens
catagaaggagagcc

SEQ ID NO: 276742 - DNA, 21 bp, Homo sapiens
catagaaggagagcccaggcc

SEQ ID NO: 276743 - DNA, 14 bp, Homo sapiens
catagaatagcatg

SEQ ID NO: 276744 - DNA, 13 bp, Homo sapiens
catagacaaaggc

SEQ ID NO: 276745 - DNA, 15 bp, Homo sapiens
catagacaaaggcct

SEQ ID NO: 276746 - DNA, 16 bp, Homo sapiens
catagacaaaggcctt

SEQ ID NO: 276747 - DNA, 15 bp, Homo sapiens
catagacacagtatt

SEQ ID NO: 276748 - DNA, 22 bp, Homo sapiens
catagacacagtattgacttct

SEQ ID NO: 276749 - DNA, 22 bp, Homo sapiens
catagagatatttaaaagacaa

SEQ ID NO: 276750 - DNA, 20 bp, Homo sapiens
catagaggatgatgtaatta

SEQ ID NO: 276751 - DNA, 14 bp, Homo sapiens
catagataagaact

SEQ ID NO: 276752 - DNA, 13 bp, Homo sapiens
catagatcttctg

SEQ ID NO: 276753 - DNA, 14 bp, Homo sapiens
catagatcttctga

SEQ ID NO: 276754 - DNA, 15 bp, Homo sapiens
catagattcacctgt

SEQ ID NO: 276755 - DNA, 18 bp, Homo sapiens
catagattcacctgtaaa

SEQ ID NO: 276756 - DNA, 16 bp, Homo sapiens
catagcattaactaat

SEQ ID NO: 276757 - DNA, 23 bp, Homo sapiens
catagcattaactaatctattgg

SEQ ID NO: 276758 - DNA, 14 bp, Homo sapiens
catagctactatat

SEQ ID NO: 276759 - DNA, 19 bp, Homo sapiens
catagctagttatgtgaga

SEQ ID NO: 276760 - DNA, 20 bp, Homo sapiens
catagctagttatgtgagaa

SEQ ID NO: 276761 - DNA, 15 bp, Homo sapiens
catagctgagctgga

SEQ ID NO: 276762 - DNA, 16 bp, Homo sapiens
catagctgggatttga

SEQ ID NO: 276763 - DNA, 20 bp, Homo sapiens
catagctgggatttgaactg

SEQ ID NO: 276764 - DNA, 12 bp, Homo sapiens
cataggaaaagt

SEQ ID NO: 276765 - DNA, 14 bp, Homo sapiens
cataggcctgggtg

SEQ ID NO: 276766 - DNA, 18 bp, Homo sapiens
cataggcctgggtgctgg

SEQ ID NO: 276767 - DNA, 19 bp, Homo sapiens
cataggcctgggtgctggc

SEQ ID NO: 276768 - DNA, 17 bp, Homo sapiens
catagggtctcttcagg

SEQ ID NO: 276769 - DNA, 18 bp, Homo sapiens
catagtaccaatcatttt

SEQ ID NO: 276770 - DNA, 21 bp, Homo sapiens
catagtactctttgtagcaaa

SEQ ID NO: 276771 - DNA, 16 bp, Homo sapiens
catagtctttgtttac

SEQ ID NO: 276772 - DNA, 18 bp, Homo sapiens
catagtgaccggctgctt

SEQ ID NO: 276773 - DNA, 22 bp, Homo sapiens
catagtgatggttcccctgttc

SEQ ID NO: 276774 - DNA, 14 bp, Homo sapiens
catagttctgttaa

SEQ ID NO: 276775 - DNA, 15 bp, Homo sapiens
catagttctgttaaa

SEQ ID NO: 276776 - DNA, 20 bp, Homo sapiens
catataaacatcacacacac

SEQ ID NO: 276777 - DNA, 15 bp, Homo sapiens
catataaagtgcaat

SEQ ID NO: 276778 - DNA, 15 bp, Homo sapiens
catataaatgtttat

SEQ ID NO: 276779 - DNA, 17 bp, Homo sapiens
catataaatgtttatat

SEQ ID NO: 276780 - DNA, 13 bp, Homo sapiens
catataaattaat

SEQ ID NO: 276781 - DNA, 23 bp, Homo sapiens
catataagattcatatttacttc

SEQ ID NO: 276782 - DNA, 22 bp, Homo sapiens
catataatatatgttttaaata

SEQ ID NO: 276783 - DNA, 18 bp, Homo sapiens
catataatgttgttattt

SEQ ID NO: 276784 - DNA, 15 bp, Homo sapiens
catatacaaataaac

SEQ ID NO: 276785 - DNA, 16 bp, Homo sapiens
catatacagcaggatg

SEQ ID NO: 276786 - DNA, 15 bp, Homo sapiens
catatataaaacaaa

SEQ ID NO: 276787 - DNA, 16 bp, Homo sapiens
catatataaattatta

SEQ ID NO: 276788 - DNA, 23 bp, Homo sapiens
catatcaagaagtcagagaaaac

SEQ ID NO: 276789 - DNA, 17 bp, Homo sapiens
catatcaagtcccgagg

SEQ ID NO: 276790 - DNA, 16 bp, Homo sapiens
catatcaccagtctta

SEQ ID NO: 276791 - DNA, 15 bp, Homo sapiens
catatcagacctctg

SEQ ID NO: 276792 - DNA, 13 bp, Homo sapiens
catatccctttct

SEQ ID NO: 276793 - DNA, 23 bp, Homo sapiens
catatcctgagccatcggtgaaa

SEQ ID NO: 276794 - DNA, 19 bp, Homo sapiens
catatcctggtgtctagtt

SEQ ID NO: 276795 - DNA, 23 bp, Homo sapiens
catatcgctgggctcaacataga

SEQ ID NO: 276796 - DNA, 15 bp, Homo sapiens
catatctagatttct

SEQ ID NO: 276797 - DNA, 18 bp, Homo sapiens
catatctctagtccctgt

SEQ ID NO: 276798 - DNA, 14 bp, Homo sapiens
catatctctccctt

SEQ ID NO: 276799 - DNA, 18 bp, Homo sapiens
catatcttaaagaaacag

SEQ ID NO: 276800 - DNA, 18 bp, Homo sapiens
catatgaattagccaaaa

SEQ ID NO: 276801 - DNA, 19 bp, Homo sapiens
catatgacaatttcaaaat

SEQ ID NO: 276802 - DNA, 23 bp, Homo sapiens
catatgacaatttcaaaatgcat

SEQ ID NO: 276803 - DNA, 23 bp, Homo sapiens
catatgagtatctttaaatataa

SEQ ID NO: 276804 - DNA, 19 bp, Homo sapiens
catatgagtgtggaagccg

SEQ ID NO: 276805 - DNA, 14 bp, Homo sapiens
catatgattgaaaa

SEQ ID NO: 276806 - DNA, 15 bp, Homo sapiens
catatgattgaaaag

SEQ ID NO: 276807 - DNA, 16 bp, Homo sapiens
catatgattgaaaaga

SEQ ID NO: 276808 - DNA, 19 bp, Homo sapiens
catatgattgaaaagaaga

SEQ ID NO: 276809 - DNA, 22 bp, Homo sapiens
catatgcaaacagccctaaata

SEQ ID NO: 276810 - DNA, 15 bp, Homo sapiens
catatgcatgccagg

SEQ ID NO: 276811 - DNA, 17 bp, Homo sapiens
catatgcttactcttgc

SEQ ID NO: 276812 - DNA, 16 bp, Homo sapiens
catatggagtgcctgt

SEQ ID NO: 276813 - DNA, 23 bp, Homo sapiens
catatggattttctattgttact

SEQ ID NO: 276814 - DNA, 15 bp, Homo sapiens
catatggcccagtgt

SEQ ID NO: 276815 - DNA, 16 bp, Homo sapiens
catatggcccagtgtc

SEQ ID NO: 276816 - DNA, 15 bp, Homo sapiens
catatgtacataaat

SEQ ID NO: 276817 - DNA, 12 bp, Homo sapiens
catatgtagata

SEQ ID NO: 276818 - DNA, 20 bp, Homo sapiens
catattaagaatagtctctg

SEQ ID NO: 276819 - DNA, 16 bp, Homo sapiens
catattactgttgcat

SEQ ID NO: 276820 - DNA, 14 bp, Homo sapiens
catattatatcaga

SEQ ID NO: 276821 - DNA, 16 bp, Homo sapiens
catattatatcagact

SEQ ID NO: 276822 - DNA, 21 bp, Homo sapiens
catattcctgcagcctggagg

SEQ ID NO: 276823 - DNA, 23 bp, Homo sapiens
catattcttgctttcacaaatat

SEQ ID NO: 276824 - DNA, 14 bp, Homo sapiens
catattgatgaaaa

SEQ ID NO: 276825 - DNA, 20 bp, Homo sapiens
catattgatgaaaagattta

SEQ ID NO: 276826 - DNA, 21 bp, Homo sapiens
catattgtgccaatatgtatt

SEQ ID NO: 276827 - DNA, 18 bp, Homo sapiens
catattgttttaaaataa

SEQ ID NO: 276828 - DNA, 22 bp, Homo sapiens
catatttaataggataaattaa

SEQ ID NO: 276829 - DNA, 16 bp, Homo sapiens
catatttacttcttat

SEQ ID NO: 276830 - DNA, 18 bp, Homo sapiens
catatttgtgttcagttc

SEQ ID NO: 276831 - DNA, 18 bp, Homo sapiens
catattttacttggaaat

SEQ ID NO: 276832 - DNA, 16 bp, Homo sapiens
catattttcctttaga

SEQ ID NO: 276833 - DNA, 16 bp, Homo sapiens
catcaaaaagagtctt

SEQ ID NO: 276834 - DNA, 21 bp, Homo sapiens
catcaaaaagagtcttaattt

SEQ ID NO: 276835 - DNA, 22 bp, Homo sapiens
catcaaaaagagtcttaatttt

SEQ ID NO: 276836 - DNA, 12 bp, Homo sapiens
catcaaacatga

SEQ ID NO: 276837 - DNA, 14 bp, Homo sapiens
catcaaacatgaaa

SEQ ID NO: 276838 - DNA, 22 bp, Homo sapiens
catcaaacatgaaaacattgat

SEQ ID NO: 276839 - DNA, 11 bp, Homo sapiens
catcaaagact

SEQ ID NO: 276840 - DNA, 17 bp, Homo sapiens
catcaaataaaccttgt

SEQ ID NO: 276841 - DNA, 13 bp, Homo sapiens
catcaaataaatt

SEQ ID NO: 276842 - DNA, 16 bp, Homo sapiens
catcaaataaatttct

SEQ ID NO: 276843 - DNA, 18 bp, Homo sapiens
catcaaataaatttctgg

SEQ ID NO: 276844 - DNA, 14 bp, Homo sapiens
catcaagatgtgac

SEQ ID NO: 276845 - DNA, 23 bp, Homo sapiens
catcaatacttttgtgtattctg

SEQ ID NO: 276846 - DNA, 12 bp, Homo sapiens
catcaatttaaa

SEQ ID NO: 276847 - DNA, 16 bp, Homo sapiens
catcaattttaacatt

SEQ ID NO: 276848 - DNA, 18 bp, Homo sapiens
catcaattttaacatttg

SEQ ID NO: 276849 - DNA, 22 bp, Homo sapiens
catcaattttaacatttgatgt

SEQ ID NO: 276850 - DNA, 14 bp, Homo sapiens
catcacacagtggc

SEQ ID NO: 276851 - DNA, 15 bp, Homo sapiens
catcacagccagccc

SEQ ID NO: 276852 - DNA, 16 bp, Homo sapiens
catcacagccagccca

SEQ ID NO: 276853 - DNA, 17 bp, Homo sapiens
catcacagccagcccag

SEQ ID NO: 276854 - DNA, 19 bp, Homo sapiens
catcacagggttgggccca

SEQ ID NO: 276855 - DNA, 22 bp, Homo sapiens
catcacagggttgggcccagat

SEQ ID NO: 276856 - DNA, 16 bp, Homo sapiens
cagttaactttcagaa

SEQ ID NO: 276857 - DNA, 16 bp, Homo sapiens
cagttaagaaaaaaat

SEQ ID NO: 276858 - DNA, 20 bp, Homo sapiens
cagttaagaaaaaaataatt

SEQ ID NO: 276859 - DNA, 21 bp, Homo sapiens
cagttaagaaaaaaataattt

SEQ ID NO: 276860 - DNA, 22 bp, Homo sapiens
cagttaagaaaaaaataatttt

SEQ ID NO: 276861 - DNA, 19 bp, Homo sapiens
cagttaagacaacaggcat

SEQ ID NO: 276862 - DNA, 14 bp, Homo sapiens
cagttaagagaaat

SEQ ID NO: 276863 - DNA, 19 bp, Homo sapiens
cagttaagcagccgccaca

SEQ ID NO: 276864 - DNA, 12 bp, Homo sapiens
cagttaatcttg

SEQ ID NO: 276865 - DNA, 23 bp, Homo sapiens
cagttacagcaggccagaaacat

SEQ ID NO: 276866 - DNA, 22 bp, Homo sapiens
cagttactggtttcagttgaca

SEQ ID NO: 276867 - DNA, 15 bp, Homo sapiens
cagttactgttcatg

SEQ ID NO: 276868 - DNA, 17 bp, Homo sapiens
cagttacttccttcctg

SEQ ID NO: 276869 - DNA, 19 bp, Homo sapiens
cagttagcccggccaagga

SEQ ID NO: 276870 - DNA, 19 bp, Homo sapiens
cagttagggttgagttact

SEQ ID NO: 276871 - DNA, 23 bp, Homo sapiens
cagttcaatctcccgctgctgct

SEQ ID NO: 276872 - DNA, 14 bp, Homo sapiens
cagttcacaccctg

SEQ ID NO: 276873 - DNA, 19 bp, Homo sapiens
cagttcacaccctgcaagg

SEQ ID NO: 276874 - DNA, 20 bp, Homo sapiens
cagttcacaccctgcaaggc

SEQ ID NO: 276875 - DNA, 13 bp, Homo sapiens
cagttcataaatt

SEQ ID NO: 276876 - DNA, 15 bp, Homo sapiens
cagttcataaatttg

SEQ ID NO: 276877 - DNA, 18 bp, Homo sapiens
cagttcataaatttgttg

SEQ ID NO: 276878 - DNA, 23 bp, Homo sapiens
cagttcataaatttgttgtcatg

SEQ ID NO: 276879 - DNA, 23 bp, Homo sapiens
cagttcatatgtaccatgtacat

SEQ ID NO: 276880 - DNA, 13 bp, Homo sapiens
cagttcatcccaa

SEQ ID NO: 276881 - DNA, 13 bp, Homo sapiens
catgcctcatgcc

SEQ ID NO: 276882 - DNA, 17 bp, Homo sapiens
catgcctcatgccacac

SEQ ID NO: 276883 - DNA, 16 bp, Homo sapiens
catgcctgagggtgga

SEQ ID NO: 276884 - DNA, 17 bp, Homo sapiens
catgccttcataaatta

SEQ ID NO: 276885 - DNA, 16 bp, Homo sapiens
catgcctttgtaagtt

SEQ ID NO: 276886 - DNA, 18 bp, Homo sapiens
catgcgaatgagctgggc

SEQ ID NO: 276887 - DNA, 16 bp, Homo sapiens
catgcggccggcctgg

SEQ ID NO: 276888 - DNA, 17 bp, Homo sapiens
catgcggccggcctggg

SEQ ID NO: 276889 - DNA, 19 bp, Homo sapiens
catgcggccggcctggggc

SEQ ID NO: 276890 - DNA, 13 bp, Homo sapiens
catgcggctgccc

SEQ ID NO: 276891 - DNA, 23 bp, Homo sapiens
catgcggctgcccacgctcctgc

SEQ ID NO: 276892 - DNA, 15 bp, Homo sapiens
catgcgggctgggca

SEQ ID NO: 276893 - DNA, 19 bp, Homo sapiens
catgcgggctgggcagctg

SEQ ID NO: 276894 - DNA, 20 bp, Homo sapiens
catgctacctgatcccactc

SEQ ID NO: 276895 - DNA, 19 bp, Homo sapiens
catgctcaacccccctccc

SEQ ID NO: 276896 - DNA, 12 bp, Homo sapiens
catgctcccagc

SEQ ID NO: 276897 - DNA, 14 bp, Homo sapiens
catgctcctcacct

SEQ ID NO: 276898 - DNA, 13 bp, Homo sapiens
catgctctcaata

SEQ ID NO: 276899 - DNA, 22 bp, Homo sapiens
catgctctgagaagaggagccc

SEQ ID NO: 276900 - DNA, 14 bp, Homo sapiens
catgctctgcccca

SEQ ID NO: 276901 - DNA, 12 bp, Homo sapiens
catgctgcctcc

SEQ ID NO: 276902 - DNA, 12 bp, Homo sapiens
catgctgcctgc

SEQ ID NO: 276903 - DNA, 15 bp, Homo sapiens
catgctgcctgcctc

SEQ ID NO: 276904 - DNA, 19 bp, Homo sapiens
catgctgcctgcctccggc

SEQ ID NO: 276905 - DNA, 20 bp, Homo sapiens
catgctgctttttggcacag

SEQ ID NO: 276906 - DNA, 16 bp, Homo sapiens
catgctggccagcctg

SEQ ID NO: 276907 - DNA, 17 bp, Homo sapiens
catgctggccagcctgg

SEQ ID NO: 276908 - DNA, 20 bp, Homo sapiens
catgctggcctcccaataaa

SEQ ID NO: 276909 - DNA, 16 bp, Homo sapiens
catgctggcggcgcag

SEQ ID NO: 276910 - DNA, 19 bp, Homo sapiens
catgctggctcccagggcc

SEQ ID NO: 276911 - DNA, 15 bp, Homo sapiens
catgctgtcccttac

SEQ ID NO: 276912 - DNA, 22 bp, Homo sapiens
catgctgtcccttacgtgagtc

SEQ ID NO: 276913 - DNA, 19 bp, Homo sapiens
catgctgtgctctttgaag

SEQ ID NO: 276914 - DNA, 12 bp, Homo sapiens
catgctgtgtaa

SEQ ID NO: 276915 - DNA, 19 bp, Homo sapiens
catgctgtgtaagctgtgt

SEQ ID NO: 276916 - DNA, 21 bp, Homo sapiens
catgctgttgcatttagaact

SEQ ID NO: 276917 - DNA, 22 bp, Homo sapiens
catgctgttggcctcaagcaag

SEQ ID NO: 276918 - DNA, 17 bp, Homo sapiens
catgcttagagcatgtt

SEQ ID NO: 276919 - DNA, 19 bp, Homo sapiens
cattgcatcatgaaactct

SEQ ID NO: 276920 - DNA, 11 bp, Homo sapiens
cattgcattta

SEQ ID NO: 276921 - DNA, 14 bp, Homo sapiens
cattgccaccagga

SEQ ID NO: 276922 - DNA, 20 bp, Homo sapiens
cattgccaccaggagaacca

SEQ ID NO: 276923 - DNA, 16 bp, Homo sapiens
cattgccagtggtgtc

SEQ ID NO: 276924 - DNA, 14 bp, Homo sapiens
cattgcccacacct

SEQ ID NO: 276925 - DNA, 20 bp, Homo sapiens
cattgcccacacctgcctct

SEQ ID NO: 276926 - DNA, 22 bp, Homo sapiens
cattgcccacacctgcctctga

SEQ ID NO: 276927 - DNA, 14 bp, Homo sapiens
cattgccccaagat

SEQ ID NO: 276928 - DNA, 22 bp, Homo sapiens
cattgcctaactactagttttt

SEQ ID NO: 276929 - DNA, 12 bp, Homo sapiens
cattgccttcct

SEQ ID NO: 276930 - DNA, 14 bp, Homo sapiens
cattgctacactta

SEQ ID NO: 276931 - DNA, 20 bp, Homo sapiens
cattgctacacttacaagta

SEQ ID NO: 276932 - DNA, 20 bp, Homo sapiens
cattgctgtgtcacactctg

SEQ ID NO: 276933 - DNA, 21 bp, Homo sapiens
cattgcttattcttgagcaca

SEQ ID NO: 276934 - DNA, 11 bp, Homo sapiens
cattgctttac

SEQ ID NO: 276935 - DNA, 14 bp, Homo sapiens
cattgctttactgg

SEQ ID NO: 276936 - DNA, 19 bp, Homo sapiens
cattgctttcgtgtaaatt

SEQ ID NO: 276937 - DNA, 18 bp, Homo sapiens
cattgctttgaagcagtt

SEQ ID NO: 276938 - DNA, 17 bp, Homo sapiens
cattggaagaccccacc

SEQ ID NO: 276939 - DNA, 22 bp, Homo sapiens
cattggatgtggagctcctgct

SEQ ID NO: 276940 - DNA, 15 bp, Homo sapiens
cattggcttcaagaa

SEQ ID NO: 276941 - DNA, 22 bp, Homo sapiens
cattgggctgacacctaccatg

SEQ ID NO: 276942 - DNA, 19 bp, Homo sapiens
cattgggtgggtaaattca

SEQ ID NO: 276943 - DNA, 17 bp, Homo sapiens
cattggttccctttgct

SEQ ID NO: 276944 - DNA, 15 bp, Homo sapiens
cattgtaaacaaact

SEQ ID NO: 276945 - DNA, 17 bp, Homo sapiens
cattgtaatctgctttg

SEQ ID NO: 276946 - DNA, 17 bp, Homo sapiens
cattgtaatgttactga

SEQ ID NO: 276947 - DNA, 18 bp, Homo sapiens
cattgtaatgttactgat

SEQ ID NO: 276948 - DNA, 22 bp, Homo sapiens
cattgtactccagcctgggtga

SEQ ID NO: 276949 - DNA, 16 bp, Homo sapiens
cattgtagagcttctg

SEQ ID NO: 276950 - DNA, 19 bp, Homo sapiens
cattgtagagcttctggca

SEQ ID NO: 276951 - DNA, 15 bp, Homo sapiens
cattgtataggccat

SEQ ID NO: 276952 - DNA, 19 bp, Homo sapiens
cattgtataggccatctgt

SEQ ID NO: 276953 - DNA, 15 bp, Homo sapiens
cattgtatatatgtg

SEQ ID NO: 276954 - DNA, 22 bp, Homo sapiens
cattgtatatatgtgtgtttaa

SEQ ID NO: 276955 - DNA, 15 bp, Homo sapiens
cattgtatgatgtgt

SEQ ID NO: 276956 - DNA, 17 bp, Homo sapiens
cattgtatgatgtgttg

SEQ ID NO: 276957 - DNA, 20 bp, Homo sapiens
cattgtatgatgtgttgtga

SEQ ID NO: 276958 - DNA, 15 bp, Homo sapiens
cattgtccatgccta

SEQ ID NO: 276959 - DNA, 19 bp, Homo sapiens
cattgtccatgcctacaga

SEQ ID NO: 276960 - DNA, 18 bp, Homo sapiens
cattgtcgtttcattcat

SEQ ID NO: 276961 - DNA, 20 bp, Homo sapiens
cattgtcgtttcattcattt

SEQ ID NO: 276962 - DNA, 17 bp, Homo sapiens
cattgtctcattgccag

SEQ ID NO: 276963 - DNA, 16 bp, Homo sapiens
cattgtgaatattaga

SEQ ID NO: 276964 - DNA, 15 bp, Homo sapiens
cattgtgaatgttgt

SEQ ID NO: 276965 - DNA, 22 bp, Homo sapiens
cattgtgaatgttgtcctgtgt

SEQ ID NO: 276966 - DNA, 22 bp, Homo sapiens
cattgtgggatgttcagcactg

SEQ ID NO: 276967 - DNA, 11 bp, Homo sapiens
cattgttccac

SEQ ID NO: 276968 - DNA, 19 bp, Homo sapiens
cattgttgtttttttaata

SEQ ID NO: 276969 - DNA, 17 bp, Homo sapiens
cattgtttgcttattgt

SEQ ID NO: 276970 - DNA, 18 bp, Homo sapiens
cattgtttgtctgtcttc

SEQ ID NO: 276971 - DNA, 13 bp, Homo sapiens
catttaaaacatt

SEQ ID NO: 276972 - DNA, 14 bp, Homo sapiens
catttaaaatgatt

SEQ ID NO: 276973 - DNA, 18 bp, Homo sapiens
catttaaaatgattagaa

SEQ ID NO: 276974 - DNA, 14 bp, Homo sapiens
catttaaaatggac

SEQ ID NO: 276975 - DNA, 16 bp, Homo sapiens
catttaaactaacctt

SEQ ID NO: 276976 - DNA, 17 bp, Homo sapiens
catttaaactaaccttt

SEQ ID NO: 276977 - DNA, 19 bp, Homo sapiens
catttaataactttgctgg

SEQ ID NO: 276978 - DNA, 20 bp, Homo sapiens
catttacagtccttcaaaat

SEQ ID NO: 276979 - DNA, 15 bp, Homo sapiens
catttacttttaata

SEQ ID NO: 276980 - DNA, 21 bp, Homo sapiens
catttagaactttctgctttg

SEQ ID NO: 276981 - DNA, 15 bp, Homo sapiens
catttagaatttgaa

SEQ ID NO: 276982 - DNA, 21 bp, Homo sapiens
catttagcattgaaataataa

SEQ ID NO: 276983 - DNA, 18 bp, Homo sapiens
catttaggagaagttggt

SEQ ID NO: 276984 - DNA, 15 bp, Homo sapiens
catttagtcctcacc

SEQ ID NO: 276985 - DNA, 14 bp, Homo sapiens
catttagttctttg

SEQ ID NO: 276986 - DNA, 15 bp, Homo sapiens
catttataaatgtgt

SEQ ID NO: 276987 - DNA, 14 bp, Homo sapiens
catttataacccca

SEQ ID NO: 276988 - DNA, 16 bp, Homo sapiens
catttataaccccagc

SEQ ID NO: 276989 - DNA, 19 bp, Homo sapiens
catttataaccccagcctg

SEQ ID NO: 276990 - DNA, 17 bp, Homo sapiens
catttatcactctgacc

SEQ ID NO: 276991 - DNA, 14 bp, Homo sapiens
catttatcttctgt

SEQ ID NO: 276992 - DNA, 17 bp, Homo sapiens
catttatcttctgtttt

SEQ ID NO: 276993 - DNA, 21 bp, Homo sapiens
catttatggtcaacacttaag

SEQ ID NO: 276994 - DNA, 13 bp, Homo sapiens
catttatgtgtga

SEQ ID NO: 276995 - DNA, 21 bp, Homo sapiens
catttattattttaatattta

SEQ ID NO: 276996 - DNA, 15 bp, Homo sapiens
catttattgcagttt

SEQ ID NO: 276997 - DNA, 22 bp, Homo sapiens
catttatttgactaaagcatca

SEQ ID NO: 276998 - DNA, 21 bp, Homo sapiens
catttattttaagcactctta

SEQ ID NO: 276999 - DNA, 22 bp, Homo sapiens
catttattttgactgtgattta

SEQ ID NO: 277000 - DNA, 18 bp, Homo sapiens
catttatttttagccatt

SEQ ID NO: 277001 - DNA, 16 bp, Homo sapiens
catttcaaagctgagt

SEQ ID NO: 277002 - DNA, 19 bp, Homo sapiens
catttcaaatctgtagcat

SEQ ID NO: 277003 - DNA, 18 bp, Homo sapiens
catttcaagatccaaatg

SEQ ID NO: 277004 - DNA, 16 bp, Homo sapiens
catttcacctgtgaca

SEQ ID NO: 277005 - DNA, 18 bp, Homo sapiens
catttcacctgtgacaaa

SEQ ID NO: 277006 - DNA, 14 bp, Homo sapiens
catttcagtatcat

SEQ ID NO: 277007 - DNA, 20 bp, Homo sapiens
catttcataaggcctgccct

SEQ ID NO: 277008 - DNA, 21 bp, Homo sapiens
catttcataaggcctgccctc

SEQ ID NO: 277009 - DNA, 22 bp, Homo sapiens
catttcataaggcctgccctcc

SEQ ID NO: 277010 - DNA, 18 bp, Homo sapiens
catttcatccatatttct

SEQ ID NO: 277011 - DNA, 19 bp, Homo sapiens
catttcatccatatttctt

SEQ ID NO: 277012 - DNA, 15 bp, Homo sapiens
catttcatgtgatct

SEQ ID NO: 277013 - DNA, 22 bp, Homo sapiens
catttcatgtgatctattactc

SEQ ID NO: 277014 - DNA, 23 bp, Homo sapiens
catttcatgtgatctattactct

SEQ ID NO: 277015 - DNA, 15 bp, Homo sapiens
catttcattcctaac

SEQ ID NO: 277016 - DNA, 18 bp, Homo sapiens
catttcattcctaacaca

SEQ ID NO: 277017 - DNA, 13 bp, Homo sapiens
catttcattgtat

SEQ ID NO: 277018 - DNA, 18 bp, Homo sapiens
catttcattgtatgatgt

SEQ ID NO: 277019 - DNA, 23 bp, Homo sapiens
catttcattgtatgatgtgttgt

SEQ ID NO: 277020 - DNA, 18 bp, Homo sapiens
catttccaactcaggtta

SEQ ID NO: 277021 - DNA, 16 bp, Homo sapiens
catttccccagacctg

SEQ ID NO: 277022 - DNA, 20 bp, Homo sapiens
catttcccctgtggtttgtt

SEQ ID NO: 277023 - DNA, 19 bp, Homo sapiens
catttcctctctatctttt

SEQ ID NO: 277024 - DNA, 13 bp, Homo sapiens
catttcctcttcc

SEQ ID NO: 277025 - DNA, 19 bp, Homo sapiens
catttcctcttccttctct

SEQ ID NO: 277026 - DNA, 13 bp, Homo sapiens
catttcctgacag

SEQ ID NO: 277027 - DNA, 20 bp, Homo sapiens
catttcctgacagaaggact

SEQ ID NO: 277028 - DNA, 16 bp, Homo sapiens
catttcgtgtaatatt

SEQ ID NO: 277029 - DNA, 15 bp, Homo sapiens
catttctaatttgaa

SEQ ID NO: 277030 - DNA, 13 bp, Homo sapiens
catttctatttat

SEQ ID NO: 277031 - DNA, 16 bp, Homo sapiens
catttctcaaagtttt

SEQ ID NO: 277032 - DNA, 12 bp, Homo sapiens
catttctcatgt

SEQ ID NO: 277033 - DNA, 15 bp, Homo sapiens
catttctcatgtgct

SEQ ID NO: 277034 - DNA, 19 bp, Homo sapiens
catttctcatgtgctttgt

SEQ ID NO: 277035 - DNA, 20 bp, Homo sapiens
catttctcatgtgctttgta

SEQ ID NO: 277036 - DNA, 17 bp, Homo sapiens
catttctgaatagaaat

SEQ ID NO: 277037 - DNA, 16 bp, Homo sapiens
catttctgatgtgaaa

SEQ ID NO: 277038 - DNA, 14 bp, Homo sapiens
catttctgccagcg

SEQ ID NO: 277039 - DNA, 14 bp, Homo sapiens
catttctgtctccc

SEQ ID NO: 277040 - DNA, 12 bp, Homo sapiens
catttcttccca

SEQ ID NO: 277041 - DNA, 14 bp, Homo sapiens
catttcttcccaag

SEQ ID NO: 277042 - DNA, 15 bp, Homo sapiens
catttcttgggccct

SEQ ID NO: 277043 - DNA, 16 bp, Homo sapiens
catttcttgggccctc

SEQ ID NO: 277044 - DNA, 17 bp, Homo sapiens
catttcttggtatgatc

SEQ ID NO: 277045 - DNA, 18 bp, Homo sapiens
catttctttatttctgtc

SEQ ID NO: 277046 - DNA, 15 bp, Homo sapiens
catttctttcaagac

SEQ ID NO: 277047 - DNA, 14 bp, Homo sapiens
ccaccaggaacctc

SEQ ID NO: 277048 - DNA, 16 bp, Homo sapiens
ccaccaggaacctctt

SEQ ID NO: 277049 - DNA, 13 bp, Homo sapiens
ccaccaggagaac

SEQ ID NO: 277050 - DNA, 19 bp, Homo sapiens
ccaccaggagaaccactac

SEQ ID NO: 277051 - DNA, 18 bp, Homo sapiens
ccaccagggctcagctcc

SEQ ID NO: 277052 - DNA, 13 bp, Homo sapiens
ccaccagtgcctt

SEQ ID NO: 277053 - DNA, 14 bp, Homo sapiens
ccaccatcctgcag

SEQ ID NO: 277054 - DNA, 22 bp, Homo sapiens
ccaccatctgtaccctgcttcc

SEQ ID NO: 277055 - DNA, 21 bp, Homo sapiens
ccaccatgcacccctgatgtt

SEQ ID NO: 277056 - DNA, 21 bp, Homo sapiens
ccaccatggccagccaacttt

SEQ ID NO: 277057 - DNA, 23 bp, Homo sapiens
ccaccatggctaaggcaccagcc

SEQ ID NO: 277058 - DNA, 19 bp, Homo sapiens
ccacccaaaccccttccca

SEQ ID NO: 277059 - DNA, 14 bp, Homo sapiens
ccacccaagcttgg

SEQ ID NO: 277060 - DNA, 22 bp, Homo sapiens
ccacccacaccccgtctgcccc

SEQ ID NO: 277061 - DNA, 15 bp, Homo sapiens
ccacccaccagggcg

SEQ ID NO: 277062 - DNA, 13 bp, Homo sapiens
ccacccaccctct

SEQ ID NO: 277063 - DNA, 11 bp, Homo sapiens
ccacccacctc

SEQ ID NO: 277064 - DNA, 15 bp, Homo sapiens
ccacccactgtccgc

SEQ ID NO: 277065 - DNA, 23 bp, Homo sapiens
ccacccactgtggggcaagcctg

SEQ ID NO: 277066 - DNA, 14 bp, Homo sapiens
ccacccaggaggga

SEQ ID NO: 277067 - DNA, 17 bp, Homo sapiens
ccacccaggagggaggg

SEQ ID NO: 277068 - DNA, 18 bp, Homo sapiens
ccacccaggagggagggg

SEQ ID NO: 277069 - DNA, 17 bp, Homo sapiens
ccacccaggctgcactg

SEQ ID NO: 277070 - DNA, 21 bp, Homo sapiens
ccacccaggctgcactgcagt

SEQ ID NO: 277071 - DNA, 12 bp, Homo sapiens
ccacccagggcc

SEQ ID NO: 277072 - DNA, 18 bp, Homo sapiens
ccacccagggctccctcc

SEQ ID NO: 277073 - DNA, 12 bp, Homo sapiens
ccacccagtgct

SEQ ID NO: 277074 - DNA, 13 bp, Homo sapiens
ccacccagtgctg

SEQ ID NO: 277075 - DNA, 21 bp, Homo sapiens
ccacccagtgctgccatgcca

SEQ ID NO: 277076 - DNA, 16 bp, Homo sapiens
ccacccattcccccat

SEQ ID NO: 277077 - DNA, 18 bp, Homo sapiens
ccaccccaactctcccca

SEQ ID NO: 277078 - DNA, 19 bp, Homo sapiens
ccaccccaattaactgaag

SEQ ID NO: 277079 - DNA, 13 bp, Homo sapiens
ccaccccacactt

SEQ ID NO: 277080 - DNA, 14 bp, Homo sapiens
ccaccccagcctaa

SEQ ID NO: 277081 - DNA, 22 bp, Homo sapiens
ccaccccagtgcacccactctg

SEQ ID NO: 277082 - DNA, 17 bp, Homo sapiens
ccacccccattgtgaat

SEQ ID NO: 277083 - DNA, 13 bp, Homo sapiens
ccacccccctcat

SEQ ID NO: 277084 - DNA, 13 bp, Homo sapiens
ccacccccttctc

SEQ ID NO: 277085 - DNA, 19 bp, Homo sapiens
ccacccccttctctgctcc

SEQ ID NO: 277086 - DNA, 13 bp, Homo sapiens
ccaccccgctgcc

SEQ ID NO: 277087 - DNA, 19 bp, Homo sapiens
ccaccccggctccccctgc

SEQ ID NO: 277088 - DNA, 14 bp, Homo sapiens
ccaccccgggctct

SEQ ID NO: 277089 - DNA, 14 bp, Homo sapiens
ccaccccgtcccgg

SEQ ID NO: 277090 - DNA, 14 bp, Homo sapiens
ccacccctaagtgc

SEQ ID NO: 277091 - DNA, 19 bp, Homo sapiens
ccacccctacagcctgcac

SEQ ID NO: 277092 - DNA, 21 bp, Homo sapiens
ccacccctacagcctgcacac

SEQ ID NO: 277093 - DNA, 15 bp, Homo sapiens
ccacccctccctctg

SEQ ID NO: 277094 - DNA, 16 bp, Homo sapiens
ccacccctcttccccc

SEQ ID NO: 277095 - DNA, 21 bp, Homo sapiens
ccacccctcttcccccttccc

SEQ ID NO: 277096 - DNA, 18 bp, Homo sapiens
ccacccctgcctttgttt

SEQ ID NO: 277097 - DNA, 13 bp, Homo sapiens
ccacccctgctgc

SEQ ID NO: 277098 - DNA, 21 bp, Homo sapiens
ccacccctgtacccagccacc

SEQ ID NO: 277099 - DNA, 13 bp, Homo sapiens
ccaccccttcccc

SEQ ID NO: 277100 - DNA, 16 bp, Homo sapiens
ccaccccttccccact

SEQ ID NO: 277101 - DNA, 15 bp, Homo sapiens
ccacccgccccagag

SEQ ID NO: 277102 - DNA, 18 bp, Homo sapiens
ccacccgccccagagact

SEQ ID NO: 277103 - DNA, 18 bp, Homo sapiens
ccacccggatctccaggc

SEQ ID NO: 277104 - DNA, 19 bp, Homo sapiens
ccacccggatctccaggcc

SEQ ID NO: 277105 - DNA, 21 bp, Homo sapiens
ccacccggatctccaggccca

SEQ ID NO: 277106 - DNA, 18 bp, Homo sapiens
ccacccggccacagctgc

SEQ ID NO: 277107 - DNA, 16 bp, Homo sapiens
ccacccgggagcagtg

SEQ ID NO: 277108 - DNA, 20 bp, Homo sapiens
ccacccgtaggcagcctctc

SEQ ID NO: 277109 - DNA, 21 bp, Homo sapiens
ccactaggtgcccagtcttga

SEQ ID NO: 277110 - DNA, 14 bp, Homo sapiens
ccactaggtgtccc

SEQ ID NO: 277111 - DNA, 15 bp, Homo sapiens
ccactaggtgtcccc

SEQ ID NO: 277112 - DNA, 21 bp, Homo sapiens
ccactaggtgtccccaacgtc

SEQ ID NO: 277113 - DNA, 13 bp, Homo sapiens
ccactatcacata

SEQ ID NO: 277114 - DNA, 14 bp, Homo sapiens
ccactatgcacaga

SEQ ID NO: 277115 - DNA, 18 bp, Homo sapiens
ccactcaccccctttgct

SEQ ID NO: 277116 - DNA, 12 bp, Homo sapiens
ccactcactcca

SEQ ID NO: 277117 - DNA, 16 bp, Homo sapiens
ccactcagggctggcc

SEQ ID NO: 277118 - DNA, 22 bp, Homo sapiens
ccactcagggctggcccgggga

SEQ ID NO: 277119 - DNA, 21 bp, Homo sapiens
ccactccagacccctggcttt

SEQ ID NO: 277120 - DNA, 13 bp, Homo sapiens
ccactcccctcat

SEQ ID NO: 277121 - DNA, 14 bp, Homo sapiens
ccactcccgccaca

SEQ ID NO: 277122 - DNA, 15 bp, Homo sapiens
ccactcccgccacac

SEQ ID NO: 277123 - DNA, 17 bp, Homo sapiens
ccactcccgccacacgc

SEQ ID NO: 277124 - DNA, 15 bp, Homo sapiens
ccactccctgccaac

SEQ ID NO: 277125 - DNA, 12 bp, Homo sapiens
ccactccctgct

SEQ ID NO: 277126 - DNA, 13 bp, Homo sapiens
ccactccctgctc

SEQ ID NO: 277127 - DNA, 16 bp, Homo sapiens
ccactccctgctccac

SEQ ID NO: 277128 - DNA, 17 bp, Homo sapiens
ccactccctgctccacg

SEQ ID NO: 277129 - DNA, 14 bp, Homo sapiens
ccactccctgtcca

SEQ ID NO: 277130 - DNA, 17 bp, Homo sapiens
ccactcctcaaccttga

SEQ ID NO: 277131 - DNA, 13 bp, Homo sapiens
ccactcctcccaa

SEQ ID NO: 277132 - DNA, 16 bp, Homo sapiens
ccactcctcctccagc

SEQ ID NO: 277133 - DNA, 22 bp, Homo sapiens
ccactcctcctccagcccaccc

SEQ ID NO: 277134 - DNA, 14 bp, Homo sapiens
ccactcctgtacac

SEQ ID NO: 277135 - DNA, 22 bp, Homo sapiens
ccactccttcctgccacctgct

SEQ ID NO: 277136 - DNA, 17 bp, Homo sapiens
ccactcgcagtcgcagg

SEQ ID NO: 277137 - DNA, 20 bp, Homo sapiens
ccactctaccctcccacccc

SEQ ID NO: 277138 - DNA, 15 bp, Homo sapiens
ccactctagttctag

SEQ ID NO: 277139 - DNA, 17 bp, Homo sapiens
ccactctagttctagat

SEQ ID NO: 277140 - DNA, 15 bp, Homo sapiens
ccactctcagagact

SEQ ID NO: 277141 - DNA, 13 bp, Homo sapiens
ccactctccccac

SEQ ID NO: 277142 - DNA, 18 bp, Homo sapiens
ccactctcggggcccttg

SEQ ID NO: 277143 - DNA, 12 bp, Homo sapiens
ccactctctgcc

SEQ ID NO: 277144 - DNA, 20 bp, Homo sapiens
ccactctctgggactctcct

SEQ ID NO: 277145 - DNA, 22 bp, Homo sapiens
ccactctgaagtcccttcctgt

SEQ ID NO: 277146 - DNA, 23 bp, Homo sapiens
ccactgaagtccccctttctcct

SEQ ID NO: 277147 - DNA, 16 bp, Homo sapiens
ccactgacagcctccc

SEQ ID NO: 277148 - DNA, 18 bp, Homo sapiens
ccactgacctggaagagc

SEQ ID NO: 277149 - DNA, 14 bp, Homo sapiens
ccactgagcccttg

SEQ ID NO: 277150 - DNA, 22 bp, Homo sapiens
ccactgagtctcattcctctgt

SEQ ID NO: 277151 - DNA, 23 bp, Homo sapiens
ccactgatatcacgggcccgctc

SEQ ID NO: 277152 - DNA, 24 bp, Homo sapiens
ccactgatatcacgggcccgctca

SEQ ID NO: 277153 - DNA, 11 bp, Homo sapiens
ccactgcaaac

SEQ ID NO: 277154 - DNA, 20 bp, Homo sapiens
ccactgcaaaccctgctgcc

SEQ ID NO: 277155 - DNA, 21 bp, Homo sapiens
ccactgcacttggtgctgctt

SEQ ID NO: 277156 - DNA, 22 bp, Homo sapiens
ccactgcacttggtgctgcttt

SEQ ID NO: 277157 - DNA, 13 bp, Homo sapiens
ccactgcagtcac

SEQ ID NO: 277158 - DNA, 20 bp, Homo sapiens
ccactgcagtcacccctgtc

SEQ ID NO: 277159 - DNA, 19 bp, Homo sapiens
ccactgccaggcacctggc

SEQ ID NO: 277160 - DNA, 12 bp, Homo sapiens
ccactgccctgc

SEQ ID NO: 277161 - DNA, 16 bp, Homo sapiens
ccactgccctgcctgc

SEQ ID NO: 277162 - DNA, 19 bp, Homo sapiens
ccactgccctgcctgccca

SEQ ID NO: 277163 - DNA, 11 bp, Homo sapiens
ccactgcctct

SEQ ID NO: 277164 - DNA, 16 bp, Homo sapiens
ccactgcctctgcctt

SEQ ID NO: 277165 - DNA, 18 bp, Homo sapiens
ccactgcctctgccttag

SEQ ID NO: 277166 - DNA, 20 bp, Homo sapiens
ccactgcctctggaattgct

SEQ ID NO: 277167 - DNA, 15 bp, Homo sapiens
ccactgcctgcccac

SEQ ID NO: 277168 - DNA, 15 bp, Homo sapiens
ccaggccctccatgg

SEQ ID NO: 277169 - DNA, 18 bp, Homo sapiens
ccaggccctcctgctggc

SEQ ID NO: 277170 - DNA, 14 bp, Homo sapiens
ccaggccgcatggc

SEQ ID NO: 277171 - DNA, 19 bp, Homo sapiens
ccaggccgcatggcccctc

SEQ ID NO: 277172 - DNA, 21 bp, Homo sapiens
ccaggccgccccagcctctga

SEQ ID NO: 277173 - DNA, 15 bp, Homo sapiens
ccaggccggccagcc

SEQ ID NO: 277174 - DNA, 17 bp, Homo sapiens
ccaggccggccagcctc

SEQ ID NO: 277175 - DNA, 18 bp, Homo sapiens
ccaggccggccagcctca

SEQ ID NO: 277176 - DNA, 21 bp, Homo sapiens
ccaggccggggtggagcatgg

SEQ ID NO: 277177 - DNA, 15 bp, Homo sapiens
ccaggcctccagcct

SEQ ID NO: 277178 - DNA, 18 bp, Homo sapiens
ccaggcctccagcctctc

SEQ ID NO: 277179 - DNA, 20 bp, Homo sapiens
ccaggcctccagcctctccc

SEQ ID NO: 277180 - DNA, 16 bp, Homo sapiens
ccaggcctcccgcatg

SEQ ID NO: 277181 - DNA, 20 bp, Homo sapiens
ccaggcctgaggctgctgac

SEQ ID NO: 277182 - DNA, 11 bp, Homo sapiens
ccaggcctgcc

SEQ ID NO: 277183 - DNA, 13 bp, Homo sapiens
ccaggcctgccag

SEQ ID NO: 277184 - DNA, 14 bp, Homo sapiens
ccaggcctgccagc

SEQ ID NO: 277185 - DNA, 23 bp, Homo sapiens
ccaggcctggcctcggggcaggg

SEQ ID NO: 277186 - DNA, 16 bp, Homo sapiens
ccaggcctgggtctgt

SEQ ID NO: 277187 - DNA, 17 bp, Homo sapiens
ccaggcctgggtctgtg

SEQ ID NO: 277188 - DNA, 18 bp, Homo sapiens
ccaggcgccccttccccc

SEQ ID NO: 277189 - DNA, 19 bp, Homo sapiens
ccaggcgccccttccccct

SEQ ID NO: 277190 - DNA, 20 bp, Homo sapiens
ccaggcggaggggcttggag

SEQ ID NO: 277191 - DNA, 22 bp, Homo sapiens
ccaggcggaggggcttggagca

SEQ ID NO: 277192 - DNA, 23 bp, Homo sapiens
ccaggcgggcggcacgccaacag

SEQ ID NO: 277193 - DNA, 17 bp, Homo sapiens
ccaggcgtagggccagg

SEQ ID NO: 277194 - DNA, 22 bp, Homo sapiens
ccaggcgtgggacgtggtcagg

SEQ ID NO: 277195 - DNA, 16 bp, Homo sapiens
ccaggcgttggtgcca

SEQ ID NO: 277196 - DNA, 18 bp, Homo sapiens
ccaggcgttggtgccact

SEQ ID NO: 277197 - DNA, 23 bp, Homo sapiens
ccaggctagtccggacccacctc

SEQ ID NO: 277198 - DNA, 19 bp, Homo sapiens
ccaggctcacaactgtttt

SEQ ID NO: 277199 - DNA, 15 bp, Homo sapiens
ccaggctccaggctg

SEQ ID NO: 277200 - DNA, 15 bp, Homo sapiens
ccaggctcccctggt

SEQ ID NO: 277201 - DNA, 16 bp, Homo sapiens
ccaggctcccctggtc

SEQ ID NO: 277202 - DNA, 16 bp, Homo sapiens
ccaggctctccctctc

SEQ ID NO: 277203 - DNA, 18 bp, Homo sapiens
ccaggctctccctctctg

SEQ ID NO: 277204 - DNA, 23 bp, Homo sapiens
ccaggctctccctctctgcacct

SEQ ID NO: 277205 - DNA, 17 bp, Homo sapiens
ccaggctctgctgactt

SEQ ID NO: 277206 - DNA, 14 bp, Homo sapiens
ccaggctcttcctg

SEQ ID NO: 277207 - DNA, 18 bp, Homo sapiens
ccaggctcttcctggacc

SEQ ID NO: 277208 - DNA, 19 bp, Homo sapiens
ccaggctcttcctggacct

SEQ ID NO: 277209 - DNA, 19 bp, Homo sapiens
ccaggctgaattacagtga

SEQ ID NO: 277210 - DNA, 12 bp, Homo sapiens
ccaggctgcact

SEQ ID NO: 277211 - DNA, 15 bp, Homo sapiens
ccaggctgcactgca

SEQ ID NO: 277212 - DNA, 20 bp, Homo sapiens
ccaggctgccaaggccagag

SEQ ID NO: 277213 - DNA, 13 bp, Homo sapiens
ccaggctgcgcct

SEQ ID NO: 277214 - DNA, 14 bp, Homo sapiens
ccaggctgcgcctg

SEQ ID NO: 277215 - DNA, 15 bp, Homo sapiens
ccaggctgcgcctgc

SEQ ID NO: 277216 - DNA, 16 bp, Homo sapiens
ccaggctgcgcctgcc

SEQ ID NO: 277217 - DNA, 20 bp, Homo sapiens
ccaggctgcgcctgcccgcc

SEQ ID NO: 277218 - DNA, 13 bp, Homo sapiens
ccaggctgggcac

SEQ ID NO: 277219 - DNA, 12 bp, Homo sapiens
ccaggctggggc

SEQ ID NO: 277220 - DNA, 18 bp, Homo sapiens
ccaggctggggcctggcc

SEQ ID NO: 277221 - DNA, 19 bp, Homo sapiens
ccaggctggggcctggcct

SEQ ID NO: 277222 - DNA, 15 bp, Homo sapiens
ccaggctggtctcaa

SEQ ID NO: 277223 - DNA, 19 bp, Homo sapiens
ccaggctggtctcaaactc

SEQ ID NO: 277224 - DNA, 18 bp, Homo sapiens
ccaggctggttcttgggc

SEQ ID NO: 277225 - DNA, 17 bp, Homo sapiens
ccaggctgtcagcgcct

SEQ ID NO: 277226 - DNA, 18 bp, Homo sapiens
ccaggcttcaccctgaat

SEQ ID NO: 277227 - DNA, 14 bp, Homo sapiens
ccagggaaaaagac

SEQ ID NO: 277228 - DNA, 15 bp, Homo sapiens
ccagggacagacgct

SEQ ID NO: 277229 - DNA, 14 bp, Homo sapiens
ccagggactgcagc

SEQ ID NO: 277230 - DNA, 22 bp, Homo sapiens
ccagggactgcagctgcaccag

SEQ ID NO: 277231 - DNA, 13 bp, Homo sapiens
ccagggagcccgg

SEQ ID NO: 277232 - DNA, 23 bp, Homo sapiens
ccagggagcccggggcagagctc

SEQ ID NO: 277233 - DNA, 13 bp, Homo sapiens
ccagggaggaagc

SEQ ID NO: 277234 - DNA, 17 bp, Homo sapiens
ccagggaggaagccgca

SEQ ID NO: 277235 - DNA, 13 bp, Homo sapiens
ccagggaggagag

SEQ ID NO: 277236 - DNA, 13 bp, Homo sapiens
ccagggagtcccc

SEQ ID NO: 277237 - DNA, 16 bp, Homo sapiens
ccagggagtcccctcc

SEQ ID NO: 277238 - DNA, 17 bp, Homo sapiens
ccagggagtcccctccc

SEQ ID NO: 277239 - DNA, 22 bp, Homo sapiens
ccagggatggggccacagccag

SEQ ID NO: 277240 - DNA, 19 bp, Homo sapiens
ccagggcaccaagcccaca

SEQ ID NO: 277241 - DNA, 13 bp, Homo sapiens
ccagggcagcagc

SEQ ID NO: 277242 - DNA, 14 bp, Homo sapiens
ccagggcagcagcc

SEQ ID NO: 277243 - DNA, 23 bp, Homo sapiens
ccagggcagggtgggcagcctat

SEQ ID NO: 277244 - DNA, 17 bp, Homo sapiens
ccagggcagtgctagtg

SEQ ID NO: 277245 - DNA, 12 bp, Homo sapiens
ccagggcccctc

SEQ ID NO: 277246 - DNA, 17 bp, Homo sapiens
ccagggcccctccctct

SEQ ID NO: 277247 - DNA, 21 bp, Homo sapiens
ccagggcccctccctctgccc

SEQ ID NO: 277248 - DNA, 22 bp, Homo sapiens
ccagggcccctccctctgcccc

SEQ ID NO: 277249 - DNA, 20 bp, Homo sapiens
ccagggcccgagcgcgtgcc

SEQ ID NO: 277250 - DNA, 13 bp, Homo sapiens
ccagggcccggca

SEQ ID NO: 277251 - DNA, 20 bp, Homo sapiens
ccagggcccggcacagagtc

SEQ ID NO: 277252 - DNA, 13 bp, Homo sapiens
ccagggccctgct

SEQ ID NO: 277253 - DNA, 14 bp, Homo sapiens
ccagggccctgctc

SEQ ID NO: 277254 - DNA, 16 bp, Homo sapiens
ccagggcctgggggca

SEQ ID NO: 277255 - DNA, 19 bp, Homo sapiens
ccagggctagtgacttgtg

SEQ ID NO: 277256 - DNA, 12 bp, Homo sapiens
ccagggctctgg

SEQ ID NO: 277257 - DNA, 17 bp, Homo sapiens
ccagggctctggcaggt

SEQ ID NO: 277258 - DNA, 13 bp, Homo sapiens
ccagggctgcccc

SEQ ID NO: 277259 - DNA, 19 bp, Homo sapiens
ccagggctgcccctgtagg

SEQ ID NO: 277260 - DNA, 23 bp, Homo sapiens
ccagggctggagacttcctctgg

SEQ ID NO: 277261 - DNA, 13 bp, Homo sapiens
ccagggctgtcct

SEQ ID NO: 277262 - DNA, 12 bp, Homo sapiens
ccaggggcacac

SEQ ID NO: 277263 - DNA, 16 bp, Homo sapiens
ccaggggcccaggctc

SEQ ID NO: 277264 - DNA, 23 bp, Homo sapiens
ccaggggcccaggctcccctgcc

SEQ ID NO: 277265 - DNA, 14 bp, Homo sapiens
ccaggggtcccagc

SEQ ID NO: 277266 - DNA, 21 bp, Homo sapiens
ccaggggtctccctgagcctg

SEQ ID NO: 277267 - DNA, 22 bp, Homo sapiens
ccaggggtctccctgagcctgc

SEQ ID NO: 277268 - DNA, 10 bp, Homo sapiens
ccagggtaga

SEQ ID NO: 277269 - DNA, 21 bp, Homo sapiens
ccagggtaggcaaggctgccg

SEQ ID NO: 277270 - DNA, 16 bp, Homo sapiens
ccagggtccgcaccag

SEQ ID NO: 277271 - DNA, 15 bp, Homo sapiens
ccagggtcctgtgcc

SEQ ID NO: 277272 - DNA, 16 bp, Homo sapiens
ccagggtcctgtgcct

SEQ ID NO: 277273 - DNA, 14 bp, Homo sapiens
ccagggtcttccct

SEQ ID NO: 277274 - DNA, 23 bp, Homo sapiens
ccagggtcttccctacctcaggc

SEQ ID NO: 277275 - DNA, 17 bp, Homo sapiens
ccagggtcttgggctac

SEQ ID NO: 277276 - DNA, 21 bp, Homo sapiens
ccagggtctttactgggaagc

SEQ ID NO: 277277 - DNA, 23 bp, Homo sapiens
ccagggtctttactgggaagcag

SEQ ID NO: 277278 - DNA, 15 bp, Homo sapiens
ccagggtgcaggcgc

SEQ ID NO: 277279 - DNA, 16 bp, Homo sapiens
ccagggtgcaggcgcg

SEQ ID NO: 277280 - DNA, 16 bp, Homo sapiens
ccagggtgcagtgtga

SEQ ID NO: 277281 - DNA, 15 bp, Homo sapiens
ccagggttccagaca

SEQ ID NO: 277282 - DNA, 16 bp, Homo sapiens
ccagggttccagacag

SEQ ID NO: 277283 - DNA, 17 bp, Homo sapiens
ccagggttccagacagg

SEQ ID NO: 277284 - DNA, 22 bp, Homo sapiens
ccagggttccagacagggtggg

SEQ ID NO: 277285 - DNA, 15 bp, Homo sapiens
ccagggttcccccag

SEQ ID NO: 277286 - DNA, 23 bp, Homo sapiens
ccatgttggccaggctggtctca

SEQ ID NO: 277287 - DNA, 15 bp, Homo sapiens
ccattaaaactgctt

SEQ ID NO: 277288 - DNA, 20 bp, Homo sapiens
ccattaacaggtctttgaaa

SEQ ID NO: 277289 - DNA, 22 bp, Homo sapiens
ccattattctagggtcttactc

SEQ ID NO: 277290 - DNA, 17 bp, Homo sapiens
ccattcagaactctcag

SEQ ID NO: 277291 - DNA, 18 bp, Homo sapiens
ccattcagaactctcaga

SEQ ID NO: 277292 - DNA, 15 bp, Homo sapiens
ccattcagtctgcag

SEQ ID NO: 277293 - DNA, 15 bp, Homo sapiens
ccattcatctgggct

SEQ ID NO: 277294 - DNA, 19 bp, Homo sapiens
ccattcccccatgtggctg

SEQ ID NO: 277295 - DNA, 15 bp, Homo sapiens
ccattcctgttctct

SEQ ID NO: 277296 - DNA, 17 bp, Homo sapiens
ccattctagatcctgca

SEQ ID NO: 277297 - DNA, 23 bp, Homo sapiens
ccattctcccttttgacacagtt

SEQ ID NO: 277298 - DNA, 14 bp, Homo sapiens
ccattctcctgcct

SEQ ID NO: 277299 - DNA, 24 bp, Homo sapiens
ccattctgctttcttgccacacag

SEQ ID NO: 277300 - DNA, 17 bp, Homo sapiens
ccattctttctgataac

SEQ ID NO: 277301 - DNA, 16 bp, Homo sapiens
ccattctttcttcctc

SEQ ID NO: 277302 - DNA, 15 bp, Homo sapiens
ccattgacctcagct

SEQ ID NO: 277303 - DNA, 18 bp, Homo sapiens
ccattgacctcagctgca

SEQ ID NO: 277304 - DNA, 16 bp, Homo sapiens
ccattgccaccaggag

SEQ ID NO: 277305 - DNA, 21 bp, Homo sapiens
ccattgccaccaggagaacca

SEQ ID NO: 277306 - DNA, 12 bp, Homo sapiens
ccattgcttcac

SEQ ID NO: 277307 - DNA, 20 bp, Homo sapiens
ccattggtctgcatgtcttt

SEQ ID NO: 277308 - DNA, 20 bp, Homo sapiens
ccattggttaatctggactt

SEQ ID NO: 277309 - DNA, 18 bp, Homo sapiens
ccattgtactccagcctg

SEQ ID NO: 277310 - DNA, 23 bp, Homo sapiens
ccattgtcgtttcattcattttg

SEQ ID NO: 277311 - DNA, 15 bp, Homo sapiens
ccattgttcagaaga

SEQ ID NO: 277312 - DNA, 20 bp, Homo sapiens
ccatttaaactaacctttta

SEQ ID NO: 277313 - DNA, 16 bp, Homo sapiens
ccatttaatcatttcc

SEQ ID NO: 277314 - DNA, 15 bp, Homo sapiens
ccatttacctggaaa

SEQ ID NO: 277315 - DNA, 18 bp, Homo sapiens
ccatttacgtgtctgaat

SEQ ID NO: 277316 - DNA, 22 bp, Homo sapiens
ccatttattattttaatattta

SEQ ID NO: 277317 - DNA, 23 bp, Homo sapiens
ccatttattattttaatatttat

SEQ ID NO: 277318 - DNA, 17 bp, Homo sapiens
ccatttcacacctgaaa

SEQ ID NO: 277319 - DNA, 11 bp, Homo sapiens
ccatttccctt

SEQ ID NO: 277320 - DNA, 17 bp, Homo sapiens
ccatttcctcttccttc

SEQ ID NO: 277321 - DNA, 19 bp, Homo sapiens
ccatttctaaaggcctctt

SEQ ID NO: 277322 - DNA, 14 bp, Homo sapiens
ccatttctatttat

SEQ ID NO: 277323 - DNA, 15 bp, Homo sapiens
ccatttctctacact

SEQ ID NO: 277324 - DNA, 12 bp, Homo sapiens
ccatttctgatg

SEQ ID NO: 277325 - DNA, 16 bp, Homo sapiens
ccatttcttcagaggg

SEQ ID NO: 277326 - DNA, 13 bp, Homo sapiens
ccatttcttccca

SEQ ID NO: 277327 - DNA, 17 bp, Homo sapiens
ccatttgtcttttgtaa

SEQ ID NO: 277328 - DNA, 14 bp, Homo sapiens
ccatttgtgtttat

SEQ ID NO: 277329 - DNA, 13 bp, Homo sapiens
ccatttgtttatt

SEQ ID NO: 277330 - DNA, 14 bp, Homo sapiens
ccattttctggttc

SEQ ID NO: 277331 - DNA, 21 bp, Homo sapiens
ccattttgcaaaatttccagt

SEQ ID NO: 277332 - DNA, 18 bp, Homo sapiens
ccattttgtaactgccta

SEQ ID NO: 277333 - DNA, 20 bp, Homo sapiens
ccatttttactaaagcagtg

SEQ ID NO: 277334 - DNA, 18 bp, Homo sapiens
ccatttttgtcagtctga

SEQ ID NO: 277335 - DNA, 21 bp, Homo sapiens
cccaaaaccacagccctgtca

SEQ ID NO: 277336 - DNA, 14 bp, Homo sapiens
cccaaacatagccc

SEQ ID NO: 277337 - DNA, 15 bp, Homo sapiens
cccaaaccaagtgcc

SEQ ID NO: 277338 - DNA, 13 bp, Homo sapiens
cccaaaccctgct

SEQ ID NO: 277339 - DNA, 23 bp, Homo sapiens
cccaaactgtagtaattgttaca

SEQ ID NO: 277340 - DNA, 19 bp, Homo sapiens
cccaaacttccaggttcca

SEQ ID NO: 277341 - DNA, 16 bp, Homo sapiens
cccaaagcagtgcatg

SEQ ID NO: 277342 - DNA, 21 bp, Homo sapiens
cccaaagcggccgatgggagt

SEQ ID NO: 277343 - DNA, 16 bp, Homo sapiens
cccaaagctttcctgc

SEQ ID NO: 277344 - DNA, 17 bp, Homo sapiens
cccaaagctttcctgcc

SEQ ID NO: 277345 - DNA, 20 bp, Homo sapiens
cccaaagctttcctgcccca

SEQ ID NO: 277346 - DNA, 19 bp, Homo sapiens
cccaaagtggggagggaca

SEQ ID NO: 277347 - DNA, 18 bp, Homo sapiens
cccaaatctactgagcca

SEQ ID NO: 277348 - DNA, 17 bp, Homo sapiens
cccaaatcttcctctgg

SEQ ID NO: 277349 - DNA, 21 bp, Homo sapiens
cccaaattatcaagctaataa

SEQ ID NO: 277350 - DNA, 16 bp, Homo sapiens
cccaacagccttagct

SEQ ID NO: 277351 - DNA, 19 bp, Homo sapiens
cccaacagccttagctgcc

SEQ ID NO: 277352 - DNA, 15 bp, Homo sapiens
cccaaccaggagggg

SEQ ID NO: 277353 - DNA, 20 bp, Homo sapiens
cccaacccattcactacagg

SEQ ID NO: 277354 - DNA, 12 bp, Homo sapiens
cccaacccccac

SEQ ID NO: 277355 - DNA, 13 bp, Homo sapiens
cccaacccccacc

SEQ ID NO: 277356 - DNA, 15 bp, Homo sapiens
cccaacccccacctc

SEQ ID NO: 277357 - DNA, 17 bp, Homo sapiens
cccaaccgggaaaggca

SEQ ID NO: 277358 - DNA, 18 bp, Homo sapiens
cccaacctcaatgccctg

SEQ ID NO: 277359 - DNA, 20 bp, Homo sapiens
cccaacctcaatgccctgcc

SEQ ID NO: 277360 - DNA, 13 bp, Homo sapiens
cccaacctcagca

SEQ ID NO: 277361 - DNA, 23 bp, Homo sapiens
cccaacctgctctcctcttgcca

SEQ ID NO: 277362 - DNA, 14 bp, Homo sapiens
cccaacgtcccctc

SEQ ID NO: 277363 - DNA, 19 bp, Homo sapiens
cccaacgtcccctccgccg

SEQ ID NO: 277364 - DNA, 17 bp, Homo sapiens
cccaactcactgtgctc

SEQ ID NO: 277365 - DNA, 15 bp, Homo sapiens
cccaactcccagcca

SEQ ID NO: 277366 - DNA, 16 bp, Homo sapiens
cccaactccgcccagc

SEQ ID NO: 277367 - DNA, 16 bp, Homo sapiens
cccaactgacttctgc

SEQ ID NO: 277368 - DNA, 17 bp, Homo sapiens
cccaactgacttctgct

SEQ ID NO: 277369 - DNA, 15 bp, Homo sapiens
cccaacttcaccacc

SEQ ID NO: 277370 - DNA, 19 bp, Homo sapiens
cccaacttcaccaccccct

SEQ ID NO: 277371 - DNA, 17 bp, Homo sapiens
cccaacttccctgttct

SEQ ID NO: 277372 - DNA, 20 bp, Homo sapiens
cccaagaaacctccatcctg

SEQ ID NO: 277373 - DNA, 15 bp, Homo sapiens
cccaagaaggctggg

SEQ ID NO: 277374 - DNA, 16 bp, Homo sapiens
cccaagaaggctgggg

SEQ ID NO: 277375 - DNA, 20 bp, Homo sapiens
cccaagacagatgccccaga

SEQ ID NO: 277376 - DNA, 21 bp, Homo sapiens
cccaagacagatgccccagag

SEQ ID NO: 277377 - DNA, 15 bp, Homo sapiens
cccaagaggctagcc

SEQ ID NO: 277378 - DNA, 19 bp, Homo sapiens
cccaagagtggtggcagct

SEQ ID NO: 277379 - DNA, 22 bp, Homo sapiens
cccaagatcattctacaagtaa

SEQ ID NO: 277380 - DNA, 18 bp, Homo sapiens
cccaagatgagctgcagc

SEQ ID NO: 277381 - DNA, 12 bp, Homo sapiens
cccaagcagcca

SEQ ID NO: 277382 - DNA, 16 bp, Homo sapiens
cccaagcagccagcca

SEQ ID NO: 277383 - DNA, 15 bp, Homo sapiens
cccaagcatgcccca

SEQ ID NO: 277384 - DNA, 17 bp, Homo sapiens
cccaagcatgccccacc

SEQ ID NO: 277385 - DNA, 20 bp, Homo sapiens
cccaagcatgccccacccac

SEQ ID NO: 277386 - DNA, 16 bp, Homo sapiens
cccaagccaaaaacct

SEQ ID NO: 277387 - DNA, 18 bp, Homo sapiens
cccaagcccgacttgctg

SEQ ID NO: 277388 - DNA, 15 bp, Homo sapiens
cccaagccctgcccc

SEQ ID NO: 277389 - DNA, 16 bp, Homo sapiens
cccaagcgttcctggc

SEQ ID NO: 277390 - DNA, 17 bp, Homo sapiens
cccaagctcttgtggta

SEQ ID NO: 277391 - DNA, 19 bp, Homo sapiens
cccaagctggagtgcagtg

SEQ ID NO: 277392 - DNA, 18 bp, Homo sapiens
ccccttcccctgcgccct

SEQ ID NO: 277393 - DNA, 14 bp, Homo sapiens
ccccttcccctgct

SEQ ID NO: 277394 - DNA, 12 bp, Homo sapiens
ccccttcctgtc

SEQ ID NO: 277395 - DNA, 15 bp, Homo sapiens
ccccttcctgtctgg

SEQ ID NO: 277396 - DNA, 22 bp, Homo sapiens
ccccttctacactctcctgggc

SEQ ID NO: 277397 - DNA, 23 bp, Homo sapiens
ccccttctacactctcctgggcc

SEQ ID NO: 277398 - DNA, 16 bp, Homo sapiens
ccccttctcccagcac

SEQ ID NO: 277399 - DNA, 12 bp, Homo sapiens
ccccttctctgc

SEQ ID NO: 277400 - DNA, 13 bp, Homo sapiens
ccccttctctgct

SEQ ID NO: 277401 - DNA, 22 bp, Homo sapiens
ccccttgcccgccagccagtgg

SEQ ID NO: 277402 - DNA, 12 bp, Homo sapiens
ccccttgcttct

SEQ ID NO: 277403 - DNA, 22 bp, Homo sapiens
ccccttgggatgggcacaggct

SEQ ID NO: 277404 - DNA, 13 bp, Homo sapiens
ccccttgggcatc

SEQ ID NO: 277405 - DNA, 15 bp, Homo sapiens
ccccttgggcggctg

SEQ ID NO: 277406 - DNA, 23 bp, Homo sapiens
cccctttccaattccaaaattcc

SEQ ID NO: 277407 - DNA, 19 bp, Homo sapiens
ccccttttgcctggctgtg

SEQ ID NO: 277408 - DNA, 22 bp, Homo sapiens
ccccttttgtgggtttctctgt

SEQ ID NO: 277409 - DNA, 23 bp, Homo sapiens
ccccttttgtgggtttctctgtg

SEQ ID NO: 277410 - DNA, 17 bp, Homo sapiens
cccctttttcttcctca

SEQ ID NO: 277411 - DNA, 17 bp, Homo sapiens
cccgaagccatcacttc

SEQ ID NO: 277412 - DNA, 21 bp, Homo sapiens
cccgaagccatcacttctccc

SEQ ID NO: 277413 - DNA, 13 bp, Homo sapiens
cccgaatgcctgt

SEQ ID NO: 277414 - DNA, 15 bp, Homo sapiens
cccgacactgctgca

SEQ ID NO: 277415 - DNA, 23 bp, Homo sapiens
cccgacactgctgcaccagagtg

SEQ ID NO: 277416 - DNA, 14 bp, Homo sapiens
cccgacagcctggc

SEQ ID NO: 277417 - DNA, 17 bp, Homo sapiens
cccgacagtggctctcc

SEQ ID NO: 277418 - DNA, 23 bp, Homo sapiens
cccgacctaccaccccactggct

SEQ ID NO: 277419 - DNA, 15 bp, Homo sapiens
cccgacgccacagcc

SEQ ID NO: 277420 - DNA, 22 bp, Homo sapiens
cccgagagctcttagtttttaa

SEQ ID NO: 277421 - DNA, 23 bp, Homo sapiens
cccgagagctcttagtttttaaa

SEQ ID NO: 277422 - DNA, 20 bp, Homo sapiens
cccgagatgtgacccaccag

SEQ ID NO: 277423 - DNA, 23 bp, Homo sapiens
cccgagatgtgacccaccagtgc

SEQ ID NO: 277424 - DNA, 12 bp, Homo sapiens
cccgagcccagc

SEQ ID NO: 277425 - DNA, 15 bp, Homo sapiens
cccgagccccctgtc

SEQ ID NO: 277426 - DNA, 18 bp, Homo sapiens
cccgagccccctgtcctt

SEQ ID NO: 277427 - DNA, 19 bp, Homo sapiens
cccgagccccctgtccttc

SEQ ID NO: 277428 - DNA, 18 bp, Homo sapiens
cccgagccgagctctcct

SEQ ID NO: 277429 - DNA, 19 bp, Homo sapiens
cccgagccgagctctcctg

SEQ ID NO: 277430 - DNA, 18 bp, Homo sapiens
cccgagcgcgtgccttcc

SEQ ID NO: 277431 - DNA, 17 bp, Homo sapiens
cccgttgccgggcctgg

SEQ ID NO: 277432 - DNA, 12 bp, Homo sapiens
cccgtttccaag

SEQ ID NO: 277433 - DNA, 14 bp, Homo sapiens
ccctaaagccctct

SEQ ID NO: 277434 - DNA, 17 bp, Homo sapiens
ccctaacctcttttctg

SEQ ID NO: 277435 - DNA, 13 bp, Homo sapiens
ccctaactcttgc

SEQ ID NO: 277436 - DNA, 18 bp, Homo sapiens
ccctaactcttgctcact

SEQ ID NO: 277437 - DNA, 17 bp, Homo sapiens
ccctaagccaagggcct

SEQ ID NO: 277438 - DNA, 13 bp, Homo sapiens
ccctaagccactc

SEQ ID NO: 277439 - DNA, 23 bp, Homo sapiens
ccctaagtggattggctttgtgc

SEQ ID NO: 277440 - DNA, 20 bp, Homo sapiens
ccctacaagttgatcatgca

SEQ ID NO: 277441 - DNA, 16 bp, Homo sapiens
ccctacacctctgggc

SEQ ID NO: 277442 - DNA, 20 bp, Homo sapiens
ccctacacctctgggccctg

SEQ ID NO: 277443 - DNA, 16 bp, Homo sapiens
ccctacagcctgcaca

SEQ ID NO: 277444 - DNA, 21 bp, Homo sapiens
ccctacagcctgcacacacct

SEQ ID NO: 277445 - DNA, 15 bp, Homo sapiens
ccctacagtatataa

SEQ ID NO: 277446 - DNA, 19 bp, Homo sapiens
ccctacagtatataagctt

SEQ ID NO: 277447 - DNA, 18 bp, Homo sapiens
ccctacatgcatgtttta

SEQ ID NO: 277448 - DNA, 16 bp, Homo sapiens
ccctacattagtaaaa

SEQ ID NO: 277449 - DNA, 21 bp, Homo sapiens
ccctaccagcgcccgctgggc

SEQ ID NO: 277450 - DNA, 15 bp, Homo sapiens
ccctacccacagggc

SEQ ID NO: 277451 - DNA, 20 bp, Homo sapiens
ccctacccacagggcctgac

SEQ ID NO: 277452 - DNA, 22 bp, Homo sapiens
ccctacccccttgtctgctgct

SEQ ID NO: 277453 - DNA, 18 bp, Homo sapiens
ccctaccgagtctcttct

SEQ ID NO: 277454 - DNA, 22 bp, Homo sapiens
ccctaccttgagaccctcttct

SEQ ID NO: 277455 - DNA, 18 bp, Homo sapiens
ccctacttccaagaaaaa

SEQ ID NO: 277456 - DNA, 14 bp, Homo sapiens
ccctagaaagccat

SEQ ID NO: 277457 - DNA, 20 bp, Homo sapiens
ccctagaaagccatattcca

SEQ ID NO: 277458 - DNA, 21 bp, Homo sapiens
ccctagaattccttttataag

SEQ ID NO: 277459 - DNA, 19 bp, Homo sapiens
ccctagatggttccctttg

SEQ ID NO: 277460 - DNA, 23 bp, Homo sapiens
ccctagatggttccctttgttgc

SEQ ID NO: 277461 - DNA, 21 bp, Homo sapiens
ccctagcacaaatttgctttg

SEQ ID NO: 277462 - DNA, 14 bp, Homo sapiens
ccctagcagagcgt

SEQ ID NO: 277463 - DNA, 19 bp, Homo sapiens
ccctagccagagaatagat

SEQ ID NO: 277464 - DNA, 14 bp, Homo sapiens
ccctaggcgcggtt

SEQ ID NO: 277465 - DNA, 21 bp, Homo sapiens
ccctaggtcagcttgctgccc

SEQ ID NO: 277466 - DNA, 16 bp, Homo sapiens
ccctaggtctccaccc

SEQ ID NO: 277467 - DNA, 22 bp, Homo sapiens
ccctaggtgggtcaactccaag

SEQ ID NO: 277468 - DNA, 17 bp, Homo sapiens
ccctagtatctggctgg

SEQ ID NO: 277469 - DNA, 17 bp, Homo sapiens
ccctagtccccctgttt

SEQ ID NO: 277470 - DNA, 22 bp, Homo sapiens
ccctagtcccttcccctccctg

SEQ ID NO: 277471 - DNA, 15 bp, Homo sapiens
ccctagttacccacc

SEQ ID NO: 277472 - DNA, 17 bp, Homo sapiens
ccctagttacccaccct

SEQ ID NO: 277473 - DNA, 13 bp, Homo sapiens
ccctatagagagg

SEQ ID NO: 277474 - DNA, 19 bp, Homo sapiens
ccctatccttggcaccaaa

SEQ ID NO: 277475 - DNA, 13 bp, Homo sapiens
ccctatgctgcct

SEQ ID NO: 277476 - DNA, 17 bp, Homo sapiens
ccctatgggcttccgca

SEQ ID NO: 277477 - DNA, 18 bp, Homo sapiens
ccctatggggatggtcca

SEQ ID NO: 277478 - DNA, 16 bp, Homo sapiens
ccctatttccccaccc

SEQ ID NO: 277479 - DNA, 15 bp, Homo sapiens
ccctcaaaccctgtg

SEQ ID NO: 277480 - DNA, 22 bp, Homo sapiens
ccctcaagccaggagaccctgt

SEQ ID NO: 277481 - DNA, 14 bp, Homo sapiens
ccctcacacacaca

SEQ ID NO: 277482 - DNA, 17 bp, Homo sapiens
ccctcacacatccagac

SEQ ID NO: 277483 - DNA, 13 bp, Homo sapiens
ccctcaccctgcc

SEQ ID NO: 277484 - DNA, 14 bp, Homo sapiens
ccctcacctcagga

SEQ ID NO: 277485 - DNA, 18 bp, Homo sapiens
ccctcaccttgcaacaca

SEQ ID NO: 277486 - DNA, 14 bp, Homo sapiens
ccctcactccactc

SEQ ID NO: 277487 - DNA, 16 bp, Homo sapiens
ccctcactccactccc

SEQ ID NO: 277488 - DNA, 15 bp, Homo sapiens
ccctcactctgccag

SEQ ID NO: 277489 - DNA, 19 bp, Homo sapiens
ccctcagagccctgccctg

SEQ ID NO: 277490 - DNA, 14 bp, Homo sapiens
ccctcagcccctct

SEQ ID NO: 277491 - DNA, 15 bp, Homo sapiens
ccctcagcgctccct

SEQ ID NO: 277492 - DNA, 16 bp, Homo sapiens
ccctcagcgctccctg

SEQ ID NO: 277493 - DNA, 18 bp, Homo sapiens
ccctcagcgctccctgtc

SEQ ID NO: 277494 - DNA, 18 bp, Homo sapiens
ccctcagctatcagtgtt

SEQ ID NO: 277495 - DNA, 16 bp, Homo sapiens
ccctcagctggcggaa

SEQ ID NO: 277496 - DNA, 21 bp, Homo sapiens
ccctcaggcataggcctgggt

SEQ ID NO: 277497 - DNA, 23 bp, Homo sapiens
ccctcaggcataggcctgggtgc

SEQ ID NO: 277498 - DNA, 18 bp, Homo sapiens
ccctcagtgtgaagcctg

SEQ ID NO: 277499 - DNA, 18 bp, Homo sapiens
ccctcatcttgaagggcc

SEQ ID NO: 277500 - DNA, 13 bp, Homo sapiens
ccctccacacctc

SEQ ID NO: 277501 - DNA, 15 bp, Homo sapiens
ccctccacatcccag

SEQ ID NO: 277502 - DNA, 19 bp, Homo sapiens
ccctccacatcccagcagc

SEQ ID NO: 277503 - DNA, 14 bp, Homo sapiens
ccctccacatccct

SEQ ID NO: 277504 - DNA, 17 bp, Homo sapiens
ccctccacctcctctct

SEQ ID NO: 277505 - DNA, 18 bp, Homo sapiens
ccctccacgttcacccct

SEQ ID NO: 277506 - DNA, 14 bp, Homo sapiens
ccctccactaggag

SEQ ID NO: 277507 - DNA, 14 bp, Homo sapiens
ccctccactcctcc

SEQ ID NO: 277508 - DNA, 22 bp, Homo sapiens
ccctccactcctcccaactctg

SEQ ID NO: 277509 - DNA, 13 bp, Homo sapiens
ccctccactgccc

SEQ ID NO: 277510 - DNA, 14 bp, Homo sapiens
ccctccactgccct

SEQ ID NO: 277511 - DNA, 19 bp, Homo sapiens
ccctccagacccctaccct

SEQ ID NO: 277512 - DNA, 14 bp, Homo sapiens
ccctccagagcagg

SEQ ID NO: 277513 - DNA, 16 bp, Homo sapiens
ccctccagagcaggag

SEQ ID NO: 277514 - DNA, 14 bp, Homo sapiens
ccctccagcacaga

SEQ ID NO: 277515 - DNA, 12 bp, Homo sapiens
ccctccagtgct

SEQ ID NO: 277516 - DNA, 17 bp, Homo sapiens
ccctccagtgcttggct

SEQ ID NO: 277517 - DNA, 22 bp, Homo sapiens
ccctccatgattccaagggccc

SEQ ID NO: 277518 - DNA, 19 bp, Homo sapiens
ccctccatggcaggaaggc

SEQ ID NO: 277519 - DNA, 23 bp, Homo sapiens
ccctccatgtggccccaggtgcc

SEQ ID NO: 277520 - DNA, 16 bp, Homo sapiens
ccctcccaacctcaat

SEQ ID NO: 277521 - DNA, 23 bp, Homo sapiens
ccctcccaacctcaatgccctgc

SEQ ID NO: 277522 - DNA, 17 bp, Homo sapiens
ccctcccaccacagcag

SEQ ID NO: 277523 - DNA, 12 bp, Homo sapiens
ccctcccagaca

SEQ ID NO: 277524 - DNA, 18 bp, Homo sapiens
ccctcccagacaggccct

SEQ ID NO: 277525 - DNA, 19 bp, Homo sapiens
ccctcccagacaggccctc

SEQ ID NO: 277526 - DNA, 15 bp, Homo sapiens
ccctcccatggccca

SEQ ID NO: 277527 - DNA, 16 bp, Homo sapiens
ccctcccatggcccag

SEQ ID NO: 277528 - DNA, 21 bp, Homo sapiens
ccctccccacagtcctcacag

SEQ ID NO: 277529 - DNA, 20 bp, Homo sapiens
ccctccccacccctgccttt

SEQ ID NO: 277530 - DNA, 16 bp, Homo sapiens
ccctccccagccagcc

SEQ ID NO: 277531 - DNA, 13 bp, Homo sapiens
ccctccccagtag

SEQ ID NO: 277532 - DNA, 23 bp, Homo sapiens
ccctccccatggtgcagtgaaga

SEQ ID NO: 277533 - DNA, 16 bp, Homo sapiens
ccctcccccaaccccc

SEQ ID NO: 277534 - DNA, 13 bp, Homo sapiens
ccctcccccacca

SEQ ID NO: 277535 - DNA, 15 bp, Homo sapiens
ccctcccccacggcc

SEQ ID NO: 277536 - DNA, 17 bp, Homo sapiens
ccctcccccgcagacag

SEQ ID NO: 277537 - DNA, 18 bp, Homo sapiens
ccctcccccgcagacaga

SEQ ID NO: 277538 - DNA, 12 bp, Homo sapiens
ccctccccctca

SEQ ID NO: 277539 - DNA, 19 bp, Homo sapiens
ccctccccggccctaccag

SEQ ID NO: 277540 - DNA, 21 bp, Homo sapiens
ccctcccctcacccgctgccc

SEQ ID NO: 277541 - DNA, 17 bp, Homo sapiens
ccctcccctcccagtcc

SEQ ID NO: 277542 - DNA, 18 bp, Homo sapiens
ccctcccctcccagtcct

SEQ ID NO: 277543 - DNA, 19 bp, Homo sapiens
ccctcccctgcccctgccc

SEQ ID NO: 277544 - DNA, 12 bp, Homo sapiens
ccctcccctggg

SEQ ID NO: 277545 - DNA, 18 bp, Homo sapiens
ccctcccctggggacgcc

SEQ ID NO: 277546 - DNA, 15 bp, Homo sapiens
ccctccctacctcaa

SEQ ID NO: 277547 - DNA, 20 bp, Homo sapiens
ccctccctatatgcacccct

SEQ ID NO: 277548 - DNA, 15 bp, Homo sapiens
ccctccctccacacc

SEQ ID NO: 277549 - DNA, 16 bp, Homo sapiens
ccctccctccctccac

SEQ ID NO: 277550 - DNA, 14 bp, Homo sapiens
ccctccctcctggc

SEQ ID NO: 277551 - DNA, 15 bp, Homo sapiens
ccctccctcgcatcc

SEQ ID NO: 277552 - DNA, 17 bp, Homo sapiens
ccctccctctgctctca

SEQ ID NO: 277553 - DNA, 18 bp, Homo sapiens
ccctccctctgctctcat

SEQ ID NO: 277554 - DNA, 18 bp, Homo sapiens
ccctccctgcctgctcct

SEQ ID NO: 277555 - DNA, 19 bp, Homo sapiens
ccctccctggctcccatga

SEQ ID NO: 277556 - DNA, 11 bp, Homo sapiens
ccctccctgtc

SEQ ID NO: 277557 - DNA, 18 bp, Homo sapiens
ccctccctgtctccaggg

SEQ ID NO: 277558 - DNA, 23 bp, Homo sapiens
ccctccctgtctccagggccccc

SEQ ID NO: 277559 - DNA, 14 bp, Homo sapiens
ccctcccttcaacc

SEQ ID NO: 277560 - DNA, 18 bp, Homo sapiens
ccctcccttgctcagtgc

SEQ ID NO: 277561 - DNA, 12 bp, Homo sapiens
ccctcccttgga

SEQ ID NO: 277562 - DNA, 23 bp, Homo sapiens
ccctcccttggaaacctgccctg

SEQ ID NO: 277563 - DNA, 16 bp, Homo sapiens
ccctccgccgtgccgg

SEQ ID NO: 277564 - DNA, 16 bp, Homo sapiens
ccctcctcacctctgg

SEQ ID NO: 277565 - DNA, 17 bp, Homo sapiens
ccctcctcacctctgga

SEQ ID NO: 277566 - DNA, 20 bp, Homo sapiens
cccgagcgcgtgccttcccc

SEQ ID NO: 277567 - DNA, 14 bp, Homo sapiens
cccgagctggtgca

SEQ ID NO: 277568 - DNA, 21 bp, Homo sapiens
cccgaggcagcaacaggacca

SEQ ID NO: 277569 - DNA, 21 bp, Homo sapiens
cccgagtggtctcctctcagc

SEQ ID NO: 277570 - DNA, 19 bp, Homo sapiens
cccgatattctccctgacc

SEQ ID NO: 277571 - DNA, 21 bp, Homo sapiens
cccgcacaccctcactctgcc

SEQ ID NO: 277572 - DNA, 21 bp, Homo sapiens
cccgcagcaccagcctgagcc

SEQ ID NO: 277573 - DNA, 21 bp, Homo sapiens
cccgcagcccgcctgccgtgc

SEQ ID NO: 277574 - DNA, 22 bp, Homo sapiens
cccgcagcccgtgaagcagtgc

SEQ ID NO: 277575 - DNA, 22 bp, Homo sapiens
cccgcatgcagcagcttgctgc

SEQ ID NO: 277576 - DNA, 17 bp, Homo sapiens
cccgcatgctgcctgcc

SEQ ID NO: 277577 - DNA, 22 bp, Homo sapiens
cccgcatgctgcctgcctccgg

SEQ ID NO: 277578 - DNA, 14 bp, Homo sapiens
cccgcattggtggc

SEQ ID NO: 277579 - DNA, 16 bp, Homo sapiens
cccgccacggccaccc

SEQ ID NO: 277580 - DNA, 15 bp, Homo sapiens
cccgccagcctcagt

SEQ ID NO: 277581 - DNA, 19 bp, Homo sapiens
cccgcccaccccgctgcct

SEQ ID NO: 277582 - DNA, 12 bp, Homo sapiens
cccgcccactgt

SEQ ID NO: 277583 - DNA, 20 bp, Homo sapiens
cccgccccagagactgccca

SEQ ID NO: 277584 - DNA, 17 bp, Homo sapiens
cccgccccagagctccg

SEQ ID NO: 277585 - DNA, 14 bp, Homo sapiens
cccgcccccacccc

SEQ ID NO: 277586 - DNA, 15 bp, Homo sapiens
cccgcccccacccct

SEQ ID NO: 277587 - DNA, 17 bp, Homo sapiens
cccgcccccacccctac

SEQ ID NO: 277588 - DNA, 15 bp, Homo sapiens
cccgccccccagagc

SEQ ID NO: 277589 - DNA, 19 bp, Homo sapiens
cccgccccccagagccagg

SEQ ID NO: 277590 - DNA, 20 bp, Homo sapiens
cccgccccccagagccaggg

SEQ ID NO: 277591 - DNA, 14 bp, Homo sapiens
cccgcccctcgctg

SEQ ID NO: 277592 - DNA, 19 bp, Homo sapiens
cccgcccctcgctgctgct

SEQ ID NO: 277593 - DNA, 22 bp, Homo sapiens
cccgcccctcgctgctgctact

SEQ ID NO: 277594 - DNA, 15 bp, Homo sapiens
cccgcccgccctcct

SEQ ID NO: 277595 - DNA, 11 bp, Homo sapiens
cccgccctcgc

SEQ ID NO: 277596 - DNA, 13 bp, Homo sapiens
cccgccctctgcc

SEQ ID NO: 277597 - DNA, 13 bp, Homo sapiens
cccgcctcagcct

SEQ ID NO: 277598 - DNA, 18 bp, Homo sapiens
cccgcctcagcctctcaa

SEQ ID NO: 277599 - DNA, 13 bp, Homo sapiens
cccgcctccactc

SEQ ID NO: 277600 - DNA, 22 bp, Homo sapiens
cccgcctccactctagttctag

SEQ ID NO: 277601 - DNA, 19 bp, Homo sapiens
cccgcctgccgtgcatggc

SEQ ID NO: 277602 - DNA, 17 bp, Homo sapiens
cccgcctggcagaactg

SEQ ID NO: 277603 - DNA, 14 bp, Homo sapiens
cccgccttccctca

SEQ ID NO: 277604 - DNA, 17 bp, Homo sapiens
cccgcgcgtgcccccag

SEQ ID NO: 277605 - DNA, 14 bp, Homo sapiens
cccgcgggttctag

SEQ ID NO: 277606 - DNA, 16 bp, Homo sapiens
cccgcgggttctagac

SEQ ID NO: 277607 - DNA, 19 bp, Homo sapiens
cccgcggtgctctggcggc

SEQ ID NO: 277608 - DNA, 21 bp, Homo sapiens
cccgcgtccaaccccggggca

SEQ ID NO: 277609 - DNA, 12 bp, Homo sapiens
cccgcgttcaag

SEQ ID NO: 277610 - DNA, 18 bp, Homo sapiens
cccgctcaacctctcaga

SEQ ID NO: 277611 - DNA, 20 bp, Homo sapiens
cccgctcctcccctcttgag

SEQ ID NO: 277612 - DNA, 16 bp, Homo sapiens
cccgctgcccagccct

SEQ ID NO: 277613 - DNA, 14 bp, Homo sapiens
cccgctgcctggcg

SEQ ID NO: 277614 - DNA, 20 bp, Homo sapiens
cccgctgcctggcgggcagc

SEQ ID NO: 277615 - DNA, 15 bp, Homo sapiens
cccgctgctgtgctc

SEQ ID NO: 277616 - DNA, 19 bp, Homo sapiens
cccgctgctgtgctctggg

SEQ ID NO: 277617 - DNA, 22 bp, Homo sapiens
cccgctggctgggggcctcact

SEQ ID NO: 277618 - DNA, 15 bp, Homo sapiens
cccgctgggctgagc

SEQ ID NO: 277619 - DNA, 21 bp, Homo sapiens
cccgctgggctgagcccctac

SEQ ID NO: 277620 - DNA, 22 bp, Homo sapiens
cccgcttattctcctccctgtt

SEQ ID NO: 277621 - DNA, 20 bp, Homo sapiens
cccgcttttgttcttcccca

SEQ ID NO: 277622 - DNA, 19 bp, Homo sapiens
cccggagattggacggcct

SEQ ID NO: 277623 - DNA, 13 bp, Homo sapiens
cccggagcacagc

SEQ ID NO: 277624 - DNA, 14 bp, Homo sapiens
cccggagcacagcc

SEQ ID NO: 277625 - DNA, 15 bp, Homo sapiens
cccggagcacagccc

SEQ ID NO: 277626 - DNA, 18 bp, Homo sapiens
cccggagcacagccctgg

SEQ ID NO: 277627 - DNA, 20 bp, Homo sapiens
cccggagcacagccctggga

SEQ ID NO: 277628 - DNA, 11 bp, Homo sapiens
cccggagctgg

SEQ ID NO: 277629 - DNA, 20 bp, Homo sapiens
cccggagctgggaaggtccc

SEQ ID NO: 277630 - DNA, 15 bp, Homo sapiens
cccggaggcgcccac

SEQ ID NO: 277631 - DNA, 18 bp, Homo sapiens
cccggatctccaggccca

SEQ ID NO: 277632 - DNA, 19 bp, Homo sapiens
cccggatctccaggcccag

SEQ ID NO: 277633 - DNA, 20 bp, Homo sapiens
cccggatgcccacccctgct

SEQ ID NO: 277634 - DNA, 18 bp, Homo sapiens
cccggatgtgtgtctcac

SEQ ID NO: 277635 - DNA, 12 bp, Homo sapiens
cccggcaggccc

SEQ ID NO: 277636 - DNA, 16 bp, Homo sapiens
cccggcaggccctgca

SEQ ID NO: 277637 - DNA, 19 bp, Homo sapiens
cccggcaggccctgcagtg

SEQ ID NO: 277638 - DNA, 13 bp, Homo sapiens
cccggcagtgcac

SEQ ID NO: 277639 - DNA, 17 bp, Homo sapiens
cccggcatgggaaagcc

SEQ ID NO: 277640 - DNA, 16 bp, Homo sapiens
cccggccaaggacact

SEQ ID NO: 277641 - DNA, 17 bp, Homo sapiens
cccggccaaggacactg

SEQ ID NO: 277642 - DNA, 13 bp, Homo sapiens
cccggccacagct

SEQ ID NO: 277643 - DNA, 21 bp, Homo sapiens
cccggccacagctgctggaga

SEQ ID NO: 277644 - DNA, 15 bp, Homo sapiens
cccggcccacgcaga

SEQ ID NO: 277645 - DNA, 18 bp, Homo sapiens
cccggcccacgcagagcc

SEQ ID NO: 277646 - DNA, 20 bp, Homo sapiens
cccggccccgcgcgtgcccc

SEQ ID NO: 277647 - DNA, 22 bp, Homo sapiens
cccggccctaccagcgcccgct

SEQ ID NO: 277648 - DNA, 21 bp, Homo sapiens
cccggccggagaacatctgcc

SEQ ID NO: 277649 - DNA, 22 bp, Homo sapiens
cccggccggagaacatctgcct

SEQ ID NO: 277650 - DNA, 12 bp, Homo sapiens
ccctcctcccat

SEQ ID NO: 277651 - DNA, 16 bp, Homo sapiens
ccctcctcgctgtgcc

SEQ ID NO: 277652 - DNA, 21 bp, Homo sapiens
ccctcctcgggcgcctgcgct

SEQ ID NO: 277653 - DNA, 15 bp, Homo sapiens
ccctcctctcctcgt

SEQ ID NO: 277654 - DNA, 12 bp, Homo sapiens
ccctcctctgcc

SEQ ID NO: 277655 - DNA, 16 bp, Homo sapiens
ccctcctctgccccct

SEQ ID NO: 277656 - DNA, 12 bp, Homo sapiens
ccctcctctgtg

SEQ ID NO: 277657 - DNA, 15 bp, Homo sapiens
ccctcctctgtgctc

SEQ ID NO: 277658 - DNA, 18 bp, Homo sapiens
ccctcctctgtgctccct

SEQ ID NO: 277659 - DNA, 14 bp, Homo sapiens
ccctcctcttccct

SEQ ID NO: 277660 - DNA, 17 bp, Homo sapiens
ccctcctcttcctgtag

SEQ ID NO: 277661 - DNA, 14 bp, Homo sapiens
ccctcctgcaggct

SEQ ID NO: 277662 - DNA, 15 bp, Homo sapiens
ccctcctggctcaca

SEQ ID NO: 277663 - DNA, 17 bp, Homo sapiens
ccctcctggctcacagc

SEQ ID NO: 277664 - DNA, 13 bp, Homo sapiens
ccctcctgttgcc

SEQ ID NO: 277665 - DNA, 19 bp, Homo sapiens
ccctccttccctggtccag

SEQ ID NO: 277666 - DNA, 16 bp, Homo sapiens
ccctccttctcccctc

SEQ ID NO: 277667 - DNA, 19 bp, Homo sapiens
ccctccttctcccctccag

SEQ ID NO: 277668 - DNA, 22 bp, Homo sapiens
ccctccttctcccctccagacc

SEQ ID NO: 277669 - DNA, 23 bp, Homo sapiens
ccctccttctcccctccagaccc

SEQ ID NO: 277670 - DNA, 21 bp, Homo sapiens
ccctccttcttgccctgagct

SEQ ID NO: 277671 - DNA, 13 bp, Homo sapiens
ccctccttgccac

SEQ ID NO: 277672 - DNA, 18 bp, Homo sapiens
ccctccttgccacccccc

SEQ ID NO: 277673 - DNA, 20 bp, Homo sapiens
ccctccttgccgctgggaga

SEQ ID NO: 277674 - DNA, 18 bp, Homo sapiens
ccctccttgcctcctgtg

SEQ ID NO: 277675 - DNA, 13 bp, Homo sapiens
ccctcctttgtct

SEQ ID NO: 277676 - DNA, 18 bp, Homo sapiens
ccctcgaaccaaggcagc

SEQ ID NO: 277677 - DNA, 21 bp, Homo sapiens
ccctcgaaccaaggcagcctc

SEQ ID NO: 277678 - DNA, 21 bp, Homo sapiens
ccctcgctgctgctactaccc

SEQ ID NO: 277679 - DNA, 14 bp, Homo sapiens
ccctcgctgcttct

SEQ ID NO: 277680 - DNA, 17 bp, Homo sapiens
ccctcgctgcttctgtg

SEQ ID NO: 277681 - DNA, 22 bp, Homo sapiens
ccctgccccacacaggcctggc

SEQ ID NO: 277682 - DNA, 14 bp, Homo sapiens
ccctgccccagaga

SEQ ID NO: 277683 - DNA, 23 bp, Homo sapiens
ccctgccccctccccttcacacc

SEQ ID NO: 277684 - DNA, 23 bp, Homo sapiens
ccctgccccgccccccagagcca

SEQ ID NO: 277685 - DNA, 21 bp, Homo sapiens
ccctgccccgtcaccatctca

SEQ ID NO: 277686 - DNA, 18 bp, Homo sapiens
ccctgcccctcccttcaa

SEQ ID NO: 277687 - DNA, 23 bp, Homo sapiens
ccctgcccctcccttcaaccatt

SEQ ID NO: 277688 - DNA, 16 bp, Homo sapiens
ccctgcccctcctgta

SEQ ID NO: 277689 - DNA, 23 bp, Homo sapiens
ccctgccccttctacactctcct

SEQ ID NO: 277690 - DNA, 13 bp, Homo sapiens
ccctgcccgagag

SEQ ID NO: 277691 - DNA, 16 bp, Homo sapiens
ccctgcccgagagctc

SEQ ID NO: 277692 - DNA, 23 bp, Homo sapiens
ccctgcccggtggtttgccatgt

SEQ ID NO: 277693 - DNA, 16 bp, Homo sapiens
ccctgccctcccccac

SEQ ID NO: 277694 - DNA, 12 bp, Homo sapiens
ccctgccctgca

SEQ ID NO: 277695 - DNA, 15 bp, Homo sapiens
ccctgccctgcacct

SEQ ID NO: 277696 - DNA, 17 bp, Homo sapiens
ccctgccctgccacctg

SEQ ID NO: 277697 - DNA, 13 bp, Homo sapiens
ccctgccgagggg

SEQ ID NO: 277698 - DNA, 15 bp, Homo sapiens
ccctgccggccttgg

SEQ ID NO: 277699 - DNA, 18 bp, Homo sapiens
ccctgcctcacatctccc

SEQ ID NO: 277700 - DNA, 15 bp, Homo sapiens
ccctgcctctcagag

SEQ ID NO: 277701 - DNA, 14 bp, Homo sapiens
ccctgcctggactt

SEQ ID NO: 277702 - DNA, 19 bp, Homo sapiens
ccctgcctggatttcttcc

SEQ ID NO: 277703 - DNA, 21 bp, Homo sapiens
ccctgcctggatttcttccta

SEQ ID NO: 277704 - DNA, 22 bp, Homo sapiens
ccctgccttatcttgcacccca

SEQ ID NO: 277705 - DNA, 13 bp, Homo sapiens
ccctgcctttgtt

SEQ ID NO: 277706 - DNA, 13 bp, Homo sapiens
ccctgcgccctcc

SEQ ID NO: 277707 - DNA, 16 bp, Homo sapiens
ccctgcgccctccctc

SEQ ID NO: 277708 - DNA, 22 bp, Homo sapiens
ccctgcgtgggggccagtcagg

SEQ ID NO: 277709 - DNA, 18 bp, Homo sapiens
ccctgcgttggagccact

SEQ ID NO: 277710 - DNA, 20 bp, Homo sapiens
ccctgcgttggagccactcc

SEQ ID NO: 277711 - DNA, 19 bp, Homo sapiens
ccctgctccatgggcacct

SEQ ID NO: 277712 - DNA, 14 bp, Homo sapiens
ccctgctcccattc

SEQ ID NO: 277713 - DNA, 17 bp, Homo sapiens
ccctgctcccattcctc

SEQ ID NO: 277714 - DNA, 14 bp, Homo sapiens
ccctgctcctcctg

SEQ ID NO: 277715 - DNA, 19 bp, Homo sapiens
ccctgctctacccatgagc

SEQ ID NO: 277716 - DNA, 19 bp, Homo sapiens
ccctgctgaccttggagga

SEQ ID NO: 277717 - DNA, 19 bp, Homo sapiens
ccctgctgccgcctcccag

SEQ ID NO: 277718 - DNA, 23 bp, Homo sapiens
ccctgctgccgcctcccagcctg

SEQ ID NO: 277719 - DNA, 19 bp, Homo sapiens
ccctgctgccttctgacgg

SEQ ID NO: 277720 - DNA, 16 bp, Homo sapiens
ccctgctgctgcctgc

SEQ ID NO: 277721 - DNA, 15 bp, Homo sapiens
ccctgctgcttccta

SEQ ID NO: 277722 - DNA, 18 bp, Homo sapiens
ccctgctgcttcctaact

SEQ ID NO: 277723 - DNA, 21 bp, Homo sapiens
ccctgcttagaacccttctgc

SEQ ID NO: 277724 - DNA, 22 bp, Homo sapiens
ccctgcttagaacccttctgct

SEQ ID NO: 277725 - DNA, 23 bp, Homo sapiens
ccctgcttagtgtcccttacctg

SEQ ID NO: 277726 - DNA, 13 bp, Homo sapiens
ccctgcttctgct

SEQ ID NO: 277727 - DNA, 18 bp, Homo sapiens
ccctgcttctgctgccct

SEQ ID NO: 277728 - DNA, 19 bp, Homo sapiens
ccctgcttgcccgctccca

SEQ ID NO: 277729 - DNA, 17 bp, Homo sapiens
ccctgcttggggcctgg

SEQ ID NO: 277730 - DNA, 23 bp, Homo sapiens
ccctggaactctatctgggcctg

SEQ ID NO: 277731 - DNA, 12 bp, Homo sapiens
ccctggaagccg

SEQ ID NO: 277732 - DNA, 9 bp, Homo sapiens
ccctggaat

SEQ ID NO: 277733 - DNA, 13 bp, Homo sapiens
ccctggaattcac

SEQ ID NO: 277734 - DNA, 15 bp, Homo sapiens
ccctggaccacacct

SEQ ID NO: 277735 - DNA, 19 bp, Homo sapiens
ccctggaccaccagcccca

SEQ ID NO: 277736 - DNA, 20 bp, Homo sapiens
ccctggaccaccagccccag

SEQ ID NO: 277737 - DNA, 14 bp, Homo sapiens
ccctggactctgtg

SEQ ID NO: 277738 - DNA, 23 bp, Homo sapiens
ccctggactggtggcccctgcct

SEQ ID NO: 277739 - DNA, 13 bp, Homo sapiens
ccctggagctgtc

SEQ ID NO: 277740 - DNA, 15 bp, Homo sapiens
ccctggagctgtcct

SEQ ID NO: 277741 - DNA, 15 bp, Homo sapiens
ccctggatgggcatt

SEQ ID NO: 277742 - DNA, 21 bp, Homo sapiens
ccctggatgggcattgggctg

SEQ ID NO: 277743 - DNA, 22 bp, Homo sapiens
ccctggatgtcccctgtcccac

SEQ ID NO: 277744 - DNA, 20 bp, Homo sapiens
ccctggatgtgtggggcatg

SEQ ID NO: 277745 - DNA, 18 bp, Homo sapiens
ccctggcacctgggtgct

SEQ ID NO: 277746 - DNA, 14 bp, Homo sapiens
ccctggccagaggc

SEQ ID NO: 277747 - DNA, 19 bp, Homo sapiens
ccctggcccatctcagcct

SEQ ID NO: 277748 - DNA, 21 bp, Homo sapiens
ccctggcccctcccacatccc

SEQ ID NO: 277749 - DNA, 19 bp, Homo sapiens
ccctggcctgttctgtttt

SEQ ID NO: 277750 - DNA, 22 bp, Homo sapiens
ccctggcctttgaggcaaaggc

SEQ ID NO: 277751 - DNA, 10 bp, Homo sapiens
ccctggctcc

SEQ ID NO: 277752 - DNA, 11 bp, Homo sapiens
ccctggctccc

SEQ ID NO: 277753 - DNA, 17 bp, Homo sapiens
ccctggctcccacaggc

SEQ ID NO: 277754 - DNA, 14 bp, Homo sapiens
ccctggctcccatg

SEQ ID NO: 277755 - DNA, 21 bp, Homo sapiens
ccctggctgtgagcagcctcc

SEQ ID NO: 277756 - DNA, 11 bp, Homo sapiens
ccctgggagag

SEQ ID NO: 277757 - DNA, 16 bp, Homo sapiens
ccctgggagagtgagg

SEQ ID NO: 277758 - DNA, 19 bp, Homo sapiens
ccctgggccagcccaggat

SEQ ID NO: 277759 - DNA, 13 bp, Homo sapiens
ccctgggcctccc

SEQ ID NO: 277760 - DNA, 17 bp, Homo sapiens
ccctgggcctcccgtcc

SEQ ID NO: 277761 - DNA, 14 bp, Homo sapiens
ccctgggcctgtct

SEQ ID NO: 277762 - DNA, 17 bp, Homo sapiens
ccctgggcctgtctcag

SEQ ID NO: 277763 - DNA, 12 bp, Homo sapiens
ccctgggctgga

SEQ ID NO: 277764 - DNA, 14 bp, Homo sapiens
ccctgggctggact

SEQ ID NO: 277765 - DNA, 15 bp, Homo sapiens
ccctggggaccagga

SEQ ID NO: 277766 - DNA, 20 bp, Homo sapiens
ccctggggactctgcttggc

SEQ ID NO: 277767 - DNA, 17 bp, Homo sapiens
ccctggggcctggacct

SEQ ID NO: 277768 - DNA, 23 bp, Homo sapiens
ccctggggcctggacctgcctcc

SEQ ID NO: 277769 - DNA, 16 bp, Homo sapiens
ccctggggctgggccc

SEQ ID NO: 277770 - DNA, 19 bp, Homo sapiens
ccctggggcttctcctgac

SEQ ID NO: 277771 - DNA, 16 bp, Homo sapiens
ccctggggggcacagc

SEQ ID NO: 277772 - DNA, 20 bp, Homo sapiens
ccctggggggcacagccaga

SEQ ID NO: 277773 - DNA, 17 bp, Homo sapiens
ccctggggtccccactc

SEQ ID NO: 277774 - DNA, 19 bp, Homo sapiens
ccctggggtctctgagcag

SEQ ID NO: 277775 - DNA, 21 bp, Homo sapiens
ccctggggtctctgagcagtg

SEQ ID NO: 277776 - DNA, 22 bp, Homo sapiens
ccctggggtctctgagcagtgg

SEQ ID NO: 277777 - DNA, 21 bp, Homo sapiens
ccctggggtttccacacaggc

SEQ ID NO: 277778 - DNA, 22 bp, Homo sapiens
ccctggggtttccacacaggcc

SEQ ID NO: 277779 - DNA, 18 bp, Homo sapiens
ccctgggtcaccttcctg

SEQ ID NO: 277780 - DNA, 23 bp, Homo sapiens
ccctgggtcaccttcctgggcag

SEQ ID NO: 277781 - DNA, 19 bp, Homo sapiens
ccctgggtgccattcccag

SEQ ID NO: 277782 - DNA, 20 bp, Homo sapiens
ccctgggtgccattcccagc

SEQ ID NO: 277783 - DNA, 16 bp, Homo sapiens
ccctggtccagggaag

SEQ ID NO: 277784 - DNA, 18 bp, Homo sapiens
ccctggtccccccaaatc

SEQ ID NO: 277785 - DNA, 23 bp, Homo sapiens
ccctggtctcctccccgtagcca

SEQ ID NO: 277786 - DNA, 21 bp, Homo sapiens
ccctggtgaccagcaccatct

SEQ ID NO: 277787 - DNA, 21 bp, Homo sapiens
ccctggtgaggaagctccagt

SEQ ID NO: 277788 - DNA, 14 bp, Homo sapiens
ccctggtgctgcca

SEQ ID NO: 277789 - DNA, 20 bp, Homo sapiens
ccctggtggggtgtgcatgc

SEQ ID NO: 277790 - DNA, 17 bp, Homo sapiens
ccctggttcccccagga

SEQ ID NO: 277791 - DNA, 19 bp, Homo sapiens
ccctggttcccccaggacc

SEQ ID NO: 277792 - DNA, 13 bp, Homo sapiens
ccctgtacccagc

SEQ ID NO: 277793 - DNA, 18 bp, Homo sapiens
ccctgtacccagccacct

SEQ ID NO: 277794 - DNA, 21 bp, Homo sapiens
ccctgtacccagccaccttcc

SEQ ID NO: 277795 - DNA, 23 bp, Homo sapiens
ccctgtacccagccaccttcctg

SEQ ID NO: 277796 - DNA, 14 bp, Homo sapiens
ccctgtacctctct

SEQ ID NO: 277797 - DNA, 17 bp, Homo sapiens
ccctgtacctctctctg

SEQ ID NO: 277798 - DNA, 23 bp, Homo sapiens
ccctgtacctctctctgctcctc

SEQ ID NO: 277799 - DNA, 14 bp, Homo sapiens
ccctgtcagaggct

SEQ ID NO: 277800 - DNA, 12 bp, Homo sapiens
ccctgtcccacc

SEQ ID NO: 277801 - DNA, 21 bp, Homo sapiens
ccctgtcccaccaactctgca

SEQ ID NO: 277802 - DNA, 22 bp, Homo sapiens
ccctgtcccaccaactctgcac

SEQ ID NO: 277803 - DNA, 13 bp, Homo sapiens
ccctgtcccattc

SEQ ID NO: 277804 - DNA, 17 bp, Homo sapiens
ccctgtcccattctaga

SEQ ID NO: 277805 - DNA, 13 bp, Homo sapiens
ccctgtccctgcc

SEQ ID NO: 277806 - DNA, 12 bp, Homo sapiens
ccctgtcctggg

SEQ ID NO: 277807 - DNA, 23 bp, Homo sapiens
ccctgtccttcccacggccactg

SEQ ID NO: 277808 - DNA, 23 bp, Homo sapiens
ccctgtctaggtcagtacccacc

SEQ ID NO: 277809 - DNA, 20 bp, Homo sapiens
ccctgtggtgatgtgcctgt

SEQ ID NO: 277810 - DNA, 15 bp, Homo sapiens
ccctgtgttgtctct

SEQ ID NO: 277811 - DNA, 18 bp, Homo sapiens
ccctgtgttgtctctaga

SEQ ID NO: 277812 - DNA, 22 bp, Homo sapiens
ccctgttcactctacttagcat

SEQ ID NO: 277813 - DNA, 19 bp, Homo sapiens
ccctgttgagtatttgctg

SEQ ID NO: 277814 - DNA, 16 bp, Homo sapiens
ccgagccgggcctggg

SEQ ID NO: 277815 - DNA, 17 bp, Homo sapiens
ccgagcgcgtgccttcc

SEQ ID NO: 277816 - DNA, 23 bp, Homo sapiens
ccgagctcgtgtatcctggggct

SEQ ID NO: 277817 - DNA, 18 bp, Homo sapiens
ccgagctctcctgggcca

SEQ ID NO: 277818 - DNA, 20 bp, Homo sapiens
ccgagctctcctgggccagg

SEQ ID NO: 277819 - DNA, 22 bp, Homo sapiens
ccgagctctcctgggccagggt

SEQ ID NO: 277820 - DNA, 14 bp, Homo sapiens
ccgagctggaaaac

SEQ ID NO: 277821 - DNA, 19 bp, Homo sapiens
ccgagctgggggccatgag

SEQ ID NO: 277822 - DNA, 16 bp, Homo sapiens
ccgagctggtgcatta

SEQ ID NO: 277823 - DNA, 21 bp, Homo sapiens
ccgaggaaacgaaacccactc

SEQ ID NO: 277824 - DNA, 12 bp, Homo sapiens
ccgaggcagggg

SEQ ID NO: 277825 - DNA, 20 bp, Homo sapiens
ccgaggcaggggctgggcag

SEQ ID NO: 277826 - DNA, 18 bp, Homo sapiens
ccgaggcgatgccacgct

SEQ ID NO: 277827 - DNA, 14 bp, Homo sapiens
ccgaggctggagct

SEQ ID NO: 277828 - DNA, 12 bp, Homo sapiens
ccgagggaaatg

SEQ ID NO: 277829 - DNA, 16 bp, Homo sapiens
ccgagggcggccaggg

SEQ ID NO: 277830 - DNA, 18 bp, Homo sapiens
ccggccactccctgccaa

SEQ ID NO: 277831 - DNA, 20 bp, Homo sapiens
ccggccactccctgccaact

SEQ ID NO: 277832 - DNA, 16 bp, Homo sapiens
ccggccatactgcctt

SEQ ID NO: 277833 - DNA, 17 bp, Homo sapiens
ccggcccacgcagagcc

SEQ ID NO: 277834 - DNA, 20 bp, Homo sapiens
ccggcccacgcagagccccg

SEQ ID NO: 277835 - DNA, 18 bp, Homo sapiens
ccggcccagcctaggccc

SEQ ID NO: 277836 - DNA, 23 bp, Homo sapiens
ccggccccccctcttttggcctt

SEQ ID NO: 277837 - DNA, 12 bp, Homo sapiens
ccggcccctacc

SEQ ID NO: 277838 - DNA, 16 bp, Homo sapiens
ccggccctgccccaca

SEQ ID NO: 277839 - DNA, 22 bp, Homo sapiens
ccggccctgccccacacaggcc

SEQ ID NO: 277840 - DNA, 19 bp, Homo sapiens
ccggccgccccgccccaga

SEQ ID NO: 277841 - DNA, 22 bp, Homo sapiens
ccggccgccccgccccagagct

SEQ ID NO: 277842 - DNA, 19 bp, Homo sapiens
ccggccggagaacatctgc

SEQ ID NO: 277843 - DNA, 16 bp, Homo sapiens
ccggcctccaggctgg

SEQ ID NO: 277844 - DNA, 16 bp, Homo sapiens
ccggcctcttccaccc

SEQ ID NO: 277845 - DNA, 18 bp, Homo sapiens
ccggcctcttccacccat

SEQ ID NO: 277846 - DNA, 15 bp, Homo sapiens
ccggcctgcagccca

SEQ ID NO: 277847 - DNA, 20 bp, Homo sapiens
ccggcctgctcccagcagcc

SEQ ID NO: 277848 - DNA, 19 bp, Homo sapiens
ccggcctggggccgggctg

SEQ ID NO: 277849 - DNA, 19 bp, Homo sapiens
ccggcggcccaagcccgac

SEQ ID NO: 277850 - DNA, 23 bp, Homo sapiens
ccggctatgggggcactgaggac

SEQ ID NO: 277851 - DNA, 17 bp, Homo sapiens
ccggctccccctgccag

SEQ ID NO: 277852 - DNA, 18 bp, Homo sapiens
ccggctccccctgccagc

SEQ ID NO: 277853 - DNA, 23 bp, Homo sapiens
ccggctcgagcagtcctgcctca

SEQ ID NO: 277854 - DNA, 22 bp, Homo sapiens
ccggctgcatacccgggcaggg

SEQ ID NO: 277855 - DNA, 13 bp, Homo sapiens
ccggctgcctgcc

SEQ ID NO: 277856 - DNA, 13 bp, Homo sapiens
ccggctggacttt

SEQ ID NO: 277857 - DNA, 15 bp, Homo sapiens
ccggctggacttttg

SEQ ID NO: 277858 - DNA, 15 bp, Homo sapiens
ccggctggccggtcc

SEQ ID NO: 277859 - DNA, 20 bp, Homo sapiens
ccggctgggtcggccctgcc

SEQ ID NO: 277860 - DNA, 13 bp, Homo sapiens
ccggcttggctag

SEQ ID NO: 277861 - DNA, 16 bp, Homo sapiens
ccggctttgcagggag

SEQ ID NO: 277862 - DNA, 21 bp, Homo sapiens
ccggctttgcagggagaccag

SEQ ID NO: 277863 - DNA, 13 bp, Homo sapiens
ccgggaaaggccg

SEQ ID NO: 277864 - DNA, 18 bp, Homo sapiens
ccgggaccacagctgctg

SEQ ID NO: 277865 - DNA, 20 bp, Homo sapiens
ccgggaccacagctgctggc

SEQ ID NO: 277866 - DNA, 21 bp, Homo sapiens
ccgggaccattgacctcagct

SEQ ID NO: 277867 - DNA, 20 bp, Homo sapiens
ccgggagatccgccctgggc

SEQ ID NO: 277868 - DNA, 21 bp, Homo sapiens
ccgggagatccgccctgggct

SEQ ID NO: 277869 - DNA, 24 bp, Homo sapiens
ccgggagatccgccctgggctctg

SEQ ID NO: 277870 - DNA, 21 bp, Homo sapiens
ccgggatggtcttgatctcct

SEQ ID NO: 277871 - DNA, 13 bp, Homo sapiens
ccgggcaggccag

SEQ ID NO: 277872 - DNA, 18 bp, Homo sapiens
ccgggcaggggagccagg

SEQ ID NO: 277873 - DNA, 19 bp, Homo sapiens
ccgggcaggggagccaggg

SEQ ID NO: 277874 - DNA, 16 bp, Homo sapiens
ccgggcccagaggagc

SEQ ID NO: 277875 - DNA, 23 bp, Homo sapiens
ccgggcccctggcacgtcctcca

SEQ ID NO: 277876 - DNA, 17 bp, Homo sapiens
ccgggccctcccttgga

SEQ ID NO: 277877 - DNA, 14 bp, Homo sapiens
ccgggccctctgta

SEQ ID NO: 277878 - DNA, 23 bp, Homo sapiens
ccgggcctgacccggcccctacc

SEQ ID NO: 277879 - DNA, 14 bp, Homo sapiens
ccgggctctctgct

SEQ ID NO: 277880 - DNA, 16 bp, Homo sapiens
ccgggctctctgctgt

SEQ ID NO: 277881 - DNA, 17 bp, Homo sapiens
ccgggctctggccaccc

SEQ ID NO: 277882 - DNA, 18 bp, Homo sapiens
ccgggctctggccaccct

SEQ ID NO: 277883 - DNA, 13 bp, Homo sapiens
ccgggctgctgct

SEQ ID NO: 277884 - DNA, 16 bp, Homo sapiens
ccgggctgctgctgat

SEQ ID NO: 277885 - DNA, 19 bp, Homo sapiens
ccggggaggagccttggag

SEQ ID NO: 277886 - DNA, 19 bp, Homo sapiens
ccggggcactggctgctct

SEQ ID NO: 277887 - DNA, 23 bp, Homo sapiens
ccggggcactggctgctctgtct

SEQ ID NO: 277888 - DNA, 12 bp, Homo sapiens
ccggggcagctg

SEQ ID NO: 277889 - DNA, 16 bp, Homo sapiens
ccggggcagggcagcc

SEQ ID NO: 277890 - DNA, 20 bp, Homo sapiens
ccggggcatggacagggcca

SEQ ID NO: 277891 - DNA, 12 bp, Homo sapiens
ccggggccatgg

SEQ ID NO: 277892 - DNA, 18 bp, Homo sapiens
ccggggccatggaagctg

SEQ ID NO: 277893 - DNA, 19 bp, Homo sapiens
ccggggcccctcaccccaa

SEQ ID NO: 277894 - DNA, 12 bp, Homo sapiens
ccggggctggca

SEQ ID NO: 277895 - DNA, 20 bp, Homo sapiens
ccggggctggcaagcaggga

SEQ ID NO: 277896 - DNA, 16 bp, Homo sapiens
ccggggctggccctgc

SEQ ID NO: 277897 - DNA, 12 bp, Homo sapiens
ccgggggtgggg

SEQ ID NO: 277898 - DNA, 18 bp, Homo sapiens
ccggggtcctgaggctgg

SEQ ID NO: 277899 - DNA, 20 bp, Homo sapiens
ccggggtctgtgctgtgcct

SEQ ID NO: 277900 - DNA, 22 bp, Homo sapiens
ccggggtctgtgctgtgcctgc

SEQ ID NO: 277901 - DNA, 21 bp, Homo sapiens
ccggggtggagcatgggcctg

SEQ ID NO: 277902 - DNA, 19 bp, Homo sapiens
ccgggtgcgtgaccggccc

SEQ ID NO: 277903 - DNA, 14 bp, Homo sapiens
ccgggtgggcctgg

SEQ ID NO: 277904 - DNA, 22 bp, Homo sapiens
ccgggtgtggcacgcacctgta

SEQ ID NO: 277905 - DNA, 15 bp, Homo sapiens
ccgggttagcctggt

SEQ ID NO: 277906 - DNA, 16 bp, Homo sapiens
ccgggttctcctgatt

SEQ ID NO: 277907 - DNA, 18 bp, Homo sapiens
ccgggttggaggcctcac

SEQ ID NO: 277908 - DNA, 22 bp, Homo sapiens
ccgggttggaggcctcaccctg

SEQ ID NO: 277909 - DNA, 24 bp, Homo sapiens
ccgggttggaggcctcaccctgct

SEQ ID NO: 277910 - DNA, 19 bp, Homo sapiens
ccgggtttggcgggccaag

SEQ ID NO: 277911 - DNA, 14 bp, Homo sapiens
ccggtcccaggccg

SEQ ID NO: 277912 - DNA, 16 bp, Homo sapiens
ccggtcccaggccgca

SEQ ID NO: 277913 - DNA, 16 bp, Homo sapiens
ccggtgtgagcccacc

SEQ ID NO: 277914 - DNA, 17 bp, Homo sapiens
ccggtgtgagcccacct

SEQ ID NO: 277915 - DNA, 17 bp, Homo sapiens
ccggttcagacccctgc

SEQ ID NO: 277916 - DNA, 19 bp, Homo sapiens
ccggttcagacccctgcct

SEQ ID NO: 277917 - DNA, 19 bp, Homo sapiens
ccggttggccggctggccg

SEQ ID NO: 277918 - DNA, 15 bp, Homo sapiens
ccgtaggcagcctct

SEQ ID NO: 277919 - DNA, 15 bp, Homo sapiens
ccgtagggagtacct

SEQ ID NO: 277920 - DNA, 14 bp, Homo sapiens
ccgtcaccagaatt

SEQ ID NO: 277921 - DNA, 20 bp, Homo sapiens
ccgtcagtatcaggcctgcc

SEQ ID NO: 277922 - DNA, 12 bp, Homo sapiens
ccgtccacccag

SEQ ID NO: 277923 - DNA, 16 bp, Homo sapiens
ccgtccacccaggctg

SEQ ID NO: 277924 - DNA, 13 bp, Homo sapiens
ccgtccatggcac

SEQ ID NO: 277925 - DNA, 14 bp, Homo sapiens
ccgtccatggcacc

SEQ ID NO: 277926 - DNA, 14 bp, Homo sapiens
ccgtcccctgggcc

SEQ ID NO: 277927 - DNA, 17 bp, Homo sapiens
ccgtcccctgggccacc

SEQ ID NO: 277928 - DNA, 14 bp, Homo sapiens
ccgtccctctgcct

SEQ ID NO: 277929 - DNA, 10 bp, Homo sapiens
ccgtccctga

SEQ ID NO: 277930 - DNA, 15 bp, Homo sapiens
ccgtccctttccctg

SEQ ID NO: 277931 - DNA, 16 bp, Homo sapiens
ccgtccgtccgcccgc

SEQ ID NO: 277932 - DNA, 16 bp, Homo sapiens
ccgtcctcccgggccc

SEQ ID NO: 277933 - DNA, 16 bp, Homo sapiens
ccgtcctggcagggca

SEQ ID NO: 277934 - DNA, 24 bp, Homo sapiens
ccgtcctggggtggttggaggcct

SEQ ID NO: 277935 - DNA, 15 bp, Homo sapiens
ccgtcggaatggtaa

SEQ ID NO: 277936 - DNA, 19 bp, Homo sapiens
ccgtctcatatttttacaa

SEQ ID NO: 277937 - DNA, 16 bp, Homo sapiens
ccgtctgactccagag

SEQ ID NO: 277938 - DNA, 17 bp, Homo sapiens
ccgtctgactccagagt

SEQ ID NO: 277939 - DNA, 20 bp, Homo sapiens
ccgtctgactccagagtctg

SEQ ID NO: 277940 - DNA, 22 bp, Homo sapiens
ccgtctgactccagagtctgag

SEQ ID NO: 277941 - DNA, 11 bp, Homo sapiens
ccgtctgcccc

SEQ ID NO: 277942 - DNA, 22 bp, Homo sapiens
ccgtctggcgagcccttagcct

SEQ ID NO: 277943 - DNA, 17 bp, Homo sapiens
ccgtgaagcagtgcctc

SEQ ID NO: 277944 - DNA, 20 bp, Homo sapiens
ccgtgatccatccatctcca

SEQ ID NO: 277945 - DNA, 23 bp, Homo sapiens
ccgtgatccatccatctccaggg

SEQ ID NO: 277946 - DNA, 21 bp, Homo sapiens
ccgtgcaacgtgtaacttgtg

SEQ ID NO: 277947 - DNA, 14 bp, Homo sapiens
ccgtgcagactgga

SEQ ID NO: 277948 - DNA, 15 bp, Homo sapiens
ccgtgcagtacaggc

SEQ ID NO: 277949 - DNA, 14 bp, Homo sapiens
ccgtgccaggagca

SEQ ID NO: 277950 - DNA, 17 bp, Homo sapiens
ccgtgccattgtactcc

SEQ ID NO: 277951 - DNA, 23 bp, Homo sapiens
ccgtgccattgtactccagcctg

SEQ ID NO: 277952 - DNA, 15 bp, Homo sapiens
ccgtgccccgcctcc

SEQ ID NO: 277953 - DNA, 19 bp, Homo sapiens
ccgtgcccgcccacctctg

SEQ ID NO: 277954 - DNA, 14 bp, Homo sapiens
ccgtgcggcccgtg

SEQ ID NO: 277955 - DNA, 21 bp, Homo sapiens
ccgtgcggcccgtgcgcagcc

SEQ ID NO: 277956 - DNA, 19 bp, Homo sapiens
ccgtggattgcacgtggcc

SEQ ID NO: 277957 - DNA, 20 bp, Homo sapiens
ccgtggccccgccctcaggc

SEQ ID NO: 277958 - DNA, 14 bp, Homo sapiens
ccgtggctgcggca

SEQ ID NO: 277959 - DNA, 14 bp, Homo sapiens
ccgtggcttcccgc

SEQ ID NO: 277960 - DNA, 21 bp, Homo sapiens
ccgtgggtcatcccagcacct

SEQ ID NO: 277961 - DNA, 19 bp, Homo sapiens
ccgtggtacattcacagca

SEQ ID NO: 277962 - DNA, 14 bp, Homo sapiens
ccgtggtgtgaggc

SEQ ID NO: 277963 - DNA, 16 bp, Homo sapiens
ccgtggtgtgaggccc

SEQ ID NO: 277964 - DNA, 18 bp, Homo sapiens
ccgtggtgtgaggccccc

SEQ ID NO: 277965 - DNA, 22 bp, Homo sapiens
ccgtggtgtgaggcccccggag

SEQ ID NO: 277966 - DNA, 18 bp, Homo sapiens
ccgtgtcccaaggagctg

SEQ ID NO: 277967 - DNA, 15 bp, Homo sapiens
ccgtgtccccccagg

SEQ ID NO: 277968 - DNA, 15 bp, Homo sapiens
ccgtgtggccccttc

SEQ ID NO: 277969 - DNA, 16 bp, Homo sapiens
ccgtgtggccccttca

SEQ ID NO: 277970 - DNA, 15 bp, Homo sapiens
ccgttaacctttttg

SEQ ID NO: 277971 - DNA, 13 bp, Homo sapiens
ccgttcccacctc

SEQ ID NO: 277972 - DNA, 12 bp, Homo sapiens
ccgttcctggga

SEQ ID NO: 277973 - DNA, 13 bp, Homo sapiens
ccgttcctgggac

SEQ ID NO: 277974 - DNA, 18 bp, Homo sapiens
ccgttgccgggcctggac

SEQ ID NO: 277975 - DNA, 23 bp, Homo sapiens
ccgttgtgtgggtttactctgtg

SEQ ID NO: 277976 - DNA, 15 bp, Homo sapiens
ccgtttatgggcctt

SEQ ID NO: 277977 - DNA, 19 bp, Homo sapiens
ccgtttatgggccttgctt

SEQ ID NO: 277978 - DNA, 13 bp, Homo sapiens
ccgtttccaagcc

SEQ ID NO: 277979 - DNA, 19 bp, Homo sapiens
ccgtttggtgtctgatgtg

SEQ ID NO: 277980 - DNA, 21 bp, Homo sapiens
ccgttttcatcctggcctcct

SEQ ID NO: 277981 - DNA, 22 bp, Homo sapiens
cctaaaaggaaatctcacccca

SEQ ID NO: 277982 - DNA, 19 bp, Homo sapiens
cctaaaagttttaacctca

SEQ ID NO: 277983 - DNA, 12 bp, Homo sapiens
cctaaagaaaaa

SEQ ID NO: 277984 - DNA, 12 bp, Homo sapiens
cctaaagagata

SEQ ID NO: 277985 - DNA, 20 bp, Homo sapiens
cctaaagtgaagaagccatc

SEQ ID NO: 277986 - DNA, 22 bp, Homo sapiens
cctaaataatatcctgaataac

SEQ ID NO: 277987 - DNA, 21 bp, Homo sapiens
cctaaatatccaaagactgta

SEQ ID NO: 277988 - DNA, 16 bp, Homo sapiens
cctaaatccattttct

SEQ ID NO: 277989 - DNA, 18 bp, Homo sapiens
cctaacacagcatgtgta

SEQ ID NO: 277990 - DNA, 19 bp, Homo sapiens
cctaacatagtgtctgctg

SEQ ID NO: 277991 - DNA, 14 bp, Homo sapiens
cctaactcttgctc

SEQ ID NO: 277992 - DNA, 22 bp, Homo sapiens
cctaactcttgctcactcccta

SEQ ID NO: 277993 - DNA, 15 bp, Homo sapiens
cctaactgagctgcc

SEQ ID NO: 277994 - DNA, 16 bp, Homo sapiens
cctaacttattgcctg

SEQ ID NO: 277995 - DNA, 20 bp, Homo sapiens
cctaacttattgcctgggca

SEQ ID NO: 277996 - DNA, 21 bp, Homo sapiens
cctaactttcttgcttcaaaa

SEQ ID NO: 277997 - DNA, 15 bp, Homo sapiens
cctaagaaaaaggaa

SEQ ID NO: 277998 - DNA, 13 bp, Homo sapiens
cctaagaattccc

SEQ ID NO: 277999 - DNA, 16 bp, Homo sapiens
cctaagaattcccaga

SEQ ID NO: 278000 - DNA, 20 bp, Homo sapiens
cctaagagatgggactagga

SEQ ID NO: 278001 - DNA, 20 bp, Homo sapiens
cctaagagtgtcactgagct

SEQ ID NO: 278002 - DNA, 13 bp, Homo sapiens
cctaagccaaggg

SEQ ID NO: 278003 - DNA, 12 bp, Homo sapiens
cctaagccactc

SEQ ID NO: 278004 - DNA, 15 bp, Homo sapiens
cctaaggaatatcca

SEQ ID NO: 278005 - DNA, 17 bp, Homo sapiens
cctaaggatctctcagg

SEQ ID NO: 278006 - DNA, 22 bp, Homo sapiens
cctaaggcaacatttccgaaga

SEQ ID NO: 278007 - DNA, 16 bp, Homo sapiens
cctaagtgcccaaagt

SEQ ID NO: 278008 - DNA, 18 bp, Homo sapiens
cctaagtgcccaaagtgg

SEQ ID NO: 278009 - DNA, 19 bp, Homo sapiens
cctaatagccttttgtaac

SEQ ID NO: 278010 - DNA, 13 bp, Homo sapiens
cctaatatcattt

SEQ ID NO: 278011 - DNA, 23 bp, Homo sapiens
cctaatatcattttattcacata

SEQ ID NO: 278012 - DNA, 22 bp, Homo sapiens
cctaatcagaaatttttatcag

SEQ ID NO: 278013 - DNA, 17 bp, Homo sapiens
cctaatgtggcagctgt

SEQ ID NO: 278014 - DNA, 23 bp, Homo sapiens
cctaattagagcagatgacccct

SEQ ID NO: 278015 - DNA, 21 bp, Homo sapiens
cctaattcttttatctttatt

SEQ ID NO: 278016 - DNA, 16 bp, Homo sapiens
cctaatttgcccttca

SEQ ID NO: 278017 - DNA, 22 bp, Homo sapiens
cctacaagatttagaaaaaagt

SEQ ID NO: 278018 - DNA, 17 bp, Homo sapiens
cctacacccttggactt

SEQ ID NO: 278019 - DNA, 14 bp, Homo sapiens
cctacacctctggg

SEQ ID NO: 278020 - DNA, 16 bp, Homo sapiens
cctacacctctgggcc

SEQ ID NO: 278021 - DNA, 23 bp, Homo sapiens
cctacagaggtctctgccggctc

SEQ ID NO: 278022 - DNA, 14 bp, Homo sapiens
cctacagatgaact

SEQ ID NO: 278023 - DNA, 16 bp, Homo sapiens
cctacagggaactggg

SEQ ID NO: 278024 - DNA, 18 bp, Homo sapiens
cctacagggggtggagag

SEQ ID NO: 278025 - DNA, 17 bp, Homo sapiens
cctacagtatataagct

SEQ ID NO: 278026 - DNA, 16 bp, Homo sapiens
cctacattccctctcc

SEQ ID NO: 278027 - DNA, 13 bp, Homo sapiens
cctaccaatgcat

SEQ ID NO: 278028 - DNA, 15 bp, Homo sapiens
cctaccaatgcatgc

SEQ ID NO: 278029 - DNA, 16 bp, Homo sapiens
cctaccaatgcatgca

SEQ ID NO: 278030 - DNA, 13 bp, Homo sapiens
cctaccacagtgt

SEQ ID NO: 278031 - DNA, 14 bp, Homo sapiens
cctaccaccccact

SEQ ID NO: 278032 - DNA, 19 bp, Homo sapiens
cctaccactgagcccttgc

SEQ ID NO: 278033 - DNA, 23 bp, Homo sapiens
cctaccactgagcccttgcacag

SEQ ID NO: 278034 - DNA, 17 bp, Homo sapiens
cctaccagcgcccgctg

SEQ ID NO: 278035 - DNA, 18 bp, Homo sapiens
ctcccttgctcagtgcct

SEQ ID NO: 278036 - DNA, 21 bp, Homo sapiens
ctcccttgctcagtgcctcct

SEQ ID NO: 278037 - DNA, 20 bp, Homo sapiens
ctcccttggaaacctgccct

SEQ ID NO: 278038 - DNA, 21 bp, Homo sapiens
ctcccttggaaacctgccctg

SEQ ID NO: 278039 - DNA, 22 bp, Homo sapiens
ctcccttggccacggcctggga

SEQ ID NO: 278040 - DNA, 18 bp, Homo sapiens
ctcccttgggttctgata

SEQ ID NO: 278041 - DNA, 14 bp, Homo sapiens
ctccctttcccttc

SEQ ID NO: 278042 - DNA, 20 bp, Homo sapiens
ctccctttgtggactttatt

SEQ ID NO: 278043 - DNA, 18 bp, Homo sapiens
ctcccttttctttttccc

SEQ ID NO: 278044 - DNA, 18 bp, Homo sapiens
ctcccttttgacacagtt

SEQ ID NO: 278045 - DNA, 14 bp, Homo sapiens
ctccctttttatat

SEQ ID NO: 278046 - DNA, 15 bp, Homo sapiens
ctccgaggctccccg

SEQ ID NO: 278047 - DNA, 14 bp, Homo sapiens
ctccgagggcggcc

SEQ ID NO: 278048 - DNA, 18 bp, Homo sapiens
ctccgagggcggccaggg

SEQ ID NO: 278049 - DNA, 20 bp, Homo sapiens
ctccgagggcggccagggac

SEQ ID NO: 278050 - DNA, 13 bp, Homo sapiens
ctccgcccaaatc

SEQ ID NO: 278051 - DNA, 17 bp, Homo sapiens
ctccgccctttttgtcc

SEQ ID NO: 278052 - DNA, 15 bp, Homo sapiens
ctccgccgtgccggc

SEQ ID NO: 278053 - DNA, 15 bp, Homo sapiens
ctccgcctctgctgg

SEQ ID NO: 278054 - DNA, 16 bp, Homo sapiens
ctccgcctctgctggc

SEQ ID NO: 278055 - DNA, 17 bp, Homo sapiens
ctccgcgggggacagga

SEQ ID NO: 278056 - DNA, 17 bp, Homo sapiens
ctccgctcccctttccc

SEQ ID NO: 278057 - DNA, 12 bp, Homo sapiens
ctccgctgtgtg

SEQ ID NO: 278058 - DNA, 20 bp, Homo sapiens
ctccggattccggccctggc

SEQ ID NO: 278059 - DNA, 23 bp, Homo sapiens
ctccggattccggccctggctgg

SEQ ID NO: 278060 - DNA, 14 bp, Homo sapiens
ctccggcagaggca

SEQ ID NO: 278061 - DNA, 20 bp, Homo sapiens
ctccggcagaggcagggccc

SEQ ID NO: 278062 - DNA, 17 bp, Homo sapiens
ctccggccatactgcct

SEQ ID NO: 278063 - DNA, 16 bp, Homo sapiens
ctccggccctgcccca

SEQ ID NO: 278064 - DNA, 23 bp, Homo sapiens
ctccgggaccattgacctcagct

SEQ ID NO: 278065 - DNA, 15 bp, Homo sapiens
ctccggggtctgtgc

SEQ ID NO: 278066 - DNA, 16 bp, Homo sapiens
ctccggggtctgtgct

SEQ ID NO: 278067 - DNA, 18 bp, Homo sapiens
ctccggggtctgtgctgt

SEQ ID NO: 278068 - DNA, 22 bp, Homo sapiens
ctccggggtctgtgctgtgcct

SEQ ID NO: 278069 - DNA, 17 bp, Homo sapiens
ctccgtccacccaggct

SEQ ID NO: 278070 - DNA, 23 bp, Homo sapiens
ctccgtccacccaggctgcactg

SEQ ID NO: 278071 - DNA, 15 bp, Homo sapiens
ctccgtccagccgcc

SEQ ID NO: 278072 - DNA, 15 bp, Homo sapiens
ctccgtgatccatcc

SEQ ID NO: 278073 - DNA, 22 bp, Homo sapiens
ctccgtggccccgccctcaggc

SEQ ID NO: 278074 - DNA, 15 bp, Homo sapiens
ctccgttcccacctc

SEQ ID NO: 278075 - DNA, 19 bp, Homo sapiens
ctccgttcccacctctgag

SEQ ID NO: 278076 - DNA, 17 bp, Homo sapiens
ctccgtttatgggcctt

SEQ ID NO: 278077 - DNA, 19 bp, Homo sapiens
ctccgtttatgggccttgc

SEQ ID NO: 278078 - DNA, 18 bp, Homo sapiens
ctcctaaaggcagcaacc

SEQ ID NO: 278079 - DNA, 19 bp, Homo sapiens
ctcctacaggcgctccagg

SEQ ID NO: 278080 - DNA, 22 bp, Homo sapiens
ctcctacaggcgctccaggcca

SEQ ID NO: 278081 - DNA, 19 bp, Homo sapiens
ctcctacccctgtcctggg

SEQ ID NO: 278082 - DNA, 14 bp, Homo sapiens
ctcctactctgtgt

SEQ ID NO: 278083 - DNA, 20 bp, Homo sapiens
ctcctactgcttcctctgaa

SEQ ID NO: 278084 - DNA, 12 bp, Homo sapiens
ctcctagactga

SEQ ID NO: 278085 - DNA, 21 bp, Homo sapiens
ctcctagactgaccctgatca

SEQ ID NO: 278086 - DNA, 23 bp, Homo sapiens
ctcctagagacagaagcaggctg

SEQ ID NO: 278087 - DNA, 18 bp, Homo sapiens
ctcctagaggtgggcagc

SEQ ID NO: 278088 - DNA, 22 bp, Homo sapiens
ctcctaggacatgttcccttct

SEQ ID NO: 278089 - DNA, 17 bp, Homo sapiens
ctcctatcacctcccct

SEQ ID NO: 278090 - DNA, 19 bp, Homo sapiens
ctcctatcacctcccctcc

SEQ ID NO: 278091 - DNA, 15 bp, Homo sapiens
ctcctatccttggag

SEQ ID NO: 278092 - DNA, 19 bp, Homo sapiens
ctcctatcttttatttcat

SEQ ID NO: 278093 - DNA, 13 bp, Homo sapiens
ctcctattttaat

SEQ ID NO: 278094 - DNA, 19 bp, Homo sapiens
ctcctattttaattggaat

SEQ ID NO: 278095 - DNA, 16 bp, Homo sapiens
ctcctcaccccagtgc

SEQ ID NO: 278096 - DNA, 14 bp, Homo sapiens
ctcctcacccccac

SEQ ID NO: 278097 - DNA, 21 bp, Homo sapiens
ctcctcacctctggactggct

SEQ ID NO: 278098 - DNA, 15 bp, Homo sapiens
ctcctcacctgtcta

SEQ ID NO: 278099 - DNA, 15 bp, Homo sapiens
ctcctcactgcccgc

SEQ ID NO: 278100 - DNA, 19 bp, Homo sapiens
ctcctcagtctttggggga

SEQ ID NO: 278101 - DNA, 14 bp, Homo sapiens
ctcctcatctctaa

SEQ ID NO: 278102 - DNA, 12 bp, Homo sapiens
ctcctccaaatg

SEQ ID NO: 278103 - DNA, 17 bp, Homo sapiens
ctcctccaagaagccct

SEQ ID NO: 278104 - DNA, 18 bp, Homo sapiens
ctcctccacagtgctgct

SEQ ID NO: 278105 - DNA, 20 bp, Homo sapiens
ctcctccacagtgctgcttc

SEQ ID NO: 278106 - DNA, 19 bp, Homo sapiens
ctcctccactcactccagc

SEQ ID NO: 278107 - DNA, 15 bp, Homo sapiens
ctcctccactccacc

SEQ ID NO: 278108 - DNA, 14 bp, Homo sapiens
ctcctccagactcg

SEQ ID NO: 278109 - DNA, 14 bp, Homo sapiens
ctcctccagcccac

SEQ ID NO: 278110 - DNA, 13 bp, Homo sapiens
ctcctccagcgag

SEQ ID NO: 278111 - DNA, 18 bp, Homo sapiens
ctcctcccaactctggcc

SEQ ID NO: 278112 - DNA, 17 bp, Homo sapiens
ctcctcccaggcgcccc

SEQ ID NO: 278113 - DNA, 14 bp, Homo sapiens
ctcctcccatccag

SEQ ID NO: 278114 - DNA, 15 bp, Homo sapiens
ctcctcccatggcct

SEQ ID NO: 278115 - DNA, 14 bp, Homo sapiens
ctcctcccctcctc

SEQ ID NO: 278116 - DNA, 12 bp, Homo sapiens
ctcctcctccag

SEQ ID NO: 278117 - DNA, 13 bp, Homo sapiens
ctcctcctccagc

SEQ ID NO: 278118 - DNA, 13 bp, Homo sapiens
ctcctcctccagt

SEQ ID NO: 278119 - DNA, 14 bp, Homo sapiens
ctcctcctcctcct

SEQ ID NO: 278120 - DNA, 16 bp, Homo sapiens
ctcctcctcctcctgt

SEQ ID NO: 278121 - DNA, 15 bp, Homo sapiens
ctcctcctcctgttc

SEQ ID NO: 278122 - DNA, 13 bp, Homo sapiens
ctcctccttgccc

SEQ ID NO: 278123 - DNA, 16 bp, Homo sapiens
ctcctcggccagagct

SEQ ID NO: 278124 - DNA, 20 bp, Homo sapiens
ctcctcggccccctccatcg

SEQ ID NO: 278125 - DNA, 16 bp, Homo sapiens
ctcctcgggcgcctgc

SEQ ID NO: 278126 - DNA, 20 bp, Homo sapiens
ctcctcgggcgcctgcgctc

SEQ ID NO: 278127 - DNA, 22 bp, Homo sapiens
ctcctcggtggcatttgctgaa

SEQ ID NO: 278128 - DNA, 21 bp, Homo sapiens
ctcctcgtccggcctgcagcc

SEQ ID NO: 278129 - DNA, 22 bp, Homo sapiens
ctcctcgtccggcctgcagccc

SEQ ID NO: 278130 - DNA, 14 bp, Homo sapiens
ctcctctcagcttc

SEQ ID NO: 278131 - DNA, 19 bp, Homo sapiens
ctcctctcagcttctaatt

SEQ ID NO: 278132 - DNA, 13 bp, Homo sapiens
ctcctctccagcc

SEQ ID NO: 278133 - DNA, 14 bp, Homo sapiens
ctcctctcccctct

SEQ ID NO: 278134 - DNA, 21 bp, Homo sapiens
ctcctctcctcgtccggcctg

SEQ ID NO: 278135 - DNA, 16 bp, Homo sapiens
ctcctctccttgggct

SEQ ID NO: 278136 - DNA, 17 bp, Homo sapiens
ctcctctccttgggctc

SEQ ID NO: 278137 - DNA, 23 bp, Homo sapiens
ctcctctccttgggctcctggct

SEQ ID NO: 278138 - DNA, 16 bp, Homo sapiens
ctcctctctccctgcc

SEQ ID NO: 278139 - DNA, 17 bp, Homo sapiens
ctcctctctccctgcct

SEQ ID NO: 278140 - DNA, 18 bp, Homo sapiens
ctcctctctccctgcctc

SEQ ID NO: 278141 - DNA, 19 bp, Homo sapiens
ctcctctctccctgcctca

SEQ ID NO: 278142 - DNA, 20 bp, Homo sapiens
ctcctctctctccctccact

SEQ ID NO: 278143 - DNA, 14 bp, Homo sapiens
ctcctctctgggcc

SEQ ID NO: 278144 - DNA, 17 bp, Homo sapiens
ctcctctgattatcagg

SEQ ID NO: 278145 - DNA, 14 bp, Homo sapiens
ctcctctgcagcct

SEQ ID NO: 278146 - DNA, 21 bp, Homo sapiens
ctcctctgcagcctgagctcc

SEQ ID NO: 278147 - DNA, 13 bp, Homo sapiens
ctcctctgccccc

SEQ ID NO: 278148 - DNA, 16 bp, Homo sapiens
ctcctctgccccctcc

SEQ ID NO: 278149 - DNA, 15 bp, Homo sapiens
ctcctctgtccaggc

SEQ ID NO: 278150 - DNA, 12 bp, Homo sapiens
ctcctctgtgct

SEQ ID NO: 278151 - DNA, 18 bp, Homo sapiens
ctcctctgttcagtcgca

SEQ ID NO: 278152 - DNA, 14 bp, Homo sapiens
ctcctctttcccct

SEQ ID NO: 278153 - DNA, 20 bp, Homo sapiens
ctcctctttcccctcctttg

SEQ ID NO: 278154 - DNA, 21 bp, Homo sapiens
ctcctctttgttttgttttaa

SEQ ID NO: 278155 - DNA, 14 bp, Homo sapiens
ctcctgaacccccc

SEQ ID NO: 278156 - DNA, 23 bp, Homo sapiens
ctcctgacatcaggtgatccacc

SEQ ID NO: 278157 - DNA, 16 bp, Homo sapiens
ctcctgacccagtccc

SEQ ID NO: 278158 - DNA, 14 bp, Homo sapiens
ctcctgaccctgtg

SEQ ID NO: 278159 - DNA, 13 bp, Homo sapiens
ctcctgagcctgt

SEQ ID NO: 278160 - DNA, 14 bp, Homo sapiens
ctcctgagcctgtc

SEQ ID NO: 278161 - DNA, 17 bp, Homo sapiens
ctcctgagcctgtctct

SEQ ID NO: 278162 - DNA, 21 bp, Homo sapiens
ctcctgaggggcatctgcccc

SEQ ID NO: 278163 - DNA, 15 bp, Homo sapiens
ctcctgaggtctgga

SEQ ID NO: 278164 - DNA, 19 bp, Homo sapiens
ctcctgatggccaagagca

SEQ ID NO: 278165 - DNA, 15 bp, Homo sapiens
ctcctgattatttat

SEQ ID NO: 278166 - DNA, 15 bp, Homo sapiens
ctcctgattgctctg

SEQ ID NO: 278167 - DNA, 16 bp, Homo sapiens
ctcctgattgctctgg

SEQ ID NO: 278168 - DNA, 19 bp, Homo sapiens
ctcctgattgctctggaag

SEQ ID NO: 278169 - DNA, 19 bp, Homo sapiens
ctcctgcaggctggctgtt

SEQ ID NO: 278170 - DNA, 20 bp, Homo sapiens
ccttttattaacatatattg

SEQ ID NO: 278171 - DNA, 21 bp, Homo sapiens
ccttttctattccttctggcc

SEQ ID NO: 278172 - DNA, 16 bp, Homo sapiens
ccttttctggctcctg

SEQ ID NO: 278173 - DNA, 12 bp, Homo sapiens
ccttttctgtga

SEQ ID NO: 278174 - DNA, 17 bp, Homo sapiens
ccttttgagtgccttac

SEQ ID NO: 278175 - DNA, 20 bp, Homo sapiens
ccttttgataaaatgttcct

SEQ ID NO: 278176 - DNA, 14 bp, Homo sapiens
ccttttgcctggct

SEQ ID NO: 278177 - DNA, 18 bp, Homo sapiens
ccttttgcctggctgtgg

SEQ ID NO: 278178 - DNA, 21 bp, Homo sapiens
ccttttggcccccgagctggg

SEQ ID NO: 278179 - DNA, 23 bp, Homo sapiens
ccttttggcccccgagctggggg

SEQ ID NO: 278180 - DNA, 21 bp, Homo sapiens
ccttttgggtttctgccctgc

SEQ ID NO: 278181 - DNA, 14 bp, Homo sapiens
ccttttgtccccag

SEQ ID NO: 278182 - DNA, 21 bp, Homo sapiens
ccttttgtccccagggcccct

SEQ ID NO: 278183 - DNA, 14 bp, Homo sapiens
cctttttctacctt

SEQ ID NO: 278184 - DNA, 22 bp, Homo sapiens
cctttttgacttttccaagccc

SEQ ID NO: 278185 - DNA, 22 bp, Homo sapiens
cctttttgtaaatactgcttga

SEQ ID NO: 278186 - DNA, 17 bp, Homo sapiens
ccttttttctcttctgt

SEQ ID NO: 278187 - DNA, 18 bp, Homo sapiens
ccttttttctttctttac

SEQ ID NO: 278188 - DNA, 19 bp, Homo sapiens
ccttttttctttctttact

SEQ ID NO: 278189 - DNA, 23 bp, Homo sapiens
cctttttttaaaattcaccccca

SEQ ID NO: 278190 - DNA, 22 bp, Homo sapiens
cgaaaagagcacttcacacaga

SEQ ID NO: 278191 - DNA, 22 bp, Homo sapiens
cgaaacaggctactctcctcgg

SEQ ID NO: 278192 - DNA, 13 bp, Homo sapiens
cgaaactgctcta

SEQ ID NO: 278193 - DNA, 12 bp, Homo sapiens
cgaaagaacagt

SEQ ID NO: 278194 - DNA, 15 bp, Homo sapiens
cgaacatcttcatat

SEQ ID NO: 278195 - DNA, 20 bp, Homo sapiens
cgaacatcttcatataaact

SEQ ID NO: 278196 - DNA, 15 bp, Homo sapiens
cgaaccaaggcagcc

SEQ ID NO: 278197 - DNA, 22 bp, Homo sapiens
cgaaccaaggcagcctccagag

SEQ ID NO: 278198 - DNA, 14 bp, Homo sapiens
cgaaccccccactc

SEQ ID NO: 278199 - DNA, 15 bp, Homo sapiens
cgaaccccccactcc

SEQ ID NO: 278200 - DNA, 23 bp, Homo sapiens
cgaaccgtgagcaggaaggcctg

SEQ ID NO: 278201 - DNA, 16 bp, Homo sapiens
cgaacgacaatagctt

SEQ ID NO: 278202 - DNA, 18 bp, Homo sapiens
cgaagaaaaaaaataaca

SEQ ID NO: 278203 - DNA, 18 bp, Homo sapiens
cgaagaccttctgaagat

SEQ ID NO: 278204 - DNA, 15 bp, Homo sapiens
cgaagctcagcccac

SEQ ID NO: 278205 - DNA, 17 bp, Homo sapiens
cgaagctcagcccaccc

SEQ ID NO: 278206 - DNA, 19 bp, Homo sapiens
cgaaggggccccggggctg

SEQ ID NO: 278207 - DNA, 23 bp, Homo sapiens
cgaagtctctttttttggcccag

SEQ ID NO: 278208 - DNA, 22 bp, Homo sapiens
cgaagtcttccatcagcagtga

SEQ ID NO: 278209 - DNA, 20 bp, Homo sapiens
cgaagtctttgccttctctg

SEQ ID NO: 278210 - DNA, 18 bp, Homo sapiens
cgaatcccctccctgtca

SEQ ID NO: 278211 - DNA, 15 bp, Homo sapiens
cgaatggagtccaga

SEQ ID NO: 278212 - DNA, 21 bp, Homo sapiens
cgaatgtgcaggtttgttaca

SEQ ID NO: 278213 - DNA, 22 bp, Homo sapiens
cgaattaatagcttttattgta

SEQ ID NO: 278214 - DNA, 15 bp, Homo sapiens
cgaattctcagacga

SEQ ID NO: 278215 - DNA, 13 bp, Homo sapiens
cgaatttctcact

SEQ ID NO: 278216 - DNA, 14 bp, Homo sapiens
cgaattttaaaaca

SEQ ID NO: 278217 - DNA, 22 bp, Homo sapiens
cgacaaaaacaagactgcctcc

SEQ ID NO: 278218 - DNA, 18 bp, Homo sapiens
cgacaaccgatgctccag

SEQ ID NO: 278219 - DNA, 14 bp, Homo sapiens
cgacaccagccctg

SEQ ID NO: 278220 - DNA, 15 bp, Homo sapiens
cgacactgctgcacc

SEQ ID NO: 278221 - DNA, 16 bp, Homo sapiens
cgacactgctgcacca

SEQ ID NO: 278222 - DNA, 20 bp, Homo sapiens
cgacactgctgcaccagagt

SEQ ID NO: 278223 - DNA, 21 bp, Homo sapiens
cgacactgctgcaccagagtg

SEQ ID NO: 278224 - DNA, 18 bp, Homo sapiens
cgacagaaaacctcaagg

SEQ ID NO: 278225 - DNA, 12 bp, Homo sapiens
cgacagcctggc

SEQ ID NO: 278226 - DNA, 13 bp, Homo sapiens
cgacagcctggca

SEQ ID NO: 278227 - DNA, 15 bp, Homo sapiens
cgacagtggctctcc

SEQ ID NO: 278228 - DNA, 18 bp, Homo sapiens
cgaccccctttctaagga

SEQ ID NO: 278229 - DNA, 16 bp, Homo sapiens
cggccccgcgcgtgcc

SEQ ID NO: 278230 - DNA, 15 bp, Homo sapiens
cggcccggcccacgc

SEQ ID NO: 278231 - DNA, 15 bp, Homo sapiens
cggcccgtgcgcagc

SEQ ID NO: 278232 - DNA, 15 bp, Homo sapiens
cggccctaagccact

SEQ ID NO: 278233 - DNA, 21 bp, Homo sapiens
cggccctaccagcgcccgctg

SEQ ID NO: 278234 - DNA, 10 bp, Homo sapiens
cggccctgcc

SEQ ID NO: 278235 - DNA, 14 bp, Homo sapiens
cggccctgccccac

SEQ ID NO: 278236 - DNA, 13 bp, Homo sapiens
cggccctggctgg

SEQ ID NO: 278237 - DNA, 22 bp, Homo sapiens
cggccctggctggggacttggc

SEQ ID NO: 278238 - DNA, 22 bp, Homo sapiens
cggccgatgggagtctccctcc

SEQ ID NO: 278239 - DNA, 14 bp, Homo sapiens
cggccgcatgtctg

SEQ ID NO: 278240 - DNA, 14 bp, Homo sapiens
cggccgcccagaca

SEQ ID NO: 278241 - DNA, 13 bp, Homo sapiens
cggccgtccctga

SEQ ID NO: 278242 - DNA, 15 bp, Homo sapiens
cggccgtccctgact

SEQ ID NO: 278243 - DNA, 19 bp, Homo sapiens
cggccgtcttcactcgccc

SEQ ID NO: 278244 - DNA, 14 bp, Homo sapiens
cggcctccaggctg

SEQ ID NO: 278245 - DNA, 14 bp, Homo sapiens
cggcctcccaaagt

SEQ ID NO: 278246 - DNA, 17 bp, Homo sapiens
cggcctccgaggctccc

SEQ ID NO: 278247 - DNA, 18 bp, Homo sapiens
cggcctccgaggctcccc

SEQ ID NO: 278248 - DNA, 20 bp, Homo sapiens
cggcctccgaggctccccgc

SEQ ID NO: 278249 - DNA, 21 bp, Homo sapiens
cggcctccgaggctccccgcc

SEQ ID NO: 278250 - DNA, 12 bp, Homo sapiens
cggcctcttcca

SEQ ID NO: 278251 - DNA, 15 bp, Homo sapiens
cggcctgatgctccc

SEQ ID NO: 278252 - DNA, 23 bp, Homo sapiens
cggcctgatgctccctcccctgc

SEQ ID NO: 278253 - DNA, 13 bp, Homo sapiens
cggcctgctccca

SEQ ID NO: 278254 - DNA, 22 bp, Homo sapiens
cggccttggccttggggccaga

SEQ ID NO: 278255 - DNA, 23 bp, Homo sapiens
cggccttggccttggggccagac

SEQ ID NO: 278256 - DNA, 13 bp, Homo sapiens
cggcgcagcccct

SEQ ID NO: 278257 - DNA, 18 bp, Homo sapiens
cggcgcccctgccacctc

SEQ ID NO: 278258 - DNA, 20 bp, Homo sapiens
cggcgcctccgcccaaatca

SEQ ID NO: 278259 - DNA, 19 bp, Homo sapiens
cggcgccttctacctgcag

SEQ ID NO: 278260 - DNA, 21 bp, Homo sapiens
cggcgccttctacctgcagga

SEQ ID NO: 278261 - DNA, 13 bp, Homo sapiens
cggcgctgcaggt

SEQ ID NO: 278262 - DNA, 23 bp, Homo sapiens
cggcggcagccccacttcacccc

SEQ ID NO: 278263 - DNA, 18 bp, Homo sapiens
cggcggcttcgcgctgga

SEQ ID NO: 278264 - DNA, 16 bp, Homo sapiens
cggctaagaggctgct

SEQ ID NO: 278265 - DNA, 17 bp, Homo sapiens
cggctaggccggccagc

SEQ ID NO: 278266 - DNA, 18 bp, Homo sapiens
cggctaggccggccagct

SEQ ID NO: 278267 - DNA, 19 bp, Homo sapiens
cggctaggccggccagctc

SEQ ID NO: 278268 - DNA, 22 bp, Homo sapiens
cggctaggccggccagctcccc

SEQ ID NO: 278269 - DNA, 18 bp, Homo sapiens
cggctccccctgccagca

SEQ ID NO: 278270 - DNA, 21 bp, Homo sapiens
cggctgaggacggggcagagc

SEQ ID NO: 278271 - DNA, 23 bp, Homo sapiens
cggctgcaccctgtatggagcta

SEQ ID NO: 278272 - DNA, 21 bp, Homo sapiens
cggctgcctgacactgagccc

SEQ ID NO: 278273 - DNA, 12 bp, Homo sapiens
cggctgcctgcc

SEQ ID NO: 278274 - DNA, 19 bp, Homo sapiens
cggctgctggcacagactt

SEQ ID NO: 278275 - DNA, 18 bp, Homo sapiens
cggctggaaagaggagaa

SEQ ID NO: 278276 - DNA, 15 bp, Homo sapiens
cggctggaagaacat

SEQ ID NO: 278277 - DNA, 23 bp, Homo sapiens
cggctggacttttgcagcttcct

SEQ ID NO: 278278 - DNA, 22 bp, Homo sapiens
cggctggccggtccaccccgtc

SEQ ID NO: 278279 - DNA, 16 bp, Homo sapiens
cggctgggcagggccg

SEQ ID NO: 278280 - DNA, 23 bp, Homo sapiens
cggctgggcagggccgcagggcg

SEQ ID NO: 278281 - DNA, 17 bp, Homo sapiens
cggctgtgtatttctgt

SEQ ID NO: 278282 - DNA, 16 bp, Homo sapiens
cggcttcctgtccact

SEQ ID NO: 278283 - DNA, 17 bp, Homo sapiens
cggcttcgcgctggaat

SEQ ID NO: 278284 - DNA, 17 bp, Homo sapiens
cggcttgtgggctggtg

SEQ ID NO: 278285 - DNA, 20 bp, Homo sapiens
cggctttgcagggagaccag

SEQ ID NO: 278286 - DNA, 18 bp, Homo sapiens
cgggaaaggcatctaaga

SEQ ID NO: 278287 - DNA, 14 bp, Homo sapiens
cgggaaattctgct

SEQ ID NO: 278288 - DNA, 17 bp, Homo sapiens
cgggaaattctgctgct

SEQ ID NO: 278289 - DNA, 13 bp, Homo sapiens
cgggaacagtgtt

SEQ ID NO: 278290 - DNA, 14 bp, Homo sapiens
cgggaagagaggag

SEQ ID NO: 278291 - DNA, 20 bp, Homo sapiens
cgggaagagaggagttcaat

SEQ ID NO: 278292 - DNA, 15 bp, Homo sapiens
cgggaaggcctgagg

SEQ ID NO: 278293 - DNA, 20 bp, Homo sapiens
cgggaaggcctgagggaagc

SEQ ID NO: 278294 - DNA, 18 bp, Homo sapiens
cgggacagcggcccggcc

SEQ ID NO: 278295 - DNA, 22 bp, Homo sapiens
cgggaccacagctgctggccag

SEQ ID NO: 278296 - DNA, 17 bp, Homo sapiens
cgggacccccggcctcc

SEQ ID NO: 278297 - DNA, 18 bp, Homo sapiens
cgggacccccggcctcca

SEQ ID NO: 278298 - DNA, 19 bp, Homo sapiens
cgggacccccggcctccag

SEQ ID NO: 278299 - DNA, 13 bp, Homo sapiens
cgggacctgtggc

SEQ ID NO: 278300 - DNA, 23 bp, Homo sapiens
cgggactgtcttcaaccctgccc

SEQ ID NO: 278301 - DNA, 21 bp, Homo sapiens
cctggtggagaggcctccctg

SEQ ID NO: 278302 - DNA, 13 bp, Homo sapiens
cctggtggctgga

SEQ ID NO: 278303 - DNA, 13 bp, Homo sapiens
cctggtggggctg

SEQ ID NO: 278304 - DNA, 20 bp, Homo sapiens
cctggtggggtgtgcatgcc

SEQ ID NO: 278305 - DNA, 14 bp, Homo sapiens
cctggttccctctt

SEQ ID NO: 278306 - DNA, 22 bp, Homo sapiens
cctggttccttcctatgcccag

SEQ ID NO: 278307 - DNA, 18 bp, Homo sapiens
cctggttctccatcccca

SEQ ID NO: 278308 - DNA, 17 bp, Homo sapiens
cctggtttcactggccc

SEQ ID NO: 278309 - DNA, 19 bp, Homo sapiens
cctggtttgaatcctggct

SEQ ID NO: 278310 - DNA, 19 bp, Homo sapiens
cctggttttaccccagctc

SEQ ID NO: 278311 - DNA, 20 bp, Homo sapiens
cctgtaaaactttattttat

SEQ ID NO: 278312 - DNA, 16 bp, Homo sapiens
cctgtaaacactcagc

SEQ ID NO: 278313 - DNA, 10 bp, Homo sapiens
cctgtaactg

SEQ ID NO: 278314 - DNA, 18 bp, Homo sapiens
cctgtaatcacaactcag

SEQ ID NO: 278315 - DNA, 15 bp, Homo sapiens
cctgtaatcccagca

SEQ ID NO: 278316 - DNA, 18 bp, Homo sapiens
cctgtaatctcagcactt

SEQ ID NO: 278317 - DNA, 21 bp, Homo sapiens
cctgtacactgaatatttata

SEQ ID NO: 278318 - DNA, 17 bp, Homo sapiens
cctgtacatacattgta

SEQ ID NO: 278319 - DNA, 19 bp, Homo sapiens
cctgtacatacattgtata

SEQ ID NO: 278320 - DNA, 14 bp, Homo sapiens
cctgtacccagcca

SEQ ID NO: 278321 - DNA, 19 bp, Homo sapiens
cctgtacccagccaccttc

SEQ ID NO: 278322 - DNA, 23 bp, Homo sapiens
cctgtacccagccaccttcctga

SEQ ID NO: 278323 - DNA, 16 bp, Homo sapiens
cctgtacccagctcct

SEQ ID NO: 278324 - DNA, 14 bp, Homo sapiens
cctgtacctctctc

SEQ ID NO: 278325 - DNA, 15 bp, Homo sapiens
cctgtacctctctct

SEQ ID NO: 278326 - DNA, 17 bp, Homo sapiens
cctgtacctctctctgc

SEQ ID NO: 278327 - DNA, 15 bp, Homo sapiens
cctgtagccactggc

SEQ ID NO: 278328 - DNA, 16 bp, Homo sapiens
cctgtagccactggca

SEQ ID NO: 278329 - DNA, 14 bp, Homo sapiens
cctgtaggaaacag

SEQ ID NO: 278330 - DNA, 16 bp, Homo sapiens
cctgtaggagtaaaga

SEQ ID NO: 278331 - DNA, 16 bp, Homo sapiens
cctgtagtcccagcta

SEQ ID NO: 278332 - DNA, 13 bp, Homo sapiens
cctgtagtgagaa

SEQ ID NO: 278333 - DNA, 14 bp, Homo sapiens
cctgtagtgagaaa

SEQ ID NO: 278334 - DNA, 14 bp, Homo sapiens
cctgtagtgcccct

SEQ ID NO: 278335 - DNA, 21 bp, Homo sapiens
cctgtagttaggaaataaaac

SEQ ID NO: 278336 - DNA, 22 bp, Homo sapiens
cctgtagttaggaaataaaacc

SEQ ID NO: 278337 - DNA, 12 bp, Homo sapiens
cctgtatagtta

SEQ ID NO: 278338 - DNA, 13 bp, Homo sapiens
cctgtatttccaa

SEQ ID NO: 278339 - DNA, 23 bp, Homo sapiens
cctgtcaagttaacaaggaatgc

SEQ ID NO: 278340 - DNA, 14 bp, Homo sapiens
cctgtcactcagct

SEQ ID NO: 278341 - DNA, 14 bp, Homo sapiens
cctgtcagccaaca

SEQ ID NO: 278342 - DNA, 23 bp, Homo sapiens
cctgtcagccaacattgccttgc

SEQ ID NO: 278343 - DNA, 14 bp, Homo sapiens
cctgtcatctgggc

SEQ ID NO: 278344 - DNA, 15 bp, Homo sapiens
cctgtcatctgggcc

SEQ ID NO: 278345 - DNA, 16 bp, Homo sapiens
cctgtccacctgtgct

SEQ ID NO: 278346 - DNA, 17 bp, Homo sapiens
cctgtccacctgtgctg

SEQ ID NO: 278347 - DNA, 16 bp, Homo sapiens
cctgtccatccccagt

SEQ ID NO: 278348 - DNA, 23 bp, Homo sapiens
cctgtcccaccaactctgcactc

SEQ ID NO: 278349 - DNA, 14 bp, Homo sapiens
cctgtcccacctca

SEQ ID NO: 278350 - DNA, 17 bp, Homo sapiens
cctgtccccctcccctc

SEQ ID NO: 278351 - DNA, 21 bp, Homo sapiens
cctgtccccctcccctcccag

SEQ ID NO: 278352 - DNA, 22 bp, Homo sapiens
cctgtccccgccttccctcact

SEQ ID NO: 278353 - DNA, 19 bp, Homo sapiens
cctgtcccctccttccagc

SEQ ID NO: 278354 - DNA, 14 bp, Homo sapiens
cctgtcccgccttc

SEQ ID NO: 278355 - DNA, 16 bp, Homo sapiens
cctgtccctgccccgc

SEQ ID NO: 278356 - DNA, 15 bp, Homo sapiens
cctgtccgccctctt

SEQ ID NO: 278357 - DNA, 15 bp, Homo sapiens
cctgtcctcaccgtc

SEQ ID NO: 278358 - DNA, 14 bp, Homo sapiens
cctgtcctgctcac

SEQ ID NO: 278359 - DNA, 18 bp, Homo sapiens
cctgtccttcccacggcc

SEQ ID NO: 278360 - DNA, 21 bp, Homo sapiens
cctgtccttctctcacctcct

SEQ ID NO: 278361 - DNA, 21 bp, Homo sapiens
cctgtcgcctgcggactccat

SEQ ID NO: 278362 - DNA, 14 bp, Homo sapiens
cctgtcgtgccagt

SEQ ID NO: 278363 - DNA, 18 bp, Homo sapiens
cctgtcgtgccagtcctg

SEQ ID NO: 278364 - DNA, 21 bp, Homo sapiens
cctgtctaacctacgacccca

SEQ ID NO: 278365 - DNA, 15 bp, Homo sapiens
cctgtctaatgaaac

SEQ ID NO: 278366 - DNA, 14 bp, Homo sapiens
cctgtctaggtctc

SEQ ID NO: 278367 - DNA, 19 bp, Homo sapiens
cctgtctaggtctcctcag

SEQ ID NO: 278368 - DNA, 16 bp, Homo sapiens
cctgtctcagcctccc

SEQ ID NO: 278369 - DNA, 15 bp, Homo sapiens
cctgtctcccctctg

SEQ ID NO: 278370 - DNA, 12 bp, Homo sapiens
cctgtctcctct

SEQ ID NO: 278371 - DNA, 14 bp, Homo sapiens
cctgtctcctctgt

SEQ ID NO: 278372 - DNA, 13 bp, Homo sapiens
cctgtctctccct

SEQ ID NO: 278373 - DNA, 21 bp, Homo sapiens
cctgtctctccctaccctctt

SEQ ID NO: 278374 - DNA, 20 bp, Homo sapiens
cctgtctctttccactttgt

SEQ ID NO: 278375 - DNA, 18 bp, Homo sapiens
cctgtctgctaggcgctg

SEQ ID NO: 278376 - DNA, 13 bp, Homo sapiens
cctgtctggaaga

SEQ ID NO: 278377 - DNA, 19 bp, Homo sapiens
cctgtctggaagacgtggc

SEQ ID NO: 278378 - DNA, 17 bp, Homo sapiens
cctgtctgtctctccat

SEQ ID NO: 278379 - DNA, 19 bp, Homo sapiens
cctgtcttcagatcctgct

SEQ ID NO: 278380 - DNA, 14 bp, Homo sapiens
cctgtcttccaagg

SEQ ID NO: 278381 - DNA, 19 bp, Homo sapiens
cctgtctttgctgtttata

SEQ ID NO: 278382 - DNA, 17 bp, Homo sapiens
cctgtgaatcatatgtt

SEQ ID NO: 278383 - DNA, 20 bp, Homo sapiens
cctgtgaccctctcactttg

SEQ ID NO: 278384 - DNA, 16 bp, Homo sapiens
cctgtgaccggggtcc

SEQ ID NO: 278385 - DNA, 15 bp, Homo sapiens
cctgtgactatggct

SEQ ID NO: 278386 - DNA, 18 bp, Homo sapiens
cctgtgactatggctctg

SEQ ID NO: 278387 - DNA, 18 bp, Homo sapiens
cctgtgacttcagctctg

SEQ ID NO: 278388 - DNA, 15 bp, Homo sapiens
cctgtgagctcccca

SEQ ID NO: 278389 - DNA, 19 bp, Homo sapiens
cctgtgaggtaactgggat

SEQ ID NO: 278390 - DNA, 14 bp, Homo sapiens
cctgtgatgcctga

SEQ ID NO: 278391 - DNA, 15 bp, Homo sapiens
cctgtgcagcagccc

SEQ ID NO: 278392 - DNA, 21 bp, Homo sapiens
cggggtctgtgctgtgcctgc

SEQ ID NO: 278393 - DNA, 23 bp, Homo sapiens
cggggtctgtgctgtgcctgcta

SEQ ID NO: 278394 - DNA, 19 bp, Homo sapiens
cggggtggacgagggagtg

SEQ ID NO: 278395 - DNA, 19 bp, Homo sapiens
cggggtggggtgcctgagc

SEQ ID NO: 278396 - DNA, 22 bp, Homo sapiens
cggggtggggtgcctgagcccg

SEQ ID NO: 278397 - DNA, 18 bp, Homo sapiens
cgggtatgaagtgtgggg

SEQ ID NO: 278398 - DNA, 17 bp, Homo sapiens
cgggtcaccctgtgacc

SEQ ID NO: 278399 - DNA, 11 bp, Homo sapiens
cgggtctgtgg

SEQ ID NO: 278400 - DNA, 13 bp, Homo sapiens
cgggtctgtggga

SEQ ID NO: 278401 - DNA, 16 bp, Homo sapiens
cgggtctgtgggactg

SEQ ID NO: 278402 - DNA, 18 bp, Homo sapiens
cgggtgccaaataaatgc

SEQ ID NO: 278403 - DNA, 13 bp, Homo sapiens
cgggtgggcctgg

SEQ ID NO: 278404 - DNA, 14 bp, Homo sapiens
cgggtgggcctggc

SEQ ID NO: 278405 - DNA, 17 bp, Homo sapiens
cgggtgggcctggcctg

SEQ ID NO: 278406 - DNA, 19 bp, Homo sapiens
cgggtgggcctggcctgag

SEQ ID NO: 278407 - DNA, 20 bp, Homo sapiens
cgggtgggcctggcctgagc

SEQ ID NO: 278408 - DNA, 17 bp, Homo sapiens
cgggtggggtgcttgct

SEQ ID NO: 278409 - DNA, 23 bp, Homo sapiens
cgggtgggtatcccacctccagc

SEQ ID NO: 278410 - DNA, 21 bp, Homo sapiens
cgggtgtggcacgcacctgta

SEQ ID NO: 278411 - DNA, 23 bp, Homo sapiens
cgggtgtggcacgcacctgtagt

SEQ ID NO: 278412 - DNA, 23 bp, Homo sapiens
cgggttagcctggtgacaggcag

SEQ ID NO: 278413 - DNA, 21 bp, Homo sapiens
cgggttgtgttttttttcctt

SEQ ID NO: 278414 - DNA, 23 bp, Homo sapiens
cgggttgtgttttttttcctttg

SEQ ID NO: 278415 - DNA, 16 bp, Homo sapiens
cggtaggtgctggcct

SEQ ID NO: 278416 - DNA, 17 bp, Homo sapiens
cggtatccacctgcagc

SEQ ID NO: 278417 - DNA, 14 bp, Homo sapiens
cggtcaataattgt

SEQ ID NO: 278418 - DNA, 23 bp, Homo sapiens
cggtcaataattgtggagaggag

SEQ ID NO: 278419 - DNA, 17 bp, Homo sapiens
cggtcatgatgtctgca

SEQ ID NO: 278420 - DNA, 22 bp, Homo sapiens
cggtccaccccgtcccggcccc

SEQ ID NO: 278421 - DNA, 12 bp, Homo sapiens
cggtcccaggcc

SEQ ID NO: 278422 - DNA, 15 bp, Homo sapiens
cggtccccatcccca

SEQ ID NO: 278423 - DNA, 11 bp, Homo sapiens
cggtcctgtct

SEQ ID NO: 278424 - DNA, 15 bp, Homo sapiens
cggtcctgtctcccc

SEQ ID NO: 278425 - DNA, 19 bp, Homo sapiens
cggtcctttaggcagcctg

SEQ ID NO: 278426 - DNA, 14 bp, Homo sapiens
cggtgagactctga

SEQ ID NO: 278427 - DNA, 13 bp, Homo sapiens
cggtgaggcaggg

SEQ ID NO: 278428 - DNA, 14 bp, Homo sapiens
cggtgcagcggtgg

SEQ ID NO: 278429 - DNA, 15 bp, Homo sapiens
cggtgccctgtgtcc

SEQ ID NO: 278430 - DNA, 17 bp, Homo sapiens
cggtgcgtggctgtggc

SEQ ID NO: 278431 - DNA, 18 bp, Homo sapiens
cggtgcgtggctgtggca

SEQ ID NO: 278432 - DNA, 11 bp, Homo sapiens
cggtgctctgg

SEQ ID NO: 278433 - DNA, 15 bp, Homo sapiens
cggtgctctggcggc

SEQ ID NO: 278434 - DNA, 16 bp, Homo sapiens
cggtggaaggagcctg

SEQ ID NO: 278435 - DNA, 17 bp, Homo sapiens
cggtggaaggagcctgc

SEQ ID NO: 278436 - DNA, 19 bp, Homo sapiens
cggtggaaggagcctgcgg

SEQ ID NO: 278437 - DNA, 17 bp, Homo sapiens
cggtggcatttgctgaa

SEQ ID NO: 278438 - DNA, 18 bp, Homo sapiens
cggtggcatttgctgaat

SEQ ID NO: 278439 - DNA, 17 bp, Homo sapiens
cggtgtgagatggtgcc

SEQ ID NO: 278440 - DNA, 20 bp, Homo sapiens
cggtgtgtggccgcctggca

SEQ ID NO: 278441 - DNA, 18 bp, Homo sapiens
cggttcaggtcagggcta

SEQ ID NO: 278442 - DNA, 19 bp, Homo sapiens
cggttccacgtccccctgg

SEQ ID NO: 278443 - DNA, 14 bp, Homo sapiens
cggtttgggagaga

SEQ ID NO: 278444 - DNA, 21 bp, Homo sapiens
cggtttggggagcagagacac

SEQ ID NO: 278445 - DNA, 22 bp, Homo sapiens
cgtacagttcttcgggaagaga

SEQ ID NO: 278446 - DNA, 17 bp, Homo sapiens
cgtactctcacatgtgg

SEQ ID NO: 278447 - DNA, 13 bp, Homo sapiens
cgtagatgctgcc

SEQ ID NO: 278448 - DNA, 19 bp, Homo sapiens
cgtagatgctgcctagggt

SEQ ID NO: 278449 - DNA, 20 bp, Homo sapiens
cgtagccactctctgcccac

SEQ ID NO: 278450 - DNA, 14 bp, Homo sapiens
cgtaggcagcctct

SEQ ID NO: 278451 - DNA, 20 bp, Homo sapiens
cgtagtgtagatttgttttg

SEQ ID NO: 278452 - DNA, 22 bp, Homo sapiens
cgtataatttagtcccttaaaa

SEQ ID NO: 278453 - DNA, 20 bp, Homo sapiens
cgtatagaaaaagcacagct

SEQ ID NO: 278454 - DNA, 14 bp, Homo sapiens
cgtatgaatgatat

SEQ ID NO: 278455 - DNA, 19 bp, Homo sapiens
cgtattgtgaaatttgtta

SEQ ID NO: 278456 - DNA, 22 bp, Homo sapiens
cgtatttatttttttattcttc

SEQ ID NO: 278457 - DNA, 21 bp, Homo sapiens
cgtcaccagaattagtcctca

SEQ ID NO: 278458 - DNA, 19 bp, Homo sapiens
cgtcacgctttcatgacca

SEQ ID NO: 278459 - DNA, 16 bp, Homo sapiens
cgtcactgccagagct

SEQ ID NO: 278460 - DNA, 15 bp, Homo sapiens
cgtcaggaggtgcct

SEQ ID NO: 278461 - DNA, 17 bp, Homo sapiens
cgtcattttgcagtgtg

SEQ ID NO: 278462 - DNA, 20 bp, Homo sapiens
cgtccaaaggagtgcatggc

SEQ ID NO: 278463 - DNA, 17 bp, Homo sapiens
cgtccaaccccggggca

SEQ ID NO: 278464 - DNA, 19 bp, Homo sapiens
cgtccacagagtataaata

SEQ ID NO: 278465 - DNA, 21 bp, Homo sapiens
cgtccacaggggcaggcctgg

SEQ ID NO: 278466 - DNA, 23 bp, Homo sapiens
cgtccacaggggcaggcctggga

SEQ ID NO: 278467 - DNA, 19 bp, Homo sapiens
cgtccacccaggctgcact

SEQ ID NO: 278468 - DNA, 22 bp, Homo sapiens
cgtccacccgtttccaagcctg

SEQ ID NO: 278469 - DNA, 22 bp, Homo sapiens
cgtccactttcccttcccctgt

SEQ ID NO: 278470 - DNA, 13 bp, Homo sapiens
cgtccatctctct

SEQ ID NO: 278471 - DNA, 19 bp, Homo sapiens
cgtccatctctctccctta

SEQ ID NO: 278472 - DNA, 20 bp, Homo sapiens
cgtccatctctctcccttac

SEQ ID NO: 278473 - DNA, 16 bp, Homo sapiens
cgtccatggcaccagc

SEQ ID NO: 278474 - DNA, 17 bp, Homo sapiens
cgtccatggcaccagcc

SEQ ID NO: 278475 - DNA, 11 bp, Homo sapiens
cgtccccaggg

SEQ ID NO: 278476 - DNA, 12 bp, Homo sapiens
cgtccccagggt

SEQ ID NO: 278477 - DNA, 19 bp, Homo sapiens
cgtccccagggtgcaggcg

SEQ ID NO: 278478 - DNA, 22 bp, Homo sapiens
cgtcccctccgccgtgccggcg

SEQ ID NO: 278479 - DNA, 18 bp, Homo sapiens
cgtcccctgggccaccct

SEQ ID NO: 278480 - DNA, 14 bp, Homo sapiens
cgtcccggccccgc

SEQ ID NO: 278481 - DNA, 22 bp, Homo sapiens
cgtcccggccccgcgcgtgccc

SEQ ID NO: 278482 - DNA, 22 bp, Homo sapiens
cgtccctttccctgcatccctt

SEQ ID NO: 278483 - DNA, 23 bp, Homo sapiens
cgtccctttccctgcatcccttg

SEQ ID NO: 278484 - DNA, 10 bp, Homo sapiens
cgtccggcct

SEQ ID NO: 278485 - DNA, 14 bp, Homo sapiens
cgtcctcgtggcgg

SEQ ID NO: 278486 - DNA, 18 bp, Homo sapiens
ctactacccgagcccagc

SEQ ID NO: 278487 - DNA, 19 bp, Homo sapiens
ctactacccgagcccagct

SEQ ID NO: 278488 - DNA, 22 bp, Homo sapiens
ctactagagtctgaacagctgt

SEQ ID NO: 278489 - DNA, 18 bp, Homo sapiens
ctactatggctgagttct

SEQ ID NO: 278490 - DNA, 12 bp, Homo sapiens
ctactattctgt

SEQ ID NO: 278491 - DNA, 23 bp, Homo sapiens
ctactcaccttgaacaccacgct

SEQ ID NO: 278492 - DNA, 21 bp, Homo sapiens
ctactcctctgcagtgccttg

SEQ ID NO: 278493 - DNA, 19 bp, Homo sapiens
ctactcgagttacagacaa

SEQ ID NO: 278494 - DNA, 13 bp, Homo sapiens
ctactctcctcat

SEQ ID NO: 278495 - DNA, 17 bp, Homo sapiens
ctactctcctcggcccc

SEQ ID NO: 278496 - DNA, 15 bp, Homo sapiens
ctactctcttgccag

SEQ ID NO: 278497 - DNA, 17 bp, Homo sapiens
ctactctcttgccagca

SEQ ID NO: 278498 - DNA, 23 bp, Homo sapiens
ctactctcttgccagcattttca

SEQ ID NO: 278499 - DNA, 14 bp, Homo sapiens
ctactctgtccagg

SEQ ID NO: 278500 - DNA, 17 bp, Homo sapiens
ctactctgtccaggcca

SEQ ID NO: 278501 - DNA, 20 bp, Homo sapiens
ctactctgtccaggccactg

SEQ ID NO: 278502 - DNA, 14 bp, Homo sapiens
ctactctgtgccag

SEQ ID NO: 278503 - DNA, 14 bp, Homo sapiens
ctactgaaaatgca

SEQ ID NO: 278504 - DNA, 12 bp, Homo sapiens
ctactgaaattt

SEQ ID NO: 278505 - DNA, 24 bp, Homo sapiens
ctactgaactgttacctaggttaa

SEQ ID NO: 278506 - DNA, 14 bp, Homo sapiens
ctactgacatgtgg

SEQ ID NO: 278507 - DNA, 12 bp, Homo sapiens
ctactgagccac

SEQ ID NO: 278508 - DNA, 16 bp, Homo sapiens
ctactgatttttgtga

SEQ ID NO: 278509 - DNA, 14 bp, Homo sapiens
ctactggcagctcc

SEQ ID NO: 278510 - DNA, 11 bp, Homo sapiens
ctactggctgt

SEQ ID NO: 278511 - DNA, 12 bp, Homo sapiens
ctactggtctgt

SEQ ID NO: 278512 - DNA, 13 bp, Homo sapiens
ctactggtctgta

SEQ ID NO: 278513 - DNA, 12 bp, Homo sapiens
ctactgtgttcc

SEQ ID NO: 278514 - DNA, 15 bp, Homo sapiens
ctacttaaacaaaaa

SEQ ID NO: 278515 - DNA, 22 bp, Homo sapiens
ctacttaaacaaaaactttcca

SEQ ID NO: 278516 - DNA, 19 bp, Homo sapiens
ctacttaattcctttctca

SEQ ID NO: 278517 - DNA, 16 bp, Homo sapiens
ctacttacttagagat

SEQ ID NO: 278518 - DNA, 19 bp, Homo sapiens
ctacttcatagctccttgg

SEQ ID NO: 278519 - DNA, 22 bp, Homo sapiens
ctacttcatagctccttggagc

SEQ ID NO: 278520 - DNA, 15 bp, Homo sapiens
ctacttgggagcctg

SEQ ID NO: 278521 - DNA, 18 bp, Homo sapiens
ctacttgtgactgaaggg

SEQ ID NO: 278522 - DNA, 12 bp, Homo sapiens
ctactttaaatc

SEQ ID NO: 278523 - DNA, 22 bp, Homo sapiens
ctactttgtcccctcacctcca

SEQ ID NO: 278524 - DNA, 17 bp, Homo sapiens
ctactttttccttcctg

SEQ ID NO: 278525 - DNA, 20 bp, Homo sapiens
ctactttttccttcctgccc

SEQ ID NO: 278526 - DNA, 22 bp, Homo sapiens
ctagaaaacaatgcaaaacctt

SEQ ID NO: 278527 - DNA, 12 bp, Homo sapiens
ctagaaaccttt

SEQ ID NO: 278528 - DNA, 14 bp, Homo sapiens
ctagaaagaaaaga

SEQ ID NO: 278529 - DNA, 19 bp, Homo sapiens
ctagaaagccatattccag

SEQ ID NO: 278530 - DNA, 23 bp, Homo sapiens
ctagaaagcccctcacctcagga

SEQ ID NO: 278531 - DNA, 22 bp, Homo sapiens
ctagaaagcctgttcccctcac

SEQ ID NO: 278532 - DNA, 20 bp, Homo sapiens
ctagaaagctctgcatgtgt

SEQ ID NO: 278533 - DNA, 21 bp, Homo sapiens
ctagaaagctctgcatgtgtg

SEQ ID NO: 278534 - DNA, 15 bp, Homo sapiens
ctagaaatatgattt

SEQ ID NO: 278535 - DNA, 18 bp, Homo sapiens
ctagaagctgatctgatt

SEQ ID NO: 278536 - DNA, 23 bp, Homo sapiens
ctagaagggccagtcctgcctgg

SEQ ID NO: 278537 - DNA, 17 bp, Homo sapiens
ctagaaggtttgggaac

SEQ ID NO: 278538 - DNA, 19 bp, Homo sapiens
ctagaataggagaaaatga

SEQ ID NO: 278539 - DNA, 20 bp, Homo sapiens
ctagaatggtttttgttgag

SEQ ID NO: 278540 - DNA, 15 bp, Homo sapiens
ctagaatttattcaa

SEQ ID NO: 278541 - DNA, 22 bp, Homo sapiens
ctagaatttattcaattcctct

SEQ ID NO: 278542 - DNA, 12 bp, Homo sapiens
ctagacagtatt

SEQ ID NO: 278543 - DNA, 16 bp, Homo sapiens
ctagacagtattgcca

SEQ ID NO: 278544 - DNA, 20 bp, Homo sapiens
ctagacagtattgccacctc

SEQ ID NO: 278545 - DNA, 16 bp, Homo sapiens
ctagaccctcccccac

SEQ ID NO: 278546 - DNA, 18 bp, Homo sapiens
ctagaccttgcctcccct

SEQ ID NO: 278547 - DNA, 20 bp, Homo sapiens
ctagacgttcatttgtgtgc

SEQ ID NO: 278548 - DNA, 22 bp, Homo sapiens
ctagactagtgctttaccttta

SEQ ID NO: 278549 - DNA, 16 bp, Homo sapiens
ctagactggagtgagg

SEQ ID NO: 278550 - DNA, 14 bp, Homo sapiens
ctagacttgaaagt

SEQ ID NO: 278551 - DNA, 22 bp, Homo sapiens
ctagacttgaaagttttccagt

SEQ ID NO: 278552 - DNA, 12 bp, Homo sapiens
ctagactttctg

SEQ ID NO: 278553 - DNA, 16 bp, Homo sapiens
ctagagacaaatcttt

SEQ ID NO: 278554 - DNA, 22 bp, Homo sapiens
ctagagacagaagcaggctgga

SEQ ID NO: 278555 - DNA, 23 bp, Homo sapiens
ctagagacagaagcaggctggag

SEQ ID NO: 278556 - DNA, 18 bp, Homo sapiens
ctagagacctctcaacag

SEQ ID NO: 278557 - DNA, 16 bp, Homo sapiens
ctagagacgcaccttg

SEQ ID NO: 278558 - DNA, 19 bp, Homo sapiens
ctagagagggaattctctt

SEQ ID NO: 278559 - DNA, 18 bp, Homo sapiens
ctagagaggggcctctgg

SEQ ID NO: 278560 - DNA, 22 bp, Homo sapiens
ctagagcaacccctgtacccag

SEQ ID NO: 278561 - DNA, 17 bp, Homo sapiens
ctagagcatctgtccca

SEQ ID NO: 278562 - DNA, 20 bp, Homo sapiens
ctagagcattctggggtggg

SEQ ID NO: 278563 - DNA, 23 bp, Homo sapiens
ctagagcattctggggtggggct

SEQ ID NO: 278564 - DNA, 19 bp, Homo sapiens
ctagagctcagtatactaa

SEQ ID NO: 278565 - DNA, 23 bp, Homo sapiens
ctagagcttcaagtctgtgcctg

SEQ ID NO: 278566 - DNA, 21 bp, Homo sapiens
ctagaggcaacagtgttctga

SEQ ID NO: 278567 - DNA, 19 bp, Homo sapiens
ctagaggccagccccaccc

SEQ ID NO: 278568 - DNA, 12 bp, Homo sapiens
ctagaggcctca

SEQ ID NO: 278569 - DNA, 18 bp, Homo sapiens
ctagaggcctgaggatga

SEQ ID NO: 278570 - DNA, 20 bp, Homo sapiens
ctagaggcctgaggatgagc

SEQ ID NO: 278571 - DNA, 15 bp, Homo sapiens
ctagagggttcctgt

SEQ ID NO: 278572 - DNA, 18 bp, Homo sapiens
ctagaggtgggcagctgg

SEQ ID NO: 278573 - DNA, 19 bp, Homo sapiens
ctagagtctgaacagctgt

SEQ ID NO: 278574 - DNA, 13 bp, Homo sapiens
ctagataaaaaga

SEQ ID NO: 278575 - DNA, 19 bp, Homo sapiens
ctagataacttaaataatt

SEQ ID NO: 278576 - DNA, 21 bp, Homo sapiens
ctagataacttaaataattta

SEQ ID NO: 278577 - DNA, 15 bp, Homo sapiens
ctagatcagaacagg

SEQ ID NO: 278578 - DNA, 15 bp, Homo sapiens
ctagatcagagagca

SEQ ID NO: 278579 - DNA, 17 bp, Homo sapiens
ctagatcctgcacccca

SEQ ID NO: 278580 - DNA, 14 bp, Homo sapiens
ctagatctcctgta

SEQ ID NO: 278581 - DNA, 22 bp, Homo sapiens
ctagatgagaattcagctgccc

SEQ ID NO: 278582 - DNA, 13 bp, Homo sapiens
ctagatggtgctg

SEQ ID NO: 278583 - DNA, 14 bp, Homo sapiens
ctagatggtgctga

SEQ ID NO: 278584 - DNA, 20 bp, Homo sapiens
ctagatggttccctttgttg

SEQ ID NO: 278585 - DNA, 17 bp, Homo sapiens
ctagatgtttaacaaat

SEQ ID NO: 278586 - DNA, 16 bp, Homo sapiens
ctagattcactgtctt

SEQ ID NO: 278587 - DNA, 14 bp, Homo sapiens
ctagcaacaactta

SEQ ID NO: 278588 - DNA, 13 bp, Homo sapiens
ctagcaagttgac

SEQ ID NO: 278589 - DNA, 18 bp, Homo sapiens
ctagcacaaggagtgccc

SEQ ID NO: 278590 - DNA, 17 bp, Homo sapiens
ctagcactcacatgctg

SEQ ID NO: 278591 - DNA, 12 bp, Homo sapiens
ctagcaggcagg

SEQ ID NO: 278592 - DNA, 13 bp, Homo sapiens
ctagcaggcagga

SEQ ID NO: 278593 - DNA, 15 bp, Homo sapiens
ctagcaggcatgccg

SEQ ID NO: 278594 - DNA, 14 bp, Homo sapiens
ctagcatagtaaac

SEQ ID NO: 278595 - DNA, 14 bp, Homo sapiens
ctagccaaggctag

SEQ ID NO: 278596 - DNA, 15 bp, Homo sapiens
ctagccaggagtctg

SEQ ID NO: 278597 - DNA, 17 bp, Homo sapiens
ctagccaggagtctgtg

SEQ ID NO: 278598 - DNA, 12 bp, Homo sapiens
ctagccaggcct

SEQ ID NO: 278599 - DNA, 13 bp, Homo sapiens
ctagccatatatt

SEQ ID NO: 278600 - DNA, 12 bp, Homo sapiens
ctagccatggct

SEQ ID NO: 278601 - DNA, 15 bp, Homo sapiens
ctagcccaccctgct

SEQ ID NO: 278602 - DNA, 18 bp, Homo sapiens
ctagcccagtccctggag

SEQ ID NO: 278603 - DNA, 15 bp, Homo sapiens
ctagccccagggtga

SEQ ID NO: 278604 - DNA, 23 bp, Homo sapiens
ctagccctctttctctctgtgtg

SEQ ID NO: 278605 - DNA, 22 bp, Homo sapiens
ctagccctggggtggcgtctgc

SEQ ID NO: 278606 - DNA, 22 bp, Homo sapiens
ctagctaatgtaataactgtga

SEQ ID NO: 278607 - DNA, 17 bp, Homo sapiens
ctagctagaaatatgat

SEQ ID NO: 278608 - DNA, 18 bp, Homo sapiens
ctagctgttgagctgttt

SEQ ID NO: 278609 - DNA, 22 bp, Homo sapiens
ctaggaaagagttgagcacagg

SEQ ID NO: 278610 - DNA, 16 bp, Homo sapiens
ctaggaatcccagagg

SEQ ID NO: 278611 - DNA, 17 bp, Homo sapiens
ctaggaatcccagaggt

SEQ ID NO: 278612 - DNA, 14 bp, Homo sapiens
ctaggactgaggag

SEQ ID NO: 278613 - DNA, 15 bp, Homo sapiens
ctaggagaccagaag

SEQ ID NO: 278614 - DNA, 17 bp, Homo sapiens
ctaggagaccagaagtg

SEQ ID NO: 278615 - DNA, 15 bp, Homo sapiens
ctaggagaggggggc

SEQ ID NO: 278616 - DNA, 13 bp, Homo sapiens
ctaggagcactgt

SEQ ID NO: 278617 - DNA, 11 bp, Homo sapiens
ctaggagctgg

SEQ ID NO: 278618 - DNA, 18 bp, Homo sapiens
ctaggagctggctggcag

SEQ ID NO: 278619 - DNA, 19 bp, Homo sapiens
ctaggagctggctggcagg

SEQ ID NO: 278620 - DNA, 21 bp, Homo sapiens
ctaggagctggctggcaggtg

SEQ ID NO: 278621 - DNA, 17 bp, Homo sapiens
ctaggaggatgctgtgc

SEQ ID NO: 278622 - DNA, 21 bp, Homo sapiens
ctaggaggatgctgtgcctcc

SEQ ID NO: 278623 - DNA, 20 bp, Homo sapiens
ctaggagttaactaccctac

SEQ ID NO: 278624 - DNA, 22 bp, Homo sapiens
ctaggagttgagtacagtgagg

SEQ ID NO: 278625 - DNA, 14 bp, Homo sapiens
ctaggataattttt

SEQ ID NO: 278626 - DNA, 20 bp, Homo sapiens
ctaggcagttagagatgcct

SEQ ID NO: 278627 - DNA, 22 bp, Homo sapiens
ctaggcagttagagatgcctcc

SEQ ID NO: 278628 - DNA, 16 bp, Homo sapiens
ctaggcatactctcca

SEQ ID NO: 278629 - DNA, 20 bp, Homo sapiens
ctaggcatactctccaggat

SEQ ID NO: 278630 - DNA, 20 bp, Homo sapiens
ctaggcatctcctctcccca

SEQ ID NO: 278631 - DNA, 15 bp, Homo sapiens
ctaggcccccaaatt

SEQ ID NO: 278632 - DNA, 13 bp, Homo sapiens
ctaggcctgtagt

SEQ ID NO: 278633 - DNA, 21 bp, Homo sapiens
ctaggctacccttgccaaggc

SEQ ID NO: 278634 - DNA, 13 bp, Homo sapiens
ctaggctgggtgc

SEQ ID NO: 278635 - DNA, 22 bp, Homo sapiens
ctaggctgggtgcccacagccc

SEQ ID NO: 278636 - DNA, 11 bp, Homo sapiens
ctagggaagaa

SEQ ID NO: 278637 - DNA, 17 bp, Homo sapiens
ctagggaaggccacctg

SEQ ID NO: 278638 - DNA, 19 bp, Homo sapiens
ctagggaaggccacctgca

SEQ ID NO: 278639 - DNA, 14 bp, Homo sapiens
ctagggaagggagg

SEQ ID NO: 278640 - DNA, 15 bp, Homo sapiens
ctagggattcaggct

SEQ ID NO: 278641 - DNA, 16 bp, Homo sapiens
ctagggattcaggctg

SEQ ID NO: 278642 - DNA, 17 bp, Homo sapiens
ctagggattcaggctgc

SEQ ID NO: 278643 - DNA, 18 bp, Homo sapiens
ctagggattcaggctgct

SEQ ID NO: 278644 - DNA, 16 bp, Homo sapiens
ctaggggagaagagcc

SEQ ID NO: 278645 - DNA, 12 bp, Homo sapiens
ctaggggccgag

SEQ ID NO: 278646 - DNA, 18 bp, Homo sapiens
ctaggggccgagtccagg

SEQ ID NO: 278647 - DNA, 22 bp, Homo sapiens
ctaggggccgagtccaggagcc

SEQ ID NO: 278648 - DNA, 14 bp, Homo sapiens
ctagggggaagtga

SEQ ID NO: 278649 - DNA, 18 bp, Homo sapiens
ctaggggtcaggctccat

SEQ ID NO: 278650 - DNA, 21 bp, Homo sapiens
ctaggggtgcgctcacctgca

SEQ ID NO: 278651 - DNA, 17 bp, Homo sapiens
ctagggtcctggccctc

SEQ ID NO: 278652 - DNA, 13 bp, Homo sapiens
ctagggtggccct

SEQ ID NO: 278653 - DNA, 19 bp, Homo sapiens
ctagggttgctggagcctg

SEQ ID NO: 278654 - DNA, 23 bp, Homo sapiens
ctagggttgcttgggccactgcc

SEQ ID NO: 278655 - DNA, 17 bp, Homo sapiens
ctagggttttggcctgc

SEQ ID NO: 278656 - DNA, 18 bp, Homo sapiens
ctaggtagaggcatttgt

SEQ ID NO: 278657 - DNA, 20 bp, Homo sapiens
ctaggtagaggcatttgtct

SEQ ID NO: 278658 - DNA, 14 bp, Homo sapiens
ctaggtataaaaaa

SEQ ID NO: 278659 - DNA, 19 bp, Homo sapiens
ctaggtataaaaaataagt

SEQ ID NO: 278660 - DNA, 11 bp, Homo sapiens
ctaggtatcat

SEQ ID NO: 278661 - DNA, 15 bp, Homo sapiens
ctaggtcaaggcctg

SEQ ID NO: 278662 - DNA, 22 bp, Homo sapiens
ctaggtcaaggcctgtccctgg

SEQ ID NO: 278663 - DNA, 20 bp, Homo sapiens
ctaggtcagtacccacctga

SEQ ID NO: 278664 - DNA, 20 bp, Homo sapiens
ctaggtctcctcagggtggg

SEQ ID NO: 278665 - DNA, 18 bp, Homo sapiens
ctaggtgcccagtcttga

SEQ ID NO: 278666 - DNA, 13 bp, Homo sapiens
ctaggtgggccag

SEQ ID NO: 278667 - DNA, 17 bp, Homo sapiens
ctaggtgggccagcccc

SEQ ID NO: 278668 - DNA, 19 bp, Homo sapiens
ctaggtgggccagcccctc

SEQ ID NO: 278669 - DNA, 23 bp, Homo sapiens
ctaggtgggtcaactccaaggca

SEQ ID NO: 278670 - DNA, 13 bp, Homo sapiens
ctaggtgtcccca

SEQ ID NO: 278671 - DNA, 15 bp, Homo sapiens
ctaggtgtccccaac

SEQ ID NO: 278672 - DNA, 23 bp, Homo sapiens
ctaggttaacaaccctgttgagt

SEQ ID NO: 278673 - DNA, 19 bp, Homo sapiens
ctaggtttaactcagatca

SEQ ID NO: 278674 - DNA, 21 bp, Homo sapiens
ctaggtttatctcatttaagc

SEQ ID NO: 278675 - DNA, 12 bp, Homo sapiens
ctagtacaaatt

SEQ ID NO: 278676 - DNA, 22 bp, Homo sapiens
ctagtaggtctgcacacataac

SEQ ID NO: 278677 - DNA, 23 bp, Homo sapiens
ctagtaggtctgcacacataaca

SEQ ID NO: 278678 - DNA, 24 bp, Homo sapiens
ctagtaggtctgcacacataacac

SEQ ID NO: 278679 - DNA, 17 bp, Homo sapiens
ctagtagttcctgctac

SEQ ID NO: 278680 - DNA, 14 bp, Homo sapiens
ctagtatacccact

SEQ ID NO: 278681 - DNA, 16 bp, Homo sapiens
ctagtatacccactgc

SEQ ID NO: 278682 - DNA, 18 bp, Homo sapiens
ctagtatacccactgcat

SEQ ID NO: 278683 - DNA, 14 bp, Homo sapiens
ctagtatctggctg

SEQ ID NO: 278684 - DNA, 18 bp, Homo sapiens
ctagtatctggctgggtt

SEQ ID NO: 278685 - DNA, 21 bp, Homo sapiens
ctagtatcttcaaactttcac

SEQ ID NO: 278686 - DNA, 23 bp, Homo sapiens
ctagtatcttcaaactttcactt

SEQ ID NO: 278687 - DNA, 15 bp, Homo sapiens
ctagtcaactgctgt

SEQ ID NO: 278688 - DNA, 18 bp, Homo sapiens
ctagtcacatatcaagtc

SEQ ID NO: 278689 - DNA, 15 bp, Homo sapiens
ctagtcagatggatg

SEQ ID NO: 278690 - DNA, 22 bp, Homo sapiens
ctagtcagatggatgtagatac

SEQ ID NO: 278691 - DNA, 14 bp, Homo sapiens
ctagtcagccacat

SEQ ID NO: 278692 - DNA, 14 bp, Homo sapiens
ctagtccagtgacc

SEQ ID NO: 278693 - DNA, 20 bp, Homo sapiens
ctagtcccttcccctccctg

SEQ ID NO: 278694 - DNA, 14 bp, Homo sapiens
ctagtccggaccca

SEQ ID NO: 278695 - DNA, 15 bp, Homo sapiens
ctagtccggacccac

SEQ ID NO: 278696 - DNA, 20 bp, Homo sapiens
ctagtcgtgaatcatttctc

SEQ ID NO: 278697 - DNA, 20 bp, Homo sapiens
ctagtcgtggagatgtcttc

SEQ ID NO: 278698 - DNA, 13 bp, Homo sapiens
ctagtctctgatt

SEQ ID NO: 278699 - DNA, 14 bp, Homo sapiens
ctagtgaatgaatc

SEQ ID NO: 278700 - DNA, 23 bp, Homo sapiens
ctagtgactaagccccgcatatg

SEQ ID NO: 278701 - DNA, 17 bp, Homo sapiens
ctagtgagctgggcatg

SEQ ID NO: 278702 - DNA, 21 bp, Homo sapiens
ctagtgattaaacgaggcaat

SEQ ID NO: 278703 - DNA, 13 bp, Homo sapiens
ctagtgcagctga

SEQ ID NO: 278704 - DNA, 14 bp, Homo sapiens
ctagtgcagctgat

SEQ ID NO: 278705 - DNA, 15 bp, Homo sapiens
ctagtgcagctgatt

SEQ ID NO: 278706 - DNA, 21 bp, Homo sapiens
ctagtgctgaagcttattaat

SEQ ID NO: 278707 - DNA, 19 bp, Homo sapiens
ctagtgggagcccagcaca

SEQ ID NO: 278708 - DNA, 20 bp, Homo sapiens
ctagtgggagcccagcacac

SEQ ID NO: 278709 - DNA, 21 bp, Homo sapiens
ctagtggggaggggcctggcc

SEQ ID NO: 278710 - DNA, 23 bp, Homo sapiens
ctagtggggaggggcctggcctg

SEQ ID NO: 278711 - DNA, 19 bp, Homo sapiens
ctagtggtggctctgagaa

SEQ ID NO: 278712 - DNA, 21 bp, Homo sapiens
ctagtgtgagtggcagccatg

SEQ ID NO: 278713 - DNA, 22 bp, Homo sapiens
ctagtgtgagtggcagccatgc

SEQ ID NO: 278714 - DNA, 21 bp, Homo sapiens
ctagtgtttctgcagaggcag

SEQ ID NO: 278715 - DNA, 23 bp, Homo sapiens
ctagtgtttctgcagaggcagca

SEQ ID NO: 278716 - DNA, 19 bp, Homo sapiens
ctagttaagtcgctgaaca

SEQ ID NO: 278717 - DNA, 13 bp, Homo sapiens
ctagttaataatt

SEQ ID NO: 278718 - DNA, 13 bp, Homo sapiens
ctagttaggccac

SEQ ID NO: 278719 - DNA, 19 bp, Homo sapiens
ctagttcatccaatcctca

SEQ ID NO: 278720 - DNA, 21 bp, Homo sapiens
ctagttcatccaatcctcact

SEQ ID NO: 278721 - DNA, 16 bp, Homo sapiens
ctagttccctcagtgt

SEQ ID NO: 278722 - DNA, 18 bp, Homo sapiens
ctagttctcaatcactgc

SEQ ID NO: 278723 - DNA, 16 bp, Homo sapiens
ctagttgtaatgtgta

SEQ ID NO: 278724 - DNA, 15 bp, Homo sapiens
ctagtttaaaattat

SEQ ID NO: 278725 - DNA, 15 bp, Homo sapiens
ctagttttttttgta

SEQ ID NO: 278726 - DNA, 19 bp, Homo sapiens
ctataaatagtgaaaattt

SEQ ID NO: 278727 - DNA, 14 bp, Homo sapiens
ctataaatggactt

SEQ ID NO: 278728 - DNA, 23 bp, Homo sapiens
ctataaatggacttgcttcttgt

SEQ ID NO: 278729 - DNA, 12 bp, Homo sapiens
ctataaatgtga

SEQ ID NO: 278730 - DNA, 22 bp, Homo sapiens
ctataaattcaacacttatttt

SEQ ID NO: 278731 - DNA, 17 bp, Homo sapiens
ctataacaactctattt

SEQ ID NO: 278732 - DNA, 21 bp, Homo sapiens
ctataacatatgtacataaat

SEQ ID NO: 278733 - DNA, 17 bp, Homo sapiens
ctataacccctgcctgg

SEQ ID NO: 278734 - DNA, 23 bp, Homo sapiens
ctataagggagtaggctgtattt

SEQ ID NO: 278735 - DNA, 13 bp, Homo sapiens
ctataattctata

SEQ ID NO: 278736 - DNA, 17 bp, Homo sapiens
ctataattctatactgt

SEQ ID NO: 278737 - DNA, 18 bp, Homo sapiens
ctataattctatactgtt

SEQ ID NO: 278738 - DNA, 15 bp, Homo sapiens
ctataattctattga

SEQ ID NO: 278739 - DNA, 15 bp, Homo sapiens
ctatacatttctgtt

SEQ ID NO: 278740 - DNA, 22 bp, Homo sapiens
ctataccctaggtctccacccc

SEQ ID NO: 278741 - DNA, 14 bp, Homo sapiens
ctatagcagtcatc

SEQ ID NO: 278742 - DNA, 15 bp, Homo sapiens
ctatagcagtcatca

SEQ ID NO: 278743 - DNA, 17 bp, Homo sapiens
ctatagtatagaatgaa

SEQ ID NO: 278744 - DNA, 18 bp, Homo sapiens
ctatagtgtataccacct

SEQ ID NO: 278745 - DNA, 19 bp, Homo sapiens
ctatagtgtataccacctg

SEQ ID NO: 278746 - DNA, 22 bp, Homo sapiens
ctatagtgtataccacctgtac

SEQ ID NO: 278747 - DNA, 15 bp, Homo sapiens
ctatataaaatgtat

SEQ ID NO: 278748 - DNA, 17 bp, Homo sapiens
ctatataaaatgtattc

SEQ ID NO: 278749 - DNA, 16 bp, Homo sapiens
ctatataaataaagca

SEQ ID NO: 278750 - DNA, 22 bp, Homo sapiens
ctatatatacatatacacaaag

SEQ ID NO: 278751 - DNA, 15 bp, Homo sapiens
ctatatatacatgta

SEQ ID NO: 278752 - DNA, 22 bp, Homo sapiens
ctatatatgaataattatgttt

SEQ ID NO: 278753 - DNA, 13 bp, Homo sapiens
ctcagtagaaagg

SEQ ID NO: 278754 - DNA, 13 bp, Homo sapiens
ctcagtcataatc

SEQ ID NO: 278755 - DNA, 16 bp, Homo sapiens
ctcagtccacctgagc

SEQ ID NO: 278756 - DNA, 18 bp, Homo sapiens
ctcagtccagtcctcaca

SEQ ID NO: 278757 - DNA, 15 bp, Homo sapiens
ctcagtccctccctc

SEQ ID NO: 278758 - DNA, 20 bp, Homo sapiens
ccttcccgccgcccgacccc

SEQ ID NO: 278759 - DNA, 19 bp, Homo sapiens
ccttccctccacctgcttg

SEQ ID NO: 278760 - DNA, 18 bp, Homo sapiens
ccttccctccccacagtc

SEQ ID NO: 278761 - DNA, 12 bp, Homo sapiens
ccttccctgcaa

SEQ ID NO: 278762 - DNA, 20 bp, Homo sapiens
ccttccctgctttgaggaca

SEQ ID NO: 278763 - DNA, 17 bp, Homo sapiens
ccttccgctctgaggca

SEQ ID NO: 278764 - DNA, 22 bp, Homo sapiens
ccttccgctgcgggcccagctg

SEQ ID NO: 278765 - DNA, 20 bp, Homo sapiens
ccttcctacacccttggact

SEQ ID NO: 278766 - DNA, 22 bp, Homo sapiens
ccttcctccgctcccctttccc

SEQ ID NO: 278767 - DNA, 16 bp, Homo sapiens
ccttcctcctccacag

SEQ ID NO: 278768 - DNA, 15 bp, Homo sapiens
ccttcctctgcagct

SEQ ID NO: 278769 - DNA, 17 bp, Homo sapiens
ccttcctctgcagctga

SEQ ID NO: 278770 - DNA, 18 bp, Homo sapiens
ccttcctctgcagctgac

SEQ ID NO: 278771 - DNA, 22 bp, Homo sapiens
ccttcctctggggctctagggt

SEQ ID NO: 278772 - DNA, 12 bp, Homo sapiens
ccttcctgactg

SEQ ID NO: 278773 - DNA, 16 bp, Homo sapiens
ccttcctgactgggaa

SEQ ID NO: 278774 - DNA, 23 bp, Homo sapiens
ccttcctgagaaacgtccatctc

SEQ ID NO: 278775 - DNA, 16 bp, Homo sapiens
ccttcctgcagcgcct

SEQ ID NO: 278776 - DNA, 17 bp, Homo sapiens
ccttcctgccacctgct

SEQ ID NO: 278777 - DNA, 18 bp, Homo sapiens
ccttcctgccacctgctg

SEQ ID NO: 278778 - DNA, 16 bp, Homo sapiens
ccttcctgccctgtac

SEQ ID NO: 278779 - DNA, 21 bp, Homo sapiens
ccttcctggactggcccttgc

SEQ ID NO: 278780 - DNA, 12 bp, Homo sapiens
ccttcctggcct

SEQ ID NO: 278781 - DNA, 13 bp, Homo sapiens
ccttcctggcctc

SEQ ID NO: 278782 - DNA, 17 bp, Homo sapiens
ccttcctggcctcactg

SEQ ID NO: 278783 - DNA, 18 bp, Homo sapiens
ccttcctggcctcactgg

SEQ ID NO: 278784 - DNA, 22 bp, Homo sapiens
ccttcctggcctcactggctgg

SEQ ID NO: 278785 - DNA, 23 bp, Homo sapiens
ccttcctggcctcactggctggg

SEQ ID NO: 278786 - DNA, 17 bp, Homo sapiens
ccttcctgggcagccca

SEQ ID NO: 278787 - DNA, 20 bp, Homo sapiens
ccttcctgggcagcccagag

SEQ ID NO: 278788 - DNA, 21 bp, Homo sapiens
ccttcctgggcagcccagaga

SEQ ID NO: 278789 - DNA, 14 bp, Homo sapiens
ccttcctgtcctgc

SEQ ID NO: 278790 - DNA, 16 bp, Homo sapiens
ccttcctgtcctgctc

SEQ ID NO: 278791 - DNA, 12 bp, Homo sapiens
ccttcctgtctt

SEQ ID NO: 278792 - DNA, 15 bp, Homo sapiens
ccttcctgttctgtg

SEQ ID NO: 278793 - DNA, 21 bp, Homo sapiens
ccttcctgttctgtgtctgct

SEQ ID NO: 278794 - DNA, 13 bp, Homo sapiens
ccttccttgacct

SEQ ID NO: 278795 - DNA, 13 bp, Homo sapiens
ccttcctttgtct

SEQ ID NO: 278796 - DNA, 18 bp, Homo sapiens
ccttcctttgtcttacat

SEQ ID NO: 278797 - DNA, 23 bp, Homo sapiens
ccttcgatacaccgggcctggag

SEQ ID NO: 278798 - DNA, 17 bp, Homo sapiens
ccttcgtgtctctccca

SEQ ID NO: 278799 - DNA, 18 bp, Homo sapiens
ccttcgtgtctctcccac

SEQ ID NO: 278800 - DNA, 22 bp, Homo sapiens
ccttcgtgtctctcccaccccg

SEQ ID NO: 278801 - DNA, 20 bp, Homo sapiens
ccttctacactctcctgggc

SEQ ID NO: 278802 - DNA, 22 bp, Homo sapiens
ccttctacactctcctgggccc

SEQ ID NO: 278803 - DNA, 14 bp, Homo sapiens
ccttctacctgcag

SEQ ID NO: 278804 - DNA, 17 bp, Homo sapiens
ccttctactttttcctt

SEQ ID NO: 278805 - DNA, 18 bp, Homo sapiens
ccttctactttttccttc

SEQ ID NO: 278806 - DNA, 20 bp, Homo sapiens
ccttctactttttccttcct

SEQ ID NO: 278807 - DNA, 23 bp, Homo sapiens
ccttctagacactgaaggcaaat

SEQ ID NO: 278808 - DNA, 19 bp, Homo sapiens
ccttctaggtgtggtccca

SEQ ID NO: 278809 - DNA, 12 bp, Homo sapiens
ccttctcagctc

SEQ ID NO: 278810 - DNA, 14 bp, Homo sapiens
ccttctcagctctc

SEQ ID NO: 278811 - DNA, 14 bp, Homo sapiens
ccttctcccagcac

SEQ ID NO: 278812 - DNA, 17 bp, Homo sapiens
ccttctcccctgcactg

SEQ ID NO: 278813 - DNA, 23 bp, Homo sapiens
ccttctcccctgcactgtaaaat

SEQ ID NO: 278814 - DNA, 17 bp, Homo sapiens
ccttctccttccaactg

SEQ ID NO: 278815 - DNA, 22 bp, Homo sapiens
ccttctcgtcttcctctctctc

SEQ ID NO: 278816 - DNA, 23 bp, Homo sapiens
ccttctcgtcttcctctctctca

SEQ ID NO: 278817 - DNA, 21 bp, Homo sapiens
ccttctctactcatgccagat

SEQ ID NO: 278818 - DNA, 17 bp, Homo sapiens
ccttctctcacctccta

SEQ ID NO: 278819 - DNA, 19 bp, Homo sapiens
ccttctctcacctcctaaa

SEQ ID NO: 278820 - DNA, 21 bp, Homo sapiens
ccttctctcttttcttctcag

SEQ ID NO: 278821 - DNA, 17 bp, Homo sapiens
ccttctctgctccacca

SEQ ID NO: 278822 - DNA, 22 bp, Homo sapiens
ccttctctgctccaccacatcc

SEQ ID NO: 278823 - DNA, 17 bp, Homo sapiens
ccttctgacggccctgc

SEQ ID NO: 278824 - DNA, 13 bp, Homo sapiens
ccttctgatgtct

SEQ ID NO: 278825 - DNA, 21 bp, Homo sapiens
ccttctgcccccgttccagct

SEQ ID NO: 278826 - DNA, 20 bp, Homo sapiens
ccttctgctggataaaatga

SEQ ID NO: 278827 - DNA, 15 bp, Homo sapiens
ccttctgctttctat

SEQ ID NO: 278828 - DNA, 13 bp, Homo sapiens
ccttctggccttt

SEQ ID NO: 278829 - DNA, 14 bp, Homo sapiens
ccttctgtccccag

SEQ ID NO: 278830 - DNA, 15 bp, Homo sapiens
ccttctgtccccagc

SEQ ID NO: 278831 - DNA, 13 bp, Homo sapiens
ccttctgtgccca

SEQ ID NO: 278832 - DNA, 22 bp, Homo sapiens
ctccacctcccccaaaccctgc

SEQ ID NO: 278833 - DNA, 12 bp, Homo sapiens
ctccacctcctc

SEQ ID NO: 278834 - DNA, 16 bp, Homo sapiens
ctccacctcctctctt

SEQ ID NO: 278835 - DNA, 18 bp, Homo sapiens
ctccacctgggagatgct

SEQ ID NO: 278836 - DNA, 22 bp, Homo sapiens
ctccacctgggagatgctggga

SEQ ID NO: 278837 - DNA, 18 bp, Homo sapiens
ctccacgttcacccctcc

SEQ ID NO: 278838 - DNA, 18 bp, Homo sapiens
ctccactcactccagccc

SEQ ID NO: 278839 - DNA, 19 bp, Homo sapiens
ctccactcactccagccca

SEQ ID NO: 278840 - DNA, 20 bp, Homo sapiens
ctccactcagggctggcccg

SEQ ID NO: 278841 - DNA, 16 bp, Homo sapiens
ctccactcccctcatc

SEQ ID NO: 278842 - DNA, 12 bp, Homo sapiens
ctccactccttc

SEQ ID NO: 278843 - DNA, 15 bp, Homo sapiens
ctccactccttcctg

SEQ ID NO: 278844 - DNA, 17 bp, Homo sapiens
ctccactctagttctag

SEQ ID NO: 278845 - DNA, 20 bp, Homo sapiens
ctccactctagttctagatg

SEQ ID NO: 278846 - DNA, 18 bp, Homo sapiens
ctccactctgaagtccct

SEQ ID NO: 278847 - DNA, 22 bp, Homo sapiens
ctccactgacctggaagagctg

SEQ ID NO: 278848 - DNA, 12 bp, Homo sapiens
ctccactgccct

SEQ ID NO: 278849 - DNA, 14 bp, Homo sapiens
ctccactgccctct

SEQ ID NO: 278850 - DNA, 15 bp, Homo sapiens
ctccactgccctctg

SEQ ID NO: 278851 - DNA, 11 bp, Homo sapiens
ctccactgcct

SEQ ID NO: 278852 - DNA, 13 bp, Homo sapiens
ctccactgccttc

SEQ ID NO: 278853 - DNA, 14 bp, Homo sapiens
ctccactgccttcg

SEQ ID NO: 278854 - DNA, 13 bp, Homo sapiens
ctccactggatgg

SEQ ID NO: 278855 - DNA, 14 bp, Homo sapiens
ctccactggatgga

SEQ ID NO: 278856 - DNA, 13 bp, Homo sapiens
ctccactggcctg

SEQ ID NO: 278857 - DNA, 19 bp, Homo sapiens
ctccacttctggtcccctg

SEQ ID NO: 278858 - DNA, 21 bp, Homo sapiens
ctccacttcttgttccccact

SEQ ID NO: 278859 - DNA, 22 bp, Homo sapiens
ctccagaacaaacctctatatg

SEQ ID NO: 278860 - DNA, 18 bp, Homo sapiens
ctccagaagcctctggct

SEQ ID NO: 278861 - DNA, 20 bp, Homo sapiens
ctccagaagcctctggctag

SEQ ID NO: 278862 - DNA, 21 bp, Homo sapiens
ctccagaagcctctggctaga

SEQ ID NO: 278863 - DNA, 18 bp, Homo sapiens
ctccagaatctgctgttg

SEQ ID NO: 278864 - DNA, 20 bp, Homo sapiens
ctccagaatctgctgttgcc

SEQ ID NO: 278865 - DNA, 19 bp, Homo sapiens
ctccagaatgtaagaaaac

SEQ ID NO: 278866 - DNA, 17 bp, Homo sapiens
ctccagacattgtattt

SEQ ID NO: 278867 - DNA, 12 bp, Homo sapiens
ctccagacccct

SEQ ID NO: 278868 - DNA, 23 bp, Homo sapiens
ctccagacccctaccctttccca

SEQ ID NO: 278869 - DNA, 20 bp, Homo sapiens
ctccagacccctggcttttc

SEQ ID NO: 278870 - DNA, 18 bp, Homo sapiens
ctccagaccctgcctgag

SEQ ID NO: 278871 - DNA, 19 bp, Homo sapiens
ctccagaccctgcctgagc

SEQ ID NO: 278872 - DNA, 21 bp, Homo sapiens
ctccagaccctgcctgagccc

SEQ ID NO: 278873 - DNA, 18 bp, Homo sapiens
ctccagagccagcctggg

SEQ ID NO: 278874 - DNA, 21 bp, Homo sapiens
ctccagagccagcctgggact

SEQ ID NO: 278875 - DNA, 15 bp, Homo sapiens
ctccagagtaggtgg

SEQ ID NO: 278876 - DNA, 20 bp, Homo sapiens
ctccagagtaggtgggtctt

SEQ ID NO: 278877 - DNA, 15 bp, Homo sapiens
ctccagagtctgagc

SEQ ID NO: 278878 - DNA, 16 bp, Homo sapiens
ctccagagtctgagcc

SEQ ID NO: 278879 - DNA, 19 bp, Homo sapiens
ctccagagtctgagccccc

SEQ ID NO: 278880 - DNA, 21 bp, Homo sapiens
ctccagcacagactgttccct

SEQ ID NO: 278881 - DNA, 14 bp, Homo sapiens
ctccagcatccagc

SEQ ID NO: 278882 - DNA, 18 bp, Homo sapiens
ctccagcatccagcctgt

SEQ ID NO: 278883 - DNA, 19 bp, Homo sapiens
ctccagcatccagcctgtg

SEQ ID NO: 278884 - DNA, 18 bp, Homo sapiens
ctccagccacccagccag

SEQ ID NO: 278885 - DNA, 12 bp, Homo sapiens
ctccagccagca

SEQ ID NO: 278886 - DNA, 13 bp, Homo sapiens
ctccagccagcaa

SEQ ID NO: 278887 - DNA, 16 bp, Homo sapiens
ctccagccagcaatga

SEQ ID NO: 278888 - DNA, 19 bp, Homo sapiens
ctccagcccacagtgctca

SEQ ID NO: 278889 - DNA, 20 bp, Homo sapiens
ctccagcccacagtgctcag

SEQ ID NO: 278890 - DNA, 23 bp, Homo sapiens
ctccagcccgagtggtctcctct

SEQ ID NO: 278891 - DNA, 14 bp, Homo sapiens
ctccagcctcccct

SEQ ID NO: 278892 - DNA, 16 bp, Homo sapiens
ctccagcctcccctcc

SEQ ID NO: 278893 - DNA, 23 bp, Homo sapiens
ctccagcctcccctcccctgggg

SEQ ID NO: 278894 - DNA, 17 bp, Homo sapiens
ctccagcctctcccggc

SEQ ID NO: 278895 - DNA, 18 bp, Homo sapiens
ctccagcctctcccggct

SEQ ID NO: 278896 - DNA, 19 bp, Homo sapiens
ctccagcctctcccggctg

SEQ ID NO: 278897 - DNA, 23 bp, Homo sapiens
ctccagcctctcccggctgcctg

SEQ ID NO: 278898 - DNA, 11 bp, Homo sapiens
ctccagcttct

SEQ ID NO: 278899 - DNA, 17 bp, Homo sapiens
ctccaggaacattccca

SEQ ID NO: 278900 - DNA, 15 bp, Homo sapiens
ctccaggaaggggct

SEQ ID NO: 278901 - DNA, 17 bp, Homo sapiens
ctccaggacttgcttcc

SEQ ID NO: 278902 - DNA, 23 bp, Homo sapiens
ctccaggacttgcttccaagccc

SEQ ID NO: 278903 - DNA, 22 bp, Homo sapiens
ctccaggagaggagcgggacct

SEQ ID NO: 278904 - DNA, 14 bp, Homo sapiens
ctccaggatcctcc

SEQ ID NO: 278905 - DNA, 17 bp, Homo sapiens
ctccaggattgtccaca

SEQ ID NO: 278906 - DNA, 18 bp, Homo sapiens
ctccaggattgtccacaa

SEQ ID NO: 278907 - DNA, 22 bp, Homo sapiens
ctccaggattgtccacaaatgt

SEQ ID NO: 278908 - DNA, 23 bp, Homo sapiens
ctccaggcatgctggcctcccaa

SEQ ID NO: 278909 - DNA, 13 bp, Homo sapiens
ctccaggccagct

SEQ ID NO: 278910 - DNA, 16 bp, Homo sapiens
ctccaggccagctcct

SEQ ID NO: 278911 - DNA, 14 bp, Homo sapiens
ctccaggcccagcc

SEQ ID NO: 278912 - DNA, 11 bp, Homo sapiens
ctccaggctgg

SEQ ID NO: 278913 - DNA, 12 bp, Homo sapiens
ctccaggctggg

SEQ ID NO: 278914 - DNA, 15 bp, Homo sapiens
ctccaggctggggcc

SEQ ID NO: 278915 - DNA, 20 bp, Homo sapiens
ctccaggctggggcctggcc

SEQ ID NO: 278916 - DNA, 22 bp, Homo sapiens
ctccaggctggggcctggccta

SEQ ID NO: 278917 - DNA, 23 bp, Homo sapiens
ctccaggctggggcctggcctat

SEQ ID NO: 278918 - DNA, 15 bp, Homo sapiens
ctccagggagcaaga

SEQ ID NO: 278919 - DNA, 21 bp, Homo sapiens
ctccagggagtcccctccccg

SEQ ID NO: 278920 - DNA, 13 bp, Homo sapiens
ctccagggccccc

SEQ ID NO: 278921 - DNA, 15 bp, Homo sapiens
ctccagggcccccca

SEQ ID NO: 278922 - DNA, 14 bp, Homo sapiens
ctccagggctgccc

SEQ ID NO: 278923 - DNA, 16 bp, Homo sapiens
ctccagggctgcccct

SEQ ID NO: 278924 - DNA, 14 bp, Homo sapiens
ctccaggggcacct

SEQ ID NO: 278925 - DNA, 23 bp, Homo sapiens
ctccaggggcccttgggacagcc

SEQ ID NO: 278926 - DNA, 16 bp, Homo sapiens
ctccagggggcctgca

SEQ ID NO: 278927 - DNA, 22 bp, Homo sapiens
ctccagggtcttgggctactgg

SEQ ID NO: 278928 - DNA, 17 bp, Homo sapiens
ctccaggtgattctgat

SEQ ID NO: 278929 - DNA, 12 bp, Homo sapiens
ctccaggtgccc

SEQ ID NO: 278930 - DNA, 14 bp, Homo sapiens
ctccaggtgccctg

SEQ ID NO: 278931 - DNA, 18 bp, Homo sapiens
ctccaggtgccctgtggg

SEQ ID NO: 278932 - DNA, 14 bp, Homo sapiens
ctccaggttcgtat

SEQ ID NO: 278933 - DNA, 18 bp, Homo sapiens
ctccagtacgtcccgctg

SEQ ID NO: 278934 - DNA, 20 bp, Homo sapiens
ctccagtattcttgtcaaaa

SEQ ID NO: 278935 - DNA, 21 bp, Homo sapiens
ctccagtccccctatccttgg

SEQ ID NO: 278936 - DNA, 23 bp, Homo sapiens
ctccagtccccctatccttggca

SEQ ID NO: 278937 - DNA, 20 bp, Homo sapiens
ctccagtcctgctctctacc

SEQ ID NO: 278938 - DNA, 23 bp, Homo sapiens
ctccagtcctgctctctacccag

SEQ ID NO: 278939 - DNA, 17 bp, Homo sapiens
ctccagtctgctgccct

SEQ ID NO: 278940 - DNA, 21 bp, Homo sapiens
ctccagtctgctgccctccat

SEQ ID NO: 278941 - DNA, 16 bp, Homo sapiens
ctccagtctgttctca

SEQ ID NO: 278942 - DNA, 19 bp, Homo sapiens
ctccagtctgttctcacat

SEQ ID NO: 278943 - DNA, 15 bp, Homo sapiens
ctccagtgcttggct

SEQ ID NO: 278944 - DNA, 20 bp, Homo sapiens
ctccagtgcttggctgcccc

SEQ ID NO: 278945 - DNA, 21 bp, Homo sapiens
ctccagtgcttggctgcccca

SEQ ID NO: 278946 - DNA, 16 bp, Homo sapiens
ctccagtgttgcctcc

SEQ ID NO: 278947 - DNA, 19 bp, Homo sapiens
ctccagtgttgcctcctcc

SEQ ID NO: 278948 - DNA, 20 bp, Homo sapiens
ctccagtgttgcctcctccc

SEQ ID NO: 278949 - DNA, 13 bp, Homo sapiens
ctccatacagcct

SEQ ID NO: 278950 - DNA, 21 bp, Homo sapiens
ctccatacagcctctacagcc

SEQ ID NO: 278951 - DNA, 22 bp, Homo sapiens
ctccatagttctgactcctgaa

SEQ ID NO: 278952 - DNA, 17 bp, Homo sapiens
ctccatatcagctctct

SEQ ID NO: 278953 - DNA, 15 bp, Homo sapiens
ctccatcataggctg

SEQ ID NO: 278954 - DNA, 18 bp, Homo sapiens
ctccatcataggctgaca

SEQ ID NO: 278955 - DNA, 16 bp, Homo sapiens
ctccatcatatgcctg

SEQ ID NO: 278956 - DNA, 18 bp, Homo sapiens
ctccatcatatgcctgac

SEQ ID NO: 278957 - DNA, 20 bp, Homo sapiens
ctccatcatatgcctgaccc

SEQ ID NO: 278958 - DNA, 14 bp, Homo sapiens
ctccatccccatgt

SEQ ID NO: 278959 - DNA, 11 bp, Homo sapiens
ctccatcccct

SEQ ID NO: 278960 - DNA, 16 bp, Homo sapiens
ctccatcccctccctg

SEQ ID NO: 278961 - DNA, 17 bp, Homo sapiens
ctccatcccctccctgc

SEQ ID NO: 278962 - DNA, 19 bp, Homo sapiens
ctccatcccctccctgcct

SEQ ID NO: 278963 - DNA, 21 bp, Homo sapiens
ctccatcccctccctgcctgc

SEQ ID NO: 278964 - DNA, 23 bp, Homo sapiens
ctccatcccctccctgcctgctc

SEQ ID NO: 278965 - DNA, 16 bp, Homo sapiens
ctcctgcatccctcca

SEQ ID NO: 278966 - DNA, 18 bp, Homo sapiens
ctcctgcatccctccacc

SEQ ID NO: 278967 - DNA, 15 bp, Homo sapiens
ctcctgcccagctct

SEQ ID NO: 278968 - DNA, 21 bp, Homo sapiens
ctcctgcccagctctgaccct

SEQ ID NO: 278969 - DNA, 13 bp, Homo sapiens
ctcctgccccctg

SEQ ID NO: 278970 - DNA, 16 bp, Homo sapiens
ctcctgccccctgcca

SEQ ID NO: 278971 - DNA, 12 bp, Homo sapiens
ctcctgcctcag

SEQ ID NO: 278972 - DNA, 15 bp, Homo sapiens
ctcctgcctcagcct

SEQ ID NO: 278973 - DNA, 21 bp, Homo sapiens
ctcctgcctcagcctcctgag

SEQ ID NO: 278974 - DNA, 12 bp, Homo sapiens
ctcctgcctgtg

SEQ ID NO: 278975 - DNA, 14 bp, Homo sapiens
ctcctgctgagtgg

SEQ ID NO: 278976 - DNA, 14 bp, Homo sapiens
ctcctgctggctga

SEQ ID NO: 278977 - DNA, 17 bp, Homo sapiens
ctcctgctggctgaggc

SEQ ID NO: 278978 - DNA, 21 bp, Homo sapiens
ctcctggacccagcaggggca

SEQ ID NO: 278979 - DNA, 19 bp, Homo sapiens
ctcctggagcatcccaggc

SEQ ID NO: 278980 - DNA, 19 bp, Homo sapiens
ctcctggagcctttgaata

SEQ ID NO: 278981 - DNA, 19 bp, Homo sapiens
ctcctggcacccagagaaa

SEQ ID NO: 278982 - DNA, 20 bp, Homo sapiens
ctcctggcctcaagccatct

SEQ ID NO: 278983 - DNA, 15 bp, Homo sapiens
ctcctggctcacagc

SEQ ID NO: 278984 - DNA, 17 bp, Homo sapiens
ctcctggctcacagcca

SEQ ID NO: 278985 - DNA, 13 bp, Homo sapiens
ctcctggctgcca

SEQ ID NO: 278986 - DNA, 12 bp, Homo sapiens
ctcctgggaagg

SEQ ID NO: 278987 - DNA, 23 bp, Homo sapiens
ctcctgggaaggctactcacctt

SEQ ID NO: 278988 - DNA, 16 bp, Homo sapiens
ctcctgggccagggtc

SEQ ID NO: 278989 - DNA, 17 bp, Homo sapiens
ctcctgggccagggtct

SEQ ID NO: 278990 - DNA, 11 bp, Homo sapiens
ctcctgggccc

SEQ ID NO: 278991 - DNA, 15 bp, Homo sapiens
ctcctgggcccaggc

SEQ ID NO: 278992 - DNA, 16 bp, Homo sapiens
ctcctgggcccaggca

SEQ ID NO: 278993 - DNA, 13 bp, Homo sapiens
ctcctgggcccct

SEQ ID NO: 278994 - DNA, 14 bp, Homo sapiens
ctcctgggggttct

SEQ ID NO: 278995 - DNA, 22 bp, Homo sapiens
ctcctgggggttctttcttcct

SEQ ID NO: 278996 - DNA, 14 bp, Homo sapiens
ctcctggtagcatg

SEQ ID NO: 278997 - DNA, 23 bp, Homo sapiens
ctcctggtcttgagatgtcttct

SEQ ID NO: 278998 - DNA, 20 bp, Homo sapiens
ctcctgtacatatagccctt

SEQ ID NO: 278999 - DNA, 13 bp, Homo sapiens
ctcctgtcccgcc

SEQ ID NO: 279000 - DNA, 12 bp, Homo sapiens
ctcctgtctggc

SEQ ID NO: 279001 - DNA, 17 bp, Homo sapiens
ctcctgtgcatgggtga

SEQ ID NO: 279002 - DNA, 20 bp, Homo sapiens
ctcctgtgcatgggtgaagg

SEQ ID NO: 279003 - DNA, 11 bp, Homo sapiens
ctcctgtgccc

SEQ ID NO: 279004 - DNA, 11 bp, Homo sapiens
ctcctgtgtaa

SEQ ID NO: 279005 - DNA, 13 bp, Homo sapiens
ctcctgttcctgc

SEQ ID NO: 279006 - DNA, 14 bp, Homo sapiens
ctcctgttgccaca

SEQ ID NO: 279007 - DNA, 18 bp, Homo sapiens
ctcctgtttcccttccct

SEQ ID NO: 279008 - DNA, 21 bp, Homo sapiens
ctccttaaagttctgggcagc

SEQ ID NO: 279009 - DNA, 19 bp, Homo sapiens
ctccttactctgagcccag

SEQ ID NO: 279010 - DNA, 21 bp, Homo sapiens
ctccttactctgagcccaggc

SEQ ID NO: 279011 - DNA, 22 bp, Homo sapiens
ctccttagaaaagactgacctt

SEQ ID NO: 279012 - DNA, 16 bp, Homo sapiens
ctccttagtcttctca

SEQ ID NO: 279013 - DNA, 19 bp, Homo sapiens
ctccttcatgcttttctca

SEQ ID NO: 279014 - DNA, 15 bp, Homo sapiens
ctccttccaactgct

SEQ ID NO: 279015 - DNA, 11 bp, Homo sapiens
ctccttccagc

SEQ ID NO: 279016 - DNA, 13 bp, Homo sapiens
ctccttcccactg

SEQ ID NO: 279017 - DNA, 15 bp, Homo sapiens
ctccttcccactgtc

SEQ ID NO: 279018 - DNA, 17 bp, Homo sapiens
ctccttcccactgtcct

SEQ ID NO: 279019 - DNA, 17 bp, Homo sapiens
ctccttcccatgcctgt

SEQ ID NO: 279020 - DNA, 16 bp, Homo sapiens
ctccttcccccagccc

SEQ ID NO: 279021 - DNA, 19 bp, Homo sapiens
ctccttcccccagcccaat

SEQ ID NO: 279022 - DNA, 20 bp, Homo sapiens
ctccttcccccagcccaata

SEQ ID NO: 279023 - DNA, 22 bp, Homo sapiens
ctccttcccccagcccaataaa

SEQ ID NO: 279024 - DNA, 23 bp, Homo sapiens
ctccttcccccagcccaataaag

SEQ ID NO: 279025 - DNA, 16 bp, Homo sapiens
ctccttccctggtcca

SEQ ID NO: 279026 - DNA, 21 bp, Homo sapiens
ctccttcctgccacctgctgc

SEQ ID NO: 279027 - DNA, 15 bp, Homo sapiens
ctccttcgtgtctct

SEQ ID NO: 279028 - DNA, 21 bp, Homo sapiens
ctccttcgtgtctctcccacc

SEQ ID NO: 279029 - DNA, 10 bp, Homo sapiens
ctccttctcc

SEQ ID NO: 279030 - DNA, 16 bp, Homo sapiens
ctccttctcccctcca

SEQ ID NO: 279031 - DNA, 19 bp, Homo sapiens
ctccttctcccctccagac

SEQ ID NO: 279032 - DNA, 12 bp, Homo sapiens
ctccttctcctt

SEQ ID NO: 279033 - DNA, 15 bp, Homo sapiens
ctccttctccttccc

SEQ ID NO: 279034 - DNA, 14 bp, Homo sapiens
ctccttcttgccct

SEQ ID NO: 279035 - DNA, 18 bp, Homo sapiens
ctccttcttgccctgagc

SEQ ID NO: 279036 - DNA, 12 bp, Homo sapiens
ctccttgccacc

SEQ ID NO: 279037 - DNA, 17 bp, Homo sapiens
ctccttgccccagtcct

SEQ ID NO: 279038 - DNA, 18 bp, Homo sapiens
ctccttgccccagtcctg

SEQ ID NO: 279039 - DNA, 13 bp, Homo sapiens
ctccttgccctgg

SEQ ID NO: 279040 - DNA, 14 bp, Homo sapiens
ctccttgccctggg

SEQ ID NO: 279041 - DNA, 15 bp, Homo sapiens
ctccttgccctgggc

SEQ ID NO: 279042 - DNA, 13 bp, Homo sapiens
ctccttggcaccc

SEQ ID NO: 279043 - DNA, 15 bp, Homo sapiens
ctccttggcaccccc

SEQ ID NO: 279044 - DNA, 21 bp, Homo sapiens
ctccttggcacccccatgctg

SEQ ID NO: 279045 - DNA, 11 bp, Homo sapiens
ctccttggcct

SEQ ID NO: 279046 - DNA, 14 bp, Homo sapiens
ctccttggcctagc

SEQ ID NO: 279047 - DNA, 22 bp, Homo sapiens
ctccttggcctagcccaccctg

SEQ ID NO: 279048 - DNA, 13 bp, Homo sapiens
ctccttgggctcc

SEQ ID NO: 279049 - DNA, 14 bp, Homo sapiens
ctccttgggctcct

SEQ ID NO: 279050 - DNA, 20 bp, Homo sapiens
ctccttgggctcctggctgc

SEQ ID NO: 279051 - DNA, 14 bp, Homo sapiens
ctccttgttcctag

SEQ ID NO: 279052 - DNA, 15 bp, Homo sapiens
ctccttgttcctaga

SEQ ID NO: 279053 - DNA, 21 bp, Homo sapiens
ctcctttaaagagagtttgta

SEQ ID NO: 279054 - DNA, 22 bp, Homo sapiens
ctcctttaacccaatggagact

SEQ ID NO: 279055 - DNA, 16 bp, Homo sapiens
ctcctttcacaacctt

SEQ ID NO: 279056 - DNA, 17 bp, Homo sapiens
ctcctttcacaaccttc

SEQ ID NO: 279057 - DNA, 16 bp, Homo sapiens
ctcctttcccacagtc

SEQ ID NO: 279058 - DNA, 14 bp, Homo sapiens
ctcctttgcactga

SEQ ID NO: 279059 - DNA, 16 bp, Homo sapiens
ctcctttgcactgagg

SEQ ID NO: 279060 - DNA, 20 bp, Homo sapiens
ctcctttgcactgagggcca

SEQ ID NO: 279061 - DNA, 21 bp, Homo sapiens
ctcctttgcactgagggccac

SEQ ID NO: 279062 - DNA, 24 bp, Homo sapiens
ctccttttcacagttctctccttc

SEQ ID NO: 279063 - DNA, 13 bp, Homo sapiens
ctccttttctctt

SEQ ID NO: 279064 - DNA, 14 bp, Homo sapiens
ctccttttctgtga

SEQ ID NO: 279065 - DNA, 18 bp, Homo sapiens
ctcgaacccacactgcaa

SEQ ID NO: 279066 - DNA, 14 bp, Homo sapiens
ctcgaactcctgac

SEQ ID NO: 279067 - DNA, 14 bp, Homo sapiens
ctcgaactcctggg

SEQ ID NO: 279068 - DNA, 16 bp, Homo sapiens
ctcgagaccatcctgg

SEQ ID NO: 279069 - DNA, 22 bp, Homo sapiens
ctcgagaccatcctggcccctc

SEQ ID NO: 279070 - DNA, 15 bp, Homo sapiens
ctcgagagggctgag

SEQ ID NO: 279071 - DNA, 17 bp, Homo sapiens
ctcgagagggctgagcc

SEQ ID NO: 279072 - DNA, 22 bp, Homo sapiens
ctcgagagggctgagcccctcc

SEQ ID NO: 279073 - DNA, 23 bp, Homo sapiens
ctcgagcagtcctgcctcagcct

SEQ ID NO: 279074 - DNA, 16 bp, Homo sapiens
ctcgagccccctggat

SEQ ID NO: 279075 - DNA, 14 bp, Homo sapiens
ctcgaggcaccggc

SEQ ID NO: 279076 - DNA, 19 bp, Homo sapiens
ctcgaggcaccggcgctgc

SEQ ID NO: 279077 - DNA, 20 bp, Homo sapiens
ctcgaggcaccggcgctgca

SEQ ID NO: 279078 - DNA, 22 bp, Homo sapiens
ctcgaggcaccggcgctgcagg

SEQ ID NO: 279079 - DNA, 20 bp, Homo sapiens
ctcgagttacagacaaagcg

SEQ ID NO: 279080 - DNA, 14 bp, Homo sapiens
ctcgatgcactgac

SEQ ID NO: 279081 - DNA, 18 bp, Homo sapiens
ctcgatgtccagctgctg

SEQ ID NO: 279082 - DNA, 19 bp, Homo sapiens
ctcgcagcacccacagcac

SEQ ID NO: 279083 - DNA, 17 bp, Homo sapiens
ctcgcatccgcctctga

SEQ ID NO: 279084 - DNA, 19 bp, Homo sapiens
ctcgcatccgcctctgagc

SEQ ID NO: 279085 - DNA, 23 bp, Homo sapiens
ctcgcatccgcctctgagccagg

SEQ ID NO: 279086 - DNA, 22 bp, Homo sapiens
ctcgccaaccgcatctgctcat

SEQ ID NO: 279087 - DNA, 14 bp, Homo sapiens
ctcgccccacccag

SEQ ID NO: 279088 - DNA, 17 bp, Homo sapiens
ctcgccccatccctgct

SEQ ID NO: 279089 - DNA, 16 bp, Homo sapiens
ctcgcccctccagtgt

SEQ ID NO: 279090 - DNA, 16 bp, Homo sapiens
ctcgcctaggcctgtg

SEQ ID NO: 279091 - DNA, 18 bp, Homo sapiens
ctcgccttctgcttccac

SEQ ID NO: 279092 - DNA, 19 bp, Homo sapiens
ctcgcggcgcagcccctgg

SEQ ID NO: 279093 - DNA, 16 bp, Homo sapiens
ctcgctcccctctgcc

SEQ ID NO: 279094 - DNA, 18 bp, Homo sapiens
ctcgctgcacaaatactc

SEQ ID NO: 279095 - DNA, 12 bp, Homo sapiens
ctcgctgctgct

SEQ ID NO: 279096 - DNA, 24 bp, Homo sapiens
ctcgctgctgctactacccgagcc

SEQ ID NO: 279097 - DNA, 15 bp, Homo sapiens
ctcgctgcttctgtg

SEQ ID NO: 279098 - DNA, 11 bp, Homo sapiens
ctcgctgtgcc

SEQ ID NO: 279099 - DNA, 14 bp, Homo sapiens
ctcgctgtgccacc

SEQ ID NO: 279100 - DNA, 23 bp, Homo sapiens
ctcgcttcacggacaggaagcac

SEQ ID NO: 279101 - DNA, 20 bp, Homo sapiens
ctcgcttcataggcagagcc

SEQ ID NO: 279102 - DNA, 19 bp, Homo sapiens
ctcggaactgcatgctgct

SEQ ID NO: 279103 - DNA, 20 bp, Homo sapiens
ctcggacccaccccaactct

SEQ ID NO: 279104 - DNA, 12 bp, Homo sapiens
ctcggagcctgt

SEQ ID NO: 279105 - DNA, 16 bp, Homo sapiens
ctcggagcctgtgtta

SEQ ID NO: 279106 - DNA, 14 bp, Homo sapiens
ctcggaggccaggc

SEQ ID NO: 279107 - DNA, 16 bp, Homo sapiens
ctcggaggccaggccc

SEQ ID NO: 279108 - DNA, 17 bp, Homo sapiens
ctcggaggccaggccct

SEQ ID NO: 279109 - DNA, 20 bp, Homo sapiens
ctcggaggccaggccctcct

SEQ ID NO: 279110 - DNA, 17 bp, Homo sapiens
ctcggagtatctgggaa

SEQ ID NO: 279111 - DNA, 20 bp, Homo sapiens
ctcggagtatctgggaactg

SEQ ID NO: 279112 - DNA, 19 bp, Homo sapiens
ctcggcagaactctctgtc

SEQ ID NO: 279113 - DNA, 13 bp, Homo sapiens
ctcggccagagct

SEQ ID NO: 279114 - DNA, 24 bp, Homo sapiens
ctcggccagagctcccaggacgca

SEQ ID NO: 279115 - DNA, 21 bp, Homo sapiens
ctcggccgtcttcactcgccc

SEQ ID NO: 279116 - DNA, 21 bp, Homo sapiens
ctcggctggaagaacatcaag

SEQ ID NO: 279117 - DNA, 13 bp, Homo sapiens
ctcggctgtggag

SEQ ID NO: 279118 - DNA, 17 bp, Homo sapiens
ctcggcttgtgggctgg

SEQ ID NO: 279119 - DNA, 20 bp, Homo sapiens
ctcggcttgtgggctggtgc

SEQ ID NO: 279120 - DNA, 20 bp, Homo sapiens
ctcgggagcattctgcctgc

SEQ ID NO: 279121 - DNA, 19 bp, Homo sapiens
ctcgggcaagggccgtgcc

SEQ ID NO: 279122 - DNA, 17 bp, Homo sapiens
ctcgggccgcctcctcc

SEQ ID NO: 279123 - DNA, 16 bp, Homo sapiens
ctcgggcgcctgcgct

SEQ ID NO: 279124 - DNA, 13 bp, Homo sapiens
ctcggggcagggc

SEQ ID NO: 279125 - DNA, 14 bp, Homo sapiens
ctcggggcagggca

SEQ ID NO: 279126 - DNA, 15 bp, Homo sapiens
ctcggtcacctgtgc

SEQ ID NO: 279127 - DNA, 16 bp, Homo sapiens
ctcgtagatgctgcct

SEQ ID NO: 279128 - DNA, 17 bp, Homo sapiens
ctcgtagatgctgccta

SEQ ID NO: 279129 - DNA, 18 bp, Homo sapiens
ctcgtatatgtctcaggt

SEQ ID NO: 279130 - DNA, 20 bp, Homo sapiens
ctcgtatatgtctcaggtcc

SEQ ID NO: 279131 - DNA, 15 bp, Homo sapiens
ctcgtatctccttga

SEQ ID NO: 279132 - DNA, 17 bp, Homo sapiens
ctcgtccacaggggcag

SEQ ID NO: 279133 - DNA, 16 bp, Homo sapiens
ctcgtccggcctgcag

SEQ ID NO: 279134 - DNA, 14 bp, Homo sapiens
ctcgtcctgtccca

SEQ ID NO: 279135 - DNA, 17 bp, Homo sapiens
ctcgtcctgtcccagag

SEQ ID NO: 279136 - DNA, 21 bp, Homo sapiens
ctcgtctgatgttttgatgcc

SEQ ID NO: 279137 - DNA, 19 bp, Homo sapiens
ctcgtcttcctctctctca

SEQ ID NO: 279138 - DNA, 20 bp, Homo sapiens
ctcgtggacacctgccctgc

SEQ ID NO: 279139 - DNA, 21 bp, Homo sapiens
ctcgtggacacctgccctgcc

SEQ ID NO: 279140 - DNA, 23 bp, Homo sapiens
ctcgtggccttccccttttgcct

SEQ ID NO: 279141 - DNA, 15 bp, Homo sapiens
ctcgtgggctctggc

SEQ ID NO: 279142 - DNA, 18 bp, Homo sapiens
ctcgtgggctctggctcc

SEQ ID NO: 279143 - DNA, 20 bp, Homo sapiens
ctcgtgggctctggctccct

SEQ ID NO: 279144 - DNA, 20 bp, Homo sapiens
ctcgtgggttcttcctctgt

SEQ ID NO: 279145 - DNA, 17 bp, Homo sapiens
ctcgtggtagaagccag

SEQ ID NO: 279146 - DNA, 21 bp, Homo sapiens
ctcgtggttattagcaaggct

SEQ ID NO: 279147 - DNA, 23 bp, Homo sapiens
ctcgtggttattagcaaggctgg

SEQ ID NO: 279148 - DNA, 20 bp, Homo sapiens
ctcgtgtatcctggggctcc

SEQ ID NO: 279149 - DNA, 13 bp, Homo sapiens
ctcgtgtgcatga

SEQ ID NO: 279150 - DNA, 21 bp, Homo sapiens
ctcgtgtgcatgagaatgtca

SEQ ID NO: 279151 - DNA, 17 bp, Homo sapiens
ctcgtttgatagtgctt

SEQ ID NO: 279152 - DNA, 20 bp, Homo sapiens
ctctaaaaataaaatgatgt

SEQ ID NO: 279153 - DNA, 16 bp, Homo sapiens
ctctaaacacacaagt

SEQ ID NO: 279154 - DNA, 11 bp, Homo sapiens
ctctaaagcac

SEQ ID NO: 279155 - DNA, 17 bp, Homo sapiens
ctctaacaccacactga

SEQ ID NO: 279156 - DNA, 18 bp, Homo sapiens
ctctaacagctcaggatc

SEQ ID NO: 279157 - DNA, 18 bp, Homo sapiens
ctctaacattactgcctt

SEQ ID NO: 279158 - DNA, 18 bp, Homo sapiens
ctctaagaggctcctaca

SEQ ID NO: 279159 - DNA, 14 bp, Homo sapiens
ctctaagcacacgg

SEQ ID NO: 279160 - DNA, 13 bp, Homo sapiens
ctctaaggccaag

SEQ ID NO: 279161 - DNA, 15 bp, Homo sapiens
ctctaaggccaaggc

SEQ ID NO: 279162 - DNA, 20 bp, Homo sapiens
ctctaaggccaaggcctcag

SEQ ID NO: 279163 - DNA, 23 bp, Homo sapiens
ctctaaggccgaagaagggtcct

SEQ ID NO: 279164 - DNA, 13 bp, Homo sapiens
ctctaagtctcca

SEQ ID NO: 279165 - DNA, 15 bp, Homo sapiens
ctctaagtgtaaaaa

SEQ ID NO: 279166 - DNA, 22 bp, Homo sapiens
ctctaataacctttatctaaat

SEQ ID NO: 279167 - DNA, 14 bp, Homo sapiens
ctctaattctctag

SEQ ID NO: 279168 - DNA, 16 bp, Homo sapiens
ctctacaactgagtcc

SEQ ID NO: 279169 - DNA, 14 bp, Homo sapiens
ctctacactaaggg

SEQ ID NO: 279170 - DNA, 15 bp, Homo sapiens
ctctacagccgtccc

SEQ ID NO: 279171 - DNA, 14 bp, Homo sapiens
ctctacccagccca

SEQ ID NO: 279172 - DNA, 15 bp, Homo sapiens
ctctacccagcccat

SEQ ID NO: 279173 - DNA, 20 bp, Homo sapiens
ctctacccagcccatcttgc

SEQ ID NO: 279174 - DNA, 17 bp, Homo sapiens
ctctacccatgagcctg

SEQ ID NO: 279175 - DNA, 19 bp, Homo sapiens
ctctacccatgagcctgcc

SEQ ID NO: 279176 - DNA, 18 bp, Homo sapiens
ctctacccccaacaccac

SEQ ID NO: 279177 - DNA, 13 bp, Homo sapiens
ctctacccctgct

SEQ ID NO: 279178 - DNA, 22 bp, Homo sapiens
ctctacccctgctcccattcct

SEQ ID NO: 279179 - DNA, 14 bp, Homo sapiens
ctctaccctcccac

SEQ ID NO: 279180 - DNA, 14 bp, Homo sapiens
ctctaccctggtag

SEQ ID NO: 279181 - DNA, 14 bp, Homo sapiens
ctctacgccaaagt

SEQ ID NO: 279182 - DNA, 23 bp, Homo sapiens
ctctacgccaaagtgcagccctt

SEQ ID NO: 279183 - DNA, 20 bp, Homo sapiens
ctctacgtggcaaattaact

SEQ ID NO: 279184 - DNA, 22 bp, Homo sapiens
ctctactaaaaatacaaaaatt

SEQ ID NO: 279185 - DNA, 15 bp, Homo sapiens
ctctactaattttta

SEQ ID NO: 279186 - DNA, 19 bp, Homo sapiens
ctctactaccacaaggaaa

SEQ ID NO: 279187 - DNA, 22 bp, Homo sapiens
ctctactggtaggaagaggtac

SEQ ID NO: 279188 - DNA, 16 bp, Homo sapiens
ctctacttagcatgtc

SEQ ID NO: 279189 - DNA, 17 bp, Homo sapiens
ctctagacaaccctgca

SEQ ID NO: 279190 - DNA, 16 bp, Homo sapiens
ctctagagcagggatt

SEQ ID NO: 279191 - DNA, 13 bp, Homo sapiens
ctctagcctcttt

SEQ ID NO: 279192 - DNA, 14 bp, Homo sapiens
ctctagcctctttg

SEQ ID NO: 279193 - DNA, 16 bp, Homo sapiens
ctctagctggcaggac

SEQ ID NO: 279194 - DNA, 17 bp, Homo sapiens
ctctagctggcaggaca

SEQ ID NO: 279195 - DNA, 18 bp, Homo sapiens
ctctaggagggagccttg

SEQ ID NO: 279196 - DNA, 14 bp, Homo sapiens
ctctaggcctcagt

SEQ ID NO: 279197 - DNA, 21 bp, Homo sapiens
ctctagggaaggccacctgca

SEQ ID NO: 279198 - DNA, 17 bp, Homo sapiens
ctctaggggtcaggctc

SEQ ID NO: 279199 - DNA, 19 bp, Homo sapiens
ctctagggttgctggagcc

SEQ ID NO: 279200 - DNA, 13 bp, Homo sapiens
ctctaggtggggc

SEQ ID NO: 279201 - DNA, 15 bp, Homo sapiens
ctctaggtggggcgg

SEQ ID NO: 279202 - DNA, 13 bp, Homo sapiens
ctctagttctaga

SEQ ID NO: 279203 - DNA, 16 bp, Homo sapiens
ctctagttctagatga

SEQ ID NO: 279204 - DNA, 17 bp, Homo sapiens
ctctagtttgcagagga

SEQ ID NO: 279205 - DNA, 13 bp, Homo sapiens
ctctatatataca

SEQ ID NO: 279206 - DNA, 21 bp, Homo sapiens
ctctatatatacatgtatagt

SEQ ID NO: 279207 - DNA, 21 bp, Homo sapiens
ctctatatctttaaataaatg

SEQ ID NO: 279208 - DNA, 22 bp, Homo sapiens
ctctatccaaagaacttgattt

SEQ ID NO: 279209 - DNA, 14 bp, Homo sapiens
ctctatctctcaaa

SEQ ID NO: 279210 - DNA, 19 bp, Homo sapiens
ctctatgcaaaatgtctgt

SEQ ID NO: 279211 - DNA, 20 bp, Homo sapiens
ctctatgggtatcaaacagc

SEQ ID NO: 279212 - DNA, 21 bp, Homo sapiens
ctctatgggtatcaaacagct

SEQ ID NO: 279213 - DNA, 20 bp, Homo sapiens
ctctatggtaaagatattat

SEQ ID NO: 279214 - DNA, 22 bp, Homo sapiens
ctctattgggcacagcctaggg

SEQ ID NO: 279215 - DNA, 20 bp, Homo sapiens
ctctattgtagcatttcttg

SEQ ID NO: 279216 - DNA, 13 bp, Homo sapiens
ctctatttagcat

SEQ ID NO: 279217 - DNA, 14 bp, Homo sapiens
ctctatttagcatg

SEQ ID NO: 279218 - DNA, 11 bp, Homo sapiens
ctctatttctt

SEQ ID NO: 279219 - DNA, 11 bp, Homo sapiens
ctctattttgt

SEQ ID NO: 279220 - DNA, 13 bp, Homo sapiens
ctctattttgtga

SEQ ID NO: 279221 - DNA, 18 bp, Homo sapiens
ctctattttgtgatgatg

SEQ ID NO: 279222 - DNA, 23 bp, Homo sapiens
ctctatttttgttaatcatcttc

SEQ ID NO: 279223 - DNA, 13 bp, Homo sapiens
ctctcaaaatgtg

SEQ ID NO: 279224 - DNA, 14 bp, Homo sapiens
ctctcaaaatgtgc

SEQ ID NO: 279225 - DNA, 16 bp, Homo sapiens
ctctcaaaatgtgccg

SEQ ID NO: 279226 - DNA, 23 bp, Homo sapiens
ctctcaatatataataaatggga

SEQ ID NO: 279227 - DNA, 18 bp, Homo sapiens
ctctcaatattcaataaa

SEQ ID NO: 279228 - DNA, 20 bp, Homo sapiens
ctctcaatttgggtcccagc

SEQ ID NO: 279229 - DNA, 21 bp, Homo sapiens
ctctcactaaactttacccaa

SEQ ID NO: 279230 - DNA, 13 bp, Homo sapiens
ctctcactggcca

SEQ ID NO: 279231 - DNA, 14 bp, Homo sapiens
ctctcagaactcct

SEQ ID NO: 279232 - DNA, 20 bp, Homo sapiens
ctctcagaactcctgtgtgt

SEQ ID NO: 279233 - DNA, 22 bp, Homo sapiens
ctctcagacccttgaagatgta

SEQ ID NO: 279234 - DNA, 15 bp, Homo sapiens
ctctcagactctaaa

SEQ ID NO: 279235 - DNA, 18 bp, Homo sapiens
ctctcagagactcccagg

SEQ ID NO: 279236 - DNA, 23 bp, Homo sapiens
ctctcagatccctcggtcagcac

SEQ ID NO: 279237 - DNA, 19 bp, Homo sapiens
ctctcagattgtaccattg

SEQ ID NO: 279238 - DNA, 17 bp, Homo sapiens
ctctcagccttacattt

SEQ ID NO: 279239 - DNA, 13 bp, Homo sapiens
ctctcaggagcac

SEQ ID NO: 279240 - DNA, 15 bp, Homo sapiens
ctctcaggagcacag

SEQ ID NO: 279241 - DNA, 21 bp, Homo sapiens
ctctcagttctctcccttcct

SEQ ID NO: 279242 - DNA, 19 bp, Homo sapiens
ctctcagttgcagccctgc

SEQ ID NO: 279243 - DNA, 15 bp, Homo sapiens
ctctcatcagcccag

SEQ ID NO: 279244 - DNA, 14 bp, Homo sapiens
ctctcatccaggtc

SEQ ID NO: 279245 - DNA, 20 bp, Homo sapiens
ctctcatccaggtcctttcc

SEQ ID NO: 279246 - DNA, 22 bp, Homo sapiens
ctctcatccaggtcctttcctt

SEQ ID NO: 279247 - DNA, 20 bp, Homo sapiens
ctctcatttctttcaagaca

SEQ ID NO: 279248 - DNA, 16 bp, Homo sapiens
ctctccaaaggggctg

SEQ ID NO: 279249 - DNA, 21 bp, Homo sapiens
ctctccaaaggggctgctggg

SEQ ID NO: 279250 - DNA, 13 bp, Homo sapiens
ctctccaagtctc

SEQ ID NO: 279251 - DNA, 16 bp, Homo sapiens
ctctccaagtctctct

SEQ ID NO: 279252 - DNA, 21 bp, Homo sapiens
ctctccaagtctctctgtgaa

SEQ ID NO: 279253 - DNA, 17 bp, Homo sapiens
ctctccaatgttctatt

SEQ ID NO: 279254 - DNA, 21 bp, Homo sapiens
ctctccacacccatgactgcc

SEQ ID NO: 279255 - DNA, 11 bp, Homo sapiens
ctctccactgc

SEQ ID NO: 279256 - DNA, 12 bp, Homo sapiens
ctctccactgcc

SEQ ID NO: 279257 - DNA, 14 bp, Homo sapiens
ctctccacttctgg

SEQ ID NO: 279258 - DNA, 20 bp, Homo sapiens
ctctcccacacaagcagtct

SEQ ID NO: 279259 - DNA, 15 bp, Homo sapiens
ctctcccaccccggc

SEQ ID NO: 279260 - DNA, 12 bp, Homo sapiens
ctctcccacccg

SEQ ID NO: 279261 - DNA, 14 bp, Homo sapiens
ctctcccacccggc

SEQ ID NO: 279262 - DNA, 19 bp, Homo sapiens
ctctcccacccggccacag

SEQ ID NO: 279263 - DNA, 21 bp, Homo sapiens
ctctcccacccggccacagct

SEQ ID NO: 279264 - DNA, 22 bp, Homo sapiens
ctctcccacccggccacagctg

SEQ ID NO: 279265 - DNA, 23 bp, Homo sapiens
ctctcccacccggccacagctgc

SEQ ID NO: 279266 - DNA, 14 bp, Homo sapiens
ctctcccagaggct

SEQ ID NO: 279267 - DNA, 17 bp, Homo sapiens
ctctccccagtgcctgc

SEQ ID NO: 279268 - DNA, 18 bp, Homo sapiens
ctctccccagtgcctgcc

SEQ ID NO: 279269 - DNA, 20 bp, Homo sapiens
ctctccccagtgcctgccac

SEQ ID NO: 279270 - DNA, 21 bp, Homo sapiens
ctctccccagtgcctgccact

SEQ ID NO: 279271 - DNA, 19 bp, Homo sapiens
ctctccccatatataaatt

SEQ ID NO: 279272 - DNA, 22 bp, Homo sapiens
ctctccccatatataaattatt

SEQ ID NO: 279273 - DNA, 23 bp, Homo sapiens
ctctcccctctcgccccatccct

SEQ ID NO: 279274 - DNA, 15 bp, Homo sapiens
ctctcccctgccctg

SEQ ID NO: 279275 - DNA, 17 bp, Homo sapiens
ctctcccctgccctgct

SEQ ID NO: 279276 - DNA, 18 bp, Homo sapiens
ctctcccggctgcctgcc

SEQ ID NO: 279277 - DNA, 20 bp, Homo sapiens
ctctccctaccctcttctca

SEQ ID NO: 279278 - DNA, 21 bp, Homo sapiens
ctctccctaccctcttctcag

SEQ ID NO: 279279 - DNA, 15 bp, Homo sapiens
ctctccctccactcc

SEQ ID NO: 279280 - DNA, 16 bp, Homo sapiens
ctctccctccactcct

SEQ ID NO: 279281 - DNA, 18 bp, Homo sapiens
ctctccctccactcctcc

SEQ ID NO: 279282 - DNA, 19 bp, Homo sapiens
ctctccctccactcctccc

SEQ ID NO: 279283 - DNA, 13 bp, Homo sapiens
ctctccctcccct

SEQ ID NO: 279284 - DNA, 16 bp, Homo sapiens
ctctccctcttctcaa

SEQ ID NO: 279285 - DNA, 16 bp, Homo sapiens
ctctccctgcctcaca

SEQ ID NO: 279286 - DNA, 21 bp, Homo sapiens
ctctcctagagacagaagcag

SEQ ID NO: 279287 - DNA, 17 bp, Homo sapiens
ctctcctatgtggcagc

SEQ ID NO: 279288 - DNA, 20 bp, Homo sapiens
ctctcctatgtggcagctgg

SEQ ID NO: 279289 - DNA, 23 bp, Homo sapiens
ctctcctcatctctaacagctca

SEQ ID NO: 279290 - DNA, 20 bp, Homo sapiens
ctctcctcggccccctccat

SEQ ID NO: 279291 - DNA, 13 bp, Homo sapiens
ctctcctcggtgg

SEQ ID NO: 279292 - DNA, 20 bp, Homo sapiens
ctctcctcgtccggcctgca

SEQ ID NO: 279293 - DNA, 16 bp, Homo sapiens
ctctcctcttgccact

SEQ ID NO: 279294 - DNA, 22 bp, Homo sapiens
ctctcctcttgccactgcctct

SEQ ID NO: 279295 - DNA, 17 bp, Homo sapiens
ctctcctgctcctcagg

SEQ ID NO: 279296 - DNA, 13 bp, Homo sapiens
ctctcctgggcca

SEQ ID NO: 279297 - DNA, 17 bp, Homo sapiens
ctctcctgggccagggt

SEQ ID NO: 279298 - DNA, 17 bp, Homo sapiens
ctctcctgggcccctcc

SEQ ID NO: 279299 - DNA, 19 bp, Homo sapiens
ctctcctgtttcccttccc

SEQ ID NO: 279300 - DNA, 17 bp, Homo sapiens
ctctccttcactctgac

SEQ ID NO: 279301 - DNA, 17 bp, Homo sapiens
ctctccttcgtgtctct

SEQ ID NO: 279302 - DNA, 12 bp, Homo sapiens
ctctccttgccc

SEQ ID NO: 279303 - DNA, 13 bp, Homo sapiens
ctctccttgccct

SEQ ID NO: 279304 - DNA, 16 bp, Homo sapiens
ctctccttgccctggg

SEQ ID NO: 279305 - DNA, 18 bp, Homo sapiens
ctctccttgggctcctgg

SEQ ID NO: 279306 - DNA, 23 bp, Homo sapiens
ctctccttgggctcctggctgcc

SEQ ID NO: 279307 - DNA, 23 bp, Homo sapiens
ctctcctttctttttcttcttcc

SEQ ID NO: 279308 - DNA, 12 bp, Homo sapiens
ctctcctttgat

SEQ ID NO: 279309 - DNA, 13 bp, Homo sapiens
ctctcgctcccct

SEQ ID NO: 279310 - DNA, 16 bp, Homo sapiens
ctctcgctcccctctg

SEQ ID NO: 279311 - DNA, 16 bp, Homo sapiens
ctctcggaactgcatg

SEQ ID NO: 279312 - DNA, 23 bp, Homo sapiens
ctctcggaactgcatgctgctgg

SEQ ID NO: 279313 - DNA, 19 bp, Homo sapiens
ctctcggagtatctgggaa

SEQ ID NO: 279314 - DNA, 15 bp, Homo sapiens
ctctcggggcccttg

SEQ ID NO: 279315 - DNA, 21 bp, Homo sapiens
ctctcggggcccttggggcct

SEQ ID NO: 279316 - DNA, 23 bp, Homo sapiens
ctctcggggcccttggggcctgg

SEQ ID NO: 279317 - DNA, 13 bp, Homo sapiens
ctctctaaaaata

SEQ ID NO: 279318 - DNA, 22 bp, Homo sapiens
ctctctaaaaataaaatgatgt

SEQ ID NO: 279319 - DNA, 24 bp, Homo sapiens
ctctctaaaaataaaatgatgtat

SEQ ID NO: 279320 - DNA, 12 bp, Homo sapiens
ctctctaacata

SEQ ID NO: 279321 - DNA, 19 bp, Homo sapiens
ctctctacccagcccatct

SEQ ID NO: 279322 - DNA, 22 bp, Homo sapiens
ctctctatatatacatgtatag

SEQ ID NO: 279323 - DNA, 20 bp, Homo sapiens
ctctctatggtaaagatatt

SEQ ID NO: 279324 - DNA, 19 bp, Homo sapiens
ctctctcacctacttcctc

SEQ ID NO: 279325 - DNA, 14 bp, Homo sapiens
ctctctcagaccct

SEQ ID NO: 279326 - DNA, 13 bp, Homo sapiens
ctctctcatgtgg

SEQ ID NO: 279327 - DNA, 13 bp, Homo sapiens
ctctctccctgcc

SEQ ID NO: 279328 - DNA, 14 bp, Homo sapiens
ctctctccctgcct

SEQ ID NO: 279329 - DNA, 17 bp, Homo sapiens
ctctctccctgcctcac

SEQ ID NO: 279330 - DNA, 12 bp, Homo sapiens
ctctctcctgta

SEQ ID NO: 279331 - DNA, 9 bp, Homo sapiens
ctctctctc

SEQ ID NO: 279332 - DNA, 13 bp, Homo sapiens
ctctctctcacct

SEQ ID NO: 279333 - DNA, 12 bp, Homo sapiens
ctctctctccct

SEQ ID NO: 279334 - DNA, 15 bp, Homo sapiens
ctctctctccctcca

SEQ ID NO: 279335 - DNA, 16 bp, Homo sapiens
ctctctctccctccac

SEQ ID NO: 279336 - DNA, 13 bp, Homo sapiens
ctctctctctctc

SEQ ID NO: 279337 - DNA, 15 bp, Homo sapiens
ctctctctctctgtt

SEQ ID NO: 279338 - DNA, 11 bp, Homo sapiens
ctctctctctg

SEQ ID NO: 279339 - DNA, 15 bp, Homo sapiens
ctctctctctttttc

SEQ ID NO: 279340 - DNA, 14 bp, Homo sapiens
ctctctctgctcct

SEQ ID NO: 279341 - DNA, 16 bp, Homo sapiens
ctctctctgctcctca

SEQ ID NO: 279342 - DNA, 14 bp, Homo sapiens
ctctctctgttcca

SEQ ID NO: 279343 - DNA, 18 bp, Homo sapiens
ctctctcttctgctccac

SEQ ID NO: 279344 - DNA, 21 bp, Homo sapiens
ctctctcttctgctccaccct

SEQ ID NO: 279345 - DNA, 22 bp, Homo sapiens
ctctctgatcttgtgctcagca

SEQ ID NO: 279346 - DNA, 23 bp, Homo sapiens
ctctctgatcttgtgctcagcat

SEQ ID NO: 279347 - DNA, 13 bp, Homo sapiens
ctctctgctcctc

SEQ ID NO: 279348 - DNA, 20 bp, Homo sapiens
ctctctgctcctcaccccca

SEQ ID NO: 279349 - DNA, 12 bp, Homo sapiens
ctctctgctcta

SEQ ID NO: 279350 - DNA, 16 bp, Homo sapiens
ctctctgctctagcca

SEQ ID NO: 279351 - DNA, 17 bp, Homo sapiens
ctctctgctctagccag

SEQ ID NO: 279352 - DNA, 11 bp, Homo sapiens
ctctctgctgg

SEQ ID NO: 279353 - DNA, 16 bp, Homo sapiens
ctctctggaaaggagg

SEQ ID NO: 279354 - DNA, 19 bp, Homo sapiens
ctctctggactttctccaa

SEQ ID NO: 279355 - DNA, 16 bp, Homo sapiens
ctctctgggacctcct

SEQ ID NO: 279356 - DNA, 12 bp, Homo sapiens
ctctctgggact

SEQ ID NO: 279357 - DNA, 18 bp, Homo sapiens
ctctctgggactctcctc

SEQ ID NO: 279358 - DNA, 20 bp, Homo sapiens
ctctctgggactctcctcct

SEQ ID NO: 279359 - DNA, 20 bp, Homo sapiens
ctctctgggcccaggggctg

SEQ ID NO: 279360 - DNA, 17 bp, Homo sapiens
ctctctgtctttttcct

SEQ ID NO: 279361 - DNA, 20 bp, Homo sapiens
ctctctgtctttttccttcc

SEQ ID NO: 279362 - DNA, 14 bp, Homo sapiens
ctctctgtgaatac

SEQ ID NO: 279363 - DNA, 21 bp, Homo sapiens
ctctctgtgaatacaattaaa

SEQ ID NO: 279364 - DNA, 22 bp, Homo sapiens
ctctctgtgtggcaaacattta

SEQ ID NO: 279365 - DNA, 15 bp, Homo sapiens
ctctctgttccaagt

SEQ ID NO: 279366 - DNA, 21 bp, Homo sapiens
ctctcttaaatgaagtgccca

SEQ ID NO: 279367 - DNA, 18 bp, Homo sapiens
ctctcttatagaatattt

SEQ ID NO: 279368 - DNA, 9 bp, Homo sapiens
ctctcttca

SEQ ID NO: 279369 - DNA, 16 bp, Homo sapiens
ctctcttcaatctctg

SEQ ID NO: 279370 - DNA, 20 bp, Homo sapiens
ctctcttccgggagctggtg

SEQ ID NO: 279371 - DNA, 12 bp, Homo sapiens
ctctcttctgct

SEQ ID NO: 279372 - DNA, 14 bp, Homo sapiens
ctctcttctgctcc

SEQ ID NO: 279373 - DNA, 15 bp, Homo sapiens
ctctcttctgctcca

SEQ ID NO: 279374 - DNA, 13 bp, Homo sapiens
ctctcttggtctc

SEQ ID NO: 279375 - DNA, 24 bp, Homo sapiens
ctctcttggtctctttctttccaa

SEQ ID NO: 279376 - DNA, 21 bp, Homo sapiens
ctctctttacgttgtaccatt

SEQ ID NO: 279377 - DNA, 16 bp, Homo sapiens
ctctctttcttccact

SEQ ID NO: 279378 - DNA, 12 bp, Homo sapiens
ctctctttgtcc

SEQ ID NO: 279379 - DNA, 20 bp, Homo sapiens
ctctctttttggaggtgctt

SEQ ID NO: 279380 - DNA, 23 bp, Homo sapiens
ctctgaaaagcaattgccctgta

SEQ ID NO: 279381 - DNA, 24 bp, Homo sapiens
ctctgaaaatatttttttctagct

SEQ ID NO: 279382 - DNA, 18 bp, Homo sapiens
ctctgaaagctgcttctg

SEQ ID NO: 279383 - DNA, 14 bp, Homo sapiens
ctctgaactgctgc

SEQ ID NO: 279384 - DNA, 16 bp, Homo sapiens
ctctgaactgctgctg

SEQ ID NO: 279385 - DNA, 18 bp, Homo sapiens
ctctgaactgctgctggt

SEQ ID NO: 279386 - DNA, 21 bp, Homo sapiens
ctctgaactgctgctggtcac

SEQ ID NO: 279387 - DNA, 18 bp, Homo sapiens
ctctgaagagatacccac

SEQ ID NO: 279388 - DNA, 14 bp, Homo sapiens
ctctgaagcatgtt

SEQ ID NO: 279389 - DNA, 20 bp, Homo sapiens
ctctgaagcatgtttcatgt

SEQ ID NO: 279390 - DNA, 14 bp, Homo sapiens
ctctgaagcatttg

SEQ ID NO: 279391 - DNA, 15 bp, Homo sapiens
ctctgaagtcccttc

SEQ ID NO: 279392 - DNA, 17 bp, Homo sapiens
ctctgaagtcccttcct

SEQ ID NO: 279393 - DNA, 20 bp, Homo sapiens
ctctgaagtcccttcctgtc

SEQ ID NO: 279394 - DNA, 23 bp, Homo sapiens
ctctgaagtcccttcctgtcctg

SEQ ID NO: 279395 - DNA, 17 bp, Homo sapiens
ctctgaagttggacagc

SEQ ID NO: 279396 - DNA, 15 bp, Homo sapiens
ctctgaatctctcaa

SEQ ID NO: 279397 - DNA, 22 bp, Homo sapiens
ctctgaatctctcaaaatgtgc

SEQ ID NO: 279398 - DNA, 16 bp, Homo sapiens
ctctgaatgggagcca

SEQ ID NO: 279399 - DNA, 18 bp, Homo sapiens
ctctgaatgggagccaga

SEQ ID NO: 279400 - DNA, 15 bp, Homo sapiens
ctctgacagcagcct

SEQ ID NO: 279401 - DNA, 23 bp, Homo sapiens
ctctgacctgcccccgctctgcc

SEQ ID NO: 279402 - DNA, 21 bp, Homo sapiens
ctctgactcccaaagagctgc

SEQ ID NO: 279403 - DNA, 15 bp, Homo sapiens
ctctgactctgagtc

SEQ ID NO: 279404 - DNA, 16 bp, Homo sapiens
ctctgagaagaggagc

SEQ ID NO: 279405 - DNA, 14 bp, Homo sapiens
ctctgagacagcag

SEQ ID NO: 279406 - DNA, 21 bp, Homo sapiens
ctctgagacggatggaaggag

SEQ ID NO: 279407 - DNA, 13 bp, Homo sapiens
ctctgagcaactg

SEQ ID NO: 279408 - DNA, 18 bp, Homo sapiens
ctctgagcaactgtgcag

SEQ ID NO: 279409 - DNA, 13 bp, Homo sapiens
ctctgagcagcct

SEQ ID NO: 279410 - DNA, 22 bp, Homo sapiens
ctctgagcagcctctgccaggc

SEQ ID NO: 279411 - DNA, 14 bp, Homo sapiens
ctctgagcagtggg

SEQ ID NO: 279412 - DNA, 16 bp, Homo sapiens
ctctgagcagtgggga

SEQ ID NO: 279413 - DNA, 21 bp, Homo sapiens
ctctgagccaccgcgagggcc

SEQ ID NO: 279414 - DNA, 20 bp, Homo sapiens
ctctgagccaggagcctcct

SEQ ID NO: 279415 - DNA, 21 bp, Homo sapiens
ctctgagccaggagcctcctg

SEQ ID NO: 279416 - DNA, 13 bp, Homo sapiens
ctctgagcccagg

SEQ ID NO: 279417 - DNA, 16 bp, Homo sapiens
ctctgagcccaggccg

SEQ ID NO: 279418 - DNA, 13 bp, Homo sapiens
ctctgagccccct

SEQ ID NO: 279419 - DNA, 15 bp, Homo sapiens
ctctgagccccctgt

SEQ ID NO: 279420 - DNA, 21 bp, Homo sapiens
ctctgagccccctgtgcccac

SEQ ID NO: 279421 - DNA, 12 bp, Homo sapiens
ctctgagccctc

SEQ ID NO: 279422 - DNA, 15 bp, Homo sapiens
ctctgagctgttatc

SEQ ID NO: 279423 - DNA, 12 bp, Homo sapiens
ctctgagtgtga

SEQ ID NO: 279424 - DNA, 16 bp, Homo sapiens
ctctgagtttaccatt

SEQ ID NO: 279425 - DNA, 18 bp, Homo sapiens
ctctgagtttaccatttg

SEQ ID NO: 279426 - DNA, 23 bp, Homo sapiens
ctctgatattccatgaatgtatc

SEQ ID NO: 279427 - DNA, 20 bp, Homo sapiens
ctctgatcttgtgctcagca

SEQ ID NO: 279428 - DNA, 14 bp, Homo sapiens
ctctgattatcagg

SEQ ID NO: 279429 - DNA, 21 bp, Homo sapiens
ctctgcaaagatgattttgct

SEQ ID NO: 279430 - DNA, 14 bp, Homo sapiens
ctctgcaactgaat

SEQ ID NO: 279431 - DNA, 15 bp, Homo sapiens
ctctgcacctgtctc

SEQ ID NO: 279432 - DNA, 22 bp, Homo sapiens
ctctgcactactcctctgcagt

SEQ ID NO: 279433 - DNA, 21 bp, Homo sapiens
ctctgcactatagccatttgc

SEQ ID NO: 279434 - DNA, 22 bp, Homo sapiens
ctctgcagactcgttctcgtga

SEQ ID NO: 279435 - DNA, 18 bp, Homo sapiens
ctctgcagcccacagagg

SEQ ID NO: 279436 - DNA, 13 bp, Homo sapiens
ctctgcagcctga

SEQ ID NO: 279437 - DNA, 15 bp, Homo sapiens
ctctgcagcctgagc

SEQ ID NO: 279438 - DNA, 17 bp, Homo sapiens
ctctgcagcctgagctc

SEQ ID NO: 279439 - DNA, 23 bp, Homo sapiens
ctctgcagcctgagctccaccct

SEQ ID NO: 279440 - DNA, 14 bp, Homo sapiens
ctctgcagctgacc

SEQ ID NO: 279441 - DNA, 18 bp, Homo sapiens
ctctgcagctgacctctg

SEQ ID NO: 279442 - DNA, 23 bp, Homo sapiens
ctctgcagggcagcctgtgggag

SEQ ID NO: 279443 - DNA, 14 bp, Homo sapiens
ctctgcagtgcctt

SEQ ID NO: 279444 - DNA, 15 bp, Homo sapiens
ctctgcagtgccttg

SEQ ID NO: 279445 - DNA, 14 bp, Homo sapiens
ctctgccacactct

SEQ ID NO: 279446 - DNA, 15 bp, Homo sapiens
ctctgccacactctg

SEQ ID NO: 279447 - DNA, 13 bp, Homo sapiens
ctctgccacccac

SEQ ID NO: 279448 - DNA, 17 bp, Homo sapiens
ctctgccaccctacctg

SEQ ID NO: 279449 - DNA, 20 bp, Homo sapiens
ctctgccaccctacctgttc

SEQ ID NO: 279450 - DNA, 18 bp, Homo sapiens
ctctgccagctccacagg

SEQ ID NO: 279451 - DNA, 15 bp, Homo sapiens
ctctgccaggcctgt

SEQ ID NO: 279452 - DNA, 13 bp, Homo sapiens
ctctgccagggca

SEQ ID NO: 279453 - DNA, 18 bp, Homo sapiens
ctctgccagggcagtgct

SEQ ID NO: 279454 - DNA, 19 bp, Homo sapiens
ctctgccagggcagtgcta

SEQ ID NO: 279455 - DNA, 13 bp, Homo sapiens
ctctgccagtgac

SEQ ID NO: 279456 - DNA, 14 bp, Homo sapiens
ctctgccagtgaca

SEQ ID NO: 279457 - DNA, 14 bp, Homo sapiens
ctctgcccagagct

SEQ ID NO: 279458 - DNA, 15 bp, Homo sapiens
ctctgcccagagctg

SEQ ID NO: 279459 - DNA, 16 bp, Homo sapiens
ctctgcccagagctgg

SEQ ID NO: 279460 - DNA, 20 bp, Homo sapiens
ctctgcccagagctgggtga

SEQ ID NO: 279461 - DNA, 13 bp, Homo sapiens
ctctgcccagctt

SEQ ID NO: 279462 - DNA, 14 bp, Homo sapiens
ctctgcccagcttg

SEQ ID NO: 279463 - DNA, 17 bp, Homo sapiens
ctctgcccagcttgggc

SEQ ID NO: 279464 - DNA, 16 bp, Homo sapiens
ctctgccccaagcagc

SEQ ID NO: 279465 - DNA, 17 bp, Homo sapiens
ctctgccccaagcagcc

SEQ ID NO: 279466 - DNA, 22 bp, Homo sapiens
ctctgccccaagcagccagcca

SEQ ID NO: 279467 - DNA, 18 bp, Homo sapiens
ctctgccccaagccccca

SEQ ID NO: 279468 - DNA, 10 bp, Homo sapiens
ctctgccccc

SEQ ID NO: 279469 - DNA, 21 bp, Homo sapiens
ctctgcccccgcgggttctag

SEQ ID NO: 279470 - DNA, 14 bp, Homo sapiens
ctctgccccctccc

SEQ ID NO: 279471 - DNA, 10 bp, Homo sapiens
ctctgcccct

SEQ ID NO: 279472 - DNA, 13 bp, Homo sapiens
ctctgcccctccg

SEQ ID NO: 279473 - DNA, 21 bp, Homo sapiens
ctctgcccctccgtccccagg

SEQ ID NO: 279474 - DNA, 22 bp, Homo sapiens
ctctgcccctccgtccccaggg

SEQ ID NO: 279475 - DNA, 16 bp, Homo sapiens
ctctgccccttctgtt

SEQ ID NO: 279476 - DNA, 20 bp, Homo sapiens
ctctgccccttgggcatcca

SEQ ID NO: 279477 - DNA, 16 bp, Homo sapiens
ctctgcccgcagagcc

SEQ ID NO: 279478 - DNA, 20 bp, Homo sapiens
ctctgccctccctccttcct

SEQ ID NO: 279479 - DNA, 14 bp, Homo sapiens
ctctgccctgcctc

SEQ ID NO: 279480 - DNA, 20 bp, Homo sapiens
ctctgccgaccgcctgcttc

SEQ ID NO: 279481 - DNA, 13 bp, Homo sapiens
ctctgccggctct

SEQ ID NO: 279482 - DNA, 15 bp, Homo sapiens
ctctgccggctcttt

SEQ ID NO: 279483 - DNA, 19 bp, Homo sapiens
ctctgccggtcccccatgc

SEQ ID NO: 279484 - DNA, 16 bp, Homo sapiens
ctctgcctctaaggcc

SEQ ID NO: 279485 - DNA, 22 bp, Homo sapiens
ctctgcctctaaggccaaggcc

SEQ ID NO: 279486 - DNA, 13 bp, Homo sapiens
ctctgcctgtccc

SEQ ID NO: 279487 - DNA, 16 bp, Homo sapiens
ctctgcctgtccctct

SEQ ID NO: 279488 - DNA, 19 bp, Homo sapiens
ctctgcctgtccctctcag

SEQ ID NO: 279489 - DNA, 21 bp, Homo sapiens
ctctgcctgtccctctcaggc

SEQ ID NO: 279490 - DNA, 15 bp, Homo sapiens
ctctgccttccaggc

SEQ ID NO: 279491 - DNA, 21 bp, Homo sapiens
ctctgccttgatggagaagga

SEQ ID NO: 279492 - DNA, 12 bp, Homo sapiens
ctctgcctttga

SEQ ID NO: 279493 - DNA, 13 bp, Homo sapiens
ctctgcctttgag

SEQ ID NO: 279494 - DNA, 14 bp, Homo sapiens
ctctgcctttgagt

SEQ ID NO: 279495 - DNA, 15 bp, Homo sapiens
ctctgcctttgagtg

SEQ ID NO: 279496 - DNA, 21 bp, Homo sapiens
ctctgcctttgagtgtgggac

SEQ ID NO: 279497 - DNA, 14 bp, Homo sapiens
ctctgcgagcaaca

SEQ ID NO: 279498 - DNA, 20 bp, Homo sapiens
ctctgcggatagcatttggt

SEQ ID NO: 279499 - DNA, 17 bp, Homo sapiens
ctctgcgtcccactgag

SEQ ID NO: 279500 - DNA, 16 bp, Homo sapiens
ctctgctaatcatgtg

SEQ ID NO: 279501 - DNA, 23 bp, Homo sapiens
ctctgctatatgccttaagccaa

SEQ ID NO: 279502 - DNA, 20 bp, Homo sapiens
ctctgctatgtctgtgatgt

SEQ ID NO: 279503 - DNA, 15 bp, Homo sapiens
ctctgctccaccaca

SEQ ID NO: 279504 - DNA, 18 bp, Homo sapiens
ctctgctccaccacatcc

SEQ ID NO: 279505 - DNA, 17 bp, Homo sapiens
ctctgctctagccagga

SEQ ID NO: 279506 - DNA, 19 bp, Homo sapiens
ctctgctctagccaggagt

SEQ ID NO: 279507 - DNA, 23 bp, Homo sapiens
ctctgctctagccaggagtctgt

SEQ ID NO: 279508 - DNA, 15 bp, Homo sapiens
ctctgctctcatagg

SEQ ID NO: 279509 - DNA, 14 bp, Homo sapiens
ctctgctctgcaca

SEQ ID NO: 279510 - DNA, 13 bp, Homo sapiens
ctctgctgacttc

SEQ ID NO: 279511 - DNA, 15 bp, Homo sapiens
ctctgctggcgggaa

SEQ ID NO: 279512 - DNA, 15 bp, Homo sapiens
ctctgctgggtttcc

SEQ ID NO: 279513 - DNA, 22 bp, Homo sapiens
ctctgctgggtttccacacagc

SEQ ID NO: 279514 - DNA, 16 bp, Homo sapiens
ctctgctggtcttcaa

SEQ ID NO: 279515 - DNA, 13 bp, Homo sapiens
ctctgcttcagct

SEQ ID NO: 279516 - DNA, 15 bp, Homo sapiens
ctctgcttcagcttg

SEQ ID NO: 279517 - DNA, 22 bp, Homo sapiens
ctctgcttccatggcttcctga

SEQ ID NO: 279518 - DNA, 17 bp, Homo sapiens
ctctgcttctctcacct

SEQ ID NO: 279519 - DNA, 22 bp, Homo sapiens
ctctgcttgccgactggctgtg

SEQ ID NO: 279520 - DNA, 17 bp, Homo sapiens
ctctggaaaactcagga

SEQ ID NO: 279521 - DNA, 23 bp, Homo sapiens
ctctggacatgatttagggaagc

SEQ ID NO: 279522 - DNA, 15 bp, Homo sapiens
ctctggaccccaggc

SEQ ID NO: 279523 - DNA, 15 bp, Homo sapiens
ctctggagccacctg

SEQ ID NO: 279524 - DNA, 16 bp, Homo sapiens
ctctggagccacctgt

SEQ ID NO: 279525 - DNA, 20 bp, Homo sapiens
ctctggagccacctgtccca

SEQ ID NO: 279526 - DNA, 15 bp, Homo sapiens
ctctggaggcctctg

SEQ ID NO: 279527 - DNA, 22 bp, Homo sapiens
ctctggaggcctctgggcctcc

SEQ ID NO: 279528 - DNA, 16 bp, Homo sapiens
ctctggatcctgcact

SEQ ID NO: 279529 - DNA, 17 bp, Homo sapiens
ctctggccaaatatgca

SEQ ID NO: 279530 - DNA, 21 bp, Homo sapiens
ctctggccacaatcctcccca

SEQ ID NO: 279531 - DNA, 23 bp, Homo sapiens
ctctggccacaatcctccccacc

SEQ ID NO: 279532 - DNA, 11 bp, Homo sapiens
ctctggccacc

SEQ ID NO: 279533 - DNA, 12 bp, Homo sapiens
ctctggccaccc

SEQ ID NO: 279534 - DNA, 16 bp, Homo sapiens
ctctggccaccctggc

SEQ ID NO: 279535 - DNA, 14 bp, Homo sapiens
ctctggccactctg

SEQ ID NO: 279536 - DNA, 21 bp, Homo sapiens
ctctggccttggttcctccag

SEQ ID NO: 279537 - DNA, 15 bp, Homo sapiens
ctctggcggcttcct

SEQ ID NO: 279538 - DNA, 16 bp, Homo sapiens
ctctggcggcttcctg

SEQ ID NO: 279539 - DNA, 22 bp, Homo sapiens
ctctggcggcttcctgtccact

SEQ ID NO: 279540 - DNA, 15 bp, Homo sapiens
ctctggctcacagac

SEQ ID NO: 279541 - DNA, 18 bp, Homo sapiens
ctctggctcacagactgg

SEQ ID NO: 279542 - DNA, 22 bp, Homo sapiens
ctctggctcagggcccacctcc

SEQ ID NO: 279543 - DNA, 13 bp, Homo sapiens
ctctggctccctg

SEQ ID NO: 279544 - DNA, 14 bp, Homo sapiens
ctctggctgcctgg

SEQ ID NO: 279545 - DNA, 19 bp, Homo sapiens
ctctggctgcctggcccag

SEQ ID NO: 279546 - DNA, 11 bp, Homo sapiens
ctctgggaaga

SEQ ID NO: 279547 - DNA, 17 bp, Homo sapiens
ctctgggactctcctcc

SEQ ID NO: 279548 - DNA, 18 bp, Homo sapiens
ctctgggccctgcaggag

SEQ ID NO: 279549 - DNA, 14 bp, Homo sapiens
ctctgggctcaggg

SEQ ID NO: 279550 - DNA, 19 bp, Homo sapiens
ctctgggctcagggctgga

SEQ ID NO: 279551 - DNA, 20 bp, Homo sapiens
ctctggggaagggaaccagc

SEQ ID NO: 279552 - DNA, 21 bp, Homo sapiens
ctctggggagaccgagtgtgg

SEQ ID NO: 279553 - DNA, 17 bp, Homo sapiens
ctctggggatttctggg

SEQ ID NO: 279554 - DNA, 21 bp, Homo sapiens
ctctgggtgagtggctgacag

SEQ ID NO: 279555 - DNA, 17 bp, Homo sapiens
ctctggtgggaaaatgt

SEQ ID NO: 279556 - DNA, 16 bp, Homo sapiens
ctctggttcttcattt

SEQ ID NO: 279557 - DNA, 15 bp, Homo sapiens
ctctgtaaccacctc

SEQ ID NO: 279558 - DNA, 21 bp, Homo sapiens
ctctgtaaccacctctctgtc

SEQ ID NO: 279559 - DNA, 22 bp, Homo sapiens
ctctgtaaccacctctctgtct

SEQ ID NO: 279560 - DNA, 23 bp, Homo sapiens
ctctgtaaccacctctctgtctt

SEQ ID NO: 279561 - DNA, 24 bp, Homo sapiens
ctctgtaaccacctctctgtcttt

SEQ ID NO: 279562 - DNA, 18 bp, Homo sapiens
ctctgtagggaactctgg

SEQ ID NO: 279563 - DNA, 14 bp, Homo sapiens
ctctgtattctgca

SEQ ID NO: 279564 - DNA, 16 bp, Homo sapiens
ctctgtcaccgccatg

SEQ ID NO: 279565 - DNA, 23 bp, Homo sapiens
ctctgtcagtttgtgaagtgatt

SEQ ID NO: 279566 - DNA, 22 bp, Homo sapiens
ctctgtcatcactccctggatg

SEQ ID NO: 279567 - DNA, 21 bp, Homo sapiens
ctctgtccaattccagagctg

SEQ ID NO: 279568 - DNA, 11 bp, Homo sapiens
ctctgtccaca

SEQ ID NO: 279569 - DNA, 13 bp, Homo sapiens
ctctgtccaggcc

SEQ ID NO: 279570 - DNA, 21 bp, Homo sapiens
ctctgtccaggccactgtggc

SEQ ID NO: 279571 - DNA, 13 bp, Homo sapiens
ctctgtccagggc

SEQ ID NO: 279572 - DNA, 14 bp, Homo sapiens
ctctgtccagggct

SEQ ID NO: 279573 - DNA, 15 bp, Homo sapiens
ctctgtccagggctt

SEQ ID NO: 279574 - DNA, 18 bp, Homo sapiens
ctctgtccagggcttcag

SEQ ID NO: 279575 - DNA, 22 bp, Homo sapiens
ctctgtcccggttcaccttgcc

SEQ ID NO: 279576 - DNA, 18 bp, Homo sapiens
ctctgtcctggctgtgca

SEQ ID NO: 279577 - DNA, 15 bp, Homo sapiens
ctctgtctacaaata

SEQ ID NO: 279578 - DNA, 17 bp, Homo sapiens
ctctgtctaccatctcc

SEQ ID NO: 279579 - DNA, 21 bp, Homo sapiens
ctctgtctaccatctccctcg

SEQ ID NO: 279580 - DNA, 10 bp, Homo sapiens
ctctgtctca

SEQ ID NO: 279581 - DNA, 13 bp, Homo sapiens
ctctgtcttctct

SEQ ID NO: 279582 - DNA, 14 bp, Homo sapiens
ctctgtcttctctc

SEQ ID NO: 279583 - DNA, 16 bp, Homo sapiens
ctctgtcttctctcca

SEQ ID NO: 279584 - DNA, 21 bp, Homo sapiens
ctctgtctttttccttcctga

SEQ ID NO: 279585 - DNA, 21 bp, Homo sapiens
ctctgtgaatacaattaaagg

SEQ ID NO: 279586 - DNA, 19 bp, Homo sapiens
ctctgtgactcgcttagct

SEQ ID NO: 279587 - DNA, 14 bp, Homo sapiens
ctctgtgactgatg

SEQ ID NO: 279588 - DNA, 19 bp, Homo sapiens
ctctgtgcaggtgctgcct

SEQ ID NO: 279589 - DNA, 13 bp, Homo sapiens
ctctgtgcctaat

SEQ ID NO: 279590 - DNA, 16 bp, Homo sapiens
ctctgtgcctaataaa

SEQ ID NO: 279591 - DNA, 20 bp, Homo sapiens
ctctgtgctaagttgtctta

SEQ ID NO: 279592 - DNA, 13 bp, Homo sapiens
ctctgtgctcacc

SEQ ID NO: 279593 - DNA, 15 bp, Homo sapiens
ctctgtggcctgtgt

SEQ ID NO: 279594 - DNA, 16 bp, Homo sapiens
ctctgtggcctgtgtc

SEQ ID NO: 279595 - DNA, 19 bp, Homo sapiens
ctctgtggcctgtgtccag

SEQ ID NO: 279596 - DNA, 19 bp, Homo sapiens
ctctgtgtaatctctgatt

SEQ ID NO: 279597 - DNA, 21 bp, Homo sapiens
ctctgtgtgagcgtgtccaca

SEQ ID NO: 279598 - DNA, 13 bp, Homo sapiens
ctctgtgtggcaa

SEQ ID NO: 279599 - DNA, 15 bp, Homo sapiens
ctctgtgtggcaaac

SEQ ID NO: 279600 - DNA, 19 bp, Homo sapiens
ctctgtgtggcaaacattt

SEQ ID NO: 279601 - DNA, 20 bp, Homo sapiens
ctctgtgtggcaaacattta

SEQ ID NO: 279602 - DNA, 16 bp, Homo sapiens
ctctgttacatcctgc

SEQ ID NO: 279603 - DNA, 19 bp, Homo sapiens
ctctgttacatcctgctac

SEQ ID NO: 279604 - DNA, 15 bp, Homo sapiens
ctctgttacccaggc

SEQ ID NO: 279605 - DNA, 14 bp, Homo sapiens
ctctgttcagtaac

SEQ ID NO: 279606 - DNA, 21 bp, Homo sapiens
ctctgttcagtaacagggcct

SEQ ID NO: 279607 - DNA, 15 bp, Homo sapiens
ctctgttcagtcgca

SEQ ID NO: 279608 - DNA, 21 bp, Homo sapiens
ctctgttccaagtgtgtgtgc

SEQ ID NO: 279609 - DNA, 14 bp, Homo sapiens
ctctgttcctggct

SEQ ID NO: 279610 - DNA, 22 bp, Homo sapiens
ctctgttcctggctcagcctca

SEQ ID NO: 279611 - DNA, 18 bp, Homo sapiens
ctctgttctggtggcccc

SEQ ID NO: 279612 - DNA, 15 bp, Homo sapiens
ctctgttgcctcctc

SEQ ID NO: 279613 - DNA, 17 bp, Homo sapiens
ctctgttgcctcctctc

SEQ ID NO: 279614 - DNA, 22 bp, Homo sapiens
ctctgttgcctcctctctccct

SEQ ID NO: 279615 - DNA, 21 bp, Homo sapiens
ctcttaaatgaagtgcccact

SEQ ID NO: 279616 - DNA, 14 bp, Homo sapiens
ctcttaattctgat

SEQ ID NO: 279617 - DNA, 20 bp, Homo sapiens
ctcttaccccgtccctttcc

SEQ ID NO: 279618 - DNA, 21 bp, Homo sapiens
ctcttaccccgtccctttccc

SEQ ID NO: 279619 - DNA, 20 bp, Homo sapiens
ctcttacccttctgtgccca

SEQ ID NO: 279620 - DNA, 20 bp, Homo sapiens
ctcttacctgtaatagcctc

SEQ ID NO: 279621 - DNA, 22 bp, Homo sapiens
ctcttacctgtaatagcctcac

SEQ ID NO: 279622 - DNA, 19 bp, Homo sapiens
ctcttactaaccaccattt

SEQ ID NO: 279623 - DNA, 17 bp, Homo sapiens
ctcttagcagcttccag

SEQ ID NO: 279624 - DNA, 19 bp, Homo sapiens
ctcttagcagcttccagat

SEQ ID NO: 279625 - DNA, 16 bp, Homo sapiens
ctcttagcttacagga

SEQ ID NO: 279626 - DNA, 12 bp, Homo sapiens
ctcttaggtcag

SEQ ID NO: 279627 - DNA, 17 bp, Homo sapiens
ctcttagtcctccctgc

SEQ ID NO: 279628 - DNA, 20 bp, Homo sapiens
ctcttagtgattgtgtctgc

SEQ ID NO: 279629 - DNA, 15 bp, Homo sapiens
ctcttagtgcccgcc

SEQ ID NO: 279630 - DNA, 21 bp, Homo sapiens
ctcttagtgcccgcctaggag

SEQ ID NO: 279631 - DNA, 20 bp, Homo sapiens
ctcttagtttttaaaaaggc

SEQ ID NO: 279632 - DNA, 18 bp, Homo sapiens
ctcttatagaatatttat

SEQ ID NO: 279633 - DNA, 21 bp, Homo sapiens
ctcttatagaatatttattac

SEQ ID NO: 279634 - DNA, 14 bp, Homo sapiens
ctcttatgaaatgg

SEQ ID NO: 279635 - DNA, 17 bp, Homo sapiens
ctcttatgcacacctcc

SEQ ID NO: 279636 - DNA, 23 bp, Homo sapiens
ctcttattctttacaaaatgaat

SEQ ID NO: 279637 - DNA, 12 bp, Homo sapiens
ctcttatttgct

SEQ ID NO: 279638 - DNA, 15 bp, Homo sapiens
ctcttattttacaat

SEQ ID NO: 279639 - DNA, 14 bp, Homo sapiens
ctcttcaaggccaa

SEQ ID NO: 279640 - DNA, 17 bp, Homo sapiens
ctcttcaccaggaagaa

SEQ ID NO: 279641 - DNA, 24 bp, Homo sapiens
ctcttcaccttggtttatgagaac

SEQ ID NO: 279642 - DNA, 22 bp, Homo sapiens
ctcttcagacacacggggcacc

SEQ ID NO: 279643 - DNA, 23 bp, Homo sapiens
ctcttcagcctcattcactgtcc

SEQ ID NO: 279644 - DNA, 13 bp, Homo sapiens
ctcttcaggcctc

SEQ ID NO: 279645 - DNA, 19 bp, Homo sapiens
ctcttcaggcctccctctc

SEQ ID NO: 279646 - DNA, 20 bp, Homo sapiens
ctcttcaggcctccctctct

SEQ ID NO: 279647 - DNA, 23 bp, Homo sapiens
ctcttcaggggtcacctcctcca

SEQ ID NO: 279648 - DNA, 15 bp, Homo sapiens
ctcttcaggttctta

SEQ ID NO: 279649 - DNA, 17 bp, Homo sapiens
ctcttcagtgtgttgac

SEQ ID NO: 279650 - DNA, 13 bp, Homo sapiens
ctcttcatacttt

SEQ ID NO: 279651 - DNA, 19 bp, Homo sapiens
ctcttcatactttttttca

SEQ ID NO: 279652 - DNA, 15 bp, Homo sapiens
ctcttccagcccaga

SEQ ID NO: 279653 - DNA, 20 bp, Homo sapiens
ctcttccaggaagcacaggc

SEQ ID NO: 279654 - DNA, 12 bp, Homo sapiens
ctcttccccaga

SEQ ID NO: 279655 - DNA, 19 bp, Homo sapiens
ctcttcccccatgtgcctg

SEQ ID NO: 279656 - DNA, 19 bp, Homo sapiens
ctcttcccccttcccctgc

SEQ ID NO: 279657 - DNA, 24 bp, Homo sapiens
ctcttcccctctaatgctcacgct

SEQ ID NO: 279658 - DNA, 16 bp, Homo sapiens
ctcttccctctcgctc

SEQ ID NO: 279659 - DNA, 19 bp, Homo sapiens
ctcttccctctcgctcccc

SEQ ID NO: 279660 - DNA, 16 bp, Homo sapiens
ctcttccgggagctgg

SEQ ID NO: 279661 - DNA, 15 bp, Homo sapiens
ctcttcctcatcctg

SEQ ID NO: 279662 - DNA, 18 bp, Homo sapiens
ctcttcctcatcctgctt

SEQ ID NO: 279663 - DNA, 15 bp, Homo sapiens
ctcttcctggacctg

SEQ ID NO: 279664 - DNA, 18 bp, Homo sapiens
ctcttcctggacctgagt

SEQ ID NO: 279665 - DNA, 15 bp, Homo sapiens
ctcttccttctctac

SEQ ID NO: 279666 - DNA, 19 bp, Homo sapiens
ctcttccttctctactcat

SEQ ID NO: 279667 - DNA, 22 bp, Homo sapiens
ctcttctacctcttccaggaag

SEQ ID NO: 279668 - DNA, 16 bp, Homo sapiens
ctcttctatcctgcaa

SEQ ID NO: 279669 - DNA, 15 bp, Homo sapiens
ctcttctcaagtgcc

SEQ ID NO: 279670 - DNA, 15 bp, Homo sapiens
ctcttctcagctcca

SEQ ID NO: 279671 - DNA, 19 bp, Homo sapiens
ctcttctcagctccactct

SEQ ID NO: 279672 - DNA, 13 bp, Homo sapiens
ctcttctccactg

SEQ ID NO: 279673 - DNA, 21 bp, Homo sapiens
ctcttctcttacgctctctgt

SEQ ID NO: 279674 - DNA, 11 bp, Homo sapiens
ctcttctgagc

SEQ ID NO: 279675 - DNA, 13 bp, Homo sapiens
ctcttctgctcca

SEQ ID NO: 279676 - DNA, 14 bp, Homo sapiens
ctcttctgctccac

SEQ ID NO: 279677 - DNA, 15 bp, Homo sapiens
ctcttctgctccacc

SEQ ID NO: 279678 - DNA, 16 bp, Homo sapiens
ctcttctgctccaccc

SEQ ID NO: 279679 - DNA, 19 bp, Homo sapiens
ctcttctgctccacccttg

SEQ ID NO: 279680 - DNA, 20 bp, Homo sapiens
ctcttctgctccacccttgg

SEQ ID NO: 279681 - DNA, 21 bp, Homo sapiens
ctcttctgctccacccttggc

SEQ ID NO: 279682 - DNA, 19 bp, Homo sapiens
ctcttctgggcagagcctg

SEQ ID NO: 279683 - DNA, 20 bp, Homo sapiens
ctcttctgggcagagcctgt

SEQ ID NO: 279684 - DNA, 21 bp, Homo sapiens
ctcttctgggcagagcctgtc

SEQ ID NO: 279685 - DNA, 22 bp, Homo sapiens
ctcttctgggcagagcctgtcc

SEQ ID NO: 279686 - DNA, 11 bp, Homo sapiens
ctcttcttcct

SEQ ID NO: 279687 - DNA, 20 bp, Homo sapiens
ctcttgaagatgctgaaaca

SEQ ID NO: 279688 - DNA, 15 bp, Homo sapiens
ctcttgactcaggtg

SEQ ID NO: 279689 - DNA, 23 bp, Homo sapiens
ctcttgactcaggtggtgtcctt

SEQ ID NO: 279690 - DNA, 15 bp, Homo sapiens
ctcttgagggagctt

SEQ ID NO: 279691 - DNA, 22 bp, Homo sapiens
ctcttgattcataatgacttaa

SEQ ID NO: 279692 - DNA, 18 bp, Homo sapiens
ctcttgcatctgggccag

SEQ ID NO: 279693 - DNA, 20 bp, Homo sapiens
ctcttgccactgcctcttcc

SEQ ID NO: 279694 - DNA, 22 bp, Homo sapiens
ctcttgccactgcctcttcctc

SEQ ID NO: 279695 - DNA, 12 bp, Homo sapiens
ctcttgcccccc

SEQ ID NO: 279696 - DNA, 16 bp, Homo sapiens
ctcttgccccccaccc

SEQ ID NO: 279697 - DNA, 19 bp, Homo sapiens
ctcttgccccccaccccag

SEQ ID NO: 279698 - DNA, 13 bp, Homo sapiens
ctcttgcctctct

SEQ ID NO: 279699 - DNA, 14 bp, Homo sapiens
ctcttgcctctctc

SEQ ID NO: 279700 - DNA, 17 bp, Homo sapiens
ctcttgcggtcccttct

SEQ ID NO: 279701 - DNA, 18 bp, Homo sapiens
ctcttgctattggaatgt

SEQ ID NO: 279702 - DNA, 12 bp, Homo sapiens
ctcttgctcact

SEQ ID NO: 279703 - DNA, 15 bp, Homo sapiens
ctcttgctcactccc

SEQ ID NO: 279704 - DNA, 17 bp, Homo sapiens
ctcttgctcactcccta

SEQ ID NO: 279705 - DNA, 20 bp, Homo sapiens
ctcttggactccctccccac

SEQ ID NO: 279706 - DNA, 22 bp, Homo sapiens
ctcttggactccctccccaccc

SEQ ID NO: 279707 - DNA, 21 bp, Homo sapiens
ctcttggcattttcctcgcct

SEQ ID NO: 279708 - DNA, 17 bp, Homo sapiens
ctcttgggctgagactg

SEQ ID NO: 279709 - DNA, 17 bp, Homo sapiens
ctcttggtcagcttttg

SEQ ID NO: 279710 - DNA, 16 bp, Homo sapiens
ctcttggtccctggtc

SEQ ID NO: 279711 - DNA, 13 bp, Homo sapiens
ctcttggtctctt

SEQ ID NO: 279712 - DNA, 21 bp, Homo sapiens
ctcttggtctctttctttcca

SEQ ID NO: 279713 - DNA, 15 bp, Homo sapiens
ctcttgtaaaaagag

SEQ ID NO: 279714 - DNA, 22 bp, Homo sapiens
ctcttgtattgctccattttct

SEQ ID NO: 279715 - DNA, 20 bp, Homo sapiens
ctcttgtcatttttaatatt

SEQ ID NO: 279716 - DNA, 21 bp, Homo sapiens
ctcttgtccctttccctacct

SEQ ID NO: 279717 - DNA, 16 bp, Homo sapiens
ctctttaatcttcagt

SEQ ID NO: 279718 - DNA, 16 bp, Homo sapiens
ctctttactcccttcc

SEQ ID NO: 279719 - DNA, 23 bp, Homo sapiens
ctctttactcccttcctggcctc

SEQ ID NO: 279720 - DNA, 15 bp, Homo sapiens
ctctttcagaaaaca

SEQ ID NO: 279721 - DNA, 17 bp, Homo sapiens
ctctttcagagaggtct

SEQ ID NO: 279722 - DNA, 21 bp, Homo sapiens
ctctttcctgcccttttcctg

SEQ ID NO: 279723 - DNA, 20 bp, Homo sapiens
ctctttcctgtgccaggact

SEQ ID NO: 279724 - DNA, 13 bp, Homo sapiens
ctctttccttgct

SEQ ID NO: 279725 - DNA, 23 bp, Homo sapiens
ctctttctacatgactgggcctc

SEQ ID NO: 279726 - DNA, 16 bp, Homo sapiens
ctctttctctctgtgt

SEQ ID NO: 279727 - DNA, 18 bp, Homo sapiens
ctctttctctgccagtga

SEQ ID NO: 279728 - DNA, 17 bp, Homo sapiens
ctctttgaaaattcttg

SEQ ID NO: 279729 - DNA, 12 bp, Homo sapiens
ctctttgtaaga

SEQ ID NO: 279730 - DNA, 18 bp, Homo sapiens
ctctttgtggggcttggc

SEQ ID NO: 279731 - DNA, 20 bp, Homo sapiens
ctctttgtggggcttggcgt

SEQ ID NO: 279732 - DNA, 21 bp, Homo sapiens
ctctttgtgtttttgttgttg

SEQ ID NO: 279733 - DNA, 11 bp, Homo sapiens
ctcttttacta

SEQ ID NO: 279734 - DNA, 16 bp, Homo sapiens
ctcttttccctctcta

SEQ ID NO: 279735 - DNA, 12 bp, Homo sapiens
ctcttttcctag

SEQ ID NO: 279736 - DNA, 15 bp, Homo sapiens
ctcttttggccttgt

SEQ ID NO: 279737 - DNA, 23 bp, Homo sapiens
ctcttttgttcctggctttgaca

SEQ ID NO: 279738 - DNA, 16 bp, Homo sapiens
ctctttttcttttcta

SEQ ID NO: 279739 - DNA, 21 bp, Homo sapiens
ctctttttttaaaaagttgat

SEQ ID NO: 279740 - DNA, 20 bp, Homo sapiens
ctgaaaaaaagtttacaagt

SEQ ID NO: 279741 - DNA, 15 bp, Homo sapiens
ctgaaaacgaagggg

SEQ ID NO: 279742 - DNA, 17 bp, Homo sapiens
ctgaaaacgaaggggcc

SEQ ID NO: 279743 - DNA, 15 bp, Homo sapiens
ctgaaaactgtaaat

SEQ ID NO: 279744 - DNA, 19 bp, Homo sapiens
ctgaaaactgtaaatacaa

SEQ ID NO: 279745 - DNA, 23 bp, Homo sapiens
ctgaaaagaaatgctaatgtaat

SEQ ID NO: 279746 - DNA, 15 bp, Homo sapiens
ctgaaaagtaaattg

SEQ ID NO: 279747 - DNA, 11 bp, Homo sapiens
ctgaaaagtgc

SEQ ID NO: 279748 - DNA, 11 bp, Homo sapiens
ctgaaaatatt

SEQ ID NO: 279749 - DNA, 20 bp, Homo sapiens
ctgaaaatatttttttctag

SEQ ID NO: 279750 - DNA, 13 bp, Homo sapiens
ctgaaaatcacta

SEQ ID NO: 279751 - DNA, 16 bp, Homo sapiens
ctgaaaatctaatatt

SEQ ID NO: 279752 - DNA, 20 bp, Homo sapiens
ctgaaaatctaatattaaaa

SEQ ID NO: 279753 - DNA, 22 bp, Homo sapiens
ctgaaaatgtttttctgccagg

SEQ ID NO: 279754 - DNA, 18 bp, Homo sapiens
ctgaaacacacaggccat

SEQ ID NO: 279755 - DNA, 15 bp, Homo sapiens
ctgaaacactttttc

SEQ ID NO: 279756 - DNA, 20 bp, Homo sapiens
ctgaaacattcacacagggc

SEQ ID NO: 279757 - DNA, 17 bp, Homo sapiens
ctgaaactatagaataa

SEQ ID NO: 279758 - DNA, 19 bp, Homo sapiens
ctgaaagaaacagttaact

SEQ ID NO: 279759 - DNA, 21 bp, Homo sapiens
ctgaaagaaacagttaacttt

SEQ ID NO: 279760 - DNA, 14 bp, Homo sapiens
ctgaaagaggctga

SEQ ID NO: 279761 - DNA, 14 bp, Homo sapiens
ctgaaagcagcagc

SEQ ID NO: 279762 - DNA, 16 bp, Homo sapiens
ctgaaagcagcagcta

SEQ ID NO: 279763 - DNA, 18 bp, Homo sapiens
ctgaaagcagcagctagg

SEQ ID NO: 279764 - DNA, 19 bp, Homo sapiens
ctgaaagcagcagctagga

SEQ ID NO: 279765 - DNA, 15 bp, Homo sapiens
ctgaaagcctgtctc

SEQ ID NO: 279766 - DNA, 23 bp, Homo sapiens
ctgaaagcctgtctctttccact

SEQ ID NO: 279767 - DNA, 22 bp, Homo sapiens
ctgaaaggaaaagtctttgcta

SEQ ID NO: 279768 - DNA, 16 bp, Homo sapiens
ctgaaagggagcccct

SEQ ID NO: 279769 - DNA, 12 bp, Homo sapiens
ctgaaagtgttt

SEQ ID NO: 279770 - DNA, 13 bp, Homo sapiens
ctgaaagtgtttt

SEQ ID NO: 279771 - DNA, 16 bp, Homo sapiens
ctgaaagtgttttact

SEQ ID NO: 279772 - DNA, 23 bp, Homo sapiens
ctgaaagtgttttactctttttc

SEQ ID NO: 279773 - DNA, 17 bp, Homo sapiens
ctgaaatacctttgcct

SEQ ID NO: 279774 - DNA, 19 bp, Homo sapiens
ctgaaatgtttccaggcat

SEQ ID NO: 279775 - DNA, 21 bp, Homo sapiens
ctgaaattaaacgagcgaaga

SEQ ID NO: 279776 - DNA, 18 bp, Homo sapiens
ctgaaattatgtcaaatg

SEQ ID NO: 279777 - DNA, 14 bp, Homo sapiens
ctgaaatttcccac

SEQ ID NO: 279778 - DNA, 15 bp, Homo sapiens
ctgaacaagaaagag

SEQ ID NO: 279779 - DNA, 18 bp, Homo sapiens
ctgaacaagaaagagtaa

SEQ ID NO: 279780 - DNA, 15 bp, Homo sapiens
ctgaacaattacctg

SEQ ID NO: 279781 - DNA, 23 bp, Homo sapiens
ctgaacaattacctgccaaatgc

SEQ ID NO: 279782 - DNA, 14 bp, Homo sapiens
ctgaacacaagcaa

SEQ ID NO: 279783 - DNA, 18 bp, Homo sapiens
ctgaacacatactagaaa

SEQ ID NO: 279784 - DNA, 15 bp, Homo sapiens
ctgaacataaatcag

SEQ ID NO: 279785 - DNA, 23 bp, Homo sapiens
ctgaacatttggaaaccatgcac

SEQ ID NO: 279786 - DNA, 18 bp, Homo sapiens
ctgaaccaccctttattc

SEQ ID NO: 279787 - DNA, 14 bp, Homo sapiens
ctgaaccattactg

SEQ ID NO: 279788 - DNA, 15 bp, Homo sapiens
ctgaaccattactgt

SEQ ID NO: 279789 - DNA, 14 bp, Homo sapiens
ctgaaccccatggg

SEQ ID NO: 279790 - DNA, 19 bp, Homo sapiens
ctgaaccccatgggcttgg

SEQ ID NO: 279791 - DNA, 18 bp, Homo sapiens
ctgaaccccccccccccg

SEQ ID NO: 279792 - DNA, 20 bp, Homo sapiens
ctgaaccttgttgatgccag

SEQ ID NO: 279793 - DNA, 23 bp, Homo sapiens
ctgaactaagttttgtgtgtata

SEQ ID NO: 279794 - DNA, 20 bp, Homo sapiens
ctgaactccatacagcctct

SEQ ID NO: 279795 - DNA, 20 bp, Homo sapiens
ctgaactcgcttctctgtga

SEQ ID NO: 279796 - DNA, 13 bp, Homo sapiens
ctgaactgctgct

SEQ ID NO: 279797 - DNA, 15 bp, Homo sapiens
ctgaactgctgctgg

SEQ ID NO: 279798 - DNA, 13 bp, Homo sapiens
ctgaactggccgc

SEQ ID NO: 279799 - DNA, 20 bp, Homo sapiens
ctgaactgtgcatcaaccag

SEQ ID NO: 279800 - DNA, 12 bp, Homo sapiens
ctgaactttgtt

SEQ ID NO: 279801 - DNA, 15 bp, Homo sapiens
ctgaacttttcagga

SEQ ID NO: 279802 - DNA, 12 bp, Homo sapiens
ctgaagaagcaa

SEQ ID NO: 279803 - DNA, 16 bp, Homo sapiens
ctgaagagatacccac

SEQ ID NO: 279804 - DNA, 19 bp, Homo sapiens
ctgaagagcgctcctctgc

SEQ ID NO: 279805 - DNA, 23 bp, Homo sapiens
ctgaagagcgctcctctgccttg

SEQ ID NO: 279806 - DNA, 12 bp, Homo sapiens
ctgaagagctga

SEQ ID NO: 279807 - DNA, 15 bp, Homo sapiens
ctgaagcaaatacca

SEQ ID NO: 279808 - DNA, 15 bp, Homo sapiens
ctgaagcatgtttca

SEQ ID NO: 279809 - DNA, 18 bp, Homo sapiens
ctgaagcatgtttcatgt

SEQ ID NO: 279810 - DNA, 18 bp, Homo sapiens
ctgaagccgccaggaccg

SEQ ID NO: 279811 - DNA, 16 bp, Homo sapiens
ctgaagcctctgccct

SEQ ID NO: 279812 - DNA, 22 bp, Homo sapiens
ctgaaggaataaattgctcctt

SEQ ID NO: 279813 - DNA, 20 bp, Homo sapiens
ctgaaggaatagccagagag

SEQ ID NO: 279814 - DNA, 23 bp, Homo sapiens
ctgaaggaatagccagagaggag

SEQ ID NO: 279815 - DNA, 23 bp, Homo sapiens
ctgaaggaattctggagtgagtt

SEQ ID NO: 279816 - DNA, 13 bp, Homo sapiens
ctgaaggagagga

SEQ ID NO: 279817 - DNA, 12 bp, Homo sapiens
ctgaaggagatt

SEQ ID NO: 279818 - DNA, 18 bp, Homo sapiens
ctgaaggagattttcctt

SEQ ID NO: 279819 - DNA, 20 bp, Homo sapiens
ctgaaggagattttccttcc

SEQ ID NO: 279820 - DNA, 21 bp, Homo sapiens
ctgaaggcaaatctcctttgt

SEQ ID NO: 279821 - DNA, 18 bp, Homo sapiens
ctgaaggcaacctggaag

SEQ ID NO: 279822 - DNA, 23 bp, Homo sapiens
ctgaaggctttcagggcctccag

SEQ ID NO: 279823 - DNA, 22 bp, Homo sapiens
ctgaaggggcacaccactgccc

SEQ ID NO: 279824 - DNA, 16 bp, Homo sapiens
ctgaaggggcttggct

SEQ ID NO: 279825 - DNA, 16 bp, Homo sapiens
ctgaagggtgacatcc

SEQ ID NO: 279826 - DNA, 21 bp, Homo sapiens
ctgaagggtgacatcccagga

SEQ ID NO: 279827 - DNA, 13 bp, Homo sapiens
ctgaaggttctgg

SEQ ID NO: 279828 - DNA, 14 bp, Homo sapiens
ctgaagtcactgca

SEQ ID NO: 279829 - DNA, 16 bp, Homo sapiens
ctgaagtcactgcaca

SEQ ID NO: 279830 - DNA, 13 bp, Homo sapiens
ctgaagtctcttt

SEQ ID NO: 279831 - DNA, 16 bp, Homo sapiens
ctgaagtcttgcattg

SEQ ID NO: 279832 - DNA, 18 bp, Homo sapiens
ctgaagtcttgcattgaa

SEQ ID NO: 279833 - DNA, 17 bp, Homo sapiens
ctgaagtctttgtacag

SEQ ID NO: 279834 - DNA, 23 bp, Homo sapiens
ctgaagtgtctaatgcattaact

SEQ ID NO: 279835 - DNA, 14 bp, Homo sapiens
ctgaataacaacaa

SEQ ID NO: 279836 - DNA, 14 bp, Homo sapiens
ctgaataacttgaa

SEQ ID NO: 279837 - DNA, 16 bp, Homo sapiens
ctgaataatttcttac

SEQ ID NO: 279838 - DNA, 20 bp, Homo sapiens
ctgaatacctctttgaaaga

SEQ ID NO: 279839 - DNA, 15 bp, Homo sapiens
ctgaatagaaatggg

SEQ ID NO: 279840 - DNA, 17 bp, Homo sapiens
ctgaatatcatatgtat

SEQ ID NO: 279841 - DNA, 20 bp, Homo sapiens
ctgaatatctgttcactttt

SEQ ID NO: 279842 - DNA, 14 bp, Homo sapiens
ctgaatattaagaa

SEQ ID NO: 279843 - DNA, 15 bp, Homo sapiens
ctgaatattaagaaa

SEQ ID NO: 279844 - DNA, 20 bp, Homo sapiens
ctgaatattaagaaacaatt

SEQ ID NO: 279845 - DNA, 15 bp, Homo sapiens
ctgaatattaatccc

SEQ ID NO: 279846 - DNA, 16 bp, Homo sapiens
ctgaatattatcattt

SEQ ID NO: 279847 - DNA, 21 bp, Homo sapiens
ctgaatattatcatttctcct

SEQ ID NO: 279848 - DNA, 22 bp, Homo sapiens
ctgaatattttttatttctaag

SEQ ID NO: 279849 - DNA, 16 bp, Homo sapiens
ctgaatcgtttcatgt

SEQ ID NO: 279850 - DNA, 20 bp, Homo sapiens
ctgaatctctcaaaatgtgc

SEQ ID NO: 279851 - DNA, 17 bp, Homo sapiens
ctgaatgaaatatcaga

SEQ ID NO: 279852 - DNA, 15 bp, Homo sapiens
ctgaatgcttctgag

SEQ ID NO: 279853 - DNA, 17 bp, Homo sapiens
ctgaatgcttctgagag

SEQ ID NO: 279854 - DNA, 18 bp, Homo sapiens
ctgaatgcttctgagagc

SEQ ID NO: 279855 - DNA, 18 bp, Homo sapiens
ctgaatggttccatgcct

SEQ ID NO: 279856 - DNA, 22 bp, Homo sapiens
ctgaatggttccatgcctgagg

SEQ ID NO: 279857 - DNA, 13 bp, Homo sapiens
ctgaatgttctga

SEQ ID NO: 279858 - DNA, 16 bp, Homo sapiens
ctgaattaaataaata

SEQ ID NO: 279859 - DNA, 15 bp, Homo sapiens
ctgaattctgaactt

SEQ ID NO: 279860 - DNA, 16 bp, Homo sapiens
ctgaattgttgaaact

SEQ ID NO: 279861 - DNA, 15 bp, Homo sapiens
ctgaatttaactact

SEQ ID NO: 279862 - DNA, 18 bp, Homo sapiens
ctgaatttctttgattta

SEQ ID NO: 279863 - DNA, 14 bp, Homo sapiens
ctgaatttgggcct

SEQ ID NO: 279864 - DNA, 16 bp, Homo sapiens
ctgacaaaaaggtgct

SEQ ID NO: 279865 - DNA, 19 bp, Homo sapiens
ctgacaaagtcatgaagct

SEQ ID NO: 279866 - DNA, 15 bp, Homo sapiens
ctgacaaatatttta

SEQ ID NO: 279867 - DNA, 20 bp, Homo sapiens
ctgacaaccaccgctcccca

SEQ ID NO: 279868 - DNA, 21 bp, Homo sapiens
ctgacaaccaccgctccccag

SEQ ID NO: 279869 - DNA, 18 bp, Homo sapiens
ctgacaaccactggtctg

SEQ ID NO: 279870 - DNA, 20 bp, Homo sapiens
ctgacaaccactggtctgta

SEQ ID NO: 279871 - DNA, 13 bp, Homo sapiens
ctgacaatcaact

SEQ ID NO: 279872 - DNA, 21 bp, Homo sapiens
ctgacaatcaactctaatagt

SEQ ID NO: 279873 - DNA, 16 bp, Homo sapiens
ctgacaatggcagcta

SEQ ID NO: 279874 - DNA, 18 bp, Homo sapiens
ctgacaatggcagctaga

SEQ ID NO: 279875 - DNA, 18 bp, Homo sapiens
ctgacacaggggacactg

SEQ ID NO: 279876 - DNA, 19 bp, Homo sapiens
ctgacacaggggacactga

SEQ ID NO: 279877 - DNA, 14 bp, Homo sapiens
ctgacacatgctct

SEQ ID NO: 279878 - DNA, 15 bp, Homo sapiens
ctgacacctaccatg

SEQ ID NO: 279879 - DNA, 17 bp, Homo sapiens
ctgacacctaccatgct

SEQ ID NO: 279880 - DNA, 19 bp, Homo sapiens
ctgacactgagccccacct

SEQ ID NO: 279881 - DNA, 20 bp, Homo sapiens
ctgacagagcaggtctgcag

SEQ ID NO: 279882 - DNA, 23 bp, Homo sapiens
ctgacagagcaggtctgcaggcc

SEQ ID NO: 279883 - DNA, 17 bp, Homo sapiens
ctgacataaacccatct

SEQ ID NO: 279884 - DNA, 20 bp, Homo sapiens
ctgacataaacccatctgta

SEQ ID NO: 279885 - DNA, 14 bp, Homo sapiens
ctgacatgtggggc

SEQ ID NO: 279886 - DNA, 21 bp, Homo sapiens
ctgacatgtggggccaggtca

SEQ ID NO: 279887 - DNA, 20 bp, Homo sapiens
ctgacattaacagttttcca

SEQ ID NO: 279888 - DNA, 12 bp, Homo sapiens
ctgaccacactt

SEQ ID NO: 279889 - DNA, 20 bp, Homo sapiens
ctgaccacacttcctgtcca

SEQ ID NO: 279890 - DNA, 21 bp, Homo sapiens
ctgaccacacttcctgtccag

SEQ ID NO: 279891 - DNA, 19 bp, Homo sapiens
ctgaccatccactctaccc

SEQ ID NO: 279892 - DNA, 22 bp, Homo sapiens
ctgaccatccactctaccctcc

SEQ ID NO: 279893 - DNA, 20 bp, Homo sapiens
ctgaccccacttatgctgct

SEQ ID NO: 279894 - DNA, 21 bp, Homo sapiens
ctgaccccacttatgctgctg

SEQ ID NO: 279895 - DNA, 13 bp, Homo sapiens
ctgaccccttgct

SEQ ID NO: 279896 - DNA, 12 bp, Homo sapiens
ctgacctcagca

SEQ ID NO: 279897 - DNA, 20 bp, Homo sapiens
ctgacctccctctaatttat

SEQ ID NO: 279898 - DNA, 22 bp, Homo sapiens
ctgacctcctggactgtaggac

SEQ ID NO: 279899 - DNA, 22 bp, Homo sapiens
ctgacctgcccccgctctgcca

SEQ ID NO: 279900 - DNA, 18 bp, Homo sapiens
ctgacctgctccgccagg

SEQ ID NO: 279901 - DNA, 18 bp, Homo sapiens
ctgacctggaagagctgg

SEQ ID NO: 279902 - DNA, 16 bp, Homo sapiens
ctgaccttagcgttct

SEQ ID NO: 279903 - DNA, 14 bp, Homo sapiens
ctgaccttcacagg

SEQ ID NO: 279904 - DNA, 18 bp, Homo sapiens
ctgaccttggctgactgg

SEQ ID NO: 279905 - DNA, 12 bp, Homo sapiens
ctgacgagagat

SEQ ID NO: 279906 - DNA, 14 bp, Homo sapiens
ctgacggccctgca

SEQ ID NO: 279907 - DNA, 15 bp, Homo sapiens
ctgacggccctgcaa

SEQ ID NO: 279908 - DNA, 17 bp, Homo sapiens
ctgacggccctgcaatg

SEQ ID NO: 279909 - DNA, 19 bp, Homo sapiens
ctgacggcgcccccagtgt

SEQ ID NO: 279910 - DNA, 22 bp, Homo sapiens
ctgacggctgtgtatttctgta

SEQ ID NO: 279911 - DNA, 18 bp, Homo sapiens
ctgacgtagctgcaaagg

SEQ ID NO: 279912 - DNA, 23 bp, Homo sapiens
ctgacgtagctgcaaaggacaga

SEQ ID NO: 279913 - DNA, 18 bp, Homo sapiens
ctgacgtttgacaccagg

SEQ ID NO: 279914 - DNA, 19 bp, Homo sapiens
ctgactattcttgatgtaa

SEQ ID NO: 279915 - DNA, 23 bp, Homo sapiens
ctgactattcttgatgtaaaatc

SEQ ID NO: 279916 - DNA, 18 bp, Homo sapiens
ctgactcaacatgttact

SEQ ID NO: 279917 - DNA, 14 bp, Homo sapiens
ctgactcagtccag

SEQ ID NO: 279918 - DNA, 13 bp, Homo sapiens
ctgactccagagt

SEQ ID NO: 279919 - DNA, 15 bp, Homo sapiens
ctgactccagagtct

SEQ ID NO: 279920 - DNA, 22 bp, Homo sapiens
ctgactccagagtctgagcccc

SEQ ID NO: 279921 - DNA, 19 bp, Homo sapiens
ctgactcccaaagagctgc

SEQ ID NO: 279922 - DNA, 21 bp, Homo sapiens
ctgactcccaaagagctgcct

SEQ ID NO: 279923 - DNA, 20 bp, Homo sapiens
ctgactcgtctgactgtgtg

SEQ ID NO: 279924 - DNA, 21 bp, Homo sapiens
ctgactcgtctgactgtgtgt

SEQ ID NO: 279925 - DNA, 21 bp, Homo sapiens
ctgactctgagtccactgctc

SEQ ID NO: 279926 - DNA, 21 bp, Homo sapiens
ctgactgcaacttctgtccct

SEQ ID NO: 279927 - DNA, 16 bp, Homo sapiens
ctgactggggctgggg

SEQ ID NO: 279928 - DNA, 18 bp, Homo sapiens
ctgactggggctggggtg

SEQ ID NO: 279929 - DNA, 12 bp, Homo sapiens
ctgactgggggc

SEQ ID NO: 279930 - DNA, 17 bp, Homo sapiens
ctgactgggggcctctg

SEQ ID NO: 279931 - DNA, 18 bp, Homo sapiens
ctgactgggggcctctgc

SEQ ID NO: 279932 - DNA, 22 bp, Homo sapiens
ctgactgggggcctctgcctcc

SEQ ID NO: 279933 - DNA, 12 bp, Homo sapiens
ctgactgtggcc

SEQ ID NO: 279934 - DNA, 17 bp, Homo sapiens
ctgactgtggccccctc

SEQ ID NO: 279935 - DNA, 19 bp, Homo sapiens
ctgactgtggccccctccg

SEQ ID NO: 279936 - DNA, 15 bp, Homo sapiens
ctgactgttgccttt

SEQ ID NO: 279937 - DNA, 16 bp, Homo sapiens
ctgacttcccagctgg

SEQ ID NO: 279938 - DNA, 24 bp, Homo sapiens
ctgacttcccagctggcagcgcct

SEQ ID NO: 279939 - DNA, 15 bp, Homo sapiens
ctgacttttacagct

SEQ ID NO: 279940 - DNA, 23 bp, Homo sapiens
ctgacttttacagcttttctctt

SEQ ID NO: 279941 - DNA, 23 bp, Homo sapiens
ctgagaaaatgagtgactagacg

SEQ ID NO: 279942 - DNA, 21 bp, Homo sapiens
ctgagaaacgtccatctctct

SEQ ID NO: 279943 - DNA, 22 bp, Homo sapiens
ctgagaaacgtccatctctctc

SEQ ID NO: 279944 - DNA, 16 bp, Homo sapiens
ctgagaaagcccacct

SEQ ID NO: 279945 - DNA, 18 bp, Homo sapiens
ctgagaagaggagccctc

SEQ ID NO: 279946 - DNA, 19 bp, Homo sapiens
ctgagaaggccagccctcc

SEQ ID NO: 279947 - DNA, 17 bp, Homo sapiens
ctgagaaggcgaggaga

SEQ ID NO: 279948 - DNA, 18 bp, Homo sapiens
ctgagaaggcgaggagag

SEQ ID NO: 279949 - DNA, 22 bp, Homo sapiens
ctgagaaggggaggacctctgg

SEQ ID NO: 279950 - DNA, 15 bp, Homo sapiens
ctgagaccagcctgg

SEQ ID NO: 279951 - DNA, 16 bp, Homo sapiens
ctgagaccttgatgag

SEQ ID NO: 279952 - DNA, 17 bp, Homo sapiens
ctgagacgggcatcgca

SEQ ID NO: 279953 - DNA, 17 bp, Homo sapiens
ctgagactcagacagga

SEQ ID NO: 279954 - DNA, 20 bp, Homo sapiens
ctgagactcagacaggaaag

SEQ ID NO: 279955 - DNA, 13 bp, Homo sapiens
ctgagactccaga

SEQ ID NO: 279956 - DNA, 17 bp, Homo sapiens
ctgagactgcagaggag

SEQ ID NO: 279957 - DNA, 21 bp, Homo sapiens
ctgagactgcagaggagccac

SEQ ID NO: 279958 - DNA, 14 bp, Homo sapiens
ctgagagaccatct

SEQ ID NO: 279959 - DNA, 19 bp, Homo sapiens
ctgagagaccatctcctat

SEQ ID NO: 279960 - DNA, 20 bp, Homo sapiens
ctgagagaccatctcctatc

SEQ ID NO: 279961 - DNA, 13 bp, Homo sapiens
ctgagagactttt

SEQ ID NO: 279962 - DNA, 15 bp, Homo sapiens
ctgagagccccagct

SEQ ID NO: 279963 - DNA, 18 bp, Homo sapiens
ctgagaggaggggtaaat

SEQ ID NO: 279964 - DNA, 23 bp, Homo sapiens
ctgagaggaggggtaaatatatg

SEQ ID NO: 279965 - DNA, 11 bp, Homo sapiens
ctgagaggttt

SEQ ID NO: 279966 - DNA, 21 bp, Homo sapiens
ctgagatgcgcaaagagtgtg

SEQ ID NO: 279967 - DNA, 18 bp, Homo sapiens
ctgagatgtttagtagct

SEQ ID NO: 279968 - DNA, 15 bp, Homo sapiens
ctgagattctgggaa

SEQ ID NO: 279969 - DNA, 16 bp, Homo sapiens
ctgagattctgggaaa

SEQ ID NO: 279970 - DNA, 20 bp, Homo sapiens
ctgagattctgggaaaggtg

SEQ ID NO: 279971 - DNA, 23 bp, Homo sapiens
ctgagattctgggaaaggtgctc

SEQ ID NO: 279972 - DNA, 15 bp, Homo sapiens
ctgagcaaatgtggc

SEQ ID NO: 279973 - DNA, 17 bp, Homo sapiens
ctgagcaaatgtggctc

SEQ ID NO: 279974 - DNA, 16 bp, Homo sapiens
ctgagcaactgtgcag

SEQ ID NO: 279975 - DNA, 20 bp, Homo sapiens
ctgagcaactgtgcagcacc

SEQ ID NO: 279976 - DNA, 21 bp, Homo sapiens
ctgagcacgggcaaagaaaac

SEQ ID NO: 279977 - DNA, 17 bp, Homo sapiens
ctgagcagtctacttct

SEQ ID NO: 279978 - DNA, 22 bp, Homo sapiens
ctgagcagtctacttctgtgtc

SEQ ID NO: 279979 - DNA, 23 bp, Homo sapiens
ctgagcagtctacttctgtgtct

SEQ ID NO: 279980 - DNA, 21 bp, Homo sapiens
ctgagcagttgttatattcat

SEQ ID NO: 279981 - DNA, 14 bp, Homo sapiens
ctgagccacagtgg

SEQ ID NO: 279982 - DNA, 17 bp, Homo sapiens
ctgagccacagtggggc

SEQ ID NO: 279983 - DNA, 21 bp, Homo sapiens
ctgagccaccgcgagggcctg

SEQ ID NO: 279984 - DNA, 19 bp, Homo sapiens
ctgagccaggagcctcctg

SEQ ID NO: 279985 - DNA, 20 bp, Homo sapiens
ctgagccaggagcctcctga

SEQ ID NO: 279986 - DNA, 15 bp, Homo sapiens
ctgagcccaggagct

SEQ ID NO: 279987 - DNA, 13 bp, Homo sapiens
ctgagcccaggcc

SEQ ID NO: 279988 - DNA, 14 bp, Homo sapiens
ctgagcccaggccg

SEQ ID NO: 279989 - DNA, 19 bp, Homo sapiens
ctgagccccctctcctgaa

SEQ ID NO: 279990 - DNA, 16 bp, Homo sapiens
ctgagccccctgcacc

SEQ ID NO: 279991 - DNA, 17 bp, Homo sapiens
ctgagccccctgcaccc

SEQ ID NO: 279992 - DNA, 21 bp, Homo sapiens
ctgagccccctgtgcccaccc

SEQ ID NO: 279993 - DNA, 17 bp, Homo sapiens
ctgagcccctaccccac

SEQ ID NO: 279994 - DNA, 22 bp, Homo sapiens
ctgagcccctaccccacaccag

SEQ ID NO: 279995 - DNA, 16 bp, Homo sapiens
ctgagcccctcctctc

SEQ ID NO: 279996 - DNA, 19 bp, Homo sapiens
ctgagccctccctcttccc

SEQ ID NO: 279997 - DNA, 19 bp, Homo sapiens
ctgagccctgccctcactc

SEQ ID NO: 279998 - DNA, 20 bp, Homo sapiens
ctgagcccttgcacaggcca

SEQ ID NO: 279999 - DNA, 22 bp, Homo sapiens
ctgagcccttgcacaggccact

SEQ ID NO: 280000 - DNA, 13 bp, Homo sapiens
ctgagcctactgt

SEQ ID NO: 280001 - DNA, 22 bp, Homo sapiens
ctgagcctactgtctccttccc

SEQ ID NO: 280002 - DNA, 15 bp, Homo sapiens
ctgagcctgccccag

SEQ ID NO: 280003 - DNA, 18 bp, Homo sapiens
ctgagcctgccccagctg

SEQ ID NO: 280004 - DNA, 22 bp, Homo sapiens
ctgagcctgccccagctgggct

SEQ ID NO: 280005 - DNA, 12 bp, Homo sapiens
ctgagcctgtct

SEQ ID NO: 280006 - DNA, 14 bp, Homo sapiens
ctgagcctgtctct

SEQ ID NO: 280007 - DNA, 11 bp, Homo sapiens
ctgagcctgtg

SEQ ID NO: 280008 - DNA, 12 bp, Homo sapiens
ctgagcctgtgg

SEQ ID NO: 280009 - DNA, 14 bp, Homo sapiens
ctgagcggccgcct

SEQ ID NO: 280010 - DNA, 19 bp, Homo sapiens
ctgagcggccgcctgtcct

SEQ ID NO: 280011 - DNA, 19 bp, Homo sapiens
ctgagctccaccctcccct

SEQ ID NO: 280012 - DNA, 20 bp, Homo sapiens
ctgagctccaccctcccctc

SEQ ID NO: 280013 - DNA, 15 bp, Homo sapiens
ctgagctcctctggg

SEQ ID NO: 280014 - DNA, 16 bp, Homo sapiens
ctgagctcctctgggc

SEQ ID NO: 280015 - DNA, 15 bp, Homo sapiens
ctgagctgccatcca

SEQ ID NO: 280016 - DNA, 23 bp, Homo sapiens
ctgagctggaaaggatgcttctg

SEQ ID NO: 280017 - DNA, 17 bp, Homo sapiens
ctgagcttgagctcccc

SEQ ID NO: 280018 - DNA, 22 bp, Homo sapiens
ctgagcttgattctaaagggga

SEQ ID NO: 280019 - DNA, 12 bp, Homo sapiens
ctgagcttggcc

SEQ ID NO: 280020 - DNA, 15 bp, Homo sapiens
ctgagcttggccaga

SEQ ID NO: 280021 - DNA, 22 bp, Homo sapiens
ctgagctttggacacacacagc

SEQ ID NO: 280022 - DNA, 13 bp, Homo sapiens
ctgagctttgtta

SEQ ID NO: 280023 - DNA, 19 bp, Homo sapiens
ctgagcttttcatggaagt

SEQ ID NO: 280024 - DNA, 21 bp, Homo sapiens
ctgaggaaggaggggaagctg

SEQ ID NO: 280025 - DNA, 23 bp, Homo sapiens
ctgaggaaggaggggaagctgca

SEQ ID NO: 280026 - DNA, 23 bp, Homo sapiens
ctgaggaatgaatagaaaggctt

SEQ ID NO: 280027 - DNA, 21 bp, Homo sapiens
ctgaggaatgcggttcagggc

SEQ ID NO: 280028 - DNA, 14 bp, Homo sapiens
ctgaggacaggccc

SEQ ID NO: 280029 - DNA, 13 bp, Homo sapiens
ctgaggacggggc

SEQ ID NO: 280030 - DNA, 16 bp, Homo sapiens
ctgaggactccctcca

SEQ ID NO: 280031 - DNA, 13 bp, Homo sapiens
ctgaggactctgg

SEQ ID NO: 280032 - DNA, 20 bp, Homo sapiens
ctgaggactctggaccccag

SEQ ID NO: 280033 - DNA, 16 bp, Homo sapiens
ctgaggagtaaaaaga

SEQ ID NO: 280034 - DNA, 12 bp, Homo sapiens
ctgaggagtcca

SEQ ID NO: 280035 - DNA, 17 bp, Homo sapiens
ctgaggcaaccccctcg

SEQ ID NO: 280036 - DNA, 15 bp, Homo sapiens
ctgaggcagaacctg

SEQ ID NO: 280037 - DNA, 16 bp, Homo sapiens
ctgaggcagaacctgg

SEQ ID NO: 280038 - DNA, 22 bp, Homo sapiens
ctgaggcagaacctggtggctg

SEQ ID NO: 280039 - DNA, 17 bp, Homo sapiens
ctgaggccattccctgt

SEQ ID NO: 280040 - DNA, 20 bp, Homo sapiens
ctgaggccattccctgtagg

SEQ ID NO: 280041 - DNA, 13 bp, Homo sapiens
ctgaggcccagag

SEQ ID NO: 280042 - DNA, 15 bp, Homo sapiens
ctgaggcccagagag

SEQ ID NO: 280043 - DNA, 16 bp, Homo sapiens
ctgaggcccagagagc

SEQ ID NO: 280044 - DNA, 18 bp, Homo sapiens
ctgaggcccagagagctg

SEQ ID NO: 280045 - DNA, 14 bp, Homo sapiens
ctgaggcccagcag

SEQ ID NO: 280046 - DNA, 23 bp, Homo sapiens
ctgaggccccttaactcatctgt

SEQ ID NO: 280047 - DNA, 15 bp, Homo sapiens
ctgaggcctcatccc

SEQ ID NO: 280048 - DNA, 15 bp, Homo sapiens
ctgaggcctccagct

SEQ ID NO: 280049 - DNA, 15 bp, Homo sapiens
ctgaggcctggactt

SEQ ID NO: 280050 - DNA, 22 bp, Homo sapiens
ctgaggcctggactttcctgca

SEQ ID NO: 280051 - DNA, 14 bp, Homo sapiens
ctgaggccttccag

SEQ ID NO: 280052 - DNA, 15 bp, Homo sapiens
ctgaggccttccaga

SEQ ID NO: 280053 - DNA, 16 bp, Homo sapiens
ctgaggcgctcgctcc

SEQ ID NO: 280054 - DNA, 15 bp, Homo sapiens
ctgaggcttagagag

SEQ ID NO: 280055 - DNA, 22 bp, Homo sapiens
ctgaggcttagagagaggaggc

SEQ ID NO: 280056 - DNA, 23 bp, Homo sapiens
ctgaggcttagagagaggaggca

SEQ ID NO: 280057 - DNA, 20 bp, Homo sapiens
ctgagggaagcccacccgcc

SEQ ID NO: 280058 - DNA, 22 bp, Homo sapiens
ctgagggaagcccacccgcccc

SEQ ID NO: 280059 - DNA, 18 bp, Homo sapiens
ctgagggaccaactgggc

SEQ ID NO: 280060 - DNA, 21 bp, Homo sapiens
ctgagggaccaactgggccca

SEQ ID NO: 280061 - DNA, 15 bp, Homo sapiens
ctgagggaccttgga

SEQ ID NO: 280062 - DNA, 16 bp, Homo sapiens
ctgagggaccttggag

SEQ ID NO: 280063 - DNA, 18 bp, Homo sapiens
ctgagggaccttggagag

SEQ ID NO: 280064 - DNA, 19 bp, Homo sapiens
ctgagggaccttggagagc

SEQ ID NO: 280065 - DNA, 11 bp, Homo sapiens
ctgagggcact

SEQ ID NO: 280066 - DNA, 20 bp, Homo sapiens
ctgagggcactctctgccag

SEQ ID NO: 280067 - DNA, 21 bp, Homo sapiens
ctgagggcactctctgccagc

SEQ ID NO: 280068 - DNA, 23 bp, Homo sapiens
ctgagggcactctctgccagctc

SEQ ID NO: 280069 - DNA, 21 bp, Homo sapiens
ctgagggcagggttctagaag

SEQ ID NO: 280070 - DNA, 16 bp, Homo sapiens
ctgagggccacactat

SEQ ID NO: 280071 - DNA, 13 bp, Homo sapiens
ctgagggcccctc

SEQ ID NO: 280072 - DNA, 16 bp, Homo sapiens
ctgagggcccctctgc

SEQ ID NO: 280073 - DNA, 22 bp, Homo sapiens
ctgagggctaattctgggaagg

SEQ ID NO: 280074 - DNA, 19 bp, Homo sapiens
ctgaggggcaacgaagaaa

SEQ ID NO: 280075 - DNA, 18 bp, Homo sapiens
ctgaggggcatctgcccc

SEQ ID NO: 280076 - DNA, 17 bp, Homo sapiens
ctgagggtctggtgcca

SEQ ID NO: 280077 - DNA, 21 bp, Homo sapiens
ctgaggtctcttgagggagct

SEQ ID NO: 280078 - DNA, 21 bp, Homo sapiens
ctgaggtgggaggatcacttg

SEQ ID NO: 280079 - DNA, 22 bp, Homo sapiens
ctgaggtgggaggatcacttga

SEQ ID NO: 280080 - DNA, 15 bp, Homo sapiens
ctgaggttaagggga

SEQ ID NO: 280081 - DNA, 14 bp, Homo sapiens
ctgagtaccttcta

SEQ ID NO: 280082 - DNA, 15 bp, Homo sapiens
ctgagtaccttctac

SEQ ID NO: 280083 - DNA, 19 bp, Homo sapiens
ctgagtagctctcctgact

SEQ ID NO: 280084 - DNA, 17 bp, Homo sapiens
ctgagtcagggcccaga

SEQ ID NO: 280085 - DNA, 12 bp, Homo sapiens
ctgagtcagttt

SEQ ID NO: 280086 - DNA, 18 bp, Homo sapiens
ctgagtcatcaaaaagag

SEQ ID NO: 280087 - DNA, 22 bp, Homo sapiens
ctgagtcatcaaaaagagtctt

SEQ ID NO: 280088 - DNA, 12 bp, Homo sapiens
ctgagtcatgcg

SEQ ID NO: 280089 - DNA, 13 bp, Homo sapiens
ctgagtccagctc

SEQ ID NO: 280090 - DNA, 14 bp, Homo sapiens
ctgagtccagctcc

SEQ ID NO: 280091 - DNA, 20 bp, Homo sapiens
ctgagtccagctccccccaa

SEQ ID NO: 280092 - DNA, 15 bp, Homo sapiens
ctgagtccccacctg

SEQ ID NO: 280093 - DNA, 12 bp, Homo sapiens
ctgagtcctgtt

SEQ ID NO: 280094 - DNA, 22 bp, Homo sapiens
ctgagtccttaaacagggcatc

SEQ ID NO: 280095 - DNA, 15 bp, Homo sapiens
ctgagtcggctgggc

SEQ ID NO: 280096 - DNA, 16 bp, Homo sapiens
ctgagtcggctgggca

SEQ ID NO: 280097 - DNA, 23 bp, Homo sapiens
ctgagtcggctgggcagggccgc

SEQ ID NO: 280098 - DNA, 21 bp, Homo sapiens
ctgagtctcattcctctgtcc

SEQ ID NO: 280099 - DNA, 14 bp, Homo sapiens
ctgagtctcctgtg

SEQ ID NO: 280100 - DNA, 19 bp, Homo sapiens
ctgagtctggcaaacatgt

SEQ ID NO: 280101 - DNA, 21 bp, Homo sapiens
ctgagtctggcaaacatgtgc

SEQ ID NO: 280102 - DNA, 14 bp, Homo sapiens
ctgagtctggctag

SEQ ID NO: 280103 - DNA, 17 bp, Homo sapiens
ctgagtctggctagggg

SEQ ID NO: 280104 - DNA, 20 bp, Homo sapiens
ctgagtctggctaggggccg

SEQ ID NO: 280105 - DNA, 14 bp, Homo sapiens
ctgagtctgtggac

SEQ ID NO: 280106 - DNA, 11 bp, Homo sapiens
ctgagtgaaca

SEQ ID NO: 280107 - DNA, 21 bp, Homo sapiens
ctgagtgcagaggctgagcag

SEQ ID NO: 280108 - DNA, 17 bp, Homo sapiens
ctgagtggaatgcaggg

SEQ ID NO: 280109 - DNA, 22 bp, Homo sapiens
ctgagtggtccacattctgctg

SEQ ID NO: 280110 - DNA, 15 bp, Homo sapiens
ctgagttacttgtct

SEQ ID NO: 280111 - DNA, 19 bp, Homo sapiens
ctgagttacttgtctgagg

SEQ ID NO: 280112 - DNA, 20 bp, Homo sapiens
ctgagttacttgtctgaggc

SEQ ID NO: 280113 - DNA, 24 bp, Homo sapiens
ctgagttacttgtctgaggcctca

SEQ ID NO: 280114 - DNA, 21 bp, Homo sapiens
ctgagttctcatccacagagg

SEQ ID NO: 280115 - DNA, 19 bp, Homo sapiens
ctgagttctggtcaaagaa

SEQ ID NO: 280116 - DNA, 22 bp, Homo sapiens
ctgagttgcaccattctttctt

SEQ ID NO: 280117 - DNA, 21 bp, Homo sapiens
ctgagttggcgttgtgggcag

SEQ ID NO: 280118 - DNA, 23 bp, Homo sapiens
ctgagttggcgttgtgggcaggc

SEQ ID NO: 280119 - DNA, 18 bp, Homo sapiens
ctgagtttaccatttgta

SEQ ID NO: 280120 - DNA, 19 bp, Homo sapiens
ctgagtttaccatttgtaa

SEQ ID NO: 280121 - DNA, 22 bp, Homo sapiens
ctgagtttaccatttgtaataa

SEQ ID NO: 280122 - DNA, 18 bp, Homo sapiens
ctgagtttagtttttcac

SEQ ID NO: 280123 - DNA, 22 bp, Homo sapiens
ctgagtttgtggtgatcgcaca

SEQ ID NO: 280124 - DNA, 21 bp, Homo sapiens
ctgagttttctctttgtgggg

SEQ ID NO: 280125 - DNA, 12 bp, Homo sapiens
ctgataaaatac

SEQ ID NO: 280126 - DNA, 17 bp, Homo sapiens
ctgataaacattaaaca

SEQ ID NO: 280127 - DNA, 22 bp, Homo sapiens
ctgataaacattaaacactgta

SEQ ID NO: 280128 - DNA, 17 bp, Homo sapiens
ctgataaagaaaccttt

SEQ ID NO: 280129 - DNA, 18 bp, Homo sapiens
ctgataactagatggtgc

SEQ ID NO: 280130 - DNA, 19 bp, Homo sapiens
ctgataactagatggtgct

SEQ ID NO: 280131 - DNA, 23 bp, Homo sapiens
ctgataactagatggtgctgaga

SEQ ID NO: 280132 - DNA, 18 bp, Homo sapiens
ctgataacttggggaggc

SEQ ID NO: 280133 - DNA, 17 bp, Homo sapiens
ctgataagactggaaaa

SEQ ID NO: 280134 - DNA, 13 bp, Homo sapiens
ctgataagggaga

SEQ ID NO: 280135 - DNA, 14 bp, Homo sapiens
ctgataagggagag

SEQ ID NO: 280136 - DNA, 15 bp, Homo sapiens
ctgataagggagagg

SEQ ID NO: 280137 - DNA, 18 bp, Homo sapiens
ctgataagggagagggaa

SEQ ID NO: 280138 - DNA, 12 bp, Homo sapiens
ctgatacctcaa

SEQ ID NO: 280139 - DNA, 22 bp, Homo sapiens
ctgatactgggtacaagagcca

SEQ ID NO: 280140 - DNA, 18 bp, Homo sapiens
ctgatagctaagtgagtt

SEQ ID NO: 280141 - DNA, 15 bp, Homo sapiens
ctgatagtagtaaaa

SEQ ID NO: 280142 - DNA, 19 bp, Homo sapiens
ctgatagtagtaaaattag

SEQ ID NO: 280143 - DNA, 20 bp, Homo sapiens
ctgatagtagtaaaattaga

SEQ ID NO: 280144 - DNA, 22 bp, Homo sapiens
ctgatagtagtaaaattagaaa

SEQ ID NO: 280145 - DNA, 19 bp, Homo sapiens
ctgatagtcacctgctggt

SEQ ID NO: 280146 - DNA, 21 bp, Homo sapiens
ctgatagtcacctgctggttg

SEQ ID NO: 280147 - DNA, 21 bp, Homo sapiens
ctgatatacttgagtgtgcaa

SEQ ID NO: 280148 - DNA, 15 bp, Homo sapiens
ctgatatcacgggcc

SEQ ID NO: 280149 - DNA, 19 bp, Homo sapiens
ctgatattcaaacacacag

SEQ ID NO: 280150 - DNA, 22 bp, Homo sapiens
ctgatattgccgcactagggga

SEQ ID NO: 280151 - DNA, 15 bp, Homo sapiens
ctgatatttgctgga

SEQ ID NO: 280152 - DNA, 17 bp, Homo sapiens
ctgatatttgctggagt

SEQ ID NO: 280153 - DNA, 21 bp, Homo sapiens
ctgatatttgctggagtgctg

SEQ ID NO: 280154 - DNA, 18 bp, Homo sapiens
ctgatcaaagcaccttga

SEQ ID NO: 280155 - DNA, 13 bp, Homo sapiens
ctgatcagtctaa

SEQ ID NO: 280156 - DNA, 14 bp, Homo sapiens
ctgatcatgcattg

SEQ ID NO: 280157 - DNA, 16 bp, Homo sapiens
ctgatcatgcattgtt

SEQ ID NO: 280158 - DNA, 22 bp, Homo sapiens
ctgatcattacatggctgtggt

SEQ ID NO: 280159 - DNA, 21 bp, Homo sapiens
ctgatccagagcacagatctg

SEQ ID NO: 280160 - DNA, 12 bp, Homo sapiens
ctgatcccactc

SEQ ID NO: 280161 - DNA, 17 bp, Homo sapiens
ctgatcccataaagaaa

SEQ ID NO: 280162 - DNA, 20 bp, Homo sapiens
ctgatcctgaacaagaaaga

SEQ ID NO: 280163 - DNA, 16 bp, Homo sapiens
ctgatcttgtgctcag

SEQ ID NO: 280164 - DNA, 17 bp, Homo sapiens
ctgatgagaatactgag

SEQ ID NO: 280165 - DNA, 13 bp, Homo sapiens
ctgatgagacaac

SEQ ID NO: 280166 - DNA, 22 bp, Homo sapiens
ctgatgatagacttcgaaaaca

SEQ ID NO: 280167 - DNA, 13 bp, Homo sapiens
ctgatgatataaa

SEQ ID NO: 280168 - DNA, 14 bp, Homo sapiens
ctgatgatcaaaac

SEQ ID NO: 280169 - DNA, 21 bp, Homo sapiens
ctgatgatcaaaacctgtgcc

SEQ ID NO: 280170 - DNA, 23 bp, Homo sapiens
ctgatgatcaaaacctgtgccag

SEQ ID NO: 280171 - DNA, 23 bp, Homo sapiens
cttttgtagtttgtattaaactt

SEQ ID NO: 280172 - DNA, 18 bp, Homo sapiens
cttttgtgcctggcttct

SEQ ID NO: 280173 - DNA, 21 bp, Homo sapiens
cttttgtgggtttctctgtgc

SEQ ID NO: 280174 - DNA, 22 bp, Homo sapiens
cttttgtgggtttctctgtgct

SEQ ID NO: 280175 - DNA, 16 bp, Homo sapiens
cttttgtgtattctgt

SEQ ID NO: 280176 - DNA, 14 bp, Homo sapiens
cttttgttctagac

SEQ ID NO: 280177 - DNA, 14 bp, Homo sapiens
cttttgttctctct

SEQ ID NO: 280178 - DNA, 15 bp, Homo sapiens
cttttgttcttcccc

SEQ ID NO: 280179 - DNA, 17 bp, Homo sapiens
cttttgttgtgactttt

SEQ ID NO: 280180 - DNA, 18 bp, Homo sapiens
cttttgttttcctgctgg

SEQ ID NO: 280181 - DNA, 14 bp, Homo sapiens
ctttttaaaaatga

SEQ ID NO: 280182 - DNA, 12 bp, Homo sapiens
ctttttaaacag

SEQ ID NO: 280183 - DNA, 20 bp, Homo sapiens
ctttttaccgttcacttccc

SEQ ID NO: 280184 - DNA, 14 bp, Homo sapiens
ctttttatatttta

SEQ ID NO: 280185 - DNA, 12 bp, Homo sapiens
ctttttcacata

SEQ ID NO: 280186 - DNA, 14 bp, Homo sapiens
ctttttcacgttta

SEQ ID NO: 280187 - DNA, 21 bp, Homo sapiens
ctttttcccagccctttccag

SEQ ID NO: 280188 - DNA, 16 bp, Homo sapiens
ctttttccttatttca

SEQ ID NO: 280189 - DNA, 13 bp, Homo sapiens
ctttttccttcct

SEQ ID NO: 280190 - DNA, 14 bp, Homo sapiens
ctttttctccaccc

SEQ ID NO: 280191 - DNA, 22 bp, Homo sapiens
ctttttctggactgaagcctgc

SEQ ID NO: 280192 - DNA, 13 bp, Homo sapiens
ctttttcttcctc

SEQ ID NO: 280193 - DNA, 14 bp, Homo sapiens
ctttttcttcctca

SEQ ID NO: 280194 - DNA, 12 bp, Homo sapiens
ctttttcttgta

SEQ ID NO: 280195 - DNA, 14 bp, Homo sapiens
ctttttcttttcta

SEQ ID NO: 280196 - DNA, 19 bp, Homo sapiens
ctttttgaatgttatttgt

SEQ ID NO: 280197 - DNA, 20 bp, Homo sapiens
ctttttgagtaattttctga

SEQ ID NO: 280198 - DNA, 21 bp, Homo sapiens
ctttttgagtaattttctgat

SEQ ID NO: 280199 - DNA, 15 bp, Homo sapiens
ctttttggaggtgct

SEQ ID NO: 280200 - DNA, 21 bp, Homo sapiens
ctttttgtaaatactgcttga

SEQ ID NO: 280201 - DNA, 24 bp, Homo sapiens
ctttttgtgtgcaggctgtctcat

SEQ ID NO: 280202 - DNA, 14 bp, Homo sapiens
cttttttaaaaaaa

SEQ ID NO: 280203 - DNA, 18 bp, Homo sapiens
cttttttatagcttaact

SEQ ID NO: 280204 - DNA, 17 bp, Homo sapiens
cttttttattgaataac

SEQ ID NO: 280205 - DNA, 17 bp, Homo sapiens
cttttttcctgtcaata

SEQ ID NO: 280206 - DNA, 19 bp, Homo sapiens
cttttttcctgtcaatata

SEQ ID NO: 280207 - DNA, 22 bp, Homo sapiens
cttttttcctgtcaatatatag

SEQ ID NO: 280208 - DNA, 11 bp, Homo sapiens
cttttttctct

SEQ ID NO: 280209 - DNA, 15 bp, Homo sapiens
cttttttctttcttt

SEQ ID NO: 280210 - DNA, 19 bp, Homo sapiens
cttttttgtcccccaactt

SEQ ID NO: 280211 - DNA, 16 bp, Homo sapiens
ctttttttggcccagg

SEQ ID NO: 280212 - DNA, 15 bp, Homo sapiens
cttttttttcatcct

SEQ ID NO: 280213 - DNA, 14 bp, Homo sapiens
cttttttttcttgg

SEQ ID NO: 280214 - DNA, 22 bp, Homo sapiens
ctttttttttctctttctctcc

SEQ ID NO: 280215 - DNA, 21 bp, Homo sapiens
ctttttttttgaaacagcagt

SEQ ID NO: 280216 - DNA, 18 bp, Homo sapiens
ctttttttttttttttga

SEQ ID NO: 280217 - DNA, 19 bp, Homo sapiens
gaaaaaaaaagaataatga

SEQ ID NO: 280218 - DNA, 18 bp, Homo sapiens
gaaaaaaaaatgttcatt

SEQ ID NO: 280219 - DNA, 14 bp, Homo sapiens
gaaaaaaaacacac

SEQ ID NO: 280220 - DNA, 19 bp, Homo sapiens
gaaaaaaagggaaaacaaa

SEQ ID NO: 280221 - DNA, 19 bp, Homo sapiens
gaaaaaaaggttaacagta

SEQ ID NO: 280222 - DNA, 22 bp, Homo sapiens
gaaaaaaaggttaacagtaaaa

SEQ ID NO: 280223 - DNA, 19 bp, Homo sapiens
gaaaaaaataattttatga

SEQ ID NO: 280224 - DNA, 23 bp, Homo sapiens
gaaaaaaataattttatgaactg

SEQ ID NO: 280225 - DNA, 14 bp, Homo sapiens
gaaaaaaatagttt

SEQ ID NO: 280226 - DNA, 14 bp, Homo sapiens
gaaaaaagtacaga

SEQ ID NO: 280227 - DNA, 23 bp, Homo sapiens
gaaaaacacggcagctgtagctc

SEQ ID NO: 280228 - DNA, 12 bp, Homo sapiens
gaaaaacatgtc

SEQ ID NO: 280229 - DNA, 15 bp, Homo sapiens
gaaaaagaaattctg

SEQ ID NO: 280230 - DNA, 18 bp, Homo sapiens
gaaaaagaaattctgtta

SEQ ID NO: 280231 - DNA, 18 bp, Homo sapiens
gaaaaaggagcttacctc

SEQ ID NO: 280232 - DNA, 12 bp, Homo sapiens
gaaaaataaata

SEQ ID NO: 280233 - DNA, 14 bp, Homo sapiens
gaaaaatcttgtgc

SEQ ID NO: 280234 - DNA, 22 bp, Homo sapiens
gaaaaatggatccccagtgaaa

SEQ ID NO: 280235 - DNA, 18 bp, Homo sapiens
gaaaaatgtaaaacacat

SEQ ID NO: 280236 - DNA, 16 bp, Homo sapiens
gaaaaatttaagcatt

SEQ ID NO: 280237 - DNA, 19 bp, Homo sapiens
gaaaaatttaagcattgtt

SEQ ID NO: 280238 - DNA, 20 bp, Homo sapiens
gaaaaatttaagcattgttt

SEQ ID NO: 280239 - DNA, 14 bp, Homo sapiens
gaaaacaacaaaaa

SEQ ID NO: 280240 - DNA, 19 bp, Homo sapiens
gaaaacaatgcaaaacctt

SEQ ID NO: 280241 - DNA, 14 bp, Homo sapiens
gaaaacactttcct

SEQ ID NO: 280242 - DNA, 11 bp, Homo sapiens
gaaaacagaaa

SEQ ID NO: 280243 - DNA, 21 bp, Homo sapiens
gaaaacagacctaatgctcct

SEQ ID NO: 280244 - DNA, 21 bp, Homo sapiens
gaaaacaggaaaaaaactttt

SEQ ID NO: 280245 - DNA, 19 bp, Homo sapiens
gaaaacagtcgatcaaggg

SEQ ID NO: 280246 - DNA, 16 bp, Homo sapiens
gaaaacagtgaatctt

SEQ ID NO: 280247 - DNA, 18 bp, Homo sapiens
gaaaacagtgaatcttat

SEQ ID NO: 280248 - DNA, 15 bp, Homo sapiens
gaaaacataaaaatc

SEQ ID NO: 280249 - DNA, 16 bp, Homo sapiens
gaaaacatatatttta

SEQ ID NO: 280250 - DNA, 22 bp, Homo sapiens
gaaaacatatattttattttca

SEQ ID NO: 280251 - DNA, 16 bp, Homo sapiens
gaaaacattccagatg

SEQ ID NO: 280252 - DNA, 15 bp, Homo sapiens
gaaaaccaacaccat

SEQ ID NO: 280253 - DNA, 21 bp, Homo sapiens
gaaaaccaacaccatcacagc

SEQ ID NO: 280254 - DNA, 21 bp, Homo sapiens
gaaaaccagtcttctccctgt

SEQ ID NO: 280255 - DNA, 16 bp, Homo sapiens
gaaaacgttttattgt

SEQ ID NO: 280256 - DNA, 20 bp, Homo sapiens
gaaaactagagctctaagcc

SEQ ID NO: 280257 - DNA, 15 bp, Homo sapiens
gaaaactcaccattt

SEQ ID NO: 280258 - DNA, 20 bp, Homo sapiens
gaaaactgaaaatctaatat

SEQ ID NO: 280259 - DNA, 19 bp, Homo sapiens
gaaaactgcctgttccttg

SEQ ID NO: 280260 - DNA, 21 bp, Homo sapiens
gaaaactgtaaatacaaaata

SEQ ID NO: 280261 - DNA, 23 bp, Homo sapiens
gaaaactgtttatggtattttcg

SEQ ID NO: 280262 - DNA, 21 bp, Homo sapiens
gaaaacttctcttctgagcct

SEQ ID NO: 280263 - DNA, 23 bp, Homo sapiens
gaaaacttctcttctgagcctct

SEQ ID NO: 280264 - DNA, 12 bp, Homo sapiens
gaaaagaagaaa

SEQ ID NO: 280265 - DNA, 21 bp, Homo sapiens
gaagctgtactcagagcagag

SEQ ID NO: 280266 - DNA, 23 bp, Homo sapiens
gaagctgtactcagagcagagca

SEQ ID NO: 280267 - DNA, 20 bp, Homo sapiens
gaagcttattaatgctaagg

SEQ ID NO: 280268 - DNA, 15 bp, Homo sapiens
gaagcttcagaagtt

SEQ ID NO: 280269 - DNA, 13 bp, Homo sapiens
gaaggaaaagagt

SEQ ID NO: 280270 - DNA, 19 bp, Homo sapiens
gaaggaaagcatgtctctg

SEQ ID NO: 280271 - DNA, 14 bp, Homo sapiens
ctgatgccccttcc

SEQ ID NO: 280272 - DNA, 14 bp, Homo sapiens
ctgatgctccctcc

SEQ ID NO: 280273 - DNA, 23 bp, Homo sapiens
ctgatgctgaaataaactagggt

SEQ ID NO: 280274 - DNA, 13 bp, Homo sapiens
ctgatgctgcccc

SEQ ID NO: 280275 - DNA, 14 bp, Homo sapiens
ctgatgctgccccg

SEQ ID NO: 280276 - DNA, 20 bp, Homo sapiens
ctgatggaccgggtgggcct

SEQ ID NO: 280277 - DNA, 23 bp, Homo sapiens
ctgatggaccgggtgggcctggc

SEQ ID NO: 280278 - DNA, 22 bp, Homo sapiens
ctgatggcacttagctatcaga

SEQ ID NO: 280279 - DNA, 11 bp, Homo sapiens
ctgatggccaa

SEQ ID NO: 280280 - DNA, 17 bp, Homo sapiens
ctgatggccaagggggt

SEQ ID NO: 280281 - DNA, 13 bp, Homo sapiens
ctgatggcttgac

SEQ ID NO: 280282 - DNA, 15 bp, Homo sapiens
ctgatggcttgacat

SEQ ID NO: 280283 - DNA, 17 bp, Homo sapiens
ctgatggcttgacatgt

SEQ ID NO: 280284 - DNA, 18 bp, Homo sapiens
ctgatggcttgacatgtg

SEQ ID NO: 280285 - DNA, 23 bp, Homo sapiens
ctgatggcttgacatgtgcaatt

SEQ ID NO: 280286 - DNA, 17 bp, Homo sapiens
ctgatgggcactggaaa

SEQ ID NO: 280287 - DNA, 14 bp, Homo sapiens
ctgatgggtcctgc

SEQ ID NO: 280288 - DNA, 15 bp, Homo sapiens
ctgatggtgagctgg

SEQ ID NO: 280289 - DNA, 17 bp, Homo sapiens
ctgatggtgagctggga

SEQ ID NO: 280290 - DNA, 18 bp, Homo sapiens
ctgatggtgagctgggaa

SEQ ID NO: 280291 - DNA, 17 bp, Homo sapiens
ctgatgtaggagctgga

SEQ ID NO: 280292 - DNA, 22 bp, Homo sapiens
ctgatgtcaatgctatggactg

SEQ ID NO: 280293 - DNA, 11 bp, Homo sapiens
ctgatgtcatc

SEQ ID NO: 280294 - DNA, 13 bp, Homo sapiens
ctgatgtcatctt

SEQ ID NO: 280295 - DNA, 14 bp, Homo sapiens
ctgatgtcatcttg

SEQ ID NO: 280296 - DNA, 16 bp, Homo sapiens
ctgatgtcatcttgag

SEQ ID NO: 280297 - DNA, 18 bp, Homo sapiens
ctgatgtcatcttgagct

SEQ ID NO: 280298 - DNA, 19 bp, Homo sapiens
ctgatgtccctagaaaaca

SEQ ID NO: 280299 - DNA, 19 bp, Homo sapiens
ctgatgtctctaaagcact

SEQ ID NO: 280300 - DNA, 15 bp, Homo sapiens
ctgatgtgtgcccag

SEQ ID NO: 280301 - DNA, 21 bp, Homo sapiens
ctgattaaatttaatatactg

SEQ ID NO: 280302 - DNA, 13 bp, Homo sapiens
ctgattactgtca

SEQ ID NO: 280303 - DNA, 16 bp, Homo sapiens
ctgattactgtcaata

SEQ ID NO: 280304 - DNA, 20 bp, Homo sapiens
ctgattactgtcaataaaca

SEQ ID NO: 280305 - DNA, 13 bp, Homo sapiens
ctgattctccctg

SEQ ID NO: 280306 - DNA, 23 bp, Homo sapiens
ctgattgtggatcttttcattct

SEQ ID NO: 280307 - DNA, 21 bp, Homo sapiens
ctgatttacaagactaacctt

SEQ ID NO: 280308 - DNA, 20 bp, Homo sapiens
ctgatttcaaggtccgagct

SEQ ID NO: 280309 - DNA, 17 bp, Homo sapiens
ctgatttccaggcccct

SEQ ID NO: 280310 - DNA, 22 bp, Homo sapiens
ctgatttccaggcccctgagga

SEQ ID NO: 280311 - DNA, 14 bp, Homo sapiens
ctgatttcctttgg

SEQ ID NO: 280312 - DNA, 13 bp, Homo sapiens
ctgatttgagttt

SEQ ID NO: 280313 - DNA, 22 bp, Homo sapiens
ctgattttaacaataactactg

SEQ ID NO: 280314 - DNA, 24 bp, Homo sapiens
ctgattttctctggcagcataatt

SEQ ID NO: 280315 - DNA, 15 bp, Homo sapiens
ctgcaaaccctgctg

SEQ ID NO: 280316 - DNA, 17 bp, Homo sapiens
ctgcaaaccctgctgcc

SEQ ID NO: 280317 - DNA, 20 bp, Homo sapiens
ctgcaaactcactgctcaag

SEQ ID NO: 280318 - DNA, 21 bp, Homo sapiens
ctgcaaagatgattttgcttt

SEQ ID NO: 280319 - DNA, 14 bp, Homo sapiens
ctgcaaaggacaga

SEQ ID NO: 280320 - DNA, 17 bp, Homo sapiens
ctgcaaatagaaaacag

SEQ ID NO: 280321 - DNA, 13 bp, Homo sapiens
ctgcaaatgccgc

SEQ ID NO: 280322 - DNA, 17 bp, Homo sapiens
ctttccccagaggctcc

SEQ ID NO: 280323 - DNA, 21 bp, Homo sapiens
ctttccccagaggctcccaat

SEQ ID NO: 280324 - DNA, 12 bp, Homo sapiens
ctttcccctcct

SEQ ID NO: 280325 - DNA, 22 bp, Homo sapiens
ctttccctagaaagccatattc

SEQ ID NO: 280326 - DNA, 23 bp, Homo sapiens
ctttccctagaaagccatattcc

SEQ ID NO: 280327 - DNA, 16 bp, Homo sapiens
ctttccctgcatccct

SEQ ID NO: 280328 - DNA, 11 bp, Homo sapiens
ctttccctggc

SEQ ID NO: 280329 - DNA, 15 bp, Homo sapiens
ctttccctggctcag

SEQ ID NO: 280330 - DNA, 17 bp, Homo sapiens
ctttccctggctcaggg

SEQ ID NO: 280331 - DNA, 17 bp, Homo sapiens
ctccccagagcactggg

SEQ ID NO: 280332 - DNA, 16 bp, Homo sapiens
ctccccagccagccct

SEQ ID NO: 280333 - DNA, 13 bp, Homo sapiens
ctccccagcccag

SEQ ID NO: 280334 - DNA, 16 bp, Homo sapiens
ctccccagcccagggt

SEQ ID NO: 280335 - DNA, 22 bp, Homo sapiens
ctccccagcccagggttccccc

SEQ ID NO: 280336 - DNA, 12 bp, Homo sapiens
ctccccaggcct

SEQ ID NO: 280337 - DNA, 13 bp, Homo sapiens
ctccccaggcctc

SEQ ID NO: 280338 - DNA, 15 bp, Homo sapiens
ctccccaggcctcca

SEQ ID NO: 280339 - DNA, 16 bp, Homo sapiens
ctccccaggcctccag

SEQ ID NO: 280340 - DNA, 17 bp, Homo sapiens
ctccccaggcctccagc

SEQ ID NO: 280341 - DNA, 13 bp, Homo sapiens
ctccccagtgcct

SEQ ID NO: 280342 - DNA, 16 bp, Homo sapiens
ctccccagtgcctgcc

SEQ ID NO: 280343 - DNA, 21 bp, Homo sapiens
ctccccatcatccacgccaag

SEQ ID NO: 280344 - DNA, 21 bp, Homo sapiens
ctccccatggctcctcaccac

SEQ ID NO: 280345 - DNA, 21 bp, Homo sapiens
ctccccatggtgcagtgaaga

SEQ ID NO: 280346 - DNA, 16 bp, Homo sapiens
ctccccatgtgcctgc

SEQ ID NO: 280347 - DNA, 21 bp, Homo sapiens
ctccccatgtgcctgcaccag

SEQ ID NO: 280348 - DNA, 23 bp, Homo sapiens
ctccccatgtgcctgcaccagga

SEQ ID NO: 280349 - DNA, 18 bp, Homo sapiens
ctcccccaccattccaca

SEQ ID NO: 280350 - DNA, 16 bp, Homo sapiens
ctcccccacctgacaa

SEQ ID NO: 280351 - DNA, 14 bp, Homo sapiens
ctcccccagagcca

SEQ ID NO: 280352 - DNA, 18 bp, Homo sapiens
ctcccccagccaggacca

SEQ ID NO: 280353 - DNA, 16 bp, Homo sapiens
ctcccccaggctgcgc

SEQ ID NO: 280354 - DNA, 22 bp, Homo sapiens
ctcccccaggctgcgcctgccc

SEQ ID NO: 280355 - DNA, 11 bp, Homo sapiens
ctcccccatcc

SEQ ID NO: 280356 - DNA, 13 bp, Homo sapiens
ctccccccagacc

SEQ ID NO: 280357 - DNA, 14 bp, Homo sapiens
ctccccccagaccc

SEQ ID NO: 280358 - DNA, 15 bp, Homo sapiens
ctcccccgcagacag

SEQ ID NO: 280359 - DNA, 22 bp, Homo sapiens
ctcccccgcagtccccagccct

SEQ ID NO: 280360 - DNA, 12 bp, Homo sapiens
ctcccccttgcc

SEQ ID NO: 280361 - DNA, 22 bp, Homo sapiens
ctccccgcagcccgcctgccgt

SEQ ID NO: 280362 - DNA, 16 bp, Homo sapiens
ctccccgcctccactc

SEQ ID NO: 280363 - DNA, 18 bp, Homo sapiens
ctccccgtagccactctc

SEQ ID NO: 280364 - DNA, 16 bp, Homo sapiens
ctcccctaatgcctgc

SEQ ID NO: 280365 - DNA, 11 bp, Homo sapiens
ctcccctccag

SEQ ID NO: 280366 - DNA, 17 bp, Homo sapiens
ctttcccttccagttcc

SEQ ID NO: 280367 - DNA, 16 bp, Homo sapiens
ctttcccttcccctgt

SEQ ID NO: 280368 - DNA, 17 bp, Homo sapiens
ctttcctactctgggaa

SEQ ID NO: 280369 - DNA, 20 bp, Homo sapiens
ctttcctagttcttaagcat

SEQ ID NO: 280370 - DNA, 15 bp, Homo sapiens
ctttcctccccaccc

SEQ ID NO: 280371 - DNA, 14 bp, Homo sapiens
ctttcctcccttct

SEQ ID NO: 280372 - DNA, 19 bp, Homo sapiens
ctttcctctaactcattct

SEQ ID NO: 280373 - DNA, 21 bp, Homo sapiens
ctttcctgcaactcaaggact

SEQ ID NO: 280374 - DNA, 10 bp, Homo sapiens
ctttcctgcc

SEQ ID NO: 280375 - DNA, 13 bp, Homo sapiens
ctttcctgcccca

SEQ ID NO: 280376 - DNA, 14 bp, Homo sapiens
ctttcctgccccag

SEQ ID NO: 280377 - DNA, 18 bp, Homo sapiens
ctttcctgccccaggcct

SEQ ID NO: 280378 - DNA, 18 bp, Homo sapiens
ctttcctgcccttttcct

SEQ ID NO: 280379 - DNA, 19 bp, Homo sapiens
ctttcctgcccttttcctg

SEQ ID NO: 280380 - DNA, 20 bp, Homo sapiens
ctttcctggataaaaaagaa

SEQ ID NO: 280381 - DNA, 14 bp, Homo sapiens
ctttccttctcgtc

SEQ ID NO: 280382 - DNA, 17 bp, Homo sapiens
ctttccttgagtagttt

SEQ ID NO: 280383 - DNA, 17 bp, Homo sapiens
ctttcctttcatcctca

SEQ ID NO: 280384 - DNA, 20 bp, Homo sapiens
ctttcctttcatcctcagca

SEQ ID NO: 280385 - DNA, 23 bp, Homo sapiens
ctttcctttcatcctcagcaagt

SEQ ID NO: 280386 - DNA, 14 bp, Homo sapiens
ctttcctttgctct

SEQ ID NO: 280387 - DNA, 15 bp, Homo sapiens
ctttcctttgctctg

SEQ ID NO: 280388 - DNA, 16 bp, Homo sapiens
ctttcctttgctctgg

SEQ ID NO: 280389 - DNA, 22 bp, Homo sapiens
ctttcgtgtaaattatgtaatg

SEQ ID NO: 280390 - DNA, 16 bp, Homo sapiens
ctttcgttggttgttt

SEQ ID NO: 280391 - DNA, 19 bp, Homo sapiens
ctttcgttggttgtttctc

SEQ ID NO: 280392 - DNA, 13 bp, Homo sapiens
ctttctagttcaa

SEQ ID NO: 280393 - DNA, 17 bp, Homo sapiens
ctttctatataaaatgt

SEQ ID NO: 280394 - DNA, 20 bp, Homo sapiens
ctttctatataaaatgtatt

SEQ ID NO: 280395 - DNA, 20 bp, Homo sapiens
ctttctattacccctcattt

SEQ ID NO: 280396 - DNA, 22 bp, Homo sapiens
ctttctattacccctcatttaa

SEQ ID NO: 280397 - DNA, 14 bp, Homo sapiens
ctttctccagccag

SEQ ID NO: 280398 - DNA, 20 bp, Homo sapiens
ctttctccagccagcaatga

SEQ ID NO: 280399 - DNA, 13 bp, Homo sapiens
ctttctccaggcc

SEQ ID NO: 280400 - DNA, 15 bp, Homo sapiens
ctttctccccatccc

SEQ ID NO: 280401 - DNA, 23 bp, Homo sapiens
ctttctcccccgacactgctgca

SEQ ID NO: 280402 - DNA, 13 bp, Homo sapiens
ctttctcctgtgg

SEQ ID NO: 280403 - DNA, 15 bp, Homo sapiens
ctttctccttagtct

SEQ ID NO: 280404 - DNA, 20 bp, Homo sapiens
ctttctccttagtcttctca

SEQ ID NO: 280405 - DNA, 20 bp, Homo sapiens
ctttctcgtggtagaagcca

SEQ ID NO: 280406 - DNA, 21 bp, Homo sapiens
ctttctcgtggtagaagccag

SEQ ID NO: 280407 - DNA, 17 bp, Homo sapiens
ctttctctcctttcttt

SEQ ID NO: 280408 - DNA, 16 bp, Homo sapiens
ctttctctctgtgtgg

SEQ ID NO: 280409 - DNA, 22 bp, Homo sapiens
ctttctctctttccatctccct

SEQ ID NO: 280410 - DNA, 20 bp, Homo sapiens
ctttctctgagagagatgat

SEQ ID NO: 280411 - DNA, 13 bp, Homo sapiens
ctttctctgccag

SEQ ID NO: 280412 - DNA, 14 bp, Homo sapiens
ctttctctgccagt

SEQ ID NO: 280413 - DNA, 14 bp, Homo sapiens
ctttctcttctaat

SEQ ID NO: 280414 - DNA, 13 bp, Homo sapiens
ctttctctttggt

SEQ ID NO: 280415 - DNA, 19 bp, Homo sapiens
ctttctgacaataaataat

SEQ ID NO: 280416 - DNA, 22 bp, Homo sapiens
ctttctgacaataaataatatt

SEQ ID NO: 280417 - DNA, 15 bp, Homo sapiens
ctttctgactgcaac

SEQ ID NO: 280418 - DNA, 23 bp, Homo sapiens
ctttctgataactagatggtgct

SEQ ID NO: 280419 - DNA, 15 bp, Homo sapiens
ctttctgcagaaaca

SEQ ID NO: 280420 - DNA, 21 bp, Homo sapiens
ctttctgcagtttttcaggag

SEQ ID NO: 280421 - DNA, 15 bp, Homo sapiens
ctttctggcctgcct

SEQ ID NO: 280422 - DNA, 12 bp, Homo sapiens
ctttctgggagg

SEQ ID NO: 280423 - DNA, 14 bp, Homo sapiens
gaacacatggcaga

SEQ ID NO: 280424 - DNA, 16 bp, Homo sapiens
gaacacatttctaatt

SEQ ID NO: 280425 - DNA, 22 bp, Homo sapiens
gaacaccacgcttgacaggaca

SEQ ID NO: 280426 - DNA, 15 bp, Homo sapiens
gaacacccggaaaga

SEQ ID NO: 280427 - DNA, 17 bp, Homo sapiens
gaacacccggaaagact

SEQ ID NO: 280428 - DNA, 16 bp, Homo sapiens
gaacaccctatatttt

SEQ ID NO: 280429 - DNA, 15 bp, Homo sapiens
gaacacgtgggtgag

SEQ ID NO: 280430 - DNA, 20 bp, Homo sapiens
gaacagaaaacaacaaaaaa

SEQ ID NO: 280431 - DNA, 15 bp, Homo sapiens
gaacagacctcggct

SEQ ID NO: 280432 - DNA, 17 bp, Homo sapiens
gaacagagtatatatgt

SEQ ID NO: 280433 - DNA, 18 bp, Homo sapiens
gaacagatctccaaagct

SEQ ID NO: 280434 - DNA, 17 bp, Homo sapiens
gaacagatggctgtgaa

SEQ ID NO: 280435 - DNA, 18 bp, Homo sapiens
gaacagatggctgtgaaa

SEQ ID NO: 280436 - DNA, 13 bp, Homo sapiens
gaacagcaggccc

SEQ ID NO: 280437 - DNA, 15 bp, Homo sapiens
gaacagcaggcccac

SEQ ID NO: 280438 - DNA, 22 bp, Homo sapiens
gaacagcgggagacctgtgcta

SEQ ID NO: 280439 - DNA, 22 bp, Homo sapiens
gaacagctatgggagccccagg

SEQ ID NO: 280440 - DNA, 13 bp, Homo sapiens
gaacagctgttcc

SEQ ID NO: 280441 - DNA, 18 bp, Homo sapiens
gaacagctgttcctgtgt

SEQ ID NO: 280442 - DNA, 16 bp, Homo sapiens
gaacaggaggaactgg

SEQ ID NO: 280443 - DNA, 17 bp, Homo sapiens
gaacaggaggaactggt

SEQ ID NO: 280444 - DNA, 18 bp, Homo sapiens
gaacaggaggaactggtc

SEQ ID NO: 280445 - DNA, 23 bp, Homo sapiens
gaatttaaatataattctgtaaa

SEQ ID NO: 280446 - DNA, 17 bp, Homo sapiens
gaatttaatttttaaaa

SEQ ID NO: 280447 - DNA, 19 bp, Homo sapiens
gaatttagcttatacaatt

SEQ ID NO: 280448 - DNA, 16 bp, Homo sapiens
gaatttcccaaagcag

SEQ ID NO: 280449 - DNA, 18 bp, Homo sapiens
gaatttcccaaagcagtg

SEQ ID NO: 280450 - DNA, 21 bp, Homo sapiens
gaatttcctctattgatgtac

SEQ ID NO: 280451 - DNA, 16 bp, Homo sapiens
gaatttgaaaggaaaa

SEQ ID NO: 280452 - DNA, 19 bp, Homo sapiens
gaatttgaagaattaatga

SEQ ID NO: 280453 - DNA, 17 bp, Homo sapiens
gaatttgaatgaaaaat

SEQ ID NO: 280454 - DNA, 17 bp, Homo sapiens
gaatttgtaacctcagc

SEQ ID NO: 280455 - DNA, 18 bp, Homo sapiens
gaatttgtaacctcagct

SEQ ID NO: 280456 - DNA, 22 bp, Homo sapiens
gaattttaaaatgtagaagaaa

SEQ ID NO: 280457 - DNA, 19 bp, Homo sapiens
gaattttggctgtgtctcc

SEQ ID NO: 280458 - DNA, 20 bp, Homo sapiens
gaattttttttaacattcct

SEQ ID NO: 280459 - DNA, 18 bp, Homo sapiens
gacaaaaacaagactgcc

SEQ ID NO: 280460 - DNA, 23 bp, Homo sapiens
gacaaaaatataaagttattaat

SEQ ID NO: 280461 - DNA, 21 bp, Homo sapiens
gacaaaaatgaactgaagttt

SEQ ID NO: 280462 - DNA, 18 bp, Homo sapiens
gacaaagaaaatgagaat

SEQ ID NO: 280463 - DNA, 22 bp, Homo sapiens
gacaaagagaataaagacttca

SEQ ID NO: 280464 - DNA, 22 bp, Homo sapiens
gacaaatagtaggctaaaaaca

SEQ ID NO: 280465 - DNA, 16 bp, Homo sapiens
gacaaatctttaagaa

SEQ ID NO: 280466 - DNA, 17 bp, Homo sapiens
gacaaatctttaagaat

SEQ ID NO: 280467 - DNA, 22 bp, Homo sapiens
gacaaatgctgcgcccttcccc

SEQ ID NO: 280468 - DNA, 14 bp, Homo sapiens
gacaaatgggactg

SEQ ID NO: 280469 - DNA, 15 bp, Homo sapiens
gacaaatgggactga

SEQ ID NO: 280470 - DNA, 20 bp, Homo sapiens
gacaaatgggactgatgtca

SEQ ID NO: 280471 - DNA, 23 bp, Homo sapiens
gacaaatgggactgatgtcatct

SEQ ID NO: 280472 - DNA, 20 bp, Homo sapiens
gacaaatttaaaacaaacaa

SEQ ID NO: 280473 - DNA, 14 bp, Homo sapiens
gacaacattttatt

SEQ ID NO: 280474 - DNA, 18 bp, Homo sapiens
gacaaccaccgctcccca

SEQ ID NO: 280475 - DNA, 23 bp, Homo sapiens
gacaaccaccgctccccagccca

SEQ ID NO: 280476 - DNA, 13 bp, Homo sapiens
gacaaccctgcaa

SEQ ID NO: 280477 - DNA, 19 bp, Homo sapiens
gacaaccgatgctccagcc

SEQ ID NO: 280478 - DNA, 13 bp, Homo sapiens
gacaacctttgtg

SEQ ID NO: 280479 - DNA, 14 bp, Homo sapiens
gacaacctttgtgt

SEQ ID NO: 280480 - DNA, 21 bp, Homo sapiens
gacaacttctaattgccatgt

SEQ ID NO: 280481 - DNA, 12 bp, Homo sapiens
gacaagaagctg

SEQ ID NO: 280482 - DNA, 13 bp, Homo sapiens
gacaagccctggc

SEQ ID NO: 280483 - DNA, 15 bp, Homo sapiens
gacaagccctggcaa

SEQ ID NO: 280484 - DNA, 17 bp, Homo sapiens
gacaagccctggcaaca

SEQ ID NO: 280485 - DNA, 14 bp, Homo sapiens
gacaaggagagcgg

SEQ ID NO: 280486 - DNA, 23 bp, Homo sapiens
gacaaggccccagagactcagag

SEQ ID NO: 280487 - DNA, 17 bp, Homo sapiens
gacaagggattctggga

SEQ ID NO: 280488 - DNA, 16 bp, Homo sapiens
gacaaggttgctgttg

SEQ ID NO: 280489 - DNA, 14 bp, Homo sapiens
gacaataaaacatt

SEQ ID NO: 280490 - DNA, 14 bp, Homo sapiens
gacaataagtttga

SEQ ID NO: 280491 - DNA, 21 bp, Homo sapiens
gacaatccccacataccatct

SEQ ID NO: 280492 - DNA, 19 bp, Homo sapiens
gacaatctaaaaaatatct

SEQ ID NO: 280493 - DNA, 20 bp, Homo sapiens
gacaatctaaaaaatatctt

SEQ ID NO: 280494 - DNA, 21 bp, Homo sapiens
gacaatgagtggaatactaaa

SEQ ID NO: 280495 - DNA, 20 bp, Homo sapiens
gacaatgatgatgataatga

SEQ ID NO: 280496 - DNA, 20 bp, Homo sapiens
gacaatgcagatgccagagc

SEQ ID NO: 280497 - DNA, 14 bp, Homo sapiens
gacaatggcagcta

SEQ ID NO: 280498 - DNA, 20 bp, Homo sapiens
gacaatttcaaaatgcatgt

SEQ ID NO: 280499 - DNA, 21 bp, Homo sapiens
gacacaaaggacaaaaatata

SEQ ID NO: 280500 - DNA, 23 bp, Homo sapiens
gacacaaccactaatttgtcact

SEQ ID NO: 280501 - DNA, 18 bp, Homo sapiens
gacacaatgttgcactga

SEQ ID NO: 280502 - DNA, 14 bp, Homo sapiens
gacacaattagaga

SEQ ID NO: 280503 - DNA, 14 bp, Homo sapiens
gacacacacacaca

SEQ ID NO: 280504 - DNA, 23 bp, Homo sapiens
gacacacacacacacacaaatgc

SEQ ID NO: 280505 - DNA, 12 bp, Homo sapiens
gacacacacacg

SEQ ID NO: 280506 - DNA, 20 bp, Homo sapiens
gacacacacacgcacgcaca

SEQ ID NO: 280507 - DNA, 21 bp, Homo sapiens
gacacacacacgcacgcacac

SEQ ID NO: 280508 - DNA, 14 bp, Homo sapiens
gacacacacagctt

SEQ ID NO: 280509 - DNA, 15 bp, Homo sapiens
gacacacagcctttc

SEQ ID NO: 280510 - DNA, 19 bp, Homo sapiens
gacacacagcctttctgta

SEQ ID NO: 280511 - DNA, 23 bp, Homo sapiens
gacacaccccacaccccagccca

SEQ ID NO: 280512 - DNA, 21 bp, Homo sapiens
gacacagatggcacctgtggc

SEQ ID NO: 280513 - DNA, 18 bp, Homo sapiens
gacacagcagcttcacca

SEQ ID NO: 280514 - DNA, 16 bp, Homo sapiens
gacacagttttgtctt

SEQ ID NO: 280515 - DNA, 21 bp, Homo sapiens
gacacatcccggcctcttcca

SEQ ID NO: 280516 - DNA, 14 bp, Homo sapiens
gacaccaagaaacc

SEQ ID NO: 280517 - DNA, 13 bp, Homo sapiens
gacacccctgctc

SEQ ID NO: 280518 - DNA, 14 bp, Homo sapiens
gacacccctgctct

SEQ ID NO: 280519 - DNA, 21 bp, Homo sapiens
gacaccctaactcttgctcac

SEQ ID NO: 280520 - DNA, 23 bp, Homo sapiens
gacaccctaactcttgctcactc

SEQ ID NO: 280521 - DNA, 13 bp, Homo sapiens
gacacctaccatg

SEQ ID NO: 280522 - DNA, 12 bp, Homo sapiens
gacacctgccct

SEQ ID NO: 280523 - DNA, 23 bp, Homo sapiens
gacacctgccctgccctgccacc

SEQ ID NO: 280524 - DNA, 17 bp, Homo sapiens
gacactaagttatagta

SEQ ID NO: 280525 - DNA, 23 bp, Homo sapiens
gacactagtagagcaaagactta

SEQ ID NO: 280526 - DNA, 22 bp, Homo sapiens
gacactctagtgacttcctggt

SEQ ID NO: 280527 - DNA, 13 bp, Homo sapiens
gacactgaaggca

SEQ ID NO: 280528 - DNA, 16 bp, Homo sapiens
gacactgagccccacc

SEQ ID NO: 280529 - DNA, 20 bp, Homo sapiens
gacactgatgggtcctgctg

SEQ ID NO: 280530 - DNA, 20 bp, Homo sapiens
gacactggaagggtccggct

SEQ ID NO: 280531 - DNA, 13 bp, Homo sapiens
gacactggtctca

SEQ ID NO: 280532 - DNA, 16 bp, Homo sapiens
gacactgtgcccagcc

SEQ ID NO: 280533 - DNA, 19 bp, Homo sapiens
gacacttcagagagctggt

SEQ ID NO: 280534 - DNA, 21 bp, Homo sapiens
gacactttgccaaggctctcc

SEQ ID NO: 280535 - DNA, 18 bp, Homo sapiens
gacagaaccaacgggtct

SEQ ID NO: 280536 - DNA, 22 bp, Homo sapiens
gacagaaccaacgggtctgtgg

SEQ ID NO: 280537 - DNA, 16 bp, Homo sapiens
gacagaagcaggctgg

SEQ ID NO: 280538 - DNA, 20 bp, Homo sapiens
gacagaaggccttgaagaat

SEQ ID NO: 280539 - DNA, 13 bp, Homo sapiens
gacagacacacac

SEQ ID NO: 280540 - DNA, 18 bp, Homo sapiens
gacagacttgagaacttg

SEQ ID NO: 280541 - DNA, 17 bp, Homo sapiens
gacagagagttctggtg

SEQ ID NO: 280542 - DNA, 20 bp, Homo sapiens
gacagagagttctggtgaga

SEQ ID NO: 280543 - DNA, 14 bp, Homo sapiens
gacagagcaggtct

SEQ ID NO: 280544 - DNA, 19 bp, Homo sapiens
gacagagcaggtctgcagg

SEQ ID NO: 280545 - DNA, 21 bp, Homo sapiens
gacagagtggatctggagtct

SEQ ID NO: 280546 - DNA, 21 bp, Homo sapiens
gacagagttcactataaatgg

SEQ ID NO: 280547 - DNA, 23 bp, Homo sapiens
gacagagttcagggaggggctga

SEQ ID NO: 280548 - DNA, 19 bp, Homo sapiens
gacagatcctccatttttg

SEQ ID NO: 280549 - DNA, 18 bp, Homo sapiens
gacagatcttgagcaagg

SEQ ID NO: 280550 - DNA, 18 bp, Homo sapiens
gacagatgtcagccgagc

SEQ ID NO: 280551 - DNA, 20 bp, Homo sapiens
gacagcaaaaccattgcttc

SEQ ID NO: 280552 - DNA, 21 bp, Homo sapiens
gacagcaaaaccattgcttca

SEQ ID NO: 280553 - DNA, 13 bp, Homo sapiens
gacagcaagggct

SEQ ID NO: 280554 - DNA, 15 bp, Homo sapiens
gacagcagcctccct

SEQ ID NO: 280555 - DNA, 20 bp, Homo sapiens
gacagcagcctccctgtcac

SEQ ID NO: 280556 - DNA, 15 bp, Homo sapiens
gacagcagcctgtga

SEQ ID NO: 280557 - DNA, 17 bp, Homo sapiens
gacagcagcctgtgagg

SEQ ID NO: 280558 - DNA, 15 bp, Homo sapiens
gacagcatgcccctt

SEQ ID NO: 280559 - DNA, 16 bp, Homo sapiens
gacagccaaaagtaag

SEQ ID NO: 280560 - DNA, 13 bp, Homo sapiens
gacagcctggcac

SEQ ID NO: 280561 - DNA, 14 bp, Homo sapiens
gacagcgacagaaa

SEQ ID NO: 280562 - DNA, 23 bp, Homo sapiens
gagcaacccctgtacccagctcc

SEQ ID NO: 280563 - DNA, 13 bp, Homo sapiens
gagcaactctcca

SEQ ID NO: 280564 - DNA, 22 bp, Homo sapiens
gagcaactggactatagcaggg

SEQ ID NO: 280565 - DNA, 17 bp, Homo sapiens
gagcaactgtgcagcac

SEQ ID NO: 280566 - DNA, 24 bp, Homo sapiens
gagcaagaaaaaagtacagaacat

SEQ ID NO: 280567 - DNA, 13 bp, Homo sapiens
gagcaagccggca

SEQ ID NO: 280568 - DNA, 13 bp, Homo sapiens
gagcaaggacatt

SEQ ID NO: 280569 - DNA, 17 bp, Homo sapiens
gagcaaggcaagaagtg

SEQ ID NO: 280570 - DNA, 13 bp, Homo sapiens
gagcaatgggact

SEQ ID NO: 280571 - DNA, 14 bp, Homo sapiens
gagcaatgggactg

SEQ ID NO: 280572 - DNA, 16 bp, Homo sapiens
gagcaatgggactgga

SEQ ID NO: 280573 - DNA, 18 bp, Homo sapiens
gagcaatgggactggagt

SEQ ID NO: 280574 - DNA, 15 bp, Homo sapiens
gagcacagccctggg

SEQ ID NO: 280575 - DNA, 14 bp, Homo sapiens
gagcacaggcagct

SEQ ID NO: 280576 - DNA, 11 bp, Homo sapiens
gagcaccccca

SEQ ID NO: 280577 - DNA, 23 bp, Homo sapiens
gagcacctactttatgtatggag

SEQ ID NO: 280578 - DNA, 20 bp, Homo sapiens
gagcaccttcctcacttcca

SEQ ID NO: 280579 - DNA, 23 bp, Homo sapiens
gagcacgtggagatagtgccagg

SEQ ID NO: 280580 - DNA, 21 bp, Homo sapiens
gagcactctgagtttaccatt

SEQ ID NO: 280581 - DNA, 14 bp, Homo sapiens
gagcactggagtgc

SEQ ID NO: 280582 - DNA, 20 bp, Homo sapiens
gagcactggagtgcagggag

SEQ ID NO: 280583 - DNA, 17 bp, Homo sapiens
gagcactggccagagag

SEQ ID NO: 280584 - DNA, 24 bp, Homo sapiens
gagcactggccagagagggcccag

SEQ ID NO: 280585 - DNA, 19 bp, Homo sapiens
gagcactgtgtaaccagca

SEQ ID NO: 280586 - DNA, 23 bp, Homo sapiens
gagcacttcacacagacaagtgg

SEQ ID NO: 280587 - DNA, 16 bp, Homo sapiens
gagcagagaattctct

SEQ ID NO: 280588 - DNA, 19 bp, Homo sapiens
gagcagagacggcagcccc

SEQ ID NO: 280589 - DNA, 21 bp, Homo sapiens
gagcagagacggcagccccat

SEQ ID NO: 280590 - DNA, 13 bp, Homo sapiens
gagcagagtctgg

SEQ ID NO: 280591 - DNA, 19 bp, Homo sapiens
gagcagagtctgggcctct

SEQ ID NO: 280592 - DNA, 15 bp, Homo sapiens
gagcagcagctgagg

SEQ ID NO: 280593 - DNA, 17 bp, Homo sapiens
gagcagcagctgaggcc

SEQ ID NO: 280594 - DNA, 16 bp, Homo sapiens
gagcagcctctgccag

SEQ ID NO: 280595 - DNA, 11 bp, Homo sapiens
gagcagcctgt

SEQ ID NO: 280596 - DNA, 14 bp, Homo sapiens
gagcagcctgtggc

SEQ ID NO: 280597 - DNA, 15 bp, Homo sapiens
gagcagcctgtggca

SEQ ID NO: 280598 - DNA, 18 bp, Homo sapiens
gagcagcctgtggcatct

SEQ ID NO: 280599 - DNA, 18 bp, Homo sapiens
gagcagcggtttggggag

SEQ ID NO: 280600 - DNA, 12 bp, Homo sapiens
gagcagctcccc

SEQ ID NO: 280601 - DNA, 15 bp, Homo sapiens
gagcagctccccagg

SEQ ID NO: 280602 - DNA, 19 bp, Homo sapiens
gagcagctgagatgtggac

SEQ ID NO: 280603 - DNA, 20 bp, Homo sapiens
gagcagctgggcactgggcc

SEQ ID NO: 280604 - DNA, 15 bp, Homo sapiens
gagcagcttcagttg

SEQ ID NO: 280605 - DNA, 22 bp, Homo sapiens
gagcaggaagcaaggccagccc

SEQ ID NO: 280606 - DNA, 17 bp, Homo sapiens
gagcaggaaggcctggg

SEQ ID NO: 280607 - DNA, 21 bp, Homo sapiens
gagcaggcaaaaaagggacag

SEQ ID NO: 280608 - DNA, 18 bp, Homo sapiens
gagcaggctggcagctct

SEQ ID NO: 280609 - DNA, 17 bp, Homo sapiens
gagcaggctttgggaac

SEQ ID NO: 280610 - DNA, 17 bp, Homo sapiens
gagcaggtctgcaggcc

SEQ ID NO: 280611 - DNA, 23 bp, Homo sapiens
gagcagtgattctctcttctctc

SEQ ID NO: 280612 - DNA, 12 bp, Homo sapiens
gagcagtgggga

SEQ ID NO: 280613 - DNA, 13 bp, Homo sapiens
gagcagtggggag

SEQ ID NO: 280614 - DNA, 11 bp, Homo sapiens
gagcagtgtct

SEQ ID NO: 280615 - DNA, 17 bp, Homo sapiens
gagcagtgtcttccata

SEQ ID NO: 280616 - DNA, 18 bp, Homo sapiens
gagcagtgtcttccataa

SEQ ID NO: 280617 - DNA, 19 bp, Homo sapiens
gagcagtgtcttccataat

SEQ ID NO: 280618 - DNA, 16 bp, Homo sapiens
gagcagtgtgtctcct

SEQ ID NO: 280619 - DNA, 19 bp, Homo sapiens
gagcagtgtgtctcctgca

SEQ ID NO: 280620 - DNA, 18 bp, Homo sapiens
gagcatcaccaccacacc

SEQ ID NO: 280621 - DNA, 19 bp, Homo sapiens
gagcatcgtgacccttcag

SEQ ID NO: 280622 - DNA, 21 bp, Homo sapiens
gagcatcgtgacccttcaggg

SEQ ID NO: 280623 - DNA, 13 bp, Homo sapiens
gagcatctgctct

SEQ ID NO: 280624 - DNA, 17 bp, Homo sapiens
gagcatctgctctgaga

SEQ ID NO: 280625 - DNA, 15 bp, Homo sapiens
gagcatgaagataaa

SEQ ID NO: 280626 - DNA, 15 bp, Homo sapiens
gagcatgggcctggc

SEQ ID NO: 280627 - DNA, 17 bp, Homo sapiens
gagcatgggcctggcca

SEQ ID NO: 280628 - DNA, 15 bp, Homo sapiens
gagcattctgcctgc

SEQ ID NO: 280629 - DNA, 19 bp, Homo sapiens
gagcattctgcctgcctgg

SEQ ID NO: 280630 - DNA, 23 bp, Homo sapiens
gagcatttccaacaccacagaca

SEQ ID NO: 280631 - DNA, 16 bp, Homo sapiens
gagcattttgtgtctt

SEQ ID NO: 280632 - DNA, 22 bp, Homo sapiens
gagccaacctcggcttgtgggc

SEQ ID NO: 280633 - DNA, 16 bp, Homo sapiens
gagccaagtcctccct

SEQ ID NO: 280634 - DNA, 19 bp, Homo sapiens
gagccaatactgagtgcct

SEQ ID NO: 280635 - DNA, 15 bp, Homo sapiens
gagccaatgaacagc

SEQ ID NO: 280636 - DNA, 18 bp, Homo sapiens
gagccaatgaacagctcc

SEQ ID NO: 280637 - DNA, 19 bp, Homo sapiens
gagccacagtggggcccat

SEQ ID NO: 280638 - DNA, 20 bp, Homo sapiens
gagccacagtggggcccatg

SEQ ID NO: 280639 - DNA, 18 bp, Homo sapiens
gagccaccgcgcccagcc

SEQ ID NO: 280640 - DNA, 21 bp, Homo sapiens
gagccctccttcttgccctga

SEQ ID NO: 280641 - DNA, 12 bp, Homo sapiens
gagccctgccct

SEQ ID NO: 280642 - DNA, 17 bp, Homo sapiens
gagccctgccctcactc

SEQ ID NO: 280643 - DNA, 19 bp, Homo sapiens
gagccctggacacccctgc

SEQ ID NO: 280644 - DNA, 19 bp, Homo sapiens
gagccctggctgggttcag

SEQ ID NO: 280645 - DNA, 13 bp, Homo sapiens
gagccctggggtt

SEQ ID NO: 280646 - DNA, 22 bp, Homo sapiens
gagccctggggtttccacacag

SEQ ID NO: 280647 - DNA, 12 bp, Homo sapiens
gagcccttagcc

SEQ ID NO: 280648 - DNA, 18 bp, Homo sapiens
gagccgagctctcctggg

SEQ ID NO: 280649 - DNA, 22 bp, Homo sapiens
gagccgcctctggttccactca

SEQ ID NO: 280650 - DNA, 15 bp, Homo sapiens
gagccgggccgcaga

SEQ ID NO: 280651 - DNA, 17 bp, Homo sapiens
gagccggtttgggagag

SEQ ID NO: 280652 - DNA, 15 bp, Homo sapiens
gagccgtgcagctgg

SEQ ID NO: 280653 - DNA, 15 bp, Homo sapiens
gagccgtggccgagg

SEQ ID NO: 280654 - DNA, 14 bp, Homo sapiens
gagccgttcctggg

SEQ ID NO: 280655 - DNA, 15 bp, Homo sapiens
gagccgttcctggga

SEQ ID NO: 280656 - DNA, 17 bp, Homo sapiens
gagccgttgctaatgcc

SEQ ID NO: 280657 - DNA, 16 bp, Homo sapiens
gagcctatggaaaggg

SEQ ID NO: 280658 - DNA, 19 bp, Homo sapiens
gagcctccgttcccacctc

SEQ ID NO: 280659 - DNA, 17 bp, Homo sapiens
gagcctcctgaccctgt

SEQ ID NO: 280660 - DNA, 17 bp, Homo sapiens
gagcctcgcccctccag

SEQ ID NO: 280661 - DNA, 18 bp, Homo sapiens
gagcctgaaatagtggtt

SEQ ID NO: 280662 - DNA, 18 bp, Homo sapiens
gagcctgaggcaggagaa

SEQ ID NO: 280663 - DNA, 16 bp, Homo sapiens
gagcctgcagggtggt

SEQ ID NO: 280664 - DNA, 22 bp, Homo sapiens
gagcctgcagggtggtgctggg

SEQ ID NO: 280665 - DNA, 23 bp, Homo sapiens
gagcctgcagggtggtgctggga

SEQ ID NO: 280666 - DNA, 16 bp, Homo sapiens
gagcctgccccagctg

SEQ ID NO: 280667 - DNA, 16 bp, Homo sapiens
gagcctgcgtggcctg

SEQ ID NO: 280668 - DNA, 17 bp, Homo sapiens
gagcctgcgtggcctgg

SEQ ID NO: 280669 - DNA, 11 bp, Homo sapiens
gagcctggagc

SEQ ID NO: 280670 - DNA, 15 bp, Homo sapiens
gagcctggagcccct

SEQ ID NO: 280671 - DNA, 22 bp, Homo sapiens
gagcctggcaggtgccccgtgg

SEQ ID NO: 280672 - DNA, 14 bp, Homo sapiens
gagcctggtagaga

SEQ ID NO: 280673 - DNA, 21 bp, Homo sapiens
gagcctgtccccgccttccct

SEQ ID NO: 280674 - DNA, 11 bp, Homo sapiens
gagcctgtctc

SEQ ID NO: 280675 - DNA, 18 bp, Homo sapiens
gagcctgtgggtccccac

SEQ ID NO: 280676 - DNA, 18 bp, Homo sapiens
gagcctgtgttagtgtct

SEQ ID NO: 280677 - DNA, 23 bp, Homo sapiens
gagcctgtgttagtgtctgtcca

SEQ ID NO: 280678 - DNA, 13 bp, Homo sapiens
gagccttgctgcc

SEQ ID NO: 280679 - DNA, 15 bp, Homo sapiens
gagccttgctgccaa

SEQ ID NO: 280680 - DNA, 17 bp, Homo sapiens
gagccttgctgccaagt

SEQ ID NO: 280681 - DNA, 22 bp, Homo sapiens
gagcctttggaagtctgcgccc

SEQ ID NO: 280682 - DNA, 17 bp, Homo sapiens
gagcgagcaagccggca

SEQ ID NO: 280683 - DNA, 18 bp, Homo sapiens
gagcgagcaagccggcaa

SEQ ID NO: 280684 - DNA, 17 bp, Homo sapiens
gagcgagcctggcaggt

SEQ ID NO: 280685 - DNA, 13 bp, Homo sapiens
gagcgcaagatag

SEQ ID NO: 280686 - DNA, 16 bp, Homo sapiens
gagcgcgggagagagt

SEQ ID NO: 280687 - DNA, 21 bp, Homo sapiens
gagcgcgggagagagtgagag

SEQ ID NO: 280688 - DNA, 14 bp, Homo sapiens
gagcgctcctctgc

SEQ ID NO: 280689 - DNA, 21 bp, Homo sapiens
gagcgctcctctgccttggac

SEQ ID NO: 280690 - DNA, 18 bp, Homo sapiens
gagcggccgcctgtcctt

SEQ ID NO: 280691 - DNA, 14 bp, Homo sapiens
gagcgggacctgtg

SEQ ID NO: 280692 - DNA, 12 bp, Homo sapiens
gagcgggcaggg

SEQ ID NO: 280693 - DNA, 19 bp, Homo sapiens
gagcgggggctaactggcc

SEQ ID NO: 280694 - DNA, 22 bp, Homo sapiens
gagcgggggctaactggcccca

SEQ ID NO: 280695 - DNA, 13 bp, Homo sapiens
gagcgggtggggt

SEQ ID NO: 280696 - DNA, 19 bp, Homo sapiens
gagctaaattacaattgtc

SEQ ID NO: 280697 - DNA, 15 bp, Homo sapiens
gagctaagttctaag

SEQ ID NO: 280698 - DNA, 20 bp, Homo sapiens
gagctagagaggggcctctg

SEQ ID NO: 280699 - DNA, 22 bp, Homo sapiens
gagagaaagtgtgagcaaacta

SEQ ID NO: 280700 - DNA, 21 bp, Homo sapiens
gagagaagtgcccctgctgcc

SEQ ID NO: 280701 - DNA, 14 bp, Homo sapiens
gagagaatcagacc

SEQ ID NO: 280702 - DNA, 13 bp, Homo sapiens
gagagacaagaag

SEQ ID NO: 280703 - DNA, 22 bp, Homo sapiens
gagagaccagcctttcttcctt

SEQ ID NO: 280704 - DNA, 13 bp, Homo sapiens
gagagaccctcac

SEQ ID NO: 280705 - DNA, 18 bp, Homo sapiens
gagagacctcatcaggat

SEQ ID NO: 280706 - DNA, 13 bp, Homo sapiens
gagagagaaagaa

SEQ ID NO: 280707 - DNA, 15 bp, Homo sapiens
gagagagagagagaa

SEQ ID NO: 280708 - DNA, 11 bp, Homo sapiens
gagagagagcc

SEQ ID NO: 280709 - DNA, 19 bp, Homo sapiens
gagagagcaatcttgctgt

SEQ ID NO: 280710 - DNA, 19 bp, Homo sapiens
gagagagcgcgggagagag

SEQ ID NO: 280711 - DNA, 19 bp, Homo sapiens
gagagagtgagagcacaaa

SEQ ID NO: 280712 - DNA, 20 bp, Homo sapiens
gagagagtgagagcacaaag

SEQ ID NO: 280713 - DNA, 13 bp, Homo sapiens
gagagagtgtgga

SEQ ID NO: 280714 - DNA, 22 bp, Homo sapiens
gagagcaagggaagtggttctt

SEQ ID NO: 280715 - DNA, 10 bp, Homo sapiens
gagagcagct

SEQ ID NO: 280716 - DNA, 11 bp, Homo sapiens
gagagcagctg

SEQ ID NO: 280717 - DNA, 12 bp, Homo sapiens
gagagcagctgg

SEQ ID NO: 280718 - DNA, 19 bp, Homo sapiens
gagagcatctgctctgaga

SEQ ID NO: 280719 - DNA, 18 bp, Homo sapiens
gagagccaacctcggctt

SEQ ID NO: 280720 - DNA, 18 bp, Homo sapiens
gagagcccaatcactgcc

SEQ ID NO: 280721 - DNA, 19 bp, Homo sapiens
gagagcccaatcactgcct

SEQ ID NO: 280722 - DNA, 21 bp, Homo sapiens
gagagcccaatcactgcctat

SEQ ID NO: 280723 - DNA, 14 bp, Homo sapiens
gagagcctgctgca

SEQ ID NO: 280724 - DNA, 19 bp, Homo sapiens
gagagcctggtgctgctgc

SEQ ID NO: 280725 - DNA, 14 bp, Homo sapiens
gagagccttggcct

SEQ ID NO: 280726 - DNA, 13 bp, Homo sapiens
gagagcgccaccc

SEQ ID NO: 280727 - DNA, 16 bp, Homo sapiens
gagagcgccacccgcc

SEQ ID NO: 280728 - DNA, 15 bp, Homo sapiens
gagagcgcgggagag

SEQ ID NO: 280729 - DNA, 16 bp, Homo sapiens
gagagcgcgggagaga

SEQ ID NO: 280730 - DNA, 11 bp, Homo sapiens
gagagctctta

SEQ ID NO: 280731 - DNA, 19 bp, Homo sapiens
gagagctcttagtttttaa

SEQ ID NO: 280732 - DNA, 23 bp, Homo sapiens
gagagctcttagtttttaaaaag

SEQ ID NO: 280733 - DNA, 14 bp, Homo sapiens
gagagctggtgccc

SEQ ID NO: 280734 - DNA, 17 bp, Homo sapiens
gagagcttcctgtttct

SEQ ID NO: 280735 - DNA, 16 bp, Homo sapiens
gagaggaaaagccagt

SEQ ID NO: 280736 - DNA, 20 bp, Homo sapiens
gagaggaaaagtaaggtgca

SEQ ID NO: 280737 - DNA, 21 bp, Homo sapiens
gagaggaagccacgtgctgga

SEQ ID NO: 280738 - DNA, 15 bp, Homo sapiens
gagaggagaaacaca

SEQ ID NO: 280739 - DNA, 11 bp, Homo sapiens
gagaggagaga

SEQ ID NO: 280740 - DNA, 13 bp, Homo sapiens
gagaggagagaat

SEQ ID NO: 280741 - DNA, 15 bp, Homo sapiens
gagaggagagcatct

SEQ ID NO: 280742 - DNA, 18 bp, Homo sapiens
gagaggagcacctgaacc

SEQ ID NO: 280743 - DNA, 21 bp, Homo sapiens
gagaggagcgggacctgtggc

SEQ ID NO: 280744 - DNA, 17 bp, Homo sapiens
gagaggaggggtaaata

SEQ ID NO: 280745 - DNA, 18 bp, Homo sapiens
gagaggagggttcctctt

SEQ ID NO: 280746 - DNA, 20 bp, Homo sapiens
gagaggaggtgtggagtgga

SEQ ID NO: 280747 - DNA, 15 bp, Homo sapiens
gagaggatgaacatc

SEQ ID NO: 280748 - DNA, 14 bp, Homo sapiens
gagaggatgaatgt

SEQ ID NO: 280749 - DNA, 14 bp, Homo sapiens
gagaggcaatgatt

SEQ ID NO: 280750 - DNA, 15 bp, Homo sapiens
gagaggcagagtgcc

SEQ ID NO: 280751 - DNA, 19 bp, Homo sapiens
gagaggcgcgtctgcccca

SEQ ID NO: 280752 - DNA, 15 bp, Homo sapiens
gagaggcgtcctggt

SEQ ID NO: 280753 - DNA, 17 bp, Homo sapiens
gagaggctgaggtgggc

SEQ ID NO: 280754 - DNA, 18 bp, Homo sapiens
gagagggaaacgtgccct

SEQ ID NO: 280755 - DNA, 17 bp, Homo sapiens
gagagggacgaagaaag

SEQ ID NO: 280756 - DNA, 17 bp, Homo sapiens
gagagggagcaagcctt

SEQ ID NO: 280757 - DNA, 10 bp, Homo sapiens
gagagggagt

SEQ ID NO: 280758 - DNA, 18 bp, Homo sapiens
gagagggagtacaaagac

SEQ ID NO: 280759 - DNA, 21 bp, Homo sapiens
gagagggcaatctttgccttt

SEQ ID NO: 280760 - DNA, 14 bp, Homo sapiens
gagagggcccagct

SEQ ID NO: 280761 - DNA, 21 bp, Homo sapiens
gagagggcccagctgtagcca

SEQ ID NO: 280762 - DNA, 14 bp, Homo sapiens
gagagggctgagcc

SEQ ID NO: 280763 - DNA, 20 bp, Homo sapiens
gagaggggcctctggctgcc

SEQ ID NO: 280764 - DNA, 21 bp, Homo sapiens
gagaggggcctctggctgcct

SEQ ID NO: 280765 - DNA, 22 bp, Homo sapiens
gagaggggcctctggctgcctg

SEQ ID NO: 280766 - DNA, 18 bp, Homo sapiens
gagagggggtaatggagg

SEQ ID NO: 280767 - DNA, 23 bp, Homo sapiens
gagagggggtaatggaggccaag

SEQ ID NO: 280768 - DNA, 18 bp, Homo sapiens
gagaggtagcgagctgct

SEQ ID NO: 280769 - DNA, 21 bp, Homo sapiens
gagaggttgaggatgcactgg

SEQ ID NO: 280770 - DNA, 11 bp, Homo sapiens
gagagtaccat

SEQ ID NO: 280771 - DNA, 18 bp, Homo sapiens
gagagtacccccctgaga

SEQ ID NO: 280772 - DNA, 15 bp, Homo sapiens
gagagtagaacagat

SEQ ID NO: 280773 - DNA, 15 bp, Homo sapiens
gagagtcccagagca

SEQ ID NO: 280774 - DNA, 18 bp, Homo sapiens
gagagtcccagagcagga

SEQ ID NO: 280775 - DNA, 19 bp, Homo sapiens
gagagtgggggagaatggc

SEQ ID NO: 280776 - DNA, 18 bp, Homo sapiens
gagagttctttgctgccc

SEQ ID NO: 280777 - DNA, 22 bp, Homo sapiens
gagagtttctatggattcactt

SEQ ID NO: 280778 - DNA, 19 bp, Homo sapiens
gagataaaccaataaatcc

SEQ ID NO: 280779 - DNA, 12 bp, Homo sapiens
gagataaatatc

SEQ ID NO: 280780 - DNA, 17 bp, Homo sapiens
gagataatttaaccctg

SEQ ID NO: 280781 - DNA, 13 bp, Homo sapiens
gagatacccagag

SEQ ID NO: 280782 - DNA, 16 bp, Homo sapiens
gagatacccagagaga

SEQ ID NO: 280783 - DNA, 20 bp, Homo sapiens
gagatcacagcctccagggc

SEQ ID NO: 280784 - DNA, 23 bp, Homo sapiens
gagtgctggaatggggacctggg

SEQ ID NO: 280785 - DNA, 23 bp, Homo sapiens
gagtgctggctccacgccctggg

SEQ ID NO: 280786 - DNA, 19 bp, Homo sapiens
gagtggaggggtcagcagg

SEQ ID NO: 280787 - DNA, 20 bp, Homo sapiens
gagtggatagatgccctgct

SEQ ID NO: 280788 - DNA, 11 bp, Homo sapiens
gagtggcagcc

SEQ ID NO: 280789 - DNA, 13 bp, Homo sapiens
gagtggcagccat

SEQ ID NO: 280790 - DNA, 18 bp, Homo sapiens
gagtggcagccatgcctc

SEQ ID NO: 280791 - DNA, 11 bp, Homo sapiens
gagtggcatgt

SEQ ID NO: 280792 - DNA, 20 bp, Homo sapiens
gagtggccaatccctgtgtg

SEQ ID NO: 280793 - DNA, 10 bp, Homo sapiens
gagtggcctg

SEQ ID NO: 280794 - DNA, 14 bp, Homo sapiens
gagtggcctggcca

SEQ ID NO: 280795 - DNA, 18 bp, Homo sapiens
gagtggcctggccaggag

SEQ ID NO: 280796 - DNA, 18 bp, Homo sapiens
gagtgggacagagtctgg

SEQ ID NO: 280797 - DNA, 14 bp, Homo sapiens
gagtgggagaggaa

SEQ ID NO: 280798 - DNA, 15 bp, Homo sapiens
gagtgggagaggaag

SEQ ID NO: 280799 - DNA, 15 bp, Homo sapiens
gagtgggctttccag

SEQ ID NO: 280800 - DNA, 22 bp, Homo sapiens
gagtggtaacaagaggagcagg

SEQ ID NO: 280801 - DNA, 20 bp, Homo sapiens
gagtggtccacattctgctg

SEQ ID NO: 280802 - DNA, 18 bp, Homo sapiens
gagtggtgaggggccact

SEQ ID NO: 280803 - DNA, 13 bp, Homo sapiens
gagtggtggcagc

SEQ ID NO: 280804 - DNA, 17 bp, Homo sapiens
gagtgtctctgataaaa

SEQ ID NO: 280805 - DNA, 13 bp, Homo sapiens
gagtgtgagggca

SEQ ID NO: 280806 - DNA, 15 bp, Homo sapiens
gagtgtgagggcagc

SEQ ID NO: 280807 - DNA, 18 bp, Homo sapiens
gagtgtgagggcagcact

SEQ ID NO: 280808 - DNA, 20 bp, Homo sapiens
gagtgtggaaaaaaaaagaa

SEQ ID NO: 280809 - DNA, 17 bp, Homo sapiens
gagtgtgtattgttccc

SEQ ID NO: 280810 - DNA, 14 bp, Homo sapiens
gagtgttcaaacta

SEQ ID NO: 280811 - DNA, 21 bp, Homo sapiens
gagtgttcaaactactgtaca

SEQ ID NO: 280812 - DNA, 22 bp, Homo sapiens
gagtgttcaaactactgtacat

SEQ ID NO: 280813 - DNA, 23 bp, Homo sapiens
gagtgttcaaactactgtacatt

SEQ ID NO: 280814 - DNA, 21 bp, Homo sapiens
gagtgttcattttagtgactg

SEQ ID NO: 280815 - DNA, 22 bp, Homo sapiens
gagttaaatagagtatatgcac

SEQ ID NO: 280816 - DNA, 15 bp, Homo sapiens
gagttacagacaaag

SEQ ID NO: 280817 - DNA, 19 bp, Homo sapiens
gagttacttgtctgaggcc

SEQ ID NO: 280818 - DNA, 14 bp, Homo sapiens
gagttcaagaccag

SEQ ID NO: 280819 - DNA, 11 bp, Homo sapiens
gagttcaatga

SEQ ID NO: 280820 - DNA, 13 bp, Homo sapiens
gagttcaatgatc

SEQ ID NO: 280821 - DNA, 14 bp, Homo sapiens
gagttcaatgatct

SEQ ID NO: 280822 - DNA, 15 bp, Homo sapiens
gagttcagctgcttc

SEQ ID NO: 280823 - DNA, 16 bp, Homo sapiens
gagttcagctgcttct

SEQ ID NO: 280824 - DNA, 19 bp, Homo sapiens
gagttcatcttgaattgta

SEQ ID NO: 280825 - DNA, 17 bp, Homo sapiens
gagttcgagaccaacct

SEQ ID NO: 280826 - DNA, 19 bp, Homo sapiens
gagttctcatccacagagg

SEQ ID NO: 280827 - DNA, 13 bp, Homo sapiens
gagttctggaaaa

SEQ ID NO: 280828 - DNA, 13 bp, Homo sapiens
gagttctggttcc

SEQ ID NO: 280829 - DNA, 22 bp, Homo sapiens
gagttctgttgtgtttgtcaaa

SEQ ID NO: 280830 - DNA, 22 bp, Homo sapiens
gagttctttgcaagcttattta

SEQ ID NO: 280831 - DNA, 16 bp, Homo sapiens
gagttctttgctgccc

SEQ ID NO: 280832 - DNA, 23 bp, Homo sapiens
gagttctttgctgcccctgtctg

SEQ ID NO: 280833 - DNA, 22 bp, Homo sapiens
gagttgaccgttttcatcctgg

SEQ ID NO: 280834 - DNA, 21 bp, Homo sapiens
gagttgaggggcttccctctg

SEQ ID NO: 280835 - DNA, 19 bp, Homo sapiens
gagttgcaccattctttct

SEQ ID NO: 280836 - DNA, 15 bp, Homo sapiens
gagttggacacactg

SEQ ID NO: 280837 - DNA, 16 bp, Homo sapiens
gagttggacacactgt

SEQ ID NO: 280838 - DNA, 22 bp, Homo sapiens
gagttggagtactatatttaca

SEQ ID NO: 280839 - DNA, 20 bp, Homo sapiens
gagtttaccatttgtaataa

SEQ ID NO: 280840 - DNA, 16 bp, Homo sapiens
gagtttcctcaggctg

SEQ ID NO: 280841 - DNA, 11 bp, Homo sapiens
gagtttccttt

SEQ ID NO: 280842 - DNA, 13 bp, Homo sapiens
gagtttctatgga

SEQ ID NO: 280843 - DNA, 18 bp, Homo sapiens
gagtttctggctgaaaat

SEQ ID NO: 280844 - DNA, 21 bp, Homo sapiens
gagtttgagacaagccctggc

SEQ ID NO: 280845 - DNA, 19 bp, Homo sapiens
gagtttgatcatagaattg

SEQ ID NO: 280846 - DNA, 18 bp, Homo sapiens
gagtttggaaggtgtcca

SEQ ID NO: 280847 - DNA, 12 bp, Homo sapiens
gagtttgtaagg

SEQ ID NO: 280848 - DNA, 13 bp, Homo sapiens
gagtttgtagtaa

SEQ ID NO: 280849 - DNA, 23 bp, Homo sapiens
gagttttactcttgttgcccagg

SEQ ID NO: 280850 - DNA, 12 bp, Homo sapiens
gataaaaggaag

SEQ ID NO: 280851 - DNA, 16 bp, Homo sapiens
gataaaaggataggaa

SEQ ID NO: 280852 - DNA, 18 bp, Homo sapiens
gataaaatgaggttcaac

SEQ ID NO: 280853 - DNA, 15 bp, Homo sapiens
gataaaatgttcctt

SEQ ID NO: 280854 - DNA, 16 bp, Homo sapiens
gataaacttgcttcag

SEQ ID NO: 280855 - DNA, 14 bp, Homo sapiens
gataaagaaaagaa

SEQ ID NO: 280856 - DNA, 17 bp, Homo sapiens
gataaagaactaaatca

SEQ ID NO: 280857 - DNA, 11 bp, Homo sapiens
gataaagatga

SEQ ID NO: 280858 - DNA, 14 bp, Homo sapiens
gataaaggcttagg

SEQ ID NO: 280859 - DNA, 18 bp, Homo sapiens
gataaatagctaaatggc

SEQ ID NO: 280860 - DNA, 19 bp, Homo sapiens
gataaatatcattatagca

SEQ ID NO: 280861 - DNA, 16 bp, Homo sapiens
gataaatcatttcagt

SEQ ID NO: 280862 - DNA, 13 bp, Homo sapiens
gataaattataag

SEQ ID NO: 280863 - DNA, 21 bp, Homo sapiens
gataacaccaccattcacaag

SEQ ID NO: 280864 - DNA, 21 bp, Homo sapiens
gataacctgtacttcaagtta

SEQ ID NO: 280865 - DNA, 14 bp, Homo sapiens
gataacgcaggaga

SEQ ID NO: 280866 - DNA, 16 bp, Homo sapiens
gataacgcaggagaga

SEQ ID NO: 280867 - DNA, 19 bp, Homo sapiens
gataacgcaggagagagag

SEQ ID NO: 280868 - DNA, 17 bp, Homo sapiens
gataactagatggtgct

SEQ ID NO: 280869 - DNA, 19 bp, Homo sapiens
gataactagatggtgctga

SEQ ID NO: 280870 - DNA, 18 bp, Homo sapiens
gataacttaaataattta

SEQ ID NO: 280871 - DNA, 20 bp, Homo sapiens
gataagacttgtttctttct

SEQ ID NO: 280872 - DNA, 16 bp, Homo sapiens
gataagggagagggaa

SEQ ID NO: 280873 - DNA, 18 bp, Homo sapiens
gataagggagagggaaat

SEQ ID NO: 280874 - DNA, 13 bp, Homo sapiens
gataagtggaaaa

SEQ ID NO: 280875 - DNA, 14 bp, Homo sapiens
gataagtggaaaaa

SEQ ID NO: 280876 - DNA, 20 bp, Homo sapiens
gataatatgtttgaggttaa

SEQ ID NO: 280877 - DNA, 15 bp, Homo sapiens
gataatcagcctctt

SEQ ID NO: 280878 - DNA, 22 bp, Homo sapiens
gataatgagttttacattacaa

SEQ ID NO: 280879 - DNA, 17 bp, Homo sapiens
gataattaaatgaaata

SEQ ID NO: 280880 - DNA, 13 bp, Homo sapiens
gataattatatca

SEQ ID NO: 280881 - DNA, 22 bp, Homo sapiens
gataatttgcatattctattgt

SEQ ID NO: 280882 - DNA, 20 bp, Homo sapiens
gatacacaagagggactgta

SEQ ID NO: 280883 - DNA, 22 bp, Homo sapiens
gatacacaagagggactgtatt

SEQ ID NO: 280884 - DNA, 22 bp, Homo sapiens
gatacacacatagtttcttttt

SEQ ID NO: 280885 - DNA, 15 bp, Homo sapiens
gatacacttgtaaat

SEQ ID NO: 280886 - DNA, 20 bp, Homo sapiens
gatacatatgagtgtggaag

SEQ ID NO: 280887 - DNA, 19 bp, Homo sapiens
gataccaagatgccatctg

SEQ ID NO: 280888 - DNA, 17 bp, Homo sapiens
gataccaggttgaaaga

SEQ ID NO: 280889 - DNA, 21 bp, Homo sapiens
gataccatcagcaaagaattt

SEQ ID NO: 280890 - DNA, 17 bp, Homo sapiens
gataccattttgaaata

SEQ ID NO: 280891 - DNA, 20 bp, Homo sapiens
gatacccagagagaaaaaga

SEQ ID NO: 280892 - DNA, 20 bp, Homo sapiens
gatacccatagcttccatga

SEQ ID NO: 280893 - DNA, 23 bp, Homo sapiens
gataccttaattctttgtttcct

SEQ ID NO: 280894 - DNA, 13 bp, Homo sapiens
gatacgactttat

SEQ ID NO: 280895 - DNA, 15 bp, Homo sapiens
gatactgcccggggc

SEQ ID NO: 280896 - DNA, 22 bp, Homo sapiens
gatactgctgatgctgaaataa

SEQ ID NO: 280897 - DNA, 21 bp, Homo sapiens
gatacttagtggtatgtctct

SEQ ID NO: 280898 - DNA, 18 bp, Homo sapiens
gatacttgatgcacttat

SEQ ID NO: 280899 - DNA, 17 bp, Homo sapiens
gatacttgttccagatg

SEQ ID NO: 280900 - DNA, 14 bp, Homo sapiens
gatagaaataaata

SEQ ID NO: 280901 - DNA, 16 bp, Homo sapiens
gatagaaataaatagc

SEQ ID NO: 280902 - DNA, 19 bp, Homo sapiens
gatagacttcgaaaacaga

SEQ ID NO: 280903 - DNA, 14 bp, Homo sapiens
gatagagctgggtg

SEQ ID NO: 280904 - DNA, 12 bp, Homo sapiens
gatagagggggg

SEQ ID NO: 280905 - DNA, 23 bp, Homo sapiens
gatagcatcccatctcagaagat

SEQ ID NO: 280906 - DNA, 13 bp, Homo sapiens
gatagcctttgta

SEQ ID NO: 280907 - DNA, 17 bp, Homo sapiens
gatagcgtgcagtagag

SEQ ID NO: 280908 - DNA, 13 bp, Homo sapiens
gattccaaagcat

SEQ ID NO: 280909 - DNA, 16 bp, Homo sapiens
gattccaagggcccag

SEQ ID NO: 280910 - DNA, 20 bp, Homo sapiens
gattccaagggcccagaggg

SEQ ID NO: 280911 - DNA, 19 bp, Homo sapiens
gattccagagagtggctcc

SEQ ID NO: 280912 - DNA, 19 bp, Homo sapiens
gattccatctccttgtctt

SEQ ID NO: 280913 - DNA, 13 bp, Homo sapiens
gattcccattgaa

SEQ ID NO: 280914 - DNA, 17 bp, Homo sapiens
gattccccggagctggg

SEQ ID NO: 280915 - DNA, 20 bp, Homo sapiens
gattccccggagctgggaag

SEQ ID NO: 280916 - DNA, 18 bp, Homo sapiens
gattcccggctggacttt

SEQ ID NO: 280917 - DNA, 17 bp, Homo sapiens
gattccggccctggctg

SEQ ID NO: 280918 - DNA, 23 bp, Homo sapiens
gattcctaagcagtgcttgtaaa

SEQ ID NO: 280919 - DNA, 17 bp, Homo sapiens
gattcctacttaaacaa

SEQ ID NO: 280920 - DNA, 18 bp, Homo sapiens
gattcctcccccagagcc

SEQ ID NO: 280921 - DNA, 19 bp, Homo sapiens
gattcctcttgcctctctc

SEQ ID NO: 280922 - DNA, 15 bp, Homo sapiens
gattccttcctgttc

SEQ ID NO: 280923 - DNA, 16 bp, Homo sapiens
gattctaaaacattct

SEQ ID NO: 280924 - DNA, 20 bp, Homo sapiens
gattctaaaacattctttaa

SEQ ID NO: 280925 - DNA, 17 bp, Homo sapiens
gattctaaacagatgtc

SEQ ID NO: 280926 - DNA, 24 bp, Homo sapiens
gattctaaaggggacagatcttga

SEQ ID NO: 280927 - DNA, 21 bp, Homo sapiens
gattctagcacatcatggcag

SEQ ID NO: 280928 - DNA, 12 bp, Homo sapiens
gattctccctgg

SEQ ID NO: 280929 - DNA, 15 bp, Homo sapiens
gattctcctctccca

SEQ ID NO: 280930 - DNA, 18 bp, Homo sapiens
gattctcctgcctcagcc

SEQ ID NO: 280931 - DNA, 14 bp, Homo sapiens
gattctcctgtgct

SEQ ID NO: 280932 - DNA, 21 bp, Homo sapiens
gattctctgcgagcaacagtg

SEQ ID NO: 280933 - DNA, 13 bp, Homo sapiens
gattctcttctca

SEQ ID NO: 280934 - DNA, 23 bp, Homo sapiens
gattctggatggccgggctgctg

SEQ ID NO: 280935 - DNA, 11 bp, Homo sapiens
gattctgggaa

SEQ ID NO: 280936 - DNA, 17 bp, Homo sapiens
gattctgggaaaggtgc

SEQ ID NO: 280937 - DNA, 18 bp, Homo sapiens
gattctgggaaaggtgct

SEQ ID NO: 280938 - DNA, 19 bp, Homo sapiens
gattctgggaaaggtgctc

SEQ ID NO: 280939 - DNA, 21 bp, Homo sapiens
gattctgggaaaggtgctcaa

SEQ ID NO: 280940 - DNA, 19 bp, Homo sapiens
gattctgtcccccacgtgg

SEQ ID NO: 280941 - DNA, 19 bp, Homo sapiens
gattctttccattatgatt

SEQ ID NO: 280942 - DNA, 14 bp, Homo sapiens
gattctttccccag

SEQ ID NO: 280943 - DNA, 22 bp, Homo sapiens
gattcttttcccatcaccagaa

SEQ ID NO: 280944 - DNA, 12 bp, Homo sapiens
gattgaaaagaa

SEQ ID NO: 280945 - DNA, 13 bp, Homo sapiens
gattgaacacagg

SEQ ID NO: 280946 - DNA, 14 bp, Homo sapiens
gattgaacacaggc

SEQ ID NO: 280947 - DNA, 15 bp, Homo sapiens
gattgaacgttctca

SEQ ID NO: 280948 - DNA, 14 bp, Homo sapiens
gattgaatgctgcc

SEQ ID NO: 280949 - DNA, 17 bp, Homo sapiens
gattgacaactgaagag

SEQ ID NO: 280950 - DNA, 20 bp, Homo sapiens
gattgagtcagtgtttgctg

SEQ ID NO: 280951 - DNA, 19 bp, Homo sapiens
gattgatagagtgttatca

SEQ ID NO: 280952 - DNA, 23 bp, Homo sapiens
gattgatttttaaagtttaaata

SEQ ID NO: 280953 - DNA, 14 bp, Homo sapiens
gattgcacattgtt

SEQ ID NO: 280954 - DNA, 16 bp, Homo sapiens
gattgcacgtggcctc

SEQ ID NO: 280955 - DNA, 23 bp, Homo sapiens
gattgcacgtggcctcttgagca

SEQ ID NO: 280956 - DNA, 14 bp, Homo sapiens
gattgcttctgtag

SEQ ID NO: 280957 - DNA, 22 bp, Homo sapiens
gattgcttttgttttcctgctg

SEQ ID NO: 280958 - DNA, 23 bp, Homo sapiens
gattgcttttgttttcctgctgg

SEQ ID NO: 280959 - DNA, 11 bp, Homo sapiens
gattggattat

SEQ ID NO: 280960 - DNA, 14 bp, Homo sapiens
gattggattattca

SEQ ID NO: 280961 - DNA, 17 bp, Homo sapiens
gattggattattcattt

SEQ ID NO: 280962 - DNA, 18 bp, Homo sapiens
gattggcacccctttcta

SEQ ID NO: 280963 - DNA, 16 bp, Homo sapiens
gattggctttaaacac

SEQ ID NO: 280964 - DNA, 11 bp, Homo sapiens
gattggctttg

SEQ ID NO: 280965 - DNA, 23 bp, Homo sapiens
gattggctttgtgcttggggcta

SEQ ID NO: 280966 - DNA, 17 bp, Homo sapiens
gattgggggctggtgcc

SEQ ID NO: 280967 - DNA, 19 bp, Homo sapiens
gattgtaaaggtaggtgca

SEQ ID NO: 280968 - DNA, 21 bp, Homo sapiens
gattgtacagaatcattgctt

SEQ ID NO: 280969 - DNA, 18 bp, Homo sapiens
gattgtccacaaatgtcc

SEQ ID NO: 280970 - DNA, 18 bp, Homo sapiens
gattgtgctctgcagcga

SEQ ID NO: 280971 - DNA, 19 bp, Homo sapiens
gatttaacagtcatttaaa

SEQ ID NO: 280972 - DNA, 15 bp, Homo sapiens
gatttaactgtgaac

SEQ ID NO: 280973 - DNA, 16 bp, Homo sapiens
gatttacagtgcctgt

SEQ ID NO: 280974 - DNA, 15 bp, Homo sapiens
gatttaccctttata

SEQ ID NO: 280975 - DNA, 23 bp, Homo sapiens
gatttaggcttctatgtccaaca

SEQ ID NO: 280976 - DNA, 16 bp, Homo sapiens
gatttagggaagcagg

SEQ ID NO: 280977 - DNA, 23 bp, Homo sapiens
gatttataaagatttttgttaag

SEQ ID NO: 280978 - DNA, 20 bp, Homo sapiens
gatttatagtttgtacatgc

SEQ ID NO: 280979 - DNA, 21 bp, Homo sapiens
gatttatagtttgtacatgca

SEQ ID NO: 280980 - DNA, 15 bp, Homo sapiens
gatttatcacacaaa

SEQ ID NO: 280981 - DNA, 12 bp, Homo sapiens
gatttatctttc

SEQ ID NO: 280982 - DNA, 15 bp, Homo sapiens
gcaaatgtccaagca

SEQ ID NO: 280983 - DNA, 13 bp, Homo sapiens
gcaaattattcta

SEQ ID NO: 280984 - DNA, 22 bp, Homo sapiens
gcaaattattctagtcaactgc

SEQ ID NO: 280985 - DNA, 23 bp, Homo sapiens
gcaaattattctagtcaactgct

SEQ ID NO: 280986 - DNA, 21 bp, Homo sapiens
gcaaattccacccctccttcc

SEQ ID NO: 280987 - DNA, 15 bp, Homo sapiens
gcaacaaaggatttg

SEQ ID NO: 280988 - DNA, 18 bp, Homo sapiens
gcaacaacaacagaacaa

SEQ ID NO: 280989 - DNA, 20 bp, Homo sapiens
gcaacaactttgtttctcat

SEQ ID NO: 280990 - DNA, 17 bp, Homo sapiens
gcaacaataataaatgt

SEQ ID NO: 280991 - DNA, 12 bp, Homo sapiens
gcaacacacaga

SEQ ID NO: 280992 - DNA, 13 bp, Homo sapiens
gcaacacacagac

SEQ ID NO: 280993 - DNA, 22 bp, Homo sapiens
gcaacactgccagaagtgtgtt

SEQ ID NO: 280994 - DNA, 13 bp, Homo sapiens
gcaacagcactgg

SEQ ID NO: 280995 - DNA, 18 bp, Homo sapiens
gcaacaggaccaggagcc

SEQ ID NO: 280996 - DNA, 13 bp, Homo sapiens
gcaacaggtttta

SEQ ID NO: 280997 - DNA, 13 bp, Homo sapiens
gcaacatcttttt

SEQ ID NO: 280998 - DNA, 19 bp, Homo sapiens
gcaacatgaagaatgcatt

SEQ ID NO: 280999 - DNA, 22 bp, Homo sapiens
gcaacatgaagaatgcattcaa

SEQ ID NO: 281000 - DNA, 16 bp, Homo sapiens
gcaaccccctcggagc

SEQ ID NO: 281001 - DNA, 19 bp, Homo sapiens
gcaacccctgtacccagct

SEQ ID NO: 281002 - DNA, 23 bp, Homo sapiens
gcaaccctcctatcacctcccct

SEQ ID NO: 281003 - DNA, 23 bp, Homo sapiens
gcaacctctgcctcccaggttcc

SEQ ID NO: 281004 - DNA, 14 bp, Homo sapiens
gcaacctgtaactg

SEQ ID NO: 281005 - DNA, 18 bp, Homo sapiens
gcaaccttaaagcaataa

SEQ ID NO: 281006 - DNA, 22 bp, Homo sapiens
gcaactcaaggactttgcagcc

SEQ ID NO: 281007 - DNA, 21 bp, Homo sapiens
gcaactcatgaacaaaatgaa

SEQ ID NO: 281008 - DNA, 16 bp, Homo sapiens
gcaactgaacaaaaaa

SEQ ID NO: 281009 - DNA, 16 bp, Homo sapiens
gcaactgttggataat

SEQ ID NO: 281010 - DNA, 23 bp, Homo sapiens
gcaacttgtctttttctggactg

SEQ ID NO: 281011 - DNA, 16 bp, Homo sapiens
gcaagaaaaaagtaca

SEQ ID NO: 281012 - DNA, 22 bp, Homo sapiens
gcaagaaattcattaaagaaaa

SEQ ID NO: 281013 - DNA, 17 bp, Homo sapiens
gcaagaagactgtattt

SEQ ID NO: 281014 - DNA, 16 bp, Homo sapiens
gcaagaagattctaaa

SEQ ID NO: 281015 - DNA, 17 bp, Homo sapiens
gcaagaagattctaaaa

SEQ ID NO: 281016 - DNA, 19 bp, Homo sapiens
gcaagaagattctaaaaca

SEQ ID NO: 281017 - DNA, 13 bp, Homo sapiens
gcaagaagtggga

SEQ ID NO: 281018 - DNA, 16 bp, Homo sapiens
gcaagaccttttttta

SEQ ID NO: 281019 - DNA, 17 bp, Homo sapiens
gcaagacgtcctggaat

SEQ ID NO: 281020 - DNA, 18 bp, Homo sapiens
gcaagacgtcctggaatg

SEQ ID NO: 281021 - DNA, 16 bp, Homo sapiens
gcaagactctgtctca

SEQ ID NO: 281022 - DNA, 17 bp, Homo sapiens
gcaagagaaggagatgt

SEQ ID NO: 281023 - DNA, 12 bp, Homo sapiens
gcaagagaatta

SEQ ID NO: 281024 - DNA, 19 bp, Homo sapiens
gcaagagactgggagccac

SEQ ID NO: 281025 - DNA, 14 bp, Homo sapiens
gcaagagagatgtt

SEQ ID NO: 281026 - DNA, 17 bp, Homo sapiens
gcaagagagatgttttg

SEQ ID NO: 281027 - DNA, 14 bp, Homo sapiens
gcaagagtatactt

SEQ ID NO: 281028 - DNA, 19 bp, Homo sapiens
gcaagagtgggctttccag

SEQ ID NO: 281029 - DNA, 21 bp, Homo sapiens
gcaagagtgggctttccaggg

SEQ ID NO: 281030 - DNA, 16 bp, Homo sapiens
gcaagatgatttttaa

SEQ ID NO: 281031 - DNA, 19 bp, Homo sapiens
gcaagattggaaagacagg

SEQ ID NO: 281032 - DNA, 17 bp, Homo sapiens
gcaagcaagctctcttg

SEQ ID NO: 281033 - DNA, 13 bp, Homo sapiens
gcaagcagggaaa

SEQ ID NO: 281034 - DNA, 14 bp, Homo sapiens
gcaagcagggaaag

SEQ ID NO: 281035 - DNA, 13 bp, Homo sapiens
gcaagccccaggg

SEQ ID NO: 281036 - DNA, 15 bp, Homo sapiens
gcaagccccagggcc

SEQ ID NO: 281037 - DNA, 16 bp, Homo sapiens
gcaagccccagggcct

SEQ ID NO: 281038 - DNA, 21 bp, Homo sapiens
gcaagccccagggcctggggg

SEQ ID NO: 281039 - DNA, 16 bp, Homo sapiens
gcaagcccctcagccc

SEQ ID NO: 281040 - DNA, 20 bp, Homo sapiens
gcaagcctgagtggtgaggg

SEQ ID NO: 281041 - DNA, 17 bp, Homo sapiens
gcaagcgagcacagtat

SEQ ID NO: 281042 - DNA, 14 bp, Homo sapiens
gcaagctctcttgc

SEQ ID NO: 281043 - DNA, 13 bp, Homo sapiens
gcaaggaaggaaa

SEQ ID NO: 281044 - DNA, 19 bp, Homo sapiens
gcaaggacaacctgcccct

SEQ ID NO: 281045 - DNA, 22 bp, Homo sapiens
gcaaggacattgccccaagata

SEQ ID NO: 281046 - DNA, 11 bp, Homo sapiens
gcaaggatcac

SEQ ID NO: 281047 - DNA, 16 bp, Homo sapiens
gcaaggcacaggctcc

SEQ ID NO: 281048 - DNA, 15 bp, Homo sapiens
gcaaggcagctccca

SEQ ID NO: 281049 - DNA, 19 bp, Homo sapiens
gcaaggcaggttggatggg

SEQ ID NO: 281050 - DNA, 13 bp, Homo sapiens
gcaaggcccacag

SEQ ID NO: 281051 - DNA, 17 bp, Homo sapiens
gcaaggcctgtgctgca

SEQ ID NO: 281052 - DNA, 12 bp, Homo sapiens
gcaaggctgggt

SEQ ID NO: 281053 - DNA, 13 bp, Homo sapiens
gcaaggctgtcaa

SEQ ID NO: 281054 - DNA, 18 bp, Homo sapiens
gcaagggcatcaggcact

SEQ ID NO: 281055 - DNA, 14 bp, Homo sapiens
gcaagggctccagc

SEQ ID NO: 281056 - DNA, 22 bp, Homo sapiens
gcaagggggtgtcatctgagga

SEQ ID NO: 281057 - DNA, 23 bp, Homo sapiens
gcaagggtcctacggagggacca

SEQ ID NO: 281058 - DNA, 22 bp, Homo sapiens
gcaaggtgggggagcctggagc

SEQ ID NO: 281059 - DNA, 14 bp, Homo sapiens
gcaagtatatttat

SEQ ID NO: 281060 - DNA, 18 bp, Homo sapiens
gcaagtatgtgagtgtgt

SEQ ID NO: 281061 - DNA, 20 bp, Homo sapiens
gcaagtccatagctgagctg

SEQ ID NO: 281062 - DNA, 18 bp, Homo sapiens
gcaagtcccagacaagga

SEQ ID NO: 281063 - DNA, 18 bp, Homo sapiens
gcaagtcgccaggcagga

SEQ ID NO: 281064 - DNA, 15 bp, Homo sapiens
gcaagtgaggcaaga

SEQ ID NO: 281065 - DNA, 20 bp, Homo sapiens
gcaagtgggagatgaaaacc

SEQ ID NO: 281066 - DNA, 16 bp, Homo sapiens
gcaagtgtctgtgtgc

SEQ ID NO: 281067 - DNA, 16 bp, Homo sapiens
gcaagtgtgcactcca

SEQ ID NO: 281068 - DNA, 23 bp, Homo sapiens
gcaagtgtgtatgtgcgtgtgtg

SEQ ID NO: 281069 - DNA, 22 bp, Homo sapiens
gcaagtgtgtgcatgtgtgcga

SEQ ID NO: 281070 - DNA, 16 bp, Homo sapiens
gcaagtgtttctgttc

SEQ ID NO: 281071 - DNA, 23 bp, Homo sapiens
gcaataaatgtcccaaataaatt

SEQ ID NO: 281072 - DNA, 14 bp, Homo sapiens
gcaataagttcatt

SEQ ID NO: 281073 - DNA, 19 bp, Homo sapiens
gcaatacattaaaataact

SEQ ID NO: 281074 - DNA, 13 bp, Homo sapiens
gcaatagtgtgtt

SEQ ID NO: 281075 - DNA, 22 bp, Homo sapiens
gcaatatgaggggactgcatgc

SEQ ID NO: 281076 - DNA, 13 bp, Homo sapiens
gcaatcctcctga

SEQ ID NO: 281077 - DNA, 13 bp, Homo sapiens
gcaatctccaggg

SEQ ID NO: 281078 - DNA, 12 bp, Homo sapiens
gcaatcttgctg

SEQ ID NO: 281079 - DNA, 16 bp, Homo sapiens
gcaatcttgctgtgaa

SEQ ID NO: 281080 - DNA, 17 bp, Homo sapiens
gcaatcttgctgtgaaa

SEQ ID NO: 281081 - DNA, 18 bp, Homo sapiens
gcaatgacaggtaaatta

SEQ ID NO: 281082 - DNA, 19 bp, Homo sapiens
gatagtagatctgtggcga

SEQ ID NO: 281083 - DNA, 19 bp, Homo sapiens
gatagtagtaaaattagaa

SEQ ID NO: 281084 - DNA, 17 bp, Homo sapiens
gatagtcacctgctggt

SEQ ID NO: 281085 - DNA, 16 bp, Homo sapiens
gatataaatggctggt

SEQ ID NO: 281086 - DNA, 17 bp, Homo sapiens
gatatacagatgaaaat

SEQ ID NO: 281087 - DNA, 15 bp, Homo sapiens
gatatatatgtataa

SEQ ID NO: 281088 - DNA, 20 bp, Homo sapiens
gatatatatgtataatttca

SEQ ID NO: 281089 - DNA, 16 bp, Homo sapiens
gatatatctttatact

SEQ ID NO: 281090 - DNA, 17 bp, Homo sapiens
gatatatctttatactt

SEQ ID NO: 281091 - DNA, 14 bp, Homo sapiens
gatatattctttcc

SEQ ID NO: 281092 - DNA, 18 bp, Homo sapiens
gatatcagagctcttaat

SEQ ID NO: 281093 - DNA, 16 bp, Homo sapiens
gatatccattctttct

SEQ ID NO: 281094 - DNA, 19 bp, Homo sapiens
gatatccattctttctgat

SEQ ID NO: 281095 - DNA, 23 bp, Homo sapiens
gatatccctatgctgcctaggct

SEQ ID NO: 281096 - DNA, 15 bp, Homo sapiens
gatatctatgactgt

SEQ ID NO: 281097 - DNA, 15 bp, Homo sapiens
gatatctgaacacat

SEQ ID NO: 281098 - DNA, 23 bp, Homo sapiens
gatatctgaacacatactagaaa

SEQ ID NO: 281099 - DNA, 20 bp, Homo sapiens
gatatctgtttgcttctaaa

SEQ ID NO: 281100 - DNA, 20 bp, Homo sapiens
gatatgagaaatataaaaat

SEQ ID NO: 281101 - DNA, 14 bp, Homo sapiens
gatatgagagggat

SEQ ID NO: 281102 - DNA, 18 bp, Homo sapiens
gatatgcatgtagcatat

SEQ ID NO: 281103 - DNA, 21 bp, Homo sapiens
gatatgcatgtagcatataaa

SEQ ID NO: 281104 - DNA, 15 bp, Homo sapiens
gatatgggctttctc

SEQ ID NO: 281105 - DNA, 21 bp, Homo sapiens
gatatgggctttctctttggt

SEQ ID NO: 281106 - DNA, 18 bp, Homo sapiens
gatatgtctttaaaatga

SEQ ID NO: 281107 - DNA, 14 bp, Homo sapiens
gatatgtggtgtat

SEQ ID NO: 281108 - DNA, 19 bp, Homo sapiens
gatatgtggtgtatatcct

SEQ ID NO: 281109 - DNA, 18 bp, Homo sapiens
gatatgtgtaatatcatt

SEQ ID NO: 281110 - DNA, 19 bp, Homo sapiens
gatatgtgtaatatcattt

SEQ ID NO: 281111 - DNA, 16 bp, Homo sapiens
gatattcaaacacaca

SEQ ID NO: 281112 - DNA, 18 bp, Homo sapiens
gatattcaaacacacagt

SEQ ID NO: 281113 - DNA, 19 bp, Homo sapiens
gatattcaaacacacagta

SEQ ID NO: 281114 - DNA, 16 bp, Homo sapiens
gatattccatgaatgt

SEQ ID NO: 281115 - DNA, 19 bp, Homo sapiens
gatattccatgaatgtatc

SEQ ID NO: 281116 - DNA, 18 bp, Homo sapiens
gatattctcattatttca

SEQ ID NO: 281117 - DNA, 15 bp, Homo sapiens
gatattctttacaaa

SEQ ID NO: 281118 - DNA, 16 bp, Homo sapiens
gatattgaccatgtga

SEQ ID NO: 281119 - DNA, 20 bp, Homo sapiens
gatattggtgtgaatgctgt

SEQ ID NO: 281120 - DNA, 16 bp, Homo sapiens
gatattgtatgtacct

SEQ ID NO: 281121 - DNA, 12 bp, Homo sapiens
gatattgtgcat

SEQ ID NO: 281122 - DNA, 17 bp, Homo sapiens
gatattgttataaataa

SEQ ID NO: 281123 - DNA, 21 bp, Homo sapiens
gatattgttttctgtaaataa

SEQ ID NO: 281124 - DNA, 16 bp, Homo sapiens
gatatttaagaaaata

SEQ ID NO: 281125 - DNA, 17 bp, Homo sapiens
gatatttcttgctttca

SEQ ID NO: 281126 - DNA, 21 bp, Homo sapiens
gatatttgctggagtgctggc

SEQ ID NO: 281127 - DNA, 18 bp, Homo sapiens
gatattttcaaattgtat

SEQ ID NO: 281128 - DNA, 23 bp, Homo sapiens
gatcaaaacctgtgccaggctga

SEQ ID NO: 281129 - DNA, 17 bp, Homo sapiens
gatcaaaataaaaagtg

SEQ ID NO: 281130 - DNA, 21 bp, Homo sapiens
gatcaaaatctgtagagcagg

SEQ ID NO: 281131 - DNA, 16 bp, Homo sapiens
gatcaaagacacacag

SEQ ID NO: 281132 - DNA, 23 bp, Homo sapiens
gatcaaattcatttttttcactg

SEQ ID NO: 281133 - DNA, 18 bp, Homo sapiens
gatcaataaaatgtgatt

SEQ ID NO: 281134 - DNA, 19 bp, Homo sapiens
gatcaataaaatgtgattt

SEQ ID NO: 281135 - DNA, 15 bp, Homo sapiens
gatcaattaaatgta

SEQ ID NO: 281136 - DNA, 13 bp, Homo sapiens
gatcacagatgtg

SEQ ID NO: 281137 - DNA, 24 bp, Homo sapiens
gatcacagatgtgcccagagtagc

SEQ ID NO: 281138 - DNA, 16 bp, Homo sapiens
gatcacagcctccagg

SEQ ID NO: 281139 - DNA, 20 bp, Homo sapiens
gatcacagcctccagggccc

SEQ ID NO: 281140 - DNA, 20 bp, Homo sapiens
gatcaccagcccggcctgct

SEQ ID NO: 281141 - DNA, 12 bp, Homo sapiens
gatcactactgc

SEQ ID NO: 281142 - DNA, 19 bp, Homo sapiens
gatcacttaagcccaggag

SEQ ID NO: 281143 - DNA, 12 bp, Homo sapiens
gatcacttgagc

SEQ ID NO: 281144 - DNA, 14 bp, Homo sapiens
gatcagaacatgaa

SEQ ID NO: 281145 - DNA, 20 bp, Homo sapiens
gatcagaactgggaaaacag

SEQ ID NO: 281146 - DNA, 19 bp, Homo sapiens
gatcagatcttacaagttt

SEQ ID NO: 281147 - DNA, 17 bp, Homo sapiens
gatcagatgactagaaa

SEQ ID NO: 281148 - DNA, 15 bp, Homo sapiens
gatcagcattcaaaa

SEQ ID NO: 281149 - DNA, 17 bp, Homo sapiens
gatcagccccgctcctc

SEQ ID NO: 281150 - DNA, 16 bp, Homo sapiens
gatcagctgtttgtca

SEQ ID NO: 281151 - DNA, 18 bp, Homo sapiens
gatcagggaatccagctc

SEQ ID NO: 281152 - DNA, 19 bp, Homo sapiens
gatcagggaatccagctcc

SEQ ID NO: 281153 - DNA, 20 bp, Homo sapiens
gatcagggaatccagctccc

SEQ ID NO: 281154 - DNA, 14 bp, Homo sapiens
gatcagtatttcac

SEQ ID NO: 281155 - DNA, 21 bp, Homo sapiens
gatcagtggggccccaaagcc

SEQ ID NO: 281156 - DNA, 22 bp, Homo sapiens
gatcagtggggccccaaagccc

SEQ ID NO: 281157 - DNA, 13 bp, Homo sapiens
gatcatctttgct

SEQ ID NO: 281158 - DNA, 16 bp, Homo sapiens
gatcatggctcactgc

SEQ ID NO: 281159 - DNA, 18 bp, Homo sapiens
gatcattacatggctgtg

SEQ ID NO: 281160 - DNA, 20 bp, Homo sapiens
gatcattggtatctgatatc

SEQ ID NO: 281161 - DNA, 18 bp, Homo sapiens
gatcattttccccccact

SEQ ID NO: 281162 - DNA, 18 bp, Homo sapiens
gatccacccacctcagcc

SEQ ID NO: 281163 - DNA, 15 bp, Homo sapiens
gatccacccacctgg

SEQ ID NO: 281164 - DNA, 19 bp, Homo sapiens
gatccacccacctgggcct

SEQ ID NO: 281165 - DNA, 13 bp, Homo sapiens
gatccacctgcct

SEQ ID NO: 281166 - DNA, 14 bp, Homo sapiens
gatccacctgtctc

SEQ ID NO: 281167 - DNA, 18 bp, Homo sapiens
gatccacctgtctcagcc

SEQ ID NO: 281168 - DNA, 19 bp, Homo sapiens
gatccacctgtctcagcct

SEQ ID NO: 281169 - DNA, 12 bp, Homo sapiens
gatccagagaga

SEQ ID NO: 281170 - DNA, 14 bp, Homo sapiens
gatccagagcacag

SEQ ID NO: 281171 - DNA, 18 bp, Homo sapiens
gatccagatccagactgt

SEQ ID NO: 281172 - DNA, 21 bp, Homo sapiens
gatccagctgtgtgttttcaa

SEQ ID NO: 281173 - DNA, 23 bp, Homo sapiens
gatccagctgtgtgttttcaatc

SEQ ID NO: 281174 - DNA, 17 bp, Homo sapiens
gatccatccatctccag

SEQ ID NO: 281175 - DNA, 15 bp, Homo sapiens
gatcccataaagaaa

SEQ ID NO: 281176 - DNA, 14 bp, Homo sapiens
gatcccccaggttc

SEQ ID NO: 281177 - DNA, 22 bp, Homo sapiens
gatcccctgctactccactgac

SEQ ID NO: 281178 - DNA, 19 bp, Homo sapiens
gatccctcggtcagcaccg

SEQ ID NO: 281179 - DNA, 21 bp, Homo sapiens
gatccctgtgttgtctctaga

SEQ ID NO: 281180 - DNA, 18 bp, Homo sapiens
gatccctgttacccagag

SEQ ID NO: 281181 - DNA, 20 bp, Homo sapiens
gatccctgttacccagagaa

SEQ ID NO: 281182 - DNA, 15 bp, Homo sapiens
gatccgcatgtgtct

SEQ ID NO: 281183 - DNA, 14 bp, Homo sapiens
gatccgccctgggc

SEQ ID NO: 281184 - DNA, 16 bp, Homo sapiens
gatccgccctgggctc

SEQ ID NO: 281185 - DNA, 18 bp, Homo sapiens
gatccgcggggaccctgc

SEQ ID NO: 281186 - DNA, 14 bp, Homo sapiens
gatccgctgccacc

SEQ ID NO: 281187 - DNA, 16 bp, Homo sapiens
gatccgctgccaccac

SEQ ID NO: 281188 - DNA, 14 bp, Homo sapiens
gatcctacccctga

SEQ ID NO: 281189 - DNA, 20 bp, Homo sapiens
gatcctgcaggaacgagcac

SEQ ID NO: 281190 - DNA, 12 bp, Homo sapiens
gatcctgctgcc

SEQ ID NO: 281191 - DNA, 14 bp, Homo sapiens
gatcctggagcccc

SEQ ID NO: 281192 - DNA, 15 bp, Homo sapiens
gatcctggagcccct

SEQ ID NO: 281193 - DNA, 17 bp, Homo sapiens
gattaacctctgcacta

SEQ ID NO: 281194 - DNA, 20 bp, Homo sapiens
gattaagatacactcctgct

SEQ ID NO: 281195 - DNA, 12 bp, Homo sapiens
gattaagatttt

SEQ ID NO: 281196 - DNA, 18 bp, Homo sapiens
gattaagattttacaaaa

SEQ ID NO: 281197 - DNA, 19 bp, Homo sapiens
gattaagttataccagcaa

SEQ ID NO: 281198 - DNA, 21 bp, Homo sapiens
gattaatctctaaaattctag

SEQ ID NO: 281199 - DNA, 22 bp, Homo sapiens
gattaatctctaaaattctagt

SEQ ID NO: 281200 - DNA, 13 bp, Homo sapiens
gattaatgtttct

SEQ ID NO: 281201 - DNA, 15 bp, Homo sapiens
gattaatgttttgta

SEQ ID NO: 281202 - DNA, 16 bp, Homo sapiens
gattaatgttttgtac

SEQ ID NO: 281203 - DNA, 14 bp, Homo sapiens
gattaatttgtgta

SEQ ID NO: 281204 - DNA, 21 bp, Homo sapiens
gattagaaatgaccaatatta

SEQ ID NO: 281205 - DNA, 19 bp, Homo sapiens
gattagaagccaagacagt

SEQ ID NO: 281206 - DNA, 14 bp, Homo sapiens
gattagaaggcaag

SEQ ID NO: 281207 - DNA, 13 bp, Homo sapiens
gattagagggagg

SEQ ID NO: 281208 - DNA, 17 bp, Homo sapiens
gattagagggaggtgtt

SEQ ID NO: 281209 - DNA, 20 bp, Homo sapiens
gattatagattggagccacc

SEQ ID NO: 281210 - DNA, 18 bp, Homo sapiens
gattatattgagacaaaa

SEQ ID NO: 281211 - DNA, 19 bp, Homo sapiens
gattatattgagacaaaaa

SEQ ID NO: 281212 - DNA, 19 bp, Homo sapiens
gattatcctgttactgaat

SEQ ID NO: 281213 - DNA, 20 bp, Homo sapiens
gattatcctgttactgaatt

SEQ ID NO: 281214 - DNA, 12 bp, Homo sapiens
gattatcttgaa

SEQ ID NO: 281215 - DNA, 13 bp, Homo sapiens
gattatcttgaaa

SEQ ID NO: 281216 - DNA, 16 bp, Homo sapiens
gattatggttttgtga

SEQ ID NO: 281217 - DNA, 14 bp, Homo sapiens
gattattcatttaa

SEQ ID NO: 281218 - DNA, 16 bp, Homo sapiens
gattattcatttaaaa

SEQ ID NO: 281219 - DNA, 21 bp, Homo sapiens
gattattcatttaaaatgatt

SEQ ID NO: 281220 - DNA, 22 bp, Homo sapiens
gattattcatttaaaatgatta

SEQ ID NO: 281221 - DNA, 12 bp, Homo sapiens
gattattggaaa

SEQ ID NO: 281222 - DNA, 23 bp, Homo sapiens
gattatttgttatttgtacagtt

SEQ ID NO: 281223 - DNA, 14 bp, Homo sapiens
gattcaaaaaaaaa

SEQ ID NO: 281224 - DNA, 19 bp, Homo sapiens
gattcaacaggttttcctg

SEQ ID NO: 281225 - DNA, 15 bp, Homo sapiens
gattcacctgtaaaa

SEQ ID NO: 281226 - DNA, 15 bp, Homo sapiens
gattcaggaatgggc

SEQ ID NO: 281227 - DNA, 14 bp, Homo sapiens
gattcataacaatg

SEQ ID NO: 281228 - DNA, 17 bp, Homo sapiens
gattcatatttacttct

SEQ ID NO: 281229 - DNA, 18 bp, Homo sapiens
gattcatggctttgtatc

SEQ ID NO: 281230 - DNA, 16 bp, Homo sapiens
gcagctccgcctggca

SEQ ID NO: 281231 - DNA, 19 bp, Homo sapiens
gcagctccgcctggcaccc

SEQ ID NO: 281232 - DNA, 19 bp, Homo sapiens
gcagctcctctccttgggc

SEQ ID NO: 281233 - DNA, 14 bp, Homo sapiens
gcagctctccagtc

SEQ ID NO: 281234 - DNA, 15 bp, Homo sapiens
gcagctctccagtca

SEQ ID NO: 281235 - DNA, 14 bp, Homo sapiens
gcagctctgtcgtg

SEQ ID NO: 281236 - DNA, 15 bp, Homo sapiens
gcagctctttcttct

SEQ ID NO: 281237 - DNA, 17 bp, Homo sapiens
gcagctctttcttcttt

SEQ ID NO: 281238 - DNA, 17 bp, Homo sapiens
gcagctgattttaacaa

SEQ ID NO: 281239 - DNA, 17 bp, Homo sapiens
gcagctgcgggtctgaa

SEQ ID NO: 281240 - DNA, 19 bp, Homo sapiens
gcagctgcgggtctgaagg

SEQ ID NO: 281241 - DNA, 16 bp, Homo sapiens
gcagctggcaggagag

SEQ ID NO: 281242 - DNA, 13 bp, Homo sapiens
gcagctgggcact

SEQ ID NO: 281243 - DNA, 17 bp, Homo sapiens
gcagctgggccccacct

SEQ ID NO: 281244 - DNA, 17 bp, Homo sapiens
gcagctgggccccatgc

SEQ ID NO: 281245 - DNA, 21 bp, Homo sapiens
gcagctgggccccatgctctg

SEQ ID NO: 281246 - DNA, 20 bp, Homo sapiens
gcagctggggagcagctgag

SEQ ID NO: 281247 - DNA, 19 bp, Homo sapiens
gcagctggggggctgtcct

SEQ ID NO: 281248 - DNA, 20 bp, Homo sapiens
gcagctggggggctgtcctg

SEQ ID NO: 281249 - DNA, 21 bp, Homo sapiens
gcagctgtcccctctccctgg

SEQ ID NO: 281250 - DNA, 21 bp, Homo sapiens
gcagctgttttagttaaattt

SEQ ID NO: 281251 - DNA, 14 bp, Homo sapiens
gcagcttcaccaga

SEQ ID NO: 281252 - DNA, 12 bp, Homo sapiens
gcagcttccaga

SEQ ID NO: 281253 - DNA, 14 bp, Homo sapiens
gcagcttggctgag

SEQ ID NO: 281254 - DNA, 21 bp, Homo sapiens
gcagcttgggagagcccctgg

SEQ ID NO: 281255 - DNA, 15 bp, Homo sapiens
gcaggaacgagcact

SEQ ID NO: 281256 - DNA, 16 bp, Homo sapiens
gcaggaacgagcactg

SEQ ID NO: 281257 - DNA, 17 bp, Homo sapiens
gcaggaacgagcactgg

SEQ ID NO: 281258 - DNA, 18 bp, Homo sapiens
gcaggaacgagcactggc

SEQ ID NO: 281259 - DNA, 22 bp, Homo sapiens
gcaggaacgagcactggccaga

SEQ ID NO: 281260 - DNA, 17 bp, Homo sapiens
gcaggaagagatgctct

SEQ ID NO: 281261 - DNA, 16 bp, Homo sapiens
gcaggaagcaaggcca

SEQ ID NO: 281262 - DNA, 17 bp, Homo sapiens
gcaggaagcaaggccag

SEQ ID NO: 281263 - DNA, 20 bp, Homo sapiens
gcaggaagcaaggccagccc

SEQ ID NO: 281264 - DNA, 16 bp, Homo sapiens
gcaggaaggagagcct

SEQ ID NO: 281265 - DNA, 17 bp, Homo sapiens
gcaggaaggagagcctg

SEQ ID NO: 281266 - DNA, 13 bp, Homo sapiens
gcaggaaggcctg

SEQ ID NO: 281267 - DNA, 14 bp, Homo sapiens
gcaggaaggcctgg

SEQ ID NO: 281268 - DNA, 16 bp, Homo sapiens
gcaggaagtcaggagc

SEQ ID NO: 281269 - DNA, 18 bp, Homo sapiens
gcaggaagtcaggagcca

SEQ ID NO: 281270 - DNA, 23 bp, Homo sapiens
gcaggaagtccctgagaagcctc

SEQ ID NO: 281271 - DNA, 20 bp, Homo sapiens
gcaggaatcaaggagcctcc

SEQ ID NO: 281272 - DNA, 22 bp, Homo sapiens
gcaggacacatcccggcctctt

SEQ ID NO: 281273 - DNA, 23 bp, Homo sapiens
gcaggacacatcccggcctcttc

SEQ ID NO: 281274 - DNA, 16 bp, Homo sapiens
gcaggacgagactcct

SEQ ID NO: 281275 - DNA, 17 bp, Homo sapiens
gcaggacgttaggcccg

SEQ ID NO: 281276 - DNA, 13 bp, Homo sapiens
gcaggactgagga

SEQ ID NO: 281277 - DNA, 16 bp, Homo sapiens
gcaggagaatcagcct

SEQ ID NO: 281278 - DNA, 23 bp, Homo sapiens
gcaggagaatcgcttgaacctgg

SEQ ID NO: 281279 - DNA, 14 bp, Homo sapiens
gcaggagacactgg

SEQ ID NO: 281280 - DNA, 14 bp, Homo sapiens
gcaggagagagaga

SEQ ID NO: 281281 - DNA, 13 bp, Homo sapiens
gcaggagcagctg

SEQ ID NO: 281282 - DNA, 16 bp, Homo sapiens
gcaggagcagctgtgc

SEQ ID NO: 281283 - DNA, 20 bp, Homo sapiens
gcaggagcagctgtgctgca

SEQ ID NO: 281284 - DNA, 22 bp, Homo sapiens
gcaggagcagctgtgctgcacc

SEQ ID NO: 281285 - DNA, 13 bp, Homo sapiens
gcaggagctcaga

SEQ ID NO: 281286 - DNA, 21 bp, Homo sapiens
gcaggaggaggaaaggtagcc

SEQ ID NO: 281287 - DNA, 16 bp, Homo sapiens
gcaggaggcccctggc

SEQ ID NO: 281288 - DNA, 18 bp, Homo sapiens
gcaggaggcccctggccc

SEQ ID NO: 281289 - DNA, 22 bp, Homo sapiens
gcaggaggcccctggcccagcg

SEQ ID NO: 281290 - DNA, 12 bp, Homo sapiens
gcaggaggcctg

SEQ ID NO: 281291 - DNA, 14 bp, Homo sapiens
gcaggaggcctggg

SEQ ID NO: 281292 - DNA, 15 bp, Homo sapiens
gcaggaggcctggga

SEQ ID NO: 281293 - DNA, 11 bp, Homo sapiens
gcaggagggag

SEQ ID NO: 281294 - DNA, 15 bp, Homo sapiens
gcaggagggtggcac

SEQ ID NO: 281295 - DNA, 16 bp, Homo sapiens
gcaggagtctctgcca

SEQ ID NO: 281296 - DNA, 23 bp, Homo sapiens
gcaggagtctctgccacccactc

SEQ ID NO: 281297 - DNA, 13 bp, Homo sapiens
gcaggagtggaag

SEQ ID NO: 281298 - DNA, 24 bp, Homo sapiens
gcaggagtggaaggtgaggcgttc

SEQ ID NO: 281299 - DNA, 19 bp, Homo sapiens
gcaggagtgggctctgagc

SEQ ID NO: 281300 - DNA, 21 bp, Homo sapiens
gcaggatagttgctccgcctc

SEQ ID NO: 281301 - DNA, 21 bp, Homo sapiens
gcaggatcaaagacacacagg

SEQ ID NO: 281302 - DNA, 17 bp, Homo sapiens
gcaggatccgctgccac

SEQ ID NO: 281303 - DNA, 18 bp, Homo sapiens
gcaggatccgctgccacc

SEQ ID NO: 281304 - DNA, 18 bp, Homo sapiens
gcaggatgattgtacaga

SEQ ID NO: 281305 - DNA, 18 bp, Homo sapiens
gcaggcaaaaaagggaca

SEQ ID NO: 281306 - DNA, 20 bp, Homo sapiens
gcaggcaaaaaagggacagc

SEQ ID NO: 281307 - DNA, 17 bp, Homo sapiens
gcaggcaccagcagcag

SEQ ID NO: 281308 - DNA, 18 bp, Homo sapiens
gcaggcagagctcagcac

SEQ ID NO: 281309 - DNA, 24 bp, Homo sapiens
gcaggcagagctcagcacagcctc

SEQ ID NO: 281310 - DNA, 15 bp, Homo sapiens
gcaggcagaggagag

SEQ ID NO: 281311 - DNA, 12 bp, Homo sapiens
gcaggcatgccg

SEQ ID NO: 281312 - DNA, 20 bp, Homo sapiens
gcaggccaaggccttctcct

SEQ ID NO: 281313 - DNA, 19 bp, Homo sapiens
gcaggccagtggacagagg

SEQ ID NO: 281314 - DNA, 13 bp, Homo sapiens
gcaggcccagctg

SEQ ID NO: 281315 - DNA, 14 bp, Homo sapiens
gcaggccccagcca

SEQ ID NO: 281316 - DNA, 14 bp, Homo sapiens
gcaggccctgcagt

SEQ ID NO: 281317 - DNA, 21 bp, Homo sapiens
gcaggccctggtggagaggcc

SEQ ID NO: 281318 - DNA, 12 bp, Homo sapiens
gcaggcctggga

SEQ ID NO: 281319 - DNA, 20 bp, Homo sapiens
gcaggcctgggacccagcta

SEQ ID NO: 281320 - DNA, 22 bp, Homo sapiens
gcaggcctgggacccagctact

SEQ ID NO: 281321 - DNA, 14 bp, Homo sapiens
gcaggcctttccta

SEQ ID NO: 281322 - DNA, 16 bp, Homo sapiens
gcaggcctttcctaca

SEQ ID NO: 281323 - DNA, 22 bp, Homo sapiens
gcaggcggtccccatccccacc

SEQ ID NO: 281324 - DNA, 23 bp, Homo sapiens
gcaggcggtccccatccccacca

SEQ ID NO: 281325 - DNA, 16 bp, Homo sapiens
gcaggcggtggggaga

SEQ ID NO: 281326 - DNA, 11 bp, Homo sapiens
gcaggctctgg

SEQ ID NO: 281327 - DNA, 12 bp, Homo sapiens
gcaggctctggg

SEQ ID NO: 281328 - DNA, 13 bp, Homo sapiens
gcaggctctgggc

SEQ ID NO: 281329 - DNA, 16 bp, Homo sapiens
gcaggctctgggctca

SEQ ID NO: 281330 - DNA, 16 bp, Homo sapiens
gcagggaaagctccac

SEQ ID NO: 281331 - DNA, 17 bp, Homo sapiens
gcagggaaagctccacg

SEQ ID NO: 281332 - DNA, 20 bp, Homo sapiens
gcagggaaggggaggcagcc

SEQ ID NO: 281333 - DNA, 15 bp, Homo sapiens
gcagggacacccccc

SEQ ID NO: 281334 - DNA, 18 bp, Homo sapiens
gcagggacacgggcagcc

SEQ ID NO: 281335 - DNA, 14 bp, Homo sapiens
gcagggagaccctg

SEQ ID NO: 281336 - DNA, 14 bp, Homo sapiens
gcagggagagttgg

SEQ ID NO: 281337 - DNA, 15 bp, Homo sapiens
gcagggagagttggg

SEQ ID NO: 281338 - DNA, 19 bp, Homo sapiens
gcagggaggcaccattcag

SEQ ID NO: 281339 - DNA, 13 bp, Homo sapiens
gcagggagggctt

SEQ ID NO: 281340 - DNA, 14 bp, Homo sapiens
gcagggaggggagg

SEQ ID NO: 281341 - DNA, 16 bp, Homo sapiens
gcagggagtgtctgca

SEQ ID NO: 281342 - DNA, 15 bp, Homo sapiens
gcagggatttgagga

SEQ ID NO: 281343 - DNA, 18 bp, Homo sapiens
gcagggcaggcagagctc

SEQ ID NO: 281344 - DNA, 13 bp, Homo sapiens
gcagggccctcag

SEQ ID NO: 281345 - DNA, 14 bp, Homo sapiens
gcagggccctcaga

SEQ ID NO: 281346 - DNA, 15 bp, Homo sapiens
gcagggccctcagag

SEQ ID NO: 281347 - DNA, 17 bp, Homo sapiens
gcagggccctcagagga

SEQ ID NO: 281348 - DNA, 20 bp, Homo sapiens
gcagggccctcagaggaaag

SEQ ID NO: 281349 - DNA, 14 bp, Homo sapiens
gcagggccctgggg

SEQ ID NO: 281350 - DNA, 15 bp, Homo sapiens
gcagggccctggggt

SEQ ID NO: 281351 - DNA, 21 bp, Homo sapiens
gcagggccctggggtctctga

SEQ ID NO: 281352 - DNA, 23 bp, Homo sapiens
gcagggccctggggtctctgagc

SEQ ID NO: 281353 - DNA, 13 bp, Homo sapiens
gcagggccgcagg

SEQ ID NO: 281354 - DNA, 14 bp, Homo sapiens
gcagggccgcaggg

SEQ ID NO: 281355 - DNA, 18 bp, Homo sapiens
gcagggccgcagggcgct

SEQ ID NO: 281356 - DNA, 21 bp, Homo sapiens
gcagggccgcccgggcccaga

SEQ ID NO: 281357 - DNA, 23 bp, Homo sapiens
gcagggccgcccgggcccagagg

SEQ ID NO: 281358 - DNA, 17 bp, Homo sapiens
gcagggcgctccggcag

SEQ ID NO: 281359 - DNA, 17 bp, Homo sapiens
gcagggcgggccaggag

SEQ ID NO: 281360 - DNA, 19 bp, Homo sapiens
gcagggcgggccaggagaa

SEQ ID NO: 281361 - DNA, 17 bp, Homo sapiens
gcagggctcccacagag

SEQ ID NO: 281362 - DNA, 14 bp, Homo sapiens
gcaggggagccagg

SEQ ID NO: 281363 - DNA, 13 bp, Homo sapiens
gcaggggagggtc

SEQ ID NO: 281364 - DNA, 14 bp, Homo sapiens
gcaggggcagaagg

SEQ ID NO: 281365 - DNA, 21 bp, Homo sapiens
gcctctgaactgctgctggtc

SEQ ID NO: 281366 - DNA, 17 bp, Homo sapiens
gcctctgacagcagcct

SEQ ID NO: 281367 - DNA, 24 bp, Homo sapiens
gcctctgactctgagtccactgct

SEQ ID NO: 281368 - DNA, 13 bp, Homo sapiens
gcctctgagccag

SEQ ID NO: 281369 - DNA, 20 bp, Homo sapiens
gccttcctcctccacagtgc

SEQ ID NO: 281370 - DNA, 19 bp, Homo sapiens
gccttcctctgcagctgac

SEQ ID NO: 281371 - DNA, 21 bp, Homo sapiens
gccttcctctgcagctgacct

SEQ ID NO: 281372 - DNA, 20 bp, Homo sapiens
gccttccttgaccttcctct

SEQ ID NO: 281373 - DNA, 16 bp, Homo sapiens
gccttcgacctggacg

SEQ ID NO: 281374 - DNA, 15 bp, Homo sapiens
gccttctacctgcag

SEQ ID NO: 281375 - DNA, 14 bp, Homo sapiens
gccttctcagctct

SEQ ID NO: 281376 - DNA, 19 bp, Homo sapiens
gccttctcagctctccacc

SEQ ID NO: 281377 - DNA, 13 bp, Homo sapiens
gccttctcctccc

SEQ ID NO: 281378 - DNA, 16 bp, Homo sapiens
gccttctcctctctgg

SEQ ID NO: 281379 - DNA, 21 bp, Homo sapiens
gccttctcctctctgggcctt

SEQ ID NO: 281380 - DNA, 15 bp, Homo sapiens
gccttctgaactcca

SEQ ID NO: 281381 - DNA, 18 bp, Homo sapiens
gccttctgaactccatac

SEQ ID NO: 281382 - DNA, 17 bp, Homo sapiens
gccttctgacggccctg

SEQ ID NO: 281383 - DNA, 18 bp, Homo sapiens
gccttctgacggccctgc

SEQ ID NO: 281384 - DNA, 21 bp, Homo sapiens
gccttgagagaaaaagtgccc

SEQ ID NO: 281385 - DNA, 20 bp, Homo sapiens
gccttgagctgcctgctctg

SEQ ID NO: 281386 - DNA, 20 bp, Homo sapiens
gccttgagtgacatgcggct

SEQ ID NO: 281387 - DNA, 15 bp, Homo sapiens
gccttgatggagaag

SEQ ID NO: 281388 - DNA, 16 bp, Homo sapiens
gccttgatggagaagg

SEQ ID NO: 281389 - DNA, 20 bp, Homo sapiens
gccttgattataccactgca

SEQ ID NO: 281390 - DNA, 12 bp, Homo sapiens
gccttgctgcca

SEQ ID NO: 281391 - DNA, 13 bp, Homo sapiens
gccttgctgccaa

SEQ ID NO: 281392 - DNA, 22 bp, Homo sapiens
gccttgctttgggctttgcagg

SEQ ID NO: 281393 - DNA, 16 bp, Homo sapiens
gccttggacaccatcc

SEQ ID NO: 281394 - DNA, 14 bp, Homo sapiens
gccttggggccaga

SEQ ID NO: 281395 - DNA, 15 bp, Homo sapiens
gccttggggccagac

SEQ ID NO: 281396 - DNA, 23 bp, Homo sapiens
gccttggggccagactggctgca

SEQ ID NO: 281397 - DNA, 18 bp, Homo sapiens
gccttggtctaacttttg

SEQ ID NO: 281398 - DNA, 19 bp, Homo sapiens
gccttggttcatcagtgtt

SEQ ID NO: 281399 - DNA, 16 bp, Homo sapiens
gccttggttcctccag

SEQ ID NO: 281400 - DNA, 22 bp, Homo sapiens
gccttggttggacctattgcca

SEQ ID NO: 281401 - DNA, 23 bp, Homo sapiens
gccttgtaaataaccacaaggtc

SEQ ID NO: 281402 - DNA, 20 bp, Homo sapiens
gccttgtaattctaaatgaa

SEQ ID NO: 281403 - DNA, 23 bp, Homo sapiens
gccttgtctgtgtatttctattt

SEQ ID NO: 281404 - DNA, 16 bp, Homo sapiens
gccttgtgacattcac

SEQ ID NO: 281405 - DNA, 15 bp, Homo sapiens
gccttgtgccctgcc

SEQ ID NO: 281406 - DNA, 16 bp, Homo sapiens
gccttgtgccctgccc

SEQ ID NO: 281407 - DNA, 16 bp, Homo sapiens
gccttgtttttttcta

SEQ ID NO: 281408 - DNA, 19 bp, Homo sapiens
gcctttaaatctgtgatga

SEQ ID NO: 281409 - DNA, 23 bp, Homo sapiens
gcctttaccctcctctatttctt

SEQ ID NO: 281410 - DNA, 19 bp, Homo sapiens
gcctttagaaactgagtcc

SEQ ID NO: 281411 - DNA, 13 bp, Homo sapiens
gcctttcaggaag

SEQ ID NO: 281412 - DNA, 23 bp, Homo sapiens
gcctttcaggaagggagaggagg

SEQ ID NO: 281413 - DNA, 21 bp, Homo sapiens
gcctttccataaggaatgtag

SEQ ID NO: 281414 - DNA, 22 bp, Homo sapiens
gcctttccataaggaatgtagc

SEQ ID NO: 281415 - DNA, 12 bp, Homo sapiens
gcctttcctgtg

SEQ ID NO: 281416 - DNA, 13 bp, Homo sapiens
gcctttcctgtgc

SEQ ID NO: 281417 - DNA, 14 bp, Homo sapiens
gcctttcctgtgcc

SEQ ID NO: 281418 - DNA, 21 bp, Homo sapiens
gcctttcctgtgccaacctga

SEQ ID NO: 281419 - DNA, 23 bp, Homo sapiens
gcctttctcgtggtagaagccag

SEQ ID NO: 281420 - DNA, 12 bp, Homo sapiens
gcctttctgtat

SEQ ID NO: 281421 - DNA, 18 bp, Homo sapiens
gcctttctgtatcaagcc

SEQ ID NO: 281422 - DNA, 20 bp, Homo sapiens
gcctttcttccatcagctct

SEQ ID NO: 281423 - DNA, 12 bp, Homo sapiens
gcctttcttcct

SEQ ID NO: 281424 - DNA, 20 bp, Homo sapiens
gcctttgaggcaaaggccag

SEQ ID NO: 281425 - DNA, 21 bp, Homo sapiens
gcctttgcagttggactctca

SEQ ID NO: 281426 - DNA, 22 bp, Homo sapiens
gcctttgcagttggactctcag

SEQ ID NO: 281427 - DNA, 15 bp, Homo sapiens
gcctttgcctccccg

SEQ ID NO: 281428 - DNA, 19 bp, Homo sapiens
gcctttgggaggcagcatc

SEQ ID NO: 281429 - DNA, 16 bp, Homo sapiens
gcctttgtaagacaca

SEQ ID NO: 281430 - DNA, 15 bp, Homo sapiens
gcctttgtaagttat

SEQ ID NO: 281431 - DNA, 13 bp, Homo sapiens
gccttttgacagc

SEQ ID NO: 281432 - DNA, 15 bp, Homo sapiens
gccttttgtgtgatg

SEQ ID NO: 281433 - DNA, 14 bp, Homo sapiens
gcgaacatcttcat

SEQ ID NO: 281434 - DNA, 19 bp, Homo sapiens
gcgaacatcttcatataaa

SEQ ID NO: 281435 - DNA, 17 bp, Homo sapiens
gcgaactctcaggacta

SEQ ID NO: 281436 - DNA, 15 bp, Homo sapiens
gcgaagctgagcggg

SEQ ID NO: 281437 - DNA, 20 bp, Homo sapiens
gcgacagaaaacctcaaggg

SEQ ID NO: 281438 - DNA, 23 bp, Homo sapiens
gcgacagcgtccggggtggtgga

SEQ ID NO: 281439 - DNA, 21 bp, Homo sapiens
gcgaccagaggtgggaggccc

SEQ ID NO: 281440 - DNA, 15 bp, Homo sapiens
gcgaccttggccgca

SEQ ID NO: 281441 - DNA, 17 bp, Homo sapiens
gcgacgtgagggtcctg

SEQ ID NO: 281442 - DNA, 19 bp, Homo sapiens
gcgacttccacagcagcag

SEQ ID NO: 281443 - DNA, 21 bp, Homo sapiens
gcgagacccttgcattagaaa

SEQ ID NO: 281444 - DNA, 21 bp, Homo sapiens
gcgagatcggggtagaaatgc

SEQ ID NO: 281445 - DNA, 22 bp, Homo sapiens
gcgagattccgtctcaaaaaaa

SEQ ID NO: 281446 - DNA, 15 bp, Homo sapiens
gcgagcatcccccaa

SEQ ID NO: 281447 - DNA, 14 bp, Homo sapiens
gcgagcccttagcc

SEQ ID NO: 281448 - DNA, 19 bp, Homo sapiens
gcgagcccttagccttgct

SEQ ID NO: 281449 - DNA, 12 bp, Homo sapiens
gcgaggcagagg

SEQ ID NO: 281450 - DNA, 16 bp, Homo sapiens
gcgaggcagaggacag

SEQ ID NO: 281451 - DNA, 15 bp, Homo sapiens
gcgaggcgaagctga

SEQ ID NO: 281452 - DNA, 18 bp, Homo sapiens
gcgaggcgaagctgagcg

SEQ ID NO: 281453 - DNA, 14 bp, Homo sapiens
gcgaggcgaggctg

SEQ ID NO: 281454 - DNA, 19 bp, Homo sapiens
gcgaggcgggggagcctgg

SEQ ID NO: 281455 - DNA, 24 bp, Homo sapiens
gcgaggcgggggagcctggagccc

SEQ ID NO: 281456 - DNA, 24 bp, Homo sapiens
gcgaggcgggggatcctggagccc

SEQ ID NO: 281457 - DNA, 14 bp, Homo sapiens
gcgaggctgcctct

SEQ ID NO: 281458 - DNA, 14 bp, Homo sapiens
gcgaggggagggtg

SEQ ID NO: 281459 - DNA, 12 bp, Homo sapiens
gcgagtctggag

SEQ ID NO: 281460 - DNA, 13 bp, Homo sapiens
gcgatatacagat

SEQ ID NO: 281461 - DNA, 15 bp, Homo sapiens
gcgatggtctcagaa

SEQ ID NO: 281462 - DNA, 13 bp, Homo sapiens
gcgatgtgtttta

SEQ ID NO: 281463 - DNA, 21 bp, Homo sapiens
gcgatgtttcaggaggctgga

SEQ ID NO: 281464 - DNA, 12 bp, Homo sapiens
gcgattctcatg

SEQ ID NO: 281465 - DNA, 22 bp, Homo sapiens
gcgcaaaactgcctgaaagcaa

SEQ ID NO: 281466 - DNA, 20 bp, Homo sapiens
gcgcaagatagatttggaat

SEQ ID NO: 281467 - DNA, 12 bp, Homo sapiens
gcgcacccggca

SEQ ID NO: 281468 - DNA, 14 bp, Homo sapiens
gcgcaccgcccaac

SEQ ID NO: 281469 - DNA, 17 bp, Homo sapiens
gcgcagagtaaaataag

SEQ ID NO: 281470 - DNA, 20 bp, Homo sapiens
gcgcagccgcgctctgcccc

SEQ ID NO: 281471 - DNA, 15 bp, Homo sapiens
gcgcaggccctccgc

SEQ ID NO: 281472 - DNA, 15 bp, Homo sapiens
gcgcagtgcctctgg

SEQ ID NO: 281473 - DNA, 12 bp, Homo sapiens
gcgccacccgcc

SEQ ID NO: 281474 - DNA, 17 bp, Homo sapiens
gcgccagcacagaaaca

SEQ ID NO: 281475 - DNA, 15 bp, Homo sapiens
gcgcccacctgccca

SEQ ID NO: 281476 - DNA, 16 bp, Homo sapiens
gcgcccacctgcccag

SEQ ID NO: 281477 - DNA, 19 bp, Homo sapiens
gcgccccgcccccacccct

SEQ ID NO: 281478 - DNA, 20 bp, Homo sapiens
gcgccccgcccccaccccta

SEQ ID NO: 281479 - DNA, 21 bp, Homo sapiens
gcgccccgcccccacccctac

SEQ ID NO: 281480 - DNA, 12 bp, Homo sapiens
gcgcccctgggg

SEQ ID NO: 281481 - DNA, 13 bp, Homo sapiens
gcgccctccctcc

SEQ ID NO: 281482 - DNA, 20 bp, Homo sapiens
gcgccctccctccctccaca

SEQ ID NO: 281483 - DNA, 20 bp, Homo sapiens
gcgcccttgtgccctgcctc

SEQ ID NO: 281484 - DNA, 15 bp, Homo sapiens
gcgccgagaccgcag

SEQ ID NO: 281485 - DNA, 20 bp, Homo sapiens
gcgccgagaccgcagaggga

SEQ ID NO: 281486 - DNA, 17 bp, Homo sapiens
gcgcctcccgccgcctc

SEQ ID NO: 281487 - DNA, 21 bp, Homo sapiens
gcgcctcccgccgcctcgggc

SEQ ID NO: 281488 - DNA, 21 bp, Homo sapiens
gcgcctgcacctgcgcctggc

SEQ ID NO: 281489 - DNA, 18 bp, Homo sapiens
gctgtgaggaatgctctg

SEQ ID NO: 281490 - DNA, 23 bp, Homo sapiens
gctgtgaggaatgctctgtgcca

SEQ ID NO: 281491 - DNA, 14 bp, Homo sapiens
gctgtgaggctgtc

SEQ ID NO: 281492 - DNA, 18 bp, Homo sapiens
gctgtgagtgtaagtgtg

SEQ ID NO: 281493 - DNA, 22 bp, Homo sapiens
gctgtgagtgtaagtgtgagta

SEQ ID NO: 281494 - DNA, 14 bp, Homo sapiens
gctgtgatgcatga

SEQ ID NO: 281495 - DNA, 9 bp, Homo sapiens
gctgtgcca

SEQ ID NO: 281496 - DNA, 17 bp, Homo sapiens
gctgtgccaccacccct

SEQ ID NO: 281497 - DNA, 14 bp, Homo sapiens
gctgtgccaggact

SEQ ID NO: 281498 - DNA, 22 bp, Homo sapiens
gctgtgccaggactgtgactca

SEQ ID NO: 281499 - DNA, 15 bp, Homo sapiens
gctgtgccaggaggc

SEQ ID NO: 281500 - DNA, 20 bp, Homo sapiens
gctgtgccccatcagcagct

SEQ ID NO: 281501 - DNA, 13 bp, Homo sapiens
gctgtgcctcccc

SEQ ID NO: 281502 - DNA, 12 bp, Homo sapiens
gctgtgcctctg

SEQ ID NO: 281503 - DNA, 13 bp, Homo sapiens
gctgtgcctgcta

SEQ ID NO: 281504 - DNA, 17 bp, Homo sapiens
gctgtgcctgctagagc

SEQ ID NO: 281505 - DNA, 18 bp, Homo sapiens
gctgtgcctgctagagca

SEQ ID NO: 281506 - DNA, 23 bp, Homo sapiens
gctgtgctccagcagtgctgggc

SEQ ID NO: 281507 - DNA, 12 bp, Homo sapiens
gctgtggaggcc

SEQ ID NO: 281508 - DNA, 13 bp, Homo sapiens
gctgtggaggcct

SEQ ID NO: 281509 - DNA, 15 bp, Homo sapiens
gctgtggaggcctga

SEQ ID NO: 281510 - DNA, 22 bp, Homo sapiens
gctgtggaggcctgatgctgcc

SEQ ID NO: 281511 - DNA, 15 bp, Homo sapiens
gctgtggcacagact

SEQ ID NO: 281512 - DNA, 15 bp, Homo sapiens
gctgtggcccctcct

SEQ ID NO: 281513 - DNA, 19 bp, Homo sapiens
gctgtggccgtctcctccc

SEQ ID NO: 281514 - DNA, 22 bp, Homo sapiens
gctgtggccgtctcctccctca

SEQ ID NO: 281515 - DNA, 21 bp, Homo sapiens
gctgtggctgggtggtcagca

SEQ ID NO: 281516 - DNA, 17 bp, Homo sapiens
gctgtgggcaggtggga

SEQ ID NO: 281517 - DNA, 15 bp, Homo sapiens
gctgtggggagctgg

SEQ ID NO: 281518 - DNA, 23 bp, Homo sapiens
gctgtgggtattcaccaccctgg

SEQ ID NO: 281519 - DNA, 19 bp, Homo sapiens
gctgtgggtcagtgtgcca

SEQ ID NO: 281520 - DNA, 12 bp, Homo sapiens
gctgtgggtggg

SEQ ID NO: 281521 - DNA, 20 bp, Homo sapiens
gctgtggttcctaagcctgt

SEQ ID NO: 281522 - DNA, 15 bp, Homo sapiens
gctgtggttcctggg

SEQ ID NO: 281523 - DNA, 16 bp, Homo sapiens
gctgtggttcctgggg

SEQ ID NO: 281524 - DNA, 15 bp, Homo sapiens
gctgtggttttcttt

SEQ ID NO: 281525 - DNA, 11 bp, Homo sapiens
gctgtgtctct

SEQ ID NO: 281526 - DNA, 16 bp, Homo sapiens
gctgtgttgactgctg

SEQ ID NO: 281527 - DNA, 14 bp, Homo sapiens
gctgttatctgtct

SEQ ID NO: 281528 - DNA, 18 bp, Homo sapiens
gctgttccagactcaggt

SEQ ID NO: 281529 - DNA, 19 bp, Homo sapiens
gctgttccagactcaggtt

SEQ ID NO: 281530 - DNA, 13 bp, Homo sapiens
gctgttcctgtgt

SEQ ID NO: 281531 - DNA, 12 bp, Homo sapiens
gctgttgagctg

SEQ ID NO: 281532 - DNA, 17 bp, Homo sapiens
gctgttgccatagcccc

SEQ ID NO: 281533 - DNA, 22 bp, Homo sapiens
gctgtttagcttcctccagagg

SEQ ID NO: 281534 - DNA, 19 bp, Homo sapiens
gctggcggaacctggctgc

SEQ ID NO: 281535 - DNA, 20 bp, Homo sapiens
gctggctccacgccctgggg

SEQ ID NO: 281536 - DNA, 22 bp, Homo sapiens
gctggctccacgccctggggag

SEQ ID NO: 281537 - DNA, 19 bp, Homo sapiens
gctggctcccagggccatg

SEQ ID NO: 281538 - DNA, 13 bp, Homo sapiens
gctggctctccac

SEQ ID NO: 281539 - DNA, 13 bp, Homo sapiens
gctggctgaaaat

SEQ ID NO: 281540 - DNA, 13 bp, Homo sapiens
gctggctgaggct

SEQ ID NO: 281541 - DNA, 15 bp, Homo sapiens
gctggctgaggcttg

SEQ ID NO: 281542 - DNA, 13 bp, Homo sapiens
gctggctgagtgg

SEQ ID NO: 281543 - DNA, 19 bp, Homo sapiens
gctggctgcccagacccct

SEQ ID NO: 281544 - DNA, 14 bp, Homo sapiens
gctggctgccttag

SEQ ID NO: 281545 - DNA, 20 bp, Homo sapiens
gctggctgccttagaacctt

SEQ ID NO: 281546 - DNA, 21 bp, Homo sapiens
gctggctgggtcgcccctcct

SEQ ID NO: 281547 - DNA, 12 bp, Homo sapiens
gctggctgttgg

SEQ ID NO: 281548 - DNA, 13 bp, Homo sapiens
gctggcttccagc

SEQ ID NO: 281549 - DNA, 20 bp, Homo sapiens
gctggcttccagcgggccct

SEQ ID NO: 281550 - DNA, 22 bp, Homo sapiens
gctggcttccagcgggccctct

SEQ ID NO: 281551 - DNA, 18 bp, Homo sapiens
gctggcttccgctgtcac

SEQ ID NO: 281552 - DNA, 18 bp, Homo sapiens
gcagttctgcaaatagaa

SEQ ID NO: 281553 - DNA, 17 bp, Homo sapiens
gcagttggactctcagg

SEQ ID NO: 281554 - DNA, 19 bp, Homo sapiens
gcagttggactctcaggga

SEQ ID NO: 281555 - DNA, 19 bp, Homo sapiens
gcagttgggagtacatatg

SEQ ID NO: 281556 - DNA, 21 bp, Homo sapiens
gcagttgttatattcattctt

SEQ ID NO: 281557 - DNA, 13 bp, Homo sapiens
gcagttttaagaa

SEQ ID NO: 281558 - DNA, 14 bp, Homo sapiens
gcagtttttcagga

SEQ ID NO: 281559 - DNA, 16 bp, Homo sapiens
gcagtttttgttcctt

SEQ ID NO: 281560 - DNA, 15 bp, Homo sapiens
gcataaacaacagta

SEQ ID NO: 281561 - DNA, 12 bp, Homo sapiens
gcataacacagc

SEQ ID NO: 281562 - DNA, 19 bp, Homo sapiens
gcataagtggacccagctg

SEQ ID NO: 281563 - DNA, 15 bp, Homo sapiens
gcataatactaattt

SEQ ID NO: 281564 - DNA, 18 bp, Homo sapiens
gcataatactaatttatt

SEQ ID NO: 281565 - DNA, 19 bp, Homo sapiens
gcataatactaatttattg

SEQ ID NO: 281566 - DNA, 21 bp, Homo sapiens
gcatacacatgcactcagtgt

SEQ ID NO: 281567 - DNA, 21 bp, Homo sapiens
gcatacacccccacctcctgc

SEQ ID NO: 281568 - DNA, 20 bp, Homo sapiens
gcataccgtttggtgtctga

SEQ ID NO: 281569 - DNA, 22 bp, Homo sapiens
gcataccgtttggtgtctgatg

SEQ ID NO: 281570 - DNA, 15 bp, Homo sapiens
gcatactctccagga

SEQ ID NO: 281571 - DNA, 21 bp, Homo sapiens
gcatactgatgagacaacaca

SEQ ID NO: 281572 - DNA, 22 bp, Homo sapiens
gcatagaggtaccagcaatatg

SEQ ID NO: 281573 - DNA, 20 bp, Homo sapiens
gcatagtaccaatcatttta

SEQ ID NO: 281574 - DNA, 22 bp, Homo sapiens
gcatagtattccattgtgtgag

SEQ ID NO: 281575 - DNA, 20 bp, Homo sapiens
gcatagtgtgctcggacaca

SEQ ID NO: 281576 - DNA, 14 bp, Homo sapiens
gcatataaatgttt

SEQ ID NO: 281577 - DNA, 19 bp, Homo sapiens
gcatataaatgtttatatt

SEQ ID NO: 281578 - DNA, 16 bp, Homo sapiens
gcatatcgctgggctc

SEQ ID NO: 281579 - DNA, 18 bp, Homo sapiens
gcatatctctagtccctg

SEQ ID NO: 281580 - DNA, 22 bp, Homo sapiens
gcatatctctagtccctgtgtt

SEQ ID NO: 281581 - DNA, 13 bp, Homo sapiens
gcatatgcatgcc

SEQ ID NO: 281582 - DNA, 14 bp, Homo sapiens
gcatatgcatgcca

SEQ ID NO: 281583 - DNA, 17 bp, Homo sapiens
gcatatgcatgccaggc

SEQ ID NO: 281584 - DNA, 23 bp, Homo sapiens
gcagcctttctgtggagagtgag

SEQ ID NO: 281585 - DNA, 15 bp, Homo sapiens
gcagcgcctcctgga

SEQ ID NO: 281586 - DNA, 16 bp, Homo sapiens
gcagcgcctcctggac

SEQ ID NO: 281587 - DNA, 14 bp, Homo sapiens
gcagcggcccagat

SEQ ID NO: 281588 - DNA, 18 bp, Homo sapiens
gcagcggtggaaggagcc

SEQ ID NO: 281589 - DNA, 21 bp, Homo sapiens
gcagcggtggaaggagcctgc

SEQ ID NO: 281590 - DNA, 16 bp, Homo sapiens
gcagcgtctgagcggc

SEQ ID NO: 281591 - DNA, 19 bp, Homo sapiens
gcagctaagctcaaatgta

SEQ ID NO: 281592 - DNA, 14 bp, Homo sapiens
gcagctagactgga

SEQ ID NO: 281593 - DNA, 14 bp, Homo sapiens
gcagctaggactga

SEQ ID NO: 281594 - DNA, 16 bp, Homo sapiens
gcagctaggactgagg

SEQ ID NO: 281595 - DNA, 21 bp, Homo sapiens
gcagctaggactgaggagtgg

SEQ ID NO: 281596 - DNA, 14 bp, Homo sapiens
gcagctagttttct

SEQ ID NO: 281597 - DNA, 14 bp, Homo sapiens
gcagctcacccctg

SEQ ID NO: 281598 - DNA, 14 bp, Homo sapiens
gcagctccccagga

SEQ ID NO: 281599 - DNA, 22 bp, Homo sapiens
gctcaggcaagcccctcagccc

SEQ ID NO: 281600 - DNA, 16 bp, Homo sapiens
gctcaggcgcagccct

SEQ ID NO: 281601 - DNA, 17 bp, Homo sapiens
gctcaggcgcagcccta

SEQ ID NO: 281602 - DNA, 18 bp, Homo sapiens
gctcaggcgcagccctag

SEQ ID NO: 281603 - DNA, 20 bp, Homo sapiens
gctcagggatcttctccctc

SEQ ID NO: 281604 - DNA, 17 bp, Homo sapiens
gctcagggcccacctcc

SEQ ID NO: 281605 - DNA, 20 bp, Homo sapiens
gctcagggcccacctcctcc

SEQ ID NO: 281606 - DNA, 21 bp, Homo sapiens
gctcagggcccacctcctcca

SEQ ID NO: 281607 - DNA, 23 bp, Homo sapiens
gctcagggctggagtgcgctctt

SEQ ID NO: 281608 - DNA, 21 bp, Homo sapiens
gctcagggtgctccctcctca

SEQ ID NO: 281609 - DNA, 11 bp, Homo sapiens
gctcagtattg

SEQ ID NO: 281610 - DNA, 14 bp, Homo sapiens
gctcagtctccctt

SEQ ID NO: 281611 - DNA, 15 bp, Homo sapiens
gctcagtgccaccta

SEQ ID NO: 281612 - DNA, 19 bp, Homo sapiens
gctcagtgccacctatgcc

SEQ ID NO: 281613 - DNA, 23 bp, Homo sapiens
gctcagtgccacctatgcctgtg

SEQ ID NO: 281614 - DNA, 16 bp, Homo sapiens
gctcagtgcctcctgg

SEQ ID NO: 281615 - DNA, 16 bp, Homo sapiens
gctcagttgtactttt

SEQ ID NO: 281616 - DNA, 19 bp, Homo sapiens
ggaaggttttaacattgaa

SEQ ID NO: 281617 - DNA, 12 bp, Homo sapiens
ggaagtactgga

SEQ ID NO: 281618 - DNA, 18 bp, Homo sapiens
ggaagtactggagaaaat

SEQ ID NO: 281619 - DNA, 17 bp, Homo sapiens
ggaagtacttccctcag

SEQ ID NO: 281620 - DNA, 18 bp, Homo sapiens
ggaagtcaggagccagca

SEQ ID NO: 281621 - DNA, 19 bp, Homo sapiens
ggaagtcaggagccagcag

SEQ ID NO: 281622 - DNA, 20 bp, Homo sapiens
ggaagtcaggagccagcagg

SEQ ID NO: 281623 - DNA, 22 bp, Homo sapiens
ggaagtcatgggaacgcagcct

SEQ ID NO: 281624 - DNA, 19 bp, Homo sapiens
ggaagtctcaaagatcttt

SEQ ID NO: 281625 - DNA, 17 bp, Homo sapiens
ggaagtgacaaggcccc

SEQ ID NO: 281626 - DNA, 22 bp, Homo sapiens
ggaagtgacaaggccccagaga

SEQ ID NO: 281627 - DNA, 18 bp, Homo sapiens
ggaagtggcagtgaaaaa

SEQ ID NO: 281628 - DNA, 21 bp, Homo sapiens
ggaagtgggagaagtggcccc

SEQ ID NO: 281629 - DNA, 16 bp, Homo sapiens
ggaagtggtggggact

SEQ ID NO: 281630 - DNA, 14 bp, Homo sapiens
ggaataaaggctga

SEQ ID NO: 281631 - DNA, 13 bp, Homo sapiens
ggaataacactgc

SEQ ID NO: 281632 - DNA, 17 bp, Homo sapiens
ggaataacactgcagcc

SEQ ID NO: 281633 - DNA, 13 bp, Homo sapiens
ggaataattattt

SEQ ID NO: 281634 - DNA, 14 bp, Homo sapiens
ggaatagcatgtca

SEQ ID NO: 281635 - DNA, 20 bp, Homo sapiens
ggaatagccagagaggagca

SEQ ID NO: 281636 - DNA, 15 bp, Homo sapiens
ggaatagggaactgt

SEQ ID NO: 281637 - DNA, 17 bp, Homo sapiens
ggaatctcccagacttg

SEQ ID NO: 281638 - DNA, 13 bp, Homo sapiens
ggaatctgccttc

SEQ ID NO: 281639 - DNA, 23 bp, Homo sapiens
ggaatctggcattctacacctgg

SEQ ID NO: 281640 - DNA, 14 bp, Homo sapiens
ggaatgaagcatgt

SEQ ID NO: 281641 - DNA, 19 bp, Homo sapiens
ggaatgactataaacatta

SEQ ID NO: 281642 - DNA, 17 bp, Homo sapiens
ggaatgactgaaagaag

SEQ ID NO: 281643 - DNA, 24 bp, Homo sapiens
ggaatgattaattaaaacacaaca

SEQ ID NO: 281644 - DNA, 16 bp, Homo sapiens
ggaatgcaagagaagg

SEQ ID NO: 281645 - DNA, 19 bp, Homo sapiens
ggaatgcaagagaaggaga

SEQ ID NO: 281646 - DNA, 16 bp, Homo sapiens
ggaatgcagtgggtgg

SEQ ID NO: 281647 - DNA, 16 bp, Homo sapiens
ggaatgcctgtgccaa

SEQ ID NO: 281648 - DNA, 21 bp, Homo sapiens
ggaatgcgctcttcaccagga

SEQ ID NO: 281649 - DNA, 17 bp, Homo sapiens
ggaatgctcaatgtgct

SEQ ID NO: 281650 - DNA, 12 bp, Homo sapiens
ggaatggagctg

SEQ ID NO: 281651 - DNA, 22 bp, Homo sapiens
ggaatggtaaccgagccagcag

SEQ ID NO: 281652 - DNA, 14 bp, Homo sapiens
ggaatgtgcccctg

SEQ ID NO: 281653 - DNA, 17 bp, Homo sapiens
ggaattaacctggtgct

SEQ ID NO: 281654 - DNA, 14 bp, Homo sapiens
ggaattagaaatga

SEQ ID NO: 281655 - DNA, 21 bp, Homo sapiens
ggaattattttgaatgtcaca

SEQ ID NO: 281656 - DNA, 17 bp, Homo sapiens
ggaattcagcaccctgg

SEQ ID NO: 281657 - DNA, 13 bp, Homo sapiens
ggaattctcttgg

SEQ ID NO: 281658 - DNA, 20 bp, Homo sapiens
ggaattgacttcagcagggg

SEQ ID NO: 281659 - DNA, 14 bp, Homo sapiens
ggaattgagaggtg

SEQ ID NO: 281660 - DNA, 17 bp, Homo sapiens
ggaattgattcaagatt

SEQ ID NO: 281661 - DNA, 20 bp, Homo sapiens
ggaattgcttaccaaaggat

SEQ ID NO: 281662 - DNA, 14 bp, Homo sapiens
ggaattggtgtata

SEQ ID NO: 281663 - DNA, 23 bp, Homo sapiens
ggaattgtctttagtgccggctg

SEQ ID NO: 281664 - DNA, 14 bp, Homo sapiens
ggaattgtgtgatg

SEQ ID NO: 281665 - DNA, 18 bp, Homo sapiens
ggaatttgtaacctcagc

SEQ ID NO: 281666 - DNA, 12 bp, Homo sapiens
ggaatttgtaag

SEQ ID NO: 281667 - DNA, 22 bp, Homo sapiens
ggacaaaaatgaactgaagttt

SEQ ID NO: 281668 - DNA, 15 bp, Homo sapiens
ggacaaaacccacct

SEQ ID NO: 281669 - DNA, 17 bp, Homo sapiens
ggacaaatttaaaacaa

SEQ ID NO: 281670 - DNA, 15 bp, Homo sapiens
ggacaagaagctgct

SEQ ID NO: 281671 - DNA, 19 bp, Homo sapiens
ggacaatcatgaaatatgc

SEQ ID NO: 281672 - DNA, 11 bp, Homo sapiens
ggacacactgt

SEQ ID NO: 281673 - DNA, 19 bp, Homo sapiens
ggacacactgtaaacccct

SEQ ID NO: 281674 - DNA, 23 bp, Homo sapiens
ggacacactgtaaacccctgggt

SEQ ID NO: 281675 - DNA, 14 bp, Homo sapiens
ggacacagaccggc

SEQ ID NO: 281676 - DNA, 21 bp, Homo sapiens
ggacacagtgtgtgacgcaga

SEQ ID NO: 281677 - DNA, 19 bp, Homo sapiens
ggacacatcccggcctctt

SEQ ID NO: 281678 - DNA, 21 bp, Homo sapiens
ggacacatcccggcctcttcc

SEQ ID NO: 281679 - DNA, 22 bp, Homo sapiens
ggacaccccccgccccccacct

SEQ ID NO: 281680 - DNA, 11 bp, Homo sapiens
ggacacctgcc

SEQ ID NO: 281681 - DNA, 17 bp, Homo sapiens
ggacacctgccctgccc

SEQ ID NO: 281682 - DNA, 14 bp, Homo sapiens
ggacacggcctctg

SEQ ID NO: 281683 - DNA, 16 bp, Homo sapiens
ggacacggcctctggg

SEQ ID NO: 281684 - DNA, 18 bp, Homo sapiens
ggacacggcctctgggga

SEQ ID NO: 281685 - DNA, 23 bp, Homo sapiens
ggacactgatgggtcctgctgct

SEQ ID NO: 281686 - DNA, 19 bp, Homo sapiens
ggacacttaattctgttct

SEQ ID NO: 281687 - DNA, 20 bp, Homo sapiens
ggacagcaaaaccattgctt

SEQ ID NO: 281688 - DNA, 21 bp, Homo sapiens
ggacagcaaaaccattgcttc

SEQ ID NO: 281689 - DNA, 22 bp, Homo sapiens
ggacagcatgccccttggctgg

SEQ ID NO: 281690 - DNA, 19 bp, Homo sapiens
ggacagccagagctgggtg

SEQ ID NO: 281691 - DNA, 18 bp, Homo sapiens
ggacagcggcccggccca

SEQ ID NO: 281692 - DNA, 21 bp, Homo sapiens
ggacagctaggctgagatgca

SEQ ID NO: 281693 - DNA, 16 bp, Homo sapiens
ggactttgcagccggc

SEQ ID NO: 281694 - DNA, 17 bp, Homo sapiens
ggactttgcagccggca

SEQ ID NO: 281695 - DNA, 13 bp, Homo sapiens
ggactttgttaca

SEQ ID NO: 281696 - DNA, 15 bp, Homo sapiens
ggagaaaagccagat

SEQ ID NO: 281697 - DNA, 12 bp, Homo sapiens
ggagaaaccagc

SEQ ID NO: 281698 - DNA, 16 bp, Homo sapiens
ggagaaaggaagggct

SEQ ID NO: 281699 - DNA, 22 bp, Homo sapiens
ggagaaccaaaaagaggctatg

SEQ ID NO: 281700 - DNA, 18 bp, Homo sapiens
ggagaagcatgaaaaagc

SEQ ID NO: 281701 - DNA, 15 bp, Homo sapiens
ggagaaggagaggct

SEQ ID NO: 281702 - DNA, 13 bp, Homo sapiens
ggagaaggcctgc

SEQ ID NO: 281703 - DNA, 23 bp, Homo sapiens
ggagaaggcctgccccccttccc

SEQ ID NO: 281704 - DNA, 13 bp, Homo sapiens
ggagaaggtgctt

SEQ ID NO: 281705 - DNA, 15 bp, Homo sapiens
ggagaatgccagccc

SEQ ID NO: 281706 - DNA, 17 bp, Homo sapiens
ggagaatgccagcccaa

SEQ ID NO: 281707 - DNA, 19 bp, Homo sapiens
ggagaatgccagcccaaag

SEQ ID NO: 281708 - DNA, 13 bp, Homo sapiens
ggagacaaagcag

SEQ ID NO: 281709 - DNA, 13 bp, Homo sapiens
ggagacagtgatc

SEQ ID NO: 281710 - DNA, 14 bp, Homo sapiens
ggagaccagaagtg

SEQ ID NO: 281711 - DNA, 16 bp, Homo sapiens
ggagaccaggactctg

SEQ ID NO: 281712 - DNA, 15 bp, Homo sapiens
ggagacccaataaag

SEQ ID NO: 281713 - DNA, 20 bp, Homo sapiens
ggagaccgcttcacccctgc

SEQ ID NO: 281714 - DNA, 23 bp, Homo sapiens
ggagacgtccacccgtttccaag

SEQ ID NO: 281715 - DNA, 18 bp, Homo sapiens
ggagactccatgagaagc

SEQ ID NO: 281716 - DNA, 15 bp, Homo sapiens
ggagactgagcttga

SEQ ID NO: 281717 - DNA, 11 bp, Homo sapiens
ggagactgccc

SEQ ID NO: 281718 - DNA, 18 bp, Homo sapiens
ggagactgccccacggcc

SEQ ID NO: 281719 - DNA, 12 bp, Homo sapiens
ggagagaaaaaa

SEQ ID NO: 281720 - DNA, 15 bp, Homo sapiens
ggagagaaaaaagaa

SEQ ID NO: 281721 - DNA, 22 bp, Homo sapiens
ggagagaatgagagagtgtgga

SEQ ID NO: 281722 - DNA, 11 bp, Homo sapiens
ggagagacctc

SEQ ID NO: 281723 - DNA, 20 bp, Homo sapiens
ggagagactgaaagcagcag

SEQ ID NO: 281724 - DNA, 22 bp, Homo sapiens
ggagagactgaaagcagcagct

SEQ ID NO: 281725 - DNA, 12 bp, Homo sapiens
ggagagacttgt

SEQ ID NO: 281726 - DNA, 19 bp, Homo sapiens
ggagagagagagagaaaga

SEQ ID NO: 281727 - DNA, 17 bp, Homo sapiens
ggagagcaactggacta

SEQ ID NO: 281728 - DNA, 15 bp, Homo sapiens
ggagagcagctggct

SEQ ID NO: 281729 - DNA, 17 bp, Homo sapiens
ggagagcagctggctct

SEQ ID NO: 281730 - DNA, 13 bp, Homo sapiens
ggagagcaggctg

SEQ ID NO: 281731 - DNA, 14 bp, Homo sapiens
ggagagcaggctgg

SEQ ID NO: 281732 - DNA, 23 bp, Homo sapiens
ggagagcatcaccaccacacccc

SEQ ID NO: 281733 - DNA, 19 bp, Homo sapiens
ggagagcatctgctctgag

SEQ ID NO: 281734 - DNA, 20 bp, Homo sapiens
ggagagcatctgctctgaga

SEQ ID NO: 281735 - DNA, 19 bp, Homo sapiens
ggagagccaacctcggctt

SEQ ID NO: 281736 - DNA, 17 bp, Homo sapiens
ggagagcccctggggcc

SEQ ID NO: 281737 - DNA, 16 bp, Homo sapiens
ggagagcgccacccgc

SEQ ID NO: 281738 - DNA, 17 bp, Homo sapiens
ggagagcgccacccgcc

SEQ ID NO: 281739 - DNA, 18 bp, Homo sapiens
ggagagcgccacccgccc

SEQ ID NO: 281740 - DNA, 12 bp, Homo sapiens
ggagaggaagcc

SEQ ID NO: 281741 - DNA, 13 bp, Homo sapiens
ggagaggagagaa

SEQ ID NO: 281742 - DNA, 15 bp, Homo sapiens
ggagaggcctccctg

SEQ ID NO: 281743 - DNA, 15 bp, Homo sapiens
ggagaggctaacctc

SEQ ID NO: 281744 - DNA, 23 bp, Homo sapiens
ggagagggaaacgtgccctctgt

SEQ ID NO: 281745 - DNA, 14 bp, Homo sapiens
ggagagggaatgtg

SEQ ID NO: 281746 - DNA, 19 bp, Homo sapiens
ggagagggacagcccactg

SEQ ID NO: 281747 - DNA, 14 bp, Homo sapiens
ggagagggatgagg

SEQ ID NO: 281748 - DNA, 21 bp, Homo sapiens
ggagaggggtgcacccactca

SEQ ID NO: 281749 - DNA, 23 bp, Homo sapiens
ggagaggttataggtcactcctg

SEQ ID NO: 281750 - DNA, 22 bp, Homo sapiens
ggagagtaaaaattcatataaa

SEQ ID NO: 281751 - DNA, 17 bp, Homo sapiens
ggagagtcacagaacaa

SEQ ID NO: 281752 - DNA, 20 bp, Homo sapiens
ggagagtgcagatctgtgct

SEQ ID NO: 281753 - DNA, 21 bp, Homo sapiens
ggagagttggggaaggcaaga

SEQ ID NO: 281754 - DNA, 19 bp, Homo sapiens
ggagatccgccctgggctc

SEQ ID NO: 281755 - DNA, 17 bp, Homo sapiens
ggagatcggggccagag

SEQ ID NO: 281756 - DNA, 17 bp, Homo sapiens
ggagatctttgcttcct

SEQ ID NO: 281757 - DNA, 18 bp, Homo sapiens
ggagatggacccctccct

SEQ ID NO: 281758 - DNA, 19 bp, Homo sapiens
ggagatggacccctccctt

SEQ ID NO: 281759 - DNA, 22 bp, Homo sapiens
ggagatggtcagtgtggagagg

SEQ ID NO: 281760 - DNA, 17 bp, Homo sapiens
ggagatgtaatgacaga

SEQ ID NO: 281761 - DNA, 20 bp, Homo sapiens
ggagatgtaatgacagagag

SEQ ID NO: 281762 - DNA, 22 bp, Homo sapiens
ggagatgtcttcgtacagttct

SEQ ID NO: 281763 - DNA, 15 bp, Homo sapiens
ggagattaaaaccag

SEQ ID NO: 281764 - DNA, 14 bp, Homo sapiens
ggagattgctctgg

SEQ ID NO: 281765 - DNA, 14 bp, Homo sapiens
ggagattgcttttg

SEQ ID NO: 281766 - DNA, 14 bp, Homo sapiens
ggagcaaaaggcag

SEQ ID NO: 281767 - DNA, 22 bp, Homo sapiens
ggagcaaaaggcagctcacccc

SEQ ID NO: 281768 - DNA, 15 bp, Homo sapiens
ggagcaatgggactg

SEQ ID NO: 281769 - DNA, 17 bp, Homo sapiens
ggagcaatgggactgga

SEQ ID NO: 281770 - DNA, 13 bp, Homo sapiens
ggagcacagccct

SEQ ID NO: 281771 - DNA, 15 bp, Homo sapiens
ggagcacagccctgg

SEQ ID NO: 281772 - DNA, 13 bp, Homo sapiens
ggagcacaggcag

SEQ ID NO: 281773 - DNA, 12 bp, Homo sapiens
ggagcaccccca

SEQ ID NO: 281774 - DNA, 13 bp, Homo sapiens
ggagcacccccag

SEQ ID NO: 281775 - DNA, 22 bp, Homo sapiens
ggagcacccccagcctccccca

SEQ ID NO: 281776 - DNA, 13 bp, Homo sapiens
ggagcacctgaac

SEQ ID NO: 281777 - DNA, 14 bp, Homo sapiens
ggagcacctgaacc

SEQ ID NO: 281778 - DNA, 15 bp, Homo sapiens
ggagcacctgaaccc

SEQ ID NO: 281779 - DNA, 19 bp, Homo sapiens
ggagcacctgaaccccatg

SEQ ID NO: 281780 - DNA, 15 bp, Homo sapiens
ggagcactggagtgc

SEQ ID NO: 281781 - DNA, 12 bp, Homo sapiens
ggagcagagaag

SEQ ID NO: 281782 - DNA, 18 bp, Homo sapiens
ggagcagagacggcagcc

SEQ ID NO: 281783 - DNA, 20 bp, Homo sapiens
ggagcagagacggcagcccc

SEQ ID NO: 281784 - DNA, 21 bp, Homo sapiens
ggagcagagacggcagcccca

SEQ ID NO: 281785 - DNA, 18 bp, Homo sapiens
ggagcagcagctgaggcc

SEQ ID NO: 281786 - DNA, 12 bp, Homo sapiens
ggagcagctgtg

SEQ ID NO: 281787 - DNA, 13 bp, Homo sapiens
ggagcagctgtgc

SEQ ID NO: 281788 - DNA, 19 bp, Homo sapiens
ggagcaggaagcaaggcca

SEQ ID NO: 281789 - DNA, 20 bp, Homo sapiens
ggagcaggaagcaaggccag

SEQ ID NO: 281790 - DNA, 18 bp, Homo sapiens
ggagcaggaggaggaaag

SEQ ID NO: 281791 - DNA, 12 bp, Homo sapiens
ggagcagtgtct

SEQ ID NO: 281792 - DNA, 13 bp, Homo sapiens
ggagcagtgtctt

SEQ ID NO: 281793 - DNA, 17 bp, Homo sapiens
ggagcattttgtgtctt

SEQ ID NO: 281794 - DNA, 17 bp, Homo sapiens
ggagccaaatgtggcat

SEQ ID NO: 281795 - DNA, 20 bp, Homo sapiens
ggagccaacagaagcttcca

SEQ ID NO: 281796 - DNA, 14 bp, Homo sapiens
ggagccacaggcag

SEQ ID NO: 281797 - DNA, 16 bp, Homo sapiens
ggagccactcctgtcc

SEQ ID NO: 281798 - DNA, 17 bp, Homo sapiens
ggagccactcctgtccc

SEQ ID NO: 281799 - DNA, 20 bp, Homo sapiens
ggagccactcctgtcccgcc

SEQ ID NO: 281800 - DNA, 15 bp, Homo sapiens
ggagccactctgttc

SEQ ID NO: 281801 - DNA, 15 bp, Homo sapiens
ggagccacttctccc

SEQ ID NO: 281802 - DNA, 21 bp, Homo sapiens
ggagccagcagggcgggccag

SEQ ID NO: 281803 - DNA, 14 bp, Homo sapiens
ggagccagccaccc

SEQ ID NO: 281804 - DNA, 18 bp, Homo sapiens
ggagcccacagagtctgt

SEQ ID NO: 281805 - DNA, 23 bp, Homo sapiens
ggagcccacggctaagaggctgc

SEQ ID NO: 281806 - DNA, 13 bp, Homo sapiens
ggagccccagcca

SEQ ID NO: 281807 - DNA, 15 bp, Homo sapiens
ggagccccagccagc

SEQ ID NO: 281808 - DNA, 17 bp, Homo sapiens
ggagccccagccagccc

SEQ ID NO: 281809 - DNA, 12 bp, Homo sapiens
ggagccccaggg

SEQ ID NO: 281810 - DNA, 13 bp, Homo sapiens
ggagccccagggt

SEQ ID NO: 281811 - DNA, 20 bp, Homo sapiens
ggagccccagggtcttccct

SEQ ID NO: 281812 - DNA, 17 bp, Homo sapiens
ggagcccctcctctgag

SEQ ID NO: 281813 - DNA, 22 bp, Homo sapiens
ggcagctaaaagcatccctgtg

SEQ ID NO: 281814 - DNA, 14 bp, Homo sapiens
ggcagctagactgg

SEQ ID NO: 281815 - DNA, 15 bp, Homo sapiens
ggcagctcacccctg

SEQ ID NO: 281816 - DNA, 16 bp, Homo sapiens
ggcagctcacccctgg

SEQ ID NO: 281817 - DNA, 16 bp, Homo sapiens
ggcagctcctctcctt

SEQ ID NO: 281818 - DNA, 13 bp, Homo sapiens
ggcagctctccag

SEQ ID NO: 281819 - DNA, 16 bp, Homo sapiens
ggcagctctccagtca

SEQ ID NO: 281820 - DNA, 21 bp, Homo sapiens
ggcagctctccagtcaggagg

SEQ ID NO: 281821 - DNA, 12 bp, Homo sapiens
ggcagctcttct

SEQ ID NO: 281822 - DNA, 17 bp, Homo sapiens
ggcagctcttctgggca

SEQ ID NO: 281823 - DNA, 22 bp, Homo sapiens
ggcagctgctcttagtgcccgc

SEQ ID NO: 281824 - DNA, 15 bp, Homo sapiens
ggcagctggcaggag

SEQ ID NO: 281825 - DNA, 18 bp, Homo sapiens
ggcagctggcaggagaga

SEQ ID NO: 281826 - DNA, 13 bp, Homo sapiens
ggcagctggggcc

SEQ ID NO: 281827 - DNA, 17 bp, Homo sapiens
ggcagctggggccggag

SEQ ID NO: 281828 - DNA, 13 bp, Homo sapiens
ggcagctgtagct

SEQ ID NO: 281829 - DNA, 17 bp, Homo sapiens
ggcagcttcagtctctg

SEQ ID NO: 281830 - DNA, 20 bp, Homo sapiens
ggcagcttcagtctctgcag

SEQ ID NO: 281831 - DNA, 11 bp, Homo sapiens
ggcaggaaaag

SEQ ID NO: 281832 - DNA, 18 bp, Homo sapiens
ggcaggaaggcgggggat

SEQ ID NO: 281833 - DNA, 10 bp, Homo sapiens
ggcaggaagt

SEQ ID NO: 281834 - DNA, 17 bp, Homo sapiens
ggcaggaatcaaggagc

SEQ ID NO: 281835 - DNA, 22 bp, Homo sapiens
ggcaggacacatcccggcctct

SEQ ID NO: 281836 - DNA, 15 bp, Homo sapiens
ggcaggagacactgg

SEQ ID NO: 281837 - DNA, 14 bp, Homo sapiens
ggcaggagggtggc

SEQ ID NO: 281838 - DNA, 15 bp, Homo sapiens
ggcaggagtggcagc

SEQ ID NO: 281839 - DNA, 20 bp, Homo sapiens
ggcaggagtgggctctgagc

SEQ ID NO: 281840 - DNA, 14 bp, Homo sapiens
ggcaggcagagctc

SEQ ID NO: 281841 - DNA, 21 bp, Homo sapiens
ggcaggccagcttcgtgctgg

SEQ ID NO: 281842 - DNA, 10 bp, Homo sapiens
ggcaggccct

SEQ ID NO: 281843 - DNA, 14 bp, Homo sapiens
ggcaggccctgcag

SEQ ID NO: 281844 - DNA, 16 bp, Homo sapiens
ggcaggccctgcagtg

SEQ ID NO: 281845 - DNA, 13 bp, Homo sapiens
ggcaggcctggga

SEQ ID NO: 281846 - DNA, 23 bp, Homo sapiens
ggcagggaaggggaggcagccgg

SEQ ID NO: 281847 - DNA, 15 bp, Homo sapiens
ggcagggaggcacca

SEQ ID NO: 281848 - DNA, 22 bp, Homo sapiens
ggcagggagggaaacccgggga

SEQ ID NO: 281849 - DNA, 17 bp, Homo sapiens
ggcagggaggtcaggcc

SEQ ID NO: 281850 - DNA, 19 bp, Homo sapiens
ggcagggaggtcaggccct

SEQ ID NO: 281851 - DNA, 15 bp, Homo sapiens
ggcagggatttgagg

SEQ ID NO: 281852 - DNA, 15 bp, Homo sapiens
ggcagggcaggcaga

SEQ ID NO: 281853 - DNA, 13 bp, Homo sapiens
ggcagggcagggc

SEQ ID NO: 281854 - DNA, 16 bp, Homo sapiens
ggcagggccgcagggc

SEQ ID NO: 281855 - DNA, 15 bp, Homo sapiens
ggcagggcctggcct

SEQ ID NO: 281856 - DNA, 17 bp, Homo sapiens
ggcagggctcccacaga

SEQ ID NO: 281857 - DNA, 15 bp, Homo sapiens
ggcaggggagccagg

SEQ ID NO: 281858 - DNA, 16 bp, Homo sapiens
ggcaggggagtctgct

SEQ ID NO: 281859 - DNA, 22 bp, Homo sapiens
ggcaggggctgcatcctcagcc

SEQ ID NO: 281860 - DNA, 13 bp, Homo sapiens
ggcaggggctggg

SEQ ID NO: 281861 - DNA, 16 bp, Homo sapiens
ggcaggggctgggcag

SEQ ID NO: 281862 - DNA, 17 bp, Homo sapiens
ggcaggggctgggcaga

SEQ ID NO: 281863 - DNA, 18 bp, Homo sapiens
ggcaggggctgggcagag

SEQ ID NO: 281864 - DNA, 15 bp, Homo sapiens
ggcaggggggagagg

SEQ ID NO: 281865 - DNA, 19 bp, Homo sapiens
ggcaggggttccagcttcc

SEQ ID NO: 281866 - DNA, 20 bp, Homo sapiens
ggcaggtagatcgcttgagc

SEQ ID NO: 281867 - DNA, 16 bp, Homo sapiens
ggcaggtgaccttctg

SEQ ID NO: 281868 - DNA, 14 bp, Homo sapiens
ggcaggtgccccgt

SEQ ID NO: 281869 - DNA, 13 bp, Homo sapiens
ggcaggtggccag

SEQ ID NO: 281870 - DNA, 14 bp, Homo sapiens
ggcaggtggccagg

SEQ ID NO: 281871 - DNA, 18 bp, Homo sapiens
ggcaggtgttgggacctg

SEQ ID NO: 281872 - DNA, 14 bp, Homo sapiens
ggcaggttgatcag

SEQ ID NO: 281873 - DNA, 23 bp, Homo sapiens
ggcagtacctgggaaaggaccca

SEQ ID NO: 281874 - DNA, 13 bp, Homo sapiens
ggcagtagcagct

SEQ ID NO: 281875 - DNA, 19 bp, Homo sapiens
ggcagtaggtgtcccccac

SEQ ID NO: 281876 - DNA, 19 bp, Homo sapiens
ggcagtcacactgctggga

SEQ ID NO: 281877 - DNA, 11 bp, Homo sapiens
ggcagtccaga

SEQ ID NO: 281878 - DNA, 21 bp, Homo sapiens
ggcagtctgaacccttgtgct

SEQ ID NO: 281879 - DNA, 14 bp, Homo sapiens
ggcagtctggaggg

SEQ ID NO: 281880 - DNA, 21 bp, Homo sapiens
ggcagtctggaggggcatggc

SEQ ID NO: 281881 - DNA, 23 bp, Homo sapiens
ggcagtgaacacactcagcagcc

SEQ ID NO: 281882 - DNA, 24 bp, Homo sapiens
ggcagtgaacacactcagcagccc

SEQ ID NO: 281883 - DNA, 14 bp, Homo sapiens
ggcagtgactggca

SEQ ID NO: 281884 - DNA, 17 bp, Homo sapiens
ggcagtgactggcaggt

SEQ ID NO: 281885 - DNA, 21 bp, Homo sapiens
ggcagtgactggcaggtgcag

SEQ ID NO: 281886 - DNA, 15 bp, Homo sapiens
ggcagtgcaccccct

SEQ ID NO: 281887 - DNA, 15 bp, Homo sapiens
ggcagtgcccaccat

SEQ ID NO: 281888 - DNA, 19 bp, Homo sapiens
ggcagtgcccaccatgcac

SEQ ID NO: 281889 - DNA, 14 bp, Homo sapiens
ggcagtggagaggg

SEQ ID NO: 281890 - DNA, 13 bp, Homo sapiens
ggcagtggcagca

SEQ ID NO: 281891 - DNA, 15 bp, Homo sapiens
ggcagtggccaggca

SEQ ID NO: 281892 - DNA, 13 bp, Homo sapiens
ggcagtggggctg

SEQ ID NO: 281893 - DNA, 20 bp, Homo sapiens
ggcagttagagatgcctccc

SEQ ID NO: 281894 - DNA, 19 bp, Homo sapiens
ggcagttctcactcctagg

SEQ ID NO: 281895 - DNA, 23 bp, Homo sapiens
ggcagttctcactcctaggagag

SEQ ID NO: 281896 - DNA, 14 bp, Homo sapiens
ggcagtttttgttc

SEQ ID NO: 281897 - DNA, 14 bp, Homo sapiens
ggcatactttctct

SEQ ID NO: 281898 - DNA, 21 bp, Homo sapiens
ggcatagctccccgcttctgc

SEQ ID NO: 281899 - DNA, 16 bp, Homo sapiens
ggcatcaaagatgaga

SEQ ID NO: 281900 - DNA, 16 bp, Homo sapiens
ggcatcagctttccct

SEQ ID NO: 281901 - DNA, 18 bp, Homo sapiens
ggcatcagctttccctgg

SEQ ID NO: 281902 - DNA, 22 bp, Homo sapiens
ggcatcagctttccctggctca

SEQ ID NO: 281903 - DNA, 12 bp, Homo sapiens
ggcatcaggcac

SEQ ID NO: 281904 - DNA, 19 bp, Homo sapiens
ggcatcaggcactggtggc

SEQ ID NO: 281905 - DNA, 18 bp, Homo sapiens
ggcatccacccagtgctg

SEQ ID NO: 281906 - DNA, 19 bp, Homo sapiens
ggcatccacccagtgctgc

SEQ ID NO: 281907 - DNA, 23 bp, Homo sapiens
ggcatccacccagtgctgccatg

SEQ ID NO: 281908 - DNA, 18 bp, Homo sapiens
ggcatcccagtggcctca

SEQ ID NO: 281909 - DNA, 19 bp, Homo sapiens
ggcatccttgaggacctcc

SEQ ID NO: 281910 - DNA, 14 bp, Homo sapiens
ggcatcgcaggagt

SEQ ID NO: 281911 - DNA, 16 bp, Homo sapiens
ggcatcgtagaagaga

SEQ ID NO: 281912 - DNA, 13 bp, Homo sapiens
ggcatctaagaca

SEQ ID NO: 281913 - DNA, 15 bp, Homo sapiens
ggcatctccaggaag

SEQ ID NO: 281914 - DNA, 16 bp, Homo sapiens
ggcatctccaggaagg

SEQ ID NO: 281915 - DNA, 14 bp, Homo sapiens
ggcatctcctgtgc

SEQ ID NO: 281916 - DNA, 15 bp, Homo sapiens
ggcatctgacacaaa

SEQ ID NO: 281917 - DNA, 19 bp, Homo sapiens
ggcatctgagtccagctcc

SEQ ID NO: 281918 - DNA, 16 bp, Homo sapiens
ggcatctgcccctccc

SEQ ID NO: 281919 - DNA, 18 bp, Homo sapiens
ggcatgccgagtgcccca

SEQ ID NO: 281920 - DNA, 19 bp, Homo sapiens
ggcatgccgagtgccccag

SEQ ID NO: 281921 - DNA, 15 bp, Homo sapiens
ggcatgcctggacaa

SEQ ID NO: 281922 - DNA, 13 bp, Homo sapiens
ggcatgcctgtgt

SEQ ID NO: 281923 - DNA, 14 bp, Homo sapiens
ggcatgcctgtgtg

SEQ ID NO: 281924 - DNA, 17 bp, Homo sapiens
ggcatgcgaatgagctg

SEQ ID NO: 281925 - DNA, 24 bp, Homo sapiens
ggcatgcgaatgagctgggccctg

SEQ ID NO: 281926 - DNA, 15 bp, Homo sapiens
ggcatgctcccagca

SEQ ID NO: 281927 - DNA, 16 bp, Homo sapiens
ggcatggacagggcca

SEQ ID NO: 281928 - DNA, 21 bp, Homo sapiens
ggcatggacagggccagggtt

SEQ ID NO: 281929 - DNA, 22 bp, Homo sapiens
ggcatggacagggccagggttg

SEQ ID NO: 281930 - DNA, 19 bp, Homo sapiens
ggcatggggtgggcctctg

SEQ ID NO: 281931 - DNA, 21 bp, Homo sapiens
ggcatggggtgggcctctggt

SEQ ID NO: 281932 - DNA, 23 bp, Homo sapiens
ggcatgggtcccttccccctgct

SEQ ID NO: 281933 - DNA, 16 bp, Homo sapiens
ggcatggtaccagccc

SEQ ID NO: 281934 - DNA, 17 bp, Homo sapiens
ggcatggtaccagccct

SEQ ID NO: 281935 - DNA, 18 bp, Homo sapiens
ggcatggtaccagccctg

SEQ ID NO: 281936 - DNA, 20 bp, Homo sapiens
ggcatggtaccagccctggg

SEQ ID NO: 281937 - DNA, 20 bp, Homo sapiens
ggcatggtggcacgtgcctg

SEQ ID NO: 281938 - DNA, 18 bp, Homo sapiens
ggcatgtattggcctgga

SEQ ID NO: 281939 - DNA, 20 bp, Homo sapiens
ggcatgtattggcctggagg

SEQ ID NO: 281940 - DNA, 23 bp, Homo sapiens
ggcatgtgaattctgtgaagaat

SEQ ID NO: 281941 - DNA, 19 bp, Homo sapiens
ggcatgtgggttgtgatat

SEQ ID NO: 281942 - DNA, 14 bp, Homo sapiens
ggcatgtgtgcctg

SEQ ID NO: 281943 - DNA, 19 bp, Homo sapiens
ggcatgtgtgcctgtggca

SEQ ID NO: 281944 - DNA, 23 bp, Homo sapiens
ggcatgtttgtctgtgtgctgta

SEQ ID NO: 281945 - DNA, 18 bp, Homo sapiens
ggcattcccagaggtggg

SEQ ID NO: 281946 - DNA, 16 bp, Homo sapiens
ggcattcctttcttta

SEQ ID NO: 281947 - DNA, 15 bp, Homo sapiens
ggcattctacacctg

SEQ ID NO: 281948 - DNA, 16 bp, Homo sapiens
gctttggtttaaaaga

SEQ ID NO: 281949 - DNA, 15 bp, Homo sapiens
gctttgtatgcactt

SEQ ID NO: 281950 - DNA, 12 bp, Homo sapiens
gctttgtcccac

SEQ ID NO: 281951 - DNA, 20 bp, Homo sapiens
gctttgtgcttggggctatt

SEQ ID NO: 281952 - DNA, 22 bp, Homo sapiens
gctttgttactgaaatgagcct

SEQ ID NO: 281953 - DNA, 23 bp, Homo sapiens
gctttgttactgaaatgagcctc

SEQ ID NO: 281954 - DNA, 14 bp, Homo sapiens
gctttgttcttgtc

SEQ ID NO: 281955 - DNA, 16 bp, Homo sapiens
gctttgtttggatgcc

SEQ ID NO: 281956 - DNA, 19 bp, Homo sapiens
gcttttaagaaacacaggg

SEQ ID NO: 281957 - DNA, 15 bp, Homo sapiens
gcttttaataaaatt

SEQ ID NO: 281958 - DNA, 16 bp, Homo sapiens
gcttttaataaaattg

SEQ ID NO: 281959 - DNA, 23 bp, Homo sapiens
gcttttagtacccacctgagctt

SEQ ID NO: 281960 - DNA, 18 bp, Homo sapiens
gcttttatgtttgtacac

SEQ ID NO: 281961 - DNA, 18 bp, Homo sapiens
gcttttatttcagtgcca

SEQ ID NO: 281962 - DNA, 14 bp, Homo sapiens
gcttttcactgctg

SEQ ID NO: 281963 - DNA, 18 bp, Homo sapiens
gcttttcactgctggctg

SEQ ID NO: 281964 - DNA, 14 bp, Homo sapiens
gcttttcatgtaga

SEQ ID NO: 281965 - DNA, 23 bp, Homo sapiens
gcttttccaggatcctgcaggaa

SEQ ID NO: 281966 - DNA, 19 bp, Homo sapiens
gcttttccctaagccaagg

SEQ ID NO: 281967 - DNA, 17 bp, Homo sapiens
gcttttcctttcttttt

SEQ ID NO: 281968 - DNA, 14 bp, Homo sapiens
gcttttctcatggt

SEQ ID NO: 281969 - DNA, 17 bp, Homo sapiens
gcttttctcttgctaat

SEQ ID NO: 281970 - DNA, 16 bp, Homo sapiens
gcttttcttgccagct

SEQ ID NO: 281971 - DNA, 20 bp, Homo sapiens
gcttttgatggctatgtttt

SEQ ID NO: 281972 - DNA, 21 bp, Homo sapiens
gcttttgctggtcactgccat

SEQ ID NO: 281973 - DNA, 22 bp, Homo sapiens
gcttttgctggtcactgccatg

SEQ ID NO: 281974 - DNA, 20 bp, Homo sapiens
gcttttgtagatggcacttt

SEQ ID NO: 281975 - DNA, 18 bp, Homo sapiens
gcttttgttgtgactttt

SEQ ID NO: 281976 - DNA, 17 bp, Homo sapiens
gctttttaaaacattag

SEQ ID NO: 281977 - DNA, 15 bp, Homo sapiens
gctttttaatattga

SEQ ID NO: 281978 - DNA, 20 bp, Homo sapiens
gctttttaccgttcacttcc

SEQ ID NO: 281979 - DNA, 18 bp, Homo sapiens
gcttttttctcaataaaa

SEQ ID NO: 281980 - DNA, 15 bp, Homo sapiens
gctttttttttctct

SEQ ID NO: 281981 - DNA, 24 bp, Homo sapiens
gctttttttttctctttctctcct

SEQ ID NO: 281982 - DNA, 15 bp, Homo sapiens
gcttttttttttcca

SEQ ID NO: 281983 - DNA, 20 bp, Homo sapiens
ggaaaaacagaacatttctc

SEQ ID NO: 281984 - DNA, 21 bp, Homo sapiens
ggaaaaacagaggatgctgaa

SEQ ID NO: 281985 - DNA, 23 bp, Homo sapiens
ggaaaaacagaggatgctgaagt

SEQ ID NO: 281986 - DNA, 19 bp, Homo sapiens
ggaaaaaccacccccaaat

SEQ ID NO: 281987 - DNA, 15 bp, Homo sapiens
ggaaaaacctgtggg

SEQ ID NO: 281988 - DNA, 22 bp, Homo sapiens
ggaaaacgtatcacctttccca

SEQ ID NO: 281989 - DNA, 21 bp, Homo sapiens
ggaaaactgagactcagacag

SEQ ID NO: 281990 - DNA, 22 bp, Homo sapiens
ggaaaagaaacaatatgcttta

SEQ ID NO: 281991 - DNA, 13 bp, Homo sapiens
ggaaaagaaatca

SEQ ID NO: 281992 - DNA, 21 bp, Homo sapiens
ggaaaatagtcctccaaaaca

SEQ ID NO: 281993 - DNA, 22 bp, Homo sapiens
ggaaaatgtcccccacctcttt

SEQ ID NO: 281994 - DNA, 19 bp, Homo sapiens
ggaaacagaaaagagaaga

SEQ ID NO: 281995 - DNA, 19 bp, Homo sapiens
ggaaaccaagtggtcagga

SEQ ID NO: 281996 - DNA, 21 bp, Homo sapiens
ggaaacccggggaactggttt

SEQ ID NO: 281997 - DNA, 14 bp, Homo sapiens
ggaaacctgccctg

SEQ ID NO: 281998 - DNA, 19 bp, Homo sapiens
ggaaacctgccctgcctga

SEQ ID NO: 281999 - DNA, 18 bp, Homo sapiens
ggaaacctgttatgccaa

SEQ ID NO: 282000 - DNA, 18 bp, Homo sapiens
ggaaacgaaacccactct

SEQ ID NO: 282001 - DNA, 21 bp, Homo sapiens
ggaaactcacctgctggcccc

SEQ ID NO: 282002 - DNA, 14 bp, Homo sapiens
ggaaactcagatgt

SEQ ID NO: 282003 - DNA, 19 bp, Homo sapiens
ggaaactgaggcccagaga

SEQ ID NO: 282004 - DNA, 20 bp, Homo sapiens
ggaaactgaggcccagagag

SEQ ID NO: 282005 - DNA, 23 bp, Homo sapiens
ggaaagaattcctacaatatata

SEQ ID NO: 282006 - DNA, 16 bp, Homo sapiens
ggaaagactgaaagaa

SEQ ID NO: 282007 - DNA, 15 bp, Homo sapiens
ggaaagaggagaagg

SEQ ID NO: 282008 - DNA, 18 bp, Homo sapiens
ggaaagaggagaaggaga

SEQ ID NO: 282009 - DNA, 15 bp, Homo sapiens
ggaaagatttaatgt

SEQ ID NO: 282010 - DNA, 15 bp, Homo sapiens
ggaaagcaataaatg

SEQ ID NO: 282011 - DNA, 19 bp, Homo sapiens
ggaaagcaccgcagcatgt

SEQ ID NO: 282012 - DNA, 23 bp, Homo sapiens
ggaaagcaccgcagcatgtgggg

SEQ ID NO: 282013 - DNA, 20 bp, Homo sapiens
ggaaagccacctctccctca

SEQ ID NO: 282014 - DNA, 15 bp, Homo sapiens
ggaaagcgggcagcc

SEQ ID NO: 282015 - DNA, 20 bp, Homo sapiens
ggaaagctgatgatgtctct

SEQ ID NO: 282016 - DNA, 12 bp, Homo sapiens
ggaaaggaccca

SEQ ID NO: 282017 - DNA, 12 bp, Homo sapiens
ggaaaggcagaa

SEQ ID NO: 282018 - DNA, 18 bp, Homo sapiens
ggaaaggccggtgggaag

SEQ ID NO: 282019 - DNA, 18 bp, Homo sapiens
ggaaaggggggagctggg

SEQ ID NO: 282020 - DNA, 18 bp, Homo sapiens
ggaaagggtgtggcttgg

SEQ ID NO: 282021 - DNA, 14 bp, Homo sapiens
ggaaaggtgctcaa

SEQ ID NO: 282022 - DNA, 20 bp, Homo sapiens
ggaaaggtgctcaaagatgt

SEQ ID NO: 282023 - DNA, 14 bp, Homo sapiens
ggaaagtgaatttg

SEQ ID NO: 282024 - DNA, 22 bp, Homo sapiens
ggaaagtgaatttgaatgaaaa

SEQ ID NO: 282025 - DNA, 19 bp, Homo sapiens
ggaaataaaacctttcaaa

SEQ ID NO: 282026 - DNA, 22 bp, Homo sapiens
ggaaataaaacctttcaaattt

SEQ ID NO: 282027 - DNA, 20 bp, Homo sapiens
ggaaatacaaggagggcctc

SEQ ID NO: 282028 - DNA, 14 bp, Homo sapiens
ggaaatattaaaag

SEQ ID NO: 282029 - DNA, 20 bp, Homo sapiens
ggaaatattttgataataaa

SEQ ID NO: 282030 - DNA, 14 bp, Homo sapiens
ggaaatcattgtgt

SEQ ID NO: 282031 - DNA, 15 bp, Homo sapiens
ggaaatccagcccca

SEQ ID NO: 282032 - DNA, 16 bp, Homo sapiens
ggaaatgacagcgggg

SEQ ID NO: 282033 - DNA, 21 bp, Homo sapiens
ggaaattcaaccccagaaatt

SEQ ID NO: 282034 - DNA, 18 bp, Homo sapiens
ggaaattcttccctgggg

SEQ ID NO: 282035 - DNA, 19 bp, Homo sapiens
ggaaattcttccctggggg

SEQ ID NO: 282036 - DNA, 20 bp, Homo sapiens
ggaaattcttccctgggggt

SEQ ID NO: 282037 - DNA, 21 bp, Homo sapiens
ggaaattcttgcactgtatcc

SEQ ID NO: 282038 - DNA, 21 bp, Homo sapiens
ggaaattgggtgtgccctggc

SEQ ID NO: 282039 - DNA, 22 bp, Homo sapiens
ggaaattgggtgtgccctggct

SEQ ID NO: 282040 - DNA, 13 bp, Homo sapiens
ggaacaagtgtac

SEQ ID NO: 282041 - DNA, 17 bp, Homo sapiens
ggaacaccccataacta

SEQ ID NO: 282042 - DNA, 15 bp, Homo sapiens
gaacttctaatatat

SEQ ID NO: 282043 - DNA, 23 bp, Homo sapiens
gaacttctcgtagatgctgccta

SEQ ID NO: 282044 - DNA, 15 bp, Homo sapiens
gaacttgaggacaca

SEQ ID NO: 282045 - DNA, 17 bp, Homo sapiens
gaacttgaggacacatg

SEQ ID NO: 282046 - DNA, 19 bp, Homo sapiens
gaacttgaggacacatgtc

SEQ ID NO: 282047 - DNA, 18 bp, Homo sapiens
gaacttgatttgcatgga

SEQ ID NO: 282048 - DNA, 22 bp, Homo sapiens
gaacttgctgctgagtgcacca

SEQ ID NO: 282049 - DNA, 12 bp, Homo sapiens
gaacttggttcc

SEQ ID NO: 282050 - DNA, 15 bp, Homo sapiens
gaactttccattttg

SEQ ID NO: 282051 - DNA, 21 bp, Homo sapiens
gaactttctcttcatactttt

SEQ ID NO: 282052 - DNA, 18 bp, Homo sapiens
gaactttgtttccagaaa

SEQ ID NO: 282053 - DNA, 20 bp, Homo sapiens
gaactttgtttccagaaatt

SEQ ID NO: 282054 - DNA, 15 bp, Homo sapiens
ggccagaccagagct

SEQ ID NO: 282055 - DNA, 14 bp, Homo sapiens
ggccagactggctg

SEQ ID NO: 282056 - DNA, 17 bp, Homo sapiens
ggccagactggctgcac

SEQ ID NO: 282057 - DNA, 21 bp, Homo sapiens
ggccagactggctgcacagcc

SEQ ID NO: 282058 - DNA, 21 bp, Homo sapiens
ggccagagagcctggtgctgc

SEQ ID NO: 282059 - DNA, 22 bp, Homo sapiens
ggccagagagcctggtgctgct

SEQ ID NO: 282060 - DNA, 13 bp, Homo sapiens
ggccagagagggc

SEQ ID NO: 282061 - DNA, 19 bp, Homo sapiens
ggccagagagggcccagct

SEQ ID NO: 282062 - DNA, 13 bp, Homo sapiens
ggccagagctgga

SEQ ID NO: 282063 - DNA, 17 bp, Homo sapiens
ggccagagctggaaggc

SEQ ID NO: 282064 - DNA, 22 bp, Homo sapiens
ggccagagctggaaggcagggc

SEQ ID NO: 282065 - DNA, 22 bp, Homo sapiens
ggccagcatccatgcggccggc

SEQ ID NO: 282066 - DNA, 14 bp, Homo sapiens
ggccagcccaggat

SEQ ID NO: 282067 - DNA, 18 bp, Homo sapiens
ggccagcccctcccacca

SEQ ID NO: 282068 - DNA, 15 bp, Homo sapiens
ggccagccctccctg

SEQ ID NO: 282069 - DNA, 22 bp, Homo sapiens
ggccagccctccctggctgtga

SEQ ID NO: 282070 - DNA, 15 bp, Homo sapiens
ggccagcctggggcc

SEQ ID NO: 282071 - DNA, 18 bp, Homo sapiens
ggccagcctggggcctgg

SEQ ID NO: 282072 - DNA, 22 bp, Homo sapiens
ggccagcctggggcctggcagg

SEQ ID NO: 282073 - DNA, 21 bp, Homo sapiens
ggccagcgaggcgaggctgcc

SEQ ID NO: 282074 - DNA, 22 bp, Homo sapiens
ggccagcgaggcgaggctgcct

SEQ ID NO: 282075 - DNA, 20 bp, Homo sapiens
ggccagcttcgtgctggagg

SEQ ID NO: 282076 - DNA, 13 bp, Homo sapiens
ggccaggagctct

SEQ ID NO: 282077 - DNA, 21 bp, Homo sapiens
ggccaggcagggagtgtctgc

SEQ ID NO: 282078 - DNA, 16 bp, Homo sapiens
ggccaggcatggccca

SEQ ID NO: 282079 - DNA, 14 bp, Homo sapiens
ggccaggccatggc

SEQ ID NO: 282080 - DNA, 15 bp, Homo sapiens
ggccaggccctcctg

SEQ ID NO: 282081 - DNA, 13 bp, Homo sapiens
ggccaggcctgcc

SEQ ID NO: 282082 - DNA, 22 bp, Homo sapiens
ggccaggttggaaaagaaatca

SEQ ID NO: 282083 - DNA, 20 bp, Homo sapiens
ggccagtcctgcctggccag

SEQ ID NO: 282084 - DNA, 13 bp, Homo sapiens
ggccagtggacag

SEQ ID NO: 282085 - DNA, 15 bp, Homo sapiens
ggccataccaggtgc

SEQ ID NO: 282086 - DNA, 17 bp, Homo sapiens
ggccataccaggtgcta

SEQ ID NO: 282087 - DNA, 20 bp, Homo sapiens
ggccataccaggtgctaggg

SEQ ID NO: 282088 - DNA, 19 bp, Homo sapiens
ggccatacttttgagaggg

SEQ ID NO: 282089 - DNA, 16 bp, Homo sapiens
ggccataggagaggag

SEQ ID NO: 282090 - DNA, 23 bp, Homo sapiens
ggccatccggcccccagagcgcc

SEQ ID NO: 282091 - DNA, 21 bp, Homo sapiens
ggccatctctgaacttcagct

SEQ ID NO: 282092 - DNA, 22 bp, Homo sapiens
ggccatctgtaaatatcccaga

SEQ ID NO: 282093 - DNA, 22 bp, Homo sapiens
ggccatgagctccagaccccca

SEQ ID NO: 282094 - DNA, 21 bp, Homo sapiens
ggccatgatgtcgttcatttt

SEQ ID NO: 282095 - DNA, 14 bp, Homo sapiens
ggccatgcctgccc

SEQ ID NO: 282096 - DNA, 22 bp, Homo sapiens
ggccatggaagctggcaggaga

SEQ ID NO: 282097 - DNA, 12 bp, Homo sapiens
ggccatggccaa

SEQ ID NO: 282098 - DNA, 15 bp, Homo sapiens
ggccatggccaaggg

SEQ ID NO: 282099 - DNA, 16 bp, Homo sapiens
ggccatggctttcatc

SEQ ID NO: 282100 - DNA, 23 bp, Homo sapiens
ggccatggctttcatcctgtgtc

SEQ ID NO: 282101 - DNA, 21 bp, Homo sapiens
ggcccaaattatcaagctaat

SEQ ID NO: 282102 - DNA, 23 bp, Homo sapiens
ggcccaaattatcaagctaataa

SEQ ID NO: 282103 - DNA, 20 bp, Homo sapiens
ggcccaagagcagagtctgg

SEQ ID NO: 282104 - DNA, 19 bp, Homo sapiens
ggcccaagcatgccccacc

SEQ ID NO: 282105 - DNA, 20 bp, Homo sapiens
ggcccaaggtcccctccaca

SEQ ID NO: 282106 - DNA, 20 bp, Homo sapiens
ggcccacacccgacaccagc

SEQ ID NO: 282107 - DNA, 18 bp, Homo sapiens
ggcccacaggaggcaagc

SEQ ID NO: 282108 - DNA, 23 bp, Homo sapiens
ggcccacaggaggcaagcaagct

SEQ ID NO: 282109 - DNA, 15 bp, Homo sapiens
ggcccacccctcttc

SEQ ID NO: 282110 - DNA, 22 bp, Homo sapiens
ggcccacctaccttcaaagctg

SEQ ID NO: 282111 - DNA, 14 bp, Homo sapiens
ggcccacgcagagc

SEQ ID NO: 282112 - DNA, 17 bp, Homo sapiens
ggcccacgcagagcccc

SEQ ID NO: 282113 - DNA, 18 bp, Homo sapiens
ggcccacgcagagccccg

SEQ ID NO: 282114 - DNA, 20 bp, Homo sapiens
ggcccacgcagagccccgga

SEQ ID NO: 282115 - DNA, 21 bp, Homo sapiens
ggcccacgcagagccccggag

SEQ ID NO: 282116 - DNA, 22 bp, Homo sapiens
ggcccacgcagagccccggagc

SEQ ID NO: 282117 - DNA, 23 bp, Homo sapiens
ggcccacgcagagccccggagca

SEQ ID NO: 282118 - DNA, 17 bp, Homo sapiens
ggcccagagctggaaca

SEQ ID NO: 282119 - DNA, 12 bp, Homo sapiens
ggcccagaggca

SEQ ID NO: 282120 - DNA, 14 bp, Homo sapiens
ggcccagaggctga

SEQ ID NO: 282121 - DNA, 23 bp, Homo sapiens
ggcccagaggggcggggccagga

SEQ ID NO: 282122 - DNA, 13 bp, Homo sapiens
ggcccagcagagc

SEQ ID NO: 282123 - DNA, 14 bp, Homo sapiens
ggcccagcagagcc

SEQ ID NO: 282124 - DNA, 15 bp, Homo sapiens
ggcccagcagcttgg

SEQ ID NO: 282125 - DNA, 19 bp, Homo sapiens
ggcccagcagcttggctga

SEQ ID NO: 282126 - DNA, 23 bp, Homo sapiens
ggcccagcagcttggctgagccc

SEQ ID NO: 282127 - DNA, 12 bp, Homo sapiens
ggcccagccagc

SEQ ID NO: 282128 - DNA, 23 bp, Homo sapiens
ggcccagccatgggccctctgag

SEQ ID NO: 282129 - DNA, 11 bp, Homo sapiens
ggcccagcctg

SEQ ID NO: 282130 - DNA, 12 bp, Homo sapiens
ggcccagcctgg

SEQ ID NO: 282131 - DNA, 12 bp, Homo sapiens
ggcccagcctgt

SEQ ID NO: 282132 - DNA, 15 bp, Homo sapiens
ggcccagcctgtcct

SEQ ID NO: 282133 - DNA, 17 bp, Homo sapiens
ggcccagcctgtcctgg

SEQ ID NO: 282134 - DNA, 15 bp, Homo sapiens
gggagaccaggcttc

SEQ ID NO: 282135 - DNA, 12 bp, Homo sapiens
gggagagacctc

SEQ ID NO: 282136 - DNA, 15 bp, Homo sapiens
gggagagcaggctgg

SEQ ID NO: 282137 - DNA, 23 bp, Homo sapiens
gggagagcaggctggcagctctc

SEQ ID NO: 282138 - DNA, 14 bp, Homo sapiens
gggagagccagctc

SEQ ID NO: 282139 - DNA, 14 bp, Homo sapiens
gggagagcccctgg

SEQ ID NO: 282140 - DNA, 13 bp, Homo sapiens
gggagagcgccac

SEQ ID NO: 282141 - DNA, 20 bp, Homo sapiens
gggagagggggtaatggagg

SEQ ID NO: 282142 - DNA, 12 bp, Homo sapiens
gggagagtgagg

SEQ ID NO: 282143 - DNA, 20 bp, Homo sapiens
gggagatccgccctgggctc

SEQ ID NO: 282144 - DNA, 15 bp, Homo sapiens
gggagcaactctcca

SEQ ID NO: 282145 - DNA, 22 bp, Homo sapiens
gggagcacttgcgtcctgcaga

SEQ ID NO: 282146 - DNA, 13 bp, Homo sapiens
gggagcagctggg

SEQ ID NO: 282147 - DNA, 23 bp, Homo sapiens
gggagcaggctcgggctccccag

SEQ ID NO: 282148 - DNA, 23 bp, Homo sapiens
gggagccaatactgagtgcctgc

SEQ ID NO: 282149 - DNA, 15 bp, Homo sapiens
gggagccatgctctt

SEQ ID NO: 282150 - DNA, 22 bp, Homo sapiens
gggagcccagcacactgcttct

SEQ ID NO: 282151 - DNA, 12 bp, Homo sapiens
gggagccccagg

SEQ ID NO: 282152 - DNA, 16 bp, Homo sapiens
gggagccccagggtct

SEQ ID NO: 282153 - DNA, 22 bp, Homo sapiens
gggagcccccgccccgccccac

SEQ ID NO: 282154 - DNA, 22 bp, Homo sapiens
gggagcccctcctctgagcagc

SEQ ID NO: 282155 - DNA, 14 bp, Homo sapiens
gggagccctgacct

SEQ ID NO: 282156 - DNA, 16 bp, Homo sapiens
gggagcctcgcccctc

SEQ ID NO: 282157 - DNA, 17 bp, Homo sapiens
gggagcctcgcccctcc

SEQ ID NO: 282158 - DNA, 18 bp, Homo sapiens
gggagcctcgcccctcca

SEQ ID NO: 282159 - DNA, 22 bp, Homo sapiens
gggagcctcgcccctccagtgt

SEQ ID NO: 282160 - DNA, 19 bp, Homo sapiens
gggaggaatcgaggaacca

SEQ ID NO: 282161 - DNA, 13 bp, Homo sapiens
gggaggacccggg

SEQ ID NO: 282162 - DNA, 12 bp, Homo sapiens
gggaggagcacc

SEQ ID NO: 282163 - DNA, 19 bp, Homo sapiens
gggaggagcacccccagcc

SEQ ID NO: 282164 - DNA, 23 bp, Homo sapiens
gggaggcaccagctctgtggcct

SEQ ID NO: 282165 - DNA, 14 bp, Homo sapiens
gggaggccaaggca

SEQ ID NO: 282166 - DNA, 17 bp, Homo sapiens
gggaggcccctggtggc

SEQ ID NO: 282167 - DNA, 18 bp, Homo sapiens
gggaggcgtgcccccctc

SEQ ID NO: 282168 - DNA, 16 bp, Homo sapiens
gggagggaacagacct

SEQ ID NO: 282169 - DNA, 15 bp, Homo sapiens
gggagggcccacttc

SEQ ID NO: 282170 - DNA, 14 bp, Homo sapiens
gggaggggaggtgg

SEQ ID NO: 282171 - DNA, 15 bp, Homo sapiens
gggaggggaggtggc

SEQ ID NO: 282172 - DNA, 23 bp, Homo sapiens
gggaggggcggcaggagggaggt

SEQ ID NO: 282173 - DNA, 12 bp, Homo sapiens
gggaggggctga

SEQ ID NO: 282174 - DNA, 15 bp, Homo sapiens
gggagggtgggcgtg

SEQ ID NO: 282175 - DNA, 15 bp, Homo sapiens
gggaggtcaggccct

SEQ ID NO: 282176 - DNA, 14 bp, Homo sapiens
gggaggtcattttg

SEQ ID NO: 282177 - DNA, 18 bp, Homo sapiens
gggagtacatatggtaga

SEQ ID NO: 282178 - DNA, 13 bp, Homo sapiens
gggagtacctgct

SEQ ID NO: 282179 - DNA, 23 bp, Homo sapiens
gggagtagcatggactctgggtt

SEQ ID NO: 282180 - DNA, 18 bp, Homo sapiens
gggagtcaagtgtgcctg

SEQ ID NO: 282181 - DNA, 17 bp, Homo sapiens
gggagtcagagccctgg

SEQ ID NO: 282182 - DNA, 22 bp, Homo sapiens
gggagtcagagccctggctggg

SEQ ID NO: 282183 - DNA, 21 bp, Homo sapiens
gggagtccactttcctctctc

SEQ ID NO: 282184 - DNA, 14 bp, Homo sapiens
gggagtccagggct

SEQ ID NO: 282185 - DNA, 20 bp, Homo sapiens
gggagtccagggctcccgga

SEQ ID NO: 282186 - DNA, 16 bp, Homo sapiens
gggagtcccctccccg

SEQ ID NO: 282187 - DNA, 13 bp, Homo sapiens
gggagtgagcttg

SEQ ID NO: 282188 - DNA, 17 bp, Homo sapiens
gggagtgggagaggaag

SEQ ID NO: 282189 - DNA, 14 bp, Homo sapiens
gggagtgggcacct

SEQ ID NO: 282190 - DNA, 16 bp, Homo sapiens
gggagtgggcacctca

SEQ ID NO: 282191 - DNA, 20 bp, Homo sapiens
gggagtgggcacctcagaaa

SEQ ID NO: 282192 - DNA, 20 bp, Homo sapiens
gggagtgttctgtgggcttg

SEQ ID NO: 282193 - DNA, 20 bp, Homo sapiens
gggagttgagtcacaagagg

SEQ ID NO: 282194 - DNA, 17 bp, Homo sapiens
gggataacagaggcagg

SEQ ID NO: 282195 - DNA, 13 bp, Homo sapiens
gggccccagatct

SEQ ID NO: 282196 - DNA, 14 bp, Homo sapiens
gggccccagatctg

SEQ ID NO: 282197 - DNA, 20 bp, Homo sapiens
gggccccagatctgcctggg

SEQ ID NO: 282198 - DNA, 21 bp, Homo sapiens
gggccccagatctgcctgggc

SEQ ID NO: 282199 - DNA, 23 bp, Homo sapiens
gggccccagatctgcctgggcct

SEQ ID NO: 282200 - DNA, 24 bp, Homo sapiens
gggccccagatctgcctgggcctg

SEQ ID NO: 282201 - DNA, 15 bp, Homo sapiens
gggccccagggaact

SEQ ID NO: 282202 - DNA, 16 bp, Homo sapiens
gggccccagggaacta

SEQ ID NO: 282203 - DNA, 17 bp, Homo sapiens
gggccccattcagaact

SEQ ID NO: 282204 - DNA, 21 bp, Homo sapiens
gggccccattctccctccatg

SEQ ID NO: 282205 - DNA, 23 bp, Homo sapiens
gggccccattctccctccatggc

SEQ ID NO: 282206 - DNA, 15 bp, Homo sapiens
gggccccccagctca

SEQ ID NO: 282207 - DNA, 23 bp, Homo sapiens
gggccccccagctcaggggcagc

SEQ ID NO: 282208 - DNA, 21 bp, Homo sapiens
gggcccccggccacgctccct

SEQ ID NO: 282209 - DNA, 14 bp, Homo sapiens
gggccccggggctg

SEQ ID NO: 282210 - DNA, 21 bp, Homo sapiens
gggctgcccctgtaggttgct

SEQ ID NO: 282211 - DNA, 15 bp, Homo sapiens
gggctgccctggtgc

SEQ ID NO: 282212 - DNA, 21 bp, Homo sapiens
gggctgccctggtgctgccac

SEQ ID NO: 282213 - DNA, 22 bp, Homo sapiens
gggctgccgtgcacggggccag

SEQ ID NO: 282214 - DNA, 17 bp, Homo sapiens
gggctgcgaccgccaga

SEQ ID NO: 282215 - DNA, 18 bp, Homo sapiens
gggctggactggaggtgg

SEQ ID NO: 282216 - DNA, 19 bp, Homo sapiens
gggctggactggaggtggg

SEQ ID NO: 282217 - DNA, 16 bp, Homo sapiens
gggctggcaagcaggg

SEQ ID NO: 282218 - DNA, 17 bp, Homo sapiens
gggctggcaagcaggga

SEQ ID NO: 282219 - DNA, 14 bp, Homo sapiens
gggctggccctgcc

SEQ ID NO: 282220 - DNA, 17 bp, Homo sapiens
gggctggccctgccctc

SEQ ID NO: 282221 - DNA, 21 bp, Homo sapiens
gggctgggcagaggggagagg

SEQ ID NO: 282222 - DNA, 23 bp, Homo sapiens
gggctgggcagaggggagaggaa

SEQ ID NO: 282223 - DNA, 20 bp, Homo sapiens
gggctgggcaggtcctgggg

SEQ ID NO: 282224 - DNA, 11 bp, Homo sapiens
gggctgggtgt

SEQ ID NO: 282225 - DNA, 15 bp, Homo sapiens
gggctggtgccagcc

SEQ ID NO: 282226 - DNA, 16 bp, Homo sapiens
gggctggtgccagcct

SEQ ID NO: 282227 - DNA, 17 bp, Homo sapiens
gggctggtgccccacag

SEQ ID NO: 282228 - DNA, 10 bp, Homo sapiens
gggctgtcct

SEQ ID NO: 282229 - DNA, 20 bp, Homo sapiens
gggctgtgttgactgctgct

SEQ ID NO: 282230 - DNA, 23 bp, Homo sapiens
gggctgtgttgactgctgctccc

SEQ ID NO: 282231 - DNA, 15 bp, Homo sapiens
gggcttacaggcatg

SEQ ID NO: 282232 - DNA, 14 bp, Homo sapiens
gggcttagaatggg

SEQ ID NO: 282233 - DNA, 23 bp, Homo sapiens
gggcttatctagccaaagagctc

SEQ ID NO: 282234 - DNA, 22 bp, Homo sapiens
gggcttcaccagtctgtctact

SEQ ID NO: 282235 - DNA, 14 bp, Homo sapiens
gggcttcagatatt

SEQ ID NO: 282236 - DNA, 19 bp, Homo sapiens
gggcttctgcggtgaggca

SEQ ID NO: 282237 - DNA, 16 bp, Homo sapiens
gggcttggacttcctg

SEQ ID NO: 282238 - DNA, 13 bp, Homo sapiens
gggcttggagcag

SEQ ID NO: 282239 - DNA, 20 bp, Homo sapiens
gggcttggcgtggagcaggc

SEQ ID NO: 282240 - DNA, 15 bp, Homo sapiens
gggcttggggctgca

SEQ ID NO: 282241 - DNA, 16 bp, Homo sapiens
gggcttggggtagaga

SEQ ID NO: 282242 - DNA, 21 bp, Homo sapiens
gggcttggggtagagaggaca

SEQ ID NO: 282243 - DNA, 24 bp, Homo sapiens
gggcttgttgtttttaagtcctgt

SEQ ID NO: 282244 - DNA, 23 bp, Homo sapiens
gggctttaacaaaacaagaaaga

SEQ ID NO: 282245 - DNA, 15 bp, Homo sapiens
gggctttgcaggctc

SEQ ID NO: 282246 - DNA, 16 bp, Homo sapiens
gggctttgcaggctct

SEQ ID NO: 282247 - DNA, 20 bp, Homo sapiens
gggctttgcaggctctgggc

SEQ ID NO: 282248 - DNA, 18 bp, Homo sapiens
gggcttttctctttcctc

SEQ ID NO: 282249 - DNA, 18 bp, Homo sapiens
ggggaaaatgtgaagctg

SEQ ID NO: 282250 - DNA, 23 bp, Homo sapiens
ggggaactcaaaggactgacctg

SEQ ID NO: 282251 - DNA, 18 bp, Homo sapiens
ggggaagagagcctgccc

SEQ ID NO: 282252 - DNA, 15 bp, Homo sapiens
ggggaaggccttgct

SEQ ID NO: 282253 - DNA, 18 bp, Homo sapiens
ggggacacggcctctggg

SEQ ID NO: 282254 - DNA, 15 bp, Homo sapiens
ggggacactgaacct

SEQ ID NO: 282255 - DNA, 19 bp, Homo sapiens
ggggacaggaacacccagc

SEQ ID NO: 282256 - DNA, 13 bp, Homo sapiens
ggggactcagccc

SEQ ID NO: 282257 - DNA, 15 bp, Homo sapiens
ggggacttggatagg

SEQ ID NO: 282258 - DNA, 17 bp, Homo sapiens
ggggagaagagccctgg

SEQ ID NO: 282259 - DNA, 20 bp, Homo sapiens
ggggagaagagccctggaca

SEQ ID NO: 282260 - DNA, 21 bp, Homo sapiens
ggggagaccgagtgtggagct

SEQ ID NO: 282261 - DNA, 12 bp, Homo sapiens
ggggagctctgg

SEQ ID NO: 282262 - DNA, 22 bp, Homo sapiens
ggggaggacccgggaccacagc

SEQ ID NO: 282263 - DNA, 16 bp, Homo sapiens
ggggaggagcaccccc

SEQ ID NO: 282264 - DNA, 18 bp, Homo sapiens
ggggaggagcacccccag

SEQ ID NO: 282265 - DNA, 22 bp, Homo sapiens
ggggaggagcacccccagcctc

SEQ ID NO: 282266 - DNA, 12 bp, Homo sapiens
ggggaggagggc

SEQ ID NO: 282267 - DNA, 14 bp, Homo sapiens
ggggaggcagccgg

SEQ ID NO: 282268 - DNA, 14 bp, Homo sapiens
ggggaggctctgaa

SEQ ID NO: 282269 - DNA, 12 bp, Homo sapiens
ggggaggctgag

SEQ ID NO: 282270 - DNA, 16 bp, Homo sapiens
ggggaggctgagacgc

SEQ ID NO: 282271 - DNA, 15 bp, Homo sapiens
ggggaggggcctagg

SEQ ID NO: 282272 - DNA, 15 bp, Homo sapiens
ggggagtccctgcca

SEQ ID NO: 282273 - DNA, 20 bp, Homo sapiens
ggggagtgggacagagtctg

SEQ ID NO: 282274 - DNA, 22 bp, Homo sapiens
ggggatcagagtctggcctgcc

SEQ ID NO: 282275 - DNA, 15 bp, Homo sapiens
ggggatcctggagcc

SEQ ID NO: 282276 - DNA, 22 bp, Homo sapiens
ggggatctaaaaggaggacagg

SEQ ID NO: 282277 - DNA, 15 bp, Homo sapiens
ggggatggagaatgc

SEQ ID NO: 282278 - DNA, 22 bp, Homo sapiens
ggggattagctagactaggaga

SEQ ID NO: 282279 - DNA, 20 bp, Homo sapiens
ggggcaaggtgggggagcct

SEQ ID NO: 282280 - DNA, 15 bp, Homo sapiens
ggggcacaccactgc

SEQ ID NO: 282281 - DNA, 20 bp, Homo sapiens
ggggcacaccactgccctgc

SEQ ID NO: 282282 - DNA, 17 bp, Homo sapiens
ggggcacacttcccctt

SEQ ID NO: 282283 - DNA, 15 bp, Homo sapiens
ggggcacagccagaa

SEQ ID NO: 282284 - DNA, 13 bp, Homo sapiens
ggggcagaaggag

SEQ ID NO: 282285 - DNA, 19 bp, Homo sapiens
ggggcagccgctaggagag

SEQ ID NO: 282286 - DNA, 12 bp, Homo sapiens
ggggcaggaagt

SEQ ID NO: 282287 - DNA, 12 bp, Homo sapiens
ggggcaggcctg

SEQ ID NO: 282288 - DNA, 13 bp, Homo sapiens
ggggcagggcagg

SEQ ID NO: 282289 - DNA, 16 bp, Homo sapiens
ggggcagggcctggcc

SEQ ID NO: 282290 - DNA, 17 bp, Homo sapiens
ggggcaggggggagagg

SEQ ID NO: 282291 - DNA, 14 bp, Homo sapiens
ggggcagtcacctg

SEQ ID NO: 282292 - DNA, 18 bp, Homo sapiens
ggggcagtgactggcagg

SEQ ID NO: 282293 - DNA, 20 bp, Homo sapiens
ggggcatctgcccctccccc

SEQ ID NO: 282294 - DNA, 15 bp, Homo sapiens
ggggcatgcctgtag

SEQ ID NO: 282295 - DNA, 20 bp, Homo sapiens
ggggcatggacagggccagg

SEQ ID NO: 282296 - DNA, 17 bp, Homo sapiens
ggggcatgggggaggct

SEQ ID NO: 282297 - DNA, 21 bp, Homo sapiens
ggggcatggttccttccctgg

SEQ ID NO: 282298 - DNA, 20 bp, Homo sapiens
ggggcatgtgtgcctgtggc

SEQ ID NO: 282299 - DNA, 21 bp, Homo sapiens
ggggccatgagctccagaccc

SEQ ID NO: 282300 - DNA, 14 bp, Homo sapiens
ggggccatgaggcc

SEQ ID NO: 282301 - DNA, 16 bp, Homo sapiens
ggggccatgaggcctc

SEQ ID NO: 282302 - DNA, 19 bp, Homo sapiens
ggggcccaggctcccctgc

SEQ ID NO: 282303 - DNA, 13 bp, Homo sapiens
ggggcccatggcc

SEQ ID NO: 282304 - DNA, 17 bp, Homo sapiens
ggggcccatggccccag

SEQ ID NO: 282305 - DNA, 22 bp, Homo sapiens
ggggccccagatctgcctgggc

SEQ ID NO: 282306 - DNA, 23 bp, Homo sapiens
ggggccccagatctgcctgggcc

SEQ ID NO: 282307 - DNA, 17 bp, Homo sapiens
ggggcccctcctctgtg

SEQ ID NO: 282308 - DNA, 19 bp, Homo sapiens
ggggcccctcctctgtgct

SEQ ID NO: 282309 - DNA, 22 bp, Homo sapiens
ggggcccctttttactcccctt

SEQ ID NO: 282310 - DNA, 16 bp, Homo sapiens
ggggcccgcctggcag

SEQ ID NO: 282311 - DNA, 18 bp, Homo sapiens
ggggcccttggggcctgg

SEQ ID NO: 282312 - DNA, 22 bp, Homo sapiens
ggggccgagtccaggagcccca

SEQ ID NO: 282313 - DNA, 18 bp, Homo sapiens
ggggccggagcctttgga

SEQ ID NO: 282314 - DNA, 12 bp, Homo sapiens
ggggcctggcag

SEQ ID NO: 282315 - DNA, 14 bp, Homo sapiens
ggggcctttcccat

SEQ ID NO: 282316 - DNA, 24 bp, Homo sapiens
ggggcgctcaggacccaggccctc

SEQ ID NO: 282317 - DNA, 16 bp, Homo sapiens
ggggctaactggcccc

SEQ ID NO: 282318 - DNA, 17 bp, Homo sapiens
ggccccagggctaccct

SEQ ID NO: 282319 - DNA, 14 bp, Homo sapiens
ggccccaggtgcca

SEQ ID NO: 282320 - DNA, 12 bp, Homo sapiens
ggccccatgctc

SEQ ID NO: 282321 - DNA, 15 bp, Homo sapiens
ggccccatgctctgc

SEQ ID NO: 282322 - DNA, 21 bp, Homo sapiens
ggcccccaaattgccttcagc

SEQ ID NO: 282323 - DNA, 12 bp, Homo sapiens
ggcccccagagc

SEQ ID NO: 282324 - DNA, 16 bp, Homo sapiens
ggcccccagagcgccc

SEQ ID NO: 282325 - DNA, 12 bp, Homo sapiens
ggcccccagctg

SEQ ID NO: 282326 - DNA, 16 bp, Homo sapiens
ggccccccaaatccca

SEQ ID NO: 282327 - DNA, 21 bp, Homo sapiens
ggccccccctcttttggcctt

SEQ ID NO: 282328 - DNA, 14 bp, Homo sapiens
ggcccccctccagg

SEQ ID NO: 282329 - DNA, 15 bp, Homo sapiens
ggcccccctccaggc

SEQ ID NO: 282330 - DNA, 13 bp, Homo sapiens
ggcccccgagctg

SEQ ID NO: 282331 - DNA, 19 bp, Homo sapiens
ggcccccgccccctcccta

SEQ ID NO: 282332 - DNA, 21 bp, Homo sapiens
ggcccccggaggcgcccacct

SEQ ID NO: 282333 - DNA, 20 bp, Homo sapiens
ggcccccggccacgctccct

SEQ ID NO: 282334 - DNA, 19 bp, Homo sapiens
ggcccccgttgggacccac

SEQ ID NO: 282335 - DNA, 15 bp, Homo sapiens
ggccccctccatcgg

SEQ ID NO: 282336 - DNA, 19 bp, Homo sapiens
ggcccccttcaccccttca

SEQ ID NO: 282337 - DNA, 18 bp, Homo sapiens
ggccccgcgcgtgccccc

SEQ ID NO: 282338 - DNA, 22 bp, Homo sapiens
ggccccgcgcgtgcccccagcg

SEQ ID NO: 282339 - DNA, 17 bp, Homo sapiens
ggccccgggctctggcc

SEQ ID NO: 282340 - DNA, 18 bp, Homo sapiens
ggccccgggctctggcca

SEQ ID NO: 282341 - DNA, 22 bp, Homo sapiens
ggcccctcaccctgccttatct

SEQ ID NO: 282342 - DNA, 14 bp, Homo sapiens
ggcccctcagagcc

SEQ ID NO: 282343 - DNA, 15 bp, Homo sapiens
ggcccctccaggaac

SEQ ID NO: 282344 - DNA, 20 bp, Homo sapiens
ggcccctccctacctcaacc

SEQ ID NO: 282345 - DNA, 21 bp, Homo sapiens
ggcccctccctacctcaacct

SEQ ID NO: 282346 - DNA, 17 bp, Homo sapiens
ggcccctccctctgccc

SEQ ID NO: 282347 - DNA, 21 bp, Homo sapiens
ggcccctccctctgccccaag

SEQ ID NO: 282348 - DNA, 13 bp, Homo sapiens
ggcccctcctctg

SEQ ID NO: 282349 - DNA, 20 bp, Homo sapiens
ggcccctcctctgtgctccc

SEQ ID NO: 282350 - DNA, 11 bp, Homo sapiens
ggcccctcctt

SEQ ID NO: 282351 - DNA, 19 bp, Homo sapiens
ggcccctctgcccagcttg

SEQ ID NO: 282352 - DNA, 22 bp, Homo sapiens
ggcccctctgctgtcctgcagt

SEQ ID NO: 282353 - DNA, 13 bp, Homo sapiens
ggcccctgaggac

SEQ ID NO: 282354 - DNA, 15 bp, Homo sapiens
ggcccctgaggactg

SEQ ID NO: 282355 - DNA, 20 bp, Homo sapiens
ggcccctgccacctcctgcc

SEQ ID NO: 282356 - DNA, 14 bp, Homo sapiens
ggcccctgccttgg

SEQ ID NO: 282357 - DNA, 17 bp, Homo sapiens
ggcccctgcgtgggggc

SEQ ID NO: 282358 - DNA, 21 bp, Homo sapiens
ggcccctggcacgtcctccac

SEQ ID NO: 282359 - DNA, 15 bp, Homo sapiens
ggcccctggcccagc

SEQ ID NO: 282360 - DNA, 18 bp, Homo sapiens
ggcccctggcccagcggc

SEQ ID NO: 282361 - DNA, 20 bp, Homo sapiens
ggcccctggcccagcggccc

SEQ ID NO: 282362 - DNA, 20 bp, Homo sapiens
ggccccttcacttctgacca

SEQ ID NO: 282363 - DNA, 14 bp, Homo sapiens
ggcccgccaccttg

SEQ ID NO: 282364 - DNA, 18 bp, Homo sapiens
ggcccgccgtgcctgcat

SEQ ID NO: 282365 - DNA, 19 bp, Homo sapiens
ggcccgccgtgcctgcatt

SEQ ID NO: 282366 - DNA, 23 bp, Homo sapiens
ggcccgcctggcagaactgagct

SEQ ID NO: 282367 - DNA, 17 bp, Homo sapiens
ggcccgctcaacctctc

SEQ ID NO: 282368 - DNA, 19 bp, Homo sapiens
ggcccgctcaacctctcag

SEQ ID NO: 282369 - DNA, 22 bp, Homo sapiens
ggcccgctgcgtgccatcactc

SEQ ID NO: 282370 - DNA, 18 bp, Homo sapiens
ggcccggaagttgctgtg

SEQ ID NO: 282371 - DNA, 17 bp, Homo sapiens
ggcccggcccacgcaga

SEQ ID NO: 282372 - DNA, 20 bp, Homo sapiens
ggcccggcccacgcagagcc

SEQ ID NO: 282373 - DNA, 14 bp, Homo sapiens
ggcccgggcccctg

SEQ ID NO: 282374 - DNA, 15 bp, Homo sapiens
ggcccgtgcgcagcc

SEQ ID NO: 282375 - DNA, 16 bp, Homo sapiens
ggcccgttgaggatga

SEQ ID NO: 282376 - DNA, 15 bp, Homo sapiens
ggccctaagccactc

SEQ ID NO: 282377 - DNA, 21 bp, Homo sapiens
ggccctaccagcgcccgctgg

SEQ ID NO: 282378 - DNA, 22 bp, Homo sapiens
ggccctaccagcgcccgctggg

SEQ ID NO: 282379 - DNA, 21 bp, Homo sapiens
ggccctaggattcctccccca

SEQ ID NO: 282380 - DNA, 22 bp, Homo sapiens
ggccctaggattcctcccccag

SEQ ID NO: 282381 - DNA, 16 bp, Homo sapiens
ggccctccatgggcta

SEQ ID NO: 282382 - DNA, 19 bp, Homo sapiens
ggccctccctgtctccagg

SEQ ID NO: 282383 - DNA, 22 bp, Homo sapiens
ggccctccctgtctccagggcc

SEQ ID NO: 282384 - DNA, 23 bp, Homo sapiens
ggccctccctgtctccagggccc

SEQ ID NO: 282385 - DNA, 15 bp, Homo sapiens
ggccctcccttggaa

SEQ ID NO: 282386 - DNA, 15 bp, Homo sapiens
ggccctcctgctggc

SEQ ID NO: 282387 - DNA, 14 bp, Homo sapiens
ggccctctctctgg

SEQ ID NO: 282388 - DNA, 16 bp, Homo sapiens
ggccctctctctgggc

SEQ ID NO: 282389 - DNA, 15 bp, Homo sapiens
ggccctctgtccaca

SEQ ID NO: 282390 - DNA, 19 bp, Homo sapiens
ggccctcttcttattcatg

SEQ ID NO: 282391 - DNA, 16 bp, Homo sapiens
ggccctgcaggaggcc

SEQ ID NO: 282392 - DNA, 23 bp, Homo sapiens
ggccctgcaggaggcctgggagg

SEQ ID NO: 282393 - DNA, 15 bp, Homo sapiens
ggccctgcagtgttc

SEQ ID NO: 282394 - DNA, 22 bp, Homo sapiens
ggccctgcagtgttcgcttggc

SEQ ID NO: 282395 - DNA, 11 bp, Homo sapiens
ggccctgcccc

SEQ ID NO: 282396 - DNA, 12 bp, Homo sapiens
ggccctgcccca

SEQ ID NO: 282397 - DNA, 14 bp, Homo sapiens
ggccctgccccaca

SEQ ID NO: 282398 - DNA, 11 bp, Homo sapiens
ggccctgccct

SEQ ID NO: 282399 - DNA, 13 bp, Homo sapiens
ggccctgccctcc

SEQ ID NO: 282400 - DNA, 14 bp, Homo sapiens
ggccctgccctccc

SEQ ID NO: 282401 - DNA, 15 bp, Homo sapiens
ggccctgccctcccc

SEQ ID NO: 282402 - DNA, 13 bp, Homo sapiens
ggccctgctcagg

SEQ ID NO: 282403 - DNA, 17 bp, Homo sapiens
ggccctgctcaggcctc

SEQ ID NO: 282404 - DNA, 22 bp, Homo sapiens
ggccctgctcaggcctcacctg

SEQ ID NO: 282405 - DNA, 22 bp, Homo sapiens
ggccctggctcccacaggccct

SEQ ID NO: 282406 - DNA, 16 bp, Homo sapiens
ggctgctggcacagac

SEQ ID NO: 282407 - DNA, 13 bp, Homo sapiens
ggctgctggggca

SEQ ID NO: 282408 - DNA, 22 bp, Homo sapiens
ggctgctggggcatgtgtgcct

SEQ ID NO: 282409 - DNA, 22 bp, Homo sapiens
ggctgctgtaaagttgagggga

SEQ ID NO: 282410 - DNA, 19 bp, Homo sapiens
ggctgcttctccacctccc

SEQ ID NO: 282411 - DNA, 23 bp, Homo sapiens
ggctgcttctccacctcccccaa

SEQ ID NO: 282412 - DNA, 10 bp, Homo sapiens
ggctggaaga

SEQ ID NO: 282413 - DNA, 14 bp, Homo sapiens
ggctggactggctg

SEQ ID NO: 282414 - DNA, 20 bp, Homo sapiens
ggctggagggcagtggcacg

SEQ ID NO: 282415 - DNA, 19 bp, Homo sapiens
ggctggagtgcagtggcgt

SEQ ID NO: 282416 - DNA, 14 bp, Homo sapiens
ggctggagtgcgct

SEQ ID NO: 282417 - DNA, 16 bp, Homo sapiens
ggctggcaagcaggga

SEQ ID NO: 282418 - DNA, 17 bp, Homo sapiens
ggctggcaagcagggaa

SEQ ID NO: 282419 - DNA, 15 bp, Homo sapiens
ggctggcagctctcc

SEQ ID NO: 282420 - DNA, 14 bp, Homo sapiens
ggctggcaggtgtt

SEQ ID NO: 282421 - DNA, 14 bp, Homo sapiens
ggctggccagcaag

SEQ ID NO: 282422 - DNA, 19 bp, Homo sapiens
ggctggccagcaaggcagg

SEQ ID NO: 282423 - DNA, 12 bp, Homo sapiens
ggctggccctgc

SEQ ID NO: 282424 - DNA, 14 bp, Homo sapiens
ggctggccctgccc

SEQ ID NO: 282425 - DNA, 15 bp, Homo sapiens
ggctggccctgccct

SEQ ID NO: 282426 - DNA, 21 bp, Homo sapiens
ggctggccctgccctccccca

SEQ ID NO: 282427 - DNA, 13 bp, Homo sapiens
ggctggccttcct

SEQ ID NO: 282428 - DNA, 16 bp, Homo sapiens
ggctggcttctccctg

SEQ ID NO: 282429 - DNA, 13 bp, Homo sapiens
ggctgggagaagg

SEQ ID NO: 282430 - DNA, 17 bp, Homo sapiens
ggctgggagaaggtgct

SEQ ID NO: 282431 - DNA, 20 bp, Homo sapiens
ggctgggagcctcgcccctc

SEQ ID NO: 282432 - DNA, 18 bp, Homo sapiens
ggctgggcagaggggaga

SEQ ID NO: 282433 - DNA, 13 bp, Homo sapiens
ggctgggcagctg

SEQ ID NO: 282434 - DNA, 14 bp, Homo sapiens
ggctgggcagggcc

SEQ ID NO: 282435 - DNA, 17 bp, Homo sapiens
ggctgggcagggccgca

SEQ ID NO: 282436 - DNA, 22 bp, Homo sapiens
ggctgggccaagccagggatgg

SEQ ID NO: 282437 - DNA, 21 bp, Homo sapiens
ggctgggccccccagctcagg

SEQ ID NO: 282438 - DNA, 22 bp, Homo sapiens
ggctgggctctgtcttcctggt

SEQ ID NO: 282439 - DNA, 19 bp, Homo sapiens
ggctggggacttggccgct

SEQ ID NO: 282440 - DNA, 11 bp, Homo sapiens
ggctggggatg

SEQ ID NO: 282441 - DNA, 16 bp, Homo sapiens
ggctggggatggccga

SEQ ID NO: 282442 - DNA, 12 bp, Homo sapiens
ggctggggcaga

SEQ ID NO: 282443 - DNA, 14 bp, Homo sapiens
ggctggggcagagg

SEQ ID NO: 282444 - DNA, 15 bp, Homo sapiens
ggctggggcctggcc

SEQ ID NO: 282445 - DNA, 19 bp, Homo sapiens
ggctggggcttttgtgcca

SEQ ID NO: 282446 - DNA, 17 bp, Homo sapiens
ggctgggggcaggaggg

SEQ ID NO: 282447 - DNA, 18 bp, Homo sapiens
ggctgggggcaggagggc

SEQ ID NO: 282448 - DNA, 17 bp, Homo sapiens
ggctgggggcatggggg

SEQ ID NO: 282449 - DNA, 15 bp, Homo sapiens
ggctgggggcctcac

SEQ ID NO: 282450 - DNA, 19 bp, Homo sapiens
ggctgggggtgaggggcca

SEQ ID NO: 282451 - DNA, 17 bp, Homo sapiens
ggctggggtgagagagg

SEQ ID NO: 282452 - DNA, 16 bp, Homo sapiens
ggctgggtcgcccctc

SEQ ID NO: 282453 - DNA, 17 bp, Homo sapiens
ggctgggtcgcccctcc

SEQ ID NO: 282454 - DNA, 21 bp, Homo sapiens
ggctgggtcgcccctcctcgg

SEQ ID NO: 282455 - DNA, 19 bp, Homo sapiens
ggctgggtcggccctgccc

SEQ ID NO: 282456 - DNA, 15 bp, Homo sapiens
ggctgggtgcccaca

SEQ ID NO: 282457 - DNA, 16 bp, Homo sapiens
ggctgggtgcccacag

SEQ ID NO: 282458 - DNA, 17 bp, Homo sapiens
ggctgggtgcccacagc

SEQ ID NO: 282459 - DNA, 18 bp, Homo sapiens
ggctgggtgggcccagaa

SEQ ID NO: 282460 - DNA, 18 bp, Homo sapiens
ggctgggttttcaggggc

SEQ ID NO: 282461 - DNA, 18 bp, Homo sapiens
ggctggtgccagccttcc

SEQ ID NO: 282462 - DNA, 17 bp, Homo sapiens
ggctggtgccccacagc

SEQ ID NO: 282463 - DNA, 18 bp, Homo sapiens
ggctggtgccccacagct

SEQ ID NO: 282464 - DNA, 17 bp, Homo sapiens
ggctggtggtcatgaat

SEQ ID NO: 282465 - DNA, 12 bp, Homo sapiens
ggctggtgtccc

SEQ ID NO: 282466 - DNA, 13 bp, Homo sapiens
ggctggtgtcccc

SEQ ID NO: 282467 - DNA, 14 bp, Homo sapiens
ggctggtgtcccct

SEQ ID NO: 282468 - DNA, 17 bp, Homo sapiens
ggctgtatttttagaga

SEQ ID NO: 282469 - DNA, 15 bp, Homo sapiens
ggctgtcaattacag

SEQ ID NO: 282470 - DNA, 23 bp, Homo sapiens
ggctgtcccctccatctggggat

SEQ ID NO: 282471 - DNA, 13 bp, Homo sapiens
ggctgtcctgtac

SEQ ID NO: 282472 - DNA, 13 bp, Homo sapiens
ggctgtcctttcc

SEQ ID NO: 282473 - DNA, 15 bp, Homo sapiens
ggctgtctggggcct

SEQ ID NO: 282474 - DNA, 16 bp, Homo sapiens
ggctgtgagcagcctc

SEQ ID NO: 282475 - DNA, 18 bp, Homo sapiens
ggctgtgagcagcctcca

SEQ ID NO: 282476 - DNA, 19 bp, Homo sapiens
ggctgtgcacattctccct

SEQ ID NO: 282477 - DNA, 16 bp, Homo sapiens
ggctgtgcctctgcct

SEQ ID NO: 282478 - DNA, 21 bp, Homo sapiens
ggctgtggagcaaaaggcagc

SEQ ID NO: 282479 - DNA, 21 bp, Homo sapiens
ggctgtggccgtctcctccct

SEQ ID NO: 282480 - DNA, 21 bp, Homo sapiens
ggctgtgggcctcaaggactt

SEQ ID NO: 282481 - DNA, 15 bp, Homo sapiens
ggctgtgtatttctg

SEQ ID NO: 282482 - DNA, 20 bp, Homo sapiens
ggctgttccagactcaggtt

SEQ ID NO: 282483 - DNA, 22 bp, Homo sapiens
ggctgtttttgggtgcaagagg

SEQ ID NO: 282484 - DNA, 22 bp, Homo sapiens
ggcttacaggggggtcggaagc

SEQ ID NO: 282485 - DNA, 21 bp, Homo sapiens
ggcttagacttcgactcagga

SEQ ID NO: 282486 - DNA, 16 bp, Homo sapiens
ggcttagtaatagatc

SEQ ID NO: 282487 - DNA, 22 bp, Homo sapiens
ggcttatctagccaaagagctc

SEQ ID NO: 282488 - DNA, 20 bp, Homo sapiens
ggcttcaatctacgatgtta

SEQ ID NO: 282489 - DNA, 16 bp, Homo sapiens
ggcttcaccagtctgt

SEQ ID NO: 282490 - DNA, 18 bp, Homo sapiens
ggcttcaccagtctgtct

SEQ ID NO: 282491 - DNA, 18 bp, Homo sapiens
ggcttcagatattttgca

SEQ ID NO: 282492 - DNA, 12 bp, Homo sapiens
ggcttcagcccc

SEQ ID NO: 282493 - DNA, 13 bp, Homo sapiens
gtgctctttcctg

SEQ ID NO: 282494 - DNA, 21 bp, Homo sapiens
gtgctctttgttactgtccac

SEQ ID NO: 282495 - DNA, 11 bp, Homo sapiens
gtgctgagaag

SEQ ID NO: 282496 - DNA, 18 bp, Homo sapiens
gtgctgagcttagccttg

SEQ ID NO: 282497 - DNA, 20 bp, Homo sapiens
gtgctgatcgtgctaaattt

SEQ ID NO: 282498 - DNA, 20 bp, Homo sapiens
gtgctgatgagggcacctct

SEQ ID NO: 282499 - DNA, 20 bp, Homo sapiens
gtgctgcatgcgacagcgtc

SEQ ID NO: 282500 - DNA, 12 bp, Homo sapiens
gtgctgccacac

SEQ ID NO: 282501 - DNA, 14 bp, Homo sapiens
gtgctgccatgcca

SEQ ID NO: 282502 - DNA, 17 bp, Homo sapiens
gtgctgccatgccactg

SEQ ID NO: 282503 - DNA, 23 bp, Homo sapiens
gtgctgccatgccactgccaggc

SEQ ID NO: 282504 - DNA, 22 bp, Homo sapiens
gtgctgccttgtagatggagca

SEQ ID NO: 282505 - DNA, 13 bp, Homo sapiens
gtgctgcttctct

SEQ ID NO: 282506 - DNA, 19 bp, Homo sapiens
gtgctggaatggggacctg

SEQ ID NO: 282507 - DNA, 11 bp, Homo sapiens
gtgctggctcc

SEQ ID NO: 282508 - DNA, 20 bp, Homo sapiens
gtgctggctccacgccctgg

SEQ ID NO: 282509 - DNA, 18 bp, Homo sapiens
gtgctggctgcccagacc

SEQ ID NO: 282510 - DNA, 20 bp, Homo sapiens
gtgctggcttccgctgtcac

SEQ ID NO: 282511 - DNA, 17 bp, Homo sapiens
gtgctgggacagctagg

SEQ ID NO: 282512 - DNA, 20 bp, Homo sapiens
gtgctgggactgagccagtc

SEQ ID NO: 282513 - DNA, 15 bp, Homo sapiens
gtgctgggagggata

SEQ ID NO: 282514 - DNA, 20 bp, Homo sapiens
gtgctgggattacaggcgtg

SEQ ID NO: 282515 - DNA, 19 bp, Homo sapiens
gtgctgggattacaggtgt

SEQ ID NO: 282516 - DNA, 19 bp, Homo sapiens
gtgctgggccagtggctgg

SEQ ID NO: 282517 - DNA, 12 bp, Homo sapiens
gtgctgggccca

SEQ ID NO: 282518 - DNA, 17 bp, Homo sapiens
gtgctgggtgcctccca

SEQ ID NO: 282519 - DNA, 18 bp, Homo sapiens
gtgctgtacccttccacc

SEQ ID NO: 282520 - DNA, 20 bp, Homo sapiens
gtgctgtacccttccacctc

SEQ ID NO: 282521 - DNA, 21 bp, Homo sapiens
gtgctgtacccttccacctcc

SEQ ID NO: 282522 - DNA, 14 bp, Homo sapiens
gtgctgtctgtcct

SEQ ID NO: 282523 - DNA, 18 bp, Homo sapiens
gtgctgtgaccatttata

SEQ ID NO: 282524 - DNA, 14 bp, Homo sapiens
gtgctgtgcctgct

SEQ ID NO: 282525 - DNA, 15 bp, Homo sapiens
gtgctgtgcctgcta

SEQ ID NO: 282526 - DNA, 18 bp, Homo sapiens
gtgctgtgcctgctagag

SEQ ID NO: 282527 - DNA, 21 bp, Homo sapiens
gtgctgtgggtattcaccacc

SEQ ID NO: 282528 - DNA, 15 bp, Homo sapiens
gtgctgttgattctt

SEQ ID NO: 282529 - DNA, 22 bp, Homo sapiens
gtgcttaagcagaagcattaac

SEQ ID NO: 282530 - DNA, 21 bp, Homo sapiens
gtgcttattctcaaagcagga

SEQ ID NO: 282531 - DNA, 13 bp, Homo sapiens
gtgcttgctgtgt

SEQ ID NO: 282532 - DNA, 20 bp, Homo sapiens
gtgcttggctgccccacagg

SEQ ID NO: 282533 - DNA, 12 bp, Homo sapiens
gtgctttaagtg

SEQ ID NO: 282534 - DNA, 14 bp, Homo sapiens
gtgctttatgctga

SEQ ID NO: 282535 - DNA, 21 bp, Homo sapiens
gtgctttgctggagtcctgtt

SEQ ID NO: 282536 - DNA, 11 bp, Homo sapiens
gtgctttgtag

SEQ ID NO: 282537 - DNA, 13 bp, Homo sapiens
gtgctttgtagct

SEQ ID NO: 282538 - DNA, 15 bp, Homo sapiens
gtgcttttaaactgg

SEQ ID NO: 282539 - DNA, 19 bp, Homo sapiens
gtgcttttcctatttgttt

SEQ ID NO: 282540 - DNA, 17 bp, Homo sapiens
gtggaaaaagaaattct

SEQ ID NO: 282541 - DNA, 20 bp, Homo sapiens
gtggaaaaagaaattctgtt

SEQ ID NO: 282542 - DNA, 19 bp, Homo sapiens
gtggaaaatggactggctt

SEQ ID NO: 282543 - DNA, 23 bp, Homo sapiens
gtggaaaatggactggcttggcc

SEQ ID NO: 282544 - DNA, 18 bp, Homo sapiens
gtggaaagattgtgtctg

SEQ ID NO: 282545 - DNA, 13 bp, Homo sapiens
gtggaaagggtgc

SEQ ID NO: 282546 - DNA, 20 bp, Homo sapiens
gtggaaagggtgctgcttcc

SEQ ID NO: 282547 - DNA, 14 bp, Homo sapiens
gtggaacaggagga

SEQ ID NO: 282548 - DNA, 17 bp, Homo sapiens
gtggaacaggaggaact

SEQ ID NO: 282549 - DNA, 15 bp, Homo sapiens
gtggaaccaggaacc

SEQ ID NO: 282550 - DNA, 22 bp, Homo sapiens
gtggaactctcctgctcctcag

SEQ ID NO: 282551 - DNA, 20 bp, Homo sapiens
gtggaagaggttctcagcaa

SEQ ID NO: 282552 - DNA, 22 bp, Homo sapiens
gtggaagaggttctcagcaagt

SEQ ID NO: 282553 - DNA, 22 bp, Homo sapiens
gtggaattacataacaggcatt

SEQ ID NO: 282554 - DNA, 23 bp, Homo sapiens
gtggaattacataacaggcattg

SEQ ID NO: 282555 - DNA, 20 bp, Homo sapiens
gtggacaatgagtggaatac

SEQ ID NO: 282556 - DNA, 11 bp, Homo sapiens
gtggacacctg

SEQ ID NO: 282557 - DNA, 14 bp, Homo sapiens
gtggacacctgccc

SEQ ID NO: 282558 - DNA, 16 bp, Homo sapiens
gtggacacctgccctg

SEQ ID NO: 282559 - DNA, 12 bp, Homo sapiens
gtggacagaagc

SEQ ID NO: 282560 - DNA, 13 bp, Homo sapiens
gtggacagggccc

SEQ ID NO: 282561 - DNA, 20 bp, Homo sapiens
gtggacgcaattgtgggatg

SEQ ID NO: 282562 - DNA, 21 bp, Homo sapiens
gtggactagacctccagctgt

SEQ ID NO: 282563 - DNA, 19 bp, Homo sapiens
gtggactgggaagcattac

SEQ ID NO: 282564 - DNA, 20 bp, Homo sapiens
gtggacttgtatgctgccca

SEQ ID NO: 282565 - DNA, 12 bp, Homo sapiens
gtggactttatt

SEQ ID NO: 282566 - DNA, 17 bp, Homo sapiens
gtggactttatttaatt

SEQ ID NO: 282567 - DNA, 16 bp, Homo sapiens
gtggactttccacccc

SEQ ID NO: 282568 - DNA, 11 bp, Homo sapiens
gtggagaaatg

SEQ ID NO: 282569 - DNA, 13 bp, Homo sapiens
gtggagaaatgga

SEQ ID NO: 282570 - DNA, 23 bp, Homo sapiens
gtggagaacaaagaccaatgtga

SEQ ID NO: 282571 - DNA, 18 bp, Homo sapiens
gtggagagaccagccttt

SEQ ID NO: 282572 - DNA, 20 bp, Homo sapiens
gtggagagaccagcctttct

SEQ ID NO: 282573 - DNA, 23 bp, Homo sapiens
gtggagagaccagcctttcttcc

SEQ ID NO: 282574 - DNA, 18 bp, Homo sapiens
gtggagaggagagaatga

SEQ ID NO: 282575 - DNA, 14 bp, Homo sapiens
gtggagagggaatg

SEQ ID NO: 282576 - DNA, 18 bp, Homo sapiens
gtggagagggaatgtgaa

SEQ ID NO: 282577 - DNA, 15 bp, Homo sapiens
gtggagagtgagaat

SEQ ID NO: 282578 - DNA, 17 bp, Homo sapiens
gtggagcaaaaggcagc

SEQ ID NO: 282579 - DNA, 20 bp, Homo sapiens
gtggagcaaaaggcagctca

SEQ ID NO: 282580 - DNA, 16 bp, Homo sapiens
gtggagccacaggcag

SEQ ID NO: 282581 - DNA, 18 bp, Homo sapiens
gtggagccacaggcagac

SEQ ID NO: 282582 - DNA, 15 bp, Homo sapiens
gtggagccagggagc

SEQ ID NO: 282583 - DNA, 23 bp, Homo sapiens
gtggagcccgcacccccaccctt

SEQ ID NO: 282584 - DNA, 12 bp, Homo sapiens
gtggaggaaggt

SEQ ID NO: 282585 - DNA, 19 bp, Homo sapiens
gtggaggaaggtgctgagc

SEQ ID NO: 282586 - DNA, 16 bp, Homo sapiens
gtggaggaatgctccc

SEQ ID NO: 282587 - DNA, 17 bp, Homo sapiens
gtggaggaatgctcccc

SEQ ID NO: 282588 - DNA, 18 bp, Homo sapiens
gtggaggcctgatgctgc

SEQ ID NO: 282589 - DNA, 19 bp, Homo sapiens
gtggaggcctgatgctgcc

SEQ ID NO: 282590 - DNA, 21 bp, Homo sapiens
gtggagggattgaacacaggc

SEQ ID NO: 282591 - DNA, 22 bp, Homo sapiens
gtggagggattgaacacaggca

SEQ ID NO: 282592 - DNA, 12 bp, Homo sapiens
gtggaggtggct

SEQ ID NO: 282593 - DNA, 16 bp, Homo sapiens
gtggaggttgagtgag

SEQ ID NO: 282594 - DNA, 19 bp, Homo sapiens
gtggaggttgagtgagccg

SEQ ID NO: 282595 - DNA, 20 bp, Homo sapiens
gtggaggttgagtgagccgg

SEQ ID NO: 282596 - DNA, 12 bp, Homo sapiens
gtggagtggagg

SEQ ID NO: 282597 - DNA, 17 bp, Homo sapiens
gtggagttcatcttgaa

SEQ ID NO: 282598 - DNA, 15 bp, Homo sapiens
gtggataagggagag

SEQ ID NO: 282599 - DNA, 14 bp, Homo sapiens
gtggatacagtcat

SEQ ID NO: 282600 - DNA, 20 bp, Homo sapiens
gtggatagatgccctgctag

SEQ ID NO: 282601 - DNA, 16 bp, Homo sapiens
gtggatcatgaaaagt

SEQ ID NO: 282602 - DNA, 16 bp, Homo sapiens
gtggatggtgactttt

SEQ ID NO: 282603 - DNA, 17 bp, Homo sapiens
gtggatggtgacttttg

SEQ ID NO: 282604 - DNA, 23 bp, Homo sapiens
gtggcacgcacctgtagtcccag

SEQ ID NO: 282605 - DNA, 18 bp, Homo sapiens
gtggcagaaaagaggaga

SEQ ID NO: 282606 - DNA, 20 bp, Homo sapiens
gtggcagaaaagaggagacc

SEQ ID NO: 282607 - DNA, 18 bp, Homo sapiens
gtggcagaaatcccagtt

SEQ ID NO: 282608 - DNA, 23 bp, Homo sapiens
gtggcagaaatcccagttcatgt

SEQ ID NO: 282609 - DNA, 23 bp, Homo sapiens
gtggcagataatcagcctcttaa

SEQ ID NO: 282610 - DNA, 19 bp, Homo sapiens
gtggcagattttacaaaag

SEQ ID NO: 282611 - DNA, 17 bp, Homo sapiens
gtggcagcaaaggaaga

SEQ ID NO: 282612 - DNA, 22 bp, Homo sapiens
gtggcagcaacaaaggatttga

SEQ ID NO: 282613 - DNA, 17 bp, Homo sapiens
gtggcagccatgcctca

SEQ ID NO: 282614 - DNA, 20 bp, Homo sapiens
gtggcagccatgcctcatgc

SEQ ID NO: 282615 - DNA, 22 bp, Homo sapiens
gtggcagccatgcctcatgcca

SEQ ID NO: 282616 - DNA, 11 bp, Homo sapiens
gtggcagctgg

SEQ ID NO: 282617 - DNA, 12 bp, Homo sapiens
gtggcagctggg

SEQ ID NO: 282618 - DNA, 15 bp, Homo sapiens
gtggcagctggggag

SEQ ID NO: 282619 - DNA, 20 bp, Homo sapiens
gtggcagctggggagcagct

SEQ ID NO: 282620 - DNA, 23 bp, Homo sapiens
gtggcagctggggagcagctgag

SEQ ID NO: 282621 - DNA, 11 bp, Homo sapiens
gtggcagctgt

SEQ ID NO: 282622 - DNA, 14 bp, Homo sapiens
gtggcagctgtccc

SEQ ID NO: 282623 - DNA, 22 bp, Homo sapiens
gtggcagctgtcccctctccct

SEQ ID NO: 282624 - DNA, 14 bp, Homo sapiens
gtggcagtggccag

SEQ ID NO: 282625 - DNA, 22 bp, Homo sapiens
gtggcatcgtagaagagatgtg

SEQ ID NO: 282626 - DNA, 20 bp, Homo sapiens
gtggcatctttgccttgggc

SEQ ID NO: 282627 - DNA, 17 bp, Homo sapiens
gtggcattcctttcttt

SEQ ID NO: 282628 - DNA, 19 bp, Homo sapiens
gtggccaaattatttgtgt

SEQ ID NO: 282629 - DNA, 16 bp, Homo sapiens
gtggccacaccacagc

SEQ ID NO: 282630 - DNA, 19 bp, Homo sapiens
gtggccacagcaggactga

SEQ ID NO: 282631 - DNA, 17 bp, Homo sapiens
gtggccagaccagagct

SEQ ID NO: 282632 - DNA, 17 bp, Homo sapiens
gtggccagagcacctca

SEQ ID NO: 282633 - DNA, 17 bp, Homo sapiens
gtggccaggcctgccag

SEQ ID NO: 282634 - DNA, 18 bp, Homo sapiens
gtggccaggcctgccagc

SEQ ID NO: 282635 - DNA, 14 bp, Homo sapiens
gtggccccaggtgc

SEQ ID NO: 282636 - DNA, 16 bp, Homo sapiens
gtggccccgccctcag

SEQ ID NO: 282637 - DNA, 18 bp, Homo sapiens
gtggcccctcacctgggc

SEQ ID NO: 282638 - DNA, 21 bp, Homo sapiens
gtggcccctcacctgggcctt

SEQ ID NO: 282639 - DNA, 12 bp, Homo sapiens
gtggcccctcct

SEQ ID NO: 282640 - DNA, 23 bp, Homo sapiens
gtggccctggggaagaggccttg

SEQ ID NO: 282641 - DNA, 17 bp, Homo sapiens
gtggccgcctggcaggt

SEQ ID NO: 282642 - DNA, 19 bp, Homo sapiens
gtggccgcctggcaggtgg

SEQ ID NO: 282643 - DNA, 23 bp, Homo sapiens
gtggccgcctggcaggtggaact

SEQ ID NO: 282644 - DNA, 16 bp, Homo sapiens
gtggccgggggtgggg

SEQ ID NO: 282645 - DNA, 18 bp, Homo sapiens
gtggccgtcacgctttca

SEQ ID NO: 282646 - DNA, 18 bp, Homo sapiens
gtggccgtctcctccctc

SEQ ID NO: 282647 - DNA, 18 bp, Homo sapiens
gtggcctaaggctgctgt

SEQ ID NO: 282648 - DNA, 20 bp, Homo sapiens
gtggcctcaaccctccctca

SEQ ID NO: 282649 - DNA, 15 bp, Homo sapiens
gtggcctcaggaggc

SEQ ID NO: 282650 - DNA, 13 bp, Homo sapiens
gtggcctctcagt

SEQ ID NO: 282651 - DNA, 18 bp, Homo sapiens
gtggcctggccaggagct

SEQ ID NO: 282652 - DNA, 20 bp, Homo sapiens
gtggcctgtgtccagcagct

SEQ ID NO: 282653 - DNA, 22 bp, Homo sapiens
gtggcctgtgtccagcagctgc

SEQ ID NO: 282654 - DNA, 21 bp, Homo sapiens
gtggcctgtttctgcagccct

SEQ ID NO: 282655 - DNA, 23 bp, Homo sapiens
gtggccttccccttttgcctggc

SEQ ID NO: 282656 - DNA, 15 bp, Homo sapiens
gtggccttgcccgcc

SEQ ID NO: 282657 - DNA, 22 bp, Homo sapiens
gtggcgctttctcctgtgccca

SEQ ID NO: 282658 - DNA, 17 bp, Homo sapiens
gtggcggggcagcagga

SEQ ID NO: 282659 - DNA, 21 bp, Homo sapiens
gtggctaaaggtcccaaggca

SEQ ID NO: 282660 - DNA, 23 bp, Homo sapiens
gtggctaaaggtcccaaggcaag

SEQ ID NO: 282661 - DNA, 14 bp, Homo sapiens
gtggctaattcaat

SEQ ID NO: 282662 - DNA, 16 bp, Homo sapiens
gtggctcacgcctgta

SEQ ID NO: 282663 - DNA, 15 bp, Homo sapiens
gtggctcattctttt

SEQ ID NO: 282664 - DNA, 17 bp, Homo sapiens
gtggctcattcttttca

SEQ ID NO: 282665 - DNA, 20 bp, Homo sapiens
gtggctcctcccggtgccca

SEQ ID NO: 282666 - DNA, 21 bp, Homo sapiens
gtggctctacaactgagtcct

SEQ ID NO: 282667 - DNA, 17 bp, Homo sapiens
gtggctctgggtgaggt

SEQ ID NO: 282668 - DNA, 18 bp, Homo sapiens
gtggctgcggcacccttg

SEQ ID NO: 282669 - DNA, 15 bp, Homo sapiens
gtggctggcgcctgt

SEQ ID NO: 282670 - DNA, 14 bp, Homo sapiens
gtggctggggctgg

SEQ ID NO: 282671 - DNA, 18 bp, Homo sapiens
gtggctggggctggcacg

SEQ ID NO: 282672 - DNA, 22 bp, Homo sapiens
gtggctgggggcaggagggccc

SEQ ID NO: 282673 - DNA, 22 bp, Homo sapiens
gtggctgggtgggcccagaact

SEQ ID NO: 282674 - DNA, 17 bp, Homo sapiens
gtggctgggtggtcagc

SEQ ID NO: 282675 - DNA, 15 bp, Homo sapiens
gtggctggtccaggg

SEQ ID NO: 282676 - DNA, 17 bp, Homo sapiens
gtggctggtccagggct

SEQ ID NO: 282677 - DNA, 14 bp, Homo sapiens
gtggctggtgtccc

SEQ ID NO: 282678 - DNA, 23 bp, Homo sapiens
gtggctgtcctcttaagacacta

SEQ ID NO: 282679 - DNA, 13 bp, Homo sapiens
gtggctgtgatta

SEQ ID NO: 282680 - DNA, 12 bp, Homo sapiens
gtggctgtggca

SEQ ID NO: 282681 - DNA, 16 bp, Homo sapiens
gtggctgtggcacaga

SEQ ID NO: 282682 - DNA, 20 bp, Homo sapiens
gtggcttcccgctcagccct

SEQ ID NO: 282683 - DNA, 16 bp, Homo sapiens
gtggcttcggcctgct

SEQ ID NO: 282684 - DNA, 13 bp, Homo sapiens
gtggcttcttcaa

SEQ ID NO: 282685 - DNA, 18 bp, Homo sapiens
gtggcttggaacatttgg

SEQ ID NO: 282686 - DNA, 18 bp, Homo sapiens
gtggcttggagcagaggt

SEQ ID NO: 282687 - DNA, 17 bp, Homo sapiens
gtggcttttgccccaga

SEQ ID NO: 282688 - DNA, 24 bp, Homo sapiens
gtgggaactcgaacttgaagcaca

SEQ ID NO: 282689 - DNA, 17 bp, Homo sapiens
gtgggaagagggcaggg

SEQ ID NO: 282690 - DNA, 20 bp, Homo sapiens
gtgggaaggacttggcgcgc

SEQ ID NO: 282691 - DNA, 15 bp, Homo sapiens
gtgggacacagagac

SEQ ID NO: 282692 - DNA, 13 bp, Homo sapiens
gtgggagaaggga

SEQ ID NO: 282693 - DNA, 17 bp, Homo sapiens
gtgggagaagggacagc

SEQ ID NO: 282694 - DNA, 16 bp, Homo sapiens
gtgggagaagtggccc

SEQ ID NO: 282695 - DNA, 10 bp, Homo sapiens
gtgggagagg

SEQ ID NO: 282696 - DNA, 17 bp, Homo sapiens
gtgggagaggaagccac

SEQ ID NO: 282697 - DNA, 12 bp, Homo sapiens
gtgggagatgaa

SEQ ID NO: 282698 - DNA, 14 bp, Homo sapiens
gtgggagcccagca

SEQ ID NO: 282699 - DNA, 17 bp, Homo sapiens
gtgggaggcccctggtg

SEQ ID NO: 282700 - DNA, 18 bp, Homo sapiens
gtgggagggcgaggcggg

SEQ ID NO: 282701 - DNA, 17 bp, Homo sapiens
gtgggaggtgagaccac

SEQ ID NO: 282702 - DNA, 22 bp, Homo sapiens
gtgggagtcaagtgtgcctgct

SEQ ID NO: 282703 - DNA, 12 bp, Homo sapiens
gtgggagtccac

SEQ ID NO: 282704 - DNA, 18 bp, Homo sapiens
gtgggagtccactttcct

SEQ ID NO: 282705 - DNA, 12 bp, Homo sapiens
gtgggagtggga

SEQ ID NO: 282706 - DNA, 17 bp, Homo sapiens
gtgggagtgggagagga

SEQ ID NO: 282707 - DNA, 16 bp, Homo sapiens
gtgggatcaaagctag

SEQ ID NO: 282708 - DNA, 13 bp, Homo sapiens
gtgggatccagag

SEQ ID NO: 282709 - DNA, 20 bp, Homo sapiens
gtgggatccagagagaagca

SEQ ID NO: 282710 - DNA, 13 bp, Homo sapiens
gtgggatcctccc

SEQ ID NO: 282711 - DNA, 16 bp, Homo sapiens
gtgggatcctccctca

SEQ ID NO: 282712 - DNA, 23 bp, Homo sapiens
gtgggatgttcagcactgtccct

SEQ ID NO: 282713 - DNA, 13 bp, Homo sapiens
gtgggattattca

SEQ ID NO: 282714 - DNA, 17 bp, Homo sapiens
gtgggattcaggaatgg

SEQ ID NO: 282715 - DNA, 17 bp, Homo sapiens
gtgggcaaacaggcagt

SEQ ID NO: 282716 - DNA, 17 bp, Homo sapiens
gtgggcaccaagagcca

SEQ ID NO: 282717 - DNA, 15 bp, Homo sapiens
gtgggcagctgagga

SEQ ID NO: 282718 - DNA, 12 bp, Homo sapiens
gtgggccagccc

SEQ ID NO: 282719 - DNA, 22 bp, Homo sapiens
gtgggcccagaactgcccccac

SEQ ID NO: 282720 - DNA, 22 bp, Homo sapiens
gtgggcctctggtttggggcga

SEQ ID NO: 282721 - DNA, 23 bp, Homo sapiens
gtgggcctctggtttggggcgag

SEQ ID NO: 282722 - DNA, 13 bp, Homo sapiens
gtgggcctggcct

SEQ ID NO: 282723 - DNA, 14 bp, Homo sapiens
gtgggcctggcctg

SEQ ID NO: 282724 - DNA, 19 bp, Homo sapiens
gtgggcctggcctgagctg

SEQ ID NO: 282725 - DNA, 19 bp, Homo sapiens
gtgggcggatcacaaggtc

SEQ ID NO: 282726 - DNA, 13 bp, Homo sapiens
gtgggcggcagag

SEQ ID NO: 282727 - DNA, 19 bp, Homo sapiens
gtgggctctggctccctgg

SEQ ID NO: 282728 - DNA, 16 bp, Homo sapiens
gtggtttcagaaaggg

SEQ ID NO: 282729 - DNA, 15 bp, Homo sapiens
gtggtttgtgagcct

SEQ ID NO: 282730 - DNA, 21 bp, Homo sapiens
gtggtttgtgagccttgctgc

SEQ ID NO: 282731 - DNA, 23 bp, Homo sapiens
gtggtttgttatcagtacaattc

SEQ ID NO: 282732 - DNA, 16 bp, Homo sapiens
gtggttttcccctccc

SEQ ID NO: 282733 - DNA, 20 bp, Homo sapiens
gtggttttcccctccctggg

SEQ ID NO: 282734 - DNA, 19 bp, Homo sapiens
gtggttttcttttgccatg

SEQ ID NO: 282735 - DNA, 16 bp, Homo sapiens
gtggtttttcttttct

SEQ ID NO: 282736 - DNA, 15 bp, Homo sapiens
gtgtaaaatgtgaag

SEQ ID NO: 282737 - DNA, 19 bp, Homo sapiens
gtgtaaccagcagtcacag

SEQ ID NO: 282738 - DNA, 12 bp, Homo sapiens
gtgtaagagaat

SEQ ID NO: 282739 - DNA, 14 bp, Homo sapiens
gtgtaatatcattt

SEQ ID NO: 282740 - DNA, 17 bp, Homo sapiens
gtgtaatatcatttcat

SEQ ID NO: 282741 - DNA, 13 bp, Homo sapiens
gtgtaatattctc

SEQ ID NO: 282742 - DNA, 19 bp, Homo sapiens
gtgtaatccaggggtgtag

SEQ ID NO: 282743 - DNA, 17 bp, Homo sapiens
gtgtacatcatgttatt

SEQ ID NO: 282744 - DNA, 16 bp, Homo sapiens
gtgtacgtggagaggg

SEQ ID NO: 282745 - DNA, 20 bp, Homo sapiens
gtgtactatggctgtatttt

SEQ ID NO: 282746 - DNA, 21 bp, Homo sapiens
gtgtagactggccatgcaagt

SEQ ID NO: 282747 - DNA, 19 bp, Homo sapiens
gtgtagatgtagcattgtt

SEQ ID NO: 282748 - DNA, 14 bp, Homo sapiens
gtgtagccaggaag

SEQ ID NO: 282749 - DNA, 22 bp, Homo sapiens
gtgtagtggaagagcagcctga

SEQ ID NO: 282750 - DNA, 23 bp, Homo sapiens
gtgtagtggaagagcagcctgat

SEQ ID NO: 282751 - DNA, 18 bp, Homo sapiens
gtgtataaaaataaaaaa

SEQ ID NO: 282752 - DNA, 15 bp, Homo sapiens
gtgtataccacctgt

SEQ ID NO: 282753 - DNA, 16 bp, Homo sapiens
gtgtataccacctgta

SEQ ID NO: 282754 - DNA, 19 bp, Homo sapiens
gtgtataccacctgtacat

SEQ ID NO: 282755 - DNA, 12 bp, Homo sapiens
gtgtatatcatg

SEQ ID NO: 282756 - DNA, 22 bp, Homo sapiens
gtgtatattatcttctggtgca

SEQ ID NO: 282757 - DNA, 21 bp, Homo sapiens
gtgtatcccccccctgtatag

SEQ ID NO: 282758 - DNA, 22 bp, Homo sapiens
gtgtatcccccccctgtatagt

SEQ ID NO: 282759 - DNA, 15 bp, Homo sapiens
gtgtatctaattccc

SEQ ID NO: 282760 - DNA, 20 bp, Homo sapiens
gtgtatctcgaagtcttcca

SEQ ID NO: 282761 - DNA, 20 bp, Homo sapiens
gtgtatggagagaaaacaga

SEQ ID NO: 282762 - DNA, 18 bp, Homo sapiens
gtgtatgtgcgtgtgtgc

SEQ ID NO: 282763 - DNA, 16 bp, Homo sapiens
gtgtatgtgtaatgat

SEQ ID NO: 282764 - DNA, 22 bp, Homo sapiens
gtgtattctgtggattctatat

SEQ ID NO: 282765 - DNA, 17 bp, Homo sapiens
gtgtatttactgtacta

SEQ ID NO: 282766 - DNA, 21 bp, Homo sapiens
gtgtatttattttcctcccca

SEQ ID NO: 282767 - DNA, 22 bp, Homo sapiens
gtgtatttctattttgcagcag

SEQ ID NO: 282768 - DNA, 14 bp, Homo sapiens
gtgtatttttattt

SEQ ID NO: 282769 - DNA, 14 bp, Homo sapiens
gtgtcaactccagg

SEQ ID NO: 282770 - DNA, 22 bp, Homo sapiens
gtgtcaactttcatttgaaagt

SEQ ID NO: 282771 - DNA, 15 bp, Homo sapiens
gtgtcacagaggcag

SEQ ID NO: 282772 - DNA, 23 bp, Homo sapiens
gtgtcacagaggcagtggcagca

SEQ ID NO: 282773 - DNA, 15 bp, Homo sapiens
gtgtcagagtgttgt

SEQ ID NO: 282774 - DNA, 16 bp, Homo sapiens
gtgtcatcagaagata

SEQ ID NO: 282775 - DNA, 23 bp, Homo sapiens
gtgtcatgtcaaagtgaaagaca

SEQ ID NO: 282776 - DNA, 20 bp, Homo sapiens
gtgtccagagacatgggcct

SEQ ID NO: 282777 - DNA, 22 bp, Homo sapiens
gtgtccagcagctgcgggtctg

SEQ ID NO: 282778 - DNA, 16 bp, Homo sapiens
gtgtccatgtgtgtgc

SEQ ID NO: 282779 - DNA, 14 bp, Homo sapiens
gtgtccatttcaag

SEQ ID NO: 282780 - DNA, 17 bp, Homo sapiens
gtgtcccaaggagctga

SEQ ID NO: 282781 - DNA, 20 bp, Homo sapiens
gtgtccccaacgtcccctcc

SEQ ID NO: 282782 - DNA, 22 bp, Homo sapiens
gtgtccccagcccactggatca

SEQ ID NO: 282783 - DNA, 20 bp, Homo sapiens
gttccaaagagaaggcctgg

SEQ ID NO: 282784 - DNA, 14 bp, Homo sapiens
gttccaagacattg

SEQ ID NO: 282785 - DNA, 16 bp, Homo sapiens
gttccaagacattgtc

SEQ ID NO: 282786 - DNA, 21 bp, Homo sapiens
gttccaagacattgtcaataa

SEQ ID NO: 282787 - DNA, 9 bp, Homo sapiens
gttccaagt

SEQ ID NO: 282788 - DNA, 18 bp, Homo sapiens
gttccaagtgtgtgtgca

SEQ ID NO: 282789 - DNA, 19 bp, Homo sapiens
gttccaagtgtgtgtgcaa

SEQ ID NO: 282790 - DNA, 21 bp, Homo sapiens
gttccaagtgtgtgtgcaatg

SEQ ID NO: 282791 - DNA, 15 bp, Homo sapiens
gttccaatcctggct

SEQ ID NO: 282792 - DNA, 23 bp, Homo sapiens
gttccaatcctggctctgtggct

SEQ ID NO: 282793 - DNA, 21 bp, Homo sapiens
gttccacgtccccctggggct

SEQ ID NO: 282794 - DNA, 15 bp, Homo sapiens
gttccactcagcttg

SEQ ID NO: 282795 - DNA, 23 bp, Homo sapiens
gttccactggagaattgaaaagg

SEQ ID NO: 282796 - DNA, 16 bp, Homo sapiens
gttccacttagagaac

SEQ ID NO: 282797 - DNA, 20 bp, Homo sapiens
gttccagaacgtctctcacc

SEQ ID NO: 282798 - DNA, 21 bp, Homo sapiens
gttccagaacgtctctcacct

SEQ ID NO: 282799 - DNA, 11 bp, Homo sapiens
gttccagacag

SEQ ID NO: 282800 - DNA, 22 bp, Homo sapiens
gttccagacagagtggatctgg

SEQ ID NO: 282801 - DNA, 16 bp, Homo sapiens
gttccagacagggtgg

SEQ ID NO: 282802 - DNA, 20 bp, Homo sapiens
gttccagacagggtggggct

SEQ ID NO: 282803 - DNA, 17 bp, Homo sapiens
gttccagcttcatctac

SEQ ID NO: 282804 - DNA, 19 bp, Homo sapiens
gttccatccaccaccttgc

SEQ ID NO: 282805 - DNA, 14 bp, Homo sapiens
gttccatgcctgag

SEQ ID NO: 282806 - DNA, 14 bp, Homo sapiens
gttccattcttggt

SEQ ID NO: 282807 - DNA, 14 bp, Homo sapiens
gttcccaataaaag

SEQ ID NO: 282808 - DNA, 10 bp, Homo sapiens
gttcccacaa

SEQ ID NO: 282809 - DNA, 16 bp, Homo sapiens
gttcccacctctgagg

SEQ ID NO: 282810 - DNA, 14 bp, Homo sapiens
gttcccccagccct

SEQ ID NO: 282811 - DNA, 15 bp, Homo sapiens
gttcccccagccctg

SEQ ID NO: 282812 - DNA, 16 bp, Homo sapiens
gttcccccagccctgt

SEQ ID NO: 282813 - DNA, 18 bp, Homo sapiens
gttcccccaggaccctga

SEQ ID NO: 282814 - DNA, 17 bp, Homo sapiens
gttcccctaaccctaca

SEQ ID NO: 282815 - DNA, 15 bp, Homo sapiens
gttcccctgttcact

SEQ ID NO: 282816 - DNA, 19 bp, Homo sapiens
gttcccggagcacagccct

SEQ ID NO: 282817 - DNA, 21 bp, Homo sapiens
gttcccggagcacagccctgg

SEQ ID NO: 282818 - DNA, 22 bp, Homo sapiens
gttcccggagcacagccctggg

SEQ ID NO: 282819 - DNA, 23 bp, Homo sapiens
gttcccggagcacagccctggga

SEQ ID NO: 282820 - DNA, 17 bp, Homo sapiens
gttccctctccctgttg

SEQ ID NO: 282821 - DNA, 16 bp, Homo sapiens
gttccctctgctcctg

SEQ ID NO: 282822 - DNA, 21 bp, Homo sapiens
gttccctctgctcctggagcc

SEQ ID NO: 282823 - DNA, 17 bp, Homo sapiens
gttccctcttccctggt

SEQ ID NO: 282824 - DNA, 15 bp, Homo sapiens
gttccctgcaccctg

SEQ ID NO: 282825 - DNA, 16 bp, Homo sapiens
gttccctgcaccctgg

SEQ ID NO: 282826 - DNA, 12 bp, Homo sapiens
gttccctgctgg

SEQ ID NO: 282827 - DNA, 17 bp, Homo sapiens
gttccctgtcagaggct

SEQ ID NO: 282828 - DNA, 14 bp, Homo sapiens
gttcccttggcctc

SEQ ID NO: 282829 - DNA, 18 bp, Homo sapiens
gttcccttggcctcagaa

SEQ ID NO: 282830 - DNA, 22 bp, Homo sapiens
gttccctttccttccatcccta

SEQ ID NO: 282831 - DNA, 19 bp, Homo sapiens
gttccggaatcctgtcctc

SEQ ID NO: 282832 - DNA, 22 bp, Homo sapiens
gttccggaatcctgtcctcagc

SEQ ID NO: 282833 - DNA, 13 bp, Homo sapiens
gttcctccagcaa

SEQ ID NO: 282834 - DNA, 20 bp, Homo sapiens
gttcctgccaggctctccct

SEQ ID NO: 282835 - DNA, 18 bp, Homo sapiens
gttcctgcccccgccctg

SEQ ID NO: 282836 - DNA, 16 bp, Homo sapiens
gttcctgccttctctt

SEQ ID NO: 282837 - DNA, 12 bp, Homo sapiens
gttcctggcaat

SEQ ID NO: 282838 - DNA, 13 bp, Homo sapiens
gttcctggcaata

SEQ ID NO: 282839 - DNA, 16 bp, Homo sapiens
gttccttgctagccct

SEQ ID NO: 282840 - DNA, 15 bp, Homo sapiens
gttcctttttctttt

SEQ ID NO: 282841 - DNA, 16 bp, Homo sapiens
gttcgagaccagtctg

SEQ ID NO: 282842 - DNA, 19 bp, Homo sapiens
gttcgtggagccacaggca

SEQ ID NO: 282843 - DNA, 23 bp, Homo sapiens
gttctaaagatggaaaaaccacc

SEQ ID NO: 282844 - DNA, 15 bp, Homo sapiens
gttctacaatctatt

SEQ ID NO: 282845 - DNA, 15 bp, Homo sapiens
gttctacttgatatt

SEQ ID NO: 282846 - DNA, 20 bp, Homo sapiens
gttctagacgcccctcccaa

SEQ ID NO: 282847 - DNA, 19 bp, Homo sapiens
gttctagacttccccatcc

SEQ ID NO: 282848 - DNA, 15 bp, Homo sapiens
gttctatgatttgta

SEQ ID NO: 282849 - DNA, 22 bp, Homo sapiens
gttctattaatcacctctctgt

SEQ ID NO: 282850 - DNA, 14 bp, Homo sapiens
gttctatttaagtg

SEQ ID NO: 282851 - DNA, 15 bp, Homo sapiens
gttctcaaaccctgt

SEQ ID NO: 282852 - DNA, 17 bp, Homo sapiens
gttctcaatgcttttct

SEQ ID NO: 282853 - DNA, 23 bp, Homo sapiens
gttctcaatgtgaaaaatgtgtc

SEQ ID NO: 282854 - DNA, 15 bp, Homo sapiens
gttctcagagctcca

SEQ ID NO: 282855 - DNA, 19 bp, Homo sapiens
gttctcagagctccacaga

SEQ ID NO: 282856 - DNA, 21 bp, Homo sapiens
gttctcatccacagaggccag

SEQ ID NO: 282857 - DNA, 22 bp, Homo sapiens
gttctccacccaccagtcaggg

SEQ ID NO: 282858 - DNA, 16 bp, Homo sapiens
gttctcccatgggggc

SEQ ID NO: 282859 - DNA, 23 bp, Homo sapiens
gttctcccatgggggctccagac

SEQ ID NO: 282860 - DNA, 18 bp, Homo sapiens
gttctcctccaaatgctg

SEQ ID NO: 282861 - DNA, 17 bp, Homo sapiens
gttctcctctcccctct

SEQ ID NO: 282862 - DNA, 15 bp, Homo sapiens
gttctcctgatttga

SEQ ID NO: 282863 - DNA, 17 bp, Homo sapiens
gttctcgtgacccagtg

SEQ ID NO: 282864 - DNA, 19 bp, Homo sapiens
gttctcgtgacccagtggc

SEQ ID NO: 282865 - DNA, 22 bp, Homo sapiens
gttctctacctaatatgttctg

SEQ ID NO: 282866 - DNA, 15 bp, Homo sapiens
gttctctctatggta

SEQ ID NO: 282867 - DNA, 21 bp, Homo sapiens
gttctctcttggtctctttct

SEQ ID NO: 282868 - DNA, 22 bp, Homo sapiens
gttctctcttggtctctttctt

SEQ ID NO: 282869 - DNA, 15 bp, Homo sapiens
gttctgaaaactgtt

SEQ ID NO: 282870 - DNA, 21 bp, Homo sapiens
gttctgaaatattttaccact

SEQ ID NO: 282871 - DNA, 19 bp, Homo sapiens
gttctgaaggtgcccagga

SEQ ID NO: 282872 - DNA, 15 bp, Homo sapiens
gttctgaataatttc

SEQ ID NO: 282873 - DNA, 18 bp, Homo sapiens
gttctgaataatttctta

SEQ ID NO: 282874 - DNA, 21 bp, Homo sapiens
gttctgacattaacagttttc

SEQ ID NO: 282875 - DNA, 21 bp, Homo sapiens
gttctgacctcatgagtgtca

SEQ ID NO: 282876 - DNA, 17 bp, Homo sapiens
gttctgagctataacat

SEQ ID NO: 282877 - DNA, 13 bp, Homo sapiens
gttctgattagaa

SEQ ID NO: 282878 - DNA, 16 bp, Homo sapiens
gttctgattagaaatg

SEQ ID NO: 282879 - DNA, 21 bp, Homo sapiens
gttctgcaaatagaaaacagg

SEQ ID NO: 282880 - DNA, 19 bp, Homo sapiens
gttctgccacttgcactgt

SEQ ID NO: 282881 - DNA, 21 bp, Homo sapiens
gttctgccacttgcactgtgc

SEQ ID NO: 282882 - DNA, 17 bp, Homo sapiens
gttctggactctgcccc

SEQ ID NO: 282883 - DNA, 16 bp, Homo sapiens
gttctggcctcagacc

SEQ ID NO: 282884 - DNA, 17 bp, Homo sapiens
gttctggcctcagacca

SEQ ID NO: 282885 - DNA, 14 bp, Homo sapiens
gttctggtggcccc

SEQ ID NO: 282886 - DNA, 22 bp, Homo sapiens
gttctggtggccccagctgtga

SEQ ID NO: 282887 - DNA, 10 bp, Homo sapiens
gttctgtatt

SEQ ID NO: 282888 - DNA, 11 bp, Homo sapiens
gttctgtattg

SEQ ID NO: 282889 - DNA, 17 bp, Homo sapiens
gttctgtgcctcccccc

SEQ ID NO: 282890 - DNA, 18 bp, Homo sapiens
gttctgtgcctcccccca

SEQ ID NO: 282891 - DNA, 19 bp, Homo sapiens
gttctgtggttttcccctc

SEQ ID NO: 282892 - DNA, 20 bp, Homo sapiens
gttctgttaaatatttttgt

SEQ ID NO: 282893 - DNA, 16 bp, Homo sapiens
gttctgttcatcctac

SEQ ID NO: 282894 - DNA, 23 bp, Homo sapiens
gttctgtttcccattactttaat

SEQ ID NO: 282895 - DNA, 17 bp, Homo sapiens
gttctgtttgttaaaac

SEQ ID NO: 282896 - DNA, 23 bp, Homo sapiens
gttctgttttgttttgtttttta

SEQ ID NO: 282897 - DNA, 22 bp, Homo sapiens
gttcttagagcagattctagca

SEQ ID NO: 282898 - DNA, 19 bp, Homo sapiens
taaacaaactgtgtaactg

SEQ ID NO: 282899 - DNA, 18 bp, Homo sapiens
taaacaaagtgactgttt

SEQ ID NO: 282900 - DNA, 15 bp, Homo sapiens
taaacacattgaatg

SEQ ID NO: 282901 - DNA, 18 bp, Homo sapiens
taaacacctgacacatct

SEQ ID NO: 282902 - DNA, 16 bp, Homo sapiens
taaacactcagctgtt

SEQ ID NO: 282903 - DNA, 18 bp, Homo sapiens
taaacagatgtccctgaa

SEQ ID NO: 282904 - DNA, 18 bp, Homo sapiens
taaacagcaaaagttctt

SEQ ID NO: 282905 - DNA, 23 bp, Homo sapiens
taaacagcttcatgcctttgtaa

SEQ ID NO: 282906 - DNA, 15 bp, Homo sapiens
taaacagtgtttatg

SEQ ID NO: 282907 - DNA, 16 bp, Homo sapiens
taaacagtgtttatga

SEQ ID NO: 282908 - DNA, 16 bp, Homo sapiens
taaacatccttgtaca

SEQ ID NO: 282909 - DNA, 13 bp, Homo sapiens
taaacatgaattt

SEQ ID NO: 282910 - DNA, 20 bp, Homo sapiens
taaacatgaatttaatgtct

SEQ ID NO: 282911 - DNA, 15 bp, Homo sapiens
taaacatgtgtttta

SEQ ID NO: 282912 - DNA, 20 bp, Homo sapiens
taaacattaaacactgtaat

SEQ ID NO: 282913 - DNA, 15 bp, Homo sapiens
taaacattcatattt

SEQ ID NO: 282914 - DNA, 15 bp, Homo sapiens
taaacattcctccag

SEQ ID NO: 282915 - DNA, 21 bp, Homo sapiens
taaacattcctccagcctccc

SEQ ID NO: 282916 - DNA, 14 bp, Homo sapiens
taaacccagaacca

SEQ ID NO: 282917 - DNA, 14 bp, Homo sapiens
taaacccatctgta

SEQ ID NO: 282918 - DNA, 18 bp, Homo sapiens
taaacccatctgtaatat

SEQ ID NO: 282919 - DNA, 20 bp, Homo sapiens
taaaccccacctttattcct

SEQ ID NO: 282920 - DNA, 21 bp, Homo sapiens
taaacctaatgtctgtataaa

SEQ ID NO: 282921 - DNA, 23 bp, Homo sapiens
taaaccttaaatgaaaaaaatga

SEQ ID NO: 282922 - DNA, 18 bp, Homo sapiens
taaaccttgtttctttct

SEQ ID NO: 282923 - DNA, 21 bp, Homo sapiens
taaaccttgtttctttctgaa

SEQ ID NO: 282924 - DNA, 22 bp, Homo sapiens
taaacgtttcagtaataaaaca

SEQ ID NO: 282925 - DNA, 12 bp, Homo sapiens
taaactaacctt

SEQ ID NO: 282926 - DNA, 11 bp, Homo sapiens
taaactactga

SEQ ID NO: 282927 - DNA, 17 bp, Homo sapiens
taaactatcagtttgtc

SEQ ID NO: 282928 - DNA, 15 bp, Homo sapiens
taaactatttgtctt

SEQ ID NO: 282929 - DNA, 15 bp, Homo sapiens
taaactcaaaactta

SEQ ID NO: 282930 - DNA, 20 bp, Homo sapiens
taaactcaaaacttaacata

SEQ ID NO: 282931 - DNA, 14 bp, Homo sapiens
taaactctaaacat

SEQ ID NO: 282932 - DNA, 22 bp, Homo sapiens
taaactctaaacattaatcaat

SEQ ID NO: 282933 - DNA, 15 bp, Homo sapiens
taaactctcctttga

SEQ ID NO: 282934 - DNA, 19 bp, Homo sapiens
taaactgactttttccccc

SEQ ID NO: 282935 - DNA, 20 bp, Homo sapiens
taaactgactttttcccccc

SEQ ID NO: 282936 - DNA, 16 bp, Homo sapiens
taaactgccctgtcta

SEQ ID NO: 282937 - DNA, 11 bp, Homo sapiens
taaactgtgag

SEQ ID NO: 282938 - DNA, 13 bp, Homo sapiens
taaactgtgagat

SEQ ID NO: 282939 - DNA, 14 bp, Homo sapiens
taaactgtgagata

SEQ ID NO: 282940 - DNA, 20 bp, Homo sapiens
taaactgtgagataaatatc

SEQ ID NO: 282941 - DNA, 17 bp, Homo sapiens
taaactgtgtctgtccc

SEQ ID NO: 282942 - DNA, 18 bp, Homo sapiens
taaactgttatgagtagt

SEQ ID NO: 282943 - DNA, 15 bp, Homo sapiens
taaactgttttcatg

SEQ ID NO: 282944 - DNA, 14 bp, Homo sapiens
taaacttaacttta

SEQ ID NO: 282945 - DNA, 20 bp, Homo sapiens
taaacttagaataaaattgt

SEQ ID NO: 282946 - DNA, 22 bp, Homo sapiens
taaacttagtgcggacaagttt

SEQ ID NO: 282947 - DNA, 16 bp, Homo sapiens
taaacttataaatcat

SEQ ID NO: 282948 - DNA, 17 bp, Homo sapiens
taaacttcagcaaccct

SEQ ID NO: 282949 - DNA, 14 bp, Homo sapiens
taaacttgtcagaa

SEQ ID NO: 282950 - DNA, 16 bp, Homo sapiens
taaactttcagaactg

SEQ ID NO: 282951 - DNA, 12 bp, Homo sapiens
taaactttgtca

SEQ ID NO: 282952 - DNA, 14 bp, Homo sapiens
taaagaaacacttt

SEQ ID NO: 282953 - DNA, 15 bp, Homo sapiens
taaagaaacagcttt

SEQ ID NO: 282954 - DNA, 19 bp, Homo sapiens
taaagaaacagctttcaag

SEQ ID NO: 282955 - DNA, 17 bp, Homo sapiens
taaagaaaccttttaaa

SEQ ID NO: 282956 - DNA, 17 bp, Homo sapiens
taaagaaagtcgaatta

SEQ ID NO: 282957 - DNA, 21 bp, Homo sapiens
taaagaaagtcgaattaatag

SEQ ID NO: 282958 - DNA, 15 bp, Homo sapiens
taaagaaagtgaaaa

SEQ ID NO: 282959 - DNA, 14 bp, Homo sapiens
taaagaagaaaata

SEQ ID NO: 282960 - DNA, 17 bp, Homo sapiens
taaagaagaaaataacc

SEQ ID NO: 282961 - DNA, 14 bp, Homo sapiens
taaagaagacacac

SEQ ID NO: 282962 - DNA, 15 bp, Homo sapiens
taaagaataatatgc

SEQ ID NO: 282963 - DNA, 15 bp, Homo sapiens
taaagaatcattatt

SEQ ID NO: 282964 - DNA, 17 bp, Homo sapiens
taaagagctaggaaaga

SEQ ID NO: 282965 - DNA, 18 bp, Homo sapiens
taaagagctaggaaagag

SEQ ID NO: 282966 - DNA, 18 bp, Homo sapiens
taaagaggcgtcttgtat

SEQ ID NO: 282967 - DNA, 13 bp, Homo sapiens
taaagatattatt

SEQ ID NO: 282968 - DNA, 16 bp, Homo sapiens
taaagatattattcac

SEQ ID NO: 282969 - DNA, 21 bp, Homo sapiens
taaagatgcaaggaccaggac

SEQ ID NO: 282970 - DNA, 22 bp, Homo sapiens
taaagatgcaaggaccaggact

SEQ ID NO: 282971 - DNA, 19 bp, Homo sapiens
taaagcaagctcacttgct

SEQ ID NO: 282972 - DNA, 21 bp, Homo sapiens
taaagcaagctcacttgcttt

SEQ ID NO: 282973 - DNA, 13 bp, Homo sapiens
taaagcaataagt

SEQ ID NO: 282974 - DNA, 20 bp, Homo sapiens
taaagcactattgtttagat

SEQ ID NO: 282975 - DNA, 20 bp, Homo sapiens
taaagcagagggactttgta

SEQ ID NO: 282976 - DNA, 16 bp, Homo sapiens
taaagcataagtatac

SEQ ID NO: 282977 - DNA, 21 bp, Homo sapiens
taaagcataagtatacagttc

SEQ ID NO: 282978 - DNA, 12 bp, Homo sapiens
taaagccctctt

SEQ ID NO: 282979 - DNA, 20 bp, Homo sapiens
taaagcctgagtttgctttc

SEQ ID NO: 282980 - DNA, 17 bp, Homo sapiens
taaagcgatatacagat

SEQ ID NO: 282981 - DNA, 17 bp, Homo sapiens
taaagcgcaaatgaatt

SEQ ID NO: 282982 - DNA, 20 bp, Homo sapiens
taaagctaaaatgattttat

SEQ ID NO: 282983 - DNA, 21 bp, Homo sapiens
taaagctggacaagaagctgc

SEQ ID NO: 282984 - DNA, 22 bp, Homo sapiens
taaagctggacaagaagctgct

SEQ ID NO: 282985 - DNA, 23 bp, Homo sapiens
taaagctggacaagaagctgcta

SEQ ID NO: 282986 - DNA, 17 bp, Homo sapiens
taaaggaattaaactaa

SEQ ID NO: 282987 - DNA, 19 bp, Homo sapiens
taaaggcaccatctaatag

SEQ ID NO: 282988 - DNA, 15 bp, Homo sapiens
taaaggcagtccaga

SEQ ID NO: 282989 - DNA, 18 bp, Homo sapiens
taaaggcagtccagagct

SEQ ID NO: 282990 - DNA, 20 bp, Homo sapiens
taaaggcagtccagagcttt

SEQ ID NO: 282991 - DNA, 15 bp, Homo sapiens
taaaggccatgtgaa

SEQ ID NO: 282992 - DNA, 19 bp, Homo sapiens
taaaggcctggaaccaggg

SEQ ID NO: 282993 - DNA, 20 bp, Homo sapiens
taaaggggacagatcttgag

SEQ ID NO: 282994 - DNA, 18 bp, Homo sapiens
taaaggggagaaactgaa

SEQ ID NO: 282995 - DNA, 22 bp, Homo sapiens
taaaggggagaaactgaaagtg

SEQ ID NO: 282996 - DNA, 14 bp, Homo sapiens
taaaggggggaggg

SEQ ID NO: 282997 - DNA, 15 bp, Homo sapiens
taaaggtcctgccct

SEQ ID NO: 282998 - DNA, 13 bp, Homo sapiens
taaagtaaagcta

SEQ ID NO: 282999 - DNA, 17 bp, Homo sapiens
taaagtaaagctaaaat

SEQ ID NO: 283000 - DNA, 15 bp, Homo sapiens
taaagtacctgtagt

SEQ ID NO: 283001 - DNA, 21 bp, Homo sapiens
taaagtacctgtagtgagaaa

SEQ ID NO: 283002 - DNA, 22 bp, Homo sapiens
taaagtacctgtagtgagaaac

SEQ ID NO: 283003 - DNA, 15 bp, Homo sapiens
taaagtatcatgcat

SEQ ID NO: 283004 - DNA, 14 bp, Homo sapiens
taaagtattccacc

SEQ ID NO: 283005 - DNA, 21 bp, Homo sapiens
taaagtattccaccttaaatt

SEQ ID NO: 283006 - DNA, 23 bp, Homo sapiens
taaagtattccaccttaaattaa

SEQ ID NO: 283007 - DNA, 19 bp, Homo sapiens
taaagtcttgctgtggtct

SEQ ID NO: 283008 - DNA, 13 bp, Homo sapiens
taaagtgcaattg

SEQ ID NO: 283009 - DNA, 16 bp, Homo sapiens
taaagtgttggtcttt

SEQ ID NO: 283010 - DNA, 18 bp, Homo sapiens
taaagttaaacattttta

SEQ ID NO: 283011 - DNA, 16 bp, Homo sapiens
taaagttactgatcac

SEQ ID NO: 283012 - DNA, 22 bp, Homo sapiens
taaagttccacttagagaacaa

SEQ ID NO: 283013 - DNA, 20 bp, Homo sapiens
taaagttccatgaagacaaa

SEQ ID NO: 283014 - DNA, 14 bp, Homo sapiens
taaagtttacagta

SEQ ID NO: 283015 - DNA, 15 bp, Homo sapiens
taaataaaaatagct

SEQ ID NO: 283016 - DNA, 14 bp, Homo sapiens
taaataaaaatgga

SEQ ID NO: 283017 - DNA, 14 bp, Homo sapiens
taaataaaactatt

SEQ ID NO: 283018 - DNA, 15 bp, Homo sapiens
taaataaaactattt

SEQ ID NO: 283019 - DNA, 16 bp, Homo sapiens
taaataaaactattta

SEQ ID NO: 283020 - DNA, 14 bp, Homo sapiens
taaataaaagcagc

SEQ ID NO: 283021 - DNA, 11 bp, Homo sapiens
taaataaaata

SEQ ID NO: 283022 - DNA, 12 bp, Homo sapiens
taaataaaataa

SEQ ID NO: 283023 - DNA, 14 bp, Homo sapiens
taaataaaataacc

SEQ ID NO: 283024 - DNA, 20 bp, Homo sapiens
taaataaacacatagattca

SEQ ID NO: 283025 - DNA, 16 bp, Homo sapiens
taaataaactcttcaa

SEQ ID NO: 283026 - DNA, 22 bp, Homo sapiens
taaataaactcttcaaggccaa

SEQ ID NO: 283027 - DNA, 15 bp, Homo sapiens
taaataaagaagaaa

SEQ ID NO: 283028 - DNA, 15 bp, Homo sapiens
taaataaagtatcat

SEQ ID NO: 283029 - DNA, 11 bp, Homo sapiens
taaataaatgt

SEQ ID NO: 283030 - DNA, 22 bp, Homo sapiens
taaataaatgtatcttattcac

SEQ ID NO: 283031 - DNA, 22 bp, Homo sapiens
taaataaattgcctcccttcct

SEQ ID NO: 283032 - DNA, 12 bp, Homo sapiens
taaataaattgt

SEQ ID NO: 283033 - DNA, 22 bp, Homo sapiens
taatgatgatgggaattgtgtg

SEQ ID NO: 283034 - DNA, 18 bp, Homo sapiens
taatgatgtgtcatatga

SEQ ID NO: 283035 - DNA, 13 bp, Homo sapiens
taatgatttttgt

SEQ ID NO: 283036 - DNA, 21 bp, Homo sapiens
taatgcaaaatttttttaatc

SEQ ID NO: 283037 - DNA, 16 bp, Homo sapiens
taatgcagacatttac

SEQ ID NO: 283038 - DNA, 19 bp, Homo sapiens
taatgcattaacttttgta

SEQ ID NO: 283039 - DNA, 13 bp, Homo sapiens
taatgctggagcg

SEQ ID NO: 283040 - DNA, 17 bp, Homo sapiens
taatgcttcaagtgttg

SEQ ID NO: 283041 - DNA, 19 bp, Homo sapiens
taatggaactgaccccctc

SEQ ID NO: 283042 - DNA, 14 bp, Homo sapiens
taatgggcctgccc

SEQ ID NO: 283043 - DNA, 16 bp, Homo sapiens
taatgggcctgcccaa

SEQ ID NO: 283044 - DNA, 19 bp, Homo sapiens
taatggtttactgctgtca

SEQ ID NO: 283045 - DNA, 19 bp, Homo sapiens
taatgtaaaattcatagca

SEQ ID NO: 283046 - DNA, 14 bp, Homo sapiens
taatgtaacttaat

SEQ ID NO: 283047 - DNA, 17 bp, Homo sapiens
taatgtaataactgtga

SEQ ID NO: 283048 - DNA, 15 bp, Homo sapiens
taatgtacagagtgg

SEQ ID NO: 283049 - DNA, 16 bp, Homo sapiens
taatgtagctattttt

SEQ ID NO: 283050 - DNA, 17 bp, Homo sapiens
taatgtaggactgtata

SEQ ID NO: 283051 - DNA, 14 bp, Homo sapiens
taatgtatcttatt

SEQ ID NO: 283052 - DNA, 21 bp, Homo sapiens
taatgtcttcatttcattgta

SEQ ID NO: 283053 - DNA, 16 bp, Homo sapiens
taatgtgaaggcccaa

SEQ ID NO: 283054 - DNA, 15 bp, Homo sapiens
taatgtgagacagca

SEQ ID NO: 283055 - DNA, 19 bp, Homo sapiens
taatgtgagacagcaagtt

SEQ ID NO: 283056 - DNA, 19 bp, Homo sapiens
taatgtgccccatgtccaa

SEQ ID NO: 283057 - DNA, 22 bp, Homo sapiens
taatgtgggaagaaacaaaccc

SEQ ID NO: 283058 - DNA, 20 bp, Homo sapiens
taatgtgtatttactgtact

SEQ ID NO: 283059 - DNA, 18 bp, Homo sapiens
taatgttaattaaagtaa

SEQ ID NO: 283060 - DNA, 12 bp, Homo sapiens
taatgttactga

SEQ ID NO: 283061 - DNA, 14 bp, Homo sapiens
taatgttactgatc

SEQ ID NO: 283062 - DNA, 21 bp, Homo sapiens
taatgttactgatcatgcatt

SEQ ID NO: 283063 - DNA, 23 bp, Homo sapiens
taatgttactgatcatgcattgt

SEQ ID NO: 283064 - DNA, 16 bp, Homo sapiens
taatgttatcctcttg

SEQ ID NO: 283065 - DNA, 22 bp, Homo sapiens
taatgttctctgggtaggtgtt

SEQ ID NO: 283066 - DNA, 14 bp, Homo sapiens
taatgttgttattt

SEQ ID NO: 283067 - DNA, 18 bp, Homo sapiens
taatgttgttatttaaag

SEQ ID NO: 283068 - DNA, 15 bp, Homo sapiens
taatgtttatgagcc

SEQ ID NO: 283069 - DNA, 18 bp, Homo sapiens
taatgtttatgagccaga

SEQ ID NO: 283070 - DNA, 12 bp, Homo sapiens
taatgtttgcta

SEQ ID NO: 283071 - DNA, 14 bp, Homo sapiens
taatgttttgtaca

SEQ ID NO: 283072 - DNA, 16 bp, Homo sapiens
taatgttttgtacaat

SEQ ID NO: 283073 - DNA, 15 bp, Homo sapiens
taatgttttttgaag

SEQ ID NO: 283074 - DNA, 22 bp, Homo sapiens
taattaaataaatcattaatac

SEQ ID NO: 283075 - DNA, 15 bp, Homo sapiens
taattaaatgaaata

SEQ ID NO: 283076 - DNA, 16 bp, Homo sapiens
taattaaatgaaatac

SEQ ID NO: 283077 - DNA, 16 bp, Homo sapiens
taattaaattttaatg

SEQ ID NO: 283078 - DNA, 20 bp, Homo sapiens
taattaacatataatatatg

SEQ ID NO: 283079 - DNA, 17 bp, Homo sapiens
taattaagctccttcag

SEQ ID NO: 283080 - DNA, 17 bp, Homo sapiens
taattaaggcagctgaa

SEQ ID NO: 283081 - DNA, 23 bp, Homo sapiens
taattaaggcagctgaaaagtaa

SEQ ID NO: 283082 - DNA, 11 bp, Homo sapiens
taattaatttc

SEQ ID NO: 283083 - DNA, 20 bp, Homo sapiens
taattagaaacacacttttg

SEQ ID NO: 283084 - DNA, 12 bp, Homo sapiens
taattagagcag

SEQ ID NO: 283085 - DNA, 22 bp, Homo sapiens
taattagagcagatgacccctc

SEQ ID NO: 283086 - DNA, 17 bp, Homo sapiens
taattaggggttgctaa

SEQ ID NO: 283087 - DNA, 18 bp, Homo sapiens
taattatcggaagcagtg

SEQ ID NO: 283088 - DNA, 19 bp, Homo sapiens
taattatcgggaacagtgt

SEQ ID NO: 283089 - DNA, 15 bp, Homo sapiens
taattatgtttacct

SEQ ID NO: 283090 - DNA, 20 bp, Homo sapiens
taattattaactacatttat

SEQ ID NO: 283091 - DNA, 14 bp, Homo sapiens
taattattattctt

SEQ ID NO: 283092 - DNA, 12 bp, Homo sapiens
taattattattt

SEQ ID NO: 283093 - DNA, 13 bp, Homo sapiens
taattattattta

SEQ ID NO: 283094 - DNA, 22 bp, Homo sapiens
taattattatttatatatgtat

SEQ ID NO: 283095 - DNA, 22 bp, Homo sapiens
taattcagattaggacacagtg

SEQ ID NO: 283096 - DNA, 17 bp, Homo sapiens
taattcattaaaagttt

SEQ ID NO: 283097 - DNA, 16 bp, Homo sapiens
taattcccattttgca

SEQ ID NO: 283098 - DNA, 17 bp, Homo sapiens
taattcccattttgcaa

SEQ ID NO: 283099 - DNA, 19 bp, Homo sapiens
taattcccattttgcaaaa

SEQ ID NO: 283100 - DNA, 21 bp, Homo sapiens
taattcccattttgcaaaatt

SEQ ID NO: 283101 - DNA, 19 bp, Homo sapiens
tacattttcagtaccaaag

SEQ ID NO: 283102 - DNA, 15 bp, Homo sapiens
tacatttttacaata

SEQ ID NO: 283103 - DNA, 19 bp, Homo sapiens
tacatttttacaataaata

SEQ ID NO: 283104 - DNA, 21 bp, Homo sapiens
tacatttttacaataaataat

SEQ ID NO: 283105 - DNA, 20 bp, Homo sapiens
tacatttttgtctttatctc

SEQ ID NO: 283106 - DNA, 18 bp, Homo sapiens
taccaaagttttatcaag

SEQ ID NO: 283107 - DNA, 18 bp, Homo sapiens
taccaaatccacaagcca

SEQ ID NO: 283108 - DNA, 14 bp, Homo sapiens
taccaaatgtgtaa

SEQ ID NO: 283109 - DNA, 17 bp, Homo sapiens
taccaactttctgtaaa

SEQ ID NO: 283110 - DNA, 16 bp, Homo sapiens
taccaagacataatgc

SEQ ID NO: 283111 - DNA, 12 bp, Homo sapiens
taccaagagtat

SEQ ID NO: 283112 - DNA, 16 bp, Homo sapiens
taccaagatcacaaat

SEQ ID NO: 283113 - DNA, 21 bp, Homo sapiens
taccaagatgccatctgtgtc

SEQ ID NO: 283114 - DNA, 21 bp, Homo sapiens
taccacaccgaggagtccagt

SEQ ID NO: 283115 - DNA, 13 bp, Homo sapiens
taccacagtgtct

SEQ ID NO: 283116 - DNA, 15 bp, Homo sapiens
taccacccttcagac

SEQ ID NO: 283117 - DNA, 20 bp, Homo sapiens
taccacccttcagaccccag

SEQ ID NO: 283118 - DNA, 23 bp, Homo sapiens
taccacccttcagaccccagttc

SEQ ID NO: 283119 - DNA, 14 bp, Homo sapiens
taccacctgtacat

SEQ ID NO: 283120 - DNA, 18 bp, Homo sapiens
taccactatttaagttat

SEQ ID NO: 283121 - DNA, 14 bp, Homo sapiens
taccactgctaata

SEQ ID NO: 283122 - DNA, 19 bp, Homo sapiens
gtgtccccaggggcacact

SEQ ID NO: 283123 - DNA, 13 bp, Homo sapiens
gtgtcccctgacc

SEQ ID NO: 283124 - DNA, 19 bp, Homo sapiens
gtgtcccctgacctgtcca

SEQ ID NO: 283125 - DNA, 21 bp, Homo sapiens
gtgtcccctgacctgtccagg

SEQ ID NO: 283126 - DNA, 14 bp, Homo sapiens
gtgtcccgttgtgt

SEQ ID NO: 283127 - DNA, 16 bp, Homo sapiens
gtgtccctctctctgg

SEQ ID NO: 283128 - DNA, 12 bp, Homo sapiens
gtgtccctgtgg

SEQ ID NO: 283129 - DNA, 13 bp, Homo sapiens
gtgtccctgtggt

SEQ ID NO: 283130 - DNA, 18 bp, Homo sapiens
gtgtccgctgctgctttc

SEQ ID NO: 283131 - DNA, 16 bp, Homo sapiens
gtgtccgggggtctag

SEQ ID NO: 283132 - DNA, 22 bp, Homo sapiens
gtgtcctgtgctttctgcatgc

SEQ ID NO: 283133 - DNA, 19 bp, Homo sapiens
gtgtcgccgtccctctgcc

SEQ ID NO: 283134 - DNA, 14 bp, Homo sapiens
gtgtcgttcccttg

SEQ ID NO: 283135 - DNA, 18 bp, Homo sapiens
gtgtctaagttttgtcat

SEQ ID NO: 283136 - DNA, 15 bp, Homo sapiens
gtgtctagcaaagcc

SEQ ID NO: 283137 - DNA, 16 bp, Homo sapiens
gtgtctagcaaagcca

SEQ ID NO: 283138 - DNA, 19 bp, Homo sapiens
gtgtctagtagaacaatgt

SEQ ID NO: 283139 - DNA, 14 bp, Homo sapiens
gtgtctcctgcatg

SEQ ID NO: 283140 - DNA, 14 bp, Homo sapiens
gtgtctctgccatg

SEQ ID NO: 283141 - DNA, 22 bp, Homo sapiens
gtgtctcttttctctttctcct

SEQ ID NO: 283142 - DNA, 18 bp, Homo sapiens
gtgtctgatgtgtgccca

SEQ ID NO: 283143 - DNA, 23 bp, Homo sapiens
gtgtctgcattgttattgtggaa

SEQ ID NO: 283144 - DNA, 17 bp, Homo sapiens
gtgtctggtccacacac

SEQ ID NO: 283145 - DNA, 13 bp, Homo sapiens
gtgtctgtattta

SEQ ID NO: 283146 - DNA, 14 bp, Homo sapiens
gtgtctgtatttat

SEQ ID NO: 283147 - DNA, 22 bp, Homo sapiens
gtgtctgtcaccacatcttgtc

SEQ ID NO: 283148 - DNA, 21 bp, Homo sapiens
gtgtcttaagaaaaataatct

SEQ ID NO: 283149 - DNA, 22 bp, Homo sapiens
gtgtcttttaatgatactgtct

SEQ ID NO: 283150 - DNA, 20 bp, Homo sapiens
gtgtcttttgttctctcttg

SEQ ID NO: 283151 - DNA, 16 bp, Homo sapiens
gtgtgacagaaaaaaa

SEQ ID NO: 283152 - DNA, 20 bp, Homo sapiens
gtgtgacatcagtggcatgg

SEQ ID NO: 283153 - DNA, 17 bp, Homo sapiens
gtgtgacgggggttggg

SEQ ID NO: 283154 - DNA, 22 bp, Homo sapiens
gtgtgagatggtgccccctggg

SEQ ID NO: 283155 - DNA, 17 bp, Homo sapiens
gtgtgaggcccccggag

SEQ ID NO: 283156 - DNA, 12 bp, Homo sapiens
gtgtgagggcag

SEQ ID NO: 283157 - DNA, 17 bp, Homo sapiens
gtgtgagtggcagccat

SEQ ID NO: 283158 - DNA, 17 bp, Homo sapiens
gtgtgatgaactttctc

SEQ ID NO: 283159 - DNA, 19 bp, Homo sapiens
gtgtgatttgtctctgagc

SEQ ID NO: 283160 - DNA, 22 bp, Homo sapiens
gtgtgcacacacaccacacata

SEQ ID NO: 283161 - DNA, 15 bp, Homo sapiens
gtgtgcacgagtggg

SEQ ID NO: 283162 - DNA, 18 bp, Homo sapiens
gtgtgcaggctgtctcat

SEQ ID NO: 283163 - DNA, 17 bp, Homo sapiens
gtgtgccacaggctgca

SEQ ID NO: 283164 - DNA, 13 bp, Homo sapiens
gtgtgccaccctc

SEQ ID NO: 283165 - DNA, 18 bp, Homo sapiens
gtgtgccaccctctgcag

SEQ ID NO: 283166 - DNA, 20 bp, Homo sapiens
gtgtgccaccctctgcaggg

SEQ ID NO: 283167 - DNA, 22 bp, Homo sapiens
gtgtgccaccctctgcagggca

SEQ ID NO: 283168 - DNA, 23 bp, Homo sapiens
gtgtgccaccctctgcagggcag

SEQ ID NO: 283169 - DNA, 21 bp, Homo sapiens
gtgtgccatagagtttaacac

SEQ ID NO: 283170 - DNA, 18 bp, Homo sapiens
gtgtgccccaagaggcta

SEQ ID NO: 283171 - DNA, 13 bp, Homo sapiens
gtgtgccctggct

SEQ ID NO: 283172 - DNA, 15 bp, Homo sapiens
gtgtgcctgctatcc

SEQ ID NO: 283173 - DNA, 16 bp, Homo sapiens
gtgtgcctgtggcaga

SEQ ID NO: 283174 - DNA, 12 bp, Homo sapiens
gtgtgctacaga

SEQ ID NO: 283175 - DNA, 22 bp, Homo sapiens
gtgtgctttatgctgaaacaga

SEQ ID NO: 283176 - DNA, 20 bp, Homo sapiens
gtgtggaaggcacccgccct

SEQ ID NO: 283177 - DNA, 18 bp, Homo sapiens
gttcttcctcttacctgt

SEQ ID NO: 283178 - DNA, 21 bp, Homo sapiens
gttcttcgggaagagaggagt

SEQ ID NO: 283179 - DNA, 18 bp, Homo sapiens
gttcttgccttccccttg

SEQ ID NO: 283180 - DNA, 15 bp, Homo sapiens
gttcttgggggaggc

SEQ ID NO: 283181 - DNA, 16 bp, Homo sapiens
gttcttggtagagatt

SEQ ID NO: 283182 - DNA, 19 bp, Homo sapiens
gttcttgtaaaactgtgac

SEQ ID NO: 283183 - DNA, 16 bp, Homo sapiens
gttctttaggagattt

SEQ ID NO: 283184 - DNA, 17 bp, Homo sapiens
gttctttaggagatttt

SEQ ID NO: 283185 - DNA, 14 bp, Homo sapiens
gttctttcttcctc

SEQ ID NO: 283186 - DNA, 18 bp, Homo sapiens
gttctttcttcctctgct

SEQ ID NO: 283187 - DNA, 14 bp, Homo sapiens
gttctttgttcctg

SEQ ID NO: 283188 - DNA, 13 bp, Homo sapiens
gttcttttctggt

SEQ ID NO: 283189 - DNA, 16 bp, Homo sapiens
gttcttttgatacatt

SEQ ID NO: 283190 - DNA, 17 bp, Homo sapiens
gttgaaaaaagaagttt

SEQ ID NO: 283191 - DNA, 13 bp, Homo sapiens
gttgaaaaatcta

SEQ ID NO: 283192 - DNA, 20 bp, Homo sapiens
gttgaaaaatctagtttttt

SEQ ID NO: 283193 - DNA, 16 bp, Homo sapiens
gttgaagactttgttt

SEQ ID NO: 283194 - DNA, 21 bp, Homo sapiens
gttgaaggcagtctgaaccct

SEQ ID NO: 283195 - DNA, 18 bp, Homo sapiens
gttgaataaaagtgcaca

SEQ ID NO: 283196 - DNA, 19 bp, Homo sapiens
gttgaatgacaacagaagc

SEQ ID NO: 283197 - DNA, 20 bp, Homo sapiens
gttgaattttttttaacatt

SEQ ID NO: 283198 - DNA, 23 bp, Homo sapiens
gttgaattttttttaacattcct

SEQ ID NO: 283199 - DNA, 17 bp, Homo sapiens
gttgacaccaagaaacc

SEQ ID NO: 283200 - DNA, 18 bp, Homo sapiens
gttgacatccaaatctag

SEQ ID NO: 283201 - DNA, 16 bp, Homo sapiens
gttgaccctactgtgg

SEQ ID NO: 283202 - DNA, 13 bp, Homo sapiens
gttgactgctgct

SEQ ID NO: 283203 - DNA, 22 bp, Homo sapiens
gttgactgtaggcgcccctggg

SEQ ID NO: 283204 - DNA, 12 bp, Homo sapiens
gttgagaaatga

SEQ ID NO: 283205 - DNA, 16 bp, Homo sapiens
gttgagacgctgttgc

SEQ ID NO: 283206 - DNA, 13 bp, Homo sapiens
gttgagctgtttt

SEQ ID NO: 283207 - DNA, 19 bp, Homo sapiens
gttgaggatgcactggcct

SEQ ID NO: 283208 - DNA, 13 bp, Homo sapiens
gttgaggggagag

SEQ ID NO: 283209 - DNA, 20 bp, Homo sapiens
gttgaggggcttccctctgc

SEQ ID NO: 283210 - DNA, 17 bp, Homo sapiens
gttgagtatttgctgtt

SEQ ID NO: 283211 - DNA, 17 bp, Homo sapiens
gttgagtcttcacattt

SEQ ID NO: 283212 - DNA, 19 bp, Homo sapiens
gttgagtcttcacatttag

SEQ ID NO: 283213 - DNA, 18 bp, Homo sapiens
gttgagtgggtatttctt

SEQ ID NO: 283214 - DNA, 13 bp, Homo sapiens
gttgagtttgctg

SEQ ID NO: 283215 - DNA, 19 bp, Homo sapiens
gttgataggagacttgtac

SEQ ID NO: 283216 - DNA, 15 bp, Homo sapiens
gttgatcatgcagga

SEQ ID NO: 283217 - DNA, 14 bp, Homo sapiens
gttgattctgtccc

SEQ ID NO: 283218 - DNA, 14 bp, Homo sapiens
gttgattctttcaa

SEQ ID NO: 283219 - DNA, 17 bp, Homo sapiens
gttgcaaattattctag

SEQ ID NO: 283220 - DNA, 15 bp, Homo sapiens
gttgcacagtccctc

SEQ ID NO: 283221 - DNA, 11 bp, Homo sapiens
gttgcagctgc

SEQ ID NO: 283222 - DNA, 15 bp, Homo sapiens
gttgcagtgagctga

SEQ ID NO: 283223 - DNA, 15 bp, Homo sapiens
gttgcagtggagagg

SEQ ID NO: 283224 - DNA, 16 bp, Homo sapiens
gttgcataaacaatcc

SEQ ID NO: 283225 - DNA, 21 bp, Homo sapiens
gttgcataaacaatccaaatg

SEQ ID NO: 283226 - DNA, 19 bp, Homo sapiens
gttgcatccacaggattcc

SEQ ID NO: 283227 - DNA, 19 bp, Homo sapiens
gttgccaaatatgtcctgg

SEQ ID NO: 283228 - DNA, 21 bp, Homo sapiens
gttgccaaatatgtcctgggg

SEQ ID NO: 283229 - DNA, 21 bp, Homo sapiens
gttgccaagaactgaaaacat

SEQ ID NO: 283230 - DNA, 15 bp, Homo sapiens
gttgccacaggacac

SEQ ID NO: 283231 - DNA, 15 bp, Homo sapiens
gttgccgggcctgga

SEQ ID NO: 283232 - DNA, 14 bp, Homo sapiens
gttgcctcctctct

SEQ ID NO: 283233 - DNA, 16 bp, Homo sapiens
gttgcgacggagagaa

SEQ ID NO: 283234 - DNA, 17 bp, Homo sapiens
gttgcgacggagagaaa

SEQ ID NO: 283235 - DNA, 22 bp, Homo sapiens
gttgctcagtctccctttccct

SEQ ID NO: 283236 - DNA, 18 bp, Homo sapiens
gttgctccgcctctgctg

SEQ ID NO: 283237 - DNA, 19 bp, Homo sapiens
gttgctcttggaaagctga

SEQ ID NO: 283238 - DNA, 19 bp, Homo sapiens
gttgcttacggtttctttg

SEQ ID NO: 283239 - DNA, 22 bp, Homo sapiens
gttgcttagatgagggtgactg

SEQ ID NO: 283240 - DNA, 17 bp, Homo sapiens
gttgcttgggccactgc

SEQ ID NO: 283241 - DNA, 20 bp, Homo sapiens
gttgctttaaagtacctgta

SEQ ID NO: 283242 - DNA, 23 bp, Homo sapiens
gttgctttaaagtacctgtagtg

SEQ ID NO: 283243 - DNA, 18 bp, Homo sapiens
gttgctttttcactgttt

SEQ ID NO: 283244 - DNA, 22 bp, Homo sapiens
gttggaactctgtgcaggtgct

SEQ ID NO: 283245 - DNA, 14 bp, Homo sapiens
gttggaactgctgc

SEQ ID NO: 283246 - DNA, 17 bp, Homo sapiens
gttggaccccagagatt

SEQ ID NO: 283247 - DNA, 17 bp, Homo sapiens
gttggacttttcgttaa

SEQ ID NO: 283248 - DNA, 21 bp, Homo sapiens
gttggacttttcgttaacatt

SEQ ID NO: 283249 - DNA, 19 bp, Homo sapiens
gttggagaaaatgaagaaa

SEQ ID NO: 283250 - DNA, 21 bp, Homo sapiens
gttggagatgacagaaatatg

SEQ ID NO: 283251 - DNA, 13 bp, Homo sapiens
gttggagccactc

SEQ ID NO: 283252 - DNA, 20 bp, Homo sapiens
gttggagccactcctgtccc

SEQ ID NO: 283253 - DNA, 18 bp, Homo sapiens
gttggagccactctgttc

SEQ ID NO: 283254 - DNA, 14 bp, Homo sapiens
gttggaggcctcac

SEQ ID NO: 283255 - DNA, 19 bp, Homo sapiens
gttggatgggagtgggcac

SEQ ID NO: 283256 - DNA, 20 bp, Homo sapiens
gttggatttaaaaatgccaa

SEQ ID NO: 283257 - DNA, 18 bp, Homo sapiens
gttggcagagaaggcctc

SEQ ID NO: 283258 - DNA, 18 bp, Homo sapiens
gttggcagtgtttgtata

SEQ ID NO: 283259 - DNA, 18 bp, Homo sapiens
gttggccaggctggtctc

SEQ ID NO: 283260 - DNA, 17 bp, Homo sapiens
gttggcccaagctcttg

SEQ ID NO: 283261 - DNA, 16 bp, Homo sapiens
gttggcccttccagtg

SEQ ID NO: 283262 - DNA, 17 bp, Homo sapiens
gttggccggctggccgg

SEQ ID NO: 283263 - DNA, 20 bp, Homo sapiens
gttggccggctggccggtcc

SEQ ID NO: 283264 - DNA, 23 bp, Homo sapiens
gttggctgggggcatgggggagg

SEQ ID NO: 283265 - DNA, 16 bp, Homo sapiens
gttggctgttccagac

SEQ ID NO: 283266 - DNA, 21 bp, Homo sapiens
gttgggattgggggctggtgc

SEQ ID NO: 283267 - DNA, 22 bp, Homo sapiens
gttgggattgggggctggtgcc

SEQ ID NO: 283268 - DNA, 13 bp, Homo sapiens
gttgggcccagat

SEQ ID NO: 283269 - DNA, 16 bp, Homo sapiens
gttgggcccagatctg

SEQ ID NO: 283270 - DNA, 17 bp, Homo sapiens
gttgggcccagatctgg

SEQ ID NO: 283271 - DNA, 19 bp, Homo sapiens
gttgggccccagggaacta

SEQ ID NO: 283272 - DNA, 15 bp, Homo sapiens
gttgggggctcctgt

SEQ ID NO: 283273 - DNA, 18 bp, Homo sapiens
gttgggggctcctgtttc

SEQ ID NO: 283274 - DNA, 12 bp, Homo sapiens
gttggtcagagg

SEQ ID NO: 283275 - DNA, 15 bp, Homo sapiens
gttgtttctgaccca

SEQ ID NO: 283276 - DNA, 13 bp, Homo sapiens
gttgtttgtaaat

SEQ ID NO: 283277 - DNA, 22 bp, Homo sapiens
gttgttttatataatgcatgta

SEQ ID NO: 283278 - DNA, 22 bp, Homo sapiens
gttgttttgattatgtaccttt

SEQ ID NO: 283279 - DNA, 17 bp, Homo sapiens
gtttaaaaaaataacat

SEQ ID NO: 283280 - DNA, 23 bp, Homo sapiens
gtttaaaagacacacttgtccac

SEQ ID NO: 283281 - DNA, 15 bp, Homo sapiens
gtttaaataaagtat

SEQ ID NO: 283282 - DNA, 16 bp, Homo sapiens
gtttaaataaagtatc

SEQ ID NO: 283283 - DNA, 19 bp, Homo sapiens
gtttaaataaagtatcatg

SEQ ID NO: 283284 - DNA, 22 bp, Homo sapiens
gtttaaataaagtatcatgcat

SEQ ID NO: 283285 - DNA, 12 bp, Homo sapiens
gtttaaatacca

SEQ ID NO: 283286 - DNA, 15 bp, Homo sapiens
gtttaacaaatctaa

SEQ ID NO: 283287 - DNA, 14 bp, Homo sapiens
gtttaactcagatc

SEQ ID NO: 283288 - DNA, 16 bp, Homo sapiens
gtttaactcagatcac

SEQ ID NO: 283289 - DNA, 23 bp, Homo sapiens
gtttaactcagatcactactgca

SEQ ID NO: 283290 - DNA, 13 bp, Homo sapiens
gtttaactcccta

SEQ ID NO: 283291 - DNA, 23 bp, Homo sapiens
gtttaagaaaaaataacacacat

SEQ ID NO: 283292 - DNA, 15 bp, Homo sapiens
gtttaagtgcttggt

SEQ ID NO: 283293 - DNA, 20 bp, Homo sapiens
gtttaatatctgactgaaat

SEQ ID NO: 283294 - DNA, 17 bp, Homo sapiens
gtttaatattgagaaag

SEQ ID NO: 283295 - DNA, 23 bp, Homo sapiens
gtttaatgtcagggtcaaactac

SEQ ID NO: 283296 - DNA, 18 bp, Homo sapiens
gtttaattctaaaagaga

SEQ ID NO: 283297 - DNA, 22 bp, Homo sapiens
gtttaattttgtgaatctattg

SEQ ID NO: 283298 - DNA, 14 bp, Homo sapiens
gtttacaacaaaca

SEQ ID NO: 283299 - DNA, 15 bp, Homo sapiens
gtttacaacaaacac

SEQ ID NO: 283300 - DNA, 23 bp, Homo sapiens
gtttacaagtgtatatcagaaaa

SEQ ID NO: 283301 - DNA, 20 bp, Homo sapiens
gtttacaatattatgtttcc

SEQ ID NO: 283302 - DNA, 14 bp, Homo sapiens
gtttacagaaaaat

SEQ ID NO: 283303 - DNA, 23 bp, Homo sapiens
gtttacatgagttcaaatacttt

SEQ ID NO: 283304 - DNA, 13 bp, Homo sapiens
gtttaccatttgt

SEQ ID NO: 283305 - DNA, 17 bp, Homo sapiens
gtttaccatttgtaata

SEQ ID NO: 283306 - DNA, 18 bp, Homo sapiens
gtttaccatttgtaataa

SEQ ID NO: 283307 - DNA, 20 bp, Homo sapiens
gtttaccatttgtaataaag

SEQ ID NO: 283308 - DNA, 21 bp, Homo sapiens
gtttaccatttgtaataaagt

SEQ ID NO: 283309 - DNA, 13 bp, Homo sapiens
gtttaccctccct

SEQ ID NO: 283310 - DNA, 13 bp, Homo sapiens
gtttacctcactg

SEQ ID NO: 283311 - DNA, 18 bp, Homo sapiens
gtttacctcactggtgca

SEQ ID NO: 283312 - DNA, 23 bp, Homo sapiens
gtttacctcactggtgcatttaa

SEQ ID NO: 283313 - DNA, 16 bp, Homo sapiens
gtttaccttcagccat

SEQ ID NO: 283314 - DNA, 19 bp, Homo sapiens
gtttacggtacttggtaag

SEQ ID NO: 283315 - DNA, 12 bp, Homo sapiens
gtttactgctgt

SEQ ID NO: 283316 - DNA, 13 bp, Homo sapiens
gtttagaaataaa

SEQ ID NO: 283317 - DNA, 16 bp, Homo sapiens
gtttagaaattacaag

SEQ ID NO: 283318 - DNA, 22 bp, Homo sapiens
gtttagaagctgagacacaaag

SEQ ID NO: 283319 - DNA, 16 bp, Homo sapiens
gtttagcattaaaaat

SEQ ID NO: 283320 - DNA, 20 bp, Homo sapiens
gtttagcattaaaaataaaa

SEQ ID NO: 283321 - DNA, 21 bp, Homo sapiens
gtttataattgttatacattt

SEQ ID NO: 283322 - DNA, 15 bp, Homo sapiens
gtttatacagtacag

SEQ ID NO: 283323 - DNA, 19 bp, Homo sapiens
gtttatacagttttaaaga

SEQ ID NO: 283324 - DNA, 12 bp, Homo sapiens
gtttatccaaat

SEQ ID NO: 283325 - DNA, 15 bp, Homo sapiens
gtttatccaaatctt

SEQ ID NO: 283326 - DNA, 22 bp, Homo sapiens
gtttatgaagaaagatactaat

SEQ ID NO: 283327 - DNA, 17 bp, Homo sapiens
gtttatgatatttcttg

SEQ ID NO: 283328 - DNA, 21 bp, Homo sapiens
gtttatgatatttcttgcttt

SEQ ID NO: 283329 - DNA, 14 bp, Homo sapiens
gtttatggcctcag

SEQ ID NO: 283330 - DNA, 15 bp, Homo sapiens
gtttatggcctcagc

SEQ ID NO: 283331 - DNA, 22 bp, Homo sapiens
gtttatggcctcagctgcctca

SEQ ID NO: 283332 - DNA, 23 bp, Homo sapiens
gtttatggcctcagctgcctcac

SEQ ID NO: 283333 - DNA, 17 bp, Homo sapiens
gtttattgcttaatccc

SEQ ID NO: 283334 - DNA, 14 bp, Homo sapiens
gtttattggaagtg

SEQ ID NO: 283335 - DNA, 20 bp, Homo sapiens
gtttattggaagtgttcaag

SEQ ID NO: 283336 - DNA, 14 bp, Homo sapiens
gtttatttatcagt

SEQ ID NO: 283337 - DNA, 17 bp, Homo sapiens
gtttatttttcatattg

SEQ ID NO: 283338 - DNA, 21 bp, Homo sapiens
gtttatttttttgatggctaa

SEQ ID NO: 283339 - DNA, 23 bp, Homo sapiens
gtttcaaccaagtcatgtgcatt

SEQ ID NO: 283340 - DNA, 22 bp, Homo sapiens
gtttcaattccacctgcaatca

SEQ ID NO: 283341 - DNA, 14 bp, Homo sapiens
gtttcaatttactt

SEQ ID NO: 283342 - DNA, 21 bp, Homo sapiens
gtttcactgccaacttttagt

SEQ ID NO: 283343 - DNA, 15 bp, Homo sapiens
gtttcagaagcccca

SEQ ID NO: 283344 - DNA, 18 bp, Homo sapiens
gtttcagaagtactggca

SEQ ID NO: 283345 - DNA, 22 bp, Homo sapiens
gtttcagacagggtctgaagga

SEQ ID NO: 283346 - DNA, 16 bp, Homo sapiens
gtttcagatatatatc

SEQ ID NO: 283347 - DNA, 20 bp, Homo sapiens
gtttcaggcaaggcagctcc

SEQ ID NO: 283348 - DNA, 16 bp, Homo sapiens
gtttcagtaatagctg

SEQ ID NO: 283349 - DNA, 14 bp, Homo sapiens
gtttcattgccttc

SEQ ID NO: 283350 - DNA, 21 bp, Homo sapiens
gtttccaagcctgggccactg

SEQ ID NO: 283351 - DNA, 23 bp, Homo sapiens
gtttccaagcctgggccactggc

SEQ ID NO: 283352 - DNA, 14 bp, Homo sapiens
gtttccacacaggc

SEQ ID NO: 283353 - DNA, 15 bp, Homo sapiens
gtttccacacaggcc

SEQ ID NO: 283354 - DNA, 17 bp, Homo sapiens
gtttccacacaggccca

SEQ ID NO: 283355 - DNA, 13 bp, Homo sapiens
gtttccacatgct

SEQ ID NO: 283356 - DNA, 16 bp, Homo sapiens
gtttccaggcatgacc

SEQ ID NO: 283357 - DNA, 18 bp, Homo sapiens
gtttccaggcatgaccct

SEQ ID NO: 283358 - DNA, 20 bp, Homo sapiens
gtttccaggcatgaccctgg

SEQ ID NO: 283359 - DNA, 21 bp, Homo sapiens
gtttcccaaaaaccccagtgt

SEQ ID NO: 283360 - DNA, 22 bp, Homo sapiens
gtttcccaaaaaccccagtgtt

SEQ ID NO: 283361 - DNA, 15 bp, Homo sapiens
gtttccccaccagtg

SEQ ID NO: 283362 - DNA, 14 bp, Homo sapiens
gtttccctgctggc

SEQ ID NO: 283363 - DNA, 17 bp, Homo sapiens
gtttccctgctggccaa

SEQ ID NO: 283364 - DNA, 23 bp, Homo sapiens
gtttccctgtgtggaccatgggg

SEQ ID NO: 283365 - DNA, 14 bp, Homo sapiens
gtttccgcggcggc

SEQ ID NO: 283366 - DNA, 15 bp, Homo sapiens
gttttgtgttgtttg

SEQ ID NO: 283367 - DNA, 15 bp, Homo sapiens
gttttgtttctgaaa

SEQ ID NO: 283368 - DNA, 12 bp, Homo sapiens
gttttgttttgg

SEQ ID NO: 283369 - DNA, 20 bp, Homo sapiens
gtttttaaaaaggcctttgg

SEQ ID NO: 283370 - DNA, 18 bp, Homo sapiens
gtttttaaaagtttcaat

SEQ ID NO: 283371 - DNA, 22 bp, Homo sapiens
gtttttaagaaaaacatgtcat

SEQ ID NO: 283372 - DNA, 19 bp, Homo sapiens
gtttttaagctgtttccat

SEQ ID NO: 283373 - DNA, 21 bp, Homo sapiens
gtttttaagggtttgtggaaa

SEQ ID NO: 283374 - DNA, 16 bp, Homo sapiens
gtttttaagtcctgta

SEQ ID NO: 283375 - DNA, 22 bp, Homo sapiens
gtttttacctaccacagtgtct

SEQ ID NO: 283376 - DNA, 16 bp, Homo sapiens
gtttttagagacaggg

SEQ ID NO: 283377 - DNA, 23 bp, Homo sapiens
gtttttattacaaattttcactg

SEQ ID NO: 283378 - DNA, 20 bp, Homo sapiens
gtttttcagcacccccaccc

SEQ ID NO: 283379 - DNA, 21 bp, Homo sapiens
gtttttcagcacccccaccca

SEQ ID NO: 283380 - DNA, 20 bp, Homo sapiens
gtttttccatgtgttttgct

SEQ ID NO: 283381 - DNA, 12 bp, Homo sapiens
gtttttctcaaa

SEQ ID NO: 283382 - DNA, 19 bp, Homo sapiens
gtttttctgttccctgctg

SEQ ID NO: 283383 - DNA, 12 bp, Homo sapiens
gtttttcttcaa

SEQ ID NO: 283384 - DNA, 22 bp, Homo sapiens
gtttttcttcaacatcaatgtt

SEQ ID NO: 283385 - DNA, 21 bp, Homo sapiens
gtttttgaagaagggaaattc

SEQ ID NO: 283386 - DNA, 21 bp, Homo sapiens
gttttttaaagtcttgctgtg

SEQ ID NO: 283387 - DNA, 22 bp, Homo sapiens
gttttttagtgcaatttcttct

SEQ ID NO: 283388 - DNA, 17 bp, Homo sapiens
gttttttggttcctttt

SEQ ID NO: 283389 - DNA, 12 bp, Homo sapiens
gttttttttcct

SEQ ID NO: 283390 - DNA, 21 bp, Homo sapiens
gttttttttttttttttggct

SEQ ID NO: 283391 - DNA, 23 bp, Homo sapiens
taaaaaaaaaaaaaaaagactaa

SEQ ID NO: 283392 - DNA, 18 bp, Homo sapiens
taaaaaaaaaaggatgaa

SEQ ID NO: 283393 - DNA, 17 bp, Homo sapiens
taaaaaaaataataaat

SEQ ID NO: 283394 - DNA, 13 bp, Homo sapiens
taaaaaaataaca

SEQ ID NO: 283395 - DNA, 16 bp, Homo sapiens
taaaaaaataacatct

SEQ ID NO: 283396 - DNA, 20 bp, Homo sapiens
taaaaaaataatataaatga

SEQ ID NO: 283397 - DNA, 14 bp, Homo sapiens
taaaaaacattcaa

SEQ ID NO: 283398 - DNA, 21 bp, Homo sapiens
taaaaaactcctgtcttgcta

SEQ ID NO: 283399 - DNA, 15 bp, Homo sapiens
taaaaaagaaaacat

SEQ ID NO: 283400 - DNA, 21 bp, Homo sapiens
taaaaaagatggatttgacac

SEQ ID NO: 283401 - DNA, 12 bp, Homo sapiens
taaaaaataact

SEQ ID NO: 283402 - DNA, 15 bp, Homo sapiens
taaaaaataactgtg

SEQ ID NO: 283403 - DNA, 15 bp, Homo sapiens
taaaaaataagtaaa

SEQ ID NO: 283404 - DNA, 19 bp, Homo sapiens
taaaaaatttattatgtcc

SEQ ID NO: 283405 - DNA, 20 bp, Homo sapiens
taaaaacacaaatgtgtact

SEQ ID NO: 283406 - DNA, 15 bp, Homo sapiens
taaaaacacctaagt

SEQ ID NO: 283407 - DNA, 18 bp, Homo sapiens
taaaaacacctaagtgac

SEQ ID NO: 283408 - DNA, 21 bp, Homo sapiens
taaaaacactacctcttttga

SEQ ID NO: 283409 - DNA, 22 bp, Homo sapiens
taaaaacccataactaccagga

SEQ ID NO: 283410 - DNA, 14 bp, Homo sapiens
taaaaactttgcta

SEQ ID NO: 283411 - DNA, 17 bp, Homo sapiens
taaaaagaaaagataaa

SEQ ID NO: 283412 - DNA, 23 bp, Homo sapiens
taaaaagaaaagataaagatgat

SEQ ID NO: 283413 - DNA, 14 bp, Homo sapiens
taaaaagaagaaaa

SEQ ID NO: 283414 - DNA, 21 bp, Homo sapiens
taaaaagacattcttccaaaa

SEQ ID NO: 283415 - DNA, 19 bp, Homo sapiens
taaaaagcctgcaatttca

SEQ ID NO: 283416 - DNA, 16 bp, Homo sapiens
taccaggttgaaagac

SEQ ID NO: 283417 - DNA, 18 bp, Homo sapiens
taccagtcgccctctgtg

SEQ ID NO: 283418 - DNA, 22 bp, Homo sapiens
taccagtcgccctctgtgccta

SEQ ID NO: 283419 - DNA, 13 bp, Homo sapiens
taccagtgtactg

SEQ ID NO: 283420 - DNA, 15 bp, Homo sapiens
taccagtgtactgct

SEQ ID NO: 283421 - DNA, 19 bp, Homo sapiens
taccagtgttagtgggaag

SEQ ID NO: 283422 - DNA, 14 bp, Homo sapiens
taccagtttgctga

SEQ ID NO: 283423 - DNA, 20 bp, Homo sapiens
taccataagggactgtgcca

SEQ ID NO: 283424 - DNA, 17 bp, Homo sapiens
taccataatgttcctta

SEQ ID NO: 283425 - DNA, 22 bp, Homo sapiens
taccatcaaatgttaacagagt

SEQ ID NO: 283426 - DNA, 14 bp, Homo sapiens
taccatcccactga

SEQ ID NO: 283427 - DNA, 21 bp, Homo sapiens
taccatcccggtgcatgcagg

SEQ ID NO: 283428 - DNA, 16 bp, Homo sapiens
taccatcggtcagcag

SEQ ID NO: 283429 - DNA, 12 bp, Homo sapiens
taccatcttaat

SEQ ID NO: 283430 - DNA, 13 bp, Homo sapiens
taccatcttaatc

SEQ ID NO: 283431 - DNA, 22 bp, Homo sapiens
taccatcttaatctttatttta

SEQ ID NO: 283432 - DNA, 17 bp, Homo sapiens
taccatcttacttgagc

SEQ ID NO: 283433 - DNA, 19 bp, Homo sapiens
taccatgaagtgaaaatgc

SEQ ID NO: 283434 - DNA, 20 bp, Homo sapiens
taccatgagaagagggcctg

SEQ ID NO: 283435 - DNA, 15 bp, Homo sapiens
taccatgatgcatgg

SEQ ID NO: 283436 - DNA, 13 bp, Homo sapiens
taccatgctgctt

SEQ ID NO: 283437 - DNA, 23 bp, Homo sapiens
taccatgctgctttttggcacag

SEQ ID NO: 283438 - DNA, 16 bp, Homo sapiens
taccatgtcactgtgg

SEQ ID NO: 283439 - DNA, 15 bp, Homo sapiens
taccatgttaaagag

SEQ ID NO: 283440 - DNA, 17 bp, Homo sapiens
taccattaaaactgctt

SEQ ID NO: 283441 - DNA, 18 bp, Homo sapiens
taccattaaaactgcttt

SEQ ID NO: 283442 - DNA, 20 bp, Homo sapiens
taccattaaaactgcttttt

SEQ ID NO: 283443 - DNA, 14 bp, Homo sapiens
taccatttatgaag

SEQ ID NO: 283444 - DNA, 14 bp, Homo sapiens
taccatttgtaata

SEQ ID NO: 283445 - DNA, 20 bp, Homo sapiens
taccatttgtaataaagtat

SEQ ID NO: 283446 - DNA, 15 bp, Homo sapiens
taccattttgaaata

SEQ ID NO: 283447 - DNA, 20 bp, Homo sapiens
taccattttgcgatgtgttt

SEQ ID NO: 283448 - DNA, 21 bp, Homo sapiens
taccattttgcgatgtgtttt

SEQ ID NO: 283449 - DNA, 14 bp, Homo sapiens
tacccacagagcaa

SEQ ID NO: 283450 - DNA, 19 bp, Homo sapiens
tacccacagggcctgactt

SEQ ID NO: 283451 - DNA, 20 bp, Homo sapiens
tacccacagggcctgacttt

SEQ ID NO: 283452 - DNA, 22 bp, Homo sapiens
tacccaccctaatttgcccttc

SEQ ID NO: 283453 - DNA, 17 bp, Homo sapiens
tacccaccgatggagcc

SEQ ID NO: 283454 - DNA, 21 bp, Homo sapiens
tacccaccgatggagccccca

SEQ ID NO: 283455 - DNA, 15 bp, Homo sapiens
tacccacctgagctt

SEQ ID NO: 283456 - DNA, 18 bp, Homo sapiens
tacccacctgagctttgg

SEQ ID NO: 283457 - DNA, 17 bp, Homo sapiens
tacccagagagaaaaag

SEQ ID NO: 283458 - DNA, 11 bp, Homo sapiens
tacccagccac

SEQ ID NO: 283459 - DNA, 14 bp, Homo sapiens
tacccagccacctt

SEQ ID NO: 283460 - DNA, 18 bp, Homo sapiens
tacccagccaccttcctg

SEQ ID NO: 283461 - DNA, 22 bp, Homo sapiens
tacccagcccatcttgcctcca

SEQ ID NO: 283462 - DNA, 14 bp, Homo sapiens
tacccagtcatgta

SEQ ID NO: 283463 - DNA, 18 bp, Homo sapiens
tacccatcggtgtccatt

SEQ ID NO: 283464 - DNA, 14 bp, Homo sapiens
tacccatgagcctg

SEQ ID NO: 283465 - DNA, 21 bp, Homo sapiens
tacccattcgtggtgatcaat

SEQ ID NO: 283466 - DNA, 16 bp, Homo sapiens
taccccaagtccacct

SEQ ID NO: 283467 - DNA, 20 bp, Homo sapiens
taccccaagtccacctgcct

SEQ ID NO: 283468 - DNA, 20 bp, Homo sapiens
taccccacctcatgcctggc

SEQ ID NO: 283469 - DNA, 12 bp, Homo sapiens
taccccctgccc

SEQ ID NO: 283470 - DNA, 20 bp, Homo sapiens
tacccctagtatctggctgg

SEQ ID NO: 283471 - DNA, 13 bp, Homo sapiens
tacccctgtcctg

SEQ ID NO: 283472 - DNA, 17 bp, Homo sapiens
taccccttacttagcat

SEQ ID NO: 283473 - DNA, 19 bp, Homo sapiens
taccccttagcctccctga

SEQ ID NO: 283474 - DNA, 20 bp, Homo sapiens
taccccttctttgcagggct

SEQ ID NO: 283475 - DNA, 23 bp, Homo sapiens
tacccgagcccagctacattcct

SEQ ID NO: 283476 - DNA, 15 bp, Homo sapiens
tacccgggcagggct

SEQ ID NO: 283477 - DNA, 16 bp, Homo sapiens
tacccgggcctgaccc

SEQ ID NO: 283478 - DNA, 22 bp, Homo sapiens
taccctaggtctccacccctca

SEQ ID NO: 283479 - DNA, 13 bp, Homo sapiens
taccctcaaagta

SEQ ID NO: 283480 - DNA, 14 bp, Homo sapiens
taccctcaaagtag

SEQ ID NO: 283481 - DNA, 15 bp, Homo sapiens
taccctcaaagtagg

SEQ ID NO: 283482 - DNA, 18 bp, Homo sapiens
taccctcccaccagaacg

SEQ ID NO: 283483 - DNA, 11 bp, Homo sapiens
taccctccctg

SEQ ID NO: 283484 - DNA, 13 bp, Homo sapiens
taccctccctgtc

SEQ ID NO: 283485 - DNA, 22 bp, Homo sapiens
taccctcttctcagctccactc

SEQ ID NO: 283486 - DNA, 18 bp, Homo sapiens
taccctggtaggaaagca

SEQ ID NO: 283487 - DNA, 20 bp, Homo sapiens
tacccttctgtgcccagctc

SEQ ID NO: 283488 - DNA, 18 bp, Homo sapiens
tacccttgagacctggaa

SEQ ID NO: 283489 - DNA, 15 bp, Homo sapiens
tacccttgccaaggc

SEQ ID NO: 283490 - DNA, 17 bp, Homo sapiens
tacccttgccaaggccg

SEQ ID NO: 283491 - DNA, 23 bp, Homo sapiens
tacccttgccaaggccgcccacc

SEQ ID NO: 283492 - DNA, 14 bp, Homo sapiens
taccctttatagaa

SEQ ID NO: 283493 - DNA, 15 bp, Homo sapiens
taccctttatagaac

SEQ ID NO: 283494 - DNA, 12 bp, Homo sapiens
taccctttccca

SEQ ID NO: 283495 - DNA, 18 bp, Homo sapiens
taccgaggagctaaacat

SEQ ID NO: 283496 - DNA, 17 bp, Homo sapiens
taccgagtatctgtaac

SEQ ID NO: 283497 - DNA, 19 bp, Homo sapiens
taccgagtatctgtaaccc

SEQ ID NO: 283498 - DNA, 17 bp, Homo sapiens
taccgagtctcttctcc

SEQ ID NO: 283499 - DNA, 21 bp, Homo sapiens
taccgagtctcttctccactg

SEQ ID NO: 283500 - DNA, 15 bp, Homo sapiens
taccgatggtcccag

SEQ ID NO: 283501 - DNA, 12 bp, Homo sapiens
taccgccctggg

SEQ ID NO: 283502 - DNA, 14 bp, Homo sapiens
taccgccctgggct

SEQ ID NO: 283503 - DNA, 16 bp, Homo sapiens
taccgccctgggctgg

SEQ ID NO: 283504 - DNA, 19 bp, Homo sapiens
taccgtttggtgtctgatg

SEQ ID NO: 283505 - DNA, 22 bp, Homo sapiens
taccgtttggtgtctgatgtgt

SEQ ID NO: 283506 - DNA, 23 bp, Homo sapiens
tacctaaaaggaaatctcacccc

SEQ ID NO: 283507 - DNA, 20 bp, Homo sapiens
tacctaagtgacatttgtag

SEQ ID NO: 283508 - DNA, 17 bp, Homo sapiens
tacctaattagagcaga

SEQ ID NO: 283509 - DNA, 23 bp, Homo sapiens
tacctacaaaatgagattcagtg

SEQ ID NO: 283510 - DNA, 14 bp, Homo sapiens
tacctataaatgga

SEQ ID NO: 283511 - DNA, 14 bp, Homo sapiens
tacctcaggcagga

SEQ ID NO: 283512 - DNA, 12 bp, Homo sapiens
tacctcatttgc

SEQ ID NO: 283513 - DNA, 14 bp, Homo sapiens
tacctcatttgcat

SEQ ID NO: 283514 - DNA, 12 bp, Homo sapiens
tacctccctcct

SEQ ID NO: 283515 - DNA, 16 bp, Homo sapiens
tacctctaacaccaca

SEQ ID NO: 283516 - DNA, 15 bp, Homo sapiens
tacctctaataacct

SEQ ID NO: 283517 - DNA, 19 bp, Homo sapiens
tacctctctctgctcctca

SEQ ID NO: 283518 - DNA, 14 bp, Homo sapiens
tacctctgatacct

SEQ ID NO: 283519 - DNA, 15 bp, Homo sapiens
tacctctgatacctc

SEQ ID NO: 283520 - DNA, 19 bp, Homo sapiens
tacctcttccaggaagcac

SEQ ID NO: 283521 - DNA, 22 bp, Homo sapiens
tacctcttccaggaagcacagg

SEQ ID NO: 283522 - DNA, 19 bp, Homo sapiens
tacctcttcccatgactgc

SEQ ID NO: 283523 - DNA, 13 bp, Homo sapiens
tacctgagaccag

SEQ ID NO: 283524 - DNA, 13 bp, Homo sapiens
tacctgaggccag

SEQ ID NO: 283525 - DNA, 20 bp, Homo sapiens
tacctgcccccactcagcat

SEQ ID NO: 283526 - DNA, 19 bp, Homo sapiens
tacctgctgccccagctga

SEQ ID NO: 283527 - DNA, 22 bp, Homo sapiens
tacctgggaaaggacccaccca

SEQ ID NO: 283528 - DNA, 20 bp, Homo sapiens
tacctggtcaacccgctgct

SEQ ID NO: 283529 - DNA, 23 bp, Homo sapiens
tacctggtcaacccgctgcttcc

SEQ ID NO: 283530 - DNA, 13 bp, Homo sapiens
tacctggtccctt

SEQ ID NO: 283531 - DNA, 23 bp, Homo sapiens
tacctgtaatagcctcaccttcc

SEQ ID NO: 283532 - DNA, 14 bp, Homo sapiens
tacctgtacactga

SEQ ID NO: 283533 - DNA, 16 bp, Homo sapiens
tacctgtaggaaacag

SEQ ID NO: 283534 - DNA, 16 bp, Homo sapiens
tacctgtcatctgggc

SEQ ID NO: 283535 - DNA, 21 bp, Homo sapiens
taccttattgagcgtgattct

SEQ ID NO: 283536 - DNA, 19 bp, Homo sapiens
taccttattgatctttgcc

SEQ ID NO: 283537 - DNA, 18 bp, Homo sapiens
taccttcagatcctaccc

SEQ ID NO: 283538 - DNA, 24 bp, Homo sapiens
taccttctgttccttatgatattc

SEQ ID NO: 283539 - DNA, 15 bp, Homo sapiens
taccttgaaaggaag

SEQ ID NO: 283540 - DNA, 20 bp, Homo sapiens
taccttgagaccctcttctc

SEQ ID NO: 283541 - DNA, 20 bp, Homo sapiens
tcaagagggcactggtggcc

SEQ ID NO: 283542 - DNA, 18 bp, Homo sapiens
tcaagatacacttgtaaa

SEQ ID NO: 283543 - DNA, 15 bp, Homo sapiens
tcaagatattaaaat

SEQ ID NO: 283544 - DNA, 16 bp, Homo sapiens
tcaagatattaaaatg

SEQ ID NO: 283545 - DNA, 22 bp, Homo sapiens
tcaagattaagttataccagca

SEQ ID NO: 283546 - DNA, 22 bp, Homo sapiens
tcaagattatattataataatg

SEQ ID NO: 283547 - DNA, 15 bp, Homo sapiens
tcaagattctacttg

SEQ ID NO: 283548 - DNA, 18 bp, Homo sapiens
tcaagattttgaatgctt

SEQ ID NO: 283549 - DNA, 14 bp, Homo sapiens
tcaagcaatcctcc

SEQ ID NO: 283550 - DNA, 16 bp, Homo sapiens
tcaagcaatcctcctg

SEQ ID NO: 283551 - DNA, 14 bp, Homo sapiens
tcaagcaccaggga

SEQ ID NO: 283552 - DNA, 16 bp, Homo sapiens
tcaagcactaaaaagt

SEQ ID NO: 283553 - DNA, 19 bp, Homo sapiens
tcaagccaggagaccctgt

SEQ ID NO: 283554 - DNA, 21 bp, Homo sapiens
tcaagccaggagaccctgtct

SEQ ID NO: 283555 - DNA, 13 bp, Homo sapiens
tcaagcccaggag

SEQ ID NO: 283556 - DNA, 19 bp, Homo sapiens
tcaagcccaggaggactgc

SEQ ID NO: 283557 - DNA, 14 bp, Homo sapiens
tcaagcccctgtct

SEQ ID NO: 283558 - DNA, 15 bp, Homo sapiens
tcaagcctgtgaata

SEQ ID NO: 283559 - DNA, 20 bp, Homo sapiens
tcacagcacgggcacagctg

SEQ ID NO: 283560 - DNA, 15 bp, Homo sapiens
tcacagccagcccag

SEQ ID NO: 283561 - DNA, 16 bp, Homo sapiens
tcacagcctaggacca

SEQ ID NO: 283562 - DNA, 12 bp, Homo sapiens
tcacagcctcca

SEQ ID NO: 283563 - DNA, 17 bp, Homo sapiens
tcacagcctccagggcc

SEQ ID NO: 283564 - DNA, 15 bp, Homo sapiens
tcacagcctctccct

SEQ ID NO: 283565 - DNA, 12 bp, Homo sapiens
tcacagctgcag

SEQ ID NO: 283566 - DNA, 15 bp, Homo sapiens
tcacagctgcagctg

SEQ ID NO: 283567 - DNA, 17 bp, Homo sapiens
tcacagctgcagctggg

SEQ ID NO: 283568 - DNA, 17 bp, Homo sapiens
tcacagcttgttttgga

SEQ ID NO: 283569 - DNA, 23 bp, Homo sapiens
tcacaggacgttgctttttcact

SEQ ID NO: 283570 - DNA, 17 bp, Homo sapiens
tcacaggactctgcctc

SEQ ID NO: 283571 - DNA, 23 bp, Homo sapiens
tcacaggagttggttagaatttc

SEQ ID NO: 283572 - DNA, 17 bp, Homo sapiens
tcacaggcagtgcatgt

SEQ ID NO: 283573 - DNA, 19 bp, Homo sapiens
tcacagggttgggcccaga

SEQ ID NO: 283574 - DNA, 24 bp, Homo sapiens
tcacagggttgggcccagatctgg

SEQ ID NO: 283575 - DNA, 16 bp, Homo sapiens
tcacagtagagtaggg

SEQ ID NO: 283576 - DNA, 18 bp, Homo sapiens
tcacagtctctttaatct

SEQ ID NO: 283577 - DNA, 17 bp, Homo sapiens
tcacagtgttgcccagg

SEQ ID NO: 283578 - DNA, 15 bp, Homo sapiens
tcacataccctcccc

SEQ ID NO: 283579 - DNA, 12 bp, Homo sapiens
tcacatatgata

SEQ ID NO: 283580 - DNA, 13 bp, Homo sapiens
tcacatatgtctt

SEQ ID NO: 283581 - DNA, 14 bp, Homo sapiens
tcacatatgtctta

SEQ ID NO: 283582 - DNA, 12 bp, Homo sapiens
tcacatatttgt

SEQ ID NO: 283583 - DNA, 23 bp, Homo sapiens
tcacatatttgtagctagaatat

SEQ ID NO: 283584 - DNA, 13 bp, Homo sapiens
tcacatcagataa

SEQ ID NO: 283585 - DNA, 16 bp, Homo sapiens
tcacatcagataagac

SEQ ID NO: 283586 - DNA, 18 bp, Homo sapiens
tcacatcagataagacat

SEQ ID NO: 283587 - DNA, 22 bp, Homo sapiens
tcacatctcccttccacctcac

SEQ ID NO: 283588 - DNA, 19 bp, Homo sapiens
tcacatgcccgctgtccca

SEQ ID NO: 283589 - DNA, 12 bp, Homo sapiens
tcacatgctgga

SEQ ID NO: 283590 - DNA, 13 bp, Homo sapiens
tcacatgtggcaa

SEQ ID NO: 283591 - DNA, 15 bp, Homo sapiens
tcacattcaggcatg

SEQ ID NO: 283592 - DNA, 16 bp, Homo sapiens
tcacattccctctcat

SEQ ID NO: 283593 - DNA, 16 bp, Homo sapiens
tcacattgccttgagc

SEQ ID NO: 283594 - DNA, 13 bp, Homo sapiens
tcacatttagaat

SEQ ID NO: 283595 - DNA, 21 bp, Homo sapiens
tcacatttcaagatccaaatg

SEQ ID NO: 283596 - DNA, 14 bp, Homo sapiens
tcaccaaagtatta

SEQ ID NO: 283597 - DNA, 15 bp, Homo sapiens
tcaccaataacttca

SEQ ID NO: 283598 - DNA, 20 bp, Homo sapiens
tcaccaataacttcagagaa

SEQ ID NO: 283599 - DNA, 21 bp, Homo sapiens
tcaccaataacttcagagaag

SEQ ID NO: 283600 - DNA, 15 bp, Homo sapiens
tcaccacacataata

SEQ ID NO: 283601 - DNA, 14 bp, Homo sapiens
tcaccacatcttgt

SEQ ID NO: 283602 - DNA, 20 bp, Homo sapiens
tcaccacatcttgtcttttc

SEQ ID NO: 283603 - DNA, 15 bp, Homo sapiens
tcaccaccacacccc

SEQ ID NO: 283604 - DNA, 21 bp, Homo sapiens
tcaccaccacacccctgccgg

SEQ ID NO: 283605 - DNA, 17 bp, Homo sapiens
tcaccaccccctgtccc

SEQ ID NO: 283606 - DNA, 21 bp, Homo sapiens
tcaccaccccctgtcccattc

SEQ ID NO: 283607 - DNA, 22 bp, Homo sapiens
tcaccaccccctgtcccattct

SEQ ID NO: 283608 - DNA, 21 bp, Homo sapiens
tcaccagaattagtcctcaca

SEQ ID NO: 283609 - DNA, 16 bp, Homo sapiens
tcaccagactttggct

SEQ ID NO: 283610 - DNA, 13 bp, Homo sapiens
tcaccagcaacat

SEQ ID NO: 283611 - DNA, 17 bp, Homo sapiens
tcaccaggaagaaggcc

SEQ ID NO: 283612 - DNA, 21 bp, Homo sapiens
tcaccagtctgtctactgtgg

SEQ ID NO: 283613 - DNA, 21 bp, Homo sapiens
tcaccagttaaaagcatttta

SEQ ID NO: 283614 - DNA, 15 bp, Homo sapiens
tcaccatctttctaa

SEQ ID NO: 283615 - DNA, 16 bp, Homo sapiens
tcaccatgtaaaacaa

SEQ ID NO: 283616 - DNA, 20 bp, Homo sapiens
tcaccatgtaaaacaaaaaa

SEQ ID NO: 283617 - DNA, 21 bp, Homo sapiens
tcaccatgtaaaacaaaaaac

SEQ ID NO: 283618 - DNA, 15 bp, Homo sapiens
tcaccatgttggcca

SEQ ID NO: 283619 - DNA, 22 bp, Homo sapiens
tcaccattgtgaagcacctact

SEQ ID NO: 283620 - DNA, 20 bp, Homo sapiens
tcaccatttggatcctgtgt

SEQ ID NO: 283621 - DNA, 11 bp, Homo sapiens
tcacccagaag

SEQ ID NO: 283622 - DNA, 13 bp, Homo sapiens
tcacccagaagga

SEQ ID NO: 283623 - DNA, 22 bp, Homo sapiens
tcacccagaaggaacccggtcc

SEQ ID NO: 283624 - DNA, 13 bp, Homo sapiens
tcacccattgtct

SEQ ID NO: 283625 - DNA, 13 bp, Homo sapiens
tcaccccaccctt

SEQ ID NO: 283626 - DNA, 13 bp, Homo sapiens
tcaccccatccca

SEQ ID NO: 283627 - DNA, 19 bp, Homo sapiens
tcacccccaaggggcagtc

SEQ ID NO: 283628 - DNA, 15 bp, Homo sapiens
tcacccccacccctg

SEQ ID NO: 283629 - DNA, 23 bp, Homo sapiens
tcacccccacccctgtacccagc

SEQ ID NO: 283630 - DNA, 14 bp, Homo sapiens
tcacccccctgctt

SEQ ID NO: 283631 - DNA, 16 bp, Homo sapiens
tcacccccctgcttag

SEQ ID NO: 283632 - DNA, 22 bp, Homo sapiens
tcaccccggcaggccctgcagt

SEQ ID NO: 283633 - DNA, 23 bp, Homo sapiens
tcaccccggcaggccctgcagtg

SEQ ID NO: 283634 - DNA, 12 bp, Homo sapiens
tcacccctccac

SEQ ID NO: 283635 - DNA, 14 bp, Homo sapiens
tcacccctgggcag

SEQ ID NO: 283636 - DNA, 11 bp, Homo sapiens
tcaccccttca

SEQ ID NO: 283637 - DNA, 16 bp, Homo sapiens
tcaccccttccccatt

SEQ ID NO: 283638 - DNA, 14 bp, Homo sapiens
tcacccgctgccca

SEQ ID NO: 283639 - DNA, 17 bp, Homo sapiens
tcacccgctgcccagcc

SEQ ID NO: 283640 - DNA, 17 bp, Homo sapiens
tcaccctcagctggcgg

SEQ ID NO: 283641 - DNA, 20 bp, Homo sapiens
tcaccctcctgaaccccccc

SEQ ID NO: 283642 - DNA, 12 bp, Homo sapiens
tcaccctgcttg

SEQ ID NO: 283643 - DNA, 18 bp, Homo sapiens
tcaccctgcttggggcct

SEQ ID NO: 283644 - DNA, 13 bp, Homo sapiens
tcacccttctggg

SEQ ID NO: 283645 - DNA, 13 bp, Homo sapiens
tcaccctttgctg

SEQ ID NO: 283646 - DNA, 12 bp, Homo sapiens
tcacccttttct

SEQ ID NO: 283647 - DNA, 17 bp, Homo sapiens
tcacctaattaatttca

SEQ ID NO: 283648 - DNA, 19 bp, Homo sapiens
tcacctaccctcaaagtag

SEQ ID NO: 283649 - DNA, 18 bp, Homo sapiens
tcacctacttcctcctcc

SEQ ID NO: 283650 - DNA, 15 bp, Homo sapiens
tcacctagaccttgc

SEQ ID NO: 283651 - DNA, 16 bp, Homo sapiens
tcacctagaccttgcc

SEQ ID NO: 283652 - DNA, 20 bp, Homo sapiens
tcacctagaccttgcctccc

SEQ ID NO: 283653 - DNA, 21 bp, Homo sapiens
tcacctagaccttgcctcccc

SEQ ID NO: 283654 - DNA, 18 bp, Homo sapiens
tcacctcaggaccccaga

SEQ ID NO: 283655 - DNA, 12 bp, Homo sapiens
tcacctccaccc

SEQ ID NO: 283656 - DNA, 15 bp, Homo sapiens
tcacctcccctcctt

SEQ ID NO: 283657 - DNA, 12 bp, Homo sapiens
tcacctcctaat

SEQ ID NO: 283658 - DNA, 17 bp, Homo sapiens
tcacctctaggcctcag

SEQ ID NO: 283659 - DNA, 18 bp, Homo sapiens
tcacctctaggcctcagt

SEQ ID NO: 283660 - DNA, 20 bp, Homo sapiens
tcacctctaggcctcagtgt

SEQ ID NO: 283661 - DNA, 18 bp, Homo sapiens
tcacctctggactggcta

SEQ ID NO: 283662 - DNA, 15 bp, Homo sapiens
tcacctgaaacactt

SEQ ID NO: 283663 - DNA, 14 bp, Homo sapiens
tcacctgacctctg

SEQ ID NO: 283664 - DNA, 23 bp, Homo sapiens
tcacctgagcccggatgcttctc

SEQ ID NO: 283665 - DNA, 13 bp, Homo sapiens
tcacctgcaagcc

SEQ ID NO: 283666 - DNA, 16 bp, Homo sapiens
tcacctgcaagcccca

SEQ ID NO: 283667 - DNA, 18 bp, Homo sapiens
tcacctgcaagccccagg

SEQ ID NO: 283668 - DNA, 17 bp, Homo sapiens
tcacctgctggcccctc

SEQ ID NO: 283669 - DNA, 21 bp, Homo sapiens
tcacctgctggcccctcacct

SEQ ID NO: 283670 - DNA, 15 bp, Homo sapiens
tcacctggcttccca

SEQ ID NO: 283671 - DNA, 13 bp, Homo sapiens
tcacctgggcctt

SEQ ID NO: 283672 - DNA, 17 bp, Homo sapiens
tcacctgtaaaacttta

SEQ ID NO: 283673 - DNA, 12 bp, Homo sapiens
tcacctgtcatc

SEQ ID NO: 283674 - DNA, 16 bp, Homo sapiens
tcacctgtgctacctc

SEQ ID NO: 283675 - DNA, 22 bp, Homo sapiens
tcaccttcctgggcagcccaga

SEQ ID NO: 283676 - DNA, 23 bp, Homo sapiens
tcaccttcctgggcagcccagag

SEQ ID NO: 283677 - DNA, 14 bp, Homo sapiens
tcaccttctgtttt

SEQ ID NO: 283678 - DNA, 15 bp, Homo sapiens
tcaccttctgtttta

SEQ ID NO: 283679 - DNA, 23 bp, Homo sapiens
tcaccttgagaggcatgacagct

SEQ ID NO: 283680 - DNA, 12 bp, Homo sapiens
tcacctttccca

SEQ ID NO: 283681 - DNA, 19 bp, Homo sapiens
tcacctttcttcttgtgtc

SEQ ID NO: 283682 - DNA, 19 bp, Homo sapiens
taaataaccaggaagcatt

SEQ ID NO: 283683 - DNA, 13 bp, Homo sapiens
taaataagagatt

SEQ ID NO: 283684 - DNA, 13 bp, Homo sapiens
taaataatgaaaa

SEQ ID NO: 283685 - DNA, 14 bp, Homo sapiens
taaataattttaca

SEQ ID NO: 283686 - DNA, 17 bp, Homo sapiens
taaataattttacatgt

SEQ ID NO: 283687 - DNA, 12 bp, Homo sapiens
taaatacaatgg

SEQ ID NO: 283688 - DNA, 18 bp, Homo sapiens
taaatacagacactaagt

SEQ ID NO: 283689 - DNA, 13 bp, Homo sapiens
taaatacatgtgt

SEQ ID NO: 283690 - DNA, 15 bp, Homo sapiens
taaatacatgtgtgg

SEQ ID NO: 283691 - DNA, 18 bp, Homo sapiens
taaataccagactgcagg

SEQ ID NO: 283692 - DNA, 15 bp, Homo sapiens
taaataccagtactt

SEQ ID NO: 283693 - DNA, 14 bp, Homo sapiens
taaatagaacttga

SEQ ID NO: 283694 - DNA, 18 bp, Homo sapiens
taaatagatacttttgat

SEQ ID NO: 283695 - DNA, 22 bp, Homo sapiens
taaatagatttttagattccta

SEQ ID NO: 283696 - DNA, 14 bp, Homo sapiens
taaatagctatatc

SEQ ID NO: 283697 - DNA, 18 bp, Homo sapiens
taaatagtaggaccaatg

SEQ ID NO: 283698 - DNA, 14 bp, Homo sapiens
taaatagtgaaaat

SEQ ID NO: 283699 - DNA, 15 bp, Homo sapiens
taaatataattctgt

SEQ ID NO: 283700 - DNA, 11 bp, Homo sapiens
taaatatacta

SEQ ID NO: 283701 - DNA, 16 bp, Homo sapiens
taaatatagttgtctt

SEQ ID NO: 283702 - DNA, 22 bp, Homo sapiens
taaatatagttgtctttctttg

SEQ ID NO: 283703 - DNA, 20 bp, Homo sapiens
taaatatatatatatttctc

SEQ ID NO: 283704 - DNA, 14 bp, Homo sapiens
taaatatatgtatg

SEQ ID NO: 283705 - DNA, 16 bp, Homo sapiens
taaatatatgtatgta

SEQ ID NO: 283706 - DNA, 20 bp, Homo sapiens
taaatatatgtatgtaaaaa

SEQ ID NO: 283707 - DNA, 12 bp, Homo sapiens
taaatatatgtt

SEQ ID NO: 283708 - DNA, 13 bp, Homo sapiens
taaatatatgttt

SEQ ID NO: 283709 - DNA, 18 bp, Homo sapiens
taaatatatgttttgaga

SEQ ID NO: 283710 - DNA, 15 bp, Homo sapiens
taaatatattgtata

SEQ ID NO: 283711 - DNA, 21 bp, Homo sapiens
taaatatcattatagcatgta

SEQ ID NO: 283712 - DNA, 13 bp, Homo sapiens
taaatatcattct

SEQ ID NO: 283713 - DNA, 17 bp, Homo sapiens
taaatatcattctttgt

SEQ ID NO: 283714 - DNA, 18 bp, Homo sapiens
taaatatccaaagactgt

SEQ ID NO: 283715 - DNA, 23 bp, Homo sapiens
taaatatccaaagactgtactgg

SEQ ID NO: 283716 - DNA, 15 bp, Homo sapiens
taaatatcccagaga

SEQ ID NO: 283717 - DNA, 23 bp, Homo sapiens
taaatatctatttatctgtctga

SEQ ID NO: 283718 - DNA, 18 bp, Homo sapiens
taaatatcttctgatttg

SEQ ID NO: 283719 - DNA, 21 bp, Homo sapiens
taaatatgaaatgataaagat

SEQ ID NO: 283720 - DNA, 13 bp, Homo sapiens
taaatatgaaatt

SEQ ID NO: 283721 - DNA, 14 bp, Homo sapiens
taaatatgaaattt

SEQ ID NO: 283722 - DNA, 17 bp, Homo sapiens
taaatattcttgtccac

SEQ ID NO: 283723 - DNA, 21 bp, Homo sapiens
taaatattcttgtccacattc

SEQ ID NO: 283724 - DNA, 22 bp, Homo sapiens
taaatattggtttgttattctt

SEQ ID NO: 283725 - DNA, 13 bp, Homo sapiens
taaatatttaatg

SEQ ID NO: 283726 - DNA, 17 bp, Homo sapiens
taaatatttatgtagat

SEQ ID NO: 283727 - DNA, 14 bp, Homo sapiens
taaatatttcctta

SEQ ID NO: 283728 - DNA, 14 bp, Homo sapiens
taaatatttttccc

SEQ ID NO: 283729 - DNA, 12 bp, Homo sapiens
taaatatttttg

SEQ ID NO: 283730 - DNA, 14 bp, Homo sapiens
taaatcaatgtcac

SEQ ID NO: 283731 - DNA, 14 bp, Homo sapiens
taaatcagttttgt

SEQ ID NO: 283732 - DNA, 21 bp, Homo sapiens
taaatcatgttaatcctagct

SEQ ID NO: 283733 - DNA, 12 bp, Homo sapiens
taaatcatttca

SEQ ID NO: 283734 - DNA, 20 bp, Homo sapiens
taaatccagtggggaaaaaa

SEQ ID NO: 283735 - DNA, 21 bp, Homo sapiens
taaatccagtggggaaaaaaa

SEQ ID NO: 283736 - DNA, 20 bp, Homo sapiens
taaatccattttctaaactg

SEQ ID NO: 283737 - DNA, 15 bp, Homo sapiens
taaatcctaccaaag

SEQ ID NO: 283738 - DNA, 20 bp, Homo sapiens
taaatctaaatgattatctt

SEQ ID NO: 283739 - DNA, 16 bp, Homo sapiens
taaatctaaattaact

SEQ ID NO: 283740 - DNA, 18 bp, Homo sapiens
taaatctctaatatggca

SEQ ID NO: 283741 - DNA, 13 bp, Homo sapiens
taaatctgattaa

SEQ ID NO: 283742 - DNA, 15 bp, Homo sapiens
taaatctgattaatc

SEQ ID NO: 283743 - DNA, 16 bp, Homo sapiens
taaatctgtaagctct

SEQ ID NO: 283744 - DNA, 18 bp, Homo sapiens
taaatctgtaagctcttt

SEQ ID NO: 283745 - DNA, 14 bp, Homo sapiens
taaatctgtctgat

SEQ ID NO: 283746 - DNA, 15 bp, Homo sapiens
taaatctgtctgatt

SEQ ID NO: 283747 - DNA, 17 bp, Homo sapiens
taaatctgtctgattct

SEQ ID NO: 283748 - DNA, 21 bp, Homo sapiens
taaatctgtctgattctatgc

SEQ ID NO: 283749 - DNA, 13 bp, Homo sapiens
taaatctgtgatg

SEQ ID NO: 283750 - DNA, 14 bp, Homo sapiens
taaatctgtgatga

SEQ ID NO: 283751 - DNA, 15 bp, Homo sapiens
taaatctgtgatgat

SEQ ID NO: 283752 - DNA, 15 bp, Homo sapiens
taaatgaaaaaaatg

SEQ ID NO: 283753 - DNA, 22 bp, Homo sapiens
taaatgaaaacacctgagctgg

SEQ ID NO: 283754 - DNA, 15 bp, Homo sapiens
taaatgaaaagagaa

SEQ ID NO: 283755 - DNA, 12 bp, Homo sapiens
taaatgaaagaa

SEQ ID NO: 283756 - DNA, 14 bp, Homo sapiens
taaatgaaattgta

SEQ ID NO: 283757 - DNA, 16 bp, Homo sapiens
taaatgaaattgtaaa

SEQ ID NO: 283758 - DNA, 20 bp, Homo sapiens
taaatgaacacatggcagaa

SEQ ID NO: 283759 - DNA, 20 bp, Homo sapiens
taaatgaagggtcatttctc

SEQ ID NO: 283760 - DNA, 21 bp, Homo sapiens
taaatgaagggtcatttctct

SEQ ID NO: 283761 - DNA, 18 bp, Homo sapiens
taaatgaagtttatacag

SEQ ID NO: 283762 - DNA, 23 bp, Homo sapiens
taaatgaagtttatacagtacag

SEQ ID NO: 283763 - DNA, 15 bp, Homo sapiens
taaatgaccagttta

SEQ ID NO: 283764 - DNA, 17 bp, Homo sapiens
taaatgacttattgatt

SEQ ID NO: 283765 - DNA, 17 bp, Homo sapiens
taaatgcagttttaaga

SEQ ID NO: 283766 - DNA, 10 bp, Homo sapiens
taaatgcata

SEQ ID NO: 283767 - DNA, 16 bp, Homo sapiens
taaatgctacctctga

SEQ ID NO: 283768 - DNA, 22 bp, Homo sapiens
taaatgctttgattgttcatat

SEQ ID NO: 283769 - DNA, 23 bp, Homo sapiens
taaatggaattattttgaatgtc

SEQ ID NO: 283770 - DNA, 22 bp, Homo sapiens
taaatggaattttctaatataa

SEQ ID NO: 283771 - DNA, 20 bp, Homo sapiens
taaatggagcttgtacatat

SEQ ID NO: 283772 - DNA, 21 bp, Homo sapiens
taaatggagcttgtacatatt

SEQ ID NO: 283773 - DNA, 17 bp, Homo sapiens
taaatggcacctgtata

SEQ ID NO: 283774 - DNA, 15 bp, Homo sapiens
taaatggtgagaatt

SEQ ID NO: 283775 - DNA, 17 bp, Homo sapiens
taaatggtgagaattaa

SEQ ID NO: 283776 - DNA, 19 bp, Homo sapiens
taaatggtgatttcttgct

SEQ ID NO: 283777 - DNA, 17 bp, Homo sapiens
taaatgtacctgatgta

SEQ ID NO: 283778 - DNA, 14 bp, Homo sapiens
taaatgtactacat

SEQ ID NO: 283779 - DNA, 14 bp, Homo sapiens
taaatgtatattga

SEQ ID NO: 283780 - DNA, 19 bp, Homo sapiens
taaatgtatattgatgtaa

SEQ ID NO: 283781 - DNA, 20 bp, Homo sapiens
taaatgtcccaaataaattt

SEQ ID NO: 283782 - DNA, 22 bp, Homo sapiens
taaatgtcccaaataaatttat

SEQ ID NO: 283783 - DNA, 19 bp, Homo sapiens
taaatgtcttttcaaaagg

SEQ ID NO: 283784 - DNA, 20 bp, Homo sapiens
taaatgtgtggtgctaactg

SEQ ID NO: 283785 - DNA, 13 bp, Homo sapiens
taaatgttatgac

SEQ ID NO: 283786 - DNA, 20 bp, Homo sapiens
taaatgttatgactccttga

SEQ ID NO: 283787 - DNA, 18 bp, Homo sapiens
taaatgtttaaatataaa

SEQ ID NO: 283788 - DNA, 20 bp, Homo sapiens
taaatgtttaatatctgact

SEQ ID NO: 283789 - DNA, 13 bp, Homo sapiens
taaattaaacaat

SEQ ID NO: 283790 - DNA, 15 bp, Homo sapiens
taaattaaataaaat

SEQ ID NO: 283791 - DNA, 16 bp, Homo sapiens
taaattaaataaaata

SEQ ID NO: 283792 - DNA, 14 bp, Homo sapiens
taaattaaatatat

SEQ ID NO: 283793 - DNA, 14 bp, Homo sapiens
taaattaacattat

SEQ ID NO: 283794 - DNA, 17 bp, Homo sapiens
taaattaacattatatt

SEQ ID NO: 283795 - DNA, 12 bp, Homo sapiens
taaattaagaca

SEQ ID NO: 283796 - DNA, 13 bp, Homo sapiens
taaattaagactt

SEQ ID NO: 283797 - DNA, 15 bp, Homo sapiens
taaattaatacataa

SEQ ID NO: 283798 - DNA, 18 bp, Homo sapiens
taaattaatacataagtt

SEQ ID NO: 283799 - DNA, 19 bp, Homo sapiens
taaattacaattgtcattt

SEQ ID NO: 283800 - DNA, 14 bp, Homo sapiens
taaattaggaataa

SEQ ID NO: 283801 - DNA, 15 bp, Homo sapiens
taaattataaggact

SEQ ID NO: 283802 - DNA, 19 bp, Homo sapiens
taaattataaggactgcat

SEQ ID NO: 283803 - DNA, 21 bp, Homo sapiens
taaattatatgatatgcatgt

SEQ ID NO: 283804 - DNA, 18 bp, Homo sapiens
taaattatgtaatgcaaa

SEQ ID NO: 283805 - DNA, 15 bp, Homo sapiens
taaattattacttta

SEQ ID NO: 283806 - DNA, 23 bp, Homo sapiens
taaattattactttaaattatat

SEQ ID NO: 283807 - DNA, 21 bp, Homo sapiens
taaattattcagttaagaaaa

SEQ ID NO: 283808 - DNA, 15 bp, Homo sapiens
taaattatttctaaa

SEQ ID NO: 283809 - DNA, 22 bp, Homo sapiens
taaaaagcctgcaatttcatat

SEQ ID NO: 283810 - DNA, 17 bp, Homo sapiens
taaaaaggcctttggga

SEQ ID NO: 283811 - DNA, 16 bp, Homo sapiens
taaaaagtcaattcat

SEQ ID NO: 283812 - DNA, 23 bp, Homo sapiens
taaaaagtctgcattacattcct

SEQ ID NO: 283813 - DNA, 14 bp, Homo sapiens
taaaaagtcttcac

SEQ ID NO: 283814 - DNA, 17 bp, Homo sapiens
taaaaagtgacacagca

SEQ ID NO: 283815 - DNA, 23 bp, Homo sapiens
taaaaagttaagctgctatagta

SEQ ID NO: 283816 - DNA, 18 bp, Homo sapiens
taaaaagtttcacgtctt

SEQ ID NO: 283817 - DNA, 17 bp, Homo sapiens
taaaaataaaaaagatc

SEQ ID NO: 283818 - DNA, 19 bp, Homo sapiens
taaaaataaaaaagatccc

SEQ ID NO: 283819 - DNA, 15 bp, Homo sapiens
taaaaataaaatgat

SEQ ID NO: 283820 - DNA, 17 bp, Homo sapiens
taaaaataaactgttat

SEQ ID NO: 283821 - DNA, 18 bp, Homo sapiens
taaaaataaactgttatg

SEQ ID NO: 283822 - DNA, 14 bp, Homo sapiens
taaaaatataaaca

SEQ ID NO: 283823 - DNA, 16 bp, Homo sapiens
taaaaatataaacaat

SEQ ID NO: 283824 - DNA, 18 bp, Homo sapiens
taaaaatataaacaatgt

SEQ ID NO: 283825 - DNA, 11 bp, Homo sapiens
taaaaatatgt

SEQ ID NO: 283826 - DNA, 14 bp, Homo sapiens
taaaaatatgtgag

SEQ ID NO: 283827 - DNA, 15 bp, Homo sapiens
taaaaatcatagtac

SEQ ID NO: 283828 - DNA, 23 bp, Homo sapiens
taaaaatccctcttcctccaaag

SEQ ID NO: 283829 - DNA, 13 bp, Homo sapiens
taaaaatctttca

SEQ ID NO: 283830 - DNA, 16 bp, Homo sapiens
taaaaatctttcagaa

SEQ ID NO: 283831 - DNA, 14 bp, Homo sapiens
taaaaatgcatgat

SEQ ID NO: 283832 - DNA, 17 bp, Homo sapiens
taaaaattatctttaaa

SEQ ID NO: 283833 - DNA, 15 bp, Homo sapiens
taaaacaaaaccaag

SEQ ID NO: 283834 - DNA, 16 bp, Homo sapiens
taaaacaaaaccaagc

SEQ ID NO: 283835 - DNA, 17 bp, Homo sapiens
taaaacaaaatctgaac

SEQ ID NO: 283836 - DNA, 24 bp, Homo sapiens
taaaacaatgaattgaatgctcta

SEQ ID NO: 283837 - DNA, 16 bp, Homo sapiens
taaaacaatgtcaagg

SEQ ID NO: 283838 - DNA, 19 bp, Homo sapiens
taaaacacatacaaaagaa

SEQ ID NO: 283839 - DNA, 17 bp, Homo sapiens
taaaacactttcaaaac

SEQ ID NO: 283840 - DNA, 19 bp, Homo sapiens
taaaacagatttgttcatt

SEQ ID NO: 283841 - DNA, 16 bp, Homo sapiens
taaaacataatagaat

SEQ ID NO: 283842 - DNA, 12 bp, Homo sapiens
taaaacatcttt

SEQ ID NO: 283843 - DNA, 20 bp, Homo sapiens
taaaacatggcaataaatgg

SEQ ID NO: 283844 - DNA, 18 bp, Homo sapiens
taaaacattagaagaaaa

SEQ ID NO: 283845 - DNA, 19 bp, Homo sapiens
taaaacattagaagaaaac

SEQ ID NO: 283846 - DNA, 15 bp, Homo sapiens
taaaacctgtcaatg

SEQ ID NO: 283847 - DNA, 16 bp, Homo sapiens
taaaacctgtcaatga

SEQ ID NO: 283848 - DNA, 14 bp, Homo sapiens
taaaaccttactta

SEQ ID NO: 283849 - DNA, 18 bp, Homo sapiens
taaaaccttacttaaagc

SEQ ID NO: 283850 - DNA, 23 bp, Homo sapiens
taaaaccttacttaaagcttgtt

SEQ ID NO: 283851 - DNA, 14 bp, Homo sapiens
taaaacctttcaaa

SEQ ID NO: 283852 - DNA, 16 bp, Homo sapiens
taaaacctttcaaatt

SEQ ID NO: 283853 - DNA, 19 bp, Homo sapiens
taaaactaggcatttgtaa

SEQ ID NO: 283854 - DNA, 21 bp, Homo sapiens
taaaactaggcatttgtaaat

SEQ ID NO: 283855 - DNA, 19 bp, Homo sapiens
taaaactgcacagtgctgt

SEQ ID NO: 283856 - DNA, 12 bp, Homo sapiens
taaaactgcttt

SEQ ID NO: 283857 - DNA, 13 bp, Homo sapiens
taaaactgctttt

SEQ ID NO: 283858 - DNA, 21 bp, Homo sapiens
taaaactgcttttttttttcc

SEQ ID NO: 283859 - DNA, 19 bp, Homo sapiens
taaaactggcatctgacac

SEQ ID NO: 283860 - DNA, 17 bp, Homo sapiens
taaaacttactatggta

SEQ ID NO: 283861 - DNA, 16 bp, Homo sapiens
taaaactttatgtact

SEQ ID NO: 283862 - DNA, 17 bp, Homo sapiens
taaaactttatgtactg

SEQ ID NO: 283863 - DNA, 17 bp, Homo sapiens
taaaactttattttata

SEQ ID NO: 283864 - DNA, 13 bp, Homo sapiens
taaaactttcctc

SEQ ID NO: 283865 - DNA, 15 bp, Homo sapiens
taaaactttcctcgc

SEQ ID NO: 283866 - DNA, 19 bp, Homo sapiens
taaaagacaagcactttgg

SEQ ID NO: 283867 - DNA, 14 bp, Homo sapiens
taaaagacagcagg

SEQ ID NO: 283868 - DNA, 12 bp, Homo sapiens
taaaagacagtg

SEQ ID NO: 283869 - DNA, 19 bp, Homo sapiens
taaaagaggaaattaaata

SEQ ID NO: 283870 - DNA, 14 bp, Homo sapiens
taaaagattcttta

SEQ ID NO: 283871 - DNA, 15 bp, Homo sapiens
taaaagattctttaa

SEQ ID NO: 283872 - DNA, 23 bp, Homo sapiens
taaaagattctttaaactactga

SEQ ID NO: 283873 - DNA, 20 bp, Homo sapiens
taaaagcaacatcagcttga

SEQ ID NO: 283874 - DNA, 16 bp, Homo sapiens
taaaagcatatataaa

SEQ ID NO: 283875 - DNA, 21 bp, Homo sapiens
taaaaggaaatctcaccccat

SEQ ID NO: 283876 - DNA, 11 bp, Homo sapiens
taaaaggaagt

SEQ ID NO: 283877 - DNA, 22 bp, Homo sapiens
taaaaggaataggtaggagacc

SEQ ID NO: 283878 - DNA, 17 bp, Homo sapiens
taaaaggataggaaaag

SEQ ID NO: 283879 - DNA, 23 bp, Homo sapiens
taaaagggggctattccctggag

SEQ ID NO: 283880 - DNA, 14 bp, Homo sapiens
taaaagtaattaat

SEQ ID NO: 283881 - DNA, 13 bp, Homo sapiens
taaaagtttcaat

SEQ ID NO: 283882 - DNA, 18 bp, Homo sapiens
taaaagtttcaatgtgat

SEQ ID NO: 283883 - DNA, 19 bp, Homo sapiens
taaaagtttcaatgtgatt

SEQ ID NO: 283884 - DNA, 16 bp, Homo sapiens
tcagctttcagagcca

SEQ ID NO: 283885 - DNA, 18 bp, Homo sapiens
tcagctttcagagccagt

SEQ ID NO: 283886 - DNA, 22 bp, Homo sapiens
tcagctttcagagccagtgaag

SEQ ID NO: 283887 - DNA, 16 bp, Homo sapiens
tcagctttccctggct

SEQ ID NO: 283888 - DNA, 20 bp, Homo sapiens
tcagctttccctggctcagg

SEQ ID NO: 283889 - DNA, 18 bp, Homo sapiens
tcagctttggatgtggtt

SEQ ID NO: 283890 - DNA, 18 bp, Homo sapiens
tcagcttttaataaaatt

SEQ ID NO: 283891 - DNA, 17 bp, Homo sapiens
tcaggaacctggaccaa

SEQ ID NO: 283892 - DNA, 20 bp, Homo sapiens
tcaggaactatgggagcctc

SEQ ID NO: 283893 - DNA, 20 bp, Homo sapiens
tcaggaagttgctgagaaat

SEQ ID NO: 283894 - DNA, 16 bp, Homo sapiens
tcaggaatgggccaag

SEQ ID NO: 283895 - DNA, 12 bp, Homo sapiens
tcaggacagctg

SEQ ID NO: 283896 - DNA, 16 bp, Homo sapiens
tcaggacccaggccct

SEQ ID NO: 283897 - DNA, 14 bp, Homo sapiens
tcaggaccttttga

SEQ ID NO: 283898 - DNA, 17 bp, Homo sapiens
tcaggagagcatcacca

SEQ ID NO: 283899 - DNA, 18 bp, Homo sapiens
tcaggaggagacagtcag

SEQ ID NO: 283900 - DNA, 14 bp, Homo sapiens
tcaggaggctggag

SEQ ID NO: 283901 - DNA, 21 bp, Homo sapiens
tcaggaggtgcctgagagcag

SEQ ID NO: 283902 - DNA, 24 bp, Homo sapiens
tcaggaggtgtctcctaccctctt

SEQ ID NO: 283903 - DNA, 12 bp, Homo sapiens
tcaggagttcct

SEQ ID NO: 283904 - DNA, 16 bp, Homo sapiens
tcaggagttggaatgt

SEQ ID NO: 283905 - DNA, 17 bp, Homo sapiens
tcaggagttgtttctga

SEQ ID NO: 283906 - DNA, 14 bp, Homo sapiens
tcaggatacatgtg

SEQ ID NO: 283907 - DNA, 19 bp, Homo sapiens
tcaggatgcacggtttctg

SEQ ID NO: 283908 - DNA, 16 bp, Homo sapiens
tcaggatttaaaaact

SEQ ID NO: 283909 - DNA, 18 bp, Homo sapiens
tcaggatttggtttttct

SEQ ID NO: 283910 - DNA, 21 bp, Homo sapiens
tcaggatttggtttttctctt

SEQ ID NO: 283911 - DNA, 14 bp, Homo sapiens
tcaggcaaggcagc

SEQ ID NO: 283912 - DNA, 16 bp, Homo sapiens
tcaggcaaggcagctc

SEQ ID NO: 283913 - DNA, 17 bp, Homo sapiens
tcaggcactggtggcat

SEQ ID NO: 283914 - DNA, 15 bp, Homo sapiens
tcaggcagtagcagc

SEQ ID NO: 283915 - DNA, 18 bp, Homo sapiens
tcaggcataggcctgggt

SEQ ID NO: 283916 - DNA, 19 bp, Homo sapiens
tcaggcataggcctgggtg

SEQ ID NO: 283917 - DNA, 14 bp, Homo sapiens
tcaggcatgcctgt

SEQ ID NO: 283918 - DNA, 15 bp, Homo sapiens
tcaggcatgcctgtg

SEQ ID NO: 283919 - DNA, 19 bp, Homo sapiens
tcaggccacctgccccctt

SEQ ID NO: 283920 - DNA, 14 bp, Homo sapiens
tcaggcctcacctg

SEQ ID NO: 283921 - DNA, 18 bp, Homo sapiens
tcaggcctcacctggctt

SEQ ID NO: 283922 - DNA, 20 bp, Homo sapiens
tcaggcctgccaatgccaca

SEQ ID NO: 283923 - DNA, 21 bp, Homo sapiens
tcaggcctgccaatgccacag

SEQ ID NO: 283924 - DNA, 17 bp, Homo sapiens
tcaggcgcagccctagt

SEQ ID NO: 283925 - DNA, 11 bp, Homo sapiens
tcaggctccat

SEQ ID NO: 283926 - DNA, 16 bp, Homo sapiens
tcaggctccattagga

SEQ ID NO: 283927 - DNA, 20 bp, Homo sapiens
tcaggctccattaggatttg

SEQ ID NO: 283928 - DNA, 15 bp, Homo sapiens
tcaggctcttctcct

SEQ ID NO: 283929 - DNA, 21 bp, Homo sapiens
tcaggctcttctcctttcaca

SEQ ID NO: 283930 - DNA, 15 bp, Homo sapiens
tcaggctgcttggga

SEQ ID NO: 283931 - DNA, 19 bp, Homo sapiens
tcagggaactgcttgccca

SEQ ID NO: 283932 - DNA, 21 bp, Homo sapiens
tcagggaactgcttgcccagg

SEQ ID NO: 283933 - DNA, 22 bp, Homo sapiens
tcagggaatccagctccctaga

SEQ ID NO: 283934 - DNA, 18 bp, Homo sapiens
tcagggacagcagcctcc

SEQ ID NO: 283935 - DNA, 14 bp, Homo sapiens
tcagggaccaagga

SEQ ID NO: 283936 - DNA, 20 bp, Homo sapiens
tcagggattttttttttaaa

SEQ ID NO: 283937 - DNA, 22 bp, Homo sapiens
tcagggcactgctgctgccttt

SEQ ID NO: 283938 - DNA, 13 bp, Homo sapiens
tcagggcagggct

SEQ ID NO: 283939 - DNA, 21 bp, Homo sapiens
tcagggccagaaggagggcag

SEQ ID NO: 283940 - DNA, 23 bp, Homo sapiens
tcagggccagaaggagggcagag

SEQ ID NO: 283941 - DNA, 17 bp, Homo sapiens
tcagggccatgcctgcc

SEQ ID NO: 283942 - DNA, 12 bp, Homo sapiens
tcagggcccaga

SEQ ID NO: 283943 - DNA, 14 bp, Homo sapiens
tcagggcccagagg

SEQ ID NO: 283944 - DNA, 21 bp, Homo sapiens
tcagggctctaccaagacata

SEQ ID NO: 283945 - DNA, 12 bp, Homo sapiens
tcagggctgaca

SEQ ID NO: 283946 - DNA, 22 bp, Homo sapiens
tcagggctgacacgtccacccc

SEQ ID NO: 283947 - DNA, 12 bp, Homo sapiens
tcagggctggag

SEQ ID NO: 283948 - DNA, 14 bp, Homo sapiens
tcagggctgggcag

SEQ ID NO: 283949 - DNA, 19 bp, Homo sapiens
tcagggctgggcaggtcct

SEQ ID NO: 283950 - DNA, 22 bp, Homo sapiens
tcagggctgggcaggtcctggg

SEQ ID NO: 283951 - DNA, 16 bp, Homo sapiens
tcaggggactcagccc

SEQ ID NO: 283952 - DNA, 13 bp, Homo sapiens
tcaggggggagaa

SEQ ID NO: 283953 - DNA, 18 bp, Homo sapiens
tcaggggttcgagaccag

SEQ ID NO: 283954 - DNA, 22 bp, Homo sapiens
tcaggggttcgagaccagtctg

SEQ ID NO: 283955 - DNA, 18 bp, Homo sapiens
tcagggtatcccagaccc

SEQ ID NO: 283956 - DNA, 16 bp, Homo sapiens
tcagggtccctcagga

SEQ ID NO: 283957 - DNA, 15 bp, Homo sapiens
tcagggttctcctct

SEQ ID NO: 283958 - DNA, 21 bp, Homo sapiens
tcagggttctcctctcccctc

SEQ ID NO: 283959 - DNA, 23 bp, Homo sapiens
tcagtggactttccaccccctcc

SEQ ID NO: 283960 - DNA, 15 bp, Homo sapiens
tcagtggatcacaca

SEQ ID NO: 283961 - DNA, 19 bp, Homo sapiens
tcagtggcatggctccagt

SEQ ID NO: 283962 - DNA, 23 bp, Homo sapiens
tcagtggttggcaattgtttcaa

SEQ ID NO: 283963 - DNA, 15 bp, Homo sapiens
tcagtgtagccccaa

SEQ ID NO: 283964 - DNA, 13 bp, Homo sapiens
tcagtgtcccggg

SEQ ID NO: 283965 - DNA, 19 bp, Homo sapiens
tcagtgtgccaccctctgc

SEQ ID NO: 283966 - DNA, 17 bp, Homo sapiens
tcagtgtggagaggggt

SEQ ID NO: 283967 - DNA, 23 bp, Homo sapiens
tcagtgttaaaaaatttttgaaa

SEQ ID NO: 283968 - DNA, 23 bp, Homo sapiens
tcagtgttcttctcaaggacaca

SEQ ID NO: 283969 - DNA, 16 bp, Homo sapiens
tcagtgtttaaataaa

SEQ ID NO: 283970 - DNA, 15 bp, Homo sapiens
tcagttaagttgctg

SEQ ID NO: 283971 - DNA, 16 bp, Homo sapiens
tcagttattcattctg

SEQ ID NO: 283972 - DNA, 16 bp, Homo sapiens
tcagttccagcttttg

SEQ ID NO: 283973 - DNA, 20 bp, Homo sapiens
tcagttcccccagtacctcc

SEQ ID NO: 283974 - DNA, 14 bp, Homo sapiens
tcagttcccggagc

SEQ ID NO: 283975 - DNA, 22 bp, Homo sapiens
tcagttcccggagcacagccct

SEQ ID NO: 283976 - DNA, 19 bp, Homo sapiens
tcagttcccttggcctcag

SEQ ID NO: 283977 - DNA, 12 bp, Homo sapiens
tcagttgcagcc

SEQ ID NO: 283978 - DNA, 14 bp, Homo sapiens
tcagttggacagta

SEQ ID NO: 283979 - DNA, 22 bp, Homo sapiens
tcagttggagaaaatgaagaaa

SEQ ID NO: 283980 - DNA, 23 bp, Homo sapiens
tcagtttatccaaggtgtaactc

SEQ ID NO: 283981 - DNA, 13 bp, Homo sapiens
tcagtttctctgg

SEQ ID NO: 283982 - DNA, 14 bp, Homo sapiens
tcagtttctgttgt

SEQ ID NO: 283983 - DNA, 17 bp, Homo sapiens
tcagtttggctgtaatt

SEQ ID NO: 283984 - DNA, 18 bp, Homo sapiens
tcagtttgtcctgtagag

SEQ ID NO: 283985 - DNA, 18 bp, Homo sapiens
tcagtttgtgaagtgatt

SEQ ID NO: 283986 - DNA, 20 bp, Homo sapiens
tcagtttgtgaagtgattga

SEQ ID NO: 283987 - DNA, 19 bp, Homo sapiens
tcagttttagtttcaaaat

SEQ ID NO: 283988 - DNA, 22 bp, Homo sapiens
tcagttttagtttcaaaatgtt

SEQ ID NO: 283989 - DNA, 20 bp, Homo sapiens
tcagttttgtgtacagtatg

SEQ ID NO: 283990 - DNA, 14 bp, Homo sapiens
tcagtttttgctga

SEQ ID NO: 283991 - DNA, 12 bp, Homo sapiens
tcagtttttgtt

SEQ ID NO: 283992 - DNA, 22 bp, Homo sapiens
tcataaaaagcctgcaatttca

SEQ ID NO: 283993 - DNA, 17 bp, Homo sapiens
tcataaaaataaccaaa

SEQ ID NO: 283994 - DNA, 16 bp, Homo sapiens
tcataaaataaagtat

SEQ ID NO: 283995 - DNA, 16 bp, Homo sapiens
tcataaattggctcct

SEQ ID NO: 283996 - DNA, 22 bp, Homo sapiens
tcataaattggctcctttccca

SEQ ID NO: 283997 - DNA, 19 bp, Homo sapiens
tcataagatattctttaca

SEQ ID NO: 283998 - DNA, 23 bp, Homo sapiens
tcataaggcatatacaaataaac

SEQ ID NO: 283999 - DNA, 17 bp, Homo sapiens
tcataaggcctgccctc

SEQ ID NO: 284000 - DNA, 12 bp, Homo sapiens
tcataatgactt

SEQ ID NO: 284001 - DNA, 23 bp, Homo sapiens
tcataattgtcaaaaaccagaat

SEQ ID NO: 284002 - DNA, 14 bp, Homo sapiens
tcataccagtcagt

SEQ ID NO: 284003 - DNA, 11 bp, Homo sapiens
tcatacctgtt

SEQ ID NO: 284004 - DNA, 19 bp, Homo sapiens
tcatacctgttgtacactt

SEQ ID NO: 284005 - DNA, 21 bp, Homo sapiens
tcatactctgttgcctcctct

SEQ ID NO: 284006 - DNA, 23 bp, Homo sapiens
tcatactctgttgcctcctctct

SEQ ID NO: 284007 - DNA, 20 bp, Homo sapiens
tcatactgtcatataatgca

SEQ ID NO: 284008 - DNA, 17 bp, Homo sapiens
tcatagaaggagagccc

SEQ ID NO: 284009 - DNA, 21 bp, Homo sapiens
tcatagaatagcatgttgtag

SEQ ID NO: 284010 - DNA, 15 bp, Homo sapiens
tcatagataccattt

SEQ ID NO: 284011 - DNA, 16 bp, Homo sapiens
tcatagccatacctgg

SEQ ID NO: 284012 - DNA, 17 bp, Homo sapiens
tcatagctgagattcct

SEQ ID NO: 284013 - DNA, 20 bp, Homo sapiens
tcataggaaaagtacattta

SEQ ID NO: 284014 - DNA, 15 bp, Homo sapiens
tcataggcagagccc

SEQ ID NO: 284015 - DNA, 18 bp, Homo sapiens
tcataggcagagcccgcc

SEQ ID NO: 284016 - DNA, 18 bp, Homo sapiens
tcatagggtctcttcagg

SEQ ID NO: 284017 - DNA, 16 bp, Homo sapiens
tcataggttgccaata

SEQ ID NO: 284018 - DNA, 22 bp, Homo sapiens
tcatagtactctttgtagcaaa

SEQ ID NO: 284019 - DNA, 12 bp, Homo sapiens
tcatagtgcctt

SEQ ID NO: 284020 - DNA, 13 bp, Homo sapiens
tcatagtgccttt

SEQ ID NO: 284021 - DNA, 18 bp, Homo sapiens
tcatagtgcctttttcct

SEQ ID NO: 284022 - DNA, 19 bp, Homo sapiens
tcatagtgcctttttcctt

SEQ ID NO: 284023 - DNA, 13 bp, Homo sapiens
tcatagttctgtt

SEQ ID NO: 284024 - DNA, 17 bp, Homo sapiens
tcatagtttctgtaatt

SEQ ID NO: 284025 - DNA, 22 bp, Homo sapiens
tcatagtttctgtaattggctt

SEQ ID NO: 284026 - DNA, 21 bp, Homo sapiens
tcatataacagctcaaagagt

SEQ ID NO: 284027 - DNA, 22 bp, Homo sapiens
tcattcttacaattgcactgct

SEQ ID NO: 284028 - DNA, 19 bp, Homo sapiens
tcattctttgtatcttaaa

SEQ ID NO: 284029 - DNA, 20 bp, Homo sapiens
tcattcttttcagcttgttt

SEQ ID NO: 284030 - DNA, 18 bp, Homo sapiens
tcattgagggaaaacata

SEQ ID NO: 284031 - DNA, 18 bp, Homo sapiens
tcattgattgtcagctac

SEQ ID NO: 284032 - DNA, 11 bp, Homo sapiens
tcattgcattt

SEQ ID NO: 284033 - DNA, 21 bp, Homo sapiens
tcattgcatttattgcagttt

SEQ ID NO: 284034 - DNA, 16 bp, Homo sapiens
tcattgctaaactgat

SEQ ID NO: 284035 - DNA, 17 bp, Homo sapiens
tcattgctaaactgatg

SEQ ID NO: 284036 - DNA, 14 bp, Homo sapiens
tcattgctgtgtca

SEQ ID NO: 284037 - DNA, 21 bp, Homo sapiens
tcattgctttgaagcagttgt

SEQ ID NO: 284038 - DNA, 18 bp, Homo sapiens
tcattgggttttatcagt

SEQ ID NO: 284039 - DNA, 19 bp, Homo sapiens
tcattgggttttatcagtg

SEQ ID NO: 284040 - DNA, 17 bp, Homo sapiens
tcattgtaatgttactg

SEQ ID NO: 284041 - DNA, 19 bp, Homo sapiens
tcattgtaatgttactgat

SEQ ID NO: 284042 - DNA, 17 bp, Homo sapiens
tcattgtagaaacacag

SEQ ID NO: 284043 - DNA, 21 bp, Homo sapiens
tcattgtatatatgtgtgttt

SEQ ID NO: 284044 - DNA, 17 bp, Homo sapiens
tcattgtatgatgtgtt

SEQ ID NO: 284045 - DNA, 18 bp, Homo sapiens
tcattgtatgatgtgttg

SEQ ID NO: 284046 - DNA, 23 bp, Homo sapiens
tcattgtatgatgtgttgtgata

SEQ ID NO: 284047 - DNA, 22 bp, Homo sapiens
tcattgtccatgcctacagata

SEQ ID NO: 284048 - DNA, 11 bp, Homo sapiens
tcattgttaca

SEQ ID NO: 284049 - DNA, 19 bp, Homo sapiens
tccacccaggctgcactgc

SEQ ID NO: 284050 - DNA, 23 bp, Homo sapiens
tccacccaggctgcactgcagtg

SEQ ID NO: 284051 - DNA, 13 bp, Homo sapiens
tccacccagtgct

SEQ ID NO: 284052 - DNA, 14 bp, Homo sapiens
tccacccagtgctg

SEQ ID NO: 284053 - DNA, 15 bp, Homo sapiens
tccacccagtgctgc

SEQ ID NO: 284054 - DNA, 13 bp, Homo sapiens
tccacccattccc

SEQ ID NO: 284055 - DNA, 24 bp, Homo sapiens
tccacccattcccccatgtggctg

SEQ ID NO: 284056 - DNA, 22 bp, Homo sapiens
tccaccccaattaactgaagca

SEQ ID NO: 284057 - DNA, 23 bp, Homo sapiens
tccaccccagtgcacccactctg

SEQ ID NO: 284058 - DNA, 17 bp, Homo sapiens
tccacccccattgtgaa

SEQ ID NO: 284059 - DNA, 18 bp, Homo sapiens
tccacccccattgtgaat

SEQ ID NO: 284060 - DNA, 23 bp, Homo sapiens
tccacccccattgtgaatgttgt

SEQ ID NO: 284061 - DNA, 18 bp, Homo sapiens
tccacccccgcctccctc

SEQ ID NO: 284062 - DNA, 12 bp, Homo sapiens
tccaccccctcc

SEQ ID NO: 284063 - DNA, 18 bp, Homo sapiens
tccaccccggctccccct

SEQ ID NO: 284064 - DNA, 18 bp, Homo sapiens
tccacccgtttccaagcc

SEQ ID NO: 284065 - DNA, 21 bp, Homo sapiens
tccaccctcatttctgccagc

SEQ ID NO: 284066 - DNA, 13 bp, Homo sapiens
tccaccctcccct

SEQ ID NO: 284067 - DNA, 16 bp, Homo sapiens
tccaggctggggcctg

SEQ ID NO: 284068 - DNA, 12 bp, Homo sapiens
tccaggctgtgt

SEQ ID NO: 284069 - DNA, 16 bp, Homo sapiens
tccagggaagctggcc

SEQ ID NO: 284070 - DNA, 16 bp, Homo sapiens
tccagggactgtacct

SEQ ID NO: 284071 - DNA, 23 bp, Homo sapiens
tccagggactgtacctgtaggaa

SEQ ID NO: 284072 - DNA, 14 bp, Homo sapiens
tccagggcagcagc

SEQ ID NO: 284073 - DNA, 14 bp, Homo sapiens
tccagggctagtga

SEQ ID NO: 284074 - DNA, 13 bp, Homo sapiens
tccagggctgccc

SEQ ID NO: 284075 - DNA, 21 bp, Homo sapiens
tccagggggcctgcaggcccc

SEQ ID NO: 284076 - DNA, 23 bp, Homo sapiens
tccaggggtcaccttgagaggca

SEQ ID NO: 284077 - DNA, 21 bp, Homo sapiens
tccagggtaggcaaggctgcc

SEQ ID NO: 284078 - DNA, 22 bp, Homo sapiens
tccagggtaggcaaggctgccg

SEQ ID NO: 284079 - DNA, 13 bp, Homo sapiens
tccagggtcttgg

SEQ ID NO: 284080 - DNA, 21 bp, Homo sapiens
tccagggtcttgggctactgg

SEQ ID NO: 284081 - DNA, 22 bp, Homo sapiens
tccagggtcttgggctactggc

SEQ ID NO: 284082 - DNA, 18 bp, Homo sapiens
tccaggtcgggctcagct

SEQ ID NO: 284083 - DNA, 19 bp, Homo sapiens
tccaggtcgggctcagctc

SEQ ID NO: 284084 - DNA, 18 bp, Homo sapiens
tccaggtgagtgtgaggg

SEQ ID NO: 284085 - DNA, 21 bp, Homo sapiens
tccaggtgagtgtgagggcag

SEQ ID NO: 284086 - DNA, 22 bp, Homo sapiens
tccaggtgagtgtgagggcagc

SEQ ID NO: 284087 - DNA, 20 bp, Homo sapiens
tccaggttcgtatagaaaaa

SEQ ID NO: 284088 - DNA, 23 bp, Homo sapiens
tccagtagggaaaatagggtcct

SEQ ID NO: 284089 - DNA, 15 bp, Homo sapiens
tccagtatcttgaag

SEQ ID NO: 284090 - DNA, 16 bp, Homo sapiens
tccagtattgaaaact

SEQ ID NO: 284091 - DNA, 15 bp, Homo sapiens
tccagtcctgctctc

SEQ ID NO: 284092 - DNA, 16 bp, Homo sapiens
tccagtcctgctctct

SEQ ID NO: 284093 - DNA, 21 bp, Homo sapiens
tccagtcctgctctctaccca

SEQ ID NO: 284094 - DNA, 19 bp, Homo sapiens
tccagtctccaccaggaac

SEQ ID NO: 284095 - DNA, 13 bp, Homo sapiens
tccagtctgctgc

SEQ ID NO: 284096 - DNA, 20 bp, Homo sapiens
tccagtctgctgccctccat

SEQ ID NO: 284097 - DNA, 17 bp, Homo sapiens
tccagtctgttctcaca

SEQ ID NO: 284098 - DNA, 17 bp, Homo sapiens
tccagtgcaaccacaca

SEQ ID NO: 284099 - DNA, 20 bp, Homo sapiens
tccagtgcttggctgcccca

SEQ ID NO: 284100 - DNA, 18 bp, Homo sapiens
tccagtggacctgaagga

SEQ ID NO: 284101 - DNA, 20 bp, Homo sapiens
tccagtggcctggctccgct

SEQ ID NO: 284102 - DNA, 19 bp, Homo sapiens
tccagtggctggtttctga

SEQ ID NO: 284103 - DNA, 20 bp, Homo sapiens
tccagtggctggtttctgag

SEQ ID NO: 284104 - DNA, 21 bp, Homo sapiens
tccagtggggtctcagtccag

SEQ ID NO: 284105 - DNA, 16 bp, Homo sapiens
tccagtgtctcggagg

SEQ ID NO: 284106 - DNA, 22 bp, Homo sapiens
tccagtgtggtcttgtttaata

SEQ ID NO: 284107 - DNA, 21 bp, Homo sapiens
tccagtgttcccttctggctg

SEQ ID NO: 284108 - DNA, 13 bp, Homo sapiens
tccagtgttgcct

SEQ ID NO: 284109 - DNA, 14 bp, Homo sapiens
tccagtgtttccac

SEQ ID NO: 284110 - DNA, 15 bp, Homo sapiens
tccagtgtttccacg

SEQ ID NO: 284111 - DNA, 19 bp, Homo sapiens
tccagtgtttccacggctg

SEQ ID NO: 284112 - DNA, 15 bp, Homo sapiens
tccagttctgatgag

SEQ ID NO: 284113 - DNA, 17 bp, Homo sapiens
tccagttctgatgaggc

SEQ ID NO: 284114 - DNA, 21 bp, Homo sapiens
tccagttggactgtggcctca

SEQ ID NO: 284115 - DNA, 22 bp, Homo sapiens
tccagttggactgtggcctcag

SEQ ID NO: 284116 - DNA, 21 bp, Homo sapiens
tccagtttgcccaccacaact

SEQ ID NO: 284117 - DNA, 23 bp, Homo sapiens
tccagttttttgccactgcaaac

SEQ ID NO: 284118 - DNA, 12 bp, Homo sapiens
tccataattatg

SEQ ID NO: 284119 - DNA, 14 bp, Homo sapiens
tccatacagctcta

SEQ ID NO: 284120 - DNA, 13 bp, Homo sapiens
tccatagacacag

SEQ ID NO: 284121 - DNA, 14 bp, Homo sapiens
tccatagacacagt

SEQ ID NO: 284122 - DNA, 23 bp, Homo sapiens
tccatagacacagtattgacttc

SEQ ID NO: 284123 - DNA, 17 bp, Homo sapiens
tccataggaatcatgtt

SEQ ID NO: 284124 - DNA, 15 bp, Homo sapiens
tccatatcagacctc

SEQ ID NO: 284125 - DNA, 13 bp, Homo sapiens
tccatatgctctt

SEQ ID NO: 284126 - DNA, 13 bp, Homo sapiens
tccatatggattt

SEQ ID NO: 284127 - DNA, 18 bp, Homo sapiens
tccatatggattttctat

SEQ ID NO: 284128 - DNA, 20 bp, Homo sapiens
tccatcacagccagcccagc

SEQ ID NO: 284129 - DNA, 21 bp, Homo sapiens
tccatcacagccagcccagct

SEQ ID NO: 284130 - DNA, 16 bp, Homo sapiens
tccatcagcagtgatt

SEQ ID NO: 284131 - DNA, 14 bp, Homo sapiens
tccatcagctccct

SEQ ID NO: 284132 - DNA, 22 bp, Homo sapiens
tccatccataaatccagttcta

SEQ ID NO: 284133 - DNA, 15 bp, Homo sapiens
tccatccccagttgg

SEQ ID NO: 284134 - DNA, 17 bp, Homo sapiens
tccatcccctccctgcc

SEQ ID NO: 284135 - DNA, 21 bp, Homo sapiens
tccatcccctccctgcctgct

SEQ ID NO: 284136 - DNA, 22 bp, Homo sapiens
tccatccctaccccctaagagc

SEQ ID NO: 284137 - DNA, 15 bp, Homo sapiens
tccatcctgccagga

SEQ ID NO: 284138 - DNA, 12 bp, Homo sapiens
tccatctccttg

SEQ ID NO: 284139 - DNA, 17 bp, Homo sapiens
tccatctctctccctta

SEQ ID NO: 284140 - DNA, 16 bp, Homo sapiens
tccatctgtctgtcct

SEQ ID NO: 284141 - DNA, 17 bp, Homo sapiens
tccatctgtctgtccta

SEQ ID NO: 284142 - DNA, 18 bp, Homo sapiens
tccatcttggtagttctg

SEQ ID NO: 284143 - DNA, 21 bp, Homo sapiens
tcattgttacaggtgtactat

SEQ ID NO: 284144 - DNA, 17 bp, Homo sapiens
tcatttaaaatgattag

SEQ ID NO: 284145 - DNA, 21 bp, Homo sapiens
tcatttataaaaccatcaaaa

SEQ ID NO: 284146 - DNA, 15 bp, Homo sapiens
tcatttatcactctg

SEQ ID NO: 284147 - DNA, 12 bp, Homo sapiens
tcatttatctta

SEQ ID NO: 284148 - DNA, 14 bp, Homo sapiens
tcatttatgaaaag

SEQ ID NO: 284149 - DNA, 15 bp, Homo sapiens
tcatttatgaaaaga

SEQ ID NO: 284150 - DNA, 14 bp, Homo sapiens
tcatttattttgac

SEQ ID NO: 284151 - DNA, 20 bp, Homo sapiens
tcatttcagtatcatctcca

SEQ ID NO: 284152 - DNA, 13 bp, Homo sapiens
tcatttcataaaa

SEQ ID NO: 284153 - DNA, 12 bp, Homo sapiens
tcatttcatcta

SEQ ID NO: 284154 - DNA, 16 bp, Homo sapiens
tcatttcattcctaac

SEQ ID NO: 284155 - DNA, 14 bp, Homo sapiens
tcatttcattgtat

SEQ ID NO: 284156 - DNA, 22 bp, Homo sapiens
tcatttccaccaagggtatctg

SEQ ID NO: 284157 - DNA, 12 bp, Homo sapiens
tcatttccagca

SEQ ID NO: 284158 - DNA, 14 bp, Homo sapiens
tcatttctgtctcc

SEQ ID NO: 284159 - DNA, 20 bp, Homo sapiens
tcatttctgtctttaagaac

SEQ ID NO: 284160 - DNA, 19 bp, Homo sapiens
tcatttgcagctgctggtt

SEQ ID NO: 284161 - DNA, 16 bp, Homo sapiens
tcatttgcatcctatc

SEQ ID NO: 284162 - DNA, 16 bp, Homo sapiens
tcatttgctaatgaat

SEQ ID NO: 284163 - DNA, 13 bp, Homo sapiens
tcatttgcttttt

SEQ ID NO: 284164 - DNA, 13 bp, Homo sapiens
tcatttggtgctg

SEQ ID NO: 284165 - DNA, 13 bp, Homo sapiens
tcattttaattat

SEQ ID NO: 284166 - DNA, 13 bp, Homo sapiens
tcattttattcac

SEQ ID NO: 284167 - DNA, 13 bp, Homo sapiens
tcattttcctggg

SEQ ID NO: 284168 - DNA, 16 bp, Homo sapiens
tcattttctctcctcg

SEQ ID NO: 284169 - DNA, 18 bp, Homo sapiens
tcattttggcaagaagac

SEQ ID NO: 284170 - DNA, 20 bp, Homo sapiens
tcattttgggaaattcttgc

SEQ ID NO: 284171 - DNA, 17 bp, Homo sapiens
tcattttgtatgtatgt

SEQ ID NO: 284172 - DNA, 20 bp, Homo sapiens
tccaaaaagattttcagaaa

SEQ ID NO: 284173 - DNA, 22 bp, Homo sapiens
tccaaaaattattataagcatt

SEQ ID NO: 284174 - DNA, 15 bp, Homo sapiens
tccaaaataatttta

SEQ ID NO: 284175 - DNA, 15 bp, Homo sapiens
tccaaactcctgcct

SEQ ID NO: 284176 - DNA, 16 bp, Homo sapiens
tccaaactcctgcctg

SEQ ID NO: 284177 - DNA, 21 bp, Homo sapiens
tccaaagaacttgatttgcat

SEQ ID NO: 284178 - DNA, 22 bp, Homo sapiens
tccaaagaacttgatttgcatg

SEQ ID NO: 284179 - DNA, 17 bp, Homo sapiens
tccaaagactgtactgg

SEQ ID NO: 284180 - DNA, 18 bp, Homo sapiens
tccaaagactgtactggc

SEQ ID NO: 284181 - DNA, 21 bp, Homo sapiens
tccaaagactgtactggccag

SEQ ID NO: 284182 - DNA, 18 bp, Homo sapiens
tccaaagagaaggcctgg

SEQ ID NO: 284183 - DNA, 19 bp, Homo sapiens
tccaaagagaaggcctggt

SEQ ID NO: 284184 - DNA, 17 bp, Homo sapiens
tccaaagcctgggcaga

SEQ ID NO: 284185 - DNA, 16 bp, Homo sapiens
tccaaaggcactgacc

SEQ ID NO: 284186 - DNA, 21 bp, Homo sapiens
tccaaaggggctgctggggca

SEQ ID NO: 284187 - DNA, 21 bp, Homo sapiens
tccaaaggttgtacatagtgg

SEQ ID NO: 284188 - DNA, 22 bp, Homo sapiens
tccaaataaaacttgagcccac

SEQ ID NO: 284189 - DNA, 22 bp, Homo sapiens
tccaaatgtgatcaactgttca

SEQ ID NO: 284190 - DNA, 19 bp, Homo sapiens
tccaaattgatgggtgggc

SEQ ID NO: 284191 - DNA, 17 bp, Homo sapiens
tccaacaccacagacac

SEQ ID NO: 284192 - DNA, 19 bp, Homo sapiens
tccaacatttcctcaggca

SEQ ID NO: 284193 - DNA, 13 bp, Homo sapiens
tccaacccatgca

SEQ ID NO: 284194 - DNA, 17 bp, Homo sapiens
tccaacccatgcatggc

SEQ ID NO: 284195 - DNA, 17 bp, Homo sapiens
tccaacgtggggcagca

SEQ ID NO: 284196 - DNA, 19 bp, Homo sapiens
tccaacgtggggcagcaca

SEQ ID NO: 284197 - DNA, 13 bp, Homo sapiens
tccaactcaggtt

SEQ ID NO: 284198 - DNA, 22 bp, Homo sapiens
tccccatgcatgggaaagtgca

SEQ ID NO: 284199 - DNA, 20 bp, Homo sapiens
tccccatggctcctcaccac

SEQ ID NO: 284200 - DNA, 20 bp, Homo sapiens
tccccatggtgcagtgaaga

SEQ ID NO: 284201 - DNA, 20 bp, Homo sapiens
tccccatgtgcctgcaccag

SEQ ID NO: 284202 - DNA, 19 bp, Homo sapiens
tccccattcattcctgatg

SEQ ID NO: 284203 - DNA, 19 bp, Homo sapiens
tccccatttcctcttcctt

SEQ ID NO: 284204 - DNA, 15 bp, Homo sapiens
tcccccaaaccctgc

SEQ ID NO: 284205 - DNA, 16 bp, Homo sapiens
tcccccaaaccctgct

SEQ ID NO: 284206 - DNA, 18 bp, Homo sapiens
tcccccaaaccctgcttc

SEQ ID NO: 284207 - DNA, 20 bp, Homo sapiens
tcccccaaaccctgcttctg

SEQ ID NO: 284208 - DNA, 21 bp, Homo sapiens
tcccccaaaccctgcttctgc

SEQ ID NO: 284209 - DNA, 20 bp, Homo sapiens
tcccccaacccccaccccac

SEQ ID NO: 284210 - DNA, 14 bp, Homo sapiens
tcccccacctcttt

SEQ ID NO: 284211 - DNA, 21 bp, Homo sapiens
tcccccacgtggactctgtgc

SEQ ID NO: 284212 - DNA, 14 bp, Homo sapiens
tcccccagccagga

SEQ ID NO: 284213 - DNA, 14 bp, Homo sapiens
tcccccagcccaat

SEQ ID NO: 284214 - DNA, 20 bp, Homo sapiens
tcccccagcccaataaaggt

SEQ ID NO: 284215 - DNA, 13 bp, Homo sapiens
tcccccagccctg

SEQ ID NO: 284216 - DNA, 15 bp, Homo sapiens
tcccccagccctgtg

SEQ ID NO: 284217 - DNA, 22 bp, Homo sapiens
tcccccaggctgcgcctgcccg

SEQ ID NO: 284218 - DNA, 19 bp, Homo sapiens
tcccccatgccaccaccca

SEQ ID NO: 284219 - DNA, 15 bp, Homo sapiens
tcccccatgtgcctg

SEQ ID NO: 284220 - DNA, 17 bp, Homo sapiens
tcccccatgtggctgaa

SEQ ID NO: 284221 - DNA, 13 bp, Homo sapiens
tccccccaaatct

SEQ ID NO: 284222 - DNA, 21 bp, Homo sapiens
tccccccactctccccacact

SEQ ID NO: 284223 - DNA, 13 bp, Homo sapiens
tcccccctcccac

SEQ ID NO: 284224 - DNA, 12 bp, Homo sapiens
tcccccctgagt

SEQ ID NO: 284225 - DNA, 17 bp, Homo sapiens
tcccccgacactgctgc

SEQ ID NO: 284226 - DNA, 20 bp, Homo sapiens
tcccccgcaatgtgccccca

SEQ ID NO: 284227 - DNA, 19 bp, Homo sapiens
tcccccgcagacagacaga

SEQ ID NO: 284228 - DNA, 16 bp, Homo sapiens
tcccccggggcaaggt

SEQ ID NO: 284229 - DNA, 14 bp, Homo sapiens
tccccctacccacc

SEQ ID NO: 284230 - DNA, 16 bp, Homo sapiens
tccccctacccaccga

SEQ ID NO: 284231 - DNA, 14 bp, Homo sapiens
tccccctccagtgc

SEQ ID NO: 284232 - DNA, 15 bp, Homo sapiens
tccccctccagtgct

SEQ ID NO: 284233 - DNA, 13 bp, Homo sapiens
tccccctgccagc

SEQ ID NO: 284234 - DNA, 15 bp, Homo sapiens
tccccctgccagcaa

SEQ ID NO: 284235 - DNA, 13 bp, Homo sapiens
tccccctgcccca

SEQ ID NO: 284236 - DNA, 14 bp, Homo sapiens
tcccccttcccagt

SEQ ID NO: 284237 - DNA, 14 bp, Homo sapiens
tcccccttttttgt

SEQ ID NO: 284238 - DNA, 19 bp, Homo sapiens
tcccccttttttgtccccc

SEQ ID NO: 284239 - DNA, 21 bp, Homo sapiens
tcccccttttttgtcccccaa

SEQ ID NO: 284240 - DNA, 15 bp, Homo sapiens
tccccgacagtggct

SEQ ID NO: 284241 - DNA, 22 bp, Homo sapiens
tccccgagtcagggcgacttcc

SEQ ID NO: 284242 - DNA, 19 bp, Homo sapiens
tccccgcagcccgcctgcc

SEQ ID NO: 284243 - DNA, 19 bp, Homo sapiens
tccccgcccgccctcctct

SEQ ID NO: 284244 - DNA, 23 bp, Homo sapiens
tccccgcccgccctcctctgccc

SEQ ID NO: 284245 - DNA, 12 bp, Homo sapiens
tccccgccttcc

SEQ ID NO: 284246 - DNA, 16 bp, Homo sapiens
tccccgctggctgggg

SEQ ID NO: 284247 - DNA, 17 bp, Homo sapiens
tccccggacgctggctc

SEQ ID NO: 284248 - DNA, 14 bp, Homo sapiens
tccccggagctggg

SEQ ID NO: 284249 - DNA, 15 bp, Homo sapiens
tccccggccctacca

SEQ ID NO: 284250 - DNA, 17 bp, Homo sapiens
tccccggccctaccagc

SEQ ID NO: 284251 - DNA, 19 bp, Homo sapiens
tccccgtgtgccccaagag

SEQ ID NO: 284252 - DNA, 22 bp, Homo sapiens
tcccctcacccgctgcccagcc

SEQ ID NO: 284253 - DNA, 17 bp, Homo sapiens
tctgctggtcttcaatt

SEQ ID NO: 284254 - DNA, 16 bp, Homo sapiens
tctgctgtacagatat

SEQ ID NO: 284255 - DNA, 20 bp, Homo sapiens
tctgctgtattgatatcact

SEQ ID NO: 284256 - DNA, 15 bp, Homo sapiens
tctgctgtcctgcag

SEQ ID NO: 284257 - DNA, 22 bp, Homo sapiens
tctgcttacaattccctgctgt

SEQ ID NO: 284258 - DNA, 17 bp, Homo sapiens
tctgcttaccaaaacat

SEQ ID NO: 284259 - DNA, 12 bp, Homo sapiens
tctgcttcaata

SEQ ID NO: 284260 - DNA, 19 bp, Homo sapiens
tctgcttcaataaatcttt

SEQ ID NO: 284261 - DNA, 14 bp, Homo sapiens
tctgcttcagcttg

SEQ ID NO: 284262 - DNA, 14 bp, Homo sapiens
tctgcttcagtgga

SEQ ID NO: 284263 - DNA, 15 bp, Homo sapiens
tctgcttcctcagcc

SEQ ID NO: 284264 - DNA, 14 bp, Homo sapiens
tctgcttgagtcag

SEQ ID NO: 284265 - DNA, 13 bp, Homo sapiens
tctgcttgtcatc

SEQ ID NO: 284266 - DNA, 14 bp, Homo sapiens
tctgcttgtcatcc

SEQ ID NO: 284267 - DNA, 18 bp, Homo sapiens
tctgctttttctttcttt

SEQ ID NO: 284268 - DNA, 19 bp, Homo sapiens
tctggaaaaaaaaaaatat

SEQ ID NO: 284269 - DNA, 22 bp, Homo sapiens
tctggaaagagctgttttggat

SEQ ID NO: 284270 - DNA, 20 bp, Homo sapiens
tctggaaattcttccctggg

SEQ ID NO: 284271 - DNA, 22 bp, Homo sapiens
tctggaaattcttccctggggg

SEQ ID NO: 284272 - DNA, 15 bp, Homo sapiens
tctggaagacgtggc

SEQ ID NO: 284273 - DNA, 16 bp, Homo sapiens
tctggaagcctgctga

SEQ ID NO: 284274 - DNA, 17 bp, Homo sapiens
tctggaagcctgctgat

SEQ ID NO: 284275 - DNA, 14 bp, Homo sapiens
tctggaaggctggc

SEQ ID NO: 284276 - DNA, 18 bp, Homo sapiens
tctggaaggctggctgag

SEQ ID NO: 284277 - DNA, 18 bp, Homo sapiens
tctggaatcccagctccg

SEQ ID NO: 284278 - DNA, 22 bp, Homo sapiens
tctggaatcccagctccgctgc

SEQ ID NO: 284279 - DNA, 12 bp, Homo sapiens
tctggacaagcc

SEQ ID NO: 284280 - DNA, 16 bp, Homo sapiens
tctggaccccaggcca

SEQ ID NO: 284281 - DNA, 17 bp, Homo sapiens
tctggacctctcttgtg

SEQ ID NO: 284282 - DNA, 13 bp, Homo sapiens
tctggactgaagc

SEQ ID NO: 284283 - DNA, 19 bp, Homo sapiens
tctggactgccccagaaaa

SEQ ID NO: 284284 - DNA, 14 bp, Homo sapiens
tctggactggctag

SEQ ID NO: 284285 - DNA, 20 bp, Homo sapiens
tctggacttatttttggact

SEQ ID NO: 284286 - DNA, 13 bp, Homo sapiens
tctggagccacct

SEQ ID NO: 284287 - DNA, 20 bp, Homo sapiens
tctggagccacctgtcccac

SEQ ID NO: 284288 - DNA, 23 bp, Homo sapiens
tctggagccacctgtcccacctc

SEQ ID NO: 284289 - DNA, 12 bp, Homo sapiens
tctggagcccct

SEQ ID NO: 284290 - DNA, 20 bp, Homo sapiens
tctggagcccctatcctgca

SEQ ID NO: 284291 - DNA, 22 bp, Homo sapiens
tctgtagggatttttggctaca

SEQ ID NO: 284292 - DNA, 14 bp, Homo sapiens
tctgtagggctgga

SEQ ID NO: 284293 - DNA, 23 bp, Homo sapiens
tctgtataaaatgcaaaataaat

SEQ ID NO: 284294 - DNA, 20 bp, Homo sapiens
tctgtatatgttgtaataaa

SEQ ID NO: 284295 - DNA, 21 bp, Homo sapiens
tctgtatcaagcccctgtcta

SEQ ID NO: 284296 - DNA, 13 bp, Homo sapiens
tctgtatctctct

SEQ ID NO: 284297 - DNA, 18 bp, Homo sapiens
tctgtattcatacagcac

SEQ ID NO: 284298 - DNA, 19 bp, Homo sapiens
tctgtattcatacagcact

SEQ ID NO: 284299 - DNA, 22 bp, Homo sapiens
tctgtattctgcaacagcctgt

SEQ ID NO: 284300 - DNA, 23 bp, Homo sapiens
tctgtatttatgtgtgaggagct

SEQ ID NO: 284301 - DNA, 18 bp, Homo sapiens
tctgtcatcactccctgg

SEQ ID NO: 284302 - DNA, 20 bp, Homo sapiens
tctgtcatcactccctggat

SEQ ID NO: 284303 - DNA, 15 bp, Homo sapiens
tctgtccaaaggagg

SEQ ID NO: 284304 - DNA, 19 bp, Homo sapiens
tctgtccaaaggaggctgg

SEQ ID NO: 284305 - DNA, 22 bp, Homo sapiens
tctgtccaaaggaggctggcag

SEQ ID NO: 284306 - DNA, 23 bp, Homo sapiens
tctgtccaaaggaggctggcagg

SEQ ID NO: 284307 - DNA, 14 bp, Homo sapiens
tctgtccagaaaat

SEQ ID NO: 284308 - DNA, 16 bp, Homo sapiens
tctgtccaggccactg

SEQ ID NO: 284309 - DNA, 17 bp, Homo sapiens
tctgtccaggccactgt

SEQ ID NO: 284310 - DNA, 13 bp, Homo sapiens
tctgtccatctgt

SEQ ID NO: 284311 - DNA, 21 bp, Homo sapiens
tctgtccatctgtctgtccta

SEQ ID NO: 284312 - DNA, 16 bp, Homo sapiens
tctgtcccactgggac

SEQ ID NO: 284313 - DNA, 17 bp, Homo sapiens
tctgtcccactgggaca

SEQ ID NO: 284314 - DNA, 18 bp, Homo sapiens
tctgtcccagttaactgt

SEQ ID NO: 284315 - DNA, 13 bp, Homo sapiens
tctgtccccagcc

SEQ ID NO: 284316 - DNA, 20 bp, Homo sapiens
tctgtccccgagccgagctc

SEQ ID NO: 284317 - DNA, 15 bp, Homo sapiens
tctgtccctgtccct

SEQ ID NO: 284318 - DNA, 16 bp, Homo sapiens
tctgtcccttgttttt

SEQ ID NO: 284319 - DNA, 20 bp, Homo sapiens
tctgtcccttgtttttgatg

SEQ ID NO: 284320 - DNA, 22 bp, Homo sapiens
tctgtcctatggagcctctgca

SEQ ID NO: 284321 - DNA, 20 bp, Homo sapiens
tctgtccttcagatggaaac

SEQ ID NO: 284322 - DNA, 17 bp, Homo sapiens
tctgtctagaatcctgc

SEQ ID NO: 284323 - DNA, 21 bp, Homo sapiens
tctgtctagaatcctgcttta

SEQ ID NO: 284324 - DNA, 13 bp, Homo sapiens
tctgtctaggaat

SEQ ID NO: 284325 - DNA, 21 bp, Homo sapiens
tctgtctcccctaccaggctg

SEQ ID NO: 284326 - DNA, 17 bp, Homo sapiens
tctgtctctctctcttt

SEQ ID NO: 284327 - DNA, 22 bp, Homo sapiens
tctgtctgagccctgccctcac

SEQ ID NO: 284328 - DNA, 13 bp, Homo sapiens
tctgtctgtccta

SEQ ID NO: 284329 - DNA, 22 bp, Homo sapiens
tctgtctgtccttccttccatt

SEQ ID NO: 284330 - DNA, 14 bp, Homo sapiens
tctgtcttcacagc

SEQ ID NO: 284331 - DNA, 22 bp, Homo sapiens
tctgtcttcacagctctgtgtt

SEQ ID NO: 284332 - DNA, 18 bp, Homo sapiens
tctgtcttccaggcccag

SEQ ID NO: 284333 - DNA, 14 bp, Homo sapiens
tctgtcttcctggt

SEQ ID NO: 284334 - DNA, 15 bp, Homo sapiens
tctgtctttaagaac

SEQ ID NO: 284335 - DNA, 19 bp, Homo sapiens
tctgtctttatgatttcat

SEQ ID NO: 284336 - DNA, 21 bp, Homo sapiens
tctgtgaacgatttagaaaga

SEQ ID NO: 284337 - DNA, 15 bp, Homo sapiens
tctgtgaagaatgaa

SEQ ID NO: 284338 - DNA, 20 bp, Homo sapiens
tctgtgaagaatgaagtgga

SEQ ID NO: 284339 - DNA, 15 bp, Homo sapiens
tctgtgaatacaatt

SEQ ID NO: 284340 - DNA, 20 bp, Homo sapiens
tctgtgaatacaattaaagg

SEQ ID NO: 284341 - DNA, 13 bp, Homo sapiens
tctgtgaattaaa

SEQ ID NO: 284342 - DNA, 18 bp, Homo sapiens
tctgtgactcgcttagct

SEQ ID NO: 284343 - DNA, 21 bp, Homo sapiens
tctgtgactcgcttagctgaa

SEQ ID NO: 284344 - DNA, 14 bp, Homo sapiens
tctgtgagtctgtc

SEQ ID NO: 284345 - DNA, 14 bp, Homo sapiens
tctgtgatcattta

SEQ ID NO: 284346 - DNA, 13 bp, Homo sapiens
tctgtgcaggtgc

SEQ ID NO: 284347 - DNA, 18 bp, Homo sapiens
tctgtgcatttgtgtctg

SEQ ID NO: 284348 - DNA, 19 bp, Homo sapiens
tctgtgcatttgtgtctgc

SEQ ID NO: 284349 - DNA, 15 bp, Homo sapiens
tctgtgccatggatt

SEQ ID NO: 284350 - DNA, 12 bp, Homo sapiens
tctgtgcccagc

SEQ ID NO: 284351 - DNA, 13 bp, Homo sapiens
tctgtgcccagct

SEQ ID NO: 284352 - DNA, 12 bp, Homo sapiens
tctgtgcctaat

SEQ ID NO: 284353 - DNA, 14 bp, Homo sapiens
tctgtgcctaataa

SEQ ID NO: 284354 - DNA, 19 bp, Homo sapiens
tctgtgcctaataaagtct

SEQ ID NO: 284355 - DNA, 19 bp, Homo sapiens
tctgtgcctccccccagac

SEQ ID NO: 284356 - DNA, 23 bp, Homo sapiens
tctgtgcctgggatcagtggggc

SEQ ID NO: 284357 - DNA, 16 bp, Homo sapiens
tctgtgcgtgaaacac

SEQ ID NO: 284358 - DNA, 17 bp, Homo sapiens
tctgtgctaagttgtct

SEQ ID NO: 284359 - DNA, 15 bp, Homo sapiens
tctgtgctcacccat

SEQ ID NO: 284360 - DNA, 19 bp, Homo sapiens
tctgtgctcatcggagact

SEQ ID NO: 284361 - DNA, 19 bp, Homo sapiens
tctgtgctgtgcctgctag

SEQ ID NO: 284362 - DNA, 20 bp, Homo sapiens
tctgtgctgtgcctgctaga

SEQ ID NO: 284363 - DNA, 21 bp, Homo sapiens
tctgtggattcagcttctgtt

SEQ ID NO: 284364 - DNA, 15 bp, Homo sapiens
tctgtggattctata

SEQ ID NO: 284365 - DNA, 22 bp, Homo sapiens
tctgtggattctatatttcata

SEQ ID NO: 284366 - DNA, 17 bp, Homo sapiens
tctgtgggactggccca

SEQ ID NO: 284367 - DNA, 15 bp, Homo sapiens
tctgtggggccacac

SEQ ID NO: 284368 - DNA, 18 bp, Homo sapiens
tctgtggtccagaagaaa

SEQ ID NO: 284369 - DNA, 11 bp, Homo sapiens
tctgtggtggg

SEQ ID NO: 284370 - DNA, 21 bp, Homo sapiens
tctgtggttttcccctccctg

SEQ ID NO: 284371 - DNA, 14 bp, Homo sapiens
tctgtgtcccagca

SEQ ID NO: 284372 - DNA, 15 bp, Homo sapiens
tctgtgtctgtcacc

SEQ ID NO: 284373 - DNA, 18 bp, Homo sapiens
tctgtgtgatgaactttc

SEQ ID NO: 284374 - DNA, 19 bp, Homo sapiens
tctgtgtgcaccttaccaa

SEQ ID NO: 284375 - DNA, 22 bp, Homo sapiens
tctgtgtgcaccttaccaactt

SEQ ID NO: 284376 - DNA, 15 bp, Homo sapiens
tctgtgttttgtgag

SEQ ID NO: 284377 - DNA, 18 bp, Homo sapiens
tctgttaaatatttttgt

SEQ ID NO: 284378 - DNA, 20 bp, Homo sapiens
tctgttaatgttaattaaag

SEQ ID NO: 284379 - DNA, 14 bp, Homo sapiens
tctgttatcctgct

SEQ ID NO: 284380 - DNA, 22 bp, Homo sapiens
tctgttcagtaacagggccttg

SEQ ID NO: 284381 - DNA, 13 bp, Homo sapiens
tctgttccctgct

SEQ ID NO: 284382 - DNA, 22 bp, Homo sapiens
tctgttcctggctcagcctcaa

SEQ ID NO: 284383 - DNA, 11 bp, Homo sapiens
tctgttctcac

SEQ ID NO: 284384 - DNA, 16 bp, Homo sapiens
tctgttctgatattaa

SEQ ID NO: 284385 - DNA, 23 bp, Homo sapiens
tctgttctgatattaatttatca

SEQ ID NO: 284386 - DNA, 16 bp, Homo sapiens
tctgttgcccaggctg

SEQ ID NO: 284387 - DNA, 19 bp, Homo sapiens
tctgttgcctcctctctcc

SEQ ID NO: 284388 - DNA, 15 bp, Homo sapiens
tctgttgtgttcgtt

SEQ ID NO: 284389 - DNA, 20 bp, Homo sapiens
tctgttgtgtttgtcaaaaa

SEQ ID NO: 284390 - DNA, 13 bp, Homo sapiens
tctgttgtttgaa

SEQ ID NO: 284391 - DNA, 12 bp, Homo sapiens
tctgttgttttt

SEQ ID NO: 284392 - DNA, 12 bp, Homo sapiens
tctgtttccata

SEQ ID NO: 284393 - DNA, 11 bp, Homo sapiens
tctgtttcctt

SEQ ID NO: 284394 - DNA, 13 bp, Homo sapiens
tctgttttctgtg

SEQ ID NO: 284395 - DNA, 20 bp, Homo sapiens
tctgttttttttttttgtat

SEQ ID NO: 284396 - DNA, 21 bp, Homo sapiens
tctgttttttttttttgtatt

SEQ ID NO: 284397 - DNA, 19 bp, Homo sapiens
tcttccttttgtatcctcc

SEQ ID NO: 284398 - DNA, 13 bp, Homo sapiens
tcttcggaggtgg

SEQ ID NO: 284399 - DNA, 16 bp, Homo sapiens
tcttctaaaaaaaaac

SEQ ID NO: 284400 - DNA, 15 bp, Homo sapiens
tcttctaatcataac

SEQ ID NO: 284401 - DNA, 20 bp, Homo sapiens
tcttctaatcataacatagt

SEQ ID NO: 284402 - DNA, 16 bp, Homo sapiens
tcttctacaaccagag

SEQ ID NO: 284403 - DNA, 17 bp, Homo sapiens
tcttctacaaccagagc

SEQ ID NO: 284404 - DNA, 19 bp, Homo sapiens
tcttctacaaccagagccc

SEQ ID NO: 284405 - DNA, 19 bp, Homo sapiens
tcttctaccaaatgtgtaa

SEQ ID NO: 284406 - DNA, 20 bp, Homo sapiens
tcttctacctcttccaggaa

SEQ ID NO: 284407 - DNA, 19 bp, Homo sapiens
tcttctacgtataaatatg

SEQ ID NO: 284408 - DNA, 15 bp, Homo sapiens
tcttctcaagtgcct

SEQ ID NO: 284409 - DNA, 15 bp, Homo sapiens
tcttctcagctccac

SEQ ID NO: 284410 - DNA, 18 bp, Homo sapiens
tcttctcatagcattaac

SEQ ID NO: 284411 - DNA, 19 bp, Homo sapiens
tcttctcatagcattaact

SEQ ID NO: 284412 - DNA, 12 bp, Homo sapiens
tcttctccactg

SEQ ID NO: 284413 - DNA, 13 bp, Homo sapiens
tcttctccctgtc

SEQ ID NO: 284414 - DNA, 13 bp, Homo sapiens
tcttctcctttca

SEQ ID NO: 284415 - DNA, 13 bp, Homo sapiens
tcttctcggggac

SEQ ID NO: 284416 - DNA, 16 bp, Homo sapiens
tcttctctccacttct

SEQ ID NO: 284417 - DNA, 15 bp, Homo sapiens
tcttctctcccacac

SEQ ID NO: 284418 - DNA, 22 bp, Homo sapiens
tcttctctccccttttccttca

SEQ ID NO: 284419 - DNA, 14 bp, Homo sapiens
tcttctctcttgat

SEQ ID NO: 284420 - DNA, 15 bp, Homo sapiens
tcttctctgggccca

SEQ ID NO: 284421 - DNA, 20 bp, Homo sapiens
tcttctcttacgctctctgt

SEQ ID NO: 284422 - DNA, 15 bp, Homo sapiens
tcttctctttttcca

SEQ ID NO: 284423 - DNA, 22 bp, Homo sapiens
tcttctgaaatgaaacaaataa

SEQ ID NO: 284424 - DNA, 12 bp, Homo sapiens
tcttctgcctgt

SEQ ID NO: 284425 - DNA, 11 bp, Homo sapiens
tcttctgctcc

SEQ ID NO: 284426 - DNA, 12 bp, Homo sapiens
tcttctgctcca

SEQ ID NO: 284427 - DNA, 13 bp, Homo sapiens
tcttctgctccac

SEQ ID NO: 284428 - DNA, 18 bp, Homo sapiens
tcttctgcttaggagaga

SEQ ID NO: 284429 - DNA, 20 bp, Homo sapiens
tcttctgggcagagcctgtc

SEQ ID NO: 284430 - DNA, 21 bp, Homo sapiens
tcttctgggcagagcctgtcc

SEQ ID NO: 284431 - DNA, 22 bp, Homo sapiens
tcttctgtaaaatgggtatatt

SEQ ID NO: 284432 - DNA, 19 bp, Homo sapiens
tcttctgtagctattcttt

SEQ ID NO: 284433 - DNA, 16 bp, Homo sapiens
tcttctgtccatcagt

SEQ ID NO: 284434 - DNA, 20 bp, Homo sapiens
tcttctgtttttctcaaata

SEQ ID NO: 284435 - DNA, 15 bp, Homo sapiens
tcttcttacatgcat

SEQ ID NO: 284436 - DNA, 18 bp, Homo sapiens
tcttcttccacacatgca

SEQ ID NO: 284437 - DNA, 22 bp, Homo sapiens
tcttcttccctccctatctaac

SEQ ID NO: 284438 - DNA, 12 bp, Homo sapiens
tcttcttctcaa

SEQ ID NO: 284439 - DNA, 23 bp, Homo sapiens
tcttcttgcggcaccgcccaccc

SEQ ID NO: 284440 - DNA, 14 bp, Homo sapiens
tcttctttctcctg

SEQ ID NO: 284441 - DNA, 15 bp, Homo sapiens
tcttgaaacagcctg

SEQ ID NO: 284442 - DNA, 14 bp, Homo sapiens
tcttgaaagctgtg

SEQ ID NO: 284443 - DNA, 14 bp, Homo sapiens
tcttgaagaatatt

SEQ ID NO: 284444 - DNA, 16 bp, Homo sapiens
tcttgaagaatattgt

SEQ ID NO: 284445 - DNA, 13 bp, Homo sapiens
tcttgaataaact

SEQ ID NO: 284446 - DNA, 17 bp, Homo sapiens
tcttgaattgtaaggaa

SEQ ID NO: 284447 - DNA, 19 bp, Homo sapiens
tcttgacattcaaggcatt

SEQ ID NO: 284448 - DNA, 13 bp, Homo sapiens
tcttgactctaaa

SEQ ID NO: 284449 - DNA, 15 bp, Homo sapiens
tcttgactctaaatg

SEQ ID NO: 284450 - DNA, 17 bp, Homo sapiens
tcttgactctaaatgca

SEQ ID NO: 284451 - DNA, 18 bp, Homo sapiens
tcttgactctaaatgcag

SEQ ID NO: 284452 - DNA, 14 bp, Homo sapiens
tcttgagatctgct

SEQ ID NO: 284453 - DNA, 22 bp, Homo sapiens
tcttgagcagtggctggtccag

SEQ ID NO: 284454 - DNA, 16 bp, Homo sapiens
tcttgagcctgagcct

SEQ ID NO: 284455 - DNA, 17 bp, Homo sapiens
tcttgagtgggccccct

SEQ ID NO: 284456 - DNA, 15 bp, Homo sapiens
tcttgatgtaaaatc

SEQ ID NO: 284457 - DNA, 16 bp, Homo sapiens
tcttgatgtaaaatct

SEQ ID NO: 284458 - DNA, 22 bp, Homo sapiens
tcttgatgtaaaatcttgtcat

SEQ ID NO: 284459 - DNA, 12 bp, Homo sapiens
tcttgatgtgaa

SEQ ID NO: 284460 - DNA, 13 bp, Homo sapiens
tcttgatgtgaag

SEQ ID NO: 284461 - DNA, 17 bp, Homo sapiens
tcttgattttcaagctt

SEQ ID NO: 284462 - DNA, 13 bp, Homo sapiens
tcttgcaaaacaa

SEQ ID NO: 284463 - DNA, 18 bp, Homo sapiens
tcttgcaaagcctttaaa

SEQ ID NO: 284464 - DNA, 23 bp, Homo sapiens
tcttgcaccccaaagctttcctg

SEQ ID NO: 284465 - DNA, 23 bp, Homo sapiens
tcttgcatggcaaggactgcagg

SEQ ID NO: 284466 - DNA, 19 bp, Homo sapiens
tcttgccgaggagccaggc

SEQ ID NO: 284467 - DNA, 20 bp, Homo sapiens
tcttgcctaagtattccttt

SEQ ID NO: 284468 - DNA, 13 bp, Homo sapiens
tcttgcctaggcc

SEQ ID NO: 284469 - DNA, 20 bp, Homo sapiens
tcttgcggcaccgcccaccc

SEQ ID NO: 284470 - DNA, 22 bp, Homo sapiens
tcttgctagacaaggttgctgt

SEQ ID NO: 284471 - DNA, 23 bp, Homo sapiens
tcttgctagacaaggttgctgtt

SEQ ID NO: 284472 - DNA, 18 bp, Homo sapiens
tcttgctcaaaaatctgt

SEQ ID NO: 284473 - DNA, 15 bp, Homo sapiens
tcttgctcactccct

SEQ ID NO: 284474 - DNA, 16 bp, Homo sapiens
tcttgctcagagctag

SEQ ID NO: 284475 - DNA, 21 bp, Homo sapiens
tcttgctctttctactctgaa

SEQ ID NO: 284476 - DNA, 13 bp, Homo sapiens
tcttgctgagcac

SEQ ID NO: 284477 - DNA, 11 bp, Homo sapiens
tcttgctgggc

SEQ ID NO: 284478 - DNA, 12 bp, Homo sapiens
tcttgctggtgc

SEQ ID NO: 284479 - DNA, 22 bp, Homo sapiens
tcttgctgtaactcagacattc

SEQ ID NO: 284480 - DNA, 12 bp, Homo sapiens
tcttgcttctgg

SEQ ID NO: 284481 - DNA, 15 bp, Homo sapiens
tcttgcttgtaaaaa

SEQ ID NO: 284482 - DNA, 18 bp, Homo sapiens
tcttggacacttaattct

SEQ ID NO: 284483 - DNA, 22 bp, Homo sapiens
tcttggacccctgaattcaatg

SEQ ID NO: 284484 - DNA, 12 bp, Homo sapiens
tcttggagagga

SEQ ID NO: 284485 - DNA, 19 bp, Homo sapiens
tcttggagaggaggtgtgg

SEQ ID NO: 284486 - DNA, 20 bp, Homo sapiens
tcttggcattttcctcgcct

SEQ ID NO: 284487 - DNA, 16 bp, Homo sapiens
tcttggcgttcctgcc

SEQ ID NO: 284488 - DNA, 19 bp, Homo sapiens
tcttggcttactgcagcct

SEQ ID NO: 284489 - DNA, 21 bp, Homo sapiens
tcttgggaaaatatcactttg

SEQ ID NO: 284490 - DNA, 14 bp, Homo sapiens
tcttgggccccaga

SEQ ID NO: 284491 - DNA, 15 bp, Homo sapiens
tcttgggccccagac

SEQ ID NO: 284492 - DNA, 20 bp, Homo sapiens
tcttgggccccagaccccag

SEQ ID NO: 284493 - DNA, 15 bp, Homo sapiens
tcttgggctactggc

SEQ ID NO: 284494 - DNA, 19 bp, Homo sapiens
tcttgggctactggcagct

SEQ ID NO: 284495 - DNA, 18 bp, Homo sapiens
tcttggtagttctgtgcc

SEQ ID NO: 284496 - DNA, 15 bp, Homo sapiens
tcttggtatgatcat

SEQ ID NO: 284497 - DNA, 14 bp, Homo sapiens
tcttggtatttgga

SEQ ID NO: 284498 - DNA, 22 bp, Homo sapiens
tcttggtatttggatatctgtt

SEQ ID NO: 284499 - DNA, 18 bp, Homo sapiens
tcttggtcaagtttttct

SEQ ID NO: 284500 - DNA, 13 bp, Homo sapiens
tcttggtcagctt

SEQ ID NO: 284501 - DNA, 22 bp, Homo sapiens
tcttggtgccttttgtgtgatg

SEQ ID NO: 284502 - DNA, 23 bp, Homo sapiens
tcttggtgccttttgtgtgatgc

SEQ ID NO: 284503 - DNA, 21 bp, Homo sapiens
tcttggttttgtattgtttaa

SEQ ID NO: 284504 - DNA, 13 bp, Homo sapiens
tcttgtaaaaaga

SEQ ID NO: 284505 - DNA, 16 bp, Homo sapiens
tcttgtaaaactgtga

SEQ ID NO: 284506 - DNA, 15 bp, Homo sapiens
tcttgtaaacctgga

SEQ ID NO: 284507 - DNA, 20 bp, Homo sapiens
tcttgtaacaactaattata

SEQ ID NO: 284508 - DNA, 23 bp, Homo sapiens
tcttgtaactgggttcaaaaaga

SEQ ID NO: 284509 - DNA, 15 bp, Homo sapiens
tcttgtaagcaaaag

SEQ ID NO: 284510 - DNA, 21 bp, Homo sapiens
tcttgtagaagatggactctg

SEQ ID NO: 284511 - DNA, 13 bp, Homo sapiens
tcttgtattttct

SEQ ID NO: 284512 - DNA, 18 bp, Homo sapiens
tcttgtattttcttccca

SEQ ID NO: 284513 - DNA, 16 bp, Homo sapiens
tcttgtcatcagtaag

SEQ ID NO: 284514 - DNA, 11 bp, Homo sapiens
tcttgtcatgt

SEQ ID NO: 284515 - DNA, 17 bp, Homo sapiens
tcttgtcatgtgtataa

SEQ ID NO: 284516 - DNA, 12 bp, Homo sapiens
tcttgtcatttt

SEQ ID NO: 284517 - DNA, 17 bp, Homo sapiens
tcttgtccacattctac

SEQ ID NO: 284518 - DNA, 19 bp, Homo sapiens
tcttgtccacattctactt

SEQ ID NO: 284519 - DNA, 23 bp, Homo sapiens
tcttgtccacattctacttcagc

SEQ ID NO: 284520 - DNA, 21 bp, Homo sapiens
tcttgtcctgtatagcaacct

SEQ ID NO: 284521 - DNA, 15 bp, Homo sapiens
tcttgtctctgggct

SEQ ID NO: 284522 - DNA, 18 bp, Homo sapiens
tcttgtcttttcccctca

SEQ ID NO: 284523 - DNA, 11 bp, Homo sapiens
tcttgtgacta

SEQ ID NO: 284524 - DNA, 16 bp, Homo sapiens
tcttgtgactagtgct

SEQ ID NO: 284525 - DNA, 21 bp, Homo sapiens
tcttgtgactagtgctgaagc

SEQ ID NO: 284526 - DNA, 18 bp, Homo sapiens
tcttgtgctcacgctccc

SEQ ID NO: 284527 - DNA, 19 bp, Homo sapiens
tcttgtgctcacgctcccc

SEQ ID NO: 284528 - DNA, 21 bp, Homo sapiens
tcttgtgcttttcctatttgt

SEQ ID NO: 284529 - DNA, 18 bp, Homo sapiens
tcttgtggaggatgaata

SEQ ID NO: 284530 - DNA, 13 bp, Homo sapiens
tcttgtgtgttta

SEQ ID NO: 284531 - DNA, 13 bp, Homo sapiens
tcttgttctgttt

SEQ ID NO: 284532 - DNA, 16 bp, Homo sapiens
tctttaacatacatct

SEQ ID NO: 284533 - DNA, 19 bp, Homo sapiens
tctttaacatacatctaag

SEQ ID NO: 284534 - DNA, 17 bp, Homo sapiens
tctttaacttagtattt

SEQ ID NO: 284535 - DNA, 14 bp, Homo sapiens
tctttaagactttt

SEQ ID NO: 284536 - DNA, 21 bp, Homo sapiens
tctttaagttttgattaatgt

SEQ ID NO: 284537 - DNA, 13 bp, Homo sapiens
tctttaatctgtt

SEQ ID NO: 284538 - DNA, 20 bp, Homo sapiens
tctttaattgttgcttttac

SEQ ID NO: 284539 - DNA, 21 bp, Homo sapiens
tctttacataattcagagtgg

SEQ ID NO: 284540 - DNA, 14 bp, Homo sapiens
tctttaccttcatt

SEQ ID NO: 284541 - DNA, 17 bp, Homo sapiens
tctttactcggcgtgct

SEQ ID NO: 284542 - DNA, 21 bp, Homo sapiens
tctttagggagacccaataaa

SEQ ID NO: 284543 - DNA, 14 bp, Homo sapiens
tctttagtggagaa

SEQ ID NO: 284544 - DNA, 18 bp, Homo sapiens
tctttatacttaaacagc

SEQ ID NO: 284545 - DNA, 12 bp, Homo sapiens
tctttatgattt

SEQ ID NO: 284546 - DNA, 14 bp, Homo sapiens
tctttatgatttca

SEQ ID NO: 284547 - DNA, 17 bp, Homo sapiens
tctttatgatttcatga

SEQ ID NO: 284548 - DNA, 16 bp, Homo sapiens
tctttattaacctcag

SEQ ID NO: 284549 - DNA, 14 bp, Homo sapiens
tctttatttctgtc

SEQ ID NO: 284550 - DNA, 19 bp, Homo sapiens
tctttatttctgtctcata

SEQ ID NO: 284551 - DNA, 22 bp, Homo sapiens
tctttcaagacagcctaatgaa

SEQ ID NO: 284552 - DNA, 17 bp, Homo sapiens
tctttcaagatcttcaa

SEQ ID NO: 284553 - DNA, 21 bp, Homo sapiens
tctttcaatccacagtattgt

SEQ ID NO: 284554 - DNA, 23 bp, Homo sapiens
tctttcacccttttctgtttgct

SEQ ID NO: 284555 - DNA, 16 bp, Homo sapiens
tctttcagaatacaat

SEQ ID NO: 284556 - DNA, 15 bp, Homo sapiens
tctttcagtattaaa

SEQ ID NO: 284557 - DNA, 17 bp, Homo sapiens
tctttcagtattaaact

SEQ ID NO: 284558 - DNA, 15 bp, Homo sapiens
tctttcatagttctg

SEQ ID NO: 284559 - DNA, 19 bp, Homo sapiens
tctttccaaaggttgtaca

SEQ ID NO: 284560 - DNA, 20 bp, Homo sapiens
tctttccaaaggttgtacat

SEQ ID NO: 284561 - DNA, 22 bp, Homo sapiens
tctttccaggcttccctgactt

SEQ ID NO: 284562 - DNA, 16 bp, Homo sapiens
tctttccatgcagtta

SEQ ID NO: 284563 - DNA, 11 bp, Homo sapiens
tctttccccag

SEQ ID NO: 284564 - DNA, 13 bp, Homo sapiens
tctttccccagag

SEQ ID NO: 284565 - DNA, 14 bp, Homo sapiens
tctttccccagagg

SEQ ID NO: 284566 - DNA, 16 bp, Homo sapiens
tctttcccctcctttg

SEQ ID NO: 284567 - DNA, 19 bp, Homo sapiens
tctttcctagatggcagtc

SEQ ID NO: 284568 - DNA, 12 bp, Homo sapiens
tctttcctcctt

SEQ ID NO: 284569 - DNA, 21 bp, Homo sapiens
tctttcctgcccttttcctgg

SEQ ID NO: 284570 - DNA, 18 bp, Homo sapiens
tctttcctgttgttgtta

SEQ ID NO: 284571 - DNA, 21 bp, Homo sapiens
tctttcctttcatcctcagca

SEQ ID NO: 284572 - DNA, 22 bp, Homo sapiens
tctttcctttcatcctcagcaa

SEQ ID NO: 284573 - DNA, 21 bp, Homo sapiens
tctttcgttggttgtttctct

SEQ ID NO: 284574 - DNA, 19 bp, Homo sapiens
tctttctaatgtagctatt

SEQ ID NO: 284575 - DNA, 18 bp, Homo sapiens
tctttctaatgtgtgaat

SEQ ID NO: 284576 - DNA, 19 bp, Homo sapiens
tctttctactctgaactaa

SEQ ID NO: 284577 - DNA, 17 bp, Homo sapiens
tctttctatataaaatg

SEQ ID NO: 284578 - DNA, 16 bp, Homo sapiens
tctttctcctgtggtt

SEQ ID NO: 284579 - DNA, 21 bp, Homo sapiens
tctttctctcagccttacatt

SEQ ID NO: 284580 - DNA, 12 bp, Homo sapiens
tctttctctctg

SEQ ID NO: 284581 - DNA, 11 bp, Homo sapiens
tctttctctgc

SEQ ID NO: 284582 - DNA, 12 bp, Homo sapiens
tctttctctgcc

SEQ ID NO: 284583 - DNA, 14 bp, Homo sapiens
tctttctgataact

SEQ ID NO: 284584 - DNA, 21 bp, Homo sapiens
tctttctgcagaaacagaaag

SEQ ID NO: 284585 - DNA, 16 bp, Homo sapiens
tctttctggcctgcct

SEQ ID NO: 284586 - DNA, 13 bp, Homo sapiens
tctttctgttttt

SEQ ID NO: 284587 - DNA, 15 bp, Homo sapiens
tctttcttcctctgc

SEQ ID NO: 284588 - DNA, 14 bp, Homo sapiens
tctttctttccaaa

SEQ ID NO: 284589 - DNA, 12 bp, Homo sapiens
tctttctttgct

SEQ ID NO: 284590 - DNA, 13 bp, Homo sapiens
tctttctttgctg

SEQ ID NO: 284591 - DNA, 14 bp, Homo sapiens
tctttctttgctgc

SEQ ID NO: 284592 - DNA, 11 bp, Homo sapiens
tctttcttttt

SEQ ID NO: 284593 - DNA, 22 bp, Homo sapiens
tctttgaaatagtctgtgtgaa

SEQ ID NO: 284594 - DNA, 18 bp, Homo sapiens
tctttgaaatatgcatgt

SEQ ID NO: 284595 - DNA, 19 bp, Homo sapiens
tctttgaaatatgcatgta

SEQ ID NO: 284596 - DNA, 22 bp, Homo sapiens
tctttgacaattcctagataaa

SEQ ID NO: 284597 - DNA, 16 bp, Homo sapiens
tctttgaccaaactgt

SEQ ID NO: 284598 - DNA, 23 bp, Homo sapiens
tctttgacctcaacctgtgatga

SEQ ID NO: 284599 - DNA, 21 bp, Homo sapiens
tctttgagggactgcctctgc

SEQ ID NO: 284600 - DNA, 23 bp, Homo sapiens
tctttgagggactgcctctgcca

SEQ ID NO: 284601 - DNA, 12 bp, Homo sapiens
tctttgcatgga

SEQ ID NO: 284602 - DNA, 20 bp, Homo sapiens
tctttgcccagttcatccca

SEQ ID NO: 284603 - DNA, 20 bp, Homo sapiens
tctttgccttgggctgctcc

SEQ ID NO: 284604 - DNA, 16 bp, Homo sapiens
tctttgctcagtggat

SEQ ID NO: 284605 - DNA, 16 bp, Homo sapiens
tctttgctcccagttt

SEQ ID NO: 284606 - DNA, 15 bp, Homo sapiens
tctttgctgcccctg

SEQ ID NO: 284607 - DNA, 20 bp, Homo sapiens
tctttgctgcccctgtctgg

SEQ ID NO: 284608 - DNA, 23 bp, Homo sapiens
tctttgctgctgtggaaaggatt

SEQ ID NO: 284609 - DNA, 14 bp, Homo sapiens
tctttgctgtgcca

SEQ ID NO: 284610 - DNA, 22 bp, Homo sapiens
tctttgctgttgacgttgatct

SEQ ID NO: 284611 - DNA, 19 bp, Homo sapiens
tctttgggggattcaaatg

SEQ ID NO: 284612 - DNA, 21 bp, Homo sapiens
tctttgggggattcaaatgca

SEQ ID NO: 284613 - DNA, 23 bp, Homo sapiens
tctttgggggattcaaatgcatg

SEQ ID NO: 284614 - DNA, 14 bp, Homo sapiens
tctttggttcctca

SEQ ID NO: 284615 - DNA, 16 bp, Homo sapiens
tctttgtaaggacttg

SEQ ID NO: 284616 - DNA, 21 bp, Homo sapiens
tctttgtaagtaaactgccct

SEQ ID NO: 284617 - DNA, 20 bp, Homo sapiens
tctttgtacagacaacaaac

SEQ ID NO: 284618 - DNA, 14 bp, Homo sapiens
tctttgtatcttaa

SEQ ID NO: 284619 - DNA, 18 bp, Homo sapiens
tctttgtatcttaaatct

SEQ ID NO: 284620 - DNA, 20 bp, Homo sapiens
tctttgtatcttaaatctgt

SEQ ID NO: 284621 - DNA, 17 bp, Homo sapiens
tctttgtcaatgctcta

SEQ ID NO: 284622 - DNA, 21 bp, Homo sapiens
tctttgtcccggataggctaa

SEQ ID NO: 284623 - DNA, 22 bp, Homo sapiens
tctttgtcccggataggctaat

SEQ ID NO: 284624 - DNA, 13 bp, Homo sapiens
tctttgtggggct

SEQ ID NO: 284625 - DNA, 18 bp, Homo sapiens
tctttgtggggcttggcg

SEQ ID NO: 284626 - DNA, 15 bp, Homo sapiens
tctttgttacaggca

SEQ ID NO: 284627 - DNA, 15 bp, Homo sapiens
tcttttaatgatact

SEQ ID NO: 284628 - DNA, 21 bp, Homo sapiens
tcttttaccccacgaagacat

SEQ ID NO: 284629 - DNA, 17 bp, Homo sapiens
tcttttactatcttttc

SEQ ID NO: 284630 - DNA, 11 bp, Homo sapiens
tcttttactgt

SEQ ID NO: 284631 - DNA, 16 bp, Homo sapiens
tcttttagagtaaact

SEQ ID NO: 284632 - DNA, 16 bp, Homo sapiens
tcttttagttttagtt

SEQ ID NO: 284633 - DNA, 13 bp, Homo sapiens
tcttttatatata

SEQ ID NO: 284634 - DNA, 15 bp, Homo sapiens
tcttttatatataaa

SEQ ID NO: 284635 - DNA, 18 bp, Homo sapiens
tcttttatatataaaata

SEQ ID NO: 284636 - DNA, 15 bp, Homo sapiens
tcttttatatctgta

SEQ ID NO: 284637 - DNA, 14 bp, Homo sapiens
tcttttatttcatt

SEQ ID NO: 284638 - DNA, 20 bp, Homo sapiens
tcttttatttcattcatatc

SEQ ID NO: 284639 - DNA, 21 bp, Homo sapiens
tcttttcagcttgtttctata

SEQ ID NO: 284640 - DNA, 15 bp, Homo sapiens
tcttttccagaaaga

SEQ ID NO: 284641 - DNA, 13 bp, Homo sapiens
tcttttccctctc

SEQ ID NO: 284642 - DNA, 19 bp, Homo sapiens
tcttttctggaatgtaatc

SEQ ID NO: 284643 - DNA, 22 bp, Homo sapiens
tcttttctgtcaccaaatttgt

SEQ ID NO: 284644 - DNA, 15 bp, Homo sapiens
tcttttcttctcagg

SEQ ID NO: 284645 - DNA, 12 bp, Homo sapiens
tcttttcttggc

SEQ ID NO: 284646 - DNA, 20 bp, Homo sapiens
tcttttcttggcgttcctgc

SEQ ID NO: 284647 - DNA, 15 bp, Homo sapiens
tcttttgacatgtgg

SEQ ID NO: 284648 - DNA, 17 bp, Homo sapiens
tcttttgacatgtggaa

SEQ ID NO: 284649 - DNA, 23 bp, Homo sapiens
tcttttgagttaggttaataaat

SEQ ID NO: 284650 - DNA, 13 bp, Homo sapiens
tcttttgatacat

SEQ ID NO: 284651 - DNA, 15 bp, Homo sapiens
tcttttgatacattt

SEQ ID NO: 284652 - DNA, 12 bp, Homo sapiens
tcttttgattct

SEQ ID NO: 284653 - DNA, 15 bp, Homo sapiens
tcttttgcttaggaa

SEQ ID NO: 284654 - DNA, 17 bp, Homo sapiens
tcttttggattgctacg

SEQ ID NO: 284655 - DNA, 14 bp, Homo sapiens
tcttttgttctctc

SEQ ID NO: 284656 - DNA, 21 bp, Homo sapiens
tctttttaaaaagttgcacat

SEQ ID NO: 284657 - DNA, 17 bp, Homo sapiens
tctttttcaaaactagt

SEQ ID NO: 284658 - DNA, 20 bp, Homo sapiens
tctttttccagaatttggaa

SEQ ID NO: 284659 - DNA, 17 bp, Homo sapiens
tctttttccagcttgag

SEQ ID NO: 284660 - DNA, 12 bp, Homo sapiens
tctttttccttt

SEQ ID NO: 284661 - DNA, 21 bp, Homo sapiens
tgaaagaaaggggcaggagct

SEQ ID NO: 284662 - DNA, 18 bp, Homo sapiens
tgaaagaagtcaaatgaa

SEQ ID NO: 284663 - DNA, 22 bp, Homo sapiens
tgaaagaagtcaaatgaatgag

SEQ ID NO: 284664 - DNA, 18 bp, Homo sapiens
tgaaagacaaagaaggaa

SEQ ID NO: 284665 - DNA, 17 bp, Homo sapiens
tgaaagaccttctccaa

SEQ ID NO: 284666 - DNA, 18 bp, Homo sapiens
tgaaagagaaccagtttc

SEQ ID NO: 284667 - DNA, 15 bp, Homo sapiens
tgaaagatgcaagca

SEQ ID NO: 284668 - DNA, 18 bp, Homo sapiens
tgaaagatggctgtgcct

SEQ ID NO: 284669 - DNA, 19 bp, Homo sapiens
tgaaagatggctgtgcctc

SEQ ID NO: 284670 - DNA, 21 bp, Homo sapiens
tgaaagatggctgtgcctctg

SEQ ID NO: 284671 - DNA, 22 bp, Homo sapiens
tgaaagatggctgtgcctctgc

SEQ ID NO: 284672 - DNA, 20 bp, Homo sapiens
tgaaagcagggaatttctat

SEQ ID NO: 284673 - DNA, 15 bp, Homo sapiens
tgaaagcctctggaa

SEQ ID NO: 284674 - DNA, 15 bp, Homo sapiens
tgaaagcctgtctct

SEQ ID NO: 284675 - DNA, 22 bp, Homo sapiens
tgaaagctccatgtttagaaat

SEQ ID NO: 284676 - DNA, 13 bp, Homo sapiens
tgaaagctgcttc

SEQ ID NO: 284677 - DNA, 18 bp, Homo sapiens
tgaaagcttccatgttta

SEQ ID NO: 284678 - DNA, 10 bp, Homo sapiens
tgaaaggaaa

SEQ ID NO: 284679 - DNA, 22 bp, Homo sapiens
tgaaaggaagagctaataaatc

SEQ ID NO: 284680 - DNA, 19 bp, Homo sapiens
tgaaaggaccagtttcttg

SEQ ID NO: 284681 - DNA, 14 bp, Homo sapiens
tgaaagggagcccc

SEQ ID NO: 284682 - DNA, 22 bp, Homo sapiens
tgaaagggagctatcaggaaca

SEQ ID NO: 284683 - DNA, 22 bp, Homo sapiens
tgaaagggctatggcaaggggg

SEQ ID NO: 284684 - DNA, 20 bp, Homo sapiens
tgaaagtctcctgtatcatt

SEQ ID NO: 284685 - DNA, 17 bp, Homo sapiens
tgaaagtcttgtgacta

SEQ ID NO: 284686 - DNA, 23 bp, Homo sapiens
tgaaagtcttgtgactagtgctg

SEQ ID NO: 284687 - DNA, 11 bp, Homo sapiens
tgaaagtgact

SEQ ID NO: 284688 - DNA, 18 bp, Homo sapiens
tgaaagtgtaaaatagaa

SEQ ID NO: 284689 - DNA, 20 bp, Homo sapiens
tgaaagtttgttctgcagag

SEQ ID NO: 284690 - DNA, 17 bp, Homo sapiens
tgaaagttttccagtat

SEQ ID NO: 284691 - DNA, 23 bp, Homo sapiens
tgaaagtttttaatatttattga

SEQ ID NO: 284692 - DNA, 22 bp, Homo sapiens
tgaaataaaaaaaaaaggatga

SEQ ID NO: 284693 - DNA, 22 bp, Homo sapiens
tgaaatacatatgataaatttg

SEQ ID NO: 284694 - DNA, 13 bp, Homo sapiens
tgaaatagtctgt

SEQ ID NO: 284695 - DNA, 21 bp, Homo sapiens
tgaaatagtggttcttggaaa

SEQ ID NO: 284696 - DNA, 16 bp, Homo sapiens
tgaaatagttatttta

SEQ ID NO: 284697 - DNA, 19 bp, Homo sapiens
tgaaatagttattttaata

SEQ ID NO: 284698 - DNA, 20 bp, Homo sapiens
tgaaatagttattttaatac

SEQ ID NO: 284699 - DNA, 10 bp, Homo sapiens
tgaaatataa

SEQ ID NO: 284700 - DNA, 20 bp, Homo sapiens
tgaaatataaactgtgagat

SEQ ID NO: 284701 - DNA, 19 bp, Homo sapiens
tgaaatatttgcttattta

SEQ ID NO: 284702 - DNA, 17 bp, Homo sapiens
tgaaatcaccttttcta

SEQ ID NO: 284703 - DNA, 19 bp, Homo sapiens
tgaaatcaccttttctaaa

SEQ ID NO: 284704 - DNA, 20 bp, Homo sapiens
tgaaatcaccttttctaaaa

SEQ ID NO: 284705 - DNA, 14 bp, Homo sapiens
tgaaatgaaaacat

SEQ ID NO: 284706 - DNA, 16 bp, Homo sapiens
tgaaatgactgtctaa

SEQ ID NO: 284707 - DNA, 17 bp, Homo sapiens
tgaaatgccctcctaaa

SEQ ID NO: 284708 - DNA, 20 bp, Homo sapiens
tgaaatgccctcctaaatgt

SEQ ID NO: 284709 - DNA, 16 bp, Homo sapiens
tgaaatgctggcattt

SEQ ID NO: 284710 - DNA, 15 bp, Homo sapiens
tgaaatgggagatgg

SEQ ID NO: 284711 - DNA, 19 bp, Homo sapiens
tgaaatgggagatggtcag

SEQ ID NO: 284712 - DNA, 16 bp, Homo sapiens
tgaaatgggctttaac

SEQ ID NO: 284713 - DNA, 18 bp, Homo sapiens
tgaaatgggctttaacaa

SEQ ID NO: 284714 - DNA, 22 bp, Homo sapiens
tgaaatgttacatgtagaaaaa

SEQ ID NO: 284715 - DNA, 17 bp, Homo sapiens
tgaaattatgtatgttt

SEQ ID NO: 284716 - DNA, 18 bp, Homo sapiens
tgaaattatgtatgttta

SEQ ID NO: 284717 - DNA, 19 bp, Homo sapiens
tgaaattatgtatgtttac

SEQ ID NO: 284718 - DNA, 18 bp, Homo sapiens
tgaaattcacaaagttaa

SEQ ID NO: 284719 - DNA, 12 bp, Homo sapiens
tgaaattgtaaa

SEQ ID NO: 284720 - DNA, 20 bp, Homo sapiens
tgaaatttaaaaatctttca

SEQ ID NO: 284721 - DNA, 21 bp, Homo sapiens
tgaaatttattagttaatata

SEQ ID NO: 284722 - DNA, 22 bp, Homo sapiens
tgaaatttattagttaatatat

SEQ ID NO: 284723 - DNA, 15 bp, Homo sapiens
tgaaatttgttaata

SEQ ID NO: 284724 - DNA, 18 bp, Homo sapiens
tgaaatttgttaatatat

SEQ ID NO: 284725 - DNA, 19 bp, Homo sapiens
tgaaattttaaaaattgtt

SEQ ID NO: 284726 - DNA, 17 bp, Homo sapiens
tgaaattttctagactt

SEQ ID NO: 284727 - DNA, 20 bp, Homo sapiens
tgaaattttctagactttct

SEQ ID NO: 284728 - DNA, 15 bp, Homo sapiens
tgacaatcaactcta

SEQ ID NO: 284729 - DNA, 13 bp, Homo sapiens
tgacaatgatgat

SEQ ID NO: 284730 - DNA, 21 bp, Homo sapiens
tgacaattcccgggcccttca

SEQ ID NO: 284731 - DNA, 19 bp, Homo sapiens
tgacaatttcaaaatgcat

SEQ ID NO: 284732 - DNA, 21 bp, Homo sapiens
tgacaatttcaaaatgcatgt

SEQ ID NO: 284733 - DNA, 16 bp, Homo sapiens
tgacaattttgtacaa

SEQ ID NO: 284734 - DNA, 17 bp, Homo sapiens
tgacacactcaccattt

SEQ ID NO: 284735 - DNA, 19 bp, Homo sapiens
tgacacaggggacactgaa

SEQ ID NO: 284736 - DNA, 16 bp, Homo sapiens
tgacacataaatctgt

SEQ ID NO: 284737 - DNA, 17 bp, Homo sapiens
tgacacataaatctgtc

SEQ ID NO: 284738 - DNA, 18 bp, Homo sapiens
tgacacataaatctgtct

SEQ ID NO: 284739 - DNA, 16 bp, Homo sapiens
tgacaccaagaaacca

SEQ ID NO: 284740 - DNA, 14 bp, Homo sapiens
tgacaccagggcca

SEQ ID NO: 284741 - DNA, 15 bp, Homo sapiens
tgacaccagggccag

SEQ ID NO: 284742 - DNA, 17 bp, Homo sapiens
tgacacctaccatgctg

SEQ ID NO: 284743 - DNA, 13 bp, Homo sapiens
tgacactgagaac

SEQ ID NO: 284744 - DNA, 18 bp, Homo sapiens
tgacactgcgaactctca

SEQ ID NO: 284745 - DNA, 23 bp, Homo sapiens
tgacagaaaaaaaaatgttttat

SEQ ID NO: 284746 - DNA, 14 bp, Homo sapiens
tgacagagagttct

SEQ ID NO: 284747 - DNA, 20 bp, Homo sapiens
tgacagagagttctggtgag

SEQ ID NO: 284748 - DNA, 18 bp, Homo sapiens
tgacagagcaagactctg

SEQ ID NO: 284749 - DNA, 16 bp, Homo sapiens
tgacagagcaggtctg

SEQ ID NO: 284750 - DNA, 23 bp, Homo sapiens
tgacagagcaggtctgcaggcca

SEQ ID NO: 284751 - DNA, 20 bp, Homo sapiens
tgacagagcccagcatccct

SEQ ID NO: 284752 - DNA, 15 bp, Homo sapiens
tgacagagttcacta

SEQ ID NO: 284753 - DNA, 21 bp, Homo sapiens
tgacagatcctccatttttgt

SEQ ID NO: 284754 - DNA, 14 bp, Homo sapiens
tgacagcagcctgt

SEQ ID NO: 284755 - DNA, 17 bp, Homo sapiens
tgacagcagcctgtgag

SEQ ID NO: 284756 - DNA, 21 bp, Homo sapiens
tgacagcatttcagctgtgag

SEQ ID NO: 284757 - DNA, 11 bp, Homo sapiens
tgacagcctcc

SEQ ID NO: 284758 - DNA, 14 bp, Homo sapiens
tgacagccttgggc

SEQ ID NO: 284759 - DNA, 18 bp, Homo sapiens
tgacagcgacagaaaacc

SEQ ID NO: 284760 - DNA, 19 bp, Homo sapiens
tgacagcgacagaaaacct

SEQ ID NO: 284761 - DNA, 22 bp, Homo sapiens
tgacagctgttccacaggggct

SEQ ID NO: 284762 - DNA, 11 bp, Homo sapiens
tgacaggaaga

SEQ ID NO: 284763 - DNA, 14 bp, Homo sapiens
tgacaggaagactg

SEQ ID NO: 284764 - DNA, 16 bp, Homo sapiens
tgacaggaagactgga

SEQ ID NO: 284765 - DNA, 15 bp, Homo sapiens
tgacaggcccagtgg

SEQ ID NO: 284766 - DNA, 23 bp, Homo sapiens
tgacgtgaccaattgccctgcca

SEQ ID NO: 284767 - DNA, 16 bp, Homo sapiens
tgactaaagagagaat

SEQ ID NO: 284768 - DNA, 12 bp, Homo sapiens
tgactaaagcat

SEQ ID NO: 284769 - DNA, 22 bp, Homo sapiens
tgactaagccccgcatatgtga

SEQ ID NO: 284770 - DNA, 16 bp, Homo sapiens
tgactagaaagtgaat

SEQ ID NO: 284771 - DNA, 21 bp, Homo sapiens
tgactagaagggccagtcctg

SEQ ID NO: 284772 - DNA, 18 bp, Homo sapiens
tgactagggattcaggct

SEQ ID NO: 284773 - DNA, 20 bp, Homo sapiens
tgactagggattcaggctgc

SEQ ID NO: 284774 - DNA, 21 bp, Homo sapiens
tgactagggattcaggctgct

SEQ ID NO: 284775 - DNA, 23 bp, Homo sapiens
tgactagggattcaggctgcttg

SEQ ID NO: 284776 - DNA, 20 bp, Homo sapiens
tgactagtacaaattataaa

SEQ ID NO: 284777 - DNA, 23 bp, Homo sapiens
tgactagtacaaattataaaaag

SEQ ID NO: 284778 - DNA, 14 bp, Homo sapiens
tgactagtgctgaa

SEQ ID NO: 284779 - DNA, 18 bp, Homo sapiens
tgactagtgctgaagctt

SEQ ID NO: 284780 - DNA, 22 bp, Homo sapiens
tgactataaacattaaaagaag

SEQ ID NO: 284781 - DNA, 14 bp, Homo sapiens
tgactatatagaga

SEQ ID NO: 284782 - DNA, 16 bp, Homo sapiens
tgactatatagagatg

SEQ ID NO: 284783 - DNA, 20 bp, Homo sapiens
tgactatgaaacgaatataa

SEQ ID NO: 284784 - DNA, 17 bp, Homo sapiens
tgactattcttgatgta

SEQ ID NO: 284785 - DNA, 19 bp, Homo sapiens
tgactattcttgatgtaaa

SEQ ID NO: 284786 - DNA, 15 bp, Homo sapiens
tgactcaacatgtta

SEQ ID NO: 284787 - DNA, 23 bp, Homo sapiens
tgactcaggatttaaaaactgga

SEQ ID NO: 284788 - DNA, 19 bp, Homo sapiens
tgactcaggtggtgtcctt

SEQ ID NO: 284789 - DNA, 16 bp, Homo sapiens
tgactcagtgtatttt

SEQ ID NO: 284790 - DNA, 14 bp, Homo sapiens
tgactcattcccag

SEQ ID NO: 284791 - DNA, 13 bp, Homo sapiens
tgactcattcttt

SEQ ID NO: 284792 - DNA, 15 bp, Homo sapiens
tgactcattcttttg

SEQ ID NO: 284793 - DNA, 17 bp, Homo sapiens
tgactccagaatttccc

SEQ ID NO: 284794 - DNA, 20 bp, Homo sapiens
tgactccagaatttcccaaa

SEQ ID NO: 284795 - DNA, 23 bp, Homo sapiens
tgactccagaatttcccaaagca

SEQ ID NO: 284796 - DNA, 23 bp, Homo sapiens
tgactccagagtctgagcccccg

SEQ ID NO: 284797 - DNA, 22 bp, Homo sapiens
tgactcccaaagagctgcctaa

SEQ ID NO: 284798 - DNA, 22 bp, Homo sapiens
tgactcccttaaaatagaaata

SEQ ID NO: 284799 - DNA, 24 bp, Homo sapiens
tgactcctcccttccccactctgc

SEQ ID NO: 284800 - DNA, 21 bp, Homo sapiens
tgactcgcttagctgaaacct

SEQ ID NO: 284801 - DNA, 16 bp, Homo sapiens
tgactcgtctgactgt

SEQ ID NO: 284802 - DNA, 20 bp, Homo sapiens
tgactcgtctgactgtgtgt

SEQ ID NO: 284803 - DNA, 18 bp, Homo sapiens
tgactctgagtccactgc

SEQ ID NO: 284804 - DNA, 20 bp, Homo sapiens
tgactctgagtccactgctc

SEQ ID NO: 284805 - DNA, 20 bp, Homo sapiens
tgactgaagcgaacatcttc

SEQ ID NO: 284806 - DNA, 21 bp, Homo sapiens
tgactgaagcgaacatcttca

SEQ ID NO: 284807 - DNA, 18 bp, Homo sapiens
tgactgaaggggcacacc

SEQ ID NO: 284808 - DNA, 21 bp, Homo sapiens
tgactgaatttgggcctcttg

SEQ ID NO: 284809 - DNA, 17 bp, Homo sapiens
tgactgacggctgtgta

SEQ ID NO: 284810 - DNA, 23 bp, Homo sapiens
tgactgacggctgtgtatttctg

SEQ ID NO: 284811 - DNA, 20 bp, Homo sapiens
tgactgagtctggcaaacat

SEQ ID NO: 284812 - DNA, 21 bp, Homo sapiens
tgactgagtctggcaaacatg

SEQ ID NO: 284813 - DNA, 20 bp, Homo sapiens
tgactgatgttaggctgggc

SEQ ID NO: 284814 - DNA, 17 bp, Homo sapiens
tgactgcacccagctcc

SEQ ID NO: 284815 - DNA, 13 bp, Homo sapiens
tgactgctgctcc

SEQ ID NO: 284816 - DNA, 14 bp, Homo sapiens
tgactgctgctccc

SEQ ID NO: 284817 - DNA, 16 bp, Homo sapiens
tgactgctgctcccca

SEQ ID NO: 284818 - DNA, 20 bp, Homo sapiens
tgactgctgctccccacccc

SEQ ID NO: 284819 - DNA, 16 bp, Homo sapiens
tgactggcaggtgcag

SEQ ID NO: 284820 - DNA, 19 bp, Homo sapiens
tgactggccccagggactc

SEQ ID NO: 284821 - DNA, 14 bp, Homo sapiens
tgactggctgtctg

SEQ ID NO: 284822 - DNA, 14 bp, Homo sapiens
tgactggctttcct

SEQ ID NO: 284823 - DNA, 12 bp, Homo sapiens
tgactgggggcc

SEQ ID NO: 284824 - DNA, 18 bp, Homo sapiens
tgactgtactcctcccag

SEQ ID NO: 284825 - DNA, 22 bp, Homo sapiens
tgactgtactcctcccaggcgc

SEQ ID NO: 284826 - DNA, 18 bp, Homo sapiens
tgactgtaggcgcccctg

SEQ ID NO: 284827 - DNA, 19 bp, Homo sapiens
tgactgtgagcgagcctgg

SEQ ID NO: 284828 - DNA, 23 bp, Homo sapiens
tgactgttgcctttgctcttata

SEQ ID NO: 284829 - DNA, 12 bp, Homo sapiens
tgactgtttggc

SEQ ID NO: 284830 - DNA, 16 bp, Homo sapiens
tgactgtttggcttat

SEQ ID NO: 284831 - DNA, 17 bp, Homo sapiens
tgactgtttttgtagtg

SEQ ID NO: 284832 - DNA, 23 bp, Homo sapiens
tgacttatttagtattctgcctc

SEQ ID NO: 284833 - DNA, 18 bp, Homo sapiens
tgacttattttctctgtg

SEQ ID NO: 284834 - DNA, 20 bp, Homo sapiens
tgacttcagactctctcctc

SEQ ID NO: 284835 - DNA, 22 bp, Homo sapiens
tgacttcagactctctcctctc

SEQ ID NO: 284836 - DNA, 17 bp, Homo sapiens
tgacttcagctgcctga

SEQ ID NO: 284837 - DNA, 22 bp, Homo sapiens
tgacttcagctgcctgaaacag

SEQ ID NO: 284838 - DNA, 13 bp, Homo sapiens
tgacttcatttct

SEQ ID NO: 284839 - DNA, 16 bp, Homo sapiens
tgacttcccagctggc

SEQ ID NO: 284840 - DNA, 17 bp, Homo sapiens
tgacttcccagctggca

SEQ ID NO: 284841 - DNA, 17 bp, Homo sapiens
tgacttcctggtgaggc

SEQ ID NO: 284842 - DNA, 20 bp, Homo sapiens
tgacttctaatatcattcac

SEQ ID NO: 284843 - DNA, 17 bp, Homo sapiens
tgacttctttttggcat

SEQ ID NO: 284844 - DNA, 16 bp, Homo sapiens
tgactttcctatgaca

SEQ ID NO: 284845 - DNA, 13 bp, Homo sapiens
tgactttctcccc

SEQ ID NO: 284846 - DNA, 17 bp, Homo sapiens
tgacttttacagctttt

SEQ ID NO: 284847 - DNA, 18 bp, Homo sapiens
tgacttttccaagccctt

SEQ ID NO: 284848 - DNA, 19 bp, Homo sapiens
tgacttttccatgtatcta

SEQ ID NO: 284849 - DNA, 17 bp, Homo sapiens
tgactttttagccagtg

SEQ ID NO: 284850 - DNA, 22 bp, Homo sapiens
tgactttttctgagcttttcat

SEQ ID NO: 284851 - DNA, 21 bp, Homo sapiens
tgagaaacgtccatctctctc

SEQ ID NO: 284852 - DNA, 21 bp, Homo sapiens
tgagaaagcccacctgggctg

SEQ ID NO: 284853 - DNA, 18 bp, Homo sapiens
tgagaaatacagtgcttt

SEQ ID NO: 284854 - DNA, 15 bp, Homo sapiens
tgagaaatgaataat

SEQ ID NO: 284855 - DNA, 23 bp, Homo sapiens
tgagaacaagtcacagctgcagc

SEQ ID NO: 284856 - DNA, 22 bp, Homo sapiens
tgagaacagatctccaaagctt

SEQ ID NO: 284857 - DNA, 24 bp, Homo sapiens
tgagaacatggtgtgtgtctctga

SEQ ID NO: 284858 - DNA, 17 bp, Homo sapiens
tgagaactgactttctc

SEQ ID NO: 284859 - DNA, 20 bp, Homo sapiens
tgagaactggttcttgcctt

SEQ ID NO: 284860 - DNA, 17 bp, Homo sapiens
tgagaacttttcataga

SEQ ID NO: 284861 - DNA, 17 bp, Homo sapiens
tgagaagagggcctgtg

SEQ ID NO: 284862 - DNA, 21 bp, Homo sapiens
tgagaagagggcctgtgggag

SEQ ID NO: 284863 - DNA, 16 bp, Homo sapiens
tgagaagattgtgaat

SEQ ID NO: 284864 - DNA, 20 bp, Homo sapiens
tgagaagcctcatgggagtc

SEQ ID NO: 284865 - DNA, 19 bp, Homo sapiens
tgagaagcttttgaataaa

SEQ ID NO: 284866 - DNA, 19 bp, Homo sapiens
tgagaaggccctgtgccct

SEQ ID NO: 284867 - DNA, 17 bp, Homo sapiens
tgagaaggcgaggagag

SEQ ID NO: 284868 - DNA, 19 bp, Homo sapiens
tgagaagtaattcctctga

SEQ ID NO: 284869 - DNA, 19 bp, Homo sapiens
tgagaagtactttgtgctg

SEQ ID NO: 284870 - DNA, 19 bp, Homo sapiens
tgagctccagacccccagc

SEQ ID NO: 284871 - DNA, 20 bp, Homo sapiens
tgagctccagacccccagca

SEQ ID NO: 284872 - DNA, 20 bp, Homo sapiens
tgagctccccaatccaaccc

SEQ ID NO: 284873 - DNA, 17 bp, Homo sapiens
tgagctcccctggagcc

SEQ ID NO: 284874 - DNA, 20 bp, Homo sapiens
tgagctcccctggagccagc

SEQ ID NO: 284875 - DNA, 16 bp, Homo sapiens
tgagctcctctgggca

SEQ ID NO: 284876 - DNA, 16 bp, Homo sapiens
tgagctctcggaactg

SEQ ID NO: 284877 - DNA, 19 bp, Homo sapiens
tgagctctctaatagaagt

SEQ ID NO: 284878 - DNA, 15 bp, Homo sapiens
tgagctcttggcagg

SEQ ID NO: 284879 - DNA, 14 bp, Homo sapiens
tgagctgcagcccc

SEQ ID NO: 284880 - DNA, 14 bp, Homo sapiens
tgagctgcctgctc

SEQ ID NO: 284881 - DNA, 16 bp, Homo sapiens
tgagctgcctgctctg

SEQ ID NO: 284882 - DNA, 19 bp, Homo sapiens
tgagctgcctgctctgcag

SEQ ID NO: 284883 - DNA, 12 bp, Homo sapiens
tgagctggaagg

SEQ ID NO: 284884 - DNA, 21 bp, Homo sapiens
tgagctggaaggagtgagagg

SEQ ID NO: 284885 - DNA, 12 bp, Homo sapiens
tgagctgggaag

SEQ ID NO: 284886 - DNA, 21 bp, Homo sapiens
tgagctgggaagctgtactca

SEQ ID NO: 284887 - DNA, 15 bp, Homo sapiens
tgagctggtttgact

SEQ ID NO: 284888 - DNA, 22 bp, Homo sapiens
tgagctgtgttttgtctgagcc

SEQ ID NO: 284889 - DNA, 23 bp, Homo sapiens
tgagcttagccttgtgccctgcc

SEQ ID NO: 284890 - DNA, 17 bp, Homo sapiens
tgagcttcggttctcca

SEQ ID NO: 284891 - DNA, 21 bp, Homo sapiens
tgagcttcggttctccagaat

SEQ ID NO: 284892 - DNA, 16 bp, Homo sapiens
tgagcttctctgtgaa

SEQ ID NO: 284893 - DNA, 15 bp, Homo sapiens
tgagcttgagctccc

SEQ ID NO: 284894 - DNA, 17 bp, Homo sapiens
tgagcttgagctcccct

SEQ ID NO: 284895 - DNA, 16 bp, Homo sapiens
tgagcttggccagaag

SEQ ID NO: 284896 - DNA, 21 bp, Homo sapiens
tgagctttggacgcacacagc

SEQ ID NO: 284897 - DNA, 22 bp, Homo sapiens
tgagcttttcagttaagttgct

SEQ ID NO: 284898 - DNA, 18 bp, Homo sapiens
tgagcttttcatggaagt

SEQ ID NO: 284899 - DNA, 17 bp, Homo sapiens
tgaggaacaatcacaaa

SEQ ID NO: 284900 - DNA, 19 bp, Homo sapiens
tgaggaagctccagtcctg

SEQ ID NO: 284901 - DNA, 23 bp, Homo sapiens
tgaggaaggaggggaagctgcag

SEQ ID NO: 284902 - DNA, 17 bp, Homo sapiens
tgaggaatgctctgtgc

SEQ ID NO: 284903 - DNA, 20 bp, Homo sapiens
tgaggacacaccccacaccc

SEQ ID NO: 284904 - DNA, 16 bp, Homo sapiens
tgaggacacatgtcca

SEQ ID NO: 284905 - DNA, 14 bp, Homo sapiens
tgaggacaggagag

SEQ ID NO: 284906 - DNA, 16 bp, Homo sapiens
tgaggacctccacctg

SEQ ID NO: 284907 - DNA, 18 bp, Homo sapiens
tgaggacggggcagagct

SEQ ID NO: 284908 - DNA, 19 bp, Homo sapiens
tgaggacggggcagagctg

SEQ ID NO: 284909 - DNA, 16 bp, Homo sapiens
tgaggagcagcttcag

SEQ ID NO: 284910 - DNA, 20 bp, Homo sapiens
tgaggagcagcttcagttgt

SEQ ID NO: 284911 - DNA, 15 bp, Homo sapiens
tgaggagccaggccg

SEQ ID NO: 284912 - DNA, 13 bp, Homo sapiens
tgaggagctgctg

SEQ ID NO: 284913 - DNA, 14 bp, Homo sapiens
tgaggaggaagcag

SEQ ID NO: 284914 - DNA, 18 bp, Homo sapiens
tgaggaggaaggagagaa

SEQ ID NO: 284915 - DNA, 14 bp, Homo sapiens
tgaggaggaggcag

SEQ ID NO: 284916 - DNA, 19 bp, Homo sapiens
tgaggaggaggcagaacca

SEQ ID NO: 284917 - DNA, 17 bp, Homo sapiens
tgaggaggcagaaagca

SEQ ID NO: 284918 - DNA, 18 bp, Homo sapiens
tgaggagggtggaggaag

SEQ ID NO: 284919 - DNA, 21 bp, Homo sapiens
tgaggagtattaagaatgcag

SEQ ID NO: 284920 - DNA, 12 bp, Homo sapiens
tgaggagtccaa

SEQ ID NO: 284921 - DNA, 22 bp, Homo sapiens
tgaggatgacccggggcagctg

SEQ ID NO: 284922 - DNA, 15 bp, Homo sapiens
tgaggatgagctgga

SEQ ID NO: 284923 - DNA, 14 bp, Homo sapiens
tgaggatgaggccg

SEQ ID NO: 284924 - DNA, 20 bp, Homo sapiens
tgaggcaaaggccagcagca

SEQ ID NO: 284925 - DNA, 21 bp, Homo sapiens
tgaggcaaaggccagcagcag

SEQ ID NO: 284926 - DNA, 13 bp, Homo sapiens
tgaggcaagagaa

SEQ ID NO: 284927 - DNA, 14 bp, Homo sapiens
tgaggcaagagaaa

SEQ ID NO: 284928 - DNA, 17 bp, Homo sapiens
tgaggcaagagaaatga

SEQ ID NO: 284929 - DNA, 20 bp, Homo sapiens
tgaggcaataaaaatcatag

SEQ ID NO: 284930 - DNA, 16 bp, Homo sapiens
tgaggcactgataata

SEQ ID NO: 284931 - DNA, 13 bp, Homo sapiens
tgaggcagaacct

SEQ ID NO: 284932 - DNA, 23 bp, Homo sapiens
tgaggcagaacctggtggctgga

SEQ ID NO: 284933 - DNA, 18 bp, Homo sapiens
tgaggcagcagaattgct

SEQ ID NO: 284934 - DNA, 14 bp, Homo sapiens
tgaggcaggggagt

SEQ ID NO: 284935 - DNA, 17 bp, Homo sapiens
tgaggcagttaaataat

SEQ ID NO: 284936 - DNA, 11 bp, Homo sapiens
tgaggcccaga

SEQ ID NO: 284937 - DNA, 13 bp, Homo sapiens
tgaggcccagaga

SEQ ID NO: 284938 - DNA, 19 bp, Homo sapiens
tgaggcccagcagagccgt

SEQ ID NO: 284939 - DNA, 15 bp, Homo sapiens
tgaggcccagcctgt

SEQ ID NO: 284940 - DNA, 13 bp, Homo sapiens
tgaggcccaggga

SEQ ID NO: 284941 - DNA, 20 bp, Homo sapiens
tgaggcccagggagaggcca

SEQ ID NO: 284942 - DNA, 23 bp, Homo sapiens
tgaggcccagggagaggccatga

SEQ ID NO: 284943 - DNA, 16 bp, Homo sapiens
tgaggccccaggccct

SEQ ID NO: 284944 - DNA, 17 bp, Homo sapiens
tgaggccgctagaggcc

SEQ ID NO: 284945 - DNA, 19 bp, Homo sapiens
tgaggccgctagaggcctg

SEQ ID NO: 284946 - DNA, 19 bp, Homo sapiens
tgaggcctggactttcctg

SEQ ID NO: 284947 - DNA, 20 bp, Homo sapiens
tgaggcctggactttcctgc

SEQ ID NO: 284948 - DNA, 20 bp, Homo sapiens
tgaggcgctcgctcccatgc

SEQ ID NO: 284949 - DNA, 16 bp, Homo sapiens
tgaggctaaaacaaat

SEQ ID NO: 284950 - DNA, 13 bp, Homo sapiens
tgaggctgtcctg

SEQ ID NO: 284951 - DNA, 16 bp, Homo sapiens
tgaggcttaacaatgt

SEQ ID NO: 284952 - DNA, 13 bp, Homo sapiens
tgaggcttccagg

SEQ ID NO: 284953 - DNA, 16 bp, Homo sapiens
tgaggcttccaggctc

SEQ ID NO: 284954 - DNA, 18 bp, Homo sapiens
tgaggcttccaggctctt

SEQ ID NO: 284955 - DNA, 19 bp, Homo sapiens
tgaggcttctccttctcct

SEQ ID NO: 284956 - DNA, 16 bp, Homo sapiens
tgaggcttgggcccag

SEQ ID NO: 284957 - DNA, 19 bp, Homo sapiens
tgaggcttgggcccagtag

SEQ ID NO: 284958 - DNA, 21 bp, Homo sapiens
tgaggcttgggcccagtagcc

SEQ ID NO: 284959 - DNA, 18 bp, Homo sapiens
tgaggcttttcccaccag

SEQ ID NO: 284960 - DNA, 14 bp, Homo sapiens
tgagggaaaacata

SEQ ID NO: 284961 - DNA, 13 bp, Homo sapiens
tgagggaagccca

SEQ ID NO: 284962 - DNA, 18 bp, Homo sapiens
tgagggaagcccacccgc

SEQ ID NO: 284963 - DNA, 21 bp, Homo sapiens
tgagggaagcccacccgcccc

SEQ ID NO: 284964 - DNA, 22 bp, Homo sapiens
tgagggaagcccacccgcccca

SEQ ID NO: 284965 - DNA, 23 bp, Homo sapiens
tgagggacaaatttaaaacaaac

SEQ ID NO: 284966 - DNA, 19 bp, Homo sapiens
tgagggaccttggagagct

SEQ ID NO: 284967 - DNA, 16 bp, Homo sapiens
tgagggacgaggtcaa

SEQ ID NO: 284968 - DNA, 16 bp, Homo sapiens
tgagggactgcctctg

SEQ ID NO: 284969 - DNA, 14 bp, Homo sapiens
tgagggataagcaa

SEQ ID NO: 284970 - DNA, 17 bp, Homo sapiens
tgagggataagcaaaag

SEQ ID NO: 284971 - DNA, 22 bp, Homo sapiens
tgagggcagcactgggaagctg

SEQ ID NO: 284972 - DNA, 21 bp, Homo sapiens
tgagggcagggttctagaagg

SEQ ID NO: 284973 - DNA, 19 bp, Homo sapiens
tgagggcagtggggagcat

SEQ ID NO: 284974 - DNA, 21 bp, Homo sapiens
tgagggcattaaaaatagtaa

SEQ ID NO: 284975 - DNA, 16 bp, Homo sapiens
tgagggcccctctgcc

SEQ ID NO: 284976 - DNA, 20 bp, Homo sapiens
tgagggctaattctgggaag

SEQ ID NO: 284977 - DNA, 13 bp, Homo sapiens
tgaggggagagga

SEQ ID NO: 284978 - DNA, 16 bp, Homo sapiens
tgaggggagaggaaat

SEQ ID NO: 284979 - DNA, 21 bp, Homo sapiens
tgaggggaggaaactcacctg

SEQ ID NO: 284980 - DNA, 17 bp, Homo sapiens
tgaggggcaacgaagaa

SEQ ID NO: 284981 - DNA, 20 bp, Homo sapiens
tgaggggccactgggcccca

SEQ ID NO: 284982 - DNA, 13 bp, Homo sapiens
tgagggggagctg

SEQ ID NO: 284983 - DNA, 22 bp, Homo sapiens
tgagggtaataaacttagaata

SEQ ID NO: 284984 - DNA, 19 bp, Homo sapiens
tgagggtcttcttacatgc

SEQ ID NO: 284985 - DNA, 21 bp, Homo sapiens
tgagggtgcttgttccctctc

SEQ ID NO: 284986 - DNA, 22 bp, Homo sapiens
tgagggtgtccgctgctgcttt

SEQ ID NO: 284987 - DNA, 22 bp, Homo sapiens
tgaggtaccagttgtatttaat

SEQ ID NO: 284988 - DNA, 20 bp, Homo sapiens
tgaggtcatttctaaggtgt

SEQ ID NO: 284989 - DNA, 18 bp, Homo sapiens
tgaggtctcttgagggag

SEQ ID NO: 284990 - DNA, 16 bp, Homo sapiens
tgaggtcttttacata

SEQ ID NO: 284991 - DNA, 15 bp, Homo sapiens
tgaggtgaaagggag

SEQ ID NO: 284992 - DNA, 18 bp, Homo sapiens
tgaggtgaaagggagcta

SEQ ID NO: 284993 - DNA, 18 bp, Homo sapiens
tgaggtgataggcaagga

SEQ ID NO: 284994 - DNA, 22 bp, Homo sapiens
tgaggtggtctgaatgttctga

SEQ ID NO: 284995 - DNA, 16 bp, Homo sapiens
tgaggttaaaatataa

SEQ ID NO: 284996 - DNA, 22 bp, Homo sapiens
tgaggttaaaatataaattaag

SEQ ID NO: 284997 - DNA, 19 bp, Homo sapiens
tgaggttatgagaaaaaaa

SEQ ID NO: 284998 - DNA, 21 bp, Homo sapiens
tgaggttatgagaaaaaaaca

SEQ ID NO: 284999 - DNA, 17 bp, Homo sapiens
tgaggtttcacctccgt

SEQ ID NO: 285000 - DNA, 16 bp, Homo sapiens
tgagtaaataaactct

SEQ ID NO: 285001 - DNA, 13 bp, Homo sapiens
tgagtaagagctg

SEQ ID NO: 285002 - DNA, 22 bp, Homo sapiens
tgagtaccaaatccacaagcca

SEQ ID NO: 285003 - DNA, 13 bp, Homo sapiens
tgagtagctggat

SEQ ID NO: 285004 - DNA, 23 bp, Homo sapiens
tgagtaggcggcgatttttgtat

SEQ ID NO: 285005 - DNA, 11 bp, Homo sapiens
tgagtatgtgt

SEQ ID NO: 285006 - DNA, 15 bp, Homo sapiens
tgagtcacctcctcc

SEQ ID NO: 285007 - DNA, 23 bp, Homo sapiens
tgagtcacctcctccactcactc

SEQ ID NO: 285008 - DNA, 17 bp, Homo sapiens
tgagtcagggcccagag

SEQ ID NO: 285009 - DNA, 18 bp, Homo sapiens
tgagtcatcaaaaagagt

SEQ ID NO: 285010 - DNA, 18 bp, Homo sapiens
tgagtcctggcatgggaa

SEQ ID NO: 285011 - DNA, 19 bp, Homo sapiens
tgagtcctggcatgggaat

SEQ ID NO: 285012 - DNA, 18 bp, Homo sapiens
tgagtccttaaacagggc

SEQ ID NO: 285013 - DNA, 19 bp, Homo sapiens
tgagtcggccccacatggg

SEQ ID NO: 285014 - DNA, 19 bp, Homo sapiens
tgagtcggctgggcagggc

SEQ ID NO: 285015 - DNA, 20 bp, Homo sapiens
tgagtcggctgggcagggcc

SEQ ID NO: 285016 - DNA, 23 bp, Homo sapiens
tgagtctcattcctctgtccccg

SEQ ID NO: 285017 - DNA, 11 bp, Homo sapiens
tgagtctctga

SEQ ID NO: 285018 - DNA, 12 bp, Homo sapiens
tgagtctctgaa

SEQ ID NO: 285019 - DNA, 14 bp, Homo sapiens
tgagtctcttcaga

SEQ ID NO: 285020 - DNA, 21 bp, Homo sapiens
tgagtctggcaaacatgtgca

SEQ ID NO: 285021 - DNA, 15 bp, Homo sapiens
tgagtctggctaggg

SEQ ID NO: 285022 - DNA, 12 bp, Homo sapiens
tgagtctgtcct

SEQ ID NO: 285023 - DNA, 13 bp, Homo sapiens
tgagtctgtcctt

SEQ ID NO: 285024 - DNA, 18 bp, Homo sapiens
tgagtctgtcctttccca

SEQ ID NO: 285025 - DNA, 22 bp, Homo sapiens
tgagtctgtgaataaagccaca

SEQ ID NO: 285026 - DNA, 12 bp, Homo sapiens
tgagtctgtgga

SEQ ID NO: 285027 - DNA, 20 bp, Homo sapiens
tgagtgacatcggttcagga

SEQ ID NO: 285028 - DNA, 18 bp, Homo sapiens
tgagtgagaagataaaaa

SEQ ID NO: 285029 - DNA, 17 bp, Homo sapiens
tgagtgatcccatttct

SEQ ID NO: 285030 - DNA, 20 bp, Homo sapiens
tgagtgatcctccaacttca

SEQ ID NO: 285031 - DNA, 14 bp, Homo sapiens
tgagtgcagaggct

SEQ ID NO: 285032 - DNA, 17 bp, Homo sapiens
tgagtgcagctctggag

SEQ ID NO: 285033 - DNA, 13 bp, Homo sapiens
tgagtgccttaca

SEQ ID NO: 285034 - DNA, 14 bp, Homo sapiens
tgagtgccttacac

SEQ ID NO: 285035 - DNA, 19 bp, Homo sapiens
tgagtggaatgcagggaag

SEQ ID NO: 285036 - DNA, 14 bp, Homo sapiens
tgagtggcagccat

SEQ ID NO: 285037 - DNA, 20 bp, Homo sapiens
tgagtgggaggagagggcag

SEQ ID NO: 285038 - DNA, 21 bp, Homo sapiens
tgagtgggaggcgtgcccccc

SEQ ID NO: 285039 - DNA, 12 bp, Homo sapiens
tgagtgggcccc

SEQ ID NO: 285040 - DNA, 16 bp, Homo sapiens
tgagtgggccccctct

SEQ ID NO: 285041 - DNA, 15 bp, Homo sapiens
tgagtgggctgggcc

SEQ ID NO: 285042 - DNA, 23 bp, Homo sapiens
tgagtggggagacacctcagagc

SEQ ID NO: 285043 - DNA, 16 bp, Homo sapiens
tgagtggtgaggggcc

SEQ ID NO: 285044 - DNA, 14 bp, Homo sapiens
tgagtgtaagtgtg

SEQ ID NO: 285045 - DNA, 21 bp, Homo sapiens
tgagtgtcaaacgtgcccccc

SEQ ID NO: 285046 - DNA, 15 bp, Homo sapiens
tgagtgtgagggcag

SEQ ID NO: 285047 - DNA, 22 bp, Homo sapiens
tgagtgtgagggcagcactggg

SEQ ID NO: 285048 - DNA, 19 bp, Homo sapiens
tgagtgtgcaagcaaagaa

SEQ ID NO: 285049 - DNA, 14 bp, Homo sapiens
tgagtgtggctccc

SEQ ID NO: 285050 - DNA, 16 bp, Homo sapiens
tgagtgtggctcccct

SEQ ID NO: 285051 - DNA, 14 bp, Homo sapiens
tgagtgttcatttt

SEQ ID NO: 285052 - DNA, 23 bp, Homo sapiens
tgagtgttcattttagtgactgt

SEQ ID NO: 285053 - DNA, 22 bp, Homo sapiens
tgagttacttgtctgaggcctc

SEQ ID NO: 285054 - DNA, 22 bp, Homo sapiens
tgagttctacataagtaattca

SEQ ID NO: 285055 - DNA, 11 bp, Homo sapiens
tgagttctcac

SEQ ID NO: 285056 - DNA, 18 bp, Homo sapiens
tgagttctcactatgttt

SEQ ID NO: 285057 - DNA, 19 bp, Homo sapiens
tgagttctcactatgtttc

SEQ ID NO: 285058 - DNA, 21 bp, Homo sapiens
tgagttctcactatgtttctc

SEQ ID NO: 285059 - DNA, 22 bp, Homo sapiens
tgagttctcactatgtttctca

SEQ ID NO: 285060 - DNA, 22 bp, Homo sapiens
tgagttgaggggcttccctctg

SEQ ID NO: 285061 - DNA, 20 bp, Homo sapiens
tgagttgcaccattctttct

SEQ ID NO: 285062 - DNA, 23 bp, Homo sapiens
tgagttgcaccattctttcttgg

SEQ ID NO: 285063 - DNA, 19 bp, Homo sapiens
tgagtttaaaaaaataaca

SEQ ID NO: 285064 - DNA, 19 bp, Homo sapiens
tgagtttaccatttgtaat

SEQ ID NO: 285065 - DNA, 16 bp, Homo sapiens
tgagtttcatttttca

SEQ ID NO: 285066 - DNA, 18 bp, Homo sapiens
tgagtttccagctaagcc

SEQ ID NO: 285067 - DNA, 15 bp, Homo sapiens
tgagttttaaagaag

SEQ ID NO: 285068 - DNA, 17 bp, Homo sapiens
tgagttttttctcttgg

SEQ ID NO: 285069 - DNA, 18 bp, Homo sapiens
tgagttttttctcttggg

SEQ ID NO: 285070 - DNA, 16 bp, Homo sapiens
tgataaaagatacatt

SEQ ID NO: 285071 - DNA, 18 bp, Homo sapiens
tgataaaagggcaaatct

SEQ ID NO: 285072 - DNA, 20 bp, Homo sapiens
tgataaaagggcaaatctgc

SEQ ID NO: 285073 - DNA, 15 bp, Homo sapiens
tgataaaatgttcct

SEQ ID NO: 285074 - DNA, 17 bp, Homo sapiens
tgataaaatgttccttt

SEQ ID NO: 285075 - DNA, 21 bp, Homo sapiens
tgataaacattaaacactgta

SEQ ID NO: 285076 - DNA, 14 bp, Homo sapiens
tgataacactggag

SEQ ID NO: 285077 - DNA, 15 bp, Homo sapiens
tgataacttggggag

SEQ ID NO: 285078 - DNA, 14 bp, Homo sapiens
tgataagtggaaaa

SEQ ID NO: 285079 - DNA, 14 bp, Homo sapiens
tgataataaattga

SEQ ID NO: 285080 - DNA, 18 bp, Homo sapiens
tgataatgtattgcagtg

SEQ ID NO: 285081 - DNA, 12 bp, Homo sapiens
tgatacagcctt

SEQ ID NO: 285082 - DNA, 14 bp, Homo sapiens
tgatacagtctcca

SEQ ID NO: 285083 - DNA, 19 bp, Homo sapiens
tgatacatttatcttctgt

SEQ ID NO: 285084 - DNA, 21 bp, Homo sapiens
tgatacatttatcttctgttt

SEQ ID NO: 285085 - DNA, 19 bp, Homo sapiens
tgatagacttcgaaaacag

SEQ ID NO: 285086 - DNA, 21 bp, Homo sapiens
tgatagacttcgaaaacagat

SEQ ID NO: 285087 - DNA, 21 bp, Homo sapiens
tgatagcactggtttgtttct

SEQ ID NO: 285088 - DNA, 13 bp, Homo sapiens
tgatagcattgct

SEQ ID NO: 285089 - DNA, 15 bp, Homo sapiens
tgatagcgttggaat

SEQ ID NO: 285090 - DNA, 21 bp, Homo sapiens
tgatagctaacattttaaata

SEQ ID NO: 285091 - DNA, 11 bp, Homo sapiens
tgatagcttta

SEQ ID NO: 285092 - DNA, 14 bp, Homo sapiens
tgatagctttattt

SEQ ID NO: 285093 - DNA, 21 bp, Homo sapiens
tgatagtagtaaaattagaaa

SEQ ID NO: 285094 - DNA, 23 bp, Homo sapiens
tgatagtctttttttttaagtgt

SEQ ID NO: 285095 - DNA, 16 bp, Homo sapiens
tgatatacaattagag

SEQ ID NO: 285096 - DNA, 18 bp, Homo sapiens
tgatatacaattagagat

SEQ ID NO: 285097 - DNA, 15 bp, Homo sapiens
tgatatatatgtata

SEQ ID NO: 285098 - DNA, 18 bp, Homo sapiens
tgatatatatgtataatt

SEQ ID NO: 285099 - DNA, 13 bp, Homo sapiens
tgatatattcttt

SEQ ID NO: 285100 - DNA, 17 bp, Homo sapiens
tgatatattctttccat

SEQ ID NO: 285101 - DNA, 18 bp, Homo sapiens
tgatatcacgggcccgct

SEQ ID NO: 285102 - DNA, 21 bp, Homo sapiens
tgatatcatgcccctgtactc

SEQ ID NO: 285103 - DNA, 19 bp, Homo sapiens
tgatatccattctttctga

SEQ ID NO: 285104 - DNA, 17 bp, Homo sapiens
tgatatgattgtaacat

SEQ ID NO: 285105 - DNA, 18 bp, Homo sapiens
tgatatgattgtaacata

SEQ ID NO: 285106 - DNA, 20 bp, Homo sapiens
tgatatgattgtaacatatt

SEQ ID NO: 285107 - DNA, 17 bp, Homo sapiens
tgatatgcatgtagcat

SEQ ID NO: 285108 - DNA, 17 bp, Homo sapiens
tgatatggagccctgta

SEQ ID NO: 285109 - DNA, 16 bp, Homo sapiens
tgatatgggctttctc

SEQ ID NO: 285110 - DNA, 14 bp, Homo sapiens
tgatatgtctttaa

SEQ ID NO: 285111 - DNA, 15 bp, Homo sapiens
tgatatgtgtaatat

SEQ ID NO: 285112 - DNA, 22 bp, Homo sapiens
tgatattaatttatcagattgc

SEQ ID NO: 285113 - DNA, 16 bp, Homo sapiens
tgatattccatgaatg

SEQ ID NO: 285114 - DNA, 20 bp, Homo sapiens
tgatattctcattatttcat

SEQ ID NO: 285115 - DNA, 14 bp, Homo sapiens
tgcagactggaggg

SEQ ID NO: 285116 - DNA, 11 bp, Homo sapiens
tgcagagactt

SEQ ID NO: 285117 - DNA, 17 bp, Homo sapiens
tgcagaggagccacctg

SEQ ID NO: 285118 - DNA, 18 bp, Homo sapiens
tgcagaggagccacctgg

SEQ ID NO: 285119 - DNA, 13 bp, Homo sapiens
tgcagaggcagca

SEQ ID NO: 285120 - DNA, 16 bp, Homo sapiens
tgcagatctagccagg

SEQ ID NO: 285121 - DNA, 17 bp, Homo sapiens
tgcagatctagccaggc

SEQ ID NO: 285122 - DNA, 14 bp, Homo sapiens
tgcagatctgtgct

SEQ ID NO: 285123 - DNA, 15 bp, Homo sapiens
tgcagatctgtgctc

SEQ ID NO: 285124 - DNA, 16 bp, Homo sapiens
tgcagattcctgggcc

SEQ ID NO: 285125 - DNA, 21 bp, Homo sapiens
tgcagattcctgggcctgtcc

SEQ ID NO: 285126 - DNA, 22 bp, Homo sapiens
tgcagattcctgggcctgtccc

SEQ ID NO: 285127 - DNA, 15 bp, Homo sapiens
tgcagcaacacccaa

SEQ ID NO: 285128 - DNA, 16 bp, Homo sapiens
tgcagcaacacccaag

SEQ ID NO: 285129 - DNA, 14 bp, Homo sapiens
tgcagcaatattct

SEQ ID NO: 285130 - DNA, 11 bp, Homo sapiens
tgcagcagccc

SEQ ID NO: 285131 - DNA, 16 bp, Homo sapiens
tgcagcagcccagctt

SEQ ID NO: 285132 - DNA, 12 bp, Homo sapiens
tgcagcagcttg

SEQ ID NO: 285133 - DNA, 16 bp, Homo sapiens
tgcagcagcttgctgc

SEQ ID NO: 285134 - DNA, 13 bp, Homo sapiens
tgcagcaggcaga

SEQ ID NO: 285135 - DNA, 17 bp, Homo sapiens
tgcagcaggcagaggag

SEQ ID NO: 285136 - DNA, 18 bp, Homo sapiens
tgcagcaggcagaggaga

SEQ ID NO: 285137 - DNA, 19 bp, Homo sapiens
tgcagcaggcagaggagag

SEQ ID NO: 285138 - DNA, 17 bp, Homo sapiens
tgcagcatgacctgtga

SEQ ID NO: 285139 - DNA, 14 bp, Homo sapiens
tgcagccaggactg

SEQ ID NO: 285140 - DNA, 12 bp, Homo sapiens
tgcagcccacag

SEQ ID NO: 285141 - DNA, 17 bp, Homo sapiens
tgcagcccacagaggac

SEQ ID NO: 285142 - DNA, 18 bp, Homo sapiens
tgcagcccacagaggaca

SEQ ID NO: 285143 - DNA, 11 bp, Homo sapiens
tgcagcccaga

SEQ ID NO: 285144 - DNA, 22 bp, Homo sapiens
tgcagcccagaacgggcctccc

SEQ ID NO: 285145 - DNA, 13 bp, Homo sapiens
tgcagcccatgcc

SEQ ID NO: 285146 - DNA, 23 bp, Homo sapiens
tgcagcccatgcccacctgccca

SEQ ID NO: 285147 - DNA, 11 bp, Homo sapiens
tgcagccccag

SEQ ID NO: 285148 - DNA, 19 bp, Homo sapiens
tgcagcccctcctcctcgg

SEQ ID NO: 285149 - DNA, 19 bp, Homo sapiens
tgcatcattctttctgcta

SEQ ID NO: 285150 - DNA, 17 bp, Homo sapiens
tgcatccaggcctgagg

SEQ ID NO: 285151 - DNA, 19 bp, Homo sapiens
tgcatccaggcctgaggct

SEQ ID NO: 285152 - DNA, 24 bp, Homo sapiens
tgcatcccgtacctcttcccatga

SEQ ID NO: 285153 - DNA, 23 bp, Homo sapiens
tgcatccctccaccccagtcccc

SEQ ID NO: 285154 - DNA, 23 bp, Homo sapiens
tgcatccgtgagcagtgtgtctc

SEQ ID NO: 285155 - DNA, 20 bp, Homo sapiens
tgcatcctcagccccagggc

SEQ ID NO: 285156 - DNA, 21 bp, Homo sapiens
tgcatctcactggatgcaaag

SEQ ID NO: 285157 - DNA, 14 bp, Homo sapiens
tgcatctcagccca

SEQ ID NO: 285158 - DNA, 22 bp, Homo sapiens
tgcatctttcatagttctgtta

SEQ ID NO: 285159 - DNA, 23 bp, Homo sapiens
tgcatctttcatagttctgttaa

SEQ ID NO: 285160 - DNA, 17 bp, Homo sapiens
tgcatgacgtttaaggc

SEQ ID NO: 285161 - DNA, 22 bp, Homo sapiens
tgcatgagaactaaatagattt

SEQ ID NO: 285162 - DNA, 18 bp, Homo sapiens
tgcatgagaatgtcattt

SEQ ID NO: 285163 - DNA, 23 bp, Homo sapiens
tgcatgagaatgtcatttgctaa

SEQ ID NO: 285164 - DNA, 20 bp, Homo sapiens
tgcatgagctccctcgctgt

SEQ ID NO: 285165 - DNA, 16 bp, Homo sapiens
tgcatgatattgtatg

SEQ ID NO: 285166 - DNA, 18 bp, Homo sapiens
tgcatgcaaaccaggagc

SEQ ID NO: 285167 - DNA, 19 bp, Homo sapiens
tgcatgcaaaccaggagca

SEQ ID NO: 285168 - DNA, 15 bp, Homo sapiens
tgcatgcagcaacac

SEQ ID NO: 285169 - DNA, 21 bp, Homo sapiens
tgcatgcagcaacacccaagt

SEQ ID NO: 285170 - DNA, 11 bp, Homo sapiens
tgcatgccagg

SEQ ID NO: 285171 - DNA, 12 bp, Homo sapiens
tgcatgccaggc

SEQ ID NO: 285172 - DNA, 16 bp, Homo sapiens
tgcatgccctaagagt

SEQ ID NO: 285173 - DNA, 15 bp, Homo sapiens
tgcatgcctgtaatc

SEQ ID NO: 285174 - DNA, 20 bp, Homo sapiens
tgcatgctgctttaattgtg

SEQ ID NO: 285175 - DNA, 13 bp, Homo sapiens
tgcatgctgtccc

SEQ ID NO: 285176 - DNA, 14 bp, Homo sapiens
tgcatgctgtccct

SEQ ID NO: 285177 - DNA, 16 bp, Homo sapiens
tgcatgctgtccctta

SEQ ID NO: 285178 - DNA, 18 bp, Homo sapiens
tgcatgctgtcccttacg

SEQ ID NO: 285179 - DNA, 21 bp, Homo sapiens
tgcatgctgtcccttacgtga

SEQ ID NO: 285180 - DNA, 13 bp, Homo sapiens
tgcatgctttgga

SEQ ID NO: 285181 - DNA, 15 bp, Homo sapiens
tgcatggacctaaca

SEQ ID NO: 285182 - DNA, 21 bp, Homo sapiens
tgcatggacctaacattcgat

SEQ ID NO: 285183 - DNA, 14 bp, Homo sapiens
tgcatggagtgttt

SEQ ID NO: 285184 - DNA, 20 bp, Homo sapiens
tgcatggccacagccacctc

SEQ ID NO: 285185 - DNA, 20 bp, Homo sapiens
tgcatggcctcccagccacc

SEQ ID NO: 285186 - DNA, 21 bp, Homo sapiens
tgcatggcctcccagccaccc

SEQ ID NO: 285187 - DNA, 18 bp, Homo sapiens
tgcatggctcctgtctgg

SEQ ID NO: 285188 - DNA, 18 bp, Homo sapiens
tgcatgtaaaatcttcag

SEQ ID NO: 285189 - DNA, 22 bp, Homo sapiens
tgcatgtaaaatcttcagctgg

SEQ ID NO: 285190 - DNA, 12 bp, Homo sapiens
tgcatgtattca

SEQ ID NO: 285191 - DNA, 16 bp, Homo sapiens
tgcatgtattcactaa

SEQ ID NO: 285192 - DNA, 18 bp, Homo sapiens
tgcatgtatttaagaaaa

SEQ ID NO: 285193 - DNA, 15 bp, Homo sapiens
tgcatgtgaagcatg

SEQ ID NO: 285194 - DNA, 14 bp, Homo sapiens
tgcatgtgtgtgct

SEQ ID NO: 285195 - DNA, 18 bp, Homo sapiens
tgcattaacttaaaagat

SEQ ID NO: 285196 - DNA, 23 bp, Homo sapiens
tgcattacagagaggagaaacac

SEQ ID NO: 285197 - DNA, 14 bp, Homo sapiens
tgcattacattcct

SEQ ID NO: 285198 - DNA, 19 bp, Homo sapiens
tgcattaccttctgttcct

SEQ ID NO: 285199 - DNA, 21 bp, Homo sapiens
tgcattcactcagcatcccca

SEQ ID NO: 285200 - DNA, 19 bp, Homo sapiens
tgcattgaatttagtcatt

SEQ ID NO: 285201 - DNA, 18 bp, Homo sapiens
tgcattggataacaccac

SEQ ID NO: 285202 - DNA, 16 bp, Homo sapiens
tgcattgtcttgtgga

SEQ ID NO: 285203 - DNA, 17 bp, Homo sapiens
tgcattgttattgtgga

SEQ ID NO: 285204 - DNA, 14 bp, Homo sapiens
tgcctaggctgacc

SEQ ID NO: 285205 - DNA, 15 bp, Homo sapiens
tgcctatccatcctg

SEQ ID NO: 285206 - DNA, 18 bp, Homo sapiens
tgcctatttactggaaac

SEQ ID NO: 285207 - DNA, 17 bp, Homo sapiens
tgcctcaaaattgtgtc

SEQ ID NO: 285208 - DNA, 16 bp, Homo sapiens
tgcctcaatgccagta

SEQ ID NO: 285209 - DNA, 14 bp, Homo sapiens
tgcctcacatctcc

SEQ ID NO: 285210 - DNA, 16 bp, Homo sapiens
tgcctcacgagatttg

SEQ ID NO: 285211 - DNA, 12 bp, Homo sapiens
tgcctcagcctt

SEQ ID NO: 285212 - DNA, 15 bp, Homo sapiens
tgcctcagccttcca

SEQ ID NO: 285213 - DNA, 13 bp, Homo sapiens
tgcctcagcgctg

SEQ ID NO: 285214 - DNA, 15 bp, Homo sapiens
tgcctcagcgctgcc

SEQ ID NO: 285215 - DNA, 19 bp, Homo sapiens
tgcctcagcgctgcccaca

SEQ ID NO: 285216 - DNA, 21 bp, Homo sapiens
tgcctcagcgctgcccacacc

SEQ ID NO: 285217 - DNA, 15 bp, Homo sapiens
tgcctcatgccacac

SEQ ID NO: 285218 - DNA, 13 bp, Homo sapiens
tgcctcatgctct

SEQ ID NO: 285219 - DNA, 18 bp, Homo sapiens
tgcctccaccgagccagc

SEQ ID NO: 285220 - DNA, 20 bp, Homo sapiens
tgcctccatggtgcctctgg

SEQ ID NO: 285221 - DNA, 22 bp, Homo sapiens
tgcctccatggtgcctctggag

SEQ ID NO: 285222 - DNA, 17 bp, Homo sapiens
tgcctcccaagctcaga

SEQ ID NO: 285223 - DNA, 18 bp, Homo sapiens
tgcctcccaagctcagag

SEQ ID NO: 285224 - DNA, 18 bp, Homo sapiens
tgcctcccacacttgctg

SEQ ID NO: 285225 - DNA, 16 bp, Homo sapiens
tgcctccccaaccctg

SEQ ID NO: 285226 - DNA, 18 bp, Homo sapiens
tgcctccccaaccctgcc

SEQ ID NO: 285227 - DNA, 15 bp, Homo sapiens
tgcctccccccagac

SEQ ID NO: 285228 - DNA, 16 bp, Homo sapiens
tgcctccccccagacc

SEQ ID NO: 285229 - DNA, 16 bp, Homo sapiens
tgcctcccgccccctt

SEQ ID NO: 285230 - DNA, 13 bp, Homo sapiens
tgcctccctctct

SEQ ID NO: 285231 - DNA, 23 bp, Homo sapiens
tgcctccctggggaccaggagct

SEQ ID NO: 285232 - DNA, 23 bp, Homo sapiens
tgcctcccttcccagtgggctgt

SEQ ID NO: 285233 - DNA, 21 bp, Homo sapiens
tgcctcccttccgctgcgggc

SEQ ID NO: 285234 - DNA, 17 bp, Homo sapiens
tgcctccctttctggga

SEQ ID NO: 285235 - DNA, 19 bp, Homo sapiens
tgcctccctttctgggagg

SEQ ID NO: 285236 - DNA, 20 bp, Homo sapiens
tgcctccggccctgccccac

SEQ ID NO: 285237 - DNA, 21 bp, Homo sapiens
tgcctcctagacacccgccct

SEQ ID NO: 285238 - DNA, 15 bp, Homo sapiens
tgcctcctcccatcc

SEQ ID NO: 285239 - DNA, 14 bp, Homo sapiens
tgcctcctctctcc

SEQ ID NO: 285240 - DNA, 16 bp, Homo sapiens
tgcctcctctctccct

SEQ ID NO: 285241 - DNA, 16 bp, Homo sapiens
tgcctcctcttcaact

SEQ ID NO: 285242 - DNA, 18 bp, Homo sapiens
tgcctccttatttatcaa

SEQ ID NO: 285243 - DNA, 17 bp, Homo sapiens
tgcctccttccacctcc

SEQ ID NO: 285244 - DNA, 17 bp, Homo sapiens
tgcctcgaggcaccggc

SEQ ID NO: 285245 - DNA, 17 bp, Homo sapiens
tgcctctaaggccaagg

SEQ ID NO: 285246 - DNA, 20 bp, Homo sapiens
tgcctctaaggccaaggcct

SEQ ID NO: 285247 - DNA, 22 bp, Homo sapiens
tgcctctaaggccaaggcctca

SEQ ID NO: 285248 - DNA, 23 bp, Homo sapiens
tgcctctaaggccaaggcctcag

SEQ ID NO: 285249 - DNA, 12 bp, Homo sapiens
tgcctctgaaaa

SEQ ID NO: 285250 - DNA, 19 bp, Homo sapiens
tgcctctgaactgctgctg

SEQ ID NO: 285251 - DNA, 20 bp, Homo sapiens
tgcctctgaactgctgctgg

SEQ ID NO: 285252 - DNA, 19 bp, Homo sapiens
tgcctctgacagcagcctg

SEQ ID NO: 285253 - DNA, 16 bp, Homo sapiens
tgcctctgccacactc

SEQ ID NO: 285254 - DNA, 13 bp, Homo sapiens
tgcctctgcctgt

SEQ ID NO: 285255 - DNA, 14 bp, Homo sapiens
tgcctctgcctgtc

SEQ ID NO: 285256 - DNA, 18 bp, Homo sapiens
tgcctctgcctgtctccc

SEQ ID NO: 285257 - DNA, 12 bp, Homo sapiens
tgcctctgggtg

SEQ ID NO: 285258 - DNA, 22 bp, Homo sapiens
tgcctgaaacagccatgtccaa

SEQ ID NO: 285259 - DNA, 22 bp, Homo sapiens
tgcctgaccatcccatgagcag

SEQ ID NO: 285260 - DNA, 17 bp, Homo sapiens
tgcctgaccccttgctc

SEQ ID NO: 285261 - DNA, 16 bp, Homo sapiens
tgcctgactaattttt

SEQ ID NO: 285262 - DNA, 22 bp, Homo sapiens
tgcctgactaatttttgtattt

SEQ ID NO: 285263 - DNA, 14 bp, Homo sapiens
tgcctgagcccgaa

SEQ ID NO: 285264 - DNA, 17 bp, Homo sapiens
tgcctgagggcccctct

SEQ ID NO: 285265 - DNA, 15 bp, Homo sapiens
tgcctgaggtctgta

SEQ ID NO: 285266 - DNA, 16 bp, Homo sapiens
tgcctgaggtctgtac

SEQ ID NO: 285267 - DNA, 19 bp, Homo sapiens
tgcctgcaccaggagacag

SEQ ID NO: 285268 - DNA, 18 bp, Homo sapiens
tgcctgcagcatctacta

SEQ ID NO: 285269 - DNA, 19 bp, Homo sapiens
tgcctgccactctctggga

SEQ ID NO: 285270 - DNA, 20 bp, Homo sapiens
tgcctgccactctctgggac

SEQ ID NO: 285271 - DNA, 16 bp, Homo sapiens
tgcctgcccacccgtg

SEQ ID NO: 285272 - DNA, 18 bp, Homo sapiens
tgcctgccccaaacaaat

SEQ ID NO: 285273 - DNA, 20 bp, Homo sapiens
tgcctgccccaaacaaatat

SEQ ID NO: 285274 - DNA, 14 bp, Homo sapiens
tgcctgccccacac

SEQ ID NO: 285275 - DNA, 14 bp, Homo sapiens
tgcctgcctccggc

SEQ ID NO: 285276 - DNA, 13 bp, Homo sapiens
tgcctgcctggga

SEQ ID NO: 285277 - DNA, 20 bp, Homo sapiens
tgcctgcctgtctgtctctc

SEQ ID NO: 285278 - DNA, 21 bp, Homo sapiens
tgcctgcctgtctgtctctcc

SEQ ID NO: 285279 - DNA, 18 bp, Homo sapiens
tgcctgcgaaacccagcg

SEQ ID NO: 285280 - DNA, 21 bp, Homo sapiens
tgcctgcgaaacccagcgttc

SEQ ID NO: 285281 - DNA, 19 bp, Homo sapiens
tgcctgcggagttgtgcac

SEQ ID NO: 285282 - DNA, 20 bp, Homo sapiens
tgcctgctctccttgccctg

SEQ ID NO: 285283 - DNA, 21 bp, Homo sapiens
tgcctgctctccttgccctgg

SEQ ID NO: 285284 - DNA, 22 bp, Homo sapiens
tgcctgctctccttgccctggg

SEQ ID NO: 285285 - DNA, 15 bp, Homo sapiens
tgcctgctctgcagc

SEQ ID NO: 285286 - DNA, 13 bp, Homo sapiens
tgcctggagaaag

SEQ ID NO: 285287 - DNA, 14 bp, Homo sapiens
tgcctggagaaagg

SEQ ID NO: 285288 - DNA, 15 bp, Homo sapiens
tgcctggagaaagga

SEQ ID NO: 285289 - DNA, 22 bp, Homo sapiens
tgcctggagaaaggatggcagc

SEQ ID NO: 285290 - DNA, 23 bp, Homo sapiens
tgcctggagaaaggatggcagcc

SEQ ID NO: 285291 - DNA, 16 bp, Homo sapiens
tgcctggagctcctgg

SEQ ID NO: 285292 - DNA, 18 bp, Homo sapiens
tgcctggatgggggtgca

SEQ ID NO: 285293 - DNA, 12 bp, Homo sapiens
tgcctggccccc

SEQ ID NO: 285294 - DNA, 18 bp, Homo sapiens
tgcctggcccccctccag

SEQ ID NO: 285295 - DNA, 20 bp, Homo sapiens
tgcctggcccccctccaggc

SEQ ID NO: 285296 - DNA, 19 bp, Homo sapiens
tgcctggcctggctcccca

SEQ ID NO: 285297 - DNA, 14 bp, Homo sapiens
tgcctggcgggcag

SEQ ID NO: 285298 - DNA, 18 bp, Homo sapiens
tgcctggcgggcagcccc

SEQ ID NO: 285299 - DNA, 21 bp, Homo sapiens
tgcctgggaaccttcctgtct

SEQ ID NO: 285300 - DNA, 16 bp, Homo sapiens
tgcctgggcagtgccc

SEQ ID NO: 285301 - DNA, 23 bp, Homo sapiens
tgcctgggcagtgcccaccatgc

SEQ ID NO: 285302 - DNA, 20 bp, Homo sapiens
tgcctgggcctgtgcagcag

SEQ ID NO: 285303 - DNA, 23 bp, Homo sapiens
tgcctgggcctgtgcagcagccc

SEQ ID NO: 285304 - DNA, 22 bp, Homo sapiens
tgcctgggttccaatcctggct

SEQ ID NO: 285305 - DNA, 18 bp, Homo sapiens
tgcctggtgcgctgtgct

SEQ ID NO: 285306 - DNA, 23 bp, Homo sapiens
tgcctggtgcgctgtgctccagc

SEQ ID NO: 285307 - DNA, 24 bp, Homo sapiens
tgcctggtgcgctgtgctccagca

SEQ ID NO: 285308 - DNA, 15 bp, Homo sapiens
tgcctgtaaacatag

SEQ ID NO: 285309 - DNA, 16 bp, Homo sapiens
tgcctgtaatcttttt

SEQ ID NO: 285310 - DNA, 20 bp, Homo sapiens
tgcctgtaatctttttctcc

SEQ ID NO: 285311 - DNA, 12 bp, Homo sapiens
tgcctgtacaag

SEQ ID NO: 285312 - DNA, 16 bp, Homo sapiens
tgcctgtagagccagc

SEQ ID NO: 285313 - DNA, 19 bp, Homo sapiens
tgcctgtagagccagcctt

SEQ ID NO: 285314 - DNA, 20 bp, Homo sapiens
tgcctgtagagccagccttg

SEQ ID NO: 285315 - DNA, 17 bp, Homo sapiens
tgcctgtagttaggaaa

SEQ ID NO: 285316 - DNA, 18 bp, Homo sapiens
tgcctgtagttaggaaat

SEQ ID NO: 285317 - DNA, 22 bp, Homo sapiens
tgcctgtatcttttattttcct

SEQ ID NO: 285318 - DNA, 21 bp, Homo sapiens
tgcctgtcacgctctggtgca

SEQ ID NO: 285319 - DNA, 15 bp, Homo sapiens
tgcctgtcactactg

SEQ ID NO: 285320 - DNA, 12 bp, Homo sapiens
tgcctgtctctg

SEQ ID NO: 285321 - DNA, 15 bp, Homo sapiens
tgcctgtgcatgacc

SEQ ID NO: 285322 - DNA, 11 bp, Homo sapiens
tgcctgtgcca

SEQ ID NO: 285323 - DNA, 12 bp, Homo sapiens
tgcctgtgccaa

SEQ ID NO: 285324 - DNA, 16 bp, Homo sapiens
tgcctgtgccaataaa

SEQ ID NO: 285325 - DNA, 16 bp, Homo sapiens
tgcctgtgccacccac

SEQ ID NO: 285326 - DNA, 21 bp, Homo sapiens
tgcctgtggtgaagtgtggct

SEQ ID NO: 285327 - DNA, 24 bp, Homo sapiens
tgcctgtggtgaagtgtggctggt

SEQ ID NO: 285328 - DNA, 18 bp, Homo sapiens
tgcctgttaagtctgaga

SEQ ID NO: 285329 - DNA, 14 bp, Homo sapiens
tgcctgttcccatt

SEQ ID NO: 285330 - DNA, 15 bp, Homo sapiens
tgccttaaagaaagt

SEQ ID NO: 285331 - DNA, 16 bp, Homo sapiens
tgccttaaccttctgg

SEQ ID NO: 285332 - DNA, 13 bp, Homo sapiens
tggcagaaaagag

SEQ ID NO: 285333 - DNA, 19 bp, Homo sapiens
tggcagaaaagaggagacc

SEQ ID NO: 285334 - DNA, 22 bp, Homo sapiens
tggcagaaatcccagttcatgt

SEQ ID NO: 285335 - DNA, 16 bp, Homo sapiens
tggcagaactgagctc

SEQ ID NO: 285336 - DNA, 23 bp, Homo sapiens
tggcagaagcgtctcccttggcc

SEQ ID NO: 285337 - DNA, 14 bp, Homo sapiens
tggcagaagtgttt

SEQ ID NO: 285338 - DNA, 12 bp, Homo sapiens
tggcagagaagg

SEQ ID NO: 285339 - DNA, 21 bp, Homo sapiens
tggcagagtggattcttgaac

SEQ ID NO: 285340 - DNA, 21 bp, Homo sapiens
tggcagataatcagcctctta

SEQ ID NO: 285341 - DNA, 13 bp, Homo sapiens
tggcagattttac

SEQ ID NO: 285342 - DNA, 16 bp, Homo sapiens
tggcagattttacaaa

SEQ ID NO: 285343 - DNA, 20 bp, Homo sapiens
tggcagattttacaaaagat

SEQ ID NO: 285344 - DNA, 15 bp, Homo sapiens
tggcagcaaaggaag

SEQ ID NO: 285345 - DNA, 16 bp, Homo sapiens
tggcagcaaaggaaga

SEQ ID NO: 285346 - DNA, 12 bp, Homo sapiens
tggcagccatgc

SEQ ID NO: 285347 - DNA, 15 bp, Homo sapiens
tggcagccatgcctc

SEQ ID NO: 285348 - DNA, 18 bp, Homo sapiens
tggcagccatgcctcatg

SEQ ID NO: 285349 - DNA, 21 bp, Homo sapiens
tggcagccatgcctcatgcca

SEQ ID NO: 285350 - DNA, 22 bp, Homo sapiens
tggcagccgtgccttcagctct

SEQ ID NO: 285351 - DNA, 14 bp, Homo sapiens
tggcagcctcaggg

SEQ ID NO: 285352 - DNA, 18 bp, Homo sapiens
tggcagcctcagggcttc

SEQ ID NO: 285353 - DNA, 14 bp, Homo sapiens
tggcagcgcctccc

SEQ ID NO: 285354 - DNA, 17 bp, Homo sapiens
tggcagcgcctcccgcc

SEQ ID NO: 285355 - DNA, 16 bp, Homo sapiens
tggcagctagactgga

SEQ ID NO: 285356 - DNA, 20 bp, Homo sapiens
tggcagctagactggagtga

SEQ ID NO: 285357 - DNA, 18 bp, Homo sapiens
tggcagctcctctccttg

SEQ ID NO: 285358 - DNA, 19 bp, Homo sapiens
tggcagctggggagcagct

SEQ ID NO: 285359 - DNA, 20 bp, Homo sapiens
tggcagctggggagcagctg

SEQ ID NO: 285360 - DNA, 13 bp, Homo sapiens
tggcagctgtccc

SEQ ID NO: 285361 - DNA, 23 bp, Homo sapiens
tggcagctgtcccctctccctgg

SEQ ID NO: 285362 - DNA, 14 bp, Homo sapiens
tggcagctgtctca

SEQ ID NO: 285363 - DNA, 19 bp, Homo sapiens
tggcagcttcaaaacagaa

SEQ ID NO: 285364 - DNA, 17 bp, Homo sapiens
tggcaggacacatcccg

SEQ ID NO: 285365 - DNA, 20 bp, Homo sapiens
tggcaggagacactggtctc

SEQ ID NO: 285366 - DNA, 22 bp, Homo sapiens
tggcaggagacactggtctcag

SEQ ID NO: 285367 - DNA, 21 bp, Homo sapiens
tggcaggagagagccttggcc

SEQ ID NO: 285368 - DNA, 22 bp, Homo sapiens
tggcaggagagagccttggcct

SEQ ID NO: 285369 - DNA, 17 bp, Homo sapiens
tggcaggagtgggctct

SEQ ID NO: 285370 - DNA, 15 bp, Homo sapiens
tggcaggccagctgt

SEQ ID NO: 285371 - DNA, 22 bp, Homo sapiens
tggcagggaggtcaggccctgg

SEQ ID NO: 285372 - DNA, 20 bp, Homo sapiens
tggcagggcaggcagagctc

SEQ ID NO: 285373 - DNA, 21 bp, Homo sapiens
tggcagggcaggcagagctca

SEQ ID NO: 285374 - DNA, 16 bp, Homo sapiens
tggcaggtggccaggg

SEQ ID NO: 285375 - DNA, 19 bp, Homo sapiens
tggcaggtggccagggctc

SEQ ID NO: 285376 - DNA, 15 bp, Homo sapiens
tggcagtacagagtg

SEQ ID NO: 285377 - DNA, 18 bp, Homo sapiens
tggcagtggccaggcagg

SEQ ID NO: 285378 - DNA, 14 bp, Homo sapiens
tggcagtgggagac

SEQ ID NO: 285379 - DNA, 14 bp, Homo sapiens
tggcagtgtttgta

SEQ ID NO: 285380 - DNA, 21 bp, Homo sapiens
tggcatataattttcacttct

SEQ ID NO: 285381 - DNA, 15 bp, Homo sapiens
tggcatcccagtggc

SEQ ID NO: 285382 - DNA, 23 bp, Homo sapiens
tggctgttatctgtctttatgat

SEQ ID NO: 285383 - DNA, 15 bp, Homo sapiens
tggctgttccagact

SEQ ID NO: 285384 - DNA, 14 bp, Homo sapiens
tggcttaaacattt

SEQ ID NO: 285385 - DNA, 15 bp, Homo sapiens
tggcttaaacatttt

SEQ ID NO: 285386 - DNA, 18 bp, Homo sapiens
tggcttaagcctgtgtat

SEQ ID NO: 285387 - DNA, 20 bp, Homo sapiens
tggcttactacatgtgggag

SEQ ID NO: 285388 - DNA, 15 bp, Homo sapiens
tggcttataaacaca

SEQ ID NO: 285389 - DNA, 17 bp, Homo sapiens
tggcttcaaaatagaga

SEQ ID NO: 285390 - DNA, 13 bp, Homo sapiens
tggcttcagcccc

SEQ ID NO: 285391 - DNA, 12 bp, Homo sapiens
tggcttcccagg

SEQ ID NO: 285392 - DNA, 23 bp, Homo sapiens
tggcttcccaggaccctgggtca

SEQ ID NO: 285393 - DNA, 18 bp, Homo sapiens
tggcttcccgctcagccc

SEQ ID NO: 285394 - DNA, 19 bp, Homo sapiens
tggcttcccgctcagccct

SEQ ID NO: 285395 - DNA, 20 bp, Homo sapiens
tggcttcccgctcagccctc

SEQ ID NO: 285396 - DNA, 22 bp, Homo sapiens
tggcttcccgctcagccctccc

SEQ ID NO: 285397 - DNA, 20 bp, Homo sapiens
tggcttccgctgtcacccag

SEQ ID NO: 285398 - DNA, 22 bp, Homo sapiens
tggcttccgctgtcacccagca

SEQ ID NO: 285399 - DNA, 15 bp, Homo sapiens
tggcttcctccgtcc

SEQ ID NO: 285400 - DNA, 21 bp, Homo sapiens
tggcttcctccgtccacccag

SEQ ID NO: 285401 - DNA, 13 bp, Homo sapiens
tggcttcctgaga

SEQ ID NO: 285402 - DNA, 16 bp, Homo sapiens
tggcttctatgatcag

SEQ ID NO: 285403 - DNA, 16 bp, Homo sapiens
tggcttctgcttgtca

SEQ ID NO: 285404 - DNA, 21 bp, Homo sapiens
tggcttctgcttgtcatccac

SEQ ID NO: 285405 - DNA, 16 bp, Homo sapiens
tggcttctgggacctg

SEQ ID NO: 285406 - DNA, 20 bp, Homo sapiens
tggcttgaagccaagtcagc

SEQ ID NO: 285407 - DNA, 15 bp, Homo sapiens
tggcttgacatgtgc

SEQ ID NO: 285408 - DNA, 19 bp, Homo sapiens
tggcttgactcaggattta

SEQ ID NO: 285409 - DNA, 13 bp, Homo sapiens
tggcttgctccag

SEQ ID NO: 285410 - DNA, 18 bp, Homo sapiens
tggcttgctccagggtct

SEQ ID NO: 285411 - DNA, 15 bp, Homo sapiens
tggcttggagcagag

SEQ ID NO: 285412 - DNA, 17 bp, Homo sapiens
tggcttggagcagaggt

SEQ ID NO: 285413 - DNA, 17 bp, Homo sapiens
tggctttacattttatt

SEQ ID NO: 285414 - DNA, 16 bp, Homo sapiens
tggctttcatcctgtg

SEQ ID NO: 285415 - DNA, 19 bp, Homo sapiens
tggctttcatcctgtgtcc

SEQ ID NO: 285416 - DNA, 20 bp, Homo sapiens
tggctttcatcctgtgtccc

SEQ ID NO: 285417 - DNA, 22 bp, Homo sapiens
tggctttccacatccccaccct

SEQ ID NO: 285418 - DNA, 14 bp, Homo sapiens
tggctttcccttcc

SEQ ID NO: 285419 - DNA, 19 bp, Homo sapiens
tggctttcctctcgttggt

SEQ ID NO: 285420 - DNA, 20 bp, Homo sapiens
tggctttgcccaacctcagc

SEQ ID NO: 285421 - DNA, 14 bp, Homo sapiens
tggctttggtctct

SEQ ID NO: 285422 - DNA, 12 bp, Homo sapiens
tggctttgtgct

SEQ ID NO: 285423 - DNA, 16 bp, Homo sapiens
tggctttgttcttgtc

SEQ ID NO: 285424 - DNA, 16 bp, Homo sapiens
tggcttttatttcagt

SEQ ID NO: 285425 - DNA, 18 bp, Homo sapiens
tggcttttcactgctggc

SEQ ID NO: 285426 - DNA, 19 bp, Homo sapiens
tggcttttcactgctggct

SEQ ID NO: 285427 - DNA, 17 bp, Homo sapiens
tggcttttctggctggg

SEQ ID NO: 285428 - DNA, 16 bp, Homo sapiens
tggcttttgaatcaaa

SEQ ID NO: 285429 - DNA, 19 bp, Homo sapiens
tggctttttaaattttcca

SEQ ID NO: 285430 - DNA, 17 bp, Homo sapiens
tgggaaaacagtgaatc

SEQ ID NO: 285431 - DNA, 18 bp, Homo sapiens
tgggaaaatatcactttg

SEQ ID NO: 285432 - DNA, 13 bp, Homo sapiens
tgggaaaatgtcc

SEQ ID NO: 285433 - DNA, 21 bp, Homo sapiens
tgggaaacccttttgcgtggt

SEQ ID NO: 285434 - DNA, 15 bp, Homo sapiens
tgggaaagccacctc

SEQ ID NO: 285435 - DNA, 12 bp, Homo sapiens
tgggaaagtgca

SEQ ID NO: 285436 - DNA, 23 bp, Homo sapiens
tgggaaatgctgatttaaacttc

SEQ ID NO: 285437 - DNA, 11 bp, Homo sapiens
tgggaaatgtc

SEQ ID NO: 285438 - DNA, 15 bp, Homo sapiens
tgggaaattcttgca

SEQ ID NO: 285439 - DNA, 19 bp, Homo sapiens
tgggaacaagtgtacagaa

SEQ ID NO: 285440 - DNA, 20 bp, Homo sapiens
tgggaaccccgcagcccgtg

SEQ ID NO: 285441 - DNA, 19 bp, Homo sapiens
tgggaacccgactgtgaaa

SEQ ID NO: 285442 - DNA, 23 bp, Homo sapiens
tgggaacctagtactctctgctc

SEQ ID NO: 285443 - DNA, 21 bp, Homo sapiens
tgggaacgcagatgatccatg

SEQ ID NO: 285444 - DNA, 24 bp, Homo sapiens
tgggaacgcagatgatccatgagt

SEQ ID NO: 285445 - DNA, 13 bp, Homo sapiens
tgggaagagctgg

SEQ ID NO: 285446 - DNA, 17 bp, Homo sapiens
tgggaagctatttcctt

SEQ ID NO: 285447 - DNA, 15 bp, Homo sapiens
tgggaagctgtactc

SEQ ID NO: 285448 - DNA, 23 bp, Homo sapiens
tgggaagctgtactcagagcaga

SEQ ID NO: 285449 - DNA, 22 bp, Homo sapiens
tgggaaggacttggcgcgccct

SEQ ID NO: 285450 - DNA, 17 bp, Homo sapiens
tgggaaggagggagctg

SEQ ID NO: 285451 - DNA, 20 bp, Homo sapiens
tgggaaggagggagctgctc

SEQ ID NO: 285452 - DNA, 21 bp, Homo sapiens
tgggaaggagggagctgctca

SEQ ID NO: 285453 - DNA, 22 bp, Homo sapiens
tgggaagggagagttctttgct

SEQ ID NO: 285454 - DNA, 23 bp, Homo sapiens
tgggaagggagagttctttgctg

SEQ ID NO: 285455 - DNA, 16 bp, Homo sapiens
tgggaatgcggcaaga

SEQ ID NO: 285456 - DNA, 15 bp, Homo sapiens
tgggacaatggcaat

SEQ ID NO: 285457 - DNA, 15 bp, Homo sapiens
tgggacacagagacc

SEQ ID NO: 285458 - DNA, 15 bp, Homo sapiens
tgggacagccagagc

SEQ ID NO: 285459 - DNA, 16 bp, Homo sapiens
tgggacagccagagct

SEQ ID NO: 285460 - DNA, 18 bp, Homo sapiens
tgggacagccagagctgg

SEQ ID NO: 285461 - DNA, 14 bp, Homo sapiens
tgggacagctaggc

SEQ ID NO: 285462 - DNA, 20 bp, Homo sapiens
tgggacccagctactctgtc

SEQ ID NO: 285463 - DNA, 22 bp, Homo sapiens
tgggacccagctactctgtcca

SEQ ID NO: 285464 - DNA, 14 bp, Homo sapiens
tgggacccctccca

SEQ ID NO: 285465 - DNA, 21 bp, Homo sapiens
tgggaccctcggggcaggaag

SEQ ID NO: 285466 - DNA, 22 bp, Homo sapiens
tgggaccctcggggcaggaagt

SEQ ID NO: 285467 - DNA, 14 bp, Homo sapiens
tgggacggaagtgg

SEQ ID NO: 285468 - DNA, 15 bp, Homo sapiens
tgggactaaatgccc

SEQ ID NO: 285469 - DNA, 15 bp, Homo sapiens
tgggactctcctcct

SEQ ID NO: 285470 - DNA, 15 bp, Homo sapiens
tgggactgagccagt

SEQ ID NO: 285471 - DNA, 20 bp, Homo sapiens
tgggactgagccagtcccag

SEQ ID NO: 285472 - DNA, 20 bp, Homo sapiens
tggtctctttctttccaaag

SEQ ID NO: 285473 - DNA, 17 bp, Homo sapiens
tggtctgaatgttctga

SEQ ID NO: 285474 - DNA, 22 bp, Homo sapiens
tggtctgaatgttctgacatta

SEQ ID NO: 285475 - DNA, 16 bp, Homo sapiens
tggtctgggacttcct

SEQ ID NO: 285476 - DNA, 17 bp, Homo sapiens
tggtctgggacttcctt

SEQ ID NO: 285477 - DNA, 12 bp, Homo sapiens
tggtctgtactc

SEQ ID NO: 285478 - DNA, 20 bp, Homo sapiens
tggtcttactttgtgcaaaa

SEQ ID NO: 285479 - DNA, 19 bp, Homo sapiens
tggtcttagctttacattt

SEQ ID NO: 285480 - DNA, 16 bp, Homo sapiens
tggtcttatttgtaaa

SEQ ID NO: 285481 - DNA, 17 bp, Homo sapiens
tggtcttgagatgtctt

SEQ ID NO: 285482 - DNA, 12 bp, Homo sapiens
tggtcttggaga

SEQ ID NO: 285483 - DNA, 15 bp, Homo sapiens
tggtcttggagagga

SEQ ID NO: 285484 - DNA, 16 bp, Homo sapiens
tggtcttggagaggag

SEQ ID NO: 285485 - DNA, 17 bp, Homo sapiens
tggtcttggagaggagg

SEQ ID NO: 285486 - DNA, 14 bp, Homo sapiens
tggtctttctggag

SEQ ID NO: 285487 - DNA, 13 bp, Homo sapiens
tggtgaaattatg

SEQ ID NO: 285488 - DNA, 18 bp, Homo sapiens
tggtgaaatttattagtt

SEQ ID NO: 285489 - DNA, 19 bp, Homo sapiens
tggtgaaatttattagtta

SEQ ID NO: 285490 - DNA, 13 bp, Homo sapiens
tggtgaagtgtgg

SEQ ID NO: 285491 - DNA, 14 bp, Homo sapiens
tggtgaagtgtggc

SEQ ID NO: 285492 - DNA, 20 bp, Homo sapiens
tggtgaagtgtggctggtgt

SEQ ID NO: 285493 - DNA, 15 bp, Homo sapiens
tggtgacagccttgg

SEQ ID NO: 285494 - DNA, 14 bp, Homo sapiens
tggtgacttttgaa

SEQ ID NO: 285495 - DNA, 17 bp, Homo sapiens
tggtgagaattaaaata

SEQ ID NO: 285496 - DNA, 22 bp, Homo sapiens
tggtgagaattaaaataaaacg

SEQ ID NO: 285497 - DNA, 21 bp, Homo sapiens
tggtgagatacccagagagaa

SEQ ID NO: 285498 - DNA, 18 bp, Homo sapiens
tggtgagctgggaagctg

SEQ ID NO: 285499 - DNA, 21 bp, Homo sapiens
tggtgaggcccagcctgtcct

SEQ ID NO: 285500 - DNA, 15 bp, Homo sapiens
tggtgatctgtagac

SEQ ID NO: 285501 - DNA, 18 bp, Homo sapiens
tggtgatgcctaaaggaa

SEQ ID NO: 285502 - DNA, 20 bp, Homo sapiens
tggtgatgtaaaacagaata

SEQ ID NO: 285503 - DNA, 16 bp, Homo sapiens
tggtgatgtgcctgta

SEQ ID NO: 285504 - DNA, 16 bp, Homo sapiens
tggtgatttcttgcta

SEQ ID NO: 285505 - DNA, 20 bp, Homo sapiens
tggtgcaaagattgcctctt

SEQ ID NO: 285506 - DNA, 23 bp, Homo sapiens
tggtgccacttcttaaaggcctg

SEQ ID NO: 285507 - DNA, 14 bp, Homo sapiens
tggtgccagccttc

SEQ ID NO: 285508 - DNA, 22 bp, Homo sapiens
tggtgcccagactcaaggcctc

SEQ ID NO: 285509 - DNA, 17 bp, Homo sapiens
tggtgccccacagctac

SEQ ID NO: 285510 - DNA, 24 bp, Homo sapiens
tggtgccctgaacctctgatgcct

SEQ ID NO: 285511 - DNA, 14 bp, Homo sapiens
tggtgcgtgtggcc

SEQ ID NO: 285512 - DNA, 17 bp, Homo sapiens
tggtgcgtgtggccctg

SEQ ID NO: 285513 - DNA, 19 bp, Homo sapiens
tggtgcgtgtggccctgtg

SEQ ID NO: 285514 - DNA, 14 bp, Homo sapiens
tggtgctaactgta

SEQ ID NO: 285515 - DNA, 22 bp, Homo sapiens
tggtgctaactgtatgtgtctt

SEQ ID NO: 285516 - DNA, 12 bp, Homo sapiens
tggtgctggata

SEQ ID NO: 285517 - DNA, 14 bp, Homo sapiens
tggtggatggtgac

SEQ ID NO: 285518 - DNA, 11 bp, Homo sapiens
tggtggcccca

SEQ ID NO: 285519 - DNA, 15 bp, Homo sapiens
tggtggcccctcccc

SEQ ID NO: 285520 - DNA, 21 bp, Homo sapiens
tggtggcctctgccccgtctc

SEQ ID NO: 285521 - DNA, 23 bp, Homo sapiens
tggtggcgctttctcctgtgccc

SEQ ID NO: 285522 - DNA, 14 bp, Homo sapiens
tggtgggaaaatgt

SEQ ID NO: 285523 - DNA, 19 bp, Homo sapiens
tggtggggctgagcctgag

SEQ ID NO: 285524 - DNA, 18 bp, Homo sapiens
tggtgggggtagagctga

SEQ ID NO: 285525 - DNA, 21 bp, Homo sapiens
tggtgggggtagagctgatcc

SEQ ID NO: 285526 - DNA, 19 bp, Homo sapiens
tggtgggttcaggggactc

SEQ ID NO: 285527 - DNA, 21 bp, Homo sapiens
tggtgggttcaggggactcag

SEQ ID NO: 285528 - DNA, 14 bp, Homo sapiens
tggtggtactttat

SEQ ID NO: 285529 - DNA, 18 bp, Homo sapiens
tggtggtactttattctt

SEQ ID NO: 285530 - DNA, 12 bp, Homo sapiens
tggtggtgcagc

SEQ ID NO: 285531 - DNA, 17 bp, Homo sapiens
tggtggtttcagaaagg

SEQ ID NO: 285532 - DNA, 16 bp, Homo sapiens
tggtgtatatcatgaa

SEQ ID NO: 285533 - DNA, 14 bp, Homo sapiens
tggtgtccttcttc

SEQ ID NO: 285534 - DNA, 16 bp, Homo sapiens
tggtgtccttcttcct

SEQ ID NO: 285535 - DNA, 17 bp, Homo sapiens
tggtgtccttcttcctc

SEQ ID NO: 285536 - DNA, 21 bp, Homo sapiens
tggtgtctgatgtgtgcccag

SEQ ID NO: 285537 - DNA, 19 bp, Homo sapiens
tggtgtgaatgctgtacct

SEQ ID NO: 285538 - DNA, 20 bp, Homo sapiens
tggtgtgaggcccccggagg

SEQ ID NO: 285539 - DNA, 14 bp, Homo sapiens
tggtgtgtgtctct

SEQ ID NO: 285540 - DNA, 21 bp, Homo sapiens
tggtgttctcaatgcttttct

SEQ ID NO: 285541 - DNA, 17 bp, Homo sapiens
tggtgttggcagtgttt

SEQ ID NO: 285542 - DNA, 21 bp, Homo sapiens
tggtgttttaaagagaatgta

SEQ ID NO: 285543 - DNA, 13 bp, Homo sapiens
tggttaataaaac

SEQ ID NO: 285544 - DNA, 15 bp, Homo sapiens
tggttaataaaactg

SEQ ID NO: 285545 - DNA, 19 bp, Homo sapiens
tggttaataaaactgcaca

SEQ ID NO: 285546 - DNA, 22 bp, Homo sapiens
tggttaataaaactgcacagtg

SEQ ID NO: 285547 - DNA, 17 bp, Homo sapiens
tggttaatctttcctga

SEQ ID NO: 285548 - DNA, 19 bp, Homo sapiens
tggttacagtgcagacagg

SEQ ID NO: 285549 - DNA, 12 bp, Homo sapiens
tggttacatgaa

SEQ ID NO: 285550 - DNA, 21 bp, Homo sapiens
tggttagagaagtaagcagag

SEQ ID NO: 285551 - DNA, 21 bp, Homo sapiens
tggttatcctgtgctacagag

SEQ ID NO: 285552 - DNA, 21 bp, Homo sapiens
tggttatgtcccatgaccttg

SEQ ID NO: 285553 - DNA, 19 bp, Homo sapiens
tggttcagagactggcagc

SEQ ID NO: 285554 - DNA, 20 bp, Homo sapiens
tggttcagagactggcagcc

SEQ ID NO: 285555 - DNA, 22 bp, Homo sapiens
tggttcagagactggcagccag

SEQ ID NO: 285556 - DNA, 19 bp, Homo sapiens
tggttccatgcctgagggt

SEQ ID NO: 285557 - DNA, 20 bp, Homo sapiens
tggttcccaataaaagtgac

SEQ ID NO: 285558 - DNA, 14 bp, Homo sapiens
tggttcctcatggc

SEQ ID NO: 285559 - DNA, 12 bp, Homo sapiens
tggttcctgccc

SEQ ID NO: 285560 - DNA, 12 bp, Homo sapiens
tggttcctgggg

SEQ ID NO: 285561 - DNA, 21 bp, Homo sapiens
tggttccttaagtggctgtga

SEQ ID NO: 285562 - DNA, 13 bp, Homo sapiens
tggttctccatcc

SEQ ID NO: 285563 - DNA, 15 bp, Homo sapiens
tggttcttgccttcc

SEQ ID NO: 285564 - DNA, 12 bp, Homo sapiens
tggttgcagcct

SEQ ID NO: 285565 - DNA, 17 bp, Homo sapiens
tggttgctgggcctcat

SEQ ID NO: 285566 - DNA, 21 bp, Homo sapiens
tggttgctgggcctcattcta

SEQ ID NO: 285567 - DNA, 23 bp, Homo sapiens
tggttggaggcctggtctggagc

SEQ ID NO: 285568 - DNA, 18 bp, Homo sapiens
tgtataacttcttaaaag

SEQ ID NO: 285569 - DNA, 19 bp, Homo sapiens
tgtataagacactttgcca

SEQ ID NO: 285570 - DNA, 13 bp, Homo sapiens
tgtatacaaacag

SEQ ID NO: 285571 - DNA, 15 bp, Homo sapiens
tgtatacaaacaggt

SEQ ID NO: 285572 - DNA, 16 bp, Homo sapiens
tgtatacaaacaggtg

SEQ ID NO: 285573 - DNA, 20 bp, Homo sapiens
tgtatacaaacaggtgctaa

SEQ ID NO: 285574 - DNA, 22 bp, Homo sapiens
tgtatacattttgttatagaat

SEQ ID NO: 285575 - DNA, 20 bp, Homo sapiens
tgtataccacctgtacatac

SEQ ID NO: 285576 - DNA, 13 bp, Homo sapiens
tgtatacttaata

SEQ ID NO: 285577 - DNA, 14 bp, Homo sapiens
tgtataggccatct

SEQ ID NO: 285578 - DNA, 18 bp, Homo sapiens
tgtataggccatctgtaa

SEQ ID NO: 285579 - DNA, 22 bp, Homo sapiens
tgtataggccatctgtaaatat

SEQ ID NO: 285580 - DNA, 13 bp, Homo sapiens
tgtataggtagat

SEQ ID NO: 285581 - DNA, 12 bp, Homo sapiens
tgtatatatgtg

SEQ ID NO: 285582 - DNA, 14 bp, Homo sapiens
tgtatatatgtgtg

SEQ ID NO: 285583 - DNA, 15 bp, Homo sapiens
tgtatatccttccaa

SEQ ID NO: 285584 - DNA, 16 bp, Homo sapiens
tgtatatgttgtaata

SEQ ID NO: 285585 - DNA, 13 bp, Homo sapiens
tgtatatgtttat

SEQ ID NO: 285586 - DNA, 19 bp, Homo sapiens
tgtatatgtttatatactg

SEQ ID NO: 285587 - DNA, 16 bp, Homo sapiens
tgtatattatcttctg

SEQ ID NO: 285588 - DNA, 18 bp, Homo sapiens
tgtatatttgaaactgct

SEQ ID NO: 285589 - DNA, 23 bp, Homo sapiens
tgtatcaaactcgtctgatgttt

SEQ ID NO: 285590 - DNA, 18 bp, Homo sapiens
tgtatcaacccagaaaca

SEQ ID NO: 285591 - DNA, 16 bp, Homo sapiens
tgtatcaagcccctgt

SEQ ID NO: 285592 - DNA, 22 bp, Homo sapiens
tgtatcacaaagctgtgaaatg

SEQ ID NO: 285593 - DNA, 17 bp, Homo sapiens
tgtatcaccctcagctg

SEQ ID NO: 285594 - DNA, 14 bp, Homo sapiens
tgtatccatttaaa

SEQ ID NO: 285595 - DNA, 22 bp, Homo sapiens
tgtatcccccccctgtatagtt

SEQ ID NO: 285596 - DNA, 13 bp, Homo sapiens
tgtatcctggggc

SEQ ID NO: 285597 - DNA, 15 bp, Homo sapiens
tgtatcggagacagt

SEQ ID NO: 285598 - DNA, 13 bp, Homo sapiens
tgtatctaaaaaa

SEQ ID NO: 285599 - DNA, 16 bp, Homo sapiens
tgtatctaaaaaataa

SEQ ID NO: 285600 - DNA, 19 bp, Homo sapiens
tgtatctagtgcagctgat

SEQ ID NO: 285601 - DNA, 18 bp, Homo sapiens
tgtatctagtggtctgat

SEQ ID NO: 285602 - DNA, 15 bp, Homo sapiens
tgtatctctaatgaa

SEQ ID NO: 285603 - DNA, 18 bp, Homo sapiens
tgtatctgaaggagattt

SEQ ID NO: 285604 - DNA, 18 bp, Homo sapiens
tgtatcttaaatctgtga

SEQ ID NO: 285605 - DNA, 11 bp, Homo sapiens
tgtatcttaag

SEQ ID NO: 285606 - DNA, 17 bp, Homo sapiens
tgtatcttatttatata

SEQ ID NO: 285607 - DNA, 20 bp, Homo sapiens
tgtatcttttattttcctgt

SEQ ID NO: 285608 - DNA, 22 bp, Homo sapiens
tgtatcttttattttcctgtct

SEQ ID NO: 285609 - DNA, 11 bp, Homo sapiens
tgtatgaaaat

SEQ ID NO: 285610 - DNA, 21 bp, Homo sapiens
tgtatgaaaatccttttaacc

SEQ ID NO: 285611 - DNA, 22 bp, Homo sapiens
tgtatgaaagatggctgtgcct

SEQ ID NO: 285612 - DNA, 14 bp, Homo sapiens
tgtatgaaggcttt

SEQ ID NO: 285613 - DNA, 14 bp, Homo sapiens
tgtatgaagtactt

SEQ ID NO: 285614 - DNA, 16 bp, Homo sapiens
tgtatgactaaagaga

SEQ ID NO: 285615 - DNA, 20 bp, Homo sapiens
tgtatgactaaagagagaat

SEQ ID NO: 285616 - DNA, 23 bp, Homo sapiens
tgtatgaggcttttcccaccagc

SEQ ID NO: 285617 - DNA, 18 bp, Homo sapiens
tgtatgatttaggcttct

SEQ ID NO: 285618 - DNA, 18 bp, Homo sapiens
tgtatgccaagtgagaag

SEQ ID NO: 285619 - DNA, 23 bp, Homo sapiens
tgtatgcctttaaatctgtgatg

SEQ ID NO: 285620 - DNA, 18 bp, Homo sapiens
tgtatggatatgtgtaaa

SEQ ID NO: 285621 - DNA, 12 bp, Homo sapiens
tgtatgtaaaaa

SEQ ID NO: 285622 - DNA, 11 bp, Homo sapiens
tgtatgtatgt

SEQ ID NO: 285623 - DNA, 12 bp, Homo sapiens
tgtatgtctgcc

SEQ ID NO: 285624 - DNA, 13 bp, Homo sapiens
tgtatgtcttata

SEQ ID NO: 285625 - DNA, 14 bp, Homo sapiens
tgtatgtcttataa

SEQ ID NO: 285626 - DNA, 17 bp, Homo sapiens
tgtatgtgcgtgtgtgc

SEQ ID NO: 285627 - DNA, 14 bp, Homo sapiens
tgtatgtggaagca

SEQ ID NO: 285628 - DNA, 15 bp, Homo sapiens
tgtatgtgtagtgtg

SEQ ID NO: 285629 - DNA, 14 bp, Homo sapiens
tgtatgttaaagca

SEQ ID NO: 285630 - DNA, 15 bp, Homo sapiens
tgtatgtttacatat

SEQ ID NO: 285631 - DNA, 16 bp, Homo sapiens
tgtatgtttacatatc

SEQ ID NO: 285632 - DNA, 22 bp, Homo sapiens
tgtatgtttgcacacttgtgtg

SEQ ID NO: 285633 - DNA, 14 bp, Homo sapiens
tgtattaatactta

SEQ ID NO: 285634 - DNA, 15 bp, Homo sapiens
tgtattacataaata

SEQ ID NO: 285635 - DNA, 15 bp, Homo sapiens
tgtcactaaagcagg

SEQ ID NO: 285636 - DNA, 20 bp, Homo sapiens
tgtcactacaaaaatacaat

SEQ ID NO: 285637 - DNA, 16 bp, Homo sapiens
tgtcactactggtctg

SEQ ID NO: 285638 - DNA, 13 bp, Homo sapiens
tgtcactcagctg

SEQ ID NO: 285639 - DNA, 16 bp, Homo sapiens
tgtcactcagctgaga

SEQ ID NO: 285640 - DNA, 12 bp, Homo sapiens
tgtcactctgcc

SEQ ID NO: 285641 - DNA, 13 bp, Homo sapiens
tgtcactctgcct

SEQ ID NO: 285642 - DNA, 15 bp, Homo sapiens
tgtcactctgcctct

SEQ ID NO: 285643 - DNA, 23 bp, Homo sapiens
tgtcactctgcctctaaggccaa

SEQ ID NO: 285644 - DNA, 20 bp, Homo sapiens
tgtcactggaacctccctgg

SEQ ID NO: 285645 - DNA, 15 bp, Homo sapiens
tgtcactgtggtcct

SEQ ID NO: 285646 - DNA, 18 bp, Homo sapiens
tgtcactgtttctctgct

SEQ ID NO: 285647 - DNA, 14 bp, Homo sapiens
tgtcactttgctct

SEQ ID NO: 285648 - DNA, 17 bp, Homo sapiens
tgtcactttgctctggg

SEQ ID NO: 285649 - DNA, 15 bp, Homo sapiens
tgtcacttttttcct

SEQ ID NO: 285650 - DNA, 19 bp, Homo sapiens
tgtcacttttttcctgtca

SEQ ID NO: 285651 - DNA, 16 bp, Homo sapiens
tgtcagaaaccagtta

SEQ ID NO: 285652 - DNA, 19 bp, Homo sapiens
tgtcagaccttcttccaca

SEQ ID NO: 285653 - DNA, 12 bp, Homo sapiens
tgtcagacttta

SEQ ID NO: 285654 - DNA, 13 bp, Homo sapiens
tgtcagagccgcc

SEQ ID NO: 285655 - DNA, 15 bp, Homo sapiens
tgtcagagctgggag

SEQ ID NO: 285656 - DNA, 17 bp, Homo sapiens
tgtcagcagctctgaga

SEQ ID NO: 285657 - DNA, 16 bp, Homo sapiens
tgtcagccattcctgt

SEQ ID NO: 285658 - DNA, 22 bp, Homo sapiens
tgtcagccgagccgggcctggg

SEQ ID NO: 285659 - DNA, 12 bp, Homo sapiens
tgtcagccttgc

SEQ ID NO: 285660 - DNA, 18 bp, Homo sapiens
tgtcagctactaatgatg

SEQ ID NO: 285661 - DNA, 15 bp, Homo sapiens
tgtcaggctctgaat

SEQ ID NO: 285662 - DNA, 20 bp, Homo sapiens
tgtcagtatctgtatctctc

SEQ ID NO: 285663 - DNA, 16 bp, Homo sapiens
tgtcagtcgtgttgct

SEQ ID NO: 285664 - DNA, 15 bp, Homo sapiens
tgtcagtctgagtca

SEQ ID NO: 285665 - DNA, 14 bp, Homo sapiens
tgtcagtgcagccc

SEQ ID NO: 285666 - DNA, 16 bp, Homo sapiens
tgtcagtgtgactgat

SEQ ID NO: 285667 - DNA, 15 bp, Homo sapiens
tgtcagtttgtgaag

SEQ ID NO: 285668 - DNA, 14 bp, Homo sapiens
tgtcatactctgtg

SEQ ID NO: 285669 - DNA, 16 bp, Homo sapiens
tgtcatactctgtgta

SEQ ID NO: 285670 - DNA, 21 bp, Homo sapiens
tgtcatagaatagcatgttgt

SEQ ID NO: 285671 - DNA, 15 bp, Homo sapiens
tgtcatataatgcaa

SEQ ID NO: 285672 - DNA, 15 bp, Homo sapiens
tgtcatcactccctg

SEQ ID NO: 285673 - DNA, 19 bp, Homo sapiens
tgtcatcagaagataactt

SEQ ID NO: 285674 - DNA, 18 bp, Homo sapiens
tgtcatcattgtatatat

SEQ ID NO: 285675 - DNA, 19 bp, Homo sapiens
tgtcatcattgtatatatg

SEQ ID NO: 285676 - DNA, 22 bp, Homo sapiens
tgtcatccacacaacaccagga

SEQ ID NO: 285677 - DNA, 18 bp, Homo sapiens
tgtcatctgtcagcttcc

SEQ ID NO: 285678 - DNA, 19 bp, Homo sapiens
tgtcatcttttagagtaaa

SEQ ID NO: 285679 - DNA, 14 bp, Homo sapiens
tgtcatgaaagcac

SEQ ID NO: 285680 - DNA, 21 bp, Homo sapiens
tgtcatgaaagcacctgccct

SEQ ID NO: 285681 - DNA, 19 bp, Homo sapiens
tgtcatgcggtttccaagg

SEQ ID NO: 285682 - DNA, 22 bp, Homo sapiens
tgtcatggaaaatgtcctgtgg

SEQ ID NO: 285683 - DNA, 12 bp, Homo sapiens
tgtcatggtgat

SEQ ID NO: 285684 - DNA, 16 bp, Homo sapiens
tgtcatggtgatgcaa

SEQ ID NO: 285685 - DNA, 20 bp, Homo sapiens
tgtcatggtgatgcaagtca

SEQ ID NO: 285686 - DNA, 15 bp, Homo sapiens
tgtcatgtaccatca

SEQ ID NO: 285687 - DNA, 21 bp, Homo sapiens
tgtcatgtaggttgtctaaaa

SEQ ID NO: 285688 - DNA, 13 bp, Homo sapiens
tgtcatgtgtata

SEQ ID NO: 285689 - DNA, 20 bp, Homo sapiens
tgtcatgtgtatgagaagta

SEQ ID NO: 285690 - DNA, 13 bp, Homo sapiens
tgtcattatttga

SEQ ID NO: 285691 - DNA, 20 bp, Homo sapiens
tgtcattcaagcctgtgaat

SEQ ID NO: 285692 - DNA, 13 bp, Homo sapiens
tgtcattgtccat

SEQ ID NO: 285693 - DNA, 12 bp, Homo sapiens
tgtcatttgcta

SEQ ID NO: 285694 - DNA, 13 bp, Homo sapiens
tgtcatttgctaa

SEQ ID NO: 285695 - DNA, 14 bp, Homo sapiens
tgtcatttgctaat

SEQ ID NO: 285696 - DNA, 22 bp, Homo sapiens
tgtcattttattttttccctcc

SEQ ID NO: 285697 - DNA, 15 bp, Homo sapiens
tgtcatttttgcagt

SEQ ID NO: 285698 - DNA, 14 bp, Homo sapiens
tgtccaacagagtg

SEQ ID NO: 285699 - DNA, 18 bp, Homo sapiens
tgtccaagtgtgtgtgcg

SEQ ID NO: 285700 - DNA, 16 bp, Homo sapiens
tgtccaagtgtttctt

SEQ ID NO: 285701 - DNA, 18 bp, Homo sapiens
tgtccaagttcttcacct

SEQ ID NO: 285702 - DNA, 20 bp, Homo sapiens
tgtccaagttcttcacctct

SEQ ID NO: 285703 - DNA, 16 bp, Homo sapiens
tgtccaatcacattca

SEQ ID NO: 285704 - DNA, 15 bp, Homo sapiens
tgtccaattccagag

SEQ ID NO: 285705 - DNA, 14 bp, Homo sapiens
tgtccacaaatgtc

SEQ ID NO: 285706 - DNA, 22 bp, Homo sapiens
tgtccacaaatgtcctcagagg

SEQ ID NO: 285707 - DNA, 14 bp, Homo sapiens
tgtccacattctac

SEQ ID NO: 285708 - DNA, 21 bp, Homo sapiens
tgtccacattctacttcagct

SEQ ID NO: 285709 - DNA, 23 bp, Homo sapiens
tgtccaccctcatttctgccagc

SEQ ID NO: 285710 - DNA, 14 bp, Homo sapiens
tgtccagaaaatag

SEQ ID NO: 285711 - DNA, 24 bp, Homo sapiens
tgtccagaaaatagggtggacaga

SEQ ID NO: 285712 - DNA, 15 bp, Homo sapiens
tgtccagaagaatat

SEQ ID NO: 285713 - DNA, 20 bp, Homo sapiens
tgtccagaagaatattcagg

SEQ ID NO: 285714 - DNA, 13 bp, Homo sapiens
tgtccagagacaa

SEQ ID NO: 285715 - DNA, 15 bp, Homo sapiens
tgtccagcagctgcg

SEQ ID NO: 285716 - DNA, 22 bp, Homo sapiens
tgtccagcagctgcgggtctga

SEQ ID NO: 285717 - DNA, 12 bp, Homo sapiens
tgtccagcctgg

SEQ ID NO: 285718 - DNA, 22 bp, Homo sapiens
tgtccagcctgggcagccaggc

SEQ ID NO: 285719 - DNA, 19 bp, Homo sapiens
tgtccaggcactgctgccc

SEQ ID NO: 285720 - DNA, 16 bp, Homo sapiens
tgtccaggccactgtg

SEQ ID NO: 285721 - DNA, 19 bp, Homo sapiens
tgtccaggccactgtggcc

SEQ ID NO: 285722 - DNA, 20 bp, Homo sapiens
tgtccaggccactgtggcca

SEQ ID NO: 285723 - DNA, 11 bp, Homo sapiens
tgtccaggtct

SEQ ID NO: 285724 - DNA, 22 bp, Homo sapiens
tgtccagttcaggaatttttgt

SEQ ID NO: 285725 - DNA, 20 bp, Homo sapiens
tgtccatatcagacctctga

SEQ ID NO: 285726 - DNA, 23 bp, Homo sapiens
tgtccatatcagacctctgatcc

SEQ ID NO: 285727 - DNA, 21 bp, Homo sapiens
tgtccatctgtctgtcctacc

SEQ ID NO: 285728 - DNA, 14 bp, Homo sapiens
tgtccatgcctaca

SEQ ID NO: 285729 - DNA, 16 bp, Homo sapiens
tgtccatgtgtgtgca

SEQ ID NO: 285730 - DNA, 19 bp, Homo sapiens
tgtccatttacctggaaac

SEQ ID NO: 285731 - DNA, 12 bp, Homo sapiens
tgtccatttata

SEQ ID NO: 285732 - DNA, 16 bp, Homo sapiens
tgtcccaacttgtaaa

SEQ ID NO: 285733 - DNA, 15 bp, Homo sapiens
tgtcccaaggagctg

SEQ ID NO: 285734 - DNA, 13 bp, Homo sapiens
tgtcccacagctt

SEQ ID NO: 285735 - DNA, 13 bp, Homo sapiens
tgtcccaccaact

SEQ ID NO: 285736 - DNA, 20 bp, Homo sapiens
tgtcccaccaactctgcact

SEQ ID NO: 285737 - DNA, 16 bp, Homo sapiens
tgtcccactgggacac

SEQ ID NO: 285738 - DNA, 17 bp, Homo sapiens
tgtcccatgatccctgt

SEQ ID NO: 285739 - DNA, 14 bp, Homo sapiens
tgtcccattctaga

SEQ ID NO: 285740 - DNA, 20 bp, Homo sapiens
tgtcccatttattattttaa

SEQ ID NO: 285741 - DNA, 20 bp, Homo sapiens
tgtcccatttctaaaggcct

SEQ ID NO: 285742 - DNA, 22 bp, Homo sapiens
tgtccccaacgtcccctccgcc

SEQ ID NO: 285743 - DNA, 13 bp, Homo sapiens
tgtccccagccca

SEQ ID NO: 285744 - DNA, 15 bp, Homo sapiens
tgtccccagcccact

SEQ ID NO: 285745 - DNA, 15 bp, Homo sapiens
tgtccccagccctgt

SEQ ID NO: 285746 - DNA, 17 bp, Homo sapiens
tgtccccagggcccctc

SEQ ID NO: 285747 - DNA, 14 bp, Homo sapiens
tgtccccattctat

SEQ ID NO: 285748 - DNA, 14 bp, Homo sapiens
tgtcccccaacttg

SEQ ID NO: 285749 - DNA, 16 bp, Homo sapiens
tgtcccccaacttgag

SEQ ID NO: 285750 - DNA, 13 bp, Homo sapiens
tgtcccccaaggt

SEQ ID NO: 285751 - DNA, 12 bp, Homo sapiens
tgtcccccacct

SEQ ID NO: 285752 - DNA, 21 bp, Homo sapiens
tgtccccccaggtgctggagg

SEQ ID NO: 285753 - DNA, 17 bp, Homo sapiens
tgtccccctacccaccg

SEQ ID NO: 285754 - DNA, 19 bp, Homo sapiens
tgtccccgccttccctcac

SEQ ID NO: 285755 - DNA, 20 bp, Homo sapiens
tgtcccctgtcccaccaact

SEQ ID NO: 285756 - DNA, 16 bp, Homo sapiens
tgtcccgattgtaact

SEQ ID NO: 285757 - DNA, 20 bp, Homo sapiens
tgtccctaccactgagccct

SEQ ID NO: 285758 - DNA, 17 bp, Homo sapiens
tgtccctatgcatatca

SEQ ID NO: 285759 - DNA, 16 bp, Homo sapiens
tgtccctcctcttcct

SEQ ID NO: 285760 - DNA, 13 bp, Homo sapiens
tgtccctcctgag

SEQ ID NO: 285761 - DNA, 22 bp, Homo sapiens
tgtccctctcactccccagccc

SEQ ID NO: 285762 - DNA, 21 bp, Homo sapiens
tgtccctctcctatgtggcag

SEQ ID NO: 285763 - DNA, 22 bp, Homo sapiens
tgtccctctcctatgtggcagc

SEQ ID NO: 285764 - DNA, 20 bp, Homo sapiens
tgtccctgaagtcttgcatt

SEQ ID NO: 285765 - DNA, 16 bp, Homo sapiens
tgtccctggccatctc

SEQ ID NO: 285766 - DNA, 22 bp, Homo sapiens
tgtccctggccatctctgaact

SEQ ID NO: 285767 - DNA, 14 bp, Homo sapiens
tgtccctgtgccta

SEQ ID NO: 285768 - DNA, 22 bp, Homo sapiens
tgtccctgtggtaccctggcag

SEQ ID NO: 285769 - DNA, 20 bp, Homo sapiens
tgtccctttctgtgtgaaga

SEQ ID NO: 285770 - DNA, 17 bp, Homo sapiens
tgtcccttttccttttt

SEQ ID NO: 285771 - DNA, 12 bp, Homo sapiens
tgtccgccctct

SEQ ID NO: 285772 - DNA, 13 bp, Homo sapiens
tgtcctacccgcc

SEQ ID NO: 285773 - DNA, 14 bp, Homo sapiens
tgtcctacccgccc

SEQ ID NO: 285774 - DNA, 12 bp, Homo sapiens
tgtcctataatt

SEQ ID NO: 285775 - DNA, 13 bp, Homo sapiens
tgtcctcaaagaa

SEQ ID NO: 285776 - DNA, 14 bp, Homo sapiens
tgtcctcagcttct

SEQ ID NO: 285777 - DNA, 17 bp, Homo sapiens
tgtcctcatctataaaa

SEQ ID NO: 285778 - DNA, 21 bp, Homo sapiens
tgtcctccaccacaagagctc

SEQ ID NO: 285779 - DNA, 16 bp, Homo sapiens
tgtcctccagaagcct

SEQ ID NO: 285780 - DNA, 18 bp, Homo sapiens
tgtcctcttaagacacta

SEQ ID NO: 285781 - DNA, 17 bp, Homo sapiens
tgtcctctttcagaaaa

SEQ ID NO: 285782 - DNA, 19 bp, Homo sapiens
tgtcctctttcagaaaaca

SEQ ID NO: 285783 - DNA, 23 bp, Homo sapiens
tgtcctctttcagaaaacagaaa

SEQ ID NO: 285784 - DNA, 17 bp, Homo sapiens
tgtcctgagccccctgc

SEQ ID NO: 285785 - DNA, 18 bp, Homo sapiens
tgtcctgatgcttttgtc

SEQ ID NO: 285786 - DNA, 19 bp, Homo sapiens
tgtcctgatggtcagctcc

SEQ ID NO: 285787 - DNA, 15 bp, Homo sapiens
tgtcctgcagagctg

SEQ ID NO: 285788 - DNA, 16 bp, Homo sapiens
tgtcctgcagagctgg

SEQ ID NO: 285789 - DNA, 12 bp, Homo sapiens
tgtcctgccagc

SEQ ID NO: 285790 - DNA, 22 bp, Homo sapiens
tgtcctgccagctgccttcctc

SEQ ID NO: 285791 - DNA, 10 bp, Homo sapiens
tgtcctgggc

SEQ ID NO: 285792 - DNA, 17 bp, Homo sapiens
tgtcctgggcgccctgg

SEQ ID NO: 285793 - DNA, 18 bp, Homo sapiens
tgtcctggtacagcaggg

SEQ ID NO: 285794 - DNA, 21 bp, Homo sapiens
tgtcctggttccttcctatgc

SEQ ID NO: 285795 - DNA, 22 bp, Homo sapiens
tgtcctgtaaacactcagctgt

SEQ ID NO: 285796 - DNA, 14 bp, Homo sapiens
tgtcctgtgctttc

SEQ ID NO: 285797 - DNA, 19 bp, Homo sapiens
tgtccttagactccttctc

SEQ ID NO: 285798 - DNA, 14 bp, Homo sapiens
tgtccttcagagct

SEQ ID NO: 285799 - DNA, 16 bp, Homo sapiens
tgtccttcagagctct

SEQ ID NO: 285800 - DNA, 19 bp, Homo sapiens
tgtccttcagagctcttca

SEQ ID NO: 285801 - DNA, 15 bp, Homo sapiens
tgtccttccttccat

SEQ ID NO: 285802 - DNA, 18 bp, Homo sapiens
tgtccttctctcacctcc

SEQ ID NO: 285803 - DNA, 21 bp, Homo sapiens
tgtccttctctcacctcctaa

SEQ ID NO: 285804 - DNA, 14 bp, Homo sapiens
tgtccttcttcctc

SEQ ID NO: 285805 - DNA, 14 bp, Homo sapiens
tgtcctttccctgg

SEQ ID NO: 285806 - DNA, 15 bp, Homo sapiens
tgtcctttccctgga

SEQ ID NO: 285807 - DNA, 16 bp, Homo sapiens
tgtcctttccctggag

SEQ ID NO: 285808 - DNA, 13 bp, Homo sapiens
tgtcctttctcca

SEQ ID NO: 285809 - DNA, 17 bp, Homo sapiens
tgtcctttctccaggcc

SEQ ID NO: 285810 - DNA, 17 bp, Homo sapiens
tgtcctttgagaaagaa

SEQ ID NO: 285811 - DNA, 20 bp, Homo sapiens
tgtcctttgagaaagaaata

SEQ ID NO: 285812 - DNA, 14 bp, Homo sapiens
tgtcgattttcaat

SEQ ID NO: 285813 - DNA, 14 bp, Homo sapiens
tgtcgccgtccctc

SEQ ID NO: 285814 - DNA, 16 bp, Homo sapiens
tgtcgccgtccctctg

SEQ ID NO: 285815 - DNA, 16 bp, Homo sapiens
tgtcggagtagaaatt

SEQ ID NO: 285816 - DNA, 19 bp, Homo sapiens
tgtcggggaagatgaaacc

SEQ ID NO: 285817 - DNA, 20 bp, Homo sapiens
tgtcggggggcgagggaggg

SEQ ID NO: 285818 - DNA, 21 bp, Homo sapiens
tgtcgttcccttgtgtctgtt

SEQ ID NO: 285819 - DNA, 23 bp, Homo sapiens
tgtcgttcccttgtgtctgttgc

SEQ ID NO: 285820 - DNA, 18 bp, Homo sapiens
tgtctaaaagattcttta

SEQ ID NO: 285821 - DNA, 21 bp, Homo sapiens
tgtctaaccccaggttttctg

SEQ ID NO: 285822 - DNA, 22 bp, Homo sapiens
tgtctaagagatctggtcaaag

SEQ ID NO: 285823 - DNA, 14 bp, Homo sapiens
tgtctaagatagta

SEQ ID NO: 285824 - DNA, 18 bp, Homo sapiens
tgtctaatgcattaactt

SEQ ID NO: 285825 - DNA, 18 bp, Homo sapiens
tgtctaattaaaacactt

SEQ ID NO: 285826 - DNA, 13 bp, Homo sapiens
tgtctacaaatat

SEQ ID NO: 285827 - DNA, 15 bp, Homo sapiens
tgtctacaaatataa

SEQ ID NO: 285828 - DNA, 21 bp, Homo sapiens
tgtctacaaatataagatttt

SEQ ID NO: 285829 - DNA, 15 bp, Homo sapiens
tgtctacatgtgcca

SEQ ID NO: 285830 - DNA, 12 bp, Homo sapiens
tgtctactgctt

SEQ ID NO: 285831 - DNA, 12 bp, Homo sapiens
tgtctactgtgg

SEQ ID NO: 285832 - DNA, 16 bp, Homo sapiens
tgtctactgtggtgat

SEQ ID NO: 285833 - DNA, 23 bp, Homo sapiens
tgtctagaggcaacagtgttctg

SEQ ID NO: 285834 - DNA, 18 bp, Homo sapiens
tgtctagataacattcat

SEQ ID NO: 285835 - DNA, 14 bp, Homo sapiens
tgtctagatggatg

SEQ ID NO: 285836 - DNA, 17 bp, Homo sapiens
tgtctagatggatgaat

SEQ ID NO: 285837 - DNA, 19 bp, Homo sapiens
tgtctaggataatttttaa

SEQ ID NO: 285838 - DNA, 18 bp, Homo sapiens
tgtctaggtcagtaccca

SEQ ID NO: 285839 - DNA, 21 bp, Homo sapiens
tgtctaggtcagtacccacct

SEQ ID NO: 285840 - DNA, 19 bp, Homo sapiens
tgtctaggtctcctcaggg

SEQ ID NO: 285841 - DNA, 21 bp, Homo sapiens
tgtctagtagaacaatgtaca

SEQ ID NO: 285842 - DNA, 20 bp, Homo sapiens
tgtctatatttaaatcattt

SEQ ID NO: 285843 - DNA, 19 bp, Homo sapiens
tgtctattctgagccttga

SEQ ID NO: 285844 - DNA, 20 bp, Homo sapiens
tgtctcaagagggcactggt

SEQ ID NO: 285845 - DNA, 23 bp, Homo sapiens
tgtctcaagagggcactggtggc

SEQ ID NO: 285846 - DNA, 15 bp, Homo sapiens
tgtctcaccagctca

SEQ ID NO: 285847 - DNA, 15 bp, Homo sapiens
tgtctcagattggga

SEQ ID NO: 285848 - DNA, 23 bp, Homo sapiens
tgtctcatccccaggggtcccag

SEQ ID NO: 285849 - DNA, 13 bp, Homo sapiens
tgtctcatgccag

SEQ ID NO: 285850 - DNA, 16 bp, Homo sapiens
tgtctccagaccccca

SEQ ID NO: 285851 - DNA, 23 bp, Homo sapiens
tgtctccagacccccaccccttc

SEQ ID NO: 285852 - DNA, 16 bp, Homo sapiens
tgtctccagctgattt

SEQ ID NO: 285853 - DNA, 19 bp, Homo sapiens
tgtctcccctaccaggctg

SEQ ID NO: 285854 - DNA, 21 bp, Homo sapiens
tgtctcccctaccaggctgta

SEQ ID NO: 285855 - DNA, 18 bp, Homo sapiens
tgtctcctactctgtgta

SEQ ID NO: 285856 - DNA, 13 bp, Homo sapiens
tgtctccttccca

SEQ ID NO: 285857 - DNA, 15 bp, Homo sapiens
tgtctccttcccact

SEQ ID NO: 285858 - DNA, 20 bp, Homo sapiens
tgtctcgaaataatttttta

SEQ ID NO: 285859 - DNA, 23 bp, Homo sapiens
tgtctctacccactatgcacaga

SEQ ID NO: 285860 - DNA, 11 bp, Homo sapiens
tgtctctccca

SEQ ID NO: 285861 - DNA, 16 bp, Homo sapiens
tgtctctgagccccct

SEQ ID NO: 285862 - DNA, 17 bp, Homo sapiens
tgtctctgagccccctg

SEQ ID NO: 285863 - DNA, 23 bp, Homo sapiens
tgtctctgggcttggggcttcct

SEQ ID NO: 285864 - DNA, 16 bp, Homo sapiens
tgtctcttcctctgca

SEQ ID NO: 285865 - DNA, 13 bp, Homo sapiens
tgtctcttgaaaa

SEQ ID NO: 285866 - DNA, 20 bp, Homo sapiens
tgtctctttaagttttgatt

SEQ ID NO: 285867 - DNA, 20 bp, Homo sapiens
tgtctgaaggtaatactata

SEQ ID NO: 285868 - DNA, 20 bp, Homo sapiens
tgtctgaagtcactgcacag

SEQ ID NO: 285869 - DNA, 22 bp, Homo sapiens
tgtctgaatcgagtgagacaaa

SEQ ID NO: 285870 - DNA, 13 bp, Homo sapiens
tgtctgagccctg

SEQ ID NO: 285871 - DNA, 15 bp, Homo sapiens
tgtctgagccctgcc

SEQ ID NO: 285872 - DNA, 19 bp, Homo sapiens
tgtctgagccctgccctca

SEQ ID NO: 285873 - DNA, 20 bp, Homo sapiens
tgtctgagccctgccctcac

SEQ ID NO: 285874 - DNA, 11 bp, Homo sapiens
tgtctgatgtg

SEQ ID NO: 285875 - DNA, 20 bp, Homo sapiens
tgtctgatgtgtgcccagat

SEQ ID NO: 285876 - DNA, 15 bp, Homo sapiens
tgtctgattctatgc

SEQ ID NO: 285877 - DNA, 22 bp, Homo sapiens
tgtctgcaaaggagggcctcag

SEQ ID NO: 285878 - DNA, 22 bp, Homo sapiens
tgtctgcaacatggattccaaa

SEQ ID NO: 285879 - DNA, 14 bp, Homo sapiens
tgtctgcctgcctc

SEQ ID NO: 285880 - DNA, 17 bp, Homo sapiens
tgtctgcgccgctgtgc

SEQ ID NO: 285881 - DNA, 18 bp, Homo sapiens
tgtctgcgccgctgtgct

SEQ ID NO: 285882 - DNA, 18 bp, Homo sapiens
tgtctgctgctgcctccc

SEQ ID NO: 285883 - DNA, 18 bp, Homo sapiens
tgtctggctgtggcccct

SEQ ID NO: 285884 - DNA, 19 bp, Homo sapiens
tgtctgggaaagcagagtg

SEQ ID NO: 285885 - DNA, 15 bp, Homo sapiens
tgtctggtccacaca

SEQ ID NO: 285886 - DNA, 22 bp, Homo sapiens
tgtctggttttaacaatttcct

SEQ ID NO: 285887 - DNA, 18 bp, Homo sapiens
tgtctgtaagagaattct

SEQ ID NO: 285888 - DNA, 23 bp, Homo sapiens
tgtctgtccatctgtctgtccta

SEQ ID NO: 285889 - DNA, 19 bp, Homo sapiens
tgtctgtctctccatctgt

SEQ ID NO: 285890 - DNA, 14 bp, Homo sapiens
tgtctgtctgtccc

SEQ ID NO: 285891 - DNA, 13 bp, Homo sapiens
tgtgctttgtagc

SEQ ID NO: 285892 - DNA, 16 bp, Homo sapiens
tgtgcttttcctattt

SEQ ID NO: 285893 - DNA, 17 bp, Homo sapiens
tgtggaaaaaaaaagaa

SEQ ID NO: 285894 - DNA, 19 bp, Homo sapiens
tgtggaaagtgaatttgaa

SEQ ID NO: 285895 - DNA, 16 bp, Homo sapiens
tgtggaacactaaaga

SEQ ID NO: 285896 - DNA, 23 bp, Homo sapiens
tgtggaagcaggttgcttcaaga

SEQ ID NO: 285897 - DNA, 20 bp, Homo sapiens
tgtggacaatgagtggaata

SEQ ID NO: 285898 - DNA, 12 bp, Homo sapiens
tgtggactttat

SEQ ID NO: 285899 - DNA, 19 bp, Homo sapiens
tgtggagaatgtacacagt

SEQ ID NO: 285900 - DNA, 17 bp, Homo sapiens
tgtggagaggagagaat

SEQ ID NO: 285901 - DNA, 19 bp, Homo sapiens
tgtggagaggagagaatga

SEQ ID NO: 285902 - DNA, 14 bp, Homo sapiens
tgtggagaggggtg

SEQ ID NO: 285903 - DNA, 21 bp, Homo sapiens
tgtggagagtgagaataattg

SEQ ID NO: 285904 - DNA, 15 bp, Homo sapiens
tgtggagcacgtgga

SEQ ID NO: 285905 - DNA, 17 bp, Homo sapiens
tgtggagctgcttccag

SEQ ID NO: 285906 - DNA, 18 bp, Homo sapiens
tgtggagctgcttccagt

SEQ ID NO: 285907 - DNA, 20 bp, Homo sapiens
tgtggaggagtccaggccat

SEQ ID NO: 285908 - DNA, 14 bp, Homo sapiens
tgtggaggtggctg

SEQ ID NO: 285909 - DNA, 13 bp, Homo sapiens
tgtggagtggagg

SEQ ID NO: 285910 - DNA, 17 bp, Homo sapiens
tgtggagttcatcttga

SEQ ID NO: 285911 - DNA, 16 bp, Homo sapiens
tgtggatcttttcatt

SEQ ID NO: 285912 - DNA, 19 bp, Homo sapiens
tgtggatcttttcattctc

SEQ ID NO: 285913 - DNA, 16 bp, Homo sapiens
tgtggatgaaaaaaag

SEQ ID NO: 285914 - DNA, 15 bp, Homo sapiens
tgtggatgtcttcct

SEQ ID NO: 285915 - DNA, 19 bp, Homo sapiens
tgtggatgtgtaaatggag

SEQ ID NO: 285916 - DNA, 13 bp, Homo sapiens
tgtggattctata

SEQ ID NO: 285917 - DNA, 19 bp, Homo sapiens
tgtggattttgtggcttca

SEQ ID NO: 285918 - DNA, 13 bp, Homo sapiens
tgtggcaaacatt

SEQ ID NO: 285919 - DNA, 19 bp, Homo sapiens
tgtggcaaagtgctgtacc

SEQ ID NO: 285920 - DNA, 15 bp, Homo sapiens
tgtggcagtggccag

SEQ ID NO: 285921 - DNA, 17 bp, Homo sapiens
tgtggcatcaggaaagg

SEQ ID NO: 285922 - DNA, 21 bp, Homo sapiens
tgtggcatctttgccttgggc

SEQ ID NO: 285923 - DNA, 13 bp, Homo sapiens
tgtggccagagca

SEQ ID NO: 285924 - DNA, 16 bp, Homo sapiens
tgtggccccaggtgcc

SEQ ID NO: 285925 - DNA, 18 bp, Homo sapiens
tgtggccccaggtgccac

SEQ ID NO: 285926 - DNA, 19 bp, Homo sapiens
tgtggcccctccttctccc

SEQ ID NO: 285927 - DNA, 15 bp, Homo sapiens
tgtggccctgtggga

SEQ ID NO: 285928 - DNA, 17 bp, Homo sapiens
tgtggccgcctggcagg

SEQ ID NO: 285929 - DNA, 18 bp, Homo sapiens
tgtggccgcctggcaggt

SEQ ID NO: 285930 - DNA, 20 bp, Homo sapiens
tgtggccgcctggcaggtgg

SEQ ID NO: 285931 - DNA, 13 bp, Homo sapiens
tgtggcctcagaa

SEQ ID NO: 285932 - DNA, 15 bp, Homo sapiens
tgtggcctgtgtcca

SEQ ID NO: 285933 - DNA, 20 bp, Homo sapiens
tgtggccttccatttatatg

SEQ ID NO: 285934 - DNA, 16 bp, Homo sapiens
tgtggcgggcagtggg

SEQ ID NO: 285935 - DNA, 19 bp, Homo sapiens
tgtggctcctatctgtgtt

SEQ ID NO: 285936 - DNA, 13 bp, Homo sapiens
tgtggctttatga

SEQ ID NO: 285937 - DNA, 21 bp, Homo sapiens
tgtggcttttatttcagtgcc

SEQ ID NO: 285938 - DNA, 18 bp, Homo sapiens
tgtgggaatgcggcaaga

SEQ ID NO: 285939 - DNA, 19 bp, Homo sapiens
tgtgggaatgcggcaagaa

SEQ ID NO: 285940 - DNA, 18 bp, Homo sapiens
tgtgggactggcccaccc

SEQ ID NO: 285941 - DNA, 12 bp, Homo sapiens
tgtgggagaagg

SEQ ID NO: 285942 - DNA, 19 bp, Homo sapiens
tgtgggatgttcagcactg

SEQ ID NO: 285943 - DNA, 16 bp, Homo sapiens
tgtgggattatgggtc

SEQ ID NO: 285944 - DNA, 19 bp, Homo sapiens
tgtgggctggtgccccaca

SEQ ID NO: 285945 - DNA, 20 bp, Homo sapiens
tgtgggctggtgccccacag

SEQ ID NO: 285946 - DNA, 14 bp, Homo sapiens
tgtgggctgtgagt

SEQ ID NO: 285947 - DNA, 23 bp, Homo sapiens
tgtggggaagcaagacgtcctgg

SEQ ID NO: 285948 - DNA, 14 bp, Homo sapiens
tgtggggagctggt

SEQ ID NO: 285949 - DNA, 12 bp, Homo sapiens
tgtggggatgtt

SEQ ID NO: 285950 - DNA, 12 bp, Homo sapiens
tgtggggccaca

SEQ ID NO: 285951 - DNA, 16 bp, Homo sapiens
tgtgggggtctgggag

SEQ ID NO: 285952 - DNA, 22 bp, Homo sapiens
tgtgggggtgtcacagaggcag

SEQ ID NO: 285953 - DNA, 12 bp, Homo sapiens
tgtggggtgggg

SEQ ID NO: 285954 - DNA, 22 bp, Homo sapiens
tgtggggtgtgcacatctctgc

SEQ ID NO: 285955 - DNA, 16 bp, Homo sapiens
tgtgggtagtcattct

SEQ ID NO: 285956 - DNA, 14 bp, Homo sapiens
tgtgggtgaccagg

SEQ ID NO: 285957 - DNA, 15 bp, Homo sapiens
tgtgggtgaccaggt

SEQ ID NO: 285958 - DNA, 16 bp, Homo sapiens
tgtgggtttctctgtg

SEQ ID NO: 285959 - DNA, 18 bp, Homo sapiens
tgtggtccagaagaaatt

SEQ ID NO: 285960 - DNA, 21 bp, Homo sapiens
tgtggtccctccactaggagt

SEQ ID NO: 285961 - DNA, 17 bp, Homo sapiens
tgtggtgaagtgtggct

SEQ ID NO: 285962 - DNA, 20 bp, Homo sapiens
tgtggtgaagtgtggctggt

SEQ ID NO: 285963 - DNA, 16 bp, Homo sapiens
tgtggtgatgtgcctg

SEQ ID NO: 285964 - DNA, 18 bp, Homo sapiens
tgtggtgatgtgcctgta

SEQ ID NO: 285965 - DNA, 15 bp, Homo sapiens
tgtggtgcctgaggt

SEQ ID NO: 285966 - DNA, 13 bp, Homo sapiens
tgtggtgggaggg

SEQ ID NO: 285967 - DNA, 22 bp, Homo sapiens
tgtggttaccgagtatctgtaa

SEQ ID NO: 285968 - DNA, 23 bp, Homo sapiens
tgtggttatggggagagggcata

SEQ ID NO: 285969 - DNA, 21 bp, Homo sapiens
tgtggttcctaagcctgttgc

SEQ ID NO: 285970 - DNA, 23 bp, Homo sapiens
tgtggttcctaagcctgttgctg

SEQ ID NO: 285971 - DNA, 13 bp, Homo sapiens
tgtggttctattt

SEQ ID NO: 285972 - DNA, 15 bp, Homo sapiens
tgtggttctatttta

SEQ ID NO: 285973 - DNA, 16 bp, Homo sapiens
tgtggttgcagcctga

SEQ ID NO: 285974 - DNA, 21 bp, Homo sapiens
tgtggttttcccctccctggg

SEQ ID NO: 285975 - DNA, 20 bp, Homo sapiens
tgtgtaaatggagcttgtac

SEQ ID NO: 285976 - DNA, 19 bp, Homo sapiens
tgtgtaaatgttatgactc

SEQ ID NO: 285977 - DNA, 20 bp, Homo sapiens
tgtgtaaccagcagtcacag

SEQ ID NO: 285978 - DNA, 16 bp, Homo sapiens
tgtgtaatagaaaact

SEQ ID NO: 285979 - DNA, 18 bp, Homo sapiens
tgtgtaatagaaaactga

SEQ ID NO: 285980 - DNA, 23 bp, Homo sapiens
tgtgtaatcatttcttgggccct

SEQ ID NO: 285981 - DNA, 23 bp, Homo sapiens
tgtgtacagtatgtgtctagcaa

SEQ ID NO: 285982 - DNA, 15 bp, Homo sapiens
tgtgtacgtggagag

SEQ ID NO: 285983 - DNA, 17 bp, Homo sapiens
tgtgtactgtaaagaat

SEQ ID NO: 285984 - DNA, 18 bp, Homo sapiens
tgtgtacttcagtcttgg

SEQ ID NO: 285985 - DNA, 13 bp, Homo sapiens
tgtgtacttcttc

SEQ ID NO: 285986 - DNA, 17 bp, Homo sapiens
tgtgtatatatttaaaa

SEQ ID NO: 285987 - DNA, 23 bp, Homo sapiens
tgtgtatgagaagtactttgtgc

SEQ ID NO: 285988 - DNA, 15 bp, Homo sapiens
tgtgtatgtacatat

SEQ ID NO: 285989 - DNA, 20 bp, Homo sapiens
tgtgtattctgtggattcta

SEQ ID NO: 285990 - DNA, 12 bp, Homo sapiens
tgtgtattgttc

SEQ ID NO: 285991 - DNA, 15 bp, Homo sapiens
tgtgtattgttccca

SEQ ID NO: 285992 - DNA, 19 bp, Homo sapiens
tgtgtatttccagtgcaat

SEQ ID NO: 285993 - DNA, 12 bp, Homo sapiens
tgtgtatttctg

SEQ ID NO: 285994 - DNA, 16 bp, Homo sapiens
tgtgtcaatgggcaat

SEQ ID NO: 285995 - DNA, 16 bp, Homo sapiens
tgtgtcacactctgtg

SEQ ID NO: 285996 - DNA, 16 bp, Homo sapiens
tgtgtcagctgtagaa

SEQ ID NO: 285997 - DNA, 16 bp, Homo sapiens
tgtgtccagcagctgc

SEQ ID NO: 285998 - DNA, 16 bp, Homo sapiens
tgtgtccatgtgaaat

SEQ ID NO: 285999 - DNA, 15 bp, Homo sapiens
tgtgtccatttcaag

SEQ ID NO: 286000 - DNA, 19 bp, Homo sapiens
tgtgtcccatgatccctgt

SEQ ID NO: 286001 - DNA, 19 bp, Homo sapiens
tgtgtccgctctctcatgt

SEQ ID NO: 286002 - DNA, 20 bp, Homo sapiens
tgtgtccgctctctcatgtg

SEQ ID NO: 286003 - DNA, 14 bp, Homo sapiens
tgtgtcctagttct

SEQ ID NO: 286004 - DNA, 20 bp, Homo sapiens
tgtgtcggggggcgagggag

SEQ ID NO: 286005 - DNA, 19 bp, Homo sapiens
tgtgtctaaatttgaatgt

SEQ ID NO: 286006 - DNA, 16 bp, Homo sapiens
tgtgtctccagctgat

SEQ ID NO: 286007 - DNA, 12 bp, Homo sapiens
tgtgtctctgta

SEQ ID NO: 286008 - DNA, 14 bp, Homo sapiens
tgtgtctcttttct

SEQ ID NO: 286009 - DNA, 16 bp, Homo sapiens
tgtgtctcttttctct

SEQ ID NO: 286010 - DNA, 20 bp, Homo sapiens
tgtgtctgcattgttattgt

SEQ ID NO: 286011 - DNA, 13 bp, Homo sapiens
tgtgtctgcctgc

SEQ ID NO: 286012 - DNA, 16 bp, Homo sapiens
tgtgtctgcctgcctc

SEQ ID NO: 286013 - DNA, 19 bp, Homo sapiens
tgtgtctggtccacacacc

SEQ ID NO: 286014 - DNA, 16 bp, Homo sapiens
tgtgtcttgtgttttt

SEQ ID NO: 286015 - DNA, 17 bp, Homo sapiens
tgtgtcttttgttctct

SEQ ID NO: 286016 - DNA, 18 bp, Homo sapiens
tgtgtcttttgttctctc

SEQ ID NO: 286017 - DNA, 12 bp, Homo sapiens
tgtgtgaagaaa

SEQ ID NO: 286018 - DNA, 19 bp, Homo sapiens
tgtgtgagcgtgtccacag

SEQ ID NO: 286019 - DNA, 17 bp, Homo sapiens
tgtgtgaggagctgctg

SEQ ID NO: 286020 - DNA, 23 bp, Homo sapiens
tgtgtgcaatgttccgttcatct

SEQ ID NO: 286021 - DNA, 13 bp, Homo sapiens
tgtgtgcagtgaa

SEQ ID NO: 286022 - DNA, 16 bp, Homo sapiens
tgtgtgcctgtggcag

SEQ ID NO: 286023 - DNA, 18 bp, Homo sapiens
tgtgtgcgagtgtgtgca

SEQ ID NO: 286024 - DNA, 12 bp, Homo sapiens
tgtgtgctccgg

SEQ ID NO: 286025 - DNA, 22 bp, Homo sapiens
tgtgtgctgtggttcctggggt

SEQ ID NO: 286026 - DNA, 19 bp, Homo sapiens
tgtgtggaaggcacccgcc

SEQ ID NO: 286027 - DNA, 14 bp, Homo sapiens
tgtgtggcaaacat

SEQ ID NO: 286028 - DNA, 15 bp, Homo sapiens
tgtgtggcaaacatt

SEQ ID NO: 286029 - DNA, 21 bp, Homo sapiens
tgtgtggcaaacatttaaaaa

SEQ ID NO: 286030 - DNA, 20 bp, Homo sapiens
tgtgtggccgcctggcaggt

SEQ ID NO: 286031 - DNA, 14 bp, Homo sapiens
tgtgtggcctgcct

SEQ ID NO: 286032 - DNA, 20 bp, Homo sapiens
tgtgtgggggtactagaagc

SEQ ID NO: 286033 - DNA, 21 bp, Homo sapiens
tgtgtgggtttactctgtgct

SEQ ID NO: 286034 - DNA, 16 bp, Homo sapiens
tgtgtgtagccaggaa

SEQ ID NO: 286035 - DNA, 13 bp, Homo sapiens
tgtgtgtatatat

SEQ ID NO: 286036 - DNA, 21 bp, Homo sapiens
tgtgtgtatatatttaaaaaa

SEQ ID NO: 286037 - DNA, 19 bp, Homo sapiens
tgtgtgtatgtttgcacac

SEQ ID NO: 286038 - DNA, 12 bp, Homo sapiens
tgtgtgtctcac

SEQ ID NO: 286039 - DNA, 14 bp, Homo sapiens
tgtgtgtgcaatgt

SEQ ID NO: 286040 - DNA, 13 bp, Homo sapiens
tgtgtgtgtatgt

SEQ ID NO: 286041 - DNA, 11 bp, Homo sapiens
tgtgtgtgtgt

SEQ ID NO: 286042 - DNA, 12 bp, Homo sapiens
tgtgtgtgtgtg

SEQ ID NO: 286043 - DNA, 16 bp, Homo sapiens
tgtgtgttcttttgat

SEQ ID NO: 286044 - DNA, 19 bp, Homo sapiens
tgtgtgttcttttgataca

SEQ ID NO: 286045 - DNA, 20 bp, Homo sapiens
tgtgtgttcttttgatacat

SEQ ID NO: 286046 - DNA, 14 bp, Homo sapiens
tgtgtgttgtctga

SEQ ID NO: 286047 - DNA, 15 bp, Homo sapiens
tgtgtgtttgtgctg

SEQ ID NO: 286048 - DNA, 16 bp, Homo sapiens
tgtgtgtttgtgctga

SEQ ID NO: 286049 - DNA, 20 bp, Homo sapiens
tgtgttaaacatgctaaata

SEQ ID NO: 286050 - DNA, 22 bp, Homo sapiens
tgtgttaagtatgtgtaaaatg

SEQ ID NO: 286051 - DNA, 18 bp, Homo sapiens
tgtgttagtgtctgtcca

SEQ ID NO: 286052 - DNA, 10 bp, Homo sapiens
tgtgttcctg

SEQ ID NO: 286053 - DNA, 14 bp, Homo sapiens
tgtgttcttttgat

SEQ ID NO: 286054 - DNA, 18 bp, Homo sapiens
tgtgttgcaaattattct

SEQ ID NO: 286055 - DNA, 23 bp, Homo sapiens
tgtgttgccacaggacacagtca

SEQ ID NO: 286056 - DNA, 16 bp, Homo sapiens
tgtgttgggccccagg

SEQ ID NO: 286057 - DNA, 18 bp, Homo sapiens
tgtgttggggggcaaggt

SEQ ID NO: 286058 - DNA, 15 bp, Homo sapiens
tgtgtttaaataaag

SEQ ID NO: 286059 - DNA, 16 bp, Homo sapiens
tgtgtttattgtcaaa

SEQ ID NO: 286060 - DNA, 19 bp, Homo sapiens
tgtgtttcaggacagctgc

SEQ ID NO: 286061 - DNA, 12 bp, Homo sapiens
tgtgtttcccta

SEQ ID NO: 286062 - DNA, 14 bp, Homo sapiens
tgtgtttccctaga

SEQ ID NO: 286063 - DNA, 20 bp, Homo sapiens
tgtgtttctatgtgacaatt

SEQ ID NO: 286064 - DNA, 15 bp, Homo sapiens
tgtgtttgcttaaac

SEQ ID NO: 286065 - DNA, 22 bp, Homo sapiens
tgtgtttgtatataaatggtga

SEQ ID NO: 286066 - DNA, 17 bp, Homo sapiens
tgtgttttcataataaa

SEQ ID NO: 286067 - DNA, 20 bp, Homo sapiens
tgtgtttttaataaagacag

SEQ ID NO: 286068 - DNA, 14 bp, Homo sapiens
tgtgtttttctttt

SEQ ID NO: 286069 - DNA, 18 bp, Homo sapiens
tgtgtttttctttttcca

SEQ ID NO: 286070 - DNA, 22 bp, Homo sapiens
tgtgtttttttttcgtttgttt

SEQ ID NO: 286071 - DNA, 19 bp, Homo sapiens
tgttaaaaaatttttgaaa

SEQ ID NO: 286072 - DNA, 14 bp, Homo sapiens
tgttaaaaaccatt

SEQ ID NO: 286073 - DNA, 19 bp, Homo sapiens
tgttaaagttgttttgatt

SEQ ID NO: 286074 - DNA, 19 bp, Homo sapiens
tgttaaatgaaattgtaaa

SEQ ID NO: 286075 - DNA, 14 bp, Homo sapiens
tgttaacactgtaa

SEQ ID NO: 286076 - DNA, 15 bp, Homo sapiens
tgttaaccatttaag

SEQ ID NO: 286077 - DNA, 19 bp, Homo sapiens
tgttaacctcagtgtcatt

SEQ ID NO: 286078 - DNA, 19 bp, Homo sapiens
tgttaactcttgtctattt

SEQ ID NO: 286079 - DNA, 23 bp, Homo sapiens
tgttaagcagatggaatgctgtg

SEQ ID NO: 286080 - DNA, 18 bp, Homo sapiens
tgttaagcagctaaattt

SEQ ID NO: 286081 - DNA, 20 bp, Homo sapiens
tgttaagcgtgtctgtattt

SEQ ID NO: 286082 - DNA, 13 bp, Homo sapiens
tgttaagtgcttt

SEQ ID NO: 286083 - DNA, 15 bp, Homo sapiens
tgttaagtggtttca

SEQ ID NO: 286084 - DNA, 16 bp, Homo sapiens
tgttaagttcaccgta

SEQ ID NO: 286085 - DNA, 13 bp, Homo sapiens
tgttaataaaggt

SEQ ID NO: 286086 - DNA, 15 bp, Homo sapiens
tgttaataaaggttt

SEQ ID NO: 286087 - DNA, 16 bp, Homo sapiens
tgttaatattaattta

SEQ ID NO: 286088 - DNA, 16 bp, Homo sapiens
tgttaatcatcttctc

SEQ ID NO: 286089 - DNA, 17 bp, Homo sapiens
tgttaatcatcttctct

SEQ ID NO: 286090 - DNA, 14 bp, Homo sapiens
tgttaattctagat

SEQ ID NO: 286091 - DNA, 14 bp, Homo sapiens
tgttacagcatcta

SEQ ID NO: 286092 - DNA, 17 bp, Homo sapiens
tgttacaggtgtactat

SEQ ID NO: 286093 - DNA, 18 bp, Homo sapiens
tgttacaggtgtactatg

SEQ ID NO: 286094 - DNA, 19 bp, Homo sapiens
tgttaccatgtcactgtgg

SEQ ID NO: 286095 - DNA, 15 bp, Homo sapiens
tgttacctaggttaa

SEQ ID NO: 286096 - DNA, 13 bp, Homo sapiens
tgttaccttaaaa

SEQ ID NO: 286097 - DNA, 15 bp, Homo sapiens
tgttaccttcacatg

SEQ ID NO: 286098 - DNA, 21 bp, Homo sapiens
tgttacggcagtcacactgct

SEQ ID NO: 286099 - DNA, 17 bp, Homo sapiens
tgttactctggttcttt

SEQ ID NO: 286100 - DNA, 14 bp, Homo sapiens
tgttactgatcatg

SEQ ID NO: 286101 - DNA, 17 bp, Homo sapiens
tgttactgtccaccctc

SEQ ID NO: 286102 - DNA, 16 bp, Homo sapiens
tgttactgtctgtagt

SEQ ID NO: 286103 - DNA, 17 bp, Homo sapiens
tgttactgttaaccatt

SEQ ID NO: 286104 - DNA, 18 bp, Homo sapiens
tgttactgttaaccattt

SEQ ID NO: 286105 - DNA, 21 bp, Homo sapiens
tgttacttaaacatcattgga

SEQ ID NO: 286106 - DNA, 15 bp, Homo sapiens
tgttacttaaatagc

SEQ ID NO: 286107 - DNA, 18 bp, Homo sapiens
tgttacttacctaaacag

SEQ ID NO: 286108 - DNA, 22 bp, Homo sapiens
tgttactttctttcagatgttt

SEQ ID NO: 286109 - DNA, 19 bp, Homo sapiens
tgttagaaaatggacactg

SEQ ID NO: 286110 - DNA, 20 bp, Homo sapiens
tgttagctttttaaaacatt

SEQ ID NO: 286111 - DNA, 20 bp, Homo sapiens
tgttagtagaaattttacaa

SEQ ID NO: 286112 - DNA, 15 bp, Homo sapiens
tgttagtattaacta

SEQ ID NO: 286113 - DNA, 16 bp, Homo sapiens
tgttagtgatttgcta

SEQ ID NO: 286114 - DNA, 18 bp, Homo sapiens
tgttagtgggaagagctg

SEQ ID NO: 286115 - DNA, 12 bp, Homo sapiens
tgttagtgtctg

SEQ ID NO: 286116 - DNA, 15 bp, Homo sapiens
tgttagtgtctgtcc

SEQ ID NO: 286117 - DNA, 16 bp, Homo sapiens
tgttagtgtctgtcca

SEQ ID NO: 286118 - DNA, 13 bp, Homo sapiens
tgttataaaatct

SEQ ID NO: 286119 - DNA, 17 bp, Homo sapiens
tgttataaaatctgtat

SEQ ID NO: 286120 - DNA, 14 bp, Homo sapiens
tgttataactctgc

SEQ ID NO: 286121 - DNA, 15 bp, Homo sapiens
tgttataactctgca

SEQ ID NO: 286122 - DNA, 17 bp, Homo sapiens
tgttataactctgcact

SEQ ID NO: 286123 - DNA, 15 bp, Homo sapiens
tgttatagaatactt

SEQ ID NO: 286124 - DNA, 20 bp, Homo sapiens
tgttatcaaaactttctttt

SEQ ID NO: 286125 - DNA, 13 bp, Homo sapiens
tgttatcaaactt

SEQ ID NO: 286126 - DNA, 20 bp, Homo sapiens
tgttatcagtacaattcttt

SEQ ID NO: 286127 - DNA, 16 bp, Homo sapiens
tgttatctgtctttat

SEQ ID NO: 286128 - DNA, 15 bp, Homo sapiens
tgttatcttgtgtat

SEQ ID NO: 286129 - DNA, 15 bp, Homo sapiens
tgttatggcttattg

SEQ ID NO: 286130 - DNA, 23 bp, Homo sapiens
tgttatggcttattgtgtgaagg

SEQ ID NO: 286131 - DNA, 19 bp, Homo sapiens
tgttattattggcttgcac

SEQ ID NO: 286132 - DNA, 20 bp, Homo sapiens
tgttattcaataactattgc

SEQ ID NO: 286133 - DNA, 14 bp, Homo sapiens
tgttattgaaaaaa

SEQ ID NO: 286134 - DNA, 23 bp, Homo sapiens
tgttattgaaaaaaattggcatt

SEQ ID NO: 286135 - DNA, 21 bp, Homo sapiens
tgttattgggcaagtgattga

SEQ ID NO: 286136 - DNA, 13 bp, Homo sapiens
tgttattgtggaa

SEQ ID NO: 286137 - DNA, 14 bp, Homo sapiens
tgttattgtggaag

SEQ ID NO: 286138 - DNA, 14 bp, Homo sapiens
tgttattgttttca

SEQ ID NO: 286139 - DNA, 17 bp, Homo sapiens
tgttatttcactttttc

SEQ ID NO: 286140 - DNA, 14 bp, Homo sapiens
tgttattttcagta

SEQ ID NO: 286141 - DNA, 18 bp, Homo sapiens
tgttattttctgttgaag

SEQ ID NO: 286142 - DNA, 18 bp, Homo sapiens
tgttattttttaattatt

SEQ ID NO: 286143 - DNA, 19 bp, Homo sapiens
tgttcaaaaaaacactagt

SEQ ID NO: 286144 - DNA, 14 bp, Homo sapiens
tgttcaaaatgtta

SEQ ID NO: 286145 - DNA, 18 bp, Homo sapiens
tgttcaaaatgttaataa

SEQ ID NO: 286146 - DNA, 19 bp, Homo sapiens
tgttcaaaatgttaataaa

SEQ ID NO: 286147 - DNA, 19 bp, Homo sapiens
tgttcaaagaacccccctc

SEQ ID NO: 286148 - DNA, 20 bp, Homo sapiens
tgttcaaagaacccccctcc

SEQ ID NO: 286149 - DNA, 22 bp, Homo sapiens
tgttcaaagaacccccctcccc

SEQ ID NO: 286150 - DNA, 12 bp, Homo sapiens
tgttcaaagtac

SEQ ID NO: 286151 - DNA, 18 bp, Homo sapiens
tgttcaagaaataaaaat

SEQ ID NO: 286152 - DNA, 19 bp, Homo sapiens
tgttcaagcttttcctttc

SEQ ID NO: 286153 - DNA, 16 bp, Homo sapiens
tgttcaatgtttaatg

SEQ ID NO: 286154 - DNA, 20 bp, Homo sapiens
tgttcagagttccacagttg

SEQ ID NO: 286155 - DNA, 15 bp, Homo sapiens
tgttcagatgtgcat

SEQ ID NO: 286156 - DNA, 17 bp, Homo sapiens
tgttcagatgtgcattt

SEQ ID NO: 286157 - DNA, 13 bp, Homo sapiens
tgttcagcactgt

SEQ ID NO: 286158 - DNA, 14 bp, Homo sapiens
tgttcagcactgtc

SEQ ID NO: 286159 - DNA, 17 bp, Homo sapiens
tgttcagcactgtccct

SEQ ID NO: 286160 - DNA, 19 bp, Homo sapiens
tgttcatgttttgctaatg

SEQ ID NO: 286161 - DNA, 14 bp, Homo sapiens
tgttcattgtaatg

SEQ ID NO: 286162 - DNA, 23 bp, Homo sapiens
tgttcattgtaatgttactgatc

SEQ ID NO: 286163 - DNA, 15 bp, Homo sapiens
tgttcatttctgtct

SEQ ID NO: 286164 - DNA, 18 bp, Homo sapiens
tgttcattttagtgactg

SEQ ID NO: 286165 - DNA, 21 bp, Homo sapiens
tgttccaagacattgtcaata

SEQ ID NO: 286166 - DNA, 10 bp, Homo sapiens
tgttccaagt

SEQ ID NO: 286167 - DNA, 16 bp, Homo sapiens
tgttccaagtgtgtgt

SEQ ID NO: 286168 - DNA, 11 bp, Homo sapiens
tgttccagact

SEQ ID NO: 286169 - DNA, 18 bp, Homo sapiens
tgttccatcctgtacaag

SEQ ID NO: 286170 - DNA, 21 bp, Homo sapiens
tgttccatcctgtacaagtgc

SEQ ID NO: 286171 - DNA, 16 bp, Homo sapiens
tgttccattcagtctg

SEQ ID NO: 286172 - DNA, 20 bp, Homo sapiens
tgttcccacaatggctggga

SEQ ID NO: 286173 - DNA, 15 bp, Homo sapiens
tgttcccctcactgg

SEQ ID NO: 286174 - DNA, 20 bp, Homo sapiens
tgttccctgcaccctggaaa

SEQ ID NO: 286175 - DNA, 16 bp, Homo sapiens
tgttccgttcatctga

SEQ ID NO: 286176 - DNA, 24 bp, Homo sapiens
tgttccgttcatctgaggagtcca

SEQ ID NO: 286177 - DNA, 15 bp, Homo sapiens
tgttcctacagcccc

SEQ ID NO: 286178 - DNA, 10 bp, Homo sapiens
tgttcctgcc

SEQ ID NO: 286179 - DNA, 15 bp, Homo sapiens
tgttcctgccttctc

SEQ ID NO: 286180 - DNA, 14 bp, Homo sapiens
tgttcctggcaata

SEQ ID NO: 286181 - DNA, 21 bp, Homo sapiens
tgttcctggcaatagtgtgtt

SEQ ID NO: 286182 - DNA, 12 bp, Homo sapiens
tgttccttttga

SEQ ID NO: 286183 - DNA, 19 bp, Homo sapiens
tgttctagacttccccatc

SEQ ID NO: 286184 - DNA, 14 bp, Homo sapiens
tgttctcaatgctt

SEQ ID NO: 286185 - DNA, 18 bp, Homo sapiens
tgttctcaatgcttttct

SEQ ID NO: 286186 - DNA, 20 bp, Homo sapiens
tgttctcatgtttgtgcatg

SEQ ID NO: 286187 - DNA, 22 bp, Homo sapiens
tgttctcctagactgaccctga

SEQ ID NO: 286188 - DNA, 20 bp, Homo sapiens
tgttctctccccttgcactg

SEQ ID NO: 286189 - DNA, 15 bp, Homo sapiens
tgttctgaactgtgg

SEQ ID NO: 286190 - DNA, 20 bp, Homo sapiens
tgttctgaaggtgcccagga

SEQ ID NO: 286191 - DNA, 16 bp, Homo sapiens
tgttctgacagcattt

SEQ ID NO: 286192 - DNA, 17 bp, Homo sapiens
tgttctgacattaacag

SEQ ID NO: 286193 - DNA, 19 bp, Homo sapiens
tgttctgacattaacagtt

SEQ ID NO: 286194 - DNA, 18 bp, Homo sapiens
tgttctgagaactgactt

SEQ ID NO: 286195 - DNA, 19 bp, Homo sapiens
tgttctgagaactgacttt

SEQ ID NO: 286196 - DNA, 22 bp, Homo sapiens
tgttctgagaactgactttctc

SEQ ID NO: 286197 - DNA, 12 bp, Homo sapiens
tgttctgagccc

SEQ ID NO: 286198 - DNA, 18 bp, Homo sapiens
tgttctgagctataacat

SEQ ID NO: 286199 - DNA, 14 bp, Homo sapiens
tgttctgattagaa

SEQ ID NO: 286200 - DNA, 19 bp, Homo sapiens
tgttctgattagaaatgac

SEQ ID NO: 286201 - DNA, 15 bp, Homo sapiens
tgttctgcagagact

SEQ ID NO: 286202 - DNA, 12 bp, Homo sapiens
tgttctggacct

SEQ ID NO: 286203 - DNA, 18 bp, Homo sapiens
tgttctggcctcagacca

SEQ ID NO: 286204 - DNA, 14 bp, Homo sapiens
tgttctggtggccc

SEQ ID NO: 286205 - DNA, 15 bp, Homo sapiens
tgttctggtggcccc

SEQ ID NO: 286206 - DNA, 18 bp, Homo sapiens
tgttctgtaatggaactg

SEQ ID NO: 286207 - DNA, 15 bp, Homo sapiens
tgttctgtttgttaa

SEQ ID NO: 286208 - DNA, 16 bp, Homo sapiens
tgttcttagagcagat

SEQ ID NO: 286209 - DNA, 19 bp, Homo sapiens
tgttcttgtaaaactgtga

SEQ ID NO: 286210 - DNA, 20 bp, Homo sapiens
tgttcttgtaaaactgtgac

SEQ ID NO: 286211 - DNA, 14 bp, Homo sapiens
tgttcttgttttgt

SEQ ID NO: 286212 - DNA, 15 bp, Homo sapiens
tgttctttaggagat

SEQ ID NO: 286213 - DNA, 19 bp, Homo sapiens
tgttctttcacccttttct

SEQ ID NO: 286214 - DNA, 13 bp, Homo sapiens
tgttctttgggga

SEQ ID NO: 286215 - DNA, 14 bp, Homo sapiens
tgttcttttgatac

SEQ ID NO: 286216 - DNA, 16 bp, Homo sapiens
tgttcttttgatacat

SEQ ID NO: 286217 - DNA, 17 bp, Homo sapiens
tgttcttttgatacatt

SEQ ID NO: 286218 - DNA, 18 bp, Homo sapiens
tgttcttttgatacattt

SEQ ID NO: 286219 - DNA, 19 bp, Homo sapiens
tgttcttttgatacattta

SEQ ID NO: 286220 - DNA, 21 bp, Homo sapiens
tgttgaaaattattttaaaca

SEQ ID NO: 286221 - DNA, 15 bp, Homo sapiens
tgttgaaattatgta

SEQ ID NO: 286222 - DNA, 22 bp, Homo sapiens
tgttgaaattatgtatgtttac

SEQ ID NO: 286223 - DNA, 16 bp, Homo sapiens
tgttgaaggactacag

SEQ ID NO: 286224 - DNA, 24 bp, Homo sapiens
tgttgaatcccacttcagtgcacc

SEQ ID NO: 286225 - DNA, 17 bp, Homo sapiens
tgttgacatccaagctt

SEQ ID NO: 286226 - DNA, 19 bp, Homo sapiens
tgttgacttctatcctgtt

SEQ ID NO: 286227 - DNA, 17 bp, Homo sapiens
tgttgagccaggcctgg

SEQ ID NO: 286228 - DNA, 18 bp, Homo sapiens
tgttgaggcatcaaaaaa

SEQ ID NO: 286229 - DNA, 20 bp, Homo sapiens
tgttgaggtggtctgaatgt

SEQ ID NO: 286230 - DNA, 21 bp, Homo sapiens
tgttgaggtggtctgaatgtt

SEQ ID NO: 286231 - DNA, 19 bp, Homo sapiens
tgttgagtatttgctgttt

SEQ ID NO: 286232 - DNA, 18 bp, Homo sapiens
tgttgagtctctgaacat

SEQ ID NO: 286233 - DNA, 18 bp, Homo sapiens
tgttgagttggacacact

SEQ ID NO: 286234 - DNA, 22 bp, Homo sapiens
tgttgatcgatgttaaacgtca

SEQ ID NO: 286235 - DNA, 14 bp, Homo sapiens
tgttgattctttca

SEQ ID NO: 286236 - DNA, 16 bp, Homo sapiens
tgttgattctttcaat

SEQ ID NO: 286237 - DNA, 16 bp, Homo sapiens
tgttgcaaattattct

SEQ ID NO: 286238 - DNA, 18 bp, Homo sapiens
tgttgcaaattattctag

SEQ ID NO: 286239 - DNA, 20 bp, Homo sapiens
tgttgcaaattattctagtc

SEQ ID NO: 286240 - DNA, 22 bp, Homo sapiens
tgttgcaaattccacccctcct

SEQ ID NO: 286241 - DNA, 20 bp, Homo sapiens
tgttgccaaatatgtcctgg

SEQ ID NO: 286242 - DNA, 19 bp, Homo sapiens
tgttgccaactaagccctc

SEQ ID NO: 286243 - DNA, 19 bp, Homo sapiens
tgttgccaggttgcagctg

SEQ ID NO: 286244 - DNA, 21 bp, Homo sapiens
tgttgccaggttgcagctgct

SEQ ID NO: 286245 - DNA, 18 bp, Homo sapiens
tgttgccattttgtctgg

SEQ ID NO: 286246 - DNA, 15 bp, Homo sapiens
tgttgcccaggctgg

SEQ ID NO: 286247 - DNA, 18 bp, Homo sapiens
tgttgcccgtggatctgg

SEQ ID NO: 286248 - DNA, 16 bp, Homo sapiens
tgttgcctcctcccat

SEQ ID NO: 286249 - DNA, 17 bp, Homo sapiens
tgttgcctcctctctcc

SEQ ID NO: 286250 - DNA, 23 bp, Homo sapiens
tgttgcctcctctctccctgcct

SEQ ID NO: 286251 - DNA, 17 bp, Homo sapiens
tgttgcctttgctctta

SEQ ID NO: 286252 - DNA, 20 bp, Homo sapiens
tgttgcctttgctcttataa

SEQ ID NO: 286253 - DNA, 13 bp, Homo sapiens
tgttgctcttgga

SEQ ID NO: 286254 - DNA, 14 bp, Homo sapiens
tgttgctcttggaa

SEQ ID NO: 286255 - DNA, 15 bp, Homo sapiens
tgttgctcttggaaa

SEQ ID NO: 286256 - DNA, 17 bp, Homo sapiens
tgttgctgtctggcttt

SEQ ID NO: 286257 - DNA, 14 bp, Homo sapiens
tgttgcttaattgt

SEQ ID NO: 286258 - DNA, 19 bp, Homo sapiens
tgttgcttaattgtgaaca

SEQ ID NO: 286259 - DNA, 18 bp, Homo sapiens
tgttgcttagatgagggt

SEQ ID NO: 286260 - DNA, 23 bp, Homo sapiens
tgttgcttagatgagggtgactg

SEQ ID NO: 286261 - DNA, 20 bp, Homo sapiens
tgttgcttagtcacttattt

SEQ ID NO: 286262 - DNA, 18 bp, Homo sapiens
tgttggcagtgtttgtat

SEQ ID NO: 286263 - DNA, 13 bp, Homo sapiens
tgttggcccctct

SEQ ID NO: 286264 - DNA, 14 bp, Homo sapiens
tgttggcccttcca

SEQ ID NO: 286265 - DNA, 18 bp, Homo sapiens
tgttggcccttccagtgg

SEQ ID NO: 286266 - DNA, 17 bp, Homo sapiens
tgttggcctccggcctc

SEQ ID NO: 286267 - DNA, 15 bp, Homo sapiens
tgttggcctgtcaga

SEQ ID NO: 286268 - DNA, 20 bp, Homo sapiens
tgttgggaaaaactggcttt

SEQ ID NO: 286269 - DNA, 19 bp, Homo sapiens
tgttgggaagctatttcct

SEQ ID NO: 286270 - DNA, 13 bp, Homo sapiens
tgttggtcagagg

SEQ ID NO: 286271 - DNA, 17 bp, Homo sapiens
tgttggtcagaggagtg

SEQ ID NO: 286272 - DNA, 22 bp, Homo sapiens
tgttgtagatacaatcagctgc

SEQ ID NO: 286273 - DNA, 15 bp, Homo sapiens
tgttgtatgccttta

SEQ ID NO: 286274 - DNA, 20 bp, Homo sapiens
tgttgtcattgctttactgg

SEQ ID NO: 286275 - DNA, 16 bp, Homo sapiens
tgttgtcctgtgtcat

SEQ ID NO: 286276 - DNA, 12 bp, Homo sapiens
tgttgtgaatgt

SEQ ID NO: 286277 - DNA, 21 bp, Homo sapiens
tgttgtgactgctgccatttt

SEQ ID NO: 286278 - DNA, 15 bp, Homo sapiens
tgttgtgcagtgtgc

SEQ ID NO: 286279 - DNA, 17 bp, Homo sapiens
tgttgttaatgaaaatg

SEQ ID NO: 286280 - DNA, 18 bp, Homo sapiens
tgttgttaatgaaaatgt

SEQ ID NO: 286281 - DNA, 21 bp, Homo sapiens
tgttgttaatgaaaatgtcag

SEQ ID NO: 286282 - DNA, 14 bp, Homo sapiens
tgttgttatgctat

SEQ ID NO: 286283 - DNA, 11 bp, Homo sapiens
tgttgttattt

SEQ ID NO: 286284 - DNA, 15 bp, Homo sapiens
tgttgttcagaagtt

SEQ ID NO: 286285 - DNA, 17 bp, Homo sapiens
tgttgttcagaagttgt

SEQ ID NO: 286286 - DNA, 22 bp, Homo sapiens
tgttgttttttcatagtgcctt

SEQ ID NO: 286287 - DNA, 19 bp, Homo sapiens
tgtttaaaaaaataacatc

SEQ ID NO: 286288 - DNA, 19 bp, Homo sapiens
tgtttaaactttgtgcctt

SEQ ID NO: 286289 - DNA, 18 bp, Homo sapiens
tgtttaaagaataaagtc

SEQ ID NO: 286290 - DNA, 17 bp, Homo sapiens
tgtttaaagagaggtta

SEQ ID NO: 286291 - DNA, 21 bp, Homo sapiens
tgtttaaagagaggttataga

SEQ ID NO: 286292 - DNA, 18 bp, Homo sapiens
tgtttaaataaagaccta

SEQ ID NO: 286293 - DNA, 18 bp, Homo sapiens
tgtttaacccaaaagatt

SEQ ID NO: 286294 - DNA, 14 bp, Homo sapiens
tgtttaactcccta

SEQ ID NO: 286295 - DNA, 15 bp, Homo sapiens
ttacacccatgcaca

SEQ ID NO: 286296 - DNA, 23 bp, Homo sapiens
ttacactgttattttcagcatga

SEQ ID NO: 286297 - DNA, 20 bp, Homo sapiens
ttacagacaataaaatggaa

SEQ ID NO: 286298 - DNA, 17 bp, Homo sapiens
ttacagattgcctcctt

SEQ ID NO: 286299 - DNA, 17 bp, Homo sapiens
ttacagcctcacttgaa

SEQ ID NO: 286300 - DNA, 14 bp, Homo sapiens
ttacagctgcctgc

SEQ ID NO: 286301 - DNA, 15 bp, Homo sapiens
ttacagcttttctct

SEQ ID NO: 286302 - DNA, 23 bp, Homo sapiens
ttacaggaaattgcaaagaaaat

SEQ ID NO: 286303 - DNA, 16 bp, Homo sapiens
ttacaggaagtactgg

SEQ ID NO: 286304 - DNA, 22 bp, Homo sapiens
ttacaggaagtactggagaaaa

SEQ ID NO: 286305 - DNA, 18 bp, Homo sapiens
ttacaggcaccgagaatg

SEQ ID NO: 286306 - DNA, 18 bp, Homo sapiens
ttacaggcgtgagccact

SEQ ID NO: 286307 - DNA, 15 bp, Homo sapiens
ttacaggtgtactat

SEQ ID NO: 286308 - DNA, 15 bp, Homo sapiens
ttacagtaaataaat

SEQ ID NO: 286309 - DNA, 22 bp, Homo sapiens
ttacagtaggagtgagaaattt

SEQ ID NO: 286310 - DNA, 16 bp, Homo sapiens
ttacagtccttcaaaa

SEQ ID NO: 286311 - DNA, 17 bp, Homo sapiens
ttacagtggattgctca

SEQ ID NO: 286312 - DNA, 22 bp, Homo sapiens
ttacagtgtatctcgaagtctt

SEQ ID NO: 286313 - DNA, 14 bp, Homo sapiens
ttacataaataaat

SEQ ID NO: 286314 - DNA, 12 bp, Homo sapiens
ttacataacagg

SEQ ID NO: 286315 - DNA, 21 bp, Homo sapiens
ttacataacaggcattgcact

SEQ ID NO: 286316 - DNA, 14 bp, Homo sapiens
ttacatacagtgat

SEQ ID NO: 286317 - DNA, 15 bp, Homo sapiens
ttacatacagtgata

SEQ ID NO: 286318 - DNA, 22 bp, Homo sapiens
ttacatatcacctcatggccta

SEQ ID NO: 286319 - DNA, 13 bp, Homo sapiens
ttacatccttaaa

SEQ ID NO: 286320 - DNA, 20 bp, Homo sapiens
ttacatctttattaacctca

SEQ ID NO: 286321 - DNA, 13 bp, Homo sapiens
ttacatgcatttg

SEQ ID NO: 286322 - DNA, 22 bp, Homo sapiens
ttacatggttaaggtaaagtaa

SEQ ID NO: 286323 - DNA, 15 bp, Homo sapiens
ttacatgttcttcca

SEQ ID NO: 286324 - DNA, 14 bp, Homo sapiens
ttacattagttaag

SEQ ID NO: 286325 - DNA, 22 bp, Homo sapiens
ttacattccttgataatgttgt

SEQ ID NO: 286326 - DNA, 16 bp, Homo sapiens
ttacattgcattcaaa

SEQ ID NO: 286327 - DNA, 17 bp, Homo sapiens
ttacatttttacaataa

SEQ ID NO: 286328 - DNA, 15 bp, Homo sapiens
ttaccaactttctgt

SEQ ID NO: 286329 - DNA, 22 bp, Homo sapiens
ttaccacatcacaccacttgga

SEQ ID NO: 286330 - DNA, 13 bp, Homo sapiens
ttaccagatgcta

SEQ ID NO: 286331 - DNA, 14 bp, Homo sapiens
ttaccagatgctac

SEQ ID NO: 286332 - DNA, 19 bp, Homo sapiens
ttaccagcaagaataaaaa

SEQ ID NO: 286333 - DNA, 12 bp, Homo sapiens
ttaccagccccc

SEQ ID NO: 286334 - DNA, 11 bp, Homo sapiens
ttaccatgaga

SEQ ID NO: 286335 - DNA, 22 bp, Homo sapiens
ttacccagagaatatatacatt

SEQ ID NO: 286336 - DNA, 22 bp, Homo sapiens
ttaccctcaggcataggcctgg

SEQ ID NO: 286337 - DNA, 13 bp, Homo sapiens
ttaccctccctgt

SEQ ID NO: 286338 - DNA, 19 bp, Homo sapiens
ttaccctccctgtcccctg

SEQ ID NO: 286339 - DNA, 20 bp, Homo sapiens
ttaccgagtatctgtaaccc

SEQ ID NO: 286340 - DNA, 13 bp, Homo sapiens
ttaccgttcactt

SEQ ID NO: 286341 - DNA, 18 bp, Homo sapiens
ttacctaaacagatataa

SEQ ID NO: 286342 - DNA, 20 bp, Homo sapiens
ttacctaagtgacatttgta

SEQ ID NO: 286343 - DNA, 17 bp, Homo sapiens
ttacctaccacagtgtc

SEQ ID NO: 286344 - DNA, 19 bp, Homo sapiens
ttacctaccgtagcttttt

SEQ ID NO: 286345 - DNA, 15 bp, Homo sapiens
ttacctagcatttca

SEQ ID NO: 286346 - DNA, 19 bp, Homo sapiens
ttacctcactggtgcattt

SEQ ID NO: 286347 - DNA, 21 bp, Homo sapiens
ttacctctgatacctcaaccc

SEQ ID NO: 286348 - DNA, 15 bp, Homo sapiens
ttacctcttaacaat

SEQ ID NO: 286349 - DNA, 20 bp, Homo sapiens
ttacctcttaacaatttctg

SEQ ID NO: 286350 - DNA, 16 bp, Homo sapiens
ttacctggaaaccaga

SEQ ID NO: 286351 - DNA, 22 bp, Homo sapiens
ttacctgtacactgacttgaga

SEQ ID NO: 286352 - DNA, 20 bp, Homo sapiens
ttacctttattaatgaactg

SEQ ID NO: 286353 - DNA, 22 bp, Homo sapiens
ttacctttattaatgaactgtg

SEQ ID NO: 286354 - DNA, 14 bp, Homo sapiens
ttacgctctctgtc

SEQ ID NO: 286355 - DNA, 13 bp, Homo sapiens
ttactaaacattt

SEQ ID NO: 286356 - DNA, 13 bp, Homo sapiens
ttactaaagcagt

SEQ ID NO: 286357 - DNA, 16 bp, Homo sapiens
ttactaaagcagtgtt

SEQ ID NO: 286358 - DNA, 16 bp, Homo sapiens
ttactaaccaccattt

SEQ ID NO: 286359 - DNA, 16 bp, Homo sapiens
ttactaagatgaaatt

SEQ ID NO: 286360 - DNA, 20 bp, Homo sapiens
ttactaagatgaaattgcca

SEQ ID NO: 286361 - DNA, 18 bp, Homo sapiens
ttactaagccacaagaaa

SEQ ID NO: 286362 - DNA, 22 bp, Homo sapiens
ttactacataattaaattttaa

SEQ ID NO: 286363 - DNA, 14 bp, Homo sapiens
ttactactgcaagt

SEQ ID NO: 286364 - DNA, 19 bp, Homo sapiens
ttactactgcaagttcaag

SEQ ID NO: 286365 - DNA, 21 bp, Homo sapiens
ttactattaactctgcataga

SEQ ID NO: 286366 - DNA, 23 bp, Homo sapiens
ttactattaactctgcatagaca

SEQ ID NO: 286367 - DNA, 23 bp, Homo sapiens
ttactattaagcagtaaaaactg

SEQ ID NO: 286368 - DNA, 23 bp, Homo sapiens
ttactcaaccaaattaaaaattt

SEQ ID NO: 286369 - DNA, 21 bp, Homo sapiens
ttactcataaggcatatacaa

SEQ ID NO: 286370 - DNA, 18 bp, Homo sapiens
ttactcccttcctggcct

SEQ ID NO: 286371 - DNA, 15 bp, Homo sapiens
ttactctgagcccag

SEQ ID NO: 286372 - DNA, 16 bp, Homo sapiens
ttactctgagcccagg

SEQ ID NO: 286373 - DNA, 20 bp, Homo sapiens
ttactctgagcccaggccgt

SEQ ID NO: 286374 - DNA, 23 bp, Homo sapiens
ttactctgtgctaagttgtctta

SEQ ID NO: 286375 - DNA, 14 bp, Homo sapiens
ttactcttcagttt

SEQ ID NO: 286376 - DNA, 22 bp, Homo sapiens
ttactcttgttgcccaggctgg

SEQ ID NO: 286377 - DNA, 21 bp, Homo sapiens
ttactctttttctaaagtgtt

SEQ ID NO: 286378 - DNA, 23 bp, Homo sapiens
ttactgaacaatcaaagcacttg

SEQ ID NO: 286379 - DNA, 14 bp, Homo sapiens
ttactgagcttctc

SEQ ID NO: 286380 - DNA, 14 bp, Homo sapiens
ttactgatcatgca

SEQ ID NO: 286381 - DNA, 15 bp, Homo sapiens
ttactgatcatgcat

SEQ ID NO: 286382 - DNA, 21 bp, Homo sapiens
ttactgatcatgcattgttga

SEQ ID NO: 286383 - DNA, 19 bp, Homo sapiens
ttactgccttcagtatcaa

SEQ ID NO: 286384 - DNA, 11 bp, Homo sapiens
ttactgctgtc

SEQ ID NO: 286385 - DNA, 14 bp, Homo sapiens
ttactgctgtcatt

SEQ ID NO: 286386 - DNA, 20 bp, Homo sapiens
ttactgctgtcattgtccat

SEQ ID NO: 286387 - DNA, 22 bp, Homo sapiens
ttactgcttttaacttctgata

SEQ ID NO: 286388 - DNA, 21 bp, Homo sapiens
ttactggtttcagttgacaaa

SEQ ID NO: 286389 - DNA, 17 bp, Homo sapiens
ttactgtcaataaacag

SEQ ID NO: 286390 - DNA, 18 bp, Homo sapiens
ttactgtcaataaacagc

SEQ ID NO: 286391 - DNA, 18 bp, Homo sapiens
ttactgtctgtaagagaa

SEQ ID NO: 286392 - DNA, 14 bp, Homo sapiens
ttactgtctgtagt

SEQ ID NO: 286393 - DNA, 18 bp, Homo sapiens
ttactgtctgtagtgttt

SEQ ID NO: 286394 - DNA, 16 bp, Homo sapiens
ttactgttcttattgt

SEQ ID NO: 286395 - DNA, 16 bp, Homo sapiens
ttacttaaacatcatt

SEQ ID NO: 286396 - DNA, 12 bp, Homo sapiens
ttacttagagat

SEQ ID NO: 286397 - DNA, 22 bp, Homo sapiens
ttacttagagatgctactgtca

SEQ ID NO: 286398 - DNA, 13 bp, Homo sapiens
ttacttagcatgc

SEQ ID NO: 286399 - DNA, 15 bp, Homo sapiens
ttacttccttcctgc

SEQ ID NO: 286400 - DNA, 16 bp, Homo sapiens
ttacttggaaataata

SEQ ID NO: 286401 - DNA, 21 bp, Homo sapiens
ttacttggaaatattaaaaga

SEQ ID NO: 286402 - DNA, 15 bp, Homo sapiens
ttactttaaattata

SEQ ID NO: 286403 - DNA, 19 bp, Homo sapiens
ttactttctttcagatgtt

SEQ ID NO: 286404 - DNA, 21 bp, Homo sapiens
ttactttggaatgactataaa

SEQ ID NO: 286405 - DNA, 13 bp, Homo sapiens
ttactttgtgcaa

SEQ ID NO: 286406 - DNA, 13 bp, Homo sapiens
ttacttttgtaaa

SEQ ID NO: 286407 - DNA, 15 bp, Homo sapiens
ttacttttgtaaata

SEQ ID NO: 286408 - DNA, 15 bp, Homo sapiens
ttacttttttatagc

SEQ ID NO: 286409 - DNA, 13 bp, Homo sapiens
ttagaaaaaaaca

SEQ ID NO: 286410 - DNA, 21 bp, Homo sapiens
ttagaaacacacttttgcaca

SEQ ID NO: 286411 - DNA, 17 bp, Homo sapiens
ttagaaataaagcatct

SEQ ID NO: 286412 - DNA, 19 bp, Homo sapiens
ttagaaataaatgtacctg

SEQ ID NO: 286413 - DNA, 11 bp, Homo sapiens
ttagaaatata

SEQ ID NO: 286414 - DNA, 15 bp, Homo sapiens
ttagaaattacaagt

SEQ ID NO: 286415 - DNA, 17 bp, Homo sapiens
ttagaacagaaaacaac

SEQ ID NO: 286416 - DNA, 19 bp, Homo sapiens
ttagaacccttctgctttc

SEQ ID NO: 286417 - DNA, 18 bp, Homo sapiens
ttagaacttagttttgtt

SEQ ID NO: 286418 - DNA, 17 bp, Homo sapiens
ttagaagaaaacatata

SEQ ID NO: 286419 - DNA, 14 bp, Homo sapiens
ttagaataaaattg

SEQ ID NO: 286420 - DNA, 21 bp, Homo sapiens
ttagaatcagccttgaaacat

SEQ ID NO: 286421 - DNA, 18 bp, Homo sapiens
ttagaatgagggaaacaa

SEQ ID NO: 286422 - DNA, 19 bp, Homo sapiens
ttaaaaatactatgtatgt

SEQ ID NO: 286423 - DNA, 12 bp, Homo sapiens
ttaaaaatataa

SEQ ID NO: 286424 - DNA, 23 bp, Homo sapiens
ttaaaaatataaacaatgttcag

SEQ ID NO: 286425 - DNA, 23 bp, Homo sapiens
ttaaaaatatggaacttctaata

SEQ ID NO: 286426 - DNA, 14 bp, Homo sapiens
ttaaaaatctttca

SEQ ID NO: 286427 - DNA, 13 bp, Homo sapiens
ttaaaaatgtaaa

SEQ ID NO: 286428 - DNA, 16 bp, Homo sapiens
ttaaaaatgtaaatat

SEQ ID NO: 286429 - DNA, 19 bp, Homo sapiens
ttaaaacaagaaagtttcc

SEQ ID NO: 286430 - DNA, 12 bp, Homo sapiens
ttaaaacacttt

SEQ ID NO: 286431 - DNA, 18 bp, Homo sapiens
ttaaaacactttcaaaac

SEQ ID NO: 286432 - DNA, 21 bp, Homo sapiens
ttaaaactaggcatttgtaaa

SEQ ID NO: 286433 - DNA, 14 bp, Homo sapiens
ttaaaagataagtt

SEQ ID NO: 286434 - DNA, 19 bp, Homo sapiens
ttaaaagccactgttacat

SEQ ID NO: 286435 - DNA, 20 bp, Homo sapiens
ttaaaataaaaattctgaat

SEQ ID NO: 286436 - DNA, 21 bp, Homo sapiens
ttaaaataaaacgttatctca

SEQ ID NO: 286437 - DNA, 15 bp, Homo sapiens
ttaaaataagtgaat

SEQ ID NO: 286438 - DNA, 15 bp, Homo sapiens
ttaaaatagaaataa

SEQ ID NO: 286439 - DNA, 17 bp, Homo sapiens
ttaaaatataaattaag

SEQ ID NO: 286440 - DNA, 19 bp, Homo sapiens
ttaaaatattcctgcattt

SEQ ID NO: 286441 - DNA, 19 bp, Homo sapiens
ttaaaatcaacttttgaaa

SEQ ID NO: 286442 - DNA, 17 bp, Homo sapiens
ttaaaatcattcaatat

SEQ ID NO: 286443 - DNA, 16 bp, Homo sapiens
ttaaaatgattgtaaa

SEQ ID NO: 286444 - DNA, 17 bp, Homo sapiens
ttaactgtgtgaagaaa

SEQ ID NO: 286445 - DNA, 22 bp, Homo sapiens
ttaactgtgtgaagaaatggaa

SEQ ID NO: 286446 - DNA, 19 bp, Homo sapiens
ttaactgttagtattaact

SEQ ID NO: 286447 - DNA, 14 bp, Homo sapiens
ttaacttcacctta

SEQ ID NO: 286448 - DNA, 18 bp, Homo sapiens
ttaactttatcacattat

SEQ ID NO: 286449 - DNA, 14 bp, Homo sapiens
ttaagaaaaaaata

SEQ ID NO: 286450 - DNA, 15 bp, Homo sapiens
ttaagaaaaaaataa

SEQ ID NO: 286451 - DNA, 16 bp, Homo sapiens
ttaagaaaaaaataat

SEQ ID NO: 286452 - DNA, 20 bp, Homo sapiens
ttaagaaaaaataacacaca

SEQ ID NO: 286453 - DNA, 17 bp, Homo sapiens
ttaagaaaaacatgtca

SEQ ID NO: 286454 - DNA, 19 bp, Homo sapiens
ttaagaaaatacaataaac

SEQ ID NO: 286455 - DNA, 15 bp, Homo sapiens
ttaagaactgacaca

SEQ ID NO: 286456 - DNA, 14 bp, Homo sapiens
ttaagacaaatggg

SEQ ID NO: 286457 - DNA, 22 bp, Homo sapiens
ttaagacaaatgggactgatgt

SEQ ID NO: 286458 - DNA, 16 bp, Homo sapiens
ttaagacaacaggcat

SEQ ID NO: 286459 - DNA, 14 bp, Homo sapiens
ttaagataattata

SEQ ID NO: 286460 - DNA, 15 bp, Homo sapiens
ttaagatacactcct

SEQ ID NO: 286461 - DNA, 19 bp, Homo sapiens
ttaagatacttagattaga

SEQ ID NO: 286462 - DNA, 17 bp, Homo sapiens
ttaagatgtctgagaga

SEQ ID NO: 286463 - DNA, 17 bp, Homo sapiens
ttaagatgtgtcttcaa

SEQ ID NO: 286464 - DNA, 21 bp, Homo sapiens
ttaagatgtgtcttcaatttg

SEQ ID NO: 286465 - DNA, 17 bp, Homo sapiens
ttaagcactacataaac

SEQ ID NO: 286466 - DNA, 12 bp, Homo sapiens
ttaagcactttg

SEQ ID NO: 286467 - DNA, 21 bp, Homo sapiens
ttaagcagatggaatgctgtg

SEQ ID NO: 286468 - DNA, 22 bp, Homo sapiens
ttaagcagctaaattttctgaa

SEQ ID NO: 286469 - DNA, 20 bp, Homo sapiens
ttaagcattgggtgggtaaa

SEQ ID NO: 286470 - DNA, 12 bp, Homo sapiens
ttaagcattgtt

SEQ ID NO: 286471 - DNA, 18 bp, Homo sapiens
ttaagcattttactgtct

SEQ ID NO: 286472 - DNA, 21 bp, Homo sapiens
ttaagcattttactgtctgta

SEQ ID NO: 286473 - DNA, 13 bp, Homo sapiens
ttaagccccctct

SEQ ID NO: 286474 - DNA, 13 bp, Homo sapiens
ttaagctccagct

SEQ ID NO: 286475 - DNA, 15 bp, Homo sapiens
ttaaggagaggagag

SEQ ID NO: 286476 - DNA, 20 bp, Homo sapiens
ttaaggcaactgaacaaaaa

SEQ ID NO: 286477 - DNA, 21 bp, Homo sapiens
ttaagggatggaaaaggaaga

SEQ ID NO: 286478 - DNA, 14 bp, Homo sapiens
ttaagtatgtgtaa

SEQ ID NO: 286479 - DNA, 22 bp, Homo sapiens
ttaagtattccttggcccagca

SEQ ID NO: 286480 - DNA, 16 bp, Homo sapiens
ttaagtatttatatat

SEQ ID NO: 286481 - DNA, 19 bp, Homo sapiens
ttaagtatttatatattta

SEQ ID NO: 286482 - DNA, 18 bp, Homo sapiens
ttaagtcgggaaattctg

SEQ ID NO: 286483 - DNA, 19 bp, Homo sapiens
ttaagtctgggatgtagaa

SEQ ID NO: 286484 - DNA, 22 bp, Homo sapiens
ttaagtctgggatgtagaactt

SEQ ID NO: 286485 - DNA, 15 bp, Homo sapiens
ttaagtcttactgtt

SEQ ID NO: 286486 - DNA, 15 bp, Homo sapiens
ttaagtgtcatttct

SEQ ID NO: 286487 - DNA, 19 bp, Homo sapiens
ttaagttctcaatgtgaaa

SEQ ID NO: 286488 - DNA, 18 bp, Homo sapiens
ttaagttgctgatgaact

SEQ ID NO: 286489 - DNA, 23 bp, Homo sapiens
ttaagtttagaaattacaagttt

SEQ ID NO: 286490 - DNA, 23 bp, Homo sapiens
ttaagttttgattaatgtttctt

SEQ ID NO: 286491 - DNA, 22 bp, Homo sapiens
ttaataaaactgcacagtgctg

SEQ ID NO: 286492 - DNA, 13 bp, Homo sapiens
ttaataataaaaa

SEQ ID NO: 286493 - DNA, 19 bp, Homo sapiens
ttaataatttttgctgaat

SEQ ID NO: 286494 - DNA, 15 bp, Homo sapiens
ttaatacataagtta

SEQ ID NO: 286495 - DNA, 21 bp, Homo sapiens
ttaatacctttaaatatcatt

SEQ ID NO: 286496 - DNA, 18 bp, Homo sapiens
ttaatactcacctcctcc

SEQ ID NO: 286497 - DNA, 17 bp, Homo sapiens
ttaatactgaatttctt

SEQ ID NO: 286498 - DNA, 21 bp, Homo sapiens
ttaatactgaatttctttgat

SEQ ID NO: 286499 - DNA, 15 bp, Homo sapiens
ttaatagaatatact

SEQ ID NO: 286500 - DNA, 13 bp, Homo sapiens
ttaatagccctcc

SEQ ID NO: 286501 - DNA, 20 bp, Homo sapiens
ttaatagcttttattgtata

SEQ ID NO: 286502 - DNA, 22 bp, Homo sapiens
ttaataggaaagatttaatgtt

SEQ ID NO: 286503 - DNA, 16 bp, Homo sapiens
ttaatagtatatctaa

SEQ ID NO: 286504 - DNA, 15 bp, Homo sapiens
ttaatagtcattcca

SEQ ID NO: 286505 - DNA, 19 bp, Homo sapiens
ttaatagtcattccaaata

SEQ ID NO: 286506 - DNA, 13 bp, Homo sapiens
ttaatatatataa

SEQ ID NO: 286507 - DNA, 20 bp, Homo sapiens
ttaatatatcccagaaatta

SEQ ID NO: 286508 - DNA, 22 bp, Homo sapiens
ttaatatgatctgtggagaatg

SEQ ID NO: 286509 - DNA, 20 bp, Homo sapiens
ttaatatgcatctttgagaa

SEQ ID NO: 286510 - DNA, 15 bp, Homo sapiens
ttaatattaatttat

SEQ ID NO: 286511 - DNA, 15 bp, Homo sapiens
ttaatattactgtct

SEQ ID NO: 286512 - DNA, 16 bp, Homo sapiens
ttaatattactgtctt

SEQ ID NO: 286513 - DNA, 22 bp, Homo sapiens
ttaatattgatatgcttataca

SEQ ID NO: 286514 - DNA, 20 bp, Homo sapiens
ttaatcatttccagcaaaat

SEQ ID NO: 286515 - DNA, 22 bp, Homo sapiens
ttaatcatttccagcaaaatat

SEQ ID NO: 286516 - DNA, 20 bp, Homo sapiens
ttaatcccggtttcagaagc

SEQ ID NO: 286517 - DNA, 14 bp, Homo sapiens
ttaatctagagcta

SEQ ID NO: 286518 - DNA, 16 bp, Homo sapiens
ttaatctagagctatg

SEQ ID NO: 286519 - DNA, 20 bp, Homo sapiens
ttaatctagagctatgcaca

SEQ ID NO: 286520 - DNA, 22 bp, Homo sapiens
ttaatcttcagttttatcttta

SEQ ID NO: 286521 - DNA, 19 bp, Homo sapiens
ttaatcttctctcttgatt

SEQ ID NO: 286522 - DNA, 21 bp, Homo sapiens
ttaatgaaaatgataaaacag

SEQ ID NO: 286523 - DNA, 19 bp, Homo sapiens
ttaatgaaggtgtgctaca

SEQ ID NO: 286524 - DNA, 12 bp, Homo sapiens
ttaatgacaaca

SEQ ID NO: 286525 - DNA, 14 bp, Homo sapiens
ttaatgacaacaaa

SEQ ID NO: 286526 - DNA, 15 bp, Homo sapiens
ttaatgacattcccc

SEQ ID NO: 286527 - DNA, 16 bp, Homo sapiens
ttaatgataagtaaat

SEQ ID NO: 286528 - DNA, 17 bp, Homo sapiens
ttaatgataagtaaatg

SEQ ID NO: 286529 - DNA, 17 bp, Homo sapiens
ttaatgatttttgtgta

SEQ ID NO: 286530 - DNA, 13 bp, Homo sapiens
ttaatgctaaggg

SEQ ID NO: 286531 - DNA, 21 bp, Homo sapiens
ttaatgctaagggcaggccca

SEQ ID NO: 286532 - DNA, 18 bp, Homo sapiens
ttaatggacttatttctt

SEQ ID NO: 286533 - DNA, 19 bp, Homo sapiens
ttaatgtacaagttttgta

SEQ ID NO: 286534 - DNA, 16 bp, Homo sapiens
ttaatgtcagtctaca

SEQ ID NO: 286535 - DNA, 23 bp, Homo sapiens
ttaatgttctgaataatttctta

SEQ ID NO: 286536 - DNA, 15 bp, Homo sapiens
ttaatgtttattcct

SEQ ID NO: 286537 - DNA, 17 bp, Homo sapiens
ttaatgtttattcctga

SEQ ID NO: 286538 - DNA, 14 bp, Homo sapiens
ttaattaaatttca

SEQ ID NO: 286539 - DNA, 20 bp, Homo sapiens
ttaattaagctccttcagtt

SEQ ID NO: 286540 - DNA, 22 bp, Homo sapiens
ttaattctgatgctaggttgtt

SEQ ID NO: 286541 - DNA, 22 bp, Homo sapiens
ttaattctgttctgatattaat

SEQ ID NO: 286542 - DNA, 20 bp, Homo sapiens
ttaattcttacctcatttgc

SEQ ID NO: 286543 - DNA, 22 bp, Homo sapiens
ttaattcttacctcatttgcat

SEQ ID NO: 286544 - DNA, 12 bp, Homo sapiens
ttaattgattaa

SEQ ID NO: 286545 - DNA, 21 bp, Homo sapiens
ttaattgattaaactgtatgt

SEQ ID NO: 286546 - DNA, 15 bp, Homo sapiens
ttaattgtggcttta

SEQ ID NO: 286547 - DNA, 18 bp, Homo sapiens
ttaattgttttgcacttt

SEQ ID NO: 286548 - DNA, 18 bp, Homo sapiens
ttaatttatatttgtctc

SEQ ID NO: 286549 - DNA, 14 bp, Homo sapiens
ttaatttatcagat

SEQ ID NO: 286550 - DNA, 20 bp, Homo sapiens
ttaatttatgagtttttgat

SEQ ID NO: 286551 - DNA, 18 bp, Homo sapiens
ttaatttgaccagaaaat

SEQ ID NO: 286552 - DNA, 18 bp, Homo sapiens
ttaatttttaaaagactt

SEQ ID NO: 286553 - DNA, 19 bp, Homo sapiens
ttaatttttaaaagacttt

SEQ ID NO: 286554 - DNA, 18 bp, Homo sapiens
ttaattttttttaatgta

SEQ ID NO: 286555 - DNA, 16 bp, Homo sapiens
ttacaaaatgaatgca

SEQ ID NO: 286556 - DNA, 14 bp, Homo sapiens
ttacaaacaaagga

SEQ ID NO: 286557 - DNA, 19 bp, Homo sapiens
ttacaaacagatgaaaaaa

SEQ ID NO: 286558 - DNA, 14 bp, Homo sapiens
ttacaaactgcaat

SEQ ID NO: 286559 - DNA, 14 bp, Homo sapiens
ttacaacaaacact

SEQ ID NO: 286560 - DNA, 16 bp, Homo sapiens
ttacaacaaacactgt

SEQ ID NO: 286561 - DNA, 14 bp, Homo sapiens
ttacaactaaataa

SEQ ID NO: 286562 - DNA, 13 bp, Homo sapiens
ttacaagtttcag

SEQ ID NO: 286563 - DNA, 13 bp, Homo sapiens
ttatatatttata

SEQ ID NO: 286564 - DNA, 12 bp, Homo sapiens
ttatatcatcaa

SEQ ID NO: 286565 - DNA, 18 bp, Homo sapiens
ttatatcatcaatacttt

SEQ ID NO: 286566 - DNA, 12 bp, Homo sapiens
ttatatctgtaa

SEQ ID NO: 286567 - DNA, 20 bp, Homo sapiens
ttatatgacttcttgttcat

SEQ ID NO: 286568 - DNA, 16 bp, Homo sapiens
ttatatgatatgcatg

SEQ ID NO: 286569 - DNA, 12 bp, Homo sapiens
ttatatgtcttg

SEQ ID NO: 286570 - DNA, 14 bp, Homo sapiens
ttatattacttttg

SEQ ID NO: 286571 - DNA, 18 bp, Homo sapiens
ttatattacttttgtaaa

SEQ ID NO: 286572 - DNA, 20 bp, Homo sapiens
ttatattacttttgtaaata

SEQ ID NO: 286573 - DNA, 22 bp, Homo sapiens
ttatattacttttgtaaatatt

SEQ ID NO: 286574 - DNA, 23 bp, Homo sapiens
ttatattgtttttatatattata

SEQ ID NO: 286575 - DNA, 18 bp, Homo sapiens
ttatatttagttatagtt

SEQ ID NO: 286576 - DNA, 19 bp, Homo sapiens
ttatatttagttatagttt

SEQ ID NO: 286577 - DNA, 20 bp, Homo sapiens
ttatattttaaagcttggtg

SEQ ID NO: 286578 - DNA, 15 bp, Homo sapiens
ttatattttatactg

SEQ ID NO: 286579 - DNA, 13 bp, Homo sapiens
ttatattttctat

SEQ ID NO: 286580 - DNA, 18 bp, Homo sapiens
ttatcaaaaagtataaat

SEQ ID NO: 286581 - DNA, 15 bp, Homo sapiens
ttatcaaaactttct

SEQ ID NO: 286582 - DNA, 14 bp, Homo sapiens
ttatcaagtgtctt

SEQ ID NO: 286583 - DNA, 19 bp, Homo sapiens
ttatcacacaaagcagaat

SEQ ID NO: 286584 - DNA, 23 bp, Homo sapiens
ttatcagtcataactaaataaag

SEQ ID NO: 286585 - DNA, 19 bp, Homo sapiens
ttatcatgacatgttatat

SEQ ID NO: 286586 - DNA, 19 bp, Homo sapiens
ttatcatggtctcagtcat

SEQ ID NO: 286587 - DNA, 18 bp, Homo sapiens
ttatcattaaacatgaat

SEQ ID NO: 286588 - DNA, 15 bp, Homo sapiens
ttatccaaatcttga

SEQ ID NO: 286589 - DNA, 23 bp, Homo sapiens
ttatccaaatcttgaatttctgc

SEQ ID NO: 286590 - DNA, 12 bp, Homo sapiens
ttatcctgtgct

SEQ ID NO: 286591 - DNA, 16 bp, Homo sapiens
ttatccttttatctca

SEQ ID NO: 286592 - DNA, 14 bp, Homo sapiens
ttatcggaagcagt

SEQ ID NO: 286593 - DNA, 15 bp, Homo sapiens
ttatcggaagcagtg

SEQ ID NO: 286594 - DNA, 23 bp, Homo sapiens
ttatcgggaacagtgtttcccat

SEQ ID NO: 286595 - DNA, 23 bp, Homo sapiens
ttatctagaaagaaaagaccctg

SEQ ID NO: 286596 - DNA, 23 bp, Homo sapiens
ttatctagcaagaagattctaaa

SEQ ID NO: 286597 - DNA, 20 bp, Homo sapiens
ttatctagtaggtctgcaca

SEQ ID NO: 286598 - DNA, 14 bp, Homo sapiens
ttatctccctgctt

SEQ ID NO: 286599 - DNA, 20 bp, Homo sapiens
ttatctccctgcttcatatc

SEQ ID NO: 286600 - DNA, 18 bp, Homo sapiens
ttatctgaaacttcccaa

SEQ ID NO: 286601 - DNA, 19 bp, Homo sapiens
ttatctgaaacttcccaac

SEQ ID NO: 286602 - DNA, 23 bp, Homo sapiens
ttatctgaaacttcccaacttcc

SEQ ID NO: 286603 - DNA, 20 bp, Homo sapiens
ttatctgcctggcctggctc

SEQ ID NO: 286604 - DNA, 23 bp, Homo sapiens
ttatctgggattatggttttgtg

SEQ ID NO: 286605 - DNA, 12 bp, Homo sapiens
ttatctgggttc

SEQ ID NO: 286606 - DNA, 18 bp, Homo sapiens
ttatctgggttctcttca

SEQ ID NO: 286607 - DNA, 17 bp, Homo sapiens
ttatctgtgaattcaga

SEQ ID NO: 286608 - DNA, 16 bp, Homo sapiens
ttatctgttaaccaaa

SEQ ID NO: 286609 - DNA, 21 bp, Homo sapiens
ttatcttctgctctttcttct

SEQ ID NO: 286610 - DNA, 22 bp, Homo sapiens
ttatcttctggtgcatgttctt

SEQ ID NO: 286611 - DNA, 12 bp, Homo sapiens
ttatcttctgtt

SEQ ID NO: 286612 - DNA, 16 bp, Homo sapiens
ttatcttgtctctggg

SEQ ID NO: 286613 - DNA, 19 bp, Homo sapiens
ttatgaatatttataacag

SEQ ID NO: 286614 - DNA, 23 bp, Homo sapiens
ttatgaatttttgtaagaaaccg

SEQ ID NO: 286615 - DNA, 15 bp, Homo sapiens
ttatgagaacatggt

SEQ ID NO: 286616 - DNA, 21 bp, Homo sapiens
ttatgagtttttgatagcttt

SEQ ID NO: 286617 - DNA, 23 bp, Homo sapiens
ttatgagtttttgatagctttat

SEQ ID NO: 286618 - DNA, 14 bp, Homo sapiens
ttatgatatttctt

SEQ ID NO: 286619 - DNA, 16 bp, Homo sapiens
ttatgcagtgctgctt

SEQ ID NO: 286620 - DNA, 11 bp, Homo sapiens
ttatgcatgag

SEQ ID NO: 286621 - DNA, 20 bp, Homo sapiens
ttatgccgtctcatattttt

SEQ ID NO: 286622 - DNA, 23 bp, Homo sapiens
ttatgccgtctcatatttttaca

SEQ ID NO: 286623 - DNA, 20 bp, Homo sapiens
ttatgctaacaaactgaaaa

SEQ ID NO: 286624 - DNA, 15 bp, Homo sapiens
ttatgctattaaagt

SEQ ID NO: 286625 - DNA, 13 bp, Homo sapiens
ttatgctgctgtg

SEQ ID NO: 286626 - DNA, 16 bp, Homo sapiens
ttatgctgctgtgaat

SEQ ID NO: 286627 - DNA, 22 bp, Homo sapiens
ttatggacatcgatatgaaaaa

SEQ ID NO: 286628 - DNA, 13 bp, Homo sapiens
ttatggcctcagc

SEQ ID NO: 286629 - DNA, 15 bp, Homo sapiens
ttatggcctcagctg

SEQ ID NO: 286630 - DNA, 18 bp, Homo sapiens
ttatggcctcagctgcct

SEQ ID NO: 286631 - DNA, 15 bp, Homo sapiens
ttatggctttgtgct

SEQ ID NO: 286632 - DNA, 21 bp, Homo sapiens
ttatgggaacaagtgtacaga

SEQ ID NO: 286633 - DNA, 18 bp, Homo sapiens
ttatgggaatgccttttc

SEQ ID NO: 286634 - DNA, 22 bp, Homo sapiens
ttatgggtatgtgttgccaaag

SEQ ID NO: 286635 - DNA, 14 bp, Homo sapiens
ttatggtgaaatta

SEQ ID NO: 286636 - DNA, 19 bp, Homo sapiens
ttatggtggaagaggttct

SEQ ID NO: 286637 - DNA, 21 bp, Homo sapiens
ttatggtggaagaggttctca

SEQ ID NO: 286638 - DNA, 15 bp, Homo sapiens
ttatgtaccttttga

SEQ ID NO: 286639 - DNA, 15 bp, Homo sapiens
ttatgtcaaatggat

SEQ ID NO: 286640 - DNA, 12 bp, Homo sapiens
ttgctttactgg

SEQ ID NO: 286641 - DNA, 21 bp, Homo sapiens
ttgctttataatttctaccca

SEQ ID NO: 286642 - DNA, 11 bp, Homo sapiens
ttgctttctga

SEQ ID NO: 286643 - DNA, 17 bp, Homo sapiens
ttgctttgggattttct

SEQ ID NO: 286644 - DNA, 18 bp, Homo sapiens
ttgctttgggattttctt

SEQ ID NO: 286645 - DNA, 21 bp, Homo sapiens
ttgcttttcatgtagaactca

SEQ ID NO: 286646 - DNA, 23 bp, Homo sapiens
ttgcttttcatgtagaactcagc

SEQ ID NO: 286647 - DNA, 12 bp, Homo sapiens
ttgctttttcac

SEQ ID NO: 286648 - DNA, 14 bp, Homo sapiens
ttgcttttttatgg

SEQ ID NO: 286649 - DNA, 15 bp, Homo sapiens
ttggaaaagaaacaa

SEQ ID NO: 286650 - DNA, 19 bp, Homo sapiens
ttggaaaagaaatcaattt

SEQ ID NO: 286651 - DNA, 16 bp, Homo sapiens
ttggaaaccatgcact

SEQ ID NO: 286652 - DNA, 15 bp, Homo sapiens
ttggaaacctgccct

SEQ ID NO: 286653 - DNA, 17 bp, Homo sapiens
ttggaaacctgccctgc

SEQ ID NO: 286654 - DNA, 21 bp, Homo sapiens
ttggaaagccattgaccaccc

SEQ ID NO: 286655 - DNA, 17 bp, Homo sapiens
ttggaaataataaatta

SEQ ID NO: 286656 - DNA, 17 bp, Homo sapiens
ttggaaatattaaaaga

SEQ ID NO: 286657 - DNA, 16 bp, Homo sapiens
ttggaaatttggaaga

SEQ ID NO: 286658 - DNA, 20 bp, Homo sapiens
ttggaacagtaatcagtttg

SEQ ID NO: 286659 - DNA, 21 bp, Homo sapiens
ttggaagagaggcacctgctg

SEQ ID NO: 286660 - DNA, 14 bp, Homo sapiens
ttggaagctctgtt

SEQ ID NO: 286661 - DNA, 15 bp, Homo sapiens
ttggaagtctgcgcc

SEQ ID NO: 286662 - DNA, 19 bp, Homo sapiens
ttggaagtttgtgttctgt

SEQ ID NO: 286663 - DNA, 20 bp, Homo sapiens
ttggaatcccacttatcaaa

SEQ ID NO: 286664 - DNA, 21 bp, Homo sapiens
ttggaatgactataaacatta

SEQ ID NO: 286665 - DNA, 15 bp, Homo sapiens
ttggaattaaaacaa

SEQ ID NO: 286666 - DNA, 17 bp, Homo sapiens
ttggaattggaattact

SEQ ID NO: 286667 - DNA, 13 bp, Homo sapiens
ttggacagcaaaa

SEQ ID NO: 286668 - DNA, 21 bp, Homo sapiens
ttggacataactgacttagtt

SEQ ID NO: 286669 - DNA, 18 bp, Homo sapiens
ttggacctcgtgctttaa

SEQ ID NO: 286670 - DNA, 15 bp, Homo sapiens
ttggacgcacacagc

SEQ ID NO: 286671 - DNA, 22 bp, Homo sapiens
ttggacggggacacggcctctg

SEQ ID NO: 286672 - DNA, 13 bp, Homo sapiens
ttggactccctcc

SEQ ID NO: 286673 - DNA, 13 bp, Homo sapiens
ttggactctcagg

SEQ ID NO: 286674 - DNA, 15 bp, Homo sapiens
ttggactgacattta

SEQ ID NO: 286675 - DNA, 20 bp, Homo sapiens
ttggacttcctggggccccg

SEQ ID NO: 286676 - DNA, 18 bp, Homo sapiens
ttggagaaaatgaagaaa

SEQ ID NO: 286677 - DNA, 15 bp, Homo sapiens
ttggagaaattattt

SEQ ID NO: 286678 - DNA, 19 bp, Homo sapiens
ttggagaacgccagtctcc

SEQ ID NO: 286679 - DNA, 12 bp, Homo sapiens
ttggagaggagg

SEQ ID NO: 286680 - DNA, 15 bp, Homo sapiens
ttggagaggaggtgt

SEQ ID NO: 286681 - DNA, 19 bp, Homo sapiens
ttggagagggacgaagaaa

SEQ ID NO: 286682 - DNA, 20 bp, Homo sapiens
ttggagatctttgcttcctt

SEQ ID NO: 286683 - DNA, 22 bp, Homo sapiens
ttggagcagagacggcagcccc

SEQ ID NO: 286684 - DNA, 23 bp, Homo sapiens
ttggagcaggcaaaaaagggaca

SEQ ID NO: 286685 - DNA, 12 bp, Homo sapiens
ttggagctgaga

SEQ ID NO: 286686 - DNA, 18 bp, Homo sapiens
ttggagggaaaaaacaag

SEQ ID NO: 286687 - DNA, 22 bp, Homo sapiens
ttggagggcccacttgtatcct

SEQ ID NO: 286688 - DNA, 23 bp, Homo sapiens
ttggaggtgcttaagcagaagca

SEQ ID NO: 286689 - DNA, 13 bp, Homo sapiens
ttggataaatcat

SEQ ID NO: 286690 - DNA, 17 bp, Homo sapiens
ttggataaatcatttca

SEQ ID NO: 286691 - DNA, 19 bp, Homo sapiens
ttggataggagcttccaga

SEQ ID NO: 286692 - DNA, 17 bp, Homo sapiens
ttggatagtcagctgta

SEQ ID NO: 286693 - DNA, 18 bp, Homo sapiens
ttggatcctgtgtggaga

SEQ ID NO: 286694 - DNA, 20 bp, Homo sapiens
ttggatgggagtgagacaga

SEQ ID NO: 286695 - DNA, 18 bp, Homo sapiens
ttggatgggagtgggcac

SEQ ID NO: 286696 - DNA, 13 bp, Homo sapiens
ttggattattcat

SEQ ID NO: 286697 - DNA, 13 bp, Homo sapiens
ttggcaaaatggg

SEQ ID NO: 286698 - DNA, 14 bp, Homo sapiens
ttggcaacagaagc

SEQ ID NO: 286699 - DNA, 15 bp, Homo sapiens
ttggcaacagaagca

SEQ ID NO: 286700 - DNA, 16 bp, Homo sapiens
ttggcaagaagactgt

SEQ ID NO: 286701 - DNA, 16 bp, Homo sapiens
ttggcaatagtttgca

SEQ ID NO: 286702 - DNA, 23 bp, Homo sapiens
ttggcaccaaagatgcagccgcc

SEQ ID NO: 286703 - DNA, 12 bp, Homo sapiens
ttggcaccccca

SEQ ID NO: 286704 - DNA, 14 bp, Homo sapiens
ttggcagagaaggc

SEQ ID NO: 286705 - DNA, 14 bp, Homo sapiens
ttggcattaaaact

SEQ ID NO: 286706 - DNA, 16 bp, Homo sapiens
ttggccaaacatcaga

SEQ ID NO: 286707 - DNA, 22 bp, Homo sapiens
ttggccacaacctgaaagacaa

SEQ ID NO: 286708 - DNA, 17 bp, Homo sapiens
ttggccacggcctggga

SEQ ID NO: 286709 - DNA, 12 bp, Homo sapiens
ttggccactggg

SEQ ID NO: 286710 - DNA, 16 bp, Homo sapiens
ttggcccaagctcttg

SEQ ID NO: 286711 - DNA, 11 bp, Homo sapiens
ttggcccagca

SEQ ID NO: 286712 - DNA, 12 bp, Homo sapiens
ttggcccaggaa

SEQ ID NO: 286713 - DNA, 22 bp, Homo sapiens
ttggcccaggaaaaacctgtgg

SEQ ID NO: 286714 - DNA, 13 bp, Homo sapiens
ttggccggctggc

SEQ ID NO: 286715 - DNA, 23 bp, Homo sapiens
ttggcctagcccaccctgctgcc

SEQ ID NO: 286716 - DNA, 17 bp, Homo sapiens
ttgggtgggcaggaaaa

SEQ ID NO: 286717 - DNA, 15 bp, Homo sapiens
ttgggtggtttgtga

SEQ ID NO: 286718 - DNA, 17 bp, Homo sapiens
ttgggtgtgccctggct

SEQ ID NO: 286719 - DNA, 20 bp, Homo sapiens
ttgggtgtgccctggctccc

SEQ ID NO: 286720 - DNA, 14 bp, Homo sapiens
ttgggttttatcag

SEQ ID NO: 286721 - DNA, 15 bp, Homo sapiens
ttgggttttatcagt

SEQ ID NO: 286722 - DNA, 14 bp, Homo sapiens
ttggtacttttaac

SEQ ID NO: 286723 - DNA, 15 bp, Homo sapiens
ttggtagagtttatt

SEQ ID NO: 286724 - DNA, 20 bp, Homo sapiens
ttggtatttggatatctgtt

SEQ ID NO: 286725 - DNA, 15 bp, Homo sapiens
ttggtcagaggagtg

SEQ ID NO: 286726 - DNA, 20 bp, Homo sapiens
ttggtcagagtaagctgctt

SEQ ID NO: 286727 - DNA, 15 bp, Homo sapiens
ttggtcagcttttgt

SEQ ID NO: 286728 - DNA, 21 bp, Homo sapiens
ttggtcctaagtccctgcccc

SEQ ID NO: 286729 - DNA, 19 bp, Homo sapiens
ttggtcctgttaaccctcc

SEQ ID NO: 286730 - DNA, 16 bp, Homo sapiens
ttggtctctttctttc

SEQ ID NO: 286731 - DNA, 17 bp, Homo sapiens
ttggtcttactttgtgc

SEQ ID NO: 286732 - DNA, 17 bp, Homo sapiens
ttggtgataagtggaaa

SEQ ID NO: 286733 - DNA, 23 bp, Homo sapiens
ttggtgataagtggaaaaaagag

SEQ ID NO: 286734 - DNA, 16 bp, Homo sapiens
ttggtgcaacccttac

SEQ ID NO: 286735 - DNA, 21 bp, Homo sapiens
ttggtgcaacccttacccctt

SEQ ID NO: 286736 - DNA, 14 bp, Homo sapiens
ttggtgccctgaac

SEQ ID NO: 286737 - DNA, 12 bp, Homo sapiens
ttggtgctgctt

SEQ ID NO: 286738 - DNA, 21 bp, Homo sapiens
ttggtggcagattttacaaaa

SEQ ID NO: 286739 - DNA, 23 bp, Homo sapiens
ttggtggccgcaaccacttgcta

SEQ ID NO: 286740 - DNA, 21 bp, Homo sapiens
ttggtggggctcgtggccttc

SEQ ID NO: 286741 - DNA, 12 bp, Homo sapiens
ttggtggttttt

SEQ ID NO: 286742 - DNA, 13 bp, Homo sapiens
ttggtgtcttggc

SEQ ID NO: 286743 - DNA, 17 bp, Homo sapiens
ttggttaatcacttaac

SEQ ID NO: 286744 - DNA, 21 bp, Homo sapiens
ttggttatgatggaaaggaag

SEQ ID NO: 286745 - DNA, 17 bp, Homo sapiens
ttggttcatcagtgtta

SEQ ID NO: 286746 - DNA, 20 bp, Homo sapiens
ttggttcatcagtgttaaaa

SEQ ID NO: 286747 - DNA, 15 bp, Homo sapiens
ttggttcctccagca

SEQ ID NO: 286748 - DNA, 18 bp, Homo sapiens
ttggttgtcaatattaaa

SEQ ID NO: 286749 - DNA, 13 bp, Homo sapiens
ttggttgtttctc

SEQ ID NO: 286750 - DNA, 13 bp, Homo sapiens
ttggtttatgaga

SEQ ID NO: 286751 - DNA, 16 bp, Homo sapiens
ttggtttctgtttgaa

SEQ ID NO: 286752 - DNA, 20 bp, Homo sapiens
ttggttttaaaaaagcatta

SEQ ID NO: 286753 - DNA, 13 bp, Homo sapiens
ttggtttttactc

SEQ ID NO: 286754 - DNA, 23 bp, Homo sapiens
ttgtaaaacctgtcaatgataca

SEQ ID NO: 286755 - DNA, 14 bp, Homo sapiens
ttgtaaaactacac

SEQ ID NO: 286756 - DNA, 17 bp, Homo sapiens
ttgtaaaagcaacatca

SEQ ID NO: 286757 - DNA, 23 bp, Homo sapiens
ttgtaaaagcaacatcagcttga

SEQ ID NO: 286758 - DNA, 21 bp, Homo sapiens
ttgtaaaatagcttgtatagt

SEQ ID NO: 286759 - DNA, 21 bp, Homo sapiens
ttgtaaagttaattcattaaa

SEQ ID NO: 286760 - DNA, 15 bp, Homo sapiens
ttgtaaataagagat

SEQ ID NO: 286761 - DNA, 12 bp, Homo sapiens
ttgtaaatacac

SEQ ID NO: 286762 - DNA, 14 bp, Homo sapiens
ttgtaaatattaaa

SEQ ID NO: 286763 - DNA, 16 bp, Homo sapiens
ttgtaaatattcttgt

SEQ ID NO: 286764 - DNA, 19 bp, Homo sapiens
ttgtaaatccaacacaagt

SEQ ID NO: 286765 - DNA, 23 bp, Homo sapiens
ttgtaaattaatacttcatttgg

SEQ ID NO: 286766 - DNA, 21 bp, Homo sapiens
ttgtaacattctatttcaact

SEQ ID NO: 286767 - DNA, 14 bp, Homo sapiens
ttgtaacctcagct

SEQ ID NO: 286768 - DNA, 16 bp, Homo sapiens
ttgtaacctcagctct

SEQ ID NO: 286769 - DNA, 21 bp, Homo sapiens
ttgtaactaaagtatttaaag

SEQ ID NO: 286770 - DNA, 21 bp, Homo sapiens
ttgtaagacacacagcctttc

SEQ ID NO: 286771 - DNA, 23 bp, Homo sapiens
ttgtaagacacacagcctttctg

SEQ ID NO: 286772 - DNA, 20 bp, Homo sapiens
ttgtaagagtggaaccaaca

SEQ ID NO: 286773 - DNA, 21 bp, Homo sapiens
ttgtaaggattgcctttgtag

SEQ ID NO: 286774 - DNA, 19 bp, Homo sapiens
ttgtaagtaaactgccctg

SEQ ID NO: 286775 - DNA, 12 bp, Homo sapiens
ttgtaagtttat

SEQ ID NO: 286776 - DNA, 20 bp, Homo sapiens
ttgtaataaagtatataatt

SEQ ID NO: 286777 - DNA, 15 bp, Homo sapiens
ttgtaatatacagtt

SEQ ID NO: 286778 - DNA, 14 bp, Homo sapiens
ttgtaatgtatctt

SEQ ID NO: 286779 - DNA, 18 bp, Homo sapiens
ttgtaatgtatcttattt

SEQ ID NO: 286780 - DNA, 19 bp, Homo sapiens
ttgtacaattactaaattg

SEQ ID NO: 286781 - DNA, 16 bp, Homo sapiens
ttgtacatattggaaa

SEQ ID NO: 286782 - DNA, 19 bp, Homo sapiens
ttgtacattcctgatactg

SEQ ID NO: 286783 - DNA, 17 bp, Homo sapiens
ttgtaccactgctaata

SEQ ID NO: 286784 - DNA, 18 bp, Homo sapiens
ttgtaccactgctaataa

SEQ ID NO: 286785 - DNA, 13 bp, Homo sapiens
ttgtacgtgggag

SEQ ID NO: 286786 - DNA, 22 bp, Homo sapiens
ttgtactatttaactgactatt

SEQ ID NO: 286787 - DNA, 20 bp, Homo sapiens
ttgtactccagcctgggtga

SEQ ID NO: 286788 - DNA, 14 bp, Homo sapiens
ttgtactgtgctga

SEQ ID NO: 286789 - DNA, 18 bp, Homo sapiens
ttgtactttgtttttcca

SEQ ID NO: 286790 - DNA, 20 bp, Homo sapiens
ttgtagaagatggactctga

SEQ ID NO: 286791 - DNA, 18 bp, Homo sapiens
ttgtagatacaatcagct

SEQ ID NO: 286792 - DNA, 16 bp, Homo sapiens
ttgtagctagtttaaa

SEQ ID NO: 286793 - DNA, 21 bp, Homo sapiens
ttgtagctcttagtcctccct

SEQ ID NO: 286794 - DNA, 16 bp, Homo sapiens
ttgtaggaatctgcct

SEQ ID NO: 286795 - DNA, 20 bp, Homo sapiens
ttgtaggggtcaaagaaatg

SEQ ID NO: 286796 - DNA, 14 bp, Homo sapiens
ttgtagtaaatatt

SEQ ID NO: 286797 - DNA, 20 bp, Homo sapiens
ttgtagtagtctcattactt

SEQ ID NO: 286798 - DNA, 12 bp, Homo sapiens
ttgtagtgttct

SEQ ID NO: 286799 - DNA, 15 bp, Homo sapiens
ttgtatagtgtaaaa

SEQ ID NO: 286800 - DNA, 14 bp, Homo sapiens
ttgtatataaatgg

SEQ ID NO: 286801 - DNA, 19 bp, Homo sapiens
ttgtatatatctgcttcag

SEQ ID NO: 286802 - DNA, 17 bp, Homo sapiens
ttgtatctagtgcagct

SEQ ID NO: 286803 - DNA, 21 bp, Homo sapiens
ttgtatctagtgcagctgatt

SEQ ID NO: 286804 - DNA, 18 bp, Homo sapiens
ttgtatgaagtactttta

SEQ ID NO: 286805 - DNA, 13 bp, Homo sapiens
ttgtatgtacctg

SEQ ID NO: 286806 - DNA, 15 bp, Homo sapiens
ttgtatgtatctatt

SEQ ID NO: 286807 - DNA, 16 bp, Homo sapiens
ttgtattacatctaat

SEQ ID NO: 286808 - DNA, 20 bp, Homo sapiens
ttgtattcctgcctttgatg

SEQ ID NO: 286809 - DNA, 12 bp, Homo sapiens
ttgtatttcttt

SEQ ID NO: 286810 - DNA, 13 bp, Homo sapiens
ttgtatttctttt

SEQ ID NO: 286811 - DNA, 16 bp, Homo sapiens
ttgtatttcttttata

SEQ ID NO: 286812 - DNA, 19 bp, Homo sapiens
ttgtatttcttttatatat

SEQ ID NO: 286813 - DNA, 20 bp, Homo sapiens
ttgtattttgtacaaagtaa

SEQ ID NO: 286814 - DNA, 17 bp, Homo sapiens
ttgtatttttgaataaa

SEQ ID NO: 286815 - DNA, 18 bp, Homo sapiens
ttgtcaatattaaataca

SEQ ID NO: 286816 - DNA, 19 bp, Homo sapiens
ttgtcaatattaaatacag

SEQ ID NO: 286817 - DNA, 22 bp, Homo sapiens
ttgtcacacagtagctccaaca

SEQ ID NO: 286818 - DNA, 14 bp, Homo sapiens
ttgtcacagctctt

SEQ ID NO: 286819 - DNA, 16 bp, Homo sapiens
ttgtcaccagcaacat

SEQ ID NO: 286820 - DNA, 16 bp, Homo sapiens
ttgtcactacaaaaat

SEQ ID NO: 286821 - DNA, 22 bp, Homo sapiens
ttgtcactcaacaaaagtgctt

SEQ ID NO: 286822 - DNA, 16 bp, Homo sapiens
ttgtcactcggctttg

SEQ ID NO: 286823 - DNA, 20 bp, Homo sapiens
ttgtcagactttaaagaata

SEQ ID NO: 286824 - DNA, 15 bp, Homo sapiens
ttgtcagtgacagta

SEQ ID NO: 286825 - DNA, 21 bp, Homo sapiens
ttgtcatataagattcatatt

SEQ ID NO: 286826 - DNA, 22 bp, Homo sapiens
ttgtcatggaaaatgtcctgtg

SEQ ID NO: 286827 - DNA, 12 bp, Homo sapiens
ttgtcatgtgta

SEQ ID NO: 286828 - DNA, 14 bp, Homo sapiens
ttgtcatgtgtata

SEQ ID NO: 286829 - DNA, 16 bp, Homo sapiens
ttgtcatttttaatat

SEQ ID NO: 286830 - DNA, 20 bp, Homo sapiens
ttgtccacaaatgtcctcag

SEQ ID NO: 286831 - DNA, 13 bp, Homo sapiens
ttgtccagagaca

SEQ ID NO: 286832 - DNA, 13 bp, Homo sapiens
ttgtccccagggc

SEQ ID NO: 286833 - DNA, 18 bp, Homo sapiens
ttgtcccccaacttgaga

SEQ ID NO: 286834 - DNA, 18 bp, Homo sapiens
ttgtcccctcacctccac

SEQ ID NO: 286835 - DNA, 17 bp, Homo sapiens
ttgtcccggataggcta

SEQ ID NO: 286836 - DNA, 13 bp, Homo sapiens
ttgtccctctcac

SEQ ID NO: 286837 - DNA, 13 bp, Homo sapiens
ttgtcctgccagc

SEQ ID NO: 286838 - DNA, 14 bp, Homo sapiens
ttgtcctgccagct

SEQ ID NO: 286839 - DNA, 15 bp, Homo sapiens
ttgtcctgccagctg

SEQ ID NO: 286840 - DNA, 19 bp, Homo sapiens
ttgtcctgccagctgcctt

SEQ ID NO: 286841 - DNA, 13 bp, Homo sapiens
ttgtcctgtgtca

SEQ ID NO: 286842 - DNA, 16 bp, Homo sapiens
ttgtccttcagagctc

SEQ ID NO: 286843 - DNA, 15 bp, Homo sapiens
ttgtcctttgagaaa

SEQ ID NO: 286844 - DNA, 17 bp, Homo sapiens
ttgtctattctgagcct

SEQ ID NO: 286845 - DNA, 16 bp, Homo sapiens
ttgtctatttttgtct

SEQ ID NO: 286846 - DNA, 17 bp, Homo sapiens
ttgtctatttttgtctt

SEQ ID NO: 286847 - DNA, 17 bp, Homo sapiens
ttgtctcgaaataattt

SEQ ID NO: 286848 - DNA, 17 bp, Homo sapiens
ttgtctgacacatgctc

SEQ ID NO: 286849 - DNA, 12 bp, Homo sapiens
ttgtctgagcct

SEQ ID NO: 286850 - DNA, 16 bp, Homo sapiens
ttgtctgctgctccca

SEQ ID NO: 286851 - DNA, 18 bp, Homo sapiens
tttaaagaatcattattt

SEQ ID NO: 286852 - DNA, 21 bp, Homo sapiens
tttaaaggacaaacagtgaat

SEQ ID NO: 286853 - DNA, 18 bp, Homo sapiens
tttaaagtttaaatacca

SEQ ID NO: 286854 - DNA, 23 bp, Homo sapiens
tttaaataaaagaaaaaatatct

SEQ ID NO: 286855 - DNA, 20 bp, Homo sapiens
tttaaatacgcactacatgt

SEQ ID NO: 286856 - DNA, 12 bp, Homo sapiens
tttaaatataat

SEQ ID NO: 286857 - DNA, 13 bp, Homo sapiens
tttaaatataatt

SEQ ID NO: 286858 - DNA, 16 bp, Homo sapiens
tttaaatataattctg

SEQ ID NO: 286859 - DNA, 21 bp, Homo sapiens
tttaaatataattctgtaaat

SEQ ID NO: 286860 - DNA, 24 bp, Homo sapiens
tttaaatatcattctttgtatctt

SEQ ID NO: 286861 - DNA, 11 bp, Homo sapiens
tttaaatcatt

SEQ ID NO: 286862 - DNA, 14 bp, Homo sapiens
tttaaatctgtgat

SEQ ID NO: 286863 - DNA, 12 bp, Homo sapiens
tttaaatgattc

SEQ ID NO: 286864 - DNA, 19 bp, Homo sapiens
tttaaatgattccaaataa

SEQ ID NO: 286865 - DNA, 16 bp, Homo sapiens
tttaaatgtaaaacat

SEQ ID NO: 286866 - DNA, 17 bp, Homo sapiens
tttaaatgttctaacag

SEQ ID NO: 286867 - DNA, 16 bp, Homo sapiens
tttaaattataaggac

SEQ ID NO: 286868 - DNA, 17 bp, Homo sapiens
tttaaattataaggact

SEQ ID NO: 286869 - DNA, 18 bp, Homo sapiens
tttaaattataaggactg

SEQ ID NO: 286870 - DNA, 19 bp, Homo sapiens
tttaaattatactgtagct

SEQ ID NO: 286871 - DNA, 15 bp, Homo sapiens
tttaacaaaagcaag

SEQ ID NO: 286872 - DNA, 13 bp, Homo sapiens
tttaacaaatcta

SEQ ID NO: 286873 - DNA, 15 bp, Homo sapiens
tttaacaaatctaat

SEQ ID NO: 286874 - DNA, 22 bp, Homo sapiens
tttaacaaatctaatctcttat

SEQ ID NO: 286875 - DNA, 23 bp, Homo sapiens
tttaacaaatctaatctcttatt

SEQ ID NO: 286876 - DNA, 21 bp, Homo sapiens
tttaacaataactactgtgtt

SEQ ID NO: 286877 - DNA, 23 bp, Homo sapiens
tttaacaataactactgtgttcc

SEQ ID NO: 286878 - DNA, 16 bp, Homo sapiens
tttaacagtcatttaa

SEQ ID NO: 286879 - DNA, 22 bp, Homo sapiens
tttaacctcaggttccaaattc

SEQ ID NO: 286880 - DNA, 21 bp, Homo sapiens
tttaactactaagaataaata

SEQ ID NO: 286881 - DNA, 16 bp, Homo sapiens
tttaactagcacttta

SEQ ID NO: 286882 - DNA, 21 bp, Homo sapiens
tttaactcagatcactactgc

SEQ ID NO: 286883 - DNA, 12 bp, Homo sapiens
tttaactctgcg

SEQ ID NO: 286884 - DNA, 13 bp, Homo sapiens
tttaactgaaaat

SEQ ID NO: 286885 - DNA, 15 bp, Homo sapiens
tttaactgaaaatgt

SEQ ID NO: 286886 - DNA, 15 bp, Homo sapiens
tttaactgcattcta

SEQ ID NO: 286887 - DNA, 14 bp, Homo sapiens
tttaactgccttgt

SEQ ID NO: 286888 - DNA, 14 bp, Homo sapiens
tttaactttaagtt

SEQ ID NO: 286889 - DNA, 15 bp, Homo sapiens
tttaagaaaaacatg

SEQ ID NO: 286890 - DNA, 19 bp, Homo sapiens
tttaagaaaaacatgtcat

SEQ ID NO: 286891 - DNA, 20 bp, Homo sapiens
tttaagaaaaacatgtcatg

SEQ ID NO: 286892 - DNA, 13 bp, Homo sapiens
tttaagaaaatac

SEQ ID NO: 286893 - DNA, 15 bp, Homo sapiens
tttaagaatgacagg

SEQ ID NO: 286894 - DNA, 12 bp, Homo sapiens
tttaagagaaat

SEQ ID NO: 286895 - DNA, 20 bp, Homo sapiens
tttaagataatagtttacat

SEQ ID NO: 286896 - DNA, 14 bp, Homo sapiens
tttaagataattat

SEQ ID NO: 286897 - DNA, 22 bp, Homo sapiens
tttaagatgtgtcttcaatttg

SEQ ID NO: 286898 - DNA, 15 bp, Homo sapiens
tttaagatttgtgtt

SEQ ID NO: 286899 - DNA, 15 bp, Homo sapiens
tttaagcaacatctt

SEQ ID NO: 286900 - DNA, 17 bp, Homo sapiens
tttaagcaacatctttt

SEQ ID NO: 286901 - DNA, 20 bp, Homo sapiens
tttaagcactacataaactg

SEQ ID NO: 286902 - DNA, 14 bp, Homo sapiens
tttaagcattgttt

SEQ ID NO: 286903 - DNA, 23 bp, Homo sapiens
tttaagcattgtttgcttattgt

SEQ ID NO: 286904 - DNA, 19 bp, Homo sapiens
tttaagcgaggcagaatgg

SEQ ID NO: 286905 - DNA, 16 bp, Homo sapiens
tttaagctccagcttt

SEQ ID NO: 286906 - DNA, 18 bp, Homo sapiens
tttaaggctaaaacttaa

SEQ ID NO: 286907 - DNA, 20 bp, Homo sapiens
tttaagggtttgtggaaaat

SEQ ID NO: 286908 - DNA, 16 bp, Homo sapiens
tttaaggtttttactg

SEQ ID NO: 286909 - DNA, 17 bp, Homo sapiens
tttaagtacaaaaaagt

SEQ ID NO: 286910 - DNA, 14 bp, Homo sapiens
tttaagtatttata

SEQ ID NO: 286911 - DNA, 15 bp, Homo sapiens
tttaagtatttatat

SEQ ID NO: 286912 - DNA, 20 bp, Homo sapiens
tttaagtatttatatattta

SEQ ID NO: 286913 - DNA, 20 bp, Homo sapiens
tttaagtcgggaaattctgc

SEQ ID NO: 286914 - DNA, 21 bp, Homo sapiens
tttaagtcgggaaattctgct

SEQ ID NO: 286915 - DNA, 18 bp, Homo sapiens
tttaagtgtactggattt

SEQ ID NO: 286916 - DNA, 12 bp, Homo sapiens
tttaataacttt

SEQ ID NO: 286917 - DNA, 19 bp, Homo sapiens
tttaatactcacctcctcc

SEQ ID NO: 286918 - DNA, 22 bp, Homo sapiens
tttaatagtatatctaatggct

SEQ ID NO: 286919 - DNA, 20 bp, Homo sapiens
tttaatatactaaccatttc

SEQ ID NO: 286920 - DNA, 12 bp, Homo sapiens
tttaatatgcat

SEQ ID NO: 286921 - DNA, 14 bp, Homo sapiens
tttaatatgcatct

SEQ ID NO: 286922 - DNA, 16 bp, Homo sapiens
tttaatatgcatcttt

SEQ ID NO: 286923 - DNA, 16 bp, Homo sapiens
tttaatattactgtct

SEQ ID NO: 286924 - DNA, 21 bp, Homo sapiens
tttaatattactgtctttatt

SEQ ID NO: 286925 - DNA, 15 bp, Homo sapiens
tttaatattgagaaa

SEQ ID NO: 286926 - DNA, 13 bp, Homo sapiens
tttaatcaaattt

SEQ ID NO: 286927 - DNA, 10 bp, Homo sapiens
tttaatcatt

SEQ ID NO: 286928 - DNA, 21 bp, Homo sapiens
tttaatcccggtttcagaagc

SEQ ID NO: 286929 - DNA, 13 bp, Homo sapiens
tttaatcttcagt

SEQ ID NO: 286930 - DNA, 12 bp, Homo sapiens
tttaatgttaca

SEQ ID NO: 286931 - DNA, 19 bp, Homo sapiens
tttaattattaactacatt

SEQ ID NO: 286932 - DNA, 14 bp, Homo sapiens
tttaattattattc

SEQ ID NO: 286933 - DNA, 14 bp, Homo sapiens
tttaattgttactc

SEQ ID NO: 286934 - DNA, 16 bp, Homo sapiens
tttaatttatgagttt

SEQ ID NO: 286935 - DNA, 20 bp, Homo sapiens
tttaatttatttattaagat

SEQ ID NO: 286936 - DNA, 12 bp, Homo sapiens
tttaatttcata

SEQ ID NO: 286937 - DNA, 19 bp, Homo sapiens
tttacaaacagatgaaaaa

SEQ ID NO: 286938 - DNA, 20 bp, Homo sapiens
tttacaaacagatgaaaaaa

SEQ ID NO: 286939 - DNA, 14 bp, Homo sapiens
tttacaacaaacac

SEQ ID NO: 286940 - DNA, 20 bp, Homo sapiens
tttacaacataatctagttt

SEQ ID NO: 286941 - DNA, 15 bp, Homo sapiens
tttacaagtgtatat

SEQ ID NO: 286942 - DNA, 23 bp, Homo sapiens
tttacaattgtaaaactgaggca

SEQ ID NO: 286943 - DNA, 18 bp, Homo sapiens
tttacacagcaattttgt

SEQ ID NO: 286944 - DNA, 16 bp, Homo sapiens
tttacagaaaaatctt

SEQ ID NO: 286945 - DNA, 20 bp, Homo sapiens
tttacagcctcacttgaatg

SEQ ID NO: 286946 - DNA, 20 bp, Homo sapiens
tttacagctttcatgattag

SEQ ID NO: 286947 - DNA, 16 bp, Homo sapiens
tttacagcttttctct

SEQ ID NO: 286948 - DNA, 22 bp, Homo sapiens
tttacaggatcatgtaaatgct

SEQ ID NO: 286949 - DNA, 19 bp, Homo sapiens
tttacagtaaataaattgt

SEQ ID NO: 286950 - DNA, 14 bp, Homo sapiens
tttacagtgcctgt

SEQ ID NO: 286951 - DNA, 15 bp, Homo sapiens
tttacatgtagtagt

SEQ ID NO: 286952 - DNA, 22 bp, Homo sapiens
tttaccactgctgtgaacaagt

SEQ ID NO: 286953 - DNA, 14 bp, Homo sapiens
tttaccacttatgc

SEQ ID NO: 286954 - DNA, 16 bp, Homo sapiens
tttaccatttgtaata

SEQ ID NO: 286955 - DNA, 14 bp, Homo sapiens
tttaccccagctcc

SEQ ID NO: 286956 - DNA, 21 bp, Homo sapiens
tttaccctcctctatttcttt

SEQ ID NO: 286957 - DNA, 19 bp, Homo sapiens
tttacctaccacagtgtct

SEQ ID NO: 286958 - DNA, 13 bp, Homo sapiens
tttacctgagacc

SEQ ID NO: 286959 - DNA, 20 bp, Homo sapiens
tttacctttattaatgaact

SEQ ID NO: 286960 - DNA, 14 bp, Homo sapiens
tttactaaagcagt

SEQ ID NO: 286961 - DNA, 14 bp, Homo sapiens
tttactaagacata

SEQ ID NO: 286962 - DNA, 21 bp, Homo sapiens
tttactaagccacaagaaatt

SEQ ID NO: 286963 - DNA, 17 bp, Homo sapiens
tttactactgcaagttc

SEQ ID NO: 286964 - DNA, 14 bp, Homo sapiens
tttactacttatgc

SEQ ID NO: 286965 - DNA, 13 bp, Homo sapiens
tttactcattatc

SEQ ID NO: 286966 - DNA, 12 bp, Homo sapiens
tttactcccctt

SEQ ID NO: 286967 - DNA, 12 bp, Homo sapiens
tttactgctttt

SEQ ID NO: 286968 - DNA, 15 bp, Homo sapiens
tttactgtactaatt

SEQ ID NO: 286969 - DNA, 15 bp, Homo sapiens
tttacttcttataca

SEQ ID NO: 286970 - DNA, 20 bp, Homo sapiens
tttacttgatcattctcagt

SEQ ID NO: 286971 - DNA, 16 bp, Homo sapiens
tttacttggaaataat

SEQ ID NO: 286972 - DNA, 15 bp, Homo sapiens
tttactttgtacttg

SEQ ID NO: 286973 - DNA, 15 bp, Homo sapiens
tttactttgtgcaat

SEQ ID NO: 286974 - DNA, 20 bp, Homo sapiens
tttactttgtgcaatatgag

SEQ ID NO: 286975 - DNA, 15 bp, Homo sapiens
tttagaacagaaaac

SEQ ID NO: 286976 - DNA, 15 bp, Homo sapiens
tttagaagtgcattt

SEQ ID NO: 286977 - DNA, 11 bp, Homo sapiens
tttagacagta

SEQ ID NO: 286978 - DNA, 15 bp, Homo sapiens
tttagaccatttatc

SEQ ID NO: 286979 - DNA, 22 bp, Homo sapiens
tttagagataagagttggctgg

SEQ ID NO: 286980 - DNA, 22 bp, Homo sapiens
tttagagattaatttgtgtaga

SEQ ID NO: 286981 - DNA, 15 bp, Homo sapiens
tttagaggtgagttt

SEQ ID NO: 286982 - DNA, 15 bp, Homo sapiens
tttagagtaaactat

SEQ ID NO: 286983 - DNA, 17 bp, Homo sapiens
tttagatattcattaat

SEQ ID NO: 286984 - DNA, 24 bp, Homo sapiens
tttagatcaaggcaaaaatatcag

SEQ ID NO: 286985 - DNA, 20 bp, Homo sapiens
tttagattcctacttaaaca

SEQ ID NO: 286986 - DNA, 14 bp, Homo sapiens
tttagcacaaaaaa

SEQ ID NO: 286987 - DNA, 23 bp, Homo sapiens
tttagcagttctgcaaatagaaa

SEQ ID NO: 286988 - DNA, 20 bp, Homo sapiens
tttagcatgacaagccccag

SEQ ID NO: 286989 - DNA, 15 bp, Homo sapiens
tttagccaaaccctt

SEQ ID NO: 286990 - DNA, 11 bp, Homo sapiens
tttagccagtg

SEQ ID NO: 286991 - DNA, 13 bp, Homo sapiens
tttagccagtgac

SEQ ID NO: 286992 - DNA, 20 bp, Homo sapiens
tttagccattgtcgtttcat

SEQ ID NO: 286993 - DNA, 14 bp, Homo sapiens
tttaggaatgctca

SEQ ID NO: 286994 - DNA, 15 bp, Homo sapiens
tttaggaatgctcaa

SEQ ID NO: 286995 - DNA, 10 bp, Homo sapiens
tttaggcagg

SEQ ID NO: 286996 - DNA, 12 bp, Homo sapiens
tttaggcttcta

SEQ ID NO: 286997 - DNA, 19 bp, Homo sapiens
tttagggagacccaataaa

SEQ ID NO: 286998 - DNA, 20 bp, Homo sapiens
tttaggtcatccaacctctt

SEQ ID NO: 286999 - DNA, 19 bp, Homo sapiens
tttaggtgtcttttaatga

SEQ ID NO: 287000 - DNA, 22 bp, Homo sapiens
tttaggtgttgattttctgttg

SEQ ID NO: 287001 - DNA, 13 bp, Homo sapiens
tttagtagctgat

SEQ ID NO: 287002 - DNA, 16 bp, Homo sapiens
tttagtagctgataaa

SEQ ID NO: 287003 - DNA, 20 bp, Homo sapiens
tttagtcacgtgtattttca

SEQ ID NO: 287004 - DNA, 13 bp, Homo sapiens
tttagtcattatt

SEQ ID NO: 287005 - DNA, 16 bp, Homo sapiens
tttagtcctcaccttc

SEQ ID NO: 287006 - DNA, 21 bp, Homo sapiens
tttagtctacataggcaaagt

SEQ ID NO: 287007 - DNA, 18 bp, Homo sapiens
tttagtcttgatgtggaa

SEQ ID NO: 287008 - DNA, 13 bp, Homo sapiens
tttagtgccaggc

SEQ ID NO: 287009 - DNA, 11 bp, Homo sapiens
tttagttcttt

SEQ ID NO: 287010 - DNA, 20 bp, Homo sapiens
tttagttgattttaattact

SEQ ID NO: 287011 - DNA, 19 bp, Homo sapiens
tttagtttaccaatcaaca

SEQ ID NO: 287012 - DNA, 14 bp, Homo sapiens
tttagtttactcaa

SEQ ID NO: 287013 - DNA, 21 bp, Homo sapiens
tttagtttgttaattgattaa

SEQ ID NO: 287014 - DNA, 13 bp, Homo sapiens
tttataaatttga

SEQ ID NO: 287015 - DNA, 19 bp, Homo sapiens
tttataaccccagcctgac

SEQ ID NO: 287016 - DNA, 19 bp, Homo sapiens
tttataactcatcataaaa

SEQ ID NO: 287017 - DNA, 22 bp, Homo sapiens
tttatacaagaagggagattca

SEQ ID NO: 287018 - DNA, 16 bp, Homo sapiens
tttatacaatatcatc

SEQ ID NO: 287019 - DNA, 16 bp, Homo sapiens
tttataccccatttga

SEQ ID NO: 287020 - DNA, 17 bp, Homo sapiens
tttatagctattactgt

SEQ ID NO: 287021 - DNA, 20 bp, Homo sapiens
tttatagctattactgtctg

SEQ ID NO: 287022 - DNA, 19 bp, Homo sapiens
tttatagcttccagattac

SEQ ID NO: 287023 - DNA, 15 bp, Homo sapiens
tttatagtttataca

SEQ ID NO: 287024 - DNA, 14 bp, Homo sapiens
tttatataaatgta

SEQ ID NO: 287025 - DNA, 12 bp, Homo sapiens
tttatataataa

SEQ ID NO: 287026 - DNA, 17 bp, Homo sapiens
tttatataataaagtat

SEQ ID NO: 287027 - DNA, 20 bp, Homo sapiens
tttatatacctggcttttac

SEQ ID NO: 287028 - DNA, 13 bp, Homo sapiens
tttatatataaaa

SEQ ID NO: 287029 - DNA, 23 bp, Homo sapiens
tttatatattataagttgacctt

SEQ ID NO: 287030 - DNA, 17 bp, Homo sapiens
tttatatcagcctgagt

SEQ ID NO: 287031 - DNA, 23 bp, Homo sapiens
tttatatccacctacctattcat

SEQ ID NO: 287032 - DNA, 17 bp, Homo sapiens
tttatatggcccagcct

SEQ ID NO: 287033 - DNA, 23 bp, Homo sapiens
tttatattcagagatgtaccatg

SEQ ID NO: 287034 - DNA, 16 bp, Homo sapiens
tttatattcatcaaat

SEQ ID NO: 287035 - DNA, 18 bp, Homo sapiens
tttatattgtttttatat

SEQ ID NO: 287036 - DNA, 14 bp, Homo sapiens
tttatatttgtctc

SEQ ID NO: 287037 - DNA, 16 bp, Homo sapiens
tttatattttatactg

SEQ ID NO: 287038 - DNA, 19 bp, Homo sapiens
tttatattttatactgcac

SEQ ID NO: 287039 - DNA, 14 bp, Homo sapiens
tttatattttctat

SEQ ID NO: 287040 - DNA, 20 bp, Homo sapiens
tttatattttctatatttgt

SEQ ID NO: 287041 - DNA, 18 bp, Homo sapiens
tttatcacacttctgtga

SEQ ID NO: 287042 - DNA, 21 bp, Homo sapiens
tttatcagtgacagagttcac

SEQ ID NO: 287043 - DNA, 21 bp, Homo sapiens
tttatcagtgcttaatgtgaa

SEQ ID NO: 287044 - DNA, 23 bp, Homo sapiens
tttatcatgacatgttatatatt

SEQ ID NO: 287045 - DNA, 22 bp, Homo sapiens
tttatcattaaacatgaattta

SEQ ID NO: 287046 - DNA, 12 bp, Homo sapiens
tttatcattttc

SEQ ID NO: 287047 - DNA, 15 bp, Homo sapiens
tttatccaaatcttg

SEQ ID NO: 287048 - DNA, 22 bp, Homo sapiens
tttatccctgcttatctgaaac

SEQ ID NO: 287049 - DNA, 23 bp, Homo sapiens
tttatctgtctgagccctgccct

SEQ ID NO: 287050 - DNA, 21 bp, Homo sapiens
tttatcttggactgacattta

SEQ ID NO: 287051 - DNA, 14 bp, Homo sapiens
tttatcttgtctct

SEQ ID NO: 287052 - DNA, 18 bp, Homo sapiens
tttatgaaaaaaatatat

SEQ ID NO: 287053 - DNA, 19 bp, Homo sapiens
tttatgaaaaaaatatatt

SEQ ID NO: 287054 - DNA, 19 bp, Homo sapiens
tttatgaaaggtttacatt

SEQ ID NO: 287055 - DNA, 17 bp, Homo sapiens
tttatgaagaaagatac

SEQ ID NO: 287056 - DNA, 18 bp, Homo sapiens
tttatgaagaaagatact

SEQ ID NO: 287057 - DNA, 23 bp, Homo sapiens
tttatgagaactggttcttgcct

SEQ ID NO: 287058 - DNA, 20 bp, Homo sapiens
tttatgagtaactattatta

SEQ ID NO: 287059 - DNA, 14 bp, Homo sapiens
tttatgcagataga

SEQ ID NO: 287060 - DNA, 20 bp, Homo sapiens
tttatgcatgagaactaaat

SEQ ID NO: 287061 - DNA, 19 bp, Homo sapiens
tttatgccttcttattgct

SEQ ID NO: 287062 - DNA, 21 bp, Homo sapiens
tttatgctgaaacagaatact

SEQ ID NO: 287063 - DNA, 12 bp, Homo sapiens
tttatgtactgc

SEQ ID NO: 287064 - DNA, 14 bp, Homo sapiens
tttatgtctaaaga

SEQ ID NO: 287065 - DNA, 14 bp, Homo sapiens
tttattaaaatgat

SEQ ID NO: 287066 - DNA, 21 bp, Homo sapiens
tttattaaaatgattgtaaaa

SEQ ID NO: 287067 - DNA, 14 bp, Homo sapiens
tttattaacctcag

SEQ ID NO: 287068 - DNA, 20 bp, Homo sapiens
tttattacaaattttcactg

SEQ ID NO: 287069 - DNA, 12 bp, Homo sapiens
tttattacatta

SEQ ID NO: 287070 - DNA, 13 bp, Homo sapiens
tttattacctctg

SEQ ID NO: 287071 - DNA, 12 bp, Homo sapiens
tttattattcag

SEQ ID NO: 287072 - DNA, 17 bp, Homo sapiens
tttattattttcacctg

SEQ ID NO: 287073 - DNA, 17 bp, Homo sapiens
tttattcaagttattgt

SEQ ID NO: 287074 - DNA, 17 bp, Homo sapiens
tttattcaattcctctg

SEQ ID NO: 287075 - DNA, 19 bp, Homo sapiens
tttattcacatatgtctta

SEQ ID NO: 287076 - DNA, 20 bp, Homo sapiens
tttattcacttgtgtttgta

SEQ ID NO: 287077 - DNA, 19 bp, Homo sapiens
tttattccagcgtcttcta

SEQ ID NO: 287078 - DNA, 21 bp, Homo sapiens
tttattctgtcaatgaaaagc

SEQ ID NO: 287079 - DNA, 13 bp, Homo sapiens
tttattcttgctg

SEQ ID NO: 287080 - DNA, 16 bp, Homo sapiens
tttattgaagatgtcc

SEQ ID NO: 287081 - DNA, 18 bp, Homo sapiens
tttattggaagtgttcaa

SEQ ID NO: 287082 - DNA, 14 bp, Homo sapiens
tttatttaaactat

SEQ ID NO: 287083 - DNA, 19 bp, Homo sapiens
ttgtggccccttttacttt

SEQ ID NO: 287084 - DNA, 11 bp, Homo sapiens
ttgtgggctgg

SEQ ID NO: 287085 - DNA, 22 bp, Homo sapiens
ttgtggtgatcgcacaaggaca

SEQ ID NO: 287086 - DNA, 13 bp, Homo sapiens
ttgtggttaatct

SEQ ID NO: 287087 - DNA, 20 bp, Homo sapiens
ttgtggttctattttacttt

SEQ ID NO: 287088 - DNA, 13 bp, Homo sapiens
ttgtggtttgttg

SEQ ID NO: 287089 - DNA, 20 bp, Homo sapiens
ttgtgtaagagaatgttgaa

SEQ ID NO: 287090 - DNA, 19 bp, Homo sapiens
ttgtgtaatagaaaactga

SEQ ID NO: 287091 - DNA, 18 bp, Homo sapiens
ttgtgtaatattacttta

SEQ ID NO: 287092 - DNA, 23 bp, Homo sapiens
ttgtgtaatattactttaacatg

SEQ ID NO: 287093 - DNA, 20 bp, Homo sapiens
ttgtgtacaaagtagagaag

SEQ ID NO: 287094 - DNA, 20 bp, Homo sapiens
ttgtgtactgataaaatact

SEQ ID NO: 287095 - DNA, 15 bp, Homo sapiens
ttgtgtagattgtgt

SEQ ID NO: 287096 - DNA, 18 bp, Homo sapiens
ttgtgtagattgtgtaaa

SEQ ID NO: 287097 - DNA, 20 bp, Homo sapiens
ttgtgtagattgtgtaaatt

SEQ ID NO: 287098 - DNA, 22 bp, Homo sapiens
ttgtgtctccttatggtacact

SEQ ID NO: 287099 - DNA, 13 bp, Homo sapiens
ttgtgtctgcctg

SEQ ID NO: 287100 - DNA, 12 bp, Homo sapiens
ttgtgtctgttg

SEQ ID NO: 287101 - DNA, 13 bp, Homo sapiens
ttgtgtgattgaa

SEQ ID NO: 287102 - DNA, 14 bp, Homo sapiens
ttgtgttcaatctg

SEQ ID NO: 287103 - DNA, 20 bp, Homo sapiens
ttgtgttctgtttgttaaaa

SEQ ID NO: 287104 - DNA, 13 bp, Homo sapiens
ttgtgttgtttga

SEQ ID NO: 287105 - DNA, 14 bp, Homo sapiens
ttgtgtttgaaaca

SEQ ID NO: 287106 - DNA, 20 bp, Homo sapiens
ttgtgtttgcttaaacaaag

SEQ ID NO: 287107 - DNA, 12 bp, Homo sapiens
ttgtgtttgtat

SEQ ID NO: 287108 - DNA, 16 bp, Homo sapiens
ttgtgtttgtatataa

SEQ ID NO: 287109 - DNA, 18 bp, Homo sapiens
ttgttaaatttagcagcc

SEQ ID NO: 287110 - DNA, 12 bp, Homo sapiens
ttgttaagctca

SEQ ID NO: 287111 - DNA, 14 bp, Homo sapiens
ttgttaagtgcttt

SEQ ID NO: 287112 - DNA, 17 bp, Homo sapiens
ttgttaatattaattta

SEQ ID NO: 287113 - DNA, 13 bp, Homo sapiens
ttgttacaatttt

SEQ ID NO: 287114 - DNA, 21 bp, Homo sapiens
ttgttacaggcaccgagaatg

SEQ ID NO: 287115 - DNA, 22 bp, Homo sapiens
ttgttaggggtgggggagaatg

SEQ ID NO: 287116 - DNA, 20 bp, Homo sapiens
ttgttagtgtgtcttagtgt

SEQ ID NO: 287117 - DNA, 16 bp, Homo sapiens
ttgttatacttcaaaa

SEQ ID NO: 287118 - DNA, 17 bp, Homo sapiens
ttgttatatatatcaag

SEQ ID NO: 287119 - DNA, 18 bp, Homo sapiens
ttgttatatcagcagaca

SEQ ID NO: 287120 - DNA, 14 bp, Homo sapiens
ttgttattgtggaa

SEQ ID NO: 287121 - DNA, 17 bp, Homo sapiens
ttgttattttattgcct

SEQ ID NO: 287122 - DNA, 22 bp, Homo sapiens
ttgttcaaagaacccccctccc

SEQ ID NO: 287123 - DNA, 12 bp, Homo sapiens
ttgttcatatca

SEQ ID NO: 287124 - DNA, 20 bp, Homo sapiens
ttgttcatatcaagaaattg

SEQ ID NO: 287125 - DNA, 11 bp, Homo sapiens
ttgttcctgat

SEQ ID NO: 287126 - DNA, 14 bp, Homo sapiens
ttgttcctgctttc

SEQ ID NO: 287127 - DNA, 15 bp, Homo sapiens
ttgttccttcctgcg

SEQ ID NO: 287128 - DNA, 14 bp, Homo sapiens
ttgttcctttttct

SEQ ID NO: 287129 - DNA, 15 bp, Homo sapiens
ttgttctagacttcc

SEQ ID NO: 287130 - DNA, 22 bp, Homo sapiens
ttgttctagacttccccatccc

SEQ ID NO: 287131 - DNA, 17 bp, Homo sapiens
ttgttctctctatggta

SEQ ID NO: 287132 - DNA, 14 bp, Homo sapiens
ttgttctgcagaga

SEQ ID NO: 287133 - DNA, 20 bp, Homo sapiens
ttgttcttgtaaaactgtga

SEQ ID NO: 287134 - DNA, 13 bp, Homo sapiens
ttgttcttgtcat

SEQ ID NO: 287135 - DNA, 17 bp, Homo sapiens
ttgttgacttattttct

SEQ ID NO: 287136 - DNA, 14 bp, Homo sapiens
ttgttgaggtggtc

SEQ ID NO: 287137 - DNA, 22 bp, Homo sapiens
ttgttgaggtggtctgaatgtt

SEQ ID NO: 287138 - DNA, 19 bp, Homo sapiens
ttgttgatattggttctat

SEQ ID NO: 287139 - DNA, 21 bp, Homo sapiens
ttgttgccaggttgcagctgc

SEQ ID NO: 287140 - DNA, 13 bp, Homo sapiens
ttgttgcccaggc

SEQ ID NO: 287141 - DNA, 20 bp, Homo sapiens
ttgttgctcagcaaggggct

SEQ ID NO: 287142 - DNA, 14 bp, Homo sapiens
ttgttgctgctttg

SEQ ID NO: 287143 - DNA, 15 bp, Homo sapiens
ttgttggagcctgca

SEQ ID NO: 287144 - DNA, 20 bp, Homo sapiens
ttgttggatcttcaatggct

SEQ ID NO: 287145 - DNA, 18 bp, Homo sapiens
ttgttggcccttccagtg

SEQ ID NO: 287146 - DNA, 18 bp, Homo sapiens
ttgttggcctccggcctc

SEQ ID NO: 287147 - DNA, 14 bp, Homo sapiens
ttgttggtcagagg

SEQ ID NO: 287148 - DNA, 17 bp, Homo sapiens
ttgttgtattcctgcct

SEQ ID NO: 287149 - DNA, 15 bp, Homo sapiens
ttgttgttgttttat

SEQ ID NO: 287150 - DNA, 13 bp, Homo sapiens
ttgtttaaaagca

SEQ ID NO: 287151 - DNA, 16 bp, Homo sapiens
ttgtttaaagaataaa

SEQ ID NO: 287152 - DNA, 12 bp, Homo sapiens
ttgtttaaagtt

SEQ ID NO: 287153 - DNA, 21 bp, Homo sapiens
ttgtttacagcactactctgt

SEQ ID NO: 287154 - DNA, 20 bp, Homo sapiens
ttgtttacatgagttcaaat

SEQ ID NO: 287155 - DNA, 12 bp, Homo sapiens
ttgtttccctgc

SEQ ID NO: 287156 - DNA, 12 bp, Homo sapiens
ttgtttctatac

SEQ ID NO: 287157 - DNA, 17 bp, Homo sapiens
ttgtttctggtgactgc

SEQ ID NO: 287158 - DNA, 19 bp, Homo sapiens
ttgtttcttccaaagcaca

SEQ ID NO: 287159 - DNA, 20 bp, Homo sapiens
ttgtttgagcgcagagtaaa

SEQ ID NO: 287160 - DNA, 18 bp, Homo sapiens
ttgtttggcaatgcactg

SEQ ID NO: 287161 - DNA, 22 bp, Homo sapiens
ttgtttgtaaataagagatttg

SEQ ID NO: 287162 - DNA, 13 bp, Homo sapiens
ttgtttgtcttta

SEQ ID NO: 287163 - DNA, 14 bp, Homo sapiens
ttgtttgtgtgaaa

SEQ ID NO: 287164 - DNA, 16 bp, Homo sapiens
ttgttttatatacctg

SEQ ID NO: 287165 - DNA, 12 bp, Homo sapiens
ttgttttattca

SEQ ID NO: 287166 - DNA, 22 bp, Homo sapiens
ttgttttattcaccatcatgta

SEQ ID NO: 287167 - DNA, 19 bp, Homo sapiens
ttgttttgacggatgattg

SEQ ID NO: 287168 - DNA, 23 bp, Homo sapiens
ttgttttgatgtttgtggcctca

SEQ ID NO: 287169 - DNA, 15 bp, Homo sapiens
ttgttttgcactttt

SEQ ID NO: 287170 - DNA, 22 bp, Homo sapiens
ttgtttttaacaactaatcaag

SEQ ID NO: 287171 - DNA, 17 bp, Homo sapiens
ttgtttttccatgtgtt

SEQ ID NO: 287172 - DNA, 19 bp, Homo sapiens
tttatttaatttcataaat

SEQ ID NO: 287173 - DNA, 15 bp, Homo sapiens
tttatttatcagtga

SEQ ID NO: 287174 - DNA, 20 bp, Homo sapiens
tttatttctaagtatttaaa

SEQ ID NO: 287175 - DNA, 12 bp, Homo sapiens
tttatttctgtc

SEQ ID NO: 287176 - DNA, 21 bp, Homo sapiens
tttattttatataataaagta

SEQ ID NO: 287177 - DNA, 16 bp, Homo sapiens
tttattttattattca

SEQ ID NO: 287178 - DNA, 21 bp, Homo sapiens
tttattttcagtatactgtgt

SEQ ID NO: 287179 - DNA, 14 bp, Homo sapiens
tttattttcctgtg

SEQ ID NO: 287180 - DNA, 18 bp, Homo sapiens
tttattttgtatttttga

SEQ ID NO: 287181 - DNA, 17 bp, Homo sapiens
tttatttttgtactgtg

SEQ ID NO: 287182 - DNA, 17 bp, Homo sapiens
tttatttttttattctt

SEQ ID NO: 287183 - DNA, 12 bp, Homo sapiens
tttcaaaactag

SEQ ID NO: 287184 - DNA, 18 bp, Homo sapiens
tttcaaacagcatcaaaa

SEQ ID NO: 287185 - DNA, 19 bp, Homo sapiens
tttcaaacagcatcaaaat

SEQ ID NO: 287186 - DNA, 23 bp, Homo sapiens
tttcaaacagcatcaaaatacaa

SEQ ID NO: 287187 - DNA, 15 bp, Homo sapiens
tttcaaagtacataa

SEQ ID NO: 287188 - DNA, 11 bp, Homo sapiens
tttcaaatgag

SEQ ID NO: 287189 - DNA, 20 bp, Homo sapiens
tttcaaatgagtttaaaaaa

SEQ ID NO: 287190 - DNA, 14 bp, Homo sapiens
tttcaaatttcaca

SEQ ID NO: 287191 - DNA, 22 bp, Homo sapiens
tttcaacataattatgggaaca

SEQ ID NO: 287192 - DNA, 20 bp, Homo sapiens
tttcaacgcagccctgcttt

SEQ ID NO: 287193 - DNA, 21 bp, Homo sapiens
tttcaagacagcctaatgaag

SEQ ID NO: 287194 - DNA, 17 bp, Homo sapiens
tttcaagtgttttcaca

SEQ ID NO: 287195 - DNA, 22 bp, Homo sapiens
tttcaataaagaaaaaaatagt

SEQ ID NO: 287196 - DNA, 15 bp, Homo sapiens
tttcccaattaggaa

SEQ ID NO: 287197 - DNA, 16 bp, Homo sapiens
tttcccacacatattc

SEQ ID NO: 287198 - DNA, 15 bp, Homo sapiens
tttcccacagtctct

SEQ ID NO: 287199 - DNA, 12 bp, Homo sapiens
tttcccagccct

SEQ ID NO: 287200 - DNA, 22 bp, Homo sapiens
tttcccagccctttccagggca

SEQ ID NO: 287201 - DNA, 16 bp, Homo sapiens
tttcccatcacccctt

SEQ ID NO: 287202 - DNA, 17 bp, Homo sapiens
tttcccatttcgtgtaa

SEQ ID NO: 287203 - DNA, 19 bp, Homo sapiens
tttccccaattatcctcct

SEQ ID NO: 287204 - DNA, 22 bp, Homo sapiens
tttccccagaggctcccaatca

SEQ ID NO: 287205 - DNA, 13 bp, Homo sapiens
tttcccctccctg

SEQ ID NO: 287206 - DNA, 21 bp, Homo sapiens
tttcccgagcaaagtctaaag

SEQ ID NO: 287207 - DNA, 13 bp, Homo sapiens
tttccctaaaata

SEQ ID NO: 287208 - DNA, 19 bp, Homo sapiens
tttccctaaaatacattta

SEQ ID NO: 287209 - DNA, 17 bp, Homo sapiens
tttccctagaaagccat

SEQ ID NO: 287210 - DNA, 22 bp, Homo sapiens
tttccctagaaagccatattcc

SEQ ID NO: 287211 - DNA, 23 bp, Homo sapiens
tttccctagaaagccatattcca

SEQ ID NO: 287212 - DNA, 18 bp, Homo sapiens
tttccctagactctgtaa

SEQ ID NO: 287213 - DNA, 13 bp, Homo sapiens
tttccctctctag

SEQ ID NO: 287214 - DNA, 15 bp, Homo sapiens
tttgctatttgcttt

SEQ ID NO: 287215 - DNA, 23 bp, Homo sapiens
tttgctcacacggggtattttag

SEQ ID NO: 287216 - DNA, 15 bp, Homo sapiens
tttgctgaattcctt

SEQ ID NO: 287217 - DNA, 17 bp, Homo sapiens
tttgctgctatgaaaat

SEQ ID NO: 287218 - DNA, 19 bp, Homo sapiens
tttgctggagtgctggctc

SEQ ID NO: 287219 - DNA, 24 bp, Homo sapiens
tttgctgtaggttttttatagcta

SEQ ID NO: 287220 - DNA, 12 bp, Homo sapiens
tttgctgtgcca

SEQ ID NO: 287221 - DNA, 10 bp, Homo sapiens
tttgctgttt

SEQ ID NO: 287222 - DNA, 14 bp, Homo sapiens
tttgcttaaacaaa

SEQ ID NO: 287223 - DNA, 17 bp, Homo sapiens
tttgcttatttatattc

SEQ ID NO: 287224 - DNA, 15 bp, Homo sapiens
tttgcttcaaaaaca

SEQ ID NO: 287225 - DNA, 21 bp, Homo sapiens
tttgcttccttgcttttatgt

SEQ ID NO: 287226 - DNA, 20 bp, Homo sapiens
ttttctattccttctggcct

SEQ ID NO: 287227 - DNA, 15 bp, Homo sapiens
ttttctcaaaagcat

SEQ ID NO: 287228 - DNA, 13 bp, Homo sapiens
ttttctcaaataa

SEQ ID NO: 287229 - DNA, 20 bp, Homo sapiens
ttttctctatacatagagct

SEQ ID NO: 287230 - DNA, 22 bp, Homo sapiens
ttttctcttgggctgagactgg

SEQ ID NO: 287231 - DNA, 22 bp, Homo sapiens
ttttctgcccaactttcattgg

SEQ ID NO: 287232 - DNA, 12 bp, Homo sapiens
ttttctgctctg

SEQ ID NO: 287233 - DNA, 18 bp, Homo sapiens
ttttctggaatgtaatca

SEQ ID NO: 287234 - DNA, 16 bp, Homo sapiens
ttttctgttccctgct

SEQ ID NO: 287235 - DNA, 22 bp, Homo sapiens
ttttcttcaacatcaatgttca

SEQ ID NO: 287236 - DNA, 20 bp, Homo sapiens
ttttcttcccatttgtaatg

SEQ ID NO: 287237 - DNA, 15 bp, Homo sapiens
ttttcttccccctcc

SEQ ID NO: 287238 - DNA, 15 bp, Homo sapiens
ttttcttcttccctc

SEQ ID NO: 287239 - DNA, 18 bp, Homo sapiens
ttttctttaatcaaaagt

SEQ ID NO: 287240 - DNA, 17 bp, Homo sapiens
ttttctttgaatgcttt

SEQ ID NO: 287241 - DNA, 16 bp, Homo sapiens
ttttcttttatatctg

SEQ ID NO: 287242 - DNA, 15 bp, Homo sapiens
ttttgaaaacactta

SEQ ID NO: 287243 - DNA, 16 bp, Homo sapiens
ttttgaaatttaaaaa

SEQ ID NO: 287244 - DNA, 19 bp, Homo sapiens
ttttgaagtagtttgtata

SEQ ID NO: 287245 - DNA, 22 bp, Homo sapiens
ttttgaataaaaaacatttgta

SEQ ID NO: 287246 - DNA, 16 bp, Homo sapiens
ttttgaataatgtagt

SEQ ID NO: 287247 - DNA, 18 bp, Homo sapiens
ttttgaatgcttcctgac

SEQ ID NO: 287248 - DNA, 14 bp, Homo sapiens
ttttgaatgttatt

SEQ ID NO: 287249 - DNA, 15 bp, Homo sapiens
ttttgaatttaaata

SEQ ID NO: 287250 - DNA, 18 bp, Homo sapiens
ttttgaatttaaataaag

SEQ ID NO: 287251 - DNA, 20 bp, Homo sapiens
ttttgaatttaaataaagtt

SEQ ID NO: 287252 - DNA, 17 bp, Homo sapiens
ttttgacttaaagcaga

SEQ ID NO: 287253 - DNA, 17 bp, Homo sapiens
ttttgagtgccttacac

SEQ ID NO: 287254 - DNA, 15 bp, Homo sapiens
ttttgatagctttat

SEQ ID NO: 287255 - DNA, 22 bp, Homo sapiens
ttttgatcctgtaatcacaact

SEQ ID NO: 287256 - DNA, 13 bp, Homo sapiens
ttttgatgcacaa

SEQ ID NO: 287257 - DNA, 18 bp, Homo sapiens
ttttgatgccatttgtct

SEQ ID NO: 287258 - DNA, 15 bp, Homo sapiens
ttttgatgtttgtgg

SEQ ID NO: 287259 - DNA, 19 bp, Homo sapiens
ttttgattaatgtttctta

SEQ ID NO: 287260 - DNA, 17 bp, Homo sapiens
ttttgcaatggctatat

SEQ ID NO: 287261 - DNA, 14 bp, Homo sapiens
ttttgcagcagtga

SEQ ID NO: 287262 - DNA, 19 bp, Homo sapiens
ttttgcagcttccttccaa

SEQ ID NO: 287263 - DNA, 15 bp, Homo sapiens
ttttgcatgtctgca

SEQ ID NO: 287264 - DNA, 20 bp, Homo sapiens
ttttgccatacatcagttat

SEQ ID NO: 287265 - DNA, 15 bp, Homo sapiens
ttttgcctcttttct

SEQ ID NO: 287266 - DNA, 14 bp, Homo sapiens
ttttgcctggctgt

SEQ ID NO: 287267 - DNA, 13 bp, Homo sapiens
ttttggaggtgct

SEQ ID NO: 287268 - DNA, 11 bp, Homo sapiens
ttttggatgcc

SEQ ID NO: 287269 - DNA, 19 bp, Homo sapiens
ttttggcactgagatattt

SEQ ID NO: 287270 - DNA, 13 bp, Homo sapiens
ttttggcctgcct

SEQ ID NO: 287271 - DNA, 17 bp, Homo sapiens
ttttggcgctattacaa

SEQ ID NO: 287272 - DNA, 19 bp, Homo sapiens
ttttggcgctattacaaat

SEQ ID NO: 287273 - DNA, 21 bp, Homo sapiens
ttttgggaaatgctgatttaa

SEQ ID NO: 287274 - DNA, 21 bp, Homo sapiens
ttttggggaactgttgtttga

SEQ ID NO: 287275 - DNA, 23 bp, Homo sapiens
ttttggtattacactgtatttgt

SEQ ID NO: 287276 - DNA, 19 bp, Homo sapiens
ttttggtgatgtaaaacag

SEQ ID NO: 287277 - DNA, 16 bp, Homo sapiens
ttttggttgtttgctg

SEQ ID NO: 287278 - DNA, 20 bp, Homo sapiens
ttttgtacaaagtaaaaata

SEQ ID NO: 287279 - DNA, 19 bp, Homo sapiens
ttttgtacaattactaaat

SEQ ID NO: 287280 - DNA, 18 bp, Homo sapiens
ttttgtacatcgcttctt

SEQ ID NO: 287281 - DNA, 19 bp, Homo sapiens
ttttgtacatcgcttcttt

SEQ ID NO: 287282 - DNA, 12 bp, Homo sapiens
ttttgtactgtg

SEQ ID NO: 287283 - DNA, 13 bp, Homo sapiens
ttttgtactgtgc

SEQ ID NO: 287284 - DNA, 16 bp, Homo sapiens
ttttgtactgtgctga

SEQ ID NO: 287285 - DNA, 21 bp, Homo sapiens
ttttgtagtagttgatgacca

SEQ ID NO: 287286 - DNA, 14 bp, Homo sapiens
ttttgtatcaaact

SEQ ID NO: 287287 - DNA, 17 bp, Homo sapiens
ttttgtatgaagtactt

SEQ ID NO: 287288 - DNA, 21 bp, Homo sapiens
ttttgtatgaagtacttttaa

SEQ ID NO: 287289 - DNA, 20 bp, Homo sapiens
ttttgtattacatctaatgc

SEQ ID NO: 287290 - DNA, 19 bp, Homo sapiens
ttttgtcacagctcttgtt

SEQ ID NO: 287291 - DNA, 15 bp, Homo sapiens
ttttgtctaattaaa

SEQ ID NO: 287292 - DNA, 13 bp, Homo sapiens
ttttgtcttatat

SEQ ID NO: 287293 - DNA, 16 bp, Homo sapiens
ttttgtgatttagaac

SEQ ID NO: 287294 - DNA, 22 bp, Homo sapiens
ttttgtggttctattttacttt

SEQ ID NO: 287295 - DNA, 18 bp, Homo sapiens
ttttgtgtacagtatgtg

SEQ ID NO: 287296 - DNA, 20 bp, Homo sapiens
ttttgtgtatccagtatgca

SEQ ID NO: 287297 - DNA, 16 bp, Homo sapiens
ttttgtgtattctgtg

SEQ ID NO: 287298 - DNA, 18 bp, Homo sapiens
ttttgtgtcttaagaaaa

SEQ ID NO: 287299 - DNA, 13 bp, Homo sapiens
ttttgtgtgtata

SEQ ID NO: 287300 - DNA, 15 bp, Homo sapiens
ttttgtgtttctaaa

SEQ ID NO: 287301 - DNA, 16 bp, Homo sapiens
ttttgttatagaatac

SEQ ID NO: 287302 - DNA, 21 bp, Homo sapiens
ttttgttccacaagttaaata

SEQ ID NO: 287303 - DNA, 15 bp, Homo sapiens
ttttgtttcttggtg

SEQ ID NO: 287304 - DNA, 17 bp, Homo sapiens
ttttgtttttacttttg

SEQ ID NO: 287305 - DNA, 19 bp, Homo sapiens
ttttgtttttgtaaaaaag

SEQ ID NO: 287306 - DNA, 19 bp, Homo sapiens
tttttaaaaagttgcacat

SEQ ID NO: 287307 - DNA, 22 bp, Homo sapiens
tttttaaaaataaatctaaatg

SEQ ID NO: 287308 - DNA, 19 bp, Homo sapiens
tttttaaaagtttcaatgt

SEQ ID NO: 287309 - DNA, 12 bp, Homo sapiens
tttttaaaatat

SEQ ID NO: 287310 - DNA, 12 bp, Homo sapiens
tttttaaagaaa

SEQ ID NO: 287311 - DNA, 16 bp, Homo sapiens
tttttaaagtttaaat

SEQ ID NO: 287312 - DNA, 14 bp, Homo sapiens
tttttaaatatatt

SEQ ID NO: 287313 - DNA, 13 bp, Homo sapiens
tttttaaatcatt

SEQ ID NO: 287314 - DNA, 16 bp, Homo sapiens
tttttaaatgattcca

SEQ ID NO: 287315 - DNA, 23 bp, Homo sapiens
tttttaactgattcttatgatta

SEQ ID NO: 287316 - DNA, 16 bp, Homo sapiens
tttttaagaatttatt

SEQ ID NO: 287317 - DNA, 14 bp, Homo sapiens
tttttaagctgtaa

SEQ ID NO: 287318 - DNA, 16 bp, Homo sapiens
tttttaaggtgagttc

SEQ ID NO: 287319 - DNA, 13 bp, Homo sapiens
tttttaagttcaa

SEQ ID NO: 287320 - DNA, 16 bp, Homo sapiens
tttttaagttcaattg

SEQ ID NO: 287321 - DNA, 20 bp, Homo sapiens
tttttaataaagacagggtt

SEQ ID NO: 287322 - DNA, 13 bp, Homo sapiens
tttttaatagaat

SEQ ID NO: 287323 - DNA, 23 bp, Homo sapiens
tttttaatagtcattccaaatat

SEQ ID NO: 287324 - DNA, 12 bp, Homo sapiens
tttttaattatt

SEQ ID NO: 287325 - DNA, 13 bp, Homo sapiens
tttttacaataaa

SEQ ID NO: 287326 - DNA, 12 bp, Homo sapiens
tttttacagtgt

SEQ ID NO: 287327 - DNA, 14 bp, Homo sapiens
tttttacagtgtat

SEQ ID NO: 287328 - DNA, 22 bp, Homo sapiens
tttttacctaccacagtgtctg

SEQ ID NO: 287329 - DNA, 15 bp, Homo sapiens
tttttactaaagcag

SEQ ID NO: 287330 - DNA, 17 bp, Homo sapiens
tttttactaaagcagtg

SEQ ID NO: 287331 - DNA, 14 bp, Homo sapiens
tttttactgaacaa

SEQ ID NO: 287332 - DNA, 14 bp, Homo sapiens
tttttagattccta

SEQ ID NO: 287333 - DNA, 12 bp, Homo sapiens
tttttagttgaa

SEQ ID NO: 287334 - DNA, 15 bp, Homo sapiens
tttttagttgaattt

SEQ ID NO: 287335 - DNA, 22 bp, Homo sapiens
tttttatattacttttgtaaat

SEQ ID NO: 287336 - DNA, 14 bp, Homo sapiens
tttttatttctaag

SEQ ID NO: 287337 - DNA, 20 bp, Homo sapiens
tttttcacctgaaacacttt

SEQ ID NO: 287338 - DNA, 15 bp, Homo sapiens
tttttcattttctct

SEQ ID NO: 287339 - DNA, 21 bp, Homo sapiens
tttttccacaaggaataaatg

SEQ ID NO: 287340 - DNA, 15 bp, Homo sapiens
tttttccagaattga

SEQ ID NO: 287341 - DNA, 22 bp, Homo sapiens
tttttcctatgaccataaaatt

SEQ ID NO: 287342 - DNA, 11 bp, Homo sapiens
tttttcctttt

SEQ ID NO: 287343 - DNA, 17 bp, Homo sapiens
tttttcgtttgtttgtt

SEQ ID NO: 287344 - DNA, 14 bp, Homo sapiens
tttttctcaaataa

SEQ ID NO: 287345 - DNA, 18 bp, Homo sapiens
tttttctcttctgtccat

SEQ ID NO: 287346 - DNA, 22 bp, Homo sapiens
tttttctcttctgtccatcagt

SEQ ID NO: 287347 - DNA, 20 bp, Homo sapiens
tttttctctttttcttgtaa

SEQ ID NO: 287348 - DNA, 14 bp, Homo sapiens
tttttctttaagat

SEQ ID NO: 287349 - DNA, 15 bp, Homo sapiens
tttttgaaacagcag

SEQ ID NO: 287350 - DNA, 21 bp, Homo sapiens
tttttgaagaagggaaattca

SEQ ID NO: 287351 - DNA, 12 bp, Homo sapiens
tttttgaataaa

SEQ ID NO: 287352 - DNA, 15 bp, Homo sapiens
tttttgaatttaaat

SEQ ID NO: 287353 - DNA, 21 bp, Homo sapiens
tttttgaatttaaataaagtt

SEQ ID NO: 287354 - DNA, 17 bp, Homo sapiens
tttttgttgtgttctgt

SEQ ID NO: 287355 - DNA, 14 bp, Homo sapiens
ttttttaatatact

SEQ ID NO: 287356 - DNA, 13 bp, Homo sapiens
ttttttagaacag

SEQ ID NO: 287357 - DNA, 12 bp, Homo sapiens
ttttttcatagt

SEQ ID NO: 287358 - DNA, 23 bp, Homo sapiens
ttttttcatccctgccaagaact

SEQ ID NO: 287359 - DNA, 13 bp, Homo sapiens
ttttttccactta

SEQ ID NO: 287360 - DNA, 13 bp, Homo sapiens
ttttttcgtttgt

SEQ ID NO: 287361 - DNA, 13 bp, Homo sapiens
ttttttcttcccc

SEQ ID NO: 287362 - DNA, 12 bp, Homo sapiens
ttttttcttggt

SEQ ID NO: 287363 - DNA, 9 bp, Homo sapiens
ttttttgaa

SEQ ID NO: 287364 - DNA, 13 bp, Homo sapiens
ttttttgaaagtg

SEQ ID NO: 287365 - DNA, 15 bp, Homo sapiens
ttttttgatggctaa

SEQ ID NO: 287366 - DNA, 16 bp, Homo sapiens
ttttttgctatggaag

SEQ ID NO: 287367 - DNA, 12 bp, Homo sapiens
ttttttgtattt

SEQ ID NO: 287368 - DNA, 13 bp, Homo sapiens
tttttttaagggc

SEQ ID NO: 287369 - DNA, 11 bp, Homo sapiens
cccaagctggc

SEQ ID NO: 287370 - DNA, 14 bp, Homo sapiens
cccaagcttggcag

SEQ ID NO: 287371 - DNA, 12 bp, Homo sapiens
cccaaggagctg

SEQ ID NO: 287372 - DNA, 19 bp, Homo sapiens
cccaagggcctcccaccag

SEQ ID NO: 287373 - DNA, 15 bp, Homo sapiens
cccaaggggcagtct

SEQ ID NO: 287374 - DNA, 21 bp, Homo sapiens
cccaaggggcagtctggaggg

SEQ ID NO: 287375 - DNA, 16 bp, Homo sapiens
cccaaggtcacatagc

SEQ ID NO: 287376 - DNA, 15 bp, Homo sapiens
cccaaggtcccctcc

SEQ ID NO: 287377 - DNA, 21 bp, Homo sapiens
cccaaggtggtcttggagagg

SEQ ID NO: 287378 - DNA, 20 bp, Homo sapiens
tgccccccttcccaccccta

SEQ ID NO: 287379 - DNA, 15 bp, Homo sapiens
tgcccccgccctgct

SEQ ID NO: 287380 - DNA, 21 bp, Homo sapiens
tgcccccgcgggttctagacg

SEQ ID NO: 287381 - DNA, 19 bp, Homo sapiens
tgcccccgttccagctgac

SEQ ID NO: 287382 - DNA, 21 bp, Homo sapiens
tgccccctaatccccttctcc

SEQ ID NO: 287383 - DNA, 11 bp, Homo sapiens
ttttaaaagca

SEQ ID NO: 287384 - DNA, 19 bp, Homo sapiens
ttttaaaagtttcaatgtg

SEQ ID NO: 287385 - DNA, 20 bp, Homo sapiens
ttttaaacaaaatagaagct

SEQ ID NO: 287386 - DNA, 17 bp, Homo sapiens
ttttaaagaaaatgtgt

SEQ ID NO: 287387 - DNA, 23 bp, Homo sapiens
aaaataatctggtgttcttgcta

SEQ ID NO: 287388 - DNA, 15 bp, Homo sapiens
aaaatacaacttcat

SEQ ID NO: 287389 - DNA, 14 bp, Homo sapiens
aaaataccaaggaa

SEQ ID NO: 287390 - DNA, 15 bp, Homo sapiens
aaaatactattggac

SEQ ID NO: 287391 - DNA, 22 bp, Homo sapiens
aaaatactattggacagacaca

SEQ ID NO: 287392 - DNA, 15 bp, Homo sapiens
aaaatactcaccaaa

SEQ ID NO: 287393 - DNA, 22 bp, Homo sapiens
aaaatactgcttttgcaaacag

SEQ ID NO: 287394 - DNA, 21 bp, Homo sapiens
aaaatacttctttttcattat

SEQ ID NO: 287395 - DNA, 17 bp, Homo sapiens
aaaatagagatgagctt

SEQ ID NO: 287396 - DNA, 16 bp, Homo sapiens
aaaatagagcttttaa

SEQ ID NO: 287397 - DNA, 15 bp, Homo sapiens
aaaatagcaatgcct

SEQ ID NO: 287398 - DNA, 21 bp, Homo sapiens
aaaatagcttgtatagtgtaa

SEQ ID NO: 287399 - DNA, 16 bp, Homo sapiens
aaaatagggtccttga

SEQ ID NO: 287400 - DNA, 20 bp, Homo sapiens
aaaatagggtccttgaaaca

SEQ ID NO: 287401 - DNA, 18 bp, Homo sapiens
aaaatagggtggacagaa

SEQ ID NO: 287402 - DNA, 19 bp, Homo sapiens
aaaatagttctatttctat

SEQ ID NO: 287403 - DNA, 13 bp, Homo sapiens
aaaatataaatta

SEQ ID NO: 287404 - DNA, 10 bp, Homo sapiens
aaaatataag

SEQ ID NO: 287405 - DNA, 21 bp, Homo sapiens
aaaatatagttaattgtggct

SEQ ID NO: 287406 - DNA, 20 bp, Homo sapiens
aaaatatatatgtatataaa

SEQ ID NO: 287407 - DNA, 14 bp, Homo sapiens
aaaatatatattgt

SEQ ID NO: 287408 - DNA, 13 bp, Homo sapiens
aaaatatcattca

SEQ ID NO: 287409 - DNA, 13 bp, Homo sapiens
aaaatatcttagg

SEQ ID NO: 287410 - DNA, 19 bp, Homo sapiens
aaaatatgagattggaaaa

SEQ ID NO: 287411 - DNA, 16 bp, Homo sapiens
aaaatatggaacttct

SEQ ID NO: 287412 - DNA, 20 bp, Homo sapiens
aaaatatggaacttctaata

SEQ ID NO: 287413 - DNA, 15 bp, Homo sapiens
aaaatatggtttggt

SEQ ID NO: 287414 - DNA, 11 bp, Homo sapiens
aaaatattatc

SEQ ID NO: 287415 - DNA, 15 bp, Homo sapiens
aaaacaagtttgcta

SEQ ID NO: 287416 - DNA, 17 bp, Homo sapiens
aaaacaatatttattgt

SEQ ID NO: 287417 - DNA, 20 bp, Homo sapiens
aaaacaatatttattgtatt

SEQ ID NO: 287418 - DNA, 13 bp, Homo sapiens
aaaacaatgaatt

SEQ ID NO: 287419 - DNA, 20 bp, Homo sapiens
aaaacaattgttctgggtga

SEQ ID NO: 287420 - DNA, 21 bp, Homo sapiens
aaaacaccaccaaatgacaag

SEQ ID NO: 287421 - DNA, 14 bp, Homo sapiens
aaaacactttcctg

SEQ ID NO: 287422 - DNA, 16 bp, Homo sapiens
aaaacactttcctgga

SEQ ID NO: 287423 - DNA, 15 bp, Homo sapiens
aaaacagaacatttc

SEQ ID NO: 287424 - DNA, 20 bp, Homo sapiens
aaaacagaacgggttctccc

SEQ ID NO: 287425 - DNA, 17 bp, Homo sapiens
aaaacataatagaattt

SEQ ID NO: 287426 - DNA, 14 bp, Homo sapiens
aaaacataatatct

SEQ ID NO: 287427 - DNA, 13 bp, Homo sapiens
aaaacatatattt

SEQ ID NO: 287428 - DNA, 14 bp, Homo sapiens
aaaacatatatttt

SEQ ID NO: 287429 - DNA, 16 bp, Homo sapiens
aaaacatatattttat

SEQ ID NO: 287430 - DNA, 12 bp, Homo sapiens
aaaacatgtaaa

SEQ ID NO: 287431 - DNA, 23 bp, Homo sapiens
aaaacattagaagaaaacatata

SEQ ID NO: 287432 - DNA, 21 bp, Homo sapiens
aaaacattccgtttacatttt

SEQ ID NO: 287433 - DNA, 22 bp, Homo sapiens
aaaacattccgtttacatttta

SEQ ID NO: 287434 - DNA, 18 bp, Homo sapiens
aaaacattttaaaatcaa

SEQ ID NO: 287435 - DNA, 13 bp, Homo sapiens
aaaaccacagata

SEQ ID NO: 287436 - DNA, 19 bp, Homo sapiens
aaaaccacagccctgtcag

SEQ ID NO: 287437 - DNA, 18 bp, Homo sapiens
aaaaccactatgcaaaga

SEQ ID NO: 287438 - DNA, 19 bp, Homo sapiens
aaaaccagtcttctccctg

SEQ ID NO: 287439 - DNA, 17 bp, Homo sapiens
aaaaccagttttgctgc

SEQ ID NO: 287440 - DNA, 18 bp, Homo sapiens
aaaaccatctggcctggc

SEQ ID NO: 287441 - DNA, 20 bp, Homo sapiens
aaacaggaaaaaaactttta

SEQ ID NO: 287442 - DNA, 17 bp, Homo sapiens
aaacaggagacaggaag

SEQ ID NO: 287443 - DNA, 18 bp, Homo sapiens
aaacaggagacaggaagg

SEQ ID NO: 287444 - DNA, 21 bp, Homo sapiens
aaacaggcagttggccagaga

SEQ ID NO: 287445 - DNA, 17 bp, Homo sapiens
aaacagggcatctccag

SEQ ID NO: 287446 - DNA, 19 bp, Homo sapiens
aaacagggggaaaatgttt

SEQ ID NO: 287447 - DNA, 18 bp, Homo sapiens
aaacagtgggagccctga

SEQ ID NO: 287448 - DNA, 23 bp, Homo sapiens
aaacagtgtggcttaaacatttt

SEQ ID NO: 287449 - DNA, 23 bp, Homo sapiens
aaacagttaactttcagaagaga

SEQ ID NO: 287450 - DNA, 22 bp, Homo sapiens
aaacagttaagacaacaggcat

SEQ ID NO: 287451 - DNA, 16 bp, Homo sapiens
aaacagttcttggacc

SEQ ID NO: 287452 - DNA, 14 bp, Homo sapiens
aaacataaaaatca

SEQ ID NO: 287453 - DNA, 15 bp, Homo sapiens
aaacataatagaatt

SEQ ID NO: 287454 - DNA, 22 bp, Homo sapiens
aaacatagagtagacctgagat

SEQ ID NO: 287455 - DNA, 18 bp, Homo sapiens
aaacatcagacctgtctt

SEQ ID NO: 287456 - DNA, 16 bp, Homo sapiens
aaacatgaaaacattg

SEQ ID NO: 287457 - DNA, 17 bp, Homo sapiens
aaacatgaatttaatgt

SEQ ID NO: 287458 - DNA, 23 bp, Homo sapiens
aaacatggccacatccaacattt

SEQ ID NO: 287459 - DNA, 16 bp, Homo sapiens
aaacatgttagaagca

SEQ ID NO: 287460 - DNA, 17 bp, Homo sapiens
aaacatgttagaagcaa

SEQ ID NO: 287461 - DNA, 14 bp, Homo sapiens
aaacattaaaagaa

SEQ ID NO: 287462 - DNA, 21 bp, Homo sapiens
aaacattagaagaaaacatat

SEQ ID NO: 287463 - DNA, 24 bp, Homo sapiens
aaacattagaagaaaacatatatt

SEQ ID NO: 287464 - DNA, 23 bp, Homo sapiens
aaacattcctccagcctcccctc

SEQ ID NO: 287465 - DNA, 14 bp, Homo sapiens
aaacattcttattt

SEQ ID NO: 287466 - DNA, 19 bp, Homo sapiens
aaacattctttaacataca

SEQ ID NO: 287467 - DNA, 16 bp, Homo sapiens
aaacattgaagtaatg

SEQ ID NO: 287468 - DNA, 15 bp, Homo sapiens
aaacattgatgaatg

SEQ ID NO: 287469 - DNA, 15 bp, Homo sapiens
aaacattgcatgtat

SEQ ID NO: 287470 - DNA, 21 bp, Homo sapiens
aaacatttgtacattcctgat

SEQ ID NO: 287471 - DNA, 15 bp, Homo sapiens
aaagtttaaatacca

SEQ ID NO: 287472 - DNA, 21 bp, Homo sapiens
aaagtttaaataccagtactt

SEQ ID NO: 287473 - DNA, 20 bp, Homo sapiens
aaagtttcctaatcagaaat

SEQ ID NO: 287474 - DNA, 16 bp, Homo sapiens
aaagttttaacctcag

SEQ ID NO: 287475 - DNA, 22 bp, Homo sapiens
aaagttttcagattgtaaaggt

SEQ ID NO: 287476 - DNA, 16 bp, Homo sapiens
aaataaaaaagatccc

SEQ ID NO: 287477 - DNA, 18 bp, Homo sapiens
aaataaaaacaaacgttt

SEQ ID NO: 287478 - DNA, 20 bp, Homo sapiens
aaataaaaagtgacacagca

SEQ ID NO: 287479 - DNA, 21 bp, Homo sapiens
aaataaaaagtgacacagcag

SEQ ID NO: 287480 - DNA, 15 bp, Homo sapiens
aaataaaaatggata

SEQ ID NO: 287481 - DNA, 12 bp, Homo sapiens
aaataaaacctt

SEQ ID NO: 287482 - DNA, 18 bp, Homo sapiens
aaataaaacttgagccca

SEQ ID NO: 287483 - DNA, 19 bp, Homo sapiens
aaataaaagcagcatctgc

SEQ ID NO: 287484 - DNA, 12 bp, Homo sapiens
aaataaaagttg

SEQ ID NO: 287485 - DNA, 13 bp, Homo sapiens
aaataaaatttac

SEQ ID NO: 287486 - DNA, 21 bp, Homo sapiens
aaataaacacatagattcacc

SEQ ID NO: 287487 - DNA, 21 bp, Homo sapiens
aaataaaccttgtttctttct

SEQ ID NO: 287488 - DNA, 16 bp, Homo sapiens
aaataaacgaaacatt

SEQ ID NO: 287489 - DNA, 11 bp, Homo sapiens
aaataaactag

SEQ ID NO: 287490 - DNA, 14 bp, Homo sapiens
aaataaactctaaa

SEQ ID NO: 287491 - DNA, 20 bp, Homo sapiens
aaataaactcttcaaggcca

SEQ ID NO: 287492 - DNA, 16 bp, Homo sapiens
aaataaagaagaaaat

SEQ ID NO: 287493 - DNA, 15 bp, Homo sapiens
aaataaagcatctca

SEQ ID NO: 287494 - DNA, 16 bp, Homo sapiens
aaataaataatctcat

SEQ ID NO: 287495 - DNA, 11 bp, Homo sapiens
aaataaatata

SEQ ID NO: 287496 - DNA, 13 bp, Homo sapiens
aaataaatatact

SEQ ID NO: 287497 - DNA, 15 bp, Homo sapiens
aaataaatatactaa

SEQ ID NO: 287498 - DNA, 16 bp, Homo sapiens
aaataaatatactaat

SEQ ID NO: 287499 - DNA, 12 bp, Homo sapiens
aaataaatgtac

SEQ ID NO: 287500 - DNA, 19 bp, Homo sapiens
aaataaattggtgataagt

SEQ ID NO: 287501 - DNA, 12 bp, Homo sapiens
aaataaattgtt

SEQ ID NO: 287502 - DNA, 14 bp, Homo sapiens
aaataaatttctgg

SEQ ID NO: 287503 - DNA, 16 bp, Homo sapiens
aaataaatttctggga

SEQ ID NO: 287504 - DNA, 15 bp, Homo sapiens
aaataacacagagag

SEQ ID NO: 287505 - DNA, 23 bp, Homo sapiens
aaataacacagatattgttataa

SEQ ID NO: 287506 - DNA, 17 bp, Homo sapiens
aaataacatattcttgc

SEQ ID NO: 287507 - DNA, 19 bp, Homo sapiens
aaataacatctgaaaagaa

SEQ ID NO: 287508 - DNA, 15 bp, Homo sapiens
aaataacattgcact

SEQ ID NO: 287509 - DNA, 22 bp, Homo sapiens
aaataaccaggaagcattgctt

SEQ ID NO: 287510 - DNA, 12 bp, Homo sapiens
aaataactgtgc

SEQ ID NO: 287511 - DNA, 15 bp, Homo sapiens
aaataacttcaagca

SEQ ID NO: 287512 - DNA, 16 bp, Homo sapiens
aaataacttcaagcaa

SEQ ID NO: 287513 - DNA, 14 bp, Homo sapiens
aaataagaaaccta

SEQ ID NO: 287514 - DNA, 12 bp, Homo sapiens
aaataagtaaca

SEQ ID NO: 287515 - DNA, 15 bp, Homo sapiens
aaataagtaatatct

SEQ ID NO: 287516 - DNA, 20 bp, Homo sapiens
aaataagtcctaaagtgaag

SEQ ID NO: 287517 - DNA, 13 bp, Homo sapiens
aaataagttaaag

SEQ ID NO: 287518 - DNA, 17 bp, Homo sapiens
aaataagttaaaggcag

SEQ ID NO: 287519 - DNA, 11 bp, Homo sapiens
aaataataaat

SEQ ID NO: 287520 - DNA, 12 bp, Homo sapiens
aaataataaatt

SEQ ID NO: 287521 - DNA, 16 bp, Homo sapiens
aaataataaattgcat

SEQ ID NO: 287522 - DNA, 13 bp, Homo sapiens
aaataatataaat

SEQ ID NO: 287523 - DNA, 14 bp, Homo sapiens
aaataatataaatg

SEQ ID NO: 287524 - DNA, 13 bp, Homo sapiens
aaataatatgcat

SEQ ID NO: 287525 - DNA, 15 bp, Homo sapiens
aaataatattatatt

SEQ ID NO: 287526 - DNA, 14 bp, Homo sapiens
aaataatctggtgt

SEQ ID NO: 287527 - DNA, 22 bp, Homo sapiens
aaataatgatttaagcatttta

SEQ ID NO: 287528 - DNA, 13 bp, Homo sapiens
aaataatttaagc

SEQ ID NO: 287529 - DNA, 16 bp, Homo sapiens
aaataattttacatgt

SEQ ID NO: 287530 - DNA, 14 bp, Homo sapiens
aaataattttatga

SEQ ID NO: 287531 - DNA, 21 bp, Homo sapiens
aaatacaagccaagctagaag

SEQ ID NO: 287532 - DNA, 22 bp, Homo sapiens
aaatacaataaactattggaaa

SEQ ID NO: 287533 - DNA, 22 bp, Homo sapiens
aaatacaccacctcactcctgt

SEQ ID NO: 287534 - DNA, 23 bp, Homo sapiens
aaatacaccacctcactcctgtt

SEQ ID NO: 287535 - DNA, 16 bp, Homo sapiens
aaatacagtattctgt

SEQ ID NO: 287536 - DNA, 22 bp, Homo sapiens
aaatacagttattaaaatgtta

SEQ ID NO: 287537 - DNA, 14 bp, Homo sapiens
aaatacatgcatct

SEQ ID NO: 287538 - DNA, 12 bp, Homo sapiens
aaatacatgtgt

SEQ ID NO: 287539 - DNA, 21 bp, Homo sapiens
aaatacatgtgtggatgtgta

SEQ ID NO: 287540 - DNA, 22 bp, Homo sapiens
aaatacatgtgtggatgtgtaa

SEQ ID NO: 287541 - DNA, 15 bp, Homo sapiens
aaatacattccagtg

SEQ ID NO: 287542 - DNA, 15 bp, Homo sapiens
aaataccaaagcagt

SEQ ID NO: 287543 - DNA, 14 bp, Homo sapiens
aaataccagtactt

SEQ ID NO: 287544 - DNA, 20 bp, Homo sapiens
aaatacctccattaaatggt

SEQ ID NO: 287545 - DNA, 21 bp, Homo sapiens
aaatacgccagaactgcttta

SEQ ID NO: 287546 - DNA, 22 bp, Homo sapiens
aaatactattggacagacacag

SEQ ID NO: 287547 - DNA, 19 bp, Homo sapiens
aaatactcaccaaaatata

SEQ ID NO: 287548 - DNA, 22 bp, Homo sapiens
aaatactgcttttgcaaacaga

SEQ ID NO: 287549 - DNA, 16 bp, Homo sapiens
aaatactggtggcgtc

SEQ ID NO: 287550 - DNA, 14 bp, Homo sapiens
aaatacttaataaa

SEQ ID NO: 287551 - DNA, 18 bp, Homo sapiens
aaatagaaaacaggaaaa

SEQ ID NO: 287552 - DNA, 13 bp, Homo sapiens
aaatagatacttt

SEQ ID NO: 287553 - DNA, 17 bp, Homo sapiens
aaatagatacttttgat

SEQ ID NO: 287554 - DNA, 18 bp, Homo sapiens
aaatagatacttttgata

SEQ ID NO: 287555 - DNA, 16 bp, Homo sapiens
aaatagatttgcaaaa

SEQ ID NO: 287556 - DNA, 14 bp, Homo sapiens
aaatagctaaatgg

SEQ ID NO: 287557 - DNA, 12 bp, Homo sapiens
aaatagctatat

SEQ ID NO: 287558 - DNA, 16 bp, Homo sapiens
aaatagctatatccat

SEQ ID NO: 287559 - DNA, 16 bp, Homo sapiens
aaatagggtccttgaa

SEQ ID NO: 287560 - DNA, 19 bp, Homo sapiens
aaatagggtccttgaaaca

SEQ ID NO: 287561 - DNA, 19 bp, Homo sapiens
aaatagggtggacagaagc

SEQ ID NO: 287562 - DNA, 20 bp, Homo sapiens
aaatagtaggctaaaaacat

SEQ ID NO: 287563 - DNA, 17 bp, Homo sapiens
aaatagtgttcttttta

SEQ ID NO: 287564 - DNA, 21 bp, Homo sapiens
aaatagtgttctttttaaaaa

SEQ ID NO: 287565 - DNA, 20 bp, Homo sapiens
aaatagttattttaatacct

SEQ ID NO: 287566 - DNA, 21 bp, Homo sapiens
aaatagtttcaaatgagttta

SEQ ID NO: 287567 - DNA, 18 bp, Homo sapiens
aaatagttttacattaac

SEQ ID NO: 287568 - DNA, 13 bp, Homo sapiens
aaatataaacaat

SEQ ID NO: 287569 - DNA, 15 bp, Homo sapiens
aaatataaactgtga

SEQ ID NO: 287570 - DNA, 18 bp, Homo sapiens
aaatataacaggtgcttc

SEQ ID NO: 287571 - DNA, 11 bp, Homo sapiens
aaatataattc

SEQ ID NO: 287572 - DNA, 12 bp, Homo sapiens
aaatataattct

SEQ ID NO: 287573 - DNA, 17 bp, Homo sapiens
aaatataattctgtaaa

SEQ ID NO: 287574 - DNA, 18 bp, Homo sapiens
aaatataattctgtaaat

SEQ ID NO: 287575 - DNA, 12 bp, Homo sapiens
aaatatactaat

SEQ ID NO: 287576 - DNA, 15 bp, Homo sapiens
aaatatactaataaa

SEQ ID NO: 287577 - DNA, 21 bp, Homo sapiens
aaatatagttgaacaagattt

SEQ ID NO: 287578 - DNA, 20 bp, Homo sapiens
aaatatataatggtttactg

SEQ ID NO: 287579 - DNA, 16 bp, Homo sapiens
aaatatatatttatca

SEQ ID NO: 287580 - DNA, 9 bp, Homo sapiens
aaatatatg

SEQ ID NO: 287581 - DNA, 12 bp, Homo sapiens
aaatatatgttt

SEQ ID NO: 287582 - DNA, 23 bp, Homo sapiens
aaatatatgtttggctgaaatta

SEQ ID NO: 287583 - DNA, 15 bp, Homo sapiens
aaatatatgttttga

SEQ ID NO: 287584 - DNA, 20 bp, Homo sapiens
aaatatatgttttgagaaaa

SEQ ID NO: 287585 - DNA, 20 bp, Homo sapiens
aaatatattaaaaatataaa

SEQ ID NO: 287586 - DNA, 22 bp, Homo sapiens
aaatatattaaaaatataaaca

SEQ ID NO: 287587 - DNA, 17 bp, Homo sapiens
aaatatattgtatattt

SEQ ID NO: 287588 - DNA, 15 bp, Homo sapiens
aaatatatttaatga

SEQ ID NO: 287589 - DNA, 15 bp, Homo sapiens
aaatatcactttgta

SEQ ID NO: 287590 - DNA, 18 bp, Homo sapiens
aaatatcataatgtaatg

SEQ ID NO: 287591 - DNA, 14 bp, Homo sapiens
aaatatcattatag

SEQ ID NO: 287592 - DNA, 11 bp, Homo sapiens
aaatatcattc

SEQ ID NO: 287593 - DNA, 13 bp, Homo sapiens
aaatatcattcag

SEQ ID NO: 287594 - DNA, 16 bp, Homo sapiens
aaatatcattcagcaa

SEQ ID NO: 287595 - DNA, 21 bp, Homo sapiens
aaatatcccagagaacaatca

SEQ ID NO: 287596 - DNA, 19 bp, Homo sapiens
aaatatccctttttcacat

SEQ ID NO: 287597 - DNA, 13 bp, Homo sapiens
aaatatgaaatga

SEQ ID NO: 287598 - DNA, 15 bp, Homo sapiens
aaatatgaaatttta

SEQ ID NO: 287599 - DNA, 13 bp, Homo sapiens
aaatatgcacttt

SEQ ID NO: 287600 - DNA, 14 bp, Homo sapiens
aaatatgcactttc

SEQ ID NO: 287601 - DNA, 20 bp, Homo sapiens
aaatatgctaaatgttagca

SEQ ID NO: 287602 - DNA, 19 bp, Homo sapiens
aaatatggaacttctaata

SEQ ID NO: 287603 - DNA, 14 bp, Homo sapiens
aaatatggtagctc

SEQ ID NO: 287604 - DNA, 19 bp, Homo sapiens
aaatatggtttggtttttc

SEQ ID NO: 287605 - DNA, 17 bp, Homo sapiens
aaatattatgattttat

SEQ ID NO: 287606 - DNA, 15 bp, Homo sapiens
aaatattatgtgttt

SEQ ID NO: 287607 - DNA, 15 bp, Homo sapiens
aatctttttctccac

SEQ ID NO: 287608 - DNA, 19 bp, Homo sapiens
aatgaaaaatttaagcatt

SEQ ID NO: 287609 - DNA, 21 bp, Homo sapiens
aatgaaaaatttaagcattgt

SEQ ID NO: 287610 - DNA, 12 bp, Homo sapiens
aatgaaaatgtc

SEQ ID NO: 287611 - DNA, 19 bp, Homo sapiens
aatgaaacaaataatcaca

SEQ ID NO: 287612 - DNA, 19 bp, Homo sapiens
aatgaaacactcagttgtt

SEQ ID NO: 287613 - DNA, 17 bp, Homo sapiens
aatgaaaccttcctctt

SEQ ID NO: 287614 - DNA, 19 bp, Homo sapiens
aatgaaagtcttgtgacta

SEQ ID NO: 287615 - DNA, 21 bp, Homo sapiens
aatgaaagtcttgtgactagt

SEQ ID NO: 287616 - DNA, 21 bp, Homo sapiens
aatgaaataatgtacatctgg

SEQ ID NO: 287617 - DNA, 12 bp, Homo sapiens
aatgaaatactt

SEQ ID NO: 287618 - DNA, 17 bp, Homo sapiens
aatgaaatataaactgt

SEQ ID NO: 287619 - DNA, 19 bp, Homo sapiens
aatgaaatataaactgtga

SEQ ID NO: 287620 - DNA, 20 bp, Homo sapiens
aatgaaatataaactgtgag

SEQ ID NO: 287621 - DNA, 22 bp, Homo sapiens
aatgaaatataaactgtgagat

SEQ ID NO: 287622 - DNA, 13 bp, Homo sapiens
aatgaaatatttg

SEQ ID NO: 287623 - DNA, 15 bp, Homo sapiens
aatgaaatctatttt

SEQ ID NO: 287624 - DNA, 23 bp, Homo sapiens
aatgaaattactacaaaatttga

SEQ ID NO: 287625 - DNA, 15 bp, Homo sapiens
aatgaactgtgacag

SEQ ID NO: 287626 - DNA, 22 bp, Homo sapiens
aatgaagaaaaaggctggctga

SEQ ID NO: 287627 - DNA, 18 bp, Homo sapiens
aatgaagcaaacacacag

SEQ ID NO: 287628 - DNA, 12 bp, Homo sapiens
aatgaagcatgt

SEQ ID NO: 287629 - DNA, 13 bp, Homo sapiens
aatgaaggaatta

SEQ ID NO: 287630 - DNA, 23 bp, Homo sapiens
aatgaaggccatcatctctgtaa

SEQ ID NO: 287631 - DNA, 22 bp, Homo sapiens
aatgaaggttaggatttaacag

SEQ ID NO: 287632 - DNA, 22 bp, Homo sapiens
aatgaagttaacttagtgttta

SEQ ID NO: 287633 - DNA, 17 bp, Homo sapiens
aatgaagtttatacagt

SEQ ID NO: 287634 - DNA, 16 bp, Homo sapiens
aatgaattaaatattg

SEQ ID NO: 287635 - DNA, 13 bp, Homo sapiens
aatgaattctgaa

SEQ ID NO: 287636 - DNA, 12 bp, Homo sapiens
aatgaattttaa

SEQ ID NO: 287637 - DNA, 17 bp, Homo sapiens
aatgaatttttatgata

SEQ ID NO: 287638 - DNA, 14 bp, Homo sapiens
aatgacaacagaag

SEQ ID NO: 287639 - DNA, 16 bp, Homo sapiens
aatgacaacagaagct

SEQ ID NO: 287640 - DNA, 16 bp, Homo sapiens
aatgacactggaaggg

SEQ ID NO: 287641 - DNA, 13 bp, Homo sapiens
aatgacagagagt

SEQ ID NO: 287642 - DNA, 13 bp, Homo sapiens
aatgaccagttta

SEQ ID NO: 287643 - DNA, 14 bp, Homo sapiens
aatgaccagtttac

SEQ ID NO: 287644 - DNA, 17 bp, Homo sapiens
aatgaccagtttacctg

SEQ ID NO: 287645 - DNA, 19 bp, Homo sapiens
aatgacgtattgtgaaatt

SEQ ID NO: 287646 - DNA, 17 bp, Homo sapiens
aatgactataaacatta

SEQ ID NO: 287647 - DNA, 20 bp, Homo sapiens
aatgactcagaatattgctt

SEQ ID NO: 287648 - DNA, 13 bp, Homo sapiens
aatgactgaaaga

SEQ ID NO: 287649 - DNA, 14 bp, Homo sapiens
aatgactgaaagaa

SEQ ID NO: 287650 - DNA, 16 bp, Homo sapiens
aatgacttattgatta

SEQ ID NO: 287651 - DNA, 15 bp, Homo sapiens
aatgacttcatttct

SEQ ID NO: 287652 - DNA, 18 bp, Homo sapiens
aatgagaatctgtgcagt

SEQ ID NO: 287653 - DNA, 16 bp, Homo sapiens
aatgagacttgctctc

SEQ ID NO: 287654 - DNA, 17 bp, Homo sapiens
aatgagagagtgtggaa

SEQ ID NO: 287655 - DNA, 16 bp, Homo sapiens
aatgagatagtagcat

SEQ ID NO: 287656 - DNA, 22 bp, Homo sapiens
aatgagatatatctttatactt

SEQ ID NO: 287657 - DNA, 14 bp, Homo sapiens
aatgagcctgtaat

SEQ ID NO: 287658 - DNA, 13 bp, Homo sapiens
aatgagctgggcc

SEQ ID NO: 287659 - DNA, 19 bp, Homo sapiens
aatgaggaacaatcacaaa

SEQ ID NO: 287660 - DNA, 12 bp, Homo sapiens
aatgaggaggaa

SEQ ID NO: 287661 - DNA, 18 bp, Homo sapiens
aatgaggaggaaggagag

SEQ ID NO: 287662 - DNA, 14 bp, Homo sapiens
aatgagggaaacaa

SEQ ID NO: 287663 - DNA, 15 bp, Homo sapiens
aatgagggaaacaaa

SEQ ID NO: 287664 - DNA, 18 bp, Homo sapiens
aatgagggaaacaaaata

SEQ ID NO: 287665 - DNA, 19 bp, Homo sapiens
aatgagggaaacaaaatat

SEQ ID NO: 287666 - DNA, 19 bp, Homo sapiens
aatgaggtctgaaatggag

SEQ ID NO: 287667 - DNA, 18 bp, Homo sapiens
aatgaggttatgagaaaa

SEQ ID NO: 287668 - DNA, 22 bp, Homo sapiens
aagtattcctttcctgatcact

SEQ ID NO: 287669 - DNA, 17 bp, Homo sapiens
aagtatttatatattta

SEQ ID NO: 287670 - DNA, 22 bp, Homo sapiens
aagtatttttgtctcttagaaa

SEQ ID NO: 287671 - DNA, 19 bp, Homo sapiens
aagtcaacactcttcttga

SEQ ID NO: 287672 - DNA, 21 bp, Homo sapiens
aagtcaactcttcagcctcat

SEQ ID NO: 287673 - DNA, 16 bp, Homo sapiens
aagtcaatcatttctc

SEQ ID NO: 287674 - DNA, 17 bp, Homo sapiens
aagtcaatcatttctca

SEQ ID NO: 287675 - DNA, 18 bp, Homo sapiens
aagtcaatcatttctcac

SEQ ID NO: 287676 - DNA, 18 bp, Homo sapiens
aagtcacagccgtttgaa

SEQ ID NO: 287677 - DNA, 23 bp, Homo sapiens
aagtcaccaggacttggggtcag

SEQ ID NO: 287678 - DNA, 19 bp, Homo sapiens
aagtcactaaatttctcag

SEQ ID NO: 287679 - DNA, 16 bp, Homo sapiens
aagtcagagaaaacac

SEQ ID NO: 287680 - DNA, 17 bp, Homo sapiens
aagtcaggagccagcag

SEQ ID NO: 287681 - DNA, 15 bp, Homo sapiens
aagtcagtaggagag

SEQ ID NO: 287682 - DNA, 16 bp, Homo sapiens
aagtcagtaggagagg

SEQ ID NO: 287683 - DNA, 18 bp, Homo sapiens
aagtcagtcaacatttac

SEQ ID NO: 287684 - DNA, 13 bp, Homo sapiens
aagtcatgaagct

SEQ ID NO: 287685 - DNA, 14 bp, Homo sapiens
aagtcatgaagctc

SEQ ID NO: 287686 - DNA, 14 bp, Homo sapiens
aagtcatgtgcatt

SEQ ID NO: 287687 - DNA, 16 bp, Homo sapiens
aagtcattttaacttt

SEQ ID NO: 287688 - DNA, 22 bp, Homo sapiens
aagtcattttaactttatcaca

SEQ ID NO: 287689 - DNA, 19 bp, Homo sapiens
aagtccatagctgagctgg

SEQ ID NO: 287690 - DNA, 15 bp, Homo sapiens
aagtcccgaggcagc

SEQ ID NO: 287691 - DNA, 16 bp, Homo sapiens
aagtcccgaggcagca

SEQ ID NO: 287692 - DNA, 11 bp, Homo sapiens
aagtccctgcc

SEQ ID NO: 287693 - DNA, 13 bp, Homo sapiens
aagtccctgcccc

SEQ ID NO: 287694 - DNA, 14 bp, Homo sapiens
aagtcctaaagtga

SEQ ID NO: 287695 - DNA, 12 bp, Homo sapiens
aagtcctggcta

SEQ ID NO: 287696 - DNA, 15 bp, Homo sapiens
aagtcctggctacat

SEQ ID NO: 287697 - DNA, 22 bp, Homo sapiens
aagtccttcagtgagcccctcc

SEQ ID NO: 287698 - DNA, 13 bp, Homo sapiens
aagtctaaagttt

SEQ ID NO: 287699 - DNA, 17 bp, Homo sapiens
aagtctaaagtttacag

SEQ ID NO: 287700 - DNA, 11 bp, Homo sapiens
aagtctatgct

SEQ ID NO: 287701 - DNA, 12 bp, Homo sapiens
aagtctatgctt

SEQ ID NO: 287702 - DNA, 12 bp, Homo sapiens
aagtctattttt

SEQ ID NO: 287703 - DNA, 21 bp, Homo sapiens
aagtctatttttttaactgaa

SEQ ID NO: 287704 - DNA, 19 bp, Homo sapiens
aagtctccaagaatacaga

SEQ ID NO: 287705 - DNA, 13 bp, Homo sapiens
aagtctctctgtg

SEQ ID NO: 287706 - DNA, 15 bp, Homo sapiens
aagtctctctgtgaa

SEQ ID NO: 287707 - DNA, 16 bp, Homo sapiens
aagtctctctgtgaat

SEQ ID NO: 287708 - DNA, 15 bp, Homo sapiens
aagtctcttaattct

SEQ ID NO: 287709 - DNA, 18 bp, Homo sapiens
aagtctcttaattctgat

SEQ ID NO: 287710 - DNA, 16 bp, Homo sapiens
aagtctctttttcttc

SEQ ID NO: 287711 - DNA, 16 bp, Homo sapiens
aagtctgtctgcactg

SEQ ID NO: 287712 - DNA, 15 bp, Homo sapiens
aagtctgtgcctgga

SEQ ID NO: 287713 - DNA, 22 bp, Homo sapiens
aagtctgtgcctggagctcctg

SEQ ID NO: 287714 - DNA, 23 bp, Homo sapiens
aagtctgtgtgatgaactttctc

SEQ ID NO: 287715 - DNA, 20 bp, Homo sapiens
aagtcttcatggtctcttcc

SEQ ID NO: 287716 - DNA, 11 bp, Homo sapiens
aagtcttcctg

SEQ ID NO: 287717 - DNA, 14 bp, Homo sapiens
aagtcttgtgacta

SEQ ID NO: 287718 - DNA, 19 bp, Homo sapiens
aagtcttgtgactagtgct

SEQ ID NO: 287719 - DNA, 22 bp, Homo sapiens
aagtcttgtgactagtgctgaa

SEQ ID NO: 287720 - DNA, 15 bp, Homo sapiens
aagtcttttctgtca

SEQ ID NO: 287721 - DNA, 20 bp, Homo sapiens
aagtgaaaaagacttcaaat

SEQ ID NO: 287722 - DNA, 18 bp, Homo sapiens
aagtgaaagacatttcaa

SEQ ID NO: 287723 - DNA, 14 bp, Homo sapiens
aagtgaatccttaa

SEQ ID NO: 287724 - DNA, 17 bp, Homo sapiens
aagtgaatctaataaaa

SEQ ID NO: 287725 - DNA, 15 bp, Homo sapiens
aagtgaatgggaaag

SEQ ID NO: 287726 - DNA, 18 bp, Homo sapiens
aagtgacaagatgctctg

SEQ ID NO: 287727 - DNA, 21 bp, Homo sapiens
aagtgacaaggccccagagac

SEQ ID NO: 287728 - DNA, 22 bp, Homo sapiens
aagtgacagatcctccattttt

SEQ ID NO: 287729 - DNA, 22 bp, Homo sapiens
aagtgactaccacttatttcta

SEQ ID NO: 287730 - DNA, 17 bp, Homo sapiens
aagtgacttgaatgtac

SEQ ID NO: 287731 - DNA, 19 bp, Homo sapiens
aagtgacttgaatgtacaa

SEQ ID NO: 287732 - DNA, 15 bp, Homo sapiens
aagtgagaagatggt

SEQ ID NO: 287733 - DNA, 17 bp, Homo sapiens
aagtgagagagacaaga

SEQ ID NO: 287734 - DNA, 17 bp, Homo sapiens
aagtgagatgggaaggg

SEQ ID NO: 287735 - DNA, 18 bp, Homo sapiens
aagtgagcaaacctgccc

SEQ ID NO: 287736 - DNA, 16 bp, Homo sapiens
aagtgaggcaagagaa

SEQ ID NO: 287737 - DNA, 12 bp, Homo sapiens
aagtgaggcctg

SEQ ID NO: 287738 - DNA, 15 bp, Homo sapiens
aagtgagtggcatgt

SEQ ID NO: 287739 - DNA, 21 bp, Homo sapiens
aagtgatgtgatttatgcatt

SEQ ID NO: 287740 - DNA, 22 bp, Homo sapiens
aagtgattgacattttgtagct

SEQ ID NO: 287741 - DNA, 17 bp, Homo sapiens
aagtgcaattgcacaaa

SEQ ID NO: 287742 - DNA, 21 bp, Homo sapiens
aagtgcagcccttcctcctga

SEQ ID NO: 287743 - DNA, 12 bp, Homo sapiens
aagtgcaggctg

SEQ ID NO: 287744 - DNA, 21 bp, Homo sapiens
aagtgcaggctggcaccgcct

SEQ ID NO: 287745 - DNA, 23 bp, Homo sapiens
aagtgccactgcccgagctggtg

SEQ ID NO: 287746 - DNA, 19 bp, Homo sapiens
aagtgcccaaagtggggag

SEQ ID NO: 287747 - DNA, 22 bp, Homo sapiens
aagtgcccctgctgcctcccca

SEQ ID NO: 287748 - DNA, 12 bp, Homo sapiens
aagtgccttgag

SEQ ID NO: 287749 - DNA, 21 bp, Homo sapiens
aagtgccttgagctgcctgct

SEQ ID NO: 287750 - DNA, 17 bp, Homo sapiens
aagtgctacttgagagt

SEQ ID NO: 287751 - DNA, 11 bp, Homo sapiens
aagtgctcttt

SEQ ID NO: 287752 - DNA, 19 bp, Homo sapiens
acccacccctcctgggccc

SEQ ID NO: 287753 - DNA, 17 bp, Homo sapiens
acccacccctgcccagg

SEQ ID NO: 287754 - DNA, 20 bp, Homo sapiens
acccaccctaatttgccctt

SEQ ID NO: 287755 - DNA, 21 bp, Homo sapiens
acccaccctaatttgcccttc

SEQ ID NO: 287756 - DNA, 18 bp, Homo sapiens
acccaccctctggtcctt

SEQ ID NO: 287757 - DNA, 19 bp, Homo sapiens
acccacccttctcccctgc

SEQ ID NO: 287758 - DNA, 14 bp, Homo sapiens
acccacctcacccc

SEQ ID NO: 287759 - DNA, 14 bp, Homo sapiens
acccacctcagcct

SEQ ID NO: 287760 - DNA, 12 bp, Homo sapiens
acccacctccac

SEQ ID NO: 287761 - DNA, 21 bp, Homo sapiens
acccacctccacccagcccct

SEQ ID NO: 287762 - DNA, 16 bp, Homo sapiens
acccacctccaccccc

SEQ ID NO: 287763 - DNA, 12 bp, Homo sapiens
acccacctgagc

SEQ ID NO: 287764 - DNA, 18 bp, Homo sapiens
acccacctgagctttgga

SEQ ID NO: 287765 - DNA, 21 bp, Homo sapiens
acccaccttgttggagcctgc

SEQ ID NO: 287766 - DNA, 17 bp, Homo sapiens
acccacgcgtgttctga

SEQ ID NO: 287767 - DNA, 15 bp, Homo sapiens
acccactagccctct

SEQ ID NO: 287768 - DNA, 20 bp, Homo sapiens
acccactagccctctttctc

SEQ ID NO: 287769 - DNA, 18 bp, Homo sapiens
acccactcaccagggtcc

SEQ ID NO: 287770 - DNA, 16 bp, Homo sapiens
acccactgtccgcctc

SEQ ID NO: 287771 - DNA, 19 bp, Homo sapiens
acccactgtggggcaagcc

SEQ ID NO: 287772 - DNA, 22 bp, Homo sapiens
acccactgtggggcaagcctga

SEQ ID NO: 287773 - DNA, 16 bp, Homo sapiens
acccacttagtccact

SEQ ID NO: 287774 - DNA, 21 bp, Homo sapiens
acccacttagtccactctgag

SEQ ID NO: 287775 - DNA, 12 bp, Homo sapiens
acccagagagaa

SEQ ID NO: 287776 - DNA, 15 bp, Homo sapiens
acccagagagaaaaa

SEQ ID NO: 287777 - DNA, 24 bp, Homo sapiens
acccagagagaaaaagagagagca

SEQ ID NO: 287778 - DNA, 15 bp, Homo sapiens
acccagattcccttc

SEQ ID NO: 287779 - DNA, 14 bp, Homo sapiens
acccagccaggagg

SEQ ID NO: 287780 - DNA, 13 bp, Homo sapiens
acccagcccctgg

SEQ ID NO: 287781 - DNA, 16 bp, Homo sapiens
acccagcgttcttcag

SEQ ID NO: 287782 - DNA, 23 bp, Homo sapiens
acccagcgttcttcaggagatga

SEQ ID NO: 287783 - DNA, 18 bp, Homo sapiens
acccagctactctgtcca

SEQ ID NO: 287784 - DNA, 20 bp, Homo sapiens
acccagctactctgtccagg

SEQ ID NO: 287785 - DNA, 14 bp, Homo sapiens
acccagctccaggg

SEQ ID NO: 287786 - DNA, 19 bp, Homo sapiens
acccagctcttctccccca

SEQ ID NO: 287787 - DNA, 13 bp, Homo sapiens
acccaggaaggga

SEQ ID NO: 287788 - DNA, 23 bp, Homo sapiens
acccaggaagggaaagcgggcag

SEQ ID NO: 287789 - DNA, 18 bp, Homo sapiens
acccaggacgcttctgaa

SEQ ID NO: 287790 - DNA, 23 bp, Homo sapiens
acccaggagatggaagttgcagt

SEQ ID NO: 287791 - DNA, 19 bp, Homo sapiens
acccaggcaggccctgcct

SEQ ID NO: 287792 - DNA, 17 bp, Homo sapiens
acccaggccactgacct

SEQ ID NO: 287793 - DNA, 14 bp, Homo sapiens
acccaggccctcca

SEQ ID NO: 287794 - DNA, 19 bp, Homo sapiens
acccaggccctccatgggc

SEQ ID NO: 287795 - DNA, 21 bp, Homo sapiens
acccaggccctccatgggcta

SEQ ID NO: 287796 - DNA, 22 bp, Homo sapiens
acccaggccctccatgggctag

SEQ ID NO: 287797 - DNA, 12 bp, Homo sapiens
acccaggctgca

SEQ ID NO: 287798 - DNA, 14 bp, Homo sapiens
acccaggctgcact

SEQ ID NO: 287799 - DNA, 16 bp, Homo sapiens
acccaggctgcactgc

SEQ ID NO: 287800 - DNA, 18 bp, Homo sapiens
acccaggctgcactgcag

SEQ ID NO: 287801 - DNA, 17 bp, Homo sapiens
acccaggctggttcttg

SEQ ID NO: 287802 - DNA, 19 bp, Homo sapiens
acccagggctccctcctgg

SEQ ID NO: 287803 - DNA, 13 bp, Homo sapiens
acccagtgctgcc

SEQ ID NO: 287804 - DNA, 14 bp, Homo sapiens
acccagtgctgcca

SEQ ID NO: 287805 - DNA, 15 bp, Homo sapiens
acccagtgctgccat

SEQ ID NO: 287806 - DNA, 17 bp, Homo sapiens
acccagtgctgccatgc

SEQ ID NO: 287807 - DNA, 15 bp, Homo sapiens
acccagttctgaata

SEQ ID NO: 287808 - DNA, 17 bp, Homo sapiens
acccatagatcttctga

SEQ ID NO: 287809 - DNA, 16 bp, Homo sapiens
acccatagcttccatg

SEQ ID NO: 287810 - DNA, 14 bp, Homo sapiens
acccataggaaatc

SEQ ID NO: 287811 - DNA, 20 bp, Homo sapiens
acccatcctaccaatgcatg

SEQ ID NO: 287812 - DNA, 17 bp, Homo sapiens
acccatcttcctgctgc

SEQ ID NO: 287813 - DNA, 16 bp, Homo sapiens
acccatgagcctgccc

SEQ ID NO: 287814 - DNA, 18 bp, Homo sapiens
acccatgagcctgcccgc

SEQ ID NO: 287815 - DNA, 20 bp, Homo sapiens
acccatgagcctgcccgctg

SEQ ID NO: 287816 - DNA, 16 bp, Homo sapiens
acccatgcatggcctc

SEQ ID NO: 287817 - DNA, 12 bp, Homo sapiens
acccatgccctg

SEQ ID NO: 287818 - DNA, 13 bp, Homo sapiens
acccatgccctgc

SEQ ID NO: 287819 - DNA, 14 bp, Homo sapiens
acccatgccctgcc

SEQ ID NO: 287820 - DNA, 13 bp, Homo sapiens
acccattattcct

SEQ ID NO: 287821 - DNA, 20 bp, Homo sapiens
acccattcccccatgtggct

SEQ ID NO: 287822 - DNA, 22 bp, Homo sapiens
acccattcccccatgtggctga

SEQ ID NO: 287823 - DNA, 23 bp, Homo sapiens
acccattcccccatgtggctgaa

SEQ ID NO: 287824 - DNA, 22 bp, Homo sapiens
acccattcgtggtgatcaatta

SEQ ID NO: 287825 - DNA, 16 bp, Homo sapiens
acccatttgccatgct

SEQ ID NO: 287826 - DNA, 14 bp, Homo sapiens
acccattttcacat

SEQ ID NO: 287827 - DNA, 17 bp, Homo sapiens
accccacaccaggccgt

SEQ ID NO: 287828 - DNA, 20 bp, Homo sapiens
accccacaccaggccgtcct

SEQ ID NO: 287829 - DNA, 20 bp, Homo sapiens
accccacacgccggggctgg

SEQ ID NO: 287830 - DNA, 23 bp, Homo sapiens
accccaccacacacacccttccc

SEQ ID NO: 287831 - DNA, 18 bp, Homo sapiens
accccaccttgccaagct

SEQ ID NO: 287832 - DNA, 22 bp, Homo sapiens
accccacttatgctgctgtgaa

SEQ ID NO: 287833 - DNA, 23 bp, Homo sapiens
accccacttatgctgctgtgaat

SEQ ID NO: 287834 - DNA, 12 bp, Homo sapiens
accccacttcca

SEQ ID NO: 287835 - DNA, 17 bp, Homo sapiens
accccagagattcccaa

SEQ ID NO: 287836 - DNA, 17 bp, Homo sapiens
accccagagggaccagc

SEQ ID NO: 287837 - DNA, 16 bp, Homo sapiens
accccagagtgactga

SEQ ID NO: 287838 - DNA, 17 bp, Homo sapiens
accccagcattccagct

SEQ ID NO: 287839 - DNA, 19 bp, Homo sapiens
accccagcattccagctct

SEQ ID NO: 287840 - DNA, 16 bp, Homo sapiens
accccagcctgacctg

SEQ ID NO: 287841 - DNA, 17 bp, Homo sapiens
accccagcctgacctga

SEQ ID NO: 287842 - DNA, 21 bp, Homo sapiens
accccagcctgacctgagact

SEQ ID NO: 287843 - DNA, 21 bp, Homo sapiens
accccagcctggccacgcagc

SEQ ID NO: 287844 - DNA, 22 bp, Homo sapiens
accccagcttttcttgccagct

SEQ ID NO: 287845 - DNA, 14 bp, Homo sapiens
accccaggttttct

SEQ ID NO: 287846 - DNA, 18 bp, Homo sapiens
accccagttcatctctgc

SEQ ID NO: 287847 - DNA, 16 bp, Homo sapiens
accccatctctcttcc

SEQ ID NO: 287848 - DNA, 16 bp, Homo sapiens
accccatgccaaagct

SEQ ID NO: 287849 - DNA, 13 bp, Homo sapiens
accccatgggctt

SEQ ID NO: 287850 - DNA, 17 bp, Homo sapiens
accccatgggcttggac

SEQ ID NO: 287851 - DNA, 17 bp, Homo sapiens
acccccaaagacctgcc

SEQ ID NO: 287852 - DNA, 20 bp, Homo sapiens
acccccaaagacctgcctgt

SEQ ID NO: 287853 - DNA, 19 bp, Homo sapiens
acccccaagcttccacctg

SEQ ID NO: 287854 - DNA, 12 bp, Homo sapiens
acccccacccca

SEQ ID NO: 287855 - DNA, 19 bp, Homo sapiens
acccccacccctgtaccca

SEQ ID NO: 287856 - DNA, 13 bp, Homo sapiens
acccccacccctt

SEQ ID NO: 287857 - DNA, 11 bp, Homo sapiens
acccccaccct

SEQ ID NO: 287858 - DNA, 17 bp, Homo sapiens
acccccagcctccccca

SEQ ID NO: 287859 - DNA, 15 bp, Homo sapiens
acccccatgctgcct

SEQ ID NO: 287860 - DNA, 17 bp, Homo sapiens
acccccatttctattta

SEQ ID NO: 287861 - DNA, 18 bp, Homo sapiens
accccccgtctcctgccg

SEQ ID NO: 287862 - DNA, 12 bp, Homo sapiens
acccccctcatt

SEQ ID NO: 287863 - DNA, 14 bp, Homo sapiens
acccccctccccaa

SEQ ID NO: 287864 - DNA, 21 bp, Homo sapiens
acccccgccacggccaccctc

SEQ ID NO: 287865 - DNA, 21 bp, Homo sapiens
acccccggcctccaggctggg

SEQ ID NO: 287866 - DNA, 20 bp, Homo sapiens
acccccgtcggaatggtaac

SEQ ID NO: 287867 - DNA, 23 bp, Homo sapiens
acccccgtgccaaatcctgggca

SEQ ID NO: 287868 - DNA, 16 bp, Homo sapiens
accccctcctgtcacc

SEQ ID NO: 287869 - DNA, 20 bp, Homo sapiens
accccctcggagcctgtgtt

SEQ ID NO: 287870 - DNA, 13 bp, Homo sapiens
accccctgtccca

SEQ ID NO: 287871 - DNA, 13 bp, Homo sapiens
acccccttctctg

SEQ ID NO: 287872 - DNA, 12 bp, Homo sapiens
accccctttcta

SEQ ID NO: 287873 - DNA, 16 bp, Homo sapiens
accccgacgccacagc

SEQ ID NO: 287874 - DNA, 14 bp, Homo sapiens
accccgagccctac

SEQ ID NO: 287875 - DNA, 13 bp, Homo sapiens
accccgcagcccg

SEQ ID NO: 287876 - DNA, 14 bp, Homo sapiens
accccgctctggca

SEQ ID NO: 287877 - DNA, 13 bp, Homo sapiens
accccggcaggcc

SEQ ID NO: 287878 - DNA, 19 bp, Homo sapiens
accccggcaggccctgcag

SEQ ID NO: 287879 - DNA, 22 bp, Homo sapiens
accccggcaggccctgcagtgt

SEQ ID NO: 287880 - DNA, 21 bp, Homo sapiens
accccggcctccactccccca

SEQ ID NO: 287881 - DNA, 20 bp, Homo sapiens
accccggctccccctgccag

SEQ ID NO: 287882 - DNA, 21 bp, Homo sapiens
accccggctccccctgccagc

SEQ ID NO: 287883 - DNA, 16 bp, Homo sapiens
accccgggctctctgc

SEQ ID NO: 287884 - DNA, 21 bp, Homo sapiens
accccgggctctctgctgtac

SEQ ID NO: 287885 - DNA, 13 bp, Homo sapiens
accccgtcccggc

SEQ ID NO: 287886 - DNA, 16 bp, Homo sapiens
acagaaagcaaatcag

SEQ ID NO: 287887 - DNA, 23 bp, Homo sapiens
acagaaagcaaatcagacacaat

SEQ ID NO: 287888 - DNA, 17 bp, Homo sapiens
acagaaatatgattgat

SEQ ID NO: 287889 - DNA, 13 bp, Homo sapiens
acagaacatttct

SEQ ID NO: 287890 - DNA, 15 bp, Homo sapiens
acagaaccagcactc

SEQ ID NO: 287891 - DNA, 16 bp, Homo sapiens
acagaaccagcactcc

SEQ ID NO: 287892 - DNA, 20 bp, Homo sapiens
acagaaccagcactcccagg

SEQ ID NO: 287893 - DNA, 14 bp, Homo sapiens
acagaagcttcaga

SEQ ID NO: 287894 - DNA, 20 bp, Homo sapiens
acagaaggccttgaagaatt

SEQ ID NO: 287895 - DNA, 16 bp, Homo sapiens
acagaatcattgctta

SEQ ID NO: 287896 - DNA, 11 bp, Homo sapiens
acagacacaca

SEQ ID NO: 287897 - DNA, 14 bp, Homo sapiens
acagacacacacac

SEQ ID NO: 287898 - DNA, 15 bp, Homo sapiens
acagacacacacacg

SEQ ID NO: 287899 - DNA, 16 bp, Homo sapiens
actgcacccagctcca

SEQ ID NO: 287900 - DNA, 19 bp, Homo sapiens
actgcacccagctccaggg

SEQ ID NO: 287901 - DNA, 22 bp, Homo sapiens
actgcacccagctccaggggcc

SEQ ID NO: 287902 - DNA, 17 bp, Homo sapiens
actgcactccagcctgg

SEQ ID NO: 287903 - DNA, 21 bp, Homo sapiens
actgcagaatacagtaagctg

SEQ ID NO: 287904 - DNA, 23 bp, Homo sapiens
actgcagaggagccacctgggct

SEQ ID NO: 287905 - DNA, 19 bp, Homo sapiens
actgcagatttctcacctg

SEQ ID NO: 287906 - DNA, 22 bp, Homo sapiens
actgcagcctcgaactcctggg

SEQ ID NO: 287907 - DNA, 15 bp, Homo sapiens
actgcagctttacat

SEQ ID NO: 287908 - DNA, 17 bp, Homo sapiens
actgcaggttggacccc

SEQ ID NO: 287909 - DNA, 20 bp, Homo sapiens
actgcaggttggaccccaga

SEQ ID NO: 287910 - DNA, 19 bp, Homo sapiens
actgcatatagataattat

SEQ ID NO: 287911 - DNA, 20 bp, Homo sapiens
actgcatcaagatgtgacat

SEQ ID NO: 287912 - DNA, 15 bp, Homo sapiens
actgcatgcaagctc

SEQ ID NO: 287913 - DNA, 16 bp, Homo sapiens
actgcatgctgctgga

SEQ ID NO: 287914 - DNA, 17 bp, Homo sapiens
actgcatggacctaaca

SEQ ID NO: 287915 - DNA, 14 bp, Homo sapiens
actgcatgtataaa

SEQ ID NO: 287916 - DNA, 22 bp, Homo sapiens
actgcattctataataaatggg

SEQ ID NO: 287917 - DNA, 13 bp, Homo sapiens
actgcattctttt

SEQ ID NO: 287918 - DNA, 21 bp, Homo sapiens
actgccaggattttgtattgc

SEQ ID NO: 287919 - DNA, 14 bp, Homo sapiens
actgccaggcacct

SEQ ID NO: 287920 - DNA, 15 bp, Homo sapiens
actgccaggcacctg

SEQ ID NO: 287921 - DNA, 16 bp, Homo sapiens
actgccaggcacctgg

SEQ ID NO: 287922 - DNA, 19 bp, Homo sapiens
actgccattagactgaatt

SEQ ID NO: 287923 - DNA, 17 bp, Homo sapiens
actgcccaccctgggcc

SEQ ID NO: 287924 - DNA, 16 bp, Homo sapiens
actgcccattgtaact

SEQ ID NO: 287925 - DNA, 18 bp, Homo sapiens
actgccccacggccctgt

SEQ ID NO: 287926 - DNA, 15 bp, Homo sapiens
actgccccatctcct

SEQ ID NO: 287927 - DNA, 22 bp, Homo sapiens
actgcccccactgtccccctac

SEQ ID NO: 287928 - DNA, 20 bp, Homo sapiens
actgcccccagaaagcctcc

SEQ ID NO: 287929 - DNA, 19 bp, Homo sapiens
actgccccgtgcagactgg

SEQ ID NO: 287930 - DNA, 13 bp, Homo sapiens
actgccccttgct

SEQ ID NO: 287931 - DNA, 15 bp, Homo sapiens
actgcccgagctggt

SEQ ID NO: 287932 - DNA, 14 bp, Homo sapiens
actgcccgcacacc

SEQ ID NO: 287933 - DNA, 16 bp, Homo sapiens
actgcccgcacaccct

SEQ ID NO: 287934 - DNA, 19 bp, Homo sapiens
actgcccgcacaccctcac

SEQ ID NO: 287935 - DNA, 20 bp, Homo sapiens
actgcccggggcagctgcca

SEQ ID NO: 287936 - DNA, 23 bp, Homo sapiens
actgccctccagctctttcctcc

SEQ ID NO: 287937 - DNA, 18 bp, Homo sapiens
actgccctctccacaccc

SEQ ID NO: 287938 - DNA, 12 bp, Homo sapiens
actgccctctgt

SEQ ID NO: 287939 - DNA, 11 bp, Homo sapiens
actgccctgcc

SEQ ID NO: 287940 - DNA, 14 bp, Homo sapiens
actgccctgcctgc

SEQ ID NO: 287941 - DNA, 18 bp, Homo sapiens
actgccctgcctgcccac

SEQ ID NO: 287942 - DNA, 17 bp, Homo sapiens
actgcccttttaaatgg

SEQ ID NO: 287943 - DNA, 20 bp, Homo sapiens
actgcccttttaaatggcat

SEQ ID NO: 287944 - DNA, 19 bp, Homo sapiens
actgccgaccgaggctgga

SEQ ID NO: 287945 - DNA, 22 bp, Homo sapiens
actgccgcaagtctgcagcccg

SEQ ID NO: 287946 - DNA, 18 bp, Homo sapiens
actgcctccctctcttcc

SEQ ID NO: 287947 - DNA, 10 bp, Homo sapiens
actgcctctg

SEQ ID NO: 287948 - DNA, 13 bp, Homo sapiens
actgcctctgcct

SEQ ID NO: 287949 - DNA, 15 bp, Homo sapiens
actgcctcttcctcc

SEQ ID NO: 287950 - DNA, 14 bp, Homo sapiens
actgcctgcccacc

SEQ ID NO: 287951 - DNA, 16 bp, Homo sapiens
actgcctgcccacccg

SEQ ID NO: 287952 - DNA, 14 bp, Homo sapiens
actgcctggaaagc

SEQ ID NO: 287953 - DNA, 14 bp, Homo sapiens
actgcctgggctcc

SEQ ID NO: 287954 - DNA, 19 bp, Homo sapiens
actgccttctcctctctgg

SEQ ID NO: 287955 - DNA, 20 bp, Homo sapiens
actgccttctcctctctggg

SEQ ID NO: 287956 - DNA, 23 bp, Homo sapiens
actgccttctcctctctgggcct

SEQ ID NO: 287957 - DNA, 14 bp, Homo sapiens
actgctaataaatg

SEQ ID NO: 287958 - DNA, 17 bp, Homo sapiens
actgctaataaatgacc

SEQ ID NO: 287959 - DNA, 20 bp, Homo sapiens
actgctaataaatgaccagt

SEQ ID NO: 287960 - DNA, 14 bp, Homo sapiens
actgctaattacac

SEQ ID NO: 287961 - DNA, 23 bp, Homo sapiens
actgctacaaatactcttaggaa

SEQ ID NO: 287962 - DNA, 16 bp, Homo sapiens
actgctaccatgaagt

SEQ ID NO: 287963 - DNA, 20 bp, Homo sapiens
actgctaggtgggccagccc

SEQ ID NO: 287964 - DNA, 21 bp, Homo sapiens
actgctaggtgggccagcccc

SEQ ID NO: 287965 - DNA, 15 bp, Homo sapiens
actgctagtacctgt

SEQ ID NO: 287966 - DNA, 17 bp, Homo sapiens
actgctctaagcacacg

SEQ ID NO: 287967 - DNA, 19 bp, Homo sapiens
actgctctaagcacacgga

SEQ ID NO: 287968 - DNA, 19 bp, Homo sapiens
actgctcttttactaagac

SEQ ID NO: 287969 - DNA, 15 bp, Homo sapiens
actgctgagccactc

SEQ ID NO: 287970 - DNA, 18 bp, Homo sapiens
actgctgatgctgaaata

SEQ ID NO: 287971 - DNA, 12 bp, Homo sapiens
actgctgcacca

SEQ ID NO: 287972 - DNA, 21 bp, Homo sapiens
actgctgcccagcctccaagc

SEQ ID NO: 287973 - DNA, 19 bp, Homo sapiens
actgctgccccaaaggaag

SEQ ID NO: 287974 - DNA, 22 bp, Homo sapiens
actgctgccccaaaggaagctt

SEQ ID NO: 287975 - DNA, 15 bp, Homo sapiens
actgctgctccccac

SEQ ID NO: 287976 - DNA, 14 bp, Homo sapiens
actgctgctcctct

SEQ ID NO: 287977 - DNA, 12 bp, Homo sapiens
actgctggctgc

SEQ ID NO: 287978 - DNA, 14 bp, Homo sapiens
actgctggctgcct

SEQ ID NO: 287979 - DNA, 16 bp, Homo sapiens
actgctgggaagtggc

SEQ ID NO: 287980 - DNA, 18 bp, Homo sapiens
actgctgggaagtggctt

SEQ ID NO: 287981 - DNA, 12 bp, Homo sapiens
actgctggggag

SEQ ID NO: 287982 - DNA, 17 bp, Homo sapiens
actgctggggagtccct

SEQ ID NO: 287983 - DNA, 21 bp, Homo sapiens
actgctgtcattgtccatgcc

SEQ ID NO: 287984 - DNA, 15 bp, Homo sapiens
actgctgtccctcct

SEQ ID NO: 287985 - DNA, 16 bp, Homo sapiens
actgctgtccctcctg

SEQ ID NO: 287986 - DNA, 13 bp, Homo sapiens
actgctgttttat

SEQ ID NO: 287987 - DNA, 19 bp, Homo sapiens
actgcttcctctgaatatt

SEQ ID NO: 287988 - DNA, 19 bp, Homo sapiens
actgcttctcggaggccag

SEQ ID NO: 287989 - DNA, 20 bp, Homo sapiens
actgcttctcggaggccagg

SEQ ID NO: 287990 - DNA, 21 bp, Homo sapiens
actgcttctcggaggccaggc

SEQ ID NO: 287991 - DNA, 22 bp, Homo sapiens
actgcttctcggaggccaggcc

SEQ ID NO: 287992 - DNA, 23 bp, Homo sapiens
actgcttctcggaggccaggccc

SEQ ID NO: 287993 - DNA, 17 bp, Homo sapiens
actgcttgcccagggtg

SEQ ID NO: 287994 - DNA, 23 bp, Homo sapiens
actgcttggatccatacaaaact

SEQ ID NO: 287995 - DNA, 21 bp, Homo sapiens
actgctttgcaccgtggtcag

SEQ ID NO: 287996 - DNA, 23 bp, Homo sapiens
actgctttgtttggatgcctcag

SEQ ID NO: 287997 - DNA, 18 bp, Homo sapiens
actgcttttaacttctga

SEQ ID NO: 287998 - DNA, 17 bp, Homo sapiens
actggaaaacatagagt

SEQ ID NO: 287999 - DNA, 21 bp, Homo sapiens
actggaacctccctgggcctg

SEQ ID NO: 288000 - DNA, 17 bp, Homo sapiens
actggaagggtccggct

SEQ ID NO: 288001 - DNA, 16 bp, Homo sapiens
actggaagttttgcat

SEQ ID NO: 288002 - DNA, 21 bp, Homo sapiens
actggactatagcagggctgg

SEQ ID NO: 288003 - DNA, 14 bp, Homo sapiens
actggagaaaatgg

SEQ ID NO: 288004 - DNA, 23 bp, Homo sapiens
actggagaccgcttcacccctgc

SEQ ID NO: 288005 - DNA, 23 bp, Homo sapiens
actggagagtggcaaaagtctga

SEQ ID NO: 288006 - DNA, 21 bp, Homo sapiens
actggaggggacgctggtaga

SEQ ID NO: 288007 - DNA, 22 bp, Homo sapiens
actggaggggacgctggtagag

SEQ ID NO: 288008 - DNA, 14 bp, Homo sapiens
actggaggtgggca

SEQ ID NO: 288009 - DNA, 18 bp, Homo sapiens
actggagtgcagggagga

SEQ ID NO: 288010 - DNA, 23 bp, Homo sapiens
actggattggccaaacatcagac

SEQ ID NO: 288011 - DNA, 11 bp, Homo sapiens
actggcagctc

SEQ ID NO: 288012 - DNA, 19 bp, Homo sapiens
accaagatcacaaatagtg

SEQ ID NO: 288013 - DNA, 14 bp, Homo sapiens
accaagatctataa

SEQ ID NO: 288014 - DNA, 16 bp, Homo sapiens
accaagccctgcaaat

SEQ ID NO: 288015 - DNA, 16 bp, Homo sapiens
accaagccggtgccca

SEQ ID NO: 288016 - DNA, 20 bp, Homo sapiens
accaagccggtgcccaccta

SEQ ID NO: 288017 - DNA, 15 bp, Homo sapiens
accaagccgtggctt

SEQ ID NO: 288018 - DNA, 17 bp, Homo sapiens
accaagccgtggcttcc

SEQ ID NO: 288019 - DNA, 11 bp, Homo sapiens
accaagccttg

SEQ ID NO: 288020 - DNA, 17 bp, Homo sapiens
accaagcttaaggagag

SEQ ID NO: 288021 - DNA, 19 bp, Homo sapiens
accaagcttaaggagagga

SEQ ID NO: 288022 - DNA, 14 bp, Homo sapiens
accaagcttagaag

SEQ ID NO: 288023 - DNA, 17 bp, Homo sapiens
accaagcttagaagcca

SEQ ID NO: 288024 - DNA, 17 bp, Homo sapiens
accaagcttgtctttaa

SEQ ID NO: 288025 - DNA, 16 bp, Homo sapiens
accaaggacccctcac

SEQ ID NO: 288026 - DNA, 18 bp, Homo sapiens
accaaggacccctcacct

SEQ ID NO: 288027 - DNA, 12 bp, Homo sapiens
accaaggcagcc

SEQ ID NO: 288028 - DNA, 21 bp, Homo sapiens
accaaggcagcctccagagcc

SEQ ID NO: 288029 - DNA, 22 bp, Homo sapiens
accaaggcagcctccagagcca

SEQ ID NO: 288030 - DNA, 14 bp, Homo sapiens
accaagtacagcct

SEQ ID NO: 288031 - DNA, 13 bp, Homo sapiens
accaagtcctggc

SEQ ID NO: 288032 - DNA, 23 bp, Homo sapiens
accaagtgccttgagctgcctgc

SEQ ID NO: 288033 - DNA, 14 bp, Homo sapiens
accaagtgggctgg

SEQ ID NO: 288034 - DNA, 23 bp, Homo sapiens
accaagtgggctggtattctctc

SEQ ID NO: 288035 - DNA, 20 bp, Homo sapiens
accaatattatactaagaaa

SEQ ID NO: 288036 - DNA, 20 bp, Homo sapiens
accaatcaacagcatgtcta

SEQ ID NO: 288037 - DNA, 21 bp, Homo sapiens
accaatcctatgtcatttcta

SEQ ID NO: 288038 - DNA, 13 bp, Homo sapiens
accaatctctgtg

SEQ ID NO: 288039 - DNA, 14 bp, Homo sapiens
accaatctctgtga

SEQ ID NO: 288040 - DNA, 17 bp, Homo sapiens
accaatgcatgcagcca

SEQ ID NO: 288041 - DNA, 18 bp, Homo sapiens
accaatgcatgcagccac

SEQ ID NO: 288042 - DNA, 20 bp, Homo sapiens
accaatgcatgcagccactg

SEQ ID NO: 288043 - DNA, 18 bp, Homo sapiens
accaatgcattaccttct

SEQ ID NO: 288044 - DNA, 18 bp, Homo sapiens
accaatgtgaagacacta

SEQ ID NO: 288045 - DNA, 20 bp, Homo sapiens
accaattgccctgccaggct

SEQ ID NO: 288046 - DNA, 16 bp, Homo sapiens
accaattggttaatct

SEQ ID NO: 288047 - DNA, 14 bp, Homo sapiens
accacaaaaattga

SEQ ID NO: 288048 - DNA, 20 bp, Homo sapiens
accacaactaacaatgcctt

SEQ ID NO: 288049 - DNA, 23 bp, Homo sapiens
accacaaggtccactccctgctc

SEQ ID NO: 288050 - DNA, 14 bp, Homo sapiens
accacaatatgtat

SEQ ID NO: 288051 - DNA, 21 bp, Homo sapiens
accacacacacccttccccac

SEQ ID NO: 288052 - DNA, 18 bp, Homo sapiens
accacacacctcaccaga

SEQ ID NO: 288053 - DNA, 22 bp, Homo sapiens
accacacccctgccggccttgg

SEQ ID NO: 288054 - DNA, 14 bp, Homo sapiens
accacacttcttga

SEQ ID NO: 288055 - DNA, 12 bp, Homo sapiens
accacagacaca

SEQ ID NO: 288056 - DNA, 13 bp, Homo sapiens
accacagacacac

SEQ ID NO: 288057 - DNA, 15 bp, Homo sapiens
accacagacacacac

SEQ ID NO: 288058 - DNA, 16 bp, Homo sapiens
accacagacacacaca

SEQ ID NO: 288059 - DNA, 20 bp, Homo sapiens
accacagacacacacacgca

SEQ ID NO: 288060 - DNA, 17 bp, Homo sapiens
accacagacgccacctg

SEQ ID NO: 288061 - DNA, 16 bp, Homo sapiens
accacagatactgaaa

SEQ ID NO: 288062 - DNA, 19 bp, Homo sapiens
accacagatactgaaacat

SEQ ID NO: 288063 - DNA, 18 bp, Homo sapiens
accacagctgctggccag

SEQ ID NO: 288064 - DNA, 22 bp, Homo sapiens
accacaggttcatgccaccatg

SEQ ID NO: 288065 - DNA, 15 bp, Homo sapiens
accacagtgggtggc

SEQ ID NO: 288066 - DNA, 21 bp, Homo sapiens
accacagtgggtggcacctcc

SEQ ID NO: 288067 - DNA, 14 bp, Homo sapiens
accacatcctccgt

SEQ ID NO: 288068 - DNA, 21 bp, Homo sapiens
accacatcctccgtccagccg

SEQ ID NO: 288069 - DNA, 13 bp, Homo sapiens
accacatttctgg

SEQ ID NO: 288070 - DNA, 15 bp, Homo sapiens
accaccactgtccct

SEQ ID NO: 288071 - DNA, 15 bp, Homo sapiens
accaccagccccagc

SEQ ID NO: 288072 - DNA, 10 bp, Homo sapiens
accaccccct

SEQ ID NO: 288073 - DNA, 11 bp, Homo sapiens
accacccctcc

SEQ ID NO: 288074 - DNA, 20 bp, Homo sapiens
accaccctagtcccttcccc

SEQ ID NO: 288075 - DNA, 12 bp, Homo sapiens
accaccctgagg

SEQ ID NO: 288076 - DNA, 19 bp, Homo sapiens
accaccgcatatgcatgcc

SEQ ID NO: 288077 - DNA, 17 bp, Homo sapiens
accaccgctccccagcc

SEQ ID NO: 288078 - DNA, 18 bp, Homo sapiens
accaccggggcactggct

SEQ ID NO: 288079 - DNA, 21 bp, Homo sapiens
accaccggggcactggctgct

SEQ ID NO: 288080 - DNA, 16 bp, Homo sapiens
accacctctggccctg

SEQ ID NO: 288081 - DNA, 23 bp, Homo sapiens
accacctggatggatctgctcca

SEQ ID NO: 288082 - DNA, 23 bp, Homo sapiens
accaccttctgtccccagccctg

SEQ ID NO: 288083 - DNA, 22 bp, Homo sapiens
accaccttgcactattggactt

SEQ ID NO: 288084 - DNA, 14 bp, Homo sapiens
accacgccctgcct

SEQ ID NO: 288085 - DNA, 20 bp, Homo sapiens
accacgcttgacaggacagc

SEQ ID NO: 288086 - DNA, 23 bp, Homo sapiens
accacggggtcgggggaggagca

SEQ ID NO: 288087 - DNA, 17 bp, Homo sapiens
accactaatttgtcact

SEQ ID NO: 288088 - DNA, 18 bp, Homo sapiens
accactaatttgtcactg

SEQ ID NO: 288089 - DNA, 22 bp, Homo sapiens
accactaatttgtcactggaac

SEQ ID NO: 288090 - DNA, 23 bp, Homo sapiens
accactaatttgtcactggaacc

SEQ ID NO: 288091 - DNA, 19 bp, Homo sapiens
accactaggaatcccagag

SEQ ID NO: 288092 - DNA, 21 bp, Homo sapiens
accactagggtcctggccctc

SEQ ID NO: 288093 - DNA, 18 bp, Homo sapiens
accactgcactccagcct

SEQ ID NO: 288094 - DNA, 15 bp, Homo sapiens
accactgccctgcct

SEQ ID NO: 288095 - DNA, 16 bp, Homo sapiens
accactgccctgcctg

SEQ ID NO: 288096 - DNA, 13 bp, Homo sapiens
accactgctaata

SEQ ID NO: 288097 - DNA, 16 bp, Homo sapiens
accactgctaataaat

SEQ ID NO: 288098 - DNA, 21 bp, Homo sapiens
accactgctaataaatgacca

SEQ ID NO: 288099 - DNA, 22 bp, Homo sapiens
accactgctaataaatgaccag

SEQ ID NO: 288100 - DNA, 17 bp, Homo sapiens
accactgggatcagctg

SEQ ID NO: 288101 - DNA, 15 bp, Homo sapiens
accactgggcctgct

SEQ ID NO: 288102 - DNA, 20 bp, Homo sapiens
accactgtaaaatgaaatta

SEQ ID NO: 288103 - DNA, 17 bp, Homo sapiens
accactgtccctaccac

SEQ ID NO: 288104 - DNA, 16 bp, Homo sapiens
accactgtgtatttaa

SEQ ID NO: 288105 - DNA, 16 bp, Homo sapiens
accactttttgcagct

SEQ ID NO: 288106 - DNA, 19 bp, Homo sapiens
accagaacgcaccccactg

SEQ ID NO: 288107 - DNA, 14 bp, Homo sapiens
accagaagccaaag

SEQ ID NO: 288108 - DNA, 18 bp, Homo sapiens
accagaagtttctacatt

SEQ ID NO: 288109 - DNA, 14 bp, Homo sapiens
accagactgcaggt

SEQ ID NO: 288110 - DNA, 12 bp, Homo sapiens
aacaacagaaac

SEQ ID NO: 288111 - DNA, 18 bp, Homo sapiens
aacaaccccccatcacaa

SEQ ID NO: 288112 - DNA, 22 bp, Homo sapiens
aacaaccccccatcacaaactt

SEQ ID NO: 288113 - DNA, 19 bp, Homo sapiens
aacaaccctgttgagtatt

SEQ ID NO: 288114 - DNA, 12 bp, Homo sapiens
aacaacctgcca

SEQ ID NO: 288115 - DNA, 19 bp, Homo sapiens
aacaacgtgtatagtgcct

SEQ ID NO: 288116 - DNA, 17 bp, Homo sapiens
aacaactaatcaagagt

SEQ ID NO: 288117 - DNA, 21 bp, Homo sapiens
aacaactccaggaaaactgtt

SEQ ID NO: 288118 - DNA, 22 bp, Homo sapiens
aacaacttaatgttctgaataa

SEQ ID NO: 288119 - DNA, 15 bp, Homo sapiens
aacaacttactaaat

SEQ ID NO: 288120 - DNA, 13 bp, Homo sapiens
aacaactttgttt

SEQ ID NO: 288121 - DNA, 14 bp, Homo sapiens
aacaagaaaacata

SEQ ID NO: 288122 - DNA, 15 bp, Homo sapiens
aacaagactgcctcc

SEQ ID NO: 288123 - DNA, 23 bp, Homo sapiens
aacaagaggagcaggaagcaagg

SEQ ID NO: 288124 - DNA, 12 bp, Homo sapiens
aacaaggaatgc

SEQ ID NO: 288125 - DNA, 21 bp, Homo sapiens
aacaagggagagacctcatca

SEQ ID NO: 288126 - DNA, 16 bp, Homo sapiens
aacaaggtagttttta

SEQ ID NO: 288127 - DNA, 14 bp, Homo sapiens
aacaagtgaacaca

SEQ ID NO: 288128 - DNA, 20 bp, Homo sapiens
aacaagtgcctcctggactg

SEQ ID NO: 288129 - DNA, 11 bp, Homo sapiens
aacaagtgtac

SEQ ID NO: 288130 - DNA, 17 bp, Homo sapiens
aacaagtgtacagaaga

SEQ ID NO: 288131 - DNA, 19 bp, Homo sapiens
aacaagttggctagaagaa

SEQ ID NO: 288132 - DNA, 14 bp, Homo sapiens
aacaagttgtgcct

SEQ ID NO: 288133 - DNA, 13 bp, Homo sapiens
aacaagtttgcta

SEQ ID NO: 288134 - DNA, 17 bp, Homo sapiens
aacaataaaaaaaaacc

SEQ ID NO: 288135 - DNA, 14 bp, Homo sapiens
aacaataaacatcc

SEQ ID NO: 288136 - DNA, 15 bp, Homo sapiens
aacaataaatgtgca

SEQ ID NO: 288137 - DNA, 21 bp, Homo sapiens
aacaataactactgtgttcct

SEQ ID NO: 288138 - DNA, 16 bp, Homo sapiens
aacaatatatgatata

SEQ ID NO: 288139 - DNA, 23 bp, Homo sapiens
aacaatatatgatatataaacct

SEQ ID NO: 288140 - DNA, 11 bp, Homo sapiens
aacaatcacaa

SEQ ID NO: 288141 - DNA, 13 bp, Homo sapiens
aacaatcacactc

SEQ ID NO: 288142 - DNA, 15 bp, Homo sapiens
aacaatcactattct

SEQ ID NO: 288143 - DNA, 14 bp, Homo sapiens
aacaatccaaatgc

SEQ ID NO: 288144 - DNA, 14 bp, Homo sapiens
aacaatgaagataa

SEQ ID NO: 288145 - DNA, 17 bp, Homo sapiens
aacaatgccttgttgta

SEQ ID NO: 288146 - DNA, 12 bp, Homo sapiens
aacaatgtatgt

SEQ ID NO: 288147 - DNA, 23 bp, Homo sapiens
aacaatgtatgtgaaagtgtaaa

SEQ ID NO: 288148 - DNA, 21 bp, Homo sapiens
aacaatgtcaaggtgctgttg

SEQ ID NO: 288149 - DNA, 21 bp, Homo sapiens
aacaatgttcaggagagtaaa

SEQ ID NO: 288150 - DNA, 20 bp, Homo sapiens
aacaattcaaagaatcacct

SEQ ID NO: 288151 - DNA, 13 bp, Homo sapiens
aacaattgatttt

SEQ ID NO: 288152 - DNA, 20 bp, Homo sapiens
aacaatttcctttatattta

SEQ ID NO: 288153 - DNA, 22 bp, Homo sapiens
aacaatttcctttatatttagt

SEQ ID NO: 288154 - DNA, 22 bp, Homo sapiens
aacacaaaaattatctgggcat

SEQ ID NO: 288155 - DNA, 15 bp, Homo sapiens
aacacaaggtgggca

SEQ ID NO: 288156 - DNA, 23 bp, Homo sapiens
aacacaagtagatgcctgaactt

SEQ ID NO: 288157 - DNA, 15 bp, Homo sapiens
aacacacacacacac

SEQ ID NO: 288158 - DNA, 16 bp, Homo sapiens
aacacacacacattct

SEQ ID NO: 288159 - DNA, 17 bp, Homo sapiens
aacacacagactctgtg

SEQ ID NO: 288160 - DNA, 23 bp, Homo sapiens
aacacacagtattcgtgaataag

SEQ ID NO: 288161 - DNA, 14 bp, Homo sapiens
aacacacgctcctc

SEQ ID NO: 288162 - DNA, 19 bp, Homo sapiens
aacacacgctcctctgccc

SEQ ID NO: 288163 - DNA, 21 bp, Homo sapiens
aacacacttttgcacatatat

SEQ ID NO: 288164 - DNA, 14 bp, Homo sapiens
aacacagatattgt

SEQ ID NO: 288165 - DNA, 14 bp, Homo sapiens
aacacagcatgtgc

SEQ ID NO: 288166 - DNA, 16 bp, Homo sapiens
aacacagcatgtgtat

SEQ ID NO: 288167 - DNA, 18 bp, Homo sapiens
aacacagcatgtgtattt

SEQ ID NO: 288168 - DNA, 10 bp, Homo sapiens
aacacaggca

SEQ ID NO: 288169 - DNA, 11 bp, Homo sapiens
aacacaggcaa

SEQ ID NO: 288170 - DNA, 15 bp, Homo sapiens
aacacagggttttgt

SEQ ID NO: 288171 - DNA, 13 bp, Homo sapiens
aacacagtttagt

SEQ ID NO: 288172 - DNA, 18 bp, Homo sapiens
aacacatagattcacctg

SEQ ID NO: 288173 - DNA, 20 bp, Homo sapiens
aacacatagattcacctgta

SEQ ID NO: 288174 - DNA, 14 bp, Homo sapiens
aacacatggcagaa

SEQ ID NO: 288175 - DNA, 23 bp, Homo sapiens
aacacattgaatgcgctttattg

SEQ ID NO: 288176 - DNA, 14 bp, Homo sapiens
aacaccacagacac

SEQ ID NO: 288177 - DNA, 17 bp, Homo sapiens
aacaccacagacacaca

SEQ ID NO: 288178 - DNA, 18 bp, Homo sapiens
aacaccacagacacacac

SEQ ID NO: 288179 - DNA, 19 bp, Homo sapiens
aacaccacagacacacaca

SEQ ID NO: 288180 - DNA, 16 bp, Homo sapiens
aacaccacttaatctt

SEQ ID NO: 288181 - DNA, 18 bp, Homo sapiens
aacaccatcacagcttgt

SEQ ID NO: 288182 - DNA, 15 bp, Homo sapiens
aacacccagccccag

SEQ ID NO: 288183 - DNA, 20 bp, Homo sapiens
aacaccgcttctgccttttc

SEQ ID NO: 288184 - DNA, 16 bp, Homo sapiens
aacacctagatcagaa

SEQ ID NO: 288185 - DNA, 14 bp, Homo sapiens
aacacctcctagca

SEQ ID NO: 288186 - DNA, 13 bp, Homo sapiens
aacacctgacaca

SEQ ID NO: 288187 - DNA, 14 bp, Homo sapiens
aacacggcagctgt

SEQ ID NO: 288188 - DNA, 18 bp, Homo sapiens
aacacggcagctgtagct

SEQ ID NO: 288189 - DNA, 15 bp, Homo sapiens
aacactaaagagcta

SEQ ID NO: 288190 - DNA, 18 bp, Homo sapiens
aacactacctcttttgag

SEQ ID NO: 288191 - DNA, 20 bp, Homo sapiens
aacactcttcttgagcagac

SEQ ID NO: 288192 - DNA, 12 bp, Homo sapiens
aacactgcagcc

SEQ ID NO: 288193 - DNA, 16 bp, Homo sapiens
aacactgtaatcttaa

SEQ ID NO: 288194 - DNA, 15 bp, Homo sapiens
aacacttatcctcct

SEQ ID NO: 288195 - DNA, 15 bp, Homo sapiens
aacacttattttctg

SEQ ID NO: 288196 - DNA, 15 bp, Homo sapiens
aacactttcctggat

SEQ ID NO: 288197 - DNA, 19 bp, Homo sapiens
aacactttgagcattttta

SEQ ID NO: 288198 - DNA, 24 bp, Homo sapiens
aacactttttccatttcttcagag

SEQ ID NO: 288199 - DNA, 12 bp, Homo sapiens
aacagaaaaaaa

SEQ ID NO: 288200 - DNA, 15 bp, Homo sapiens
aacagaaaaaaaaca

SEQ ID NO: 288201 - DNA, 18 bp, Homo sapiens
aacagaaaacaacaaaaa

SEQ ID NO: 288202 - DNA, 16 bp, Homo sapiens
aacagaaaagagaaga

SEQ ID NO: 288203 - DNA, 16 bp, Homo sapiens
aacagaagcttccatt

SEQ ID NO: 288204 - DNA, 15 bp, Homo sapiens
aacagaatattctgt

SEQ ID NO: 288205 - DNA, 14 bp, Homo sapiens
aaggcaaatgtcca

SEQ ID NO: 288206 - DNA, 18 bp, Homo sapiens
aaggcaactagtggagag

SEQ ID NO: 288207 - DNA, 16 bp, Homo sapiens
aaggcaagccacagaa

SEQ ID NO: 288208 - DNA, 13 bp, Homo sapiens
aaggcaaggctgt

SEQ ID NO: 288209 - DNA, 16 bp, Homo sapiens
aaggcaaggctgtcaa

SEQ ID NO: 288210 - DNA, 17 bp, Homo sapiens
aaggcaaggctgtcaat

SEQ ID NO: 288211 - DNA, 17 bp, Homo sapiens
aaggcagagaaaacaca

SEQ ID NO: 288212 - DNA, 20 bp, Homo sapiens
aaggcagagaaaacacacgc

SEQ ID NO: 288213 - DNA, 19 bp, Homo sapiens
aaggcagcctccagagcca

SEQ ID NO: 288214 - DNA, 22 bp, Homo sapiens
aaggcagcctccagagccagcc

SEQ ID NO: 288215 - DNA, 23 bp, Homo sapiens
aaggcagcctccagagccagcct

SEQ ID NO: 288216 - DNA, 16 bp, Homo sapiens
aaggcagctcacccct

SEQ ID NO: 288217 - DNA, 21 bp, Homo sapiens
aaggcagctcacccctgggca

SEQ ID NO: 288218 - DNA, 23 bp, Homo sapiens
aaggcagctcacccctgggcagg

SEQ ID NO: 288219 - DNA, 16 bp, Homo sapiens
aaggcaggcatatcaa

SEQ ID NO: 288220 - DNA, 19 bp, Homo sapiens
aaggcaggcctttcctaca

SEQ ID NO: 288221 - DNA, 23 bp, Homo sapiens
aaggcaggtagatcgcttgagcc

SEQ ID NO: 288222 - DNA, 16 bp, Homo sapiens
aaggcagtgttcctca

SEQ ID NO: 288223 - DNA, 15 bp, Homo sapiens
aaggcatatacaaat

SEQ ID NO: 288224 - DNA, 21 bp, Homo sapiens
aaggcatgcctggacaaaccc

SEQ ID NO: 288225 - DNA, 18 bp, Homo sapiens
aaggcatgctcccagcat

SEQ ID NO: 288226 - DNA, 13 bp, Homo sapiens
aaggccacaggcc

SEQ ID NO: 288227 - DNA, 23 bp, Homo sapiens
aaggccacgtatagtcctagctg

SEQ ID NO: 288228 - DNA, 19 bp, Homo sapiens
aaggccagagtggcctggc

SEQ ID NO: 288229 - DNA, 21 bp, Homo sapiens
aaggccagagtggcctggcca

SEQ ID NO: 288230 - DNA, 22 bp, Homo sapiens
aaggccagagtggcctggccag

SEQ ID NO: 288231 - DNA, 13 bp, Homo sapiens
aaggcccaagagc

SEQ ID NO: 288232 - DNA, 15 bp, Homo sapiens
aaggccccagagact

SEQ ID NO: 288233 - DNA, 14 bp, Homo sapiens
aaggcctcaggaga

SEQ ID NO: 288234 - DNA, 15 bp, Homo sapiens
aaggcctcaggagag

SEQ ID NO: 288235 - DNA, 20 bp, Homo sapiens
aaggcctcgctcttgacaga

SEQ ID NO: 288236 - DNA, 17 bp, Homo sapiens
aaggcctcggcagaact

SEQ ID NO: 288237 - DNA, 15 bp, Homo sapiens
aaggcctcttgctgg

SEQ ID NO: 288238 - DNA, 15 bp, Homo sapiens
aaggcctcttgtgct

SEQ ID NO: 288239 - DNA, 23 bp, Homo sapiens
aaggcctcttgtgctcacgctcc

SEQ ID NO: 288240 - DNA, 23 bp, Homo sapiens
aaggcctgagggaagcccacccg

SEQ ID NO: 288241 - DNA, 20 bp, Homo sapiens
aaggcctgccccccttccca

SEQ ID NO: 288242 - DNA, 22 bp, Homo sapiens
aaggcctggaaccagggaggag

SEQ ID NO: 288243 - DNA, 14 bp, Homo sapiens
aaggcctggtcagc

SEQ ID NO: 288244 - DNA, 15 bp, Homo sapiens
aaggccttaatatgt

SEQ ID NO: 288245 - DNA, 12 bp, Homo sapiens
aaggccttgaag

SEQ ID NO: 288246 - DNA, 12 bp, Homo sapiens
aaggcctttggg

SEQ ID NO: 288247 - DNA, 19 bp, Homo sapiens
aaggctctcacccccatcc

SEQ ID NO: 288248 - DNA, 12 bp, Homo sapiens
aaggctctcccc

SEQ ID NO: 288249 - DNA, 17 bp, Homo sapiens
aaggctgactcttacta

SEQ ID NO: 288250 - DNA, 13 bp, Homo sapiens
aaggctgcacact

SEQ ID NO: 288251 - DNA, 18 bp, Homo sapiens
aaggctgcctggagaaag

SEQ ID NO: 288252 - DNA, 19 bp, Homo sapiens
aaggctgcctggagaaagg

SEQ ID NO: 288253 - DNA, 20 bp, Homo sapiens
aaggctgcctggagaaagga

SEQ ID NO: 288254 - DNA, 23 bp, Homo sapiens
aaggctggccagcaaggcaggtt

SEQ ID NO: 288255 - DNA, 12 bp, Homo sapiens
aaggctggctga

SEQ ID NO: 288256 - DNA, 21 bp, Homo sapiens
aaggctgttttaacggcctgc

SEQ ID NO: 288257 - DNA, 17 bp, Homo sapiens
aaggctttcagggcctc

SEQ ID NO: 288258 - DNA, 16 bp, Homo sapiens
aaggctttgccatggg

SEQ ID NO: 288259 - DNA, 21 bp, Homo sapiens
aaggctttgccatgggcctgc

SEQ ID NO: 288260 - DNA, 16 bp, Homo sapiens
aagggaacaggaaaag

SEQ ID NO: 288261 - DNA, 15 bp, Homo sapiens
aagggaaccagccct

SEQ ID NO: 288262 - DNA, 17 bp, Homo sapiens
aagggaagttgtgcctt

SEQ ID NO: 288263 - DNA, 19 bp, Homo sapiens
aagggacagtattctcagt

SEQ ID NO: 288264 - DNA, 18 bp, Homo sapiens
aagggacttaacttgttt

SEQ ID NO: 288265 - DNA, 13 bp, Homo sapiens
aagggagaaaaag

SEQ ID NO: 288266 - DNA, 14 bp, Homo sapiens
aagggagagggaaa

SEQ ID NO: 288267 - DNA, 22 bp, Homo sapiens
aagggagattcaaaaaaaaaat

SEQ ID NO: 288268 - DNA, 14 bp, Homo sapiens
aagggagcccctcc

SEQ ID NO: 288269 - DNA, 18 bp, Homo sapiens
aagggagctatcaggaac

SEQ ID NO: 288270 - DNA, 22 bp, Homo sapiens
aagggaggattttgggtggcca

SEQ ID NO: 288271 - DNA, 15 bp, Homo sapiens
aagggatggaaaagg

SEQ ID NO: 288272 - DNA, 18 bp, Homo sapiens
aagggcaagatgtaaagc

SEQ ID NO: 288273 - DNA, 18 bp, Homo sapiens
aagggcagcccctcccca

SEQ ID NO: 288274 - DNA, 22 bp, Homo sapiens
aagggcagggcatctcctgtgc

SEQ ID NO: 288275 - DNA, 16 bp, Homo sapiens
aagggcatcaggcact

SEQ ID NO: 288276 - DNA, 18 bp, Homo sapiens
aagggcatcaggcactgg

SEQ ID NO: 288277 - DNA, 14 bp, Homo sapiens
aagggcatccttct

SEQ ID NO: 288278 - DNA, 17 bp, Homo sapiens
accagagccatggactc

SEQ ID NO: 288279 - DNA, 21 bp, Homo sapiens
accagagccccccacaatgat

SEQ ID NO: 288280 - DNA, 21 bp, Homo sapiens
accagataagaatgctggttt

SEQ ID NO: 288281 - DNA, 20 bp, Homo sapiens
accagatgacacataaatct

SEQ ID NO: 288282 - DNA, 21 bp, Homo sapiens
accagatgagaagttaagcag

SEQ ID NO: 288283 - DNA, 14 bp, Homo sapiens
accagcaacatctc

SEQ ID NO: 288284 - DNA, 16 bp, Homo sapiens
accagcaagtcccaga

SEQ ID NO: 288285 - DNA, 17 bp, Homo sapiens
accagcaagtcccagac

SEQ ID NO: 288286 - DNA, 13 bp, Homo sapiens
accagcactccca

SEQ ID NO: 288287 - DNA, 18 bp, Homo sapiens
accagcactcccagggcc

SEQ ID NO: 288288 - DNA, 19 bp, Homo sapiens
accagcactcccagggccc

SEQ ID NO: 288289 - DNA, 12 bp, Homo sapiens
accagcaggtgt

SEQ ID NO: 288290 - DNA, 23 bp, Homo sapiens
accagcaggtgtggtggctcatg

SEQ ID NO: 288291 - DNA, 14 bp, Homo sapiens
accagccccagcaa

SEQ ID NO: 288292 - DNA, 17 bp, Homo sapiens
accagccccagcaagag

SEQ ID NO: 288293 - DNA, 22 bp, Homo sapiens
accagccccccaccccacagat

SEQ ID NO: 288294 - DNA, 15 bp, Homo sapiens
accagccctgctgct

SEQ ID NO: 288295 - DNA, 16 bp, Homo sapiens
accagccctgctgctt

SEQ ID NO: 288296 - DNA, 12 bp, Homo sapiens
accagccctggg

SEQ ID NO: 288297 - DNA, 13 bp, Homo sapiens
accagcgcccgct

SEQ ID NO: 288298 - DNA, 18 bp, Homo sapiens
accagcgcccgctgggct

SEQ ID NO: 288299 - DNA, 20 bp, Homo sapiens
accagctcagccccggccac

SEQ ID NO: 288300 - DNA, 22 bp, Homo sapiens
accagctcagccccggccactc

SEQ ID NO: 288301 - DNA, 14 bp, Homo sapiens
accagctcatctcc

SEQ ID NO: 288302 - DNA, 15 bp, Homo sapiens
accagctcatctcca

SEQ ID NO: 288303 - DNA, 22 bp, Homo sapiens
accagctcccaacagaggcctc

SEQ ID NO: 288304 - DNA, 12 bp, Homo sapiens
accagctctgtg

SEQ ID NO: 288305 - DNA, 14 bp, Homo sapiens
accagctctgtggc

SEQ ID NO: 288306 - DNA, 16 bp, Homo sapiens
accagctgctctgccc

SEQ ID NO: 288307 - DNA, 17 bp, Homo sapiens
accagctgctctgcccc

SEQ ID NO: 288308 - DNA, 17 bp, Homo sapiens
accagctgtaacacagc

SEQ ID NO: 288309 - DNA, 16 bp, Homo sapiens
accagcttagatttta

SEQ ID NO: 288310 - DNA, 23 bp, Homo sapiens
accaggaagaaggcccgggagga

SEQ ID NO: 288311 - DNA, 16 bp, Homo sapiens
accaggactctgcctt

SEQ ID NO: 288312 - DNA, 20 bp, Homo sapiens
accaggagaaccactacatg

SEQ ID NO: 288313 - DNA, 12 bp, Homo sapiens
accaggagacag

SEQ ID NO: 288314 - DNA, 15 bp, Homo sapiens
accaggagctagccc

SEQ ID NO: 288315 - DNA, 18 bp, Homo sapiens
accaggagctagcccagt

SEQ ID NO: 288316 - DNA, 12 bp, Homo sapiens
accaggccacca

SEQ ID NO: 288317 - DNA, 17 bp, Homo sapiens
accaggccccagcctcc

SEQ ID NO: 288318 - DNA, 16 bp, Homo sapiens
accaggccgccccagc

SEQ ID NO: 288319 - DNA, 16 bp, Homo sapiens
accaggccgtcctccc

SEQ ID NO: 288320 - DNA, 20 bp, Homo sapiens
accaggccgtcctcccgggc

SEQ ID NO: 288321 - DNA, 13 bp, Homo sapiens
accaggcttccca

SEQ ID NO: 288322 - DNA, 14 bp, Homo sapiens
accaggcttcccaa

SEQ ID NO: 288323 - DNA, 15 bp, Homo sapiens
accagggctcagctc

SEQ ID NO: 288324 - DNA, 12 bp, Homo sapiens
accagggctctg

SEQ ID NO: 288325 - DNA, 22 bp, Homo sapiens
accagggctctgtattctgcaa

SEQ ID NO: 288326 - DNA, 21 bp, Homo sapiens
accagggtccgcaccagctgc

SEQ ID NO: 288327 - DNA, 23 bp, Homo sapiens
accagggtccgcaccagctgctc

SEQ ID NO: 288328 - DNA, 20 bp, Homo sapiens
accaggtcctttctcctgat

SEQ ID NO: 288329 - DNA, 20 bp, Homo sapiens
accaggtgttctacactcat

SEQ ID NO: 288330 - DNA, 20 bp, Homo sapiens
accaggttacctcactttta

SEQ ID NO: 288331 - DNA, 14 bp, Homo sapiens
accaggttgaaaga

SEQ ID NO: 288332 - DNA, 23 bp, Homo sapiens
accagtaggttgaggacaggaga

SEQ ID NO: 288333 - DNA, 16 bp, Homo sapiens
accagtcacacattat

SEQ ID NO: 288334 - DNA, 21 bp, Homo sapiens
accagtcagggacagcagcct

SEQ ID NO: 288335 - DNA, 16 bp, Homo sapiens
accagtcgccctctgt

SEQ ID NO: 288336 - DNA, 22 bp, Homo sapiens
accagtcgccctctgtgcctaa

SEQ ID NO: 288337 - DNA, 23 bp, Homo sapiens
accagtcgccctctgtgcctaat

SEQ ID NO: 288338 - DNA, 15 bp, Homo sapiens
accagtctgtctact

SEQ ID NO: 288339 - DNA, 15 bp, Homo sapiens
accagtcttctccct

SEQ ID NO: 288340 - DNA, 17 bp, Homo sapiens
accagtgcaacagcact

SEQ ID NO: 288341 - DNA, 12 bp, Homo sapiens
accagtgtactg

SEQ ID NO: 288342 - DNA, 15 bp, Homo sapiens
accagtgtactgctt

SEQ ID NO: 288343 - DNA, 16 bp, Homo sapiens
accagtgtactgcttt

SEQ ID NO: 288344 - DNA, 17 bp, Homo sapiens
accagtgttagtgggaa

SEQ ID NO: 288345 - DNA, 18 bp, Homo sapiens
accagtgttagtgggaag

SEQ ID NO: 288346 - DNA, 20 bp, Homo sapiens
accagttgggagcactggag

SEQ ID NO: 288347 - DNA, 22 bp, Homo sapiens
accataaaataaataatctcat

SEQ ID NO: 288348 - DNA, 18 bp, Homo sapiens
accataatgttacattat

SEQ ID NO: 288349 - DNA, 15 bp, Homo sapiens
accataatgttcctt

SEQ ID NO: 288350 - DNA, 20 bp, Homo sapiens
accatagaagaacagcagat

SEQ ID NO: 288351 - DNA, 18 bp, Homo sapiens
accatagcgctgctctta

SEQ ID NO: 288352 - DNA, 13 bp, Homo sapiens
accatcagttact

SEQ ID NO: 288353 - DNA, 16 bp, Homo sapiens
accatcagttactggt

SEQ ID NO: 288354 - DNA, 19 bp, Homo sapiens
accatcattggaaatgaaa

SEQ ID NO: 288355 - DNA, 22 bp, Homo sapiens
accatccactctaccctcccac

SEQ ID NO: 288356 - DNA, 23 bp, Homo sapiens
accatccactctaccctcccacc

SEQ ID NO: 288357 - DNA, 15 bp, Homo sapiens
accatcccactgata

SEQ ID NO: 288358 - DNA, 16 bp, Homo sapiens
accatcctgcagcctc

SEQ ID NO: 288359 - DNA, 17 bp, Homo sapiens
accatcctgcagcctcc

SEQ ID NO: 288360 - DNA, 17 bp, Homo sapiens
accatcgcgtgcaatga

SEQ ID NO: 288361 - DNA, 15 bp, Homo sapiens
accatctcaggccac

SEQ ID NO: 288362 - DNA, 17 bp, Homo sapiens
accatctcaggccacct

SEQ ID NO: 288363 - DNA, 13 bp, Homo sapiens
accatcttaatct

SEQ ID NO: 288364 - DNA, 15 bp, Homo sapiens
accatcttaatcttt

SEQ ID NO: 288365 - DNA, 16 bp, Homo sapiens
accatcttaatcttta

SEQ ID NO: 288366 - DNA, 20 bp, Homo sapiens
accatgagaagagggcctgt

SEQ ID NO: 288367 - DNA, 20 bp, Homo sapiens
accatgagcacctccagctg

SEQ ID NO: 288368 - DNA, 17 bp, Homo sapiens
accatgcaaagcaacga

SEQ ID NO: 288369 - DNA, 21 bp, Homo sapiens
accatgctgctttttggcaca

SEQ ID NO: 288370 - DNA, 21 bp, Homo sapiens
accatggcaagagagaaagaa

SEQ ID NO: 288371 - DNA, 15 bp, Homo sapiens
accatggccagccaa

SEQ ID NO: 288372 - DNA, 19 bp, Homo sapiens
accatggggatcagagtct

SEQ ID NO: 288373 - DNA, 13 bp, Homo sapiens
accatgtaaaaca

SEQ ID NO: 288374 - DNA, 17 bp, Homo sapiens
accatgtaaaacaaaaa

SEQ ID NO: 288375 - DNA, 15 bp, Homo sapiens
accatgtcactgtgg

SEQ ID NO: 288376 - DNA, 17 bp, Homo sapiens
accattaaaactgcttt

SEQ ID NO: 288377 - DNA, 18 bp, Homo sapiens
accattaaaactgctttt

SEQ ID NO: 288378 - DNA, 15 bp, Homo sapiens
accattatggctttg

SEQ ID NO: 288379 - DNA, 20 bp, Homo sapiens
accattcaggaacctggacc

SEQ ID NO: 288380 - DNA, 15 bp, Homo sapiens
accattccccatggg

SEQ ID NO: 288381 - DNA, 22 bp, Homo sapiens
accattcctttaaattctccaa

SEQ ID NO: 288382 - DNA, 18 bp, Homo sapiens
accattgacctcagctgc

SEQ ID NO: 288383 - DNA, 19 bp, Homo sapiens
accattgacctcagctgca

SEQ ID NO: 288384 - DNA, 21 bp, Homo sapiens
accattgcttcactacccatc

SEQ ID NO: 288385 - DNA, 18 bp, Homo sapiens
accatttaatcatttcca

SEQ ID NO: 288386 - DNA, 11 bp, Homo sapiens
accatttataa

SEQ ID NO: 288387 - DNA, 20 bp, Homo sapiens
accatttcccctgtggtttg

SEQ ID NO: 288388 - DNA, 16 bp, Homo sapiens
accatttgtaataaag

SEQ ID NO: 288389 - DNA, 18 bp, Homo sapiens
accatttgtaataaagta

SEQ ID NO: 288390 - DNA, 21 bp, Homo sapiens
accatttgtaataaagtatat

SEQ ID NO: 288391 - DNA, 12 bp, Homo sapiens
acccaaaagatt

SEQ ID NO: 288392 - DNA, 17 bp, Homo sapiens
acccaaaccccttccca

SEQ ID NO: 288393 - DNA, 22 bp, Homo sapiens
acccaacaggtgctgaactgtg

SEQ ID NO: 288394 - DNA, 18 bp, Homo sapiens
acccaaggtcacatagct

SEQ ID NO: 288395 - DNA, 18 bp, Homo sapiens
acccaaggtggtcttgga

SEQ ID NO: 288396 - DNA, 18 bp, Homo sapiens
acccaagtggggcctcct

SEQ ID NO: 288397 - DNA, 12 bp, Homo sapiens
acccaataaaga

SEQ ID NO: 288398 - DNA, 18 bp, Homo sapiens
acccaatttccaagacag

SEQ ID NO: 288399 - DNA, 14 bp, Homo sapiens
acccaattttaaaa

SEQ ID NO: 288400 - DNA, 20 bp, Homo sapiens
acccacaccccgtctgcccc

SEQ ID NO: 288401 - DNA, 22 bp, Homo sapiens
acccacaccccgtctgcccctt

SEQ ID NO: 288402 - DNA, 15 bp, Homo sapiens
acccacactgcaaca

SEQ ID NO: 288403 - DNA, 16 bp, Homo sapiens
acccacagagtgtggt

SEQ ID NO: 288404 - DNA, 19 bp, Homo sapiens
acccaccagggctcagctc

SEQ ID NO: 288405 - DNA, 21 bp, Homo sapiens
acccaccagggctcagctcct

SEQ ID NO: 288406 - DNA, 13 bp, Homo sapiens
acccaccagtgcc

SEQ ID NO: 288407 - DNA, 14 bp, Homo sapiens
acccaccagtgcct

SEQ ID NO: 288408 - DNA, 23 bp, Homo sapiens
acccacccatcttcctgctgctg

SEQ ID NO: 288409 - DNA, 14 bp, Homo sapiens
acccaccccaaact

SEQ ID NO: 288410 - DNA, 12 bp, Homo sapiens
acccacccctcc

SEQ ID NO: 288411 - DNA, 18 bp, Homo sapiens
acccacccctcctgggcc

SEQ ID NO: 288412 - DNA, 18 bp, Homo sapiens
actttgttggcccttcca

SEQ ID NO: 288413 - DNA, 11 bp, Homo sapiens
acttttaataa

SEQ ID NO: 288414 - DNA, 13 bp, Homo sapiens
acttttaattagt

SEQ ID NO: 288415 - DNA, 15 bp, Homo sapiens
acttttacttgttca

SEQ ID NO: 288416 - DNA, 16 bp, Homo sapiens
acttttataaattaaa

SEQ ID NO: 288417 - DNA, 21 bp, Homo sapiens
acttttataaattaaatatat

SEQ ID NO: 288418 - DNA, 22 bp, Homo sapiens
acttttattatgggtatgtgtt

SEQ ID NO: 288419 - DNA, 14 bp, Homo sapiens
acttttatttgcaa

SEQ ID NO: 288420 - DNA, 21 bp, Homo sapiens
acttttcaatcccaattctgt

SEQ ID NO: 288421 - DNA, 19 bp, Homo sapiens
acttttcatttttgctttt

SEQ ID NO: 288422 - DNA, 17 bp, Homo sapiens
acttttcccctgtcctg

SEQ ID NO: 288423 - DNA, 16 bp, Homo sapiens
acttttctttcagcca

SEQ ID NO: 288424 - DNA, 17 bp, Homo sapiens
acttttgcacatatatt

SEQ ID NO: 288425 - DNA, 16 bp, Homo sapiens
acttttgcagcttcct

SEQ ID NO: 288426 - DNA, 17 bp, Homo sapiens
acttttgtaaatattct

SEQ ID NO: 288427 - DNA, 18 bp, Homo sapiens
acttttgtgtattctgtg

SEQ ID NO: 288428 - DNA, 20 bp, Homo sapiens
acttttgtgtattctgtgga

SEQ ID NO: 288429 - DNA, 17 bp, Homo sapiens
actttttaaaatataag

SEQ ID NO: 288430 - DNA, 11 bp, Homo sapiens
actttttcaca

SEQ ID NO: 288431 - DNA, 21 bp, Homo sapiens
actttttcagagttgctttaa

SEQ ID NO: 288432 - DNA, 22 bp, Homo sapiens
actttttccatttcttcagagg

SEQ ID NO: 288433 - DNA, 14 bp, Homo sapiens
actttttccttcct

SEQ ID NO: 288434 - DNA, 18 bp, Homo sapiens
actttttccttcctgccc

SEQ ID NO: 288435 - DNA, 23 bp, Homo sapiens
actttttccttcctgccctgtac

SEQ ID NO: 288436 - DNA, 12 bp, Homo sapiens
actttttgcagc

SEQ ID NO: 288437 - DNA, 17 bp, Homo sapiens
actttttgcagctttct

SEQ ID NO: 288438 - DNA, 13 bp, Homo sapiens
agaaaaaaaacac

SEQ ID NO: 288439 - DNA, 20 bp, Homo sapiens
agaaaaaaaataacacagag

SEQ ID NO: 288440 - DNA, 17 bp, Homo sapiens
agaaaaaaagatttatt

SEQ ID NO: 288441 - DNA, 22 bp, Homo sapiens
agaaaaaaataattttatgaac

SEQ ID NO: 288442 - DNA, 20 bp, Homo sapiens
agaaaaaaatagttttacat

SEQ ID NO: 288443 - DNA, 21 bp, Homo sapiens
agaaaaaaatagttttacatt

SEQ ID NO: 288444 - DNA, 15 bp, Homo sapiens
agaaaaacatgtcat

SEQ ID NO: 288445 - DNA, 19 bp, Homo sapiens
agaaaaaccaatgattcat

SEQ ID NO: 288446 - DNA, 13 bp, Homo sapiens
agaaaaagagaga

SEQ ID NO: 288447 - DNA, 14 bp, Homo sapiens
agaaaaagagagag

SEQ ID NO: 288448 - DNA, 13 bp, Homo sapiens
agaaaaaggaaat

SEQ ID NO: 288449 - DNA, 15 bp, Homo sapiens
agaaaaaggaaattg

SEQ ID NO: 288450 - DNA, 21 bp, Homo sapiens
agaaaaatcttgtgctagaat

SEQ ID NO: 288451 - DNA, 23 bp, Homo sapiens
agaaaaatcttgtgctagaatac

SEQ ID NO: 288452 - DNA, 14 bp, Homo sapiens
agaaaaatgaaaga

SEQ ID NO: 288453 - DNA, 13 bp, Homo sapiens
agaaaacagaaaa

SEQ ID NO: 288454 - DNA, 15 bp, Homo sapiens
agaaaacagccactg

SEQ ID NO: 288455 - DNA, 20 bp, Homo sapiens
agaaaacaggaaaaaaactt

SEQ ID NO: 288456 - DNA, 23 bp, Homo sapiens
agaaaacaggaaaaaaactttta

SEQ ID NO: 288457 - DNA, 23 bp, Homo sapiens
agaaaacccgacaacatttctgc

SEQ ID NO: 288458 - DNA, 16 bp, Homo sapiens
agaaaacccttttcta

SEQ ID NO: 288459 - DNA, 15 bp, Homo sapiens
agaaaacctcaaggg

SEQ ID NO: 288460 - DNA, 18 bp, Homo sapiens
agaaaactggcagtgcac

SEQ ID NO: 288461 - DNA, 17 bp, Homo sapiens
agaaaagaaaatatagt

SEQ ID NO: 288462 - DNA, 12 bp, Homo sapiens
agaaaagacact

SEQ ID NO: 288463 - DNA, 15 bp, Homo sapiens
agaaaagagaagaaa

SEQ ID NO: 288464 - DNA, 20 bp, Homo sapiens
agaaaagatacgactttatt

SEQ ID NO: 288465 - DNA, 21 bp, Homo sapiens
agaaaagattaaaattagtga

SEQ ID NO: 288466 - DNA, 11 bp, Homo sapiens
agaaaagccag

SEQ ID NO: 288467 - DNA, 23 bp, Homo sapiens
agaaaagggaagttgtgcctttt

SEQ ID NO: 288468 - DNA, 15 bp, Homo sapiens
agaaaataccaagga

SEQ ID NO: 288469 - DNA, 19 bp, Homo sapiens
agaaaatagagatgagctt

SEQ ID NO: 288470 - DNA, 20 bp, Homo sapiens
agaaaatagggtggacagaa

SEQ ID NO: 288471 - DNA, 16 bp, Homo sapiens
agaaaatcaaagcagt

SEQ ID NO: 288472 - DNA, 11 bp, Homo sapiens
agaaaatgaag

SEQ ID NO: 288473 - DNA, 15 bp, Homo sapiens
agaaaatgaatttga

SEQ ID NO: 288474 - DNA, 21 bp, Homo sapiens
agaaaatgaatttgactggtt

SEQ ID NO: 288475 - DNA, 15 bp, Homo sapiens
agaaaatggacgtgt

SEQ ID NO: 288476 - DNA, 16 bp, Homo sapiens
agaaaattatgcagct

SEQ ID NO: 288477 - DNA, 16 bp, Homo sapiens
agaaacacagttttga

SEQ ID NO: 288478 - DNA, 19 bp, Homo sapiens
agaaacaccacttaatctt

SEQ ID NO: 288479 - DNA, 20 bp, Homo sapiens
agaaacaccacttaatcttc

SEQ ID NO: 288480 - DNA, 21 bp, Homo sapiens
agaaacaccacttaatcttct

SEQ ID NO: 288481 - DNA, 19 bp, Homo sapiens
agaaacacctagatcagaa

SEQ ID NO: 288482 - DNA, 20 bp, Homo sapiens
agaaacacctagatcagaac

SEQ ID NO: 288483 - DNA, 21 bp, Homo sapiens
agaaacagggggaaaatgttt

SEQ ID NO: 288484 - DNA, 13 bp, Homo sapiens
agaaacagttaac

SEQ ID NO: 288485 - DNA, 20 bp, Homo sapiens
agaaacagttaactttcaga

SEQ ID NO: 288486 - DNA, 14 bp, Homo sapiens
agaaacatggtttt

SEQ ID NO: 288487 - DNA, 19 bp, Homo sapiens
agaaaccaagtgggctggt

SEQ ID NO: 288488 - DNA, 15 bp, Homo sapiens
agaaacccccaggag

SEQ ID NO: 288489 - DNA, 17 bp, Homo sapiens
agaaaccgtaattttat

SEQ ID NO: 288490 - DNA, 21 bp, Homo sapiens
agaaacctccatcctgccagg

SEQ ID NO: 288491 - DNA, 22 bp, Homo sapiens
agaaacctccatcctgccagga

SEQ ID NO: 288492 - DNA, 13 bp, Homo sapiens
agaaaccttgttt

SEQ ID NO: 288493 - DNA, 19 bp, Homo sapiens
agaaaccttgtttgtttta

SEQ ID NO: 288494 - DNA, 22 bp, Homo sapiens
agaaaccttttaaaaaaataat

SEQ ID NO: 288495 - DNA, 16 bp, Homo sapiens
agaaacgagatttgcc

SEQ ID NO: 288496 - DNA, 23 bp, Homo sapiens
agaaacgtccatctctctccctt

SEQ ID NO: 288497 - DNA, 23 bp, Homo sapiens
agaaactcacccccaaggggcag

SEQ ID NO: 288498 - DNA, 19 bp, Homo sapiens
agaaactgaaaactgtaaa

SEQ ID NO: 288499 - DNA, 14 bp, Homo sapiens
agaaactgaaagtg

SEQ ID NO: 288500 - DNA, 17 bp, Homo sapiens
agaaactgaaagtgttt

SEQ ID NO: 288501 - DNA, 19 bp, Homo sapiens
agaaactttgatctctgct

SEQ ID NO: 288502 - DNA, 19 bp, Homo sapiens
agaaagaaaagaccctgag

SEQ ID NO: 288503 - DNA, 12 bp, Homo sapiens
agaaagaaagtt

SEQ ID NO: 288504 - DNA, 11 bp, Homo sapiens
agaaagaaata

SEQ ID NO: 288505 - DNA, 11 bp, Homo sapiens
agaaagaatga

SEQ ID NO: 288506 - DNA, 15 bp, Homo sapiens
agaaagaatgagaaa

SEQ ID NO: 288507 - DNA, 17 bp, Homo sapiens
agaaagaatgagaaaga

SEQ ID NO: 288508 - DNA, 13 bp, Homo sapiens
agaaagatatcta

SEQ ID NO: 288509 - DNA, 14 bp, Homo sapiens
agaaagcaaaaaat

SEQ ID NO: 288510 - DNA, 17 bp, Homo sapiens
agaaagcaaaaaataaa

SEQ ID NO: 288511 - DNA, 18 bp, Homo sapiens
agaaagcaaaaaataaaa

SEQ ID NO: 288512 - DNA, 19 bp, Homo sapiens
agaaagcaaaaaataaaat

SEQ ID NO: 288513 - DNA, 19 bp, Homo sapiens
agaaagcaaatcagacaca

SEQ ID NO: 288514 - DNA, 17 bp, Homo sapiens
agaaagcacctgttttt

SEQ ID NO: 288515 - DNA, 14 bp, Homo sapiens
agaaagcagaggct

SEQ ID NO: 288516 - DNA, 15 bp, Homo sapiens
agaaagcagccaaac

SEQ ID NO: 288517 - DNA, 14 bp, Homo sapiens
agaaagcccacctg

SEQ ID NO: 288518 - DNA, 21 bp, Homo sapiens
agaaagcccacctgggctggg

SEQ ID NO: 288519 - DNA, 21 bp, Homo sapiens
agaaagcccctcacctcagga

SEQ ID NO: 288520 - DNA, 23 bp, Homo sapiens
agaaagcctcctgccccctgcca

SEQ ID NO: 288521 - DNA, 19 bp, Homo sapiens
agaaagctggtaaactatt

SEQ ID NO: 288522 - DNA, 18 bp, Homo sapiens
agaaagctgtgaaattga

SEQ ID NO: 288523 - DNA, 11 bp, Homo sapiens
agaaaggagac

SEQ ID NO: 288524 - DNA, 19 bp, Homo sapiens
agaaaggatatttaagaaa

SEQ ID NO: 288525 - DNA, 16 bp, Homo sapiens
agaaaggattaagata

SEQ ID NO: 288526 - DNA, 17 bp, Homo sapiens
agaaaggcagagattgg

SEQ ID NO: 288527 - DNA, 24 bp, Homo sapiens
agaaaggcttccagatgtctaaaa

SEQ ID NO: 288528 - DNA, 12 bp, Homo sapiens
agaaagggcagc

SEQ ID NO: 288529 - DNA, 19 bp, Homo sapiens
agaaagggcagcccctccc

SEQ ID NO: 288530 - DNA, 14 bp, Homo sapiens
agaaagggcagctt

SEQ ID NO: 288531 - DNA, 17 bp, Homo sapiens
agaaaggggcaggagct

SEQ ID NO: 288532 - DNA, 22 bp, Homo sapiens
agaaaggggcaggagctcagat

SEQ ID NO: 288533 - DNA, 17 bp, Homo sapiens
agaaaggttgattctca

SEQ ID NO: 288534 - DNA, 15 bp, Homo sapiens
agaaagtaaaaagaa

SEQ ID NO: 288535 - DNA, 14 bp, Homo sapiens
agaaagtcaccagg

SEQ ID NO: 288536 - DNA, 17 bp, Homo sapiens
agaaagtcaccaggact

SEQ ID NO: 288537 - DNA, 20 bp, Homo sapiens
agaaagtcgaattaatagct

SEQ ID NO: 288538 - DNA, 21 bp, Homo sapiens
agaaagtcgaattaatagctt

SEQ ID NO: 288539 - DNA, 15 bp, Homo sapiens
agaaagtgatttcta

SEQ ID NO: 288540 - DNA, 16 bp, Homo sapiens
agaaagtgtgagcaaa

SEQ ID NO: 288541 - DNA, 16 bp, Homo sapiens
agaaagtgtgctttat

SEQ ID NO: 288542 - DNA, 22 bp, Homo sapiens
agaaagtgtgctttatgctgaa

SEQ ID NO: 288543 - DNA, 13 bp, Homo sapiens
agaaagtttagaa

SEQ ID NO: 288544 - DNA, 15 bp, Homo sapiens
agaaataaatagcta

SEQ ID NO: 288545 - DNA, 18 bp, Homo sapiens
agaaataaatagctatat

SEQ ID NO: 288546 - DNA, 19 bp, Homo sapiens
agaactgccccatctcctc

SEQ ID NO: 288547 - DNA, 16 bp, Homo sapiens
agaactgcttgcattt

SEQ ID NO: 288548 - DNA, 16 bp, Homo sapiens
agaactggtcttccat

SEQ ID NO: 288549 - DNA, 22 bp, Homo sapiens
agaactggtcttccattttgcc

SEQ ID NO: 288550 - DNA, 19 bp, Homo sapiens
agaactggttcttgccttc

SEQ ID NO: 288551 - DNA, 16 bp, Homo sapiens
agaactgttggctgct

SEQ ID NO: 288552 - DNA, 16 bp, Homo sapiens
agaacttgatttgcat

SEQ ID NO: 288553 - DNA, 17 bp, Homo sapiens
agaacttgatttgcatg

SEQ ID NO: 288554 - DNA, 15 bp, Homo sapiens
agaacttttcataga

SEQ ID NO: 288555 - DNA, 21 bp, Homo sapiens
agaacttttggtaagggaaaa

SEQ ID NO: 288556 - DNA, 14 bp, Homo sapiens
agaagaaaacatat

SEQ ID NO: 288557 - DNA, 16 bp, Homo sapiens
agaagaaaacatatat

SEQ ID NO: 288558 - DNA, 17 bp, Homo sapiens
agaagaaaacatatatt

SEQ ID NO: 288559 - DNA, 23 bp, Homo sapiens
agaagaaaatggatgacaaagaa

SEQ ID NO: 288560 - DNA, 14 bp, Homo sapiens
agaagaaagactct

SEQ ID NO: 288561 - DNA, 13 bp, Homo sapiens
agaagaaagcaaa

SEQ ID NO: 288562 - DNA, 19 bp, Homo sapiens
agaagaaagtaaaaagaac

SEQ ID NO: 288563 - DNA, 15 bp, Homo sapiens
agaagaatattcagg

SEQ ID NO: 288564 - DNA, 18 bp, Homo sapiens
agaagacacgtgtttttg

SEQ ID NO: 288565 - DNA, 15 bp, Homo sapiens
agaagacatgaacca

SEQ ID NO: 288566 - DNA, 19 bp, Homo sapiens
agaagacatggagactcct

SEQ ID NO: 288567 - DNA, 20 bp, Homo sapiens
agaagaccagtcacagccat

SEQ ID NO: 288568 - DNA, 15 bp, Homo sapiens
agaagactagcagct

SEQ ID NO: 288569 - DNA, 21 bp, Homo sapiens
agaagacttctttgcaacaat

SEQ ID NO: 288570 - DNA, 19 bp, Homo sapiens
agaagagatgagaaatgat

SEQ ID NO: 288571 - DNA, 20 bp, Homo sapiens
agaagagatgggcttgtttt

SEQ ID NO: 288572 - DNA, 22 bp, Homo sapiens
agaagagatgtggcaaagtgct

SEQ ID NO: 288573 - DNA, 18 bp, Homo sapiens
agaagagggagaaggaga

SEQ ID NO: 288574 - DNA, 22 bp, Homo sapiens
agaagagggagaaggagaggct

SEQ ID NO: 288575 - DNA, 14 bp, Homo sapiens
agaagagggcctgt

SEQ ID NO: 288576 - DNA, 24 bp, Homo sapiens
agaagagggcctgtgggagcctgc

SEQ ID NO: 288577 - DNA, 21 bp, Homo sapiens
agaagaggttcatttttctgg

SEQ ID NO: 288578 - DNA, 12 bp, Homo sapiens
agaagattctaa

SEQ ID NO: 288579 - DNA, 15 bp, Homo sapiens
agaagattctaaaac

SEQ ID NO: 288580 - DNA, 23 bp, Homo sapiens
agaagatttgatgctggagaggt

SEQ ID NO: 288581 - DNA, 17 bp, Homo sapiens
agaagcagccataaaac

SEQ ID NO: 288582 - DNA, 15 bp, Homo sapiens
agaagcatgaaaaag

SEQ ID NO: 288583 - DNA, 16 bp, Homo sapiens
agaagccaagacagtg

SEQ ID NO: 288584 - DNA, 18 bp, Homo sapiens
agaagccaagacagtggc

SEQ ID NO: 288585 - DNA, 19 bp, Homo sapiens
agaagccaagacagtggca

SEQ ID NO: 288586 - DNA, 14 bp, Homo sapiens
agaagccgtgggtg

SEQ ID NO: 288587 - DNA, 22 bp, Homo sapiens
agaagcctattgtaaatacaag

SEQ ID NO: 288588 - DNA, 19 bp, Homo sapiens
agaagcctcatgggagtca

SEQ ID NO: 288589 - DNA, 12 bp, Homo sapiens
agaagcctctgg

SEQ ID NO: 288590 - DNA, 14 bp, Homo sapiens
agaagctaatgtag

SEQ ID NO: 288591 - DNA, 22 bp, Homo sapiens
agaagctaatgtaggactgtat

SEQ ID NO: 288592 - DNA, 17 bp, Homo sapiens
agaagcttcagaagttt

SEQ ID NO: 288593 - DNA, 17 bp, Homo sapiens
agaaggaaattgagatt

SEQ ID NO: 288594 - DNA, 13 bp, Homo sapiens
agaaggaagggca

SEQ ID NO: 288595 - DNA, 20 bp, Homo sapiens
agaaggacttcctgctacag

SEQ ID NO: 288596 - DNA, 16 bp, Homo sapiens
agaaggagagcccagg

SEQ ID NO: 288597 - DNA, 17 bp, Homo sapiens
agaaggaggaagggact

SEQ ID NO: 288598 - DNA, 15 bp, Homo sapiens
agaaggagggcagag

SEQ ID NO: 288599 - DNA, 18 bp, Homo sapiens
agaaggagggcagagcca

SEQ ID NO: 288600 - DNA, 19 bp, Homo sapiens
agaaggagggcagagccat

SEQ ID NO: 288601 - DNA, 22 bp, Homo sapiens
agaaggcaagtttctagctaga

SEQ ID NO: 288602 - DNA, 17 bp, Homo sapiens
agaaggcagagaaaaca

SEQ ID NO: 288603 - DNA, 20 bp, Homo sapiens
agaaggcagagaaaacacac

SEQ ID NO: 288604 - DNA, 13 bp, Homo sapiens
agaaggcagcagg

SEQ ID NO: 288605 - DNA, 13 bp, Homo sapiens
agaaggcccggga

SEQ ID NO: 288606 - DNA, 22 bp, Homo sapiens
agaaggcctcttgtgctcacgc

SEQ ID NO: 288607 - DNA, 22 bp, Homo sapiens
agaaggcctgccccccttccca

SEQ ID NO: 288608 - DNA, 17 bp, Homo sapiens
agaaggcctggtcagca

SEQ ID NO: 288609 - DNA, 12 bp, Homo sapiens
agaagggaaaca

SEQ ID NO: 288610 - DNA, 16 bp, Homo sapiens
agaagggaaacagtca

SEQ ID NO: 288611 - DNA, 20 bp, Homo sapiens
agaagggaaattcacactgt

SEQ ID NO: 288612 - DNA, 14 bp, Homo sapiens
agaaggggcgaggc

SEQ ID NO: 288613 - DNA, 20 bp, Homo sapiens
agaagggtccttccctctcc

SEQ ID NO: 288614 - DNA, 23 bp, Homo sapiens
agaagggtccttccctctcccca

SEQ ID NO: 288615 - DNA, 20 bp, Homo sapiens
agaaggtaataggaagaaca

SEQ ID NO: 288616 - DNA, 20 bp, Homo sapiens
agaaggtcggaggcttggga

SEQ ID NO: 288617 - DNA, 15 bp, Homo sapiens
agaaggtgcttgggc

SEQ ID NO: 288618 - DNA, 14 bp, Homo sapiens
agaagtaactcccc

SEQ ID NO: 288619 - DNA, 17 bp, Homo sapiens
agaagtagcaagatctt

SEQ ID NO: 288620 - DNA, 15 bp, Homo sapiens
agaagtatccaatta

SEQ ID NO: 288621 - DNA, 22 bp, Homo sapiens
agaagtcagcccgaatgcctgt

SEQ ID NO: 288622 - DNA, 17 bp, Homo sapiens
agaagtcagttggagaa

SEQ ID NO: 288623 - DNA, 17 bp, Homo sapiens
agaagtccatgagttga

SEQ ID NO: 288624 - DNA, 22 bp, Homo sapiens
agaagtcttcatggtctcttcc

SEQ ID NO: 288625 - DNA, 16 bp, Homo sapiens
agaagtgaatgggaaa

SEQ ID NO: 288626 - DNA, 19 bp, Homo sapiens
agaagtgaatgggaaaggg

SEQ ID NO: 288627 - DNA, 13 bp, Homo sapiens
agaagtgaggcct

SEQ ID NO: 288628 - DNA, 15 bp, Homo sapiens
agaagtgaggcctgg

SEQ ID NO: 288629 - DNA, 16 bp, Homo sapiens
agaagtgcatttctga

SEQ ID NO: 288630 - DNA, 13 bp, Homo sapiens
agaagtgcccctg

SEQ ID NO: 288631 - DNA, 16 bp, Homo sapiens
agaagtgcccctgctg

SEQ ID NO: 288632 - DNA, 19 bp, Homo sapiens
agaagtgcccctgctgcct

SEQ ID NO: 288633 - DNA, 12 bp, Homo sapiens
agaagtggcccc

SEQ ID NO: 288634 - DNA, 19 bp, Homo sapiens
agaagtgggagtgggagag

SEQ ID NO: 288635 - DNA, 20 bp, Homo sapiens
agaagtgggagtgggagagg

SEQ ID NO: 288636 - DNA, 22 bp, Homo sapiens
agaagtgggagtgggagaggaa

SEQ ID NO: 288637 - DNA, 24 bp, Homo sapiens
agaagtggtgttccatgacttcag

SEQ ID NO: 288638 - DNA, 13 bp, Homo sapiens
agaagtgtgtttt

SEQ ID NO: 288639 - DNA, 16 bp, Homo sapiens
agaagtgtttcatgca

SEQ ID NO: 288640 - DNA, 19 bp, Homo sapiens
agaagttaagcagcctttc

SEQ ID NO: 288641 - DNA, 21 bp, Homo sapiens
agaagttggtcttactttgtg

SEQ ID NO: 288642 - DNA, 14 bp, Homo sapiens
agaataaaattgta

SEQ ID NO: 288643 - DNA, 22 bp, Homo sapiens
agaataatatgctgccaaattt

SEQ ID NO: 288644 - DNA, 23 bp, Homo sapiens
agaataatatgctgccaaatttt

SEQ ID NO: 288645 - DNA, 22 bp, Homo sapiens
agaataatgtgggaagaaacaa

SEQ ID NO: 288646 - DNA, 19 bp, Homo sapiens
agaataatgttctattgtg

SEQ ID NO: 288647 - DNA, 17 bp, Homo sapiens
agaataattgtgtacaa

SEQ ID NO: 288648 - DNA, 15 bp, Homo sapiens
agaatataattatcg

SEQ ID NO: 288649 - DNA, 23 bp, Homo sapiens
agaatataattatcggaagcagt

SEQ ID NO: 288650 - DNA, 15 bp, Homo sapiens
agaatatactgtctt

SEQ ID NO: 288651 - DNA, 19 bp, Homo sapiens
agaatatcctatactggtt

SEQ ID NO: 288652 - DNA, 14 bp, Homo sapiens
agaatattataaaa

SEQ ID NO: 288653 - DNA, 21 bp, Homo sapiens
agaatattatagtttaaaagt

SEQ ID NO: 288654 - DNA, 20 bp, Homo sapiens
agaatattgcccaaataata

SEQ ID NO: 288655 - DNA, 16 bp, Homo sapiens
agaatatttattacct

SEQ ID NO: 288656 - DNA, 13 bp, Homo sapiens
agaatcagcctag

SEQ ID NO: 288657 - DNA, 19 bp, Homo sapiens
agaatcatgctgttgcatt

SEQ ID NO: 288658 - DNA, 19 bp, Homo sapiens
aatttggtttttactcaac

SEQ ID NO: 288659 - DNA, 19 bp, Homo sapiens
aatttgtaattgcttacat

SEQ ID NO: 288660 - DNA, 15 bp, Homo sapiens
aatttgtatctgaag

SEQ ID NO: 288661 - DNA, 15 bp, Homo sapiens
aatttgtatgtttcc

SEQ ID NO: 288662 - DNA, 14 bp, Homo sapiens
aatttgtcactgga

SEQ ID NO: 288663 - DNA, 13 bp, Homo sapiens
aatttgtctccta

SEQ ID NO: 288664 - DNA, 20 bp, Homo sapiens
aatttgtctcctactctgtg

SEQ ID NO: 288665 - DNA, 18 bp, Homo sapiens
aatttgttgaaattatgt

SEQ ID NO: 288666 - DNA, 18 bp, Homo sapiens
aatttgtttaaagaataa

SEQ ID NO: 288667 - DNA, 20 bp, Homo sapiens
aatttgtttaaagaataaag

SEQ ID NO: 288668 - DNA, 21 bp, Homo sapiens
aatttgtttaaagaataaagt

SEQ ID NO: 288669 - DNA, 14 bp, Homo sapiens
aattttaaaaaata

SEQ ID NO: 288670 - DNA, 15 bp, Homo sapiens
aattttaaaaaataa

SEQ ID NO: 288671 - DNA, 18 bp, Homo sapiens
aattttaaaaaataacat

SEQ ID NO: 288672 - DNA, 16 bp, Homo sapiens
aattttaaaagcatat

SEQ ID NO: 288673 - DNA, 23 bp, Homo sapiens
aattttaaaagcatatataaaac

SEQ ID NO: 288674 - DNA, 17 bp, Homo sapiens
aattttaaataaaagtg

SEQ ID NO: 288675 - DNA, 22 bp, Homo sapiens
aattttaacaaacgcattaaga

SEQ ID NO: 288676 - DNA, 22 bp, Homo sapiens
aattttaagtgctttgtaatgg

SEQ ID NO: 288677 - DNA, 13 bp, Homo sapiens
aattttaatgcta

SEQ ID NO: 288678 - DNA, 13 bp, Homo sapiens
aattttaatgtaa

SEQ ID NO: 288679 - DNA, 19 bp, Homo sapiens
aattttatagctcagttta

SEQ ID NO: 288680 - DNA, 12 bp, Homo sapiens
aattttatgaac

SEQ ID NO: 288681 - DNA, 21 bp, Homo sapiens
aattttatgtgactatgaaac

SEQ ID NO: 288682 - DNA, 15 bp, Homo sapiens
aattttcaagtaatt

SEQ ID NO: 288683 - DNA, 13 bp, Homo sapiens
aattttcactgct

SEQ ID NO: 288684 - DNA, 14 bp, Homo sapiens
aattttcacttctg

SEQ ID NO: 288685 - DNA, 17 bp, Homo sapiens
aattttcattggatgca

SEQ ID NO: 288686 - DNA, 12 bp, Homo sapiens
aattttctagac

SEQ ID NO: 288687 - DNA, 18 bp, Homo sapiens
aattttctagactttctg

SEQ ID NO: 288688 - DNA, 20 bp, Homo sapiens
aattttctagactttctgtt

SEQ ID NO: 288689 - DNA, 23 bp, Homo sapiens
aattttctcaaaagcatttatca

SEQ ID NO: 288690 - DNA, 17 bp, Homo sapiens
aattttgaggtctttta

SEQ ID NO: 288691 - DNA, 20 bp, Homo sapiens
aattttgagttctacataag

SEQ ID NO: 288692 - DNA, 19 bp, Homo sapiens
aattttggtccaaattctt

SEQ ID NO: 288693 - DNA, 19 bp, Homo sapiens
aattttgtatccatttaaa

SEQ ID NO: 288694 - DNA, 23 bp, Homo sapiens
aattttgtatccatttaaactaa

SEQ ID NO: 288695 - DNA, 17 bp, Homo sapiens
aattttgtatttaatga

SEQ ID NO: 288696 - DNA, 15 bp, Homo sapiens
aatttttaaaagact

SEQ ID NO: 288697 - DNA, 16 bp, Homo sapiens
aatttttacagaattg

SEQ ID NO: 288698 - DNA, 17 bp, Homo sapiens
aatttttagatattcat

SEQ ID NO: 288699 - DNA, 15 bp, Homo sapiens
aatttttatttttct

SEQ ID NO: 288700 - DNA, 16 bp, Homo sapiens
aatttttatttttcta

SEQ ID NO: 288701 - DNA, 15 bp, Homo sapiens
aattttttaaaaagc

SEQ ID NO: 288702 - DNA, 16 bp, Homo sapiens
aattttttaaaccact

SEQ ID NO: 288703 - DNA, 21 bp, Homo sapiens
aattttttgatgtcagccttg

SEQ ID NO: 288704 - DNA, 17 bp, Homo sapiens
aattttttttaacattc

SEQ ID NO: 288705 - DNA, 21 bp, Homo sapiens
aattttttttttaaatgattc

SEQ ID NO: 288706 - DNA, 20 bp, Homo sapiens
aattttttttttttaacttt

SEQ ID NO: 288707 - DNA, 20 bp, Homo sapiens
acaaaaaaatatatttaatg

SEQ ID NO: 288708 - DNA, 15 bp, Homo sapiens
acaaaaaacaatatt

SEQ ID NO: 288709 - DNA, 13 bp, Homo sapiens
acaaaaaagttta

SEQ ID NO: 288710 - DNA, 13 bp, Homo sapiens
acaaaaactaaaa

SEQ ID NO: 288711 - DNA, 21 bp, Homo sapiens
acaaaaactttccatgacagt

SEQ ID NO: 288712 - DNA, 13 bp, Homo sapiens
acaaaaagaacaa

SEQ ID NO: 288713 - DNA, 12 bp, Homo sapiens
acaaaaagcaca

SEQ ID NO: 288714 - DNA, 13 bp, Homo sapiens
acaaaaagcacaa

SEQ ID NO: 288715 - DNA, 13 bp, Homo sapiens
acaaaaatacaat

SEQ ID NO: 288716 - DNA, 23 bp, Homo sapiens
acaaaaatgaactgaagtttcac

SEQ ID NO: 288717 - DNA, 11 bp, Homo sapiens
acaaaaattat

SEQ ID NO: 288718 - DNA, 12 bp, Homo sapiens
acaaaaattatc

SEQ ID NO: 288719 - DNA, 17 bp, Homo sapiens
acaaaaattcacaagct

SEQ ID NO: 288720 - DNA, 23 bp, Homo sapiens
acaaaacaaacaacctgccacaa

SEQ ID NO: 288721 - DNA, 13 bp, Homo sapiens
acaaaaccaagcc

SEQ ID NO: 288722 - DNA, 19 bp, Homo sapiens
acaaaacttaaaagtattc

SEQ ID NO: 288723 - DNA, 19 bp, Homo sapiens
acaaaagactagtttgtta

SEQ ID NO: 288724 - DNA, 23 bp, Homo sapiens
acaaaagaggagcacttccaaaa

SEQ ID NO: 288725 - DNA, 15 bp, Homo sapiens
acaaaagattatgta

SEQ ID NO: 288726 - DNA, 18 bp, Homo sapiens
acaaaagcaaagtgaagt

SEQ ID NO: 288727 - DNA, 15 bp, Homo sapiens
acaaaagggagaaca

SEQ ID NO: 288728 - DNA, 18 bp, Homo sapiens
acaaaatagaagctgtag

SEQ ID NO: 288729 - DNA, 19 bp, Homo sapiens
acaaaatctgaactctcaa

SEQ ID NO: 288730 - DNA, 13 bp, Homo sapiens
acaaaatgaagtt

SEQ ID NO: 288731 - DNA, 21 bp, Homo sapiens
acaaaatgtgtgcttggaaaa
